United States Patent 7,250,496 (BIOINFORMATICALLY DETECTABLE GROUP OF NOVEL REGULATORY GENES AND USES THEREOF) - sequence listing, part 22

SEQ ID NO: 925508 - RNA, 25 nt, Human
acuuuguuacccaggcuggucuuga

SEQ ID NO: 925509 - RNA, 21 nt, Human
aggcaugagccaccaugacca

SEQ ID NO: 925510 - RNA, 24 nt, Human
aggguguugggauuauaggcauga

SEQ ID NO: 925511 - RNA, 23 nt, Human
agugcaguggagugaucagagcu

SEQ ID NO: 925512 - RNA, 24 nt, Human
agugcaguggagugaucagagcuc

SEQ ID NO: 925513 - RNA, 18 nt, Human
augguggagaccagggca

SEQ ID NO: 925514 - RNA, 19 nt, Human
augugccaccacacccagc

SEQ ID NO: 925515 - RNA, 24 nt, Human
caauggauccucccaccccagucu

SEQ ID NO: 925516 - RNA, 21 nt, Human
caauuaaaaaaaaaaaaaaaa

SEQ ID NO: 925517 - RNA, 19 nt, Human
cacuuuguuacccaggcug

SEQ ID NO: 925518 - RNA, 24 nt, Human
cacuuuguuacccaggcuggucuu

SEQ ID NO: 925519 - RNA, 23 nt, Human
cagccuugaucuccuggucucaa

SEQ ID NO: 925520 - RNA, 20 nt, Human
caugugccaccacacccagc

SEQ ID NO: 925521 - RNA, 18 nt, Human
cauuuuagggaguuggga

SEQ ID NO: 925522 - RNA, 24 nt, Human
ccaggguguugggauuauaggcau

SEQ ID NO: 925523 - RNA, 20 nt, Human
ccagucucggguagcugcac

SEQ ID NO: 925524 - RNA, 20 nt, Human
ccucaggcuacaaaggugaa

SEQ ID NO: 925525 - RNA, 21 nt, Human
ccucccaccccagucucgggu

SEQ ID NO: 925526 - RNA, 19 nt, Human
ccuccugccuuagucuccc

SEQ ID NO: 925527 - RNA, 22 nt, Human
cucaagcuauccuuccuccugc

SEQ ID NO: 925528 - RNA, 21 nt, Human
cugggugugggagggaggugu

SEQ ID NO: 925529 - RNA, 19 nt, Human
cugucacccaggcuggagu

SEQ ID NO: 925530 - RNA, 20 nt, Human
cuguuguuuucuaaguccug

SEQ ID NO: 925531 - RNA, 19 nt, Human
cuuaaccugcaaacuaaau

SEQ ID NO: 925532 - RNA, 23 nt, Human
cuuauaccuucucugguugggca

SEQ ID NO: 925533 - RNA, 23 nt, Human
gaaggaaagcagacagaaauuuc

SEQ ID NO: 925534 - RNA, 24 nt, Human
gagcucgcugcagccuugaucucc

SEQ ID NO: 925535 - RNA, 21 nt, Human
gauuauaggcaugagccacca

SEQ ID NO: 925536 - RNA, 22 nt, Human
gauuauaggcaugagccaccau

SEQ ID NO: 925537 - RNA, 24 nt, Human
gccuuagucucccaggguguuggg

SEQ ID NO: 925538 - RNA, 19 nt, Human
gcugcagccuugaucuccu

SEQ ID NO: 925539 - RNA, 23 nt, Human
gcuggucuugagcuccugaccuc

SEQ ID NO: 925540 - RNA, 24 nt, Human
ggagaauguucaguaagacuugaa

SEQ ID NO: 925541 - RNA, 24 nt, Human
ggauuauaggcaugagccaccaug

SEQ ID NO: 925542 - RNA, 20 nt, Human
ggcaugugccaccacaccca

SEQ ID NO: 925543 - RNA, 24 nt, Human
ggcuggucuugagcuccugaccuc

SEQ ID NO: 925544 - RNA, 20 nt, Human
gggagggaggugugaaaagu

SEQ ID NO: 925545 - RNA, 19 nt, Human
guagagaugggggucucac

SEQ ID NO: 925546 - RNA, 19 nt, Human
gucucggguagcugcacug

SEQ ID NO: 925547 - RNA, 18 nt, Human
uaagcccucaggcuacaa

SEQ ID NO: 925548 - RNA, 24 nt, Human
uaagcuagaacgguaggggaagua

SEQ ID NO: 925549 - RNA, 20 nt, Human
uaaggcauuuuagggaguug

SEQ ID NO: 925550 - RNA, 21 nt, Human
uacaaaucuugaagcacuuua

SEQ ID NO: 925551 - RNA, 24 nt, Human
uacccaggcuggucuugagcuccu

SEQ ID NO: 925552 - RNA, 21 nt, Human
uaggacaaacugaauagccag

SEQ ID NO: 925553 - RNA, 23 nt, Human
uaggacaaacugaauagccagua

SEQ ID NO: 925554 - RNA, 21 nt, Human
uaggcaugagccaccaugacc

SEQ ID NO: 925555 - RNA, 20 nt, Human
uagggaauaugccugagucc

SEQ ID NO: 925556 - RNA, 25 nt, Human
uauacagacaacuacaauauaugau

SEQ ID NO: 925557 - RNA, 22 nt, Human
uauauaauccuuuuuucugaag

SEQ ID NO: 925558 - RNA, 20 nt, Human
ucaauggauccucccacccc

SEQ ID NO: 925559 - RNA, 22 nt, Human
ucacccaggcuggagugcagug

SEQ ID NO: 925560 - RNA, 22 nt, Human
uccacacuggguaaaauaaaag

SEQ ID NO: 925561 - RNA, 24 nt, Human
ucccaggguguugggauuauaggc

SEQ ID NO: 925562 - RNA, 23 nt, Human
ucgcugcagccuugaucuccugg

SEQ ID NO: 925563 - RNA, 19 nt, Human
ucucacuuuguuacccagg

SEQ ID NO: 925564 - RNA, 23 nt, Human
ucucacuuuguuacccaggcugg

SEQ ID NO: 925565 - RNA, 26 nt, Human
ucucacuuuguuacccaggcuggucu

SEQ ID NO: 925566 - RNA, 27 nt, Human
ucucacuuuguuacccaggcuggucuu

SEQ ID NO: 925567 - RNA, 23 nt, Human
ucucggucugucacccaggcugg

SEQ ID NO: 925568 - RNA, 24 nt, Human
ucucggucugucacccaggcugga

SEQ ID NO: 925569 - RNA, 19 nt, Human
ucugucacccaggcuggag

SEQ ID NO: 925570 - RNA, 24 nt, Human
ucugucacccaggcuggagugcag

SEQ ID NO: 925571 - RNA, 23 nt, Human
ugaaagacagagucucggucugu

SEQ ID NO: 925572 - RNA, 20 nt, Human
ugaauccuugcaauaacccu

SEQ ID NO: 925573 - RNA, 19 nt, Human
ugccaccacacccagcugu

SEQ ID NO: 925574 - RNA, 19 nt, Human
uggagugcaguggagugau

SEQ ID NO: 925575 - RNA, 20 nt, Human
uggagugcaguggagugauc

SEQ ID NO: 925576 - RNA, 22 nt, Human
uggauccucccaccccagucuc

SEQ ID NO: 925577 - RNA, 18 nt, Human
ugggauuauaggcaugag

SEQ ID NO: 925578 - RNA, 22 nt, Human
ugggauuauaggcaugagccac

SEQ ID NO: 925579 - RNA, 23 nt, Human
ugggauuauaggcaugagccacc

SEQ ID NO: 925580 - RNA, 24 nt, Human
ugggauuauaggcaugagccacca

SEQ ID NO: 925581 - RNA, 25 nt, Human
ugggauuauaggcaugagccaccau

SEQ ID NO: 925582 - RNA, 23 nt, Human
ugguacagacuacugguuaagag

SEQ ID NO: 925583 - RNA, 20 nt, Human
ugucuuagaaguguggacau

SEQ ID NO: 925584 - RNA, 18 nt, Human
uguuacccaggcuggucu

SEQ ID NO: 925585 - RNA, 21 nt, Human
uguuacccaggcuggucuuga

SEQ ID NO: 925586 - RNA, 18 nt, Human
uuagucucccaggguguu

SEQ ID NO: 925587 - RNA, 22 nt, Human
uuccucagggucuggaaaaugg

SEQ ID NO: 925588 - RNA, 21 nt, Human
uugggauuauaggcaugagcc

SEQ ID NO: 925589 - RNA, 21 nt, Human
uuucauguuuuguagagaugg

SEQ ID NO: 925590 - RNA, 24 nt, Human
uuuguuacccaggcuggucuugag

SEQ ID NO: 925591 - RNA, 20 nt, Human
uuuuugaaagacagagucuc

SEQ ID NO: 925592 - RNA, 20 nt, Human
aaaaaacaagcuguaacuua

SEQ ID NO: 925593 - RNA, 25 nt, Human
aaaaacaaacaaaaccaugcuaugc

SEQ ID NO: 925594 - RNA, 25 nt, Human
aaaaacaaacaaaaccaugcuaugc

SEQ ID NO: 925595 - RNA, 23 nt, Human
aaaaaucacuaaacuaccacaac

SEQ ID NO: 925596 - RNA, 22 nt, Human
aacgcuccaucuccucuguaag

SEQ ID NO: 925597 - RNA, 22 nt, Human
aagaaugugcugcucuccaccc

SEQ ID NO: 925598 - RNA, 23 nt, Human
aagcaaaaacaaacaaaaccaug

SEQ ID NO: 925599 - RNA, 19 nt, Human
aaggaggcugacucagggg

SEQ ID NO: 925600 - RNA, 20 nt, Human
acaaacaaaaccaugcuaug

SEQ ID NO: 925601 - RNA, 21 nt, Human
accaugcaaucccacacacaa

SEQ ID NO: 925602 - RNA, 21 nt, Human
acccaacaguggcccagcaca

SEQ ID NO: 925603 - RNA, 22 nt, Human
acuaauccuaauccugaacaug

SEQ ID NO: 925604 - RNA, 21 nt, Human
agaaaauugaaagcaaaaaca

SEQ ID NO: 925605 - RNA, 24 nt, Human
agaaagaacaugaaaaauaaacau

SEQ ID NO: 925606 - RNA, 19 nt, Human
agguagaacuaacucaaaa

SEQ ID NO: 925607 - RNA, 24 nt, Human
auagugcaguauucucacaaaaca

SEQ ID NO: 925608 - RNA, 18 nt, Human
augucaaaaacguauagc

SEQ ID NO: 925609 - RNA, 20 nt, Human
auuaauuauccucuauuuca

SEQ ID NO: 925610 - RNA, 21 nt, Human
auucacuggucuucauaauaa

SEQ ID NO: 925611 - RNA, 18 nt, Human
auuugcuuuuucucucca

SEQ ID NO: 925612 - RNA, 20 nt, Human
caaaacaacuuuugggacaa

SEQ ID NO: 925613 - RNA, 26 nt, Human
caaaagaggcacugcaucuggaagua

SEQ ID NO: 925614 - RNA, 19 nt, Human
caaauaauguagugcaguc

SEQ ID NO: 925615 - RNA, 19 nt, Human
caacaggaacaaaaguaaa

SEQ ID NO: 925616 - RNA, 25 nt, Human
caaucccacacacaaucagaaagga

SEQ ID NO: 925617 - RNA, 22 nt, Human
cagauccaugugugacaaauaa

SEQ ID NO: 925618 - RNA, 20 nt, Human
cagggguguaagcaacagua

SEQ ID NO: 925619 - RNA, 18 nt, Human
cauuugcuuuuucucucc

SEQ ID NO: 925620 - RNA, 18 nt, Human
ccccuccucccuuuucuc

SEQ ID NO: 925621 - RNA, 19 nt, Human
ccccuccucccuuuucuca

SEQ ID NO: 925622 - RNA, 20 nt, Human
ccccuccucccuuuucucaa

SEQ ID NO: 925623 - RNA, 22 nt, Human
ccucuguaagaaugugcugcuc

SEQ ID NO: 925624 - RNA, 21 nt, Human
cuaauccuaauccugaacaug

SEQ ID NO: 925625 - RNA, 27 nt, Human
cucauaacgcuccaucucuugacgggc

SEQ ID NO: 925626 - RNA, 19 nt, Human
cuccaaaagaggcacugca

SEQ ID NO: 925627 - RNA, 21 nt, Human
cucccuugucccaagcucggg

SEQ ID NO: 925628 - RNA, 22 nt, Human
cucucaaaaaacaagcuguaac

SEQ ID NO: 925629 - RNA, 19 nt, Human
cugacucaggggcgggcag

SEQ ID NO: 925630 - RNA, 19 nt, Human
gugaagauaccuauccaca

SEQ ID NO: 925631 - RNA, 21 nt, Human
guggcccagcacauuccaucc

SEQ ID NO: 925632 - RNA, 26 nt, Human
guggcccagcacauuccauccgcucc

SEQ ID NO: 925633 - RNA, 19 nt, Human
guuaaaaacaacaggaaca

SEQ ID NO: 925634 - RNA, 22 nt, Human
uaaaaacaacaggaacaaaagu

SEQ ID NO: 925635 - RNA, 18 nt, Human
uaacagauccauguguga

SEQ ID NO: 925636 - RNA, 20 nt, Human
uaagaauaauuagguaagag

SEQ ID NO: 925637 - RNA, 24 nt, Human
uaaggaguuuuuaguucuaccuuu

SEQ ID NO: 925638 - RNA, 21 nt, Human
uaaugcaaauacaaauguagc

SEQ ID NO: 925639 - RNA, 21 nt, Human
uaccacaacuuaaaacuugua

SEQ ID NO: 925640 - RNA, 20 nt, Human
uagaugcaaucaggacacca

SEQ ID NO: 925641 - RNA, 25 nt, Human
ucagaaagaacaugaaaaauaaaca

SEQ ID NO: 925642 - RNA, 21 nt, Human
ucagacuaucuuccccuccuc

SEQ ID NO: 925643 - RNA, 22 nt, Human
uccgcuccaccuagaugcaauc

SEQ ID NO: 925644 - RNA, 24 nt, Human
ucugaaccaccaugggaagacccu

SEQ ID NO: 925645 - RNA, 27 nt, Human
ugaaaaauaaacaugucuucuccaaaa

SEQ ID NO: 925646 - RNA, 18 nt, Human
ugacucaggggcgggcag

SEQ ID NO: 925647 - RNA, 20 nt, Human
ugagaaaaagaguaaugauu

SEQ ID NO: 925648 - RNA, 24 nt, Human
ugcaguauucucacaaaacagaga

SEQ ID NO: 925649 - RNA, 20 nt, Human
ugcugcucuccacccaacag

SEQ ID NO: 925650 - RNA, 24 nt, Human
ugggcaccagguagaacuaacuca

SEQ ID NO: 925651 - RNA, 22 nt, Human
uguaauugugaaaauuagacuc

SEQ ID NO: 925652 - RNA, 24 nt, Human
uuaaaaaauuuaugcauacuagga

SEQ ID NO: 925653 - RNA, 22 nt, Human
uuaaaaacagacuuucaggggu

SEQ ID NO: 925654 - RNA, 20 nt, Human
uucacuggucuucauaauaa

SEQ ID NO: 925655 - RNA, 18 nt, Human
uuccccuccucccuuuuc

SEQ ID NO: 925656 - RNA, 20 nt, Human
uuuuuuuuuuuuuaacuuuu

SEQ ID NO: 925657 - RNA, 23 nt, Human
aaaaaagaacaggauaacagcga

SEQ ID NO: 925658 - RNA, 20 nt, Human
aaaagaacaggauaacagcg

SEQ ID NO: 925659 - RNA, 24 nt, Human
aaaauacuaaauuccuacuauaau

SEQ ID NO: 925660 - RNA, 19 nt, Human
aaagaaaauaaacuauaaa

SEQ ID NO: 925661 - RNA, 19 nt, Human
aacaccccugagaaagaga

SEQ ID NO: 925662 - RNA, 24 nt, Human
aauaaacuauaaaacacaaaucca

SEQ ID NO: 925663 - RNA, 22 nt, Human
aauagucuuugaacauuuguuc

SEQ ID NO: 925664 - RNA, 20 nt, Human
aaucaauuuuggucagaccg

SEQ ID NO: 925665 - RNA, 19 nt, Human
aaugucuaucaauagguga

SEQ ID NO: 925666 - RNA, 19 nt, Human
acacccuucacccccaaau

SEQ ID NO: 925667 - RNA, 19 nt, Human
acccccaaauuccacagcu

SEQ ID NO: 925668 - RNA, 22 nt, Human
agaaguaaacaaaauaaaguca

SEQ ID NO: 925669 - RNA, 25 nt, Human
agaauuaaaagcaaucugucauuua

SEQ ID NO: 925670 - RNA, 20 nt, Human
agacaccaggagcauaagca

SEQ ID NO: 925671 - RNA, 18 nt, Human
aggucaaaaguguuucuu

SEQ ID NO: 925672 - RNA, 25 nt, Human
auacaugguuauuuacuggaguuga

SEQ ID NO: 925673 - RNA, 25 nt, Human
caaaagacaccaggagcauaagcac

SEQ ID NO: 925674 - RNA, 20 nt, Human
caaagcaaaggaaaacaaac

SEQ ID NO: 925675 - RNA, 24 nt, Human
caaucaaagcaaaggaaaacaaac

SEQ ID NO: 925676 - RNA, 18 nt, Human
caaucugucauuuagauu

SEQ ID NO: 925677 - RNA, 22 nt, Human
caauucacagucucaggaaucc

SEQ ID NO: 925678 - RNA, 19 nt, Human
caauuuucaagcauauaau

SEQ ID NO: 925679 - RNA, 20 nt, Human
cacacccuucacccccaaag

SEQ ID NO: 925680 - RNA, 24 nt, Human
caccagcaaguggagcaaaagaca

SEQ ID NO: 925681 - RNA, 27 nt, Human
cacccccaaauuccacagcugguucaa

SEQ ID NO: 925682 - RNA, 25 nt, Human
cacccuucacccccaaauuccacag

SEQ ID NO: 925683 - RNA, 19 nt, Human
caccugacugaaaguggac

SEQ ID NO: 925684 - RNA, 18 nt, Human
cacugaauucucuuucuc

SEQ ID NO: 925685 - RNA, 27 nt, Human
cagcaaggaacaccccugagaaagaga

SEQ ID NO: 925686 - RNA, 22 nt, Human
cagccaaaaacuguagaccauc

SEQ ID NO: 925687 - RNA, 18 nt, Human
cagcgauguucagggaac

SEQ ID NO: 925688 - RNA, 28 nt, Human
cccccaucuccccuagugcucccaggcu

SEQ ID NO: 925689 - RNA, 21 nt, Human
cccuucacccccaaauuccac

SEQ ID NO: 925690 - RNA, 20 nt, Human
ccucacacccuucaccccca

SEQ ID NO: 925691 - RNA, 20 nt, Human
ccucuuuaaaauuguaacac

SEQ ID NO: 925692 - RNA, 20 nt, Human
cuagagaaaugaaaauuaaa

SEQ ID NO: 925693 - RNA, 21 nt, Human
cuaggcaacuuguccuauacc

SEQ ID NO: 925694 - RNA, 23 nt, Human
cuauaccacuuccucacacccuu

SEQ ID NO: 925695 - RNA, 21 nt, Human
cuccccuagugcucccaggcu

SEQ ID NO: 925696 - RNA, 18 nt, Human
cucuuguccauagucauu

SEQ ID NO: 925697 - RNA, 22 nt, Human
cugaaggaaacaauaauuuuaa

SEQ ID NO: 925698 - RNA, 25 nt, Human
cugcuucuuuuuaaauuauucuuaa

SEQ ID NO: 925699 - RNA, 22 nt, Human
cuggcugccugugggcugggug

SEQ ID NO: 925700 - RNA, 22 nt, Human
gaaaguggacacaagagaacuu

SEQ ID NO: 925701 - RNA, 19 nt, Human
gaauagcuaaauggaacua

SEQ ID NO: 925702 - RNA, 19 nt, Human
gcaacuuguccuauaccac

SEQ ID NO: 925703 - RNA, 18 nt, Human
gcuggcugccugugggcu

SEQ ID NO: 925704 - RNA, 21 nt, Human
gcuggcugccugugggcuggg

SEQ ID NO: 925705 - RNA, 18 nt, Human
ggaaauucccaccuaauc

SEQ ID NO: 925706 - RNA, 25 nt, Human
gggaacaagggagauaaccgguacc

SEQ ID NO: 925707 - RNA, 22 nt, Human
guggagcaaaagacaccaggag

SEQ ID NO: 925708 - RNA, 23 nt, Human
guggagcaaaagacaccaggagc

SEQ ID NO: 925709 - RNA, 19 nt, Human
uaaaacaccagcaagugga

SEQ ID NO: 925710 - RNA, 21 nt, Human
uaaaacaccagcaaguggagc

SEQ ID NO: 925711 - RNA, 24 nt, Human
uaaaauacuaaauuccuacuauaa

SEQ ID NO: 925712 - RNA, 24 nt, Human
uaacagcgauguucagggaacaag

SEQ ID NO: 925713 - RNA, 28 nt, Human
uagaagguguguguguuuaauuuacaca

SEQ ID NO: 925714 - RNA, 21 nt, Human
uauaccacuuccucacacccu

SEQ ID NO: 925715 - RNA, 24 nt, Human
uaucaggggcugguuucccccgau

SEQ ID NO: 925716 - RNA, 21 nt, Human
uauuuuauuaacuaucucaau

SEQ ID NO: 925717 - RNA, 25 nt, Human
ucaaaagcaaauaggagaaauauca

SEQ ID NO: 925718 - RNA, 23 nt, Human
ucaauagcaugauacaugcagua

SEQ ID NO: 925719 - RNA, 22 nt, Human
ucaaugacaaugcgugcccgaa

SEQ ID NO: 925720 - RNA, 18 nt, Human
ucacuagcaauuuuaauu

SEQ ID NO: 925721 - RNA, 24 nt, Human
uccaaccaaggagaauuaaaagca

SEQ ID NO: 925722 - RNA, 18 nt, Human
ucccucaaaaugaagaga

SEQ ID NO: 925723 - RNA, 21 nt, Human
ucgcacacguguuugccucuu

SEQ ID NO: 925724 - RNA, 20 nt, Human
ucucucacaggucaaaagug

SEQ ID NO: 925725 - RNA, 19 nt, Human
ucugaucucacccugccuc

SEQ ID NO: 925726 - RNA, 28 nt, Human
ucugcuucuuuuuaaauuauucuuaauu

SEQ ID NO: 925727 - RNA, 23 nt, Human
ugaaagaggcaaaaucuacugau

SEQ ID NO: 925728 - RNA, 21 nt, Human
ugaaauacauauacauugugg

SEQ ID NO: 925729 - RNA, 24 nt, Human
ugaaauggcugcuuugggaauguc

SEQ ID NO: 925730 - RNA, 23 nt, Human
ugaaucuauaaaacaccagcaag

SEQ ID NO: 925731 - RNA, 18 nt, Human
ugaaugaguucuggagga

SEQ ID NO: 925732 - RNA, 21 nt, Human
ugccccgguccucugaucuca

SEQ ID NO: 925733 - RNA, 28 nt, Human
uggaacagagccauauuucucuucuuuc

SEQ ID NO: 925734 - RNA, 26 nt, Human
uggaauagcuaaauggaacuaacuaa

SEQ ID NO: 925735 - RNA, 25 nt, Human
uggcacaccugacugaaaguggaca

SEQ ID NO: 925736 - RNA, 20 nt, Human
uggcugccugugggcugggu

SEQ ID NO: 925737 - RNA, 20 nt, Human
ugggaaugucugucuuuuac

SEQ ID NO: 925738 - RNA, 23 nt, Human
ugggauggcacaccugacugaaa

SEQ ID NO: 925739 - RNA, 20 nt, Human
uucauaacagccaaaaacug

SEQ ID NO: 925740 - RNA, 22 nt, Human
uucccccgauacacaaaaagac

SEQ ID NO: 925741 - RNA, 18 nt, Human
uuccuacuauaauccagg

SEQ ID NO: 925742 - RNA, 24 nt, Human
uuccucacacccuucacccccaaa

SEQ ID NO: 925743 - RNA, 19 nt, Human
uucucuuucucagcaagga

SEQ ID NO: 925744 - RNA, 20 nt, Human
uugaacauuuguuccaacca

SEQ ID NO: 925745 - RNA, 19 nt, Human
uuguaacacuuaauacuga

SEQ ID NO: 925746 - RNA, 22 nt, Human
uuguacauguuuaucauguaua

SEQ ID NO: 925747 - RNA, 21 nt, Human
uuucucagcaaggaacacccc

SEQ ID NO: 925748 - RNA, 24 nt, Human
uuucucagcaaggaacaccccuga

SEQ ID NO: 925749 - RNA, 23 nt, Human
uuugggaaugucugucuuuuacg

SEQ ID NO: 925750 - RNA, 24 nt, Human
aaaaauuuucuugggcccucacaa

SEQ ID NO: 925751 - RNA, 18 nt, Human
aaaagcaaauaaaaauug

SEQ ID NO: 925752 - RNA, 22 nt, Human
aaaaggaaccuaauuuuucuca

SEQ ID NO: 925753 - RNA, 23 nt, Human
aaacucgcaauauguaagucagc

SEQ ID NO: 925754 - RNA, 19 nt, Human
aaauaaaaauugugagucu

SEQ ID NO: 925755 - RNA, 22 nt, Human
aaauaaauacaaaugaaaaaga

SEQ ID NO: 925756 - RNA, 18 nt, Human
aaauacaaaugaaaaaga

SEQ ID NO: 925757 - RNA, 22 nt, Human
aaaucagaacguaugucaagug

SEQ ID NO: 925758 - RNA, 21 nt, Human
aaaucaguugccugaaacuga

SEQ ID NO: 925759 - RNA, 24 nt, Human
aaccaagaaagggaaacuuaaguc

SEQ ID NO: 925760 - RNA, 21 nt, Human
aagaggaaaaauuuucuuggg

SEQ ID NO: 925761 - RNA, 21 nt, Human
aagcauuugacaugggcaaua

SEQ ID NO: 925762 - RNA, 18 nt, Human
aagcuuuacauaaagagu

SEQ ID NO: 925763 - RNA, 22 nt, Human
accccuaugugccacaaaauga

SEQ ID NO: 925764 - RNA, 21 nt, Human
agaaaggaauuaaaccauaaa

SEQ ID NO: 925765 - RNA, 21 nt, Human
aggaugauuuacaagcaacua

SEQ ID NO: 925766 - RNA, 19 nt, Human
aguggccaucuauucuugu

SEQ ID NO: 925767 - RNA, 23 nt, Human
auagaauuccucaguuuucaaaa

SEQ ID NO: 925768 - RNA, 23 nt, Human
aucaauugcuuccuuuaaaaaau

SEQ ID NO: 925769 - RNA, 25 nt, Human
caaauaaaucgcuagcuccuaggcc

SEQ ID NO: 925770 - RNA, 24 nt, Human
caaauaaaugcaacagaaugugga

SEQ ID NO: 925771 - RNA, 23 nt, Human
cagcagagauagauguugaggca

SEQ ID NO: 925772 - RNA, 23 nt, Human
caggguuuagguuugcuaacgcc

SEQ ID NO: 925773 - RNA, 19 nt, Human
cauaaaccaagaaagggaa

SEQ ID NO: 925774 - RNA, 18 nt, Human
cauuuuuauuuucagggg

SEQ ID NO: 925775 - RNA, 18 nt, Human
cauuuuuauuuucagggg

SEQ ID NO: 925776 - RNA, 18 nt, Human
ccacugcugugacuggca

SEQ ID NO: 925777 - RNA, 20 nt, Human
ccaucagcugucguauucuu

SEQ ID NO: 925778 - RNA, 18 nt, Human
ccccacugccugucuucu

SEQ ID NO: 925779 - RNA, 21 nt, Human
ccuacagcuaaagacagccau

SEQ ID NO: 925780 - RNA, 27 nt, Human
ccuacagcuaaagacagccauucuaac

SEQ ID NO: 925781 - RNA, 19 nt, Human
ccuggaucaaaaacaaauu

SEQ ID NO: 925782 - RNA, 20 nt, Human
cuaaagacagccauucuaac

SEQ ID NO: 925783 - RNA, 26 nt, Human
cuacagcuaaagacagccauucuaac

SEQ ID NO: 925784 - RNA, 19 nt, Human
cucagauaaugaguucagg

SEQ ID NO: 925785 - RNA, 20 nt, Human
gaaaaagcagaggacucaga

SEQ ID NO: 925786 - RNA, 19 nt, Human
gagaaaaagcagaggacuc

SEQ ID NO: 925787 - RNA, 19 nt, Human
gagaacaguagaacagacc

SEQ ID NO: 925788 - RNA, 22 nt, Human
gauauugaggggccgagaaaaa

SEQ ID NO: 925789 - RNA, 21 nt, Human
ggacucagacccagacuaaug

SEQ ID NO: 925790 - RNA, 22 nt, Human
ggggccgagaaaaagcagagga

SEQ ID NO: 925791 - RNA, 19 nt, Human
uaaagacagccauucuaac

SEQ ID NO: 925792 - RNA, 22 nt, Human
uaaagcuuuacauaaagaguuu

SEQ ID NO: 925793 - RNA, 19 nt, Human
uaagaaaugauacauugca

SEQ ID NO: 925794 - RNA, 19 nt, Human
uaauacauaucuaaaauca

SEQ ID NO: 925795 - RNA, 18 nt, Human
uaccuugaugacuaagcc

SEQ ID NO: 925796 - RNA, 20 nt, Human
uagcuccuaggccuacagcu

SEQ ID NO: 925797 - RNA, 23 nt, Human
uaugucaaguggaaauuuaaauc

SEQ ID NO: 925798 - RNA, 23 nt, Human
uauuuaacuaucauaucuacaua

SEQ ID NO: 925799 - RNA, 21 nt, Human
ucaaugacacuucaaaaagaa

SEQ ID NO: 925800 - RNA, 19 nt, Human
ucccuggaucaaaaacaaa

SEQ ID NO: 925801 - RNA, 18 nt, Human
ucgcuagcuccuaggccu

SEQ ID NO: 925802 - RNA, 20 nt, Human
ucggcaaauaaaugcaacag

SEQ ID NO: 925803 - RNA, 23 nt, Human
ucguauucuuucaacuucagacc

SEQ ID NO: 925804 - RNA, 21 nt, Human
ucucuuuucccaagugagagc

SEQ ID NO: 925805 - RNA, 18 nt, Human
ucuucucagccucucucc

SEQ ID NO: 925806 - RNA, 23 nt, Human
ugaaaaagaacaacuaaucuucu

SEQ ID NO: 925807 - RNA, 24 nt, Human
ugaaaaggaaccuaauuuuucuca

SEQ ID NO: 925808 - RNA, 22 nt, Human
ugacacuucaaaaagaaaggaa

SEQ ID NO: 925809 - RNA, 24 nt, Human
ugaggcaggagaauuuuggaguuc

SEQ ID NO: 925810 - RNA, 26 nt, Human
ugaguauaauuaaaauagggcaagac

SEQ ID NO: 925811 - RNA, 22 nt, Human
ugagucugaaaaugaaucuuua

SEQ ID NO: 925812 - RNA, 24 nt, Human
ugcaacagaauguggaagucagaa

SEQ ID NO: 925813 - RNA, 25 nt, Human
ugccugaaacugagaacaguagaac

SEQ ID NO: 925814 - RNA, 20 nt, Human
uguuguuuuaauccuccaag

SEQ ID NO: 925815 - RNA, 22 nt, Human
uuaauuuacuucucuuuuccca

SEQ ID NO: 925816 - RNA, 22 nt, Human
uuacauacuuaacauucauucc

SEQ ID NO: 925817 - RNA, 25 nt, Human
uuacauacuuaacauucauuccauc

SEQ ID NO: 925818 - RNA, 21 nt, Human
uuagaaucucaaccugccuuc

SEQ ID NO: 925819 - RNA, 22 nt, Human
uuagaaucucaaccugccuucu

SEQ ID NO: 925820 - RNA, 19 nt, Human
uucaaaaccaagcauuuga

SEQ ID NO: 925821 - RNA, 20 nt, Human
uucaggggaaaagaggaaaa

SEQ ID NO: 925822 - RNA, 22 nt, Human
uuccaucagcugucguauucuu

SEQ ID NO: 925823 - RNA, 24 nt, Human
uuucauaggcauuugaaaucaguu

SEQ ID NO: 925824 - RNA, 23 nt, Human
uuuccaccccaggucuuuuccac

SEQ ID NO: 925825 - RNA, 21 nt, Human
uuucccaagugagagccccac

SEQ ID NO: 925826 - RNA, 19 nt, Human
uuuuuuuuuuuuuaaggga

SEQ ID NO: 925827 - RNA, 25 nt, Human
uuuuuuuuuuuuuuuuuuuuaaggg

SEQ ID NO: 925828 - RNA, 21 nt, Human
aaacaugguuaaauagugccg

SEQ ID NO: 925829 - RNA, 23 nt, Human
aaacgcagccaccgccgucacca

SEQ ID NO: 925830 - RNA, 20 nt, Human
aaacgcagccaccgccgucu

SEQ ID NO: 925831 - RNA, 21 nt, Human
aagauaaccgccccggccccc

SEQ ID NO: 925832 - RNA, 24 nt, Human
aaguguuuucuguuaaaaggaucc

SEQ ID NO: 925833 - RNA, 23 nt, Human
accaauauugguauuuuugccau

SEQ ID NO: 925834 - RNA, 18 nt, Human
acuuuagggaaugaggaa

SEQ ID NO: 925835 - RNA, 18 nt, Human
agggaagggccgccugcg

SEQ ID NO: 925836 - RNA, 22 nt, Human
aucuaucacccccaccucccag

SEQ ID NO: 925837 - RNA, 19 nt, Human
auggugguuccuuucugga

SEQ ID NO: 925838 - RNA, 21 nt, Human
auuuacauacaguaaaaucac

SEQ ID NO: 925839 - RNA, 18 nt, Human
caagauaaccgccccggc

SEQ ID NO: 925840 - RNA, 23 nt, Human
cacccccaccucccagucccugg

SEQ ID NO: 925841 - RNA, 21 nt, Human
caccucccuccgccccccggg

SEQ ID NO: 925842 - RNA, 23 nt, Human
cagcagccaggacuuucucucug

SEQ ID NO: 925843 - RNA, 24 nt, Human
cagucuuacugaaaaaagggaaac

SEQ ID NO: 925844 - RNA, 19 nt, Human
ccagcccagcugcuaaccu

SEQ ID NO: 925845 - RNA, 22 nt, Human
ccaggacuuucucucugggucc

SEQ ID NO: 925846 - RNA, 18 nt, Human
cccaagauaaccgccccg

SEQ ID NO: 925847 - RNA, 18 nt, Human
ccccccgggacagauggc

SEQ ID NO: 925848 - RNA, 19 nt, Human
cccggcccccucucagcga

SEQ ID NO: 925849 - RNA, 22 nt, Human
ccgccccggcccccucucagcg

SEQ ID NO: 925850 - RNA, 20 nt, Human
cgccccggcccccucucagc

SEQ ID NO: 925851 - RNA, 23 nt, Human
cggaggcgauuuugacaccuccc

SEQ ID NO: 925852 - RNA, 21 nt, Human
cguuccaaguguguuuucugc

SEQ ID NO: 925853 - RNA, 22 nt, Human
cugaagguccugcagugcccaa

SEQ ID NO: 925854 - RNA, 22 nt, Human
cuuccaaaacgcagccaccgcc

SEQ ID NO: 925855 - RNA, 27 nt, Human
cuuccaaaacgcagccaccgccgucac

SEQ ID NO: 925856 - RNA, 18 nt, Human
gaaguagaauauaucuau

SEQ ID NO: 925857 - RNA, 19 nt, Human
gauggcaacgccuggggac

SEQ ID NO: 925858 - RNA, 18 nt, Human
gauuuugacaccucccuc

SEQ ID NO: 925859 - RNA, 21 nt, Human
gcccauuugugcauucuuggu

SEQ ID NO: 925860 - RNA, 21 nt, Human
ggaaaaaauaucuccuuguga

SEQ ID NO: 925861 - RNA, 22 nt, Human
ggaggcgauuuugacaccuccc

SEQ ID NO: 925862 - RNA, 21 nt, Human
guagaauauaucuaucacccc

SEQ ID NO: 925863 - RNA, 23 nt, Human
gugcauucuugguaacggugggu

SEQ ID NO: 925864 - RNA, 23 nt, Human
uaaaaguugcucagaacaguaau

SEQ ID NO: 925865 - RNA, 23 nt, Human
uaaccgccccggcccccucucag

SEQ ID NO: 925866 - RNA, 22 nt, Human
uaauaauaauaguccagucuua

SEQ ID NO: 925867 - RNA, 21 nt, Human
uagaaggggcuguuguugggc

SEQ ID NO: 925868 - RNA, 24 nt, Human
uauaucuaucacccccaccuccca

SEQ ID NO: 925869 - RNA, 19 nt, Human
uauggugguuccuuucugg

SEQ ID NO: 925870 - RNA, 21 nt, Human
uauguaauuaaauguuuucag

SEQ ID NO: 925871 - RNA, 24 nt, Human
ucagaccgagugugucagcagcca

SEQ ID NO: 925872 - RNA, 19 nt, Human
ucagugguuagcuuugauu

SEQ ID NO: 925873 - RNA, 23 nt, Human
uccaaaaacagaauuuugaaaua

SEQ ID NO: 925874 - RNA, 18 nt, Human
ugaaaagaaacgcuaacu

SEQ ID NO: 925875 - RNA, 23 nt, Human
ugaagguccugcagugcccaaga

SEQ ID NO: 925876 - RNA, 18 nt, Human
ugacaccucccuccgccc

SEQ ID NO: 925877 - RNA, 23 nt, Human
ugaguagacuacaguuuuuuggg

SEQ ID NO: 925878 - RNA, 18 nt, Human
ugaguccauagguuuguu

SEQ ID NO: 925879 - RNA, 19 nt, Human
ugcauucuugguaacggug

SEQ ID NO: 925880 - RNA, 20 nt, Human
ugcgucagggugucugcccu

SEQ ID NO: 925881 - RNA, 24 nt, Human
uggaauggcucuugguuccgaccc

SEQ ID NO: 925882 - RNA, 18 nt, Human
uggaauggcucuugguuu

SEQ ID NO: 925883 - RNA, 21 nt, Human
uggcuugcuuuucagaccgag

SEQ ID NO: 925884 - RNA, 19 nt, Human
ugggacaguaauuugagaa

SEQ ID NO: 925885 - RNA, 19 nt, Human
uggugaaaagaaacgcuaa

SEQ ID NO: 925886 - RNA, 19 nt, Human
uguuaacgugcugcucuuc

SEQ ID NO: 925887 - RNA, 20 nt, Human
uuaaaaguugcucagaacag

SEQ ID NO: 925888 - RNA, 24 nt, Human
uuaaucuuaagaaauauguaauua

SEQ ID NO: 925889 - RNA, 20 nt, Human
uuccaaaacgcagccaccgc

SEQ ID NO: 925890 - RNA, 19 nt, Human
uucuguuaaaaggauccua

SEQ ID NO: 925891 - RNA, 22 nt, Human
uuuauggaaaaaggauuugacu

SEQ ID NO: 925892 - RNA, 22 nt, Human
uuucuggaguuaaucccccucc

SEQ ID NO: 925893 - RNA, 24 nt, Human
uuuggcaagauuuuuauggaaaaa

SEQ ID NO: 925894 - RNA, 18 nt, Human
uuugugcauuucaaaaau

SEQ ID NO: 925895 - RNA, 19 nt, Human
uuuuuuuuuuuuaagaagu

SEQ ID NO: 925896 - RNA, 19 nt, Human
uuuuuuuuuuuuuuuuugg

SEQ ID NO: 925897 - RNA, 22 nt, Human
uuuuuuuuuuuuuuuuuggcuu

SEQ ID NO: 925898 - RNA, 18 nt, Human
aaaaacugucaagaaccu

SEQ ID NO: 925899 - RNA, 24 nt, Human
aaaaggcugaaaagacagaaauca

SEQ ID NO: 925900 - RNA, 22 nt, Human
aaaaggucuauaguccaaaaaa

SEQ ID NO: 925901 - RNA, 20 nt, Human
aaaauuacagaauuagccaa

SEQ ID NO: 925902 - RNA, 22 nt, Human
aaacaauaagaugugaccaaga

SEQ ID NO: 925903 - RNA, 22 nt, Human
aacaagaugggaaagcauucac

SEQ ID NO: 925904 - RNA, 20 nt, Human
aagaagccaggcaauagacu

SEQ ID NO: 925905 - RNA, 22 nt, Human
aagcauucacagccacagagaa

SEQ ID NO: 925906 - RNA, 18 nt, Human
aaggggugggguauaaga

SEQ ID NO: 925907 - RNA, 24 nt, Human
aauaaacaauaagaugugaccaag

SEQ ID NO: 925908 - RNA, 21 nt, Human
accucauuaucucuacacuuc

SEQ ID NO: 925909 - RNA, 22 nt, Human
accugaugauccagauauacug

SEQ ID NO: 925910 - RNA, 18 nt, Human
acgugcaagaacagaaau

SEQ ID NO: 925911 - RNA, 22 nt, Human
acuaacauguuaccauauauac

SEQ ID NO: 925912 - RNA, 18 nt, Human
acucacacaguaacucau

SEQ ID NO: 925913 - RNA, 18 nt, Human
acucacacaguaacucau

SEQ ID NO: 925914 - RNA, 23 nt, Human
agaaaaaggcugaaaagacagaa

SEQ ID NO: 925915 - RNA, 22 nt, Human
agaaaacaaaaagaaugaaagg

SEQ ID NO: 925916 - RNA, 21 nt, Human
agaaacacagacacuugcaga

SEQ ID NO: 925917 - RNA, 19 nt, Human
agaaagaaacaagguuaga

SEQ ID NO: 925918 - RNA, 22 nt, Human
agaaagaaacaagguuagagaa

SEQ ID NO: 925919 - RNA, 21 nt, Human
agaagaacgugcaagaacaga

SEQ ID NO: 925920 - RNA, 21 nt, Human
agagaaacacagacacuugca

SEQ ID NO: 925921 - RNA, 19 nt, Human
agaugccaccaaaaaaaag

SEQ ID NO: 925922 - RNA, 21 nt, Human
agaugccaccaaaaaaaaggg

SEQ ID NO: 925923 - RNA, 18 nt, Human
agccuauacccacccagc

SEQ ID NO: 925924 - RNA, 21 nt, Human
agcuguccacaacucuccaaa

SEQ ID NO: 925925 - RNA, 27 nt, Human
aggaacaauaugagagcuguccacaac

SEQ ID NO: 925926 - RNA, 21 nt, Human
aggcaaaaacagaaaacaaaa

SEQ ID NO: 925927 - RNA, 28 nt, Human
aggcaaaaacagaaaacaaaagggaccc

SEQ ID NO: 925928 - RNA, 25 nt, Human
agugcuucuaagguuauucuuaauu

SEQ ID NO: 925929 - RNA, 18 nt, Human
aucaaguagaagaaggga

SEQ ID NO: 925930 - RNA, 20 nt, Human
augcacagucuugaagagaa

SEQ ID NO: 925931 - RNA, 20 nt, Human
auguuaccauauauacccaa

SEQ ID NO: 925932 - RNA, 21 nt, Human
caaaaaggaccauuuaugaca

SEQ ID NO: 925933 - RNA, 21 nt, Human
caaaaaggaccauuuaugaca

SEQ ID NO: 925934 - RNA, 22 nt, Human
cacugauaguugcaggcaaggc

SEQ ID NO: 925935 - RNA, 19 nt, Human
cacugcacucagugcugag

SEQ ID NO: 925936 - RNA, 24 nt, Human
cacuucaaaauacauauaccuaga

SEQ ID NO: 925937 - RNA, 23 nt, Human
cagaaagaaacaagguuagagaa

SEQ ID NO: 925938 - RNA, 22 nt, Human
cagaguagcuauucuagaagac

SEQ ID NO: 925939 - RNA, 22 nt, Human
cagcagccuauacccacccagc

SEQ ID NO: 925940 - RNA, 23 nt, Human
cagcagccuauacccacccagca

SEQ ID NO: 925941 - RNA, 20 nt, Human
cagcaugucacagaaaucuu

SEQ ID NO: 925942 - RNA, 21 nt, Human
cagccaagcuaacucaauuac

SEQ ID NO: 925943 - RNA, 19 nt, Human
caggauuccuaagaauauc

SEQ ID NO: 925944 - RNA, 19 nt, Human
caggauuccuaagaauauc

SEQ ID NO: 925945 - RNA, 21 nt, Human
cagugcugaggacucagcagu

SEQ ID NO: 925946 - RNA, 24 nt, Human
cauccaaaaaggaccauuuaugac

SEQ ID NO: 925947 - RNA, 24 nt, Human
cauccaaaaaggaccauuuaugac

SEQ ID NO: 925948 - RNA, 25 nt, Human
cauccaaaaaggaccauuuaugaca

SEQ ID NO: 925949 - RNA, 25 nt, Human
cauccaaaaaggaccauuuaugaca

SEQ ID NO: 925950 - RNA, 22 nt, Human
ccaaaaaggaccauuuaugaca

SEQ ID NO: 925951 - RNA, 22 nt, Human
ccaaaaaggaccauuuaugaca

SEQ ID NO: 925952 - RNA, 24 nt, Human
ccaaaaggucuauaguccaaaaaa

SEQ ID NO: 925953 - RNA, 24 nt, Human
ccaagacaugagacagcagccuau

SEQ ID NO: 925954 - RNA, 19 nt, Human
ccacagagaacauccugaa

SEQ ID NO: 925955 - RNA, 19 nt, Human
ccaggaaaugacguuaggg

SEQ ID NO: 925956 - RNA, 18 nt, Human
ccucugcugaggcuugcc

SEQ ID NO: 925957 - RNA, 20 nt, Human
ccugugaauuucagagauga

SEQ ID NO: 925958 - RNA, 20 nt, Human
ccuuaagaauacuacuuucu

SEQ ID NO: 925959 - RNA, 19 nt, Human
cugacaaccaaggaacaau

SEQ ID NO: 925960 - RNA, 18 nt, Human
cuucacuccaaucucaga

SEQ ID NO: 925961 - RNA, 24 nt, Human
cuuccagguaccaacugugaacaa

SEQ ID NO: 925962 - RNA, 18 nt, Human
gaaaagacagaaaucaag

SEQ ID NO: 925963 - RNA, 23 nt, Human
gaaacacagacacuugcagaucu

SEQ ID NO: 925964 - RNA, 22 nt, Human
gaacaauaugagagcuguccac

SEQ ID NO: 925965 - RNA, 24 nt, Human
gaagcuuuacuuuggggaauggga

SEQ ID NO: 925966 - RNA, 22 nt, Human
gacaaacaaguauaucagcaau

SEQ ID NO: 925967 - RNA, 18 nt, Human
gagaugccaccaaaaaaa

SEQ ID NO: 925968 - RNA, 22 nt, Human
gcauuuaccacgcacugcacuc

SEQ ID NO: 925969 - RNA, 20 nt, Human
gccacagagaacauccugaa

SEQ ID NO: 925970 - RNA, 20 nt, Human
guagaagaagccaggcaaua

SEQ ID NO: 925971 - RNA, 25 nt, Human
gugaauuucagagaugaagacagag

SEQ ID NO: 925972 - RNA, 18 nt, Human
uaacuuggcugacaacca

SEQ ID NO: 925973 - RNA, 23 nt, Human
uaccauauauacccaagggugcc

SEQ ID NO: 925974 - RNA, 21 nt, Human
uacuacuuucugggagagcaa

SEQ ID NO: 925975 - RNA, 19 nt, Human
ucaaaauaaacccagccug

SEQ ID NO: 925976 - RNA, 24 nt, Human
ucacagaaaucuucacuccaaucu

SEQ ID NO: 925977 - RNA, 21 nt, Human
ucacagccacagagaacaucc

SEQ ID NO: 925978 - RNA, 23 nt, Human
ucacuggauggccuucaggaauc

SEQ ID NO: 925979 - RNA, 23 nt, Human
uccagagauuuuccaaaucaucu

SEQ ID NO: 925980 - RNA, 18 nt, Human
ucccucccagagaaacac

SEQ ID NO: 925981 - RNA, 19 nt, Human
ucccuguaagccaugcaca

SEQ ID NO: 925982 - RNA, 21 nt, Human
ucuccagagauuuuccaaauc

SEQ ID NO: 925983 - RNA, 23 nt, Human
ucuccagagauuuuccaaaucau

SEQ ID NO: 925984 - RNA, 24 nt, Human
ucuccagagauuuuccaaaucauc

SEQ ID NO: 925985 - RNA, 19 nt, Human
ucucugggagaaggucaau

SEQ ID NO: 925986 - RNA, 21 nt, Human
ugaaaagacagaaaucaagua

SEQ ID NO: 925987 - RNA, 24 nt, Human
ugaaaagacagaaaucaaguagaa

SEQ ID NO: 925988 - RNA, 25 nt, Human
ugacaaacaaguauaucagcaauau

SEQ ID NO: 925989 - RNA, 19 nt, Human
ugacaaccaaggaacaaua

SEQ ID NO: 925990 - RNA, 19 nt, Human
ugacaaggaaaaaauaagg

SEQ ID NO: 925991 - RNA, 19 nt, Human
ugaccaagacaugagacag

SEQ ID NO: 925992 - RNA, 22 nt, Human
ugaccaagacaugagacagcag

SEQ ID NO: 925993 - RNA, 19 nt, Human
ugagaccaggaaaugacgu

SEQ ID NO: 925994 - RNA, 24 nt, Human
ugagaugccaccaaaaaaaagggg

SEQ ID NO: 925995 - RNA, 18 nt, Human
ugagcuggucaagagcug

SEQ ID NO: 925996 - RNA, 24 nt, Human
ugagcuggucaagagcugauucgg

SEQ ID NO: 925997 - RNA, 22 nt, Human
ugcacuccugaaugauauaugu

SEQ ID NO: 925998 - RNA, 21 nt, Human
ugcuucuaagguuauucuuaa

SEQ ID NO: 925999 - RNA, 22 nt, Human
uggaugagcauuccagguuugg

SEQ ID NO: 926000 - RNA, 18 nt, Human
ugggagaagaacgugcaa

SEQ ID NO: 926001 - RNA, 19 nt, Human
uguagaagaagccaggcaa

SEQ ID NO: 926002 - RNA, 22 nt, Human
uguagaauauaaaccugacaac

SEQ ID NO: 926003 - RNA, 20 nt, Human
ugucaagaaccucugcugag

SEQ ID NO: 926004 - RNA, 23 nt, Human
ugucacagaaaucuucacuccaa

SEQ ID NO: 926005 - RNA, 22 nt, Human
uucacagccacagagaacaucc

SEQ ID NO: 926006 - RNA, 19 nt, Human
uugccuaacaucucagagg

SEQ ID NO: 926007 - RNA, 23 nt, Human
uuuucagucucuccagagauuuu

SEQ ID NO: 926008 - RNA, 22 nt, Human
uuuuuuuuuuuuuuuuucuagg

SEQ ID NO: 926009 - RNA, 24 nt, Human
aaguagauuuuuuuaaagugguuu

SEQ ID NO: 926010 - RNA, 19 nt, Human
acaagucaagccaaagcgg

SEQ ID NO: 926011 - RNA, 24 nt, Human
agacucaguuggaagaggaagaau

SEQ ID NO: 926012 - RNA, 24 nt, Human
ggagaggacuuuacaccccucuag

SEQ ID NO: 926013 - RNA, 24 nt, Human
guagauuuuuuuaaagugguuuua

SEQ ID NO: 926014 - RNA, 25 nt, Human
uacuuaguaaaaaguagauuuuuuu

SEQ ID NO: 926015 - RNA, 19 nt, Human
uccagaucaggacucuagg

SEQ ID NO: 926016 - RNA, 28 nt, Human
uggaagaggaagaauuacaguuccagau

SEQ ID NO: 926017 - RNA, 23 nt, Human
uguuacuuaguaaaaaguagauu

SEQ ID NO: 926018 - RNA, 26 nt, Human
uuuucugcaaauccaucugagucuga

SEQ ID NO: 926019 - RNA, 19 nt, Human
aaacaguacagcaccaaca

SEQ ID NO: 926020 - RNA, 19 nt, Human
aacauuuccucaguaaucu

SEQ ID NO: 926021 - RNA, 22 nt, Human
acuggguguggugccucacgcc

SEQ ID NO: 926022 - RNA, 23 nt, Human
agaaaaaaguaaaaaucaaagau

SEQ ID NO: 926023 - RNA, 24 nt, Human
agaaaaaaguaaaaaucaaagaug

SEQ ID NO: 926024 - RNA, 21 nt, Human
agaaugggggagaaauuagaa

SEQ ID NO: 926025 - RNA, 23 nt, Human
agaugaacuagaauaacaaagaa

SEQ ID NO: 926026 - RNA, 23 nt, Human
agcacuuugggaggcuggggugg

SEQ ID NO: 926027 - RNA, 18 nt, Human
auaaauuuuccucuaagc

SEQ ID NO: 926028 - RNA, 20 nt, Human
auauuuuaaaauuucuguua

SEQ ID NO: 926029 - RNA, 21 nt, Human
caaaauaauucauggacuuaa

SEQ ID NO: 926030 - RNA, 24 nt, Human
cacgccuauaaucucagcacuuug

SEQ ID NO: 926031 - RNA, 24 nt, Human
cagcacuuugggaggcuggggugg

SEQ ID NO: 926032 - RNA, 23 nt, Human
caguacagcaccaacauuuccuc

SEQ ID NO: 926033 - RNA, 22 nt, Human
ccuauaaucucagcacuuuggg

SEQ ID NO: 926034 - RNA, 22 nt, Human
cucacgccuauaaucucagcac

SEQ ID NO: 926035 - RNA, 24 nt, Human
cucacgccuauaaucucagcacuu

SEQ ID NO: 926036 - RNA, 24 nt, Human
cucuucuuuuucuacuuuccuaaa

SEQ ID NO: 926037 - RNA, 22 nt, Human
cugcccagugguagaggcuugc

SEQ ID NO: 926038 - RNA, 20 nt, Human
cuuccucugcaaaccagccu

SEQ ID NO: 926039 - RNA, 24 nt, Human
gauuacuugggcucgggaguuuga

SEQ ID NO: 926040 - RNA, 19 nt, Human
gcauuucccccugcccagu

SEQ ID NO: 926041 - RNA, 19 nt, Human
gcccagugguagaggcuug

SEQ ID NO: 926042 - RNA, 18 nt, Human
ggcucgggaguuugagac

SEQ ID NO: 926043 - RNA, 24 nt, Human
ggugccucacgccuauaaucucag

SEQ ID NO: 926044 - RNA, 23 nt, Human
gguguggugccucacgccuauaa

SEQ ID NO: 926045 - RNA, 20 nt, Human
guaaaaaucaaagauguuua

SEQ ID NO: 926046 - RNA, 22 nt, Human
gugggugucucuucagagcagg

SEQ ID NO: 926047 - RNA, 23 nt, Human
uaaaaaaagucauaauuucaagu

SEQ ID NO: 926048 - RNA, 20 nt, Human
uagaauaacaaagaaaaaag

SEQ ID NO: 926049 - RNA, 26 nt, Human
uagaauaacaaagaaaaaaguaaaaa

SEQ ID NO: 926050 - RNA, 19 nt, Human
uagaugaacuagaauaaca

SEQ ID NO: 926051 - RNA, 19 nt, Human
uagcuacauugcauagauu

SEQ ID NO: 926052 - RNA, 18 nt, Human
uauaacaaucaaaaggau

SEQ ID NO: 926053 - RNA, 19 nt, Human
uauaugcauucauacuaua

SEQ ID NO: 926054 - RNA, 21 nt, Human
ucaaaaggauuugagauaauu

SEQ ID NO: 926055 - RNA, 19 nt, Human
ucuguuaagauuucuucuu

SEQ ID NO: 926056 - RNA, 23 nt, Human
ugacauuguuguacaacagaucu

SEQ ID NO: 926057 - RNA, 20 nt, Human
ugagacuagcuugggcccuc

SEQ ID NO: 926058 - RNA, 26 nt, Human
ugauaguuguauuuuuauuuucauuu

SEQ ID NO: 926059 - RNA, 21 nt, Human
ugccaaaauuaaacaguacag

SEQ ID NO: 926060 - RNA, 22 nt, Human
ugccucacgccuauaaucucag

SEQ ID NO: 926061 - RNA, 24 nt, Human
ugccucacgccuauaaucucagca

SEQ ID NO: 926062 - RNA, 18 nt, Human
ugggaagauaauccaugu

SEQ ID NO: 926063 - RNA, 21 nt, Human
ugggaggcugggguggcggau

SEQ ID NO: 926064 - RNA, 22 nt, Human
ugggcccucaaauguaauuuau

SEQ ID NO: 926065 - RNA, 22 nt, Human
uggguguggugccucacgccua

SEQ ID NO: 926066 - RNA, 21 nt, Human
uugagauaauuuuuuucauua

SEQ ID NO: 926067 - RNA, 24 nt, Human
uugcauagauuuugauaguuguau

SEQ ID NO: 926068 - RNA, 24 nt, Human
uuuuuucccucuauuuccuauuuu

SEQ ID NO: 926069 - RNA, 18 nt, Human
uuuuuuuuuuuuuuuuug

SEQ ID NO: 926070 - RNA, 22 nt, Human
uuuuuuuuuuuuuuuuugccaa

SEQ ID NO: 926071 - RNA, 21 nt, Human
aaaaacagagcaccugacuua

SEQ ID NO: 926072 - RNA, 24 nt, Human
aaaacagagcaccugacuuaaaau

SEQ ID NO: 926073 - RNA, 20 nt, Human
aaagagauuauguucugccu

SEQ ID NO: 926074 - RNA, 22 nt, Human
aaagagauuauguucugccuuc

SEQ ID NO: 926075 - RNA, 25 nt, Human
aaauagcauuuuuaaaaguaccucu

SEQ ID NO: 926076 - RNA, 22 nt, Human
aagcauuaauuagcaagaauau

SEQ ID NO: 926077 - RNA, 19 nt, Human
acaaauauucagaccauag

SEQ ID NO: 926078 - RNA, 19 nt, Human
acagagcaccugacuuaaa

SEQ ID NO: 926079 - RNA, 19 nt, Human
acauaggaaauuuuggggg

SEQ ID NO: 926080 - RNA, 21 nt, Human
accauguaaaaacuuccugaa

SEQ ID NO: 926081 - RNA, 22 nt, Human
agaccauagcaaguggucauuu

SEQ ID NO: 926082 - RNA, 18 nt, Human
agagcaccugacuuaaaa

SEQ ID NO: 926083 - RNA, 23 nt, Human
agagguccauuuacugggagcua

SEQ ID NO: 926084 - RNA, 21 nt, Human
agcauuaauuagcaagaauau

SEQ ID NO: 926085 - RNA, 21 nt, Human
agcuaaugaagcuucaguuuc

SEQ ID NO: 926086 - RNA, 28 nt, Human
aggcacccagcagauuggugccuggcga

SEQ ID NO: 926087 - RNA, 21 nt, Human
aguguuggaccugagacuuug

SEQ ID NO: 926088 - RNA, 22 nt, Human
auuauguuaguccuuggugaua

SEQ ID NO: 926089 - RNA, 26 nt, Human
caaaagucuaaccuuuuaguaccauc

SEQ ID NO: 926090 - RNA, 18 nt, Human
cagagcaccugacuuaaa

SEQ ID NO: 926091 - RNA, 18 nt, Human
cagagccuugugccacuc

SEQ ID NO: 926092 - RNA, 20 nt, Human
cagcagauuggugccuggcg

SEQ ID NO: 926093 - RNA, 18 nt, Human
cucacaguguccucacau

SEQ ID NO: 926094 - RNA, 20 nt, Human
cucuccuauguaugagaccu

SEQ ID NO: 926095 - RNA, 18 nt, Human
ggaggcuuagaaauaaca

SEQ ID NO: 926096 - RNA, 19 nt, Human
gggggacacaaauauucag

SEQ ID NO: 926097 - RNA, 19 nt, Human
guuggaccugagacuuugc

SEQ ID NO: 926098 - RNA, 25 nt, Human
uaaaaucuacacaucucaguuuuga

SEQ ID NO: 926099 - RNA, 23 nt, Human
uaaagaaagagauuauguucugc

SEQ ID NO: 926100 - RNA, 18 nt, Human
uaaauaaaaacagagcac

SEQ ID NO: 926101 - RNA, 19 nt, Human
uaaauguaugcucauaguc

SEQ ID NO: 926102 - RNA, 21 nt, Human
uaacaaaauacuauaaacugg

SEQ ID NO: 926103 - RNA, 20 nt, Human
uagcaagaauaugaaguaaa

SEQ ID NO: 926104 - RNA, 21 nt, Human
uagcaaguggucauuuguguc

SEQ ID NO: 926105 - RNA, 22 nt, Human
uagcaugaguuaaagaaagaga

SEQ ID NO: 926106 - RNA, 22 nt, Human
uauguaugagaccuaguuauuu

SEQ ID NO: 926107 - RNA, 22 nt, Human
uauuuuaaauaaaaacagagca

SEQ ID NO: 926108 - RNA, 26 nt, Human
ucagaccauagcaaguggugggaaac

SEQ ID NO: 926109 - RNA, 21 nt, Human
uccaaggucaaggcacccagc

SEQ ID NO: 926110 - RNA, 22 nt, Human
uccgaaaugauuucucaacuag

SEQ ID NO: 926111 - RNA, 21 nt, Human
ugaagcuucaguuucaggucu

SEQ ID NO: 926112 - RNA, 19 nt, Human
ugaauccauuuccacuaaa

SEQ ID NO: 926113 - RNA, 18 nt, Human
ugacuugccuggugucau

SEQ ID NO: 926114 - RNA, 19 nt, Human
ugagacuuugccuccaauu

SEQ ID NO: 926115 - RNA, 21 nt, Human
ugccuucucagagggugcuac

SEQ ID NO: 926116 - RNA, 18 nt, Human
uggaagggacuagccagg

SEQ ID NO: 926117 - RNA, 18 nt, Human
uggcgauauuuuguaugg

SEQ ID NO: 926118 - RNA, 18 nt, Human
uggcgauauuuuguaugg

SEQ ID NO: 926119 - RNA, 18 nt, Human
ugggggcccagaagucca

SEQ ID NO: 926120 - RNA, 26 nt, Human
ugggggcccagaaguccaaggucaag

SEQ ID NO: 926121 - RNA, 22 nt, Human
ugucagaguuacuuucagauuu

SEQ ID NO: 926122 - RNA, 21 nt, Human
uguugcauagauaauacuaaa

SEQ ID NO: 926123 - RNA, 19 nt, Human
uuaguccuuggcgauacuu

SEQ ID NO: 926124 - RNA, 19 nt, Human
uuaguccuuggcgauacuu

SEQ ID NO: 926125 - RNA, 19 nt, Human
uuaguccuuggcgauacuu

SEQ ID NO: 926126 - RNA, 19 nt, Human
uuaguccuuggcgauacuu

SEQ ID NO: 926127 - RNA, 19 nt, Human
uuaguccuuggcgauacuu

SEQ ID NO: 926128 - RNA, 19 nt, Human
uuaguccuuggcgauacuu

SEQ ID NO: 926129 - RNA, 24 nt, Human
aaaagaaagcucauccccuuuagc

SEQ ID NO: 926130 - RNA, 20 nt, Human
aaagugcugagauuacaggc

SEQ ID NO: 926131 - RNA, 20 nt, Human
aaagugcugagauuacaggc

SEQ ID NO: 926132 - RNA, 24 nt, Human
aaagugcugagauuacaggcguga

SEQ ID NO: 926133 - RNA, 20 nt, Human
aaccuccaucucccaggcuc

SEQ ID NO: 926134 - RNA, 26 nt, Human
aagugcugagauuacaggcgugagcc

SEQ ID NO: 926135 - RNA, 21 nt, Human
aauuuuugacauaaucaaaau

SEQ ID NO: 926136 - RNA, 21 nt, Human
acuaaacuccuaucuauagua

SEQ ID NO: 926137 - RNA, 21 nt, Human
acuacuuuuuuuuuuuuuuuu

SEQ ID NO: 926138 - RNA, 20 nt, Human
agauuacaggcgugagccac

SEQ ID NO: 926139 - RNA, 18 nt, Human
aggcagaaaugcaguggc

SEQ ID NO: 926140 - RNA, 21 nt, Human
aggcagaaaugcaguggcacc

SEQ ID NO: 926141 - RNA, 24 nt, Human
aggugaucugcccgccucggccuc

SEQ ID NO: 926142 - RNA, 18 nt, Human
agugcugagauuacaggc

SEQ ID NO: 926143 - RNA, 24 nt, Human
augggguuuugccgccuuggccag

SEQ ID NO: 926144 - RNA, 20 nt, Human
auuacaggcaugagccacca

SEQ ID NO: 926145 - RNA, 24 nt, Human
auuuuuguauuuuuaguagagaug

SEQ ID NO: 926146 - RNA, 23 nt, Human
caaccuccaucucccaggcucaa

SEQ ID NO: 926147 - RNA, 24 nt, Human
caaccuccaucucccaggcucaag

SEQ ID NO: 926148 - RNA, 20 nt, Human
caagcgauucuccugccuca

SEQ ID NO: 926149 - RNA, 22 nt, Human
caagcgauucuccugccucagc

SEQ ID NO: 926150 - RNA, 24 nt, Human
caccacaccuggcuaauuuuugua

SEQ ID NO: 926151 - RNA, 26 nt, Human
cauuuugccagcccugggcacccacu

SEQ ID NO: 926152 - RNA, 20 nt, Human
ccagcccugggcacccacug

SEQ ID NO: 926153 - RNA, 23 nt, Human
ccagcccugggcacccacuguaa

SEQ ID NO: 926154 - RNA, 20 nt, Human
cccaggcucaagcgauucuc

SEQ ID NO: 926155 - RNA, 20 nt, Human
cccauuuugccagcccuggg

SEQ ID NO: 926156 - RNA, 21 nt, Human
cccauuuugccagcccugggc

SEQ ID NO: 926157 - RNA, 24 nt, Human
cccgaguagcugcuauuacaggca

SEQ ID NO: 926158 - RNA, 18 nt, Human
cccuuuucccauuuugcc

SEQ ID NO: 926159 - RNA, 23 nt, Human
cccuuuucccauuuugccagccc

SEQ ID NO: 926160 - RNA, 19 nt, Human
ccgccuuggccaggcuggu

SEQ ID NO: 926161 - RNA, 21 nt, Human
ccgccuuggccaggcuggucu

SEQ ID NO: 926162 - RNA, 22 nt, Human
ccuucauucucuugauuaguua

SEQ ID NO: 926163 - RNA, 18 nt, Human
ccuuuaggaacuuuuauu

SEQ ID NO: 926164 - RNA, 19 nt, Human
cgugaccucaggugaucug

SEQ ID NO: 926165 - RNA, 23 nt, Human
cuaauuuuuguauuuuuaguaga

SEQ ID NO: 926166 - RNA, 24 nt, Human
cucaagcgauucuccugccucagc

SEQ ID NO: 926167 - RNA, 24 nt, Human
cucacugcaaccuccaucucccag

SEQ ID NO: 926168 - RNA, 25 nt, Human
cucccaggcucaagcgauucuccug

SEQ ID NO: 926169 - RNA, 25 nt, Human
cucccuuuucccauuuugccagccc

SEQ ID NO: 926170 - RNA, 26 nt, Human
cucgugaccucaggugaucugcccgc

SEQ ID NO: 926171 - RNA, 23 nt, Human
cugcaaccuccaucucccaggcu

SEQ ID NO: 926172 - RNA, 24 nt, Human
cugcaaccuccaucucccaggcuc

SEQ ID NO: 926173 - RNA, 23 nt, Human
cugccucagccucccgaguagcu

SEQ ID NO: 926174 - RNA, 19 nt, Human
cuuaaagugcugagauuac

SEQ ID NO: 926175 - RNA, 23 nt, Human
cuuguauagcuccaggggaaaau

SEQ ID NO: 926176 - RNA, 18 nt, Human
cuuuuuuuuuuuuuuuug

SEQ ID NO: 926177 - RNA, 24 nt, Human
gaccucaggugaucugcccgccuc

SEQ ID NO: 926178 - RNA, 24 nt, Human
gacggagucucgcucuguugccag

SEQ ID NO: 926179 - RNA, 18 nt, Human
gauuacaggcgugagcca

SEQ ID NO: 926180 - RNA, 24 nt, Human
gauuacaggcgugagccacagugc

SEQ ID NO: 926181 - RNA, 21 nt, Human
gauucuccugccucagccucc

SEQ ID NO: 926182 - RNA, 26 nt, Human
gccauuaccucucccuuuucccauuu

SEQ ID NO: 926183 - RNA, 20 nt, Human
gccucagccucccgaguagc

SEQ ID NO: 926184 - RNA, 20 nt, Human
gccuuggccaggcuggucuu

SEQ ID NO: 926185 - RNA, 24 nt, Human
gcgauucuccugccucagccuccc

SEQ ID NO: 926186 - RNA, 22 nt, Human
ggcuacuuuacuaaacuccuau

SEQ ID NO: 926187 - RNA, 22 nt, Human
gggguuuugccgccuuggccag

SEQ ID NO: 926188 - RNA, 21 nt, Human
guccauuuagauuuggcaagu

SEQ ID NO: 926189 - RNA, 24 nt, Human
gugaucugcccgccucggccucuu

SEQ ID NO: 926190 - RNA, 24 nt, Human
uaaagugcugagauuacaggcgug

SEQ ID NO: 926191 - RNA, 22 nt, Human
uaagucuuucaagaaacuuuaa

SEQ ID NO: 926192 - RNA, 24 nt, Human
uaauuuuuguauuuuuaguagaga

SEQ ID NO: 926193 - RNA, 18 nt, Human
uacaggcaugagccacca

SEQ ID NO: 926194 - RNA, 22 nt, Human
uacaggcaugagccaccacacc

SEQ ID NO: 926195 - RNA, 24 nt, Human
uacaggcgugagccacagugccca

SEQ ID NO: 926196 - RNA, 24 nt, Human
uacauuuauuaacuuaggaagaac

SEQ ID NO: 926197 - RNA, 24 nt, Human
uaccuuuucuugucuagucuuuuu

SEQ ID NO: 926198 - RNA, 23 nt, Human
uacuuuacuaaacuccuaucuau

SEQ ID NO: 926199 - RNA, 22 nt, Human
uaggaacuuuuauuuguaacuu

SEQ ID NO: 926200 - RNA, 21 nt, Human
uaggaagaacuaauaauaaug

SEQ ID NO: 926201 - RNA, 19 nt, Human
uaguagagaugggguuuug

SEQ ID NO: 926202 - RNA, 22 nt, Human
uaguagagaugggguuuugccg

SEQ ID NO: 926203 - RNA, 25 nt, Human
uauuuuguuuguauaugacaacugg

SEQ ID NO: 926204 - RNA, 23 nt, Human
ucaagaaacuuuaaacuuuucau

SEQ ID NO: 926205 - RNA, 24 nt, Human
ucacugcaaccuccaucucccagg

SEQ ID NO: 926206 - RNA, 25 nt, Human
ucacugcaaccuccaucucccaggc

SEQ ID NO: 926207 - RNA, 26 nt, Human
ucagcucacugcaaccuccaucuccc

SEQ ID NO: 926208 - RNA, 22 nt, Human
ucauuugaaguguacaauucaa

SEQ ID NO: 926209 - RNA, 24 nt, Human
ucauuugaaguguacaauucaagg

SEQ ID NO: 926210 - RNA, 22 nt, Human
uccaacaauaucaccagcaaau

SEQ ID NO: 926211 - RNA, 21 nt, Human
ucccaggcucaagcgauucuc

SEQ ID NO: 926212 - RNA, 24 nt, Human
ucccaggcucaagcgauucuccug

SEQ ID NO: 926213 - RNA, 24 nt, Human
ucccgaguagcugcuauuacaggc

SEQ ID NO: 926214 - RNA, 24 nt, Human
ucucccaggcucaagcgauucucc

SEQ ID NO: 926215 - RNA, 24 nt, Human
ucuccugccucagccucccgagua

SEQ ID NO: 926216 - RNA, 23 nt, Human
ucucgcucuguugccaggcagaa

SEQ ID NO: 926217 - RNA, 23 nt, Human
ucuguagauaccuuuucuugucu

SEQ ID NO: 926218 - RNA, 20 nt, Human
ucuguugccaggcagaaauu

SEQ ID NO: 926219 - RNA, 18 nt, Human
ugaccucaggugaucugc

SEQ ID NO: 926220 - RNA, 20 nt, Human
ugaccucaggugaucugccc

SEQ ID NO: 926221 - RNA, 24 nt, Human
ugaccucaggugaucugcccgccu

SEQ ID NO: 926222 - RNA, 22 nt, Human
ugagacggagucucgcucuguu

SEQ ID NO: 926223 - RNA, 18 nt, Human
ugagauuacaggcgugag

SEQ ID NO: 926224 - RNA, 19 nt, Human
ugagauuacaggcgugagc

SEQ ID NO: 926225 - RNA, 21 nt, Human
ugagauuacaggcgugagcca

SEQ ID NO: 926226 - RNA, 22 nt, Human
ugagauuacaggcgugagccac

SEQ ID NO: 926227 - RNA, 22 nt, Human
ugagauuacaggcgugagccac

SEQ ID NO: 926228 - RNA, 26 nt, Human
ugagauuacaggcgugagccacagug

SEQ ID NO: 926229 - RNA, 27 nt, Human
ugagauuacaggcgugagccacagugc

SEQ ID NO: 926230 - RNA, 25 nt, Human
ugcaaccuccaucucccaggcucaa

SEQ ID NO: 926231 - RNA, 22 nt, Human
ugcaguggcaccaucucagcuc

SEQ ID NO: 926232 - RNA, 23 nt, Human
ugccucagccucccgaguagcug

SEQ ID NO: 926233 - RNA, 24 nt, Human
ugcuauuacaggcaugagccacca

SEQ ID NO: 926234 - RNA, 25 nt, Human
ugcugagauuacaggcgugagccac

SEQ ID NO: 926235 - RNA, 19 nt, Human
uggcaccaucucagcucac

SEQ ID NO: 926236 - RNA, 24 nt, Human
uggcaccaucucagcucacugcaa

SEQ ID NO: 926237 - RNA, 24 nt, Human
uggccaggcuggucuugaacucgu

SEQ ID NO: 926238 - RNA, 24 nt, Human
ugggguuuugccgccuuggccagg

SEQ ID NO: 926239 - RNA, 21 nt, Human
uguauuuuuaguagagauggg

SEQ ID NO: 926240 - RNA, 20 nt, Human
uguugcuguuguaaaggucu

SEQ ID NO: 926241 - RNA, 24 nt, Human
uuaaagugcugagauuacaggcgu

SEQ ID NO: 926242 - RNA, 18 nt, Human
uuaguagagaugggguuu

SEQ ID NO: 926243 - RNA, 22 nt, Human
uuaguagagaugggguuuugcc

SEQ ID NO: 926244 - RNA, 23 nt, Human
uuaguagagaugggguuuugccg

SEQ ID NO: 926245 - RNA, 23 nt, Human
uuaucacuuccaaaagaaagcuc

SEQ ID NO: 926246 - RNA, 23 nt, Human
uuguauuuuuaguagagaugggg

SEQ ID NO: 926247 - RNA, 25 nt, Human
uuucaagaaacuuuaaacuuuucau

SEQ ID NO: 926248 - RNA, 20 nt, Human
uuucagaagugacuuuauag

SEQ ID NO: 926249 - RNA, 20 nt, Human
uuugaaguguacaauucaag

SEQ ID NO: 926250 - RNA, 21 nt, Human
uuuugccagcccugggcaccc

SEQ ID NO: 926251 - RNA, 23 nt, Human
uuuugccaugguauuuuuuguuc

SEQ ID NO: 926252 - RNA, 21 nt, Human
uuuuuaguagagaugggguuu

SEQ ID NO: 926253 - RNA, 24 nt, Human
uuuuuaguagagaugggguuuugc

SEQ ID NO: 926254 - RNA, 20 nt, Human
uuuuuguauuuuuaguagag

SEQ ID NO: 926255 - RNA, 25 nt, Human
uuuuuuuuuuuugagacggagucuc

SEQ ID NO: 926256 - RNA, 22 nt, Human
uuuuuuuuuuuuuugagacgga

SEQ ID NO: 926257 - RNA, 22 nt, Human
uuuuuuuuuuuuuuuuuccuuu

SEQ ID NO: 926258 - RNA, 23 nt, Human
uuuuuuuuuuuuuuuuuuccuuu

SEQ ID NO: 926259 - RNA, 26 nt, Human
uuuuuuuuuuuuuuuuuuuccuuuag

SEQ ID NO: 926260 - RNA, 18 nt, Human
aaaaaaaaaaaaaaaagc

SEQ ID NO: 926261 - RNA, 19 nt, Human
aaaaaaaaaaaaaagcggc

SEQ ID NO: 926262 - RNA, 23 nt, Human
aaaaauaacaaauaagacacagc

SEQ ID NO: 926263 - RNA, 20 nt, Human
aaaaggaaaaaauuuagcca

SEQ ID NO: 926264 - RNA, 20 nt, Human
aaaaugccauucugccaaaa

SEQ ID NO: 926265 - RNA, 18 nt, Human
aaaauuagcugggcgugg

SEQ ID NO: 926266 - RNA, 23 nt, Human
aaaauuuccaaaacugauuaaag

SEQ ID NO: 926267 - RNA, 20 nt, Human
aacauagugaaaccccgucu

SEQ ID NO: 926268 - RNA, 21 nt, Human
aacauagugaaaccccgucuc

SEQ ID NO: 926269 - RNA, 20 nt, Human
aacauggcaaaaccaugucu

SEQ ID NO: 926270 - RNA, 22 nt, Human
aacauggcaaaaccaugucucu

SEQ ID NO: 926271 - RNA, 24 nt, Human
aacugcuugauccugggaggugga

SEQ ID NO: 926272 - RNA, 19 nt, Human
aagacuguaaaccagccuu

SEQ ID NO: 926273 - RNA, 24 nt, Human
aaucaccugaaccugggagacaga

SEQ ID NO: 926274 - RNA, 25 nt, Human
aauggcaugugaaaauacuaauuua

SEQ ID NO: 926275 - RNA, 26 nt, Human
acaagaaugcuaaaaacuaaagauaa

SEQ ID NO: 926276 - RNA, 21 nt, Human
acacacauauaugugcauaua

SEQ ID NO: 926277 - RNA, 20 nt, Human
acacgccuauaaucccagca

SEQ ID NO: 926278 - RNA, 24 nt, Human
acagagcaagacuccaucucaaaa

SEQ ID NO: 926279 - RNA, 24 nt, Human
acagagcgagacucugucucaaaa

SEQ ID NO: 926280 - RNA, 23 nt, Human
acauaagugaaaaaguggcuuug

SEQ ID NO: 926281 - RNA, 29 nt, Human
acauauacacacauauaugugcauauaua

SEQ ID NO: 926282 - RNA, 18 nt, Human
accaugucucuacuaaaa

SEQ ID NO: 926283 - RNA, 24 nt, Human
accccgucucuacugaaaauacaa

SEQ ID NO: 926284 - RNA, 28 nt, Human
acuccaucucaaaaaaaaaaaaaaaaaa

SEQ ID NO: 926285 - RNA, 23 nt, Human
acugcacuucagccuggcgacag

SEQ ID NO: 926286 - RNA, 25 nt, Human
acugcacuucagccuggcgacagag

SEQ ID NO: 926287 - RNA, 24 nt, Human
agaagauaggauuaggaaaccaga

SEQ ID NO: 926288 - RNA, 24 nt, Human
agacagagguugcagugagccaag

SEQ ID NO: 926289 - RNA, 22 nt, Human
agagguugcagugagccaagau

SEQ ID NO: 926290 - RNA, 24 nt, Human
agagguugcagugagccaagauug

SEQ ID NO: 926291 - RNA, 22 nt, Human
agagugaaaacaguauuugaaa

SEQ ID NO: 926292 - RNA, 24 nt, Human
agcacuuugggaggccgaggcagg

SEQ ID NO: 926293 - RNA, 18 nt, Human
agccuggccaacauggca

SEQ ID NO: 926294 - RNA, 21 nt, Human
agccuggcgacagagcgagac

SEQ ID NO: 926295 - RNA, 23 nt, Human
agccuggcgacagagcgagacuc

SEQ ID NO: 926296 - RNA, 23 nt, Human
agcugggcgugguggcaggugcc

SEQ ID NO: 926297 - RNA, 18 nt, Human
aggcaggagaaucaccug

SEQ ID NO: 926298 - RNA, 22 nt, Human
aggcaggagaaucaccugaacc

SEQ ID NO: 926299 - RNA, 24 nt, Human
aggcaggagaaucaccugaaccug

SEQ ID NO: 926300 - RNA, 24 nt, Human
aggcagguggaucaugaggucagg

SEQ ID NO: 926301 - RNA, 20 nt, Human
aggccgaggcagguggauca

SEQ ID NO: 926302 - RNA, 21 nt, Human
aggcgggcagaucacuugagg

SEQ ID NO: 926303 - RNA, 23 nt, Human
aggcgggcagaucacuugagguc

SEQ ID NO: 926304 - RNA, 26 nt, Human
aggcgggcagaucacuugaggucagg

SEQ ID NO: 926305 - RNA, 24 nt, Human
aggcugaggcaggagaaucaccug

SEQ ID NO: 926306 - RNA, 25 nt, Human
agguggagguugcagugacaacggu

SEQ ID NO: 926307 - RNA, 20 nt, Human
agguggagguugcagugagc

SEQ ID NO: 926308 - RNA, 24 nt, Human
agguggagguugcagugagcugag

SEQ ID NO: 926309 - RNA, 24 nt, Human
agguggaucaugaggucaggagau

SEQ ID NO: 926310 - RNA, 22 nt, Human
aggugugugugugugugugugu

SEQ ID NO: 926311 - RNA, 22 nt, Human
auacacacguauauaugugugu

SEQ ID NO: 926312 - RNA, 18 nt, Human
auauauauguauauaugu

SEQ ID NO: 926313 - RNA, 23 nt, Human
auauauguguauauauauauuua

SEQ ID NO: 926314 - RNA, 25 nt, Human
auaugugcauauauacguguauaua

SEQ ID NO: 926315 - RNA, 23 nt, Human
auggcacacgccuauaaucccag

SEQ ID NO: 926316 - RNA, 20 nt, Human
auguguguauauauauguau

SEQ ID NO: 926317 - RNA, 24 nt, Human
auugcgccacugcacuucagccug

SEQ ID NO: 926318 - RNA, 19 nt, Human
caaaaccaugucucuacua

SEQ ID NO: 926319 - RNA, 18 nt, Human
caaacaagaaugcuaaaa

SEQ ID NO: 926320 - RNA, 23 nt, Human
caaauaagacacagcagaagaua

SEQ ID NO: 926321 - RNA, 24 nt, Human
caacauagugaaaccccgucucua

SEQ ID NO: 926322 - RNA, 24 nt, Human
caacauggcaaaaccaugucucua

SEQ ID NO: 926323 - RNA, 24 nt, Human
caagacuauccuggccaacauagu

SEQ ID NO: 926324 - RNA, 21 nt, Human
caagacuccaucucaaaaaaa

SEQ ID NO: 926325 - RNA, 24 nt, Human
caagauugcgccacugcacuucag

SEQ ID NO: 926326 - RNA, 24 nt, Human
caaggcgggcagaucacuugaggu

SEQ ID NO: 926327 - RNA, 26 nt, Human
caaggcgggcagaucacuugagguca

SEQ ID NO: 926328 - RNA, 24 nt, Human
cacaccuguaaccccagcuauuug

SEQ ID NO: 926329 - RNA, 21 nt, Human
caccacauuaucucuccagca

SEQ ID NO: 926330 - RNA, 18 nt, Human
caccuguaaccccagcua

SEQ ID NO: 926331 - RNA, 22 nt, Human
caccuguaaccccagcuauuug

SEQ ID NO: 926332 - RNA, 22 nt, Human
cacgccuauaaucccagcacuu

SEQ ID NO: 926333 - RNA, 24 nt, Human
cacgccuauaaucccagcacuuug

SEQ ID NO: 926334 - RNA, 18 nt, Human
cacugcacuucagccugg

SEQ ID NO: 926335 - RNA, 20 nt, Human
cacugcacuucagccuggcg

SEQ ID NO: 926336 - RNA, 22 nt, Human
cacugcacuucagccuggcgac

SEQ ID NO: 926337 - RNA, 23 nt, Human
cacugcacuucagccuggcgaca

SEQ ID NO: 926338 - RNA, 23 nt, Human
cacugcacuucagccuggcgaca

SEQ ID NO: 926339 - RNA, 22 nt, Human
cacuucagccuggcgacagagc

SEQ ID NO: 926340 - RNA, 23 nt, Human
cacuucagccuggcgacagagcg

SEQ ID NO: 926341 - RNA, 27 nt, Human
cagaucacuugaggucaggaauucaag

SEQ ID NO: 926342 - RNA, 24 nt, Human
cagcacuuugggaggccgaggcag

SEQ ID NO: 926343 - RNA, 26 nt, Human
cagcacuuugggaggccgaggcaggu

SEQ ID NO: 926344 - RNA, 24 nt, Human
cagcauuuuggaaggccaaggcgg

SEQ ID NO: 926345 - RNA, 20 nt, Human
cagccuggcgacagagcgag

SEQ ID NO: 926346 - RNA, 24 nt, Human
cagcuacucgggaggcugaggcag

SEQ ID NO: 926347 - RNA, 25 nt, Human
cagcuuuauuugggaauucuuagac

SEQ ID NO: 926348 - RNA, 26 nt, Human
cauauauacguguauauauauacacg

SEQ ID NO: 926349 - RNA, 18 nt, Human
ccacugcacuucagccug

SEQ ID NO: 926350 - RNA, 19 nt, Human
ccacugcacuucagccugg

SEQ ID NO: 926351 - RNA, 19 nt, Human
ccacugcacuucagccugg

SEQ ID NO: 926352 - RNA, 20 nt, Human
ccacugcacuucagccuggc

SEQ ID NO: 926353 - RNA, 23 nt, Human
ccacugcacuucagccuggcgac

SEQ ID NO: 926354 - RNA, 26 nt, Human
ccagccuggccaacauggcaaaacca

SEQ ID NO: 926355 - RNA, 21 nt, Human
ccaggcaccauggcacacgcc

SEQ ID NO: 926356 - RNA, 24 nt, Human
cccagcugggcgugguggcucacg

SEQ ID NO: 926357 - RNA, 24 nt, Human
cccauacugaaacauguacaagag

SEQ ID NO: 926358 - RNA, 22 nt, Human
ccuaggugacagagcaagacuc

SEQ ID NO: 926359 - RNA, 22 nt, Human
ccuauaaucccagcacuuuggg

SEQ ID NO: 926360 - RNA, 23 nt, Human
ccuggccaacauagugaaacccc

SEQ ID NO: 926361 - RNA, 24 nt, Human
ccuggccaacauagugaaaccccg

SEQ ID NO: 926362 - RNA, 21 nt, Human
ccuggcgacagagcgagacuc

SEQ ID NO: 926363 - RNA, 21 nt, Human
ccugggagguggagguugcag

SEQ ID NO: 926364 - RNA, 24 nt, Human
ccuguaaccccagcuauuugugag

SEQ ID NO: 926365 - RNA, 19 nt, Human
ccuguagucccagcuacuc

SEQ ID NO: 926366 - RNA, 21 nt, Human
ccuguagucccagcuacucgg

SEQ ID NO: 926367 - RNA, 24 nt, Human
cgaggcagguggaucaugagguca

SEQ ID NO: 926368 - RNA, 23 nt, Human
cgccuauaaucccagcacuuugg

SEQ ID NO: 926369 - RNA, 18 nt, Human
cgggcagaucacuugagg

SEQ ID NO: 926370 - RNA, 24 nt, Human
cgggcagaucacuugaggucagga

SEQ ID NO: 926371 - RNA, 26 nt, Human
cguauauauguguguauauauaugua

SEQ ID NO: 926372 - RNA, 19 nt, Human
cuagucacuugggagugcc

SEQ ID NO: 926373 - RNA, 19 nt, Human
cuauuugugagacugaagc

SEQ ID NO: 926374 - RNA, 18 nt, Human
cucaaaaaaaaaaaaaaa

SEQ ID NO: 926375 - RNA, 23 nt, Human
cucacgccuauauaaucgcagca

SEQ ID NO: 926376 - RNA, 19 nt, Human
cuccaucucaaaaaaaaaa

SEQ ID NO: 926377 - RNA, 25 nt, Human
cucuacuaaaaggaaaaaauuuagc

SEQ ID NO: 926378 - RNA, 19 nt, Human
cucugucucaaaaaaaaaa

SEQ ID NO: 926379 - RNA, 24 nt, Human
cugcuugauccugggagguggagg

SEQ ID NO: 926380 - RNA, 18 nt, Human
cuguugggcugacagaau

SEQ ID NO: 926381 - RNA, 24 nt, Human
cuucagccuggcgacagagcgaga

SEQ ID NO: 926382 - RNA, 21 nt, Human
gaauuugaauucuuucaaaga

SEQ ID NO: 926383 - RNA, 24 nt, Human
gacagagcgagacucugucucaaa

SEQ ID NO: 926384 - RNA, 20 nt, Human
gagaucgugccuaggugaca

SEQ ID NO: 926385 - RNA, 18 nt, Human
gagcugagaucgugccua

SEQ ID NO: 926386 - RNA, 23 nt, Human
gaggcagguggaucaugagguca

SEQ ID NO: 926387 - RNA, 18 nt, Human
gagguugcagugagccaa

SEQ ID NO: 926388 - RNA, 23 nt, Human
gagguugcagugagcugagaucg

SEQ ID NO: 926389 - RNA, 18 nt, Human
gaucacuugaggucagga

SEQ ID NO: 926390 - RNA, 24 nt, Human
gaucacuugaggucaggaauucaa

SEQ ID NO: 926391 - RNA, 19 nt, Human
gcacaccuguaaccccagc

SEQ ID NO: 926392 - RNA, 23 nt, Human
gcacuucagccuggcgacagagc

SEQ ID NO: 926393 - RNA, 18 nt, Human
gcagcauuuuggaaggcc

SEQ ID NO: 926394 - RNA, 22 nt, Human
gcaggagaaucaccugaaccug

SEQ ID NO: 926395 - RNA, 24 nt, Human
gccaacauagugaaaccccgucuc

SEQ ID NO: 926396 - RNA, 24 nt, Human
gcgacagagcgagacucugucuca

SEQ ID NO: 926397 - RNA, 18 nt, Human
gcugggcgugguggcuca

SEQ ID NO: 926398 - RNA, 19 nt, Human
gcuugauccugggaggugg

SEQ ID NO: 926399 - RNA, 18 nt, Human
gcuuguuuacuagucacu

SEQ ID NO: 926400 - RNA, 20 nt, Human
ggagaacugcuugauccugg

SEQ ID NO: 926401 - RNA, 22 nt, Human
ggagguugcagugagcugagau

SEQ ID NO: 926402 - RNA, 23 nt, Human
ggagguugcagugagcugagauc

SEQ ID NO: 926403 - RNA, 24 nt, Human
ggagguugcagugagcugagaucg

SEQ ID NO: 926404 - RNA, 23 nt, Human
gggaggcugaggcaggagaauca

SEQ ID NO: 926405 - RNA, 21 nt, Human
gggcgugguggcucacgccua

SEQ ID NO: 926406 - RNA, 19 nt, Human
gguggagguugcagugagc

SEQ ID NO: 926407 - RNA, 26 nt, Human
gguggcucacgccuauauaaucgcag

SEQ ID NO: 926408 - RNA, 33 nt, Human
guauauacauacauauacacacauauauguggu

SEQ ID NO: 926409 - RNA, 25 nt, Human
guauauauacacacguauauauggu

SEQ ID NO: 926410 - RNA, 21 nt, Human
gugaaaccccgucucuacuga

SEQ ID NO: 926411 - RNA, 23 nt, Human
guguauauauauacacguauaua

SEQ ID NO: 926412 - RNA, 21 nt, Human
guguauauauauguauauaaa

SEQ ID NO: 926413 - RNA, 22 nt, Human
guguguguguguguguguguaa

SEQ ID NO: 926414 - RNA, 24 nt, Human
guuccuuagacaccucaucacagu

SEQ ID NO: 926415 - RNA, 24 nt, Human
guugcagugagcugagaucgugcc

SEQ ID NO: 926416 - RNA, 25 nt, Human
uaaaaaaauaacaaauaagacacag

SEQ ID NO: 926417 - RNA, 23 nt, Human
uaaagacuguaaaccagccuuga

SEQ ID NO: 926418 - RNA, 18 nt, Human
uaacaaaaaugguacaua

SEQ ID NO: 926419 - RNA, 20 nt, Human
uaacugugagaauggguugg

SEQ ID NO: 926420 - RNA, 20 nt, Human
uaauaugcugaaaacauggu

SEQ ID NO: 926421 - RNA, 20 nt, Human
uacacacguauauaugugug

SEQ ID NO: 926422 - RNA, 26 nt, Human
uacacacguauauauguguguauaua

SEQ ID NO: 926423 - RNA, 19 nt, Human
uacauaaauuguuuuuaca

SEQ ID NO: 926424 - RNA, 22 nt, Human
uacauacauauacacacauaua

SEQ ID NO: 926425 - RNA, 19 nt, Human
uacauauacacacauauau

SEQ ID NO: 926426 - RNA, 18 nt, Human
uacguguauauauauaca

SEQ ID NO: 926427 - RNA, 26 nt, Human
uacguguauauauauacacguauaua

SEQ ID NO: 926428 - RNA, 23 nt, Human
uacugaaaauacaaaaauuagcu

SEQ ID NO: 926429 - RNA, 18 nt, Human
uagugcacaccuguaacc

SEQ ID NO: 926430 - RNA, 24 nt, Human
uauacacacguauauaugugugua

SEQ ID NO: 926431 - RNA, 24 nt, Human
uauauacacacguauauaugugug

SEQ ID NO: 926432 - RNA, 32 nt, Human
uauauacacguauauacauacauauacacagu

SEQ ID NO: 926433 - RNA, 27 nt, Human
uauauacacguauauacauacauauag

SEQ ID NO: 926434 - RNA, 22 nt, Human
uauauacacguauauauacaca

SEQ ID NO: 926435 - RNA, 23 nt, Human
uauauacguguauauauauacac

SEQ ID NO: 926436 - RNA, 21 nt, Human
uauauauacacacguauauau

SEQ ID NO: 926437 - RNA, 19 nt, Human
uauauauacacguauauac

SEQ ID NO: 926438 - RNA, 25 nt, Human
uauauauacacguauauauacacac

SEQ ID NO: 926439 - RNA, 19 nt, Human
uauauauauacacguauau

SEQ ID NO: 926440 - RNA, 22 nt, Human
uauauauauacacguauauaua

SEQ ID NO: 926441 - RNA, 23 nt, Human
uauauauauacacguauauauac

SEQ ID NO: 926442 - RNA, 18 nt, Human
uauauauguguauauaua

SEQ ID NO: 926443 - RNA, 21 nt, Human
uauauauguguguauauauau

SEQ ID NO: 926444 - RNA, 18 nt, Human
uauauguauauaugugua

SEQ ID NO: 926445 - RNA, 19 nt, Human
uauauguauauauguguau

SEQ ID NO: 926446 - RNA, 22 nt, Human
uauauguauauauguguauaua

SEQ ID NO: 926447 - RNA, 22 nt, Human
uauauguauauauguguauaua

SEQ ID NO: 926448 - RNA, 18 nt, Human
uauauguguauauauaua

SEQ ID NO: 926449 - RNA, 24 nt, Human
uauguauauauauacacguauaua

SEQ ID NO: 926450 - RNA, 26 nt, Human
uauguauauauauacacguauauaca

SEQ ID NO: 926451 - RNA, 20 nt, Human
uauguauauauguguauaua

SEQ ID NO: 926452 - RNA, 22 nt, Human
uauguauauauguguauauaua

SEQ ID NO: 926453 - RNA, 24 nt, Human
uaugugcauauauacguguauaua

SEQ ID NO: 926454 - RNA, 18 nt, Human
uauguguauauauauauu

SEQ ID NO: 926455 - RNA, 22 nt, Human
uauguguauauauauauuuaua

SEQ ID NO: 926456 - RNA, 18 nt, Human
ucaagacuauccuggcca

SEQ ID NO: 926457 - RNA, 19 nt, Human
ucaagacuauccuggccaa

SEQ ID NO: 926458 - RNA, 23 nt, Human
ucaccugaaccugggagacagag

SEQ ID NO: 926459 - RNA, 22 nt, Human
ucacuugggagugccauuuaac

SEQ ID NO: 926460 - RNA, 18 nt, Human
ucaugaggucaggagauc

SEQ ID NO: 926461 - RNA, 24 nt, Human
ucaugaggucaggagaucaagacu

SEQ ID NO: 926462 - RNA, 19 nt, Human
uccacagaauauguagguc

SEQ ID NO: 926463 - RNA, 23 nt, Human
uccaucucaaaaaaaaaaaaaaa

SEQ ID NO: 926464 - RNA, 25 nt, Human
ucgggaggcugaggcaggagaauca

SEQ ID NO: 926465 - RNA, 18 nt, Human
ucuaguuucuuuuuuauu

SEQ ID NO: 926466 - RNA, 18 nt, Human
ucuccagcaguaggaagg

SEQ ID NO: 926467 - RNA, 21 nt, Human
ucucuacugaaaauacaaaaa

SEQ ID NO: 926468 - RNA, 19 nt, Human
ucugucucaaaaaaaaaaa

SEQ ID NO: 926469 - RNA, 25 nt, Human
ugaaaggugugugugugugugugug

SEQ ID NO: 926470 - RNA, 19 nt, Human
ugaaccggacugaauccua

SEQ ID NO: 926471 - RNA, 24 nt, Human
ugaaccugggagacagagguugca

SEQ ID NO: 926472 - RNA, 18 nt, Human
ugaaucacuuaaaguagu

SEQ ID NO: 926473 - RNA, 22 nt, Human
ugagccaagauugcgccacugc

SEQ ID NO: 926474 - RNA, 20 nt, Human
ugaggcaggagaaucaccug

SEQ ID NO: 926475 - RNA, 24 nt, Human
ugaggcaggagaaucaccugaacc

SEQ ID NO: 926476 - RNA, 25 nt, Human
ugaggcaggagaaucaccugaaccu

SEQ ID NO: 926477 - RNA, 26 nt, Human
ugcagguagggugggacagcuggcag

SEQ ID NO: 926478 - RNA, 24 nt, Human
ugccuguagucccagcuacucggg

SEQ ID NO: 926479 - RNA, 24 nt, Human
ugcuaaaaacuaaagauaacacag

SEQ ID NO: 926480 - RNA, 21 nt, Human
ugcuugauccugggaggugga

SEQ ID NO: 926481 - RNA, 24 nt, Human
uggaaggccaaggcgggcagauca

SEQ ID NO: 926482 - RNA, 23 nt, Human
uggcaaaaccaugucucuacuaa

SEQ ID NO: 926483 - RNA, 24 nt, Human
uggcacacgccuauaaucccagca

SEQ ID NO: 926484 - RNA, 26 nt, Human
uggcucacgccuauauaaucgcagca

SEQ ID NO: 926485 - RNA, 19 nt, Human
uggcuuuggccuugaauuu

SEQ ID NO: 926486 - RNA, 24 nt, Human
ugggagacagagguugcagugagc

SEQ ID NO: 926487 - RNA, 24 nt, Human
ugggaggccgaggcagguggauca

SEQ ID NO: 926488 - RNA, 18 nt, Human
ugggagguggagguugca

SEQ ID NO: 926489 - RNA, 24 nt, Human
ugggagguggagguugcagugagc

SEQ ID NO: 926490 - RNA, 21 nt, Human
ugguacauaagugaaaaagug

SEQ ID NO: 926491 - RNA, 24 nt, Human
ugguggcaggugccuguaguccca

SEQ ID NO: 926492 - RNA, 22 nt, Human
ugguguaauggcuccacagaau

SEQ ID NO: 926493 - RNA, 22 nt, Human
uguauauauauacacguauaua

SEQ ID NO: 926494 - RNA, 23 nt, Human
uguauauauauacacguauauac

SEQ ID NO: 926495 - RNA, 24 nt, Human
uguauauauauacacguauauaua

SEQ ID NO: 926496 - RNA, 18 nt, Human
uguauauauauguauaua

SEQ ID NO: 926497 - RNA, 20 nt, Human
uguauauauauguauauauu

SEQ ID NO: 926498 - RNA, 18 nt, Human
uguauauauguguauaua

SEQ ID NO: 926499 - RNA, 22 nt, Human
uguauauauguguauauauaua

SEQ ID NO: 926500 - RNA, 22 nt, Human
uguauguauauauauacacgua

SEQ ID NO: 926501 - RNA, 22 nt, Human
ugugagaauggguuggugucua

SEQ ID NO: 926502 - RNA, 22 nt, Human
ugugcauauauacguguauaua

SEQ ID NO: 926503 - RNA, 24 nt, Human
uguguauauauauauuuauauuug

SEQ ID NO: 926504 - RNA, 20 nt, Human
uguguauauauauguauaua

SEQ ID NO: 926505 - RNA, 20 nt, Human
uguguauauauauguauaua

SEQ ID NO: 926506 - RNA, 23 nt, Human
uguguauauauauguauauaugu

SEQ ID NO: 926507 - RNA, 18 nt, Human
uguguauguauauauaua

SEQ ID NO: 926508 - RNA, 20 nt, Human
uguguauguauauauauaca

SEQ ID NO: 926509 - RNA, 21 nt, Human
uguguauguauauauauacac

SEQ ID NO: 926510 - RNA, 22 nt, Human
uguguauguauauauauacacg

SEQ ID NO: 926511 - RNA, 22 nt, Human
uguguguauauauauguauaua

SEQ ID NO: 926512 - RNA, 18 nt, Human
uguguguauguauauaua

SEQ ID NO: 926513 - RNA, 20 nt, Human
uguguguguguauguauaua

SEQ ID NO: 926514 - RNA, 19 nt, Human
uguguguguguguauguau

SEQ ID NO: 926515 - RNA, 24 nt, Human
uguguguguguguguauguauaua

SEQ ID NO: 926516 - RNA, 21 nt, Human
uguguguguguguguguaugu

SEQ ID NO: 926517 - RNA, 22 nt, Human
uguguguguguguguguaugua

SEQ ID NO: 926518 - RNA, 18 nt, Human
ugugugugugugugugug

SEQ ID NO: 926519 - RNA, 24 nt, Human
uuagcugggcgugguggcaggugc

SEQ ID NO: 926520 - RNA, 19 nt, Human
uuaucagagaaacuuucaa

SEQ ID NO: 926521 - RNA, 19 nt, Human
uugaaaaguggauggcuaa

SEQ ID NO: 926522 - RNA, 24 nt, Human
uugauccugggagguggagguugc

SEQ ID NO: 926523 - RNA, 19 nt, Human
uugcagguagggugggaca

SEQ ID NO: 926524 - RNA, 22 nt, Human
uugcagugagccaagauugcgc

SEQ ID NO: 926525 - RNA, 21 nt, Human
uugcagugagcugagaucgug

SEQ ID NO: 926526 - RNA, 22 nt, Human
uugcagugagcugagaucgugc

SEQ ID NO: 926527 - RNA, 24 nt, Human
uugcagugagcugagaucgugccu

SEQ ID NO: 926528 - RNA, 25 nt, Human
uugggaggccgaggcagguggauca

SEQ ID NO: 926529 - RNA, 28 nt, Human
uuuaacaaaaaugguacauaagugaaaa

SEQ ID NO: 926530 - RNA, 18 nt, Human
uuuuuuuuuuuuuuuuug

SEQ ID NO: 926531 - RNA, 18 nt, Human
uuuuuuuuuuuuuuuuug

SEQ ID NO: 926532 - RNA, 18 nt, Human
aaaaucacuuagggugcu

SEQ ID NO: 926533 - RNA, 19 nt, Human
aaccauguggcauauaccc

SEQ ID NO: 926534 - RNA, 22 nt, Human
aaccauguggcauauaccccca

SEQ ID NO: 926535 - RNA, 19 nt, Human
aauuuauaaaaaguucccc

SEQ ID NO: 926536 - RNA, 19 nt, Human
acaguggagaaugcaccuc

SEQ ID NO: 926537 - RNA, 26 nt, Human
acccagugaagucuuugcaguggccc

SEQ ID NO: 926538 - RNA, 18 nt, Human
aggcaguguuuccuaagc

SEQ ID NO: 926539 - RNA, 20 nt, Human
aggggagugcaacaggggcc

SEQ ID NO: 926540 - RNA, 24 nt, Human
aggggccccuggaguuggaucugc

SEQ ID NO: 926541 - RNA, 21 nt, Human
agugaagggcuuugagaaaaa

SEQ ID NO: 926542 - RNA, 23 nt, Human
aguucuucaggauguuaauagaa

SEQ ID NO: 926543 - RNA, 24 nt, Human
auaaaucugccucauuuuauucug

SEQ ID NO: 926544 - RNA, 21 nt, Human
aucuguagauucuucuucccc

SEQ ID NO: 926545 - RNA, 21 nt, Human
caagagcaccuguggccuugc

SEQ ID NO: 926546 - RNA, 20 nt, Human
cagauuaauuucucaguggu

SEQ ID NO: 926547 - RNA, 24 nt, Human
caugagaauaaggagaugaaacca

SEQ ID NO: 926548 - RNA, 20 nt, Human
ccaggcaguguuuccuaagc

SEQ ID NO: 926549 - RNA, 20 nt, Human
cccagacuagggccuuggag

SEQ ID NO: 926550 - RNA, 21 nt, Human
ccucuaaaauccagucuauag

SEQ ID NO: 926551 - RNA, 26 nt, Human
ccugguacccccuuucagagaugcua

SEQ ID NO: 926552 - RNA, 20 nt, Human
cugaaggcuggaaaaagacc

SEQ ID NO: 926553 - RNA, 18 nt, Human
cuggccaggcagcaaccu

SEQ ID NO: 926554 - RNA, 19 nt, Human
cuggcccucaaagccuaag

SEQ ID NO: 926555 - RNA, 22 nt, Human
cuuccugguacccccuuucaga

SEQ ID NO: 926556 - RNA, 19 nt, Human
cuuuguuccucuaaaaucc

SEQ ID NO: 926557 - RNA, 27 nt, Human
gaagggcuuugagaaaaagcauuuuga

SEQ ID NO: 926558 - RNA, 19 nt, Human
gagaaugcaccuccccaag

SEQ ID NO: 926559 - RNA, 20 nt, Human
gagccagugaagggcuuuga

SEQ ID NO: 926560 - RNA, 21 nt, Human
gagugcacuagaacugaaggc

SEQ ID NO: 926561 - RNA, 23 nt, Human
gaguugcagaguggcuacagagg

SEQ ID NO: 926562 - RNA, 20 nt, Human
gaugagaaaacaauuaagaa

SEQ ID NO: 926563 - RNA, 23 nt, Human
gcaaccucauucucacccugucu

SEQ ID NO: 926564 - RNA, 22 nt, Human
ggaccuuuguaaagcuaaccug

SEQ ID NO: 926565 - RNA, 18 nt, Human
ggauucugaugagggaag

SEQ ID NO: 926566 - RNA, 22 nt, Human
gggcuuugagaaaaagcauuuu

SEQ ID NO: 926567 - RNA, 18 nt, Human
ggggagccagugaagggc

SEQ ID NO: 926568 - RNA, 21 nt, Human
ggugauaagugugacgaguac

SEQ ID NO: 926569 - RNA, 23 nt, Human
gugcaacaggggccccuggaguu

SEQ ID NO: 926570 - RNA, 23 nt, Human
guggagaaugcaccuccccaagg

SEQ ID NO: 926571 - RNA, 20 nt, Human
guuccucuaaaauccagucu

SEQ ID NO: 926572 - RNA, 19 nt, Human
uaaaugaagaguuuggacc

SEQ ID NO: 926573 - RNA, 20 nt, Human
uacccccauucccucuauga

SEQ ID NO: 926574 - RNA, 19 nt, Human
uaccuggacucagauggga

SEQ ID NO: 926575 - RNA, 19 nt, Human
uaccuggacucagauggga

SEQ ID NO: 926576 - RNA, 21 nt, Human
uaccuggacucagaugggacc

SEQ ID NO: 926577 - RNA, 21 nt, Human
uaccuggacucagaugggacc

SEQ ID NO: 926578 - RNA, 21 nt, Human
ucagugaaucuccaaggggga

SEQ ID NO: 926579 - RNA, 19 nt, Human
ucaguggaacuggaaucug

SEQ ID NO: 926580 - RNA, 18 nt, Human
uccacagaacauuaguuc

SEQ ID NO: 926581 - RNA, 22 nt, Human
uccacagaacauuaguucuuca

SEQ ID NO: 926582 - RNA, 23 nt, Human
uccauacucuaagccaaagcgag

SEQ ID NO: 926583 - RNA, 19 nt, Human
ugaauggaugagaaaacaa

SEQ ID NO: 926584 - RNA, 21 nt, Human
ugagaaaacaauuaagaagcc

SEQ ID NO: 926585 - RNA, 20 nt, Human
ugcaggguggaucagagugc

SEQ ID NO: 926586 - RNA, 22 nt, Human
ugcccagacuagggccuuggag

SEQ ID NO: 926587 - RNA, 24 nt, Human
ugcccagacuagggccuuggagac

SEQ ID NO: 926588 - RNA, 18 nt, Human
ugccuaaacuauuauaau

SEQ ID NO: 926589 - RNA, 19 nt, Human
uggaaaaagacccagugaa

SEQ ID NO: 926590 - RNA, 22 nt, Human
uggaaaaagacccagugaaguc

SEQ ID NO: 926591 - RNA, 21 nt, Human
uggaaucugagacauacuguu

SEQ ID NO: 926592 - RNA, 22 nt, Human
uguccaagagguuuuaaaggag

SEQ ID NO: 926593 - RNA, 18 nt, Human
uguguaauguucugugug

SEQ ID NO: 926594 - RNA, 25 nt, Human
ugugugcucagugaaucuccaaggg

SEQ ID NO: 926595 - RNA, 20 nt, Human
uguucugugugcucagugaa

SEQ ID NO: 926596 - RNA, 23 nt, Human
uuaagugggauuugacuuuuuuu

SEQ ID NO: 926597 - RNA, 28 nt, Human
uuaccagauuaauuucucaguggugugc

SEQ ID NO: 926598 - RNA, 18 nt, Human
uugcccagacuagggccu

SEQ ID NO: 926599 - RNA, 19 nt, Human
uuuaccagauuaauuucuc

SEQ ID NO: 926600 - RNA, 18 nt, Human
uuucucaucucuuaaaug

SEQ ID NO: 926601 - RNA, 18 nt, Human
uuuuugguugcaaauuug

SEQ ID NO: 926602 - RNA, 23 nt, Human
uuuuuuuuuuuuuuuuaaguggg

SEQ ID NO: 926603 - RNA, 20 nt, Human
aaaaugccaugaaguuacag

SEQ ID NO: 926604 - RNA, 24 nt, Human
aaagugaugggguuacaggcguga

SEQ ID NO: 926605 - RNA, 23 nt, Human
aaaugccaugaaguuacagggau

SEQ ID NO: 926606 - RNA, 24 nt, Human
aagcaauccaccuacucuggccuc

SEQ ID NO: 926607 - RNA, 18 nt, Human
aauccaccuacucuggcc

SEQ ID NO: 926608 - RNA, 21 nt, Human
acaaaaaugccaugaaguuac

SEQ ID NO: 926609 - RNA, 19 nt, Human
acuacaggcgcaugccacc

SEQ ID NO: 926610 - RNA, 22 nt, Human
acugcaaccuccacuucccagg

SEQ ID NO: 926611 - RNA, 22 nt, Human
agaaagaacccaaauguccacc

SEQ ID NO: 926612 - RNA, 21 nt, Human
agaggauggcuggagccugag

SEQ ID NO: 926613 - RNA, 18 nt, Human
agcacagauacauguagg

SEQ ID NO: 926614 - RNA, 26 nt, Human
agccaaaagguagaaagaagggaccc

SEQ ID NO: 926615 - RNA, 24 nt, Human
aggcacaguggcacacgccuguag

SEQ ID NO: 926616 - RNA, 24 nt, Human
aggcucaggugauccauccaccuc

SEQ ID NO: 926617 - RNA, 19 nt, Human
aggcugaggugagaggaug

SEQ ID NO: 926618 - RNA, 22 nt, Human
aggguuuugccaugcuguccag

SEQ ID NO: 926619 - RNA, 23 nt, Human
aggguuuugccaugcuguccagg

SEQ ID NO: 926620 - RNA, 18 nt, Human
agguagaaagaacccaaa

SEQ ID NO: 926621 - RNA, 24 nt, Human
aggugauccauccaccucagccuc

SEQ ID NO: 926622 - RNA, 18 nt, Human
agugcaguggcaugacuu

SEQ ID NO: 926623 - RNA, 24 nt, Human
aguggcacacgccuguaguccuag

SEQ ID NO: 926624 - RNA, 21 nt, Human
auacauguagggguauaugca

SEQ ID NO: 926625 - RNA, 19 nt, Human
auaggguuuugccaugcug

SEQ ID NO: 926626 - RNA, 24 nt, Human
aucgcaauugaaaaaguuuugauc

SEQ ID NO: 926627 - RNA, 19 nt, Human
cacaauagccaaaagguag

SEQ ID NO: 926628 - RNA, 24 nt, Human
cacagauacauguagggguauaug

SEQ ID NO: 926629 - RNA, 23 nt, Human
caccuacucuggccucccaaagu

SEQ ID NO: 926630 - RNA, 24 nt, Human
caccucagccucccaaguagaugg

SEQ ID NO: 926631 - RNA, 23 nt, Human
cacgccuguaguccuagcuacuu

SEQ ID NO: 926632 - RNA, 19 nt, Human
cacugauauauccauucag

SEQ ID NO: 926633 - RNA, 22 nt, Human
cacugcacccagccuaaauuca

SEQ ID NO: 926634 - RNA, 23 nt, Human
cagccuacugcaaccuccacuuc

SEQ ID NO: 926635 - RNA, 24 nt, Human
caguucugcucuuaacugauuuca

SEQ ID NO: 926636 - RNA, 24 nt, Human
caugccaccacaccuggcuaauuu

SEQ ID NO: 926637 - RNA, 24 nt, Human
caugcuguccaggcuagucucgaa

SEQ ID NO: 926638 - RNA, 22 nt, Human
ccaaagugaugggguuacaggc

SEQ ID NO: 926639 - RNA, 24 nt, Human
ccaaagugaugggguuacaggcgu

SEQ ID NO: 926640 - RNA, 23 nt, Human
ccacagaguaugaauuccaguuc

SEQ ID NO: 926641 - RNA, 19 nt, Human
ccacugcacccagccuaaa

SEQ ID NO: 926642 - RNA, 20 nt, Human
ccacugcacccagccuaaau

SEQ ID NO: 926643 - RNA, 21 nt, Human
ccagaacagguaaauccauag

SEQ ID NO: 926644 - RNA, 23 nt, Human
ccaggcucaggugauccauccac

SEQ ID NO: 926645 - RNA, 18 nt, Human
cccaaauguccaccaacu

SEQ ID NO: 926646 - RNA, 23 nt, Human
cccaaguagaugggacuacaggc

SEQ ID NO: 926647 - RNA, 18 nt, Human
cccaggcucaggugaucc

SEQ ID NO: 926648 - RNA, 20 nt, Human
ccuggguugaagcaauccac

SEQ ID NO: 926649 - RNA, 22 nt, Human
ccuguaguccuagcuacuuggg

SEQ ID NO: 926650 - RNA, 26 nt, Human
cgacacugugaaugcacuaaauacca

SEQ ID NO: 926651 - RNA, 24 nt, Human
cgccuguaguccuagcuacuuggg

SEQ ID NO: 926652 - RNA, 22 nt, Human
cuaaaguuuucuuugcagaaaa

SEQ ID NO: 926653 - RNA, 24 nt, Human
cuacugcaaccuccacuucccagg

SEQ ID NO: 926654 - RNA, 24 nt, Human
cugcaaccuccacuucccaggcuc

SEQ ID NO: 926655 - RNA, 20 nt, Human
cugcacccagccuaaauuca

SEQ ID NO: 926656 - RNA, 23 nt, Human
gaaugccuggguugaagcaaucc

SEQ ID NO: 926657 - RNA, 21 nt, Human
gagcagcuacugugugccaga

SEQ ID NO: 926658 - RNA, 24 nt, Human
gcaaaguauuauucagucauaaag

SEQ ID NO: 926659 - RNA, 19 nt, Human
gcaguggcaugacuucagc

SEQ ID NO: 926660 - RNA, 22 nt, Human
ggaggagggggaugggagaggg

SEQ ID NO: 926661 - RNA, 20 nt, Human
ggaggcugaggugagaggau

SEQ ID NO: 926662 - RNA, 21 nt, Human
ggguuuugccaugcuguccag

SEQ ID NO: 926663 - RNA, 22 nt, Human
ggguuuugccaugcuguccagg

SEQ ID NO: 926664 - RNA, 18 nt, Human
gguuacaggcgugagcca

SEQ ID NO: 926665 - RNA, 22 nt, Human
gguuacaggcgugagccacugc

SEQ ID NO: 926666 - RNA, 21 nt, Human
guagagauaggguuuugccau

SEQ ID NO: 926667 - RNA, 22 nt, Human
guagagauaggguuuugccaug

SEQ ID NO: 926668 - RNA, 19 nt, Human
gucacaauagccaaaaggu

SEQ ID NO: 926669 - RNA, 22 nt, Human
guccaggcuagucucgaaugcc

SEQ ID NO: 926670 - RNA, 20 nt, Human
gucuuggaacuagauacagg

SEQ ID NO: 926671 - RNA, 24 nt, Human
gugauccauccaccucagccuccc

SEQ ID NO: 926672 - RNA, 25 nt, Human
uaaauccauagagacaaaaagcaaa

SEQ ID NO: 926673 - RNA, 23 nt, Human
uaauuuuuuauuuuuuguagaga

SEQ ID NO: 926674 - RNA, 22 nt, Human
uacacaauauaagggagggcag

SEQ ID NO: 926675 - RNA, 20 nt, Human
uacagacauuuaaaauuaua

SEQ ID NO: 926676 - RNA, 22 nt, Human
uacaggcgcaugccaccacacc

SEQ ID NO: 926677 - RNA, 19 nt, Human
uacaggcgugagccacugc

SEQ ID NO: 926678 - RNA, 24 nt, Human
uacaggcgugagccacugcaccca

SEQ ID NO: 926679 - RNA, 21 nt, Human
uagaaagaacccaaaugucca

SEQ ID NO: 926680 - RNA, 20 nt, Human
uagagauaggguuuugccau

SEQ ID NO: 926681 - RNA, 24 nt, Human
uaggguuuugccaugcuguccagg

SEQ ID NO: 926682 - RNA, 19 nt, Human
uauaacauggaugcuuagu

SEQ ID NO: 926683 - RNA, 28 nt, Human
uauccagaacagguaaauccauagaggg

SEQ ID NO: 926684 - RNA, 23 nt, Human
ucaacaauuuucuaaaguuuucu

SEQ ID NO: 926685 - RNA, 18 nt, Human
ucagaagaaacggaaaca

SEQ ID NO: 926686 - RNA, 25 nt, Human
ucagccuacugcaaccuccacuucc

SEQ ID NO: 926687 - RNA, 24 nt, Human
uccaccaacugaugaaaggacaaa

SEQ ID NO: 926688 - RNA, 20 nt, Human
uccagaacagguaaauccau

SEQ ID NO: 926689 - RNA, 24 nt, Human
uccagaacagguaaauccauagag

SEQ ID NO: 926690 - RNA, 21 nt, Human
uccauccaccucagccuccca

SEQ ID NO: 926691 - RNA, 22 nt, Human
uccauuauaaacucuuagggau

SEQ ID NO: 926692 - RNA, 24 nt, Human
ucccaaagugaugggguuacaggc

SEQ ID NO: 926693 - RNA, 24 nt, Human
ucccaaguagaugggacuacaggc

SEQ ID NO: 926694 - RNA, 20 nt, Human
ucccacucaguauacguaac

SEQ ID NO: 926695 - RNA, 18 nt, Human
ucccaggcucaggugauc

SEQ ID NO: 926696 - RNA, 19 nt, Human
uccgccagguuugagugca

SEQ ID NO: 926697 - RNA, 24 nt, Human
ucuacagcaaaugagaccgggguc

SEQ ID NO: 926698 - RNA, 25 nt, Human
ucucacucuguccgccagguuugag

SEQ ID NO: 926699 - RNA, 23 nt, Human
ucuccuuuuggggagaugaaaau

SEQ ID NO: 926700 - RNA, 19 nt, Human
ucuuggaacuagauacagg

SEQ ID NO: 926701 - RNA, 19 nt, Human
ugaaaggacaaauaaaaca

SEQ ID NO: 926702 - RNA, 19 nt, Human
ugaaugcacuaaauaccac

SEQ ID NO: 926703 - RNA, 22 nt, Human
ugagauagggucucacucuguc

SEQ ID NO: 926704 - RNA, 21 nt, Human
ugagcagcuacugugugccaa

SEQ ID NO: 926705 - RNA, 18 nt, Human
ugaggugagaggauggcu

SEQ ID NO: 926706 - RNA, 24 nt, Human
ugauccauccaccucagccuccca

SEQ ID NO: 926707 - RNA, 25 nt, Human
ugcaaccuccacuucccaggcucaa

SEQ ID NO: 926708 - RNA, 24 nt, Human
ugccaugaaguuacagggauguau

SEQ ID NO: 926709 - RNA, 24 nt, Human
ugccaugcuguccaggcuagucuc

SEQ ID NO: 926710 - RNA, 21 nt, Human
uggcacacgccuguaguccua

SEQ ID NO: 926711 - RNA, 19 nt, Human
uggcuggagccugagaagu

SEQ ID NO: 926712 - RNA, 21 nt, Human
ugggacuacaggcgcaugcca

SEQ ID NO: 926713 - RNA, 22 nt, Human
ugggacuacaggcgcaugccac

SEQ ID NO: 926714 - RNA, 24 nt, Human
ugggacuacaggcgcaugccacca

SEQ ID NO: 926715 - RNA, 19 nt, Human
ugggaggcugaggugagag

SEQ ID NO: 926716 - RNA, 18 nt, Human
ugggguuacaggcgugag

SEQ ID NO: 926717 - RNA, 19 nt, Human
ugggguuacaggcgugagc

SEQ ID NO: 926718 - RNA, 22 nt, Human
ugggguuacaggcgugagccac

SEQ ID NO: 926719 - RNA, 22 nt, Human
ugggguuacaggcgugagccac

SEQ ID NO: 926720 - RNA, 24 nt, Human
ugggguuacaggcgugagccacug

SEQ ID NO: 926721 - RNA, 18 nt, Human
uggguugaagcaauccac

SEQ ID NO: 926722 - RNA, 22 nt, Human
uguagagauaggguuuugccau

SEQ ID NO: 926723 - RNA, 21 nt, Human
ugugaaugcacuaaauaccac

SEQ ID NO: 926724 - RNA, 24 nt, Human
uguuaugugaguuuuaucgcaauu

SEQ ID NO: 926725 - RNA, 21 nt, Human
uguuuucuguuauuacauccc

SEQ ID NO: 926726 - RNA, 21 nt, Human
uuacaggcgugagccacugca

SEQ ID NO: 926727 - RNA, 24 nt, Human
uuaggccaggcacaguggcacacg

SEQ ID NO: 926728 - RNA, 22 nt, Human
uuccacauugcugauucauucc

SEQ ID NO: 926729 - RNA, 19 nt, Human
uugagugcaguggcaugac

SEQ ID NO: 926730 - RNA, 18 nt, Human
uugggaggcugaggugag

SEQ ID NO: 926731 - RNA, 19 nt, Human
uugggaggcugaggugaga

SEQ ID NO: 926732 - RNA, 24 nt, Human
uuguagagauaggguuuugccaug

SEQ ID NO: 926733 - RNA, 21 nt, Human
uuugcaacaccacuagucaca

SEQ ID NO: 926734 - RNA, 20 nt, Human
uuuguagagauaggguuuug

SEQ ID NO: 926735 - RNA, 23 nt, Human
uuuguagagauaggguuuugcca

SEQ ID NO: 926736 - RNA, 24 nt, Human
uuuguagagauaggguuuugccau

SEQ ID NO: 926737 - RNA, 24 nt, Human
uuuuuuguagagauaggguuuugc

SEQ ID NO: 926738 - RNA, 23 nt, Human
uuuuuuuuuugagauagggucuc

SEQ ID NO: 926739 - RNA, 23 nt, Human
uuuuuuuuuuuugagauaggguc

SEQ ID NO: 926740 - RNA, 26 nt, Human
uuuuuuuuuuuugagauagggucuca

SEQ ID NO: 926741 - RNA, 30 nt, Human
uuuuuuuuuuuuuuuuuuuugagauagggg

SEQ ID NO: 926742 - RNA, 22 nt, Human
aaaaaaaaaaaggauaaacaga

SEQ ID NO: 926743 - RNA, 23 nt, Human
aaaaggucugccuuuuguaaaaa

SEQ ID NO: 926744 - RNA, 21 nt, Human
aaauaaccuuauauaagaaua

SEQ ID NO: 926745 - RNA, 25 nt, Human
acacagcuuaaaaaagggggaacgc

SEQ ID NO: 926746 - RNA, 23 nt, Human
acagcuacagcagcucuaaauac

SEQ ID NO: 926747 - RNA, 23 nt, Human
acccagugagucaacauaggcuc

SEQ ID NO: 926748 - RNA, 19 nt, Human
agcuacagaccagguagag

SEQ ID NO: 926749 - RNA, 20 nt, Human
agcuacagcagcucuaaaua

SEQ ID NO: 926750 - RNA, 21 nt, Human
aggucugccuuuuguaaaaag

SEQ ID NO: 926751 - RNA, 19 nt, Human
caacaacguggccccgaac

SEQ ID NO: 926752 - RNA, 21 nt, Human
caccugaaagacguacuaguc

SEQ ID NO: 926753 - RNA, 21 nt, Human
caguuacagcuacagaccagg

SEQ ID NO: 926754 - RNA, 18 nt, Human
caugucaaguuugaaaau

SEQ ID NO: 926755 - RNA, 20 nt, Human
ccacccagugagucaacaua

SEQ ID NO: 926756 - RNA, 24 nt, Human
ccaccugaaagacguacuagucau

SEQ ID NO: 926757 - RNA, 20 nt, Human
ccagaaaaaaaguuguaaaa

SEQ ID NO: 926758 - RNA, 28 nt, Human
ccagcaaauaaccuuauauuguaaugac

SEQ ID NO: 926759 - RNA, 23 nt, Human
cuaguaucauugcauuuguuuuc

SEQ ID NO: 926760 - RNA, 23 nt, Human
cugaaagacguacuagucauuua

SEQ ID NO: 926761 - RNA, 20 nt, Human
cugaacuagaggccaacaau

SEQ ID NO: 926762 - RNA, 27 nt, Human
gaaaauaacuggggaaaaguguaugac

SEQ ID NO: 926763 - RNA, 25 nt, Human
ggccaacaauagccagcaaauaacc

SEQ ID NO: 926764 - RNA, 20 nt, Human
ggcuauguggguuacacagc

SEQ ID NO: 926765 - RNA, 18 nt, Human
ggggaaaaguguaugacg

SEQ ID NO: 926766 - RNA, 18 nt, Human
ggguuacacagcuuaaaa

SEQ ID NO: 926767 - RNA, 24 nt, Human
uaaauaacacagacugaacuagag

SEQ ID NO: 926768 - RNA, 25 nt, Human
uaacacagacugaacuagaggccaa

SEQ ID NO: 926769 - RNA, 23 nt, Human
uaagaagggacccccacccagug

SEQ ID NO: 926770 - RNA, 20 nt, Human
uacaacaacguggccccgaa

SEQ ID NO: 926771 - RNA, 22 nt, Human
ucaggcacuugccacgugugcu

SEQ ID NO: 926772 - RNA, 20 nt, Human
ugccaggugguuaggcuaug

SEQ ID NO: 926773 - RNA, 19 nt, Human
ugguaacuacaccuaaagc

SEQ ID NO: 926774 - RNA, 21 nt, Human
uuaaaaaaggucugccuuuug

SEQ ID NO: 926775 - RNA, 23 nt, Human
uuaggcuauguggguuacacagc

SEQ ID NO: 926776 - RNA, 20 nt, Human
uucguagucauucugccagg

SEQ ID NO: 926777 - RNA, 23 nt, Human
aaacuucugggcacaagcgaucc

SEQ ID NO: 926778 - RNA, 24 nt, Human
aaagugcugggauuacaggcauga

SEQ ID NO: 926779 - RNA, 24 nt, Human
aaagugcugggauuacagguguga

SEQ ID NO: 926780 - RNA, 18 nt, Human
aaauguauaagcuugaaa

SEQ ID NO: 926781 - RNA, 18 nt, Human
aacauggagauaaguuga

SEQ ID NO: 926782 - RNA, 20 nt, Human
aaccuccgccucccugguuc

SEQ ID NO: 926783 - RNA, 23 nt, Human
aagguaucauuuccaaauuugug

SEQ ID NO: 926784 - RNA, 18 nt, Human
aagugcugggauuacagg

SEQ ID NO: 926785 - RNA, 19 nt, Human
aagugcugggauuacaggc

SEQ ID NO: 926786 - RNA, 21 nt, Human
aagugcugggauuacaggcau

SEQ ID NO: 926787 - RNA, 26 nt, Human
aagugcugggauuacaggcaugagcc

SEQ ID NO: 926788 - RNA, 19 nt, Human
aagugcugggauuacaggu

SEQ ID NO: 926789 - RNA, 26 nt, Human
aagugcugggauuacaggugugagcc

SEQ ID NO: 926790 - RNA, 19 nt, Human
aauaaaucauaaagaauug

SEQ ID NO: 926791 - RNA, 24 nt, Human
aaugguaugaucucggcucauugc

SEQ ID NO: 926792 - RNA, 25 nt, Human
aauuguuuaaaaucuuuuuuuuuuu

SEQ ID NO: 926793 - RNA, 24 nt, Human
acaggguuaauccauguuggucag

SEQ ID NO: 926794 - RNA, 23 nt, Human
acccaguuaauuuuguauuuuua

SEQ ID NO: 926795 - RNA, 19 nt, Human
acgggguuucaccaugcua

SEQ ID NO: 926796 - RNA, 20 nt, Human
acgggguuucaccaugcuag

SEQ ID NO: 926797 - RNA, 26 nt, Human
acgggguuucaccaugcuagccagga

SEQ ID NO: 926798 - RNA, 25 nt, Human
acucuguuguccaggcuggagugca

SEQ ID NO: 926799 - RNA, 18 nt, Human
acugcaagcuaugccucc

SEQ ID NO: 926800 - RNA, 19 nt, Human
acugcagccucaaacuucu

SEQ ID NO: 926801 - RNA, 18 nt, Human
agaaaauucuccucacca

SEQ ID NO: 926802 - RNA, 24 nt, Human
agcaauucuugugccucagccucc

SEQ ID NO: 926803 - RNA, 18 nt, Human
agccaccacaccuggccc

SEQ ID NO: 926804 - RNA, 20 nt, Human
agccaccacaccuggcccua

SEQ ID NO: 926805 - RNA, 23 nt, Human
aggcaugagccacugugccuggc

SEQ ID NO: 926806 - RNA, 25 nt, Human
aggcuggagugcaguggcgcaaucu

SEQ ID NO: 926807 - RNA, 25 nt, Human
aggcuggagugcaguggcgugaucu

SEQ ID NO: 926808 - RNA, 21 nt, Human
aggcugggauuacagguguga

SEQ ID NO: 926809 - RNA, 23 nt, Human
aggcugggauuacaggugugagc

SEQ ID NO: 926810 - RNA, 24 nt, Human
aguacaauggcgugaucuuggcuu

SEQ ID NO: 926811 - RNA, 18 nt, Human
aguaccugggauuacagg

SEQ ID NO: 926812 - RNA, 18 nt, Human
aguagcugggauuacagg

SEQ ID NO: 926813 - RNA, 24 nt, Human
agugcaaugguaugaucucggcuc

SEQ ID NO: 926814 - RNA, 20 nt, Human
agugcaguggcgcaaucucg

SEQ ID NO: 926815 - RNA, 24 nt, Human
agugcaguggcgcaaucucggcuc

SEQ ID NO: 926816 - RNA, 23 nt, Human
agugcaguggcgugaucuuggcu

SEQ ID NO: 926817 - RNA, 24 nt, Human
agugcaguggcgugaucuuggcuc

SEQ ID NO: 926818 - RNA, 18 nt, Human
agugcugggauuacaggc

SEQ ID NO: 926819 - RNA, 26 nt, Human
aguuaauuuuguauuuuuaguagaga

SEQ ID NO: 926820 - RNA, 24 nt, Human
aguuuaaaaaucaaauuaaaugua

SEQ ID NO: 926821 - RNA, 24 nt, Human
aucugcucaccuccgccucccaaa

SEQ ID NO: 926822 - RNA, 24 nt, Human
augaucugcccgccucggccuccc

SEQ ID NO: 926823 - RNA, 24 nt, Human
auuccaggcugggauuacaggugu

SEQ ID NO: 926824 - RNA, 24 nt, Human
auugcaccacugcauuccaggcug

SEQ ID NO: 926825 - RNA, 24 nt, Human
caaagugcugggauuacaggcaug

SEQ ID NO: 926826 - RNA, 24 nt, Human
caaagugcugggauuacaggugug

SEQ ID NO: 926827 - RNA, 20 nt, Human
caaccuccgcuuccugggcu

SEQ ID NO: 926828 - RNA, 23 nt, Human
caaccuccgcuuccugggcucaa

SEQ ID NO: 926829 - RNA, 28 nt, Human
caagcaauucuugugccucagccuccug

SEQ ID NO: 926830 - RNA, 20 nt, Human
caagcgauccuccugcccca

SEQ ID NO: 926831 - RNA, 22 nt, Human
caagcgauucuccugcuucagc

SEQ ID NO: 926832 - RNA, 22 nt, Human
cacaucauucuccugccucagc

SEQ ID NO: 926833 - RNA, 24 nt, Human
caccacacccagcuaauuuuugua

SEQ ID NO: 926834 - RNA, 22 nt, Human
caccaugcuagccaggaugguc

SEQ ID NO: 926835 - RNA, 24 nt, Human
caccaugcuagccaggauggucuc

SEQ ID NO: 926836 - RNA, 24 nt, Human
caccuccgccucccaaagugcugg

SEQ ID NO: 926837 - RNA, 24 nt, Human
cacucuguuguccaggcuggagug

SEQ ID NO: 926838 - RNA, 23 nt, Human
cacugcaagcuaugccucccggg

SEQ ID NO: 926839 - RNA, 18 nt, Human
cacugcauuccaggcugg

SEQ ID NO: 926840 - RNA, 19 nt, Human
cacugcauuccaggcuggg

SEQ ID NO: 926841 - RNA, 21 nt, Human
cacugcauuccaggcugggau

SEQ ID NO: 926842 - RNA, 20 nt, Human
cagccucccgaguaccuggg

SEQ ID NO: 926843 - RNA, 20 nt, Human
cagccuccugaguagcuggg

SEQ ID NO: 926844 - RNA, 21 nt, Human
caggaguuugaaguugcugug

SEQ ID NO: 926845 - RNA, 21 nt, Human
caggcgcccgccacuacgccc

SEQ ID NO: 926846 - RNA, 24 nt, Human
caggguuaauccauguuggucagg

SEQ ID NO: 926847 - RNA, 30 nt, Human
caguuaauuuuguauuuuuaguagagacaa

SEQ ID NO: 926848 - RNA, 24 nt, Human
cauguuggucaggcuggucuugaa

SEQ ID NO: 926849 - RNA, 24 nt, Human
cauuccaggcugggauuacaggug

SEQ ID NO: 926850 - RNA, 21 nt, Human
ccaaagugcugggauuacagg

SEQ ID NO: 926851 - RNA, 21 nt, Human
ccaaagugcugggauuacagg

SEQ ID NO: 926852 - RNA, 23 nt, Human
ccaaagugcugggauuacaggca

SEQ ID NO: 926853 - RNA, 24 nt, Human
ccaaagugcugggauuacaggcau

SEQ ID NO: 926854 - RNA, 24 nt, Human
ccaaagugcugggauuacaggugu

SEQ ID NO: 926855 - RNA, 19 nt, Human
ccaccacaccuggcccuaa

SEQ ID NO: 926856 - RNA, 20 nt, Human
ccacugcauuccaggcuggg

SEQ ID NO: 926857 - RNA, 20 nt, Human
ccacugcauuccaggcuggg

SEQ ID NO: 926858 - RNA, 22 nt, Human
ccacugcauuccaggcugggau

SEQ ID NO: 926859 - RNA, 18 nt, Human
ccaggcuggagugcagug

SEQ ID NO: 926860 - RNA, 21 nt, Human
ccaggcuggagugcaguggcg

SEQ ID NO: 926861 - RNA, 18 nt, Human
ccaggcugggauuacagg

SEQ ID NO: 926862 - RNA, 18 nt, Human
ccaggcugggauuacagg

SEQ ID NO: 926863 - RNA, 21 nt, Human
ccaggcugggauuacaggugu

SEQ ID NO: 926864 - RNA, 19 nt, Human
ccauguuggucaggcuggu

SEQ ID NO: 926865 - RNA, 21 nt, Human
ccauguuggucaggcuggucu

SEQ ID NO: 926866 - RNA, 21 nt, Human
ccauguuggucaggcuggucu

SEQ ID NO: 926867 - RNA, 24 nt, Human
cccaaagugcugggauuacaggca

SEQ ID NO: 926868 - RNA, 20 nt, Human
cccacauaccuggccaagau

SEQ ID NO: 926869 - RNA, 19 nt, Human
ccccaggcuggagugcagu

SEQ ID NO: 926870 - RNA, 19 nt, Human
cccgaguaccugggauuac

SEQ ID NO: 926871 - RNA, 24 nt, Human
cccgaguggcugagacuacaggcg

SEQ ID NO: 926872 - RNA, 22 nt, Human
cccguacugaguacacaagggg

SEQ ID NO: 926873 - RNA, 19 nt, Human
cccugguucaagcaauucu

SEQ ID NO: 926874 - RNA, 21 nt, Human
ccgaguaccugggauuacagg

SEQ ID NO: 926875 - RNA, 24 nt, Human
ccgaguaccugggauuacaggugu

SEQ ID NO: 926876 - RNA, 19 nt, Human
ccuaggcuggagugcaaug

SEQ ID NO: 926877 - RNA, 24 nt, Human
ccugaccucaggugaucugcucac

SEQ ID NO: 926878 - RNA, 23 nt, Human
ccugaguagcugggauuacaggc

SEQ ID NO: 926879 - RNA, 24 nt, Human
ccugaguagcugggauuacaggcg

SEQ ID NO: 926880 - RNA, 23 nt, Human
ccuggccaagauuuugaguuuuu

SEQ ID NO: 926881 - RNA, 20 nt, Human
ccugggcucaagcgauucuc

SEQ ID NO: 926882 - RNA, 23 nt, Human
ccugggcucaagcgauucuccug

SEQ ID NO: 926883 - RNA, 22 nt, Human
ccuugcucugucccccaggcug

SEQ ID NO: 926884 - RNA, 23 nt, Human
ccuugcucugucccccaggcugg

SEQ ID NO: 926885 - RNA, 24 nt, Human
ccuugcucugucccccaggcugga

SEQ ID NO: 926886 - RNA, 24 nt, Human
cgccucggccucccaaagugcugg

SEQ ID NO: 926887 - RNA, 24 nt, Human
cgcucuuguugccuaggcuggagu

SEQ ID NO: 926888 - RNA, 24 nt, Human
cgggguuucaccaugcuagccagg

SEQ ID NO: 926889 - RNA, 24 nt, Human
cucaagcgauucuccugcuucagc

SEQ ID NO: 926890 - RNA, 24 nt, Human
cucacucuguuguccaggcuggag

SEQ ID NO: 926891 - RNA, 24 nt, Human
cucacugcaagcuaugccucccgg

SEQ ID NO: 926892 - RNA, 24 nt, Human
cucacugcagccucaaacuucugg

SEQ ID NO: 926893 - RNA, 23 nt, Human
cucagccuccugaguagcuggga

SEQ ID NO: 926894 - RNA, 24 nt, Human
cucaggugaucugcucaccuccgc

SEQ ID NO: 926895 - RNA, 18 nt, Human
cucaugaucugcccgccu

SEQ ID NO: 926896 - RNA, 24 nt, Human
cucauugcaaccuccgcuuccugg

SEQ ID NO: 926897 - RNA, 24 nt, Human
cuccugaccucaugaucugcccgc

SEQ ID NO: 926898 - RNA, 21 nt, Human
cuccugccccagugcucagga

SEQ ID NO: 926899 - RNA, 23 nt, Human
cucgcucuguugccaggcuggag

SEQ ID NO: 926900 - RNA, 22 nt, Human
cugaguagcugggauuacaggc

SEQ ID NO: 926901 - RNA, 21 nt, Human
cugcaaccuccgccucccugg

SEQ ID NO: 926902 - RNA, 21 nt, Human
cugcaaccuccgccucccugg

SEQ ID NO: 926903 - RNA, 24 nt, Human
cugcaaccuccgccucccugguuc

SEQ ID NO: 926904 - RNA, 23 nt, Human
cugccucagccucccgaguggcu

SEQ ID NO: 926905 - RNA, 23 nt, Human
cugcuucagccucccgaguaccu

SEQ ID NO: 926906 - RNA, 24 nt, Human
cuggagugcaaugguaugaucucg

SEQ ID NO: 926907 - RNA, 20 nt, Human
cuggccaagauuuugaguuu

SEQ ID NO: 926908 - RNA, 19 nt, Human
cuggcccgauuuugaguuu

SEQ ID NO: 926909 - RNA, 23 nt, Human
cugggacucucuacccguacuga

SEQ ID NO: 926910 - RNA, 24 nt, Human
cuuccugggcucaagcgauucucc

SEQ ID NO: 926911 - RNA, 25 nt, Human
cuugugccucagccuccugaguagc

SEQ ID NO: 926912 - RNA, 24 nt, Human
cuuguugccuaggcuggagugcaa

SEQ ID NO: 926913 - RNA, 23 nt, Human
gaaagcacacguaacuuagagaa

SEQ ID NO: 926914 - RNA, 20 nt, Human
gaauuuuuuuuuuuuuuucc

SEQ ID NO: 926915 - RNA, 24 nt, Human
gaccucaggugaucugcucaccuc

SEQ ID NO: 926916 - RNA, 24 nt, Human
gacggagucucgcucuguugccag

SEQ ID NO: 926917 - RNA, 20 nt, Human
gagacgggguuucaccaugc

SEQ ID NO: 926918 - RNA, 26 nt, Human
gaguagcugggauuacaggcgcacgc

SEQ ID NO: 926919 - RNA, 20 nt, Human
gaucucaccacuccucccac

SEQ ID NO: 926920 - RNA, 18 nt, Human
gauuacaggcaugagcca

SEQ ID NO: 926921 - RNA, 21 nt, Human
gauuacaggcaugagccacug

SEQ ID NO: 926922 - RNA, 24 nt, Human
gauuacaggcaugagccacugugc

SEQ ID NO: 926923 - RNA, 18 nt, Human
gauuacaggcgcacgcca

SEQ ID NO: 926924 - RNA, 18 nt, Human
gauuacaggugugagcca

SEQ ID NO: 926925 - RNA, 21 nt, Human
gauuacaggugugagccacca

SEQ ID NO: 926926 - RNA, 22 nt, Human
gauuacaggugugagccaccac

SEQ ID NO: 926927 - RNA, 18 nt, Human
gauuacaggugugagcua

SEQ ID NO: 926928 - RNA, 21 nt, Human
gauucuccugcuucagccucc

SEQ ID NO: 926929 - RNA, 22 nt, Human
gcaaccuccgccucccugguuc

SEQ ID NO: 926930 - RNA, 20 nt, Human
gcaaccuccgcuuccugggc

SEQ ID NO: 926931 - RNA, 21 nt, Human
gcacuacaccaccgcacccag

SEQ ID NO: 926932 - RNA, 19 nt, Human
gccacugugccuggcccga

SEQ ID NO: 926933 - RNA, 25 nt, Human
gcccagcuaauuuuuuuuuguauuu

SEQ ID NO: 926934 - RNA, 24 nt, Human
gccuaggcuggagugcaaugguau

SEQ ID NO: 926935 - RNA, 20 nt, Human
gccucagccucccgaguggc

SEQ ID NO: 926936 - RNA, 24 nt, Human
gcgauucuccugcuucagccuccc

SEQ ID NO: 926937 - RNA, 19 nt, Human
gcuggaguacaauggcgug

SEQ ID NO: 926938 - RNA, 19 nt, Human
gcuggagugcaguggcgca

SEQ ID NO: 926939 - RNA, 19 nt, Human
gcuggagugcaguggcgug

SEQ ID NO: 926940 - RNA, 23 nt, Human
gcuggucuugaacuccugaccuc

SEQ ID NO: 926941 - RNA, 20 nt, Human
ggaauuuuuuuuuuuuuuuc

SEQ ID NO: 926942 - RNA, 24 nt, Human
ggauuacaggcaugagccacugug

SEQ ID NO: 926943 - RNA, 22 nt, Human
ggcuggaguacaauggcgugau

SEQ ID NO: 926944 - RNA, 22 nt, Human
ggcuggagugcaguggcgugau

SEQ ID NO: 926945 - RNA, 24 nt, Human
ggcuggucuugaacuccugaccuc

SEQ ID NO: 926946 - RNA, 19 nt, Human
gggcacaagcgauccuccu

SEQ ID NO: 926947 - RNA, 19 nt, Human
gggcucaagcgauucuccu

SEQ ID NO: 926948 - RNA, 23 nt, Human
gggguuucaccaugcuagccagg

SEQ ID NO: 926949 - RNA, 20 nt, Human
ggucucgaucuccugaccuc

SEQ ID NO: 926950 - RNA, 19 nt, Human
ggucuugaacuccugaccu

SEQ ID NO: 926951 - RNA, 24 nt, Human
gguuucaccaugcuagccaggaug

SEQ ID NO: 926952 - RNA, 18 nt, Human
guagcugggauuacaggc

SEQ ID NO: 926953 - RNA, 24 nt, Human
guccaggcuggagugcaguggcgu

SEQ ID NO: 926954 - RNA, 24 nt, Human
gucucgcucuguugccaggcugga

SEQ ID NO: 926955 - RNA, 22 nt, Human
gugccucagccuccugaguagc

SEQ ID NO: 926956 - RNA, 20 nt, Human
uaaacauggagauaaguuga

SEQ ID NO: 926957 - RNA, 23 nt, Human
uaaccuagaggauauuucagcac

SEQ ID NO: 926958 - RNA, 18 nt, Human
uacaaaauacugugucac

SEQ ID NO: 926959 - RNA, 22 nt, Human
uacaggcaugagccacugugcc

SEQ ID NO: 926960 - RNA, 24 nt, Human
uacaggcgcacgccaccacaccca

SEQ ID NO: 926961 - RNA, 22 nt, Human
uacaggugugagccaccacacc

SEQ ID NO: 926962 - RNA, 23 nt, Human
uacaggugugagccaccacaccu

SEQ ID NO: 926963 - RNA, 22 nt, Human
uagagacaggguuaauccaugu

SEQ ID NO: 926964 - RNA, 24 nt, Human
uaguagagacaggguuaauccaug

SEQ ID NO: 926965 - RNA, 24 nt, Human
uaguagagacgggguuucaccaug

SEQ ID NO: 926966 - RNA, 26 nt, Human
uaguagagacgggguuucaccaugcu

SEQ ID NO: 926967 - RNA, 21 nt, Human
ucacaucauucuccugccuca

SEQ ID NO: 926968 - RNA, 24 nt, Human
ucaccaugcuagccaggauggucu

SEQ ID NO: 926969 - RNA, 23 nt, Human
ucaccuccgccucccaaagugcu

SEQ ID NO: 926970 - RNA, 24 nt, Human
ucacucuguuguccaggcuggagu

SEQ ID NO: 926971 - RNA, 24 nt, Human
ucacugcaagcuaugccucccggg

SEQ ID NO: 926972 - RNA, 24 nt, Human
ucacugcagccucaaacuucuggg

SEQ ID NO: 926973 - RNA, 20 nt, Human
ucagccuccugaguagcugg

SEQ ID NO: 926974 - RNA, 24 nt, Human
ucauugcaaccuccgcuuccuggg

SEQ ID NO: 926975 - RNA, 25 nt, Human
ucauugcaaccuccgcuuccugggc

SEQ ID NO: 926976 - RNA, 19 nt, Human
uccaggcugggauuacagg

SEQ ID NO: 926977 - RNA, 24 nt, Human
uccaggcugggauuacagguguga

SEQ ID NO: 926978 - RNA, 23 nt, Human
uccauguuggucaggcuggucuu

SEQ ID NO: 926979 - RNA, 23 nt, Human
ucccaaagugcugggauuacagg

SEQ ID NO: 926980 - RNA, 24 nt, Human
ucccaaagugcugggauuacaggc

SEQ ID NO: 926981 - RNA, 24 nt, Human
ucccccaggcuggagugcaguggc

SEQ ID NO: 926982 - RNA, 23 nt, Human
ucccgaguaccugggauuacagg

SEQ ID NO: 926983 - RNA, 24 nt, Human
ucccgaguaccugggauuacaggu

SEQ ID NO: 926984 - RNA, 24 nt, Human
ucccgaguggcugagacuacaggc

SEQ ID NO: 926985 - RNA, 21 nt, Human
ucccggguucacaucauucuc

SEQ ID NO: 926986 - RNA, 24 nt, Human
ucccggguucacaucauucuccug

SEQ ID NO: 926987 - RNA, 20 nt, Human
ucccugguucaagcaauucu

SEQ ID NO: 926988 - RNA, 20 nt, Human
ucccugguucaagcaauucu

SEQ ID NO: 926989 - RNA, 24 nt, Human
uccgccucccugguucaagcaauu

SEQ ID NO: 926990 - RNA, 21 nt, Human
uccucccacauaccuggccaa

SEQ ID NO: 926991 - RNA, 24 nt, Human
uccugaguagcugggauuacaggc

SEQ ID NO: 926992 - RNA, 20 nt, Human
uccugggcucaagcgauucu

SEQ ID NO: 926993 - RNA, 21 nt, Human
uccugggcucaagcgauucuc

SEQ ID NO: 926994 - RNA, 24 nt, Human
uccugggcucaagcgauucuccug

SEQ ID NO: 926995 - RNA, 21 nt, Human
ucgcucuuguugccuaggcug

SEQ ID NO: 926996 - RNA, 23 nt, Human
ucgcucuuguugccuaggcugga

SEQ ID NO: 926997 - RNA, 18 nt, Human
ucggccucccaaagugcu

SEQ ID NO: 926998 - RNA, 22 nt, Human
ucucacucuguuguccaggcug

SEQ ID NO: 926999 - RNA, 22 nt, Human
ucucacucuguuguccaggcug

SEQ ID NO: 927000 - RNA, 23 nt, Human
ucucacucuguuguccaggcugg

SEQ ID NO: 927001 - RNA, 24 nt, Human
ucucacucuguuguccaggcugga

SEQ ID NO: 927002 - RNA, 26 nt, Human
ucuccugccucagccucccgaguggc

SEQ ID NO: 927003 - RNA, 21 nt, Human
ucucgcucuguugccaggcug

SEQ ID NO: 927004 - RNA, 22 nt, Human
ucucgcucuguugccaggcugg

SEQ ID NO: 927005 - RNA, 23 nt, Human
ucucgcucuguugccaggcugga

SEQ ID NO: 927006 - RNA, 19 nt, Human
ucugucccccaggcuggag

SEQ ID NO: 927007 - RNA, 24 nt, Human
ucugucccccaggcuggagugcag

SEQ ID NO: 927008 - RNA, 18 nt, Human
ucuguugccaggcuggag

SEQ ID NO: 927009 - RNA, 24 nt, Human
ucuguuguccaggcuggagugcag

SEQ ID NO: 927010 - RNA, 23 nt, Human
ucuugaacuccugaccucaggug

SEQ ID NO: 927011 - RNA, 19 nt, Human
ucuuguugccuaggcugga

SEQ ID NO: 927012 - RNA, 20 nt, Human
ucuuuuuuuuuuuuuuuaag

SEQ ID NO: 927013 - RNA, 19 nt, Human
ugaaaugcagauaaauugu

SEQ ID NO: 927014 - RNA, 25 nt, Human
ugaccucaggugaucugcucaccuc

SEQ ID NO: 927015 - RNA, 22 nt, Human
ugagacggagccuugcucuguc

SEQ ID NO: 927016 - RNA, 22 nt, Human
ugagacggagucucgcucuguu

SEQ ID NO: 927017 - RNA, 21 nt, Human
ugagacuacaggcgcccgcca

SEQ ID NO: 927018 - RNA, 24 nt, Human
ugagacuacaggcgcccgccacua

SEQ ID NO: 927019 - RNA, 23 nt, Human
ugaggaucuugaguuuuuguuug

SEQ ID NO: 927020 - RNA, 24 nt, Human
ugaucugcucaccuccgccuccca

SEQ ID NO: 927021 - RNA, 20 nt, Human
ugcaaccuccgcuuccuggg

SEQ ID NO: 927022 - RNA, 19 nt, Human
ugcacuacaccaccgcacc

SEQ ID NO: 927023 - RNA, 20 nt, Human
ugcacuacaccaccgcaccc

SEQ ID NO: 927024 - RNA, 22 nt, Human
ugcaguggcgcaaucucggcuc

SEQ ID NO: 927025 - RNA, 23 nt, Human
ugcaguggcgcaaucucggcuca

SEQ ID NO: 927026 - RNA, 23 nt, Human
ugccaggcuggaguacaauggcg

SEQ ID NO: 927027 - RNA, 24 nt, Human
ugccaggcuggaguacaauggcgu

SEQ ID NO: 927028 - RNA, 20 nt, Human
ugccuaggcuggagugcaau

SEQ ID NO: 927029 - RNA, 21 nt, Human
ugccuaggcuggagugcaaug

SEQ ID NO: 927030 - RNA, 24 nt, Human
ugccuaggcuggagugcaauggua

SEQ ID NO: 927031 - RNA, 24 nt, Human
ugccucagccucccgaguggcuga

SEQ ID NO: 927032 - RNA, 24 nt, Human
ugccucagccuccugaguagcugg

SEQ ID NO: 927033 - RNA, 24 nt, Human
ugccuggcccgauuuugaguuuuu

SEQ ID NO: 927034 - RNA, 21 nt, Human
ugcucugucccccaggcugga

SEQ ID NO: 927035 - RNA, 24 nt, Human
ugcucugucccccaggcuggagug

SEQ ID NO: 927036 - RNA, 24 nt, Human
ugcugggauuacaggugugagcca

SEQ ID NO: 927037 - RNA, 24 nt, Human
ugcuucagccucccgaguaccugg

SEQ ID NO: 927038 - RNA, 19 nt, Human
uggaguacaauggcgugau

SEQ ID NO: 927039 - RNA, 23 nt, Human
uggaguacaauggcgugaucuug

SEQ ID NO: 927040 - RNA, 24 nt, Human
uggaguacaauggcgugaucuugg

SEQ ID NO: 927041 - RNA, 19 nt, Human
uggagugcaaugguaugau

SEQ ID NO: 927042 - RNA, 24 nt, Human
uggagugcaaugguaugaucucgg

SEQ ID NO: 927043 - RNA, 23 nt, Human
uggagugcaguggcgcaaucucg

SEQ ID NO: 927044 - RNA, 24 nt, Human
uggagugcaguggcgcaaucucgg

SEQ ID NO: 927045 - RNA, 19 nt, Human
uggagugcaguggcgugau

SEQ ID NO: 927046 - RNA, 23 nt, Human
uggagugcaguggcgugaucuug

SEQ ID NO: 927047 - RNA, 24 nt, Human
uggagugcaguggcgugaucuugg

SEQ ID NO: 927048 - RNA, 18 nt, Human
uggaguguacugguguga

SEQ ID NO: 927049 - RNA, 18 nt, Human
uggcccgauuuugaguuu

SEQ ID NO: 927050 - RNA, 18 nt, Human
ugggauuacaggcaugag

SEQ ID NO: 927051 - RNA, 21 nt, Human
ugggauuacaggcaugagcca

SEQ ID NO: 927052 - RNA, 22 nt, Human
ugggauuacaggcaugagccac

SEQ ID NO: 927053 - RNA, 22 nt, Human
ugggauuacaggcaugagccac

SEQ ID NO: 927054 - RNA, 22 nt, Human
ugggauuacaggcaugagccac

SEQ ID NO: 927055 - RNA, 23 nt, Human
ugggauuacaggcaugagccacu

SEQ ID NO: 927056 - RNA, 24 nt, Human
ugggauuacaggcaugagccacug

SEQ ID NO: 927057 - RNA, 22 nt, Human
ugggauuacaggcgcacgccac

SEQ ID NO: 927058 - RNA, 24 nt, Human
ugggauuacaggcgcacgccacca

SEQ ID NO: 927059 - RNA, 18 nt, Human
ugggauuacaggugugag

SEQ ID NO: 927060 - RNA, 18 nt, Human
ugggauuacaggugugag

SEQ ID NO: 927061 - RNA, 19 nt, Human
ugggauuacaggugugagc

SEQ ID NO: 927062 - RNA, 19 nt, Human
ugggauuacaggugugagc

SEQ ID NO: 927063 - RNA, 19 nt, Human
ugggauuacaggugugagc

SEQ ID NO: 927064 - RNA, 19 nt, Human
ugggauuacaggugugagc

SEQ ID NO: 927065 - RNA, 22 nt, Human
ugggauuacaggugugagccac

SEQ ID NO: 927066 - RNA, 23 nt, Human
ugggauuacaggugugagccacc

SEQ ID NO: 927067 - RNA, 24 nt, Human
ugggauuacaggugugagccacca

SEQ ID NO: 927068 - RNA, 21 nt, Human
ugggauuacaggugugagcua

SEQ ID NO: 927069 - RNA, 22 nt, Human
ugggauuacaggugugagcuau

SEQ ID NO: 927070 - RNA, 19 nt, Human
ugggauuacaggugugcac

SEQ ID NO: 927071 - RNA, 19 nt, Human
ugggauuacaggugugcac

SEQ ID NO: 927072 - RNA, 22 nt, Human
ugggauuacaggugugcacuaa

SEQ ID NO: 927073 - RNA, 22 nt, Human
ugggauuacaggugugcacuac

SEQ ID NO: 927074 - RNA, 26 nt, Human
ugggauuacaggugugcacuacacca

SEQ ID NO: 927075 - RNA, 29 nt, Human
ugggauuacaggugugcacuacaccaccg

SEQ ID NO: 927076 - RNA, 30 nt, Human
ugggauuacaggugugcacuacaccaccgg

SEQ ID NO: 927077 - RNA, 24 nt, Human
ugggcucaagcgauucuccugcuu

SEQ ID NO: 927078 - RNA, 24 nt, Human
uggucaggcuggucuugaacuccu

SEQ ID NO: 927079 - RNA, 24 nt, Human
uggugugaugacggcucacugcag

SEQ ID NO: 927080 - RNA, 21 nt, Human
uguauuuuuaguagagacggg

SEQ ID NO: 927081 - RNA, 20 nt, Human
uguccaggcuggagugcagu

SEQ ID NO: 927082 - RNA, 22 nt, Human
uguccaggcuggagugcagugg

SEQ ID NO: 927083 - RNA, 24 nt, Human
uguccaggcuggagugcaguggcg

SEQ ID NO: 927084 - RNA, 22 nt, Human
ugugcacuacaccaccgcaccc

SEQ ID NO: 927085 - RNA, 24 nt, Human
ugugccucagccuccugaguagcu

SEQ ID NO: 927086 - RNA, 25 nt, Human
ugugucacaacaaaggaaguuugcg

SEQ ID NO: 927087 - RNA, 20 nt, Human
uguugccuaggcuggagugc

SEQ ID NO: 927088 - RNA, 19 nt, Human
uguuguccaggcuggagug

SEQ ID NO: 927089 - RNA, 23 nt, Human
uuaaaaucuuuuuuuuuuuuuuu

SEQ ID NO: 927090 - RNA, 24 nt, Human
uuacaggugugcacuacaccaccg

SEQ ID NO: 927091 - RNA, 24 nt, Human
uuaguagagacaggguuaauccau

SEQ ID NO: 927092 - RNA, 18 nt, Human
uuaguagagacgggguuu

SEQ ID NO: 927093 - RNA, 22 nt, Human
uuaguagagacgggguuucacc

SEQ ID NO: 927094 - RNA, 24 nt, Human
uuaguagagacgggguuucaccau

SEQ ID NO: 927095 - RNA, 23 nt, Human
uucaagcaauucuugugccucag

SEQ ID NO: 927096 - RNA, 23 nt, Human
uuccaggcugggauuacaggugu

SEQ ID NO: 927097 - RNA, 25 nt, Human
uuccugggcucaagcgauucuccug

SEQ ID NO: 927098 - RNA, 24 nt, Human
uucgcucuuguugccuaggcugga

SEQ ID NO: 927099 - RNA, 24 nt, Human
uugcaaccuccgcuuccugggcuc

SEQ ID NO: 927100 - RNA, 18 nt, Human
uugccuaggcuggagugc

SEQ ID NO: 927101 - RNA, 24 nt, Human
uugcucugucccccaggcuggagu

SEQ ID NO: 927102 - RNA, 19 nt, Human
uugcugcaaccuccgccuc

SEQ ID NO: 927103 - RNA, 24 nt, Human
uugcugcaaccuccgccucccugg

SEQ ID NO: 927104 - RNA, 19 nt, Human
uuguuuguuuguuuuugau

SEQ ID NO: 927105 - RNA, 20 nt, Human
uuucaccaugcuagccagga

SEQ ID NO: 927106 - RNA, 24 nt, Human
uuucgcucuuguugccuaggcugg

SEQ ID NO: 927107 - RNA, 19 nt, Human
uuuuguauuuuuaguagag

SEQ ID NO: 927108 - RNA, 20 nt, Human
uuuuguauuuuuaguagaga

SEQ ID NO: 927109 - RNA, 24 nt, Human
uuuuuaguagagacgggguuucac

SEQ ID NO: 927110 - RNA, 23 nt, Human
uuuuucgcucuuguugccuaggc

SEQ ID NO: 927111 - RNA, 22 nt, Human
uuuuugauuuugagacacgguc

SEQ ID NO: 927112 - RNA, 21 nt, Human
uuuuuguauuuuuaguagaga

SEQ ID NO: 927113 - RNA, 19 nt, Human
uuuuuguuuguuuguuuuu

SEQ ID NO: 927114 - RNA, 22 nt, Human
uuuuuguuuguuuguuuuugau

SEQ ID NO: 927115 - RNA, 20 nt, Human
uuuuuguuuguuuguuuuuu

SEQ ID NO: 927116 - RNA, 21 nt, Human
uuuuuuguauuuuuaguagag

SEQ ID NO: 927117 - RNA, 24 nt, Human
uuuuuuguauuuuuaguagagacg

SEQ ID NO: 927118 - RNA, 24 nt, Human
uuuuuuuccugagacggagccuuu

SEQ ID NO: 927119 - RNA, 19 nt, Human
uuuuuuuuuuaagacagag

SEQ ID NO: 927120 - RNA, 19 nt, Human
aaacaaaagacugagcucc

SEQ ID NO: 927121 - RNA, 24 nt, Human
aacuugacacucccccagcacuuc

SEQ ID NO: 927122 - RNA, 25 nt, Human
agccacugucaggcugucgucucga

SEQ ID NO: 927123 - RNA, 18 nt, Human
agcccucuauggccaccu

SEQ ID NO: 927124 - RNA, 22 nt, Human
augacacagggagccaagagag

SEQ ID NO: 927125 - RNA, 21 nt, Human
auuucauuuuucuuggagcga

SEQ ID NO: 927126 - RNA, 22 nt, Human
caccagccaagaucacauuaac

SEQ ID NO: 927127 - RNA, 26 nt, Human
cacuucugccuuuggcccuucagaga

SEQ ID NO: 927128 - RNA, 18 nt, Human
cagcaggucagccuccuc

SEQ ID NO: 927129 - RNA, 18 nt, Human
ccagcccacacacgguca

SEQ ID NO: 927130 - RNA, 25 nt, Human
cccacacacggucacuggauuggug

SEQ ID NO: 927131 - RNA, 24 nt, Human
cccccagcacuucugccuuuggcc

SEQ ID NO: 927132 - RNA, 20 nt, Human
cccucuauggccaccugguc

SEQ ID NO: 927133 - RNA, 19 nt, Human
ccuugcucugcccucccca

SEQ ID NO: 927134 - RNA, 19 nt, Human
cuccugaagauaccugguu

SEQ ID NO: 927135 - RNA, 21 nt, Human
cugguuugguguggugacccc

SEQ ID NO: 927136 - RNA, 22 nt, Human
cuucugccuuuggcccuucaga

SEQ ID NO: 927137 - RNA, 24 nt, Human
gacacucccccagcacuucugccu

SEQ ID NO: 927138 - RNA, 24 nt, Human
gagccgccagcccacacacgguca

SEQ ID NO: 927139 - RNA, 23 nt, Human
gcauccagaaauguaugcacaga

SEQ ID NO: 927140 - RNA, 21 nt, Human
ggcauacuggguggugguggg

SEQ ID NO: 927141 - RNA, 23 nt, Human
gugggguuguccuugcucugccc

SEQ ID NO: 927142 - RNA, 18 nt, Human
uaaaugaaaacuugacac

SEQ ID NO: 927143 - RNA, 19 nt, Human
uaacaaagaaaucucugcc

SEQ ID NO: 927144 - RNA, 19 nt, Human
uaaguaaaugcauccagaa

SEQ ID NO: 927145 - RNA, 24 nt, Human
uaauacacuugucaacaccagcca

SEQ ID NO: 927146 - RNA, 20 nt, Human
uaugaacaaacaaaagacug

SEQ ID NO: 927147 - RNA, 21 nt, Human
ucacgcacggugcuccgugcc

SEQ ID NO: 927148 - RNA, 21 nt, Human
ucacuggauuggugugagugg

SEQ ID NO: 927149 - RNA, 21 nt, Human
ucagccuccucuuuccugucc

SEQ ID NO: 927150 - RNA, 19 nt, Human
uccccagcccucuauggcc

SEQ ID NO: 927151 - RNA, 21 nt, Human
ucccccagcacuucugccuuu

SEQ ID NO: 927152 - RNA, 26 nt, Human
ucccccagcacuucugccuuuggccc

SEQ ID NO: 927153 - RNA, 22 nt, Human
uccuguccaccucugguuccca

SEQ ID NO: 927154 - RNA, 21 nt, Human
ugaacaaacaaaagacugagc

SEQ ID NO: 927155 - RNA, 22 nt, Human
ugacacagggagccaagagagu

SEQ ID NO: 927156 - RNA, 19 nt, Human
ugacauuaacauucuuggg

SEQ ID NO: 927157 - RNA, 19 nt, Human
ugagggcaaggggaaucuc

SEQ ID NO: 927158 - RNA, 21 nt, Human
ugcacagauuuaaguuuuccc

SEQ ID NO: 927159 - RNA, 21 nt, Human
ugccccugagucuucucuccu

SEQ ID NO: 927160 - RNA, 27 nt, Human
ugccuuuggcccuucagagauuuggag

SEQ ID NO: 927161 - RNA, 26 nt, Human
uggcauacugggugguggugggguug

SEQ ID NO: 927162 - RNA, 22 nt, Human
ugguggugggguuguccuugcu

SEQ ID NO: 927163 - RNA, 22 nt, Human
uggugugaguggguuccaagcc

SEQ ID NO: 927164 - RNA, 18 nt, Human
ugguucccagauugguuu

SEQ ID NO: 927165 - RNA, 21 nt, Human
uucagacuuuaacaaagaaau

SEQ ID NO: 927166 - RNA, 24 nt, Human
uugcucugcccuccccagcccucu

SEQ ID NO: 927167 - RNA, 18 nt, Human
uuuuuuuuuuuuuuuuug

SEQ ID NO: 927168 - RNA, 24 nt, Human
aaagugcugggauuacaggcauga

SEQ ID NO: 927169 - RNA, 20 nt, Human
aacaguaagcgaggccaccc

SEQ ID NO: 927170 - RNA, 21 nt, Human
aagcugguuucaucaaacuua

SEQ ID NO: 927171 - RNA, 23 nt, Human
aagcugguuucauccgugacaca

SEQ ID NO: 927172 - RNA, 19 nt, Human
aagugcugggauuacaggc

SEQ ID NO: 927173 - RNA, 21 nt, Human
aagugcugggauuacaggcau

SEQ ID NO: 927174 - RNA, 26 nt, Human
aagugcugggauuacaggcaugagcc

SEQ ID NO: 927175 - RNA, 22 nt, Human
acaaaauaaguaauucucucuu

SEQ ID NO: 927176 - RNA, 31 nt, Human
acaaacccaaagugcugggauuacaggcauu

SEQ ID NO: 927177 - RNA, 19 nt, Human
acaugggauuuugaugagu

SEQ ID NO: 927178 - RNA, 27 nt, Human
acuaagugcuaaauuaauggguucuga

SEQ ID NO: 927179 - RNA, 21 nt, Human
acucccaccccccaaaacaaa

SEQ ID NO: 927180 - RNA, 27 nt, Human
agaccaggggcagacugggugggagga

SEQ ID NO: 927181 - RNA, 22 nt, Human
agagcaggaguuucuaauucuu

SEQ ID NO: 927182 - RNA, 18 nt, Human
agugcugggauuacaggc

SEQ ID NO: 927183 - RNA, 19 nt, Human
augaaacaguaguggaaua

SEQ ID NO: 927184 - RNA, 22 nt, Human
auuggaugggcagagaccaggg

SEQ ID NO: 927185 - RNA, 18 nt, Human
caaacccaaagugcuggg

SEQ ID NO: 927186 - RNA, 30 nt, Human
caaacccaaagugcugggauuacaggcauu

SEQ ID NO: 927187 - RNA, 24 nt, Human
caaagugcugggauuacaggcaug

SEQ ID NO: 927188 - RNA, 31 nt, Human
caacucccaccccccaaaacaaacccaaagg

SEQ ID NO: 927189 - RNA, 19 nt, Human
caccccccaaaacaaaccc

SEQ ID NO: 927190 - RNA, 21 nt, Human
caccccccaaaacaaacccaa

SEQ ID NO: 927191 - RNA, 24 nt, Human
caccccccaaaacaaacccaaagu

SEQ ID NO: 927192 - RNA, 23 nt, Human
cacugaaugagugggagcacccc

SEQ ID NO: 927193 - RNA, 23 nt, Human
ccaaagugcugggauuacaggca

SEQ ID NO: 927194 - RNA, 24 nt, Human
ccaaagugcugggauuacaggcau

SEQ ID NO: 927195 - RNA, 25 nt, Human
ccaaagugcugggauuacaggcauu

SEQ ID NO: 927196 - RNA, 18 nt, Human
ccacguggcagucagagu

SEQ ID NO: 927197 - RNA, 21 nt, Human
ccacugcgcccagccagaaga

SEQ ID NO: 927198 - RNA, 22 nt, Human
ccacugcgcccagccagaagag

SEQ ID NO: 927199 - RNA, 25 nt, Human
ccagccucugcucaggggccccaca

SEQ ID NO: 927200 - RNA, 24 nt, Human
cccaaagugcugggauuacaggca

SEQ ID NO: 927201 - RNA, 25 nt, Human
cccaaagugcugggauuacaggcau

SEQ ID NO: 927202 - RNA, 24 nt, Human
cccaaagugcugggauuacaggcc

SEQ ID NO: 927203 - RNA, 24 nt, Human
cccacacacugaaugagugggagc

SEQ ID NO: 927204 - RNA, 20 nt, Human
cccaccccccaaaacaaacc

SEQ ID NO: 927205 - RNA, 19 nt, Human
ccccccaaaacaaacccaa

SEQ ID NO: 927206 - RNA, 21 nt, Human
cccugugcucggccugggcug

SEQ ID NO: 927207 - RNA, 25 nt, Human
ccugggcuggaacaguaagcgaggc

SEQ ID NO: 927208 - RNA, 18 nt, Human
cucccaccccccaaaaca

SEQ ID NO: 927209 - RNA, 23 nt, Human
cucccaccccccaaaacaaaccc

SEQ ID NO: 927210 - RNA, 19 nt, Human
cugccagcacucugaacac

SEQ ID NO: 927211 - RNA, 18 nt, Human
cuggaacaguaagcgagg

SEQ ID NO: 927212 - RNA, 23 nt, Human
cugguuggugguuagguugaaga

SEQ ID NO: 927213 - RNA, 21 nt, Human
gagcacccccaggugugcuga

SEQ ID NO: 927214 - RNA, 18 nt, Human
gauuacaggcaugagcca

SEQ ID NO: 927215 - RNA, 22 nt, Human
gauuacaggcaugagccacugc

SEQ ID NO: 927216 - RNA, 22 nt, Human
gauuacaggcaugagccacugc

SEQ ID NO: 927217 - RNA, 20 nt, Human
gcaaauagggaaaagguaau

SEQ ID NO: 927218 - RNA, 22 nt, Human
ggauuacaggcaugagccacug

SEQ ID NO: 927219 - RNA, 21 nt, Human
guaguggaauauuuggggaac

SEQ ID NO: 927220 - RNA, 23 nt, Human
gugcugagccccagauuguuugc

SEQ ID NO: 927221 - RNA, 25 nt, Human
guggcaaugcccagccucugcucag

SEQ ID NO: 927222 - RNA, 24 nt, Human
uaagguuuauuuauaagagcagga

SEQ ID NO: 927223 - RNA, 24 nt, Human
uacaggcaugagccacugcgccca

SEQ ID NO: 927224 - RNA, 23 nt, Human
uaggaaaugagaagacacuuuaa

SEQ ID NO: 927225 - RNA, 18 nt, Human
ucagugguucuuugaaau

SEQ ID NO: 927226 - RNA, 22 nt, Human
ucccuggacacgugcagggcug

SEQ ID NO: 927227 - RNA, 24 nt, Human
uccuugcucucuaggagcucaggu

SEQ ID NO: 927228 - RNA, 20 nt, Human
ucugaaauaagcaacaaagg

SEQ ID NO: 927229 - RNA, 20 nt, Human
ugaaauaagcaacaaaggug

SEQ ID NO: 927230 - RNA, 22 nt, Human
ugcagugucccuggacacgugc

SEQ ID NO: 927231 - RNA, 22 nt, Human
ugcccagccucugcucaggggc

SEQ ID NO: 927232 - RNA, 22 nt, Human
ugcucggccugggcuggaacag

SEQ ID NO: 927233 - RNA, 19 nt, Human
uggaugggcagagaccaac

SEQ ID NO: 927234 - RNA, 18 nt, Human
ugggauuacaggcaugag

SEQ ID NO: 927235 - RNA, 19 nt, Human
ugggauuacaggcaugagc

SEQ ID NO: 927236 - RNA, 21 nt, Human
ugggauuacaggcaugagcca

SEQ ID NO: 927237 - RNA, 22 nt, Human
ugggauuacaggcaugagccac

SEQ ID NO: 927238 - RNA, 22 nt, Human
ugggauuacaggcaugagccac

SEQ ID NO: 927239 - RNA, 24 nt, Human
ugggauuacaggcaugagccacug

SEQ ID NO: 927240 - RNA, 26 nt, Human
ugggauuacaggcaugagccacugcg

SEQ ID NO: 927241 - RNA, 21 nt, Human
uguaagguuuauuuauaagag

SEQ ID NO: 927242 - RNA, 21 nt, Human
uuagcugugacaugggauuuu

SEQ ID NO: 927243 - RNA, 23 nt, Human
uuagcugugccuugaaagacuuu

SEQ ID NO: 927244 - RNA, 20 nt, Human
uuccaggagggugggcucug

SEQ ID NO: 927245 - RNA, 24 nt, Human
uugacaaaauaaguaauucucucu

SEQ ID NO: 927246 - RNA, 23 nt, Human
uuguuuguuuuugugugugccgu

SEQ ID NO: 927247 - RNA, 22 nt, Human
uuuagaguuugcugcaaauggu

SEQ ID NO: 927248 - RNA, 24 nt, Human
uuuagcagcaguuugaggcauucu

SEQ ID NO: 927249 - RNA, 22 nt, Human
uuugugugugccgugaacuucu

SEQ ID NO: 927250 - RNA, 27 nt, Human
uuuuagaauaggaaucugguuuggagg

SEQ ID NO: 927251 - RNA, 22 nt, Human
uuuuuuuuuuuuuuuuuuucag

SEQ ID NO: 927252 - RNA, 21 nt, Human
aaaacaaacagaaaaagaaac

SEQ ID NO: 927253 - RNA, 21 nt, Human
aaacaaaaugguaauuucgau

SEQ ID NO: 927254 - RNA, 26 nt, Human
aaacagaaaaagaaacaaaagggacc

SEQ ID NO: 927255 - RNA, 23 nt, Human
aaacagaaaaagaaacaaaaugg

SEQ ID NO: 927256 - RNA, 25 nt, Human
aaacagaaaaagaaacaaaauggua

SEQ ID NO: 927257 - RNA, 23 nt, Human
aaacccugccccucuuuuuacac

SEQ ID NO: 927258 - RNA, 20 nt, Human
aaagugcugggauuacaggc

SEQ ID NO: 927259 - RNA, 22 nt, Human
aaagugcugggauuacaggcgu

SEQ ID NO: 927260 - RNA, 24 nt, Human
aaagugcugggauuacaggcguga

SEQ ID NO: 927261 - RNA, 21 nt, Human
aaauggcaagucgcuuaagca

SEQ ID NO: 927262 - RNA, 19 nt, Human
aagugcugggauuacaggc

SEQ ID NO: 927263 - RNA, 19 nt, Human
aagugcugggauuacaggc

SEQ ID NO: 927264 - RNA, 18 nt, Human
acaggguuucaccauguu

SEQ ID NO: 927265 - RNA, 19 nt, Human
acaggguuucaccauguua

SEQ ID NO: 927266 - RNA, 20 nt, Human
acaggguuucaccauguuag

SEQ ID NO: 927267 - RNA, 24 nt, Human
acaggguuucaccauguuagccag

SEQ ID NO: 927268 - RNA, 24 nt, Human
acccugccccucuuuuuacacaca

SEQ ID NO: 927269 - RNA, 24 nt, Human
accuugugaucuucccgccuuggc

SEQ ID NO: 927270 - RNA, 24 nt, Human
acucugccaccaggcuagagguca

SEQ ID NO: 927271 - RNA, 19 nt, Human
agaacuuuucaaagcuuac

SEQ ID NO: 927272 - RNA, 20 nt, Human
agaguuguuucugcuuuauc

SEQ ID NO: 927273 - RNA, 24 nt, Human
agcgauucuccugccucagccucc

SEQ ID NO: 927274 - RNA, 22 nt, Human
aggagacaguuuugaggaaagc

SEQ ID NO: 927275 - RNA, 20 nt, Human
aggcacgcaccaccgugccc

SEQ ID NO: 927276 - RNA, 23 nt, Human
aggcgugagucacugcgcccggc

SEQ ID NO: 927277 - RNA, 24 nt, Human
agguaaaaaacaaacagaaaaaga

SEQ ID NO: 927278 - RNA, 24 nt, Human
aggucaguggugugaucuuggcuc

SEQ ID NO: 927279 - RNA, 22 nt, Human
aguagagacaggguuucaccau

SEQ ID NO: 927280 - RNA, 18 nt, Human
aguagcugggacuacagg

SEQ ID NO: 927281 - RNA, 18 nt, Human
agugcugggauuacaggc

SEQ ID NO: 927282 - RNA, 24 nt, Human
auuuuuguauuuuuaguagagaca

SEQ ID NO: 927283 - RNA, 20 nt, Human
caagcgauucuccugccuca

SEQ ID NO: 927284 - RNA, 22 nt, Human
caagcgauucuccugccucagc

SEQ ID NO: 927285 - RNA, 23 nt, Human
caauggcagcaacaagcugagag

SEQ ID NO: 927286 - RNA, 24 nt, Human
cacaaaucaucaguuuucuauacu

SEQ ID NO: 927287 - RNA, 18 nt, Human
cacacaaaucaucaguuu

SEQ ID NO: 927288 - RNA, 18 nt, Human
caccauauaaccuugggg

SEQ ID NO: 927289 - RNA, 23 nt, Human
caccauauaaccuuggggaugcc

SEQ ID NO: 927290 - RNA, 18 nt, Human
caccauguuagccaggau

SEQ ID NO: 927291 - RNA, 22 nt, Human
caccauguuagccaggaugguc

SEQ ID NO: 927292 - RNA, 24 nt, Human
caccauguuagccaggauggucuc

SEQ ID NO: 927293 - RNA, 24 nt, Human
caccgugcccagcuaauuuuugua

SEQ ID NO: 927294 - RNA, 23 nt, Human
cacgcaccaccgugcccagcuaa

SEQ ID NO: 927295 - RNA, 18 nt, Human
cacucugucgccaccuag

SEQ ID NO: 927296 - RNA, 21 nt, Human
cacugcaaccucugccucccg

SEQ ID NO: 927297 - RNA, 23 nt, Human
cacugcaaccucugccucccggg

SEQ ID NO: 927298 - RNA, 23 nt, Human
cagaaucaaucaagacuuuucgu

SEQ ID NO: 927299 - RNA, 27 nt, Human
cagcugcacucugucgccaccuaguca

SEQ ID NO: 927300 - RNA, 24 nt, Human
caggguuucaccauguuagccagg

SEQ ID NO: 927301 - RNA, 19 nt, Human
caguuuucuauacuguuca

SEQ ID NO: 927302 - RNA, 19 nt, Human
cauauaaccuuggggaugc

SEQ ID NO: 927303 - RNA, 23 nt, Human
cccgaguagcugggacuacaggc

SEQ ID NO: 927304 - RNA, 24 nt, Human
cccgaguagcugggacuacaggca

SEQ ID NO: 927305 - RNA, 20 nt, Human
cccggguucaagcgauucuc

SEQ ID NO: 927306 - RNA, 23 nt, Human
cccggguucaagcgauucuccug

SEQ ID NO: 927307 - RNA, 23 nt, Human
ccuaaagugcugggauuacaggc

SEQ ID NO: 927308 - RNA, 24 nt, Human
ccucccggguucaagcgauucucc

SEQ ID NO: 927309 - RNA, 20 nt, Human
ccucugcuguguaaaggugu

SEQ ID NO: 927310 - RNA, 23 nt, Human
ccugccucagccucccgaguagc

SEQ ID NO: 927311 - RNA, 21 nt, Human
ccuugcuuuuaccuguuuccc

SEQ ID NO: 927312 - RNA, 22 nt, Human
ccuuggggaugccucagcuucc

SEQ ID NO: 927313 - RNA, 21 nt, Human
cgacaaauagguaaaaaacaa

SEQ ID NO: 927314 - RNA, 23 nt, Human
cgcccuuuccccuuggugaugua

SEQ ID NO: 927315 - RNA, 22 nt, Human
cuaaagugcugggauuacaggc

SEQ ID NO: 927316 - RNA, 24 nt, Human
cuaaagugcugggauuacaggcgu

SEQ ID NO: 927317 - RNA, 24 nt, Human
cucacugcaaccucugccucccgg

SEQ ID NO: 927318 - RNA, 24 nt, Human
cucagccucccgaguagcugggac

SEQ ID NO: 927319 - RNA, 24 nt, Human
cuccugaccuugugaucuucccgc

SEQ ID NO: 927320 - RNA, 23 nt, Human
cugaccuugugaucuucccgccu

SEQ ID NO: 927321 - RNA, 19 nt, Human
cugcaaccucugccucccg

SEQ ID NO: 927322 - RNA, 23 nt, Human
cugcaaccucugccucccggguu

SEQ ID NO: 927323 - RNA, 24 nt, Human
cugcaaccucugccucccggguuc

SEQ ID NO: 927324 - RNA, 23 nt, Human
cugccucagccucccgaguagcu

SEQ ID NO: 927325 - RNA, 27 nt, Human
cuugugaucuucccgccuuggccuccu

SEQ ID NO: 927326 - RNA, 20 nt, Human
gaaaucaaugaguuggacaa

SEQ ID NO: 927327 - RNA, 21 nt, Human
gaccuugugaucuucccgccu

SEQ ID NO: 927328 - RNA, 24 nt, Human
gaccuugugaucuucccgccuugg

SEQ ID NO: 927329 - RNA, 24 nt, Human
gacuacaggcacgcaccaccgugc

SEQ ID NO: 927330 - RNA, 23 nt, Human
gagacaguuuugaggaaagcuga

SEQ ID NO: 927331 - RNA, 20 nt, Human
gagcaauggcagcaacaagc

SEQ ID NO: 927332 - RNA, 20 nt, Human
gaguagcugggacuacaggc

SEQ ID NO: 927333 - RNA, 24 nt, Human
gaguagcugggacuacaggcacgc

SEQ ID NO: 927334 - RNA, 18 nt, Human
gauuacaggcgugaguca

SEQ ID NO: 927335 - RNA, 22 nt, Human
gauuacaggcgugagucacugc

SEQ ID NO: 927336 - RNA, 22 nt, Human
gauuacaggcgugagucacugc

SEQ ID NO: 927337 - RNA, 22 nt, Human
gcaaccucugccucccggguuc

SEQ ID NO: 927338 - RNA, 19 nt, Human
gcacgcaccaccgugccca

SEQ ID NO: 927339 - RNA, 22 nt, Human
gcccagcuaauuuuuguauuuu

SEQ ID NO: 927340 - RNA, 22 nt, Human
gccuuggccuccuaaagugcug

SEQ ID NO: 927341 - RNA, 24 nt, Human
gcgauucuccugccucagccuccc

SEQ ID NO: 927342 - RNA, 21 nt, Human
gcucacugcaaccucugccuc

SEQ ID NO: 927343 - RNA, 24 nt, Human
ggauggucucgaucuccugaccuu

SEQ ID NO: 927344 - RNA, 20 nt, Human
ggucucgaucuccugaccuu

SEQ ID NO: 927345 - RNA, 24 nt, Human
gguuucaccauguuagccaggaug

SEQ ID NO: 927346 - RNA, 22 nt, Human
guaaaccaaaacccaaagauac

SEQ ID NO: 927347 - RNA, 24 nt, Human
guccuugcuuuuaccuguuuccca

SEQ ID NO: 927348 - RNA, 25 nt, Human
uaaaaaacaaacagaaaaagaaaca

SEQ ID NO: 927349 - RNA, 24 nt, Human
uaaagugcugggauuacaggcgug

SEQ ID NO: 927350 - RNA, 19 nt, Human
uaaauagauuaucugggga

SEQ ID NO: 927351 - RNA, 24 nt, Human
uaauuuuuguauuuuuaguagaga

SEQ ID NO: 927352 - RNA, 19 nt, Human
uacaggcgugagucacugc

SEQ ID NO: 927353 - RNA, 19 nt, Human
uaccuuggcuaaaaucagc

SEQ ID NO: 927354 - RNA, 24 nt, Human
uacgacaaauagguaaaaaacaaa

SEQ ID NO: 927355 - RNA, 22 nt, Human
uagagacaggguuucaccaugu

SEQ ID NO: 927356 - RNA, 24 nt, Human
uagauuaucuggggagacugucuu

SEQ ID NO: 927357 - RNA, 20 nt, Human
uaggugcaaauguccuauag

SEQ ID NO: 927358 - RNA, 24 nt, Human
uaguagagacaggguuucaccaug

SEQ ID NO: 927359 - RNA, 26 nt, Human
uaguagagacaggguuucaccauguu

SEQ ID NO: 927360 - RNA, 19 nt, Human
uaucuuucaaacccugccc

SEQ ID NO: 927361 - RNA, 24 nt, Human
ucaccauguuagccaggauggucu

SEQ ID NO: 927362 - RNA, 24 nt, Human
ucacugcaaccucugccucccggg

SEQ ID NO: 927363 - RNA, 25 nt, Human
ucacugcaaccucugccucccgggu

SEQ ID NO: 927364 - RNA, 23 nt, Human
ucagccucccgaguagcugggac

SEQ ID NO: 927365 - RNA, 24 nt, Human
ucccgaguagcugggacuacaggc

SEQ ID NO: 927366 - RNA, 21 nt, Human
ucccggguucaagcgauucuc

SEQ ID NO: 927367 - RNA, 24 nt, Human
ucccggguucaagcgauucuccug

SEQ ID NO: 927368 - RNA, 24 nt, Human
uccuaaagugcugggauuacaggc

SEQ ID NO: 927369 - RNA, 23 nt, Human
ucucacucugccaccaggcuaga

SEQ ID NO: 927370 - RNA, 24 nt, Human
ucuccugccucagccucccgagua

SEQ ID NO: 927371 - RNA, 21 nt, Human
ucuuucgcccuuuccccuugg

SEQ ID NO: 927372 - RNA, 23 nt, Human
ugaaauaguuuauuuuaaaggca

SEQ ID NO: 927373 - RNA, 22 nt, Human
ugaaggauacacauuuccacag

SEQ ID NO: 927374 - RNA, 22 nt, Human
ugaccuugugaucuucccgccu

SEQ ID NO: 927375 - RNA, 22 nt, Human
ugagauggagucucacucugcc

SEQ ID NO: 927376 - RNA, 25 nt, Human
ugaggaaagcugacuaauuacagua

SEQ ID NO: 927377 - RNA, 24 nt, Human
ugccucagccucccgaguagcugg

SEQ ID NO: 927378 - RNA, 23 nt, Human
ugccucagcuucccuaucucuga

SEQ ID NO: 927379 - RNA, 24 nt, Human
ugcugggauuacaggcgugaguca

SEQ ID NO: 927380 - RNA, 23 nt, Human
uggcaagucgcuuaagcagagau

SEQ ID NO: 927381 - RNA, 21 nt, Human
ugggacuacaggcacgcacca

SEQ ID NO: 927382 - RNA, 24 nt, Human
ugggacuacaggcacgcaccaccg

SEQ ID NO: 927383 - RNA, 18 nt, Human
ugggauuacaggcgugag

SEQ ID NO: 927384 - RNA, 18 nt, Human
ugggauuacaggcgugag

SEQ ID NO: 927385 - RNA, 21 nt, Human
ugggauuacaggcgugaguca

SEQ ID NO: 927386 - RNA, 22 nt, Human
ugggauuacaggcgugagucac

SEQ ID NO: 927387 - RNA, 22 nt, Human
ugggauuacaggcgugagucac

SEQ ID NO: 927388 - RNA, 24 nt, Human
ugggauuacaggcgugagucacug

SEQ ID NO: 927389 - RNA, 20 nt, Human
uguaacucaaauggcaaguc

SEQ ID NO: 927390 - RNA, 21 nt, Human
uguggauaacuaggagacagu

SEQ ID NO: 927391 - RNA, 24 nt, Human
uuaguagagacaggguuucaccau

SEQ ID NO: 927392 - RNA, 21 nt, Human
uucaagcgauucuccugccuc

SEQ ID NO: 927393 - RNA, 23 nt, Human
uucaagcgauucuccugccucag

SEQ ID NO: 927394 - RNA, 24 nt, Human
uucaagcgauucuccugccucagc

SEQ ID NO: 927395 - RNA, 18 nt, Human
uuggccuccuaaagugcu

SEQ ID NO: 927396 - RNA, 19 nt, Human
uuucaccauguuagccagg

SEQ ID NO: 927397 - RNA, 20 nt, Human
uuucaccauguuagccagga

SEQ ID NO: 927398 - RNA, 18 nt, Human
uuucccaauuucucuuuu

SEQ ID NO: 927399 - RNA, 20 nt, Human
uuugacgcugagguaggugc

SEQ ID NO: 927400 - RNA, 24 nt, Human
uuuuuaguagagacaggguuucac

SEQ ID NO: 927401 - RNA, 20 nt, Human
uuuuuguauuuuuaguagag

SEQ ID NO: 927402 - RNA, 26 nt, Human
uuuuuuuuuuuugagauggagucuca

SEQ ID NO: 927403 - RNA, 22 nt, Human
uuuuuuuuuuuuuugagaugga

SEQ ID NO: 927404 - RNA, 21 nt, Human
aaaaaucugggaagaugagua

SEQ ID NO: 927405 - RNA, 19 nt, Human
aaagugcugggauuacaug

SEQ ID NO: 927406 - RNA, 24 nt, Human
aaagugcugggauuacaugcguga

SEQ ID NO: 927407 - RNA, 22 nt, Human
aaauggaucuuaguagagaucu

SEQ ID NO: 927408 - RNA, 22 nt, Human
aaggauuaucacagaagcauca

SEQ ID NO: 927409 - RNA, 19 nt, Human
aagugcugggauuacaugc

SEQ ID NO: 927410 - RNA, 26 nt, Human
aagugcugggauuacaugcgugagcc

SEQ ID NO: 927411 - RNA, 18 nt, Human
aauagucucccggccucc

SEQ ID NO: 927412 - RNA, 20 nt, Human
acagaagcaucacaacaggc

SEQ ID NO: 927413 - RNA, 18 nt, Human
acaggguuucaccguguu

SEQ ID NO: 927414 - RNA, 23 nt, Human
acaggguuucaccguguuggcca

SEQ ID NO: 927415 - RNA, 24 nt, Human
acaggguuucaccguguuggccag

SEQ ID NO: 927416 - RNA, 24 nt, Human
accguguuggccaggauggucucg

SEQ ID NO: 927417 - RNA, 19 nt, Human
agauacaggguuucaccgu

SEQ ID NO: 927418 - RNA, 24 nt, Human
agugcugggauuacaugcgugagc

SEQ ID NO: 927419 - RNA, 20 nt, Human
auacaaggaaugugcccaca

SEQ ID NO: 927420 - RNA, 24 nt, Human
caaagugcugggauuacaugcgug

SEQ ID NO: 927421 - RNA, 18 nt, Human
caccguguuggccaggau

SEQ ID NO: 927422 - RNA, 21 nt, Human
caccguguuggccaggauggu

SEQ ID NO: 927423 - RNA, 24 nt, Human
caccguguuggccaggauggucuc

SEQ ID NO: 927424 - RNA, 19 nt, Human
cagagaacucucaaagcac

SEQ ID NO: 927425 - RNA, 24 nt, Human
caggguuucaccguguuggccagg

SEQ ID NO: 927426 - RNA, 20 nt, Human
ccaaagugcugggauuacau

SEQ ID NO: 927427 - RNA, 22 nt, Human
ccaaagugcugggauuacaugc

SEQ ID NO: 927428 - RNA, 24 nt, Human
ccaaagugcugggauuacaugcgu

SEQ ID NO: 927429 - RNA, 19 nt, Human
cccacaauaggguuggauu

SEQ ID NO: 927430 - RNA, 28 nt, Human
ccugaccucgugauccaccagccucggc

SEQ ID NO: 927431 - RNA, 25 nt, Human
cggccuccaacccccucuacauccc

SEQ ID NO: 927432 - RNA, 24 nt, Human
cgugauccaccagccucggccucc

SEQ ID NO: 927433 - RNA, 19 nt, Human
cucagaaaugaaagaaguc

SEQ ID NO: 927434 - RNA, 18 nt, Human
cuccugaccucgugaucc

SEQ ID NO: 927435 - RNA, 19 nt, Human
cucuguagcuccauugccc

SEQ ID NO: 927436 - RNA, 23 nt, Human
cuuuuucuuucguuuuccucuga

SEQ ID NO: 927437 - RNA, 19 nt, Human
gaccucgugauccaccagc

SEQ ID NO: 927438 - RNA, 22 nt, Human
gaccucgugauccaccagccuc

SEQ ID NO: 927439 - RNA, 22 nt, Human
gaccucgugauccaccagccuc

SEQ ID NO: 927440 - RNA, 24 nt, Human
gaccucgugauccaccagccucgg

SEQ ID NO: 927441 - RNA, 18 nt, Human
gauuacaugcgugagcca

SEQ ID NO: 927442 - RNA, 23 nt, Human
gcaaaaggauuaucacagaagca

SEQ ID NO: 927443 - RNA, 24 nt, Human
ggauggucucgaucuccugaccuc

SEQ ID NO: 927444 - RNA, 22 nt, Human
ggguuucaccguguuggccagg

SEQ ID NO: 927445 - RNA, 18 nt, Human
gugagccaccgcgccaag

SEQ ID NO: 927446 - RNA, 24 nt, Human
gugauccaccagccucggccuccc

SEQ ID NO: 927447 - RNA, 20 nt, Human
uaaaaguaggcaggaggacu

SEQ ID NO: 927448 - RNA, 20 nt, Human
uagcucauaaaauaugggga

SEQ ID NO: 927449 - RNA, 21 nt, Human
uaguagauacaggguuucacc

SEQ ID NO: 927450 - RNA, 24 nt, Human
uaguagauacaggguuucaccgug

SEQ ID NO: 927451 - RNA, 23 nt, Human
uauggaauagggccuaauuuuaa

SEQ ID NO: 927452 - RNA, 18 nt, Human
uauuuguuaauuuuuuaa

SEQ ID NO: 927453 - RNA, 19 nt, Human
uauuuuacuucucccccaa

SEQ ID NO: 927454 - RNA, 21 nt, Human
ucaaagauaaacauaucagga

SEQ ID NO: 927455 - RNA, 24 nt, Human
ucaccguguuggccaggauggucu

SEQ ID NO: 927456 - RNA, 18 nt, Human
ucccaaagugcugggauu

SEQ ID NO: 927457 - RNA, 24 nt, Human
ucccaaagugcugggauuacaugc

SEQ ID NO: 927458 - RNA, 18 nt, Human
ucggccucccaaagugcu

SEQ ID NO: 927459 - RNA, 20 nt, Human
ugaaagaagucuauugaugu

SEQ ID NO: 927460 - RNA, 23 nt, Human
ugcgugagccaccgcgccaagcc

SEQ ID NO: 927461 - RNA, 24 nt, Human
ugcugggauuacaugcgugagcca

SEQ ID NO: 927462 - RNA, 24 nt, Human
uggccaggauggucucgaucuccu

SEQ ID NO: 927463 - RNA, 19 nt, Human
ugggauuacaugcgugagc

SEQ ID NO: 927464 - RNA, 22 nt, Human
ugggauuacaugcgugagccac

SEQ ID NO: 927465 - RNA, 23 nt, Human
ugggauuacaugcgugagccacc

SEQ ID NO: 927466 - RNA, 24 nt, Human
ugggauuacaugcgugagccaccg

SEQ ID NO: 927467 - RNA, 21 nt, Human
uguagcaguacagaagauggg

SEQ ID NO: 927468 - RNA, 23 nt, Human
uguagcaguacagaagaugggcu

SEQ ID NO: 927469 - RNA, 19 nt, Human
uuaaaagucuucaaagcuu

SEQ ID NO: 927470 - RNA, 22 nt, Human
uuaguagauacaggguuucacc

SEQ ID NO: 927471 - RNA, 24 nt, Human
uuaguagauacaggguuucaccgu

SEQ ID NO: 927472 - RNA, 20 nt, Human
uucaauaugucuugugucag

SEQ ID NO: 927473 - RNA, 23 nt, Human
uucucccccaaaacguuuuuaaa

SEQ ID NO: 927474 - RNA, 19 nt, Human
uuucaccguguuggccagg

SEQ ID NO: 927475 - RNA, 24 nt, Human
uuuuuaguagauacaggguuucac

SEQ ID NO: 927476 - RNA, 22 nt, Human
uuuuuuguguuuuuaguagaua

SEQ ID NO: 927477 - RNA, 23 nt, Human
aaaaaaaaaaaaaaagcacauag

SEQ ID NO: 927478 - RNA, 20 nt, Human
aaaaaaaaaaagcacauaga

SEQ ID NO: 927479 - RNA, 23 nt, Human
aaaaaaaaaaagcacauagaugg

SEQ ID NO: 927480 - RNA, 27 nt, Human
aaaaaacaaaaaccaaacccuauguac

SEQ ID NO: 927481 - RNA, 18 nt, Human
aaaacaaaaaccaaaccc

SEQ ID NO: 927482 - RNA, 18 nt, Human
aaacauguagagacacau

SEQ ID NO: 927483 - RNA, 24 nt, Human
aaacauguagagacacaugcuccu

SEQ ID NO: 927484 - RNA, 23 nt, Human
aaauuacccugcuaaauaaaagc

SEQ ID NO: 927485 - RNA, 24 nt, Human
aacauaccuauaaauaaagcagaa

SEQ ID NO: 927486 - RNA, 20 nt, Human
aagagugugggucccugagc

SEQ ID NO: 927487 - RNA, 18 nt, Human
aagccagucacccuaaug

SEQ ID NO: 927488 - RNA, 22 nt, Human
aaucucuuuagaagaauaacaa

SEQ ID NO: 927489 - RNA, 20 nt, Human
aaugaagaauaaaauugucu

SEQ ID NO: 927490 - RNA, 24 nt, Human
aauucaugucuuuguuuucuuccu

SEQ ID NO: 927491 - RNA, 21 nt, Human
acaaauccaaugugaacacca

SEQ ID NO: 927492 - RNA, 20 nt, Human
acaauagggguggggaaaga

SEQ ID NO: 927493 - RNA, 18 nt, Human
accagaagucugcauaug

SEQ ID NO: 927494 - RNA, 23 nt, Human
accagaagucugcauaugauggg

SEQ ID NO: 927495 - RNA, 21 nt, Human
acuaacauguaccugagacag

SEQ ID NO: 927496 - RNA, 22 nt, Human
acuuccaggaaaugaaaagaag

SEQ ID NO: 927497 - RNA, 22 nt, Human
acuuuaagagugaggugaggaa

SEQ ID NO: 927498 - RNA, 19 nt, Human
agacacaugcuccucagua

SEQ ID NO: 927499 - RNA, 26 nt, Human
agagacacaugcuccucaguagaccc

SEQ ID NO: 927500 - RNA, 20 nt, Human
agauguugggagcuucaacu

SEQ ID NO: 927501 - RNA, 20 nt, Human
agccagugacaacuacuguc

SEQ ID NO: 927502 - RNA, 18 nt, Human
agggaagagccagugaca

SEQ ID NO: 927503 - RNA, 26 nt, Human
aguugagagucacauacagcugagau

SEQ ID NO: 927504 - RNA, 25 nt, Human
auaaagcagaauguaauauuuaccu

SEQ ID NO: 927505 - RNA, 23 nt, Human
auagcccagaguaaggauauucc

SEQ ID NO: 927506 - RNA, 24 nt, Human
aucucaucucuuacacauccccaa

SEQ ID NO: 927507 - RNA, 26 nt, Human
caaaaaccaaacccuauguacuucca

SEQ ID NO: 927508 - RNA, 21 nt, Human
caaaguaaaaggagcaagcca

SEQ ID NO: 927509 - RNA, 20 nt, Human
caauacagcauaaugacauu

SEQ ID NO: 927510 - RNA, 18 nt, Human
cacacaggacuauguggg

SEQ ID NO: 927511 - RNA, 18 nt, Human
cacauacagcugagauga

SEQ ID NO: 927512 - RNA, 20 nt, Human
cagaauagcuguaagaaagc

SEQ ID NO: 927513 - RNA, 21 nt, Human
cauguaaaaaaaaaaaacaaa

SEQ ID NO: 927514 - RNA, 23 nt, Human
cauguaaaaaaaaaaaacaaaaa

SEQ ID NO: 927515 - RNA, 20 nt, Human
cauguagagacacaugcucc

SEQ ID NO: 927516 - RNA, 20 nt, Human
cauuccuuuuuuuaccacuu

SEQ ID NO: 927517 - RNA, 20 nt, Human
ccagaagucugcauaugaug

SEQ ID NO: 927518 - RNA, 18 nt, Human
cccacagaauucugagcc

SEQ ID NO: 927519 - RNA, 19 nt, Human
cccacagaauucugagcca

SEQ ID NO: 927520 - RNA, 19 nt, Human
cccacuuuaagagugaggu

SEQ ID NO: 927521 - RNA, 24 nt, Human
ccuucuaugccuuugcuuuucuca

SEQ ID NO: 927522 - RNA, 25 nt, Human
cugaaaaucccaaaccacuguugcu

SEQ ID NO: 927523 - RNA, 22 nt, Human
cuggaagggauauccuagauua

SEQ ID NO: 927524 - RNA, 18 nt, Human
cuuaaaaaaaaaaaaaaa

SEQ ID NO: 927525 - RNA, 24 nt, Human
cuuaaaaaaaaaaaaaaagcacau

SEQ ID NO: 927526 - RNA, 18 nt, Human
cuucuuguaaguugagag

SEQ ID NO: 927527 - RNA, 21 nt, Human
gagcccgucuuagaccauccg

SEQ ID NO: 927528 - RNA, 22 nt, Human
gaggcucuccuaguccaacuaa

SEQ ID NO: 927529 - RNA, 22 nt, Human
ggcagaggggcaaggaaacucc

SEQ ID NO: 927530 - RNA, 18 nt, Human
guaaggauauuccuaggu

SEQ ID NO: 927531 - RNA, 30 nt, Human
uaaaaaaaaaaaacaaaaaccaaacccuag

SEQ ID NO: 927532 - RNA, 21 nt, Human
uaaaaggagcaagccagucac

SEQ ID NO: 927533 - RNA, 23 nt, Human
uaaaagggcacuacuuaugaaca

SEQ ID NO: 927534 - RNA, 20 nt, Human
uaaaauugucuuaaaaaaaa

SEQ ID NO: 927535 - RNA, 21 nt, Human
uaaauaaagcagaauguaaua

SEQ ID NO: 927536 - RNA, 23 nt, Human
uaaauaaauagauauacacacaa

SEQ ID NO: 927537 - RNA, 23 nt, Human
uaaaugagccuuucccuggcuac

SEQ ID NO: 927538 - RNA, 21 nt, Human
uaacauguaccugagacaguu

SEQ ID NO: 927539 - RNA, 19 nt, Human
uaagaaagcugaagcugug

SEQ ID NO: 927540 - RNA, 20 nt, Human
uaagaaagcugaagcugugg

SEQ ID NO: 927541 - RNA, 22 nt, Human
uaagcuaaaagggcacuacuua

SEQ ID NO: 927542 - RNA, 18 nt, Human
uaaucugugaacauaccu

SEQ ID NO: 927543 - RNA, 22 nt, Human
uaaugcaugcccauuauguaug

SEQ ID NO: 927544 - RNA, 26 nt, Human
uacauuaucuugguauucuggaaggg

SEQ ID NO: 927545 - RNA, 22 nt, Human
uacccugaaaaucccaaaccac

SEQ ID NO: 927546 - RNA, 18 nt, Human
uaccugagacaguugggc

SEQ ID NO: 927547 - RNA, 19 nt, Human
uacugugguaguacaugaa

SEQ ID NO: 927548 - RNA, 27 nt, Human
uacuuccaggaaaugaaaagaaguaaa

SEQ ID NO: 927549 - RNA, 20 nt, Human
uagaaauccuguuuauguau

SEQ ID NO: 927550 - RNA, 23 nt, Human
uaguccaacuaaccaacagccaa

SEQ ID NO: 927551 - RNA, 21 nt, Human
uaucaugaaauucaugucuuu

SEQ ID NO: 927552 - RNA, 21 nt, Human
uccacacaggacuaugugggc

SEQ ID NO: 927553 - RNA, 20 nt, Human
ucccaaucucaucucuuaca

SEQ ID NO: 927554 - RNA, 18 nt, Human
ucccugagccagguuucc

SEQ ID NO: 927555 - RNA, 23 nt, Human
uccucaguagaccagaagucugc

SEQ ID NO: 927556 - RNA, 19 nt, Human
uccucuagauacuuaauua

SEQ ID NO: 927557 - RNA, 19 nt, Human
ugaaaagaaguaaagaacc

SEQ ID NO: 927558 - RNA, 21 nt, Human
ugaaaagaaguaaagaaccaa

SEQ ID NO: 927559 - RNA, 23 nt, Human
ugagaauguugaugcuacuaucc

SEQ ID NO: 927560 - RNA, 21 nt, Human
ugagacaguugggcacaaagu

SEQ ID NO: 927561 - RNA, 26 nt, Human
ugagggcagagaaauucuccccgagg

SEQ ID NO: 927562 - RNA, 21 nt, Human
ugaggugaggaagcuagaaug

SEQ ID NO: 927563 - RNA, 21 nt, Human
ugccaagagaaacaaugaagu

SEQ ID NO: 927564 - RNA, 24 nt, Human
uggcagaggggcaaggaaacucca

SEQ ID NO: 927565 - RNA, 23 nt, Human
ugguacccugaaaaucccaaacc

SEQ ID NO: 927566 - RNA, 18 nt, Human
uggucuagcuucuuguaa

SEQ ID NO: 927567 - RNA, 23 nt, Human
uguaaaaaaaaaaaacaaaaacc

SEQ ID NO: 927568 - RNA, 23 nt, Human
uguaagaaagcugaagcuguggg

SEQ ID NO: 927569 - RNA, 19 nt, Human
ugucacacaucauuguuca

SEQ ID NO: 927570 - RNA, 18 nt, Human
ugucuuuguuuucuuccu

SEQ ID NO: 927571 - RNA, 23 nt, Human
uguugggagcuucaacucucacg

SEQ ID NO: 927572 - RNA, 23 nt, Human
uguuuucuuccucuagauacuua

SEQ ID NO: 927573 - RNA, 23 nt, Human
uucaacucucacguucuuggaau

SEQ ID NO: 927574 - RNA, 24 nt, Human
uucaucauguaaaaaaaaaaaaca

SEQ ID NO: 927575 - RNA, 23 nt, Human
uucaugucuuuguuuucuuccuc

SEQ ID NO: 927576 - RNA, 27 nt, Human
uucccaaucucaucucuuacacauccc

SEQ ID NO: 927577 - RNA, 20 nt, Human
uuccuagguguucaagaaaa

SEQ ID NO: 927578 - RNA, 21 nt, Human
uugggcacaaaguaaaaggag

SEQ ID NO: 927579 - RNA, 20 nt, Human
uuuagccuccauccaaguuu

SEQ ID NO: 927580 - RNA, 21 nt, Human
uuucaggucauuccuuuuuuu

SEQ ID NO: 927581 - RNA, 25 nt, Human
uuugcuuuucucaaauaaaugagcc

SEQ ID NO: 927582 - RNA, 24 nt, Human
uuugguacccugaaaaucccaaac

SEQ ID NO: 927583 - RNA, 19 nt, Human
uuugucuuaggcaauacag

SEQ ID NO: 927584 - RNA, 18 nt, Human
uuuuuuuuuuuuuuuuug

SEQ ID NO: 927585 - RNA, 20 nt, Human
uuuuuuuuuuuuuuuuuggu

SEQ ID NO: 927586 - RNA, 22 nt, Human
aagccaaagauaguuuagacac

SEQ ID NO: 927587 - RNA, 23 nt, Human
aaugaccauuugaacugaaaaag

SEQ ID NO: 927588 - RNA, 24 nt, Human
agacaacuauuuuacuuuacaaaa

SEQ ID NO: 927589 - RNA, 22 nt, Human
agccagugggggaguggcuggc

SEQ ID NO: 927590 - RNA, 22 nt, Human
aguucuguggagcgucacaggg

SEQ ID NO: 927591 - RNA, 19 nt, Human
aucacagcucuuugaggca

SEQ ID NO: 927592 - RNA, 23 nt, Human
auucucauauaaauaacagcuac

SEQ ID NO: 927593 - RNA, 24 nt, Human
caaaagacugcuuuaucuaaccau

SEQ ID NO: 927594 - RNA, 18 nt, Human
caguccccugccuagccu

SEQ ID NO: 927595 - RNA, 19 nt, Human
caguccccugccuagccuc

SEQ ID NO: 927596 - RNA, 18 nt, Human
cauugcacgugaaugucc

SEQ ID NO: 927597 - RNA, 22 nt, Human
ccacuggguucuaaaggggaag

SEQ ID NO: 927598 - RNA, 19 nt, Human
cccgccugcugucccuacc

SEQ ID NO: 927599 - RNA, 19 nt, Human
cuagagagcaaaagacugc

SEQ ID NO: 927600 - RNA, 20 nt, Human
cucgcaguccccugccuagc

SEQ ID NO: 927601 - RNA, 18 nt, Human
cugcaggacuagcccgga

SEQ ID NO: 927602 - RNA, 20 nt, Human
cuggcucggugccugacccc

SEQ ID NO: 927603 - RNA, 19 nt, Human
cuuccagugagccuuucug

SEQ ID NO: 927604 - RNA, 19 nt, Human
gaaaauguggauucagaua

SEQ ID NO: 927605 - RNA, 19 nt, Human
gacaccuucugccuuuuag

SEQ ID NO: 927606 - RNA, 18 nt, Human
gauuuuuuuuuuuuuuuu

SEQ ID NO: 927607 - RNA, 23 nt, Human
gcaaaagacugcuuuaucuaacc

SEQ ID NO: 927608 - RNA, 22 nt, Human
gccaaaagaaaaaaauuggauc

SEQ ID NO: 927609 - RNA, 21 nt, Human
ggguucuaaaggggaagccaa

SEQ ID NO: 927610 - RNA, 21 nt, Human
gguacucgcaguccccugccu

SEQ ID NO: 927611 - RNA, 19 nt, Human
gugcuuuuuaacuuggcau

SEQ ID NO: 927612 - RNA, 19 nt, Human
guugcacuucuugucuguu

SEQ ID NO: 927613 - RNA, 20 nt, Human
uaaaagcaaauaaugaccau

SEQ ID NO: 927614 - RNA, 21 nt, Human
uaaauaacagcuaccucuuuu

SEQ ID NO: 927615 - RNA, 26 nt, Human
uaaaugaauauuuucaaaagucagaa

SEQ ID NO: 927616 - RNA, 21 nt, Human
uaacagcuaccucuuuuuugc

SEQ ID NO: 927617 - RNA, 20 nt, Human
uaacuuggcauugcacguga

SEQ ID NO: 927618 - RNA, 21 nt, Human
uaaggagguuccuaagacauu

SEQ ID NO: 927619 - RNA, 18 nt, Human
uaauuacucugguucaag

SEQ ID NO: 927620 - RNA, 26 nt, Human
uagaauucucauauaaauaacagcua

SEQ ID NO: 927621 - RNA, 20 nt, Human
ucagguugcacuucuugucu

SEQ ID NO: 927622 - RNA, 19 nt, Human
uccacauaggcuagagagc

SEQ ID NO: 927623 - RNA, 21 nt, Human
uccccgccugcugucccuacc

SEQ ID NO: 927624 - RNA, 22 nt, Human
ucuguguggcugcaggacuagc

SEQ ID NO: 927625 - RNA, 18 nt, Human
ucuuugaggcacucagcu

SEQ ID NO: 927626 - RNA, 24 nt, Human
ugaggcacucagcuccuuugaaag

SEQ ID NO: 927627 - RNA, 18 nt, Human
uggagcgucacagggcgg

SEQ ID NO: 927628 - RNA, 18 nt, Human
ugggggaguggcuggcca

SEQ ID NO: 927629 - RNA, 21 nt, Human
uggguucuaaaggggaagcca

SEQ ID NO: 927630 - RNA, 21 nt, Human
ugguaggugcauaauacccuc

SEQ ID NO: 927631 - RNA, 22 nt, Human
ugugccugagaguuucucgucg

SEQ ID NO: 927632 - RNA, 21 nt, Human
ugugccugagaguuucucgug

SEQ ID NO: 927633 - RNA, 23 nt, Human
uguguguauuuagucugaauaau

SEQ ID NO: 927634 - RNA, 24 nt, Human
uguuaagaucucuguucuggauga

SEQ ID NO: 927635 - RNA, 18 nt, Human
uucuguggagcgucacag

SEQ ID NO: 927636 - RNA, 18 nt, Human
uugaaaccauuauuggca

SEQ ID NO: 927637 - RNA, 21 nt, Human
uuguaacuaccaaccuggcuc

SEQ ID NO: 927638 - RNA, 23 nt, Human
uuuacuagaaucuuuugaaacca

SEQ ID NO: 927639 - RNA, 20 nt, Human
uuuuaaaaauuuccucaucu

SEQ ID NO: 927640 - RNA, 18 nt, Human
aacacggcggcuccgucu

SEQ ID NO: 927641 - RNA, 18 nt, Human
acaaggcauucacacuac

SEQ ID NO: 927642 - RNA, 23 nt, Human
accaaguucucauuccacauucc

SEQ ID NO: 927643 - RNA, 25 nt, Human
agaaugacaggcacgaaacaugagg

SEQ ID NO: 927644 - RNA, 24 nt, Human
augggcccacacccaggcgcugcc

SEQ ID NO: 927645 - RNA, 22 nt, Human
caaaaugggcccacacccaggc

SEQ ID NO: 927646 - RNA, 19 nt, Human
cagcaggaagggaagagag

SEQ ID NO: 927647 - RNA, 22 nt, Human
cccacacccaggcgcugccaac

SEQ ID NO: 927648 - RNA, 19 nt, Human
ccccaaaaugggcccacac

SEQ ID NO: 927649 - RNA, 19 nt, Human
gaccacagcuugcuguuug

SEQ ID NO: 927650 - RNA, 19 nt, Human
gggaagagagauggagauc

SEQ ID NO: 927651 - RNA, 21 nt, Human
uacauacauguagcuuaucac

SEQ ID NO: 927652 - RNA, 21 nt, Human
uacauguagcuuaucacauac

SEQ ID NO: 927653 - RNA, 25 nt, Human
uauugcaacauuuacauacauguag

SEQ ID NO: 927654 - RNA, 21 nt, Human
uccacauuccuuucccacacu

SEQ ID NO: 927655 - RNA, 22 nt, Human
uccaucccaugggggugcacgu

SEQ ID NO: 927656 - RNA, 18 nt, Human
uccccaaaaugggcccac

SEQ ID NO: 927657 - RNA, 18 nt, Human
ugcugggaggacucccac

SEQ ID NO: 927658 - RNA, 20 nt, Human
uuccacauuccuuucccaca

SEQ ID NO: 927659 - RNA, 24 nt, Human
uugcuguuugguccccaaaauggg

SEQ ID NO: 927660 - RNA, 21 nt, Human
uuuuuuuuuuuuuuuuccauu

SEQ ID NO: 927661 - RNA, 24 nt, Human
aaaaacaccaccaaaacuggagac

SEQ ID NO: 927662 - RNA, 20 nt, Human
aaaaauagaaagcuaagaac

SEQ ID NO: 927663 - RNA, 18 nt, Human
aaaacaaaaacaccacca

SEQ ID NO: 927664 - RNA, 20 nt, Human
aaaacaaaaacaccaccaaa

SEQ ID NO: 927665 - RNA, 23 nt, Human
aaaacaccaccaaaacccacucc

SEQ ID NO: 927666 - RNA, 24 nt, Human
aaaacagaauaaaacaaaaacacc

SEQ ID NO: 927667 - RNA, 24 nt, Human
aaacaaaaacaccaccaaaaccca

SEQ ID NO: 927668 - RNA, 20 nt, Human
aaacaccaccaaaacccacu

SEQ ID NO: 927669 - RNA, 21 nt, Human
aacaccaccaaaacccacucu

SEQ ID NO: 927670 - RNA, 23 nt, Human
aacagaugggauaaaaauucaaa

SEQ ID NO: 927671 - RNA, 19 nt, Human
aacauuguggauauaugcu

SEQ ID NO: 927672 - RNA, 21 nt, Human
aagaaaagaaaguacccaaac

SEQ ID NO: 927673 - RNA, 22 nt, Human
acaccaccaaaacccacuccaa

SEQ ID NO: 927674 - RNA, 21 nt, Human
acagaguauacaggaauucuu

SEQ ID NO: 927675 - RNA, 25 nt, Human
agaaaacagaauaaaacaaaaacac

SEQ ID NO: 927676 - RNA, 28 nt, Human
agaaaacagaauaaaacaaaaacaccac

SEQ ID NO: 927677 - RNA, 26 nt, Human
agaaaagaaaguacccaaacaaagaa

SEQ ID NO: 927678 - RNA, 28 nt, Human
agaaaagaaaguacccaaacaaagaaaa

SEQ ID NO: 927679 - RNA, 26 nt, Human
agaauaaaacaaaaacaccaccaaaa

SEQ ID NO: 927680 - RNA, 21 nt, Human
agacuguuaagccuaugaaaa

SEQ ID NO: 927681 - RNA, 23 nt, Human
agaguagcuuguugcccaaagaa

SEQ ID NO: 927682 - RNA, 23 nt, Human
aggcugccaugagaaauaaccaa

SEQ ID NO: 927683 - RNA, 21 nt, Human
agguaggcucuguucuuguga

SEQ ID NO: 927684 - RNA, 23 nt, Human
aguggaaggcugccaugagaaau

SEQ ID NO: 927685 - RNA, 19 nt, Human
auaaaacaaaaacaccacc

SEQ ID NO: 927686 - RNA, 22 nt, Human
auuauuuccagaguagcuuguu

SEQ ID NO: 927687 - RNA, 18 nt, Human
caaaaaaaacccaguaac

SEQ ID NO: 927688 - RNA, 21 nt, Human
caccaccaaaacccacuccaa

SEQ ID NO: 927689 - RNA, 26 nt, Human
cacuucuaauuugauagagccaagaa

SEQ ID NO: 927690 - RNA, 26 nt, Human
cagaacuuauuaaagcacucaauaaa

SEQ ID NO: 927691 - RNA, 22 nt, Human
cauagggaaaauuauuauuucc

SEQ ID NO: 927692 - RNA, 23 nt, Human
caucuugguuuuaaaagucuucc

SEQ ID NO: 927693 - RNA, 26 nt, Human
cauguaacaguuaagaaaacagaaua

SEQ ID NO: 927694 - RNA, 26 nt, Human
ccaaaacccacuccaauacauuauac

SEQ ID NO: 927695 - RNA, 25 nt, Human
ccaauaaagcaguggugaagcucuu

SEQ ID NO: 927696 - RNA, 23 nt, Human
ccccuaaacagaugggauaaaaa

SEQ ID NO: 927697 - RNA, 23 nt, Human
cggcaggaagaaaagaaaguacc

SEQ ID NO: 927698 - RNA, 27 nt, Human
cggcaggaagaaaagaaaguacccaaa

SEQ ID NO: 927699 - RNA, 28 nt, Human
cggcaggaagaaaagaaaguacccaaac

SEQ ID NO: 927700 - RNA, 21 nt, Human
cucaagcacuucuaauuugau

SEQ ID NO: 927701 - RNA, 24 nt, Human
cuccccaucuugguuuuaaaaguc

SEQ ID NO: 927702 - RNA, 22 nt, Human
cuucacaggaauaaaguaacaa

SEQ ID NO: 927703 - RNA, 24 nt, Human
cuucuccccaucuugguuuuaaaa

SEQ ID NO: 927704 - RNA, 23 nt, Human
cuuuuguaaacucaaguugaaaa

SEQ ID NO: 927705 - RNA, 21 nt, Human
gaaaagugacaaaaaaaaccc

SEQ ID NO: 927706 - RNA, 22 nt, Human
gaaaguacccaaacaaagaaaa

SEQ ID NO: 927707 - RNA, 22 nt, Human
gaaggaaaaugaaauugaaagu

SEQ ID NO: 927708 - RNA, 20 nt, Human
gcuguuuucuucuccccauc

SEQ ID NO: 927709 - RNA, 23 nt, Human
gggauaaaaauucaaaagaagga

SEQ ID NO: 927710 - RNA, 24 nt, Human
gucacaucucaagcacuucuaauu

SEQ ID NO: 927711 - RNA, 19 nt, Human
uaaaacaaaaacaccacca

SEQ ID NO: 927712 - RNA, 24 nt, Human
uaaaacaaaaacaccaccaaaacc

SEQ ID NO: 927713 - RNA, 23 nt, Human
uaaaauccccuaaacagauggga

SEQ ID NO: 927714 - RNA, 25 nt, Human
uaagaaaacagaauaaaacaaaaac

SEQ ID NO: 927715 - RNA, 18 nt, Human
uaagccuaugaaaacaga

SEQ ID NO: 927716 - RNA, 19 nt, Human
uagaaagcuaagaacggca

SEQ ID NO: 927717 - RNA, 27 nt, Human
ucaauaguaaucacagguaggcucuuu

SEQ ID NO: 927718 - RNA, 21 nt, Human
ucaugucacaucucaagcacu

SEQ ID NO: 927719 - RNA, 18 nt, Human
ucauuugucauuucauuu

SEQ ID NO: 927720 - RNA, 21 nt, Human
uccccuaaacagaugggauaa

SEQ ID NO: 927721 - RNA, 22 nt, Human
uccccuaaacagaugggauaaa

SEQ ID NO: 927722 - RNA, 22 nt, Human
uccccuaaacagaugggauaaa

SEQ ID NO: 927723 - RNA, 20 nt, Human
uccuacaaaagucugcaaaa

SEQ ID NO: 927724 - RNA, 22 nt, Human
ucuaaggaaugccucacaagaa

SEQ ID NO: 927725 - RNA, 19 nt, Human
ugaaaaauagaaagcuaag

SEQ ID NO: 927726 - RNA, 23 nt, Human
ugacaaaaaaaacccaguaacau

SEQ ID NO: 927727 - RNA, 26 nt, Human
ugccaugagaaauaaccaacauaggg

SEQ ID NO: 927728 - RNA, 19 nt, Human
ugcuguuuucuucucccca

SEQ ID NO: 927729 - RNA, 18 nt, Human
uggaaggcugccaugaga

SEQ ID NO: 927730 - RNA, 25 nt, Human
uguaacaguuaagaaaacagaauaa

SEQ ID NO: 927731 - RNA, 20 nt, Human
uguccccaauuaugaugauc

SEQ ID NO: 927732 - RNA, 18 nt, Human
uucaaaagaaggaaaaug

SEQ ID NO: 927733 - RNA, 19 nt, Human
uugguuaaaugaacauugu

SEQ ID NO: 927734 - RNA, 21 nt, Human
uuuaaaauccccuaaacagau

SEQ ID NO: 927735 - RNA, 24 nt, Human
uuuaaauuugaaggcucuccuaaa

SEQ ID NO: 927736 - RNA, 23 nt, Human
uuuauuugcaggugauuucuuuc

SEQ ID NO: 927737 - RNA, 18 nt, Human
uuuugguuacauuuucuu

SEQ ID NO: 927738 - RNA, 19 nt, Human
aaaaaaguguggaacuaag

SEQ ID NO: 927739 - RNA, 22 nt, Human
aagcaugaagagaaaagacaac

SEQ ID NO: 927740 - RNA, 21 nt, Human
acaaacaaaauuuaaccuuca

SEQ ID NO: 927741 - RNA, 20 nt, Human
acaaccaacuauccaaaacc

SEQ ID NO: 927742 - RNA, 22 nt, Human
acaggauccugauucaguauca

SEQ ID NO: 927743 - RNA, 23 nt, Human
accucaccaucacucgagugucc

SEQ ID NO: 927744 - RNA, 24 nt, Human
acgauaaauugaaaacuggugagg

SEQ ID NO: 927745 - RNA, 22 nt, Human
acuuuaagaggacaaggaggga

SEQ ID NO: 927746 - RNA, 22 nt, Human
agaaguugugugucuguaagaa

SEQ ID NO: 927747 - RNA, 24 nt, Human
agacuggucaacaugaugaaaccu

SEQ ID NO: 927748 - RNA, 22 nt, Human
agauaaggaagcaugaagagaa

SEQ ID NO: 927749 - RNA, 24 nt, Human
agcaaauauaccuuuucuauucuc

SEQ ID NO: 927750 - RNA, 23 nt, Human
aggagggaggauugcuugagccc

SEQ ID NO: 927751 - RNA, 23 nt, Human
agggaggauugcuugagcccagg

SEQ ID NO: 927752 - RNA, 18 nt, Human
auugcuugagcccagggg

SEQ ID NO: 927753 - RNA, 21 nt, Human
auugcuugagcccagggguuc

SEQ ID NO: 927754 - RNA, 19 nt, Human
caacaugaugaaaccugau

SEQ ID NO: 927755 - RNA, 22 nt, Human
caaccaacuauccaaaaccaga

SEQ ID NO: 927756 - RNA, 22 nt, Human
caagcgcagugacucgcaccca

SEQ ID NO: 927757 - RNA, 23 nt, Human
caagugauuuacauuuacacaga

SEQ ID NO: 927758 - RNA, 24 nt, Human
caccucaccaucacucgagugucc

SEQ ID NO: 927759 - RNA, 21 nt, Human
caggauccugauucaguauca

SEQ ID NO: 927760 - RNA, 21 nt, Human
ccaaaaccagacaaaagccaa

SEQ ID NO: 927761 - RNA, 24 nt, Human
ccaacuauccaaaaccagacaaaa

SEQ ID NO: 927762 - RNA, 22 nt, Human
ccagaccagacuggucaacaug

SEQ ID NO: 927763 - RNA, 18 nt, Human
cccauaauuucaacacuu

SEQ ID NO: 927764 - RNA, 20 nt, Human
cgcacccauaauuucaacac

SEQ ID NO: 927765 - RNA, 22 nt, Human
cucaccaucacucgaguguccu

SEQ ID NO: 927766 - RNA, 21 nt, Human
cuggugaggcauaaaauuuca

SEQ ID NO: 927767 - RNA, 21 nt, Human
cuugagcccagggguuccaga

SEQ ID NO: 927768 - RNA, 19 nt, Human
gaagauguuagacaagauc

SEQ ID NO: 927769 - RNA, 23 nt, Human
gaagauguuagacaagaucagug

SEQ ID NO: 927770 - RNA, 19 nt, Human
gagucuuggaagggaugca

SEQ ID NO: 927771 - RNA, 24 nt, Human
ggagauaaggaagcaugaagagaa

SEQ ID NO: 927772 - RNA, 22 nt, Human
ggccaggugaagaaauuuggaa

SEQ ID NO: 927773 - RNA, 23 nt, Human
gggaagauguuagacaagaucag

SEQ ID NO: 927774 - RNA, 18 nt, Human
ggugauaugguagaaagg

SEQ ID NO: 927775 - RNA, 18 nt, Human
uaaaugguauaccuaaga

SEQ ID NO: 927776 - RNA, 22 nt, Human
uaauagagcuagaauggccaag

SEQ ID NO: 927777 - RNA, 24 nt, Human
uaauuagaaaugugaaauuggcuu

SEQ ID NO: 927778 - RNA, 23 nt, Human
uacaaacaaaauuuaaccuucaa

SEQ ID NO: 927779 - RNA, 21 nt, Human
uagaaaugugaaauuggcuua

SEQ ID NO: 927780 - RNA, 27 nt, Human
uagcagggaaguggagguagaagaaga

SEQ ID NO: 927781 - RNA, 19 nt, Human
uauccaaaaccagacaaaa

SEQ ID NO: 927782 - RNA, 21 nt, Human
uauccaaaaccagacaaaagc

SEQ ID NO: 927783 - RNA, 27 nt, Human
uccaaaaccagacaaaagccaaagcaa

SEQ ID NO: 927784 - RNA, 18 nt, Human
uccucuugccuucucaaa

SEQ ID NO: 927785 - RNA, 22 nt, Human
uccuuuguuuucaagcauaugu

SEQ ID NO: 927786 - RNA, 22 nt, Human
ucuggcagcugugaggagcaag

SEQ ID NO: 927787 - RNA, 24 nt, Human
ugaaugaauucagcucauuuguga

SEQ ID NO: 927788 - RNA, 23 nt, Human
ugagcccagggguuccagaccag

SEQ ID NO: 927789 - RNA, 24 nt, Human
ugaggggcuugagaaguagcaggg

SEQ ID NO: 927790 - RNA, 21 nt, Human
uggaugacauaggagcuucug

SEQ ID NO: 927791 - RNA, 18 nt, Human
uggcagcugugaggagca

SEQ ID NO: 927792 - RNA, 23 nt, Human
uggcagcugugaggagcaaggau

SEQ ID NO: 927793 - RNA, 21 nt, Human
uggccaagugauuuacauuua

SEQ ID NO: 927794 - RNA, 23 nt, Human
ugggaguauauggaugacuuagu

SEQ ID NO: 927795 - RNA, 22 nt, Human
ugucucugggaaacuauaaauu

SEQ ID NO: 927796 - RNA, 19 nt, Human
uuacugaauaacuaaagug

SEQ ID NO: 927797 - RNA, 19 nt, Human
uuccaugaauuaacagagg

SEQ ID NO: 927798 - RNA, 22 nt, Human
uugaggggcuugagaaguagca

SEQ ID NO: 927799 - RNA, 23 nt, Human
uugcuugagcccagggguuccag

SEQ ID NO: 927800 - RNA, 25 nt, Human
uugggaguucagaauauccauguaa

SEQ ID NO: 927801 - RNA, 24 nt, Human
uuuucuauucucugugaugccuua

SEQ ID NO: 927802 - RNA, 21 nt, Human
aacaaaaacacuuagaaagga

SEQ ID NO: 927803 - RNA, 18 nt, Human
aagcaggaggauugcuug

SEQ ID NO: 927804 - RNA, 24 nt, Human
aagcaggaggauugcuugggccca

SEQ ID NO: 927805 - RNA, 26 nt, Human
acaaaacaaaacaaaaacacuuagaa

SEQ ID NO: 927806 - RNA, 27 nt, Human
acaaaacaaaacaaaaacacuuagaaa

SEQ ID NO: 927807 - RNA, 20 nt, Human
accccacacucucccccgag

SEQ ID NO: 927808 - RNA, 20 nt, Human
acuguggggcuggggacccu

SEQ ID NO: 927809 - RNA, 21 nt, Human
acuguggggcuggggacccuc

SEQ ID NO: 927810 - RNA, 24 nt, Human
agacugaagcaggaggauugcuug

SEQ ID NO: 927811 - RNA, 24 nt, Human
agcacuuugggaggccgagguggg

SEQ ID NO: 927812 - RNA, 19 nt, Human
agcccccagcacuuuggga

SEQ ID NO: 927813 - RNA, 22 nt, Human
agccugggcaacauaguaagac

SEQ ID NO: 927814 - RNA, 18 nt, Human
agccugggcaacauggug

SEQ ID NO: 927815 - RNA, 18 nt, Human
agccugggcaacauggug

SEQ ID NO: 927816 - RNA, 21 nt, Human
agccugggcaacauggugucc

SEQ ID NO: 927817 - RNA, 20 nt, Human
aggaucucuugggcccagga

SEQ ID NO: 927818 - RNA, 20 nt, Human
aggauugcuugggcccagga

SEQ ID NO: 927819 - RNA, 24 nt, Human
aggauugcuugggcccaggaguuc

SEQ ID NO: 927820 - RNA, 22 nt, Human
aggcagcucaugcugaaguuca

SEQ ID NO: 927821 - RNA, 24 nt, Human
aggcaugguggcucacaccuguag

SEQ ID NO: 927822 - RNA, 18 nt, Human
aggccgaggugggaggau

SEQ ID NO: 927823 - RNA, 24 nt, Human
aggccgaggugggaggaucucuug

SEQ ID NO: 927824 - RNA, 22 nt, Human
aggugggaggaucucuugggcc

SEQ ID NO: 927825 - RNA, 24 nt, Human
auugcuugggcccaggaguucagg

SEQ ID NO: 927826 - RNA, 24 nt, Human
auugcuugggcccaggaguucagg

SEQ ID NO: 927827 - RNA, 24 nt, Human
auuuguaauccaaacacuuugcca

SEQ ID NO: 927828 - RNA, 22 nt, Human
caaaacaaaacaaaaacacuua

SEQ ID NO: 927829 - RNA, 24 nt, Human
caacauaguaagacgcugucucuu

SEQ ID NO: 927830 - RNA, 25 nt, Human
cacaccuguagcccccagcacuuug

SEQ ID NO: 927831 - RNA, 24 nt, Human
caccuguagcccccagcacuuugg

SEQ ID NO: 927832 - RNA, 25 nt, Human
caccuguagcccccagcacuuuggg

SEQ ID NO: 927833 - RNA, 19 nt, Human
cacuuagaaaggggccagg

SEQ ID NO: 927834 - RNA, 23 nt, Human
cacuuagccucuuugggccucca

SEQ ID NO: 927835 - RNA, 21 nt, Human
cagcacuuugggaggccgagg

SEQ ID NO: 927836 - RNA, 24 nt, Human
cagcacuuugggaggccgaggugg

SEQ ID NO: 927837 - RNA, 22 nt, Human
caggaguucagggccagccugg

SEQ ID NO: 927838 - RNA, 24 nt, Human
cagggacaucccugcuccagccca

SEQ ID NO: 927839 - RNA, 19 nt, Human
caguaucagucuacugugg

SEQ ID NO: 927840 - RNA, 19 nt, Human
caucacccucuacaccaug

SEQ ID NO: 927841 - RNA, 21 nt, Human
ccacacucucccccgagagaa

SEQ ID NO: 927842 - RNA, 20 nt, Human
ccccagcacuuugggaggcc

SEQ ID NO: 927843 - RNA, 20 nt, Human
cccccagcacuuugggaggc

SEQ ID NO: 927844 - RNA, 20 nt, Human
cccccgagagaaggcagcuc

SEQ ID NO: 927845 - RNA, 18 nt, Human
cccucacaggugacaggg

SEQ ID NO: 927846 - RNA, 21 nt, Human
ccucccaugagaugggagggc

SEQ ID NO: 927847 - RNA, 23 nt, Human
ccucuacaccauguuugucaccu

SEQ ID NO: 927848 - RNA, 22 nt, Human
ccugggcaacauggugucccca

SEQ ID NO: 927849 - RNA, 21 nt, Human
ccugggcaagucacuuagccu

SEQ ID NO: 927850 - RNA, 23 nt, Human
ccuugugacugcugagcgcucug

SEQ ID NO: 927851 - RNA, 19 nt, Human
cggagugggcugggugggg

SEQ ID NO: 927852 - RNA, 25 nt, Human
cucacaccuguagcccccagcacuu

SEQ ID NO: 927853 - RNA, 18 nt, Human
cugaaguucacauagagg

SEQ ID NO: 927854 - RNA, 21 nt, Human
cuugccaggacgcccagccca

SEQ ID NO: 927855 - RNA, 22 nt, Human
gaggaucucuugggcccaggag

SEQ ID NO: 927856 - RNA, 23 nt, Human
gaggugggaggaucucuugggcc

SEQ ID NO: 927857 - RNA, 21 nt, Human
gauccugggcaagucacuuag

SEQ ID NO: 927858 - RNA, 23 nt, Human
gauugagaccagccugggcaaca

SEQ ID NO: 927859 - RNA, 24 nt, Human
gauugcuugggcccaggaguucag

SEQ ID NO: 927860 - RNA, 22 nt, Human
gcccaggaguucagggccagcc

SEQ ID NO: 927861 - RNA, 18 nt, Human
gccucggucaucacccuc

SEQ ID NO: 927862 - RNA, 24 nt, Human
gcucacaccuguagcccccagcac

SEQ ID NO: 927863 - RNA, 19 nt, Human
gcugggugggguggggugu

SEQ ID NO: 927864 - RNA, 18 nt, Human
gcugugaccccacacucu

SEQ ID NO: 927865 - RNA, 21 nt, Human
ggagauugagaccagccuggg

SEQ ID NO: 927866 - RNA, 23 nt, Human
ggauugcuugggcccaggaguuc

SEQ ID NO: 927867 - RNA, 25 nt, Human
ggcaugguggcucacaccuguagcc

SEQ ID NO: 927868 - RNA, 21 nt, Human
ggccaggcaugguggcucaca

SEQ ID NO: 927869 - RNA, 19 nt, Human
ggcccaggagauugagacc

SEQ ID NO: 927870 - RNA, 18 nt, Human
gggcuggguggggugggg

SEQ ID NO: 927871 - RNA, 19 nt, Human
gggugcagacggcuguggg

SEQ ID NO: 927872 - RNA, 20 nt, Human
gggugucucuggucuggcag

SEQ ID NO: 927873 - RNA, 20 nt, Human
gugauccugggcaagucacu

SEQ ID NO: 927874 - RNA, 18 nt, Human
guggacucaaaugccugc

SEQ ID NO: 927875 - RNA, 19 nt, Human
uaaaaauaguaccuuccuc

SEQ ID NO: 927876 - RNA, 24 nt, Human
uaaaaauuaacaaaacaaaacaaa

SEQ ID NO: 927877 - RNA, 22 nt, Human
uagaaaggggccaggcauggug

SEQ ID NO: 927878 - RNA, 28 nt, Human
ucaccuggucagcccuauccaguauccc

SEQ ID NO: 927879 - RNA, 20 nt, Human
uccauguggacucaaaugcc

SEQ ID NO: 927880 - RNA, 21 nt, Human
ucccaugagaugggagggccc

SEQ ID NO: 927881 - RNA, 20 nt, Human
uccccaaaaaaaaaaaaaaa

SEQ ID NO: 927882 - RNA, 23 nt, Human
uccccugcugugcggcuuggggu

SEQ ID NO: 927883 - RNA, 22 nt, Human
uccugggucaguaucagucuac

SEQ ID NO: 927884 - RNA, 19 nt, Human
ucucucugcccuugugacu

SEQ ID NO: 927885 - RNA, 19 nt, Human
ucuguuccugaguugucuc

SEQ ID NO: 927886 - RNA, 24 nt, Human
ucuugggcccaggagauugagacc

SEQ ID NO: 927887 - RNA, 25 nt, Human
ugaagcaggaggauugcuugggccc

SEQ ID NO: 927888 - RNA, 24 nt, Human
ugagaccagccugggcaacauagu

SEQ ID NO: 927889 - RNA, 18 nt, Human
ugagccuggcauugccac

SEQ ID NO: 927890 - RNA, 21 nt, Human
ugagugguuggcuguguaucu

SEQ ID NO: 927891 - RNA, 22 nt, Human
ugccagacugaagcaggaggau

SEQ ID NO: 927892 - RNA, 23 nt, Human
uggauuguugaagggcuauagau

SEQ ID NO: 927893 - RNA, 23 nt, Human
uggcucacaccuguagcccccag

SEQ ID NO: 927894 - RNA, 25 nt, Human
uggcucacaccuguagcccccagca

SEQ ID NO: 927895 - RNA, 19 nt, Human
ugggaggccgaggugggag

SEQ ID NO: 927896 - RNA, 23 nt, Human
ugggcccaggagauugagaccag

SEQ ID NO: 927897 - RNA, 23 nt, Human
ugggcccaggaguucagggccag

SEQ ID NO: 927898 - RNA, 21 nt, Human
uggggucagggaaggagcaug

SEQ ID NO: 927899 - RNA, 23 nt, Human
uggggucagggaaggagcaugga

SEQ ID NO: 927900 - RNA, 25 nt, Human
uggggucagggaaggagcauggacu

SEQ ID NO: 927901 - RNA, 26 nt, Human
ugggugcagacggcuguggggucagg

SEQ ID NO: 927902 - RNA, 24 nt, Human
ugggugggguggggugucucuggu

SEQ ID NO: 927903 - RNA, 23 nt, Human
ugguguccccaaaaaaaaaaaaa

SEQ ID NO: 927904 - RNA, 27 nt, Human
uguaaaacacuuagaaaggggccaggc

SEQ ID NO: 927905 - RNA, 18 nt, Human
uguaauccaaacacuuug

SEQ ID NO: 927906 - RNA, 20 nt, Human
uguaauccaaacacuuugcc

SEQ ID NO: 927907 - RNA, 22 nt, Human
uguccccaaaaaaaaaaaaaaa

SEQ ID NO: 927908 - RNA, 24 nt, Human
ugugauccugggcaagucacuuag

SEQ ID NO: 927909 - RNA, 24 nt, Human
uguugcugggacuugagugguugg

SEQ ID NO: 927910 - RNA, 23 nt, Human
uuccuugucuguaaaauagagau

SEQ ID NO: 927911 - RNA, 23 nt, Human
uugcuugggcccaggaguucagg

SEQ ID NO: 927912 - RNA, 23 nt, Human
uugggccuccauuuccuugucug

SEQ ID NO: 927913 - RNA, 22 nt, Human
aaagcugaacuugucagaaagu

SEQ ID NO: 927914 - RNA, 23 nt, Human
aacagcccaacaccccacccaaa

SEQ ID NO: 927915 - RNA, 22 nt, Human
aagaaaaucaucucacaaaugg

SEQ ID NO: 927916 - RNA, 21 nt, Human
aaguauaaugaagaggaugau

SEQ ID NO: 927917 - RNA, 19 nt, Human
acaaaguaguggaagaaga

SEQ ID NO: 927918 - RNA, 21 nt, Human
acccaaagagauguuccagag

SEQ ID NO: 927919 - RNA, 18 nt, Human
acuacacuccagccuggg

SEQ ID NO: 927920 - RNA, 24 nt, Human
acuacacuccagccugggugacag

SEQ ID NO: 927921 - RNA, 18 nt, Human
acuucaguaaccaucuaa

SEQ ID NO: 927922 - RNA, 19 nt, Human
acuuuuuuuuuuuuuccuu

SEQ ID NO: 927923 - RNA, 19 nt, Human
agaaacugaggcacagaua

SEQ ID NO: 927924 - RNA, 22 nt, Human
agagcacauguacucuaucuuc

SEQ ID NO: 927925 - RNA, 20 nt, Human
agaggaacauggugcuccag

SEQ ID NO: 927926 - RNA, 22 nt, Human
agcccaacaccccacccaaaga

SEQ ID NO: 927927 - RNA, 24 nt, Human
aggcgugguggcucaggccaguaa

SEQ ID NO: 927928 - RNA, 22 nt, Human
aggguuauuauaauguuaaaug

SEQ ID NO: 927929 - RNA, 23 nt, Human
aggugggaggauugcuugagccc

SEQ ID NO: 927930 - RNA, 22 nt, Human
aguaaccaucuaauuagguagc

SEQ ID NO: 927931 - RNA, 19 nt, Human
agucacacacccucugcuu

SEQ ID NO: 927932 - RNA, 18 nt, Human
auaaguauaaugaagagg

SEQ ID NO: 927933 - RNA, 19 nt, Human
auccuuuuucuaucccucu

SEQ ID NO: 927934 - RNA, 18 nt, Human
augaauucauuuuguuca

SEQ ID NO: 927935 - RNA, 27 nt, Human
auucuuguuuuaaagagauuuuaaaga

SEQ ID NO: 927936 - RNA, 21 nt, Human
caaaguaauuacuuacuaggc

SEQ ID NO: 927937 - RNA, 22 nt, Human
caaauuggaaaauucaaagcac

SEQ ID NO: 927938 - RNA, 20 nt, Human
caacaccccacccaaagaga

SEQ ID NO: 927939 - RNA, 21 nt, Human
caacuuccaggacuuuccaau

SEQ ID NO: 927940 - RNA, 24 nt, Human
caacuuuuuuuuuuuuuccuuaga

SEQ ID NO: 927941 - RNA, 18 nt, Human
caagaugucagagacuua

SEQ ID NO: 927942 - RNA, 18 nt, Human
cacagucuagaagaagca

SEQ ID NO: 927943 - RNA, 27 nt, Human
cacccaaagagauguuccagagcacau

SEQ ID NO: 927944 - RNA, 19 nt, Human
caccccacccaaagagaug

SEQ ID NO: 927945 - RNA, 24 nt, Human
cacuacacuccagccugggugaca

SEQ ID NO: 927946 - RNA, 18 nt, Human
cacuccagccugggugac

SEQ ID NO: 927947 - RNA, 22 nt, Human
cacuccagccugggugacagag

SEQ ID NO: 927948 - RNA, 23 nt, Human
caguacuucuggagccaaggugg

SEQ ID NO: 927949 - RNA, 18 nt, Human
ccaauaccucauucagug

SEQ ID NO: 927950 - RNA, 20 nt, Human
ccacccaaagagauguucca

SEQ ID NO: 927951 - RNA, 20 nt, Human
ccacuacacuccagccuggg

SEQ ID NO: 927952 - RNA, 21 nt, Human
ccacuacacuccagccugggu

SEQ ID NO: 927953 - RNA, 23 nt, Human
ccacuacacuccagccuggguga

SEQ ID NO: 927954 - RNA, 24 nt, Human
ccacuacacuccagccugggugac

SEQ ID NO: 927955 - RNA, 24 nt, Human
ccagagcacauguacucuaucuuc

SEQ ID NO: 927956 - RNA, 23 nt, Human
cccaaagagauguuccagagcac

SEQ ID NO: 927957 - RNA, 19 nt, Human
ccuuagaaggauacuaggc

SEQ ID NO: 927958 - RNA, 19 nt, Human
cucacaaauggaaguaaca

SEQ ID NO: 927959 - RNA, 20 nt, Human
cucacaaauggaaguaacac

SEQ ID NO: 927960 - RNA, 20 nt, Human
cucuaaaugcugucuagcca

SEQ ID NO: 927961 - RNA, 18 nt, Human
cuggagccaaggugggag

SEQ ID NO: 927962 - RNA, 18 nt, Human
cuuugugugaguuaucca

SEQ ID NO: 927963 - RNA, 23 nt, Human
gaaagcauuuggcagacacuuga

SEQ ID NO: 927964 - RNA, 25 nt, Human
gaagaaacagcccaacaccccaccc

SEQ ID NO: 927965 - RNA, 18 nt, Human
gaagaagcaauuauucaa

SEQ ID NO: 927966 - RNA, 21 nt, Human
gagaaagcauuuggcagacac

SEQ ID NO: 927967 - RNA, 24 nt, Human
gagccaaggugggaggauugcuug

SEQ ID NO: 927968 - RNA, 23 nt, Human
gagcccaaggcaaaguaacacaa

SEQ ID NO: 927969 - RNA, 20 nt, Human
gcagacacuugaugaucauc

SEQ ID NO: 927970 - RNA, 19 nt, Human
gccacuacacuccagccug

SEQ ID NO: 927971 - RNA, 20 nt, Human
ggcaacuuuuuuuuuuuuuc

SEQ ID NO: 927972 - RNA, 21 nt, Human
ggcaacuuuuuuuuuuuuucc

SEQ ID NO: 927973 - RNA, 19 nt, Human
ggguaggcgugguggcuca

SEQ ID NO: 927974 - RNA, 19 nt, Human
gucaucuuuauccuuuuuc

SEQ ID NO: 927975 - RNA, 18 nt, Human
gugugacuuugugugagu

SEQ ID NO: 927976 - RNA, 22 nt, Human
uaaaaaaaaaaccucacaaguu

SEQ ID NO: 927977 - RNA, 21 nt, Human
uaaaaaacgucucuuaaagaa

SEQ ID NO: 927978 - RNA, 24 nt, Human
uaaaaaacgucucuuaaagaagca

SEQ ID NO: 927979 - RNA, 23 nt, Human
uaaaauguuuccaaaugaguuuc

SEQ ID NO: 927980 - RNA, 20 nt, Human
uaaagguggagaaacugagg

SEQ ID NO: 927981 - RNA, 21 nt, Human
uaaaugcugucuagccacuga

SEQ ID NO: 927982 - RNA, 22 nt, Human
uaacuagugcuaacuauguccc

SEQ ID NO: 927983 - RNA, 23 nt, Human
uaagaauauguuaccauaucugu

SEQ ID NO: 927984 - RNA, 19 nt, Human
uaagcauaggcaagaacug

SEQ ID NO: 927985 - RNA, 22 nt, Human
uaauccugauuuuaccaauacc

SEQ ID NO: 927986 - RNA, 18 nt, Human
uaauuggaagaaacagcc

SEQ ID NO: 927987 - RNA, 21 nt, Human
uaccauaucugucuuuccuag

SEQ ID NO: 927988 - RNA, 24 nt, Human
uacucuaucuucuuuucagaauua

SEQ ID NO: 927989 - RNA, 21 nt, Human
uacugugcagugcuggagagu

SEQ ID NO: 927990 - RNA, 21 nt, Human
uacuucaguaaccaucuaauu

SEQ ID NO: 927991 - RNA, 19 nt, Human
uacuucuggagccaaggug

SEQ ID NO: 927992 - RNA, 19 nt, Human
uagaauggcaaauaugaca

SEQ ID NO: 927993 - RNA, 24 nt, Human
uagaguaagaauccaaaucugaga

SEQ ID NO: 927994 - RNA, 24 nt, Human
uauaauguuaaaugagauauaugu

SEQ ID NO: 927995 - RNA, 20 nt, Human
uccagccugggugacagaga

SEQ ID NO: 927996 - RNA, 20 nt, Human
ucuccuaugugccagagguu

SEQ ID NO: 927997 - RNA, 23 nt, Human
ucucuugggaucuaaaauucuug

SEQ ID NO: 927998 - RNA, 23 nt, Human
ugagauuaaaaaaaaaaccucac

SEQ ID NO: 927999 - RNA, 22 nt, Human
ugagcccaguaguuugaggcug

SEQ ID NO: 928000 - RNA, 26 nt, Human
ugagcccaguaguuugaggcuggacc

SEQ ID NO: 928001 - RNA, 21 nt, Human
ugcuaacuaugucccagguac

SEQ ID NO: 928002 - RNA, 25 nt, Human
uggaagaaacagcccaacaccccac

SEQ ID NO: 928003 - RNA, 20 nt, Human
uggaagaaacagcccaacag

SEQ ID NO: 928004 - RNA, 20 nt, Human
uggcaacuuuuuuuuuuuuu

SEQ ID NO: 928005 - RNA, 20 nt, Human
ugguggcucaggccaguaau

SEQ ID NO: 928006 - RNA, 25 nt, Human
ugucagaaaguccuaaucauuucag

SEQ ID NO: 928007 - RNA, 19 nt, Human
uguucuguauuuuuuguuu

SEQ ID NO: 928008 - RNA, 22 nt, Human
uguucuguauuuuuuguuuaau

SEQ ID NO: 928009 - RNA, 23 nt, Human
uuaauccugauuuuaccaauacc

SEQ ID NO: 928010 - RNA, 20 nt, Human
uuaaugauuauuaaaucuaa

SEQ ID NO: 928011 - RNA, 22 nt, Human
uuacuaggcuagcucauaguau

SEQ ID NO: 928012 - RNA, 21 nt, Human
uuagggcuaugaaacucuuuu

SEQ ID NO: 928013 - RNA, 21 nt, Human
uuauacugcauggagucuuuc

SEQ ID NO: 928014 - RNA, 23 nt, Human
uuaugagugucaucuuuauccuu

SEQ ID NO: 928015 - RNA, 24 nt, Human
uugcuugagcccaguaguuugagg

SEQ ID NO: 928016 - RNA, 18 nt, Human
uuguucuguauuuuuugu

SEQ ID NO: 928017 - RNA, 22 nt, Human
uuguuuguuuggauuacuugaa

SEQ ID NO: 928018 - RNA, 20 nt, Human
uuucagaauuagaauuuguu

SEQ ID NO: 928019 - RNA, 18 nt, Human
uuuggcagacacuugaug

SEQ ID NO: 928020 - RNA, 24 nt, Human
uuuguucaccauuuaacacagucu

SEQ ID NO: 928021 - RNA, 32 nt, Human
uuuuauaauuauauguaagaauauguuaccuc

SEQ ID NO: 928022 - RNA, 19 nt, Human
uuuuccauugucugucuuc

SEQ ID NO: 928023 - RNA, 23 nt, Human
aaagauaaaaugagugacuacag

SEQ ID NO: 928024 - RNA, 24 nt, Human
aacuuugguaaacugaauucugaa

SEQ ID NO: 928025 - RNA, 21 nt, Human
aagacuuuccaccguccacag

SEQ ID NO: 928026 - RNA, 20 nt, Human
aagcaacguggugauagaau

SEQ ID NO: 928027 - RNA, 20 nt, Human
accguccacaguucucuaag

SEQ ID NO: 928028 - RNA, 23 nt, Human
agaaagcaacguggugauagaau

SEQ ID NO: 928029 - RNA, 22 nt, Human
agauauuuuuacuagaauuuca

SEQ ID NO: 928030 - RNA, 19 nt, Human
caccagggacucuuucagc

SEQ ID NO: 928031 - RNA, 21 nt, Human
caccccagcgaaggauggccu

SEQ ID NO: 928032 - RNA, 20 nt, Human
ccucuaaaugacuaauaccu

SEQ ID NO: 928033 - RNA, 19 nt, Human
ccugcacugcgcaccaggg

SEQ ID NO: 928034 - RNA, 21 nt, Human
cuaaaugacuaauaccugcac

SEQ ID NO: 928035 - RNA, 24 nt, Human
cugaaugcuuuccguucaccccag

SEQ ID NO: 928036 - RNA, 21 nt, Human
cuggucaugauaagacuuucc

SEQ ID NO: 928037 - RNA, 24 nt, Human
cuguaauaguaacuauaccucuaa

SEQ ID NO: 928038 - RNA, 18 nt, Human
gaaaauagacuuuuaaaa

SEQ ID NO: 928039 - RNA, 21 nt, Human
gaucuuuuugcccacuccgaa

SEQ ID NO: 928040 - RNA, 23 nt, Human
gcaggaggcagacaugaggucgc

SEQ ID NO: 928041 - RNA, 18 nt, Human
gccuggucaugauaagac

SEQ ID NO: 928042 - RNA, 20 nt, Human
gcuaauggaauaaauaauau

SEQ ID NO: 928043 - RNA, 20 nt, Human
guacccaggguuacugcuuc

SEQ ID NO: 928044 - RNA, 20 nt, Human
uaaaaugaaguucagagaaa

SEQ ID NO: 928045 - RNA, 18 nt, Human
uacauauccaauugcagc

SEQ ID NO: 928046 - RNA, 23 nt, Human
uaccugcacugcgcaccagggac

SEQ ID NO: 928047 - RNA, 23 nt, Human
uauaugucauauaggcacauaua

SEQ ID NO: 928048 - RNA, 22 nt, Human
ucaaaaugaauauggaguaguc

SEQ ID NO: 928049 - RNA, 20 nt, Human
ucagagaaagcaacguggug

SEQ ID NO: 928050 - RNA, 24 nt, Human
ucauuuccaucucaaaauucucuu

SEQ ID NO: 928051 - RNA, 19 nt, Human
uccacagaaugccaaaugc

SEQ ID NO: 928052 - RNA, 26 nt, Human
ugccuuauccuccugcauuagguuua

SEQ ID NO: 928053 - RNA, 19 nt, Human
uucagaaugucugcaguua

SEQ ID NO: 928054 - RNA, 21 nt, Human
uuccacagaaugccaaaugcc

SEQ ID NO: 928055 - RNA, 19 nt, Human
uuccugguugagcaguguu

SEQ ID NO: 928056 - RNA, 18 nt, Human
uuguuuucaauuuucccc

SEQ ID NO: 928057 - RNA, 24 nt, Human
uuuuuuuuuuuuguuguuuucaau

SEQ ID NO: 928058 - RNA, 18 nt, Human
uuuuuuuuuuuuuuuuug

SEQ ID NO: 928059 - RNA, 25 nt, Human
uuuuuuuuuuuuuuuuuuguuguuu

SEQ ID NO: 928060 - RNA, 22 nt, Human
aaaaaggagauaaaacuacaga

SEQ ID NO: 928061 - RNA, 18 nt, Human
aaaauauuuccaagacac

SEQ ID NO: 928062 - RNA, 19 nt, Human
aaacaaggucacacaauuu

SEQ ID NO: 928063 - RNA, 21 nt, Human
aaaugcuauaaagacaagaca

SEQ ID NO: 928064 - RNA, 24 nt, Human
aaaugggguucaaggaccgagggc

SEQ ID NO: 928065 - RNA, 18 nt, Human
aacaaaaagccaagaaaa

SEQ ID NO: 928066 - RNA, 20 nt, Human
aagcaccuuguacuacaagg

SEQ ID NO: 928067 - RNA, 29 nt, Human
aagcagaaggcagaugaugaagggacccc

SEQ ID NO: 928068 - RNA, 21 nt, Human
aagcauuuacagcaugguuuc

SEQ ID NO: 928069 - RNA, 21 nt, Human
aaggcuaagcacaaucacuua

SEQ ID NO: 928070 - RNA, 20 nt, Human
aaugcuggaaacgggaacac

SEQ ID NO: 928071 - RNA, 24 nt, Human
aauguguuuauucacaaccauuug

SEQ ID NO: 928072 - RNA, 22 nt, Human
aauuaauuuuaaaaauugaaag

SEQ ID NO: 928073 - RNA, 18 nt, Human
acaaaaaggcuaagcaca

SEQ ID NO: 928074 - RNA, 22 nt, Human
acaaugaaauaggcuucauaaa

SEQ ID NO: 928075 - RNA, 23 nt, Human
acccaggcccggcagcugcaucc

SEQ ID NO: 928076 - RNA, 18 nt, Human
aggaaaaaccaaaaaaca

SEQ ID NO: 928077 - RNA, 21 nt, Human
agggcacggggcgacgaaaga

SEQ ID NO: 928078 - RNA, 26 nt, Human
aucauaccaaauccucagcaaaauca

SEQ ID NO: 928079 - RNA, 20 nt, Human
aucccauuaaagcaccuugu

SEQ ID NO: 928080 - RNA, 24 nt, Human
aucuaacaucguucauuggaaaua

SEQ ID NO: 928081 - RNA, 19 nt, Human
aucucccuuacaaaaaggc

SEQ ID NO: 928082 - RNA, 23 nt, Human
augccgcccaggcgccgccgcuc

SEQ ID NO: 928083 - RNA, 24 nt, Human
caaaguaaauuuaaucaguaacau

SEQ ID NO: 928084 - RNA, 23 nt, Human
caaauccucagcaaaaucaagga

SEQ ID NO: 928085 - RNA, 23 nt, Human
caagacacagcuacaacuuaaau

SEQ ID NO: 928086 - RNA, 22 nt, Human
caagaggaaaaaaaauuaaaaa

SEQ ID NO: 928087 - RNA, 19 nt, Human
caaggaccgagggcgggcc

SEQ ID NO: 928088 - RNA, 21 nt, Human
cacaucaacuguacuuacuau

SEQ ID NO: 928089 - RNA, 20 nt, Human
caccgucauuguugcaagag

SEQ ID NO: 928090 - RNA, 18 nt, Human
cagaaaugcuauaaagac

SEQ ID NO: 928091 - RNA, 24 nt, Human
cauagaaauaaauaaugcuggaaa

SEQ ID NO: 928092 - RNA, 20 nt, Human
cauguaaauaaacacaugua

SEQ ID NO: 928093 - RNA, 23 nt, Human
ccaaaaaacaguuugcuuacuaa

SEQ ID NO: 928094 - RNA, 19 nt, Human
ccaacuugaaauguccaaa

SEQ ID NO: 928095 - RNA, 22 nt, Human
ccauuaaagcaccuuguacuac

SEQ ID NO: 928096 - RNA, 19 nt, Human
cccaaacccaggcccggca

SEQ ID NO: 928097 - RNA, 24 nt, Human
cccauuaaagcaccuuguacuaca

SEQ ID NO: 928098 - RNA, 24 nt, Human
ccgcacggcacgagccgaaauggg

SEQ ID NO: 928099 - RNA, 21 nt, Human
ccucccgcucaaugcccaaac

SEQ ID NO: 928100 - RNA, 20 nt, Human
cgaaaugggguucaaggacc

SEQ ID NO: 928101 - RNA, 19 nt, Human
cgagggaggagcaccgggc

SEQ ID NO: 928102 - RNA, 18 nt, Human
cgcacggcacgagccgaa

SEQ ID NO: 928103 - RNA, 19 nt, Human
cgcaugccgcccaggcgcc

SEQ ID NO: 928104 - RNA, 19 nt, Human
cgcucaaugcccaaaccca

SEQ ID NO: 928105 - RNA, 23 nt, Human
cucuggacucccucgccguccgc

SEQ ID NO: 928106 - RNA, 25 nt, Human
cugacgaucccuccucaugcuuccu

SEQ ID NO: 928107 - RNA, 22 nt, Human
cugagucugacgaucccuccuc

SEQ ID NO: 928108 - RNA, 21 nt, Human
cuuacaaaaaggcuaagcaca

SEQ ID NO: 928109 - RNA, 24 nt, Human
cuuucauaccagaaaggauuuuau

SEQ ID NO: 928110 - RNA, 20 nt, Human
gaaauaggcuucauaaauca

SEQ ID NO: 928111 - RNA, 19 nt, Human
gauccuaucaucccuacuc

SEQ ID NO: 928112 - RNA, 19 nt, Human
gccgcccaggcgccgccgc

SEQ ID NO: 928113 - RNA, 20 nt, Human
ggcggcgugagggcacgggg

SEQ ID NO: 928114 - RNA, 18 nt, Human
gggaacaaaggcaguguu

SEQ ID NO: 928115 - RNA, 22 nt, Human
gggaacaaaggcaguguuuacu

SEQ ID NO: 928116 - RNA, 21 nt, Human
ggucuugaaaagcagaaggca

SEQ ID NO: 928117 - RNA, 21 nt, Human
gguucaaggaccgagggcggg

SEQ ID NO: 928118 - RNA, 25 nt, Human
uaaaaucauaccaaauccucagcaa

SEQ ID NO: 928119 - RNA, 24 nt, Human
uaaaaugaaguggaaaaaacuaaa

SEQ ID NO: 928120 - RNA, 23 nt, Human
uaaagcaccuuguacuacaaggu

SEQ ID NO: 928121 - RNA, 21 nt, Human
uaauucuguaucaauucagau

SEQ ID NO: 928122 - RNA, 20 nt, Human
uaccaaauccucagcaaaau

SEQ ID NO: 928123 - RNA, 20 nt, Human
uaccauaguaaacagaaaug

SEQ ID NO: 928124 - RNA, 19 nt, Human
uaccauuuguuaccauucc

SEQ ID NO: 928125 - RNA, 18 nt, Human
uagagucaucuacccaca

SEQ ID NO: 928126 - RNA, 23 nt, Human
uauauuuacauauuuaaaguauc

SEQ ID NO: 928127 - RNA, 21 nt, Human
ucaaauauugaaagagccaca

SEQ ID NO: 928128 - RNA, 25 nt, Human
ucaaauauugaaagagccacaugau

SEQ ID NO: 928129 - RNA, 23 nt, Human
ugacauauacauuuuagagaaaa

SEQ ID NO: 928130 - RNA, 19 nt, Human
ugauaaacaaggucacaca

SEQ ID NO: 928131 - RNA, 20 nt, Human
ugcccaaacccaggcccggc

SEQ ID NO: 928132 - RNA, 21 nt, Human
ugccgauacuucagcauuucu

SEQ ID NO: 928133 - RNA, 22 nt, Human
uggaaaaaacuaaauauauaua

SEQ ID NO: 928134 - RNA, 23 nt, Human
uggcaccuaaaaacuuaauacug

SEQ ID NO: 928135 - RNA, 26 nt, Human
uguguuuauucacaaccauuuguaaa

SEQ ID NO: 928136 - RNA, 18 nt, Human
uguuuucuaucccuggcc

SEQ ID NO: 928137 - RNA, 24 nt, Human
uucagauccuaucaucccuacucc

SEQ ID NO: 928138 - RNA, 18 nt, Human
uucuuacacaucucccuu

SEQ ID NO: 928139 - RNA, 24 nt, Human
uuuaaaguaucauauuaauuucua

SEQ ID NO: 928140 - RNA, 21 nt, Human
uuuaagcacagcaagaacuuu

SEQ ID NO: 928141 - RNA, 19 nt, Human
uuuaugaacaaaaagccaa

SEQ ID NO: 928142 - RNA, 20 nt, Human
uuuucuaucccuggccuugu

SEQ ID NO: 928143 - RNA, 21 nt, Human
uuuuuuuuuuuuuuuuuuaag

SEQ ID NO: 928144 - RNA, 22 nt, Human
aaagaucagaccguuccuaaga

SEQ ID NO: 928145 - RNA, 19 nt, Human
aaagugcuaggauuacagg

SEQ ID NO: 928146 - RNA, 24 nt, Human
aaagugcuaggauuacagguguga

SEQ ID NO: 928147 - RNA, 19 nt, Human
aaagugcugggauuacaga

SEQ ID NO: 928148 - RNA, 24 nt, Human
aaagugcugggauuacagauguga

SEQ ID NO: 928149 - RNA, 22 nt, Human
aaauagcugaauagaagacccu

SEQ ID NO: 928150 - RNA, 19 nt, Human
aaccaucauucccauccua

SEQ ID NO: 928151 - RNA, 28 nt, Human
aacuuucuuuuuaaaaaaaauagaggcc

SEQ ID NO: 928152 - RNA, 24 nt, Human
aacuuuuuuuuuuuugagaugggg

SEQ ID NO: 928153 - RNA, 20 nt, Human
aagcccccauuauugcccag

SEQ ID NO: 928154 - RNA, 22 nt, Human
aaguagcugggacuacuggcgc

SEQ ID NO: 928155 - RNA, 26 nt, Human
aagugcuaggauuacaggugugagcc

SEQ ID NO: 928156 - RNA, 18 nt, Human
aagugcugggauuacaga

SEQ ID NO: 928157 - RNA, 19 nt, Human
aagugcugggauuacagau

SEQ ID NO: 928158 - RNA, 23 nt, Human
aaguguucccugaguucaagucc

SEQ ID NO: 928159 - RNA, 18 nt, Human
acagaugugagucaccau

SEQ ID NO: 928160 - RNA, 24 nt, Human
acccaggccuggagugcaguggcg

SEQ ID NO: 928161 - RNA, 18 nt, Human
acgggguuucaccauguu

SEQ ID NO: 928162 - RNA, 19 nt, Human
acgggguuucaccauguua

SEQ ID NO: 928163 - RNA, 20 nt, Human
acgggguuucaccauguuag

SEQ ID NO: 928164 - RNA, 24 nt, Human
acgggguuucaccauguuagccag

SEQ ID NO: 928165 - RNA, 24 nt, Human
acuccagccugggcagcagaguga

SEQ ID NO: 928166 - RNA, 25 nt, Human
acucuauugcccaggcugguuugca

SEQ ID NO: 928167 - RNA, 21 nt, Human
acugaauaaaaacugaacaua

SEQ ID NO: 928168 - RNA, 20 nt, Human
acugcaagcucugccuccug

SEQ ID NO: 928169 - RNA, 24 nt, Human
acuguacuccagccugggcagcag

SEQ ID NO: 928170 - RNA, 26 nt, Human
acuguacuccagccugggcagcagag

SEQ ID NO: 928171 - RNA, 20 nt, Human
agaaaucaguaaaaaaauaa

SEQ ID NO: 928172 - RNA, 19 nt, Human
agaauauauauccuuucuc

SEQ ID NO: 928173 - RNA, 18 nt, Human
agacagggucucgcacug

SEQ ID NO: 928174 - RNA, 23 nt, Human
agaggcagggguggacacagugg

SEQ ID NO: 928175 - RNA, 22 nt, Human
agcaaagcccccauuauugccc

SEQ ID NO: 928176 - RNA, 23 nt, Human
agccaucuucucgccuuggucuc

SEQ ID NO: 928177 - RNA, 24 nt, Human
agccugggaaauguagggaaaccu

SEQ ID NO: 928178 - RNA, 19 nt, Human
agccugggaggucgagacu

SEQ ID NO: 928179 - RNA, 23 nt, Human
agccugggcagcagagugagauc

SEQ ID NO: 928180 - RNA, 20 nt, Human
agcgcgguggcgcagucucg

SEQ ID NO: 928181 - RNA, 24 nt, Human
agcgcgguggcgcagucucggcuc

SEQ ID NO: 928182 - RNA, 18 nt, Human
agcucugccuccuggguu

SEQ ID NO: 928183 - RNA, 19 nt, Human
aggaguucaagaccagccu

SEQ ID NO: 928184 - RNA, 22 nt, Human
aggcaggaggaucgcuugagcc

SEQ ID NO: 928185 - RNA, 24 nt, Human
aggcaggaggaucgcuugagccug

SEQ ID NO: 928186 - RNA, 21 nt, Human
aggcagggguggacacagugg

SEQ ID NO: 928187 - RNA, 24 nt, Human
aggcagggguggacacagugguuc

SEQ ID NO: 928188 - RNA, 21 nt, Human
aggcugagacgggucagucgc

SEQ ID NO: 928189 - RNA, 24 nt, Human
aggcugagacgggucagucgcuug

SEQ ID NO: 928190 - RNA, 24 nt, Human
agguguguuggcacacaccugugg

SEQ ID NO: 928191 - RNA, 18 nt, Human
aguagcugggacuacagg

SEQ ID NO: 928192 - RNA, 19 nt, Human
aguagcugggacuacaggc

SEQ ID NO: 928193 - RNA, 27 nt, Human
aguccaggaguucaagaccagccuggg

SEQ ID NO: 928194 - RNA, 24 nt, Human
agucgcuugaguccaggaguucaa

SEQ ID NO: 928195 - RNA, 20 nt, Human
agugcaguggcgcgaucucg

SEQ ID NO: 928196 - RNA, 23 nt, Human
agugcaguggcgcgaucucggcu

SEQ ID NO: 928197 - RNA, 24 nt, Human
agugcaguggcgcgaucucggcuc

SEQ ID NO: 928198 - RNA, 23 nt, Human
agugguucacgccugugguccca

SEQ ID NO: 928199 - RNA, 19 nt, Human
auaaagccuuccuacuaaa

SEQ ID NO: 928200 - RNA, 24 nt, Human
augauccgcccgccucggccuccc

SEQ ID NO: 928201 - RNA, 23 nt, Human
auguagcauuucuauggcagaau

SEQ ID NO: 928202 - RNA, 22 nt, Human
auuccuggccucaagccaucuu

SEQ ID NO: 928203 - RNA, 20 nt, Human
auucuguaguacucaauugc

SEQ ID NO: 928204 - RNA, 24 nt, Human
caaagugcuaggauuacaggugug

SEQ ID NO: 928205 - RNA, 24 nt, Human
caaagugcugggauuacagaugug

SEQ ID NO: 928206 - RNA, 23 nt, Human
caaccuugaccucccgggcccaa

SEQ ID NO: 928207 - RNA, 24 nt, Human
caaccuugaccucccgggcccaag

SEQ ID NO: 928208 - RNA, 21 nt, Human
caagaacauuccuucuuagau

SEQ ID NO: 928209 - RNA, 24 nt, Human
caauuuuuuguauuuuuuauagag

SEQ ID NO: 928210 - RNA, 25 nt, Human
cacaccuguggucccagcuacucug

SEQ ID NO: 928211 - RNA, 19 nt, Human
caccacaagcucugccucc

SEQ ID NO: 928212 - RNA, 19 nt, Human
caccaugucuaauuucaaa

SEQ ID NO: 928213 - RNA, 24 nt, Human
caccaugucuaauuucaaaacucu

SEQ ID NO: 928214 - RNA, 18 nt, Human
caccauguuagccaggau

SEQ ID NO: 928215 - RNA, 22 nt, Human
caccauguuagccaggaugguc

SEQ ID NO: 928216 - RNA, 24 nt, Human
caccauguuagccaggauggucuc

SEQ ID NO: 928217 - RNA, 21 nt, Human
caccuguggucccagcuacuc

SEQ ID NO: 928218 - RNA, 24 nt, Human
caccuguggucccagcuacucugg

SEQ ID NO: 928219 - RNA, 24 nt, Human
cacgccuguggucccaacaccuug

SEQ ID NO: 928220 - RNA, 19 nt, Human
cacucuauugcccaggcug

SEQ ID NO: 928221 - RNA, 20 nt, Human
cacugcaaccuugaccuccc

SEQ ID NO: 928222 - RNA, 21 nt, Human
cacugcaaccuugaccucccg

SEQ ID NO: 928223 - RNA, 23 nt, Human
cacugcaaccuugaccucccggg

SEQ ID NO: 928224 - RNA, 23 nt, Human
cacugcaagcucugccuccuggg

SEQ ID NO: 928225 - RNA, 19 nt, Human
cacuguacuccagccuggg

SEQ ID NO: 928226 - RNA, 20 nt, Human
cacuguacuccagccugggc

SEQ ID NO: 928227 - RNA, 22 nt, Human
cacuguacuccagccugggcag

SEQ ID NO: 928228 - RNA, 23 nt, Human
cacuguacuccagccugggcagc

SEQ ID NO: 928229 - RNA, 24 nt, Human
cacuguacuccagccugggcagca

SEQ ID NO: 928230 - RNA, 21 nt, Human
cagaggucuauguugcccagg

SEQ ID NO: 928231 - RNA, 24 nt, Human
cagaguagcugggacuacaggcac

SEQ ID NO: 928232 - RNA, 18 nt, Human
cagcagagugagauccug

SEQ ID NO: 928233 - RNA, 24 nt, Human
cagggucucacucuauugcccagg

SEQ ID NO: 928234 - RNA, 24 nt, Human
cauguagcauuucuauggcagaau

SEQ ID NO: 928235 - RNA, 18 nt, Human
cauuccuguuuggcugga

SEQ ID NO: 928236 - RNA, 21 nt, Human
ccaaagugcuaggauuacagg

SEQ ID NO: 928237 - RNA, 24 nt, Human
ccaaagugcuaggauuacaggugu

SEQ ID NO: 928238 - RNA, 21 nt, Human
ccaaagugcugggauuacaga

SEQ ID NO: 928239 - RNA, 22 nt, Human
ccaaagugcugggauuacagau

SEQ ID NO: 928240 - RNA, 24 nt, Human
ccaaagugcugggauuacagaugu

SEQ ID NO: 928241 - RNA, 19 nt, Human
ccacaagcucugccucccg

SEQ ID NO: 928242 - RNA, 21 nt, Human
ccacaagcucugccucccggg

SEQ ID NO: 928243 - RNA, 20 nt, Human
ccacuguacuccagccuggg

SEQ ID NO: 928244 - RNA, 20 nt, Human
ccacuguacuccagccuggg

SEQ ID NO: 928245 - RNA, 22 nt, Human
ccacuguacuccagccugggca

SEQ ID NO: 928246 - RNA, 22 nt, Human
ccacuguacuccagccugggca

SEQ ID NO: 928247 - RNA, 22 nt, Human
ccacuguacuccagccugggca

SEQ ID NO: 928248 - RNA, 24 nt, Human
ccacuguacuccagccugggcagc

SEQ ID NO: 928249 - RNA, 24 nt, Human
ccagaguagcugggacuacaggca

SEQ ID NO: 928250 - RNA, 25 nt, Human
ccaugcucggccuaacuuuuuuuuu

SEQ ID NO: 928251 - RNA, 20 nt, Human
cccaaguagcugggacuacu

SEQ ID NO: 928252 - RNA, 20 nt, Human
cccauuauugcccagccauu

SEQ ID NO: 928253 - RNA, 21 nt, Human
cccgggcccaagugaaccucu

SEQ ID NO: 928254 - RNA, 22 nt, Human
cccuuggccaaaguccucaaaa

SEQ ID NO: 928255 - RNA, 20 nt, Human
ccgcgcccggccaacucaua

SEQ ID NO: 928256 - RNA, 18 nt, Human
ccuaagaugacacggacu

SEQ ID NO: 928257 - RNA, 21 nt, Human
ccuggucagguaucucaaacc

SEQ ID NO: 928258 - RNA, 22 nt, Human
ccuguggucccagcuacucugg

SEQ ID NO: 928259 - RNA, 22 nt, Human
ccuugaccucccgggcccaagu

SEQ ID NO: 928260 - RNA, 23 nt, Human
cgcaaugacagcucacugcaacc

SEQ ID NO: 928261 - RNA, 18 nt, Human
cgcacugucacccaggcc

SEQ ID NO: 928262 - RNA, 24 nt, Human
cgccucggccucccaaagugcuag

SEQ ID NO: 928263 - RNA, 23 nt, Human
cgccuguggucccaacaccuugg

SEQ ID NO: 928264 - RNA, 19 nt, Human
cgcgggccgagaaggaagc

SEQ ID NO: 928265 - RNA, 24 nt, Human
cuaggccucccaaguagcugggac

SEQ ID NO: 928266 - RNA, 20 nt, Human
cucacucuauugcccaggcc

SEQ ID NO: 928267 - RNA, 24 nt, Human
cucacugcaaccuugaccucccgg

SEQ ID NO: 928268 - RNA, 24 nt, Human
cucacugcaagcucugccuccugg

SEQ ID NO: 928269 - RNA, 18 nt, Human
cucaugauccgcccgccu

SEQ ID NO: 928270 - RNA, 21 nt, Human
cucccggguucacaccauucu

SEQ ID NO: 928271 - RNA, 24 nt, Human
cuccugaccucaugauccgcccgc

SEQ ID NO: 928272 - RNA, 19 nt, Human
cuccugccuaggccuccca

SEQ ID NO: 928273 - RNA, 24 nt, Human
cucgcucugucacccaggcuggag

SEQ ID NO: 928274 - RNA, 22 nt, Human
cucugucacccaggcuggagcg

SEQ ID NO: 928275 - RNA, 20 nt, Human
cugaauaaaaacugaacaua

SEQ ID NO: 928276 - RNA, 22 nt, Human
cugcaaccuugaccucccgggc

SEQ ID NO: 928277 - RNA, 23 nt, Human
cugcaaccuugaccucccgggcc

SEQ ID NO: 928278 - RNA, 19 nt, Human
cugcaagcucugccuccug

SEQ ID NO: 928279 - RNA, 24 nt, Human
cugcaccuggugaugacccucguc

SEQ ID NO: 928280 - RNA, 22 nt, Human
cuggcgccugccaccaugccca

SEQ ID NO: 928281 - RNA, 21 nt, Human
cuugaccucccgggcccaagu

SEQ ID NO: 928282 - RNA, 21 nt, Human
cuuuuuuuuuuuugagauggg

SEQ ID NO: 928283 - RNA, 20 nt, Human
gaacuuggagaaccuauggg

SEQ ID NO: 928284 - RNA, 21 nt, Human
gacacagugguucacgccugu

SEQ ID NO: 928285 - RNA, 20 nt, Human
gaccguuccuaagaugacac

SEQ ID NO: 928286 - RNA, 22 nt, Human
gaccucaugauccgcccgccuc

SEQ ID NO: 928287 - RNA, 24 nt, Human
gacuacaggcacaugccaccauac

SEQ ID NO: 928288 - RNA, 20 nt, Human
gagacagggucucgcacugu

SEQ ID NO: 928289 - RNA, 23 nt, Human
gaggaucgcuugagccugggagg

SEQ ID NO: 928290 - RNA, 25 nt, Human
gaguagcugggacuacaggcacaug

SEQ ID NO: 928291 - RNA, 24 nt, Human
gaucgcuugagccugggaggucga

SEQ ID NO: 928292 - RNA, 18 nt, Human
gauuacagaugugaguca

SEQ ID NO: 928293 - RNA, 21 nt, Human
gauuacagaugugagucacca

SEQ ID NO: 928294 - RNA, 24 nt, Human
gauuacagaugugagucaccaugc

SEQ ID NO: 928295 - RNA, 18 nt, Human
gauuacaggugugagcca

SEQ ID NO: 928296 - RNA, 20 nt, Human
gauuacaggugugagccacc

SEQ ID NO: 928297 - RNA, 22 nt, Human
gauuacaggugugagccaccgc

SEQ ID NO: 928298 - RNA, 22 nt, Human
gcaaagcccccauuauugccca

SEQ ID NO: 928299 - RNA, 22 nt, Human
gcacacaccuguggucccagcu

SEQ ID NO: 928300 - RNA, 20 nt, Human
gcagugcucucagauauucc

SEQ ID NO: 928301 - RNA, 19 nt, Human
gccacuguacuccagccug

SEQ ID NO: 928302 - RNA, 22 nt, Human
gccacuguacuccagccugggc

SEQ ID NO: 928303 - RNA, 23 nt, Human
gccacuguacuccagccugggca

SEQ ID NO: 928304 - RNA, 24 nt, Human
gccacuguacuccagccugggcag

SEQ ID NO: 928305 - RNA, 25 nt, Human
gcccagcuaauuuuuuuuguauuuu

SEQ ID NO: 928306 - RNA, 23 nt, Human
gcccuuggccaaaguccucaaaa

SEQ ID NO: 928307 - RNA, 21 nt, Human
gccucagacuccagaguagcu

SEQ ID NO: 928308 - RNA, 23 nt, Human
gccucagacuccagaguagcugg

SEQ ID NO: 928309 - RNA, 25 nt, Human
gccucccggguucacaccauucucc

SEQ ID NO: 928310 - RNA, 22 nt, Human
gccuuggucucccaaagugcug

SEQ ID NO: 928311 - RNA, 24 nt, Human
gccuuggucucccaaagugcuggg

SEQ ID NO: 928312 - RNA, 23 nt, Human
gcgcgguggcgcagucucggcuc

SEQ ID NO: 928313 - RNA, 25 nt, Human
gcucugucacccaggcuggagcgcg

SEQ ID NO: 928314 - RNA, 20 nt, Human
gcugggauuacagaugugag

SEQ ID NO: 928315 - RNA, 22 nt, Human
gcuugaguccaggaguucaaga

SEQ ID NO: 928316 - RNA, 22 nt, Human
ggauuacaggugugagccaccg

SEQ ID NO: 928317 - RNA, 25 nt, Human
ggcgcaaugacagcucacugcaacc

SEQ ID NO: 928318 - RNA, 22 nt, Human
gggaggucgagacuucagugag

SEQ ID NO: 928319 - RNA, 21 nt, Human
gggcagcagagugagauccug

SEQ ID NO: 928320 - RNA, 23 nt, Human
gggguuucaccauguuagccagg

SEQ ID NO: 928321 - RNA, 22 nt, Human
ggguuucaccauguuagccagg

SEQ ID NO: 928322 - RNA, 20 nt, Human
ggucucaaucuccugaccuc

SEQ ID NO: 928323 - RNA, 24 nt, Human
ggugagaucucagaauucuguggc

SEQ ID NO: 928324 - RNA, 24 nt, Human
gguuucaccauguuagccaggaug

SEQ ID NO: 928325 - RNA, 23 nt, Human
guacuccagccugggcagcagag

SEQ ID NO: 928326 - RNA, 24 nt, Human
gucucgcucugucacccaggcugg

SEQ ID NO: 928327 - RNA, 24 nt, Human
guuggcacacaccuguggucccag

SEQ ID NO: 928328 - RNA, 20 nt, Human
uaaaaauucuggagcaugau

SEQ ID NO: 928329 - RNA, 24 nt, Human
uaaauuuuaaaaauugccaaaaag

SEQ ID NO: 928330 - RNA, 22 nt, Human
uaagaaaucaguaaaaaaauaa

SEQ ID NO: 928331 - RNA, 18 nt, Human
uaagagguucacgcccuu

SEQ ID NO: 928332 - RNA, 20 nt, Human
uaagccacaaaaaaaccuaa

SEQ ID NO: 928333 - RNA, 21 nt, Human
uacaagcauaauuuaauaaac

SEQ ID NO: 928334 - RNA, 22 nt, Human
uacagacgggguuucaccaugu

SEQ ID NO: 928335 - RNA, 24 nt, Human
uacaggcacaugccaccauaccca

SEQ ID NO: 928336 - RNA, 23 nt, Human
uacaggugugagccaccgcgccc

SEQ ID NO: 928337 - RNA, 22 nt, Human
uacuccagccugggcagcagag

SEQ ID NO: 928338 - RNA, 23 nt, Human
uacuccagccugggcagcagagu

SEQ ID NO: 928339 - RNA, 24 nt, Human
uacuccagccugggcagcagagug

SEQ ID NO: 928340 - RNA, 21 nt, Human
uagaaaaauguugagggcaag

SEQ ID NO: 928341 - RNA, 19 nt, Human
uagagacagaggucuaugu

SEQ ID NO: 928342 - RNA, 21 nt, Human
uagaggcagggguggacacag

SEQ ID NO: 928343 - RNA, 18 nt, Human
uaggauuacaggugugag

SEQ ID NO: 928344 - RNA, 19 nt, Human
uaggauuacaggugugagc

SEQ ID NO: 928345 - RNA, 21 nt, Human
uaggauuacaggugugagcca

SEQ ID NO: 928346 - RNA, 22 nt, Human
uaggauuacaggugugagccac

SEQ ID NO: 928347 - RNA, 23 nt, Human
uaggauuacaggugugagccacc

SEQ ID NO: 928348 - RNA, 24 nt, Human
uaggauuacaggugugagccaccg

SEQ ID NO: 928349 - RNA, 18 nt, Human
uaggccucccaaguagcu

SEQ ID NO: 928350 - RNA, 24 nt, Human
uaguacagacgggguuucaccaug

SEQ ID NO: 928351 - RNA, 20 nt, Human
uauguugcccaggcuggccu

SEQ ID NO: 928352 - RNA, 22 nt, Human
uauguugcccaggcuggccuug

SEQ ID NO: 928353 - RNA, 24 nt, Human
uauguugcccaggcuggccuugaa

SEQ ID NO: 928354 - RNA, 24 nt, Human
ucaccacaagcucugccucccggg

SEQ ID NO: 928355 - RNA, 24 nt, Human
ucaccauguuagccaggauggucu

SEQ ID NO: 928356 - RNA, 23 nt, Human
ucacgccuguggucccaacaccu

SEQ ID NO: 928357 - RNA, 23 nt, Human
ucacugcaaccuugaccucccgg

SEQ ID NO: 928358 - RNA, 24 nt, Human
ucacugcaaccuugaccucccggg

SEQ ID NO: 928359 - RNA, 18 nt, Human
ucacugcaagcucugccu

SEQ ID NO: 928360 - RNA, 23 nt, Human
ucacugcaagcucugccuccugg

SEQ ID NO: 928361 - RNA, 24 nt, Human
ucacugcaagcucugccuccuggg

SEQ ID NO: 928362 - RNA, 23 nt, Human
uccacggcacgaugcaugugcag

SEQ ID NO: 928363 - RNA, 24 nt, Human
uccagaguagcugggacuacaggc

SEQ ID NO: 928364 - RNA, 23 nt, Human
uccagccugggcagcagagugag

SEQ ID NO: 928365 - RNA, 24 nt, Human
uccagccugggcagcagagugaga

SEQ ID NO: 928366 - RNA, 23 nt, Human
ucccaaagugcuaggauuacagg

SEQ ID NO: 928367 - RNA, 18 nt, Human
ucccaaagugcugggauu

SEQ ID NO: 928368 - RNA, 23 nt, Human
ucccaaagugcugggauuacaga

SEQ ID NO: 928369 - RNA, 24 nt, Human
ucccaaguagcugggacuacuggc

SEQ ID NO: 928370 - RNA, 23 nt, Human
ucccgggcccaagugaaccucuc

SEQ ID NO: 928371 - RNA, 21 nt, Human
ucccggguucacaccauucuc

SEQ ID NO: 928372 - RNA, 24 nt, Human
ucccggguucacaccauucuccug

SEQ ID NO: 928373 - RNA, 19 nt, Human
ucccugaguucaagucccu

SEQ ID NO: 928374 - RNA, 21 nt, Human
uccugagcuaaaguggugagc

SEQ ID NO: 928375 - RNA, 22 nt, Human
uccuguaucaacaacuacaaaa

SEQ ID NO: 928376 - RNA, 19 nt, Human
ucgcacugucacccaggcc

SEQ ID NO: 928377 - RNA, 25 nt, Human
ucgcacugucacccaggccuggagu

SEQ ID NO: 928378 - RNA, 23 nt, Human
ucgccuuggucucccaaagugcu

SEQ ID NO: 928379 - RNA, 18 nt, Human
ucgcuugagccugggagg

SEQ ID NO: 928380 - RNA, 23 nt, Human
ucgcuugagccugggaggucgag

SEQ ID NO: 928381 - RNA, 23 nt, Human
ucgcuugaguccaggaguucaag

SEQ ID NO: 928382 - RNA, 18 nt, Human
ucggccucccaaagugcu

SEQ ID NO: 928383 - RNA, 18 nt, Human
ucuauguugcccaggcug

SEQ ID NO: 928384 - RNA, 24 nt, Human
ucuauguugcccaggcuggccuug

SEQ ID NO: 928385 - RNA, 23 nt, Human
ucucaaaccaucauucccauccu

SEQ ID NO: 928386 - RNA, 18 nt, Human
ucucacucuauugcccag

SEQ ID NO: 928387 - RNA, 23 nt, Human
ucucacucuauugcccaggcugg

SEQ ID NO: 928388 - RNA, 26 nt, Human
ucucacucuauugcccaggcugguuu

SEQ ID NO: 928389 - RNA, 27 nt, Human
ucucacucuauugcccaggcugguuug

SEQ ID NO: 928390 - RNA, 25 nt, Human
ucucgcacugucacccaggccugga

SEQ ID NO: 928391 - RNA, 19 nt, Human
ucucgcucugucacccagg

SEQ ID NO: 928392 - RNA, 23 nt, Human
ucucgcucugucacccaggcugg

SEQ ID NO: 928393 - RNA, 24 nt, Human
ucucgcucugucacccaggcugga

SEQ ID NO: 928394 - RNA, 18 nt, Human
ucugaggcaggaggaucg

SEQ ID NO: 928395 - RNA, 19 nt, Human
ucuguauugauugaggaag

SEQ ID NO: 928396 - RNA, 18 nt, Human
ucugucacccaggcugga

SEQ ID NO: 928397 - RNA, 23 nt, Human
ugaagaguguuucucagaaacaa

SEQ ID NO: 928398 - RNA, 21 nt, Human
ugaauagaagacccuuuugaa

SEQ ID NO: 928399 - RNA, 22 nt, Human
ugacagcucacugcaaccuuga

SEQ ID NO: 928400 - RNA, 21 nt, Human
ugagaaauguaauagagagug

SEQ ID NO: 928401 - RNA, 22 nt, Human
ugagacagggucucgcacuguc

SEQ ID NO: 928402 - RNA, 25 nt, Human
ugagacgggucagucgcuugagucc

SEQ ID NO: 928403 - RNA, 20 nt, Human
ugagaucucagaauucugug

SEQ ID NO: 928404 - RNA, 22 nt, Human
ugagauggggucucgcucuguc

SEQ ID NO: 928405 - RNA, 18 nt, Human
ugagccugggaggucgag

SEQ ID NO: 928406 - RNA, 22 nt, Human
ugagcugugauugugccacugu

SEQ ID NO: 928407 - RNA, 21 nt, Human
ugaggaaucugcaucucaaca

SEQ ID NO: 928408 - RNA, 24 nt, Human
ugaggaaucugcaucucaacagaa

SEQ ID NO: 928409 - RNA, 24 nt, Human
ugaggcaggaggaucgcuugagcc

SEQ ID NO: 928410 - RNA, 25 nt, Human
ugaggcaggaggaucgcuugagccu

SEQ ID NO: 928411 - RNA, 22 nt, Human
ugcaguggcgcgaucucggcuc

SEQ ID NO: 928412 - RNA, 24 nt, Human
ugcccaggcuggccuugaauuccu

SEQ ID NO: 928413 - RNA, 19 nt, Human
ugccucccggguucacacc

SEQ ID NO: 928414 - RNA, 24 nt, Human
ugcuaggauuacaggugugagcca

SEQ ID NO: 928415 - RNA, 21 nt, Human
ugcugagggaggcugcuaauu

SEQ ID NO: 928416 - RNA, 18 nt, Human
ugcugggauuacagaugu

SEQ ID NO: 928417 - RNA, 24 nt, Human
ugcugggauuacagaugugaguca

SEQ ID NO: 928418 - RNA, 19 nt, Human
uggacacagugguucacgc

SEQ ID NO: 928419 - RNA, 20 nt, Human
uggagcaucucagccccagc

SEQ ID NO: 928420 - RNA, 24 nt, Human
uggagcgcgguggcgcagucucgg

SEQ ID NO: 928421 - RNA, 23 nt, Human
uggagugcaguggcgcgaucucg

SEQ ID NO: 928422 - RNA, 24 nt, Human
uggagugcaguggcgcgaucucgg

SEQ ID NO: 928423 - RNA, 24 nt, Human
uggccucaagccaucuucucgccu

SEQ ID NO: 928424 - RNA, 20 nt, Human
uggccuugaauuccuggccu

SEQ ID NO: 928425 - RNA, 24 nt, Human
uggcgcaaugacagcucacugcaa

SEQ ID NO: 928426 - RNA, 28 nt, Human
uggcgcaaugacagcucacugcaaccuu

SEQ ID NO: 928427 - RNA, 20 nt, Human
uggcgcagucucggcucacu

SEQ ID NO: 928428 - RNA, 24 nt, Human
uggcgcgaucucggcucaccacaa

SEQ ID NO: 928429 - RNA, 20 nt, Human
uggcuggacuaagauuuagc

SEQ ID NO: 928430 - RNA, 21 nt, Human
ugggacuacaggcacaugcca

SEQ ID NO: 928431 - RNA, 22 nt, Human
ugggacuacaggcacaugccac

SEQ ID NO: 928432 - RNA, 24 nt, Human
ugggacuacaggcacaugccacca

SEQ ID NO: 928433 - RNA, 25 nt, Human
ugggacuacaggcacaugccaccau

SEQ ID NO: 928434 - RNA, 24 nt, Human
ugggacuacuggcgccugccacca

SEQ ID NO: 928435 - RNA, 23 nt, Human
ugggaggcugagacgggucaguc

SEQ ID NO: 928436 - RNA, 24 nt, Human
ugggaggcugagacgggucagucg

SEQ ID NO: 928437 - RNA, 24 nt, Human
ugggaggucgagacuucagugagc

SEQ ID NO: 928438 - RNA, 18 nt, Human
ugggauuacagaugugag

SEQ ID NO: 928439 - RNA, 19 nt, Human
ugggauuacagaugugagu

SEQ ID NO: 928440 - RNA, 22 nt, Human
ugggauuacagaugugagucac

SEQ ID NO: 928441 - RNA, 24 nt, Human
ugggauuacagaugugagucacca

SEQ ID NO: 928442 - RNA, 25 nt, Human
ugggauuacagaugugagucaccau

SEQ ID NO: 928443 - RNA, 21 nt, Human
ugggcagcagagugagauccu

SEQ ID NO: 928444 - RNA, 24 nt, Human
uggggucucgcucugucacccagg

SEQ ID NO: 928445 - RNA, 24 nt, Human
ugguucacgccuguggucccaaca

SEQ ID NO: 928446 - RNA, 24 nt, Human
ugucugaggcaggaggaucgcuug

SEQ ID NO: 928447 - RNA, 21 nt, Human
ugugagucaccaugcucggcc

SEQ ID NO: 928448 - RNA, 22 nt, Human
ugugccacuguacuccagccug

SEQ ID NO: 928449 - RNA, 24 nt, Human
uguuggcacacaccugugguccca

SEQ ID NO: 928450 - RNA, 24 nt, Human
uuaguacagacgggguuucaccau

SEQ ID NO: 928451 - RNA, 24 nt, Human
uucuuuuagauuaaauauuucuuu

SEQ ID NO: 928452 - RNA, 21 nt, Human
uugagauggggucucgcucug

SEQ ID NO: 928453 - RNA, 22 nt, Human
uugaguccaggaguucaagacc

SEQ ID NO: 928454 - RNA, 20 nt, Human
uuggaucugcucagaugcuu

SEQ ID NO: 928455 - RNA, 23 nt, Human
uuguauuuuuaguacagacgggg

SEQ ID NO: 928456 - RNA, 23 nt, Human
uugugccacuguacuccagccug

SEQ ID NO: 928457 - RNA, 19 nt, Human
uuucaccauguuagccagg

SEQ ID NO: 928458 - RNA, 20 nt, Human
uuucaccauguuagccagga

SEQ ID NO: 928459 - RNA, 22 nt, Human
uuugagauggggucucgcucug

SEQ ID NO: 928460 - RNA, 24 nt, Human
uuuuauaaagccuuccuacuaaaa

SEQ ID NO: 928461 - RNA, 19 nt, Human
uuuuuagauaaggaaaauu

SEQ ID NO: 928462 - RNA, 24 nt, Human
uuuuuaguacagacgggguuucac

SEQ ID NO: 928463 - RNA, 24 nt, Human
uuuuuuguauuuuuaguacagacg

SEQ ID NO: 928464 - RNA, 24 nt, Human
uuuuuuguauuuuuuauagagaca

SEQ ID NO: 928465 - RNA, 24 nt, Human
uuuuuuuuuugagacagggucucg

SEQ ID NO: 928466 - RNA, 24 nt, Human
uuuuuuuuuugagauggggucucg

SEQ ID NO: 928467 - RNA, 20 nt, Human
uuuuuuuuuuugagacaggg

SEQ ID NO: 928468 - RNA, 23 nt, Human
uuuuuuuuuuuugagacaggguc

SEQ ID NO: 928469 - RNA, 25 nt, Human
uuuuuuuuuuuugagauggggucuc

SEQ ID NO: 928470 - RNA, 18 nt, Human
aaaugggguugagaaccc

SEQ ID NO: 928471 - RNA, 24 nt, Human
aagaauaagauauauuuaagagga

SEQ ID NO: 928472 - RNA, 19 nt, Human
aagacacagaagaauaaga

SEQ ID NO: 928473 - RNA, 21 nt, Human
aagacacagaagaauaagaua

SEQ ID NO: 928474 - RNA, 20 nt, Human
aagcccugcagucacccaaa

SEQ ID NO: 928475 - RNA, 20 nt, Human
aagcccugcagucacccaaa

SEQ ID NO: 928476 - RNA, 23 nt, Human
acagcuggagccaaaucugcuga

SEQ ID NO: 928477 - RNA, 21 nt, Human
accguuccuccauucccuucu

SEQ ID NO: 928478 - RNA, 22 nt, Human
acugugugaccucaagcagguc

SEQ ID NO: 928479 - RNA, 20 nt, Human
aggggcuagcucgaggcagg

SEQ ID NO: 928480 - RNA, 20 nt, Human
caaaagcccuagagucaccc

SEQ ID NO: 928481 - RNA, 22 nt, Human
caaaagcccuagaguccagaca

SEQ ID NO: 928482 - RNA, 19 nt, Human
caaagcccuagagucaccc

SEQ ID NO: 928483 - RNA, 22 nt, Human
cacccaaaagcccuagagucac

SEQ ID NO: 928484 - RNA, 24 nt, Human
cacccaaaagcccuagaguccaga

SEQ ID NO: 928485 - RNA, 22 nt, Human
cacccaaaagcccugcagucac

SEQ ID NO: 928486 - RNA, 22 nt, Human
cacccaaaagcccugcagucac

SEQ ID NO: 928487 - RNA, 23 nt, Human
cagccaccgcaccuggaccuuuc

SEQ ID NO: 928488 - RNA, 19 nt, Human
caggagugaugacgggugg

SEQ ID NO: 928489 - RNA, 25 nt, Human
cagucacccaaaagcccuagagucc

SEQ ID NO: 928490 - RNA, 21 nt, Human
cagugagguaugguggugugc

SEQ ID NO: 928491 - RNA, 19 nt, Human
cccaaaagcccuagaguca

SEQ ID NO: 928492 - RNA, 22 nt, Human
cccaaaagcccuagagucaccc

SEQ ID NO: 928493 - RNA, 20 nt, Human
cccaaaagcccugcagucac

SEQ ID NO: 928494 - RNA, 20 nt, Human
cccaaaagcccugcagucac

SEQ ID NO: 928495 - RNA, 24 nt, Human
cccaaagcccuagagucacucaaa

SEQ ID NO: 928496 - RNA, 24 nt, Human
cccaaagcccuagagucacucaaa

SEQ ID NO: 928497 - RNA, 22 nt, Human
cccuagagucacucaaaagccc

SEQ ID NO: 928498 - RNA, 22 nt, Human
cccuagagucacucaaaagccc

SEQ ID NO: 928499 - RNA, 22 nt, Human
cccuagaguccagacagcugga

SEQ ID NO: 928500 - RNA, 21 nt, Human
ccuagagucacccaaaagccc

SEQ ID NO: 928501 - RNA, 21 nt, Human
ccuagagucacccaaaagccc

SEQ ID NO: 928502 - RNA, 21 nt, Human
ccuagagucacucaaaagccc

SEQ ID NO: 928503 - RNA, 21 nt, Human
ccuagagucacucaaaagccc

SEQ ID NO: 928504 - RNA, 21 nt, Human
ccuguugacagaagcccuaga

SEQ ID NO: 928505 - RNA, 19 nt, Human
cuagagucacucaaaagcc

SEQ ID NO: 928506 - RNA, 19 nt, Human
cuagagucacucaaaagcc

SEQ ID NO: 928507 - RNA, 21 nt, Human
cucaaaagcccuagagucacc

SEQ ID NO: 928508 - RNA, 21 nt, Human
cucaaaagcccuagagucacc

SEQ ID NO: 928509 - RNA, 22 nt, Human
cucaaaagcccuagagucaccc

SEQ ID NO: 928510 - RNA, 19 nt, Human
cucucagcaaggccuccca

SEQ ID NO: 928511 - RNA, 26 nt, Human
cucuucuucccucugccucucuguca

SEQ ID NO: 928512 - RNA, 19 nt, Human
cugcagucacccaaaagcc

SEQ ID NO: 928513 - RNA, 19 nt, Human
cugcagucacccaaaagcc

SEQ ID NO: 928514 - RNA, 19 nt, Human
gaagcagccaccgcaccug

SEQ ID NO: 928515 - RNA, 22 nt, Human
gacagaagcccuagagucaccc

SEQ ID NO: 928516 - RNA, 22 nt, Human
gaggaagcagccaccgcaccug

SEQ ID NO: 928517 - RNA, 20 nt, Human
ggaggagagcuugugggaga

SEQ ID NO: 928518 - RNA, 19 nt, Human
uagagucacccaaaagccc

SEQ ID NO: 928519 - RNA, 22 nt, Human
uagaguccagacagcuggagcc

SEQ ID NO: 928520 - RNA, 25 nt, Human
uaugguggugugccuuacuugagag

SEQ ID NO: 928521 - RNA, 24 nt, Human
ucaagcaggucauuuaaacucaug

SEQ ID NO: 928522 - RNA, 24 nt, Human
ucacccaaaagcccuagagucacc

SEQ ID NO: 928523 - RNA, 24 nt, Human
ucagugcaguuugguaauacagga

SEQ ID NO: 928524 - RNA, 19 nt, Human
ucccuucuccccuuaucag

SEQ ID NO: 928525 - RNA, 22 nt, Human
uccuccauucccuucuccccuu

SEQ ID NO: 928526 - RNA, 21 nt, Human
ucuucugcagucucuugaaag

SEQ ID NO: 928527 - RNA, 19 nt, Human
ugaaaagggcuaaaauuua

SEQ ID NO: 928528 - RNA, 22 nt, Human
ugacagaagcccuagagucacc

SEQ ID NO: 928529 - RNA, 20 nt, Human
ugacugugugaccucaagca

SEQ ID NO: 928530 - RNA, 18 nt, Human
ugagaggcggaggagagc

SEQ ID NO: 928531 - RNA, 26 nt, Human
ugaguggaucuuuucuucugcagucu

SEQ ID NO: 928532 - RNA, 18 nt, Human
ugccccaggcucauucag

SEQ ID NO: 928533 - RNA, 19 nt, Human
ugccccaggcucauucagu

SEQ ID NO: 928534 - RNA, 21 nt, Human
uggaguaggcgcccaggcauc

SEQ ID NO: 928535 - RNA, 25 nt, Human
uggcaggagugaugacgggugggau

SEQ ID NO: 928536 - RNA, 21 nt, Human
ugggaaaacagugagguaugg

SEQ ID NO: 928537 - RNA, 20 nt, Human
ugguggggccugaggccagu

SEQ ID NO: 928538 - RNA, 24 nt, Human
ugugccuuacuugagaggcggagg

SEQ ID NO: 928539 - RNA, 19 nt, Human
uucucuucuucccucugcc

SEQ ID NO: 928540 - RNA, 18 nt, Human
uuuaaacuuugcauuguu

SEQ ID NO: 928541 - RNA, 24 nt, Human
uuuuuuugccccaggcucauucag

SEQ ID NO: 928542 - RNA, 21 nt, Human
aaaccauucauaucaguauug

SEQ ID NO: 928543 - RNA, 18 nt, Human
aaccuuugacugcuuccu

SEQ ID NO: 928544 - RNA, 20 nt, Human
acugauuuauauccuguuca

SEQ ID NO: 928545 - RNA, 19 nt, Human
acugcuuccucucucaacc

SEQ ID NO: 928546 - RNA, 24 nt, Human
acuguuuguacaggaacauguuga

SEQ ID NO: 928547 - RNA, 22 nt, Human
agaaaggaggcucacagaggua

SEQ ID NO: 928548 - RNA, 18 nt, Human
agacaaaaacaagacuga

SEQ ID NO: 928549 - RNA, 21 nt, Human
agucaaaguagagaaaggagg

SEQ ID NO: 928550 - RNA, 25 nt, Human
auaaauacuacuuccugauucucau

SEQ ID NO: 928551 - RNA, 22 nt, Human
aucucacccuucuggguuccag

SEQ ID NO: 928552 - RNA, 21 nt, Human
augaauguucaugugugugca

SEQ ID NO: 928553 - RNA, 20 nt, Human
augcaaugaauguucaugug

SEQ ID NO: 928554 - RNA, 22 nt, Human
caaaccauucauaucaguauug

SEQ ID NO: 928555 - RNA, 22 nt, Human
caaguuagacaaaaacaagacu

SEQ ID NO: 928556 - RNA, 23 nt, Human
caaugaaagaaaaugauuccaga

SEQ ID NO: 928557 - RNA, 18 nt, Human
cacacaaguuagacaaaa

SEQ ID NO: 928558 - RNA, 20 nt, Human
cagaauaccccauaaaacca

SEQ ID NO: 928559 - RNA, 22 nt, Human
caguagauuggcauaaccuucc

SEQ ID NO: 928560 - RNA, 23 nt, Human
cauaaccuuccuguaaaauccaa

SEQ ID NO: 928561 - RNA, 25 nt, Human
caucacacaaguuagacaaaaacaa

SEQ ID NO: 928562 - RNA, 25 nt, Human
caugcaaugaauguucaugugugug

SEQ ID NO: 928563 - RNA, 18 nt, Human
caugcccucauuagcaau

SEQ ID NO: 928564 - RNA, 24 nt, Human
ccaaaaugaagcugauagugcuac

SEQ ID NO: 928565 - RNA, 23 nt, Human
ccaaucuggaaaccuuugacugc

SEQ ID NO: 928566 - RNA, 27 nt, Human
ccaucuucuccauaaucauuuccagaa

SEQ ID NO: 928567 - RNA, 19 nt, Human
ccccauaaaaccaaauuac

SEQ ID NO: 928568 - RNA, 19 nt, Human
cccccuuccuuccuuccca

SEQ ID NO: 928569 - RNA, 18 nt, Human
ccuuuuguagaacgagag

SEQ ID NO: 928570 - RNA, 21 nt, Human
cggugaguucuucccaggcuu

SEQ ID NO: 928571 - RNA, 20 nt, Human
cucaaacucaucacacaagu

SEQ ID NO: 928572 - RNA, 21 nt, Human
cuccauacuacuccccaaaag

SEQ ID NO: 928573 - RNA, 24 nt, Human
cucccucuaauucaccuuuuguag

SEQ ID NO: 928574 - RNA, 23 nt, Human
cuuaacagcagucaaaguagaga

SEQ ID NO: 928575 - RNA, 18 nt, Human
cuuacucuugauuucugu

SEQ ID NO: 928576 - RNA, 20 nt, Human
cuuccuguaaaauccaaauu

SEQ ID NO: 928577 - RNA, 21 nt, Human
cuuugacugcuuccucucuca

SEQ ID NO: 928578 - RNA, 19 nt, Human
gaguuaucuuuccaaaauu

SEQ ID NO: 928579 - RNA, 18 nt, Human
gcgcccccuuccuuccuu

SEQ ID NO: 928580 - RNA, 27 nt, Human
guagagaaaggaggcucaacccaagag

SEQ ID NO: 928581 - RNA, 20 nt, Human
gucaaaguagagaaaggagg

SEQ ID NO: 928582 - RNA, 23 nt, Human
guuaaaauacaagaaccuugcca

SEQ ID NO: 928583 - RNA, 26 nt, Human
uacacaacucaaacucaucacacaag

SEQ ID NO: 928584 - RNA, 18 nt, Human
uaccccauaaaaccaaau

SEQ ID NO: 928585 - RNA, 21 nt, Human
uauuugaguaaaaacugaggg

SEQ ID NO: 928586 - RNA, 24 nt, Human
ucaaaguagagaaaggaggcucac

SEQ ID NO: 928587 - RNA, 18 nt, Human
uccccaaaagacagaggc

SEQ ID NO: 928588 - RNA, 22 nt, Human
uccuccauacuacuccccaaaa

SEQ ID NO: 928589 - RNA, 18 nt, Human
uccuuccuucccagcucc

SEQ ID NO: 928590 - RNA, 21 nt, Human
ucuaccuuaccgccaucucac

SEQ ID NO: 928591 - RNA, 23 nt, Human
ucugugugacaggugggccacag

SEQ ID NO: 928592 - RNA, 20 nt, Human
ugaaauuagaauaauccucc

SEQ ID NO: 928593 - RNA, 18 nt, Human
ugggaaauuuguuagugc

SEQ ID NO: 928594 - RNA, 24 nt, Human
uguagaacgagaguuaucuuucca

SEQ ID NO: 928595 - RNA, 25 nt, Human
ugugugcacuguuuguacaggaaca

SEQ ID NO: 928596 - RNA, 23 nt, Human
uuagcaaucaaguggauuugugu

SEQ ID NO: 928597 - RNA, 21 nt, Human
uuccuucccagcucccucuaa

SEQ ID NO: 928598 - RNA, 22 nt, Human
uugacugcuuccucucucaacc

SEQ ID NO: 928599 - RNA, 23 nt, Human
uugaguaaaaacugaggguggga

SEQ ID NO: 928600 - RNA, 21 nt, Human
uuucaaaauaaccuuaaaaca

SEQ ID NO: 928601 - RNA, 24 nt, Human
uuuuuuuuuuuuuuuuuuaauaug

SEQ ID NO: 928602 - RNA, 27 nt, Human
aaaaaaaaaaaaaagcggcuggggcag

SEQ ID NO: 928603 - RNA, 20 nt, Human
aaaaaaaaaaagcggcuggg

SEQ ID NO: 928604 - RNA, 25 nt, Human
aaagccuuuuguccuuccuucuuac

SEQ ID NO: 928605 - RNA, 24 nt, Human
aaaucagugccacuggcaagccag

SEQ ID NO: 928606 - RNA, 22 nt, Human
aaauggaaguaaauguuacccc

SEQ ID NO: 928607 - RNA, 19 nt, Human
aaggaaaagucagaaacca

SEQ ID NO: 928608 - RNA, 24 nt, Human
aauaaauguaaauucauuguacaa

SEQ ID NO: 928609 - RNA, 19 nt, Human
acaaaaaaaaaaaaaaagc

SEQ ID NO: 928610 - RNA, 20 nt, Human
acaaaaaaaaaaaaaaagcg

SEQ ID NO: 928611 - RNA, 24 nt, Human
acagcagugguucccaaacauuga

SEQ ID NO: 928612 - RNA, 20 nt, Human
acccccaaaauacaaaucaa

SEQ ID NO: 928613 - RNA, 24 nt, Human
acucuucuuugggggcagggggug

SEQ ID NO: 928614 - RNA, 20 nt, Human
agaaaccagaauagaaggug

SEQ ID NO: 928615 - RNA, 21 nt, Human
agauguagaaggaucuggaac

SEQ ID NO: 928616 - RNA, 21 nt, Human
aggaaaagucagaaaccagaa

SEQ ID NO: 928617 - RNA, 22 nt, Human
aguuuguagaaagggcagauuu

SEQ ID NO: 928618 - RNA, 18 nt, Human
augucacauuuuauguuc

SEQ ID NO: 928619 - RNA, 20 nt, Human
cacccgaaagucuaacuuaa

SEQ ID NO: 928620 - RNA, 20 nt, Human
cacuggcaagccagggaaau

SEQ ID NO: 928621 - RNA, 24 nt, Human
cagaauagaaggugguaccuccag

SEQ ID NO: 928622 - RNA, 24 nt, Human
cagcaaguugagaguaaaagcuaa

SEQ ID NO: 928623 - RNA, 21 nt, Human
cagcuacagagagccagcuac

SEQ ID NO: 928624 - RNA, 22 nt, Human
cagguacccccaaaauacaaau

SEQ ID NO: 928625 - RNA, 31 nt, Human
cagguacccccaaaauacaaaucaaaauagu

SEQ ID NO: 928626 - RNA, 25 nt, Human
caucaagaaggaaaagucagaaacc

SEQ ID NO: 928627 - RNA, 19 nt, Human
ccacacccgaaagucuaac

SEQ ID NO: 928628 - RNA, 23 nt, Human
ccccugagagagaagccacaccc

SEQ ID NO: 928629 - RNA, 24 nt, Human
cccuuacagcagugguucccaaac

SEQ ID NO: 928630 - RNA, 23 nt, Human
cuaaagccuuuuguccuuccuuc

SEQ ID NO: 928631 - RNA, 24 nt, Human
cuaacuuaaggaauguaaagagaa

SEQ ID NO: 928632 - RNA, 21 nt, Human
cuagccaucuaucagcuacag

SEQ ID NO: 928633 - RNA, 22 nt, Human
cucaacacagguacccccaaaa

SEQ ID NO: 928634 - RNA, 22 nt, Human
cugaaagggaagaccucagucu

SEQ ID NO: 928635 - RNA, 22 nt, Human
cuggcaagccagggaaaugaaa

SEQ ID NO: 928636 - RNA, 23 nt, Human
cuggcaagccagggaaaugaaau

SEQ ID NO: 928637 - RNA, 19 nt, Human
cuuacuucccugggcugga

SEQ ID NO: 928638 - RNA, 18 nt, Human
gaauguggggugagagag

SEQ ID NO: 928639 - RNA, 22 nt, Human
gacacacacaaaaaaaaaaaaa

SEQ ID NO: 928640 - RNA, 21 nt, Human
gagagagaagccacacccgaa

SEQ ID NO: 928641 - RNA, 20 nt, Human
ggcccagagggucaaauuua

SEQ ID NO: 928642 - RNA, 19 nt, Human
ggguaguuuguagaaaggg

SEQ ID NO: 928643 - RNA, 20 nt, Human
guccuuccuucuuaccacac

SEQ ID NO: 928644 - RNA, 22 nt, Human
gucuaacuuaaggaauguaaag

SEQ ID NO: 928645 - RNA, 23 nt, Human
uaaaagaggacucuucuuugggg

SEQ ID NO: 928646 - RNA, 21 nt, Human
uacccccaaaauacaaaucaa

SEQ ID NO: 928647 - RNA, 25 nt, Human
uacuuggaaccuccucccuucucuc

SEQ ID NO: 928648 - RNA, 19 nt, Human
uaucaaaugucacauuuua

SEQ ID NO: 928649 - RNA, 21 nt, Human
ucccuaaaagaggacucuucu

SEQ ID NO: 928650 - RNA, 26 nt, Human
ucccuaaaagaggacucuucuuuggg

SEQ ID NO: 928651 - RNA, 26 nt, Human
uccuuugacaaugacaugcucuguaa

SEQ ID NO: 928652 - RNA, 23 nt, Human
ucucagggccacagauuuccuuu

SEQ ID NO: 928653 - RNA, 19 nt, Human
ucuuucugcugaaagggaa

SEQ ID NO: 928654 - RNA, 23 nt, Human
ugaagguucugauucccuaaaag

SEQ ID NO: 928655 - RNA, 23 nt, Human
ugagagagguggguuauugaaau

SEQ ID NO: 928656 - RNA, 20 nt, Human
ugagaguaaaagcuaaaaug

SEQ ID NO: 928657 - RNA, 21 nt, Human
ugcaacagaacaacuugggua

SEQ ID NO: 928658 - RNA, 21 nt, Human
uggaaccuccucccuucucuc

SEQ ID NO: 928659 - RNA, 22 nt, Human
uggggugagagagguggguuau

SEQ ID NO: 928660 - RNA, 20 nt, Human
uguaaauucauuguacaaaa

SEQ ID NO: 928661 - RNA, 22 nt, Human
ugucaccauaaauaaauguaaa

SEQ ID NO: 928662 - RNA, 20 nt, Human
uuaaacucauuggguguucg

SEQ ID NO: 928663 - RNA, 23 nt, Human
uucugauucccuaaaagaggacu

SEQ ID NO: 928664 - RNA, 19 nt, Human
uugagaguaaaagcuaaaa

SEQ ID NO: 928665 - RNA, 19 nt, Human
uuggaaccuccucccuucu

SEQ ID NO: 928666 - RNA, 20 nt, Human
aaaacaaacaacaaaacgug

SEQ ID NO: 928667 - RNA, 24 nt, Human
aaacaaaacaaaacaaacaacaaa

SEQ ID NO: 928668 - RNA, 26 nt, Human
aaacaaaacaaaacaaacaacaaaac

SEQ ID NO: 928669 - RNA, 21 nt, Human
aaacaaguacaaagagccagg

SEQ ID NO: 928670 - RNA, 18 nt, Human
aaagagccagggcauuag

SEQ ID NO: 928671 - RNA, 22 nt, Human
aaagugcugguaauacaagcuu

SEQ ID NO: 928672 - RNA, 18 nt, Human
aaauaucacccucagaca

SEQ ID NO: 928673 - RNA, 24 nt, Human
aacaaaacaaaacaaacaacaaaa

SEQ ID NO: 928674 - RNA, 20 nt, Human
aacaaaacaaacaacaaaac

SEQ ID NO: 928675 - RNA, 21 nt, Human
aaccucuccaagcuuaugcug

SEQ ID NO: 928676 - RNA, 23 nt, Human
aacgugugugugugugugugugu

SEQ ID NO: 928677 - RNA, 24 nt, Human
aagaagacugcuuguuaaacauuu

SEQ ID NO: 928678 - RNA, 20 nt, Human
aagagccagggcauuaggug

SEQ ID NO: 928679 - RNA, 23 nt, Human
acaaaacaaaacaaacaacaaaa

SEQ ID NO: 928680 - RNA, 26 nt, Human
accucacuuaucugauauuucuucca

SEQ ID NO: 928681 - RNA, 22 nt, Human
acgugugugugugugugugugu

SEQ ID NO: 928682 - RNA, 22 nt, Human
acgugugugugugugugugugu

SEQ ID NO: 928683 - RNA, 21 nt, Human
acuccagaaaugcccaguccu

SEQ ID NO: 928684 - RNA, 23 nt, Human
acucuccaauuaucuucaugaaa

SEQ ID NO: 928685 - RNA, 24 nt, Human
acucuccaauuaucuucaugaaag

SEQ ID NO: 928686 - RNA, 25 nt, Human
acucuguugcccaggcuggaguaca

SEQ ID NO: 928687 - RNA, 19 nt, Human
acugaagccuugaccucuu

SEQ ID NO: 928688 - RNA, 26 nt, Human
acugcaccuggccagauuucuuaauc

SEQ ID NO: 928689 - RNA, 26 nt, Human
agaguccucugaugcccuguccacuc

SEQ ID NO: 928690 - RNA, 24 nt, Human
agauggugaugauauuugaaaaug

SEQ ID NO: 928691 - RNA, 18 nt, Human
agccuccugaauagcugg

SEQ ID NO: 928692 - RNA, 21 nt, Human
aggcaaacaaaauagguaucc

SEQ ID NO: 928693 - RNA, 20 nt, Human
aguacaguggugcaaucaug

SEQ ID NO: 928694 - RNA, 23 nt, Human
aguacaguggugcaaucauggcu

SEQ ID NO: 928695 - RNA, 21 nt, Human
augcccaguccuuucuggagg

SEQ ID NO: 928696 - RNA, 24 nt, Human
auggcucacugaagccuugaccuc

SEQ ID NO: 928697 - RNA, 19 nt, Human
augggguuuugccauguug

SEQ ID NO: 928698 - RNA, 24 nt, Human
augggguuuugccauguugcccag

SEQ ID NO: 928699 - RNA, 21 nt, Human
caaaacaaaacaaaacaaaca

SEQ ID NO: 928700 - RNA, 24 nt, Human
caaaacaaaacagcaggaauaaau

SEQ ID NO: 928701 - RNA, 27 nt, Human
caaaacgugugugugugugugugugug

SEQ ID NO: 928702 - RNA, 19 nt, Human
caaaagaaaggcaaacaaa

SEQ ID NO: 928703 - RNA, 22 nt, Human
caaaagaucaaaacaaaacaaa

SEQ ID NO: 928704 - RNA, 24 nt, Human
caaaagaucaaaacaaaacaaaac

SEQ ID NO: 928705 - RNA, 22 nt, Human
cacucuguugcccaggcuggag

SEQ ID NO: 928706 - RNA, 23 nt, Human
cagagcaucauuugucauaacuu

SEQ ID NO: 928707 - RNA, 18 nt, Human
cagaguccucugaugccc

SEQ ID NO: 928708 - RNA, 23 nt, Human
cagcaggaauaaauaucacccuc

SEQ ID NO: 928709 - RNA, 24 nt, Human
cagggucucacucuguugcccagg

SEQ ID NO: 928710 - RNA, 22 nt, Human
caugccucuuucucauucaaaa

SEQ ID NO: 928711 - RNA, 20 nt, Human
cauggcucacugaagccuug

SEQ ID NO: 928712 - RNA, 22 nt, Human
cauguugcccaggcugcucuug

SEQ ID NO: 928713 - RNA, 24 nt, Human
cauguugcccaggcugcucuugaa

SEQ ID NO: 928714 - RNA, 24 nt, Human
cauuccuguuuccaccuaugggga

SEQ ID NO: 928715 - RNA, 23 nt, Human
cauuucuuauuucugccucccua

SEQ ID NO: 928716 - RNA, 23 nt, Human
ccacuaagcuaucugagcuucua

SEQ ID NO: 928717 - RNA, 18 nt, Human
ccacugcaccuggccaga

SEQ ID NO: 928718 - RNA, 19 nt, Human
ccacugcaccuggccagau

SEQ ID NO: 928719 - RNA, 21 nt, Human
ccauguugcccaggcugcucu

SEQ ID NO: 928720 - RNA, 22 nt, Human
cccaacucugcaaugaaugaac

SEQ ID NO: 928721 - RNA, 22 nt, Human
ccccuagagcacagagaauaga

SEQ ID NO: 928722 - RNA, 23 nt, Human
ccuaccugguccccaaaacaaaa

SEQ ID NO: 928723 - RNA, 22 nt, Human
ccucccuaccugguccccaaaa

SEQ ID NO: 928724 - RNA, 24 nt, Human
ccugaauagcugggacuaugggug

SEQ ID NO: 928725 - RNA, 20 nt, Human
ccuucucuggguuuucuugg

SEQ ID NO: 928726 - RNA, 24 nt, Human
cucacucuguugcccaggcuggag

SEQ ID NO: 928727 - RNA, 18 nt, Human
cuccugaauagcugggac

SEQ ID NO: 928728 - RNA, 23 nt, Human
cugagcuucuaucuccccaucug

SEQ ID NO: 928729 - RNA, 24 nt, Human
cugccuugaccuccuaaagugcug

SEQ ID NO: 928730 - RNA, 23 nt, Human
cuuaccuuagccuccugaauagc

SEQ ID NO: 928731 - RNA, 24 nt, Human
cuuagccuccugaauagcugggac

SEQ ID NO: 928732 - RNA, 20 nt, Human
cuuauuucugccucccuaga

SEQ ID NO: 928733 - RNA, 22 nt, Human
cuuccugccuugaccuccuaaa

SEQ ID NO: 928734 - RNA, 19 nt, Human
cuucugcagcaaucugcau

SEQ ID NO: 928735 - RNA, 21 nt, Human
cuugaacuccugagcuccagg

SEQ ID NO: 928736 - RNA, 24 nt, Human
cuuuuuaauuguaaguuugcugcu

SEQ ID NO: 928737 - RNA, 18 nt, Human
gagaugggguuuugccau

SEQ ID NO: 928738 - RNA, 23 nt, Human
gaucaaaacaaaacaaaacaaac

SEQ ID NO: 928739 - RNA, 18 nt, Human
gcauuuuuuuccaaggga

SEQ ID NO: 928740 - RNA, 22 nt, Human
gcugcuucguacaaagaguaaa

SEQ ID NO: 928741 - RNA, 20 nt, Human
ggaaaguaguagcagcuaga

SEQ ID NO: 928742 - RNA, 22 nt, Human
gggguuuugccauguugcccag

SEQ ID NO: 928743 - RNA, 22 nt, Human
ggguuuugccauguugcccagg

SEQ ID NO: 928744 - RNA, 19 nt, Human
guagagaugggguuuugcc

SEQ ID NO: 928745 - RNA, 21 nt, Human
guagagaugggguuuugccau

SEQ ID NO: 928746 - RNA, 22 nt, Human
guagagaugggguuuugccaug

SEQ ID NO: 928747 - RNA, 19 nt, Human
gugcugguaauacaagcuu

SEQ ID NO: 928748 - RNA, 21 nt, Human
gugugugugugugugugugug

SEQ ID NO: 928749 - RNA, 21 nt, Human
gugugugugugugugugugug

SEQ ID NO: 928750 - RNA, 25 nt, Human
uaaacaaguacaaagagccagggca

SEQ ID NO: 928751 - RNA, 20 nt, Human
uaauagcaacaguuguguua

SEQ ID NO: 928752 - RNA, 22 nt, Human
uacaagcuugagccacugcacc

SEQ ID NO: 928753 - RNA, 23 nt, Human
uacaguggugcaaucauggcuca

SEQ ID NO: 928754 - RNA, 24 nt, Human
uaccuuagccuccugaauagcugg

SEQ ID NO: 928755 - RNA, 23 nt, Human
uagaaugugugcugugauaggga

SEQ ID NO: 928756 - RNA, 20 nt, Human
uagacucuccaauuaucuuc

SEQ ID NO: 928757 - RNA, 22 nt, Human
uagagaugggguuuugccaugu

SEQ ID NO: 928758 - RNA, 20 nt, Human
uagguaaauauuccuaauag

SEQ ID NO: 928759 - RNA, 18 nt, Human
uaggucccaaaagaucaa

SEQ ID NO: 928760 - RNA, 21 nt, Human
uauagcagaugcuaaaugaaa

SEQ ID NO: 928761 - RNA, 21 nt, Human
ucaaaagaaaggcaaacaaaa

SEQ ID NO: 928762 - RNA, 24 nt, Human
ucacucuguugcccaggcuggagu

SEQ ID NO: 928763 - RNA, 24 nt, Human
ucacugaagccuugaccucuuggg

SEQ ID NO: 928764 - RNA, 23 nt, Human
uccccaaaacaaaacagcaggaa

SEQ ID NO: 928765 - RNA, 19 nt, Human
ucccuaccugguccccaaa

SEQ ID NO: 928766 - RNA, 24 nt, Human
uccugaauagcugggacuaugggu

SEQ ID NO: 928767 - RNA, 23 nt, Human
ucucacucuguugcccaggcugg

SEQ ID NO: 928768 - RNA, 24 nt, Human
ucucacucuguugcccaggcugga

SEQ ID NO: 928769 - RNA, 25 nt, Human
ucucacucuguugcccaggcuggag

SEQ ID NO: 928770 - RNA, 26 nt, Human
ucucacucuguugcccaggcuggagu

SEQ ID NO: 928771 - RNA, 25 nt, Human
ucuccaauuaucuucaugaaagaau

SEQ ID NO: 928772 - RNA, 18 nt, Human
ucuguugcccaggcugga

SEQ ID NO: 928773 - RNA, 21 nt, Human
ucuugaacuccugagcuccag

SEQ ID NO: 928774 - RNA, 22 nt, Human
ugaaaaggggauggggagacca

SEQ ID NO: 928775 - RNA, 24 nt, Human
ugaacuccugagcuccagggaucu

SEQ ID NO: 928776 - RNA, 24 nt, Human
ugaaugaacugugcgucauugagc

SEQ ID NO: 928777 - RNA, 20 nt, Human
ugagacagggucucacucug

SEQ ID NO: 928778 - RNA, 22 nt, Human
ugagacagggucucacucuguu

SEQ ID NO: 928779 - RNA, 20 nt, Human
ugagcuccagggaucuuccu

SEQ ID NO: 928780 - RNA, 20 nt, Human
ugauuccaagucacuggccu

SEQ ID NO: 928781 - RNA, 23 nt, Human
ugcaaugaaugaacugugcguca

SEQ ID NO: 928782 - RNA, 24 nt, Human
ugccauguugcccaggcugcucuu

SEQ ID NO: 928783 - RNA, 31 nt, Human
ugccauguugcccaggcugcucuugaacucc

SEQ ID NO: 928784 - RNA, 24 nt, Human
ugcccaggcugcucuugaacuccu

SEQ ID NO: 928785 - RNA, 21 nt, Human
ugcccaggcuggaguacagug

SEQ ID NO: 928786 - RNA, 24 nt, Human
ugcccaggcuggaguacaguggug

SEQ ID NO: 928787 - RNA, 25 nt, Human
ugcucuugaacuccugagcuccagg

SEQ ID NO: 928788 - RNA, 24 nt, Human
uggaguacaguggugcaaucaugg

SEQ ID NO: 928789 - RNA, 24 nt, Human
uggcucacugaagccuugaccucu

SEQ ID NO: 928790 - RNA, 21 nt, Human
ugggacuaugggugaguacca

SEQ ID NO: 928791 - RNA, 23 nt, Human
ugggccaauuagggaaaaaaaaa

SEQ ID NO: 928792 - RNA, 24 nt, Human
ugggcucaggugauuuucuuaccu

SEQ ID NO: 928793 - RNA, 24 nt, Human
ugggguuuugccauguugcccagg

SEQ ID NO: 928794 - RNA, 24 nt, Human
uguagagaugggguuuugccaugu

SEQ ID NO: 928795 - RNA, 18 nt, Human
uguggaaagacaugacug

SEQ ID NO: 928796 - RNA, 18 nt, Human
ugugugugugugugugug

SEQ ID NO: 928797 - RNA, 18 nt, Human
ugugugugugugugugug

SEQ ID NO: 928798 - RNA, 18 nt, Human
ugugugugugugugugug

SEQ ID NO: 928799 - RNA, 18 nt, Human
ugugugugugugugugug

SEQ ID NO: 928800 - RNA, 18 nt, Human
ugugugugugugugugug

SEQ ID NO: 928801 - RNA, 18 nt, Human
ugugugugugugugugug

SEQ ID NO: 928802 - RNA, 18 nt, Human
ugugugugugugugugug

SEQ ID NO: 928803 - RNA, 18 nt, Human
ugugugugugugugugug

SEQ ID NO: 928804 - RNA, 18 nt, Human
ugugugugugugugugug

SEQ ID NO: 928805 - RNA, 18 nt, Human
ugugugugugugugugug

SEQ ID NO: 928806 - RNA, 21 nt, Human
ugugugugugugugugugugu

SEQ ID NO: 928807 - RNA, 21 nt, Human
ugugugugugugugugugugu

SEQ ID NO: 928808 - RNA, 21 nt, Human
ugugugugugugugugugugu

SEQ ID NO: 928809 - RNA, 21 nt, Human
ugugugugugugugugugugu

SEQ ID NO: 928810 - RNA, 21 nt, Human
ugugugugugugugugugugu

SEQ ID NO: 928811 - RNA, 21 nt, Human
ugugugugugugugugugugu

SEQ ID NO: 928812 - RNA, 21 nt, Human
ugugugugugugugugugugu

SEQ ID NO: 928813 - RNA, 21 nt, Human
ugugugugugugugugugugu

SEQ ID NO: 928814 - RNA, 21 nt, Human
ugugugugugugugugugugu

SEQ ID NO: 928815 - RNA, 21 nt, Human
ugugugugugugugugugugu

SEQ ID NO: 928816 - RNA, 21 nt, Human
ugugugugugugugugugugu

SEQ ID NO: 928817 - RNA, 21 nt, Human
ugugugugugugugugugugu

SEQ ID NO: 928818 - RNA, 21 nt, Human
ugugugugugugugugugugu

SEQ ID NO: 928819 - RNA, 21 nt, Human
ugugugugugugugugugugu

SEQ ID NO: 928820 - RNA, 21 nt, Human
ugugugugugugugugugugu

SEQ ID NO: 928821 - RNA, 21 nt, Human
ugugugugugugugugugugu

SEQ ID NO: 928822 - RNA, 22 nt, Human
ugugugugugugugugugugug

SEQ ID NO: 928823 - RNA, 22 nt, Human
ugugugugugugugugugugug

SEQ ID NO: 928824 - RNA, 22 nt, Human
ugugugugugugugugugugug

SEQ ID NO: 928825 - RNA, 22 nt, Human
ugugugugugugugugugugug

SEQ ID NO: 928826 - RNA, 22 nt, Human
ugugugugugugugugugugug

SEQ ID NO: 928827 - RNA, 22 nt, Human
ugugugugugugugugugugug

SEQ ID NO: 928828 - RNA, 22 nt, Human
uuaaugucuuaauuugucuucu

SEQ ID NO: 928829 - RNA, 21 nt, Human
uuagggaaaaaaaaaaaaaaa

SEQ ID NO: 928830 - RNA, 24 nt, Human
uuauuucugccucccuagacaugu

SEQ ID NO: 928831 - RNA, 26 nt, Human
uucaacagccucccuaccuggucccc

SEQ ID NO: 928832 - RNA, 18 nt, Human
uucagguuucagaccuug

SEQ ID NO: 928833 - RNA, 18 nt, Human
uuccuguuuccaccuaug

SEQ ID NO: 928834 - RNA, 21 nt, Human
uuccuguuuccaccuaugggg

SEQ ID NO: 928835 - RNA, 21 nt, Human
uucucuggguuuucuuggcuu

SEQ ID NO: 928836 - RNA, 22 nt, Human
uugagacagggucucacucugu

SEQ ID NO: 928837 - RNA, 24 nt, Human
uugcccaggcuggaguacaguggu

SEQ ID NO: 928838 - RNA, 24 nt, Human
uuguagagaugggguuuugccaug

SEQ ID NO: 928839 - RNA, 23 nt, Human
uuuguagagaugggguuuugcca

SEQ ID NO: 928840 - RNA, 24 nt, Human
uuuguagagaugggguuuugccau

SEQ ID NO: 928841 - RNA, 22 nt, Human
uuugucauaacuuaaagaagac

SEQ ID NO: 928842 - RNA, 19 nt, Human
uuuugccauguugcccagg

SEQ ID NO: 928843 - RNA, 19 nt, Human
uuuuucuuuuugagacagg

SEQ ID NO: 928844 - RNA, 24 nt, Human
uuuuucuuuuugagacagggucuc

SEQ ID NO: 928845 - RNA, 24 nt, Human
uuuuuuguagagaugggguuuugc

SEQ ID NO: 928846 - RNA, 20 nt, Human
aaacaccccucccaacuccc

SEQ ID NO: 928847 - RNA, 22 nt, Human
aacaccccucccaacucccuua

SEQ ID NO: 928848 - RNA, 27 nt, Human
aaccaaaagguggcguaagguuuuacu

SEQ ID NO: 928849 - RNA, 22 nt, Human
aagcauuuuguucuccucugua

SEQ ID NO: 928850 - RNA, 21 nt, Human
aaugcuguaaaaaaaauuaaa

SEQ ID NO: 928851 - RNA, 18 nt, Human
agagauugggaccuagug

SEQ ID NO: 928852 - RNA, 25 nt, Human
aggaacuauagagucuuuauaaacu

SEQ ID NO: 928853 - RNA, 18 nt, Human
aggaugaaacaccccucc

SEQ ID NO: 928854 - RNA, 19 nt, Human
auaccacagcagucagcag

SEQ ID NO: 928855 - RNA, 21 nt, Human
caaaagaguuacuuuauagug

SEQ ID NO: 928856 - RNA, 18 nt, Human
caugauccgugccaauac

SEQ ID NO: 928857 - RNA, 22 nt, Human
ccaauaccacagcagucagcag

SEQ ID NO: 928858 - RNA, 20 nt, Human
cccucucccuccucccuucc

SEQ ID NO: 928859 - RNA, 21 nt, Human
cccuguccucccucucccucc

SEQ ID NO: 928860 - RNA, 21 nt, Human
ccuagggccugacaaagugac

SEQ ID NO: 928861 - RNA, 18 nt, Human
ccucccucucccuccucc

SEQ ID NO: 928862 - RNA, 19 nt, Human
ccucccuuccccuaucuau

SEQ ID NO: 928863 - RNA, 20 nt, Human
ccucuguaacagcacagggc

SEQ ID NO: 928864 - RNA, 18 nt, Human
ccuugcugaaagcauuuu

SEQ ID NO: 928865 - RNA, 18 nt, Human
cucccuccucccuucccc

SEQ ID NO: 928866 - RNA, 23 nt, Human
cugcaguaacuguaugaaauuua

SEQ ID NO: 928867 - RNA, 20 nt, Human
gaucgguuuugaaaauuagg

SEQ ID NO: 928868 - RNA, 19 nt, Human
gguguggaagauagaaagg

SEQ ID NO: 928869 - RNA, 20 nt, Human
gucaucuccagccaucuguu

SEQ ID NO: 928870 - RNA, 22 nt, Human
gugaguauuuuuagcuucaguc

SEQ ID NO: 928871 - RNA, 18 nt, Human
uaacagcacccugaucga

SEQ ID NO: 928872 - RNA, 24 nt, Human
uaauagacuauagccaaaagaguu

SEQ ID NO: 928873 - RNA, 19 nt, Human
uaccaauagacaauacuca

SEQ ID NO: 928874 - RNA, 22 nt, Human
uaccaauagacaauacucaggc

SEQ ID NO: 928875 - RNA, 19 nt, Human
uaccacagcagucagcagc

SEQ ID NO: 928876 - RNA, 21 nt, Human
uacuuugcagaguugcuguga

SEQ ID NO: 928877 - RNA, 23 nt, Human
ucagauauccaauaguuacaaau

SEQ ID NO: 928878 - RNA, 21 nt, Human
ucagcagcuguugucugugcu

SEQ ID NO: 928879 - RNA, 28 nt, Human
uccauguggugcacuuuuucaggcauug

SEQ ID NO: 928880 - RNA, 20 nt, Human
uccucccucucccuccuccc

SEQ ID NO: 928881 - RNA, 19 nt, Human
ucucccuguccucccucuc

SEQ ID NO: 928882 - RNA, 19 nt, Human
ucugcaccucagucucuuc

SEQ ID NO: 928883 - RNA, 22 nt, Human
ugaaacaccccucccaacuccc

SEQ ID NO: 928884 - RNA, 24 nt, Human
ugacaaagugacccuggauaaaug

SEQ ID NO: 928885 - RNA, 22 nt, Human
ugaccccuggauucagauaucc

SEQ ID NO: 928886 - RNA, 22 nt, Human
uggaaauauuuugaacacucag

SEQ ID NO: 928887 - RNA, 24 nt, Human
uugaacacucagauauaaaaauuc

SEQ ID NO: 928888 - RNA, 23 nt, Human
uuuagcuucagucccacauucuc

SEQ ID NO: 928889 - RNA, 24 nt, Human
uuuuuuuuuuuuuuuuuuucaaag

SEQ ID NO: 928890 - RNA, 21 nt, Human
aaaacuugaacauuuucuaga

SEQ ID NO: 928891 - RNA, 24 nt, Human
aaaaggauagaaaaugcccacagg

SEQ ID NO: 928892 - RNA, 20 nt, Human
aaacuuaucugucagcuggc

SEQ ID NO: 928893 - RNA, 23 nt, Human
aaagaaccguuuuacauguccca

SEQ ID NO: 928894 - RNA, 24 nt, Human
aagaaacugacccaaagucauaug

SEQ ID NO: 928895 - RNA, 23 nt, Human
aagcaggcaccccaguggccuca

SEQ ID NO: 928896 - RNA, 18 nt, Human
aagcagucaguguagcag

SEQ ID NO: 928897 - RNA, 23 nt, Human
accaacagcuaucguuucugacc

SEQ ID NO: 928898 - RNA, 18 nt, Human
agagaagcagagaagcug

SEQ ID NO: 928899 - RNA, 22 nt, Human
agaugaaaucagggauguggcu

SEQ ID NO: 928900 - RNA, 21 nt, Human
agcaaaaaggauagaaaaugc

SEQ ID NO: 928901 - RNA, 24 nt, Human
agcagcguagcagagaagcagaga

SEQ ID NO: 928902 - RNA, 22 nt, Human
agcuagcaaacagcugagcuuc

SEQ ID NO: 928903 - RNA, 22 nt, Human
aggaaaacuugaacauuuucua

SEQ ID NO: 928904 - RNA, 20 nt, Human
aggccuuacaucugugaaaa

SEQ ID NO: 928905 - RNA, 23 nt, Human
aucccacuucucaggccccuucc

SEQ ID NO: 928906 - RNA, 19 nt, Human
auugggggaaagggaaaag

SEQ ID NO: 928907 - RNA, 21 nt, Human
caccccaguggccucauccua

SEQ ID NO: 928908 - RNA, 18 nt, Human
cacugugcaaaguauuuu

SEQ ID NO: 928909 - RNA, 22 nt, Human
cagcaccccagucucagcacuu

SEQ ID NO: 928910 - RNA, 22 nt, Human
cagcacucuuugguggaugucc

SEQ ID NO: 928911 - RNA, 21 nt, Human
caggaugccugugacaaccga

SEQ ID NO: 928912 - RNA, 21 nt, Human
caggccccgaaaugggcacag

SEQ ID NO: 928913 - RNA, 20 nt, Human
cagugcuuuguuuggcuucu

SEQ ID NO: 928914 - RNA, 25 nt, Human
caguggccucauccuaguucuggcc

SEQ ID NO: 928915 - RNA, 19 nt, Human
cauccuaguucuggcccug

SEQ ID NO: 928916 - RNA, 19 nt, Human
ccacauuuagaaacaaaau

SEQ ID NO: 928917 - RNA, 22 nt, Human
ccaguggccucauccuaguucu

SEQ ID NO: 928918 - RNA, 19 nt, Human
ccaugggagccgaaacccu

SEQ ID NO: 928919 - RNA, 20 nt, Human
ccccaaagaguugugaaaga

SEQ ID NO: 928920 - RNA, 24 nt, Human
ccccaaagaguugugaaagauaag

SEQ ID NO: 928921 - RNA, 18 nt, Human
ccccagaucacgcagcua

SEQ ID NO: 928922 - RNA, 21 nt, Human
ccugauacaguggugauuacu

SEQ ID NO: 928923 - RNA, 21 nt, Human
cuacagcaccccagucucagc

SEQ ID NO: 928924 - RNA, 21 nt, Human
cuucucaggccccuuccacua

SEQ ID NO: 928925 - RNA, 18 nt, Human
gauugccuccauucucca

SEQ ID NO: 928926 - RNA, 22 nt, Human
gcagcguagcagagaagcagag

SEQ ID NO: 928927 - RNA, 22 nt, Human
gcccacaggggaaaaaaaugau

SEQ ID NO: 928928 - RNA, 23 nt, Human
gcccugaaauguucugaaaugag

SEQ ID NO: 928929 - RNA, 21 nt, Human
gcuugccgaggucuuagguga

SEQ ID NO: 928930 - RNA, 24 nt, Human
ggcaagcaggcaccccaguggccc

SEQ ID NO: 928931 - RNA, 26 nt, Human
guagcagcguagcagagaagcagaga

SEQ ID NO: 928932 - RNA, 18 nt, Human
uaaauguaauaagcaaaa

SEQ ID NO: 928933 - RNA, 26 nt, Human
uaaauucccccagaucacgcagcuag

SEQ ID NO: 928934 - RNA, 23 nt, Human
uaagaaacugacccaaagucaua

SEQ ID NO: 928935 - RNA, 19 nt, Human
uaauaggccuuacaucugu

SEQ ID NO: 928936 - RNA, 23 nt, Human
uacaguggugauuacuucugaaa

SEQ ID NO: 928937 - RNA, 23 nt, Human
uaccaacagcuaucguuucugac

SEQ ID NO: 928938 - RNA, 18 nt, Human
uacugugcagcaucacug

SEQ ID NO: 928939 - RNA, 23 nt, Human
uagaaaaccgaaucuguuuauca

SEQ ID NO: 928940 - RNA, 25 nt, Human
uagaaaaugcccacaggggaaaaaa

SEQ ID NO: 928941 - RNA, 22 nt, Human
uagucacuugaaacugcuguuc

SEQ ID NO: 928942 - RNA, 18 nt, Human
uauagaaaaccgaaucug

SEQ ID NO: 928943 - RNA, 21 nt, Human
uaucugucagcuggcccugaa

SEQ ID NO: 928944 - RNA, 26 nt, Human
ucaaaguagaagcauauuauuaaaaa

SEQ ID NO: 928945 - RNA, 19 nt, Human
uccccaaagaguugugaaa

SEQ ID NO: 928946 - RNA, 21 nt, Human
ucccccagaucacgcagcuag

SEQ ID NO: 928947 - RNA, 18 nt, Human
ucuaugcucauccuaagg

SEQ ID NO: 928948 - RNA, 18 nt, Human
ucucaggccccuuccacu

SEQ ID NO: 928949 - RNA, 18 nt, Human
ucugucagcuggcccuga

SEQ ID NO: 928950 - RNA, 21 nt, Human
ugaauaggaaugaaaucccac

SEQ ID NO: 928951 - RNA, 19 nt, Human
ugaccauuuacugugcagc

SEQ ID NO: 928952 - RNA, 20 nt, Human
ugacccaaagucauaugcag

SEQ ID NO: 928953 - RNA, 22 nt, Human
ugagguucagagaagugaagua

SEQ ID NO: 928954 - RNA, 23 nt, Human
ugccugugacaaccgaauaguuu

SEQ ID NO: 928955 - RNA, 23 nt, Human
ugggggcggcuccuucagugcuu

SEQ ID NO: 928956 - RNA, 26 nt, Human
uguaauaagcaaaaaggauagaaaau

SEQ ID NO: 928957 - RNA, 19 nt, Human
ugugaaaacuuaucuguca

SEQ ID NO: 928958 - RNA, 22 nt, Human
uuaagggaggauacaauaaggu

SEQ ID NO: 928959 - RNA, 20 nt, Human
uucaggaaggaaaacuugaa

SEQ ID NO: 928960 - RNA, 26 nt, Human
uucagugcuuuguuuggcuucuuuuu

SEQ ID NO: 928961 - RNA, 22 nt, Human
uucucuaaggaaguucucccca

SEQ ID NO: 928962 - RNA, 18 nt, Human
uugggggcggcuccuuca

SEQ ID NO: 928963 - RNA, 18 nt, Human
uuuguuccugaaugccac

SEQ ID NO: 928964 - RNA, 22 nt, Human
aaaaaugccucuugcgugagga

SEQ ID NO: 928965 - RNA, 23 nt, Human
aaacaagaagagaacuuuucuaa

SEQ ID NO: 928966 - RNA, 21 nt, Human
aagaacggcgguaacaguuau

SEQ ID NO: 928967 - RNA, 20 nt, Human
acaaggcaccuccugguguc

SEQ ID NO: 928968 - RNA, 23 nt, Human
acacacacacacacacacacaca

SEQ ID NO: 928969 - RNA, 23 nt, Human
acacacacacacacacacacaca

SEQ ID NO: 928970 - RNA, 23 nt, Human
acacacacacacacacacacaca

SEQ ID NO: 928971 - RNA, 23 nt, Human
acacacacacacacacacacaca

SEQ ID NO: 928972 - RNA, 23 nt, Human
acacacacacacacacacacaca

SEQ ID NO: 928973 - RNA, 23 nt, Human
acacacacacacacacacacaca

SEQ ID NO: 928974 - RNA, 25 nt, Human
acacacacacacacacacacacgaa

SEQ ID NO: 928975 - RNA, 23 nt, Human
acacacacacacacacgaaaaac

SEQ ID NO: 928976 - RNA, 23 nt, Human
acacacacacacacgaaaaacaa

SEQ ID NO: 928977 - RNA, 24 nt, Human
acacacacgaaaaacaaagaaaaa

SEQ ID NO: 928978 - RNA, 22 nt, Human
acacacgaaaaacaaagaaaaa

SEQ ID NO: 928979 - RNA, 20 nt, Human
agaaaaacacacacacacac

SEQ ID NO: 928980 - RNA, 21 nt, Human
agagugccaaauaucuugaaa

SEQ ID NO: 928981 - RNA, 23 nt, Human
aggaauguguuuaaaacaagaag

SEQ ID NO: 928982 - RNA, 20 nt, Human
auccuuggauguacaaaaaa

SEQ ID NO: 928983 - RNA, 20 nt, Human
caagagguuucccuucccuu

SEQ ID NO: 928984 - RNA, 20 nt, Human
cacacacacacacacacaca

SEQ ID NO: 928985 - RNA, 20 nt, Human
cacacacacacacacacaca

SEQ ID NO: 928986 - RNA, 20 nt, Human
cacacacacacacacacaca

SEQ ID NO: 928987 - RNA, 20 nt, Human
cacacacacacacacacaca

SEQ ID NO: 928988 - RNA, 20 nt, Human
cacacacacacacacacaca

SEQ ID NO: 928989 - RNA, 20 nt, Human
cacacacacacacacacaca

SEQ ID NO: 928990 - RNA, 20 nt, Human
cacacacacacacacacaca

SEQ ID NO: 928991 - RNA, 20 nt, Human
cacacacacacacacacaca

SEQ ID NO: 928992 - RNA, 20 nt, Human
cacacacacacacacacaca

SEQ ID NO: 928993 - RNA, 20 nt, Human
cacacacacacacacacaca

SEQ ID NO: 928994 - RNA, 20 nt, Human
cacacacacacacacacaca

SEQ ID NO: 928995 - RNA, 22 nt, Human
cacacacacacacacacacaca

SEQ ID NO: 928996 - RNA, 22 nt, Human
cacacacacacacacacacaca

SEQ ID NO: 928997 - RNA, 22 nt, Human
cacacacacacacacacacaca

SEQ ID NO: 928998 - RNA, 22 nt, Human
cacacacacacacacacacaca

SEQ ID NO: 928999 - RNA, 22 nt, Human
cacacacacacacacacacaca

SEQ ID NO: 929000 - RNA, 26 nt, Human
cacacacacacacacacacacacaca

SEQ ID NO: 929001 - RNA, 26 nt, Human
cacacacacacacacacacacacaca

SEQ ID NO: 929002 - RNA, 26 nt, Human
cacacacacacacacacacacacaca

SEQ ID NO: 929003 - RNA, 26 nt, Human
cacacacacacacacacacacacaca

SEQ ID NO: 929004 - RNA, 26 nt, Human
cacacacacacacacacacacacaca

SEQ ID NO: 929005 - RNA, 26 nt, Human
cacacacacacacacacacacacacg

SEQ ID NO: 929006 - RNA, 23 nt, Human
cacacacacacacgaaaaacaaa

SEQ ID NO: 929007 - RNA, 21 nt, Human
cacacacacacgaaaaacaaa

SEQ ID NO: 929008 - RNA, 20 nt, Human
caccuccuggugucuaacuc

SEQ ID NO: 929009 - RNA, 21 nt, Human
cagaaaaacacacacacacac

SEQ ID NO: 929010 - RNA, 21 nt, Human
cagcugccuguuuugcauggu

SEQ ID NO: 929011 - RNA, 24 nt, Human
cagcugccuguuuugcaugguauu

SEQ ID NO: 929012 - RNA, 22 nt, Human
cgaaaaacaaagaaaaaaaugc

SEQ ID NO: 929013 - RNA, 24 nt, Human
cgaaaaacaaagaaaaaaaugcuu

SEQ ID NO: 929014 - RNA, 18 nt, Human
cggccggagcaagcgggu

SEQ ID NO: 929015 - RNA, 19 nt, Human
cggccggagcaagcggguu

SEQ ID NO: 929016 - RNA, 24 nt, Human
cggcgguaacaguuauuggcaaaa

SEQ ID NO: 929017 - RNA, 21 nt, Human
cguucccucuuuucuuaauuc

SEQ ID NO: 929018 - RNA, 23 nt, Human
cucuuaaggcacaccagcugccu

SEQ ID NO: 929019 - RNA, 24 nt, Human
gaaaaacaaagaaaaaaaugcuug

SEQ ID NO: 929020 - RNA, 31 nt, Human
gaaaaacacacacacacacacacacacacag

SEQ ID NO: 929021 - RNA, 22 nt, Human
gaaaaauaugaccgacaaggca

SEQ ID NO: 929022 - RNA, 21 nt, Human
gacaaugaguuaagggagaga

SEQ ID NO: 929023 - RNA, 19 nt, Human
gagugccaaauaucuugaa

SEQ ID NO: 929024 - RNA, 20 nt, Human
gucuguugugugagcagccu

SEQ ID NO: 929025 - RNA, 22 nt, Human
guuucccuucccuuccccguuc

SEQ ID NO: 929026 - RNA, 23 nt, Human
uaaaaagaagucucaguugcagc

SEQ ID NO: 929027 - RNA, 22 nt, Human
uaucaggaauguguuuaaaaca

SEQ ID NO: 929028 - RNA, 24 nt, Human
uauuaugucaguuuauucucuuua

SEQ ID NO: 929029 - RNA, 33 nt, Human
ucagaaaaacacacacacacacacacacacagu

SEQ ID NO: 929030 - RNA, 20 nt, Human
ucccccaaagacaaugaguu

SEQ ID NO: 929031 - RNA, 19 nt, Human
uccccuugcagucuguugu

SEQ ID NO: 929032 - RNA, 19 nt, Human
ucgcugauuuggcuguucc

SEQ ID NO: 929033 - RNA, 20 nt, Human
ucucugugcucugaguccac

SEQ ID NO: 929034 - RNA, 19 nt, Human
ucuguagauauucuguuuu

SEQ ID NO: 929035 - RNA, 18 nt, Human
ucuguuauuuauagggau

SEQ ID NO: 929036 - RNA, 24 nt, Human
ucuuaaggcacaccagcugccugu

SEQ ID NO: 929037 - RNA, 21 nt, Human
ugaaaugccaaaaggcauuuu

SEQ ID NO: 929038 - RNA, 18 nt, Human
ugaagcggcaacaccagg

SEQ ID NO: 929039 - RNA, 25 nt, Human
ugaagcggcaacaccagguguuuug

SEQ ID NO: 929040 - RNA, 19 nt, Human
ugggccagaucggccggag

SEQ ID NO: 929041 - RNA, 20 nt, Human
ugguauuugcaaaaaugccu

SEQ ID NO: 929042 - RNA, 21 nt, Human
uguguuuaaaacaagaagaga

SEQ ID NO: 929043 - RNA, 24 nt, Human
uguguuucuuuguugcugcaagcu

SEQ ID NO: 929044 - RNA, 18 nt, Human
uguuuuauuuuggucauc

SEQ ID NO: 929045 - RNA, 20 nt, Human
uuccccuugcagucuguugu

SEQ ID NO: 929046 - RNA, 27 nt, Human
uucuucgcugauuuggcuguucccaau

SEQ ID NO: 929047 - RNA, 22 nt, Human
uugcugcaagcuaucugcccaa

SEQ ID NO: 929048 - RNA, 23 nt, Human
uuuuuuauguuguuauccuugga

SEQ ID NO: 929049 - RNA, 23 nt, Human
uuuuuuauguuguuauccuugga

SEQ ID NO: 929050 - RNA, 18 nt, Human
aaaaagaagaagagaugg

SEQ ID NO: 929051 - RNA, 19 nt, Human
aaaagaagaagagauggua

SEQ ID NO: 929052 - RNA, 24 nt, Human
aaagugcugggauuacaggcauga

SEQ ID NO: 929053 - RNA, 21 nt, Human
aaaguucccucaaccuucccu

SEQ ID NO: 929054 - RNA, 19 nt, Human
aagaagaagagaugguacc

SEQ ID NO: 929055 - RNA, 25 nt, Human
aagcgauccucccaccuuggccuuc

SEQ ID NO: 929056 - RNA, 22 nt, Human
aagcucccuuacaucuuccccu

SEQ ID NO: 929057 - RNA, 19 nt, Human
aagugcugggauuacaggc

SEQ ID NO: 929058 - RNA, 21 nt, Human
aagugcugggauuacaggcau

SEQ ID NO: 929059 - RNA, 26 nt, Human
aagugcugggauuacaggcaugaacc

SEQ ID NO: 929060 - RNA, 23 nt, Human
acaugccugguacacgcacagaa

SEQ ID NO: 929061 - RNA, 23 nt, Human
acccuauuguugucagccucagc

SEQ ID NO: 929062 - RNA, 20 nt, Human
acuggucuugaacuccuggg

SEQ ID NO: 929063 - RNA, 19 nt, Human
agccuugaccucccagggc

SEQ ID NO: 929064 - RNA, 19 nt, Human
agcucagacuccugaguag

SEQ ID NO: 929065 - RNA, 22 nt, Human
agcucagacuccugaguagcug

SEQ ID NO: 929066 - RNA, 19 nt, Human
aggcaugaaccaccaugcc

SEQ ID NO: 929067 - RNA, 18 nt, Human
aguagcugggacuacagg

SEQ ID NO: 929068 - RNA, 20 nt, Human
auggaaauccagcuccucuc

SEQ ID NO: 929069 - RNA, 24 nt, Human
caaagugcugggauuacaggcaug

SEQ ID NO: 929070 - RNA, 22 nt, Human
caaaucccuggaccggguccca

SEQ ID NO: 929071 - RNA, 27 nt, Human
caagcgauccucccaccuuggccuucc

SEQ ID NO: 929072 - RNA, 22 nt, Human
cacugcagccuugaccucccag

SEQ ID NO: 929073 - RNA, 25 nt, Human
cagccuugaccucccagggcuugag

SEQ ID NO: 929074 - RNA, 24 nt, Human
cagcucacugcagccuugaccucc

SEQ ID NO: 929075 - RNA, 24 nt, Human
cagcuuuccauugcuucuuuccca

SEQ ID NO: 929076 - RNA, 19 nt, Human
cagugggccuuguggaagu

SEQ ID NO: 929077 - RNA, 21 nt, Human
cagugggccuuguggaaguuc

SEQ ID NO: 929078 - RNA, 22 nt, Human
ccaaagugcugggauuacaggc

SEQ ID NO: 929079 - RNA, 24 nt, Human
ccaaagugcugggauuacaggcau

SEQ ID NO: 929080 - RNA, 21 nt, Human
ccacagaucccguccucaccc

SEQ ID NO: 929081 - RNA, 24 nt, Human
ccagacuggucuugaacuccuggg

SEQ ID NO: 929082 - RNA, 20 nt, Human
ccagggcuugagugauccuc

SEQ ID NO: 929083 - RNA, 26 nt, Human
ccauugcuucuuucccacuucucuca

SEQ ID NO: 929084 - RNA, 20 nt, Human
ccccuuagcuccccacccua

SEQ ID NO: 929085 - RNA, 18 nt, Human
cccuaaaguucccucaac

SEQ ID NO: 929086 - RNA, 21 nt, Human
cccuauuguugucagccucag

SEQ ID NO: 929087 - RNA, 24 nt, Human
cccuggaccgggucccauuuccca

SEQ ID NO: 929088 - RNA, 23 nt, Human
ccuacugagauggauuucccacc

SEQ ID NO: 929089 - RNA, 18 nt, Human
ccucaaucaaacccaucu

SEQ ID NO: 929090 - RNA, 26 nt, Human
ccucccaccuuggccuuccaaagugc

SEQ ID NO: 929091 - RNA, 19 nt, Human
ccucccagcucagacuccu

SEQ ID NO: 929092 - RNA, 19 nt, Human
ccucccagcucagacuccu

SEQ ID NO: 929093 - RNA, 21 nt, Human
ccucuugcuaaggguugggag

SEQ ID NO: 929094 - RNA, 22 nt, Human
ccucuugcuaaggguugggagc

SEQ ID NO: 929095 - RNA, 23 nt, Human
ccugaguagcugggacuacaggc

SEQ ID NO: 929096 - RNA, 24 nt, Human
ccugaguagcugggacuacaggca

SEQ ID NO: 929097 - RNA, 18 nt, Human
ccugggcucaagcgaucc

SEQ ID NO: 929098 - RNA, 24 nt, Human
cucaagcgauccucccaccuuggc

SEQ ID NO: 929099 - RNA, 24 nt, Human
cucaaguccaaaucacuccauucc

SEQ ID NO: 929100 - RNA, 23 nt, Human
cuccugggcucaagcgauccucc

SEQ ID NO: 929101 - RNA, 23 nt, Human
cucucauuuuuccagugggccuu

SEQ ID NO: 929102 - RNA, 25 nt, Human
cuuagcuucuucauguccuuacuug

SEQ ID NO: 929103 - RNA, 24 nt, Human
gacuacaggcacaugccaccaugc

SEQ ID NO: 929104 - RNA, 20 nt, Human
gaguagcugggacuacaggc

SEQ ID NO: 929105 - RNA, 25 nt, Human
gaguagcugggacuacaggcacaug

SEQ ID NO: 929106 - RNA, 23 nt, Human
gauccucccagcucagacuccug

SEQ ID NO: 929107 - RNA, 21 nt, Human
gauuacaggcaugaaccacca

SEQ ID NO: 929108 - RNA, 22 nt, Human
gauuacaggcaugaaccaccau

SEQ ID NO: 929109 - RNA, 24 nt, Human
gauugccaucacuuucucucauuc

SEQ ID NO: 929110 - RNA, 24 nt, Human
gccuggcuaauuuuuuuguauuuu

SEQ ID NO: 929111 - RNA, 19 nt, Human
gccugguacacgcacagaa

SEQ ID NO: 929112 - RNA, 19 nt, Human
gcucagacuccugaguagc

SEQ ID NO: 929113 - RNA, 24 nt, Human
ggauuacaggcaugaaccaccaug

SEQ ID NO: 929114 - RNA, 21 nt, Human
gguugggcaggacacuuagcu

SEQ ID NO: 929115 - RNA, 19 nt, Human
guagagaugggggccucaa

SEQ ID NO: 929116 - RNA, 20 nt, Human
guauuuuuuuguagagaugg

SEQ ID NO: 929117 - RNA, 22 nt, Human
gugauccucccagcucagacuc

SEQ ID NO: 929118 - RNA, 21 nt, Human
guuucuuaaccuuucugugcu

SEQ ID NO: 929119 - RNA, 20 nt, Human
uaaaguucccucaaccuucc

SEQ ID NO: 929120 - RNA, 22 nt, Human
uacaggcacaugccaccaugcc

SEQ ID NO: 929121 - RNA, 24 nt, Human
uacaggcaugaaccaccaugccca

SEQ ID NO: 929122 - RNA, 19 nt, Human
ucaaauggggauccugauu

SEQ ID NO: 929123 - RNA, 24 nt, Human
ucaagcgauccucccaccuuggcc

SEQ ID NO: 929124 - RNA, 23 nt, Human
ucacccugaggauggccccucuu

SEQ ID NO: 929125 - RNA, 19 nt, Human
ucacugcagccuugaccuc

SEQ ID NO: 929126 - RNA, 23 nt, Human
ucacugcagccuugaccucccag

SEQ ID NO: 929127 - RNA, 24 nt, Human
ucacugcagccuugaccucccagg

SEQ ID NO: 929128 - RNA, 25 nt, Human
ucacugcagccuugaccucccaggg

SEQ ID NO: 929129 - RNA, 23 nt, Human
uccaaagugcugggauuacaggc

SEQ ID NO: 929130 - RNA, 24 nt, Human
uccaaagugcugggauuacaggca

SEQ ID NO: 929131 - RNA, 21 nt, Human
uccacagaucccguccucacc

SEQ ID NO: 929132 - RNA, 22 nt, Human
ucccagggcuugagugauccuc

SEQ ID NO: 929133 - RNA, 19 nt, Human
ucccucaaccuucccucaa

SEQ ID NO: 929134 - RNA, 24 nt, Human
uccugaguagcugggacuacaggc

SEQ ID NO: 929135 - RNA, 21 nt, Human
uccugggcucaagcgauccuc

SEQ ID NO: 929136 - RNA, 24 nt, Human
uccugggcucaagcgauccuccca

SEQ ID NO: 929137 - RNA, 23 nt, Human
ucucggucugucacccagguugg

SEQ ID NO: 929138 - RNA, 24 nt, Human
ucucggucugucacccagguugga

SEQ ID NO: 929139 - RNA, 18 nt, Human
ucugucacccagguugga

SEQ ID NO: 929140 - RNA, 19 nt, Human
ucuugaacuccugggcuca

SEQ ID NO: 929141 - RNA, 23 nt, Human
ucuugaacuccugggcucaagcg

SEQ ID NO: 929142 - RNA, 25 nt, Human
ugaacuccugggcucaagcgauccu

SEQ ID NO: 929143 - RNA, 19 nt, Human
ugaacuggaaaccuucccu

SEQ ID NO: 929144 - RNA, 22 nt, Human
ugacccagcuuuccauugcuuc

SEQ ID NO: 929145 - RNA, 18 nt, Human
ugaccuugggcaaguuuc

SEQ ID NO: 929146 - RNA, 22 nt, Human
ugagacagggucucggucuguc

SEQ ID NO: 929147 - RNA, 21 nt, Human
ugauugcagcucacugcagcc

SEQ ID NO: 929148 - RNA, 24 nt, Human
ugcccagacuggucuugaacuccu

SEQ ID NO: 929149 - RNA, 23 nt, Human
ugcugggauuacaggcaugaacc

SEQ ID NO: 929150 - RNA, 21 nt, Human
uggaaaccuucccuaaaguuc

SEQ ID NO: 929151 - RNA, 22 nt, Human
uggaaaccuucccuaaaguucc

SEQ ID NO: 929152 - RNA, 21 nt, Human
ugggacuacaggcacaugcca

SEQ ID NO: 929153 - RNA, 22 nt, Human
ugggacuacaggcacaugccac

SEQ ID NO: 929154 - RNA, 24 nt, Human
ugggacuacaggcacaugccacca

SEQ ID NO: 929155 - RNA, 25 nt, Human
ugggacuacaggcacaugccaccau

SEQ ID NO: 929156 - RNA, 23 nt, Human
ugggauuacaggcaugaaccacc

SEQ ID NO: 929157 - RNA, 24 nt, Human
ugggauuacaggcaugaaccacca

SEQ ID NO: 929158 - RNA, 25 nt, Human
ugggauuacaggcaugaaccaccau

SEQ ID NO: 929159 - RNA, 25 nt, Human
uguagagaugggggccucaauuugu

SEQ ID NO: 929160 - RNA, 19 nt, Human
ugucaaauggggauccuga

SEQ ID NO: 929161 - RNA, 20 nt, Human
ugugaggaggguuaagcccu

SEQ ID NO: 929162 - RNA, 22 nt, Human
uguugcccagacuggucuugaa

SEQ ID NO: 929163 - RNA, 24 nt, Human
uuaacaagcucccuuacaucuucc

SEQ ID NO: 929164 - RNA, 18 nt, Human
uugggcaggacacuuagc

SEQ ID NO: 929165 - RNA, 22 nt, Human
uuucucccucucucucucuuuu

SEQ ID NO: 929166 - RNA, 23 nt, Human
uuucugugcuauuucccuaucug

SEQ ID NO: 929167 - RNA, 24 nt, Human
uuuguugcccagacuggucuugaa

SEQ ID NO: 929168 - RNA, 26 nt, Human
uuuguuuuuuugagacagggucucgg

SEQ ID NO: 929169 - RNA, 25 nt, Human
uuuuguuuuuuugagacagggucuc

SEQ ID NO: 929170 - RNA, 20 nt, Human
uuuuuuguagagaugggggc

SEQ ID NO: 929171 - RNA, 22 nt, Human
uuuuuuguauuuuuuuguagag

SEQ ID NO: 929172 - RNA, 25 nt, Human
uuuuuuguauuuuuuuguagagaug

SEQ ID NO: 929173 - RNA, 24 nt, Human
uuuuuuuguuuuuuugagacaggg

SEQ ID NO: 929174 - RNA, 23 nt, Human
aaaugaaagcaaaagucuaaaac

SEQ ID NO: 929175 - RNA, 20 nt, Human
aacagaauuaggaaauccuc

SEQ ID NO: 929176 - RNA, 19 nt, Human
agaaaacuuggcgcugacc

SEQ ID NO: 929177 - RNA, 21 nt, Human
agauuccugaaguguucuuug

SEQ ID NO: 929178 - RNA, 19 nt, Human
aggguggauuuuuaaaugg

SEQ ID NO: 929179 - RNA, 20 nt, Human
auagauggggcaaaaguuug

SEQ ID NO: 929180 - RNA, 23 nt, Human
auuauuuuaauguaguugauuuu

SEQ ID NO: 929181 - RNA, 22 nt, Human
auuuuuuuuucugucucucuca

SEQ ID NO: 929182 - RNA, 22 nt, Human
caaaagucuaaaaccgguucua

SEQ ID NO: 929183 - RNA, 21 nt, Human
caagaagagagaaaacuuggc

SEQ ID NO: 929184 - RNA, 22 nt, Human
cagguaaccacagugaaauguu

SEQ ID NO: 929185 - RNA, 20 nt, Human
cagguuuucacugacaaugc

SEQ ID NO: 929186 - RNA, 22 nt, Human
caguaaauucauuucaagguuu

SEQ ID NO: 929187 - RNA, 18 nt, Human
caguuaaaaugaauggaa

SEQ ID NO: 929188 - RNA, 21 nt, Human
gagaacaagaagagagaaaac

SEQ ID NO: 929189 - RNA, 26 nt, Human
gagaacaagaagagagaaaacuuggc

SEQ ID NO: 929190 - RNA, 18 nt, Human
gaucacagcuucaaauuu

SEQ ID NO: 929191 - RNA, 21 nt, Human
gcuuuuguuaggucugggcaa

SEQ ID NO: 929192 - RNA, 22 nt, Human
gguaugagaacaagaagagaga

SEQ ID NO: 929193 - RNA, 19 nt, Human
guaaaauauacucuggccc

SEQ ID NO: 929194 - RNA, 20 nt, Human
guccuguuaucuucaauugc

SEQ ID NO: 929195 - RNA, 22 nt, Human
gugaaacuuuuuucugaauuuu

SEQ ID NO: 929196 - RNA, 18 nt, Human
uaacauagaugagggugg

SEQ ID NO: 929197 - RNA, 23 nt, Human
uacuauguuuuugcuccauguuu

SEQ ID NO: 929198 - RNA, 18 nt, Human
uaguugauuuuucuggaa

SEQ ID NO: 929199 - RNA, 25 nt, Human
ucaccaaaaacucugguaacagaau

SEQ ID NO: 929200 - RNA, 21 nt, Human
uccauaaaguaucuaguuaaa

SEQ ID NO: 929201 - RNA, 22 nt, Human
ugagaagagggccuuaaugacc

SEQ ID NO: 929202 - RNA, 18 nt, Human
ugaggguggauuuuuaaa

SEQ ID NO: 929203 - RNA, 22 nt, Human
ugguaacauagaugagggugga

SEQ ID NO: 929204 - RNA, 21 nt, Human
uguacugcccauucuuuugug

SEQ ID NO: 929205 - RNA, 18 nt, Human
uucacugacaaugcuuuu

SEQ ID NO: 929206 - RNA, 26 nt, Human
uucacugacaaugcuuuuuuaaaaau

SEQ ID NO: 929207 - RNA, 27 nt, Human
uucacugacaaugcuuuuuuaaaaaua

SEQ ID NO: 929208 - RNA, 18 nt, Human
uucaggauaucauuuaau

SEQ ID NO: 929209 - RNA, 25 nt, Human
uuggagagaauuucuggacauuuuu

SEQ ID NO: 929210 - RNA, 24 nt, Human
uuggucauuaccuacagagugcca

SEQ ID NO: 929211 - RNA, 21 nt, Human
uuguaucgaccccuuucuaca

SEQ ID NO: 929212 - RNA, 23 nt, Human
uuuaaacagaguugaaaagugag

SEQ ID NO: 929213 - RNA, 21 nt, Human
uuuucaacauguuuuacucag

SEQ ID NO: 929214 - RNA, 23 nt, Human
uuuucaguccuguuaucuucaau

SEQ ID NO: 929215 - RNA, 24 nt, Human
uuuuucuaucuuucuucuuuaauu

SEQ ID NO: 929216 - RNA, 18 nt, Human
uuuuuuuuuuuuuuuuug

SEQ ID NO: 929217 - RNA, 24 nt, Human
uuuuuuuuuuuuuuuuuuguuagu

SEQ ID NO: 929218 - RNA, 21 nt, Human
aagaagcagaagugaagagaa

SEQ ID NO: 929219 - RNA, 23 nt, Human
aagaauccaaaacagcuguugua

SEQ ID NO: 929220 - RNA, 25 nt, Human
aagcacccaugauagugcccggcaa

SEQ ID NO: 929221 - RNA, 23 nt, Human
aagcagaagugaagagaagggac

SEQ ID NO: 929222 - RNA, 25 nt, Human
aagcagaagugaagagaaguggacc

SEQ ID NO: 929223 - RNA, 23 nt, Human
aagcagggggaaugaucuucucu

SEQ ID NO: 929224 - RNA, 21 nt, Human
aaggaaaaagcaugggcuuua

SEQ ID NO: 929225 - RNA, 19 nt, Human
aaggggaggagcugggacc

SEQ ID NO: 929226 - RNA, 18 nt, Human
aaggguggcgggggggca

SEQ ID NO: 929227 - RNA, 30 nt, Human
acucacuuuucaaugaauauguuuucuacu

SEQ ID NO: 929228 - RNA, 19 nt, Human
agagaacaugagaccucau

SEQ ID NO: 929229 - RNA, 21 nt, Human
agagaaguggaccucguacug

SEQ ID NO: 929230 - RNA, 20 nt, Human
agagaggggaaugagugaca

SEQ ID NO: 929231 - RNA, 18 nt, Human
aggggaggagcugggacc

SEQ ID NO: 929232 - RNA, 19 nt, Human
aucuuuucaaaugcucugg

SEQ ID NO: 929233 - RNA, 20 nt, Human
caaaaaggcuguauuaguga

SEQ ID NO: 929234 - RNA, 24 nt, Human
caaacaaaccugggcucaccuucu

SEQ ID NO: 929235 - RNA, 19 nt, Human
caagauggagcugcuggca

SEQ ID NO: 929236 - RNA, 19 nt, Human
cacacugagucccuuuugg

SEQ ID NO: 929237 - RNA, 22 nt, Human
cagaguaaguagaccacacuga

SEQ ID NO: 929238 - RNA, 22 nt, Human
cagucaugugcaauggacacuc

SEQ ID NO: 929239 - RNA, 21 nt, Human
ccaaaggucuuggcuuaggug

SEQ ID NO: 929240 - RNA, 22 nt, Human
ccccuuggcacagggcagaggc

SEQ ID NO: 929241 - RNA, 19 nt, Human
ccugccuggauagugcuga

SEQ ID NO: 929242 - RNA, 18 nt, Human
cuacuggacaaacaagcu

SEQ ID NO: 929243 - RNA, 18 nt, Human
cugaguggaaggggagga

SEQ ID NO: 929244 - RNA, 23 nt, Human
cugaguggaaggggaggagcugg

SEQ ID NO: 929245 - RNA, 21 nt, Human
cuguuguaacucugcagcuca

SEQ ID NO: 929246 - RNA, 24 nt, Human
cuuacaagaauccaaaacagcugu

SEQ ID NO: 929247 - RNA, 18 nt, Human
cuucugcugucgugugcu

SEQ ID NO: 929248 - RNA, 22 nt, Human
gaguggaggccaagauggagcu

SEQ ID NO: 929249 - RNA, 24 nt, Human
gaucuucucuggagcuuccucagc

SEQ ID NO: 929250 - RNA, 20 nt, Human
gcggccuuuuuaaccuaucu

SEQ ID NO: 929251 - RNA, 18 nt, Human
ggaggagcugggacccaa

SEQ ID NO: 929252 - RNA, 18 nt, Human
ggcucuacuggacaaaca

SEQ ID NO: 929253 - RNA, 22 nt, Human
ggggagguacaaaggaaaaagc

SEQ ID NO: 929254 - RNA, 21 nt, Human
gguaaggaucugacuggaagc

SEQ ID NO: 929255 - RNA, 22 nt, Human
guacugaugaugacaugaacac

SEQ ID NO: 929256 - RNA, 24 nt, Human
gugaagaagcagaagugaagagaa

SEQ ID NO: 929257 - RNA, 20 nt, Human
guggaaggggaggagcuggg

SEQ ID NO: 929258 - RNA, 19 nt, Human
guuaagagagaggggaaug

SEQ ID NO: 929259 - RNA, 19 nt, Human
guuuucuucugcaaaaggg

SEQ ID NO: 929260 - RNA, 20 nt, Human
uaaccaaaguagauggagca

SEQ ID NO: 929261 - RNA, 20 nt, Human
uaagacaaugaguguaaagc

SEQ ID NO: 929262 - RNA, 24 nt, Human
uacaaaaaaaaaaaaaaaaaaaaa

SEQ ID NO: 929263 - RNA, 23 nt, Human
uaccuaaccaaaguagauggagc

SEQ ID NO: 929264 - RNA, 21 nt, Human
uaguuuguuuuuguuuucuuc

SEQ ID NO: 929265 - RNA, 19 nt, Human
ucaaacaaaccugggcuca

SEQ ID NO: 929266 - RNA, 20 nt, Human
ucaaacaaaccugggcucac

SEQ ID NO: 929267 - RNA, 20 nt, Human
ucaaugaauauguuuucuac

SEQ ID NO: 929268 - RNA, 22 nt, Human
ucagagacuuucagccccuugg

SEQ ID NO: 929269 - RNA, 20 nt, Human
uccaaaacagcuguuguaac

SEQ ID NO: 929270 - RNA, 22 nt, Human
uccaaaacagcuguuguaacuc

SEQ ID NO: 929271 - RNA, 20 nt, Human
uccuaaaucuccaaaggcuc

SEQ ID NO: 929272 - RNA, 18 nt, Human
uccugcggccuuuuuaac

SEQ ID NO: 929273 - RNA, 20 nt, Human
ucuacaaaaaaaaaaaaaaa

SEQ ID NO: 929274 - RNA, 21 nt, Human
ucucuggagcuuccucagccu

SEQ ID NO: 929275 - RNA, 22 nt, Human
ugagggagaguggaggccaaga

SEQ ID NO: 929276 - RNA, 20 nt, Human
ugagucccuuuugguccucc

SEQ ID NO: 929277 - RNA, 24 nt, Human
ugaguguaaagcacccaugauagu

SEQ ID NO: 929278 - RNA, 21 nt, Human
ugauaugcacagucaugugca

SEQ ID NO: 929279 - RNA, 20 nt, Human
ugccuggauagugcugagug

SEQ ID NO: 929280 - RNA, 22 nt, Human
ugcuaugugcuuacuuaaucug

SEQ ID NO: 929281 - RNA, 19 nt, Human
ugcugaagcaaacaugaag

SEQ ID NO: 929282 - RNA, 18 nt, Human
uggcuaaagagggguggg

SEQ ID NO: 929283 - RNA, 23 nt, Human
ugggacaaggcauauccgagagc

SEQ ID NO: 929284 - RNA, 21 nt, Human
uuacuuaaucugacucuuagu

SEQ ID NO: 929285 - RNA, 23 nt, Human
uuaggugugggagcagagaacau

SEQ ID NO: 929286 - RNA, 24 nt, Human
uuccucagccuguagaagcuggga

SEQ ID NO: 929287 - RNA, 20 nt, Human
aaacaggcgagagccagcac

SEQ ID NO: 929288 - RNA, 26 nt, Human
aaacaggcgagagccagcacacacag

SEQ ID NO: 929289 - RNA, 21 nt, Human
acaccggaaacaggcgagagc

SEQ ID NO: 929290 - RNA, 19 nt, Human
acaggcgagagccagcaca

SEQ ID NO: 929291 - RNA, 19 nt, Human
accgcggggcaggccagac

SEQ ID NO: 929292 - RNA, 19 nt, Human
acuuuguaaauaaaaaggg

SEQ ID NO: 929293 - RNA, 22 nt, Human
agaaagagagaguuugagccuc

SEQ ID NO: 929294 - RNA, 24 nt, Human
agaaggcccccaaccccucggucc

SEQ ID NO: 929295 - RNA, 24 nt, Human
agacaccggaaacaggcgagagcc

SEQ ID NO: 929296 - RNA, 22 nt, Human
agagaaacaagccaguuagagg

SEQ ID NO: 929297 - RNA, 22 nt, Human
agagccagcacacacagcccua

SEQ ID NO: 929298 - RNA, 26 nt, Human
aggcccccaaccccucgguccuccac

SEQ ID NO: 929299 - RNA, 22 nt, Human
aguuaugacaaggagaaagaga

SEQ ID NO: 929300 - RNA, 24 nt, Human
auaaagaaaucaaggggaauggag

SEQ ID NO: 929301 - RNA, 23 nt, Human
caaauaaagacuguaaaccaaua

SEQ ID NO: 929302 - RNA, 21 nt, Human
caaaugagacuaacuguggua

SEQ ID NO: 929303 - RNA, 23 nt, Human
caaccccucgguccuccacaccg

SEQ ID NO: 929304 - RNA, 20 nt, Human
cacacagcccuagucugagc

SEQ ID NO: 929305 - RNA, 21 nt, Human
caccccaccccaccccccacc

SEQ ID NO: 929306 - RNA, 23 nt, Human
caccggaaacaggcgagagccaa

SEQ ID NO: 929307 - RNA, 21 nt, Human
cagacggacagccagugggca

SEQ ID NO: 929308 - RNA, 24 nt, Human
caguuuacuuaaggacaucacauc

SEQ ID NO: 929309 - RNA, 22 nt, Human
ccaccccccaccaccgcuuacc

SEQ ID NO: 929310 - RNA, 22 nt, Human
cccaccaccgcuuaccuaagaa

SEQ ID NO: 929311 - RNA, 18 nt, Human
cccaccccccaccaccgc

SEQ ID NO: 929312 - RNA, 20 nt, Human
ccccaaccccucgguccucc

SEQ ID NO: 929313 - RNA, 20 nt, Human
ccccaccccaccccccacca

SEQ ID NO: 929314 - RNA, 19 nt, Human
cccccaaccccucgguccu

SEQ ID NO: 929315 - RNA, 24 nt, Human
ccccggccagcccgccugagauga

SEQ ID NO: 929316 - RNA, 22 nt, Human
ccguccggaugcagcugauugc

SEQ ID NO: 929317 - RNA, 24 nt, Human
ccugcccaucgggucaaccucagc

SEQ ID NO: 929318 - RNA, 20 nt, Human
cgagggccccggccagcccg

SEQ ID NO: 929319 - RNA, 19 nt, Human
cggaaacaggcgagagcca

SEQ ID NO: 929320 - RNA, 19 nt, Human
cggaaacaggcgagagcca

SEQ ID NO: 929321 - RNA, 24 nt, Human
cggccagcccgccugagaugaugu

SEQ ID NO: 929322 - RNA, 22 nt, Human
cgguagaaggcccccaaccccu

SEQ ID NO: 929323 - RNA, 23 nt, Human
cucaggguuuuaauggccucaug

SEQ ID NO: 929324 - RNA, 25 nt, Human
cuccaccccaccccaccccccacca

SEQ ID NO: 929325 - RNA, 23 nt, Human
cugcaagcgcugcuucaccacug

SEQ ID NO: 929326 - RNA, 21 nt, Human
cugugguuggaaccgcggggc

SEQ ID NO: 929327 - RNA, 23 nt, Human
gaaggcccccaaccccucggucc

SEQ ID NO: 929328 - RNA, 18 nt, Human
gagcagccgcggagggcc

SEQ ID NO: 929329 - RNA, 21 nt, Human
gagcagccgcggagggccagc

SEQ ID NO: 929330 - RNA, 18 nt, Human
gagggccccggccagccc

SEQ ID NO: 929331 - RNA, 20 nt, Human
gcaaaugagacuaacugugg

SEQ ID NO: 929332 - RNA, 18 nt, Human
gcauuuuuagguuuuuca

SEQ ID NO: 929333 - RNA, 24 nt, Human
gcccccaaccccucgguccuccac

SEQ ID NO: 929334 - RNA, 18 nt, Human
gccugagaugauguggga

SEQ ID NO: 929335 - RNA, 21 nt, Human
gcgaauguuuauuugggcauu

SEQ ID NO: 929336 - RNA, 24 nt, Human
gcgagagccagcacacacagcccu

SEQ ID NO: 929337 - RNA, 18 nt, Human
gcugcuucaccacugugg

SEQ ID NO: 929338 - RNA, 26 nt, Human
ggacuggaaggggauguucaugguca

SEQ ID NO: 929339 - RNA, 20 nt, Human
ggauguggccccaccccagg

SEQ ID NO: 929340 - RNA, 21 nt, Human
ggccagcucccggcaguccua

SEQ ID NO: 929341 - RNA, 23 nt, Human
ggccagcucccggcaguccuagg

SEQ ID NO: 929342 - RNA, 19 nt, Human
ggggauguucauggucagc

SEQ ID NO: 929343 - RNA, 23 nt, Human
gguuggauguggccccaccccag

SEQ ID NO: 929344 - RNA, 23 nt, Human
guccgguggggguugaccugcuc

SEQ ID NO: 929345 - RNA, 22 nt, Human
guguacuaaacaaaacagaaca

SEQ ID NO: 929346 - RNA, 18 nt, Human
uaaaaagaagcccaagau

SEQ ID NO: 929347 - RNA, 18 nt, Human
uagaaggcccccaacccc

SEQ ID NO: 929348 - RNA, 25 nt, Human
uagcuccgguagaaggcccccaacc

SEQ ID NO: 929349 - RNA, 22 nt, Human
uagguuaaaauccauuuuuauc

SEQ ID NO: 929350 - RNA, 23 nt, Human
uagucugagcagccgcggagggc

SEQ ID NO: 929351 - RNA, 18 nt, Human
ucaaggggaauggagaag

SEQ ID NO: 929352 - RNA, 22 nt, Human
uccaccccaccccaccccccac

SEQ ID NO: 929353 - RNA, 19 nt, Human
uccucuccaccccacccca

SEQ ID NO: 929354 - RNA, 19 nt, Human
ucuccaccccaccccaccc

SEQ ID NO: 929355 - RNA, 22 nt, Human
ucugcaagcgcugcuucaccac

SEQ ID NO: 929356 - RNA, 22 nt, Human
ugagaugaugugggacugcggg

SEQ ID NO: 929357 - RNA, 22 nt, Human
ugagcagccgcggagggccagc

SEQ ID NO: 929358 - RNA, 21 nt, Human
ugccugaaucuugcugaaggc

SEQ ID NO: 929359 - RNA, 18 nt, Human
uggaaggggauguucaug

SEQ ID NO: 929360 - RNA, 21 nt, Human
uggccccaccccaggucggaa

SEQ ID NO: 929361 - RNA, 22 nt, Human
ugggcaguggguuggauguggc

SEQ ID NO: 929362 - RNA, 25 nt, Human
uguaaaccaauaguuaugacaagga

SEQ ID NO: 929363 - RNA, 20 nt, Human
uguguacuaaacaaaacaga

SEQ ID NO: 929364 - RNA, 21 nt, Human
uguguacuaaacaaaacagaa

SEQ ID NO: 929365 - RNA, 21 nt, Human
uuaaaaaagauaaacaaaacc

SEQ ID NO: 929366 - RNA, 22 nt, Human
uuuaauggccucauguauugcc

SEQ ID NO: 929367 - RNA, 19 nt, Human
uuuguaaauaaaaaggggg

SEQ ID NO: 929368 - RNA, 26 nt, Human
uuuucauugaacuacuuccuagaagg

SEQ ID NO: 929369 - RNA, 21 nt, Human
aaaaaggagauauaucugaga

SEQ ID NO: 929370 - RNA, 19 nt, Human
aagaaaucacaaagguaaa

SEQ ID NO: 929371 - RNA, 23 nt, Human
aagaacauuuuuuggggaggaaa

SEQ ID NO: 929372 - RNA, 18 nt, Human
aauacuguguuaaaauau

SEQ ID NO: 929373 - RNA, 19 nt, Human
accauauggccugcaaagu

SEQ ID NO: 929374 - RNA, 19 nt, Human
aggaaauguugauaacaaa

SEQ ID NO: 929375 - RNA, 21 nt, Human
agugggaaaauacuuuuaaau

SEQ ID NO: 929376 - RNA, 18 nt, Human
cacaaaaauggaaacaaa

SEQ ID NO: 929377 - RNA, 24 nt, Human
caccuccccaucacaaaaaaagga

SEQ ID NO: 929378 - RNA, 23 nt, Human
cagcacugaaagguuguaguaga

SEQ ID NO: 929379 - RNA, 23 nt, Human
cauauggccugcaaagucaaaaa

SEQ ID NO: 929380 - RNA, 24 nt, Human
caugacuuaaaauacguguauaug

SEQ ID NO: 929381 - RNA, 18 nt, Human
ccagagcagaguugagua

SEQ ID NO: 929382 - RNA, 22 nt, Human
gacaccuccccaucacaaaaaa

SEQ ID NO: 929383 - RNA, 20 nt, Human
gagauagaagaaaucacaaa

SEQ ID NO: 929384 - RNA, 22 nt, Human
gccgacaccuccccaucacaag

SEQ ID NO: 929385 - RNA, 20 nt, Human
gccucacucaccucauccca

SEQ ID NO: 929386 - RNA, 22 nt, Human
uaaaaagcaaacagcacugaaa

SEQ ID NO: 929387 - RNA, 25 nt, Human
uaaaaagcaaacagcacugaaaggu

SEQ ID NO: 929388 - RNA, 20 nt, Human
uaaugugccgacaccucccc

SEQ ID NO: 929389 - RNA, 24 nt, Human
uacuccagaauuccgaguauaagu

SEQ ID NO: 929390 - RNA, 22 nt, Human
uauuuugcucuucauggaccuu

SEQ ID NO: 929391 - RNA, 18 nt, Human
ucacaaagguaaaaacug

SEQ ID NO: 929392 - RNA, 24 nt, Human
ucacucaccucaucccagucacau

SEQ ID NO: 929393 - RNA, 20 nt, Human
uccaccagagcagaguugag

SEQ ID NO: 929394 - RNA, 30 nt, Human
ugaaauaaaaacaaaauuuaaacagcauuu

SEQ ID NO: 929395 - RNA, 24 nt, Human
ugaguaguugggacagagaccaua

SEQ ID NO: 929396 - RNA, 20 nt, Human
ugcagaguuuuugcauguuu

SEQ ID NO: 929397 - RNA, 25 nt, Human
ugccucacucaccucaucccaguca

SEQ ID NO: 929398 - RNA, 23 nt, Human
uggcacaaaaauggaaacaaaua

SEQ ID NO: 929399 - RNA, 23 nt, Human
ugggaaaauacuuuuaaauggug

SEQ ID NO: 929400 - RNA, 24 nt, Human
ugggaaaauacuuuuaaauggugu

SEQ ID NO: 929401 - RNA, 21 nt, Human
uggggaggaaaacaaccuguc

SEQ ID NO: 929402 - RNA, 25 nt, Human
uguaaaaagcaaacagcacugaaag

SEQ ID NO: 929403 - RNA, 23 nt, Human
uguuauguuucuuaaauaauaca

SEQ ID NO: 929404 - RNA, 25 nt, Human
uuuucauaaauuacuggaguaaaua

SEQ ID NO: 929405 - RNA, 19 nt, Human
uuuuuggggaggaaaacaa

SEQ ID NO: 929406 - RNA, 18 nt, Human
uuuuuuuuuuccacccac

SEQ ID NO: 929407 - RNA, 19 nt, Human
aaacagccaaaaaccuucg

SEQ ID NO: 929408 - RNA, 24 nt, Human
aaagccaaagacaucuccaaucac

SEQ ID NO: 929409 - RNA, 22 nt, Human
aaccaugcugauuggcagcaca

SEQ ID NO: 929410 - RNA, 19 nt, Human
aacccccauuuacuuuuca

SEQ ID NO: 929411 - RNA, 20 nt, Human
aagaagaauguucaccucau

SEQ ID NO: 929412 - RNA, 23 nt, Human
aagcagcaccuauucacuggcuc

SEQ ID NO: 929413 - RNA, 18 nt, Human
acacuguggaauuugucc

SEQ ID NO: 929414 - RNA, 20 nt, Human
agacagaguacugucuugua

SEQ ID NO: 929415 - RNA, 18 nt, Human
agagagccacaggggagc

SEQ ID NO: 929416 - RNA, 24 nt, Human
agagagccacaggggagcagaggg

SEQ ID NO: 929417 - RNA, 24 nt, Human
agccaaaaaccuucgguucuuguu

SEQ ID NO: 929418 - RNA, 25 nt, Human
agcuaaagugcaaagccaaagacau

SEQ ID NO: 929419 - RNA, 19 nt, Human
aggcaaaaaggauuccaga

SEQ ID NO: 929420 - RNA, 25 nt, Human
agguuuuuaguuggucuguaaucau

SEQ ID NO: 929421 - RNA, 19 nt, Human
auccucauuuuuuuuuucc

SEQ ID NO: 929422 - RNA, 23 nt, Human
cacuaggaaggguccuacacagg

SEQ ID NO: 929423 - RNA, 24 nt, Human
cagaggguuccuucgcuaaaacac

SEQ ID NO: 929424 - RNA, 23 nt, Human
cagcuaaagugcaaagccaaaga

SEQ ID NO: 929425 - RNA, 24 nt, Human
cagcuuaagccauagccagaaacc

SEQ ID NO: 929426 - RNA, 18 nt, Human
cauuucuucccucaaccc

SEQ ID NO: 929427 - RNA, 19 nt, Human
ccauuaaucuagaggcaaa

SEQ ID NO: 929428 - RNA, 21 nt, Human
cccuuagcuuuuaugagccuc

SEQ ID NO: 929429 - RNA, 19 nt, Human
ccuacugccaugcuguugu

SEQ ID NO: 929430 - RNA, 20 nt, Human
ccuaggcccucuuccacucc

SEQ ID NO: 929431 - RNA, 21 nt, Human
cuaaagugcaaagccaaagac

SEQ ID NO: 929432 - RNA, 24 nt, Human
cucaaaugcuccacuagaacagcu

SEQ ID NO: 929433 - RNA, 22 nt, Human
cucuguccuaggcccucuucca

SEQ ID NO: 929434 - RNA, 20 nt, Human
cuggaaccgagugcuucaua

SEQ ID NO: 929435 - RNA, 18 nt, Human
cuggaaucuccuagguuu

SEQ ID NO: 929436 - RNA, 22 nt, Human
cugguguccucuguaaaaucuc

SEQ ID NO: 929437 - RNA, 22 nt, Human
cugucccggucuacucucuucc

SEQ ID NO: 929438 - RNA, 19 nt, Human
cuuuauaccugguguccuc

SEQ ID NO: 929439 - RNA, 18 nt, Human
gaaauuccuucuugucuu

SEQ ID NO: 929440 - RNA, 23 nt, Human
gaagacagaaccacacuaggaag

SEQ ID NO: 929441 - RNA, 21 nt, Human
gagugcuucauaaauguuugg

SEQ ID NO: 929442 - RNA, 22 nt, Human
gaugaugagaaacagccaaaaa

SEQ ID NO: 929443 - RNA, 23 nt, Human
gcaaagccaaagacaucuccaau

SEQ ID NO: 929444 - RNA, 21 nt, Human
gcugauaccuccccaacccua

SEQ ID NO: 929445 - RNA, 18 nt, Human
gcugcauuucuucccuca

SEQ ID NO: 929446 - RNA, 22 nt, Human
gcuuccaucucaaaugcuccac

SEQ ID NO: 929447 - RNA, 19 nt, Human
gggaaugggaauaagaaga

SEQ ID NO: 929448 - RNA, 18 nt, Human
gucuacucucuucccuua

SEQ ID NO: 929449 - RNA, 21 nt, Human
uaagccauagccagaaaccca

SEQ ID NO: 929450 - RNA, 18 nt, Human
uacacaagaaaagccauc

SEQ ID NO: 929451 - RNA, 20 nt, Human
uacuugacuccucugucccg

SEQ ID NO: 929452 - RNA, 18 nt, Human
uagaacagcucucacuaa

SEQ ID NO: 929453 - RNA, 24 nt, Human
uagaacagcucucacuaacgucuu

SEQ ID NO: 929454 - RNA, 23 nt, Human
uagccagaaacccaaauccuauu

SEQ ID NO: 929455 - RNA, 24 nt, Human
ucaaaugugcauaucuuuugccuc

SEQ ID NO: 929456 - RNA, 20 nt, Human
ucacugauguuggauuccca

SEQ ID NO: 929457 - RNA, 20 nt, Human
ucauuuuuuuuuuccugcau

SEQ ID NO: 929458 - RNA, 23 nt, Human
uccauaccaugacacuguggaag

SEQ ID NO: 929459 - RNA, 19 nt, Human
uccuacugccaugcuguug

SEQ ID NO: 929460 - RNA, 19 nt, Human
ucuccuagguuuuuaguug

SEQ ID NO: 929461 - RNA, 23 nt, Human
ucuguaaaaucucuuuuuuguuu

SEQ ID NO: 929462 - RNA, 20 nt, Human
ugacacuguggaauuugucc

SEQ ID NO: 929463 - RNA, 19 nt, Human
ugacauguuucuuuagcaa

SEQ ID NO: 929464 - RNA, 20 nt, Human
ugacauguuucuuuagcaca

SEQ ID NO: 929465 - RNA, 19 nt, Human
ugagaaacagccaaaaacc

SEQ ID NO: 929466 - RNA, 24 nt, Human
ugagaaacagccaaaaaccuucgg

SEQ ID NO: 929467 - RNA, 19 nt, Human
ugagccucauccucauuuu

SEQ ID NO: 929468 - RNA, 19 nt, Human
ugccaggagcccauuauuc

SEQ ID NO: 929469 - RNA, 21 nt, Human
ugccugccagacacauuauuu

SEQ ID NO: 929470 - RNA, 25 nt, Human
uggcagcagcagcaaagggcacuuc

SEQ ID NO: 929471 - RNA, 21 nt, Human
uggugaauaagugaaugacau

SEQ ID NO: 929472 - RNA, 19 nt, Human
uguaaaaucucuuuuuugu

SEQ ID NO: 929473 - RNA, 22 nt, Human
uuagcuuuuaugagccucaucc

SEQ ID NO: 929474 - RNA, 21 nt, Human
uucacugauguuggauuccca

SEQ ID NO: 929475 - RNA, 20 nt, Human
uucauggugcuaaauucaac

SEQ ID NO: 929476 - RNA, 23 nt, Human
uuccagaaugggaaugggaauaa

SEQ ID NO: 929477 - RNA, 23 nt, Human
uucuucccucaacccccauuuac

SEQ ID NO: 929478 - RNA, 20 nt, Human
uucuuuagcacaagaccugg

SEQ ID NO: 929479 - RNA, 23 nt, Human
uuggcugauaccuccccaacccu

SEQ ID NO: 929480 - RNA, 23 nt, Human
uuguuguuguuuuccacuuucuc

SEQ ID NO: 929481 - RNA, 20 nt, Human
uuuaaccuauuuacuuaccu

SEQ ID NO: 929482 - RNA, 26 nt, Human
uuucccacugugguuguuucuacuuu

SEQ ID NO: 929483 - RNA, 25 nt, Human
uuuuuuuguuguuguuguuuuccac

SEQ ID NO: 929484 - RNA, 23 nt, Human
aaaaauaaggauugugagagaga

SEQ ID NO: 929485 - RNA, 18 nt, Human
aaaagaaaagcaaaagaa

SEQ ID NO: 929486 - RNA, 26 nt, Human
aaaagaaaagcaaaagaaacaugcga

SEQ ID NO: 929487 - RNA, 19 nt, Human
aacaaaagaaaagcaaaag

SEQ ID NO: 929488 - RNA, 24 nt, Human
aagaaaagcaaaagaaacaugcga

SEQ ID NO: 929489 - RNA, 18 nt, Human
aagcaaaagaaacaugcg

SEQ ID NO: 929490 - RNA, 19 nt, Human
aaucucuguucugagucuc

SEQ ID NO: 929491 - RNA, 23 nt, Human
acacaacaaaagaaaagcaaaag

SEQ ID NO: 929492 - RNA, 26 nt, Human
accuugacaguuuuggucuuuccuug

SEQ ID NO: 929493 - RNA, 20 nt, Human
agagaauagaaucugacuau

SEQ ID NO: 929494 - RNA, 23 nt, Human
agccaagugucaguuucuuuauu

SEQ ID NO: 929495 - RNA, 19 nt, Human
aguuuuggucuuuccuugg

SEQ ID NO: 929496 - RNA, 20 nt, Human
auucuacagcguuccucuaa

SEQ ID NO: 929497 - RNA, 23 nt, Human
caaaguaaccaacagcaccugac

SEQ ID NO: 929498 - RNA, 21 nt, Human
caacagcaccugacauauaau

SEQ ID NO: 929499 - RNA, 21 nt, Human
cacaacaaaagaaaagcaaaa

SEQ ID NO: 929500 - RNA, 19 nt, Human
cagauugcagaauuaugac

SEQ ID NO: 929501 - RNA, 22 nt, Human
cagauugcagaauuaugaccaa

SEQ ID NO: 929502 - RNA, 23 nt, Human
cagcaagaugacuguaagaacug

SEQ ID NO: 929503 - RNA, 25 nt, Human
caucugaacauuggccugaauguuu

SEQ ID NO: 929504 - RNA, 23 nt, Human
ccaauaccagcuaacaaaagaga

SEQ ID NO: 929505 - RNA, 28 nt, Human
ccuugcuaaaagauguuuacuuuucucg

SEQ ID NO: 929506 - RNA, 18 nt, Human
cuacagcguuccucuaag

SEQ ID NO: 929507 - RNA, 19 nt, Human
cucaagagauaggguugcc

SEQ ID NO: 929508 - RNA, 20 nt, Human
cucagucuucaagcuuuagc

SEQ ID NO: 929509 - RNA, 22 nt, Human
cugaacauuggccugaauguuu

SEQ ID NO: 929510 - RNA, 18 nt, Human
cugagucucuucagagaa

SEQ ID NO: 929511 - RNA, 22 nt, Human
cuugacaguuuuggucuuuccu

SEQ ID NO: 929512 - RNA, 24 nt, Human
gaaaauaaaagccuugcuaaaaga

SEQ ID NO: 929513 - RNA, 20 nt, Human
gagaauggagccuagcuagg

SEQ ID NO: 929514 - RNA, 19 nt, Human
gccugaauguuuuaguugu

SEQ ID NO: 929515 - RNA, 20 nt, Human
uaacaaaagagaaauaguaa

SEQ ID NO: 929516 - RNA, 20 nt, Human
uaacagguuccacuuauaau

SEQ ID NO: 929517 - RNA, 28 nt, Human
uaacagguuccacuuauaauuaagauuc

SEQ ID NO: 929518 - RNA, 20 nt, Human
uaaguuuuggggugguuugu

SEQ ID NO: 929519 - RNA, 19 nt, Human
uaauugcucagucuucaag

SEQ ID NO: 929520 - RNA, 22 nt, Human
uacagcguuccucuaagacagg

SEQ ID NO: 929521 - RNA, 21 nt, Human
uagccuuggcuuuauuuguuc

SEQ ID NO: 929522 - RNA, 20 nt, Human
ucucaagagauaggguugcc

SEQ ID NO: 929523 - RNA, 19 nt, Human
ucucggccuaccuugacag

SEQ ID NO: 929524 - RNA, 20 nt, Human
ucugauucuucuuuucuguc

SEQ ID NO: 929525 - RNA, 21 nt, Human
ucugugguuuuaaaaaaaaag

SEQ ID NO: 929526 - RNA, 19 nt, Human
ucuguucugagucucuuca

SEQ ID NO: 929527 - RNA, 19 nt, Human
ugacuguaagaacugccua

SEQ ID NO: 929528 - RNA, 21 nt, Human
ugccaguaaguuuuggggugg

SEQ ID NO: 929529 - RNA, 18 nt, Human
ugccuaguugagcccugc

SEQ ID NO: 929530 - RNA, 20 nt, Human
ugcuggcuguguaacuaugg

SEQ ID NO: 929531 - RNA, 18 nt, Human
uggcugaaagcaguagua

SEQ ID NO: 929532 - RNA, 22 nt, Human
ugugguuuuaaaaaaaaagcgg

SEQ ID NO: 929533 - RNA, 23 nt, Human
uguguaacuaugggcagguuacu

SEQ ID NO: 929534 - RNA, 23 nt, Human
uguugugccaguaaguuuugggg

SEQ ID NO: 929535 - RNA, 20 nt, Human
uuauacuuaccauccuguca

SEQ ID NO: 929536 - RNA, 20 nt, Human
uuccuuucaguuuggguugg

SEQ ID NO: 929537 - RNA, 18 nt, Human
uuguuacacaacaaaaga

SEQ ID NO: 929538 - RNA, 19 nt, Human
uuuggggugguuuguuaca

SEQ ID NO: 929539 - RNA, 19 nt, Human
uuuucucggccuaccuuga

SEQ ID NO: 929540 - RNA, 18 nt, Human
aaaauuguagcaaggaca

SEQ ID NO: 929541 - RNA, 22 nt, Human
aaaucuguuuuaaacaugcuag

SEQ ID NO: 929542 - RNA, 20 nt, Human
aacauacucaagauuuaaga

SEQ ID NO: 929543 - RNA, 23 nt, Human
aagaaaaaauaaguucaggaaaa

SEQ ID NO: 929544 - RNA, 21 nt, Human
acucaagauuuaagaaagagg

SEQ ID NO: 929545 - RNA, 26 nt, Human
agaaagaaaaugaaacauacucaaga

SEQ ID NO: 929546 - RNA, 27 nt, Human
agaaagagggaacgagcaguaccauuu

SEQ ID NO: 929547 - RNA, 20 nt, Human
agacuuaaguguaacugaua

SEQ ID NO: 929548 - RNA, 21 nt, Human
aguaccauucacugauuuggc

SEQ ID NO: 929549 - RNA, 23 nt, Human
augaaaucuguuuuaaacaugcu

SEQ ID NO: 929550 - RNA, 22 nt, Human
augaagccugcagcagcagacc

SEQ ID NO: 929551 - RNA, 22 nt, Human
caagaaaagccacugguuggua

SEQ ID NO: 929552 - RNA, 21 nt, Human
caaggcaaaaucaauucugcu

SEQ ID NO: 929553 - RNA, 20 nt, Human
caagucaagaaaagccacug

SEQ ID NO: 929554 - RNA, 25 nt, Human
caggaaaaccagaugcuucucaaau

SEQ ID NO: 929555 - RNA, 23 nt, Human
ccaacaucucaauugguucagcu

SEQ ID NO: 929556 - RNA, 19 nt, Human
cuugaaauguccaguaagc

SEQ ID NO: 929557 - RNA, 19 nt, Human
cuugacagcauuugaucuc

SEQ ID NO: 929558 - RNA, 21 nt, Human
gacgaagcaaaguuuuagaug

SEQ ID NO: 929559 - RNA, 19 nt, Human
gcacauauuuuuccauaca

SEQ ID NO: 929560 - RNA, 21 nt, Human
ggaaaaguuaaucuuguuuau

SEQ ID NO: 929561 - RNA, 27 nt, Human
ggugaagaagaaagaaaagggagggcc

SEQ ID NO: 929562 - RNA, 20 nt, Human
guccaguaagcauuuauucu

SEQ ID NO: 929563 - RNA, 22 nt, Human
uaaauuuucuugcaccaaaaua

SEQ ID NO: 929564 - RNA, 20 nt, Human
uaacuugcugcacauauuuu

SEQ ID NO: 929565 - RNA, 19 nt, Human
uaagaaagagggaacgagc

SEQ ID NO: 929566 - RNA, 21 nt, Human
uaagaaggauaggacaucagu

SEQ ID NO: 929567 - RNA, 20 nt, Human
uaauuccauucuauuagacu

SEQ ID NO: 929568 - RNA, 22 nt, Human
uaauugggacaaggcauugucc

SEQ ID NO: 929569 - RNA, 20 nt, Human
uagaggugaagaagaaagaa

SEQ ID NO: 929570 - RNA, 21 nt, Human
uagcaaggacaaacaucaaau

SEQ ID NO: 929571 - RNA, 18 nt, Human
uauaacaugucugaacag

SEQ ID NO: 929572 - RNA, 20 nt, Human
uauaacaugucugaacagga

SEQ ID NO: 929573 - RNA, 20 nt, Human
uccauucuauuagacuuaag

SEQ ID NO: 929574 - RNA, 20 nt, Human
ucucugauuauagaggugaa

SEQ ID NO: 929575 - RNA, 24 nt, Human
ucugaacaggaucuaguuugaggc

SEQ ID NO: 929576 - RNA, 25 nt, Human
ugaaacauacucaagauuuaagaaa

SEQ ID NO: 929577 - RNA, 21 nt, Human
ugaaacuagaguaggaacugg

SEQ ID NO: 929578 - RNA, 21 nt, Human
ugacagcauuugaucucugau

SEQ ID NO: 929579 - RNA, 19 nt, Human
ugcaaagagucccuaucaa

SEQ ID NO: 929580 - RNA, 21 nt, Human
ugccccaaagaaaucaguagc

SEQ ID NO: 929581 - RNA, 23 nt, Human
uggaagaauggugaaaucauuga

SEQ ID NO: 929582 - RNA, 24 nt, Human
uggaagaauggugaaaucauugau

SEQ ID NO: 929583 - RNA, 23 nt, Human
ugggacaaggcauugucccaaac

SEQ ID NO: 929584 - RNA, 19 nt, Human
ugguggggggaggaaaacu

SEQ ID NO: 929585 - RNA, 22 nt, Human
uguaacugauacuuuaguucaa

SEQ ID NO: 929586 - RNA, 22 nt, Human
ugucaaaaucuuugcggguucc

SEQ ID NO: 929587 - RNA, 25 nt, Human
uuaagaaaaaauaaguucaggaaaa

SEQ ID NO: 929588 - RNA, 23 nt, Human
uuaaggagagauuuguuuuucau

SEQ ID NO: 929589 - RNA, 18 nt, Human
uugauggugaaaguugug

SEQ ID NO: 929590 - RNA, 22 nt, Human
uugguggggggaggaaaacuug

SEQ ID NO: 929591 - RNA, 23 nt, Human
uuuuuuuuuuuuuuucuuaauug

SEQ ID NO: 929592 - RNA, 26 nt, Human
aaauaacugagagugugcuaaaucuc

SEQ ID NO: 929593 - RNA, 21 nt, Human
aacuguguuuuccuuccuuaa

SEQ ID NO: 929594 - RNA, 18 nt, Human
acaaaacaaaacucagaa

SEQ ID NO: 929595 - RNA, 23 nt, Human
acaccaagucccuagaguucggc

SEQ ID NO: 929596 - RNA, 21 nt, Human
acagaaucagaguauuaaaaa

SEQ ID NO: 929597 - RNA, 18 nt, Human
acuuuuuuuuuuuuuucu

SEQ ID NO: 929598 - RNA, 24 nt, Human
agaaacaggaacaccacacaaugu

SEQ ID NO: 929599 - RNA, 21 nt, Human
aggaggagaggggcuggggaa

SEQ ID NO: 929600 - RNA, 20 nt, Human
auacagaaaauacagaaaaa

SEQ ID NO: 929601 - RNA, 20 nt, Human
auccaauauggaauaucaau

SEQ ID NO: 929602 - RNA, 19 nt, Human
caaugcuaacaaaacaaca

SEQ ID NO: 929603 - RNA, 23 nt, Human
caaugcuaacaaaacaacaggaa

SEQ ID NO: 929604 - RNA, 19 nt, Human
cagcaccauagacacaucg

SEQ ID NO: 929605 - RNA, 20 nt, Human
caggaaggguacucgugagc

SEQ ID NO: 929606 - RNA, 22 nt, Human
cauacagaaaauacagaaaaaa

SEQ ID NO: 929607 - RNA, 23 nt, Human
caugaacauaacagaacaucacg

SEQ ID NO: 929608 - RNA, 23 nt, Human
ccaagcaacaccaagucccuaga

SEQ ID NO: 929609 - RNA, 21 nt, Human
ccagaaacaggaacaccacac

SEQ ID NO: 929610 - RNA, 20 nt, Human
ccagacacacauggauacau

SEQ ID NO: 929611 - RNA, 24 nt, Human
ccagccaaggucagacgacccuaa

SEQ ID NO: 929612 - RNA, 20 nt, Human
ccucuuggucuucugauugc

SEQ ID NO: 929613 - RNA, 20 nt, Human
ccugccuccacacuguuucu

SEQ ID NO: 929614 - RNA, 28 nt, Human
cuuucuauucaugauauuggcaguuuca

SEQ ID NO: 929615 - RNA, 27 nt, Human
gagcaucucacgguuaagucagaaaug

SEQ ID NO: 929616 - RNA, 18 nt, Human
gcuucccagacacacaug

SEQ ID NO: 929617 - RNA, 20 nt, Human
ggaucguuuuaaaaacugug

SEQ ID NO: 929618 - RNA, 19 nt, Human
guaaaacaaaacaaaacuc

SEQ ID NO: 929619 - RNA, 19 nt, Human
uaaaaaaaaggaggagagg

SEQ ID NO: 929620 - RNA, 19 nt, Human
uaaaacaaaacaaaacuca

SEQ ID NO: 929621 - RNA, 22 nt, Human
uaaaacaaaacaaaacucagaa

SEQ ID NO: 929622 - RNA, 19 nt, Human
uaaauuagaucacagugcu

SEQ ID NO: 929623 - RNA, 25 nt, Human
uaauagguucaccauaucgaagucu

SEQ ID NO: 929624 - RNA, 27 nt, Human
uacaaaggaaaaaaagacaccauuaca

SEQ ID NO: 929625 - RNA, 24 nt, Human
uacagaaaaaaaauuggcuuuuga

SEQ ID NO: 929626 - RNA, 21 nt, Human
uacgaagaaugcaaaaugcag

SEQ ID NO: 929627 - RNA, 19 nt, Human
uagugagugugaaugacac

SEQ ID NO: 929628 - RNA, 22 nt, Human
uauaguaguauaaauaauaaaa

SEQ ID NO: 929629 - RNA, 19 nt, Human
ucaacauacauacucaaga

SEQ ID NO: 929630 - RNA, 22 nt, Human
ucaaugcuaacaaaacaacagg

SEQ ID NO: 929631 - RNA, 23 nt, Human
ucagaaguacaacagcaaggugc

SEQ ID NO: 929632 - RNA, 25 nt, Human
ucagaaguacaacagcaaggugcag

SEQ ID NO: 929633 - RNA, 23 nt, Human
ucaggccacagucaugaaaggau

SEQ ID NO: 929634 - RNA, 20 nt, Human
uccagaaacaggaacaccac

SEQ ID NO: 929635 - RNA, 22 nt, Human
ucguaaauuaauuuggccgugu

SEQ ID NO: 929636 - RNA, 22 nt, Human
ucuuucuccuuuaugguucucc

SEQ ID NO: 929637 - RNA, 23 nt, Human
ucuuucuccuuuaugguucuccc

SEQ ID NO: 929638 - RNA, 19 nt, Human
ugaaauacaguggaaaaac

SEQ ID NO: 929639 - RNA, 19 nt, Human
ugagagugugcuaaaucuc

SEQ ID NO: 929640 - RNA, 22 nt, Human
uggaagaacugcaaggucacac

SEQ ID NO: 929641 - RNA, 23 nt, Human
uggaauaucaauuauuuugcaaa

SEQ ID NO: 929642 - RNA, 18 nt, Human
uggaucguuuuaaaaacu

SEQ ID NO: 929643 - RNA, 21 nt, Human
ugguaggucuggggaaaagug

SEQ ID NO: 929644 - RNA, 19 nt, Human
uguuucuuuagguuuacau

SEQ ID NO: 929645 - RNA, 22 nt, Human
uucggcugaucgcgccugccuc

SEQ ID NO: 929646 - RNA, 23 nt, Human
uucuuuagguuuacaugaacaua

SEQ ID NO: 929647 - RNA, 25 nt, Human
uuuaaaaacuguguuuuccuuccuu

SEQ ID NO: 929648 - RNA, 22 nt, Human
uuuuccuuccuuaauuuuuggu

SEQ ID NO: 929649 - RNA, 18 nt, Human
uuuuuuuuuuuuuuuuug

SEQ ID NO: 929650 - RNA, 22 nt, Human
aaaaaacugccauacaagccaa

SEQ ID NO: 929651 - RNA, 21 nt, Human
aaaacaaccaagauucaggug

SEQ ID NO: 929652 - RNA, 24 nt, Human
aaagaagcacaaaucacugccugu

SEQ ID NO: 929653 - RNA, 21 nt, Human
aaagguccaagccccaaccaa

SEQ ID NO: 929654 - RNA, 19 nt, Human
aagcaggaaauauauaagg

SEQ ID NO: 929655 - RNA, 19 nt, Human
aagcaggaaauauauaagg

SEQ ID NO: 929656 - RNA, 19 nt, Human
aagguacucauuacccaaa

SEQ ID NO: 929657 - RNA, 22 nt, Human
aagguacucauuacccaaaugu

SEQ ID NO: 929658 - RNA, 24 nt, Human
aauaguaaaaacaaccaagauuca

SEQ ID NO: 929659 - RNA, 24 nt, Human
acaaagcagaauuugucaagccuu

SEQ ID NO: 929660 - RNA, 21 nt, Human
acucauuacccaaauguucag

SEQ ID NO: 929661 - RNA, 22 nt, Human
acucauuacccaaauguucaga

SEQ ID NO: 929662 - RNA, 18 nt, Human
agacaagcaggaaauaua

SEQ ID NO: 929663 - RNA, 23 nt, Human
agagucccaguuggagcacccag

SEQ ID NO: 929664 - RNA, 20 nt, Human
agauaccacaaaaggagcgg

SEQ ID NO: 929665 - RNA, 21 nt, Human
agccaauucccuaggcugaag

SEQ ID NO: 929666 - RNA, 22 nt, Human
caaagaagcacaaaucacugcc

SEQ ID NO: 929667 - RNA, 20 nt, Human
caaagguccaagccccaacc

SEQ ID NO: 929668 - RNA, 18 nt, Human
caccugacaaagcagaau

SEQ ID NO: 929669 - RNA, 22 nt, Human
cacugugcucaguuuaucuucc

SEQ ID NO: 929670 - RNA, 25 nt, Human
cagcuuuggcugaucaggacaacuu

SEQ ID NO: 929671 - RNA, 24 nt, Human
caggaaauauauaaggaacuccau

SEQ ID NO: 929672 - RNA, 21 nt, Human
caggacggacaagagucagaa

SEQ ID NO: 929673 - RNA, 21 nt, Human
caggcaaugacacaccauucc

SEQ ID NO: 929674 - RNA, 21 nt, Human
ccaaaggcauacaagacaagc

SEQ ID NO: 929675 - RNA, 18 nt, Human
cccuaggcugaaggcaga

SEQ ID NO: 929676 - RNA, 22 nt, Human
ccgaugauaaaaaccaaagaag

SEQ ID NO: 929677 - RNA, 24 nt, Human
cgaugauaaaaaccaaagaagcac

SEQ ID NO: 929678 - RNA, 19 nt, Human
cuagauccaaaggcauaca

SEQ ID NO: 929679 - RNA, 18 nt, Human
cucaaccucuccuuauuu

SEQ ID NO: 929680 - RNA, 23 nt, Human
cucauuacccaaauguucagacu

SEQ ID NO: 929681 - RNA, 23 nt, Human
cugaaccauauuuuaugacaccu

SEQ ID NO: 929682 - RNA, 22 nt, Human
cugacaaagcagaauuugucaa

SEQ ID NO: 929683 - RNA, 18 nt, Human
cuuggcaaaauauuucua

SEQ ID NO: 929684 - RNA, 20 nt, Human
gaucaggacaacuuaaaaga

SEQ ID NO: 929685 - RNA, 26 nt, Human
gccccaaccaaggggauucuucgauc

SEQ ID NO: 929686 - RNA, 20 nt, Human
gcggaaaaaacugccauaca

SEQ ID NO: 929687 - RNA, 24 nt, Human
uaaaacaaagacuccaucauaagc

SEQ ID NO: 929688 - RNA, 24 nt, Human
uaauaguaaaaacaaccaagauuc

SEQ ID NO: 929689 - RNA, 18 nt, Human
uacaagacaagcaggaaa

SEQ ID NO: 929690 - RNA, 23 nt, Human
uacuagauccaaaggcauacaag

SEQ ID NO: 929691 - RNA, 26 nt, Human
uaggacaagguacucauuacccaaau

SEQ ID NO: 929692 - RNA, 21 nt, Human
uaguaacuccauuucauaaag

SEQ ID NO: 929693 - RNA, 22 nt, Human
uauaaggaacuccauuauggca

SEQ ID NO: 929694 - RNA, 25 nt, Human
uaucuuacagauaaugugacucuug

SEQ ID NO: 929695 - RNA, 21 nt, Human
uaugacaccugacaaagcaga

SEQ ID NO: 929696 - RNA, 22 nt, Human
ucaaccucuccuuauuuccuua

SEQ ID NO: 929697 - RNA, 24 nt, Human
ucagaagugguaauacagggaaug

SEQ ID NO: 929698 - RNA, 21 nt, Human
uccaagccccaaccaagggga

SEQ ID NO: 929699 - RNA, 22 nt, Human
ucccuaggcugaaggcagaaau

SEQ ID NO: 929700 - RNA, 21 nt, Human
ucugaaccauauuuuaugaca

SEQ ID NO: 929701 - RNA, 23 nt, Human
ucugaagagucuuagcguuugug

SEQ ID NO: 929702 - RNA, 28 nt, Human
ucuugugauguuuuccuuuggucacgga

SEQ ID NO: 929703 - RNA, 23 nt, Human
ugacacuacagaugcguucugaa

SEQ ID NO: 929704 - RNA, 26 nt, Human
ugacacuacagaugcguucugaacca

SEQ ID NO: 929705 - RNA, 27 nt, Human
ugacacuacagaugcguucugaaccag

SEQ ID NO: 929706 - RNA, 23 nt, Human
ugauuuuacaaugugugguuuug

SEQ ID NO: 929707 - RNA, 23 nt, Human
ugcucaguuuaucuuccuaggac

SEQ ID NO: 929708 - RNA, 19 nt, Human
uggcaaagguccaagcccc

SEQ ID NO: 929709 - RNA, 26 nt, Human
uggcaaagguccaagccccaaccaag

SEQ ID NO: 929710 - RNA, 20 nt, Human
ugugauguuuuccuuuggcc

SEQ ID NO: 929711 - RNA, 23 nt, Human
uucaggacggacaagagucagaa

SEQ ID NO: 929712 - RNA, 21 nt, Human
uucucaaccucuccuuauuuc

SEQ ID NO: 929713 - RNA, 22 nt, Human
uuuaucuuccuaggacaaggua

SEQ ID NO: 929714 - RNA, 22 nt, Human
uuucugcuuugaguuuuaagag

SEQ ID NO: 929715 - RNA, 19 nt, Human
aaaggagaaaucacaugag

SEQ ID NO: 929716 - RNA, 23 nt, Human
aacuccgccccuccaggcauuca

SEQ ID NO: 929717 - RNA, 19 nt, Human
aggaaucacuccuaggacc

SEQ ID NO: 929718 - RNA, 22 nt, Human
agguaaucggaaggaaauagaa

SEQ ID NO: 929719 - RNA, 20 nt, Human
caaaguaguuauguaucagc

SEQ ID NO: 929720 - RNA, 18 nt, Human
cacaggagcaccauuuga

SEQ ID NO: 929721 - RNA, 21 nt, Human
cacugagcggagucuaguccu

SEQ ID NO: 929722 - RNA, 21 nt, Human
cagcagaugggccacccuucu

SEQ ID NO: 929723 - RNA, 18 nt, Human
caggcauucacucgcacc

SEQ ID NO: 929724 - RNA, 23 nt, Human
cauuggaggaaucacuccuagga

SEQ ID NO: 929725 - RNA, 22 nt, Human
ccagaagacggagguaucuagg

SEQ ID NO: 929726 - RNA, 24 nt, Human
cccuucuaauucugcaguagcuug

SEQ ID NO: 929727 - RNA, 21 nt, Human
ccucugcauagacucugcugu

SEQ ID NO: 929728 - RNA, 22 nt, Human
cggaaggaaauagaaaccuauc

SEQ ID NO: 929729 - RNA, 24 nt, Human
cuacuggucuuuuugggguuuucc

SEQ ID NO: 929730 - RNA, 24 nt, Human
cuccuaggaccuuccugauucguc

SEQ ID NO: 929731 - RNA, 25 nt, Human
gaaaaagaaaacacaauagcuguua

SEQ ID NO: 929732 - RNA, 22 nt, Human
gcacugagcggagucuaguccu

SEQ ID NO: 929733 - RNA, 18 nt, Human
gcagugaaaggcacccgg

SEQ ID NO: 929734 - RNA, 20 nt, Human
gugaaaaagaaaacacaaua

SEQ ID NO: 929735 - RNA, 20 nt, Human
guuuuuuuuuuuuuguaggu

SEQ ID NO: 929736 - RNA, 21 nt, Human
uacccagcagaugggccaccc

SEQ ID NO: 929737 - RNA, 23 nt, Human
ucaacauuacauuccuagccuaa

SEQ ID NO: 929738 - RNA, 19 nt, Human
ucgcaccccaggcauuugc

SEQ ID NO: 929739 - RNA, 21 nt, Human
ucugaagugugaaaaagaaaa

SEQ ID NO: 929740 - RNA, 30 nt, Human
ugaaaggcacccggcgaagucugcgaaagg

SEQ ID NO: 929741 - RNA, 21 nt, Human
ugagacuacaaauacaagaca

SEQ ID NO: 929742 - RNA, 24 nt, Human
ugauacauuugcuaaagcuuaaca

SEQ ID NO: 929743 - RNA, 20 nt, Human
uggaggcagccacugugcua

SEQ ID NO: 929744 - RNA, 19 nt, Human
uguagguuuccccuguguu

SEQ ID NO: 929745 - RNA, 27 nt, Human
uuauauaauuauauauacauuugggcu

SEQ ID NO: 929746 - RNA, 19 nt, Human
uucagauuccuuccuuguc

SEQ ID NO: 929747 - RNA, 22 nt, Human
uuugagacuacaaauacaagac

SEQ ID NO: 929748 - RNA, 23 nt, Human
uuugcaggcccucugcauagacu

SEQ ID NO: 929749 - RNA, 24 nt, Human
uuuugagacuacaaauacaagaca

SEQ ID NO: 929750 - RNA, 21 nt, Human
aaaaaggaaacuaaaguuaga

SEQ ID NO: 929751 - RNA, 27 nt, Human
aaaaggaaacuaaaguuagagacagaa

SEQ ID NO: 929752 - RNA, 20 nt, Human
aaaauuaacaaggaauuuaa

SEQ ID NO: 929753 - RNA, 18 nt, Human
aacuaaaguuagagacag

SEQ ID NO: 929754 - RNA, 27 nt, Human
aacuucuaauucaacauauucugacac

SEQ ID NO: 929755 - RNA, 22 nt, Human
aauauuuacaccccauaucuaa

SEQ ID NO: 929756 - RNA, 19 nt, Human
aaucugcagucauguccuu

SEQ ID NO: 929757 - RNA, 21 nt, Human
accccuuucaccacugugucc

SEQ ID NO: 929758 - RNA, 25 nt, Human
acgguaaugaaagugaaauccaaga

SEQ ID NO: 929759 - RNA, 19 nt, Human
acuaaguaaagauaagaaa

SEQ ID NO: 929760 - RNA, 21 nt, Human
aggaguagcugucauuugaua

SEQ ID NO: 929761 - RNA, 19 nt, Human
aguggcaucugggagcaga

SEQ ID NO: 929762 - RNA, 24 nt, Human
cauaacucuaaacagcaaucugca

SEQ ID NO: 929763 - RNA, 18 nt, Human
ccccuccccaucuuccca

SEQ ID NO: 929764 - RNA, 22 nt, Human
cccuccccaucuucccacuuaa

SEQ ID NO: 929765 - RNA, 20 nt, Human
cucuccucaagcccuuaaaa

SEQ ID NO: 929766 - RNA, 21 nt, Human
cuuacauguuuguccucccca

SEQ ID NO: 929767 - RNA, 21 nt, Human
cuuucaccacuguguccuuuu

SEQ ID NO: 929768 - RNA, 23 nt, Human
gagcuuuacaaagcuacucuagu

SEQ ID NO: 929769 - RNA, 18 nt, Human
gggagcagaaaaauccaa

SEQ ID NO: 929770 - RNA, 24 nt, Human
gucaccccuuucaccacugugucc

SEQ ID NO: 929771 - RNA, 24 nt, Human
gucagggaagcugaaaaaggaaac

SEQ ID NO: 929772 - RNA, 20 nt, Human
uaaacagcaaucugcaguca

SEQ ID NO: 929773 - RNA, 22 nt, Human
uaacaaggaauuuaacauacaa

SEQ ID NO: 929774 - RNA, 21 nt, Human
uaacauacaaaugagggacca

SEQ ID NO: 929775 - RNA, 22 nt, Human
uaagcaaaaggguucaucucuc

SEQ ID NO: 929776 - RNA, 23 nt, Human
uaaguucuggcucuaagcaaaag

SEQ ID NO: 929777 - RNA, 23 nt, Human
uauaaaguuucuccuaaaaguca

SEQ ID NO: 929778 - RNA, 19 nt, Human
uaucauuuuucucucauau

SEQ ID NO: 929779 - RNA, 23 nt, Human
uccauauuucuucuuccccuuuu

SEQ ID NO: 929780 - RNA, 24 nt, Human
uccccacaucuagcccagugauug

SEQ ID NO: 929781 - RNA, 19 nt, Human
uccccaucuucccacuuaa

SEQ ID NO: 929782 - RNA, 22 nt, Human
uccuaaaagucaccccuuucac

SEQ ID NO: 929783 - RNA, 23 nt, Human
uccuaaaagucaccccuuucacc

SEQ ID NO: 929784 - RNA, 21 nt, Human
uccucaagcccuuaaaaucac

SEQ ID NO: 929785 - RNA, 19 nt, Human
uccuguugacuucuguuca

SEQ ID NO: 929786 - RNA, 20 nt, Human
ucucuccucaagcccuuaaa

SEQ ID NO: 929787 - RNA, 19 nt, Human
ucugacacuaaacacaaau

SEQ ID NO: 929788 - RNA, 19 nt, Human
ugaaaaaggaaacuaaagu

SEQ ID NO: 929789 - RNA, 26 nt, Human
ugaaagugaaauccaagaucaacaau

SEQ ID NO: 929790 - RNA, 21 nt, Human
ugagggaccaggaguagcugu

SEQ ID NO: 929791 - RNA, 27 nt, Human
ugcaaggaacauuauugcugccuuuga

SEQ ID NO: 929792 - RNA, 24 nt, Human
ugcagaauuaguaacuucuguuaa

SEQ ID NO: 929793 - RNA, 24 nt, Human
uguacagaccguuucauauguaua

SEQ ID NO: 929794 - RNA, 23 nt, Human
ugucaucaucucuaccaccacuc

SEQ ID NO: 929795 - RNA, 22 nt, Human
uuacauguuuguccuccccaca

SEQ ID NO: 929796 - RNA, 24 nt, Human
uuagcacacuuccccuccccaucu

SEQ ID NO: 929797 - RNA, 25 nt, Human
uugaucccaucucuuaauauuuccu

SEQ ID NO: 929798 - RNA, 30 nt, Human
uugcaaggaacauuauugcugccuuugauu

SEQ ID NO: 929799 - RNA, 21 nt, Human
uuuuacacacuuuguacaagu

SEQ ID NO: 929800 - RNA, 24 nt, Human
uuuuaucacauauccaauacuuaa

SEQ ID NO: 929801 - RNA, 19 nt, Human
aaaaacaguccccuacuaa

SEQ ID NO: 929802 - RNA, 29 nt, Human
aaaagcaaacagaccaauugucaaccuag

SEQ ID NO: 929803 - RNA, 22 nt, Human
aagcaaacagaccaauugucaa

SEQ ID NO: 929804 - RNA, 18 nt, Human
aagccagggccauaagca

SEQ ID NO: 929805 - RNA, 22 nt, Human
aaugcugggauuacaggcauga

SEQ ID NO: 929806 - RNA, 19 nt, Human
agccaccacgcucacccug

SEQ ID NO: 929807 - RNA, 21 nt, Human
aggacuuuguaagcuugugcu

SEQ ID NO: 929808 - RNA, 22 nt, Human
aguaacuaagggugaagagaga

SEQ ID NO: 929809 - RNA, 19 nt, Human
auagaacagauauuaagac

SEQ ID NO: 929810 - RNA, 24 nt, Human
caaaagcaaacagaccaauuguca

SEQ ID NO: 929811 - RNA, 22 nt, Human
caagugagccuccugccucagc

SEQ ID NO: 929812 - RNA, 22 nt, Human
caauugucaaccuaauuauuuu

SEQ ID NO: 929813 - RNA, 19 nt, Human
cacacuccuccgcccgccc

SEQ ID NO: 929814 - RNA, 22 nt, Human
cacugaacaucugccuuccucc

SEQ ID NO: 929815 - RNA, 23 nt, Human
cacuggacuuggccucauacacc

SEQ ID NO: 929816 - RNA, 24 nt, Human
cagaaugcugggauuacaggcaug

SEQ ID NO: 929817 - RNA, 20 nt, Human
cagggcagaguuucuaagga

SEQ ID NO: 929818 - RNA, 23 nt, Human
ccagaaugcugggauuacaggca

SEQ ID NO: 929819 - RNA, 24 nt, Human
ccagaaugcugggauuacaggcau

SEQ ID NO: 929820 - RNA, 24 nt, Human
cccagaaugcugggauuacaggca

SEQ ID NO: 929821 - RNA, 22 nt, Human
ccuccugccucagccucccaga

SEQ ID NO: 929822 - RNA, 24 nt, Human
ccugccucagccucccagaaugcu

SEQ ID NO: 929823 - RNA, 18 nt, Human
ccugggcucaagugagcc

SEQ ID NO: 929824 - RNA, 20 nt, Human
ccugggcucaagugagccuc

SEQ ID NO: 929825 - RNA, 21 nt, Human
ccugggcucaagugagccucc

SEQ ID NO: 929826 - RNA, 23 nt, Human
ccugggcucaagugagccuccug

SEQ ID NO: 929827 - RNA, 18 nt, Human
ccuuuuccauuugcugac

SEQ ID NO: 929828 - RNA, 22 nt, Human
cuaaccuuagaaagccagcaug

SEQ ID NO: 929829 - RNA, 19 nt, Human
cugaggacuccaacacaaa

SEQ ID NO: 929830 - RNA, 24 nt, Human
cugccucagccucccagaaugcug

SEQ ID NO: 929831 - RNA, 19 nt, Human
gaacagauauuaagacucu

SEQ ID NO: 929832 - RNA, 21 nt, Human
gacuuuguaagcuugugcuug

SEQ ID NO: 929833 - RNA, 22 nt, Human
gagugguccugaggacuccaac

SEQ ID NO: 929834 - RNA, 18 nt, Human
gauuacaggcaugagcca

SEQ ID NO: 929835 - RNA, 21 nt, Human
gauuacaggcaugagccacca

SEQ ID NO: 929836 - RNA, 22 nt, Human
gauuacaggcaugagccaccac

SEQ ID NO: 929837 - RNA, 20 nt, Human
gcaaacagaccaauugucaa

SEQ ID NO: 929838 - RNA, 19 nt, Human
gcccuaaggcccgucacac

SEQ ID NO: 929839 - RNA, 27 nt, Human
gccuccugccucagccucccagaaugc

SEQ ID NO: 929840 - RNA, 18 nt, Human
gcuuguuuuccacuggac

SEQ ID NO: 929841 - RNA, 19 nt, Human
ggauuacaggcaugagcca

SEQ ID NO: 929842 - RNA, 20 nt, Human
gucuugugaagguccuugug

SEQ ID NO: 929843 - RNA, 24 nt, Human
gugagccuccugccucagccuccc

SEQ ID NO: 929844 - RNA, 19 nt, Human
gugcuuguuuuccacugga

SEQ ID NO: 929845 - RNA, 19 nt, Human
uaaaaacaguccccuacua

SEQ ID NO: 929846 - RNA, 21 nt, Human
uaaauacauguaugacaaaag

SEQ ID NO: 929847 - RNA, 22 nt, Human
uaacaucaaauggaaaagauau

SEQ ID NO: 929848 - RNA, 22 nt, Human
uacacugaacaucugccuuccu

SEQ ID NO: 929849 - RNA, 19 nt, Human
uacaggcaugagccaccac

SEQ ID NO: 929850 - RNA, 18 nt, Human
uagaaagccagcaugcuu

SEQ ID NO: 929851 - RNA, 24 nt, Human
ucccagaaugcugggauuacaggc

SEQ ID NO: 929852 - RNA, 21 nt, Human
uccugggcucaagugagccuc

SEQ ID NO: 929853 - RNA, 22 nt, Human
uccugggcucaagugagccucc

SEQ ID NO: 929854 - RNA, 22 nt, Human
uccugggcucaagugagccucc

SEQ ID NO: 929855 - RNA, 24 nt, Human
uccugggcucaagugagccuccug

SEQ ID NO: 929856 - RNA, 25 nt, Human
uccuuuugcugaaauaagccagggc

SEQ ID NO: 929857 - RNA, 22 nt, Human
ucuacacugaacaucugccuuc

SEQ ID NO: 929858 - RNA, 21 nt, Human
ucucaaacuccugggcucaag

SEQ ID NO: 929859 - RNA, 20 nt, Human
ucuggaauuuugguacauac

SEQ ID NO: 929860 - RNA, 23 nt, Human
ugaaacaauauggucuacacuga

SEQ ID NO: 929861 - RNA, 19 nt, Human
ugacaaaagcaaacagacc

SEQ ID NO: 929862 - RNA, 24 nt, Human
ugacaaaagcaaacagaccaauug

SEQ ID NO: 929863 - RNA, 25 nt, Human
ugacaauacuaaccuuagaaagcca

SEQ ID NO: 929864 - RNA, 24 nt, Human
ugccucagccucccagaaugcugg

SEQ ID NO: 929865 - RNA, 20 nt, Human
ugccugaauuaguuaugaaa

SEQ ID NO: 929866 - RNA, 18 nt, Human
ugggauuacaggcaugag

SEQ ID NO: 929867 - RNA, 19 nt, Human
ugggauuacaggcaugagc

SEQ ID NO: 929868 - RNA, 22 nt, Human
ugggauuacaggcaugagccac

SEQ ID NO: 929869 - RNA, 23 nt, Human
ugggauuacaggcaugagccacc

SEQ ID NO: 929870 - RNA, 24 nt, Human
ugggauuacaggcaugagccacca

SEQ ID NO: 929871 - RNA, 24 nt, Human
ugggauuacaggcaugagccacca

SEQ ID NO: 929872 - RNA, 21 nt, Human
ugucuugugaagguccuugug

SEQ ID NO: 929873 - RNA, 20 nt, Human
uuaaaaacaguccccuacua

SEQ ID NO: 929874 - RNA, 23 nt, Human
uuaacaucaaauggaaaagauau

SEQ ID NO: 929875 - RNA, 21 nt, Human
uuacuaccuuaaaaacagucc

SEQ ID NO: 929876 - RNA, 24 nt, Human
uuacuaccuuaaaaacaguccccu

SEQ ID NO: 929877 - RNA, 23 nt, Human
uugaaguaugaagucauauccac

SEQ ID NO: 929878 - RNA, 23 nt, Human
uugauuucucgaggguucccauu

SEQ ID NO: 929879 - RNA, 25 nt, Human
aaauugugaucugaacuuggaguga

SEQ ID NO: 929880 - RNA, 24 nt, Human
aaugcggaauuguaaauugugauc

SEQ ID NO: 929881 - RNA, 19 nt, Human
acaauuacaaaaugcggaa

SEQ ID NO: 929882 - RNA, 22 nt, Human
agaaggcucuuggauuuaaucc

SEQ ID NO: 929883 - RNA, 24 nt, Human
agaaugagcuugaggucuuugggg

SEQ ID NO: 929884 - RNA, 19 nt, Human
aucugaacuuggagugaga

SEQ ID NO: 929885 - RNA, 24 nt, Human
caaaaugcggaauuguaaauugug

SEQ ID NO: 929886 - RNA, 21 nt, Human
cagccccgucucccaacccaa

SEQ ID NO: 929887 - RNA, 19 nt, Human
ccugggcagaaugagcuug

SEQ ID NO: 929888 - RNA, 27 nt, Human
ccuuccauuauuguaugcuuccugcau

SEQ ID NO: 929889 - RNA, 20 nt, Human
gcucuuggauuuaauccugg

SEQ ID NO: 929890 - RNA, 19 nt, Human
gcuuccugcaugccagaaa

SEQ ID NO: 929891 - RNA, 24 nt, Human
gggcagaaugagcuugaggucuuu

SEQ ID NO: 929892 - RNA, 21 nt, Human
ucaggguuaaaaagaugccuc

SEQ ID NO: 929893 - RNA, 23 nt, Human
ucuucuuucuuucccuuccauua

SEQ ID NO: 929894 - RNA, 20 nt, Human
ugccucagagccuagaugac

SEQ ID NO: 929895 - RNA, 20 nt, Human
ugcggaauuguaaauuguga

SEQ ID NO: 929896 - RNA, 21 nt, Human
ugggcagaaugagcuugaggu

SEQ ID NO: 929897 - RNA, 21 nt, Human
uucuuucuuucccuuccauua

SEQ ID NO: 929898 - RNA, 20 nt, Human
uuuuuuuuuuuuuuugucuu

SEQ ID NO: 929899 - RNA, 18 nt, Human
aaacuaaaaauuuagacu

SEQ ID NO: 929900 - RNA, 23 nt, Human
aaaucgguuucuugaugucuuuu

SEQ ID NO: 929901 - RNA, 21 nt, Human
aagcaaaucgguuucuugaug

SEQ ID NO: 929902 - RNA, 18 nt, Human
aagguguguaccaaguga

SEQ ID NO: 929903 - RNA, 24 nt, Human
agccauggagaacucugaaaggaa

SEQ ID NO: 929904 - RNA, 21 nt, Human
aggguuugcccucuucauguc

SEQ ID NO: 929905 - RNA, 18 nt, Human
agucacauacaugauguc

SEQ ID NO: 929906 - RNA, 18 nt, Human
cagagugcucuagaauaa

SEQ ID NO: 929907 - RNA, 24 nt, Human
caugcuacucuuaaccucccaaaa

SEQ ID NO: 929908 - RNA, 20 nt, Human
ccaaauaguuauauccaaaa

SEQ ID NO: 929909 - RNA, 24 nt, Human
cccaaaaagcaguaucuaagucac

SEQ ID NO: 929910 - RNA, 20 nt, Human
cccaaguuuccuucuccacu

SEQ ID NO: 929911 - RNA, 19 nt, Human
ccccccaaguuuccuucuc

SEQ ID NO: 929912 - RNA, 26 nt, Human
cccccuauuaaaauagaaacagggau

SEQ ID NO: 929913 - RNA, 20 nt, Human
ccccuaccuuguccccccua

SEQ ID NO: 929914 - RNA, 21 nt, Human
cccucuccccuaccuuguccc

SEQ ID NO: 929915 - RNA, 27 nt, Human
cucuccccuaccuuguccccccuauua

SEQ ID NO: 929916 - RNA, 19 nt, Human
cuuuugguucuccuugccu

SEQ ID NO: 929917 - RNA, 23 nt, Human
gcaagcccuucucccaucagucc

SEQ ID NO: 929918 - RNA, 18 nt, Human
ggagaaacaccuugaucu

SEQ ID NO: 929919 - RNA, 23 nt, Human
ggagccuuucuuacaaccuugau

SEQ ID NO: 929920 - RNA, 19 nt, Human
ggauucaugagguggccag

SEQ ID NO: 929921 - RNA, 23 nt, Human
uauauccaaaacuguuuuucccu

SEQ ID NO: 929922 - RNA, 20 nt, Human
uaugcgugcugcagcagugg

SEQ ID NO: 929923 - RNA, 23 nt, Human
ucacauacaugaugucuugggca

SEQ ID NO: 929924 - RNA, 22 nt, Human
ugagagaauaaaugguaaugga

SEQ ID NO: 929925 - RNA, 24 nt, Human
ugagagaauaaaugguaauggaga

SEQ ID NO: 929926 - RNA, 22 nt, Human
ugagguggccagaccaaugugu

SEQ ID NO: 929927 - RNA, 21 nt, Human
ugggcauuuucucagccaugg

SEQ ID NO: 929928 - RNA, 24 nt, Human
uguuguuguuuuuuuaagcuuccc

SEQ ID NO: 929929 - RNA, 21 nt, Human
uguuuuucccucuccccuacc

SEQ ID NO: 929930 - RNA, 22 nt, Human
uuaaaauagaaacagggauuga

SEQ ID NO: 929931 - RNA, 21 nt, Human
uucuccuugccugcuccugau

SEQ ID NO: 929932 - RNA, 20 nt, Human
uugggcauuuucucagccau

SEQ ID NO: 929933 - RNA, 19 nt, Human
uuguuguuguuguuuuuuu

SEQ ID NO: 929934 - RNA, 23 nt, Human
uuguuuuguuguuguuguuuuuu

SEQ ID NO: 929935 - RNA, 24 nt, Human
uuucucagccauggagaacucuga

SEQ ID NO: 929936 - RNA, 24 nt, Human
aaagugcugggauuacaggcauga

SEQ ID NO: 929937 - RNA, 23 nt, Human
aagauaaaagcuguacccucuac

SEQ ID NO: 929938 - RNA, 19 nt, Human
aagugcugggauuacaggc

SEQ ID NO: 929939 - RNA, 21 nt, Human
aagugcugggauuacaggcau

SEQ ID NO: 929940 - RNA, 26 nt, Human
aagugcugggauuacaggcaugagcc

SEQ ID NO: 929941 - RNA, 23 nt, Human
acagauccaaguugagugaacac

SEQ ID NO: 929942 - RNA, 23 nt, Human
accucagccucccaaagugcugg

SEQ ID NO: 929943 - RNA, 18 nt, Human
agagaugggguuucucca

SEQ ID NO: 929944 - RNA, 27 nt, Human
agcuguacccucuaccagauguacuga

SEQ ID NO: 929945 - RNA, 20 nt, Human
aggcauguaccaccauaccc

SEQ ID NO: 929946 - RNA, 18 nt, Human
aggcuucugcuggggugg

SEQ ID NO: 929947 - RNA, 22 nt, Human
aguagagaugggguuucuccau

SEQ ID NO: 929948 - RNA, 18 nt, Human
agugcugggauuacaggc

SEQ ID NO: 929949 - RNA, 20 nt, Human
aguuuaucagaaaccugugg

SEQ ID NO: 929950 - RNA, 20 nt, Human
auaaaauagaaauauggcaa

SEQ ID NO: 929951 - RNA, 22 nt, Human
auaugaaauguguuuccuuuau

SEQ ID NO: 929952 - RNA, 23 nt, Human
aucaaugucaacaaauacuucuc

SEQ ID NO: 929953 - RNA, 21 nt, Human
aucaugaccauaaucagcaac

SEQ ID NO: 929954 - RNA, 20 nt, Human
augggguuucuccauuuugg

SEQ ID NO: 929955 - RNA, 24 nt, Human
augggguuucuccauuuuggucag

SEQ ID NO: 929956 - RNA, 24 nt, Human
caaagugcugggauuacaggcaug

SEQ ID NO: 929957 - RNA, 20 nt, Human
caaauacuucucgccauccc

SEQ ID NO: 929958 - RNA, 23 nt, Human
cagaaaccuguggaucaauguca

SEQ ID NO: 929959 - RNA, 18 nt, Human
cagcaucaggacacacuu

SEQ ID NO: 929960 - RNA, 24 nt, Human
caggugauaugcccaccccugaag

SEQ ID NO: 929961 - RNA, 22 nt, Human
caugaccauaaucagcaaccag

SEQ ID NO: 929962 - RNA, 23 nt, Human
ccaaagugcugggauuacaggca

SEQ ID NO: 929963 - RNA, 24 nt, Human
ccaaagugcugggauuacaggcau

SEQ ID NO: 929964 - RNA, 18 nt, Human
ccaccacgcccagccgca

SEQ ID NO: 929965 - RNA, 19 nt, Human
ccauuuuggucaggcuggu

SEQ ID NO: 929966 - RNA, 24 nt, Human
cccaaagugcugggauuacaggca

SEQ ID NO: 929967 - RNA, 22 nt, Human
ccgccaggagcugggccucgug

SEQ ID NO: 929968 - RNA, 23 nt, Human
cgcaaaacccucugaagguaucu

SEQ ID NO: 929969 - RNA, 29 nt, Human
cggcuaguuuuguauuuuuaguagagaug

SEQ ID NO: 929970 - RNA, 24 nt, Human
cuccauuuuggucaggcuggucuu

SEQ ID NO: 929971 - RNA, 21 nt, Human
cucgcuccgccaggagcuggg

SEQ ID NO: 929972 - RNA, 23 nt, Human
cuguacccucuaccagauguacu

SEQ ID NO: 929973 - RNA, 21 nt, Human
cugugguguuuucugaaauuu

SEQ ID NO: 929974 - RNA, 21 nt, Human
cuguuagaucugcuguuccug

SEQ ID NO: 929975 - RNA, 21 nt, Human
gaaaccuguggaucaauguca

SEQ ID NO: 929976 - RNA, 24 nt, Human
gaccucaggugauaugcccaccuc

SEQ ID NO: 929977 - RNA, 18 nt, Human
gagaugggguuucuccau

SEQ ID NO: 929978 - RNA, 24 nt, Human
gagaugggguuucuccauuuuggu

SEQ ID NO: 929979 - RNA, 18 nt, Human
gauuacaggcaugagcca

SEQ ID NO: 929980 - RNA, 21 nt, Human
gauuacaggcaugagccacca

SEQ ID NO: 929981 - RNA, 22 nt, Human
gauuacaggcaugagccaccac

SEQ ID NO: 929982 - RNA, 24 nt, Human
gauuacaggcauguaccaccauac

SEQ ID NO: 929983 - RNA, 18 nt, Human
gcugggauuacaggcaug

SEQ ID NO: 929984 - RNA, 19 nt, Human
ggauuacaggcaugagcca

SEQ ID NO: 929985 - RNA, 26 nt, Human
ggcuaguuuuguauuuuuaguagaga

SEQ ID NO: 929986 - RNA, 24 nt, Human
ggugauaugcccaccucagccucc

SEQ ID NO: 929987 - RNA, 22 nt, Human
gucaacaaauacuucucgccau

SEQ ID NO: 929988 - RNA, 24 nt, Human
gugauaugcccaccucagccuccc

SEQ ID NO: 929989 - RNA, 19 nt, Human
uaaaauguccaagcugaaa

SEQ ID NO: 929990 - RNA, 24 nt, Human
uacaggcaugagccaccacgccca

SEQ ID NO: 929991 - RNA, 23 nt, Human
uacaggcauguaccaccauaccc

SEQ ID NO: 929992 - RNA, 27 nt, Human
uaccugcaguauaugaaauguguuucc

SEQ ID NO: 929993 - RNA, 18 nt, Human
uaguagagaugggguuuc

SEQ ID NO: 929994 - RNA, 19 nt, Human
uaguagagaugggguuucu

SEQ ID NO: 929995 - RNA, 26 nt, Human
uaguagagaugggguuucuccauuuu

SEQ ID NO: 929996 - RNA, 23 nt, Human
uauaugaaauguguuuccuuuau

SEQ ID NO: 929997 - RNA, 20 nt, Human
ucaacaugaucccuuguuuc

SEQ ID NO: 929998 - RNA, 18 nt, Human
ucagccucccaaagugcu

SEQ ID NO: 929999 - RNA, 24 nt, Human
ucccaaagugcugggauuacaggc

SEQ ID NO: 930000 - RNA, 24 nt, Human
ucgaugauaacaccagcaucagga

SEQ ID NO: 930001 - RNA, 25 nt, Human
ucgcaaaacccucugaagguaucug

SEQ ID NO: 930002 - RNA, 18 nt, Human
ucugcuguuccuggggca

SEQ ID NO: 930003 - RNA, 21 nt, Human
ugaaaagauaaaauacuuuga

SEQ ID NO: 930004 - RNA, 18 nt, Human
ugaccucaggugauaugc

SEQ ID NO: 930005 - RNA, 26 nt, Human
ugagaaaguuccucgaugauaacacc

SEQ ID NO: 930006 - RNA, 21 nt, Human
ugauaugcccaccucagccuc

SEQ ID NO: 930007 - RNA, 19 nt, Human
ugcacaggaagaacaucaa

SEQ ID NO: 930008 - RNA, 26 nt, Human
ugcacaggaagaacaucaaaaaauuc

SEQ ID NO: 930009 - RNA, 22 nt, Human
ugcaccaaagccagucacaacc

SEQ ID NO: 930010 - RNA, 18 nt, Human
ugggauuacaggcaugag

SEQ ID NO: 930011 - RNA, 19 nt, Human
ugggauuacaggcaugagc

SEQ ID NO: 930012 - RNA, 22 nt, Human
ugggauuacaggcaugagccac

SEQ ID NO: 930013 - RNA, 23 nt, Human
ugggauuacaggcaugagccacc

SEQ ID NO: 930014 - RNA, 24 nt, Human
ugggauuacaggcaugagccacca

SEQ ID NO: 930015 - RNA, 24 nt, Human
ugggauuacaggcaugagccacca

SEQ ID NO: 930016 - RNA, 21 nt, Human
ugggauuacaggcauguacca

SEQ ID NO: 930017 - RNA, 24 nt, Human
ugggauuacaggcauguaccacca

SEQ ID NO: 930018 - RNA, 21 nt, Human
uggucaggcuggucuuuaacu

SEQ ID NO: 930019 - RNA, 19 nt, Human
uggucgcaaaacccucuga

SEQ ID NO: 930020 - RNA, 21 nt, Human
uguauuuuuaguagagauggg

SEQ ID NO: 930021 - RNA, 18 nt, Human
ugugcaagauaaaagcug

SEQ ID NO: 930022 - RNA, 24 nt, Human
uguuuucugaaauuuaugcacagg

SEQ ID NO: 930023 - RNA, 18 nt, Human
uuaguagagaugggguuu

SEQ ID NO: 930024 - RNA, 22 nt, Human
uuaguagagaugggguuucucc

SEQ ID NO: 930025 - RNA, 24 nt, Human
uuaguagagaugggguuucuccau

SEQ ID NO: 930026 - RNA, 24 nt, Human
uuauaugaaauguguuuccuuuau

SEQ ID NO: 930027 - RNA, 22 nt, Human
uugcaccaaagccagucacaac

SEQ ID NO: 930028 - RNA, 23 nt, Human
uuguauuuuuaguagagaugggg

SEQ ID NO: 930029 - RNA, 23 nt, Human
uuuaacugcugaccucagguuga

SEQ ID NO: 930030 - RNA, 23 nt, Human
uuucuugggccgacugaagggua

SEQ ID NO: 930031 - RNA, 23 nt, Human
uuuguuaccugcaguauaugaaa

SEQ ID NO: 930032 - RNA, 19 nt, Human
uuuuguauuuuuaguagag

SEQ ID NO: 930033 - RNA, 20 nt, Human
uuuuguauuuuuaguagaga

SEQ ID NO: 930034 - RNA, 22 nt, Human
uuuuuaguagagaugggguuuc

SEQ ID NO: 930035 - RNA, 18 nt, Human
aaacaauucuaaaccuca

SEQ ID NO: 930036 - RNA, 18 nt, Human
aaacuagcugggagacua

SEQ ID NO: 930037 - RNA, 24 nt, Human
aaagaauaccagagugggaaucca

SEQ ID NO: 930038 - RNA, 21 nt, Human
aaaggcccucugugucucuga

SEQ ID NO: 930039 - RNA, 20 nt, Human
aaaggucauuagggcuaaaa

SEQ ID NO: 930040 - RNA, 20 nt, Human
aacuagagcugucauagaca

SEQ ID NO: 930041 - RNA, 22 nt, Human
aacugccccccacgcccccccg

SEQ ID NO: 930042 - RNA, 19 nt, Human
aaguacaacuagagcuguc

SEQ ID NO: 930043 - RNA, 24 nt, Human
aaugaagaaguccuacaaagagga

SEQ ID NO: 930044 - RNA, 18 nt, Human
aaugauguaaagggaaga

SEQ ID NO: 930045 - RNA, 22 nt, Human
acuccaaggcugggaggcagca

SEQ ID NO: 930046 - RNA, 21 nt, Human
acugccccccacgcccccccg

SEQ ID NO: 930047 - RNA, 20 nt, Human
agccuggacuguugccauuu

SEQ ID NO: 930048 - RNA, 20 nt, Human
aggaauguguagugauucug

SEQ ID NO: 930049 - RNA, 21 nt, Human
aggcaagaaaaugcuuaauuu

SEQ ID NO: 930050 - RNA, 23 nt, Human
aggcagcaggugcugggaacaag

SEQ ID NO: 930051 - RNA, 20 nt, Human
agguauuuagucacaccaag

SEQ ID NO: 930052 - RNA, 21 nt, Human
agguauuuagucacaccaagu

SEQ ID NO: 930053 - RNA, 19 nt, Human
agucauggaagaccucagu

SEQ ID NO: 930054 - RNA, 20 nt, Human
auccuguuuccauuuaugcc

SEQ ID NO: 930055 - RNA, 21 nt, Human
aucugcagccauuugaugaug

SEQ ID NO: 930056 - RNA, 21 nt, Human
augaagcaaaggaggcaagaa

SEQ ID NO: 930057 - RNA, 21 nt, Human
cacccccaagccuacuccuuu

SEQ ID NO: 930058 - RNA, 21 nt, Human
cacgcccccccgccaccuccc

SEQ ID NO: 930059 - RNA, 24 nt, Human
cagaacccaauuccauaggaaucc

SEQ ID NO: 930060 - RNA, 23 nt, Human
cagagugggaauccaguuuugcc

SEQ ID NO: 930061 - RNA, 21 nt, Human
cagucccauccaaaaggucau

SEQ ID NO: 930062 - RNA, 26 nt, Human
caguuuugccucaaacuagcugggag

SEQ ID NO: 930063 - RNA, 18 nt, Human
caugcagguaacugcccc

SEQ ID NO: 930064 - RNA, 23 nt, Human
cauuucuccucauuccuucaggg

SEQ ID NO: 930065 - RNA, 24 nt, Human
cauuucuccucauuccuucaggga

SEQ ID NO: 930066 - RNA, 20 nt, Human
ccacccccaagccuacuccu

SEQ ID NO: 930067 - RNA, 21 nt, Human
ccagagauuuuguguggcugc

SEQ ID NO: 930068 - RNA, 22 nt, Human
ccaugacacagucauuucugau

SEQ ID NO: 930069 - RNA, 18 nt, Human
ccccacccccaagccuac

SEQ ID NO: 930070 - RNA, 22 nt, Human
cccccaagccuacuccuuuagg

SEQ ID NO: 930071 - RNA, 22 nt, Human
cccccacgcccccccgccaccu

SEQ ID NO: 930072 - RNA, 21 nt, Human
cccccaguuccuccugaucua

SEQ ID NO: 930073 - RNA, 18 nt, Human
cccccccgccaccuccca

SEQ ID NO: 930074 - RNA, 21 nt, Human
ccucccauuucuccucauucc

SEQ ID NO: 930075 - RNA, 26 nt, Human
ccuccuugcuuacuggcaauuaggga

SEQ ID NO: 930076 - RNA, 22 nt, Human
cgugguguucuaguccccccca

SEQ ID NO: 930077 - RNA, 23 nt, Human
cucagccacugagcugccucaac

SEQ ID NO: 930078 - RNA, 21 nt, Human
cucccauuucuccucauuccu

SEQ ID NO: 930079 - RNA, 20 nt, Human
cucuccccacccccaagccu

SEQ ID NO: 930080 - RNA, 18 nt, Human
cucucuccccacccccaa

SEQ ID NO: 930081 - RNA, 21 nt, Human
gaagaaguccuacaaagagga

SEQ ID NO: 930082 - RNA, 23 nt, Human
gaaugaagaaguccuacaaagag

SEQ ID NO: 930083 - RNA, 23 nt, Human
gacuggauggucaugaagucccu

SEQ ID NO: 930084 - RNA, 18 nt, Human
gacuggauuuacugagcg

SEQ ID NO: 930085 - RNA, 18 nt, Human
gagccaaggagcuugcaa

SEQ ID NO: 930086 - RNA, 21 nt, Human
gaugacuaugcggacuucuau

SEQ ID NO: 930087 - RNA, 21 nt, Human
gauucuugcucccuccggggg

SEQ ID NO: 930088 - RNA, 19 nt, Human
gcagguaacugccccccac

SEQ ID NO: 930089 - RNA, 22 nt, Human
gcugggaggcagcaggugcugg

SEQ ID NO: 930090 - RNA, 24 nt, Human
ggaaugaagaaguccuacaaagag

SEQ ID NO: 930091 - RNA, 18 nt, Human
guucuagucccccccagu

SEQ ID NO: 930092 - RNA, 21 nt, Human
uaaagcauuuguaccaauggu

SEQ ID NO: 930093 - RNA, 24 nt, Human
uacacagcuuuauauaacaacuag

SEQ ID NO: 930094 - RNA, 24 nt, Human
uaccaugaaagagucuaugcuuca

SEQ ID NO: 930095 - RNA, 26 nt, Human
uaccccuaccucccaguuuagacugg

SEQ ID NO: 930096 - RNA, 25 nt, Human
uacccugauucccagggaggaauga

SEQ ID NO: 930097 - RNA, 18 nt, Human
uacgcagcagagcuaugg

SEQ ID NO: 930098 - RNA, 24 nt, Human
uagaaucaaacaauucuaaaccuc

SEQ ID NO: 930099 - RNA, 24 nt, Human
uaguagaaacgagccuugccuuua

SEQ ID NO: 930100 - RNA, 25 nt, Human
ucaaaaccugcagaagcagguugcc

SEQ ID NO: 930101 - RNA, 21 nt, Human
ucaggacauuauaaaggaggg

SEQ ID NO: 930102 - RNA, 21 nt, Human
ucagugucuuaugaagcugac

SEQ ID NO: 930103 - RNA, 23 nt, Human
uccaaaaggucauuagggcuaaa

SEQ ID NO: 930104 - RNA, 23 nt, Human
uccaaacuccaaggcugggaggc

SEQ ID NO: 930105 - RNA, 24 nt, Human
uccccacccccaagccuacucccc

SEQ ID NO: 930106 - RNA, 23 nt, Human
ucuggugugaguucuggucucuc

SEQ ID NO: 930107 - RNA, 18 nt, Human
ugaagcaaaggaggcaag

SEQ ID NO: 930108 - RNA, 24 nt, Human
ugaagcaaaggaggcaagaaaaug

SEQ ID NO: 930109 - RNA, 24 nt, Human
ugaaugagcaccaugacacaguca

SEQ ID NO: 930110 - RNA, 22 nt, Human
ugacacagucauuucugauccc

SEQ ID NO: 930111 - RNA, 18 nt, Human
ugagguccuaaagaaaac

SEQ ID NO: 930112 - RNA, 20 nt, Human
ugcagaagcagguugccuuu

SEQ ID NO: 930113 - RNA, 22 nt, Human
ugcagaagcagguugccuuuga

SEQ ID NO: 930114 - RNA, 18 nt, Human
ugcuagccauugggugau

SEQ ID NO: 930115 - RNA, 23 nt, Human
ugggaggcagcaggugcugggaa

SEQ ID NO: 930116 - RNA, 21 nt, Human
ugggaguuugcagugaaugag

SEQ ID NO: 930117 - RNA, 18 nt, Human
ugggcaggacuccacagg

SEQ ID NO: 930118 - RNA, 21 nt, Human
ugggcaggacuccacaggagc

SEQ ID NO: 930119 - RNA, 21 nt, Human
uguaaagggaagaaagaauac

SEQ ID NO: 930120 - RNA, 22 nt, Human
ugucuuaugaagcugacacuuc

SEQ ID NO: 930121 - RNA, 19 nt, Human
uuuuuuuuuuuuuugucca

SEQ ID NO: 930122 - RNA, 20 nt, Human
uuuuuuuuuuuuuuugucca

SEQ ID NO: 930123 - RNA, 18 nt, Human
uuuuuuuuuuuuuuuuug

SEQ ID NO: 930124 - RNA, 19 nt, Human
uuuuuuuuuuuuuuuuugu

SEQ ID NO: 930125 - RNA, 18 nt, Human
aaacagaauauacaugca

SEQ ID NO: 930126 - RNA, 23 nt, Human
aaagaaacagaauauacaugcaa

SEQ ID NO: 930127 - RNA, 18 nt, Human
aaagacauacucaagacu

SEQ ID NO: 930128 - RNA, 24 nt, Human
aaaggcaaaugaagauuugggcca

SEQ ID NO: 930129 - RNA, 20 nt, Human
acuuaaaaugaacauuuucc

SEQ ID NO: 930130 - RNA, 22 nt, Human
agacugggaagaaaaagaggug

SEQ ID NO: 930131 - RNA, 21 nt, Human
agaucagagguggccaaagac

SEQ ID NO: 930132 - RNA, 19 nt, Human
agccaaaccauaucauaaa

SEQ ID NO: 930133 - RNA, 20 nt, Human
caacagaaaaacauguaaug

SEQ ID NO: 930134 - RNA, 22 nt, Human
caaguaacgucuuacauggaug

SEQ ID NO: 930135 - RNA, 22 nt, Human
cacaacacauaggaauucaaga

SEQ ID NO: 930136 - RNA, 26 nt, Human
cacaacacauaggaauucaagaugag

SEQ ID NO: 930137 - RNA, 19 nt, Human
caccuugacuuggugaccc

SEQ ID NO: 930138 - RNA, 19 nt, Human
cauaggaauucaagaugag

SEQ ID NO: 930139 - RNA, 30 nt, Human
caugcuggagauaaaggaguugaaaaggcc

SEQ ID NO: 930140 - RNA, 23 nt, Human
cauggagucuggugcccauaggg

SEQ ID NO: 930141 - RNA, 21 nt, Human
ccaaaccauaucauaaaagaa

SEQ ID NO: 930142 - RNA, 23 nt, Human
cuaaagcaucccuuuuucaauag

SEQ ID NO: 930143 - RNA, 22 nt, Human
cuacaaugguucaaccuaaagc

SEQ ID NO: 930144 - RNA, 18 nt, Human
cuaucaccagaacagcau

SEQ ID NO: 930145 - RNA, 20 nt, Human
cuccacaugcuggagauaaa

SEQ ID NO: 930146 - RNA, 24 nt, Human
cuccacaugcuggagauaaaggag

SEQ ID NO: 930147 - RNA, 20 nt, Human
cucugcaaaauguuuuuccu

SEQ ID NO: 930148 - RNA, 24 nt, Human
cuuuaauguguuuauuuaggaaaa

SEQ ID NO: 930149 - RNA, 21 nt, Human
gaagaaaaagagguguaaugg

SEQ ID NO: 930150 - RNA, 18 nt, Human
gacugggaagaaaaagag

SEQ ID NO: 930151 - RNA, 22 nt, Human
gcugaagugcaaagacuggaug

SEQ ID NO: 930152 - RNA, 23 nt, Human
ggacacagccaaaccauaucaua

SEQ ID NO: 930153 - RNA, 19 nt, Human
ggaguugaaaaggcaaaug

SEQ ID NO: 930154 - RNA, 18 nt, Human
ggcagcaggcaaagagag

SEQ ID NO: 930155 - RNA, 26 nt, Human
gggaagaaaaagagguguaauggaag

SEQ ID NO: 930156 - RNA, 21 nt, Human
ggugguggguacacauguugg

SEQ ID NO: 930157 - RNA, 23 nt, Human
gucuaagagauuuaaaaagagaa

SEQ ID NO: 930158 - RNA, 18 nt, Human
uaaaaagagaagugauau

SEQ ID NO: 930159 - RNA, 18 nt, Human
uaacccagaucaauagca

SEQ ID NO: 930160 - RNA, 23 nt, Human
uaacccagaucaauagcaccuug

SEQ ID NO: 930161 - RNA, 24 nt, Human
uaagucaguaaccauguuaaacaa

SEQ ID NO: 930162 - RNA, 18 nt, Human
uacaugcaacagaaaaac

SEQ ID NO: 930163 - RNA, 25 nt, Human
uagaguggacagucaggaaagacca

SEQ ID NO: 930164 - RNA, 21 nt, Human
uagcagaugagaucagaggug

SEQ ID NO: 930165 - RNA, 19 nt, Human
ucaagacugggaagaaaaa

SEQ ID NO: 930166 - RNA, 19 nt, Human
ucaauagcaccuugacuug

SEQ ID NO: 930167 - RNA, 20 nt, Human
ucaauagcaccuugacuugg

SEQ ID NO: 930168 - RNA, 26 nt, Human
ucaaugaccucccacaggguccuucc

SEQ ID NO: 930169 - RNA, 23 nt, Human
ucacuaucaccagaacagcaugg

SEQ ID NO: 930170 - RNA, 18 nt, Human
ucauaaaagaaacagacu

SEQ ID NO: 930171 - RNA, 24 nt, Human
uccacaugcuggagauaaaggagu

SEQ ID NO: 930172 - RNA, 24 nt, Human
uccccugcuauguuuuguggaagc

SEQ ID NO: 930173 - RNA, 18 nt, Human
ugagaaagaaacagaaua

SEQ ID NO: 930174 - RNA, 19 nt, Human
ugagaucagagguggccaa

SEQ ID NO: 930175 - RNA, 24 nt, Human
ugagaucagagguggccaaagacu

SEQ ID NO: 930176 - RNA, 22 nt, Human
ugagauuugcauggggacacag

SEQ ID NO: 930177 - RNA, 19 nt, Human
ugauggguguauuuuaggu

SEQ ID NO: 930178 - RNA, 19 nt, Human
uggcugggaagaucucaca

SEQ ID NO: 930179 - RNA, 18 nt, Human
uggcuugggauggacuga

SEQ ID NO: 930180 - RNA, 24 nt, Human
ugggaagaucucacaagcauggug

SEQ ID NO: 930181 - RNA, 19 nt, Human
uuaacccagaucaauagca

SEQ ID NO: 930182 - RNA, 23 nt, Human
uuaacccagaucaauagcaccuu

SEQ ID NO: 930183 - RNA, 18 nt, Human
uuacaauuuugcuguaag

SEQ ID NO: 930184 - RNA, 20 nt, Human
uuaguccauuuucaggcugc

SEQ ID NO: 930185 - RNA, 18 nt, Human
uucaaauucaguuugugc

SEQ ID NO: 930186 - RNA, 20 nt, Human
uugaaauuuuccuaucauca

SEQ ID NO: 930187 - RNA, 19 nt, Human
uuuacauuuaugagaaaga

SEQ ID NO: 930188 - RNA, 24 nt, Human
uuuaggaaaagauagaaucugagg

SEQ ID NO: 930189 - RNA, 22 nt, Human
uuuguggaagcauucaagggac

SEQ ID NO: 930190 - RNA, 27 nt, Human
uuuuuuuuuuuuuuuuuuuuuuugggg

SEQ ID NO: 930191 - RNA, 20 nt, Human
aaaaaaauagacuccuggau

SEQ ID NO: 930192 - RNA, 22 nt, Human
aaauaaacccaagggugaacac

SEQ ID NO: 930193 - RNA, 21 nt, Human
aaauaacccagccacaaaaau

SEQ ID NO: 930194 - RNA, 27 nt, Human
aacccagccacaaaaauauaaauacug

SEQ ID NO: 930195 - RNA, 20 nt, Human
aaccuuguauuuucuaaaua

SEQ ID NO: 930196 - RNA, 22 nt, Human
aagggcaauggggacuuaaaac

SEQ ID NO: 930197 - RNA, 21 nt, Human
aaucauggagacaaaauagaa

SEQ ID NO: 930198 - RNA, 18 nt, Human
agcccaugagccucagau

SEQ ID NO: 930199 - RNA, 20 nt, Human
agggcaauggggacuuaaaa

SEQ ID NO: 930200 - RNA, 19 nt, Human
caaacuuaucucagaacca

SEQ ID NO: 930201 - RNA, 24 nt, Human
caagacauaauccacuacagugaa

SEQ ID NO: 930202 - RNA, 21 nt, Human
caaguugaaaaaaaaauagac

SEQ ID NO: 930203 - RNA, 21 nt, Human
ccuuaccacuuuuccuuuccu

SEQ ID NO: 930204 - RNA, 19 nt, Human
ccuuguauuuucuaaauaa

SEQ ID NO: 930205 - RNA, 24 nt, Human
cuaaauaaacccaagggugaacac

SEQ ID NO: 930206 - RNA, 25 nt, Human
cuuacugcuaauaaugaucuuugga

SEQ ID NO: 930207 - RNA, 18 nt, Human
cuucccacuuccuuacca

SEQ ID NO: 930208 - RNA, 20 nt, Human
gaaaaaaaaauagacuccug

SEQ ID NO: 930209 - RNA, 19 nt, Human
gcguacccaccccauccca

SEQ ID NO: 930210 - RNA, 23 nt, Human
ggacuuaaaacggccauaguuuc

SEQ ID NO: 930211 - RNA, 21 nt, Human
uaaacccaagggugaacacaa

SEQ ID NO: 930212 - RNA, 26 nt, Human
uaaauuucucucacuuagauguaauc

SEQ ID NO: 930213 - RNA, 21 nt, Human
uaaccaaaaucauggagacaa

SEQ ID NO: 930214 - RNA, 21 nt, Human
uaaccaaaaucauggagacaa

SEQ ID NO: 930215 - RNA, 24 nt, Human
uaaccaaaaucauggagacaaaau

SEQ ID NO: 930216 - RNA, 24 nt, Human
uaagugaaauaacccagccacaaa

SEQ ID NO: 930217 - RNA, 18 nt, Human
uaauuccacugacaugaa

SEQ ID NO: 930218 - RNA, 23 nt, Human
uagaauagugguuacugggaaga

SEQ ID NO: 930219 - RNA, 25 nt, Human
uagacuccuggauauaguauucaaa

SEQ ID NO: 930220 - RNA, 25 nt, Human
uauagaguaaccaaaaucauggaga

SEQ ID NO: 930221 - RNA, 21 nt, Human
uauauacuacacauuacaugg

SEQ ID NO: 930222 - RNA, 20 nt, Human
uauuagggcaauuuucuaac

SEQ ID NO: 930223 - RNA, 18 nt, Human
ucucagaaccacaagaau

SEQ ID NO: 930224 - RNA, 18 nt, Human
ucuuuuuauugcguaccc

SEQ ID NO: 930225 - RNA, 23 nt, Human
ugaaauaacccagccacaaaaau

SEQ ID NO: 930226 - RNA, 19 nt, Human
ugacaugaaguauauagag

SEQ ID NO: 930227 - RNA, 21 nt, Human
ugauauauacuacacauuaca

SEQ ID NO: 930228 - RNA, 21 nt, Human
ugauuucuucaaacuuaucuc

SEQ ID NO: 930229 - RNA, 18 nt, Human
aagcgcugcaggcccagc

SEQ ID NO: 930230 - RNA, 22 nt, Human
acaguucuuccuagggacugug

SEQ ID NO: 930231 - RNA, 18 nt, Human
agagugaagaucucgaag

SEQ ID NO: 930232 - RNA, 23 nt, Human
auuuacaguucuuccuagggacu

SEQ ID NO: 930233 - RNA, 20 nt, Human
uagggcacccucuuuucuug

SEQ ID NO: 930234 - RNA, 18 nt, Human
uccauguggugguguaug

SEQ ID NO: 930235 - RNA, 22 nt, Human
ugcuaugucaucguagucagug

SEQ ID NO: 930236 - RNA, 23 nt, Human
uggugguguaugugcgcuuccca

SEQ ID NO: 930237 - RNA, 22 nt, Human
uguaugugcgcuucccagggau

SEQ ID NO: 930238 - RNA, 23 nt, Human
aaacaggagaaucacaugcuuua

SEQ ID NO: 930239 - RNA, 26 nt, Human
aaaccaauugcagaucaaaaauauua

SEQ ID NO: 930240 - RNA, 23 nt, Human
aaccaauaccccauggauaccaa

SEQ ID NO: 930241 - RNA, 23 nt, Human
aagcaagauaaugguuuacagaa

SEQ ID NO: 930242 - RNA, 24 nt, Human
aauuaauaagguagucauuccugu

SEQ ID NO: 930243 - RNA, 23 nt, Human
aauuuuuauuuuaauuaauaagg

SEQ ID NO: 930244 - RNA, 21 nt, Human
agacuuuauuugcguaaguga

SEQ ID NO: 930245 - RNA, 28 nt, Human
aggaaugaaaauauacauguuaagaaga

SEQ ID NO: 930246 - RNA, 22 nt, Human
augcuuuaaagaacacuuucuc

SEQ ID NO: 930247 - RNA, 19 nt, Human
caaaaacaggagaaucaca

SEQ ID NO: 930248 - RNA, 22 nt, Human
caaaaacaggagaaucacaugc

SEQ ID NO: 930249 - RNA, 21 nt, Human
caauugcagaucaaaaauauu

SEQ ID NO: 930250 - RNA, 20 nt, Human
cagcaaaaacaggagaauca

SEQ ID NO: 930251 - RNA, 22 nt, Human
cagcaaaaacaggagaaucaca

SEQ ID NO: 930252 - RNA, 21 nt, Human
caucuguggauuaaaccaauu

SEQ ID NO: 930253 - RNA, 22 nt, Human
cauggauaccaagggacaacug

SEQ ID NO: 930254 - RNA, 22 nt, Human
ccaauaccccauggauaccaag

SEQ ID NO: 930255 - RNA, 19 nt, Human
cugcaucuguggauuaaac

SEQ ID NO: 930256 - RNA, 25 nt, Human
cuucuuauggaaacuuuauaggaau

SEQ ID NO: 930257 - RNA, 23 nt, Human
gaaccaauaccccauggauacca

SEQ ID NO: 930258 - RNA, 19 nt, Human
gaaguaccuguaacaaaac

SEQ ID NO: 930259 - RNA, 23 nt, Human
gaaguaccuguaacaaaacaguu

SEQ ID NO: 930260 - RNA, 21 nt, Human
gacuugaguauacuuggauuu

SEQ ID NO: 930261 - RNA, 18 nt, Human
gagauauguuccuccagu

SEQ ID NO: 930262 - RNA, 23 nt, Human
gcccucuguauccauguacucug

SEQ ID NO: 930263 - RNA, 21 nt, Human
uaaaaucuucaggaaugacau

SEQ ID NO: 930264 - RNA, 21 nt, Human
uaaaccaauugcagaucaaaa

SEQ ID NO: 930265 - RNA, 22 nt, Human
uaagaugcuuguagaguugugg

SEQ ID NO: 930266 - RNA, 19 nt, Human
uaagcugaaaagaggaaca

SEQ ID NO: 930267 - RNA, 23 nt, Human
uacacaaaacuugucaagaacuc

SEQ ID NO: 930268 - RNA, 22 nt, Human
uacagaauuugcuuuacacaaa

SEQ ID NO: 930269 - RNA, 24 nt, Human
uacuuggauuuuugguaucugugg

SEQ ID NO: 930270 - RNA, 25 nt, Human
uagaaaaaauaaaaauaauacaaau

SEQ ID NO: 930271 - RNA, 24 nt, Human
uagcaauaaaaggaaugaacccua

SEQ ID NO: 930272 - RNA, 22 nt, Human
uagguggugguuaaaauucuug

SEQ ID NO: 930273 - RNA, 24 nt, Human
uauaacaguuauuuaaauagcauu

SEQ ID NO: 930274 - RNA, 20 nt, Human
uauuugaagaaaauguuuug

SEQ ID NO: 930275 - RNA, 18 nt, Human
ucccagccuaaacaggga

SEQ ID NO: 930276 - RNA, 19 nt, Human
ucccagccuaaacagggag

SEQ ID NO: 930277 - RNA, 23 nt, Human
ucccagccuaaacagggagaguc

SEQ ID NO: 930278 - RNA, 19 nt, Human
ucuaagcugaaaagaggaa

SEQ ID NO: 930279 - RNA, 26 nt, Human
ucuagggauaaaguauacaggcggau

SEQ ID NO: 930280 - RNA, 20 nt, Human
ugaaaagaggaacagguggg

SEQ ID NO: 930281 - RNA, 20 nt, Human
ugccuuuguuuauaaaaucu

SEQ ID NO: 930282 - RNA, 19 nt, Human
uggguuggggggacggucc

SEQ ID NO: 930283 - RNA, 19 nt, Human
uggguuggggggacggucc

SEQ ID NO: 930284 - RNA, 22 nt, Human
uguaaaaauuuugucaaagaug

SEQ ID NO: 930285 - RNA, 19 nt, Human
uguuucuaagcugaaaaga

SEQ ID NO: 930286 - RNA, 20 nt, Human
uuagaaaaaauaaaaauaau

SEQ ID NO: 930287 - RNA, 22 nt, Human
uuccaggcuguaguaugaucau

SEQ ID NO: 930288 - RNA, 22 nt, Human
uucucuagcaauaaaaggaaug

SEQ ID NO: 930289 - RNA, 23 nt, Human
uucucuagcaauaaaaggaauga

SEQ ID NO: 930290 - RNA, 22 nt, Human
uugggaaauauucuuuacuaca

SEQ ID NO: 930291 - RNA, 20 nt, Human
uuuuuuguuugagugauucc

SEQ ID NO: 930292 - RNA, 18 nt, Human
uuuuuuuuuuuuuuuuug

SEQ ID NO: 930293 - RNA, 21 nt, Human
uuuuuuuuuuuuuuuuugcag

SEQ ID NO: 930294 - RNA, 22 nt, Human
uuuuuuuuuuuuuuuuugcagg

SEQ ID NO: 930295 - RNA, 22 nt, Human
aagcuucacugagugcugcagu

SEQ ID NO: 930296 - RNA, 22 nt, Human
agagacaaggucucuuucuguu

SEQ ID NO: 930297 - RNA, 21 nt, Human
agugguuugccugcuggggcc

SEQ ID NO: 930298 - RNA, 20 nt, Human
cacaguggcuuauaaggaac

SEQ ID NO: 930299 - RNA, 19 nt, Human
caccacaaccauccaaggu

SEQ ID NO: 930300 - RNA, 23 nt, Human
cacugagugcugcaguucucaaa

SEQ ID NO: 930301 - RNA, 21 nt, Human
cauucccuuuaacaaagcuuc

SEQ ID NO: 930302 - RNA, 24 nt, Human
cucuuucuguuguccaggcuggag

SEQ ID NO: 930303 - RNA, 21 nt, Human
cuuuucaugaauugauuucgu

SEQ ID NO: 930304 - RNA, 22 nt, Human
ggcuggaguguaguggugugau

SEQ ID NO: 930305 - RNA, 24 nt, Human
guccaggcuggaguguaguggugu

SEQ ID NO: 930306 - RNA, 20 nt, Human
ucaagaucagaagcuggguu

SEQ ID NO: 930307 - RNA, 27 nt, Human
ucaccacaaccauccaagggggcccuc

SEQ ID NO: 930308 - RNA, 20 nt, Human
ucauucccuuuaacaaagcu

SEQ ID NO: 930309 - RNA, 23 nt, Human
ucucuuucuguuguccaggcugg

SEQ ID NO: 930310 - RNA, 24 nt, Human
ucucuuucuguuguccaggcugga

SEQ ID NO: 930311 - RNA, 24 nt, Human
ucuguuguccaggcuggaguguag

SEQ ID NO: 930312 - RNA, 21 nt, Human
ucuuucuguuguccaggcugg

SEQ ID NO: 930313 - RNA, 24 nt, Human
ucuuucuguuguccaggcuggagu

SEQ ID NO: 930314 - RNA, 24 nt, Human
ugaagugguuugccugcuggggcc

SEQ ID NO: 930315 - RNA, 20 nt, Human
ugagcucuucauccuagcac

SEQ ID NO: 930316 - RNA, 22 nt, Human
ugaguuaacgaaaguaguugau

SEQ ID NO: 930317 - RNA, 23 nt, Human
ugauguuauucucauuuaacauu

SEQ ID NO: 930318 - RNA, 21 nt, Human
ugccugcuggggccuaaacuc

SEQ ID NO: 930319 - RNA, 19 nt, Human
ugcuggggccuaaacuccu

SEQ ID NO: 930320 - RNA, 18 nt, Human
uggguuuugggguugaga

SEQ ID NO: 930321 - RNA, 20 nt, Human
uguccaggcuggaguguagu

SEQ ID NO: 930322 - RNA, 24 nt, Human
uguccaggcuggaguguaguggug

SEQ ID NO: 930323 - RNA, 19 nt, Human
uguuguccaggcuggagug

SEQ ID NO: 930324 - RNA, 30 nt, Human; identical to SEQ ID NO: 834456

SEQ ID NO: 930325 - RNA, 21 nt, Human
uguuuuguuuuguuuuuagag

SEQ ID NO: 930326 - RNA, 24 nt, Human
uguuuuguuuuguuuuuagagaca

SEQ ID NO: 930327 - RNA, 23 nt, Human
uguuuuguuuuuagagacaaggu

SEQ ID NO: 930328 - RNA, 24 nt, Human
uguuuuguuuuuagagacaagguc

SEQ ID NO: 930329 - RNA, 20 nt, Human
uuaacauugaguuaacgaaa

SEQ ID NO: 930330 - RNA, 19 nt, Human
uuagagacaaggucucuuu

SEQ ID NO: 930331 - RNA, 24 nt, Human
uuguccaggcuggaguguaguggu

SEQ ID NO: 930332 - RNA, 20 nt, Human
uuguuuguuuguuuuguuuu

SEQ ID NO: 930333 - RNA, 18 nt, Human
uuuguuuuguuuuguuuu

SEQ ID NO: 930334 - RNA, 25 nt, Human
uuuuuuaagccgaaaaaaugcuuaa

SEQ ID NO: 930335 - RNA, 19 nt, Human
aaaaaaaaacagacugaga

SEQ ID NO: 930336 - RNA, 23 nt, Human
aaaaaaaaacagacugagaaaaa

SEQ ID NO: 930337 - RNA, 24 nt, Human
aaaaaaaaauacaaaaacaaagaa

SEQ ID NO: 930338 - RNA, 19 nt, Human
aaaaaaacagacugagaaa

SEQ ID NO: 930339 - RNA, 23 nt, Human
aaaacagacugagaaaaaagccc

SEQ ID NO: 930340 - RNA, 21 nt, Human
aaaauuaaaagcaagggggcc

SEQ ID NO: 930341 - RNA, 23 nt, Human
aaacagacugagaaaaaagccca

SEQ ID NO: 930342 - RNA, 19 nt, Human
aaagaaacaaacacaaagc

SEQ ID NO: 930343 - RNA, 21 nt, Human
aaagagauggacaaugccauu

SEQ ID NO: 930344 - RNA, 24 nt, Human
aaagcaacugauucgugaaaauaa

SEQ ID NO: 930345 - RNA, 18 nt, Human
aaagcaagaaaaugagaa

SEQ ID NO: 930346 - RNA, 21 nt, Human
aaaugucuccuuuaaaauccc

SEQ ID NO: 930347 - RNA, 22 nt, Human
aaccucuccacugaccuccaaa

SEQ ID NO: 930348 - RNA, 23 nt, Human
aagacagacaucgaaacgagaua

SEQ ID NO: 930349 - RNA, 26 nt, Human
aagcaagaaaaugagaaauaaccuag

SEQ ID NO: 930350 - RNA, 19 nt, Human
aagcccaggucucuuuacc

SEQ ID NO: 930351 - RNA, 23 nt, Human
aauacacacacacacacaaaaau

SEQ ID NO: 930352 - RNA, 24 nt, Human
aaucgcuugaauccuggaggugga

SEQ ID NO: 930353 - RNA, 21 nt, Human
aaugccauuuauccuuuucac

SEQ ID NO: 930354 - RNA, 18 nt, Human
aauuagccaggcauggug

SEQ ID NO: 930355 - RNA, 20 nt, Human
aauugcuugaacccaggagg

SEQ ID NO: 930356 - RNA, 24 nt, Human
aauugcuugaacccaggaggcaga

SEQ ID NO: 930357 - RNA, 20 nt, Human
acaagagcgaaacucugucu

SEQ ID NO: 930358 - RNA, 21 nt, Human
acaagagcgaaacucugucuc

SEQ ID NO: 930359 - RNA, 24 nt, Human
acagagcaagaccuagucucaaaa

SEQ ID NO: 930360 - RNA, 19 nt, Human
acaugguaaaaccccaucu

SEQ ID NO: 930361 - RNA, 24 nt, Human
acccaggaggcagagguugcagug

SEQ ID NO: 930362 - RNA, 18 nt, Human
accccaucucuacuaaaa

SEQ ID NO: 930363 - RNA, 18 nt, Human
acugcacuccagccuggg

SEQ ID NO: 930364 - RNA, 24 nt, Human
acugcacuccagccugggugacaa

SEQ ID NO: 930365 - RNA, 25 nt, Human
acugcacuccagccugggugacaag

SEQ ID NO: 930366 - RNA, 24 nt, Human
acugcacuccagucugggugacag

SEQ ID NO: 930367 - RNA, 26 nt, Human
acugcacuccagucugggugacagag

SEQ ID NO: 930368 - RNA, 20 nt, Human
agaaaggucuaauauccaga

SEQ ID NO: 930369 - RNA, 24 nt, Human
agacugaggcaggggaaucgcuug

SEQ ID NO: 930370 - RNA, 24 nt, Human
agagauggacaaugccauuuaucc

SEQ ID NO: 930371 - RNA, 22 nt, Human
agagcgaaacucugucucaaaa

SEQ ID NO: 930372 - RNA, 18 nt, Human
agagguugcagugagccg

SEQ ID NO: 930373 - RNA, 23 nt, Human
agagguugcagugagccgagauc

SEQ ID NO: 930374 - RNA, 24 nt, Human
agagguugcagugagccgagauca

SEQ ID NO: 930375 - RNA, 20 nt, Human
agcacuuugggaggcuaagg

SEQ ID NO: 930376 - RNA, 23 nt, Human
agccaggcauggugguguguacc

SEQ ID NO: 930377 - RNA, 21 nt, Human
agcgguggcucaugccuguaa

SEQ ID NO: 930378 - RNA, 18 nt, Human
aggcacgagaauugcuug

SEQ ID NO: 930379 - RNA, 21 nt, Human
aggcagagguugcagugagcc

SEQ ID NO: 930380 - RNA, 24 nt, Human
aggcagagguugcagugagccgag

SEQ ID NO: 930381 - RNA, 18 nt, Human
aggcaggcggaucaccug

SEQ ID NO: 930382 - RNA, 22 nt, Human
aggcaggcggaucaccugaggg

SEQ ID NO: 930383 - RNA, 25 nt, Human
aggcaggggaaucgcuugaauccug

SEQ ID NO: 930384 - RNA, 24 nt, Human
agguggagacugcagcgagucaag

SEQ ID NO: 930385 - RNA, 24 nt, Human
agucugggugacagagcaagaccu

SEQ ID NO: 930386 - RNA, 24 nt, Human
aucaugccacugcacuccagucug

SEQ ID NO: 930387 - RNA, 19 nt, Human
augccuguaaucccagcac

SEQ ID NO: 930388 - RNA, 20 nt, Human
auuauauuacacaagaugcc

SEQ ID NO: 930389 - RNA, 24 nt, Human
auugugccacugcacuccagccug

SEQ ID NO: 930390 - RNA, 20 nt, Human
caaaaaaaaacagacugaga

SEQ ID NO: 930391 - RNA, 24 nt, Human
caaaaacaaagaaacaaacacaaa

SEQ ID NO: 930392 - RNA, 21 nt, Human
caaaauuaaaagcaagaaaau

SEQ ID NO: 930393 - RNA, 26 nt, Human
caaagaaacaaacacaaagcaacuga

SEQ ID NO: 930394 - RNA, 23 nt, Human
caagaugccucaaagaaacacua

SEQ ID NO: 930395 - RNA, 24 nt, Human
caagauugugccacugcacuccag

SEQ ID NO: 930396 - RNA, 20 nt, Human
caagggggccgagagcggug

SEQ ID NO: 930397 - RNA, 19 nt, Human
cacaugguaaaaccccauc

SEQ ID NO: 930398 - RNA, 21 nt, Human
cacaugguaaaaccccaucuc

SEQ ID NO: 930399 - RNA, 21 nt, Human
cacuccagccugggugacaag

SEQ ID NO: 930400 - RNA, 24 nt, Human
cacuccagccugggugacaagagc

SEQ ID NO: 930401 - RNA, 25 nt, Human
cacuccagccugggugacaagagcg

SEQ ID NO: 930402 - RNA, 22 nt, Human
cacuccagucugggugacagag

SEQ ID NO: 930403 - RNA, 23 nt, Human
cacuccagucugggugacagagc

SEQ ID NO: 930404 - RNA, 19 nt, Human
cacugcacuccagccuggg

SEQ ID NO: 930405 - RNA, 19 nt, Human
cacugcacuccagccuggg

SEQ ID NO: 930406 - RNA, 22 nt, Human
cacugcacuccagccuggguga

SEQ ID NO: 930407 - RNA, 23 nt, Human
cacugcacuccagccugggugac

SEQ ID NO: 930408 - RNA, 24 nt, Human
cacugcacuccagccugggugaca

SEQ ID NO: 930409 - RNA, 25 nt, Human
cacugcacuccagccugggugacaa

SEQ ID NO: 930410 - RNA, 19 nt, Human
cacugcacuccagucuggg

SEQ ID NO: 930411 - RNA, 21 nt, Human
cacugcacuccagucugggug

SEQ ID NO: 930412 - RNA, 22 nt, Human
cacugcacuccagucuggguga

SEQ ID NO: 930413 - RNA, 23 nt, Human
cacugcacuccagucugggugac

SEQ ID NO: 930414 - RNA, 24 nt, Human
cacugcacuccagucugggugaca

SEQ ID NO: 930415 - RNA, 24 nt, Human
cacugcacuccagucugggugaca

SEQ ID NO: 930416 - RNA, 24 nt, Human
cagcacuuugggaggcuaaggcag

SEQ ID NO: 930417 - RNA, 24 nt, Human
cagcacuuugggaggcuaaggcag

SEQ ID NO: 930418 - RNA, 19 nt, Human
caggaacaaaaaaaaaaaa

SEQ ID NO: 930419 - RNA, 21 nt, Human
caugagaaaaagaagaauauu

SEQ ID NO: 930420 - RNA, 24 nt, Human
caugccuguaaucccagcacuuug

SEQ ID NO: 930421 - RNA, 21 nt, Human
ccacugaccuccaaaugacau

SEQ ID NO: 930422 - RNA, 20 nt, Human
ccacugcacuccagccuggg

SEQ ID NO: 930423 - RNA, 20 nt, Human
ccacugcacuccagccuggg

SEQ ID NO: 930424 - RNA, 20 nt, Human
ccacugcacuccagccuggg

SEQ ID NO: 930425 - RNA, 21 nt, Human
ccacugcacuccagccugggu

SEQ ID NO: 930426 - RNA, 21 nt, Human
ccacugcacuccagccugggu

SEQ ID NO: 930427 - RNA, 23 nt, Human
ccacugcacuccagccuggguga

SEQ ID NO: 930428 - RNA, 24 nt, Human
ccacugcacuccagccugggugac

SEQ ID NO: 930429 - RNA, 20 nt, Human
ccacugcacuccagucuggg

SEQ ID NO: 930430 - RNA, 20 nt, Human
ccacugcacuccagucuggg

SEQ ID NO: 930431 - RNA, 20 nt, Human
ccacugcacuccagucuggg

SEQ ID NO: 930432 - RNA, 21 nt, Human
ccacugcacuccagucugggu

SEQ ID NO: 930433 - RNA, 21 nt, Human
ccacugcacuccagucugggu

SEQ ID NO: 930434 - RNA, 24 nt, Human
ccacugcacuccagucugggugac

SEQ ID NO: 930435 - RNA, 18 nt, Human
ccgagagcgguggcucau

SEQ ID NO: 930436 - RNA, 21 nt, Human
ccuacaaucccagcugcuugg

SEQ ID NO: 930437 - RNA, 23 nt, Human
ccuggccacaugguaaaacccca

SEQ ID NO: 930438 - RNA, 21 nt, Human
ccuuuaaaauccuacugcaaa

SEQ ID NO: 930439 - RNA, 24 nt, Human
cgagaucaugccacugcacuccag

SEQ ID NO: 930440 - RNA, 22 nt, Human
cggaucaccugagguugaguuc

SEQ ID NO: 930441 - RNA, 20 nt, Human
cuagaccagccuggccacau

SEQ ID NO: 930442 - RNA, 21 nt, Human
cucaaaaaauucuuccucuua

SEQ ID NO: 930443 - RNA, 23 nt, Human
cucaugccuguaaucccagcacu

SEQ ID NO: 930444 - RNA, 24 nt, Human
cucaugccuguaaucccagcacuu

SEQ ID NO: 930445 - RNA, 22 nt, Human
cuggccacaugguaaaacccca

SEQ ID NO: 930446 - RNA, 19 nt, Human
cugggugacagagcaagac

SEQ ID NO: 930447 - RNA, 25 nt, Human
gaaaaaaaaauacaaaaacaaagaa

SEQ ID NO: 930448 - RNA, 22 nt, Human
gacaagagcgaaacucugucuc

SEQ ID NO: 930449 - RNA, 20 nt, Human
gagcaagaccuagucucaaa

SEQ ID NO: 930450 - RNA, 21 nt, Human
gagugcuuuauaacuaaucug

SEQ ID NO: 930451 - RNA, 20 nt, Human
gaucaccugagguugaguuc

SEQ ID NO: 930452 - RNA, 24 nt, Human
gcacuccagucugggugacagagc

SEQ ID NO: 930453 - RNA, 18 nt, Human
gcagcgagucaagauugu

SEQ ID NO: 930454 - RNA, 19 nt, Human
gccacugcacuccagccug

SEQ ID NO: 930455 - RNA, 24 nt, Human
gccacugcacuccagccuggguga

SEQ ID NO: 930456 - RNA, 19 nt, Human
gccacugcacuccagucug

SEQ ID NO: 930457 - RNA, 24 nt, Human
gccacugcacuccagucuggguga

SEQ ID NO: 930458 - RNA, 20 nt, Human
gccgagaucaugccacugca

SEQ ID NO: 930459 - RNA, 22 nt, Human
gcuuaaaaaaaaucaaaagcuc

SEQ ID NO: 930460 - RNA, 22 nt, Human
ggaggcagagguugcagugagc

SEQ ID NO: 930461 - RNA, 21 nt, Human
ggaucaccugagguugaguuc

SEQ ID NO: 930462 - RNA, 19 nt, Human
ggccacaugguaaaacccc

SEQ ID NO: 930463 - RNA, 21 nt, Human
ggcucaugccuguaaucccag

SEQ ID NO: 930464 - RNA, 18 nt, Human
gggagaaaauauucauaa

SEQ ID NO: 930465 - RNA, 18 nt, Human
gguagggaaugcagucaa

SEQ ID NO: 930466 - RNA, 23 nt, Human
gguggcucaugccuguaauccca

SEQ ID NO: 930467 - RNA, 24 nt, Human
gguggcucaugccuguaaucccag

SEQ ID NO: 930468 - RNA, 24 nt, Human
guugcagugagccgagaucaugcc

SEQ ID NO: 930469 - RNA, 21 nt, Human
uaaaaauacacacacacacac

SEQ ID NO: 930470 - RNA, 19 nt, Human
uaaagagauggacaaugcc

SEQ ID NO: 930471 - RNA, 26 nt, Human
uaacaaguuuauuacaaugucaaaaa

SEQ ID NO: 930472 - RNA, 20 nt, Human
uaaggcaggcggaucaccug

SEQ ID NO: 930473 - RNA, 21 nt, Human
uaaggcaggcggaucaccuga

SEQ ID NO: 930474 - RNA, 24 nt, Human
uaaggcaggcggaucaccugaggu

SEQ ID NO: 930475 - RNA, 22 nt, Human
uaagugguuaaucaaaaaauug

SEQ ID NO: 930476 - RNA, 21 nt, Human
uaaucacuaugaguucuccau

SEQ ID NO: 930477 - RNA, 24 nt, Human
uaccuacaaucccagcugcuuggg

SEQ ID NO: 930478 - RNA, 24 nt, Human
uaggcacgagaauugcuugaaccc

SEQ ID NO: 930479 - RNA, 24 nt, Human
uaguucauuaaagagauggacaau

SEQ ID NO: 930480 - RNA, 21 nt, Human
uauccagaaucuauaagaaac

SEQ ID NO: 930481 - RNA, 22 nt, Human
uaucuggucuugaauggucauu

SEQ ID NO: 930482 - RNA, 21 nt, Human
ucaaaauuaaaagcaaggggg

SEQ ID NO: 930483 - RNA, 18 nt, Human
ucaaaccucuccacugac

SEQ ID NO: 930484 - RNA, 20 nt, Human
ucaggaacaaaaaaaaaaaa

SEQ ID NO: 930485 - RNA, 23 nt, Human
ucaggaacaaaaaaaaaaaaaaa

SEQ ID NO: 930486 - RNA, 21 nt, Human
ucaguucucucuagggaagca

SEQ ID NO: 930487 - RNA, 23 nt, Human
ucaugccacugcacuccagucug

SEQ ID NO: 930488 - RNA, 25 nt, Human
ucauuugcaucaugagaucaguucu

SEQ ID NO: 930489 - RNA, 19 nt, Human
uccagccugggugacaaga

SEQ ID NO: 930490 - RNA, 24 nt, Human
uccagucugggugacagagcaaga

SEQ ID NO: 930491 - RNA, 18 nt, Human
ucgcuugaauccuggagg

SEQ ID NO: 930492 - RNA, 22 nt, Human
ucgcuugaauccuggaggugga

SEQ ID NO: 930493 - RNA, 24 nt, Human
ucuaaagacagacaucgaaacgag

SEQ ID NO: 930494 - RNA, 30 nt, Human
ucuacuaaaaauacacacacacacacagug

SEQ ID NO: 930495 - RNA, 20 nt, Human
ucuagaccagccuggccaca

SEQ ID NO: 930496 - RNA, 24 nt, Human
ugaaaaaaaaauacaaaaacaaag

SEQ ID NO: 930497 - RNA, 21 nt, Human
ugacaagagcgaaacucuguc

SEQ ID NO: 930498 - RNA, 19 nt, Human
ugagaaaaaagcccagguc

SEQ ID NO: 930499 - RNA, 21 nt, Human
ugagaaaaaagcccaggucuc

SEQ ID NO: 930500 - RNA, 26 nt, Human
ugagaaaaagaagaauauucuucuua

SEQ ID NO: 930501 - RNA, 22 nt, Human
ugagccgagaucaugccacugc

SEQ ID NO: 930502 - RNA, 22 nt, Human
ugaggcaggggaaucgcuugaa

SEQ ID NO: 930503 - RNA, 25 nt, Human
ugaggcaggggaaucgcuugaaucc

SEQ ID NO: 930504 - RNA, 24 nt, Human
ugccacugcacuccagucugggug

SEQ ID NO: 930505 - RNA, 24 nt, Human
ugcccguaagcccagcuacucggg

SEQ ID NO: 930506 - RNA, 23 nt, Human
ugccuguaaucccagcacuuugg

SEQ ID NO: 930507 - RNA, 24 nt, Human
ugccuguaaucccagcacuuuggg

SEQ ID NO: 930508 - RNA, 20 nt, Human
uggagguggagacugcagcg

SEQ ID NO: 930509 - RNA, 24 nt, Human
uggcucaugccuguaaucccagca

SEQ ID NO: 930510 - RNA, 18 nt, Human
ugggaggcuaaggcaggc

SEQ ID NO: 930511 - RNA, 24 nt, Human
ugggaggcuaaggcaggcggauca

SEQ ID NO: 930512 - RNA, 19 nt, Human
uggguaggugaaaaaaaaa

SEQ ID NO: 930513 - RNA, 24 nt, Human
uggugguguguaccuacaauccca

SEQ ID NO: 930514 - RNA, 22 nt, Human
ugguguguaccuacaaucccag

SEQ ID NO: 930515 - RNA, 24 nt, Human
ugguguguaccuacaaucccagcu

SEQ ID NO: 930516 - RNA, 24 nt, Human
uguaauuugaguuucaacaugaga

SEQ ID NO: 930517 - RNA, 23 nt, Human
uuaauuaacacuucagucuuccu

SEQ ID NO: 930518 - RNA, 23 nt, Human
uuauguguacuuucaaaauuaaa

SEQ ID NO: 930519 - RNA, 21 nt, Human
uucaacaugagaaaaagaaga

SEQ ID NO: 930520 - RNA, 22 nt, Human
uucaacaugagaaaaagaagaa

SEQ ID NO: 930521 - RNA, 23 nt, Human
uucaggaacaaaaaaaaaaaaaa

SEQ ID NO: 930522 - RNA, 24 nt, Human
uucaggaacaaaaaaaaaaaaaaa

SEQ ID NO: 930523 - RNA, 20 nt, Human
uuccaauaaagaauccacag

SEQ ID NO: 930524 - RNA, 18 nt, Human
uugcagugagccgagauc

SEQ ID NO: 930525 - RNA, 19 nt, Human
uugcagugagccgagauca

SEQ ID NO: 930526 - RNA, 20 nt, Human
uugcagugagccgagaucau

SEQ ID NO: 930527 - RNA, 24 nt, Human
uugcuugaacccaggaggcagagg

SEQ ID NO: 930528 - RNA, 24 nt, Human
uugggagacugaggcaggggaauc

SEQ ID NO: 930529 - RNA, 25 nt, Human
uugggaggcuaaggcaggcggauca

SEQ ID NO: 930530 - RNA, 23 nt, Human
uugugccacugcacuccagccug

SEQ ID NO: 930531 - RNA, 22 nt, Human
aaaaaucucuccauaaucacgg

SEQ ID NO: 930532 - RNA, 25 nt, Human
aaacacucggaaucgcuugucaaua

SEQ ID NO: 930533 - RNA, 20 nt, Human
aacaauucuugcaccucuuc

SEQ ID NO: 930534 - RNA, 25 nt, Human
aaucgcuugucaauagcaagccuau

SEQ ID NO: 930535 - RNA, 18 nt, Human
aggaggcuuagcagcuug

SEQ ID NO: 930536 - RNA, 21 nt, Human
caggaaccucaucagggucaa

SEQ ID NO: 930537 - RNA, 30 nt, Human
cuauguguaacauuucuuaagaaaauccuu

SEQ ID NO: 930538 - RNA, 22 nt, Human
cucuaaauguaucuucuucuug

SEQ ID NO: 930539 - RNA, 23 nt, Human
cucuccauaaucacggauaaaca

SEQ ID NO: 930540 - RNA, 24 nt, Human
cuucuuguucuucuagucguuuca

SEQ ID NO: 930541 - RNA, 18 nt, Human
cuugcaccucuucuggca

SEQ ID NO: 930542 - RNA, 25 nt, Human
gaaugggguuugucagaaguugcaa

SEQ ID NO: 930543 - RNA, 19 nt, Human
gcuacugggaguaccucca

SEQ ID NO: 930544 - RNA, 19 nt, Human
guaccuccaaagccugcaa

SEQ ID NO: 930545 - RNA, 22 nt, Human
gugacauaaucaggaaccucau

SEQ ID NO: 930546 - RNA, 19 nt, Human
uaaagaauacucgauacca

SEQ ID NO: 930547 - RNA, 21 nt, Human
uaacauuucuuaagaaaaucc

SEQ ID NO: 930548 - RNA, 18 nt, Human
uaacuggacauuaaaaau

SEQ ID NO: 930549 - RNA, 19 nt, Human
uaccuccaaagccugcaaa

SEQ ID NO: 930550 - RNA, 23 nt, Human
uacugggaguaccuccaaagccu

SEQ ID NO: 930551 - RNA, 24 nt, Human
uauaaagaauacucgauaccauga

SEQ ID NO: 930552 - RNA, 22 nt, Human
uaucaggaaaguuuaaauacuu

SEQ ID NO: 930553 - RNA, 19 nt, Human
ucaguuaucuuacacauga

SEQ ID NO: 930554 - RNA, 18 nt, Human
uccaaagccugcaaaacu

SEQ ID NO: 930555 - RNA, 24 nt, Human
uccaaagccugcaaaacugcuuuc

SEQ ID NO: 930556 - RNA, 24 nt, Human
ugacaaaaaugacuuaaauaggaa

SEQ ID NO: 930557 - RNA, 23 nt, Human
ugcaaguaguaaaacuggagcaa

SEQ ID NO: 930558 - RNA, 25 nt, Human
ugcaaguaguaaaacuggagcaaau

SEQ ID NO: 930559 - RNA, 19 nt, Human
uggcucaggugguggugcu

SEQ ID NO: 930560 - RNA, 24 nt, Human
uggcucaggugguggugcuacugg

SEQ ID NO: 930561 - RNA, 26 nt, Human
uggcucaggugguggugcuacuggga

SEQ ID NO: 930562 - RNA, 19 nt, Human
uuggcucaggugguggugc

SEQ ID NO: 930563 - RNA, 18 nt, Human
aacuuuugccagcuugau

SEQ ID NO: 930564 - RNA, 21 nt, Human
aucagucuuuuucuuuaugac

SEQ ID NO: 930565 - RNA, 23 nt, Human
caagugacccugcuauauuuccc

SEQ ID NO: 930566 - RNA, 27 nt, Human
cacaacuacuuauccauucuccugcag

SEQ ID NO: 930567 - RNA, 23 nt, Human
cagagaauauaaacacccaugua

SEQ ID NO: 930568 - RNA, 22 nt, Human
cauuuuuguuuuaaugauaaaa

SEQ ID NO: 930569 - RNA, 18 nt, Human
ccccacucuucuuuccca

SEQ ID NO: 930570 - RNA, 21 nt, Human
ccccauuuccccacauccuca

SEQ ID NO: 930571 - RNA, 20 nt, Human
cccugcuauauuucccccca

SEQ ID NO: 930572 - RNA, 27 nt, Human
ccucacagucacacauuaacuuuugcc

SEQ ID NO: 930573 - RNA, 22 nt, Human
ccugaagcugaugugcaucuuc

SEQ ID NO: 930574 - RNA, 26 nt, Human
cucacagucacacauuaacuuuugcc

SEQ ID NO: 930575 - RNA, 19 nt, Human
gcauauaccacaacuacuu

SEQ ID NO: 930576 - RNA, 20 nt, Human
gccaaauuguuuuccacagu

SEQ ID NO: 930577 - RNA, 21 nt, Human
gccaaauuguuuuccacagug

SEQ ID NO: 930578 - RNA, 25 nt, Human
gucugcuuuucagguuuauuccuac

SEQ ID NO: 930579 - RNA, 24 nt, Human
uaaaauaauuccugauaccuggua

SEQ ID NO: 930580 - RNA, 24 nt, Human
uaaacacccauguaaauaucaccc

SEQ ID NO: 930581 - RNA, 18 nt, Human
uaacuggaucuugccaaa

SEQ ID NO: 930582 - RNA, 21 nt, Human
uaacuuuugccagcuugaugg

SEQ ID NO: 930583 - RNA, 19 nt, Human
ucacccacagauuaaacag

SEQ ID NO: 930584 - RNA, 25 nt, Human
ucagugcugaaauuaauauccuaau

SEQ ID NO: 930585 - RNA, 22 nt, Human
ucauucagaagucugcuuuuca

SEQ ID NO: 930586 - RNA, 20 nt, Human
uccacagugguuggaccaau

SEQ ID NO: 930587 - RNA, 23 nt, Human
ucccagacauaucuaaauauccu

SEQ ID NO: 930588 - RNA, 19 nt, Human
ucccaugugaacaagugac

SEQ ID NO: 930589 - RNA, 19 nt, Human
ucccccagcagugugugug

SEQ ID NO: 930590 - RNA, 21 nt, Human
uccucguguauaccguucccc

SEQ ID NO: 930591 - RNA, 19 nt, Human
ucguguauaccguucccca

SEQ ID NO: 930592 - RNA, 24 nt, Human
ucucuaugcagagauuauaaagau

SEQ ID NO: 930593 - RNA, 25 nt, Human
ucuuguguuuuuaguuauaauuguu

SEQ ID NO: 930594 - RNA, 21 nt, Human
ugaacaagugacccugcuaua

SEQ ID NO: 930595 - RNA, 23 nt, Human
ugcaucuucccuuucuugguuuu

SEQ ID NO: 930596 - RNA, 23 nt, Human
ugcuuguuuuucagguuuuuauu

SEQ ID NO: 930597 - RNA, 24 nt, Human
uggauauuuagguuguuuccaauu

SEQ ID NO: 930598 - RNA, 18 nt, Human
uggaucuguuuggauacu

SEQ ID NO: 930599 - RNA, 20 nt, Human
uguaauggcuauuucugcuu

SEQ ID NO: 930600 - RNA, 19 nt, Human
uguacagaguuuguuuggc

SEQ ID NO: 930601 - RNA, 21 nt, Human
uuacugaguuguauguuauau

SEQ ID NO: 930602 - RNA, 20 nt, Human
uucagaagucugcuuuucag

SEQ ID NO: 930603 - RNA, 26 nt, Human
uucccaugugaacaagugacccugcu

SEQ ID NO: 930604 - RNA, 19 nt, Human
uucuauauuuucuucuaaa

SEQ ID NO: 930605 - RNA, 22 nt, Human
uucuugguuuuagauguucauu

SEQ ID NO: 930606 - RNA, 25 nt, Human
uuuacauaaauauuaccuguauccu

SEQ ID NO: 930607 - RNA, 24 nt, Human
uuuccacagugguuggaccaauuu

SEQ ID NO: 930608 - RNA, 20 nt, Human
aaaaaagccaauccugcagg

SEQ ID NO: 930609 - RNA, 19 nt, Human
aaaaagccaauccugcagg

SEQ ID NO: 930610 - RNA, 22 nt, Human
aaaccaaccaacaagcacacuu

SEQ ID NO: 930611 - RNA, 21 nt, Human
aacuacuggccucaagugcuc

SEQ ID NO: 930612 - RNA, 19 nt, Human
aagugcugggauuacaggc

SEQ ID NO: 930613 - RNA, 19 nt, Human
aagugcugggauuacaggc

SEQ ID NO: 930614 - RNA, 23 nt, Human
aagugcugggauuacaggcguga

SEQ ID NO: 930615 - RNA, 26 nt, Human
aagugcugggauuacaggcgugagcc

SEQ ID NO: 930616 - RNA, 19 nt, Human
aauguuacaggguggagua

SEQ ID NO: 930617 - RNA, 22 nt, Human
acaaccuccgccucccggguuc

SEQ ID NO: 930618 - RNA, 20 nt, Human
acacguauuugaccacugaa

SEQ ID NO: 930619 - RNA, 25 nt, Human
acccugcccccuccucagcaccgcc

SEQ ID NO: 930620 - RNA, 19 nt, Human
acggagucucacugugugg

SEQ ID NO: 930621 - RNA, 23 nt, Human
acggagucucacuguguggccca

SEQ ID NO: 930622 - RNA, 18 nt, Human
acgggguuucgccauguu

SEQ ID NO: 930623 - RNA, 23 nt, Human
acgggguuucgccauguuggcca

SEQ ID NO: 930624 - RNA, 24 nt, Human
acgggguuucgccauguuggccag

SEQ ID NO: 930625 - RNA, 21 nt, Human
agcacagcguguuggcuaccu

SEQ ID NO: 930626 - RNA, 22 nt, Human
aggcuguuuuuucuaagcuucu

SEQ ID NO: 930627 - RNA, 22 nt, Human
aguagagacgggguuucgccau

SEQ ID NO: 930628 - RNA, 20 nt, Human
agugcagcggcgcgaucucg

SEQ ID NO: 930629 - RNA, 24 nt, Human
agugcagcggcgcgaucucggcuc

SEQ ID NO: 930630 - RNA, 18 nt, Human
agugcugggauuacaggc

SEQ ID NO: 930631 - RNA, 24 nt, Human
auuggccagguaugguggcucaca

SEQ ID NO: 930632 - RNA, 24 nt, Human
auuuuuguaucuuuaguagagacg

SEQ ID NO: 930633 - RNA, 20 nt, Human
caacaagcacacuucuccaa

SEQ ID NO: 930634 - RNA, 24 nt, Human
caacaagcacacuucuccaacccu

SEQ ID NO: 930635 - RNA, 22 nt, Human
caacccagcuccuacccucacu

SEQ ID NO: 930636 - RNA, 21 nt, Human
caagcgauucuccugccucag

SEQ ID NO: 930637 - RNA, 24 nt, Human
caccacacccagcuaauuuuugua

SEQ ID NO: 930638 - RNA, 18 nt, Human
cacccauggccaacucuc

SEQ ID NO: 930639 - RNA, 23 nt, Human
caccgccugccuuuggucucauu

SEQ ID NO: 930640 - RNA, 21 nt, Human
cacuacaaccuccgccucccg

SEQ ID NO: 930641 - RNA, 23 nt, Human
cacuguguggcccaggcuggagu

SEQ ID NO: 930642 - RNA, 24 nt, Human
cacuguguggcccaggcuggagug

SEQ ID NO: 930643 - RNA, 24 nt, Human
cagcuccuacccucacuuccagau

SEQ ID NO: 930644 - RNA, 21 nt, Human
caggguggaguaggaaaaaug

SEQ ID NO: 930645 - RNA, 24 nt, Human
cauguuggccaggcuggucuccaa

SEQ ID NO: 930646 - RNA, 24 nt, Human
cauuggcaaaugucacuagagggg

SEQ ID NO: 930647 - RNA, 20 nt, Human
cauuugucccuguguguccu

SEQ ID NO: 930648 - RNA, 20 nt, Human
ccagggccccucccuuuccu

SEQ ID NO: 930649 - RNA, 22 nt, Human
ccauggccaacucucgcuagcu

SEQ ID NO: 930650 - RNA, 19 nt, Human
ccauguuggccaggcuggu

SEQ ID NO: 930651 - RNA, 25 nt, Human
ccccuucugucuguccauuuguccc

SEQ ID NO: 930652 - RNA, 24 nt, Human
cccgaagugcugggauuacaggcg

SEQ ID NO: 930653 - RNA, 20 nt, Human
cccggguucaagcgauucuc

SEQ ID NO: 930654 - RNA, 23 nt, Human
cccggguucaagcgauucuccug

SEQ ID NO: 930655 - RNA, 19 nt, Human
cccucccuuuccuucacgc

SEQ ID NO: 930656 - RNA, 22 nt, Human
cccucccuuuccuucacgcuuc

SEQ ID NO: 930657 - RNA, 24 nt, Human
ccgaagugcugggauuacaggcgu

SEQ ID NO: 930658 - RNA, 21 nt, Human
ccgaguagcuggaacuacagg

SEQ ID NO: 930659 - RNA, 24 nt, Human
ccgccucccggguucaagcgauuc

SEQ ID NO: 930660 - RNA, 24 nt, Human
ccgcugaacacaugcaguguuucc

SEQ ID NO: 930661 - RNA, 21 nt, Human
ccucagcaccgccugccuuug

SEQ ID NO: 930662 - RNA, 18 nt, Human
ccuccagggccccucccu

SEQ ID NO: 930663 - RNA, 24 nt, Human
ccucccggguucaagcgauucucc

SEQ ID NO: 930664 - RNA, 24 nt, Human
ccuccuaucccacuguuugaaacc

SEQ ID NO: 930665 - RNA, 18 nt, Human
ccucucuuccuccccuuc

SEQ ID NO: 930666 - RNA, 23 nt, Human
ccugccucagucuccgaguagcu

SEQ ID NO: 930667 - RNA, 24 nt, Human
cgaagugcugggauuacaggcgug

SEQ ID NO: 930668 - RNA, 24 nt, Human
cgccauguuggccaggcuggucuc

SEQ ID NO: 930669 - RNA, 21 nt, Human
cgugagccaccacgccuggcc

SEQ ID NO: 930670 - RNA, 23 nt, Human
cuacaaccuccgccucccggguu

SEQ ID NO: 930671 - RNA, 24 nt, Human
cucacuacaaccuccgccucccgg

SEQ ID NO: 930672 - RNA, 27 nt, Human
cuccccuucugucuguccauuuguccc

SEQ ID NO: 930673 - RNA, 22 nt, Human
cucgggauucugguuuccuaag

SEQ ID NO: 930674 - RNA, 18 nt, Human
cugcccccuccucagcac

SEQ ID NO: 930675 - RNA, 25 nt, Human
cuggaacuacaggugcccaccacac

SEQ ID NO: 930676 - RNA, 22 nt, Human
cuguaauagcaagcugagcaca

SEQ ID NO: 930677 - RNA, 20 nt, Human
cuguagucagccucuccucc

SEQ ID NO: 930678 - RNA, 23 nt, Human
cuucuuagcccguaaacauugcu

SEQ ID NO: 930679 - RNA, 24 nt, Human
gaagugcugggauuacaggcguga

SEQ ID NO: 930680 - RNA, 24 nt, Human
gagacgggguuucgccauguuggc

SEQ ID NO: 930681 - RNA, 19 nt, Human
gaggagggaggguaacauc

SEQ ID NO: 930682 - RNA, 18 nt, Human
gauuacaggcgugagcca

SEQ ID NO: 930683 - RNA, 21 nt, Human
gauuacaggcgugagccacca

SEQ ID NO: 930684 - RNA, 22 nt, Human
gauuacaggcgugagccaccac

SEQ ID NO: 930685 - RNA, 21 nt, Human
gauucuccugccucagucucc

SEQ ID NO: 930686 - RNA, 23 nt, Human
gccauguuggccaggcuggucuc

SEQ ID NO: 930687 - RNA, 19 nt, Human
gcccaggcuggagugcagc

SEQ ID NO: 930688 - RNA, 25 nt, Human
gcugcaaaaaagccaauccugcagg

SEQ ID NO: 930689 - RNA, 19 nt, Human
gcuggagugcagcggcgcg

SEQ ID NO: 930690 - RNA, 24 nt, Human
ggaaggagggguccuguuucuuuc

SEQ ID NO: 930691 - RNA, 19 nt, Human
ggauuacaggcgugagcca

SEQ ID NO: 930692 - RNA, 23 nt, Human
ggccaaugagaggaaacucuggc

SEQ ID NO: 930693 - RNA, 24 nt, Human
ggccucaagugcucugcccaucuc

SEQ ID NO: 930694 - RNA, 23 nt, Human
ggcgcgaucucggcucacuacaa

SEQ ID NO: 930695 - RNA, 23 nt, Human
gggaaggagggguccuguuucuu

SEQ ID NO: 930696 - RNA, 18 nt, Human
gggaggguaacaucuuuu

SEQ ID NO: 930697 - RNA, 23 nt, Human
gggguuucgccauguuggccagg

SEQ ID NO: 930698 - RNA, 22 nt, Human
ggguuucgccauguuggccagg

SEQ ID NO: 930699 - RNA, 23 nt, Human
guacugguuuguaucugucuuuu

SEQ ID NO: 930700 - RNA, 23 nt, Human
guagagacgggguuucgccaugu

SEQ ID NO: 930701 - RNA, 22 nt, Human
gucacaucuccacucgggauuc

SEQ ID NO: 930702 - RNA, 20 nt, Human
guccuaggccuguuugugcc

SEQ ID NO: 930703 - RNA, 19 nt, Human
guggcccaggcuggagugc

SEQ ID NO: 930704 - RNA, 26 nt, Human
uaaagacacgaggccucucuuccucc

SEQ ID NO: 930705 - RNA, 22 nt, Human
uaaguuuccaacccagcuccua

SEQ ID NO: 930706 - RNA, 24 nt, Human
uaauuuuuguaucuuuaguagaga

SEQ ID NO: 930707 - RNA, 22 nt, Human
uacaggcgugagccaccacgcc

SEQ ID NO: 930708 - RNA, 22 nt, Human
uacaggcgugagccaccacgcc

SEQ ID NO: 930709 - RNA, 23 nt, Human
uacaggcgugagccaccacgccu

SEQ ID NO: 930710 - RNA, 21 nt, Human
uacaggugcccaccacaccca

SEQ ID NO: 930711 - RNA, 22 nt, Human
uagagacgggguuucgccaugu

SEQ ID NO: 930712 - RNA, 20 nt, Human
uagcuggaacuacaggugcc

SEQ ID NO: 930713 - RNA, 23 nt, Human
uaggauacaccccuuugccacuc

SEQ ID NO: 930714 - RNA, 24 nt, Human
uaguagagacgggguuucgccaug

SEQ ID NO: 930715 - RNA, 24 nt, Human
uagucagccucuccuccagggccc

SEQ ID NO: 930716 - RNA, 24 nt, Human
ucacuacaaccuccgccucccggg

SEQ ID NO: 930717 - RNA, 25 nt, Human
ucacuacaaccuccgccucccgggu

SEQ ID NO: 930718 - RNA, 27 nt, Human
ucacuacaaccuccgccucccggguuc

SEQ ID NO: 930719 - RNA, 19 nt, Human
ucagggaaaaaauaaagac

SEQ ID NO: 930720 - RNA, 21 nt, Human
ucagggaaaaaauaaagacac

SEQ ID NO: 930721 - RNA, 25 nt, Human
ucagggaauauuuguuaggggauag

SEQ ID NO: 930722 - RNA, 19 nt, Human
ucccgaagugcugggauua

SEQ ID NO: 930723 - RNA, 24 nt, Human
ucccgaagugcugggauuacaggc

SEQ ID NO: 930724 - RNA, 21 nt, Human
ucccggguucaagcgauucuc

SEQ ID NO: 930725 - RNA, 24 nt, Human
ucccggguucaagcgauucuccug

SEQ ID NO: 930726 - RNA, 18 nt, Human
ucccuguguguccuuccu

SEQ ID NO: 930727 - RNA, 23 nt, Human
uccgaguagcuggaacuacaggu

SEQ ID NO: 930728 - RNA, 24 nt, Human
uccgaguagcuggaacuacaggug

SEQ ID NO: 930729 - RNA, 23 nt, Human
uccucuuuuuugagaggagggag

SEQ ID NO: 930730 - RNA, 22 nt, Human
ucgccauguuggccaggcuggu

SEQ ID NO: 930731 - RNA, 24 nt, Human
ucgccauguuggccaggcuggucu

SEQ ID NO: 930732 - RNA, 24 nt, Human
ucucacuguguggcccaggcugga

SEQ ID NO: 930733 - RNA, 26 nt, Human
ucucacuguguggcccaggcuggagu

SEQ ID NO: 930734 - RNA, 20 nt, Human
ucucggccucccgaagugcu

SEQ ID NO: 930735 - RNA, 21 nt, Human
ucugcucugggcugcaaaaaa

SEQ ID NO: 930736 - RNA, 21 nt, Human
ucuguagucagccucuccucc

SEQ ID NO: 930737 - RNA, 21 nt, Human
ucugucuguccauuugucccu

SEQ ID NO: 930738 - RNA, 25 nt, Human
ucuuacacaaacuuggaguucaaga

SEQ ID NO: 930739 - RNA, 22 nt, Human
ucuuuaguagagacgggguuuc

SEQ ID NO: 930740 - RNA, 23 nt, Human
ucuuuaguagagacgggguuucg

SEQ ID NO: 930741 - RNA, 19 nt, Human
ugaaaccaaccaacaagca

SEQ ID NO: 930742 - RNA, 23 nt, Human
ugaauuaacacaaaaauuggcug

SEQ ID NO: 930743 - RNA, 20 nt, Human
ugacugcagaccagggacug

SEQ ID NO: 930744 - RNA, 18 nt, Human
ugagaggaaacucuggca

SEQ ID NO: 930745 - RNA, 22 nt, Human
ugagcacagcguguuggcuacc

SEQ ID NO: 930746 - RNA, 24 nt, Human
ugauuaaaaaguuuuuugucuguu

SEQ ID NO: 930747 - RNA, 23 nt, Human
ugccucagucuccgaguagcugg

SEQ ID NO: 930748 - RNA, 21 nt, Human
ugccuggguuuggccaaugag

SEQ ID NO: 930749 - RNA, 24 nt, Human
ugcugggauuacaggcgugagcca

SEQ ID NO: 930750 - RNA, 21 nt, Human
uggaacuacaggugcccacca

SEQ ID NO: 930751 - RNA, 23 nt, Human
uggagugcagcggcgcgaucucg

SEQ ID NO: 930752 - RNA, 24 nt, Human
uggagugcagcggcgcgaucucgg

SEQ ID NO: 930753 - RNA, 19 nt, Human
uggauaggauacaccccuu

SEQ ID NO: 930754 - RNA, 21 nt, Human
uggccaggcuggucuccaacu

SEQ ID NO: 930755 - RNA, 18 nt, Human
uggcccaggcuggagugc

SEQ ID NO: 930756 - RNA, 23 nt, Human
uggcccaggcuggagugcagcgg

SEQ ID NO: 930757 - RNA, 18 nt, Human
uggccucaagugcucugc

SEQ ID NO: 930758 - RNA, 18 nt, Human
ugggauuacaggcgugag

SEQ ID NO: 930759 - RNA, 19 nt, Human
ugggauuacaggcgugagc

SEQ ID NO: 930760 - RNA, 22 nt, Human
ugggauuacaggcgugagccac

SEQ ID NO: 930761 - RNA, 23 nt, Human
ugggauuacaggcgugagccacc

SEQ ID NO: 930762 - RNA, 24 nt, Human
ugggauuacaggcgugagccacca

SEQ ID NO: 930763 - RNA, 19 nt, Human
ugggcugcaaaaaagccaa

SEQ ID NO: 930764 - RNA, 20 nt, Human
ugguuucugccccacugccc

SEQ ID NO: 930765 - RNA, 19 nt, Human
uguaauagcaagcugagca

SEQ ID NO: 930766 - RNA, 24 nt, Human
ugucuguagucagccucuccucca

SEQ ID NO: 930767 - RNA, 21 nt, Human
uguggcccaggcuggagugca

SEQ ID NO: 930768 - RNA, 22 nt, Human
uguguggcccaggcuggagugc

SEQ ID NO: 930769 - RNA, 24 nt, Human
uuaacacaaaaauuggccagguau

SEQ ID NO: 930770 - RNA, 21 nt, Human
uuaacauuacacaucgucuaa

SEQ ID NO: 930771 - RNA, 18 nt, Human
uuaguagagacgggguuu

SEQ ID NO: 930772 - RNA, 22 nt, Human
uuaguagagacgggguuucgcc

SEQ ID NO: 930773 - RNA, 24 nt, Human
uuaguagagacgggguuucgccau

SEQ ID NO: 930774 - RNA, 21 nt, Human
uucaagcgauucuccugccuc

SEQ ID NO: 930775 - RNA, 23 nt, Human
uucaagcgauucuccugccucag

SEQ ID NO: 930776 - RNA, 24 nt, Human
uucaagcgauucuccugccucagu

SEQ ID NO: 930777 - RNA, 20 nt, Human
uuggcaaaugucacuagagg

SEQ ID NO: 930778 - RNA, 22 nt, Human
uuggcaaaugucacuagagggg

SEQ ID NO: 930779 - RNA, 24 nt, Human
uuucgccauguuggccaggcuggu

SEQ ID NO: 930780 - RNA, 18 nt, Human
uuucucaccuuuucccug

SEQ ID NO: 930781 - RNA, 27 nt, Human
uuucuguaauagcaagcugagcacagc

SEQ ID NO: 930782 - RNA, 19 nt, Human
uuucuuucuaaagccacug

SEQ ID NO: 930783 - RNA, 20 nt, Human
uuuuuguaucuuuaguagag

SEQ ID NO: 930784 - RNA, 26 nt, Human
uuuuuuuuuuuugagacggagucuca

SEQ ID NO: 930785 - RNA, 22 nt, Human
uuuuuuuuuuuuuugagacgga

SEQ ID NO: 930786 - RNA, 18 nt, Human
uuuuuuuuuuuuuuuuug

SEQ ID NO: 930787 - RNA, 19 nt, Human
aaacauauuccaagggcaa

SEQ ID NO: 930788 - RNA, 22 nt, Human
aacuaccugagaccagcuguga

SEQ ID NO: 930789 - RNA, 25 nt, Human
acagaauaacucuucuuaacuaaaa

SEQ ID NO: 930790 - RNA, 19 nt, Human
acaucaaagugugguguuu

SEQ ID NO: 930791 - RNA, 18 nt, Human
acugcaaauuugacugug

SEQ ID NO: 930792 - RNA, 19 nt, Human
auaccccaccaaacaaagu

SEQ ID NO: 930793 - RNA, 22 nt, Human
caagcacaaguacuggggacac

SEQ ID NO: 930794 - RNA, 20 nt, Human
ccaccaaacaaagucuugaa

SEQ ID NO: 930795 - RNA, 23 nt, Human
cccaccaaacaaagucuugaagg

SEQ ID NO: 930796 - RNA, 19 nt, Human
ccccaccaaacaaagucuu

SEQ ID NO: 930797 - RNA, 25 nt, Human
cuucuugacaauauaaaugcugcag

SEQ ID NO: 930798 - RNA, 21 nt, Human
gaaacuuugcacgguaugagc

SEQ ID NO: 930799 - RNA, 21 nt, Human
gauguaguucuucuggacaga

SEQ ID NO: 930800 - RNA, 21 nt, Human
ggacagaccacaacucuaaga

SEQ ID NO: 930801 - RNA, 18 nt, Human
ggguauguuucacuucuu

SEQ ID NO: 930802 - RNA, 20 nt, Human
guacauacauauuauauaua

SEQ ID NO: 930803 - RNA, 23 nt, Human
guacauacauauuauauauacac

SEQ ID NO: 930804 - RNA, 22 nt, Human
guuaaaaaagaaacauauucca

SEQ ID NO: 930805 - RNA, 21 nt, Human
uaaaaaagaaacauauuccaa

SEQ ID NO: 930806 - RNA, 20 nt, Human
uaaaaaccuagucaaacaag

SEQ ID NO: 930807 - RNA, 23 nt, Human
uacauacauauuauauauacaca

SEQ ID NO: 930808 - RNA, 23 nt, Human
uauacacauacauauauauacua

SEQ ID NO: 930809 - RNA, 19 nt, Human
uauauacacauacauauau

SEQ ID NO: 930810 - RNA, 20 nt, Human
uauauacacauacauauaua

SEQ ID NO: 930811 - RNA, 19 nt, Human
uauauauacacauacauau

SEQ ID NO: 930812 - RNA, 25 nt, Human
uauauauacacauacauauauauag

SEQ ID NO: 930813 - RNA, 24 nt, Human
uccagcuugacaagauugagaggc

SEQ ID NO: 930814 - RNA, 23 nt, Human
uccauaacuauagcugaugcaga

SEQ ID NO: 930815 - RNA, 22 nt, Human
ugaaguaaaaccgauaccuguc

SEQ ID NO: 930816 - RNA, 24 nt, Human
ugacaagauugagaggcccaugcc

SEQ ID NO: 930817 - RNA, 19 nt, Human
ugacuacagcauggaaaaa

SEQ ID NO: 930818 - RNA, 24 nt, Human
ugacuacagcauggaaaaaaauag

SEQ ID NO: 930819 - RNA, 25 nt, Human
ugacuacagcauggaaaaaaauagu

SEQ ID NO: 930820 - RNA, 19 nt, Human
ugaugcagaaaguccagcc

SEQ ID NO: 930821 - RNA, 18 nt, Human
ugcagaaaguccagccag

SEQ ID NO: 930822 - RNA, 19 nt, Human
ugcagaaaguccagccagu

SEQ ID NO: 930823 - RNA, 19 nt, Human
ugccagacuucauccagcu

SEQ ID NO: 930824 - RNA, 18 nt, Human
uggaaauucaagcacaag

SEQ ID NO: 930825 - RNA, 21 nt, Human
uggggacacaucaaagugugg

SEQ ID NO: 930826 - RNA, 19 nt, Human
ugguaugcuuaguauauuc

SEQ ID NO: 930827 - RNA, 24 nt, Human
uguaaacaaaaaguagauaguuuc

SEQ ID NO: 930828 - RNA, 19 nt, Human
uuaguauauuccaaccuaa

SEQ ID NO: 930829 - RNA, 21 nt, Human
uucaagcacaaguacugggga

SEQ ID NO: 930830 - RNA, 26 nt, Human
uucacauuuuauauguugcacauagc

SEQ ID NO: 930831 - RNA, 21 nt, Human
uucuaauuuaaguaaguuuga

SEQ ID NO: 930832 - RNA, 21 nt, Human
uuuuauauguugcacauagcc

SEQ ID NO: 930833 - RNA, 19 nt, Human
uuuugcauuucaaaaguug

SEQ ID NO: 930834 - RNA, 27 nt, Human
aaaaaaaaaccaaccugagagucagaa

SEQ ID NO: 930835 - RNA, 26 nt, Human
aaaaaaacaaaauauaaccuugcaaa

SEQ ID NO: 930836 - RNA, 24 nt, Human
aaaaaaaccaaccugagagucaga

SEQ ID NO: 930837 - RNA, 23 nt, Human
aaacuccuggacucaagcaaucc

SEQ ID NO: 930838 - RNA, 18 nt, Human
aaagcugggauuacaggc

SEQ ID NO: 930839 - RNA, 19 nt, Human
aaaguuaugagaauuuaug

SEQ ID NO: 930840 - RNA, 24 nt, Human
aagcaauccucuugccuuggucuc

SEQ ID NO: 930841 - RNA, 25 nt, Human
aagcaauccucuugccuuggucucc

SEQ ID NO: 930842 - RNA, 24 nt, Human
acagcauuugguucucuaaaaugu

SEQ ID NO: 930843 - RNA, 19 nt, Human
acauagcaccucgccugau

SEQ ID NO: 930844 - RNA, 20 nt, Human
accccaagaaaguuaugaga

SEQ ID NO: 930845 - RNA, 22 nt, Human
accccaagaaaguuaugagaau

SEQ ID NO: 930846 - RNA, 25 nt, Human
caaacuccuggacucaagcaauccu

SEQ ID NO: 930847 - RNA, 24 nt, Human
caaagcugggauuacaggccugag

SEQ ID NO: 930848 - RNA, 25 nt, Human
caaaugcaacaaguacaugaggucu

SEQ ID NO: 930849 - RNA, 18 nt, Human
caagcaauccucuugccu

SEQ ID NO: 930850 - RNA, 19 nt, Human
caccaccuaaaaauccaac

SEQ ID NO: 930851 - RNA, 22 nt, Human
caccaccuaaaaauccaacuca

SEQ ID NO: 930852 - RNA, 23 nt, Human
caccuaaaaauccaacucacaga

SEQ ID NO: 930853 - RNA, 25 nt, Human
caccuaaaaauccaacucacagaag

SEQ ID NO: 930854 - RNA, 20 nt, Human
caugacugauuucuacagcu

SEQ ID NO: 930855 - RNA, 18 nt, Human
ccaacugucuuacaguga

SEQ ID NO: 930856 - RNA, 23 nt, Human
ccaagaaaguuaugagaauuuau

SEQ ID NO: 930857 - RNA, 18 nt, Human
ccaauaaauaaaagcuac

SEQ ID NO: 930858 - RNA, 22 nt, Human
ccaccaccuaaaaauccaacuc

SEQ ID NO: 930859 - RNA, 28 nt, Human
cccaaagcugggauuacaggccugagac

SEQ ID NO: 930860 - RNA, 18 nt, Human
ccccuauaccauacugcu

SEQ ID NO: 930861 - RNA, 19 nt, Human
cccuauaccauacugcuuc

SEQ ID NO: 930862 - RNA, 20 nt, Human
ccuggacucaagcaauccuc

SEQ ID NO: 930863 - RNA, 22 nt, Human
cuacagcucuucuauaggaaau

SEQ ID NO: 930864 - RNA, 22 nt, Human
cucccaaagcugggauuacagg

SEQ ID NO: 930865 - RNA, 21 nt, Human
cuuacagugaaagccugugca

SEQ ID NO: 930866 - RNA, 21 nt, Human
cuuggucucccaaagcuggga

SEQ ID NO: 930867 - RNA, 23 nt, Human
gaaaaaaaaaaccaaccugagag

SEQ ID NO: 930868 - RNA, 23 nt, Human
gagagguuuguacuagauugcuu

SEQ ID NO: 930869 - RNA, 18 nt, Human
gauuacaggccugagaca

SEQ ID NO: 930870 - RNA, 22 nt, Human
gccuuggucucccaaagcuggg

SEQ ID NO: 930871 - RNA, 19 nt, Human
gcuagucucaaacuccugg

SEQ ID NO: 930872 - RNA, 21 nt, Human
ggccugagacauagcaccucg

SEQ ID NO: 930873 - RNA, 21 nt, Human
guauaauggaaaaaaaaaacc

SEQ ID NO: 930874 - RNA, 19 nt, Human
guuuguacuagauugcuuc

SEQ ID NO: 930875 - RNA, 18 nt, Human
uaaaaugucuuaagcuua

SEQ ID NO: 930876 - RNA, 22 nt, Human
uaacaauauuccuguaauuuau

SEQ ID NO: 930877 - RNA, 24 nt, Human
uaaccuugcaaagguuauacugcc

SEQ ID NO: 930878 - RNA, 20 nt, Human
uaagcaacuugcccaagguc

SEQ ID NO: 930879 - RNA, 19 nt, Human
uaauagcaaaguaaagacu

SEQ ID NO: 930880 - RNA, 22 nt, Human
uacuagauugcuuccaagaucc

SEQ ID NO: 930881 - RNA, 18 nt, Human
uacugcuucuacuacuuc

SEQ ID NO: 930882 - RNA, 23 nt, Human
uauaccauacugcuucuacuacu

SEQ ID NO: 930883 - RNA, 19 nt, Human
uaucauaaacagcauuugg

SEQ ID NO: 930884 - RNA, 22 nt, Human
ucccaaagcugggauuacaggc

SEQ ID NO: 930885 - RNA, 19 nt, Human
ucgccugaugauauucucu

SEQ ID NO: 930886 - RNA, 24 nt, Human
ucucccaaagcugggauuacaggc

SEQ ID NO: 930887 - RNA, 22 nt, Human
ucugugcugaaauauauuacaa

SEQ ID NO: 930888 - RNA, 23 nt, Human
ucuuacagugaaagccugugcaa

SEQ ID NO: 930889 - RNA, 23 nt, Human
ucuucaagaaacauuucuuucac

SEQ ID NO: 930890 - RNA, 22 nt, Human
ucuugcugacacaggaaaaaaa

SEQ ID NO: 930891 - RNA, 25 nt, Human
ugaaaagaggcuguaaaguauaaug

SEQ ID NO: 930892 - RNA, 20 nt, Human
ugaagcagagauaagcaacu

SEQ ID NO: 930893 - RNA, 23 nt, Human
ugacaauauuuuugagcuggaag

SEQ ID NO: 930894 - RNA, 19 nt, Human
ugagcuggaagagaccuuu

SEQ ID NO: 930895 - RNA, 19 nt, Human
ugccuuggucucccaaagc

SEQ ID NO: 930896 - RNA, 21 nt, Human
uggaaaaaaaaaaccaaccug

SEQ ID NO: 930897 - RNA, 24 nt, Human
uggacucaagcaauccucuugccu

SEQ ID NO: 930898 - RNA, 18 nt, Human
ugggauuacaggccugag

SEQ ID NO: 930899 - RNA, 21 nt, Human
ugggauuacaggccugagaca

SEQ ID NO: 930900 - RNA, 21 nt, Human
ugggauuacaggccugagaca

SEQ ID NO: 930901 - RNA, 24 nt, Human
uguacuagauugcuuccaagaucc

SEQ ID NO: 930902 - RNA, 18 nt, Human
ugucacaggaaugacaau

SEQ ID NO: 930903 - RNA, 23 nt, Human
uguuauaaguaaugauacauauu

SEQ ID NO: 930904 - RNA, 21 nt, Human
uucauaacaauauuccuguaa

SEQ ID NO: 930905 - RNA, 23 nt, Human
uugaccccaagaaaguuaugaga

SEQ ID NO: 930906 - RNA, 21 nt, Human
uugccuuggucucccaaagcu

SEQ ID NO: 930907 - RNA, 18 nt, Human
uuuaugaaacuacaugac

SEQ ID NO: 930908 - RNA, 19 nt, Human
aaaaaaaaaacucacccau

SEQ ID NO: 930909 - RNA, 19 nt, Human
aagaagcuggcuggaggag

SEQ ID NO: 930910 - RNA, 20 nt, Human
acugggggcaggugugugcc

SEQ ID NO: 930911 - RNA, 27 nt, Human
agcccucuccaaggcacaaucuuauug

SEQ ID NO: 930912 - RNA, 18 nt, Human
aggacuuaugaauggaaa

SEQ ID NO: 930913 - RNA, 23 nt, Human
aggcgagacugggggcaggugug

SEQ ID NO: 930914 - RNA, 22 nt, Human
aggugauucagucuggcuagga

SEQ ID NO: 930915 - RNA, 18 nt, Human
aucuugacaaauguaaaa

SEQ ID NO: 930916 - RNA, 23 nt, Human
augccucucugcgggaggaaagg

SEQ ID NO: 930917 - RNA, 21 nt, Human
auuucauaguguggcuauaau

SEQ ID NO: 930918 - RNA, 24 nt, Human
caaucuuauuggaggggaaaauaa

SEQ ID NO: 930919 - RNA, 21 nt, Human
ccggaaccuaaagguagaaaa

SEQ ID NO: 930920 - RNA, 23 nt, Human
cgggaggaaaggagagugcaggc

SEQ ID NO: 930921 - RNA, 20 nt, Human
cugcgggaggaaaggagagu

SEQ ID NO: 930922 - RNA, 20 nt, Human
cuugacaaauguaaaacucu

SEQ ID NO: 930923 - RNA, 20 nt, Human
gaaaaguggguuugugagga

SEQ ID NO: 930924 - RNA, 24 nt, Human
gaaaauaacacacauaccaaaaca

SEQ ID NO: 930925 - RNA, 19 nt, Human
gaagaaaauuuugaagcau

SEQ ID NO: 930926 - RNA, 24 nt, Human
gagccggaaccuaaagguagaaaa

SEQ ID NO: 930927 - RNA, 21 nt, Human
gaggagaccgccucuggaacc

SEQ ID NO: 930928 - RNA, 21 nt, Human
ggaggggaaaauaacacacau

SEQ ID NO: 930929 - RNA, 22 nt, Human
guaggguaugugaggcacucag

SEQ ID NO: 930930 - RNA, 25 nt, Human
uaccaaaacaaaaaauucagggcag

SEQ ID NO: 930931 - RNA, 24 nt, Human
uagcuuuuuuuucaacuguuuaca

SEQ ID NO: 930932 - RNA, 27 nt, Human
uaggcaucugagguguuuacaauuuuu

SEQ ID NO: 930933 - RNA, 27 nt, Human
uauauguauuuuucuacguguguauau

SEQ ID NO: 930934 - RNA, 24 nt, Human
uauguauuuuucuacguguguaua

SEQ ID NO: 930935 - RNA, 21 nt, Human
uauuucauaguguggcuauaa

SEQ ID NO: 930936 - RNA, 18 nt, Human
ucaauaaaaauaauacac

SEQ ID NO: 930937 - RNA, 21 nt, Human
ucugcgggaggaaaggagagu

SEQ ID NO: 930938 - RNA, 23 nt, Human
ucuguauugucuuugaaaaaaaa

SEQ ID NO: 930939 - RNA, 18 nt, Human
ugagaggaggagaaagga

SEQ ID NO: 930940 - RNA, 19 nt, Human
ugaggcacucaggcaagag

SEQ ID NO: 930941 - RNA, 24 nt, Human
ugcgggaggaaaggagagugcagg

SEQ ID NO: 930942 - RNA, 20 nt, Human
ugcuuacauagaaguggaau

SEQ ID NO: 930943 - RNA, 21 nt, Human
ugcuuacauagaaguggaaua

SEQ ID NO: 930944 - RNA, 24 nt, Human
ugggaagaaaauuuugaagcauuu

SEQ ID NO: 930945 - RNA, 21 nt, Human
ugggaggugauucagucuggc

SEQ ID NO: 930946 - RNA, 22 nt, Human
uguaaaacacucuagaugcugu

SEQ ID NO: 930947 - RNA, 19 nt, Human
uguagcuuuuuuuucaacu

SEQ ID NO: 930948 - RNA, 21 nt, Human
ugugaggacuuaugaauggaa

SEQ ID NO: 930949 - RNA, 21 nt, Human
uguguauauggauuucacaug

SEQ ID NO: 930950 - RNA, 19 nt, Human
uuacuggcauauaauugug

SEQ ID NO: 930951 - RNA, 18 nt, Human
uuuuuuuuuuuuuuucug

SEQ ID NO: 930952 - RNA, 22 nt, Human
uuuuuuuuuuuuuuucuguauu

SEQ ID NO: 930953 - RNA, 25 nt, Human
aagugauccucccaccucagccucc

SEQ ID NO: 930954 - RNA, 25 nt, Human
acacuggaacuuccacaaccggagg

SEQ ID NO: 930955 - RNA, 25 nt, Human
accacaccaagcuaauuuuuugauc

SEQ ID NO: 930956 - RNA, 23 nt, Human
accucagccuccuggguagcuga

SEQ ID NO: 930957 - RNA, 22 nt, Human
acuuuuguaaugagaaaaaaaa

SEQ ID NO: 930958 - RNA, 20 nt, Human
agagaagguuaaagcccaga

SEQ ID NO: 930959 - RNA, 20 nt, Human
agauguugauucagacuccu

SEQ ID NO: 930960 - RNA, 24 nt, Human
aggcgcgcgccaccacaccaagcu

SEQ ID NO: 930961 - RNA, 18 nt, Human
aguauaauaggcuuaaaa

SEQ ID NO: 930962 - RNA, 25 nt, Human
agugauccucccaccucagccuccu

SEQ ID NO: 930963 - RNA, 21 nt, Human
agugcagugguaugaucagug

SEQ ID NO: 930964 - RNA, 24 nt, Human
agugcagugguaugaucaguggcu

SEQ ID NO: 930965 - RNA, 25 nt, Human
agugcagugguaugaucaguggcuc

SEQ ID NO: 930966 - RNA, 20 nt, Human
cacagcagccucgaccuccc

SEQ ID NO: 930967 - RNA, 20 nt, Human
cagccuccuggguagcugag

SEQ ID NO: 930968 - RNA, 21 nt, Human
cagccucgaccucccgggcuu

SEQ ID NO: 930969 - RNA, 24 nt, Human
cagccucgaccucccgggcuuaag

SEQ ID NO: 930970 - RNA, 24 nt, Human
cccaccucagccuccuggguagcu

SEQ ID NO: 930971 - RNA, 22 nt, Human
cccgggcuuaagugauccuccc

SEQ ID NO: 930972 - RNA, 23 nt, Human
cccgggcuuaagugauccuccca

SEQ ID NO: 930973 - RNA, 20 nt, Human
ccucgaccucccgggcuuaa

SEQ ID NO: 930974 - RNA, 21 nt, Human
ccucgaccucccgggcuuaag

SEQ ID NO: 930975 - RNA, 24 nt, Human
cgcgcgccaccacaccaagcuaau

SEQ ID NO: 930976 - RNA, 23 nt, Human
cuagaaauccucuaccgaagugg

SEQ ID NO: 930977 - RNA, 18 nt, Human
cucacaauauggcccagg

SEQ ID NO: 930978 - RNA, 18 nt, Human
cucacagcagccucgacc

SEQ ID NO: 930979 - RNA, 24 nt, Human
cucacagcagccucgaccucccgg

SEQ ID NO: 930980 - RNA, 20 nt, Human
cucuguugcccagacuggag

SEQ ID NO: 930981 - RNA, 24 nt, Human
cugaaacaggaucgcucuguugcc

SEQ ID NO: 930982 - RNA, 24 nt, Human
cuuaagugauccucccaccucagc

SEQ ID NO: 930983 - RNA, 25 nt, Human
cuuccacagaaguuucgcuuuauca

SEQ ID NO: 930984 - RNA, 24 nt, Human
cuuuuguaaugagaaaaaaaaaaa

SEQ ID NO: 930985 - RNA, 26 nt, Human
gaaaauagagauauaccccaaaaugu

SEQ ID NO: 930986 - RNA, 22 nt, Human
gaagagaagguuaaagcccaga

SEQ ID NO: 930987 - RNA, 18 nt, Human
gagaaauaacaucaacuu

SEQ ID NO: 930988 - RNA, 24 nt, Human
gaucgcucuguugcccagacugga

SEQ ID NO: 930989 - RNA, 20 nt, Human
gcccagacuggagugcagug

SEQ ID NO: 930990 - RNA, 24 nt, Human
gcccagacuggagugcagugguau

SEQ ID NO: 930991 - RNA, 20 nt, Human
gcccaggcugguguugaacu

SEQ ID NO: 930992 - RNA, 23 nt, Human
gcgcgccaccacaccaagcuaau

SEQ ID NO: 930993 - RNA, 18 nt, Human
gcucacggcucacagcag

SEQ ID NO: 930994 - RNA, 25 nt, Human
gcucuguugcccagacuggagugca

SEQ ID NO: 930995 - RNA, 21 nt, Human
gucuuggaucuuuuuuuucuc

SEQ ID NO: 930996 - RNA, 24 nt, Human
gugauccucccaccucagccuccu

SEQ ID NO: 930997 - RNA, 18 nt, Human
uaagugauccucccaccu

SEQ ID NO: 930998 - RNA, 23 nt, Human
uaauuuuuugaucgucuguagag

SEQ ID NO: 930999 - RNA, 19 nt, Human
uaccacgagaaauaacauc

SEQ ID NO: 931000 - RNA, 24 nt, Human
uagaagagaagguuaaagcccaga

SEQ ID NO: 931001 - RNA, 23 nt, Human
ucacagcagccucgaccucccgg

SEQ ID NO: 931002 - RNA, 24 nt, Human
ucacagcagccucgaccucccggg

SEQ ID NO: 931003 - RNA, 22 nt, Human
ucacauuuugaacuaacuugga

SEQ ID NO: 931004 - RNA, 26 nt, Human
uccucccaccucagccuccuggguag

SEQ ID NO: 931005 - RNA, 19 nt, Human
uccucuaccgaaguggaau

SEQ ID NO: 931006 - RNA, 24 nt, Human
uccuggguagcugagaucacaggc

SEQ ID NO: 931007 - RNA, 22 nt, Human
ucgcucuguugcccagacugga

SEQ ID NO: 931008 - RNA, 24 nt, Human
ucuguugcccagacuggagugcag

SEQ ID NO: 931009 - RNA, 24 nt, Human
ugagaucacaggcgcgcgccacca

SEQ ID NO: 931010 - RNA, 21 nt, Human
ugcccagacuggagugcagug

SEQ ID NO: 931011 - RNA, 21 nt, Human
uggaacuuccacagaaguuuc

SEQ ID NO: 931012 - RNA, 19 nt, Human
uggagugcagugguaugau

SEQ ID NO: 931013 - RNA, 21 nt, Human
uggagugcagugguaugauca

SEQ ID NO: 931014 - RNA, 25 nt, Human
uggagugcagugguaugaucagugg

SEQ ID NO: 931015 - RNA, 26 nt, Human
uguaaugagaaaaaaaaaaaaaaagc

SEQ ID NO: 931016 - RNA, 21 nt, Human
uguagagacguguucucacaa

SEQ ID NO: 931017 - RNA, 23 nt, Human
uuaauuagcccacaagaaacuag

SEQ ID NO: 931018 - RNA, 22 nt, Human
uuacugaggagugcaacggugg

SEQ ID NO: 931019 - RNA, 20 nt, Human
uuuguaaacgcuaauauuac

SEQ ID NO: 931020 - RNA, 22 nt, Human
uuuucugaauuuaccacgagaa

SEQ ID NO: 931021 - RNA, 25 nt, Human
uuuucugaauuuaccacgagaaaua

SEQ ID NO: 931022 - RNA, 20 nt, Human
uuuuuuuuuuuuagaagagu

SEQ ID NO: 931023 - RNA, 20 nt, Human
aacccaaaaguaaaaaauaa

SEQ ID NO: 931024 - RNA, 21 nt, Human
auaaaagcuccugacuccuuu

SEQ ID NO: 931025 - RNA, 23 nt, Human
caagcuuacuuaacaaucauaaa

SEQ ID NO: 931026 - RNA, 19 nt, Human
cauaugaucuaggugaacc

SEQ ID NO: 931027 - RNA, 21 nt, Human
ccaauuuacauaguaaaguca

SEQ ID NO: 931028 - RNA, 18 nt, Human
ccauauucucagcaaagu

SEQ ID NO: 931029 - RNA, 23 nt, Human
cccacagcuccucuccuucacua

SEQ ID NO: 931030 - RNA, 22 nt, Human
ccuaacuccucauuccuucucc

SEQ ID NO: 931031 - RNA, 19 nt, Human
cucaggauuugccuuuaug

SEQ ID NO: 931032 - RNA, 19 nt, Human
gauuccugacccacagcuc

SEQ ID NO: 931033 - RNA, 24 nt, Human
uaaaugguaugaauauauauuuug

SEQ ID NO: 931034 - RNA, 24 nt, Human
uaaauuacaaaaaacgcacuauga

SEQ ID NO: 931035 - RNA, 19 nt, Human
uacaagaucuaacacuaag

SEQ ID NO: 931036 - RNA, 23 nt, Human
uagaaguuauguuuguugauguu

SEQ ID NO: 931037 - RNA, 23 nt, Human
uauaaaacaaugcuuguggaaaa

SEQ ID NO: 931038 - RNA, 24 nt, Human
uauaaaauacaaugcagcccuuga

SEQ ID NO: 931039 - RNA, 23 nt, Human
uauucuguuuucuuccuuacugc

SEQ ID NO: 931040 - RNA, 24 nt, Human
ucagcaaaguuggcauaaaucuga

SEQ ID NO: 931041 - RNA, 18 nt, Human
uccucauuccuucuccuu

SEQ ID NO: 931042 - RNA, 24 nt, Human
uccugacuccuuuuaaggaccaaa

SEQ ID NO: 931043 - RNA, 28 nt, Human
ucuaacacuaagcuuguguuauccugau

SEQ ID NO: 931044 - RNA, 21 nt, Human
ugacccacagcuccucuccuu

SEQ ID NO: 931045 - RNA, 23 nt, Human
ugacccacagcuccucuccuuca

SEQ ID NO: 931046 - RNA, 22 nt, Human
ugaccugaauaaacaggguuau

SEQ ID NO: 931047 - RNA, 23 nt, Human
ugauuccugacccacagcuccuc

SEQ ID NO: 931048 - RNA, 23 nt, Human
ugcauacuuuacaauaaagaaaa

SEQ ID NO: 931049 - RNA, 20 nt, Human
ugcuuguggaaaauuaaccu

SEQ ID NO: 931050 - RNA, 22 nt, Human
uggaaaauuaaccuaggagaaa

SEQ ID NO: 931051 - RNA, 21 nt, Human
uggccauagauuaccacaaaa

SEQ ID NO: 931052 - RNA, 23 nt, Human
uguucacucaucuauacccucca

SEQ ID NO: 931053 - RNA, 25 nt, Human
uguuuucuuccuuacugccauuuca

SEQ ID NO: 931054 - RNA, 19 nt, Human
uuacaaaaaacgcacuaug

SEQ ID NO: 931055 - RNA, 18 nt, Human
uuccauguguaaguuuua

SEQ ID NO: 931056 - RNA, 24 nt, Human
uucuuccuuacugccauuucacau

SEQ ID NO: 931057 - RNA, 18 nt, Human
uuuuuuuuuuuuuuuuug

SEQ ID NO: 931058 - RNA, 19 nt, Human
uuuuuuuuuuuuuuuuugu

SEQ ID NO: 931059 - RNA, 20 nt, Human
aaagauaauauccuuuauuc

SEQ ID NO: 931060 - RNA, 24 nt, Human
aaagugccgggauuacaggcguga

SEQ ID NO: 931061 - RNA, 25 nt, Human
aagcaagcuuuucuccuaaaguaau

SEQ ID NO: 931062 - RNA, 19 nt, Human
aaguaacugggauuacagg

SEQ ID NO: 931063 - RNA, 24 nt, Human
aaguaacugggauuacaggcgcgc

SEQ ID NO: 931064 - RNA, 19 nt, Human
aaguaauuguacucguuga

SEQ ID NO: 931065 - RNA, 24 nt, Human
aagugauccacccaccuuggccuc

SEQ ID NO: 931066 - RNA, 26 nt, Human
aagugccgggauuacaggcgugagcc

SEQ ID NO: 931067 - RNA, 22 nt, Human
acagauuccccuccuauuguuu

SEQ ID NO: 931068 - RNA, 19 nt, Human
accaggcaccaugcuaagc

SEQ ID NO: 931069 - RNA, 25 nt, Human
acccaccuuggccucccaaagugcc

SEQ ID NO: 931070 - RNA, 23 nt, Human
aguaggauuauagcucacauuug

SEQ ID NO: 931071 - RNA, 19 nt, Human
agugauccacccaccuugg

SEQ ID NO: 931072 - RNA, 22 nt, Human
aguuuuguauuuuuaguagaca

SEQ ID NO: 931073 - RNA, 19 nt, Human
augggguuccacugugugg

SEQ ID NO: 931074 - RNA, 24 nt, Human
augggguuccacuguguggccuaa

SEQ ID NO: 931075 - RNA, 24 nt, Human
caaagugccgggauuacaggcgug

SEQ ID NO: 931076 - RNA, 20 nt, Human
caaccuccgccucccagguu

SEQ ID NO: 931077 - RNA, 22 nt, Human
cacccaccuuggccucccaaag

SEQ ID NO: 931078 - RNA, 23 nt, Human
cacccaccuuggccucccaaagu

SEQ ID NO: 931079 - RNA, 21 nt, Human
cacugcaaccuccgccuccca

SEQ ID NO: 931080 - RNA, 22 nt, Human
cacuguguggccuaauacgggc

SEQ ID NO: 931081 - RNA, 23 nt, Human
cagccuccuaaguaacugggauu

SEQ ID NO: 931082 - RNA, 24 nt, Human
cagcguuucgccaucuuggccagg

SEQ ID NO: 931083 - RNA, 20 nt, Human
cagugacuuucucuaaggac

SEQ ID NO: 931084 - RNA, 22 nt, Human
ccaaagugccgggauuacaggc

SEQ ID NO: 931085 - RNA, 24 nt, Human
ccaaagugccgggauuacaggcgu

SEQ ID NO: 931086 - RNA, 24 nt, Human
ccacaguggaacugcuuagcaucc

SEQ ID NO: 931087 - RNA, 19 nt, Human
ccaucuuggccaggcuggu

SEQ ID NO: 931088 - RNA, 22 nt, Human
ccaucuuggccaggcuggucuc

SEQ ID NO: 931089 - RNA, 19 nt, Human
ccuaaguaacugggauuac

SEQ ID NO: 931090 - RNA, 23 nt, Human
ccuaaguaacugggauuacaggc

SEQ ID NO: 931091 - RNA, 24 nt, Human
ccuaaguaacugggauuacaggcg

SEQ ID NO: 931092 - RNA, 24 nt, Human
ccucccagguugaugugauucucc

SEQ ID NO: 931093 - RNA, 29 nt, Human
ccucccagguugaugugauucuccugccu

SEQ ID NO: 931094 - RNA, 24 nt, Human
ccugaccucaagugauccacccac

SEQ ID NO: 931095 - RNA, 24 nt, Human
cgccaucuuggccaggcuggucuc

SEQ ID NO: 931096 - RNA, 21 nt, Human
cgggauuacaggcgugagcca

SEQ ID NO: 931097 - RNA, 22 nt, Human
cgggauuacaggcgugagccau

SEQ ID NO: 931098 - RNA, 24 nt, Human
cgggauuacaggcgugagccaucg

SEQ ID NO: 931099 - RNA, 20 nt, Human
cgggcagcaacaacucugau

SEQ ID NO: 931100 - RNA, 22 nt, Human
cuaaguaacugggauuacaggc

SEQ ID NO: 931101 - RNA, 24 nt, Human
cucaagugauccacccaccuuggc

SEQ ID NO: 931102 - RNA, 24 nt, Human
cucacugcaaccuccgccucccag

SEQ ID NO: 931103 - RNA, 18 nt, Human
cuuggccaggcuggucuc

SEQ ID NO: 931104 - RNA, 21 nt, Human
cuuuauucugcucauuuucua

SEQ ID NO: 931105 - RNA, 23 nt, Human
gaccucaagugauccacccaccu

SEQ ID NO: 931106 - RNA, 18 nt, Human
gauuacaggcgcgcgcca

SEQ ID NO: 931107 - RNA, 18 nt, Human
gauuacaggcgugagcca

SEQ ID NO: 931108 - RNA, 22 nt, Human
gauuacaggcgugagccaucgc

SEQ ID NO: 931109 - RNA, 23 nt, Human
gauuacaggcgugagccaucgca

SEQ ID NO: 931110 - RNA, 21 nt, Human
gcaaccuccgccucccagguu

SEQ ID NO: 931111 - RNA, 24 nt, Human
gccaucuuggccaggcuggucucg

SEQ ID NO: 931112 - RNA, 23 nt, Human
gcuggucucgaacuccugaccuc

SEQ ID NO: 931113 - RNA, 24 nt, Human
ggcuggucucgaacuccugaccuc

SEQ ID NO: 931114 - RNA, 18 nt, Human
gggauuacaggcgugagc

SEQ ID NO: 931115 - RNA, 20 nt, Human
gggauuacaggcgugagcca

SEQ ID NO: 931116 - RNA, 25 nt, Human
gggauuacaggcgugagccaucgca

SEQ ID NO: 931117 - RNA, 19 nt, Human
ggucucgaacuccugaccu

SEQ ID NO: 931118 - RNA, 24 nt, Human
gugauccacccaccuuggccuccc

SEQ ID NO: 931119 - RNA, 19 nt, Human
gugauucuccugccucagc

SEQ ID NO: 931120 - RNA, 23 nt, Human
gugauucuccugccucagccucc

SEQ ID NO: 931121 - RNA, 19 nt, Human
guucacauugauaauccua

SEQ ID NO: 931122 - RNA, 19 nt, Human
uaacugggauuacaggcgc

SEQ ID NO: 931123 - RNA, 22 nt, Human
uauaccaggcaccaugcuaagc

SEQ ID NO: 931124 - RNA, 23 nt, Human
uauucugcucauuuucuaggcgu

SEQ ID NO: 931125 - RNA, 19 nt, Human
ucacugcaaccuccgccuc

SEQ ID NO: 931126 - RNA, 24 nt, Human
ucacugcaaccuccgccucccagg

SEQ ID NO: 931127 - RNA, 25 nt, Human
ucacugcaaccuccgccucccaggu

SEQ ID NO: 931128 - RNA, 26 nt, Human
ucacugcaaccuccgccucccagguu

SEQ ID NO: 931129 - RNA, 24 nt, Human
ucccaaagugccgggauuacaggc

SEQ ID NO: 931130 - RNA, 21 nt, Human
ucccagguugaugugauucuc

SEQ ID NO: 931131 - RNA, 24 nt, Human
ucccagguugaugugauucuccug

SEQ ID NO: 931132 - RNA, 24 nt, Human
uccuaaguaacugggauuacaggc

SEQ ID NO: 931133 - RNA, 21 nt, Human
ucguauauaccaggcaccaug

SEQ ID NO: 931134 - RNA, 18 nt, Human
ucuaaggacccugaagca

SEQ ID NO: 931135 - RNA, 24 nt, Human
ucuccugccucagccuccuaagua

SEQ ID NO: 931136 - RNA, 21 nt, Human
ucucgaacuccugaccucaag

SEQ ID NO: 931137 - RNA, 18 nt, Human
ugacaccugccacagugg

SEQ ID NO: 931138 - RNA, 24 nt, Human
ugauccacccaccuuggccuccca

SEQ ID NO: 931139 - RNA, 20 nt, Human
ugauucuccugccucagccu

SEQ ID NO: 931140 - RNA, 22 nt, Human
ugcaaauauuuucuuccauauc

SEQ ID NO: 931141 - RNA, 24 nt, Human
ugccgggauuacaggcgugagcca

SEQ ID NO: 931142 - RNA, 24 nt, Human
ugccucagccuccuaaguaacugg

SEQ ID NO: 931143 - RNA, 24 nt, Human
uggcaugaucuaagcucacugcaa

SEQ ID NO: 931144 - RNA, 24 nt, Human
uggccaggcuggucucgaacuccu

SEQ ID NO: 931145 - RNA, 18 nt, Human
ugggauuacaggcgcgcg

SEQ ID NO: 931146 - RNA, 22 nt, Human
ugggauuacaggcgcgcgccac

SEQ ID NO: 931147 - RNA, 24 nt, Human
ugggauuacaggcgcgcgccacca

SEQ ID NO: 931148 - RNA, 25 nt, Human
ugggauuacaggcgcgcgccaccau

SEQ ID NO: 931149 - RNA, 24 nt, Human
ugugauucuccugccucagccucc

SEQ ID NO: 931150 - RNA, 24 nt, Human
uuaguagacacagcguuucgccau

SEQ ID NO: 931151 - RNA, 21 nt, Human
uucuacuagcaaaugacaccu

SEQ ID NO: 931152 - RNA, 24 nt, Human
uuucgccaucuuggccaggcuggu

SEQ ID NO: 931153 - RNA, 18 nt, Human
uuuuguauuuuuaguaga

SEQ ID NO: 931154 - RNA, 22 nt, Human
uuuuuugguugcgaaaucugcu

SEQ ID NO: 931155 - RNA, 24 nt, Human
uuuuuuuuuuuuuuuuuuccaaag

SEQ ID NO: 931156 - RNA, 21 nt, Human
aaaaaggagauccuacuguuu

SEQ ID NO: 931157 - RNA, 18 nt, Human
aaggagaggaaaugggga

SEQ ID NO: 931158 - RNA, 20 nt, Human
acaaaaauaaacuuugcagu

SEQ ID NO: 931159 - RNA, 18 nt, Human
acaauggaacauuauuca

SEQ ID NO: 931160 - RNA, 18 nt, Human
acaguagaaaugacauga

SEQ ID NO: 931161 - RNA, 19 nt, Human
acuucgaaagaacagaagg

SEQ ID NO: 931162 - RNA, 19 nt, Human
aggaaauggggagauauag

SEQ ID NO: 931163 - RNA, 24 nt, Human
aggaaauggggagauauaggucaa

SEQ ID NO: 931164 - RNA, 18 nt, Human
agguaaauacgaguucac

SEQ ID NO: 931165 - RNA, 18 nt, Human
auauguaggaugaacaag

SEQ ID NO: 931166 - RNA, 21 nt, Human
aucugcuucaccauuuugcug

SEQ ID NO: 931167 - RNA, 21 nt, Human
auguguguguauagacaaugu

SEQ ID NO: 931168 - RNA, 24 nt, Human
auguguguguguauacguuuaugu

SEQ ID NO: 931169 - RNA, 20 nt, Human
auuagggugcaauaaaaugu

SEQ ID NO: 931170 - RNA, 23 nt, Human
caaaauagcagauauguaggaug

SEQ ID NO: 931171 - RNA, 24 nt, Human
caagauagggaagcaaccuaaaug

SEQ ID NO: 931172 - RNA, 23 nt, Human
caccaaggaaaauauugcauaau

SEQ ID NO: 931173 - RNA, 22 nt, Human
cagcaaaaguaggauuuacaua

SEQ ID NO: 931174 - RNA, 20 nt, Human
cagggggaccaauguuagua

SEQ ID NO: 931175 - RNA, 23 nt, Human
cauguaucuuuuuaugugccuca

SEQ ID NO: 931176 - RNA, 20 nt, Human
ccaagggagaggaaaucacc

SEQ ID NO: 931177 - RNA, 21 nt, Human
cccaagggagaggaaaucacc

SEQ ID NO: 931178 - RNA, 18 nt, Human
ccccucaagcuuucccuu

SEQ ID NO: 931179 - RNA, 18 nt, Human
ccugucccugguauacac

SEQ ID NO: 931180 - RNA, 22 nt, Human
cuaaaauacacagaacgaaaca

SEQ ID NO: 931181 - RNA, 18 nt, Human
cuacuggugguggggaag

SEQ ID NO: 931182 - RNA, 20 nt, Human
cucacucauauguagaauau

SEQ ID NO: 931183 - RNA, 20 nt, Human
cucuucagauuacuuucuug

SEQ ID NO: 931184 - RNA, 18 nt, Human
gacaauguacaauggaac

SEQ ID NO: 931185 - RNA, 18 nt, Human
gauauguaggaugaacaa

SEQ ID NO: 931186 - RNA, 21 nt, Human
gauccaugucccuauuucaga

SEQ ID NO: 931187 - RNA, 23 nt, Human
gcuaaaauacacagaacgaaaca

SEQ ID NO: 931188 - RNA, 19 nt, Human
ggaccugaaggacguuaug

SEQ ID NO: 931189 - RNA, 24 nt, Human
gguggggaaggagaggaaaugggg

SEQ ID NO: 931190 - RNA, 22 nt, Human
guuugcuuccucucacuuccau

SEQ ID NO: 931191 - RNA, 24 nt, Human
guuuuucuuuuggcuugcugaugg

SEQ ID NO: 931192 - RNA, 18 nt, Human
uaaaccucaguugcacaa

SEQ ID NO: 931193 - RNA, 19 nt, Human
uaaaugagauaagccagac

SEQ ID NO: 931194 - RNA, 26 nt, Human
uacaaaauagcagauauguaggauga

SEQ ID NO: 931195 - RNA, 22 nt, Human
uaccacaacauagauggaccug

SEQ ID NO: 931196 - RNA, 18 nt, Human
uacuguuuaccacaacau

SEQ ID NO: 931197 - RNA, 21 nt, Human
uaggaugaacaaguuuagaga

SEQ ID NO: 931198 - RNA, 22 nt, Human
uauacguuuauguguguguaua

SEQ ID NO: 931199 - RNA, 26 nt, Human
uauggucauguaucuuuuuaugugcc

SEQ ID NO: 931200 - RNA, 22 nt, Human
uauuucagaccacacuuuuccc

SEQ ID NO: 931201 - RNA, 19 nt, Human
ucccugguauacacccaag

SEQ ID NO: 931202 - RNA, 22 nt, Human
ucccuuuuucacuuuaaagaag

SEQ ID NO: 931203 - RNA, 26 nt, Human
ugaaaugauagcuauauuaaucugcu

SEQ ID NO: 931204 - RNA, 18 nt, Human
ugacuugauguuuuucuu

SEQ ID NO: 931205 - RNA, 19 nt, Human
ugagacaguagaaaugaca

SEQ ID NO: 931206 - RNA, 18 nt, Human
ugaggaauggcuaaagaa

SEQ ID NO: 931207 - RNA, 18 nt, Human
ugaguaaagaagggcugc

SEQ ID NO: 931208 - RNA, 19 nt, Human
ugaguaaagaagggcugcu

SEQ ID NO: 931209 - RNA, 21 nt, Human
ugauggaguugguggaaggca

SEQ ID NO: 931210 - RNA, 20 nt, Human
ugauguuuuucuuuuggcuu

SEQ ID NO: 931211 - RNA, 20 nt, Human
ugcugucuauauuccauagc

SEQ ID NO: 931212 - RNA, 23 nt, Human
ugcuucaccauuuugcugucuau

SEQ ID NO: 931213 - RNA, 26 nt, Human
uguaaaccucaguugcacaaugaaau

SEQ ID NO: 931214 - RNA, 25 nt, Human
uguauacguuuauguguguguauaa

SEQ ID NO: 931215 - RNA, 22 nt, Human
ugugaaaugauagcuauauuaa

SEQ ID NO: 931216 - RNA, 24 nt, Human
uguguguauacguuuaugugugug

SEQ ID NO: 931217 - RNA, 25 nt, Human
uguguguauacguuuaugugugugu

SEQ ID NO: 931218 - RNA, 21 nt, Human
uguguguguauacguuuaugu

SEQ ID NO: 931219 - RNA, 22 nt, Human
uuaaucugcuucaccauuuugc

SEQ ID NO: 931220 - RNA, 21 nt, Human
uucuuuuggcuugcugauggc

SEQ ID NO: 931221 - RNA, 21 nt, Human
uugaagauucugggugcacag

SEQ ID NO: 931222 - RNA, 20 nt, Human
uuguuugcuuccucucacuu

SEQ ID NO: 931223 - RNA, 20 nt, Human
uuugcaguuggaggaacacu

SEQ ID NO: 931224 - RNA, 19 nt, Human
uuugcugucuauauuccau

SEQ ID NO: 931225 - RNA, 23 nt, Human
aaaggaaacauuuacacuucuag

SEQ ID NO: 931226 - RNA, 23 nt, Human
aaauaaaagcaacuccucagccc

SEQ ID NO: 931227 - RNA, 20 nt, Human
aaaucaagcuauggaaaggc

SEQ ID NO: 931228 - RNA, 21 nt, Human
aaaucaagcuauggaaaggcu

SEQ ID NO: 931229 - RNA, 23 nt, Human
aacaucuaccuuauccuuuuggc

SEQ ID NO: 931230 - RNA, 24 nt, Human
aagcagccaaaagacauuccccag

SEQ ID NO: 931231 - RNA, 19 nt, Human
aagcuauggaaaggcuuug

SEQ ID NO: 931232 - RNA, 19 nt, Human
aaggaaaaacccuuggaug

SEQ ID NO: 931233 - RNA, 23 nt, Human
aauguuucaagaugaaaagcaaa

SEQ ID NO: 931234 - RNA, 25 nt, Human
acaaagcagccaaaagacauucccc

SEQ ID NO: 931235 - RNA, 24 nt, Human
acacggcuuuugcagagguccccc

SEQ ID NO: 931236 - RNA, 26 nt, Human
acaucaccucuuucccuuuaaauuca

SEQ ID NO: 931237 - RNA, 21 nt, Human
accccaggaccccuguuccca

SEQ ID NO: 931238 - RNA, 23 nt, Human
accccaggggccgcaucccacac

SEQ ID NO: 931239 - RNA, 20 nt, Human
acccccaccccaggggccgc

SEQ ID NO: 931240 - RNA, 22 nt, Human
acugugaaaaaaggaaaaaccc

SEQ ID NO: 931241 - RNA, 24 nt, Human
agcuguauggcccagcaugacccc

SEQ ID NO: 931242 - RNA, 18 nt, Human
aggaauguuuuguaacuu

SEQ ID NO: 931243 - RNA, 22 nt, Human
aggagucauuaagucagacacc

SEQ ID NO: 931244 - RNA, 23 nt, Human
aggucccccuuucauucuucacc

SEQ ID NO: 931245 - RNA, 23 nt, Human
aucaccucuuucccuuuaaauuc

SEQ ID NO: 931246 - RNA, 21 nt, Human
augaaaagcaaaagucugaag

SEQ ID NO: 931247 - RNA, 18 nt, Human
auuacaaauccaauaaga

SEQ ID NO: 931248 - RNA, 23 nt, Human
caaagccccuacccaccuccaaa

SEQ ID NO: 931249 - RNA, 25 nt, Human
caaaguacagaaaaaacugggcaua

SEQ ID NO: 931250 - RNA, 23 nt, Human
caaauacagagguauauacuucg

SEQ ID NO: 931251 - RNA, 20 nt, Human
caagaugaaaagcaaaaguc

SEQ ID NO: 931252 - RNA, 23 nt, Human
caagcuauggaaaggcuuugucu

SEQ ID NO: 931253 - RNA, 22 nt, Human
caauacgggcaaggcaaagccc

SEQ ID NO: 931254 - RNA, 22 nt, Human
cacacaguccggcacccccacc

SEQ ID NO: 931255 - RNA, 20 nt, Human
caccuccuacuucuccugga

SEQ ID NO: 931256 - RNA, 20 nt, Human
cagaauucucaauuaaaaaa

SEQ ID NO: 931257 - RNA, 21 nt, Human
cagccaaaagacauuccccag

SEQ ID NO: 931258 - RNA, 21 nt, Human
caguaggcuguuggcuuccca

SEQ ID NO: 931259 - RNA, 21 nt, Human
cauucuauuacuuuucaucuu

SEQ ID NO: 931260 - RNA, 18 nt, Human
ccagucucaucuaacacu

SEQ ID NO: 931261 - RNA, 19 nt, Human
ccccaggaccccuguuccc

SEQ ID NO: 931262 - RNA, 21 nt, Human
ccccaggaccccuguucccag

SEQ ID NO: 931263 - RNA, 20 nt, Human
cccccuuucauucuucaccc

SEQ ID NO: 931264 - RNA, 20 nt, Human
cccuacccaccuccaaacag

SEQ ID NO: 931265 - RNA, 19 nt, Human
ccuauagcgacugcacuca

SEQ ID NO: 931266 - RNA, 27 nt, Human
ccuccaauccuauagcgacugcacuca

SEQ ID NO: 931267 - RNA, 18 nt, Human
cggcacccccaccccagg

SEQ ID NO: 931268 - RNA, 20 nt, Human
cuacaaagcagccaaaagaa

SEQ ID NO: 931269 - RNA, 23 nt, Human
cuccaauccuauagcgacugcac

SEQ ID NO: 931270 - RNA, 19 nt, Human
cugaacugaagccacucag

SEQ ID NO: 931271 - RNA, 18 nt, Human
gaauuacaaauccaauaa

SEQ ID NO: 931272 - RNA, 18 nt, Human
gaggaccuagugaaaaac

SEQ ID NO: 931273 - RNA, 19 nt, Human
gaggacuacuguuuauguc

SEQ ID NO: 931274 - RNA, 22 nt, Human
gcaaagccccuacccaccucca

SEQ ID NO: 931275 - RNA, 22 nt, Human
gcaacuccucagccccaauuuu

SEQ ID NO: 931276 - RNA, 23 nt, Human
gcaaggcaaagccccuacccacc

SEQ ID NO: 931277 - RNA, 20 nt, Human
gcaugaccccuaccuugccu

SEQ ID NO: 931278 - RNA, 21 nt, Human
gccuaccugccucccagucuc

SEQ ID NO: 931279 - RNA, 23 nt, Human
gcuauggaaaggcuuugucuaaa

SEQ ID NO: 931280 - RNA, 21 nt, Human
gcucacacagaaaucuuugca

SEQ ID NO: 931281 - RNA, 22 nt, Human
gcugaaaauaaauauaugaaua

SEQ ID NO: 931282 - RNA, 24 nt, Human
gcugcccuacuacuuugcuaagaa

SEQ ID NO: 931283 - RNA, 21 nt, Human
ggcaaaaauaaaacguuucca

SEQ ID NO: 931284 - RNA, 23 nt, Human
ggcaaaaauaaaacguuuccaaa

SEQ ID NO: 931285 - RNA, 22 nt, Human
ggccucuaacauagagagguuu

SEQ ID NO: 931286 - RNA, 23 nt, Human
ggcuacgaggaccuagugaaaaa

SEQ ID NO: 931287 - RNA, 27 nt, Human
gggcuuuuuuuuaagucauaccaaagg

SEQ ID NO: 931288 - RNA, 22 nt, Human
ggguugauuucuucauuauucu

SEQ ID NO: 931289 - RNA, 21 nt, Human
guacagaaaaaacugggcaua

SEQ ID NO: 931290 - RNA, 18 nt, Human
gucugaagucccuuggaa

SEQ ID NO: 931291 - RNA, 19 nt, Human
gugaaaaaaggaaaaaccc

SEQ ID NO: 931292 - RNA, 27 nt, Human
uaaacuguuaucuuuuaggaauguguu

SEQ ID NO: 931293 - RNA, 22 nt, Human
uaacgagacauuuaaaucaagc

SEQ ID NO: 931294 - RNA, 22 nt, Human
uaagaacaagaaccacacaguc

SEQ ID NO: 931295 - RNA, 21 nt, Human
uaagucagacaccuaugugag

SEQ ID NO: 931296 - RNA, 19 nt, Human
uaaguuaauuuaggaaugu

SEQ ID NO: 931297 - RNA, 20 nt, Human
uaaguuaauuuaggaauguu

SEQ ID NO: 931298 - RNA, 25 nt, Human
uacaaagcagccaaaagacauuccc

SEQ ID NO: 931299 - RNA, 22 nt, Human
uaccuuauccuuuuggccucua

SEQ ID NO: 931300 - RNA, 22 nt, Human
uaccuugccuaccugccuccca

SEQ ID NO: 931301 - RNA, 26 nt, Human
uaccuugccuaccugccucccagucu

SEQ ID NO: 931302 - RNA, 21 nt, Human
uagaggacuacuguuuauguc

SEQ ID NO: 931303 - RNA, 21 nt, Human
uauacaaacccgcuacacggc

SEQ ID NO: 931304 - RNA, 21 nt, Human
uauacugugaaaaaaggaaaa

SEQ ID NO: 931305 - RNA, 19 nt, Human
uaugcuuauuaaaaguuca

SEQ ID NO: 931306 - RNA, 23 nt, Human
uaugcuuauuaaaaguucaacau

SEQ ID NO: 931307 - RNA, 23 nt, Human
uauuauuacuaaaggcucacaca

SEQ ID NO: 931308 - RNA, 25 nt, Human
uauuuuauuuaaacuuuaaacaagc

SEQ ID NO: 931309 - RNA, 19 nt, Human
ucaaauggacaaccauaga

SEQ ID NO: 931310 - RNA, 23 nt, Human
ucaacugucaagcugaaaauaaa

SEQ ID NO: 931311 - RNA, 26 nt, Human
ucacacagaaaucuuugcaugcuaca

SEQ ID NO: 931312 - RNA, 19 nt, Human
ucaccuccuacuucuccug

SEQ ID NO: 931313 - RNA, 21 nt, Human
ucaguucuuuccagaauucac

SEQ ID NO: 931314 - RNA, 21 nt, Human
uccacaaaagccuauccuagg

SEQ ID NO: 931315 - RNA, 30 nt, Human
ucccacaccccaggaccccuguucccaguu

SEQ ID NO: 931316 - RNA, 18 nt, Human
uccccuugacaucagccc

SEQ ID NO: 931317 - RNA, 21 nt, Human
uccucgggcuacgaggaccua

SEQ ID NO: 931318 - RNA, 24 nt, Human
ucuaacacuauaugcccccucaau

SEQ ID NO: 931319 - RNA, 25 nt, Human
ucucugaacugaagccacucaguuc

SEQ ID NO: 931320 - RNA, 24 nt, Human
ugaagccacucaguucuuuccaga

SEQ ID NO: 931321 - RNA, 19 nt, Human
ugagcucuuuuccccagga

SEQ ID NO: 931322 - RNA, 20 nt, Human
uggccucuaacauagagagg

SEQ ID NO: 931323 - RNA, 21 nt, Human
uguuuaugucuauguuaccag

SEQ ID NO: 931324 - RNA, 18 nt, Human
uucaaaguacagaaaaaa

SEQ ID NO: 931325 - RNA, 19 nt, Human
uucauuauacaaacccgcu

SEQ ID NO: 931326 - RNA, 22 nt, Human
uuuugcagaggucccccuuuca

SEQ ID NO: 931327 - RNA, 26 nt, Human
uuuuuuaagucauaccaaaggugaua

SEQ ID NO: 931328 - RNA, 21 nt, Human
aacaagugagaacaugcacaa

SEQ ID NO: 931329 - RNA, 21 nt, Human
aaguucuccccaccacccucc

SEQ ID NO: 931330 - RNA, 24 nt, Human
acaacauuuucuuuauccauuugu

SEQ ID NO: 931331 - RNA, 19 nt, Human
acaagugagaacaugcaca

SEQ ID NO: 931332 - RNA, 18 nt, Human
acccggugguccccggga

SEQ ID NO: 931333 - RNA, 19 nt, Human
accgcuacaccagcagagu

SEQ ID NO: 931334 - RNA, 22 nt, Human
acuaacgugugcacaccuuuca

SEQ ID NO: 931335 - RNA, 26 nt, Human
caaaugacaggaucucagucuuuuuu

SEQ ID NO: 931336 - RNA, 19 nt, Human
cacuuaacauaaugaccuu

SEQ ID NO: 931337 - RNA, 20 nt, Human
cagacacccgaggggcccau

SEQ ID NO: 931338 - RNA, 22 nt, Human
cagacacccgaggggcccaugu

SEQ ID NO: 931339 - RNA, 18 nt, Human
cagcagaguaagacugca

SEQ ID NO: 931340 - RNA, 20 nt, Human
caggagcccgcggugcaggg

SEQ ID NO: 931341 - RNA, 22 nt, Human
caggagcccgcggugcagggug

SEQ ID NO: 931342 - RNA, 21 nt, Human
ccauccucucggccucgaccc

SEQ ID NO: 931343 - RNA, 23 nt, Human
ccccaccacccuccauuccagca

SEQ ID NO: 931344 - RNA, 20 nt, Human
cccucccuccuaugcccuuc

SEQ ID NO: 931345 - RNA, 22 nt, Human
ccuccuaugcccuucuguucag

SEQ ID NO: 931346 - RNA, 20 nt, Human
cuccuacaaacaagugagaa

SEQ ID NO: 931347 - RNA, 20 nt, Human
cuccuacaaacaagugagac

SEQ ID NO: 931348 - RNA, 19 nt, Human
cucggccucgacccggugg

SEQ ID NO: 931349 - RNA, 22 nt, Human
cugcagggcugcggcccucccu

SEQ ID NO: 931350 - RNA, 23 nt, Human
cuucaguuccauccacguuguug

SEQ ID NO: 931351 - RNA, 18 nt, Human
guaagacugcagggcugc

SEQ ID NO: 931352 - RNA, 19 nt, Human
guauaguacuccauuuugu

SEQ ID NO: 931353 - RNA, 20 nt, Human
gugcaggguggggugggagu

SEQ ID NO: 931354 - RNA, 25 nt, Human
uacgaccagaaaacaggacccuaga

SEQ ID NO: 931355 - RNA, 18 nt, Human
uagguuuucaagucuugg

SEQ ID NO: 931356 - RNA, 24 nt, Human
uauugugaauacugcugccauaaa

SEQ ID NO: 931357 - RNA, 19 nt, Human
uccccaccacccuccauuc

SEQ ID NO: 931358 - RNA, 22 nt, Human
ucuccccaccacccuccauucc

SEQ ID NO: 931359 - RNA, 24 nt, Human
ucuugguuauugugaauacugcug

SEQ ID NO: 931360 - RNA, 19 nt, Human
ugacaggaucucagucuuu

SEQ ID NO: 931361 - RNA, 21 nt, Human
uguucagacacccgaggggcc

SEQ ID NO: 931362 - RNA, 24 nt, Human
uucagacacccgaggggcccaugu

SEQ ID NO: 931363 - RNA, 18 nt, Human
uucuccccaccacccucc

SEQ ID NO: 931364 - RNA, 24 nt, Human
uucugugccuggcuuauuucacuu

SEQ ID NO: 931365 - RNA, 21 nt, Human
uuugucuuucugugccuggcu

SEQ ID NO: 931366 - RNA, 18 nt, Human
uuuuuuuuuuuuuuuuug

SEQ ID NO: 931367 - RNA, 23 nt, Human
uuuuuuuuuuuuuuuuugacaag

SEQ ID NO: 931368 - RNA, 23 nt, Human
aaaacaauaauuuggaaaaaccc

SEQ ID NO: 931369 - RNA, 22 nt, Human
aaacaauaauuuggaaaaaccc

SEQ ID NO: 931370 - RNA, 20 nt, Human
aacaaagaauccaaaggcug

SEQ ID NO: 931371 - RNA, 20 nt, Human
aacauagaagaauuucugcc

SEQ ID NO: 931372 - RNA, 23 nt, Human
aagaaaacggugaaagccaucag

SEQ ID NO: 931373 - RNA, 22 nt, Human
aagagacaaaaaagucgcaacc

SEQ ID NO: 931374 - RNA, 23 nt, Human
aagagacaaaaaagucgcaacca

SEQ ID NO: 931375 - RNA, 20 nt, Human
aaggaaaaacuaagagaaug

SEQ ID NO: 931376 - RNA, 19 nt, Human
aagggcuuuaagggagagg

SEQ ID NO: 931377 - RNA, 20 nt, Human
aagugccccgguggggccgg

SEQ ID NO: 931378 - RNA, 23 nt, Human
acauaaucuucucuaaacacuaa

SEQ ID NO: 931379 - RNA, 22 nt, Human
agacaaaaaagucgcaaccaau

SEQ ID NO: 931380 - RNA, 21 nt, Human
agauggucagugguuuuaagc

SEQ ID NO: 931381 - RNA, 19 nt, Human
agcucugggcagaggggcc

SEQ ID NO: 931382 - RNA, 19 nt, Human
agcucugggcagaggggcc

SEQ ID NO: 931383 - RNA, 18 nt, Human
aggaggcucaagccuguc

SEQ ID NO: 931384 - RNA, 23 nt, Human
aggcagaacauagaagaagggac

SEQ ID NO: 931385 - RNA, 22 nt, Human
aggcaggagcgaaugggcaagg

SEQ ID NO: 931386 - RNA, 21 nt, Human
agggcuuuaagggagaggaga

SEQ ID NO: 931387 - RNA, 23 nt, Human
agggugaaggugcugagggcugg

SEQ ID NO: 931388 - RNA, 21 nt, Human
aggugcugagggcuggaggcu

SEQ ID NO: 931389 - RNA, 24 nt, Human
aggugcugagggcuggaggcucag

SEQ ID NO: 931390 - RNA, 24 nt, Human
aggugggccuggggcucgcugagu

SEQ ID NO: 931391 - RNA, 18 nt, Human
aggugguggcaggggccu

SEQ ID NO: 931392 - RNA, 24 nt, Human
agugugaaaaugaucacaauacac

SEQ ID NO: 931393 - RNA, 23 nt, Human
aucuucucuaaacacuaaugcca

SEQ ID NO: 931394 - RNA, 19 nt, Human
auguuuuaguaccuguaau

SEQ ID NO: 931395 - RNA, 20 nt, Human
auuuggcccagacugaggca

SEQ ID NO: 931396 - RNA, 18 nt, Human
caacggaacaggccacuc

SEQ ID NO: 931397 - RNA, 18 nt, Human
caacggagcaggccacuc

SEQ ID NO: 931398 - RNA, 22 nt, Human
cacacagccauauauacauaau

SEQ ID NO: 931399 - RNA, 18 nt, Human
cagugggaagugccccgg

SEQ ID NO: 931400 - RNA, 24 nt, Human
cauaaacacugucccuccaccgaa

SEQ ID NO: 931401 - RNA, 22 nt, Human
cauagaagaauuucugccaggu

SEQ ID NO: 931402 - RNA, 20 nt, Human
ccaggaaccagguccacgcu

SEQ ID NO: 931403 - RNA, 19 nt, Human
cccacucauggucccagac

SEQ ID NO: 931404 - RNA, 24 nt, Human
cccagggagaaggcaggagcgaau

SEQ ID NO: 931405 - RNA, 19 nt, Human
ccccaggaaccagguccac

SEQ ID NO: 931406 - RNA, 21 nt, Human
ccccaugcugucuggaggacc

SEQ ID NO: 931407 - RNA, 19 nt, Human
cccccaggaaccaggucca

SEQ ID NO: 931408 - RNA, 23 nt, Human
cccgcacgcggccaucuuggcca

SEQ ID NO: 931409 - RNA, 24 nt, Human
cccucaaaagcacguggagaagga

SEQ ID NO: 931410 - RNA, 20 nt, Human
ccucugcucucuggcggggc

SEQ ID NO: 931411 - RNA, 18 nt, Human
ccugaaaacugcagauac

SEQ ID NO: 931412 - RNA, 20 nt, Human
cgaucgcccccaggaaccag

SEQ ID NO: 931413 - RNA, 30 nt, Human
cgggaucauaaacacugucccuccaccgag

SEQ ID NO: 931414 - RNA, 18 nt, Human
cucugcucagcggccuag

SEQ ID NO: 931415 - RNA, 18 nt, Human
cucugcucagcggccuag

SEQ ID NO: 931416 - RNA, 23 nt, Human
cugaccuuuaaaggcagaacaua

SEQ ID NO: 931417 - RNA, 22 nt, Human
cugggugugcucagaggcucau

SEQ ID NO: 931418 - RNA, 21 nt, Human
cuuggagccgggcagcaggcu

SEQ ID NO: 931419 - RNA, 21 nt, Human
cuuuaagggagaggagaggug

SEQ ID NO: 931420 - RNA, 18 nt, Human
gaaacuggggagaagcau

SEQ ID NO: 931421 - RNA, 22 nt, Human
gagaagcaugccuccugucccc

SEQ ID NO: 931422 - RNA, 21 nt, Human
gaggaccaaggaggcucaagc

SEQ ID NO: 931423 - RNA, 20 nt, Human
gccaggaaggauucagacac

SEQ ID NO: 931424 - RNA, 19 nt, Human
gccuaaguuuagagucugu

SEQ ID NO: 931425 - RNA, 24 nt, Human
gcuuuaagggagaggagagguggg

SEQ ID NO: 931426 - RNA, 19 nt, Human
ggaaaaacccaugaaggua

SEQ ID NO: 931427 - RNA, 21 nt, Human
ggagccgggcagcaggcuggg

SEQ ID NO: 931428 - RNA, 25 nt, Human
ggcagcaggcggccgccaggaagga

SEQ ID NO: 931429 - RNA, 24 nt, Human
ggccugggcgucgggcuuccucug

SEQ ID NO: 931430 - RNA, 19 nt, Human
ggcgucgggcuuccucugc

SEQ ID NO: 931431 - RNA, 19 nt, Human
gggcagcaggcggccgccc

SEQ ID NO: 931432 - RNA, 24 nt, Human
gggcuggaggcucaggagguggug

SEQ ID NO: 931433 - RNA, 20 nt, Human
ggugcugagggcuggaggcu

SEQ ID NO: 931434 - RNA, 19 nt, Human
gucgcaaccaauugaagau

SEQ ID NO: 931435 - RNA, 22 nt, Human
guuaauaaaaaaaaaaaaaaaa

SEQ ID NO: 931436 - RNA, 18 nt, Human
uaagggagaggagaggug

SEQ ID NO: 931437 - RNA, 23 nt, Human
uagagugaggcacauuuuccacu

SEQ ID NO: 931438 - RNA, 24 nt, Human
ucccacucauggucccagacacuu

SEQ ID NO: 931439 - RNA, 21 nt, Human
uccuucccacucaugguccca

SEQ ID NO: 931440 - RNA, 22 nt, Human
ugaaaaguauuugccucuggaa

SEQ ID NO: 931441 - RNA, 24 nt, Human
ugaugggugacuggcgaucgcccc

SEQ ID NO: 931442 - RNA, 22 nt, Human
ugccucuggaaagaacaacugg

SEQ ID NO: 931443 - RNA, 19 nt, Human
ugccugggagugagggcuc

SEQ ID NO: 931444 - RNA, 19 nt, Human
ugccugggagugagggcuc

SEQ ID NO: 931445 - RNA, 18 nt, Human
uggaaagaacaacuggca

SEQ ID NO: 931446 - RNA, 18 nt, Human
uggcccagacugaggcag

SEQ ID NO: 931447 - RNA, 22 nt, Human
ugggaagugccccgguggggcc

SEQ ID NO: 931448 - RNA, 20 nt, Human
ugguguggggguagaaccgc

SEQ ID NO: 931449 - RNA, 18 nt, Human
uguacuuaaccauuuuca

SEQ ID NO: 931450 - RNA, 21 nt, Human
ugucuggaggaccaaggaggc

SEQ ID NO: 931451 - RNA, 18 nt, Human
uucaagguggugugaaaa

SEQ ID NO: 931452 - RNA, 26 nt, Human
uucacacagccauauauacauaaucu

SEQ ID NO: 931453 - RNA, 22 nt, Human
uugacccucuggaaugccagaa

SEQ ID NO: 931454 - RNA, 24 nt, Human
uuggcccagacugaggcagauggg

SEQ ID NO: 931455 - RNA, 22 nt, Human
uuuagagucuguucaagguggu

SEQ ID NO: 931456 - RNA, 22 nt, Human
uuucccucaaaagcacguggaa

SEQ ID NO: 931457 - RNA, 20 nt, Human
aaaacacccaggacacuucu

SEQ ID NO: 931458 - RNA, 22 nt, Human
aaacacccuuacccaugccccu

SEQ ID NO: 931459 - RNA, 23 nt, Human
aaagacccucgacgcccccaccu

SEQ ID NO: 931460 - RNA, 19 nt, Human
aacaugauuaaaaacaccc

SEQ ID NO: 931461 - RNA, 24 nt, Human
aacauucaaacaugauuaaaaaca

SEQ ID NO: 931462 - RNA, 20 nt, Human
aaccuacuuccuuaaagcug

SEQ ID NO: 931463 - RNA, 20 nt, Human
aaccuucuccaauccuaucg

SEQ ID NO: 931464 - RNA, 19 nt, Human
aagggaggaggaggcagag

SEQ ID NO: 931465 - RNA, 23 nt, Human
acacaaaccuucuccaauccuau

SEQ ID NO: 931466 - RNA, 18 nt, Human
acagcagacauaaucccc

SEQ ID NO: 931467 - RNA, 20 nt, Human
acccuaaagacccagacaug

SEQ ID NO: 931468 - RNA, 20 nt, Human
acucuggccagagauaggga

SEQ ID NO: 931469 - RNA, 18 nt, Human
agacauaauccccacccc

SEQ ID NO: 931470 - RNA, 20 nt, Human
agacccagacaugacagcag

SEQ ID NO: 931471 - RNA, 21 nt, Human
agaccuggcaggccuggcuga

SEQ ID NO: 931472 - RNA, 22 nt, Human
agccaaagccagugagaggacg

SEQ ID NO: 931473 - RNA, 20 nt, Human
aggaggaggcagagagcuuu

SEQ ID NO: 931474 - RNA, 21 nt, Human
aggccuggcugacaggucugu

SEQ ID NO: 931475 - RNA, 18 nt, Human
agggaggaggaggcagag

SEQ ID NO: 931476 - RNA, 21 nt, Human
agggaggaggaggcagagagc

SEQ ID NO: 931477 - RNA, 19 nt, Human
auaccagggucuccugaga

SEQ ID NO: 931478 - RNA, 22 nt, Human
caaccuacuuccuuaaagcugu

SEQ ID NO: 931479 - RNA, 24 nt, Human
caacuaccaaggcgucgggaacac

SEQ ID NO: 931480 - RNA, 24 nt, Human
caagagguucacccuauauggggc

SEQ ID NO: 931481 - RNA, 18 nt, Human
cacaugaagccuugugga

SEQ ID NO: 931482 - RNA, 21 nt, Human
caggccuggcugacaggucug

SEQ ID NO: 931483 - RNA, 24 nt, Human
cagguaaccucucugaccgaccaa

SEQ ID NO: 931484 - RNA, 18 nt, Human
ccaggacacuucucuugc

SEQ ID NO: 931485 - RNA, 24 nt, Human
ccaggacacuucucuugcuggcag

SEQ ID NO: 931486 - RNA, 25 nt, Human
ccagugauuccuccaaacauucccc

SEQ ID NO: 931487 - RNA, 19 nt, Human
ccccggacuggggagcggg

SEQ ID NO: 931488 - RNA, 21 nt, Human
ccccuagagaccucaggaaga

SEQ ID NO: 931489 - RNA, 21 nt, Human
ccuacccuaaagacccagaca

SEQ ID NO: 931490 - RNA, 23 nt, Human
ccuacccuaaagacccagacaug

SEQ ID NO: 931491 - RNA, 19 nt, Human
ccuccugucaccuccuugg

SEQ ID NO: 931492 - RNA, 22 nt, Human
ccuccuuggguuuggugaaagc

SEQ ID NO: 931493 - RNA, 26 nt, Human
ccugccaaacucuggccagagauagg

SEQ ID NO: 931494 - RNA, 19 nt, Human
ccuuacccaugccccuccc

SEQ ID NO: 931495 - RNA, 21 nt, Human
cgggagggguguugggcggug

SEQ ID NO: 931496 - RNA, 26 nt, Human
cucaaagacccucgacgcccccaccu

SEQ ID NO: 931497 - RNA, 18 nt, Human
cuccuccugucaccuccu

SEQ ID NO: 931498 - RNA, 18 nt, Human
cugaggaaacacccuuac

SEQ ID NO: 931499 - RNA, 18 nt, Human
cuuguggagacuccugcc

SEQ ID NO: 931500 - RNA, 21 nt, Human
gaaacacccuuacccaugccc

SEQ ID NO: 931501 - RNA, 20 nt, Human
gaaagggaggaggaggcaga

SEQ ID NO: 931502 - RNA, 22 nt, Human
gagaaucuuccagggcucagcu

SEQ ID NO: 931503 - RNA, 20 nt, Human
gaggaaacacccuuacccau

SEQ ID NO: 931504 - RNA, 24 nt, Human
gcaaagcgugcucuagaaauaccc

SEQ ID NO: 931505 - RNA, 21 nt, Human
gcaugaagggaccuucccaga

SEQ ID NO: 931506 - RNA, 21 nt, Human
gccacaccccagauaauggca

SEQ ID NO: 931507 - RNA, 20 nt, Human
gcucagcugaggcucagagc

SEQ ID NO: 931508 - RNA, 19 nt, Human
ggacuggggagcgggaggg

SEQ ID NO: 931509 - RNA, 21 nt, Human
ggacuggggagcgggaggggu

SEQ ID NO: 931510 - RNA, 20 nt, Human
ggagccaaagccagugagag

SEQ ID NO: 931511 - RNA, 30 nt, Human
ggagccaaagccagugagaggacgaaggaa

SEQ ID NO: 931512 - RNA, 19 nt, Human
ggagcgggagggguguugg

SEQ ID NO: 931513 - RNA, 20 nt, Human
ggaggcagagagcuuaucaa

SEQ ID NO: 931514 - RNA, 20 nt, Human
ggccuggcugacaggucugu

SEQ ID NO: 931515 - RNA, 20 nt, Human
gggaacacaaaccuucucca

SEQ ID NO: 931516 - RNA, 19 nt, Human
gggcagggccugcccuaua

SEQ ID NO: 931517 - RNA, 20 nt, Human
guaaccucucugaccgacca

SEQ ID NO: 931518 - RNA, 21 nt, Human
uaauggcaguccugccaaacu

SEQ ID NO: 931519 - RNA, 24 nt, Human
uacccaugccccuccccuagagac

SEQ ID NO: 931520 - RNA, 20 nt, Human
uacccuaaagacccagacau

SEQ ID NO: 931521 - RNA, 20 nt, Human
ucacccuauauggggcugga

SEQ ID NO: 931522 - RNA, 19 nt, Human
ucccagagggcagggccug

SEQ ID NO: 931523 - RNA, 21 nt, Human
ucccagagggcagggccugcc

SEQ ID NO: 931524 - RNA, 18 nt, Human
uccuccugucaccuccuu

SEQ ID NO: 931525 - RNA, 19 nt, Human
ucggggcugagaucccuuu

SEQ ID NO: 931526 - RNA, 24 nt, Human
ucucugaccgaccaaucgaaaucc

SEQ ID NO: 931527 - RNA, 21 nt, Human
ucucuugcuggcagaggccac

SEQ ID NO: 931528 - RNA, 27 nt, Human
ugaaagcaaagcgugcucuagaaauac

SEQ ID NO: 931529 - RNA, 20 nt, Human
ugaagggaccuucccagagg

SEQ ID NO: 931530 - RNA, 21 nt, Human
ugagaggacgaaggaguccua

SEQ ID NO: 931531 - RNA, 20 nt, Human
ugauuccuccaaacauuccc

SEQ ID NO: 931532 - RNA, 26 nt, Human
ugcgggggcuccuccugucaccuccu

SEQ ID NO: 931533 - RNA, 24 nt, Human
uggcaggccuggcugacaggucug

SEQ ID NO: 931534 - RNA, 23 nt, Human
uggcaguccugccaaacucuggc

SEQ ID NO: 931535 - RNA, 25 nt, Human
uggccagagauagggacccaagcug

SEQ ID NO: 931536 - RNA, 21 nt, Human
uucacccuauauggggcugga

SEQ ID NO: 931537 - RNA, 18 nt, Human
uuccagggcucagcugag

SEQ ID NO: 931538 - RNA, 24 nt, Human
aagcgcuugacacuggccaccacc

SEQ ID NO: 931539 - RNA, 21 nt, Human
agccgaauauuauacagacug

SEQ ID NO: 931540 - RNA, 21 nt, Human
aucacagcuaagagagcagca

SEQ ID NO: 931541 - RNA, 23 nt, Human
aucacucuccaucacauagaucc

SEQ ID NO: 931542 - RNA, 21 nt, Human
aucuuccuccagcccucggcg

SEQ ID NO: 931543 - RNA, 22 nt, Human
caauaauagugaaucacagcua

SEQ ID NO: 931544 - RNA, 22 nt, Human
cagaaaggugcucucgucgaua

SEQ ID NO: 931545 - RNA, 24 nt, Human
cagcaguuccuuucccgagguauu

SEQ ID NO: 931546 - RNA, 19 nt, Human
caucugcucugggcaauaa

SEQ ID NO: 931547 - RNA, 20 nt, Human
ccaacaacgggaaguagggu

SEQ ID NO: 931548 - RNA, 21 nt, Human
ccagaacaccauggcauccuc

SEQ ID NO: 931549 - RNA, 22 nt, Human
ccggcggggccuccaucuuccu

SEQ ID NO: 931550 - RNA, 21 nt, Human
ccuccaacaacgggaaguagg

SEQ ID NO: 931551 - RNA, 23 nt, Human
cggcuuaaugugcuccugcucau

SEQ ID NO: 931552 - RNA, 20 nt, Human
cucggccguaggccuuggcc

SEQ ID NO: 931553 - RNA, 24 nt, Human
cugaacguugagaagcgcuugaca

SEQ ID NO: 931554 - RNA, 21 nt, Human
cugaaggcagcaguuccuuuc

SEQ ID NO: 931555 - RNA, 19 nt, Human
cugaggucggacucuguca

SEQ ID NO: 931556 - RNA, 24 nt, Human
cugcagguuggcggcgaucuuggc

SEQ ID NO: 931557 - RNA, 24 nt, Human
cuggaugacagacuggugucccug

SEQ ID NO: 931558 - RNA, 25 nt, Human
cugguccccuuucaggaugaggcuu

SEQ ID NO: 931559 - RNA, 18 nt, Human
gaaguucuuucgaggcac

SEQ ID NO: 931560 - RNA, 18 nt, Human
gagagcagcaccaucacu

SEQ ID NO: 931561 - RNA, 19 nt, Human
gagcagcaccaucacugcc

SEQ ID NO: 931562 - RNA, 21 nt, Human
gcggggccuccaucuuccucc

SEQ ID NO: 931563 - RNA, 22 nt, Human
gcugaaggcagcaguuccuuuc

SEQ ID NO: 931564 - RNA, 23 nt, Human
ggccaccaccuucucgaugcuga

SEQ ID NO: 931565 - RNA, 22 nt, Human
ggccuccaucuuccuccagccc

SEQ ID NO: 931566 - RNA, 23 nt, Human
ggccuccaucuuccuccagcccu

SEQ ID NO: 931567 - RNA, 18 nt, Human
gggcauccaccauugcca

SEQ ID NO: 931568 - RNA, 21 nt, Human
gggucucugagguccucaggg

SEQ ID NO: 931569 - RNA, 22 nt, Human
guagaaagggucucugaggucc

SEQ ID NO: 931570 - RNA, 22 nt, Human
uaacuucuuucucuguuaucuc

SEQ ID NO: 931571 - RNA, 19 nt, Human
uaagauauucauuggagaa

SEQ ID NO: 931572 - RNA, 20 nt, Human
uagcggaccuuuugaugagc

SEQ ID NO: 931573 - RNA, 19 nt, Human
ucagaaaggugcucucguc

SEQ ID NO: 931574 - RNA, 20 nt, Human
ucagggauguuaucucggcc

SEQ ID NO: 931575 - RNA, 21 nt, Human
ucaucuccacaguguaggcca

SEQ ID NO: 931576 - RNA, 21 nt, Human
uccaucuuccuccagcccucg

SEQ ID NO: 931577 - RNA, 21 nt, Human
ucuccaucacauagaucccuu

SEQ ID NO: 931578 - RNA, 21 nt, Human
ugccaugugggcacucauuuu

SEQ ID NO: 931579 - RNA, 19 nt, Human
uucucgaugcugaucaucu

SEQ ID NO: 931580 - RNA, 20 nt, Human
aaaaaacaauagcaagagca

SEQ ID NO: 931581 - RNA, 19 nt, Human
aaaaacaauagcaagagcc

SEQ ID NO: 931582 - RNA, 18 nt, Human
aaaguggauggaugaagc

SEQ ID NO: 931583 - RNA, 24 nt, Human
aaauacaugcuucgagcaaauaug

SEQ ID NO: 931584 - RNA, 19 nt, Human
aacagauuucacacauauu

SEQ ID NO: 931585 - RNA, 23 nt, Human
aagaagcagaggaaaugugcucc

SEQ ID NO: 931586 - RNA, 21 nt, Human
acaguuugugaaguuugucua

SEQ ID NO: 931587 - RNA, 18 nt, Human
agaaagcucagaaacaga

SEQ ID NO: 931588 - RNA, 21 nt, Human
agaaagcucagaaacagauuu

SEQ ID NO: 931589 - RNA, 18 nt, Human
agaagcugcaaaguggau

SEQ ID NO: 931590 - RNA, 24 nt, Human
auauaaagaguaugcuauacuuua

SEQ ID NO: 931591 - RNA, 23 nt, Human
auccaucccuuuucccuccuuca

SEQ ID NO: 931592 - RNA, 19 nt, Human
aucccuuuucccuccuuca

SEQ ID NO: 931593 - RNA, 21 nt, Human
augauaaaagaagcagaggaa

SEQ ID NO: 931594 - RNA, 28 nt, Human
caucccuuuucccuccuucccucugaag

SEQ ID NO: 931595 - RNA, 18 nt, Human
cccagagauacuguaaaa

SEQ ID NO: 931596 - RNA, 25 nt, Human
cccuccuucaccaucccuuuauauc

SEQ ID NO: 931597 - RNA, 24 nt, Human
cccuuuucccuccuucaccauccc

SEQ ID NO: 931598 - RNA, 18 nt, Human
ccuccaauaucccucucu

SEQ ID NO: 931599 - RNA, 19 nt, Human
ccuccaauaucccucucug

SEQ ID NO: 931600 - RNA, 22 nt, Human
ccuccaauaucccucucuguca

SEQ ID NO: 931601 - RNA, 24 nt, Human
cuccuucaccaucccuuuauaucc

SEQ ID NO: 931602 - RNA, 20 nt, Human
gaugaagcacagucuuugga

SEQ ID NO: 931603 - RNA, 22 nt, Human
gcuccaaguucacaaggguagg

SEQ ID NO: 931604 - RNA, 22 nt, Human
guaaaaaucagagaugaaaaua

SEQ ID NO: 931605 - RNA, 22 nt, Human
uaaaagaagcagaggaaaugug

SEQ ID NO: 931606 - RNA, 21 nt, Human
uaagacaguuugugaaguuug

SEQ ID NO: 931607 - RNA, 19 nt, Human
uacaugcuucgagcaaaua

SEQ ID NO: 931608 - RNA, 27 nt, Human
uauccuaagaaugguuucuuacugugg

SEQ ID NO: 931609 - RNA, 25 nt, Human
ucacacauauuuggaaaaugggauu

SEQ ID NO: 931610 - RNA, 24 nt, Human
ucauuugagcucuuaguaaaugug

SEQ ID NO: 931611 - RNA, 25 nt, Human
uccuuugucccccuaguaauuugug

SEQ ID NO: 931612 - RNA, 23 nt, Human
ugagaugggcuacacauccaucc

SEQ ID NO: 931613 - RNA, 21 nt, Human
ugcugggacaauuaguuacuc

SEQ ID NO: 931614 - RNA, 24 nt, Human
uggcaggggaugguuaaaaaacaa

SEQ ID NO: 931615 - RNA, 22 nt, Human
ugguacauauauaaagaguaug

SEQ ID NO: 931616 - RNA, 22 nt, Human
uuaaaaaacaauagcaagagca

SEQ ID NO: 931617 - RNA, 20 nt, Human
uucaccaucccuuuauaucc

SEQ ID NO: 931618 - RNA, 23 nt, Human
uucaccaucccuuuauauccuuu

SEQ ID NO: 931619 - RNA, 22 nt, Human
uugucuaaauuaagacaguuug

SEQ ID NO: 931620 - RNA, 22 nt, Human
uugucuaaauuaagacaguuug

SEQ ID NO: 931621 - RNA, 24 nt, Human
uuuccacauaaacuuucuguuaua

SEQ ID NO: 931622 - RNA, 21 nt, Human
aaacccagaggcuugugggga

SEQ ID NO: 931623 - RNA, 18 nt, Human
aagaaugguuggcugcuu

SEQ ID NO: 931624 - RNA, 22 nt, Human
aagauccacaaaagaaaugaaa

SEQ ID NO: 931625 - RNA, 20 nt, Human
aagccaauuucaguuuuugg

SEQ ID NO: 931626 - RNA, 20 nt, Human
acaaccugccacuuuuaauc

SEQ ID NO: 931627 - RNA, 19 nt, Human
agaaacagaagccaauuuc

SEQ ID NO: 931628 - RNA, 24 nt, Human
agcaacugaagauccacaaaagaa

SEQ ID NO: 931629 - RNA, 19 nt, Human
aggugucaggccucugaac

SEQ ID NO: 931630 - RNA, 20 nt, Human
augguaguggcgauggcagu

SEQ ID NO: 931631 - RNA, 22 nt, Human
cagaaacagaagccaauuucag

SEQ ID NO: 931632 - RNA, 18 nt, Human
cauccagauggccugaag

SEQ ID NO: 931633 - RNA, 20 nt, Human
ccugugaccugcauguauac

SEQ ID NO: 931634 - RNA, 19 nt, Human
cuuguggggagaaagggcu

SEQ ID NO: 931635 - RNA, 20 nt, Human
gccuggaccaacucagaaac

SEQ ID NO: 931636 - RNA, 22 nt, Human
gcgauggcagugaggacagacu

SEQ ID NO: 931637 - RNA, 27 nt, Human
ggcagugaggacagacugguaaaggga

SEQ ID NO: 931638 - RNA, 24 nt, Human
gguaaagggaaaacccagaggcuu

SEQ ID NO: 931639 - RNA, 25 nt, Human
guaaagggaaaacccagaggcuugg

SEQ ID NO: 931640 - RNA, 18 nt, Human
guggggagaaagggcuuu

SEQ ID NO: 931641 - RNA, 19 nt, Human
uaaagggaaaacccagagg

SEQ ID NO: 931642 - RNA, 24 nt, Human
uaaaucuuccacauuuggcagccu

SEQ ID NO: 931643 - RNA, 24 nt, Human
uaugaaauccaggcugguuuugga

SEQ ID NO: 931644 - RNA, 19 nt, Human
uauucccugugaccugcau

SEQ ID NO: 931645 - RNA, 21 nt, Human
ucaggccucugaacccaagcu

SEQ ID NO: 931646 - RNA, 24 nt, Human
uccacaaaagaaaugaaaauagcc

SEQ ID NO: 931647 - RNA, 21 nt, Human
ugcacaaccugccacuuuuaa

SEQ ID NO: 931648 - RNA, 18 nt, Human
uggcagccugagguguca

SEQ ID NO: 931649 - RNA, 23 nt, Human
uggcagccugaggugucaggccu

SEQ ID NO: 931650 - RNA, 25 nt, Human
uggcagugaggacagacugguaaag

SEQ ID NO: 931651 - RNA, 25 nt, Human
uggcgauggcagugaggacagacug

SEQ ID NO: 931652 - RNA, 19 nt, Human
uuggauguuaacauggagc

SEQ ID NO: 931653 - RNA, 24 nt, Human
uuuuuuuuuuuuuuuuuuaacaug

SEQ ID NO: 931654 - RNA, 21 nt, Human
aaagaugguccucaaugaacc

SEQ ID NO: 931655 - RNA, 24 nt, Human
acaaaacacaaauaaucaacugaa

SEQ ID NO: 931656 - RNA, 21 nt, Human
acuuacugucuuggcugcugg

SEQ ID NO: 931657 - RNA, 23 nt, Human
aggagagggaauuuuaaaaauau

SEQ ID NO: 931658 - RNA, 23 nt, Human
auaaaauaagcauaagaguaguc

SEQ ID NO: 931659 - RNA, 20 nt, Human
auucugaaauaaggaguagc

SEQ ID NO: 931660 - RNA, 18 nt, Human
caaugaaccaugccuccc

SEQ ID NO: 931661 - RNA, 19 nt, Human
cauuuggaaaagugguuuc

SEQ ID NO: 931662 - RNA, 22 nt, Human
ccacacagccacgcugaucacc

SEQ ID NO: 931663 - RNA, 25 nt, Human
cgcugaucacccuuuucuuccuuug

SEQ ID NO: 931664 - RNA, 22 nt, Human
cuaugagccaagaggagaggga

SEQ ID NO: 931665 - RNA, 24 nt, Human
gccaagaggagagggaauuuuaaa

SEQ ID NO: 931666 - RNA, 18 nt, Human
gcugaucacccuuuucuu

SEQ ID NO: 931667 - RNA, 23 nt, Human
ggauaacaaaauaaggauguaau

SEQ ID NO: 931668 - RNA, 21 nt, Human
gugaugugaaaugacagaaua

SEQ ID NO: 931669 - RNA, 18 nt, Human
uaaaacaacagcuccaua

SEQ ID NO: 931670 - RNA, 24 nt, Human
uaaaacaacagcuccauagggucc

SEQ ID NO: 931671 - RNA, 19 nt, Human
uaaaauaagcauaagagua

SEQ ID NO: 931672 - RNA, 18 nt, Human
uaaaauagaucaggaaac

SEQ ID NO: 931673 - RNA, 21 nt, Human
uaaagcaauuuguuuagagua

SEQ ID NO: 931674 - RNA, 20 nt, Human
uaaggauguaauguaaccau

SEQ ID NO: 931675 - RNA, 19 nt, Human
uacugaccacacagccacg

SEQ ID NO: 931676 - RNA, 20 nt, Human
uagcaagucgacaaagaugg

SEQ ID NO: 931677 - RNA, 22 nt, Human
uaucuuacaaaucuugccaaau

SEQ ID NO: 931678 - RNA, 24 nt, Human
ucacugaaauuugguugacucaaa

SEQ ID NO: 931679 - RNA, 23 nt, Human
ucacuuacugucuuggcugcugg

SEQ ID NO: 931680 - RNA, 18 nt, Human
ucccaaaggcuaauacuu

SEQ ID NO: 931681 - RNA, 21 nt, Human
uccugacagauauuauugaag

SEQ ID NO: 931682 - RNA, 20 nt, Human
ugaaaucaaggggaucuuca

SEQ ID NO: 931683 - RNA, 19 nt, Human
ugaagugauuuguuuucug

SEQ ID NO: 931684 - RNA, 23 nt, Human
ugaagugauuuguuuucuguuuu

SEQ ID NO: 931685 - RNA, 19 nt, Human
ugauacaauacaacauuuu

SEQ ID NO: 931686 - RNA, 22 nt, Human
ugauacaauacaacauuuuaaa

SEQ ID NO: 931687 - RNA, 27 nt, Human
ugcacuaaauuaguucuaauuuacucc

SEQ ID NO: 931688 - RNA, 22 nt, Human
ugguaagugcaacaaugaggac

SEQ ID NO: 931689 - RNA, 20 nt, Human
uuaaaacaacagcuccauag

SEQ ID NO: 931690 - RNA, 20 nt, Human
uuaacacugguuuaaaguca

SEQ ID NO: 931691 - RNA, 24 nt, Human
uuggcugcuggaugaaaucaaggg

SEQ ID NO: 931692 - RNA, 21 nt, Human
uugugacaucacagcuccacc

SEQ ID NO: 931693 - RNA, 18 nt, Human
aaaagaaacugaucaaaa

SEQ ID NO: 931694 - RNA, 21 nt, Human
aaacaaacacccagcaacaac

SEQ ID NO: 931695 - RNA, 25 nt, Human
aaacaaacacccagcaacaacccuc

SEQ ID NO: 931696 - RNA, 26 nt, Human
aaacaaacacccagcaacaacccucg

SEQ ID NO: 931697 - RNA, 20 nt, Human
aaacacccagcaacaacccu

SEQ ID NO: 931698 - RNA, 22 nt, Human
aagagagcaucucccuguagcc

SEQ ID NO: 931699 - RNA, 22 nt, Human
aauguuuccugaaaagaaacug

SEQ ID NO: 931700 - RNA, 20 nt, Human
acaaagcaacccaacuacuc

SEQ ID NO: 931701 - RNA, 23 nt, Human
agaaacugaucaaaacguuugaa

SEQ ID NO: 931702 - RNA, 21 nt, Human
agaaguggcaaacgguuacaa

SEQ ID NO: 931703 - RNA, 22 nt, Human
auaaaauaacugugugaaaagc

SEQ ID NO: 931704 - RNA, 22 nt, Human
aucacuuagcucaggaaacaaa

SEQ ID NO: 931705 - RNA, 20 nt, Human
caaagcaacccaacuacucc

SEQ ID NO: 931706 - RNA, 24 nt, Human
caaagccaguaggccuacauaugg

SEQ ID NO: 931707 - RNA, 19 nt, Human
caacaacccucguaucuca

SEQ ID NO: 931708 - RNA, 18 nt, Human
caacccaacuacuccagc

SEQ ID NO: 931709 - RNA, 23 nt, Human
caacccaacuacuccagcuacac

SEQ ID NO: 931710 - RNA, 22 nt, Human
caaucuguggcccucacugacu

SEQ ID NO: 931711 - RNA, 23 nt, Human
caaugcccaggagccucucaaag

SEQ ID NO: 931712 - RNA, 23 nt, Human
cacaaagcaacccaacuacucca

SEQ ID NO: 931713 - RNA, 22 nt, Human
cacccucaaacccaaaugauuc

SEQ ID NO: 931714 - RNA, 18 nt, Human
cacuuagcucaggaaaca

SEQ ID NO: 931715 - RNA, 18 nt, Human
caggaaacaaacacccag

SEQ ID NO: 931716 - RNA, 23 nt, Human
caucccccacgguuuaaaccuaa

SEQ ID NO: 931717 - RNA, 24 nt, Human
caugacucaaaauaacacacccuc

SEQ ID NO: 931718 - RNA, 20 nt, Human
cccaccuacgaaaaaaaggu

SEQ ID NO: 931719 - RNA, 24 nt, Human
cccccuauugcuacaguucugccc

SEQ ID NO: 931720 - RNA, 18 nt, Human
cgcuucauccgcugcuug

SEQ ID NO: 931721 - RNA, 20 nt, Human
cuacauaugaaacgcaaagg

SEQ ID NO: 931722 - RNA, 24 nt, Human
gagccaagcucugauaggaaaagc

SEQ ID NO: 931723 - RNA, 21 nt, Human
gcugcaacuccacuacagucu

SEQ ID NO: 931724 - RNA, 18 nt, Human
ggaaaagcccaccuacga

SEQ ID NO: 931725 - RNA, 19 nt, Human
ggaaacaaacacccagcaa

SEQ ID NO: 931726 - RNA, 22 nt, Human
ggaugucaggucgaagcaauuc

SEQ ID NO: 931727 - RNA, 25 nt, Human
uaacacaaagcaacccaacuacucc

SEQ ID NO: 931728 - RNA, 20 nt, Human
uaacacacaucacacuguuu

SEQ ID NO: 931729 - RNA, 19 nt, Human
uaacacacccucaaaccca

SEQ ID NO: 931730 - RNA, 19 nt, Human
uacacaaagccaguaggcc

SEQ ID NO: 931731 - RNA, 24 nt, Human
uacauucaugacucaaaauaacac

SEQ ID NO: 931732 - RNA, 23 nt, Human
uaggaaaagcccaccuacgaaaa

SEQ ID NO: 931733 - RNA, 25 nt, Human
ucaaacccaaaugauucuaaagcca

SEQ ID NO: 931734 - RNA, 22 nt, Human
uccuccuaacacaaagcaaccc

SEQ ID NO: 931735 - RNA, 21 nt, Human
ucugaagaaguggcaaacggu

SEQ ID NO: 931736 - RNA, 25 nt, Human
ugaaaagaaacugaucaaaacguuu

SEQ ID NO: 931737 - RNA, 22 nt, Human
ugaccaagccuuggcaaaaguc

SEQ ID NO: 931738 - RNA, 19 nt, Human
ugcaacuccacuacagucu

SEQ ID NO: 931739 - RNA, 21 nt, Human
ugugaaaagccauggccuuca

SEQ ID NO: 931740 - RNA, 22 nt, Human
uuccaaaagcugagaaaacgcu

SEQ ID NO: 931741 - RNA, 21 nt, Human
agacagggacauggcagggga

SEQ ID NO: 931742 - RNA, 18 nt, Human
agagcgggaagacaggca

SEQ ID NO: 931743 - RNA, 23 nt, Human
agcaaggaggcugcaggggcucg

SEQ ID NO: 931744 - RNA, 23 nt, Human
agggcuggagagcgggaagacag

SEQ ID NO: 931745 - RNA, 21 nt, Human
aggggacacaggacagagggg

SEQ ID NO: 931746 - RNA, 21 nt, Human
aguugcagcaggacgucacca

SEQ ID NO: 931747 - RNA, 19 nt, Human
caccgcaauucauuuagua

SEQ ID NO: 931748 - RNA, 21 nt, Human
ccacgggaggggggccccggg

SEQ ID NO: 931749 - RNA, 22 nt, Human
ccuaugccggagccucgagggc

SEQ ID NO: 931750 - RNA, 21 nt, Human
ccucacccaccgcaauucauu

SEQ ID NO: 931751 - RNA, 21 nt, Human
ccucgagggcuggagagcggg

SEQ ID NO: 931752 - RNA, 19 nt, Human
cggagccucgagggcugga

SEQ ID NO: 931753 - RNA, 21 nt, Human
gcggagagggcccacagugga

SEQ ID NO: 931754 - RNA, 21 nt, Human
ggcacaggggcagcuccggca

SEQ ID NO: 931755 - RNA, 19 nt, Human
ggcccacaguggacuuggu

SEQ ID NO: 931756 - RNA, 18 nt, Human
gucccacgaggcacugcg

SEQ ID NO: 931757 - RNA, 21 nt, Human
uaccccaggccugggucagac

SEQ ID NO: 931758 - RNA, 23 nt, Human
uaugccggagccucgagggcugg

SEQ ID NO: 931759 - RNA, 24 nt, Human
uccccagcugccaccucacccacc

SEQ ID NO: 931760 - RNA, 19 nt, Human
ucucaggccuaugccggag

SEQ ID NO: 931761 - RNA, 19 nt, Human
ucuggugcggagagggccc

SEQ ID NO: 931762 - RNA, 22 nt, Human
ugcgcagcaaggaggcugcagg

SEQ ID NO: 931763 - RNA, 20 nt, Human
ugcucggggaguugcagcag

SEQ ID NO: 931764 - RNA, 19 nt, Human
aacuucucucuuacauccc

SEQ ID NO: 931765 - RNA, 18 nt, Human
agacacaugagcagcaau

SEQ ID NO: 931766 - RNA, 22 nt, Human
aucccgcuccccuuguugcuua

SEQ ID NO: 931767 - RNA, 21 nt, Human
auuuuccagacauaauuucuc

SEQ ID NO: 931768 - RNA, 26 nt, Human
caccaugaaaggaaagcaaaugaucc

SEQ ID NO: 931769 - RNA, 23 nt, Human
cccugggcugauccccucuccac

SEQ ID NO: 931770 - RNA, 24 nt, Human
ccucuauggggcaccuacaggaau

SEQ ID NO: 931771 - RNA, 22 nt, Human
ccugggcugauccccucuccac

SEQ ID NO: 931772 - RNA, 18 nt, Human
cggcuauagauucaggca

SEQ ID NO: 931773 - RNA, 21 nt, Human
cguuucuccaucuucagcuga

SEQ ID NO: 931774 - RNA, 19 nt, Human
cucuuacaucccgcucccc

SEQ ID NO: 931775 - RNA, 22 nt, Human
cucuuacaucccgcuccccuug

SEQ ID NO: 931776 - RNA, 20 nt, Human
cugggcugauccccucucca

SEQ ID NO: 931777 - RNA, 23 nt, Human
uaacaccaugaaaggaaagcaaa

SEQ ID NO: 931778 - RNA, 22 nt, Human
uaauuucucaaugccacaccuc

SEQ ID NO: 931779 - RNA, 21 nt, Human
ucgcaggcaugccuggccccu

SEQ ID NO: 931780 - RNA, 20 nt, Human
ucuauggggcaccuacagga

SEQ ID NO: 931781 - RNA, 21 nt, Human
ucucaaugccacaccucuaug

SEQ ID NO: 931782 - RNA, 18 nt, Human
ugaaaggaaagcaaauga

SEQ ID NO: 931783 - RNA, 19 nt, Human
ugaaaggaaagcaaaugau

SEQ ID NO: 931784 - RNA, 21 nt, Human
ugggcugauccccucuccacu

SEQ ID NO: 931785 - RNA, 18 nt, Human
ugugaugaugcggcaaca

SEQ ID NO: 931786 - RNA, 19 nt, Human
uguuuuaaggggcagcaca

SEQ ID NO: 931787 - RNA, 24 nt, Human
uucauuugaccuucucugugauga

SEQ ID NO: 931788 - RNA, 25 nt, Human
aaaagccaggggugggcaauaacaa

SEQ ID NO: 931789 - RNA, 21 nt, Human
aaaagugcuagcaauucacag

SEQ ID NO: 931790 - RNA, 18 nt, Human
aaacagguaaucgggccu

SEQ ID NO: 931791 - RNA, 20 nt, Human
aaaccagacauggaagccau

SEQ ID NO: 931792 - RNA, 20 nt, Human
aaaguaauuauuuucuuuug

SEQ ID NO: 931793 - RNA, 24 nt, Human
aaagugcugggauuacagguguga

SEQ ID NO: 931794 - RNA, 22 nt, Human
aaaugccacaaaccagacaugg

SEQ ID NO: 931795 - RNA, 23 nt, Human
aaauggccccuuaucaaaagaac

SEQ ID NO: 931796 - RNA, 24 nt, Human
aagcaaaaagggggcuaauacugc

SEQ ID NO: 931797 - RNA, 20 nt, Human
aagcaagcagacauaccagg

SEQ ID NO: 931798 - RNA, 23 nt, Human
aagcaagcagacauaccagguca

SEQ ID NO: 931799 - RNA, 25 nt, Human
aagcaauucuccugccucagccucc

SEQ ID NO: 931800 - RNA, 21 nt, Human
aagccuccagugugacagcuu

SEQ ID NO: 931801 - RNA, 22 nt, Human
aagcggcugagcugcccaagca

SEQ ID NO: 931802 - RNA, 23 nt, Human
aagcugaguuccaauugagucug

SEQ ID NO: 931803 - RNA, 18 nt, Human
aaggaaaagcagcaagca

SEQ ID NO: 931804 - RNA, 20 nt, Human
aaguagcugagauuauaggc

SEQ ID NO: 931805 - RNA, 26 nt, Human
aaguagcugagauuauaggcgcaugc

SEQ ID NO: 931806 - RNA, 19 nt, Human
aagugcagcuugaggaaca

SEQ ID NO: 931807 - RNA, 18 nt, Human
aagugcugggauuacagg

SEQ ID NO: 931808 - RNA, 19 nt, Human
aagugcugggauuacaggu

SEQ ID NO: 931809 - RNA, 26 nt, Human
aagugcugggauuacaggugugagcc

SEQ ID NO: 931810 - RNA, 21 nt, Human
aauguuucuguaaauguuugg

SEQ ID NO: 931811 - RNA, 24 nt, Human
aauuuuguauuuuuaguagagaug

SEQ ID NO: 931812 - RNA, 23 nt, Human
acaaaaauagacucccaccuugc

SEQ ID NO: 931813 - RNA, 21 nt, Human
acaaaccagacauggaagcca

SEQ ID NO: 931814 - RNA, 23 nt, Human
acacacacaggcacagacagagu

SEQ ID NO: 931815 - RNA, 24 nt, Human
acacaggcacagacagaguaccuc

SEQ ID NO: 931816 - RNA, 22 nt, Human
acagaaauagccaagcagcaac

SEQ ID NO: 931817 - RNA, 21 nt, Human
acagaguaccaccaagcaaaa

SEQ ID NO: 931818 - RNA, 21 nt, Human
acagcaagucaucccaagacc

SEQ ID NO: 931819 - RNA, 18 nt, Human
accaggacuuuggcuucc

SEQ ID NO: 931820 - RNA, 22 nt, Human
acccggaaaagccagggguggg

SEQ ID NO: 931821 - RNA, 21 nt, Human
acccucccgcuacccuccccu

SEQ ID NO: 931822 - RNA, 23 nt, Human
accggcuccucagcagcauguac

SEQ ID NO: 931823 - RNA, 18 nt, Human
accuuauccccaaaugcc

SEQ ID NO: 931824 - RNA, 21 nt, Human
accuuauccccaaaugccaca

SEQ ID NO: 931825 - RNA, 25 nt, Human
acggaguuuugcuguuguugcccag

SEQ ID NO: 931826 - RNA, 18 nt, Human
acucccaccuugcuuuug

SEQ ID NO: 931827 - RNA, 23 nt, Human
acugcaccaggcugcugcuaaac

SEQ ID NO: 931828 - RNA, 23 nt, Human
agaaagcaaggaaaagcagcaag

SEQ ID NO: 931829 - RNA, 18 nt, Human
agacauaccaggucaaca

SEQ ID NO: 931830 - RNA, 26 nt, Human
agaguccuuuccucuuccuccucugg

SEQ ID NO: 931831 - RNA, 20 nt, Human
agcaagcaagcagacauacc

SEQ ID NO: 931832 - RNA, 25 nt, Human
agcaccuacauauucuugagcaagu

SEQ ID NO: 931833 - RNA, 18 nt, Human
agcccgaggccugcccaa

SEQ ID NO: 931834 - RNA, 20 nt, Human
aggcgcaugccaccacgccc

SEQ ID NO: 931835 - RNA, 24 nt, Human
agugacuaucacacacacacacag

SEQ ID NO: 931836 - RNA, 24 nt, Human
auacugcaucuuaaagguagcaaa

SEQ ID NO: 931837 - RNA, 19 nt, Human
auccaugggaaggccaugu

SEQ ID NO: 931838 - RNA, 21 nt, Human
aucucaguucccucugaguuu

SEQ ID NO: 931839 - RNA, 24 nt, Human
augggguuucuccauguuggucag

SEQ ID NO: 931840 - RNA, 22 nt, Human
caaaccagacauggaagccaug

SEQ ID NO: 931841 - RNA, 24 nt, Human
caaagugcugggauuacaggugug

SEQ ID NO: 931842 - RNA, 23 nt, Human
caacgaggccucaaacaaacugc

SEQ ID NO: 931843 - RNA, 19 nt, Human
caagcaagcagacauacca

SEQ ID NO: 931844 - RNA, 25 nt, Human
caagcaagguccuucuguaucuguc

SEQ ID NO: 931845 - RNA, 22 nt, Human
caagcaauucuccugccucagc

SEQ ID NO: 931846 - RNA, 21 nt, Human
caagcggcugagcugcccaag

SEQ ID NO: 931847 - RNA, 24 nt, Human
cacacacacaggcacagacagagu

SEQ ID NO: 931848 - RNA, 21 nt, Human
cacagcaagucaucccaagac

SEQ ID NO: 931849 - RNA, 22 nt, Human
cacagcaagucaucccaagacc

SEQ ID NO: 931850 - RNA, 25 nt, Human
cacagggagacccaguaacaagaca

SEQ ID NO: 931851 - RNA, 24 nt, Human
caccaagcaaaaagggggcuaaua

SEQ ID NO: 931852 - RNA, 22 nt, Human
caccacuccuuugaaugcauca

SEQ ID NO: 931853 - RNA, 22 nt, Human
caccaggcugcugcuaaaccuu

SEQ ID NO: 931854 - RNA, 21 nt, Human
cacccaacaccuacagcccga

SEQ ID NO: 931855 - RNA, 21 nt, Human
caccgcaaccuccgccuccug

SEQ ID NO: 931856 - RNA, 23 nt, Human
cacucucucuuaacaaucauucc

SEQ ID NO: 931857 - RNA, 22 nt, Human
cagagauggccccaaagugcag

SEQ ID NO: 931858 - RNA, 19 nt, Human
cagcaagcaagcagacaua

SEQ ID NO: 931859 - RNA, 19 nt, Human
cagcagcauguacauucaa

SEQ ID NO: 931860 - RNA, 24 nt, Human
cagucaucaauggugggcaaccaa

SEQ ID NO: 931861 - RNA, 21 nt, Human
caguggguggcauccugcaga

SEQ ID NO: 931862 - RNA, 24 nt, Human
cauaacccccaaaugugugcauca

SEQ ID NO: 931863 - RNA, 24 nt, Human
caugccaccacgcccggcuaauuu

SEQ ID NO: 931864 - RNA, 24 nt, Human
cauuccagacauggaucuugccau

SEQ ID NO: 931865 - RNA, 21 nt, Human
ccaaagugcugggauuacagg

SEQ ID NO: 931866 - RNA, 21 nt, Human
ccaaagugcugggauuacagg

SEQ ID NO: 931867 - RNA, 24 nt, Human
ccaaagugcugggauuacaggugu

SEQ ID NO: 931868 - RNA, 18 nt, Human
ccaacaccuacagcccga

SEQ ID NO: 931869 - RNA, 22 nt, Human
ccaacaccuacagcccgaggcc

SEQ ID NO: 931870 - RNA, 23 nt, Human
ccaaccaccuagccucacacgac

SEQ ID NO: 931871 - RNA, 22 nt, Human
ccaaguagcugagauuauaggc

SEQ ID NO: 931872 - RNA, 18 nt, Human
ccaccaagcaaaaagggg

SEQ ID NO: 931873 - RNA, 19 nt, Human
ccagaguccuuuccucuuc

SEQ ID NO: 931874 - RNA, 24 nt, Human
ccagcagagcuuggugcagugaca

SEQ ID NO: 931875 - RNA, 23 nt, Human
ccaggccggagugcaauggcacg

SEQ ID NO: 931876 - RNA, 19 nt, Human
ccauguuggucaggcuggu

SEQ ID NO: 931877 - RNA, 22 nt, Human
ccauguuggucaggcuggucuc

SEQ ID NO: 931878 - RNA, 23 nt, Human
cccaaagugcagcuugaggaaca

SEQ ID NO: 931879 - RNA, 23 nt, Human
cccaaguagcugagauuauaggc

SEQ ID NO: 931880 - RNA, 23 nt, Human
cccaaguagcugagauuauaggc

SEQ ID NO: 931881 - RNA, 21 nt, Human
cccaggaggaccguggguuug

SEQ ID NO: 931882 - RNA, 18 nt, Human
ccccaaagugcagcuuga

SEQ ID NO: 931883 - RNA, 23 nt, Human
ccccuuaucaaaagaacgaaggu

SEQ ID NO: 931884 - RNA, 21 nt, Human
cccgcuacccuccccuuuccc

SEQ ID NO: 931885 - RNA, 18 nt, Human
ccgcaaccuccgccuccu

SEQ ID NO: 931886 - RNA, 23 nt, Human
ccgcaaccuccgccuccuggguu

SEQ ID NO: 931887 - RNA, 24 nt, Human
ccgcaaccuccgccuccuggguuc

SEQ ID NO: 931888 - RNA, 26 nt, Human
ccgccuccuggguucaagcaauucuu

SEQ ID NO: 931889 - RNA, 22 nt, Human
ccuccccuuucccucccuuuca

SEQ ID NO: 931890 - RNA, 23 nt, Human
ccuccccuuucccucccuuuccc

SEQ ID NO: 931891 - RNA, 27 nt, Human
ccucccgcuacccuccccuuucccucc

SEQ ID NO: 931892 - RNA, 21 nt, Human
ccucccuuucaggcccuuggg

SEQ ID NO: 931893 - RNA, 19 nt, Human
ccuccgccuccuggguuca

SEQ ID NO: 931894 - RNA, 24 nt, Human
ccuccuggguucaagcaauucucc

SEQ ID NO: 931895 - RNA, 20 nt, Human
ccugcccgcugaacagaaau

SEQ ID NO: 931896 - RNA, 24 nt, Human
ccugccucagccucccaaguagcu

SEQ ID NO: 931897 - RNA, 23 nt, Human
ccuggguucaagcaauucuccug

SEQ ID NO: 931898 - RNA, 19 nt, Human
cgcacuggcaaaagucaug

SEQ ID NO: 931899 - RNA, 19 nt, Human
cggcugagcugcccaagca

SEQ ID NO: 931900 - RNA, 22 nt, Human
cuaacugcauggcuuccugcaa

SEQ ID NO: 931901 - RNA, 24 nt, Human
cuaauuuuguauuuuuaguagaga

SEQ ID NO: 931902 - RNA, 19 nt, Human
cuacccuccccuuucccuc

SEQ ID NO: 931903 - RNA, 21 nt, Human
cuccagcccagucaaaugauc

SEQ ID NO: 931904 - RNA, 24 nt, Human
cuccauguuggucaggcuggucuc

SEQ ID NO: 931905 - RNA, 26 nt, Human
cucccgaccuccggugauccgcccgc

SEQ ID NO: 931906 - RNA, 25 nt, Human
cuccugccucagccucccaaguagc

SEQ ID NO: 931907 - RNA, 21 nt, Human
cuccuggguucaagcaauucu

SEQ ID NO: 931908 - RNA, 25 nt, Human
cucucugcucuaagaaggccaugag

SEQ ID NO: 931909 - RNA, 22 nt, Human
cugaccccaagauauaugaaaa

SEQ ID NO: 931910 - RNA, 24 nt, Human
cuugagagccccacuauaccaaau

SEQ ID NO: 931911 - RNA, 20 nt, Human
gacauacuccucucucugcu

SEQ ID NO: 931912 - RNA, 24 nt, Human
gaccuccggugauccgcccgccuc

SEQ ID NO: 931913 - RNA, 24 nt, Human
gagaaagcaaggaaaagcagcaag

SEQ ID NO: 931914 - RNA, 24 nt, Human
gagaugggguuucuccauguuggu

SEQ ID NO: 931915 - RNA, 23 nt, Human
gagcagauguacagcacauccau

SEQ ID NO: 931916 - RNA, 18 nt, Human
gauuacaggugugagcca

SEQ ID NO: 931917 - RNA, 22 nt, Human
gauuacaggugugagccaccgc

SEQ ID NO: 931918 - RNA, 22 nt, Human
gauuacaggugugagccaccgc

SEQ ID NO: 931919 - RNA, 23 nt, Human
gcaaaagucaugaacuugggguu

SEQ ID NO: 931920 - RNA, 22 nt, Human
gcaaccaaaaggccauguugga

SEQ ID NO: 931921 - RNA, 21 nt, Human
gcauguuuucaaagaacaugg

SEQ ID NO: 931922 - RNA, 19 nt, Human
gccggagugcaauggcacg

SEQ ID NO: 931923 - RNA, 20 nt, Human
gccucagccucccaaguagc

SEQ ID NO: 931924 - RNA, 23 nt, Human
gccucggccucccaaagugcugg

SEQ ID NO: 931925 - RNA, 22 nt, Human
gcuaaguaaugcuugguggcug

SEQ ID NO: 931926 - RNA, 25 nt, Human
gcugcagcucaucucacucagccug

SEQ ID NO: 931927 - RNA, 20 nt, Human
gcugcuaaaccuuccagccc

SEQ ID NO: 931928 - RNA, 23 nt, Human
gcuggucucaaacucccgaccuc

SEQ ID NO: 931929 - RNA, 21 nt, Human
gcuguuguugcccaggccgga

SEQ ID NO: 931930 - RNA, 19 nt, Human
gcuuccugcaagcaagguc

SEQ ID NO: 931931 - RNA, 18 nt, Human
gggguuucuccauguugg

SEQ ID NO: 931932 - RNA, 22 nt, Human
gggguuucuccauguuggucag

SEQ ID NO: 931933 - RNA, 19 nt, Human
guaccaccaagcaaaaagg

SEQ ID NO: 931934 - RNA, 24 nt, Human
gugauccgcccgccucggccuccc

SEQ ID NO: 931935 - RNA, 26 nt, Human
uaacugcauggcuuccugcaagcaag

SEQ ID NO: 931936 - RNA, 22 nt, Human
uaaugcuugguggcugcucuga

SEQ ID NO: 931937 - RNA, 24 nt, Human
uacaggugugagccaccgcgccca

SEQ ID NO: 931938 - RNA, 18 nt, Human
uacaguggguggcauccu

SEQ ID NO: 931939 - RNA, 21 nt, Human
uacugcaucuuaaagguagca

SEQ ID NO: 931940 - RNA, 24 nt, Human
uaguagagaugggguuucuccaug

SEQ ID NO: 931941 - RNA, 22 nt, Human
uaucucaguucccucugaguuu

SEQ ID NO: 931942 - RNA, 24 nt, Human
ucaaaaccaggacuuuggcuuccc

SEQ ID NO: 931943 - RNA, 19 nt, Human
ucaagcaauucuccugccu

SEQ ID NO: 931944 - RNA, 21 nt, Human
ucacacgacuaacugcagaaa

SEQ ID NO: 931945 - RNA, 24 nt, Human
ucaccgcaaccuccgccuccuggg

SEQ ID NO: 931946 - RNA, 25 nt, Human
ucaccgcaaccuccgccuccugggu

SEQ ID NO: 931947 - RNA, 27 nt, Human
ucaccgcaaccuccgccuccuggguuc

SEQ ID NO: 931948 - RNA, 21 nt, Human
ucagccucccaaguagcugag

SEQ ID NO: 931949 - RNA, 20 nt, Human
uccaagagaaagcaaggaaa

SEQ ID NO: 931950 - RNA, 18 nt, Human
uccauguuggucaggcug

SEQ ID NO: 931951 - RNA, 23 nt, Human
ucccaaagugcugggauuacagg

SEQ ID NO: 931952 - RNA, 24 nt, Human
ucccaaguagcugagauuauaggc

SEQ ID NO: 931953 - RNA, 23 nt, Human
uccccaaaugccacaaaccagac

SEQ ID NO: 931954 - RNA, 24 nt, Human
uccgccuccuggguucaagcaauu

SEQ ID NO: 931955 - RNA, 23 nt, Human
uccucucugggaaagcagaacua

SEQ ID NO: 931956 - RNA, 21 nt, Human
uccuggguucaagcaauucuc

SEQ ID NO: 931957 - RNA, 24 nt, Human
uccuggguucaagcaauucuccug

SEQ ID NO: 931958 - RNA, 18 nt, Human
ucggccucccaaagugcu

SEQ ID NO: 931959 - RNA, 19 nt, Human
ucuggaucugcaaggagug

SEQ ID NO: 931960 - RNA, 24 nt, Human
ugaagaugcuugagagccccacua

SEQ ID NO: 931961 - RNA, 21 nt, Human
ugagauuauaggcgcaugcca

SEQ ID NO: 931962 - RNA, 22 nt, Human
ugagauuauaggcgcaugccac

SEQ ID NO: 931963 - RNA, 24 nt, Human
ugagauuauaggcgcaugccacca

SEQ ID NO: 931964 - RNA, 23 nt, Human
ugagucuggucacuccuccagca

SEQ ID NO: 931965 - RNA, 18 nt, Human
ugcagggugagggcaagc

SEQ ID NO: 931966 - RNA, 21 nt, Human
ugcagggugagggcaagcggc

SEQ ID NO: 931967 - RNA, 21 nt, Human
ugccacaaaccagacauggaa

SEQ ID NO: 931968 - RNA, 20 nt, Human
ugccacaaguacacagggag

SEQ ID NO: 931969 - RNA, 24 nt, Human
ugcccaaccaccuagccucacacg

SEQ ID NO: 931970 - RNA, 24 nt, Human
ugcccaggccggagugcaauggca

SEQ ID NO: 931971 - RNA, 24 nt, Human
ugccucagccucccaaguagcuga

SEQ ID NO: 931972 - RNA, 25 nt, Human
ugcuaaaccuuccagcccuaggaac

SEQ ID NO: 931973 - RNA, 24 nt, Human
ugcugggauuacaggugugagcca

SEQ ID NO: 931974 - RNA, 20 nt, Human
uggaacacgcacuggcaaaa

SEQ ID NO: 931975 - RNA, 24 nt, Human
uggcacgaucucaacucaccgcaa

SEQ ID NO: 931976 - RNA, 23 nt, Human
ugggaaagcagaacuauacagug

SEQ ID NO: 931977 - RNA, 18 nt, Human
ugggauuacaggugugag

SEQ ID NO: 931978 - RNA, 19 nt, Human
ugggauuacaggugugagc

SEQ ID NO: 931979 - RNA, 21 nt, Human
ugggauuacaggugugagcca

SEQ ID NO: 931980 - RNA, 22 nt, Human
ugggauuacaggugugagccac

SEQ ID NO: 931981 - RNA, 23 nt, Human
ugggauuacaggugugagccacc

SEQ ID NO: 931982 - RNA, 24 nt, Human
ugggauuacaggugugagccaccg

SEQ ID NO: 931983 - RNA, 22 nt, Human
ugggguugaauugcaaacaggu

SEQ ID NO: 931984 - RNA, 24 nt, Human
ugggguuucuccauguuggucagg

SEQ ID NO: 931985 - RNA, 20 nt, Human
ugggucuuuuucccacccaa

SEQ ID NO: 931986 - RNA, 21 nt, Human
uggguucaagcaauucuccug

SEQ ID NO: 931987 - RNA, 23 nt, Human
uggguucaagcaauucuccugcc

SEQ ID NO: 931988 - RNA, 21 nt, Human
uggucaggcuggucucaaacu

SEQ ID NO: 931989 - RNA, 19 nt, Human
uggucucaaacucccgacc

SEQ ID NO: 931990 - RNA, 21 nt, Human
uguauuuuuaguagagauggg

SEQ ID NO: 931991 - RNA, 21 nt, Human
ugugacagcuuugcuguuggc

SEQ ID NO: 931992 - RNA, 20 nt, Human
uguugcccaggccggagugc

SEQ ID NO: 931993 - RNA, 24 nt, Human
uuaguaaaaugacauacuccucuc

SEQ ID NO: 931994 - RNA, 18 nt, Human
uuaguagagaugggguuu

SEQ ID NO: 931995 - RNA, 24 nt, Human
uuaguagagaugggguuucuccau

SEQ ID NO: 931996 - RNA, 24 nt, Human
uuauaccgcucucuccauuccaga

SEQ ID NO: 931997 - RNA, 21 nt, Human
uucaagcaauucuccugccuc

SEQ ID NO: 931998 - RNA, 24 nt, Human
uucaagcaauucuccugccucagc

SEQ ID NO: 931999 - RNA, 18 nt, Human
uugcccaggccggagugc

SEQ ID NO: 932000 - RNA, 18 nt, Human
uugcugaauuuaaguccu

SEQ ID NO: 932001 - RNA, 23 nt, Human
uuguauuuuuaguagagaugggg

SEQ ID NO: 932002 - RNA, 23 nt, Human
uuguugcccaggccggagugcaa

SEQ ID NO: 932003 - RNA, 21 nt, Human
uuucuccauguuggucaggcu

SEQ ID NO: 932004 - RNA, 24 nt, Human
uuugcuguuguugcccaggccgga

SEQ ID NO: 932005 - RNA, 18 nt, Human
uuuggcuucccaugcagu

SEQ ID NO: 932006 - RNA, 18 nt, Human
uuuucccacccaacaccu

SEQ ID NO: 932007 - RNA, 24 nt, Human
uuuugcuguuguugcccaggccgg

SEQ ID NO: 932008 - RNA, 19 nt, Human
uuuuguauuuuuaguagag

SEQ ID NO: 932009 - RNA, 20 nt, Human
uuuuguauuuuuaguagaga

SEQ ID NO: 932010 - RNA, 22 nt, Human
uuuuuaguagagaugggguuuc

SEQ ID NO: 932011 - RNA, 22 nt, Human
uuuuuuuuuuuuuugagacgga

SEQ ID NO: 932012 - RNA, 18 nt, Human
uuuuuuuuuuuuuuuuug

SEQ ID NO: 932013 - RNA, 25 nt, Human
aaaugggaccuaaagaccagcaacc

SEQ ID NO: 932014 - RNA, 22 nt, Human
aacauuauuaaugaaagcuauu

SEQ ID NO: 932015 - RNA, 21 nt, Human
aagagucaccaccucaugcca

SEQ ID NO: 932016 - RNA, 23 nt, Human
aauauggaagaagauggaaaaaa

SEQ ID NO: 932017 - RNA, 22 nt, Human
acaucaguuuuaaggacuugua

SEQ ID NO: 932018 - RNA, 19 nt, Human
accaccucaugccaucuug

SEQ ID NO: 932019 - RNA, 20 nt, Human
agaccagcaaccauacugaa

SEQ ID NO: 932020 - RNA, 23 nt, Human
aggugggaggauggcuugaggcc

SEQ ID NO: 932021 - RNA, 22 nt, Human
aucacaguuuuuuuuuuacucu

SEQ ID NO: 932022 - RNA, 23 nt, Human
aucuaccccuucuuuuucuccaa

SEQ ID NO: 932023 - RNA, 21 nt, Human
auggaaaaaacuuguuuaaug

SEQ ID NO: 932024 - RNA, 19 nt, Human
caaugacuguggaauaaua

SEQ ID NO: 932025 - RNA, 23 nt, Human
cauaaacucuagaugucuuuggc

SEQ ID NO: 932026 - RNA, 21 nt, Human
cauucugaacuuucaccgcuu

SEQ ID NO: 932027 - RNA, 23 nt, Human
ccgcuuuuaaagaagcaugccgc

SEQ ID NO: 932028 - RNA, 18 nt, Human
ccuaaaacaaaugcagaa

SEQ ID NO: 932029 - RNA, 19 nt, Human
ccuaaagaccagcaaccau

SEQ ID NO: 932030 - RNA, 19 nt, Human
cuaacuccauucugaacuu

SEQ ID NO: 932031 - RNA, 23 nt, Human
cuaccccuucuuuuucuccaaau

SEQ ID NO: 932032 - RNA, 23 nt, Human
cugguccuuuuuugaauuuguau

SEQ ID NO: 932033 - RNA, 20 nt, Human
cuuugggagguugagguggg

SEQ ID NO: 932034 - RNA, 22 nt, Human
ggagguugaggugggaggaugg

SEQ ID NO: 932035 - RNA, 20 nt, Human
gguaagaaauaaaaacugua

SEQ ID NO: 932036 - RNA, 21 nt, Human
guacuccaauuuaaaacuuuu

SEQ ID NO: 932037 - RNA, 21 nt, Human
uaaaaugggaccuaaagacca

SEQ ID NO: 932038 - RNA, 22 nt, Human
uaagauagagaucguaucuguc

SEQ ID NO: 932039 - RNA, 24 nt, Human
uaagauagagaucguaucugucau

SEQ ID NO: 932040 - RNA, 18 nt, Human
uaagugacugacucuuug

SEQ ID NO: 932041 - RNA, 20 nt, Human
uaagugacugacucuuuggg

SEQ ID NO: 932042 - RNA, 19 nt, Human
uaauggguaagaaauaaaa

SEQ ID NO: 932043 - RNA, 23 nt, Human
uacagaauauauaccgcuuuuaa

SEQ ID NO: 932044 - RNA, 24 nt, Human
uacucuuagcugaaaagaaagauc

SEQ ID NO: 932045 - RNA, 19 nt, Human
uagcugaaaagaaagauca

SEQ ID NO: 932046 - RNA, 20 nt, Human
uaggucuugaaacuuggugg

SEQ ID NO: 932047 - RNA, 21 nt, Human
uaugcaaauauaauguguaau

SEQ ID NO: 932048 - RNA, 19 nt, Human
ucagucuacccauaaguga

SEQ ID NO: 932049 - RNA, 23 nt, Human
ucuaggguaggucuugaaacuug

SEQ ID NO: 932050 - RNA, 25 nt, Human
ucuuuuauuuauuuauuuaguuuug

SEQ ID NO: 932051 - RNA, 22 nt, Human
ucuuuuuauauauauauaugua

SEQ ID NO: 932052 - RNA, 21 nt, Human
ugaggugggaggauggcuuga

SEQ ID NO: 932053 - RNA, 24 nt, Human
ugaggugggaggauggcuugaggc

SEQ ID NO: 932054 - RNA, 21 nt, Human
ugagguuggcauacuaugagg

SEQ ID NO: 932055 - RNA, 21 nt, Human
uggaagaagauggaaaaaacu

SEQ ID NO: 932056 - RNA, 27 nt, Human
uggaagaagauggaaaaaacuuguuua

SEQ ID NO: 932057 - RNA, 20 nt, Human
ugugucagaaaccuuaaaca

SEQ ID NO: 932058 - RNA, 20 nt, Human
uguguuuuuuccugaguuuc

SEQ ID NO: 932059 - RNA, 24 nt, Human
uucugcuuugggagguugaggugg

SEQ ID NO: 932060 - RNA, 20 nt, Human
uucuuuuuauauauauauau

SEQ ID NO: 932061 - RNA, 19 nt, Human
uuucaugccauguauuagc

SEQ ID NO: 932062 - RNA, 23 nt, Human
uuugggagguugaggugggagga

SEQ ID NO: 932063 - RNA, 22 nt, Human
uuuuuuuuuuucuucuuucuuu

SEQ ID NO: 932064 - RNA, 18 nt, Human
aaacccaggggauaacag

SEQ ID NO: 932065 - RNA, 24 nt, Human
aaacuuccaagcaauuaacacuuu

SEQ ID NO: 932066 - RNA, 24 nt, Human
aaagugcugggauuacaggcauga

SEQ ID NO: 932067 - RNA, 25 nt, Human
aaccucagaaaucugucaucaguau

SEQ ID NO: 932068 - RNA, 20 nt, Human
aacuucugccuccugaguuc

SEQ ID NO: 932069 - RNA, 23 nt, Human
aagagaaaaacacuugaacuuca

SEQ ID NO: 932070 - RNA, 19 nt, Human
aagugcugggauuacaggc

SEQ ID NO: 932071 - RNA, 21 nt, Human
aagugcugggauuacaggcau

SEQ ID NO: 932072 - RNA, 26 nt, Human
aagugcugggauuacaggcaugagcc

SEQ ID NO: 932073 - RNA, 24 nt, Human
acacagaaucucgcucugucuccc

SEQ ID NO: 932074 - RNA, 21 nt, Human
acagugugugugucugcuggg

SEQ ID NO: 932075 - RNA, 24 nt, Human
accauguuggccaggguggucuug

SEQ ID NO: 932076 - RNA, 24 nt, Human
acgggacuucaccauguuggccag

SEQ ID NO: 932077 - RNA, 26 nt, Human
acucgaauuugaucaggaaaguaacc

SEQ ID NO: 932078 - RNA, 21 nt, Human
agaggacagggagucgggacu

SEQ ID NO: 932079 - RNA, 24 nt, Human
agcugggacuacaagugcccgcca

SEQ ID NO: 932080 - RNA, 21 nt, Human
aggcaaccucagaaaucuguc

SEQ ID NO: 932081 - RNA, 21 nt, Human
agggagucgggacuuaggaag

SEQ ID NO: 932082 - RNA, 20 nt, Human
agggcaguggcgugaucucg

SEQ ID NO: 932083 - RNA, 22 nt, Human
agggcaguggcgugaucucggc

SEQ ID NO: 932084 - RNA, 24 nt, Human
aggugaucugcccaccucggccuc

SEQ ID NO: 932085 - RNA, 18 nt, Human
aguagcugggacuacaag

SEQ ID NO: 932086 - RNA, 24 nt, Human
agugauucuccugcuucagccucc

SEQ ID NO: 932087 - RNA, 20 nt, Human
aguucaagugauucuccugc

SEQ ID NO: 932088 - RNA, 20 nt, Human
auaacguaaccuucccagua

SEQ ID NO: 932089 - RNA, 21 nt, Human
aucaagauuuucaaaagaucu

SEQ ID NO: 932090 - RNA, 19 nt, Human
aucucgcucugucucccca

SEQ ID NO: 932091 - RNA, 20 nt, Human
augaggcugauaugaacacc

SEQ ID NO: 932092 - RNA, 24 nt, Human
auuugaaacaaaaaacacaaaaca

SEQ ID NO: 932093 - RNA, 22 nt, Human
auuuuuguauuuuuaguagaga

SEQ ID NO: 932094 - RNA, 24 nt, Human
auuuuuguauuuuuaguagagacg

SEQ ID NO: 932095 - RNA, 23 nt, Human
caaaagcuauuuugaaagacucg

SEQ ID NO: 932096 - RNA, 24 nt, Human
caaagugcugggauuacaggcaug

SEQ ID NO: 932097 - RNA, 22 nt, Human
caagugauucuccugcuucagc

SEQ ID NO: 932098 - RNA, 23 nt, Human
cacagaaucucgcucugucuccc

SEQ ID NO: 932099 - RNA, 24 nt, Human
caccaugcccagcugauuuuugua

SEQ ID NO: 932100 - RNA, 18 nt, Human
caccauguuggccagggu

SEQ ID NO: 932101 - RNA, 22 nt, Human
caccauguuggccagggugguc

SEQ ID NO: 932102 - RNA, 24 nt, Human
caccauguuggccaggguggucuu

SEQ ID NO: 932103 - RNA, 24 nt, Human
caccucggccucccaaagugcugg

SEQ ID NO: 932104 - RNA, 20 nt, Human
cagccuccugaguagcuggg

SEQ ID NO: 932105 - RNA, 24 nt, Human
cagcgucuaaacccaggggauaac

SEQ ID NO: 932106 - RNA, 20 nt, Human
cauauuuacauaccguguuu

SEQ ID NO: 932107 - RNA, 23 nt, Human
caucaguauuaaccugcuuaaaa

SEQ ID NO: 932108 - RNA, 23 nt, Human
ccaaagugcugggauuacaggca

SEQ ID NO: 932109 - RNA, 24 nt, Human
ccaaagugcugggauuacaggcau

SEQ ID NO: 932110 - RNA, 24 nt, Human
cccaaagugcugggauuacaggca

SEQ ID NO: 932111 - RNA, 20 nt, Human
cccaaggucacacugcuguu

SEQ ID NO: 932112 - RNA, 23 nt, Human
cccagcugauuuuuguauuuuua

SEQ ID NO: 932113 - RNA, 24 nt, Human
ccccaggcuggagggcaguggcgu

SEQ ID NO: 932114 - RNA, 23 nt, Human
ccgcaacuucugccuccugaguu

SEQ ID NO: 932115 - RNA, 24 nt, Human
ccuccugaguucaagugauucucc

SEQ ID NO: 932116 - RNA, 23 nt, Human
ccugaguagcugggacuacaagu

SEQ ID NO: 932117 - RNA, 23 nt, Human
ccugaguucaagugauucuccug

SEQ ID NO: 932118 - RNA, 24 nt, Human
cgggacuucaccauguuggccagg

SEQ ID NO: 932119 - RNA, 19 nt, Human
cuccugaguucaagugauu

SEQ ID NO: 932120 - RNA, 23 nt, Human
cugaccucaggugaucugcccac

SEQ ID NO: 932121 - RNA, 23 nt, Human
cugccuccugaguucaagugauu

SEQ ID NO: 932122 - RNA, 24 nt, Human
cugccuccugaguucaagugauuc

SEQ ID NO: 932123 - RNA, 23 nt, Human
cugcuucagccuccugaguagcu

SEQ ID NO: 932124 - RNA, 18 nt, Human
cuuaggaaggccuugccc

SEQ ID NO: 932125 - RNA, 19 nt, Human
cuucaccauguuggccagg

SEQ ID NO: 932126 - RNA, 21 nt, Human
gaacagugugugugucugcug

SEQ ID NO: 932127 - RNA, 18 nt, Human
gaauacauacaccaucaa

SEQ ID NO: 932128 - RNA, 24 nt, Human
gaccucaggugaucugcccaccuc

SEQ ID NO: 932129 - RNA, 18 nt, Human
gacuucaccauguuggcc

SEQ ID NO: 932130 - RNA, 18 nt, Human
gaggcugauaugaacacc

SEQ ID NO: 932131 - RNA, 18 nt, Human
gauuacaggcaugagcca

SEQ ID NO: 932132 - RNA, 21 nt, Human
gauuacaggcaugagccacca

SEQ ID NO: 932133 - RNA, 22 nt, Human
gauuacaggcaugagccaccac

SEQ ID NO: 932134 - RNA, 19 nt, Human
ggauuacaggcaugagcca

SEQ ID NO: 932135 - RNA, 22 nt, Human
ggcuggagggcaguggcgugau

SEQ ID NO: 932136 - RNA, 23 nt, Human
gggacuucaccauguuggccagg

SEQ ID NO: 932137 - RNA, 23 nt, Human
gguggucuuggacugcugaccuc

SEQ ID NO: 932138 - RNA, 24 nt, Human
gugaucugcccaccucggccuccc

SEQ ID NO: 932139 - RNA, 24 nt, Human
gugauucuccugcuucagccuccu

SEQ ID NO: 932140 - RNA, 18 nt, Human
guguuauuccggugaaca

SEQ ID NO: 932141 - RNA, 21 nt, Human
uaaccgcaacuucugccuccu

SEQ ID NO: 932142 - RNA, 23 nt, Human
uacaggcaugagccaccacgccc

SEQ ID NO: 932143 - RNA, 22 nt, Human
uagagacgggacuucaccaugu

SEQ ID NO: 932144 - RNA, 24 nt, Human
uaguagagacgggacuucaccaug

SEQ ID NO: 932145 - RNA, 26 nt, Human
uaguagagacgggacuucaccauguu

SEQ ID NO: 932146 - RNA, 21 nt, Human
uaucgaggaagagaauggucu

SEQ ID NO: 932147 - RNA, 24 nt, Human
ucaccauguuggccaggguggucu

SEQ ID NO: 932148 - RNA, 23 nt, Human
ucagccuccugaguagcugggac

SEQ ID NO: 932149 - RNA, 24 nt, Human
ucccaaagugcugggauuacaggc

SEQ ID NO: 932150 - RNA, 18 nt, Human
uccugaguagcugggacu

SEQ ID NO: 932151 - RNA, 21 nt, Human
uccugaguucaagugauucuc

SEQ ID NO: 932152 - RNA, 24 nt, Human
uccugaguucaagugauucuccug

SEQ ID NO: 932153 - RNA, 18 nt, Human
ucggccucccaaagugcu

SEQ ID NO: 932154 - RNA, 24 nt, Human
ucucgcucugucuccccaggcugg

SEQ ID NO: 932155 - RNA, 25 nt, Human
ucucgcucugucuccccaggcugga

SEQ ID NO: 932156 - RNA, 23 nt, Human
ucucuacaggcaaccucagaaau

SEQ ID NO: 932157 - RNA, 18 nt, Human
ucugucuccccaggcugg

SEQ ID NO: 932158 - RNA, 23 nt, Human
ugaaacaaaaaacacaaaacauu

SEQ ID NO: 932159 - RNA, 23 nt, Human
ugaaacuuccaagcaauuaacac

SEQ ID NO: 932160 - RNA, 22 nt, Human
ugacacagaaucucgcucuguc

SEQ ID NO: 932161 - RNA, 24 nt, Human
ugacacagaaucucgcucugucuc

SEQ ID NO: 932162 - RNA, 18 nt, Human
ugaccucaggugaucugc

SEQ ID NO: 932163 - RNA, 21 nt, Human
ugaccucaggugaucugccca

SEQ ID NO: 932164 - RNA, 24 nt, Human
ugaccucaggugaucugcccaccu

SEQ ID NO: 932165 - RNA, 18 nt, Human
ugaguucaagugauucuc

SEQ ID NO: 932166 - RNA, 20 nt, Human
ugaguucaagugauucuccu

SEQ ID NO: 932167 - RNA, 24 nt, Human
ugaguucaagugauucuccugcuu

SEQ ID NO: 932168 - RNA, 24 nt, Human
ugaucugcccaccucggccuccca

SEQ ID NO: 932169 - RNA, 20 nt, Human
ugauucuccugcuucagccu

SEQ ID NO: 932170 - RNA, 22 nt, Human
ugccuccugaguucaagugauu

SEQ ID NO: 932171 - RNA, 24 nt, Human
ugcuucagccuccugaguagcugg

SEQ ID NO: 932172 - RNA, 19 nt, Human
uggagggcaguggcgugau

SEQ ID NO: 932173 - RNA, 24 nt, Human
uggagggcaguggcgugaucucgg

SEQ ID NO: 932174 - RNA, 21 nt, Human
ugggacuacaagugcccgcca

SEQ ID NO: 932175 - RNA, 24 nt, Human
ugggacuacaagugcccgccacca

SEQ ID NO: 932176 - RNA, 18 nt, Human
ugggauuacaggcaugag

SEQ ID NO: 932177 - RNA, 19 nt, Human
ugggauuacaggcaugagc

SEQ ID NO: 932178 - RNA, 22 nt, Human
ugggauuacaggcaugagccac

SEQ ID NO: 932179 - RNA, 23 nt, Human
ugggauuacaggcaugagccacc

SEQ ID NO: 932180 - RNA, 24 nt, Human
ugggauuacaggcaugagccacca

SEQ ID NO: 932181 - RNA, 24 nt, Human
ugggauuacaggcaugagccacca

SEQ ID NO: 932182 - RNA, 22 nt, Human
ugugauggaauuuccaccagaa

SEQ ID NO: 932183 - RNA, 18 nt, Human
uuaagugguuaauuucac

SEQ ID NO: 932184 - RNA, 18 nt, Human
uuaguagagacgggacuu

SEQ ID NO: 932185 - RNA, 24 nt, Human
uuaguagagacgggacuucaccau

SEQ ID NO: 932186 - RNA, 23 nt, Human
uucaagggacgaauguuuuagcg

SEQ ID NO: 932187 - RNA, 23 nt, Human
uucaagugauucuccugcuucag

SEQ ID NO: 932188 - RNA, 24 nt, Human
uucaagugauucuccugcuucagc

SEQ ID NO: 932189 - RNA, 24 nt, Human
uucagccuccugaguagcugggac

SEQ ID NO: 932190 - RNA, 24 nt, Human
uuuuuaguagagacgggacuucac

SEQ ID NO: 932191 - RNA, 20 nt, Human
uuuuuguauuuuuaguagag

SEQ ID NO: 932192 - RNA, 25 nt, Human
uuuuuuuuuuuugacacagaaucuc

SEQ ID NO: 932193 - RNA, 18 nt, Human
uuuuuuuuuuuuuuuuug

SEQ ID NO: 932194 - RNA, 24 nt, Human
uuuuuuuuuuuuuuuuugacacag

SEQ ID NO: 932195 - RNA, 26 nt, Human
aaaaauugagacaauuuuucagacaa

SEQ ID NO: 932196 - RNA, 22 nt, Human
aaaagagaagauaugcagagga

SEQ ID NO: 932197 - RNA, 19 nt, Human
aaacaggguauuucauaua

SEQ ID NO: 932198 - RNA, 20 nt, Human
aaacugcugggauuacaggc

SEQ ID NO: 932199 - RNA, 24 nt, Human
aaacugcugggauuacaggcuuga

SEQ ID NO: 932200 - RNA, 27 nt, Human
aagaguucuucuauccaaauaaaggag

SEQ ID NO: 932201 - RNA, 19 nt, Human
aauaaaggagcaaugaaaa

SEQ ID NO: 932202 - RNA, 23 nt, Human
aauagcuggaauuacaggcgugu

SEQ ID NO: 932203 - RNA, 23 nt, Human
aaugaguugcaggauaaugcagu

SEQ ID NO: 932204 - RNA, 21 nt, Human
aauuaaaaaaaaaaaaaaaaa

SEQ ID NO: 932205 - RNA, 22 nt, Human
aauuacaggcgugugcuaccau

SEQ ID NO: 932206 - RNA, 18 nt, Human
acgggguuucuccauguu

SEQ ID NO: 932207 - RNA, 20 nt, Human
acgggguuucuccauguugg

SEQ ID NO: 932208 - RNA, 24 nt, Human
acgggguuucuccauguuggucag

SEQ ID NO: 932209 - RNA, 24 nt, Human
acugcugggauuacaggcuugagc

SEQ ID NO: 932210 - RNA, 22 nt, Human
agaagcuauggcuuuugcaggu

SEQ ID NO: 932211 - RNA, 22 nt, Human
agagaaucaagaguucuucuau

SEQ ID NO: 932212 - RNA, 18 nt, Human
agaugauccgcccgccuc

SEQ ID NO: 932213 - RNA, 18 nt, Human
agccuccugaauagcugg

SEQ ID NO: 932214 - RNA, 20 nt, Human
agugcaauggcgugaucucg

SEQ ID NO: 932215 - RNA, 24 nt, Human
agugcaauggcgugaucucggcuc

SEQ ID NO: 932216 - RNA, 24 nt, Human
aucacuaacucuuagaagcuaugg

SEQ ID NO: 932217 - RNA, 21 nt, Human
augaacuuuuaaaaccuucag

SEQ ID NO: 932218 - RNA, 24 nt, Human
augauccgcccgccucagccuccc

SEQ ID NO: 932219 - RNA, 18 nt, Human
augcagaggaacgaaccc

SEQ ID NO: 932220 - RNA, 20 nt, Human
augcauuucacugcccauau

SEQ ID NO: 932221 - RNA, 24 nt, Human
auuaaaaaaaaaaaaaaaaagaau

SEQ ID NO: 932222 - RNA, 20 nt, Human
auuccccugccucagccucc

SEQ ID NO: 932223 - RNA, 21 nt, Human
caaacugagauacaguaaugu

SEQ ID NO: 932224 - RNA, 18 nt, Human
caaacugcugggauuaca

SEQ ID NO: 932225 - RNA, 23 nt, Human
caaccuccaccucccggguucaa

SEQ ID NO: 932226 - RNA, 22 nt, Human
caauauaguucccaagaauuaa

SEQ ID NO: 932227 - RNA, 18 nt, Human
cacacaaaccucacaaua

SEQ ID NO: 932228 - RNA, 26 nt, Human
caccuccgaaagaaagaggagguaac

SEQ ID NO: 932229 - RNA, 21 nt, Human
cacugcaaccuccaccucccg

SEQ ID NO: 932230 - RNA, 23 nt, Human
cacugcaaccuccaccucccggg

SEQ ID NO: 932231 - RNA, 21 nt, Human
cagcucuuaacuuaauuaaua

SEQ ID NO: 932232 - RNA, 23 nt, Human
caucuuuauugcuaaucuggagg

SEQ ID NO: 932233 - RNA, 24 nt, Human
cauuuuguauuuuuaguagagacg

SEQ ID NO: 932234 - RNA, 23 nt, Human
ccaaacugcugggauuacaggcu

SEQ ID NO: 932235 - RNA, 19 nt, Human
ccaagaauuaaaaaaaaaa

SEQ ID NO: 932236 - RNA, 29 nt, Human
ccaagaauuaaaaaaaaaaaaaaaaagaa

SEQ ID NO: 932237 - RNA, 24 nt, Human
ccacaucuuuauugcuaaucugga

SEQ ID NO: 932238 - RNA, 20 nt, Human
ccaccgcgcccggccaaaca

SEQ ID NO: 932239 - RNA, 22 nt, Human
ccaccgcgcccggccaaacagg

SEQ ID NO: 932240 - RNA, 27 nt, Human
ccaccucccggguucaagcaauucuuu

SEQ ID NO: 932241 - RNA, 19 nt, Human
ccauguuggucaggcuggu

SEQ ID NO: 932242 - RNA, 22 nt, Human
ccauguuggucaggcuggucuc

SEQ ID NO: 932243 - RNA, 23 nt, Human
ccauguuggucaggcuggucucg

SEQ ID NO: 932244 - RNA, 24 nt, Human
cccaaacugcugggauuacaggcu

SEQ ID NO: 932245 - RNA, 20 nt, Human
cccggguucaagcaauuccc

SEQ ID NO: 932246 - RNA, 23 nt, Human
cccggguucaagcaauuccccug

SEQ ID NO: 932247 - RNA, 23 nt, Human
ccgcccgccucagccucccaaac

SEQ ID NO: 932248 - RNA, 22 nt, Human
ccucccggguucaagcaauucc

SEQ ID NO: 932249 - RNA, 18 nt, Human
ccugaccucagaugaucc

SEQ ID NO: 932250 - RNA, 22 nt, Human
ccugaccucagaugauccgccc

SEQ ID NO: 932251 - RNA, 23 nt, Human
ccugccucagccuccugaauagc

SEQ ID NO: 932252 - RNA, 24 nt, Human
ccugccucagccuccugaauagcu

SEQ ID NO: 932253 - RNA, 24 nt, Human
cgggguuucuccauguuggucagg

SEQ ID NO: 932254 - RNA, 22 nt, Human
cuaaagaaauacgguugggguc

SEQ ID NO: 932255 - RNA, 23 nt, Human
cuagaaucaucgcaaaaguauua

SEQ ID NO: 932256 - RNA, 24 nt, Human
cucacugcaaccuccaccucccgg

SEQ ID NO: 932257 - RNA, 24 nt, Human
cuccauguuggucaggcuggucuc

SEQ ID NO: 932258 - RNA, 21 nt, Human
cucccaaacugcugggauuac

SEQ ID NO: 932259 - RNA, 18 nt, Human
cucccacccucuuuucca

SEQ ID NO: 932260 - RNA, 24 nt, Human
cuccugaauagcuggaauuacagg

SEQ ID NO: 932261 - RNA, 26 nt, Human
cuccugaccucagaugauccgcccgc

SEQ ID NO: 932262 - RNA, 24 nt, Human
cugaauagcuggaauuacaggcgu

SEQ ID NO: 932263 - RNA, 18 nt, Human
cugcaaccuccaccuccc

SEQ ID NO: 932264 - RNA, 23 nt, Human
cugcaaccuccaccucccggguu

SEQ ID NO: 932265 - RNA, 24 nt, Human
cugcaaccuccaccucccggguuc

SEQ ID NO: 932266 - RNA, 24 nt, Human
cuuauugcccagguuggagugcaa

SEQ ID NO: 932267 - RNA, 25 nt, Human
cuucccuuuucucccacccucuuuu

SEQ ID NO: 932268 - RNA, 23 nt, Human
cuuccugcugcucucauuagcac

SEQ ID NO: 932269 - RNA, 25 nt, Human
gaauagcuggaauuacaggcgugug

SEQ ID NO: 932270 - RNA, 24 nt, Human
gaccucagaugauccgcccgccuc

SEQ ID NO: 932271 - RNA, 23 nt, Human
gagacgggguuucuccauguugg

SEQ ID NO: 932272 - RNA, 24 nt, Human
gagacgggguuucuccauguuggu

SEQ ID NO: 932273 - RNA, 18 nt, Human
gauuacaggcuugagcca

SEQ ID NO: 932274 - RNA, 22 nt, Human
gauuacaggcuugagccaccgc

SEQ ID NO: 932275 - RNA, 23 nt, Human
gccucagccucccaaacugcugg

SEQ ID NO: 932276 - RNA, 22 nt, Human
gcgugugcuaccaugcccagcu

SEQ ID NO: 932277 - RNA, 20 nt, Human
gcucuuauugcccagguugg

SEQ ID NO: 932278 - RNA, 21 nt, Human
gcucuuauugcccagguugga

SEQ ID NO: 932279 - RNA, 23 nt, Human
gcuggucucgaacuccugaccuc

SEQ ID NO: 932280 - RNA, 21 nt, Human
ggcgugugcuaccaugcccag

SEQ ID NO: 932281 - RNA, 24 nt, Human
ggcuggucucgaacuccugaccuc

SEQ ID NO: 932282 - RNA, 23 nt, Human
gggguuucuccauguuggucagg

SEQ ID NO: 932283 - RNA, 19 nt, Human
ggucucgaacuccugaccu

SEQ ID NO: 932284 - RNA, 22 nt, Human
gguuggagugcaauggcgugau

SEQ ID NO: 932285 - RNA, 23 nt, Human
guagagacgggguuucuccaugu

SEQ ID NO: 932286 - RNA, 18 nt, Human
gucucacacaaaccucac

SEQ ID NO: 932287 - RNA, 19 nt, Human
uaaagucagguuuccaacu

SEQ ID NO: 932288 - RNA, 23 nt, Human
uacaggcuugagccaccgcgccc

SEQ ID NO: 932289 - RNA, 23 nt, Human
uaccaaagaauuucaacauucca

SEQ ID NO: 932290 - RNA, 24 nt, Human
uaguagagacgggguuucuccaug

SEQ ID NO: 932291 - RNA, 19 nt, Human
uauaaaagagaagauaugc

SEQ ID NO: 932292 - RNA, 18 nt, Human
uaugcagaggaacgaacc

SEQ ID NO: 932293 - RNA, 19 nt, Human
uauugcccagguuggagug

SEQ ID NO: 932294 - RNA, 23 nt, Human
ucacugcaaccuccaccucccgg

SEQ ID NO: 932295 - RNA, 24 nt, Human
ucacugcaaccuccaccucccggg

SEQ ID NO: 932296 - RNA, 25 nt, Human
ucacugcaaccuccaccucccgggu

SEQ ID NO: 932297 - RNA, 27 nt, Human
ucacugcaaccuccaccucccggguuc

SEQ ID NO: 932298 - RNA, 21 nt, Human
ucacuucccuuuucucccacc

SEQ ID NO: 932299 - RNA, 26 nt, Human
ucauuagcaccuccgaaagaaagagg

SEQ ID NO: 932300 - RNA, 23 nt, Human
uccaaauaaaggagcaaugaaaa

SEQ ID NO: 932301 - RNA, 26 nt, Human
uccaccacaccaugaagguaugugca

SEQ ID NO: 932302 - RNA, 23 nt, Human
uccacugcaaucuuggaagaaug

SEQ ID NO: 932303 - RNA, 24 nt, Human
ucccaaacugcugggauuacaggc

SEQ ID NO: 932304 - RNA, 24 nt, Human
uccccugccucagccuccugaaua

SEQ ID NO: 932305 - RNA, 19 nt, Human
ucccggguucaagcaauuc

SEQ ID NO: 932306 - RNA, 24 nt, Human
ucccggguucaagcaauuccccug

SEQ ID NO: 932307 - RNA, 21 nt, Human
uccgcccgccucagccuccca

SEQ ID NO: 932308 - RNA, 19 nt, Human
uccucguggaugcauuuca

SEQ ID NO: 932309 - RNA, 22 nt, Human
ucguggaugcauuucacugccc

SEQ ID NO: 932310 - RNA, 21 nt, Human
ucuuuaucuucccucccucac

SEQ ID NO: 932311 - RNA, 24 nt, Human
ugaagguaugugcaauuuccuaaa

SEQ ID NO: 932312 - RNA, 18 nt, Human
ugaccucagaugauccgc

SEQ ID NO: 932313 - RNA, 24 nt, Human
ugaccucagaugauccgcccgccu

SEQ ID NO: 932314 - RNA, 18 nt, Human
ugcccagguuggagugca

SEQ ID NO: 932315 - RNA, 21 nt, Human
ugcccagguuggagugcaaug

SEQ ID NO: 932316 - RNA, 24 nt, Human
ugcccagguuggagugcaauggcg

SEQ ID NO: 932317 - RNA, 27 nt, Human
ugccucagccuccugaauagcuggaau

SEQ ID NO: 932318 - RNA, 19 nt, Human
uggaagaauguuacaaagg

SEQ ID NO: 932319 - RNA, 18 nt, Human
uggaauuacaggcgugug

SEQ ID NO: 932320 - RNA, 22 nt, Human
uggaauuacaggcgugugcuac

SEQ ID NO: 932321 - RNA, 24 nt, Human
uggaauuacaggcgugugcuacca

SEQ ID NO: 932322 - RNA, 25 nt, Human
uggaauuacaggcgugugcuaccau

SEQ ID NO: 932323 - RNA, 20 nt, Human
uggaauuuuagcaugaacuu

SEQ ID NO: 932324 - RNA, 19 nt, Human
uggagugcaauggcgugau

SEQ ID NO: 932325 - RNA, 23 nt, Human
uggagugcaauggcgugaucucg

SEQ ID NO: 932326 - RNA, 24 nt, Human
uggagugcaauggcgugaucucgg

SEQ ID NO: 932327 - RNA, 20 nt, Human
uggcgugaucucggcucacu

SEQ ID NO: 932328 - RNA, 18 nt, Human
ugggauuacaggcuugag

SEQ ID NO: 932329 - RNA, 19 nt, Human
ugggauuacaggcuugagc

SEQ ID NO: 932330 - RNA, 21 nt, Human
ugggauuacaggcuugagcca

SEQ ID NO: 932331 - RNA, 22 nt, Human
ugggauuacaggcuugagccac

SEQ ID NO: 932332 - RNA, 23 nt, Human
ugggauuacaggcuugagccacc

SEQ ID NO: 932333 - RNA, 24 nt, Human
ugggauuacaggcuugagccaccg

SEQ ID NO: 932334 - RNA, 24 nt, Human
uggucaggcuggucucgaacuccu

SEQ ID NO: 932335 - RNA, 20 nt, Human
uguuacaaaggaaagacguu

SEQ ID NO: 932336 - RNA, 18 nt, Human
uuaguagagacgggguuu

SEQ ID NO: 932337 - RNA, 24 nt, Human
uuaguagagacgggguuucuccau

SEQ ID NO: 932338 - RNA, 21 nt, Human
uucaagcaauuccccugccuc

SEQ ID NO: 932339 - RNA, 24 nt, Human
uucaagcaauuccccugccucagc

SEQ ID NO: 932340 - RNA, 22 nt, Human
uucagacaauauaguucccaag

SEQ ID NO: 932341 - RNA, 19 nt, Human
uuccccugccucagccucc

SEQ ID NO: 932342 - RNA, 18 nt, Human
uucuccuaaguauuugag

SEQ ID NO: 932343 - RNA, 21 nt, Human
uucuuuaucuucccucccuca

SEQ ID NO: 932344 - RNA, 18 nt, Human
uugcccagguuggagugc

SEQ ID NO: 932345 - RNA, 23 nt, Human
uuguauuuuuaguagagacgggg

SEQ ID NO: 932346 - RNA, 22 nt, Human
uuuccaagcuguuucgcuuugc

SEQ ID NO: 932347 - RNA, 21 nt, Human
uuucuccauguuggucaggcu

SEQ ID NO: 932348 - RNA, 24 nt, Human
uuugcucuuauugcccagguugga

SEQ ID NO: 932349 - RNA, 24 nt, Human
uuuugcucuuauugcccagguugg

SEQ ID NO: 932350 - RNA, 19 nt, Human
uuuuguauuuuuaguagag

SEQ ID NO: 932351 - RNA, 20 nt, Human
uuuuguauuuuuaguagaga

SEQ ID NO: 932352 - RNA, 22 nt, Human
uuuuuaguagagacgggguuuc

SEQ ID NO: 932353 - RNA, 23 nt, Human
acagcaggaggcagguuccugga

SEQ ID NO: 932354 - RNA, 18 nt, Human
accccacacacccgucuc

SEQ ID NO: 932355 - RNA, 21 nt, Human
accucccuccugccaguuucc

SEQ ID NO: 932356 - RNA, 20 nt, Human
agaccuggcaauggacagca

SEQ ID NO: 932357 - RNA, 19 nt, Human
agacucgaauucuugagua

SEQ ID NO: 932358 - RNA, 21 nt, Human
agcacaggugucagggugcaa

SEQ ID NO: 932359 - RNA, 18 nt, Human
agcgccucagcacaggug

SEQ ID NO: 932360 - RNA, 24 nt, Human
aggcagcccugaaugggccuguuu

SEQ ID NO: 932361 - RNA, 19 nt, Human
agggucccugccccuaccu

SEQ ID NO: 932362 - RNA, 22 nt, Human
aguccccauuugcucaggcagc

SEQ ID NO: 932363 - RNA, 22 nt, Human
caccccacacacccgucucuug

SEQ ID NO: 932364 - RNA, 21 nt, Human
cacuaaaccaaggucaugagc

SEQ ID NO: 932365 - RNA, 22 nt, Human
cagcaggaggcagguuccugga

SEQ ID NO: 932366 - RNA, 22 nt, Human
cagccccucccugccccugccc

SEQ ID NO: 932367 - RNA, 21 nt, Human
cagcugccagagcgccucagc

SEQ ID NO: 932368 - RNA, 22 nt, Human
cagcuucauaggcuggggugac

SEQ ID NO: 932369 - RNA, 23 nt, Human
caguggccagcaggcccaucugg

SEQ ID NO: 932370 - RNA, 20 nt, Human
cagugggggcaguuugccuu

SEQ ID NO: 932371 - RNA, 19 nt, Human
ccaccugcagccccucccu

SEQ ID NO: 932372 - RNA, 21 nt, Human
ccaccugcagccccucccugc

SEQ ID NO: 932373 - RNA, 19 nt, Human
ccagacaguccuguuugug

SEQ ID NO: 932374 - RNA, 20 nt, Human
ccaucuggagugggaguggg

SEQ ID NO: 932375 - RNA, 21 nt, Human
cccagacggcuuagcccaagu

SEQ ID NO: 932376 - RNA, 18 nt, Human
cccgggugacuggcaguu

SEQ ID NO: 932377 - RNA, 20 nt, Human
cccguggagcuggggguggg

SEQ ID NO: 932378 - RNA, 21 nt, Human
cccuugguccagacaguccug

SEQ ID NO: 932379 - RNA, 23 nt, Human
ccgcagccguggcuaggauucca

SEQ ID NO: 932380 - RNA, 23 nt, Human
ccgcccacaggccauccggcugu

SEQ ID NO: 932381 - RNA, 19 nt, Human
ccugcagccccucccugcc

SEQ ID NO: 932382 - RNA, 27 nt, Human
ccugccccugcccuagcugcugugugu

SEQ ID NO: 932383 - RNA, 19 nt, Human
ccuugacaccucacucuca

SEQ ID NO: 932384 - RNA, 23 nt, Human
cgucacagugucugcugugauug

SEQ ID NO: 932385 - RNA, 19 nt, Human
cguggagcugggggugggc

SEQ ID NO: 932386 - RNA, 18 nt, Human
cguggggucugaaagcac

SEQ ID NO: 932387 - RNA, 18 nt, Human
cuaccucagccggcgugg

SEQ ID NO: 932388 - RNA, 19 nt, Human
cucaagcuuggucaucuuc

SEQ ID NO: 932389 - RNA, 20 nt, Human
cuccugccaguuucccuugg

SEQ ID NO: 932390 - RNA, 23 nt, Human
cuucacaccaccugcagccccuc

SEQ ID NO: 932391 - RNA, 18 nt, Human
cuuccgccuugacaccuc

SEQ ID NO: 932392 - RNA, 23 nt, Human
gacagcaggaggcagguuccugg

SEQ ID NO: 932393 - RNA, 20 nt, Human
gagaggcagagggugacggg

SEQ ID NO: 932394 - RNA, 23 nt, Human
gagugggagugggcacuuccacc

SEQ ID NO: 932395 - RNA, 23 nt, Human
gcagccccucccugccccugccc

SEQ ID NO: 932396 - RNA, 22 nt, Human
gcucaggcagcccugaaugggc

SEQ ID NO: 932397 - RNA, 19 nt, Human
ggaaaaaaaaaaaaaaagc

SEQ ID NO: 932398 - RNA, 21 nt, Human
ggaaggaauauagcuuccagc

SEQ ID NO: 932399 - RNA, 24 nt, Human
ggacagcaggaggcagguuccugg

SEQ ID NO: 932400 - RNA, 20 nt, Human
ggcaccaucuggguccccug

SEQ ID NO: 932401 - RNA, 21 nt, Human
ggcagguuccuggagcugggg

SEQ ID NO: 932402 - RNA, 18 nt, Human
ggucccgggugacuggca

SEQ ID NO: 932403 - RNA, 22 nt, Human
guagacccagacggcuuagccc

SEQ ID NO: 932404 - RNA, 23 nt, Human
guagacccagacggcuuagccca

SEQ ID NO: 932405 - RNA, 24 nt, Human
uaacucaagcuuggucaucuucag

SEQ ID NO: 932406 - RNA, 18 nt, Human
uaagauaacagacuccag

SEQ ID NO: 932407 - RNA, 20 nt, Human
uaccuaagcuggaggcuggc

SEQ ID NO: 932408 - RNA, 21 nt, Human
uaccuaagcuggaggcuggcg

SEQ ID NO: 932409 - RNA, 25 nt, Human
uagacccagacggcuuagcccaagu

SEQ ID NO: 932410 - RNA, 20 nt, Human
uagcccaagucuaguugcag

SEQ ID NO: 932411 - RNA, 20 nt, Human
ucccaccucccuccugccag

SEQ ID NO: 932412 - RNA, 23 nt, Human
ucccucagcacaggugggucagu

SEQ ID NO: 932413 - RNA, 21 nt, Human
ucccugccccuaccuccacug

SEQ ID NO: 932414 - RNA, 18 nt, Human
ucccuggggacagucgcu

SEQ ID NO: 932415 - RNA, 22 nt, Human
ucccuggggacagucgcuuccg

SEQ ID NO: 932416 - RNA, 20 nt, Human
uccgcagccguggcuaggau

SEQ ID NO: 932417 - RNA, 19 nt, Human
uccugccaguuucccuugg

SEQ ID NO: 932418 - RNA, 20 nt, Human
uccuuucccaccucccuccu

SEQ ID NO: 932419 - RNA, 18 nt, Human
ucucaggcaguccugauu

SEQ ID NO: 932420 - RNA, 23 nt, Human
ucucugugcaguuagugccaccc

SEQ ID NO: 932421 - RNA, 18 nt, Human
ugccaguuucccuugguu

SEQ ID NO: 932422 - RNA, 26 nt, Human
ugccccuaccuccacugccagacccu

SEQ ID NO: 932423 - RNA, 21 nt, Human
ugccguggggucugaaagcac

SEQ ID NO: 932424 - RNA, 19 nt, Human
ugccuucuuucuaccucag

SEQ ID NO: 932425 - RNA, 19 nt, Human
ugcucaggcagcccugaau

SEQ ID NO: 932426 - RNA, 18 nt, Human
uggaaggaauauagcuuc

SEQ ID NO: 932427 - RNA, 24 nt, Human
uggagugcaaucagccuccuccag

SEQ ID NO: 932428 - RNA, 22 nt, Human
uggcuaggauuccacuuccugu

SEQ ID NO: 932429 - RNA, 20 nt, Human
ugggcacuuccaccccgccc

SEQ ID NO: 932430 - RNA, 22 nt, Human
uggggggugaccugagaggcag

SEQ ID NO: 932431 - RNA, 21 nt, Human
uggugaguggagccuggaggc

SEQ ID NO: 932432 - RNA, 21 nt, Human
uguaccuaagcuggaggcugg

SEQ ID NO: 932433 - RNA, 21 nt, Human
uucccuugguccagacagucc

SEQ ID NO: 932434 - RNA, 21 nt, Human
uuuacaggaaugguaaauugg

SEQ ID NO: 932435 - RNA, 20 nt, Human
uuuaccugccguggggucug

SEQ ID NO: 932436 - RNA, 23 nt, Human
aaacccacuuacaauccuguacc

SEQ ID NO: 932437 - RNA, 24 nt, Human
aaagugcugggauuacaggcauga

SEQ ID NO: 932438 - RNA, 20 nt, Human
aagacacuccuauguacccc

SEQ ID NO: 932439 - RNA, 19 nt, Human
aagugcugggauuacaggc

SEQ ID NO: 932440 - RNA, 21 nt, Human
aagugcugggauuacaggcau

SEQ ID NO: 932441 - RNA, 26 nt, Human
aagugcugggauuacaggcaugagcc

SEQ ID NO: 932442 - RNA, 21 nt, Human
acaaagacaagauauguauua

SEQ ID NO: 932443 - RNA, 24 nt, Human
acacuaccccuaccaucgucacug

SEQ ID NO: 932444 - RNA, 18 nt, Human
acagaaaaguuacaaaga

SEQ ID NO: 932445 - RNA, 27 nt, Human
acuuacaauccuguaccacaaucuguc

SEQ ID NO: 932446 - RNA, 19 nt, Human
agaaaacccacuuacaauc

SEQ ID NO: 932447 - RNA, 19 nt, Human
agagaugggguuucaccgu

SEQ ID NO: 932448 - RNA, 18 nt, Human
agugcugggauuacaggc

SEQ ID NO: 932449 - RNA, 20 nt, Human
aucugucuuccuuuucuuuc

SEQ ID NO: 932450 - RNA, 19 nt, Human
augaucaaauauauuuauc

SEQ ID NO: 932451 - RNA, 18 nt, Human
augggguuucaccguguu

SEQ ID NO: 932452 - RNA, 24 nt, Human
augggguuucaccguguuagccag

SEQ ID NO: 932453 - RNA, 19 nt, Human
auucugcauuaucuuacua

SEQ ID NO: 932454 - RNA, 24 nt, Human
caaagugcugggauuacaggcaug

SEQ ID NO: 932455 - RNA, 28 nt, Human
caagacacuccuauguaccccacaggac

SEQ ID NO: 932456 - RNA, 23 nt, Human
caagacacuccuauguaccccuc

SEQ ID NO: 932457 - RNA, 20 nt, Human
cacaauaaugauaauagaaa

SEQ ID NO: 932458 - RNA, 18 nt, Human
caccguguuagccaggau

SEQ ID NO: 932459 - RNA, 24 nt, Human
caccguguuagccaggaugaucuc

SEQ ID NO: 932460 - RNA, 23 nt, Human
caccuugcagcccgaguucuacu

SEQ ID NO: 932461 - RNA, 25 nt, Human
cagcccgaguucuacugaauccaga

SEQ ID NO: 932462 - RNA, 23 nt, Human
ccaaagugcugggauuacaggca

SEQ ID NO: 932463 - RNA, 24 nt, Human
ccaaagugcugggauuacaggcau

SEQ ID NO: 932464 - RNA, 24 nt, Human
cccaaagugcugggauuacaggca

SEQ ID NO: 932465 - RNA, 20 nt, Human
ccccacagcugguugccacu

SEQ ID NO: 932466 - RNA, 22 nt, Human
cccgucucggccucccaaagug

SEQ ID NO: 932467 - RNA, 19 nt, Human
ccuguaccacaaucugucu

SEQ ID NO: 932468 - RNA, 19 nt, Human
cgaucacagcaccagcuuu

SEQ ID NO: 932469 - RNA, 18 nt, Human
cuacugguguugaccugg

SEQ ID NO: 932470 - RNA, 22 nt, Human
cuccccugacuugugacaauuu

SEQ ID NO: 932471 - RNA, 23 nt, Human
cuccugaccucgugauccgcccg

SEQ ID NO: 932472 - RNA, 19 nt, Human
cuggucccagauccaucga

SEQ ID NO: 932473 - RNA, 20 nt, Human
cuguaugcugagcccuuauc

SEQ ID NO: 932474 - RNA, 22 nt, Human
gaccucgugauccgcccgucuc

SEQ ID NO: 932475 - RNA, 22 nt, Human
gaccucgugauccgcccgucuc

SEQ ID NO: 932476 - RNA, 24 nt, Human
gaccucgugauccgcccgucucgg

SEQ ID NO: 932477 - RNA, 24 nt, Human
gagaugggguuucaccguguuagc

SEQ ID NO: 932478 - RNA, 18 nt, Human
gauuacaggcaugagcca

SEQ ID NO: 932479 - RNA, 22 nt, Human
gauuacaggcaugagccaccgc

SEQ ID NO: 932480 - RNA, 22 nt, Human
gauuacaggcaugagccaccgc

SEQ ID NO: 932481 - RNA, 20 nt, Human
gccaaguuucuccaccauac

SEQ ID NO: 932482 - RNA, 24 nt, Human
gcccggcuaauuuuuuuguauuuu

SEQ ID NO: 932483 - RNA, 23 nt, Human
gccucuguugugauuuuccugau

SEQ ID NO: 932484 - RNA, 19 nt, Human
gccuguuuuuucccuuccg

SEQ ID NO: 932485 - RNA, 22 nt, Human
ggauuacaggcaugagccaccg

SEQ ID NO: 932486 - RNA, 18 nt, Human
gggguuucaccguguuag

SEQ ID NO: 932487 - RNA, 22 nt, Human
gggguuucaccguguuagccag

SEQ ID NO: 932488 - RNA, 19 nt, Human
guaccacaaucugucuucc

SEQ ID NO: 932489 - RNA, 19 nt, Human
guagagaugggguuucacc

SEQ ID NO: 932490 - RNA, 19 nt, Human
guagagaugggguuucacc

SEQ ID NO: 932491 - RNA, 19 nt, Human
guauuuuuuguagagaugg

SEQ ID NO: 932492 - RNA, 22 nt, Human
gucuuccuuuucuuucucauua

SEQ ID NO: 932493 - RNA, 20 nt, Human
gugacaauuucucugacucu

SEQ ID NO: 932494 - RNA, 23 nt, Human
guuuugguuagaaucacaugaga

SEQ ID NO: 932495 - RNA, 19 nt, Human
uaaggaaaaccagcauagg

SEQ ID NO: 932496 - RNA, 19 nt, Human
uacaaagauaguacaagac

SEQ ID NO: 932497 - RNA, 24 nt, Human
uacaggcaugagccaccgcgccca

SEQ ID NO: 932498 - RNA, 25 nt, Human
uaccccuaccaucgucacugucugc

SEQ ID NO: 932499 - RNA, 18 nt, Human
uagacacuaccccuacca

SEQ ID NO: 932500 - RNA, 18 nt, Human
uaucuuacuaguaugaag

SEQ ID NO: 932501 - RNA, 22 nt, Human
ucaaaagacauacggugagcac

SEQ ID NO: 932502 - RNA, 24 nt, Human
ucaaaagacauacggugagcacga

SEQ ID NO: 932503 - RNA, 24 nt, Human
ucaccguguuagccaggaugaucu

SEQ ID NO: 932504 - RNA, 19 nt, Human
ucacugucugccucuucuc

SEQ ID NO: 932505 - RNA, 24 nt, Human
ucaucugggcuggcuguucccgac

SEQ ID NO: 932506 - RNA, 24 nt, Human
ucccaaagugcugggauuacaggc

SEQ ID NO: 932507 - RNA, 20 nt, Human
ucucggccucccaaagugcu

SEQ ID NO: 932508 - RNA, 21 nt, Human
ucugaaaauccacucucucau

SEQ ID NO: 932509 - RNA, 24 nt, Human
ugaccuggaugaacuggcugaggu

SEQ ID NO: 932510 - RNA, 24 nt, Human
ugacuugugacaauuucucugacu

SEQ ID NO: 932511 - RNA, 22 nt, Human
ugagaaaguugcucaucugggc

SEQ ID NO: 932512 - RNA, 19 nt, Human
ugauaugcuauuauuaacu

SEQ ID NO: 932513 - RNA, 21 nt, Human
ugauaugcuauuauuaacuag

SEQ ID NO: 932514 - RNA, 24 nt, Human
ugccagacauaaggaaaaccagca

SEQ ID NO: 932515 - RNA, 19 nt, Human
uggaagaauucaaggagaa

SEQ ID NO: 932516 - RNA, 18 nt, Human
uggcugaggucguacuug

SEQ ID NO: 932517 - RNA, 18 nt, Human
ugggauuacaggcaugag

SEQ ID NO: 932518 - RNA, 19 nt, Human
ugggauuacaggcaugagc

SEQ ID NO: 932519 - RNA, 21 nt, Human
ugggauuacaggcaugagcca

SEQ ID NO: 932520 - RNA, 22 nt, Human
ugggauuacaggcaugagccac

SEQ ID NO: 932521 - RNA, 23 nt, Human
ugggauuacaggcaugagccacc

SEQ ID NO: 932522 - RNA, 24 nt, Human
ugggauuacaggcaugagccaccg

SEQ ID NO: 932523 - RNA, 24 nt, Human
ugggauuacaggcaugagccaccg

SEQ ID NO: 932524 - RNA, 26 nt, Human
ugggauuacaggcaugagccaccgcg

SEQ ID NO: 932525 - RNA, 24 nt, Human
ugggguuucaccguguuagccagg

SEQ ID NO: 932526 - RNA, 18 nt, Human
ugggucgaucacagcacc

SEQ ID NO: 932527 - RNA, 24 nt, Human
uguagagaugggguuucaccgugu

SEQ ID NO: 932528 - RNA, 24 nt, Human
uguccaugaaucauccauagcuuu

SEQ ID NO: 932529 - RNA, 24 nt, Human
uguguccuuaggcuccccugacuu

SEQ ID NO: 932530 - RNA, 21 nt, Human
uuaaagucucugaaaauccac

SEQ ID NO: 932531 - RNA, 20 nt, Human
uuaguuuuugccuguuuuuu

SEQ ID NO: 932532 - RNA, 22 nt, Human
uuaucugggucgaucacagcac

SEQ ID NO: 932533 - RNA, 23 nt, Human
uuccauuuuuuaaaauaaauguu

SEQ ID NO: 932534 - RNA, 21 nt, Human
uucucugacucuguuuuugau

SEQ ID NO: 932535 - RNA, 24 nt, Human
uuguagagaugggguuucaccgug

SEQ ID NO: 932536 - RNA, 24 nt, Human
uuuacagaaaaguuacaaagauag

SEQ ID NO: 932537 - RNA, 19 nt, Human
uuuaguggucauguguccu

SEQ ID NO: 932538 - RNA, 19 nt, Human
uuucaccguguuagccagg

SEQ ID NO: 932539 - RNA, 24 nt, Human
uuuguagagaugggguuucaccgu

SEQ ID NO: 932540 - RNA, 22 nt, Human
uuuuuuguagagaugggguuuc

SEQ ID NO: 932541 - RNA, 24 nt, Human
uuuuuuguagagaugggguuucac

SEQ ID NO: 932542 - RNA, 21 nt, Human
uuuuuuguauuuuuuguagag

SEQ ID NO: 932543 - RNA, 24 nt, Human
uuuuuuguauuuuuuguagagaug

SEQ ID NO: 932544 - RNA, 24 nt, Human
aaaaagaaaaaaagaugaggaaaa

SEQ ID NO: 932545 - RNA, 24 nt, Human
aaaaggaaacuaagggacagugaa

SEQ ID NO: 932546 - RNA, 19 nt, Human
aaaccuaaagcagauggcg

SEQ ID NO: 932547 - RNA, 20 nt, Human
aacaugguaaaacccugucu

SEQ ID NO: 932548 - RNA, 21 nt, Human
aacaugguaaaacccugucuc

SEQ ID NO: 932549 - RNA, 21 nt, Human
aaccaaugggaaaccuaaagc

SEQ ID NO: 932550 - RNA, 24 nt, Human
aagaaccuuuauuuaaccuaccaa

SEQ ID NO: 932551 - RNA, 24 nt, Human
aaucacuugaacccgggaggcaga

SEQ ID NO: 932552 - RNA, 23 nt, Human
acagagagagacucugucucaaa

SEQ ID NO: 932553 - RNA, 24 nt, Human
acagagagagacucugucucaaaa

SEQ ID NO: 932554 - RNA, 21 nt, Human
accaaacuaaaagagcaauaa

SEQ ID NO: 932555 - RNA, 24 nt, Human
accaacaugguaaaacccugucuc

SEQ ID NO: 932556 - RNA, 22 nt, Human
accaugcgguguaacaccugga

SEQ ID NO: 932557 - RNA, 24 nt, Human
acccugucucuacuaaaaauacaa

SEQ ID NO: 932558 - RNA, 24 nt, Human
accugaggucaggaguuugagacc

SEQ ID NO: 932559 - RNA, 22 nt, Human
acuucagccugggggacagaga

SEQ ID NO: 932560 - RNA, 24 nt, Human
agaaaaaggcagauucaguuucca

SEQ ID NO: 932561 - RNA, 22 nt, Human
agaaucacuugaacccgggagg

SEQ ID NO: 932562 - RNA, 18 nt, Human
agagagagacucugucuc

SEQ ID NO: 932563 - RNA, 18 nt, Human
agagguugcagugagcug

SEQ ID NO: 932564 - RNA, 22 nt, Human
agagguugcagugagcugagau

SEQ ID NO: 932565 - RNA, 23 nt, Human
agagguugcagugagcugagauc

SEQ ID NO: 932566 - RNA, 24 nt, Human
agagguugcagugagcugagauca

SEQ ID NO: 932567 - RNA, 20 nt, Human
agagguugcagugagcuggc

SEQ ID NO: 932568 - RNA, 20 nt, Human
agcaacuucuugggauuagc

SEQ ID NO: 932569 - RNA, 24 nt, Human
agcacuuugggaggccgaggcagg

SEQ ID NO: 932570 - RNA, 23 nt, Human
agccaggugugguggugggugcc

SEQ ID NO: 932571 - RNA, 18 nt, Human
agcccugugcauuagggu

SEQ ID NO: 932572 - RNA, 24 nt, Human
agccugggggacagagagagacuc

SEQ ID NO: 932573 - RNA, 20 nt, Human
aggaguuugagaccagccug

SEQ ID NO: 932574 - RNA, 20 nt, Human
aggcagagguugcagugagc

SEQ ID NO: 932575 - RNA, 24 nt, Human
aggcagagguugcagugagcugag

SEQ ID NO: 932576 - RNA, 18 nt, Human
aggcaggagaaucacuug

SEQ ID NO: 932577 - RNA, 24 nt, Human
aggcaggagaaucacuugaacccg

SEQ ID NO: 932578 - RNA, 18 nt, Human
aggcagguggaucaccug

SEQ ID NO: 932579 - RNA, 22 nt, Human
aggcagguggaucaccugaggu

SEQ ID NO: 932580 - RNA, 26 nt, Human
aggcagguggaucaccugaggucagg

SEQ ID NO: 932581 - RNA, 21 nt, Human
aggccgaggcagguggaucac

SEQ ID NO: 932582 - RNA, 24 nt, Human
aggcugaggcaggagaaucacuug

SEQ ID NO: 932583 - RNA, 24 nt, Human
aggugugguggugggugccuguaa

SEQ ID NO: 932584 - RNA, 24 nt, Human
aguggcucacgccuguaaucccag

SEQ ID NO: 932585 - RNA, 26 nt, Human
auaaaacuuuucuuaagacccuuaaa

SEQ ID NO: 932586 - RNA, 27 nt, Human
auaaaacuuuucuuaagacccuuaaaa

SEQ ID NO: 932587 - RNA, 24 nt, Human
auaggccgggcgcaguggcucacg

SEQ ID NO: 932588 - RNA, 20 nt, Human
auauauauauucaaccaccc

SEQ ID NO: 932589 - RNA, 23 nt, Human
augaaacaauacauucauuccuu

SEQ ID NO: 932590 - RNA, 22 nt, Human
caaaaaaaagaaaaaaagauga

SEQ ID NO: 932591 - RNA, 24 nt, Human
caacaugguaaaacccugucucua

SEQ ID NO: 932592 - RNA, 20 nt, Human
caaccaccccaaaagcccug

SEQ ID NO: 932593 - RNA, 24 nt, Human
caaguaagacugcugccacuuggg

SEQ ID NO: 932594 - RNA, 23 nt, Human
caccugaggucaggaguuugaga

SEQ ID NO: 932595 - RNA, 18 nt, Human
caccuggauauaccaauu

SEQ ID NO: 932596 - RNA, 24 nt, Human
cacgccuguaaucccagcacuuug

SEQ ID NO: 932597 - RNA, 24 nt, Human
cacugaccaauacagagaaaaggg

SEQ ID NO: 932598 - RNA, 26 nt, Human
cacuucagccugggggacagagagag

SEQ ID NO: 932599 - RNA, 26 nt, Human
cagaagauauauauauauucaaccac

SEQ ID NO: 932600 - RNA, 24 nt, Human
cagcacuuugggaggccgaggcag

SEQ ID NO: 932601 - RNA, 26 nt, Human
cagcacuuugggaggccgaggcaggu

SEQ ID NO: 932602 - RNA, 22 nt, Human
cagccugggggacagagagaga

SEQ ID NO: 932603 - RNA, 24 nt, Human
cagcuacucaggaggcugaggcag

SEQ ID NO: 932604 - RNA, 24 nt, Human
caggaggcugaggcaggagaauca

SEQ ID NO: 932605 - RNA, 19 nt, Human
ccgcugcacuucagccugg

SEQ ID NO: 932606 - RNA, 22 nt, Human
ccgcugcacuucagccuggggg

SEQ ID NO: 932607 - RNA, 24 nt, Human
ccgcugcacuucagccugggggac

SEQ ID NO: 932608 - RNA, 18 nt, Human
ccuaccaaacuaaaagag

SEQ ID NO: 932609 - RNA, 22 nt, Human
ccugaccaacaugguaaaaccc

SEQ ID NO: 932610 - RNA, 24 nt, Human
ccugaccaacaugguaaaacccug

SEQ ID NO: 932611 - RNA, 22 nt, Human
ccugaggucaggaguuugagac

SEQ ID NO: 932612 - RNA, 22 nt, Human
ccuguaaucccagcacuuuggg

SEQ ID NO: 932613 - RNA, 21 nt, Human
ccuguaaucccagcuacucag

SEQ ID NO: 932614 - RNA, 20 nt, Human
cgaggcagguggaucaccug

SEQ ID NO: 932615 - RNA, 24 nt, Human
cgaggcagguggaucaccugaggu

SEQ ID NO: 932616 - RNA, 26 nt, Human
cgaggcagguggaucaccugagguca

SEQ ID NO: 932617 - RNA, 18 nt, Human
cgcugcacuucagccugg

SEQ ID NO: 932618 - RNA, 25 nt, Human
cgcugcacuucagccugggggacag

SEQ ID NO: 932619 - RNA, 24 nt, Human
cgggaggcagagguugcagugagc

SEQ ID NO: 932620 - RNA, 20 nt, Human
cucaaaaaaaagaaaaaaag

SEQ ID NO: 932621 - RNA, 23 nt, Human
cucaaaaggauauccaacugaug

SEQ ID NO: 932622 - RNA, 22 nt, Human
cucacgccuguaaucccagcac

SEQ ID NO: 932623 - RNA, 24 nt, Human
cucacgccuguaaucccagcacuu

SEQ ID NO: 932624 - RNA, 20 nt, Human
cugcacuucagccuggggga

SEQ ID NO: 932625 - RNA, 22 nt, Human
cugcugccacuugggucugucu

SEQ ID NO: 932626 - RNA, 23 nt, Human
gagaccagccugaccaacauggu

SEQ ID NO: 932627 - RNA, 21 nt, Human
gaucaccugaggucaggaguu

SEQ ID NO: 932628 - RNA, 24 nt, Human
gaucaccugaggucaggaguuuga

SEQ ID NO: 932629 - RNA, 23 nt, Human
gcaggagaaucacuugaacccgg

SEQ ID NO: 932630 - RNA, 26 nt, Human
gccaaagcacuuccauuaaaaauuaa

SEQ ID NO: 932631 - RNA, 20 nt, Human
gcgcaguggcucacgccugu

SEQ ID NO: 932632 - RNA, 24 nt, Human
gcugcacuucagccugggggacag

SEQ ID NO: 932633 - RNA, 21 nt, Human
ggaaaccuaaagcagauggcg

SEQ ID NO: 932634 - RNA, 21 nt, Human
ggaaauaggccgggcgcagug

SEQ ID NO: 932635 - RNA, 23 nt, Human
ggcgcaguggcucacgccuguaa

SEQ ID NO: 932636 - RNA, 21 nt, Human
ggggacagagagagacucugu

SEQ ID NO: 932637 - RNA, 19 nt, Human
ggucaggaguuugagacca

SEQ ID NO: 932638 - RNA, 24 nt, Human
gguggugggugccuguaaucccag

SEQ ID NO: 932639 - RNA, 21 nt, Human
guggaucaccugaggucagga

SEQ ID NO: 932640 - RNA, 24 nt, Human
guugcagugagcugagaucaugcc

SEQ ID NO: 932641 - RNA, 24 nt, Human
uaaaaagaauuugcucauguuuuu

SEQ ID NO: 932642 - RNA, 22 nt, Human
uaaaagagcaauaaaauaaaaa

SEQ ID NO: 932643 - RNA, 24 nt, Human
uaaaagagcaauaaaauaaaaaua

SEQ ID NO: 932644 - RNA, 21 nt, Human
uaaaaggaaacuaagggacag

SEQ ID NO: 932645 - RNA, 23 nt, Human
uaaaaggaaacuaagggacagug

SEQ ID NO: 932646 - RNA, 21 nt, Human
uaaaauagaauguucugagug

SEQ ID NO: 932647 - RNA, 25 nt, Human
uaaauaauauacuuaaaauagaaug

SEQ ID NO: 932648 - RNA, 22 nt, Human
uaacaccuggauauaccaauug

SEQ ID NO: 932649 - RNA, 21 nt, Human
uaaccaaugggaaaccuaaag

SEQ ID NO: 932650 - RNA, 25 nt, Human
uaaccuaccaaacuaaaagagcaau

SEQ ID NO: 932651 - RNA, 25 nt, Human
uaagacugcugccacuugggucugu

SEQ ID NO: 932652 - RNA, 24 nt, Human
uaaucaaucuucuucugaucaauu

SEQ ID NO: 932653 - RNA, 19 nt, Human
uaccaugcgguguaacacc

SEQ ID NO: 932654 - RNA, 22 nt, Human
uauauauauauucaaccacccc

SEQ ID NO: 932655 - RNA, 20 nt, Human
uauauauauucaaccacccc

SEQ ID NO: 932656 - RNA, 24 nt, Human
uauauauauucaaccaccccaaaa

SEQ ID NO: 932657 - RNA, 21 nt, Human
uauauauucaaccaccccaaa

SEQ ID NO: 932658 - RNA, 18 nt, Human
ucaaugauuaguguaaug

SEQ ID NO: 932659 - RNA, 19 nt, Human
ucaccugaggucaggaguu

SEQ ID NO: 932660 - RNA, 23 nt, Human
ucaugccgcugcacuucagccug

SEQ ID NO: 932661 - RNA, 22 nt, Human
ucucuacuaaaaauacaaaaaa

SEQ ID NO: 932662 - RNA, 24 nt, Human
ucugaucaauuuguccauaguucu

SEQ ID NO: 932663 - RNA, 22 nt, Human
ucugucucaaaaaaaagaaaaa

SEQ ID NO: 932664 - RNA, 23 nt, Human
ucugucucaaaaaaaagaaaaaa

SEQ ID NO: 932665 - RNA, 24 nt, Human
ucugucucaaaaaaaagaaaaaaa

SEQ ID NO: 932666 - RNA, 23 nt, Human
ugaaacaauacauucauuccuuu

SEQ ID NO: 932667 - RNA, 24 nt, Human
ugaccaacaugguaaaacccuguc

SEQ ID NO: 932668 - RNA, 23 nt, Human
ugagaccagccugaccaacaugg

SEQ ID NO: 932669 - RNA, 22 nt, Human
ugaggaacugccaacaauaaau

SEQ ID NO: 932670 - RNA, 20 nt, Human
ugaggcaggagaaucacuug

SEQ ID NO: 932671 - RNA, 24 nt, Human
ugaggcaggagaaucacuugaacc

SEQ ID NO: 932672 - RNA, 25 nt, Human
ugaggcaggagaaucacuugaaccc

SEQ ID NO: 932673 - RNA, 18 nt, Human
ugaggucaggaguuugag

SEQ ID NO: 932674 - RNA, 23 nt, Human
ugagugucccagggcagcaacuu

SEQ ID NO: 932675 - RNA, 21 nt, Human
ugccacuugggucugucuguu

SEQ ID NO: 932676 - RNA, 23 nt, Human
ugccgcugcacuucagccugggg

SEQ ID NO: 932677 - RNA, 24 nt, Human
ugccuguaaucccagcuacucagg

SEQ ID NO: 932678 - RNA, 23 nt, Human
uggaucaccugaggucaggaguu

SEQ ID NO: 932679 - RNA, 24 nt, Human
uggaucaccugaggucaggaguuu

SEQ ID NO: 932680 - RNA, 27 nt, Human
uggaucaccugaggucaggaguuugag

SEQ ID NO: 932681 - RNA, 22 nt, Human
uggcucacgccuguaaucccag

SEQ ID NO: 932682 - RNA, 24 nt, Human
uggcucacgccuguaaucccagca

SEQ ID NO: 932683 - RNA, 24 nt, Human
ugggaggccgaggcagguggauca

SEQ ID NO: 932684 - RNA, 22 nt, Human
uggugggugccuguaaucccag

SEQ ID NO: 932685 - RNA, 24 nt, Human
uggugggugccuguaaucccagcu

SEQ ID NO: 932686 - RNA, 24 nt, Human
ugguggugggugccuguaauccca

SEQ ID NO: 932687 - RNA, 18 nt, Human
ugugggcauauauauaug

SEQ ID NO: 932688 - RNA, 21 nt, Human
uuaaaaauuaacaacagacac

SEQ ID NO: 932689 - RNA, 24 nt, Human
uuaccaagaaccuuuauuuaaccu

SEQ ID NO: 932690 - RNA, 24 nt, Human
uuagccaggugugguggugggugc

SEQ ID NO: 932691 - RNA, 24 nt, Human
uucagaauaaaaggaaacuaaggg

SEQ ID NO: 932692 - RNA, 18 nt, Human
uugcagugagcugagauc

SEQ ID NO: 932693 - RNA, 19 nt, Human
uugcagugagcugagauca

SEQ ID NO: 932694 - RNA, 20 nt, Human
uugcagugagcugagaucau

SEQ ID NO: 932695 - RNA, 25 nt, Human
uugggaggccgaggcagguggauca

SEQ ID NO: 932696 - RNA, 22 nt, Human
uuuaaaguaucuauuacuuuca

SEQ ID NO: 932697 - RNA, 19 nt, Human
uuuguccauaguucuggaa

SEQ ID NO: 932698 - RNA, 22 nt, Human
aaacagaaugagcuaguggcau

SEQ ID NO: 932699 - RNA, 24 nt, Human
aaacagaugugaaucuagcuucau

SEQ ID NO: 932700 - RNA, 25 nt, Human
aacagaaugagcuaguggcaugaga

SEQ ID NO: 932701 - RNA, 20 nt, Human
aagaaaaauacagagugcuc

SEQ ID NO: 932702 - RNA, 18 nt, Human
aagagggagggaagaaag

SEQ ID NO: 932703 - RNA, 24 nt, Human
aagcaagaaaaugagcuuaucuga

SEQ ID NO: 932704 - RNA, 19 nt, Human
aaucuacauuacaaacuuu

SEQ ID NO: 932705 - RNA, 23 nt, Human
agaaaaaaaauggaaucuacaaa

SEQ ID NO: 932706 - RNA, 24 nt, Human
agaaaaaaaauggaaucuacaaag

SEQ ID NO: 932707 - RNA, 22 nt, Human
agaagaaaaaagaaguagaaag

SEQ ID NO: 932708 - RNA, 18 nt, Human
agaaggagggagagaggg

SEQ ID NO: 932709 - RNA, 23 nt, Human
aggaagaaggugcaaaaagaagc

SEQ ID NO: 932710 - RNA, 25 nt, Human
aggaaggaagaaggugcaaaaagaa

SEQ ID NO: 932711 - RNA, 21 nt, Human
aguaagcagcaggguauacaa

SEQ ID NO: 932712 - RNA, 21 nt, Human
agucugcagagacagucaugg

SEQ ID NO: 932713 - RNA, 20 nt, Human
aguugugaaguuuaacagau

SEQ ID NO: 932714 - RNA, 22 nt, Human
aucccaaagccacagagcacac

SEQ ID NO: 932715 - RNA, 28 nt, Human
augaaaauacagauuagguauacaaaua

SEQ ID NO: 932716 - RNA, 18 nt, Human
augagcuuaucugauuua

SEQ ID NO: 932717 - RNA, 21 nt, Human
auugaaggacuauaagaggag

SEQ ID NO: 932718 - RNA, 24 nt, Human
caaaaagaagcuagcaggaaucug

SEQ ID NO: 932719 - RNA, 24 nt, Human
caaagaaaagaacauggcacccuu

SEQ ID NO: 932720 - RNA, 23 nt, Human
cacccuugaugagcugagauaag

SEQ ID NO: 932721 - RNA, 19 nt, Human
cagaagaaaaaagaaguag

SEQ ID NO: 932722 - RNA, 20 nt, Human
cagagcacacauuuaauuug

SEQ ID NO: 932723 - RNA, 23 nt, Human
cagagugcucuaagagagaauaa

SEQ ID NO: 932724 - RNA, 23 nt, Human
ccaaaaaaaaaaaaaaaaaaaaa

SEQ ID NO: 932725 - RNA, 19 nt, Human
ccaaagccacagagcacac

SEQ ID NO: 932726 - RNA, 18 nt, Human
cccaaaaaaaaaaaaaaa

SEQ ID NO: 932727 - RNA, 23 nt, Human
cccaaaaaaaaaaaaaaaaaaaa

SEQ ID NO: 932728 - RNA, 22 nt, Human
cuagaguuccacuugcuauaaa

SEQ ID NO: 932729 - RNA, 22 nt, Human
cucucuggagggcccauaaaag

SEQ ID NO: 932730 - RNA, 18 nt, Human
cugaaggcuauccuacug

SEQ ID NO: 932731 - RNA, 21 nt, Human
gaaagagggagggaagaaagg

SEQ ID NO: 932732 - RNA, 21 nt, Human
gaacugggcuacagaugccag

SEQ ID NO: 932733 - RNA, 20 nt, Human
gaagaaggugcaaaaagaag

SEQ ID NO: 932734 - RNA, 20 nt, Human
gaaggacuggguagugucag

SEQ ID NO: 932735 - RNA, 19 nt, Human
gaagugcagaggagaacug

SEQ ID NO: 932736 - RNA, 25 nt, Human
gagaauaacaauaggaaccgguacc

SEQ ID NO: 932737 - RNA, 21 nt, Human
gcaaggaaagagggagggaag

SEQ ID NO: 932738 - RNA, 21 nt, Human
gcagaggagaacugggcuaca

SEQ ID NO: 932739 - RNA, 19 nt, Human
ggagagagggaggaaggaa

SEQ ID NO: 932740 - RNA, 18 nt, Human
gugaaucuagcuucaugg

SEQ ID NO: 932741 - RNA, 19 nt, Human
uaaaaccauucccaauaga

SEQ ID NO: 932742 - RNA, 19 nt, Human
uacaaagaaaagaacaugg

SEQ ID NO: 932743 - RNA, 21 nt, Human
uacaaagaaaagaacauggca

SEQ ID NO: 932744 - RNA, 27 nt, Human
uaggagagaugacaaauuauacaaugg

SEQ ID NO: 932745 - RNA, 19 nt, Human
uaggggaacugauuaagua

SEQ ID NO: 932746 - RNA, 22 nt, Human
uaugaguagguauugaaauuac

SEQ ID NO: 932747 - RNA, 28 nt, Human
uauuuaucccaaaaaaaaaaaaaaaaaa

SEQ ID NO: 932748 - RNA, 20 nt, Human
ucccaaaaaaaaaaaaaaaa

SEQ ID NO: 932749 - RNA, 22 nt, Human
ucugaagugcagaggagaacug

SEQ ID NO: 932750 - RNA, 24 nt, Human
ucugcagagacagucaugggccag

SEQ ID NO: 932751 - RNA, 20 nt, Human
ugaaaaauagagcugaugcc

SEQ ID NO: 932752 - RNA, 23 nt, Human
ugaaaaauagagcugaugcccaa

SEQ ID NO: 932753 - RNA, 23 nt, Human
ugagaaaaaauuaauuaaugagg

SEQ ID NO: 932754 - RNA, 23 nt, Human
ugaggauaugaaaaauagagcug

SEQ ID NO: 932755 - RNA, 18 nt, Human
ugauagcaucccaaagcc

SEQ ID NO: 932756 - RNA, 22 nt, Human
ugcaaaaagaagcuagcaggaa

SEQ ID NO: 932757 - RNA, 18 nt, Human
ugcagaggagaacugggc

SEQ ID NO: 932758 - RNA, 21 nt, Human
ugucagcaauaauuuucaggu

SEQ ID NO: 932759 - RNA, 23 nt, Human
uuaucccaaaaaaaaaaaaaaaa

SEQ ID NO: 932760 - RNA, 21 nt, Human
uugauucugucaucauucuua

SEQ ID NO: 932761 - RNA, 27 nt, Human
uuggcaaaaggauggauuacugaggcc

SEQ ID NO: 932762 - RNA, 23 nt, Human
uuuuuuaagucacuaagguugcu

SEQ ID NO: 932763 - RNA, 24 nt, Human
aaauugcugggauuacaggcguga

SEQ ID NO: 932764 - RNA, 18 nt, Human
acgagguuucaccguguu

SEQ ID NO: 932765 - RNA, 20 nt, Human
acgagguuucaccguguuag

SEQ ID NO: 932766 - RNA, 20 nt, Human
acugcaagcuccgccucccg

SEQ ID NO: 932767 - RNA, 20 nt, Human
acuugcuguuaggaguuuga

SEQ ID NO: 932768 - RNA, 18 nt, Human
aguagcugggacuacagg

SEQ ID NO: 932769 - RNA, 24 nt, Human
agugcaauggcgccaucucggcuc

SEQ ID NO: 932770 - RNA, 22 nt, Human
auagcaguuauaaucuauggug

SEQ ID NO: 932771 - RNA, 24 nt, Human
augauccgccagccucagccuccc

SEQ ID NO: 932772 - RNA, 21 nt, Human
auucuccugccucagccuccc

SEQ ID NO: 932773 - RNA, 24 nt, Human
caaauugcugggauuacaggcgug

SEQ ID NO: 932774 - RNA, 28 nt, Human
caauaauaaauauaauuguguuaguuuc

SEQ ID NO: 932775 - RNA, 21 nt, Human
cacaguguuuuaaaauacuug

SEQ ID NO: 932776 - RNA, 18 nt, Human
caccguguuagccaggau

SEQ ID NO: 932777 - RNA, 24 nt, Human
caccguguuagccaggauggucuc

SEQ ID NO: 932778 - RNA, 22 nt, Human
cacgccauucuccugccucagc

SEQ ID NO: 932779 - RNA, 21 nt, Human
cagccucagccucccaaauug

SEQ ID NO: 932780 - RNA, 25 nt, Human
cagccucagccucccaaauugcugg

SEQ ID NO: 932781 - RNA, 21 nt, Human
caggugcccgccaucgcgccc

SEQ ID NO: 932782 - RNA, 24 nt, Human
caugauccgccagccucagccucc

SEQ ID NO: 932783 - RNA, 20 nt, Human
ccaaauugcugggauuacag

SEQ ID NO: 932784 - RNA, 22 nt, Human
ccaaauugcugggauuacaggc

SEQ ID NO: 932785 - RNA, 22 nt, Human
ccaaauugcugggauuacaggc

SEQ ID NO: 932786 - RNA, 24 nt, Human
ccaaauugcugggauuacaggcgu

SEQ ID NO: 932787 - RNA, 22 nt, Human
ccacuguggauauuuugaguau

SEQ ID NO: 932788 - RNA, 22 nt, Human
cccaggcuggagugcaauggcg

SEQ ID NO: 932789 - RNA, 23 nt, Human
cccgaguagcugggacuacaggu

SEQ ID NO: 932790 - RNA, 24 nt, Human
cccgaguagcugggacuacaggug

SEQ ID NO: 932791 - RNA, 24 nt, Human
ccgccagccucagccucccaaauu

SEQ ID NO: 932792 - RNA, 28 nt, Human
ccugaccucaugauccgccagccucagc

SEQ ID NO: 932793 - RNA, 23 nt, Human
ccugccucagccucccgaguagc

SEQ ID NO: 932794 - RNA, 24 nt, Human
cgagguuucaccguguuagccagg

SEQ ID NO: 932795 - RNA, 19 nt, Human
cgccucccggguucacgcc

SEQ ID NO: 932796 - RNA, 18 nt, Human
cguguccauuuaacugag

SEQ ID NO: 932797 - RNA, 25 nt, Human
cuaccaaaaaaagauagcaguuaua

SEQ ID NO: 932798 - RNA, 24 nt, Human
cucagccucccgaguagcugggac

SEQ ID NO: 932799 - RNA, 18 nt, Human
cucaugauccgccagccu

SEQ ID NO: 932800 - RNA, 21 nt, Human
cucccggguucacgccauucu

SEQ ID NO: 932801 - RNA, 20 nt, Human
cuccugaccucaugauccgc

SEQ ID NO: 932802 - RNA, 19 nt, Human
cucuuuuugcccaggcugg

SEQ ID NO: 932803 - RNA, 21 nt, Human
cucuuuuugcccaggcuggag

SEQ ID NO: 932804 - RNA, 22 nt, Human
cucuuuuugcccaggcuggagu

SEQ ID NO: 932805 - RNA, 23 nt, Human
cugccucagccucccgaguagcu

SEQ ID NO: 932806 - RNA, 18 nt, Human
cuggcucuuuuugcccag

SEQ ID NO: 932807 - RNA, 24 nt, Human
cuuuuugcccaggcuggagugcaa

SEQ ID NO: 932808 - RNA, 18 nt, Human
gaagaagacacuucuccg

SEQ ID NO: 932809 - RNA, 20 nt, Human
gaaguuggaagaagacacuu

SEQ ID NO: 932810 - RNA, 22 nt, Human
gaccucaugauccgccagccuc

SEQ ID NO: 932811 - RNA, 18 nt, Human
gauuacaggcgugagcca

SEQ ID NO: 932812 - RNA, 22 nt, Human
gauuacaggcgugagccaccgc

SEQ ID NO: 932813 - RNA, 22 nt, Human
gauuacaggcgugagccaccgc

SEQ ID NO: 932814 - RNA, 20 nt, Human
gcaacaaaaauuuaugaaga

SEQ ID NO: 932815 - RNA, 19 nt, Human
gcccaggcuggagugcaau

SEQ ID NO: 932816 - RNA, 25 nt, Human
gcccggcuaauuuuuuuuuguauuu

SEQ ID NO: 932817 - RNA, 25 nt, Human
gccucccggguucacgccauucucc

SEQ ID NO: 932818 - RNA, 21 nt, Human
gcucuuuuugcccaggcugga

SEQ ID NO: 932819 - RNA, 20 nt, Human
gcuggagugcaauggcgcca

SEQ ID NO: 932820 - RNA, 24 nt, Human
ggauggucucgaucuccugaccuc

SEQ ID NO: 932821 - RNA, 28 nt, Human
uaauuuuuuuuuguauuuuuaguagaga

SEQ ID NO: 932822 - RNA, 21 nt, Human
uacaggcgugagccaccgcgc

SEQ ID NO: 932823 - RNA, 22 nt, Human
uacaggcgugagccaccgcgcu

SEQ ID NO: 932824 - RNA, 18 nt, Human
uaccaaaaaaagauagca

SEQ ID NO: 932825 - RNA, 24 nt, Human
uaccaaaaaaagauagcaguuaua

SEQ ID NO: 932826 - RNA, 26 nt, Human
uaccaaaaaaagauagcaguuauaau

SEQ ID NO: 932827 - RNA, 26 nt, Human
uaccaaaaaaagauagcaguuauaau

SEQ ID NO: 932828 - RNA, 27 nt, Human
uagaauguaauuuuauucuuuaauaau

SEQ ID NO: 932829 - RNA, 21 nt, Human
uaguagagacgagguuucacc

SEQ ID NO: 932830 - RNA, 24 nt, Human
uaguagagacgagguuucaccgug

SEQ ID NO: 932831 - RNA, 25 nt, Human
uaguagagacgagguuucaccgugu

SEQ ID NO: 932832 - RNA, 18 nt, Human
uauauacuuauauaaaca

SEQ ID NO: 932833 - RNA, 24 nt, Human
ucaccguguuagccaggauggucu

SEQ ID NO: 932834 - RNA, 18 nt, Human
ucacugcaagcuccgccu

SEQ ID NO: 932835 - RNA, 19 nt, Human
ucacugcaagcuccgccuc

SEQ ID NO: 932836 - RNA, 24 nt, Human
ucacugcaagcuccgccucccggg

SEQ ID NO: 932837 - RNA, 23 nt, Human
ucagccucccgaguagcugggac

SEQ ID NO: 932838 - RNA, 24 nt, Human
ucccaaauugcugggauuacaggc

SEQ ID NO: 932839 - RNA, 23 nt, Human
ucccgaguagcugggacuacagg

SEQ ID NO: 932840 - RNA, 24 nt, Human
ucccgaguagcugggacuacaggu

SEQ ID NO: 932841 - RNA, 21 nt, Human
ucccggguucacgccauucuc

SEQ ID NO: 932842 - RNA, 24 nt, Human
ucccggguucacgccauucuccug

SEQ ID NO: 932843 - RNA, 24 nt, Human
ucuccugccucagccucccgagua

SEQ ID NO: 932844 - RNA, 24 nt, Human
ucuggcucuuuuugcccaggcugg

SEQ ID NO: 932845 - RNA, 23 nt, Human
ugaccuagucuagagguuaaugg

SEQ ID NO: 932846 - RNA, 24 nt, Human
ugcaaacuuuuacuuaggcuacug

SEQ ID NO: 932847 - RNA, 23 nt, Human
ugcaacaaaaauuuaugaagaaa

SEQ ID NO: 932848 - RNA, 18 nt, Human
ugcccaggcuggagugca

SEQ ID NO: 932849 - RNA, 21 nt, Human
ugcccaggcuggagugcaaug

SEQ ID NO: 932850 - RNA, 21 nt, Human
ugcccaggcuggagugcaaug

SEQ ID NO: 932851 - RNA, 24 nt, Human
ugccucagccucccgaguagcugg

SEQ ID NO: 932852 - RNA, 20 nt, Human
ugcugggauuacaggcguga

SEQ ID NO: 932853 - RNA, 24 nt, Human
ugcugggauuacaggcgugagcca

SEQ ID NO: 932854 - RNA, 23 nt, Human
uggagugcaauggcgccaucucg

SEQ ID NO: 932855 - RNA, 24 nt, Human
uggagugcaauggcgccaucucgg

SEQ ID NO: 932856 - RNA, 18 nt, Human
ugggacuacaggugcccg

SEQ ID NO: 932857 - RNA, 19 nt, Human
ugggacuacaggugcccgc

SEQ ID NO: 932858 - RNA, 21 nt, Human
ugggacuacaggugcccgcca

SEQ ID NO: 932859 - RNA, 21 nt, Human
ugggacuacaggugcccgcca

SEQ ID NO: 932860 - RNA, 22 nt, Human
ugggacuacaggugcccgccau

SEQ ID NO: 932861 - RNA, 24 nt, Human
ugggacuacaggugcccgccaucg

SEQ ID NO: 932862 - RNA, 18 nt, Human
ugggauuacaggcgugag

SEQ ID NO: 932863 - RNA, 19 nt, Human
ugggauuacaggcgugagc

SEQ ID NO: 932864 - RNA, 21 nt, Human
ugggauuacaggcgugagcca

SEQ ID NO: 932865 - RNA, 22 nt, Human
ugggauuacaggcgugagccac

SEQ ID NO: 932866 - RNA, 23 nt, Human
ugggauuacaggcgugagccacc

SEQ ID NO: 932867 - RNA, 24 nt, Human
ugggauuacaggcgugagccaccg

SEQ ID NO: 932868 - RNA, 22 nt, Human
uuaggcuacugguguuuuuggu

SEQ ID NO: 932869 - RNA, 22 nt, Human
uuaguagagacgagguuucacc

SEQ ID NO: 932870 - RNA, 24 nt, Human
uuaguagagacgagguuucaccgu

SEQ ID NO: 932871 - RNA, 23 nt, Human
uugaaaugaaguuggaagaagac

SEQ ID NO: 932872 - RNA, 24 nt, Human
uugaccucaaaaaacuaauuuaga

SEQ ID NO: 932873 - RNA, 25 nt, Human
uugaccucaaaaaacuaauuuagaa

SEQ ID NO: 932874 - RNA, 24 nt, Human
uugagacggagucuggcucuuuuu

SEQ ID NO: 932875 - RNA, 18 nt, Human
uugcccaggcuggagugc

SEQ ID NO: 932876 - RNA, 19 nt, Human
uuucaccguguuagccagg

SEQ ID NO: 932877 - RNA, 25 nt, Human
uuugaguaauccuaccaaaaaaaga

SEQ ID NO: 932878 - RNA, 18 nt, Human
uuugcuguuguuuuugac

SEQ ID NO: 932879 - RNA, 24 nt, Human
uuuuuaguagagacgagguuucac

SEQ ID NO: 932880 - RNA, 21 nt, Human
uuuuuguauuuuuaguagaga

SEQ ID NO: 932881 - RNA, 21 nt, Human
uuuuuuguauuuuuaguagag

SEQ ID NO: 932882 - RNA, 24 nt, Human
uuuuuuguauuuuuaguagagacg

SEQ ID NO: 932883 - RNA, 23 nt, Human
uuuuuuuuugagacggagucugg

SEQ ID NO: 932884 - RNA, 25 nt, Human
uuuuuuuuuuugagacggagucugg

SEQ ID NO: 932885 - RNA, 22 nt, Human
uuuuuuuuuuuuuugagacgga

SEQ ID NO: 932886 - RNA, 18 nt, Human
uuuuuuuuuuuuuuuuug

SEQ ID NO: 932887 - RNA, 18 nt, Human
uuuuauugaccacaugac

SEQ ID NO: 932888 - RNA, 26 nt, Human
aaaaauggcaaagaguuuuugccaaa

SEQ ID NO: 932889 - RNA, 21 nt, Human
agagcaguuuggaaaauauca

SEQ ID NO: 932890 - RNA, 22 nt, Human
agagcaguuuggaaaauaucau

SEQ ID NO: 932891 - RNA, 19 nt, Human
caaccaaaaauggcaaaga

SEQ ID NO: 932892 - RNA, 18 nt, Human
cauugcaguuuauuucuu

SEQ ID NO: 932893 - RNA, 19 nt, Human
cugggcugcuuaauauagu

SEQ ID NO: 932894 - RNA, 22 nt, Human
guuccaucaaaaucauugcagu

SEQ ID NO: 932895 - RNA, 23 nt, Human
ucagagcaguuuggaaaauauca

SEQ ID NO: 932896 - RNA, 20 nt, Human
ucuuuggaacaaauuacugc

SEQ ID NO: 932897 - RNA, 19 nt, Human
ugccaaaaacuuuuaaagg

SEQ ID NO: 932898 - RNA, 23 nt, Human
uggcaaagaguuuuugccaaaaa

SEQ ID NO: 932899 - RNA, 19 nt, Human
ugugcugguuagaucaggg

SEQ ID NO: 932900 - RNA, 23 nt, Human
uucuuuggaacaaauuacugcuu

SEQ ID NO: 932901 - RNA, 18 nt, Human
uugguagaagauucuucu

SEQ ID NO: 932902 - RNA, 21 nt, Human
uugguagaagauucuucuuug

SEQ ID NO: 932903 - RNA, 22 nt, Human
uuuugccaaaaacuuuuaaagg

SEQ ID NO: 932904 - RNA, 23 nt, Human
aaagagucaagacuauuuuaaaa

SEQ ID NO: 932905 - RNA, 20 nt, Human
aaauacauacuuucauaaca

SEQ ID NO: 932906 - RNA, 23 nt, Human
aaggagaaggugaagccagugaa

SEQ ID NO: 932907 - RNA, 23 nt, Human
acacacuuaaaauuuauccauug

SEQ ID NO: 932908 - RNA, 21 nt, Human
acacauucaaacaugagaaac

SEQ ID NO: 932909 - RNA, 23 nt, Human
acacauucaaacaugagaaacag

SEQ ID NO: 932910 - RNA, 24 nt, Human
acagcgucuguuacccaggcugga

SEQ ID NO: 932911 - RNA, 19 nt, Human
acccaggcuggagugcagu

SEQ ID NO: 932912 - RNA, 19 nt, Human
agagaaacaaaccccaugc

SEQ ID NO: 932913 - RNA, 24 nt, Human
agcgucuguuacccaggcuggagu

SEQ ID NO: 932914 - RNA, 22 nt, Human
aggcauggcggcucacacucag

SEQ ID NO: 932915 - RNA, 18 nt, Human
aggcuggagugcaguggc

SEQ ID NO: 932916 - RNA, 21 nt, Human
agugcaguggccugauccuag

SEQ ID NO: 932917 - RNA, 24 nt, Human
agugcaguggccugauccuagcuc

SEQ ID NO: 932918 - RNA, 22 nt, Human
auacaagcuguuuguauguaau

SEQ ID NO: 932919 - RNA, 24 nt, Human
auacauacuuucauaacaaaacua

SEQ ID NO: 932920 - RNA, 20 nt, Human
auauaaaauauaauacaagc

SEQ ID NO: 932921 - RNA, 23 nt, Human
aucaauuuagagaaacaaacccc

SEQ ID NO: 932922 - RNA, 23 nt, Human
augguauacaguauuuacaaaau

SEQ ID NO: 932923 - RNA, 23 nt, Human
caaaauacauacuuucauaacaa

SEQ ID NO: 932924 - RNA, 26 nt, Human
caaaucaauuuagagaaacaaacccc

SEQ ID NO: 932925 - RNA, 19 nt, Human
caaguacuaugcucaaaaa

SEQ ID NO: 932926 - RNA, 18 nt, Human
caaucuccacuucucagg

SEQ ID NO: 932927 - RNA, 19 nt, Human
cacacacaaagagucaaga

SEQ ID NO: 932928 - RNA, 18 nt, Human
cacauuuagaucuucacc

SEQ ID NO: 932929 - RNA, 20 nt, Human
caggcucaagagaugcuccc

SEQ ID NO: 932930 - RNA, 18 nt, Human
caguggccugauccuagc

SEQ ID NO: 932931 - RNA, 22 nt, Human
caucuccuagucacacauucaa

SEQ ID NO: 932932 - RNA, 21 nt, Human
ccaguaaaguagaagucaaaa

SEQ ID NO: 932933 - RNA, 19 nt, Human
ccugcaaugugggcagggc

SEQ ID NO: 932934 - RNA, 19 nt, Human
ccuuuuuuuugagacagcg

SEQ ID NO: 932935 - RNA, 20 nt, Human
ccuuuuuuuugagacagcgu

SEQ ID NO: 932936 - RNA, 23 nt, Human
cgucuguuacccaggcuggagug

SEQ ID NO: 932937 - RNA, 24 nt, Human
cucaaaaaccucaaugcugcuccu

SEQ ID NO: 932938 - RNA, 25 nt, Human
gaauggauauauaccaaaaccagaa

SEQ ID NO: 932939 - RNA, 22 nt, Human
gagaaggagaaggugaagccag

SEQ ID NO: 932940 - RNA, 20 nt, Human
gcagggcaaaauacauacuu

SEQ ID NO: 932941 - RNA, 19 nt, Human
gcgauggaugcugcuagga

SEQ ID NO: 932942 - RNA, 21 nt, Human
gcgucuguuacccaggcugga

SEQ ID NO: 932943 - RNA, 25 nt, Human
gcuggagugcaguggccugauccua

SEQ ID NO: 932944 - RNA, 20 nt, Human
uaaaauuagaggcauuaagc

SEQ ID NO: 932945 - RNA, 18 nt, Human
uaaaguagaagucaaaaa

SEQ ID NO: 932946 - RNA, 23 nt, Human
uaaaguagaagucaaaaaaaucc

SEQ ID NO: 932947 - RNA, 20 nt, Human
uaauauaccucucaaguaug

SEQ ID NO: 932948 - RNA, 21 nt, Human
uacccaggcuggagugcagug

SEQ ID NO: 932949 - RNA, 18 nt, Human
uagagaaacaaaccccau

SEQ ID NO: 932950 - RNA, 20 nt, Human
uagcaaaaaugggaauagga

SEQ ID NO: 932951 - RNA, 18 nt, Human
uauaaaauauaauacaag

SEQ ID NO: 932952 - RNA, 22 nt, Human
uauacacauaauacaugguaua

SEQ ID NO: 932953 - RNA, 24 nt, Human
uauggccaggcauggcggcucaca

SEQ ID NO: 932954 - RNA, 21 nt, Human
ucaagaguccagggauauggg

SEQ ID NO: 932955 - RNA, 22 nt, Human
ucaaguacuaugcucaaaaacc

SEQ ID NO: 932956 - RNA, 25 nt, Human
uccauuucuguaccaauuuucucaa

SEQ ID NO: 932957 - RNA, 21 nt, Human
ucucaggcucaagagaugcuc

SEQ ID NO: 932958 - RNA, 19 nt, Human
ucuguuacccaggcuggag

SEQ ID NO: 932959 - RNA, 24 nt, Human
ucuguuacccaggcuggagugcag

SEQ ID NO: 932960 - RNA, 20 nt, Human
ugagaaacagucacacacaa

SEQ ID NO: 932961 - RNA, 21 nt, Human
ugcaaauaaaaucggucuucc

SEQ ID NO: 932962 - RNA, 25 nt, Human
ugcaaucuccacuucucaggcucaa

SEQ ID NO: 932963 - RNA, 24 nt, Human
uggaauggauauauaccaaaacca

SEQ ID NO: 932964 - RNA, 19 nt, Human
uggagugcaguggccugau

SEQ ID NO: 932965 - RNA, 19 nt, Human
uggagugcaguggccugau

SEQ ID NO: 932966 - RNA, 18 nt, Human
uggauauauaccaaaacc

SEQ ID NO: 932967 - RNA, 18 nt, Human
uguauauauacaaaacac

SEQ ID NO: 932968 - RNA, 24 nt, Human
uuacccaggcuggagugcaguggc

SEQ ID NO: 932969 - RNA, 25 nt, Human
uucucaggcucaagagaugcucccg

SEQ ID NO: 932970 - RNA, 22 nt, Human
uucuguaccaauuuucucaaga

SEQ ID NO: 932971 - RNA, 23 nt, Human
uugucgcucagcaacgaagagag

SEQ ID NO: 932972 - RNA, 23 nt, Human
uuuagaucuucaccuugagauuu

SEQ ID NO: 932973 - RNA, 19 nt, Human
uuuagcaaaaaugggaaua

SEQ ID NO: 932974 - RNA, 19 nt, Human
uuuugagacagcgucuguu

SEQ ID NO: 932975 - RNA, 22 nt, Human
agaauuuacagggaaaaaugga

SEQ ID NO: 932976 - RNA, 22 nt, Human
agauuauuucuccccaaagcuc

SEQ ID NO: 932977 - RNA, 20 nt, Human
aucugcuggucaaaaugacu

SEQ ID NO: 932978 - RNA, 22 nt, Human
caaaaugacucuugccaguuga

SEQ ID NO: 932979 - RNA, 24 nt, Human
caguuguucauauuuggggugcag

SEQ ID NO: 932980 - RNA, 21 nt, Human
cauggguuuuuucuacaauuu

SEQ ID NO: 932981 - RNA, 19 nt, Human
cgggaaggaggcuguggau

SEQ ID NO: 932982 - RNA, 24 nt, Human
gagaauuuacagggaaaaauggag

SEQ ID NO: 932983 - RNA, 19 nt, Human
gcaucaggauggaguggug

SEQ ID NO: 932984 - RNA, 23 nt, Human
ggggcaucaggauggaguggugg

SEQ ID NO: 932985 - RNA, 22 nt, Human
ggguaguggugucuuuuguggu

SEQ ID NO: 932986 - RNA, 19 nt, Human
uauuuggggugcaggagua

SEQ ID NO: 932987 - RNA, 21 nt, Human
ucgggaaggaggcuguggaua

SEQ ID NO: 932988 - RNA, 22 nt, Human
ucuuacaguugauuaaucugcu

SEQ ID NO: 932989 - RNA, 18 nt, Human
ucuuuuguggugguggug

SEQ ID NO: 932990 - RNA, 24 nt, Human
ugcaggaguagggaggguaggauc

SEQ ID NO: 932991 - RNA, 21 nt, Human
ugcauggguuuuuucuacaau

SEQ ID NO: 932992 - RNA, 24 nt, Human
ugcauggguuuuuucuacaauuuc

SEQ ID NO: 932993 - RNA, 23 nt, Human
ugugguggugguggcaccugcug

SEQ ID NO: 932994 - RNA, 21 nt, Human
uucucauccaaaaauggaagc

SEQ ID NO: 932995 - RNA, 18 nt, Human
aaguuucagcgcccucca

SEQ ID NO: 932996 - RNA, 19 nt, Human
agugccagcuuggaauccc

SEQ ID NO: 932997 - RNA, 22 nt, Human
gauaaagaguuccagggaaaga

SEQ ID NO: 932998 - RNA, 22 nt, Human
ggaaagaaaggucacagugcuc

SEQ ID NO: 932999 - RNA, 24 nt, Human
gguuguguuguucauucuggcuag

SEQ ID NO: 933000 - RNA, 23 nt, Human
gucacagugcucgguaaacaacc

SEQ ID NO: 933001 - RNA, 23 nt, Human
uggcagugccagcuuggaauccc

SEQ ID NO: 933002 - RNA, 22 nt, Human
uggucuggggcugugacggccu

SEQ ID NO: 933003 - RNA, 21 nt, Human
ugugaugaaguuucagcgccc

SEQ ID NO: 933004 - RNA, 21 nt, Human
uuccagggaaagaaaggucac

SEQ ID NO: 933005 - RNA, 24 nt, Human
aaaaaacaaaaugaaguugcaaau

SEQ ID NO: 933006 - RNA, 24 nt, Human
aaacaaagggucaaugucaucaac

SEQ ID NO: 933007 - RNA, 27 nt, Human
uaaauaacauuuauaaaaaacaaaaug

SEQ ID NO: 933008 - RNA, 18 nt, Human
uaaaucaaguuaucauca

SEQ ID NO: 933009 - RNA, 20 nt, Human
ugacaauggaucaaaaauga

SEQ ID NO: 933010 - RNA, 20 nt, Human
uuaucaucagauacauuuaa

SEQ ID NO: 933011 - RNA, 19 nt, Human
uuuuuuguauaaauaacau

SEQ ID NO: 933012 - RNA, 19 nt, Human
uuuuuuuuuuuuuuuuugu

SEQ ID NO: 933013 - RNA, 20 nt, Human
uuuuuuuuuuuuuuuuuugg

SEQ ID NO: 933014 - RNA, 18 nt, Human
cggcggcgguggcggcgg

SEQ ID NO: 933015 - RNA, 18 nt, Human
cucggcggcgguggcggc

SEQ ID NO: 933016 - RNA, 26 nt, Human
cucggcggcgguggcggcggcucccu

SEQ ID NO: 933017 - RNA, 20 nt, Human
gcggcgguggcggcggcucc

SEQ ID NO: 933018 - RNA, 22 nt, Human
gcggcgguggcggcggcucccg

SEQ ID NO: 933019 - RNA, 25 nt, Human
gcggcgguggcggcggcucccggac

SEQ ID NO: 933020 - RNA, 21 nt, Human
gcgguggcggcggcucccgga

SEQ ID NO: 933021 - RNA, 25 nt, Human
uccugacuccucggcggcgguggcg

SEQ ID NO: 933022 - RNA, 18 nt, Human
ucuucagucuuuguauuu

SEQ ID NO: 933023 - RNA, 24 nt, Human
ugacuccucggcggcgguggcggc

SEQ ID NO: 933024 - RNA, 19 nt, Human
ugcugugaaauuucuucag

SEQ ID NO: 933025 - RNA, 24 nt, Human
uuccucaaauuugcuggagaaaua

SEQ ID NO: 933026 - RNA, 21 nt, Human
uuuguauuuacucaaacccuu

SEQ ID NO: 933027 - RNA, 22 nt, Human
aaacaaugucuacacaguucgu

SEQ ID NO: 933028 - RNA, 19 nt, Human
aaacacuucaauucuucuc

SEQ ID NO: 933029 - RNA, 19 nt, Human
aaagugcuaggauuacagg

SEQ ID NO: 933030 - RNA, 24 nt, Human
aaagugcuaggauuacaggcguga

SEQ ID NO: 933031 - RNA, 18 nt, Human
aaccucugccucccaggc

SEQ ID NO: 933032 - RNA, 27 nt, Human
aaguagccggaaucacaggcagaagcc

SEQ ID NO: 933033 - RNA, 26 nt, Human
aagugcuaggauuacaggcgugagcc

SEQ ID NO: 933034 - RNA, 23 nt, Human
accucggccucccaaagugcuag

SEQ ID NO: 933035 - RNA, 28 nt, Human
agaaaacaugauagaacuaaacacuuca

SEQ ID NO: 933036 - RNA, 19 nt, Human
agcgaucuacccaccucgg

SEQ ID NO: 933037 - RNA, 20 nt, Human
agugcaauggcgcaaucucg

SEQ ID NO: 933038 - RNA, 24 nt, Human
agugcaauggcgcaaucucggcuc

SEQ ID NO: 933039 - RNA, 24 nt, Human
caaagugcuaggauuacaggcgug

SEQ ID NO: 933040 - RNA, 23 nt, Human
caaccucugccucccaggcuuaa

SEQ ID NO: 933041 - RNA, 18 nt, Human
cacacaggcuagagugca

SEQ ID NO: 933042 - RNA, 24 nt, Human
caccucagccucccaaguagccgg

SEQ ID NO: 933043 - RNA, 19 nt, Human
cacgcccggccaaacaaaa

SEQ ID NO: 933044 - RNA, 18 nt, Human
cacugcaaccucugccuc

SEQ ID NO: 933045 - RNA, 21 nt, Human
cacugcaaccucugccuccca

SEQ ID NO: 933046 - RNA, 24 nt, Human
cagcgaaacccgaacacucccuuu

SEQ ID NO: 933047 - RNA, 18 nt, Human
cagcuccuuagagagagc

SEQ ID NO: 933048 - RNA, 20 nt, Human
cauguugcccaggcucgucu

SEQ ID NO: 933049 - RNA, 24 nt, Human
cauguugcccaggcucgucuugaa

SEQ ID NO: 933050 - RNA, 22 nt, Human
ccaaagugcuaggauuacaggc

SEQ ID NO: 933051 - RNA, 24 nt, Human
ccaaagugcuaggauuacaggcgu

SEQ ID NO: 933052 - RNA, 22 nt, Human
ccaccacgcccggccaaacaaa

SEQ ID NO: 933053 - RNA, 19 nt, Human
ccauguugcccaggcucgu

SEQ ID NO: 933054 - RNA, 21 nt, Human
ccauguugcccaggcucgucu

SEQ ID NO: 933055 - RNA, 23 nt, Human
cccaccucagccucccaaguagc

SEQ ID NO: 933056 - RNA, 18 nt, Human
cccagcgaaacccgaaca

SEQ ID NO: 933057 - RNA, 18 nt, Human
cccaggcuuaagcaaucc

SEQ ID NO: 933058 - RNA, 18 nt, Human
ccccagcgaaacccgaac

SEQ ID NO: 933059 - RNA, 28 nt, Human
cccgaacacucccuuucagaccguccuu

SEQ ID NO: 933060 - RNA, 22 nt, Human
ccuagggauugggcugccuucc

SEQ ID NO: 933061 - RNA, 23 nt, Human
ccucccaccucagccucccaagu

SEQ ID NO: 933062 - RNA, 26 nt, Human
ccucccaccucagccucccaaguagc

SEQ ID NO: 933063 - RNA, 24 nt, Human
ccugagcucaagcgaucuacccac

SEQ ID NO: 933064 - RNA, 24 nt, Human
cgaucuacccaccucggccuccca

SEQ ID NO: 933065 - RNA, 23 nt, Human
cggcauuugccauguugcccagg

SEQ ID NO: 933066 - RNA, 25 nt, Human
cgugagccaccacgcccggccaaac

SEQ ID NO: 933067 - RNA, 24 nt, Human
cucaagcgaucuacccaccucggc

SEQ ID NO: 933068 - RNA, 24 nt, Human
cucacugcaaccucugccucccag

SEQ ID NO: 933069 - RNA, 24 nt, Human
cucacugcaaccucugccucccag

SEQ ID NO: 933070 - RNA, 26 nt, Human
cucccaggcuuaagcaaucccuccca

SEQ ID NO: 933071 - RNA, 20 nt, Human
cucugucacacaggcuagag

SEQ ID NO: 933072 - RNA, 23 nt, Human
cugcaaccucugccucccaggcu

SEQ ID NO: 933073 - RNA, 24 nt, Human
cugcaaccucugccucccaggcuu

SEQ ID NO: 933074 - RNA, 24 nt, Human
gagcucaagcgaucuacccaccuc

SEQ ID NO: 933075 - RNA, 21 nt, Human
gagguucaaguccuuuuccca

SEQ ID NO: 933076 - RNA, 18 nt, Human
gauuacaggcgugagcca

SEQ ID NO: 933077 - RNA, 21 nt, Human
gauuacaggcgugagccacca

SEQ ID NO: 933078 - RNA, 22 nt, Human
gauuacaggcgugagccaccac

SEQ ID NO: 933079 - RNA, 24 nt, Human
gcgaucuacccaccucggccuccc

SEQ ID NO: 933080 - RNA, 19 nt, Human
gcuagagugcaauggcgca

SEQ ID NO: 933081 - RNA, 20 nt, Human
ggaaucacaggcagaagcca

SEQ ID NO: 933082 - RNA, 23 nt, Human
ggaaucacaggcagaagccaccg

SEQ ID NO: 933083 - RNA, 19 nt, Human
ggauuacaggcgugagcca

SEQ ID NO: 933084 - RNA, 22 nt, Human
ggauuacaggcgugagccacca

SEQ ID NO: 933085 - RNA, 22 nt, Human
ggcauuugccauguugcccagg

SEQ ID NO: 933086 - RNA, 22 nt, Human
uaauaaaaacaaugucuacaca

SEQ ID NO: 933087 - RNA, 25 nt, Human
uaauuuuaguauuuuuuugcagaga

SEQ ID NO: 933088 - RNA, 23 nt, Human
uacaggcgugagccaccacgccc

SEQ ID NO: 933089 - RNA, 22 nt, Human
uacccaccucggccucccaaag

SEQ ID NO: 933090 - RNA, 23 nt, Human
uacccaccucggccucccaaagu

SEQ ID NO: 933091 - RNA, 22 nt, Human
uagagugcaauggcgcaaucuc

SEQ ID NO: 933092 - RNA, 24 nt, Human
uagccggaaucacaggcagaagcc

SEQ ID NO: 933093 - RNA, 18 nt, Human
uaggauuacaggcgugag

SEQ ID NO: 933094 - RNA, 19 nt, Human
uaggauuacaggcgugagc

SEQ ID NO: 933095 - RNA, 22 nt, Human
uaggauuacaggcgugagccac

SEQ ID NO: 933096 - RNA, 24 nt, Human
uaggauuacaggcgugagccacca

SEQ ID NO: 933097 - RNA, 21 nt, Human
ucaaccgugagagggguuccc

SEQ ID NO: 933098 - RNA, 20 nt, Human
ucacaggcagaagccaccgc

SEQ ID NO: 933099 - RNA, 19 nt, Human
ucacugcaaccucugccuc

SEQ ID NO: 933100 - RNA, 24 nt, Human
ucacugcaaccucugccucccagg

SEQ ID NO: 933101 - RNA, 25 nt, Human
ucacugcaaccucugccucccaggc

SEQ ID NO: 933102 - RNA, 20 nt, Human
ucagccucccaaguagccgg

SEQ ID NO: 933103 - RNA, 21 nt, Human
ucagccucccaaguagccgga

SEQ ID NO: 933104 - RNA, 24 nt, Human
ucccaaagugcuaggauuacaggc

SEQ ID NO: 933105 - RNA, 18 nt, Human
ucccaggcuuaagcaauc

SEQ ID NO: 933106 - RNA, 18 nt, Human
ucggccucccaaagugcu

SEQ ID NO: 933107 - RNA, 24 nt, Human
ucugucacacaggcuagagugcaa

SEQ ID NO: 933108 - RNA, 18 nt, Human
ucuugaacuccugagcuc

SEQ ID NO: 933109 - RNA, 23 nt, Human
ucuugaacuccugagcucaagcg

SEQ ID NO: 933110 - RNA, 19 nt, Human
ucuugcucugucacacagg

SEQ ID NO: 933111 - RNA, 24 nt, Human
ucuugcucugucacacaggcuaga

SEQ ID NO: 933112 - RNA, 22 nt, Human
ugagacagggucuugcucuguc

SEQ ID NO: 933113 - RNA, 23 nt, Human
ugcaauggcgcaaucucggcuca

SEQ ID NO: 933114 - RNA, 23 nt, Human
ugcagagacggcauuugccaugu

SEQ ID NO: 933115 - RNA, 24 nt, Human
ugccauguugcccaggcucgucuu

SEQ ID NO: 933116 - RNA, 31 nt, Human
ugccauguugcccaggcucgucuugaacucc

SEQ ID NO: 933117 - RNA, 24 nt, Human
ugcccaggcucgucuugaacuccu

SEQ ID NO: 933118 - RNA, 24 nt, Human
ugcuaggauuacaggcgugagcca

SEQ ID NO: 933119 - RNA, 22 nt, Human
uggcagggcguaaaaagguaau

SEQ ID NO: 933120 - RNA, 22 nt, Human
uucaaguccuuuucccauuguc

SEQ ID NO: 933121 - RNA, 22 nt, Human
uugagacagggucuugcucugu

SEQ ID NO: 933122 - RNA, 18 nt, Human
uugccauguugcccaggc

SEQ ID NO: 933123 - RNA, 24 nt, Human
aacauuucuucuccgcaccuacua

SEQ ID NO: 933124 - RNA, 23 nt, Human
aacccccucccacagauccccug

SEQ ID NO: 933125 - RNA, 20 nt, Human
aagagucuguucauccuuug

SEQ ID NO: 933126 - RNA, 23 nt, Human
accaggaaugaccccuuggucca

SEQ ID NO: 933127 - RNA, 22 nt, Human
acccccucccacagauccccug

SEQ ID NO: 933128 - RNA, 24 nt, Human
acccugaacaggcaguaagagaga

SEQ ID NO: 933129 - RNA, 23 nt, Human
accucauuuucuucaucugccaa

SEQ ID NO: 933130 - RNA, 20 nt, Human
aggcacagaggaggggaggg

SEQ ID NO: 933131 - RNA, 18 nt, Human
agggauggggaucgugaa

SEQ ID NO: 933132 - RNA, 24 nt, Human
auauacauacauugcuggugugug

SEQ ID NO: 933133 - RNA, 22 nt, Human
caccugacucugaccauucauc

SEQ ID NO: 933134 - RNA, 19 nt, Human
cacgagguugaauguagca

SEQ ID NO: 933135 - RNA, 22 nt, Human
cagaaugaauaaaugaagaguc

SEQ ID NO: 933136 - RNA, 24 nt, Human
cagauccccugcagggcaaagccu

SEQ ID NO: 933137 - RNA, 21 nt, Human
cauccugggcucaucugcucc

SEQ ID NO: 933138 - RNA, 22 nt, Human
ccagggucccucucugugcucc

SEQ ID NO: 933139 - RNA, 19 nt, Human
cccaggccaaguucccagg

SEQ ID NO: 933140 - RNA, 19 nt, Human
cccccggagacccucaauu

SEQ ID NO: 933141 - RNA, 20 nt, Human
cccccggagacccucaauuc

SEQ ID NO: 933142 - RNA, 21 nt, Human
ccccuugguccacagagcucu

SEQ ID NO: 933143 - RNA, 22 nt, Human
cccucccacagauccccugcag

SEQ ID NO: 933144 - RNA, 22 nt, Human
ccuccuaacccccucccacaga

SEQ ID NO: 933145 - RNA, 18 nt, Human
ccugaacaggcaguaaga

SEQ ID NO: 933146 - RNA, 24 nt, Human
cggagacccucaauucuggacuga

SEQ ID NO: 933147 - RNA, 20 nt, Human
cgggcagcaccugacucuga

SEQ ID NO: 933148 - RNA, 24 nt, Human
cuaggcacagaggaggggaggggg

SEQ ID NO: 933149 - RNA, 23 nt, Human
cucauaacaaugccgcuuccucc

SEQ ID NO: 933150 - RNA, 19 nt, Human
cucccuccuaacccccucc

SEQ ID NO: 933151 - RNA, 21 nt, Human
cucccuccuaacccccuccca

SEQ ID NO: 933152 - RNA, 22 nt, Human
cucccuggacucgugaccuccg

SEQ ID NO: 933153 - RNA, 23 nt, Human
cucucugcaccucauuuucuuca

SEQ ID NO: 933154 - RNA, 23 nt, Human
cugcaccucauuuucuucaucug

SEQ ID NO: 933155 - RNA, 21 nt, Human
cuucugggauucuagccaugu

SEQ ID NO: 933156 - RNA, 18 nt, Human
gaccccuugguccacaga

SEQ ID NO: 933157 - RNA, 26 nt, Human
gcagggcaaagccucugcccuccccc

SEQ ID NO: 933158 - RNA, 23 nt, Human
gccucccuugcuuucccagagac

SEQ ID NO: 933159 - RNA, 23 nt, Human
ggaaugaccccuugguccacaga

SEQ ID NO: 933160 - RNA, 18 nt, Human
ggggaucgugaagcucug

SEQ ID NO: 933161 - RNA, 23 nt, Human
uaacaaugccgcuuccuccagga

SEQ ID NO: 933162 - RNA, 21 nt, Human
uaacccccucccacagauccc

SEQ ID NO: 933163 - RNA, 19 nt, Human
uacauacauugcuggugug

SEQ ID NO: 933164 - RNA, 20 nt, Human
uacauacauugcuggugugu

SEQ ID NO: 933165 - RNA, 20 nt, Human
ucccacagauccccugcagg

SEQ ID NO: 933166 - RNA, 20 nt, Human
ucccagagacagcuguggcu

SEQ ID NO: 933167 - RNA, 19 nt, Human
ucccagggucccucucugu

SEQ ID NO: 933168 - RNA, 24 nt, Human
uccccugcagggcaaagccucugc

SEQ ID NO: 933169 - RNA, 22 nt, Human
ucccuugcuuucccagagacag

SEQ ID NO: 933170 - RNA, 22 nt, Human
uccgccgggcagcaccugacuc

SEQ ID NO: 933171 - RNA, 20 nt, Human
ucugaccauucauccugggc

SEQ ID NO: 933172 - RNA, 20 nt, Human
ucugaccauucauccugggg

SEQ ID NO: 933173 - RNA, 23 nt, Human
ucugcucccuccuaacccccucc

SEQ ID NO: 933174 - RNA, 24 nt, Human
ucugguguaugcauggaggugggg

SEQ ID NO: 933175 - RNA, 19 nt, Human
ugauccccucccuggacuc

SEQ ID NO: 933176 - RNA, 20 nt, Human
ugcauggagguggggggugg

SEQ ID NO: 933177 - RNA, 22 nt, Human
ugcucaaauacauuuugcugau

SEQ ID NO: 933178 - RNA, 23 nt, Human
ugcucccuccuaacccccuccca

SEQ ID NO: 933179 - RNA, 18 nt, Human
uggagguggggggugggc

SEQ ID NO: 933180 - RNA, 18 nt, Human
ugguuguucagggauggg

SEQ ID NO: 933181 - RNA, 18 nt, Human
ugucucuuccuucaaggc

SEQ ID NO: 933182 - RNA, 18 nt, Human
uucccaggccaaguuccc

SEQ ID NO: 933183 - RNA, 21 nt, Human
uuccuucaaggcucauaacaa

SEQ ID NO: 933184 - RNA, 19 nt, Human
aaaaaaccccacacauaca

SEQ ID NO: 933185 - RNA, 21 nt, Human
aaaagccaaaucaaacucaaa

SEQ ID NO: 933186 - RNA, 19 nt, Human
aaacaagccgaaugccacc

SEQ ID NO: 933187 - RNA, 23 nt, Human
aaacaagccgaaugccaccaaag

SEQ ID NO: 933188 - RNA, 21 nt, Human
aaagacaaaaacauguccaca

SEQ ID NO: 933189 - RNA, 21 nt, Human
aaauggccauauuuucaaaaa

SEQ ID NO: 933190 - RNA, 24 nt, Human
aacacagaaacauaagaaagaccc

SEQ ID NO: 933191 - RNA, 26 nt, Human
aacagaccagagcauggcagugggca

SEQ ID NO: 933192 - RNA, 22 nt, Human
aaccaaacaaacaaaccuaaga

SEQ ID NO: 933193 - RNA, 20 nt, Human
aacuaaagaaaauaaaacaa

SEQ ID NO: 933194 - RNA, 24 nt, Human
aagaaaaaaguaaaaacccuacag

SEQ ID NO: 933195 - RNA, 21 nt, Human
aagaaacucaguuuauaaaac

SEQ ID NO: 933196 - RNA, 23 nt, Human
aagauggcaauguuugggugacc

SEQ ID NO: 933197 - RNA, 23 nt, Human
aagcacaauaauaauaacauuac

SEQ ID NO: 933198 - RNA, 22 nt, Human
aaguacuuuuguucaugagguu

SEQ ID NO: 933199 - RNA, 22 nt, Human
acaauaauaauaacauuacgaa

SEQ ID NO: 933200 - RNA, 19 nt, Human
acacaaauucuugauaccc

SEQ ID NO: 933201 - RNA, 21 nt, Human
acacaacauaucuaucuguac

SEQ ID NO: 933202 - RNA, 23 nt, Human
acacagaaacauaagaaagaccc

SEQ ID NO: 933203 - RNA, 24 nt, Human
acacaguucacuggaucaaacacu

SEQ ID NO: 933204 - RNA, 18 nt, Human
acacuguuuaauuuugga

SEQ ID NO: 933205 - RNA, 22 nt, Human
acagaaacauaagaaagacccc

SEQ ID NO: 933206 - RNA, 19 nt, Human
acauacuauuuacacagaa

SEQ ID NO: 933207 - RNA, 24 nt, Human
acauguaugucucaucacaucaca

SEQ ID NO: 933208 - RNA, 24 nt, Human
acuaaaaaaaccugaaaauuuuua

SEQ ID NO: 933209 - RNA, 28 nt, Human
acuaaaccuauuaacuagcacacacgcc

SEQ ID NO: 933210 - RNA, 21 nt, Human
agaaagacaaaagcauaaagg

SEQ ID NO: 933211 - RNA, 23 nt, Human
agaaagacccccauuaguauguu

SEQ ID NO: 933212 - RNA, 23 nt, Human
agaaauuauuuuguugccuggga

SEQ ID NO: 933213 - RNA, 22 nt, Human
agacaaaagcauaaaaaauaua

SEQ ID NO: 933214 - RNA, 20 nt, Human
agagauuugugagaagaugg

SEQ ID NO: 933215 - RNA, 22 nt, Human
agagcaaggaggcagaaagugc

SEQ ID NO: 933216 - RNA, 23 nt, Human
agagcaaggaggcagaaagugcc

SEQ ID NO: 933217 - RNA, 21 nt, Human
agcaaggaggcagaaagugcc

SEQ ID NO: 933218 - RNA, 23 nt, Human
agcaaggaggcagaaagugccaa

SEQ ID NO: 933219 - RNA, 21 nt, Human
aggaacccagggguccauugg

SEQ ID NO: 933220 - RNA, 24 nt, Human
aggaaguauaauuuuuugugacau

SEQ ID NO: 933221 - RNA, 23 nt, Human
aggcauguaaaccauucuacagg

SEQ ID NO: 933222 - RNA, 21 nt, Human
aguaaacccauuacaugcuaa

SEQ ID NO: 933223 - RNA, 20 nt, Human
auaguccccccugaaaggcu

SEQ ID NO: 933224 - RNA, 25 nt, Human
aucacaucacagaaagacccccauu

SEQ ID NO: 933225 - RNA, 20 nt, Human
auggauaaugauucuauaac

SEQ ID NO: 933226 - RNA, 24 nt, Human
caaaacaagccgaaugccaccaaa

SEQ ID NO: 933227 - RNA, 25 nt, Human
caaacaaacaaaccuaagauaaugu

SEQ ID NO: 933228 - RNA, 21 nt, Human
caaaccaaacaaacaaaccua

SEQ ID NO: 933229 - RNA, 22 nt, Human
caaaccaaacaaacaaaccuaa

SEQ ID NO: 933230 - RNA, 22 nt, Human
caagaaaaaaguaaaaacccua

SEQ ID NO: 933231 - RNA, 22 nt, Human
caagaugcuaagaaaacacugu

SEQ ID NO: 933232 - RNA, 23 nt, Human
caagccgaaugccaccaaauacc

SEQ ID NO: 933233 - RNA, 23 nt, Human
caauaggaaaagaagaaaucauu

SEQ ID NO: 933234 - RNA, 20 nt, Human
cacaguuucagaacagacca

SEQ ID NO: 933235 - RNA, 23 nt, Human
caccaaauaccuuauugcuaucu

SEQ ID NO: 933236 - RNA, 18 nt, Human
cagaccagagcauggcag

SEQ ID NO: 933237 - RNA, 23 nt, Human
cagcgggucccgcuccgcuacuc

SEQ ID NO: 933238 - RNA, 22 nt, Human
cauauauacacuuacauguaug

SEQ ID NO: 933239 - RNA, 20 nt, Human
caucacagaaagacccccau

SEQ ID NO: 933240 - RNA, 21 nt, Human
caucacaucacagaaagaccc

SEQ ID NO: 933241 - RNA, 18 nt, Human
cauguccacacaaaaggu

SEQ ID NO: 933242 - RNA, 18 nt, Human
ccaaaaacacagaaacau

SEQ ID NO: 933243 - RNA, 18 nt, Human
ccaaacaaacaaaccuaa

SEQ ID NO: 933244 - RNA, 20 nt, Human
ccaaacaaacaaaccuaaga

SEQ ID NO: 933245 - RNA, 19 nt, Human
ccaacagucuaaaaagcua

SEQ ID NO: 933246 - RNA, 22 nt, Human
ccagggcaggacucggggagga

SEQ ID NO: 933247 - RNA, 24 nt, Human
ccccucaguguuccuccuuccuuu

SEQ ID NO: 933248 - RNA, 18 nt, Human
cccucaguguuccuccuu

SEQ ID NO: 933249 - RNA, 19 nt, Human
ccuguucucucugcuccaa

SEQ ID NO: 933250 - RNA, 19 nt, Human
ccuucugccugccucauca

SEQ ID NO: 933251 - RNA, 19 nt, Human
cgaaugcuaagaaacucag

SEQ ID NO: 933252 - RNA, 18 nt, Human
cgguaagaguccaauaaa

SEQ ID NO: 933253 - RNA, 23 nt, Human
cucauacaauuuaggaaaacaga

SEQ ID NO: 933254 - RNA, 18 nt, Human
cucuaaaaagcagcauua

SEQ ID NO: 933255 - RNA, 24 nt, Human
cuggacccccuuacacuuacgcuc

SEQ ID NO: 933256 - RNA, 22 nt, Human
gaaaauacaaaaggaaguagca

SEQ ID NO: 933257 - RNA, 18 nt, Human
gaaaugacacaccugaaa

SEQ ID NO: 933258 - RNA, 21 nt, Human
gaggagucuguagggauggag

SEQ ID NO: 933259 - RNA, 19 nt, Human
gcaaaaaugagcauggaua

SEQ ID NO: 933260 - RNA, 22 nt, Human
gccugacauuaaagacaaaaac

SEQ ID NO: 933261 - RNA, 18 nt, Human
gcucacacacacuuuuuc

SEQ ID NO: 933262 - RNA, 18 nt, Human
ggaaaacagaggggaaaa

SEQ ID NO: 933263 - RNA, 19 nt, Human
ggacaaaugauguuauccc

SEQ ID NO: 933264 - RNA, 19 nt, Human
guuucuggcacgucccugg

SEQ ID NO: 933265 - RNA, 26 nt, Human
uaaaaaaaccugaaaauuuuuaaagg

SEQ ID NO: 933266 - RNA, 23 nt, Human
uaaaagccaaaucaaacucaaac

SEQ ID NO: 933267 - RNA, 19 nt, Human
uaaagaaaaaaaccccaca

SEQ ID NO: 933268 - RNA, 19 nt, Human
uaaaguugcaagaaaucac

SEQ ID NO: 933269 - RNA, 23 nt, Human
uaacagcccacacacucagauua

SEQ ID NO: 933270 - RNA, 28 nt, Human
uaacuaaacucuuaagggcuugaaaauu

SEQ ID NO: 933271 - RNA, 21 nt, Human
uaagaaaacacuguuuaauuu

SEQ ID NO: 933272 - RNA, 24 nt, Human
uaagaaacucaguuuauaaaacca

SEQ ID NO: 933273 - RNA, 21 nt, Human
uaagaaagacaaaagcauaaa

SEQ ID NO: 933274 - RNA, 18 nt, Human
uaagaaagacccuaccua

SEQ ID NO: 933275 - RNA, 18 nt, Human
uaagaaagguacuaaaua

SEQ ID NO: 933276 - RNA, 18 nt, Human
uacaugcuaacacaaaua

SEQ ID NO: 933277 - RNA, 23 nt, Human
uaccaaaaacacagaaacauaag

SEQ ID NO: 933278 - RNA, 19 nt, Human
uaggaaaagaagaaaucau

SEQ ID NO: 933279 - RNA, 23 nt, Human
uaggauuccagacacaacuacug

SEQ ID NO: 933280 - RNA, 20 nt, Human
uagguaaucuggcucuauga

SEQ ID NO: 933281 - RNA, 26 nt, Human
uauaacaagaaacaaaacuaaagaaa

SEQ ID NO: 933282 - RNA, 28 nt, Human
ucaaacaucaacauucauucugauacuu

SEQ ID NO: 933283 - RNA, 18 nt, Human
ucaagaaugacuaugugu

SEQ ID NO: 933284 - RNA, 19 nt, Human
ucaaucagguaagaaagac

SEQ ID NO: 933285 - RNA, 21 nt, Human
ucauuuaaaaauaaagaaaaa

SEQ ID NO: 933286 - RNA, 21 nt, Human
uccaagaaaaaaguaaaaacc

SEQ ID NO: 933287 - RNA, 18 nt, Human
uccaguuugcaaaaaucu

SEQ ID NO: 933288 - RNA, 18 nt, Human
uccauuggccauacuuug

SEQ ID NO: 933289 - RNA, 21 nt, Human
ucccgcuccgcuacucgcgga

SEQ ID NO: 933290 - RNA, 18 nt, Human
ucccuagguaaucuggcu

SEQ ID NO: 933291 - RNA, 25 nt, Human
ucuaaaacuuuuggucucuggaccc

SEQ ID NO: 933292 - RNA, 19 nt, Human
ucuaaucuaaagccugaca

SEQ ID NO: 933293 - RNA, 28 nt, Human
ucuauaacaagaaacaaaaccggggucc

SEQ ID NO: 933294 - RNA, 21 nt, Human
ucucucugcuccaagaaaaaa

SEQ ID NO: 933295 - RNA, 19 nt, Human
ucuggacccccuuacacuu

SEQ ID NO: 933296 - RNA, 19 nt, Human
ucuuaagggcuugaaaauu

SEQ ID NO: 933297 - RNA, 18 nt, Human
ugaaaaguuuggaagugg

SEQ ID NO: 933298 - RNA, 22 nt, Human
ugaaaggcucucaaggaaccca

SEQ ID NO: 933299 - RNA, 24 nt, Human
ugaacaacugucuuguuuucuuuu

SEQ ID NO: 933300 - RNA, 19 nt, Human
ugagaucuguguggggcua

SEQ ID NO: 933301 - RNA, 23 nt, Human
ugauauacaauagcagguucuug

SEQ ID NO: 933302 - RNA, 22 nt, Human
ugcaacacuuuuuuugagauag

SEQ ID NO: 933303 - RNA, 19 nt, Human
uggaagcagcaggaaauga

SEQ ID NO: 933304 - RNA, 20 nt, Human
uggcaagcaugugauagagg

SEQ ID NO: 933305 - RNA, 19 nt, Human
uggcagggguucucuaaca

SEQ ID NO: 933306 - RNA, 18 nt, Human
uguagggauggagcugga

SEQ ID NO: 933307 - RNA, 23 nt, Human
uuaaaccuguuugugcugugugg

SEQ ID NO: 933308 - RNA, 26 nt, Human
uuacauguaugucucaucacaucaca

SEQ ID NO: 933309 - RNA, 21 nt, Human
uuacugccugucauuaaucca

SEQ ID NO: 933310 - RNA, 24 nt, Human
uuagaaaacaugcuaaguacaucc

SEQ ID NO: 933311 - RNA, 25 nt, Human
uuagaguugaggagguugaggguca

SEQ ID NO: 933312 - RNA, 23 nt, Human
uuaugaacaacugucuuguuuuc

SEQ ID NO: 933313 - RNA, 23 nt, Human
uuauugcucacacacacuuuuuc

SEQ ID NO: 933314 - RNA, 19 nt, Human
uucaaaaacaaaaaaagag

SEQ ID NO: 933315 - RNA, 19 nt, Human
uugauccuuguaaagcccu

SEQ ID NO: 933316 - RNA, 21 nt, Human
uugguuccagggcaggacucg

SEQ ID NO: 933317 - RNA, 24 nt, Human
uuuauuuagcauaccaaaaacaca

SEQ ID NO: 933318 - RNA, 23 nt, Human
uuucuugugguuucuggcacguc

SEQ ID NO: 933319 - RNA, 23 nt, Human
uuugcaacacuuuuuuugagaua

SEQ ID NO: 933320 - RNA, 26 nt, Human
agugcacgaagacacgcgugugcaca

SEQ ID NO: 933321 - RNA, 20 nt, Human
ccagggcagccucgggccgg

SEQ ID NO: 933322 - RNA, 24 nt, Human
cccauacacaagauggcacagccg

SEQ ID NO: 933323 - RNA, 18 nt, Human
ccccacuccaaguccagc

SEQ ID NO: 933324 - RNA, 23 nt, Human
ccccccgcccuuucccuggguua

SEQ ID NO: 933325 - RNA, 26 nt, Human
ccccuacucccaccauuccccacucc

SEQ ID NO: 933326 - RNA, 19 nt, Human
ccucgggccggaugacccc

SEQ ID NO: 933327 - RNA, 22 nt, Human
gcagccucgggccggaugaccc

SEQ ID NO: 933328 - RNA, 21 nt, Human
gccaggacacgggaacacguu

SEQ ID NO: 933329 - RNA, 21 nt, Human
gcggaacugaccagugcccuc

SEQ ID NO: 933330 - RNA, 21 nt, Human
gcggggcucugcgugugcgua

SEQ ID NO: 933331 - RNA, 21 nt, Human
gggaacacguugccgaaaaca

SEQ ID NO: 933332 - RNA, 24 nt, Human
gggcagccucgggccggaugaccc

SEQ ID NO: 933333 - RNA, 22 nt, Human
uagcggcuuccggaauccgguu

SEQ ID NO: 933334 - RNA, 21 nt, Human
uccagcuucggcgucuaugag

SEQ ID NO: 933335 - RNA, 19 nt, Human
uccuggguccgaauuuccc

SEQ ID NO: 933336 - RNA, 23 nt, Human
ucugcccauacacaagauggcac

SEQ ID NO: 933337 - RNA, 18 nt, Human
ugaccccuacucccacca

SEQ ID NO: 933338 - RNA, 27 nt, Human
ugcacaggcggggcucugaccucaagg

SEQ ID NO: 933339 - RNA, 18 nt, Human
ugcgugugcguacccugu

SEQ ID NO: 933340 - RNA, 21 nt, Human
ugggcuccuggguccgaauuu

SEQ ID NO: 933341 - RNA, 24 nt, Human
ugggcuccuggguccgaauuuccc

SEQ ID NO: 933342 - RNA, 24 nt, Human
ugugcacaggcggggcucugcgug

SEQ ID NO: 933343 - RNA, 21 nt, Human
ugugggggcccgugaggggcc

SEQ ID NO: 933344 - RNA, 18 nt, Human
uguguauauccauacgcg

SEQ ID NO: 933345 - RNA, 22 nt, Human
uugcaaauaugccccccgcccu

SEQ ID NO: 933346 - RNA, 25 nt, Human
aaaagaaaaagaaaagcaagucucc

SEQ ID NO: 933347 - RNA, 26 nt, Human
aaaaggcaaaauggauggugggcacc

SEQ ID NO: 933348 - RNA, 26 nt, Human
aaagagaccauuccauaaccuguuac

SEQ ID NO: 933349 - RNA, 21 nt, Human
aauguuaacacugaaauuuac

SEQ ID NO: 933350 - RNA, 22 nt, Human
aauuuucuuuuuaaaaaauugc

SEQ ID NO: 933351 - RNA, 19 nt, Human
acaaacaugcaaauuugca

SEQ ID NO: 933352 - RNA, 21 nt, Human
acaguucuauagagacucuuc

SEQ ID NO: 933353 - RNA, 18 nt, Human
agagaccauuccauaacc

SEQ ID NO: 933354 - RNA, 25 nt, Human
agcuaugaggacaguucuauagaga

SEQ ID NO: 933355 - RNA, 24 nt, Human
caaaauggaugccugacuaauuaa

SEQ ID NO: 933356 - RNA, 21 nt, Human
caaugagaagaaaccagauau

SEQ ID NO: 933357 - RNA, 21 nt, Human
cacacagaaaagauacaaaaa

SEQ ID NO: 933358 - RNA, 24 nt, Human
cacaccaacauggcacauguauac

SEQ ID NO: 933359 - RNA, 24 nt, Human
cagaaugggggguccaauaauguc

SEQ ID NO: 933360 - RNA, 23 nt, Human
caugcaaauuugcagugcacgau

SEQ ID NO: 933361 - RNA, 21 nt, Human
ccacaauucaguugcuggauu

SEQ ID NO: 933362 - RNA, 18 nt, Human
cccccggggaggcacuac

SEQ ID NO: 933363 - RNA, 24 nt, Human
cgcuuauucuucuguccacuuuua

SEQ ID NO: 933364 - RNA, 20 nt, Human
cucauauauccugaacaaac

SEQ ID NO: 933365 - RNA, 22 nt, Human
cuccaugcaaagucuuacugug

SEQ ID NO: 933366 - RNA, 23 nt, Human
cuccaugcaaagucuuacugugc

SEQ ID NO: 933367 - RNA, 19 nt, Human
cugaaggacaggagaugaa

SEQ ID NO: 933368 - RNA, 24 nt, Human
cugcacguugugcucguguacccu

SEQ ID NO: 933369 - RNA, 21 nt, Human
cuggguucagcacaccaacau

SEQ ID NO: 933370 - RNA, 20 nt, Human
cuuggucgcuuuucucuccu

SEQ ID NO: 933371 - RNA, 18 nt, Human
gaguugcguaaaguggcc

SEQ ID NO: 933372 - RNA, 18 nt, Human
gauaauuuugugcugcag

SEQ ID NO: 933373 - RNA, 25 nt, Human
gauaucuaaagaacuuugcauucaa

SEQ ID NO: 933374 - RNA, 22 nt, Human
gcaaagucuuacugugcucuaa

SEQ ID NO: 933375 - RNA, 23 nt, Human
gcaaagucuuacugugcucuaaa

SEQ ID NO: 933376 - RNA, 19 nt, Human
gcuaccuaaauggaugacc

SEQ ID NO: 933377 - RNA, 24 nt, Human
gcucucugcaggcagcucuucaca

SEQ ID NO: 933378 - RNA, 19 nt, Human
guaaaacaaaauauugccc

SEQ ID NO: 933379 - RNA, 18 nt, Human
gugauaggauaaaagaga

SEQ ID NO: 933380 - RNA, 18 nt, Human
uaacaaaacugacauaug

SEQ ID NO: 933381 - RNA, 24 nt, Human
uaauauauauauuucacugagccu

SEQ ID NO: 933382 - RNA, 21 nt, Human
uacaacuguaacaaaacugac

SEQ ID NO: 933383 - RNA, 22 nt, Human
uacacacagaaaagauacaaaa

SEQ ID NO: 933384 - RNA, 23 nt, Human
uacauugaguauguagcuacaac

SEQ ID NO: 933385 - RNA, 18 nt, Human
uagaaggggguaauagua

SEQ ID NO: 933386 - RNA, 21 nt, Human
uaguccaaaacaaacaugcaa

SEQ ID NO: 933387 - RNA, 18 nt, Human
uauaaaaaaagaaaaaga

SEQ ID NO: 933388 - RNA, 31 nt, Human
uauaaaaaaagaaaaagaaaagcaagucucc

SEQ ID NO: 933389 - RNA, 20 nt, Human
uauauauuucacugagccuu

SEQ ID NO: 933390 - RNA, 24 nt, Human
uaugaagauuuguguuuuaaaguu

SEQ ID NO: 933391 - RNA, 19 nt, Human
uauguuuacacacagaaaa

SEQ ID NO: 933392 - RNA, 22 nt, Human
uccaauguuaacacugaaauuu

SEQ ID NO: 933393 - RNA, 19 nt, Human
uccacuuuuaucuuggucg

SEQ ID NO: 933394 - RNA, 24 nt, Human
ucgccagagucgauaauuuugugc

SEQ ID NO: 933395 - RNA, 22 nt, Human
ucucugcaggcagcucuucaca

SEQ ID NO: 933396 - RNA, 22 nt, Human
ugaaauaagagaaaaaugaagg

SEQ ID NO: 933397 - RNA, 19 nt, Human
ugaacaaacccagcuauga

SEQ ID NO: 933398 - RNA, 24 nt, Human
ugaacaaacccagcuaugaggaca

SEQ ID NO: 933399 - RNA, 22 nt, Human
ugaacgcaagaaaacugaaaaa

SEQ ID NO: 933400 - RNA, 20 nt, Human
ugaccacaauucaguugcug

SEQ ID NO: 933401 - RNA, 18 nt, Human
ugagaagaaaccagauau

SEQ ID NO: 933402 - RNA, 23 nt, Human
ugagcuugagaaacaaaaacugg

SEQ ID NO: 933403 - RNA, 18 nt, Human
ugaggaaaauuacaaaau

SEQ ID NO: 933404 - RNA, 22 nt, Human
ugccacauaaguaaaacaaaau

SEQ ID NO: 933405 - RNA, 21 nt, Human
uggaaugcugaggcaguccag

SEQ ID NO: 933406 - RNA, 18 nt, Human
uggaugaacgcaagaaaa

SEQ ID NO: 933407 - RNA, 18 nt, Human
uggcaaaaggacaaaguc

SEQ ID NO: 933408 - RNA, 19 nt, Human
uggcacauguauacauaug

SEQ ID NO: 933409 - RNA, 27 nt, Human
uguauacauauguaacuaaccugcacg

SEQ ID NO: 933410 - RNA, 23 nt, Human
uguuuuaaaguuuuuuagugggg

SEQ ID NO: 933411 - RNA, 21 nt, Human
uuaaaaaauugcaucucucau

SEQ ID NO: 933412 - RNA, 20 nt, Human
uuaguccaaaacaaacaugc

SEQ ID NO: 933413 - RNA, 19 nt, Human
uuguuugcuuuuguaaagu

SEQ ID NO: 933414 - RNA, 22 nt, Human
uuuugaggaaaauuacaaaaug

SEQ ID NO: 933415 - RNA, 20 nt, Human
aaaauguucacaaauuucuc

SEQ ID NO: 933416 - RNA, 22 nt, Human
aagcagcaggggguacacaauu

SEQ ID NO: 933417 - RNA, 20 nt, Human
acaacacaaagcaaaaacag

SEQ ID NO: 933418 - RNA, 24 nt, Human
acuuugagaauauauugugacagg

SEQ ID NO: 933419 - RNA, 21 nt, Human
aguggaauucuuuaaccacug

SEQ ID NO: 933420 - RNA, 20 nt, Human
cacaacacaaagcaaaaaca

SEQ ID NO: 933421 - RNA, 22 nt, Human
cacaacacaaagcaaaaacaga

SEQ ID NO: 933422 - RNA, 22 nt, Human
caguucaaauguaaaaaugauc

SEQ ID NO: 933423 - RNA, 24 nt, Human
ccaaauaucagaucacuuugagaa

SEQ ID NO: 933424 - RNA, 21 nt, Human
ccacaacacaaagcaaaaaca

SEQ ID NO: 933425 - RNA, 25 nt, Human
cucaacaaggauacuuguuuccaaa

SEQ ID NO: 933426 - RNA, 19 nt, Human
cugguccaugcuccccagc

SEQ ID NO: 933427 - RNA, 24 nt, Human
gcuuuacuacuccuauucaggccu

SEQ ID NO: 933428 - RNA, 20 nt, Human
uaccacaacacaaagcaaaa

SEQ ID NO: 933429 - RNA, 23 nt, Human
uaccacaacacaaagcaaaaaca

SEQ ID NO: 933430 - RNA, 24 nt, Human
uaccacaacacaaagcaaaaacag

SEQ ID NO: 933431 - RNA, 19 nt, Human
uagguaggggauagaugag

SEQ ID NO: 933432 - RNA, 18 nt, Human
uaugccacucaugagugu

SEQ ID NO: 933433 - RNA, 19 nt, Human
ugaaaauguucacaaauuu

SEQ ID NO: 933434 - RNA, 19 nt, Human
ugacaggcagauguccuug

SEQ ID NO: 933435 - RNA, 18 nt, Human
ugagaaauagguagggga

SEQ ID NO: 933436 - RNA, 23 nt, Human
ugcugagugcuaauagugggggu

SEQ ID NO: 933437 - RNA, 21 nt, Human
uguaaaaucagcauagaauga

SEQ ID NO: 933438 - RNA, 21 nt, Human
uucagacaccacugauucaau

SEQ ID NO: 933439 - RNA, 19 nt, Human
uuugagaaauagguagggg

SEQ ID NO: 933440 - RNA, 20 nt, Human
aaacaagacagaagagaacc

SEQ ID NO: 933441 - RNA, 20 nt, Human
accagggccugacuuggcag

SEQ ID NO: 933442 - RNA, 23 nt, Human
accagggccugacuuggcagugg

SEQ ID NO: 933443 - RNA, 23 nt, Human
agacagaagagaaccagggccug

SEQ ID NO: 933444 - RNA, 24 nt, Human
agacagaagagaaccagggccuga

SEQ ID NO: 933445 - RNA, 20 nt, Human
caaacaagacagaagagaac

SEQ ID NO: 933446 - RNA, 21 nt, Human
ccccaggcugcaugggcucag

SEQ ID NO: 933447 - RNA, 18 nt, Human
cccccugggggcggggcg

SEQ ID NO: 933448 - RNA, 24 nt, Human
ccgcggccugacgcccccucugcc

SEQ ID NO: 933449 - RNA, 19 nt, Human
ccuccucucgcgccgggcc

SEQ ID NO: 933450 - RNA, 23 nt, Human
ccucugccuccucucgcgccggg

SEQ ID NO: 933451 - RNA, 23 nt, Human
cgcggccugacgcccccucugcc

SEQ ID NO: 933452 - RNA, 23 nt, Human
cgggcccggggcgcccccugggg

SEQ ID NO: 933453 - RNA, 18 nt, Human
cucugccuccucucgcgc

SEQ ID NO: 933454 - RNA, 18 nt, Human
cugacgcccccucugccu

SEQ ID NO: 933455 - RNA, 18 nt, Human
cugcccucuacucccagc

SEQ ID NO: 933456 - RNA, 25 nt, Human
gcccggggcgcccccugggggcggg

SEQ ID NO: 933457 - RNA, 24 nt, Human
gcgcccccugggggcggggcgggg

SEQ ID NO: 933458 - RNA, 21 nt, Human
gcggggcggggugggagcucu

SEQ ID NO: 933459 - RNA, 23 nt, Human
ggcccggggcgcccccugggggc

SEQ ID NO: 933460 - RNA, 21 nt, Human
ugccuccucucgcgccgggcc

SEQ ID NO: 933461 - RNA, 23 nt, Human
ugggggcggggcggggugggagc

SEQ ID NO: 933462 - RNA, 24 nt, Human
ugggggcggggcggggugggagcu

SEQ ID NO: 933463 - RNA, 22 nt, Human
uuuuuuuuuuuugaagaaugcc

SEQ ID NO: 933464 - RNA, 24 nt, Human
aaagcgcuggggcccggggcgggg

SEQ ID NO: 933465 - RNA, 19 nt, Human
acaaaagcgcuggggcccg

SEQ ID NO: 933466 - RNA, 23 nt, Human
agcgcuggggcccggggcggggc

SEQ ID NO: 933467 - RNA, 24 nt, Human
aggaauaaauaagauaugugggca

SEQ ID NO: 933468 - RNA, 23 nt, Human
aggcggggccugaggccgucggg

SEQ ID NO: 933469 - RNA, 21 nt, Human
auacacaaaagcgcuggggcc

SEQ ID NO: 933470 - RNA, 19 nt, Human
ccccagagguagagguaga

SEQ ID NO: 933471 - RNA, 19 nt, Human
ccgcccgaggccgccgcag

SEQ ID NO: 933472 - RNA, 22 nt, Human
cgcccgaggccgccgcagaucc

SEQ ID NO: 933473 - RNA, 19 nt, Human
cgggggagcaggcagcagg

SEQ ID NO: 933474 - RNA, 22 nt, Human
cguccgggcccccagagguaga

SEQ ID NO: 933475 - RNA, 21 nt, Human
gaagucgugggggcggggaca

SEQ ID NO: 933476 - RNA, 18 nt, Human
gaggcggggccugaggcc

SEQ ID NO: 933477 - RNA, 23 nt, Human
gagguagagguagaugagccuau

SEQ ID NO: 933478 - RNA, 23 nt, Human
gcagcagccguccgggcccccag

SEQ ID NO: 933479 - RNA, 23 nt, Human
ggcccggggcggggccggaaguc

SEQ ID NO: 933480 - RNA, 18 nt, Human
ggccggaagucguggggg

SEQ ID NO: 933481 - RNA, 18 nt, Human
ggccugaugccuuggagg

SEQ ID NO: 933482 - RNA, 24 nt, Human
gggcggggccggaagucguggggg

SEQ ID NO: 933483 - RNA, 21 nt, Human
gggcggggccugaugccuugg

SEQ ID NO: 933484 - RNA, 22 nt, Human
gggcgggggagcaggcagcagg

SEQ ID NO: 933485 - RNA, 21 nt, Human
uagagguagaugagccuauuu

SEQ ID NO: 933486 - RNA, 20 nt, Human
uggaggaauaaauaagauau

SEQ ID NO: 933487 - RNA, 19 nt, Human
uggggcccggggcggggcc

SEQ ID NO: 933488 - RNA, 24 nt, Human
uuuuuuguuuuuuuuuuuauuuuu

SEQ ID NO: 933489 - RNA, 21 nt, Human
uuuuuuuuuuuuuuuguuuuu

SEQ ID NO: 933490 - RNA, 18 nt, Human
uuuuuuuuuuuuuuuuug

SEQ ID NO: 933491 - RNA, 22 nt, Human
aaagauccagcccucccaccuc

SEQ ID NO: 933492 - RNA, 24 nt, Human
aagugcacgccgggaccaggauuc

SEQ ID NO: 933493 - RNA, 21 nt, Human
accacuucgccucucgccccc

SEQ ID NO: 933494 - RNA, 23 nt, Human
accugaaguccuucagaagugca

SEQ ID NO: 933495 - RNA, 23 nt, Human
acgccgggaccaggauuccggga

SEQ ID NO: 933496 - RNA, 22 nt, Human
aguuauggagcuucccucaggg

SEQ ID NO: 933497 - RNA, 24 nt, Human
caaggggccgcgggguaugcuggg

SEQ ID NO: 933498 - RNA, 18 nt, Human
cacccaggacgcgagcag

SEQ ID NO: 933499 - RNA, 20 nt, Human
ccacuucgccucucgccccc

SEQ ID NO: 933500 - RNA, 23 nt, Human
cccaaagacuccgccuucccaag

SEQ ID NO: 933501 - RNA, 26 nt, Human
cccaaagacuccgccuucccaagagc

SEQ ID NO: 933502 - RNA, 25 nt, Human
cccaagagccccugcggccgggcgc

SEQ ID NO: 933503 - RNA, 18 nt, Human
ccccucaccccgggcgga

SEQ ID NO: 933504 - RNA, 19 nt, Human
cccgggcggaugcccaaag

SEQ ID NO: 933505 - RNA, 23 nt, Human
cccucccaccucauuuuuuacua

SEQ ID NO: 933506 - RNA, 24 nt, Human
cccucccaccucauuuuuuacuau

SEQ ID NO: 933507 - RNA, 19 nt, Human
ccucagaaccucagccaga

SEQ ID NO: 933508 - RNA, 28 nt, Human
cgacuccucccugccccacgaaugcccc

SEQ ID NO: 933509 - RNA, 19 nt, Human
cgggaagagaccgaucccc

SEQ ID NO: 933510 - RNA, 19 nt, Human
cuccgccuuggcugccucc

SEQ ID NO: 933511 - RNA, 21 nt, Human
cucggccuucggcgccugacc

SEQ ID NO: 933512 - RNA, 21 nt, Human
cugaaguccuucagaagugca

SEQ ID NO: 933513 - RNA, 19 nt, Human
cuuccgggugacugcuucc

SEQ ID NO: 933514 - RNA, 20 nt, Human
gaaguccuucagaagugcac

SEQ ID NO: 933515 - RNA, 22 nt, Human
gacggccgggcgcuccugaagc

SEQ ID NO: 933516 - RNA, 22 nt, Human
gcaggagccucauacucuuggu

SEQ ID NO: 933517 - RNA, 19 nt, Human
gcccaggagucagugcugg

SEQ ID NO: 933518 - RNA, 21 nt, Human
gcccccaggcuuccgggugac

SEQ ID NO: 933519 - RNA, 20 nt, Human
gccggacgcgaguugugaga

SEQ ID NO: 933520 - RNA, 21 nt, Human
gccgggaccaggauuccggga

SEQ ID NO: 933521 - RNA, 18 nt, Human
gcgggguaugcugggacc

SEQ ID NO: 933522 - RNA, 21 nt, Human
ggacaguaggacgcggggcac

SEQ ID NO: 933523 - RNA, 18 nt, Human
ggccggggccggagcggc

SEQ ID NO: 933524 - RNA, 26 nt, Human
gggccggggccggagcggcucuuuga

SEQ ID NO: 933525 - RNA, 21 nt, Human
ggucaggauggucagcuccag

SEQ ID NO: 933526 - RNA, 21 nt, Human
gguccccucaccccgggcgga

SEQ ID NO: 933527 - RNA, 18 nt, Human
gguucugccuccucgucc

SEQ ID NO: 933528 - RNA, 18 nt, Human
guccugcgccucuuucuc

SEQ ID NO: 933529 - RNA, 21 nt, Human
guccuucagaagugcacgccg

SEQ ID NO: 933530 - RNA, 21 nt, Human
guuauggagcuucccucaggg

SEQ ID NO: 933531 - RNA, 22 nt, Human
uacagcuuuaccucuagccuuu

SEQ ID NO: 933532 - RNA, 20 nt, Human
uacugcucgugcugcugcuc

SEQ ID NO: 933533 - RNA, 24 nt, Human
ucagaggcggcacccaggacgcga

SEQ ID NO: 933534 - RNA, 19 nt, Human
uccccgcgugcucucggcc

SEQ ID NO: 933535 - RNA, 19 nt, Human
uccccgcgugcucucggcc

SEQ ID NO: 933536 - RNA, 24 nt, Human
ucccugccccacgaaugccgggaa

SEQ ID NO: 933537 - RNA, 21 nt, Human
uccuacugcucgugcugcugc

SEQ ID NO: 933538 - RNA, 21 nt, Human
ucggguucugccuccucgucc

SEQ ID NO: 933539 - RNA, 24 nt, Human
ucggugcccucagaaccucagcca

SEQ ID NO: 933540 - RNA, 25 nt, Human
ucugccuccucguccugcgccucuu

SEQ ID NO: 933541 - RNA, 22 nt, Human
ugaccacuucgccucucgcccc

SEQ ID NO: 933542 - RNA, 18 nt, Human
uggcggcggcggcgacgg

SEQ ID NO: 933543 - RNA, 26 nt, Human
uugcuagguauaauuuuauuuuauau

SEQ ID NO: 933544 - RNA, 18 nt, Human
uuggagggaccugccccc

SEQ ID NO: 933545 - RNA, 22 nt, Human
uuuuuuuuuuuucagcagcuca

SEQ ID NO: 933546 - RNA, 21 nt, Human
gguauagagacugcagaggga

SEQ ID NO: 933547 - RNA, 18 nt, Human
aaacugaccaaugaggaa

SEQ ID NO: 933548 - RNA, 22 nt, Human
aacaugagcugccccuucccag

SEQ ID NO: 933549 - RNA, 23 nt, Human
aacugaccaaugaggaauguggc

SEQ ID NO: 933550 - RNA, 23 nt, Human
acagacgaacaaucaagaaacug

SEQ ID NO: 933551 - RNA, 19 nt, Human
accaaugaggaauguggcu

SEQ ID NO: 933552 - RNA, 24 nt, Human
agccaggaugaugguggugguggg

SEQ ID NO: 933553 - RNA, 19 nt, Human
agcugccccuucccagccc

SEQ ID NO: 933554 - RNA, 18 nt, Human
agcuucuaccuagagcag

SEQ ID NO: 933555 - RNA, 23 nt, Human
aggcaucagaacagcugagagca

SEQ ID NO: 933556 - RNA, 21 nt, Human
cagaaaccaugcuccacagca

SEQ ID NO: 933557 - RNA, 19 nt, Human
cagcacuggagcugggaca

SEQ ID NO: 933558 - RNA, 19 nt, Human
cagcugagagcagcuccau

SEQ ID NO: 933559 - RNA, 19 nt, Human
ccaacagacgaacaaucaa

SEQ ID NO: 933560 - RNA, 21 nt, Human
ccaggaugaugguggugguuu

SEQ ID NO: 933561 - RNA, 18 nt, Human
cccagcccccgucacccu

SEQ ID NO: 933562 - RNA, 21 nt, Human
cccagcccccgucacccucuc

SEQ ID NO: 933563 - RNA, 21 nt, Human
ccccuucccagcccccgucac

SEQ ID NO: 933564 - RNA, 23 nt, Human
ccuccacaacaggccuucuaccc

SEQ ID NO: 933565 - RNA, 21 nt, Human
ccuucccagcccccgucaccc

SEQ ID NO: 933566 - RNA, 23 nt, Human
cgaacaaucaagaaacugaccaa

SEQ ID NO: 933567 - RNA, 20 nt, Human
gagcugccccuucccagccc

SEQ ID NO: 933568 - RNA, 18 nt, Human
gcuuuuucuuucuaaugu

SEQ ID NO: 933569 - RNA, 19 nt, Human
ggagagcuucuaccuagag

SEQ ID NO: 933570 - RNA, 21 nt, Human
gggguccaguucuucaaaucu

SEQ ID NO: 933571 - RNA, 23 nt, Human
uagggagcaccucuccaacagac

SEQ ID NO: 933572 - RNA, 21 nt, Human
uaucaggacuuauuggaaggg

SEQ ID NO: 933573 - RNA, 22 nt, Human
uccaacagacgaacaaucaaga

SEQ ID NO: 933574 - RNA, 22 nt, Human
ucccagcccccgucacccucuc

SEQ ID NO: 933575 - RNA, 23 nt, Human
ucccagcccccgucacccucucc

SEQ ID NO: 933576 - RNA, 23 nt, Human
ugaaggcaucagaacagcugaga

SEQ ID NO: 933577 - RNA, 21 nt, Human
ugagcugccccuucccagccc

SEQ ID NO: 933578 - RNA, 21 nt, Human
ugaggucuuccugcugaaggc

SEQ ID NO: 933579 - RNA, 19 nt, Human
ugcaaugaggucuuccugc

SEQ ID NO: 933580 - RNA, 21 nt, Human
ugcaaugaggucuuccugcug

SEQ ID NO: 933581 - RNA, 18 nt, Human
uggaaggguuucccaguu

SEQ ID NO: 933582 - RNA, 20 nt, Human
uggcuucuuaaaaacagcag

SEQ ID NO: 933583 - RNA, 22 nt, Human
ugggagcccacaaguucagguc

SEQ ID NO: 933584 - RNA, 18 nt, Human
uggugguggugggaggca

SEQ ID NO: 933585 - RNA, 26 nt, Human
uguggcuucuuaaaaacagcagggag

SEQ ID NO: 933586 - RNA, 23 nt, Human
uuaguagacuucccaauaggcuu

SEQ ID NO: 933587 - RNA, 26 nt, Human
uuaguagacuucccaauaggcuuccc

SEQ ID NO: 933588 - RNA, 18 nt, Human
uuuuugggacccugaagu

SEQ ID NO: 933589 - RNA, 19 nt, Human
uuuuuuuuuuuugggaccc

SEQ ID NO: 933590 - RNA, 26 nt, Human
aaaaaaaaaaaaaaaaaugcagggag

SEQ ID NO: 933591 - RNA, 20 nt, Human
aaaugaguucucccuccccu

SEQ ID NO: 933592 - RNA, 23 nt, Human
aagagcuuugcuuuucuccuuag

SEQ ID NO: 933593 - RNA, 26 nt, Human
acacacacaucccucaucacaccucu

SEQ ID NO: 933594 - RNA, 20 nt, Human
cacaccucucucucaaaaaa

SEQ ID NO: 933595 - RNA, 26 nt, Human
cccuguacauguuucuauugaauccu

SEQ ID NO: 933596 - RNA, 18 nt, Human
cucaaaaaaaaaaaaaaa

SEQ ID NO: 933597 - RNA, 18 nt, Human
cucucucaaaaaaaaaaa

SEQ ID NO: 933598 - RNA, 23 nt, Human
gauuaugaggaaaauaagaaaga

SEQ ID NO: 933599 - RNA, 18 nt, Human
gcagggagauguguccug

SEQ ID NO: 933600 - RNA, 23 nt, Human
uaauggucuacaauaagcugcac

SEQ ID NO: 933601 - RNA, 22 nt, Human
uacccuguacauguuucuauug

SEQ ID NO: 933602 - RNA, 23 nt, Human
ucccucaucacaccucucucuca

SEQ ID NO: 933603 - RNA, 25 nt, Human
ucccucaucacaccucucucucaaa

SEQ ID NO: 933604 - RNA, 25 nt, Human
ucucucaaaaaaaaaaaaaaaaaaa

SEQ ID NO: 933605 - RNA, 23 nt, Human
ucucucucaaaaaaaaaaaaaaa

SEQ ID NO: 933606 - RNA, 20 nt, Human
ugagcuggaaauccucgugc

SEQ ID NO: 933607 - RNA, 20 nt, Human
ugggaaagcuaaaaugggua

SEQ ID NO: 933608 - RNA, 25 nt, Human
uguaaaaugaguucucccuccccuc

SEQ ID NO: 933609 - RNA, 18 nt, Human
cacagugggcuuaucuuu

SEQ ID NO: 933610 - RNA, 19 nt, Human
cagccucugaaugucagcc

SEQ ID NO: 933611 - RNA, 26 nt, Human
caggucucccccaucauugaugccuc

SEQ ID NO: 933612 - RNA, 20 nt, Human
cauugggguugugcagacug

SEQ ID NO: 933613 - RNA, 18 nt, Human
cucgguucauggcaauga

SEQ ID NO: 933614 - RNA, 26 nt, Human
gcaaugaaccucuccacagugggcuu

SEQ ID NO: 933615 - RNA, 22 nt, Human
gcuacuucugcuaucucauccu

SEQ ID NO: 933616 - RNA, 25 nt, Human
ucagccagcagcuccuguuuucucc

SEQ ID NO: 933617 - RNA, 25 nt, Human
ucccccaucauugaugccucgguuc

SEQ ID NO: 933618 - RNA, 23 nt, Human
uccuucagccucugaaugucagc

SEQ ID NO: 933619 - RNA, 24 nt, Human
ugggcuuaucuuugacauuggggu

SEQ ID NO: 933620 - RNA, 18 nt, Human
uuccuuuccucuguggau

SEQ ID NO: 933621 - RNA, 23 nt, Human
uuuucaauuucauuagcuacuuc

SEQ ID NO: 933622 - RNA, 19 nt, Human
ccccgggagccaccgccgc

SEQ ID NO: 933623 - RNA, 23 nt, Human
ccccgggagccaccgccgccucc

SEQ ID NO: 933624 - RNA, 18 nt, Human
cgcggggaauccggggcg

SEQ ID NO: 933625 - RNA, 19 nt, Human
cgcucaaacgccccgggag

SEQ ID NO: 933626 - RNA, 19 nt, Human
cucaaacgccccgggagcc

SEQ ID NO: 933627 - RNA, 22 nt, Human
cucagcgcugaaaagacucuuc

SEQ ID NO: 933628 - RNA, 20 nt, Human
gaaaagacucuuccuucgga

SEQ ID NO: 933629 - RNA, 18 nt, Human
ggcucgggugagcccgcu

SEQ ID NO: 933630 - RNA, 23 nt, Human
ucagcgcugaaaagacucuuccu

SEQ ID NO: 933631 - RNA, 25 nt, Human
uccucagcgccaguccucagcgcug

SEQ ID NO: 933632 - RNA, 21 nt, Human
uccucagcgcugaaaagacuc

SEQ ID NO: 933633 - RNA, 18 nt, Human
ugaaaagacucuuccuuc

SEQ ID NO: 933634 - RNA, 21 nt, Human
ugaaaagacucuuccuucgga

SEQ ID NO: 933635 - RNA, 22 nt, Human
ugaaaagacucuuccuucggaa

SEQ ID NO: 933636 - RNA, 25 nt, Human
aaaaaaaaaaaaaaaaaacggaaga

SEQ ID NO: 933637 - RNA, 21 nt, Human
aaaaaaaaaaaaaacggaaug

SEQ ID NO: 933638 - RNA, 18 nt, Human
aaaaaaacggaaugaugg

SEQ ID NO: 933639 - RNA, 18 nt, Human
aagcccgggaggcggcga

SEQ ID NO: 933640 - RNA, 21 nt, Human
accaucuucgucugagcuugu

SEQ ID NO: 933641 - RNA, 22 nt, Human
caaugagucuguaucaagaucu

SEQ ID NO: 933642 - RNA, 19 nt, Human
ccacuuguauucucuuuuc

SEQ ID NO: 933643 - RNA, 25 nt, Human
cgaggagaugcggcggcgcggggcg

SEQ ID NO: 933644 - RNA, 20 nt, Human
gaaucugaacauucuuccau

SEQ ID NO: 933645 - RNA, 24 nt, Human
gagaccggggguccgaagcccggg

SEQ ID NO: 933646 - RNA, 20 nt, Human
gaggagaugcggcggcgcgg

SEQ ID NO: 933647 - RNA, 20 nt, Human
gaugaauaauguacaaccac

SEQ ID NO: 933648 - RNA, 23 nt, Human
ugcggcggcgcggggcggccgcg

SEQ ID NO: 933649 - RNA, 20 nt, Human
uuaaaaaaaaaaaaaaaaaa

SEQ ID NO: 933650 - RNA, 31 nt, Human
uuaagcuugguuaaaaaaaaaaaaaaaaaaa

SEQ ID NO: 933651 - RNA, 18 nt, Human
uucaucucuuguuugcuc

SEQ ID NO: 933652 - RNA, 19 nt, Human
uugguuaaaaaaaaaaaaa

SEQ ID NO: 933653 - RNA, 26 nt, Human
uuuuuaaaaaaaacuuuauuuuaaaa

SEQ ID NO: 933654 - RNA, 28 nt, Human
uuuuuuuaaaaaaaacuuuauuuuaaaa

SEQ ID NO: 933655 - RNA, 21 nt, Human
aaaaaaaaccauacagagcac

SEQ ID NO: 933656 - RNA, 18 nt, Human
aaaacccacaaacaguga

SEQ ID NO: 933657 - RNA, 22 nt, Human
aaacagugaaaagacagucugg

SEQ ID NO: 933658 - RNA, 18 nt, Human
aaaugacccuaauauuca

SEQ ID NO: 933659 - RNA, 22 nt, Human
aacaaagggauuuucucccuca

SEQ ID NO: 933660 - RNA, 18 nt, Human
aagcccgggaggcggcga

SEQ ID NO: 933661 - RNA, 20 nt, Human
acaaacagugaaaagacagu

SEQ ID NO: 933662 - RNA, 24 nt, Human
acacuaauugaaaauaugcuacaa

SEQ ID NO: 933663 - RNA, 21 nt, Human
acagugaaaagacagucuggu

SEQ ID NO: 933664 - RNA, 22 nt, Human
acuaguguuuguauuuuuggaa

SEQ ID NO: 933665 - RNA, 18 nt, Human
acuaucaauuacacauua

SEQ ID NO: 933666 - RNA, 22 nt, Human
agaaaauaaaaacaauauagcc

SEQ ID NO: 933667 - RNA, 23 nt, Human
agaaaugcuauccuuuaguuaac

SEQ ID NO: 933668 - RNA, 18 nt, Human
agcaucaugauuuuuucu

SEQ ID NO: 933669 - RNA, 21 nt, Human
agccacaaaacuaaauuaccu

SEQ ID NO: 933670 - RNA, 25 nt, Human
auaccaaaaaaaaccauacagagca

SEQ ID NO: 933671 - RNA, 20 nt, Human
augcggcggcgcggggaugc

SEQ ID NO: 933672 - RNA, 24 nt, Human
cacacacuaauugaaaauaugcua

SEQ ID NO: 933673 - RNA, 19 nt, Human
caccagcugccgcagaggc

SEQ ID NO: 933674 - RNA, 19 nt, Human
cacgcaagccaccugcgcc

SEQ ID NO: 933675 - RNA, 21 nt, Human
cacgcaagccaccugcgccac

SEQ ID NO: 933676 - RNA, 23 nt, Human
cagagcacacauuguuccaaaga

SEQ ID NO: 933677 - RNA, 23 nt, Human
cauaccaaaaaaaaccauacaga

SEQ ID NO: 933678 - RNA, 23 nt, Human
ccaaaaaaaaccauacagagcac

SEQ ID NO: 933679 - RNA, 24 nt, Human
ccaaaaaaaaccauacagagcaca

SEQ ID NO: 933680 - RNA, 25 nt, Human
ccaaaaaaaaccauacagagcacac

SEQ ID NO: 933681 - RNA, 24 nt, Human
ccaaagaagcuggauaauguagca

SEQ ID NO: 933682 - RNA, 25 nt, Human
cccacaguauuugggaaaagaggca

SEQ ID NO: 933683 - RNA, 18 nt, Human
ccgccgcugccgccgccg

SEQ ID NO: 933684 - RNA, 22 nt, Human
ccgcugccgccgccguagcugc

SEQ ID NO: 933685 - RNA, 24 nt, Human
ccuaagacuucacugaaugcccuu

SEQ ID NO: 933686 - RNA, 19 nt, Human
ccucuuuaaaagcaaaaau

SEQ ID NO: 933687 - RNA, 25 nt, Human
ccugcgccaccagcugccgcagagg

SEQ ID NO: 933688 - RNA, 21 nt, Human
ccugcugccggggccgcgggc

SEQ ID NO: 933689 - RNA, 21 nt, Human
cgccgcugccgccgccguagc

SEQ ID NO: 933690 - RNA, 18 nt, Human
cggggaugcgggcggcgg

SEQ ID NO: 933691 - RNA, 22 nt, Human
cggggaugcgggcggcggacgc

SEQ ID NO: 933692 - RNA, 23 nt, Human
cguccacgcaagccaccugcgcc

SEQ ID NO: 933693 - RNA, 21 nt, Human
cugccggggccgcgggcgccg

SEQ ID NO: 933694 - RNA, 21 nt, Human
gagaaguauccuacuugcuga

SEQ ID NO: 933695 - RNA, 24 nt, Human
gagaccggggguccgaagcccggg

SEQ ID NO: 933696 - RNA, 20 nt, Human
gaggagaugcggcggcgcgg

SEQ ID NO: 933697 - RNA, 24 nt, Human
gauucauuccuauauauacccagu

SEQ ID NO: 933698 - RNA, 22 nt, Human
gcccgcgggcgggggaggaugc

SEQ ID NO: 933699 - RNA, 19 nt, Human
ggcggcgcggggaugcggg

SEQ ID NO: 933700 - RNA, 19 nt, Human
gggcccagcuaccgggccc

SEQ ID NO: 933701 - RNA, 24 nt, Human
uaacuagaauaaaucuaaguaagu

SEQ ID NO: 933702 - RNA, 22 nt, Human
uagaauucucaguucaauguca

SEQ ID NO: 933703 - RNA, 24 nt, Human
uaguguuuguauuuuuggaaucua

SEQ ID NO: 933704 - RNA, 21 nt, Human
uauuugggaaaagaggcaagg

SEQ ID NO: 933705 - RNA, 21 nt, Human
ucauaccaaaaaaaaccauac

SEQ ID NO: 933706 - RNA, 19 nt, Human
uccacgcaagccaccugcg

SEQ ID NO: 933707 - RNA, 22 nt, Human
uccacgcaagccaccugcgcca

SEQ ID NO: 933708 - RNA, 20 nt, Human
uccacgcaagccaccugcgg

SEQ ID NO: 933709 - RNA, 30 nt, Human
ucgcaaccgcgccgccgcugccgccgccgg

SEQ ID NO: 933710 - RNA, 25 nt, Human
ucuagaaaauaaaaacaauauagcc

SEQ ID NO: 933711 - RNA, 24 nt, Human
ucucaaaacggugauuccuaguuc

SEQ ID NO: 933712 - RNA, 23 nt, Human
ugaaaacaguuaucucagagggu

SEQ ID NO: 933713 - RNA, 23 nt, Human
ugaaaagacagucugguaaaucc

SEQ ID NO: 933714 - RNA, 25 nt, Human
ugcuacaaccaugucuggaaaagca

SEQ ID NO: 933715 - RNA, 24 nt, Human
ugguaaauccaagguuuguaaaaa

SEQ ID NO: 933716 - RNA, 23 nt, Human
uuaacuuuugauaaaaagggagu

SEQ ID NO: 933717 - RNA, 26 nt, Human
uuaauacugcacaaguuacacuuagc

SEQ ID NO: 933718 - RNA, 23 nt, Human
uuccauuauaagaccucuuuaaa

SEQ ID NO: 933719 - RNA, 21 nt, Human
uugaaaauaugcuacaaccau

SEQ ID NO: 933720 - RNA, 25 nt, Human
uuuaaaagcaaaaaugcaauucugu

SEQ ID NO: 933721 - RNA, 23 nt, Human
uuuaacauuuucuaaauggauuu

SEQ ID NO: 933722 - RNA, 18 nt, Human
uuuaacccuaaagccaga

SEQ ID NO: 933723 - RNA, 18 nt, Human
uuuuuuuuuuuuuuuuug

SEQ ID NO: 933724 - RNA, 22 nt, Human
uuuuuuuuuuuuuuuuugauag

SEQ ID NO: 933725 - RNA, 22 nt, Human
aaaaaaaacaugacucuuccca

SEQ ID NO: 933726 - RNA, 30 nt, Human
aaaaaaacaugacucuucccacccuccacu

SEQ ID NO: 933727 - RNA, 24 nt, Human
aaaaacaugacucuucccacccuc

SEQ ID NO: 933728 - RNA, 21 nt, Human
aagggagacagaaaaacaaaa

SEQ ID NO: 933729 - RNA, 21 nt, Human
aaggggacagguuggaaggga

SEQ ID NO: 933730 - RNA, 21 nt, Human
aaugagggugaggaugagcac

SEQ ID NO: 933731 - RNA, 25 nt, Human
acucuucccacccuccaccaccccu

SEQ ID NO: 933732 - RNA, 19 nt, Human
agaaaaacaaaaucaaaga

SEQ ID NO: 933733 - RNA, 22 nt, Human
agaaaaacaaaaucaaagagga

SEQ ID NO: 933734 - RNA, 21 nt, Human
agaaaggaggaggggcaaagc

SEQ ID NO: 933735 - RNA, 19 nt, Human
agacagaaaaacaaaauca

SEQ ID NO: 933736 - RNA, 18 nt, Human
agagagguugggacccga

SEQ ID NO: 933737 - RNA, 22 nt, Human
agagagguugggacccgagucc

SEQ ID NO: 933738 - RNA, 20 nt, Human
agaggggcaaggagaccuuu

SEQ ID NO: 933739 - RNA, 22 nt, Human
agcccccacucccgccccggcc

SEQ ID NO: 933740 - RNA, 22 nt, Human
aggaaggugggugaaaagagag

SEQ ID NO: 933741 - RNA, 23 nt, Human
aggaaggugggugaaaagagagg

SEQ ID NO: 933742 - RNA, 24 nt, Human
aggaaggugggugaaaagagagga

SEQ ID NO: 933743 - RNA, 25 nt, Human
aggaaggugggugaaaagagaggac

SEQ ID NO: 933744 - RNA, 20 nt, Human
aggagaaaaaaaacaugacu

SEQ ID NO: 933745 - RNA, 22 nt, Human
auuuuauuuguguuugucuuuu

SEQ ID NO: 933746 - RNA, 19 nt, Human
cacagcugaggaggcugcc

SEQ ID NO: 933747 - RNA, 19 nt, Human
caccucuuccucggcuuuc

SEQ ID NO: 933748 - RNA, 23 nt, Human
cagaaaaacaaaaucaaagagga

SEQ ID NO: 933749 - RNA, 20 nt, Human
cagcccccacucccgccccg

SEQ ID NO: 933750 - RNA, 18 nt, Human
cagcgccuccgcuuccgc

SEQ ID NO: 933751 - RNA, 19 nt, Human
cagcgccuccgcuuccgcc

SEQ ID NO: 933752 - RNA, 23 nt, Human
ccaccccgaggacguccggccgc

SEQ ID NO: 933753 - RNA, 24 nt, Human
cccacccuccaccaccccuggccc

SEQ ID NO: 933754 - RNA, 26 nt, Human
cccacccuccaccaccccuggcccca

SEQ ID NO: 933755 - RNA, 22 nt, Human
ccccagcgccuccgcuuccgcc

SEQ ID NO: 933756 - RNA, 24 nt, Human
ccccagcgccuccgcuuccgccug

SEQ ID NO: 933757 - RNA, 23 nt, Human
cccccacucccgccccggccucc

SEQ ID NO: 933758 - RNA, 24 nt, Human
ccccggccuccucccucucccuuc

SEQ ID NO: 933759 - RNA, 18 nt, Human
ccccuggaggggaggggg

SEQ ID NO: 933760 - RNA, 18 nt, Human
ccccuugccaccucuucc

SEQ ID NO: 933761 - RNA, 18 nt, Human
cccgcgcccucucugccu

SEQ ID NO: 933762 - RNA, 20 nt, Human
cccucucccuucucucuucc

SEQ ID NO: 933763 - RNA, 20 nt, Human
cccucucccuucucucuucc

SEQ ID NO: 933764 - RNA, 20 nt, Human
cccuggaggggaggggguga

SEQ ID NO: 933765 - RNA, 18 nt, Human
cccugggggcccugagag

SEQ ID NO: 933766 - RNA, 23 nt, Human
ccgagggugacagcccccacucc

SEQ ID NO: 933767 - RNA, 22 nt, Human
ccgcuuccgccugggguccucc

SEQ ID NO: 933768 - RNA, 22 nt, Human
ccgucucagcucgugccgaauu

SEQ ID NO: 933769 - RNA, 22 nt, Human
ccuccaccaccccuggccccag

SEQ ID NO: 933770 - RNA, 21 nt, Human
ccucggcuuucgcccuuccug

SEQ ID NO: 933771 - RNA, 18 nt, Human
ccucuccucuucuccguc

SEQ ID NO: 933772 - RNA, 18 nt, Human
ccugaggggcgggcccgg

SEQ ID NO: 933773 - RNA, 21 nt, Human
ccugggggcccugagaguggg

SEQ ID NO: 933774 - RNA, 23 nt, Human
cgagucccggauaucuggacuau

SEQ ID NO: 933775 - RNA, 21 nt, Human
cgcacggccccucucacgccg

SEQ ID NO: 933776 - RNA, 20 nt, Human
cgcccucucugccucuccuc

SEQ ID NO: 933777 - RNA, 18 nt, Human
cgccugggguccuccagc

SEQ ID NO: 933778 - RNA, 24 nt, Human
cggccaccgacugggggcccaccc

SEQ ID NO: 933779 - RNA, 25 nt, Human
cggccccucucacgccgggguccga

SEQ ID NO: 933780 - RNA, 22 nt, Human
cuccacagcugaggaggcugcc

SEQ ID NO: 933781 - RNA, 18 nt, Human
cuccccuggaggggaggg

SEQ ID NO: 933782 - RNA, 21 nt, Human
cugacgguccccgcgcccucu

SEQ ID NO: 933783 - RNA, 25 nt, Human
cuuccgagaauagcugaacgauugu

SEQ ID NO: 933784 - RNA, 22 nt, Human
cuuuccccuugccaccucuucc

SEQ ID NO: 933785 - RNA, 21 nt, Human
gaauagcugaacgauuguagc

SEQ ID NO: 933786 - RNA, 20 nt, Human
gaccucgcgguccaguccuc

SEQ ID NO: 933787 - RNA, 21 nt, Human
gagaauagcugaacgauugua

SEQ ID NO: 933788 - RNA, 22 nt, Human
gagacagaaaaacaaaaucaaa

SEQ ID NO: 933789 - RNA, 22 nt, Human
gaggaggggcaaagccuggaaa

SEQ ID NO: 933790 - RNA, 23 nt, Human
gcacacacagcgggcgaacagca

SEQ ID NO: 933791 - RNA, 21 nt, Human
gccaggagaacacagagugac

SEQ ID NO: 933792 - RNA, 22 nt, Human
gccccagcgccuccgcuuccgc

SEQ ID NO: 933793 - RNA, 20 nt, Human
gcccucucugccucuccucu

SEQ ID NO: 933794 - RNA, 21 nt, Human
gccuccucccucucccuucuc

SEQ ID NO: 933795 - RNA, 20 nt, Human
gcggcucugccaagcaggga

SEQ ID NO: 933796 - RNA, 21 nt, Human
ggagacagaaaaacaaaauca

SEQ ID NO: 933797 - RNA, 21 nt, Human
ggccaccgacugggggcccac

SEQ ID NO: 933798 - RNA, 18 nt, Human
gggaaugaaccccggaua

SEQ ID NO: 933799 - RNA, 18 nt, Human
gggagacagaaaaacaaa

SEQ ID NO: 933800 - RNA, 21 nt, Human
gggcaaagccuggaaauuugg

SEQ ID NO: 933801 - RNA, 18 nt, Human
ggggagggggugacaacc

SEQ ID NO: 933802 - RNA, 20 nt, Human
ggggccuggccugguagggg

SEQ ID NO: 933803 - RNA, 21 nt, Human
ggggggaaggggacagguugg

SEQ ID NO: 933804 - RNA, 22 nt, Human
ggguaucugagaaaggaggagg

SEQ ID NO: 933805 - RNA, 21 nt, Human
gguggggggaaggggacaggu

SEQ ID NO: 933806 - RNA, 23 nt, Human
gucaaugagggugaggaugagca

SEQ ID NO: 933807 - RNA, 18 nt, Human
uagagguccgaagggcug

SEQ ID NO: 933808 - RNA, 21 nt, Human
uaucugaacgggauggagacu

SEQ ID NO: 933809 - RNA, 19 nt, Human
uaucuggacuaugaggacu

SEQ ID NO: 933810 - RNA, 23 nt, Human
uccaccaccccuggccccaggcc

SEQ ID NO: 933811 - RNA, 19 nt, Human
uccagcggcucugccaagc

SEQ ID NO: 933812 - RNA, 18 nt, Human
ucccacccuccaccaccc

SEQ ID NO: 933813 - RNA, 20 nt, Human
uccccgcgcccucucugccu

SEQ ID NO: 933814 - RNA, 20 nt, Human
uccccuugccaccucuuccu

SEQ ID NO: 933815 - RNA, 20 nt, Human
ucccuucucucuuccgagaa

SEQ ID NO: 933816 - RNA, 20 nt, Human
uccgaagggcugggccuggg

SEQ ID NO: 933817 - RNA, 18 nt, Human
uccuccagcggcucugcc

SEQ ID NO: 933818 - RNA, 18 nt, Human
uccucccucucccuucuc

SEQ ID NO: 933819 - RNA, 22 nt, Human
uccucggcuuucgcccuuccug

SEQ ID NO: 933820 - RNA, 21 nt, Human
ucgagggcgacagcugccgaa

SEQ ID NO: 933821 - RNA, 21 nt, Human
ucuuuuucuuuuuuugguggg

SEQ ID NO: 933822 - RNA, 18 nt, Human
ugacgguccccgcgcccu

SEQ ID NO: 933823 - RNA, 21 nt, Human
ugacugcuggacuccacagcu

SEQ ID NO: 933824 - RNA, 18 nt, Human
ugagaaaggaggaggggc

SEQ ID NO: 933825 - RNA, 19 nt, Human
ugagcaaacugaggaaggu

SEQ ID NO: 933826 - RNA, 23 nt, Human
ugaggaaggugggugaaaagaga

SEQ ID NO: 933827 - RNA, 24 nt, Human
ugaggacuguuacccggguaucug

SEQ ID NO: 933828 - RNA, 23 nt, Human
ugaggaggcugccugucuagagg

SEQ ID NO: 933829 - RNA, 21 nt, Human
ugggggcccugagaguggggc

SEQ ID NO: 933830 - RNA, 21 nt, Human
uggggucugaaccccgaauau

SEQ ID NO: 933831 - RNA, 22 nt, Human
ugucuuuuucuuuuuuuggugg

SEQ ID NO: 933832 - RNA, 26 nt, Human
uucccacccuccaccaccccuggccc

SEQ ID NO: 933833 - RNA, 23 nt, Human
uuccggauuucugauuguggggu

SEQ ID NO: 933834 - RNA, 18 nt, Human
uuuguguuugucuuuuuc

SEQ ID NO: 933835 - RNA, 22 nt, Human
uuuuuuuuuuuuuuuuucacag

SEQ ID NO: 933836 - RNA, 24 nt, Human
uuuuuuuuuuuuuuuuucacaguu

SEQ ID NO: 933837 - RNA, 20 nt, Human
accccgaucucucuccucug

SEQ ID NO: 933838 - RNA, 21 nt, Human
acuguaggaucuccagggcca

SEQ ID NO: 933839 - RNA, 22 nt, Human
acuguaggaucuccagggccau

SEQ ID NO: 933840 - RNA, 19 nt, Human
agccagggaggagggcagc

SEQ ID NO: 933841 - RNA, 23 nt, Human
aggaggggaggggcguccugggu

SEQ ID NO: 933842 - RNA, 18 nt, Human
agggcagccaggaggcag

SEQ ID NO: 933843 - RNA, 23 nt, Human
cagggccaucaaagcccccucgu

SEQ ID NO: 933844 - RNA, 24 nt, Human
ccaccuuuccuccgucuccgaccu

SEQ ID NO: 933845 - RNA, 21 nt, Human
ccccucgugggauagggagac

SEQ ID NO: 933846 - RNA, 24 nt, Human
ccgaucucucuccucugugccucu

SEQ ID NO: 933847 - RNA, 19 nt, Human
cucgugggauagggagacu

SEQ ID NO: 933848 - RNA, 23 nt, Human
gaggaggggaggggcguccuggg

SEQ ID NO: 933849 - RNA, 19 nt, Human
gaggggcguccuggguccu

SEQ ID NO: 933850 - RNA, 27 nt, Human
gcugccaccuuuccuccgucuccgacc

SEQ ID NO: 933851 - RNA, 21 nt, Human
gggaggagggcagccaggagg

SEQ ID NO: 933852 - RNA, 21 nt, Human
ggguccugcagcuguagucuu

SEQ ID NO: 933853 - RNA, 22 nt, Human
gugggauagggagacuauuuac

SEQ ID NO: 933854 - RNA, 18 nt, Human
uacuguaggaucuccagg

SEQ ID NO: 933855 - RNA, 19 nt, Human
uccuggguccugcagcugu

SEQ ID NO: 933856 - RNA, 18 nt, Human
ucucuccucugugccucu

SEQ ID NO: 933857 - RNA, 21 nt, Human
ugaggaggggaggggcguccu

SEQ ID NO: 933858 - RNA, 24 nt, Human
ugcccgaaugaggaggggaggggc

SEQ ID NO: 933859 - RNA, 21 nt, Human
uggguccugcagcuguagucu

SEQ ID NO: 933860 - RNA, 20 nt, Human
uuuuuuuuuuuuuugggcgg

SEQ ID NO: 933861 - RNA, 23 nt, Human
uuuuuuuuuuuuuuuuuuuuggg

SEQ ID NO: 933862 - RNA, 18 nt, Human
aaacccccuguccugccc

SEQ ID NO: 933863 - RNA, 21 nt, Human
aaagggccuggcccaggcugc

SEQ ID NO: 933864 - RNA, 21 nt, Human
aaccacccccaguugggaagg

SEQ ID NO: 933865 - RNA, 22 nt, Human
aagcagcacaggguggacgggg

SEQ ID NO: 933866 - RNA, 18 nt, Human
aagcagccacccaacccc

SEQ ID NO: 933867 - RNA, 21 nt, Human
aagcagccacccaaccccacc

SEQ ID NO: 933868 - RNA, 26 nt, Human
aagcagccacccaaccccacccaccu

SEQ ID NO: 933869 - RNA, 21 nt, Human
aagccccagggcuucaggucc

SEQ ID NO: 933870 - RNA, 21 nt, Human
aaggauagaacccaggcugac

SEQ ID NO: 933871 - RNA, 24 nt, Human
aagggccuggcccaggcugccgac

SEQ ID NO: 933872 - RNA, 24 nt, Human
aaucuggagaggcuggagccuggg

SEQ ID NO: 933873 - RNA, 22 nt, Human
acacaguccagaagggugaagg

SEQ ID NO: 933874 - RNA, 23 nt, Human
acagagaaagggcuggagccaga

SEQ ID NO: 933875 - RNA, 23 nt, Human
acaggugugcaccaugggugggu

SEQ ID NO: 933876 - RNA, 21 nt, Human
accacaguguguggccaggcu

SEQ ID NO: 933877 - RNA, 19 nt, Human
acccaaccccacccaccuc

SEQ ID NO: 933878 - RNA, 22 nt, Human
acccaaccccacccaccucccg

SEQ ID NO: 933879 - RNA, 18 nt, Human
acccagauggcaccacag

SEQ ID NO: 933880 - RNA, 19 nt, Human
acccuaaucgggaggaccc

SEQ ID NO: 933881 - RNA, 19 nt, Human
accuggcccaggcccaugg

SEQ ID NO: 933882 - RNA, 22 nt, Human
acuuggggaacuggggggaaau

SEQ ID NO: 933883 - RNA, 18 nt, Human
agaagcugagugggaacc

SEQ ID NO: 933884 - RNA, 25 nt, Human
agaaggcaccaagggcggugggcug

SEQ ID NO: 933885 - RNA, 23 nt, Human
agacauucuucaccuacuguggg

SEQ ID NO: 933886 - RNA, 19 nt, Human
agaggagggagcaacagag

SEQ ID NO: 933887 - RNA, 22 nt, Human
agaggugagcagcccgggaccc

SEQ ID NO: 933888 - RNA, 19 nt, Human
agcaacagagccugaaggg

SEQ ID NO: 933889 - RNA, 23 nt, Human
agccacccaaccccacccaccuc

SEQ ID NO: 933890 - RNA, 23 nt, Human
agcccccugugcuaccucuacuc

SEQ ID NO: 933891 - RNA, 20 nt, Human
aggaggcaccuggggaaugg

SEQ ID NO: 933892 - RNA, 22 nt, Human
aggcaggucacacaguauggcu

SEQ ID NO: 933893 - RNA, 24 nt, Human
aggccagguccuaucccuucccaa

SEQ ID NO: 933894 - RNA, 18 nt, Human
aggcccacaucuccaaac

SEQ ID NO: 933895 - RNA, 21 nt, Human
aggcugggucgugcugcaugu

SEQ ID NO: 933896 - RNA, 21 nt, Human
agggagacagugaaggccagg

SEQ ID NO: 933897 - RNA, 20 nt, Human
auagaacccaggcugacacu

SEQ ID NO: 933898 - RNA, 27 nt, Human
auggaauggacauccaacggggagagg

SEQ ID NO: 933899 - RNA, 22 nt, Human
caaacccccuguccugcccuca

SEQ ID NO: 933900 - RNA, 22 nt, Human
caaagcugggcccuggccccau

SEQ ID NO: 933901 - RNA, 24 nt, Human
caaaggcccacaucuccaaacccc

SEQ ID NO: 933902 - RNA, 19 nt, Human
caacuccaccagagcagcu

SEQ ID NO: 933903 - RNA, 26 nt, Human
caagggagacagugaaggccaggucc

SEQ ID NO: 933904 - RNA, 19 nt, Human
cacaggacacuccacccag

SEQ ID NO: 933905 - RNA, 18 nt, Human
cacauaggccuaucucca

SEQ ID NO: 933906 - RNA, 21 nt, Human
caccacaguguguggccaggc

SEQ ID NO: 933907 - RNA, 19 nt, Human
cacccaaccccacccaccu

SEQ ID NO: 933908 - RNA, 20 nt, Human
cagacaccagauggcgccuu

SEQ ID NO: 933909 - RNA, 18 nt, Human
cagcacaggguggacggg

SEQ ID NO: 933910 - RNA, 19 nt, Human
cagccacccaaccccaccc

SEQ ID NO: 933911 - RNA, 19 nt, Human
cagcccccugugcuaccuc

SEQ ID NO: 933912 - RNA, 21 nt, Human
cagcccgggacccucccccag

SEQ ID NO: 933913 - RNA, 21 nt, Human
cagcugcccaccaagaggggu

SEQ ID NO: 933914 - RNA, 18 nt, Human
caggcugacacucgaccc

SEQ ID NO: 933915 - RNA, 24 nt, Human
cagggcggcaacuccuaccuuccc

SEQ ID NO: 933916 - RNA, 22 nt, Human
caggguggacggggcaaggcca

SEQ ID NO: 933917 - RNA, 23 nt, Human
cagguccccagagacacuugggg

SEQ ID NO: 933918 - RNA, 24 nt, Human
cagguccuaucccuucccaacucc

SEQ ID NO: 933919 - RNA, 22 nt, Human
cagugccaggccaggcucccag

SEQ ID NO: 933920 - RNA, 21 nt, Human
caguguguggccaggcugggu

SEQ ID NO: 933921 - RNA, 19 nt, Human
caugcagacaccagauggc

SEQ ID NO: 933922 - RNA, 22 nt, Human
caugcaggaaaagggccuggcc

SEQ ID NO: 933923 - RNA, 19 nt, Human
cauggcccuccaccagagg

SEQ ID NO: 933924 - RNA, 22 nt, Human
ccaaagcugggcccuggcccca

SEQ ID NO: 933925 - RNA, 22 nt, Human
ccaaagcugggcccuggcccca

SEQ ID NO: 933926 - RNA, 18 nt, Human
ccaacacccaugcagaca

SEQ ID NO: 933927 - RNA, 23 nt, Human
ccaacacccaugcagacaccaga

SEQ ID NO: 933928 - RNA, 23 nt, Human
ccaacuccaccagagcagcugcc

SEQ ID NO: 933929 - RNA, 23 nt, Human
ccacccaaccccacccaccuccc

SEQ ID NO: 933930 - RNA, 24 nt, Human
ccacccaccucccgcaggggcuga

SEQ ID NO: 933931 - RNA, 21 nt, Human
ccacugaaggcagcuguggag

SEQ ID NO: 933932 - RNA, 18 nt, Human
ccagcacugcaguucccu

SEQ ID NO: 933933 - RNA, 18 nt, Human
ccaggcucccaguucagg

SEQ ID NO: 933934 - RNA, 19 nt, Human
ccaggcugccaacacccau

SEQ ID NO: 933935 - RNA, 18 nt, Human
ccccagagacacuugggg

SEQ ID NO: 933936 - RNA, 23 nt, Human
ccccagggcuucagguccccaga

SEQ ID NO: 933937 - RNA, 23 nt, Human
cccccaggugccccauuccccag

SEQ ID NO: 933938 - RNA, 27 nt, Human
cccccuguccugcccucaggaccaggc

SEQ ID NO: 933939 - RNA, 25 nt, Human
cccccugugcuaccucuacucuguc

SEQ ID NO: 933940 - RNA, 20 nt, Human
ccccugugcuaccucuacuc

SEQ ID NO: 933941 - RNA, 19 nt, Human
cccuggccccauucuaccc

SEQ ID NO: 933942 - RNA, 24 nt, Human
ccucgcgcgggcggcgggcucuuc

SEQ ID NO: 933943 - RNA, 26 nt, Human
ccucugggaaagcagccacccaaccc

SEQ ID NO: 933944 - RNA, 18 nt, Human
ccugccgucaagcuaagg

SEQ ID NO: 933945 - RNA, 20 nt, Human
ccuggccccauucuacccac

SEQ ID NO: 933946 - RNA, 18 nt, Human
cgugcagcugcagaggag

SEQ ID NO: 933947 - RNA, 19 nt, Human
cgugcugcaugugugcaca

SEQ ID NO: 933948 - RNA, 23 nt, Human
cuacaggugugcaccaugggugg

SEQ ID NO: 933949 - RNA, 19 nt, Human
cucccaggcugccaacacc

SEQ ID NO: 933950 - RNA, 22 nt, Human
cucccuggagaggcagccuguu

SEQ ID NO: 933951 - RNA, 18 nt, Human
cucccuuuaaccaccccc

SEQ ID NO: 933952 - RNA, 18 nt, Human
cucggcggcucugccggc

SEQ ID NO: 933953 - RNA, 18 nt, Human
cucugccuuggcccccag

SEQ ID NO: 933954 - RNA, 19 nt, Human
cugcaccaaaggauagaac

SEQ ID NO: 933955 - RNA, 22 nt, Human
cugccgucaagcuaaggccaaa

SEQ ID NO: 933956 - RNA, 21 nt, Human
cugggagguggagggcuguuu

SEQ ID NO: 933957 - RNA, 26 nt, Human
gaacccaggcugacacucgacccuaa

SEQ ID NO: 933958 - RNA, 25 nt, Human
gaacuggggggaaauucugaggcca

SEQ ID NO: 933959 - RNA, 24 nt, Human
gaaggcacagagaaagggcuggag

SEQ ID NO: 933960 - RNA, 21 nt, Human
gaaggcagugccccgucuaca

SEQ ID NO: 933961 - RNA, 20 nt, Human
gaccuagccaggggcuacgg

SEQ ID NO: 933962 - RNA, 24 nt, Human
gagaaggcagugccccuggcaccc

SEQ ID NO: 933963 - RNA, 21 nt, Human
gagauaccacaaaagaaaugg

SEQ ID NO: 933964 - RNA, 23 nt, Human
gaggacccccuucccucugccuu

SEQ ID NO: 933965 - RNA, 20 nt, Human
gaugguucuggcucaggccu

SEQ ID NO: 933966 - RNA, 19 nt, Human
gcagcuguggaggaagggg

SEQ ID NO: 933967 - RNA, 22 nt, Human
gcaggaaaagggccuggcccag

SEQ ID NO: 933968 - RNA, 23 nt, Human
gcaggaaaagggccuggcccagg

SEQ ID NO: 933969 - RNA, 22 nt, Human
gcccauggugaggacaggggcu

SEQ ID NO: 933970 - RNA, 22 nt, Human
gccccagggcuucaggucccca

SEQ ID NO: 933971 - RNA, 22 nt, Human
gccucugggaaagcagccaccc

SEQ ID NO: 933972 - RNA, 20 nt, Human
gcgggcucuucggcgucucg

SEQ ID NO: 933973 - RNA, 18 nt, Human
gcuggagccagacauucu

SEQ ID NO: 933974 - RNA, 26 nt, Human
ggaccaggcccacccugggcaagaga

SEQ ID NO: 933975 - RNA, 22 nt, Human
ggacccagauggcaccacagug

SEQ ID NO: 933976 - RNA, 20 nt, Human
ggacuacaggugugcaccau

SEQ ID NO: 933977 - RNA, 21 nt, Human
ggacuacaggugugcaccaug

SEQ ID NO: 933978 - RNA, 18 nt, Human
ggagaggcuggagccugg

SEQ ID NO: 933979 - RNA, 23 nt, Human
ggagccagacauucuucaccuac

SEQ ID NO: 933980 - RNA, 23 nt, Human
ggcaggugugcacgaugggcgug

SEQ ID NO: 933981 - RNA, 21 nt, Human
ggccacacaguccagaagggu

SEQ ID NO: 933982 - RNA, 18 nt, Human
ggccaggcugggucgugc

SEQ ID NO: 933983 - RNA, 21 nt, Human
gggaaugugugaaaccaggga

SEQ ID NO: 933984 - RNA, 21 nt, Human
gggcucccuuuaaccaccccc

SEQ ID NO: 933985 - RNA, 22 nt, Human
ggggcaaggccagcugugagaa

SEQ ID NO: 933986 - RNA, 19 nt, Human
ggguggacggggcaaggcc

SEQ ID NO: 933987 - RNA, 23 nt, Human
ggugugcacgaugggcaggugug

SEQ ID NO: 933988 - RNA, 20 nt, Human
gucaaggcacaagcuuugug

SEQ ID NO: 933989 - RNA, 19 nt, Human
guccugggaccaggaaggc

SEQ ID NO: 933990 - RNA, 21 nt, Human
guccugggaccaggaaggcuc

SEQ ID NO: 933991 - RNA, 19 nt, Human
gugccaggccaggcuccca

SEQ ID NO: 933992 - RNA, 21 nt, Human
gugccccauuccccagguagc

SEQ ID NO: 933993 - RNA, 20 nt, Human
guggccaggcugggucgugc

SEQ ID NO: 933994 - RNA, 21 nt, Human
uacaaagaaggcaccaagggc

SEQ ID NO: 933995 - RNA, 24 nt, Human
uacaaagaaggcaccaagggcggu

SEQ ID NO: 933996 - RNA, 25 nt, Human
uacagaggauacguuuacaaacugg

SEQ ID NO: 933997 - RNA, 24 nt, Human
uacaggugugcaccaugggugggu

SEQ ID NO: 933998 - RNA, 23 nt, Human
uaccagggucucccacuggagca

SEQ ID NO: 933999 - RNA, 18 nt, Human
uacugugggccacauagg

SEQ ID NO: 934000 - RNA, 23 nt, Human
ucacucccaggcugccaacaccc

SEQ ID NO: 934001 - RNA, 23 nt, Human
ucagcagaaggggagaggugagc

SEQ ID NO: 934002 - RNA, 22 nt, Human
ucaggaccaggcccacccuggg

SEQ ID NO: 934003 - RNA, 21 nt, Human
uccaaacccccuguccugccc

SEQ ID NO: 934004 - RNA, 18 nt, Human
uccacgccauggcccucc

SEQ ID NO: 934005 - RNA, 22 nt, Human
uccagcuugaggcucaguggga

SEQ ID NO: 934006 - RNA, 18 nt, Human
ucccaaaggguccugagc

SEQ ID NO: 934007 - RNA, 18 nt, Human
uccccagguagcagcagu

SEQ ID NO: 934008 - RNA, 21 nt, Human
uccccagguagcagcaguggg

SEQ ID NO: 934009 - RNA, 19 nt, Human
ucccccagggcggcaacuc

SEQ ID NO: 934010 - RNA, 20 nt, Human
ucccccagggcggcaacucc

SEQ ID NO: 934011 - RNA, 18 nt, Human
ucccgcaggggcuccuuc

SEQ ID NO: 934012 - RNA, 18 nt, Human
ucccucugccuuggcccc

SEQ ID NO: 934013 - RNA, 19 nt, Human
ucccuggagaggcagccug

SEQ ID NO: 934014 - RNA, 22 nt, Human
ucgugcugcaugugugcacagc

SEQ ID NO: 934015 - RNA, 21 nt, Human
ucuccaaacccccuguccugc

SEQ ID NO: 934016 - RNA, 24 nt, Human
ucuccacugccuccugcccagggg

SEQ ID NO: 934017 - RNA, 19 nt, Human
ucucggcggcucugccggc

SEQ ID NO: 934018 - RNA, 19 nt, Human
ucuggagaggcuggagccu

SEQ ID NO: 934019 - RNA, 20 nt, Human
ucuggagaggcuggagccug

SEQ ID NO: 934020 - RNA, 22 nt, Human
ucuuggcugggagguggagggc

SEQ ID NO: 934021 - RNA, 21 nt, Human
ugaaaccagggagaagggcuc

SEQ ID NO: 934022 - RNA, 20 nt, Human
ugaaggaagacagaucuugg

SEQ ID NO: 934023 - RNA, 22 nt, Human
ugaaggcacagagaaagggcug

SEQ ID NO: 934024 - RNA, 25 nt, Human
ugaaggcacagagaaagggcuggag

SEQ ID NO: 934025 - RNA, 25 nt, Human
ugaaggcagcuguggaggaaggggc

SEQ ID NO: 934026 - RNA, 21 nt, Human
ugaagggaagcagcacagggu

SEQ ID NO: 934027 - RNA, 19 nt, Human
ugaggcucagugggaccca

SEQ ID NO: 934028 - RNA, 19 nt, Human
ugccuuggcccccaggugc

SEQ ID NO: 934029 - RNA, 21 nt, Human
uggaagguuaaugcugugaag

SEQ ID NO: 934030 - RNA, 22 nt, Human
uggaagguuaaugcugugaagg

SEQ ID NO: 934031 - RNA, 20 nt, Human
uggagaggcuggagccuggg

SEQ ID NO: 934032 - RNA, 21 nt, Human
uggagccagacauucuucacc

SEQ ID NO: 934033 - RNA, 19 nt, Human
uggccaggcugggucgugc

SEQ ID NO: 934034 - RNA, 23 nt, Human
uggcccccaggugccccauuccc

SEQ ID NO: 934035 - RNA, 19 nt, Human
uggcgccuucgugcagcug

SEQ ID NO: 934036 - RNA, 18 nt, Human
ugggaaccaaacccuccu

SEQ ID NO: 934037 - RNA, 27 nt, Human
ugggaaggaggcaccuggggaauggaa

SEQ ID NO: 934038 - RNA, 22 nt, Human
ugggagguggagggcuguuucg

SEQ ID NO: 934039 - RNA, 23 nt, Human
uggggaugguucuggcucaggcc

SEQ ID NO: 934040 - RNA, 22 nt, Human
ugugaagggaagcagcacaggg

SEQ ID NO: 934041 - RNA, 21 nt, Human
ugugcaccaugggugggugug

SEQ ID NO: 934042 - RNA, 19 nt, Human
ugugcacgaugggcaggug

SEQ ID NO: 934043 - RNA, 24 nt, Human
ugugcacgaugggcaggugugcac

SEQ ID NO: 934044 - RNA, 22 nt, Human
ugugcacgaugggcgugcagug

SEQ ID NO: 934045 - RNA, 22 nt, Human
uguggaggaaagggggucccag

SEQ ID NO: 934046 - RNA, 19 nt, Human
ugugggccacauaggccua

SEQ ID NO: 934047 - RNA, 26 nt, Human
uguguggccaggcugggucgugcugc

SEQ ID NO: 934048 - RNA, 22 nt, Human
uuaguuuuguuucccacuggag

SEQ ID NO: 934049 - RNA, 20 nt, Human
uugggaaggaggcaccuggg

SEQ ID NO: 934050 - RNA, 22 nt, Human
uuggggaaaagucaaagggcaa

SEQ ID NO: 934051 - RNA, 18 nt, Human
aagaauaaaccaccaccg

SEQ ID NO: 934052 - RNA, 21 nt, Human
aaugacaaggacccaauucag

SEQ ID NO: 934053 - RNA, 24 nt, Human
accaccgcucaccgaauaaccgcu

SEQ ID NO: 934054 - RNA, 22 nt, Human
agaaaugacaaggacccaauuc

SEQ ID NO: 934055 - RNA, 21 nt, Human
agacccugaagaccugagaug

SEQ ID NO: 934056 - RNA, 22 nt, Human
caccgaauaaccgcugcuaaua

SEQ ID NO: 934057 - RNA, 18 nt, Human
ccaguuaaaaaaaguaaa

SEQ ID NO: 934058 - RNA, 27 nt, Human
cggaagaauaaaccaccaccgcucacu

SEQ ID NO: 934059 - RNA, 21 nt, Human
gacagaaaugacaaggaccca

SEQ ID NO: 934060 - RNA, 19 nt, Human
gacccaauucaguauguaa

SEQ ID NO: 934061 - RNA, 23 nt, Human
guaaagccuuccuaguguggaag

SEQ ID NO: 934062 - RNA, 21 nt, Human
ugacaaggacccaauucagua

SEQ ID NO: 934063 - RNA, 21 nt, Human
ugagauguccacggagcccuu

SEQ ID NO: 934064 - RNA, 25 nt, Human
uggaagauuaagacguccaugaagg

SEQ ID NO: 934065 - RNA, 22 nt, Human
uggacagaaaugacaaggaccc

SEQ ID NO: 934066 - RNA, 23 nt, Human
uggacagaaaugacaaggaccca

SEQ ID NO: 934067 - RNA, 20 nt, Human
uguggaagauuaagacgucc

SEQ ID NO: 934068 - RNA, 20 nt, Human
uuccaaaaaaaggggaugug

SEQ ID NO: 934069 - RNA, 23 nt, Human
uuccagauggaagacccugaaga

SEQ ID NO: 934070 - RNA, 23 nt, Human
aaacacacagguaaguggcauca

SEQ ID NO: 934071 - RNA, 24 nt, Human
caaucccugggccccguagcuccc

SEQ ID NO: 934072 - RNA, 22 nt, Human
caccaggcacacaagcaccucc

SEQ ID NO: 934073 - RNA, 22 nt, Human
cacuacuuuaaacacaaucccu

SEQ ID NO: 934074 - RNA, 18 nt, Human
cccugggccccguagcuc

SEQ ID NO: 934075 - RNA, 21 nt, Human
cuuccgggguaccagccgcgu

SEQ ID NO: 934076 - RNA, 18 nt, Human
ggaggagugggagaggcu

SEQ ID NO: 934077 - RNA, 22 nt, Human
uaaacacaaucccugggccccg

SEQ ID NO: 934078 - RNA, 23 nt, Human
uaggaggagugggagaggcuccu

SEQ ID NO: 934079 - RNA, 19 nt, Human
uauagaguccuaaccacuu

SEQ ID NO: 934080 - RNA, 22 nt, Human
ucccgcaccaggcacacaagca

SEQ ID NO: 934081 - RNA, 24 nt, Human
ucccgcaccaggcacacaagcacc

SEQ ID NO: 934082 - RNA, 20 nt, Human
ucccggaaguugcagcgacu

SEQ ID NO: 934083 - RNA, 22 nt, Human
ucccugggccccguagcucccg

SEQ ID NO: 934084 - RNA, 20 nt, Human
uccgggguaccagccgcguu

SEQ ID NO: 934085 - RNA, 20 nt, Human
aaaaauuacaagcaaagaca

SEQ ID NO: 934086 - RNA, 24 nt, Human
auggaauggaaaggccuacacauc

SEQ ID NO: 934087 - RNA, 22 nt, Human
guaggacacucagugugaauaa

SEQ ID NO: 934088 - RNA, 19 nt, Human
auugcauacuagaauccca

SEQ ID NO: 934089 - RNA, 20 nt, Human
aaccaaagacuuggagacag

SEQ ID NO: 934090 - RNA, 18 nt, Human
agcucaggggccgcucag

SEQ ID NO: 934091 - RNA, 21 nt, Human
aucuucucuucaaccaaagac

SEQ ID NO: 934092 - RNA, 19 nt, Human
cgccguuccacugcgcagu

SEQ ID NO: 934093 - RNA, 21 nt, Human
cuucaggucagugcagaggca

SEQ ID NO: 934094 - RNA, 21 nt, Human
gaaaaccaaguucugugaaag

SEQ ID NO: 934095 - RNA, 20 nt, Human
ucaacagucauauaucuucu

SEQ ID NO: 934096 - RNA, 20 nt, Human
ucgccguuccacugcgcagu

SEQ ID NO: 934097 - RNA, 19 nt, Human
ugaauagcaggucucggca

SEQ ID NO: 934098 - RNA, 24 nt, Human
aaauaucccuccuaucacaaaaau

SEQ ID NO: 934099 - RNA, 20 nt, Human
aacaacacaacauacaaagu

SEQ ID NO: 934100 - RNA, 19 nt, Human
aacauuacagaauccacau

SEQ ID NO: 934101 - RNA, 19 nt, Human
aagcuguaagcuucgaaca

SEQ ID NO: 934102 - RNA, 23 nt, Human
acaguagaacaaucucaacaguu

SEQ ID NO: 934103 - RNA, 18 nt, Human
acucagcaggaacaagag

SEQ ID NO: 934104 - RNA, 18 nt, Human
acuggggacaacaacaca

SEQ ID NO: 934105 - RNA, 23 nt, Human
agaaacaucuggcagaacaacua

SEQ ID NO: 934106 - RNA, 22 nt, Human
agacuuugaaggugagaaaacu

SEQ ID NO: 934107 - RNA, 21 nt, Human
agguauaugggcuauuguuuu

SEQ ID NO: 934108 - RNA, 25 nt, Human
caacacaacauacaaaguaagaaua

SEQ ID NO: 934109 - RNA, 19 nt, Human
caaguaacucagcaggaac

SEQ ID NO: 934110 - RNA, 18 nt, Human
cacuggggacaacaacac

SEQ ID NO: 934111 - RNA, 18 nt, Human
cacuggggacaacaacac

SEQ ID NO: 934112 - RNA, 21 nt, Human
cacuggggacaacaacacaac

SEQ ID NO: 934113 - RNA, 19 nt, Human
cuuguugcuauuggagcug

SEQ ID NO: 934114 - RNA, 20 nt, Human
cuuguugcuauuggagcugu

SEQ ID NO: 934115 - RNA, 22 nt, Human
ggaaaacaagcuguaagcuucg

SEQ ID NO: 934116 - RNA, 24 nt, Human
gggugcugaagacucacaacagcc

SEQ ID NO: 934117 - RNA, 21 nt, Human
guaaacaacccaucaaaaaca

SEQ ID NO: 934118 - RNA, 24 nt, Human
uaaaauauguaaauaucccuccua

SEQ ID NO: 934119 - RNA, 19 nt, Human
uaagcuucgaacaaguaac

SEQ ID NO: 934120 - RNA, 24 nt, Human
uacaggaugacacaaaauagguac

SEQ ID NO: 934121 - RNA, 20 nt, Human
uagaaacaucuggcagaaca

SEQ ID NO: 934122 - RNA, 24 nt, Human
uagagcacaccauccaacuuaaaa

SEQ ID NO: 934123 - RNA, 24 nt, Human
uaucacaaaaauaaauuaaaccuc

SEQ ID NO: 934124 - RNA, 19 nt, Human
ucaaaacagccguuagagc

SEQ ID NO: 934125 - RNA, 22 nt, Human
uccacauagaaacaucuggcag

SEQ ID NO: 934126 - RNA, 24 nt, Human
ugaaaaacaaguuaggauguuuua

SEQ ID NO: 934127 - RNA, 19 nt, Human
ugagaaaacuucaucauuc

SEQ ID NO: 934128 - RNA, 24 nt, Human
ugcacaaauacauuaguuuguagg

SEQ ID NO: 934129 - RNA, 26 nt, Human
uggggacaacaacacaacauacaaag

SEQ ID NO: 934130 - RNA, 25 nt, Human
uucagaguaaacaacccaucaaaaa

SEQ ID NO: 934131 - RNA, 20 nt, Human
uucgcugucccagcaacuac

SEQ ID NO: 934132 - RNA, 19 nt, Human
aaaaaaaaaaaaaaaaguc

SEQ ID NO: 934133 - RNA, 24 nt, Human
aaaaaaaccccaacauauacacca

SEQ ID NO: 934134 - RNA, 18 nt, Human
aaaucacaacucuauccc

SEQ ID NO: 934135 - RNA, 22 nt, Human
aagacaaagaagcuuagaaaaa

SEQ ID NO: 934136 - RNA, 26 nt, Human
aaucacuaccccacaaaauguugaga

SEQ ID NO: 934137 - RNA, 23 nt, Human
acacaguuacaaauagcacugaa

SEQ ID NO: 934138 - RNA, 18 nt, Human
acacuaaugacaaugaaa

SEQ ID NO: 934139 - RNA, 22 nt, Human
acacuugccaaaucacuacccc

SEQ ID NO: 934140 - RNA, 24 nt, Human
accagccggacucaaaaaaaaaaa

SEQ ID NO: 934141 - RNA, 18 nt, Human
agaaaggaaauauguaua

SEQ ID NO: 934142 - RNA, 21 nt, Human
agaaaggggagaggaagaaga

SEQ ID NO: 934143 - RNA, 25 nt, Human
agacaaagaagcuuagaaaaaaaac

SEQ ID NO: 934144 - RNA, 18 nt, Human
agagauaaugaauuugga

SEQ ID NO: 934145 - RNA, 19 nt, Human
agagauaaugaauuuggaa

SEQ ID NO: 934146 - RNA, 23 nt, Human
agagcugaaaacaauuuaaaaua

SEQ ID NO: 934147 - RNA, 22 nt, Human
agaggaagaagagcaaaaaaaa

SEQ ID NO: 934148 - RNA, 21 nt, Human
agcaaaaaaaaaaaaaaaaaa

SEQ ID NO: 934149 - RNA, 25 nt, Human
agcgucccuugcugucccccugcuu

SEQ ID NO: 934150 - RNA, 20 nt, Human
aggaagaagagcaaaaaaaa

SEQ ID NO: 934151 - RNA, 21 nt, Human
agggcugaaagcaaucaagcu

SEQ ID NO: 934152 - RNA, 20 nt, Human
aguaacauauggaaauugag

SEQ ID NO: 934153 - RNA, 23 nt, Human
aguggcucaugccuguaauccca

SEQ ID NO: 934154 - RNA, 24 nt, Human
aguggcucaugccuguaaucccag

SEQ ID NO: 934155 - RNA, 20 nt, Human
aucauaauacacaaagagcc

SEQ ID NO: 934156 - RNA, 24 nt, Human
augcaaaguuaacaaugaacuugg

SEQ ID NO: 934157 - RNA, 22 nt, Human
caaaaaaaaaaaaaaaaaaaaa

SEQ ID NO: 934158 - RNA, 21 nt, Human
caauaaugauguaaucagacu

SEQ ID NO: 934159 - RNA, 23 nt, Human
cacaaaucacaacucuaucccaa

SEQ ID NO: 934160 - RNA, 23 nt, Human
cacgaaauggaugaacagcugau

SEQ ID NO: 934161 - RNA, 22 nt, Human
cagacuuacaaguuaaagccac

SEQ ID NO: 934162 - RNA, 24 nt, Human
caugccuguaaucccagccuuuuu

SEQ ID NO: 934163 - RNA, 29 nt, Human
ccagccggacucaaaaaaaaaaaaaaaaa

SEQ ID NO: 934164 - RNA, 23 nt, Human
cgccugagcgucccuugcugucc

SEQ ID NO: 934165 - RNA, 23 nt, Human
cucaugccuguaaucccagccuu

SEQ ID NO: 934166 - RNA, 23 nt, Human
cuucuccugauugccagcuuuag

SEQ ID NO: 934167 - RNA, 20 nt, Human
cuugccaaaucacuacccca

SEQ ID NO: 934168 - RNA, 24 nt, Human
gaaaaaaaaccccaacauauacac

SEQ ID NO: 934169 - RNA, 26 nt, Human
gaaaaaaaaccccaacauauacacca

SEQ ID NO: 934170 - RNA, 22 nt, Human
gaaaucuguauuuuugcaccaa

SEQ ID NO: 934171 - RNA, 18 nt, Human
gaacuaaaaguuccuaca

SEQ ID NO: 934172 - RNA, 23 nt, Human
gaagcuuagaaaaaaaaccccaa

SEQ ID NO: 934173 - RNA, 18 nt, Human
gauguaaucagacuuaca

SEQ ID NO: 934174 - RNA, 23 nt, Human
gccaaaucacuaccccacaaaau

SEQ ID NO: 934175 - RNA, 24 nt, Human
gccuuuuuugguuaguuuuaaaaa

SEQ ID NO: 934176 - RNA, 24 nt, Human
gcgucccuugcugucccccugcuu

SEQ ID NO: 934177 - RNA, 21 nt, Human
ggaguugggugcaguggcuca

SEQ ID NO: 934178 - RNA, 23 nt, Human
ggugcaguggcucaugccuguaa

SEQ ID NO: 934179 - RNA, 23 nt, Human
guuaauacacuaaugacaaugaa

SEQ ID NO: 934180 - RNA, 22 nt, Human
uaaaauaaaaaaauuauaugga

SEQ ID NO: 934181 - RNA, 22 nt, Human
uaaaugacugauaacuuuacaa

SEQ ID NO: 934182 - RNA, 23 nt, Human
uaagacaaagaagcuuagaaaaa

SEQ ID NO: 934183 - RNA, 21 nt, Human
uaaucagacuuacaaguuaaa

SEQ ID NO: 934184 - RNA, 19 nt, Human
uacaguuuaccagcauaca

SEQ ID NO: 934185 - RNA, 19 nt, Human
uaugacacaacuuuuugug

SEQ ID NO: 934186 - RNA, 21 nt, Human
uaugacacaacuuuuugugua

SEQ ID NO: 934187 - RNA, 20 nt, Human
ucaaaugauagaaaaacaua

SEQ ID NO: 934188 - RNA, 22 nt, Human
ucauuauucacaaugacucaca

SEQ ID NO: 934189 - RNA, 19 nt, Human
uccaaagaauaaaaucaga

SEQ ID NO: 934190 - RNA, 19 nt, Human
uccacauuuaaaacaaagu

SEQ ID NO: 934191 - RNA, 23 nt, Human
uccaguguucauauaauggaacu

SEQ ID NO: 934192 - RNA, 24 nt, Human
ucuacaguuuaccagcauacacac

SEQ ID NO: 934193 - RNA, 19 nt, Human
ugaacaacugaucaaguga

SEQ ID NO: 934194 - RNA, 20 nt, Human
ugaacagcugaucgagucga

SEQ ID NO: 934195 - RNA, 22 nt, Human
ugaacuuggggaacugaaaggu

SEQ ID NO: 934196 - RNA, 25 nt, Human
ugauagaaaaacauaucuggguaag

SEQ ID NO: 934197 - RNA, 22 nt, Human
ugccaaaucacuaccccacaaa

SEQ ID NO: 934198 - RNA, 24 nt, Human
ugccaaaucacuaccccacaaaau

SEQ ID NO: 934199 - RNA, 19 nt, Human
ugccuguaaucccagccuu

SEQ ID NO: 934200 - RNA, 19 nt, Human
ugccuguaaucccagccuu

SEQ ID NO: 934201 - RNA, 23 nt, Human
uggaaccagccggacucaaaaaa

SEQ ID NO: 934202 - RNA, 21 nt, Human
uggaacuaaaaguuccuacag

SEQ ID NO: 934203 - RNA, 24 nt, Human
uggaacuguuugaauuuuaaagau

SEQ ID NO: 934204 - RNA, 19 nt, Human
uggaauauguuuguuaguu

SEQ ID NO: 934205 - RNA, 18 nt, Human
uggaugaacagcugaucg

SEQ ID NO: 934206 - RNA, 21 nt, Human
uggcucaugccuguaauccca

SEQ ID NO: 934207 - RNA, 22 nt, Human
uggcucaugccuguaaucccag

SEQ ID NO: 934208 - RNA, 23 nt, Human
uguuugaauuuuaaagauguuuu

SEQ ID NO: 934209 - RNA, 21 nt, Human
uuaaacccauauaaagaaagg

SEQ ID NO: 934210 - RNA, 18 nt, Human
uucaaaugauagaaaaac

SEQ ID NO: 934211 - RNA, 23 nt, Human
uucacaaaucacaacucuauccc

SEQ ID NO: 934212 - RNA, 19 nt, Human
uucacaaugacucacagga

SEQ ID NO: 934213 - RNA, 25 nt, Human
uuuccaaagaauaaaaucagauuac

SEQ ID NO: 934214 - RNA, 24 nt, Human
aagaacaaccgggaugucagccgg

SEQ ID NO: 934215 - RNA, 20 nt, Human
aaugucgaccgucugagcag

SEQ ID NO: 934216 - RNA, 21 nt, Human
aaugucgaccgucugagcagc

SEQ ID NO: 934217 - RNA, 23 nt, Human
acagguggauggggauggagauc

SEQ ID NO: 934218 - RNA, 18 nt, Human
agacaggaucccaacccc

SEQ ID NO: 934219 - RNA, 20 nt, Human
aggaacauucucaaacugca

SEQ ID NO: 934220 - RNA, 21 nt, Human
aucccaacccccacccaaauu

SEQ ID NO: 934221 - RNA, 25 nt, Human
auuggcugcaaacgccucucucagg

SEQ ID NO: 934222 - RNA, 23 nt, Human
caccuaagacccugagaccucca

SEQ ID NO: 934223 - RNA, 20 nt, Human
caggagagacccacaaagaa

SEQ ID NO: 934224 - RNA, 23 nt, Human
caggaucccaacccccacccaaa

SEQ ID NO: 934225 - RNA, 19 nt, Human
ccgcggggauggcugccgg

SEQ ID NO: 934226 - RNA, 22 nt, Human
ccggcacagaagaacaaccggg

SEQ ID NO: 934227 - RNA, 21 nt, Human
ccuaagacccugagaccucca

SEQ ID NO: 934228 - RNA, 23 nt, Human
ccugccuggcacguucuuucucu

SEQ ID NO: 934229 - RNA, 23 nt, Human
ccuggcucccaucagggacaguc

SEQ ID NO: 934230 - RNA, 22 nt, Human
cuaagacccugagaccuccacc

SEQ ID NO: 934231 - RNA, 19 nt, Human
cucaaacugcaacggaaaa

SEQ ID NO: 934232 - RNA, 22 nt, Human
ucaaacugcaacggaaaagaug

SEQ ID NO: 934233 - RNA, 18 nt, Human
ucccaacccccacccaaa

SEQ ID NO: 934234 - RNA, 20 nt, Human
ucccuguggccuggcuccca

SEQ ID NO: 934235 - RNA, 21 nt, Human
ucccuguggccuggcucccau

SEQ ID NO: 934236 - RNA, 21 nt, Human
uuggcugcaaacgccucucuc

SEQ ID NO: 934237 - RNA, 24 nt, Human
acaagccaagacaucccaguucua

SEQ ID NO: 934238 - RNA, 21 nt, Human
acccccaagggggaaagagcc

SEQ ID NO: 934239 - RNA, 18 nt, Human
accccuccccagcccccc

SEQ ID NO: 934240 - RNA, 18 nt, Human
acggagcagcugcaaacc

SEQ ID NO: 934241 - RNA, 19 nt, Human
agcugugugugggaaaaug

SEQ ID NO: 934242 - RNA, 23 nt, Human
aggagcccugggggaggucaggg

SEQ ID NO: 934243 - RNA, 25 nt, Human
auucccccuaccccuccccagcccc

SEQ ID NO: 934244 - RNA, 21 nt, Human
caaaaaacauacaagccaaga

SEQ ID NO: 934245 - RNA, 22 nt, Human
caaaaaacauacaagccaagac

SEQ ID NO: 934246 - RNA, 24 nt, Human
caagacaucccaguucuagucccc

SEQ ID NO: 934247 - RNA, 18 nt, Human
caggagccgagccgggcc

SEQ ID NO: 934248 - RNA, 21 nt, Human
caguucuagucccccacuccc

SEQ ID NO: 934249 - RNA, 21 nt, Human
cccacucccuaaaggaguaca

SEQ ID NO: 934250 - RNA, 22 nt, Human
cccagcacccccacccccugca

SEQ ID NO: 934251 - RNA, 20 nt, Human
ccccauucccccuaccccuc

SEQ ID NO: 934252 - RNA, 22 nt, Human
ccccauucccccuaccccuccc

SEQ ID NO: 934253 - RNA, 25 nt, Human
ccccauucccccuaccccuccccag

SEQ ID NO: 934254 - RNA, 22 nt, Human
cccccaagggggaaagagccug

SEQ ID NO: 934255 - RNA, 18 nt, Human
cccccacccccugcacga

SEQ ID NO: 934256 - RNA, 21 nt, Human
cccccuaccccuccccagccc

SEQ ID NO: 934257 - RNA, 20 nt, Human
ccccuaccccuccccagccc

SEQ ID NO: 934258 - RNA, 23 nt, Human
ccccuaccccuccccagcccccc

SEQ ID NO: 934259 - RNA, 24 nt, Human
ccccuaccccuccccagcccccca

SEQ ID NO: 934260 - RNA, 20 nt, Human
ccccuccccagccccccagc

SEQ ID NO: 934261 - RNA, 19 nt, Human
cccggggagguugccugcc

SEQ ID NO: 934262 - RNA, 23 nt, Human
cccugggcaggggacccccaagg

SEQ ID NO: 934263 - RNA, 18 nt, Human
cccugggggaggucaggg

SEQ ID NO: 934264 - RNA, 22 nt, Human
cccugggggaggucaggguggc

SEQ ID NO: 934265 - RNA, 21 nt, Human
ccugcucccacacugcuggcc

SEQ ID NO: 934266 - RNA, 25 nt, Human
cgcggccgcuuuuuuuuuuuuuuuu

SEQ ID NO: 934267 - RNA, 19 nt, Human
cuagucccccacucccuaa

SEQ ID NO: 934268 - RNA, 20 nt, Human
cugcaaaccagcggccgcga

SEQ ID NO: 934269 - RNA, 18 nt, Human
cugcacacgagcgcgaga

SEQ ID NO: 934270 - RNA, 18 nt, Human
gaccgaggccggggccuc

SEQ ID NO: 934271 - RNA, 26 nt, Human
gaggagcccugggggaggucagggug

SEQ ID NO: 934272 - RNA, 19 nt, Human
gcggccgcuuuuuuuuuuu

SEQ ID NO: 934273 - RNA, 22 nt, Human
gcuggggaggagcccuggggga

SEQ ID NO: 934274 - RNA, 26 nt, Human
ggagcccugggggaggucaggguggc

SEQ ID NO: 934275 - RNA, 19 nt, Human
ggaggagcccugggggagg

SEQ ID NO: 934276 - RNA, 18 nt, Human
ggaggucaggguggcugg

SEQ ID NO: 934277 - RNA, 19 nt, Human
ggaggucaggguggcuggc

SEQ ID NO: 934278 - RNA, 22 nt, Human
ggccgcuuuuuuuuuuuuuuuu

SEQ ID NO: 934279 - RNA, 20 nt, Human
gggaaagagccuguccccau

SEQ ID NO: 934280 - RNA, 19 nt, Human
ggggaggagcccuggggga

SEQ ID NO: 934281 - RNA, 18 nt, Human
ucaccggcuggggaggag

SEQ ID NO: 934282 - RNA, 19 nt, Human
ucccacacugcuggccagg

SEQ ID NO: 934283 - RNA, 23 nt, Human
uccccauucccccuaccccuccc

SEQ ID NO: 934284 - RNA, 23 nt, Human
ucccccuaccccuccccagcccc

SEQ ID NO: 934285 - RNA, 22 nt, Human
ugcagcauaugagcugugugug

SEQ ID NO: 934286 - RNA, 20 nt, Human
ugcccugggcaggggacccc

SEQ ID NO: 934287 - RNA, 23 nt, Human
uggcucccagcacccccaccccc

SEQ ID NO: 934288 - RNA, 21 nt, Human
uggggaggagcccugggggag

SEQ ID NO: 934289 - RNA, 19 nt, Human
uucaaaaaacauacaagcc

SEQ ID NO: 934290 - RNA, 18 nt, Human
uucccccuaccccucccc

SEQ ID NO: 934291 - RNA, 19 nt, Human
uucccccuaccccucccca

SEQ ID NO: 934292 - RNA, 24 nt, Human
uuuuuuuuuuuuuuuuuuuuuggg

SEQ ID NO: 934293 - RNA, 19 nt, Human
acacacaucuaacccuaua

SEQ ID NO: 934294 - RNA, 21 nt, Human
cacaucuaacccuauauuccg

SEQ ID NO: 934295 - RNA, 19 nt, Human
cccaugcaguccccuaagc

SEQ ID NO: 934296 - RNA, 18 nt, Human
ccuuccucccucccgacc

SEQ ID NO: 934297 - RNA, 21 nt, Human
cucagcuacccuuucccucca

SEQ ID NO: 934298 - RNA, 22 nt, Human
cucagcuacccuuucccuccag

SEQ ID NO: 934299 - RNA, 28 nt, Human
gggucuccgggacggccuaacaacaacu

SEQ ID NO: 934300 - RNA, 21 nt, Human
ucccgaccgggucuccgggac

SEQ ID NO: 934301 - RNA, 21 nt, Human
agguugccgcgggcccggagc

SEQ ID NO: 934302 - RNA, 20 nt, Human
cucgagaagccugccgcccc

SEQ ID NO: 934303 - RNA, 20 nt, Human
uugccgcgggcccggagcuc

SEQ ID NO: 934304 - RNA, 21 nt, Human
agggggcggggguagugcagu

SEQ ID NO: 934305 - RNA, 19 nt, Human
ccggcuccgcggccggggu

SEQ ID NO: 934306 - RNA, 18 nt, Human
gagcgcccgcgacuucgg

SEQ ID NO: 934307 - RNA, 19 nt, Human
ggaggaaagaagggggcgg

SEQ ID NO: 934308 - RNA, 23 nt, Human
gggcggggguagugcagugagcc

SEQ ID NO: 934309 - RNA, 23 nt, Human
uccgcggccgggguagcuauaac

SEQ ID NO: 934310 - RNA, 19 nt, Human
ucuggaggaaagaaggggg

SEQ ID NO: 934311 - RNA, 22 nt, Human
uggaggaaagaagggggcgggg

SEQ ID NO: 934312 - RNA, 20 nt, Human
aaaaagccaaaacccucaau

SEQ ID NO: 934313 - RNA, 26 nt, Human
aaagccaaaacccucaaugcaaagga

SEQ ID NO: 934314 - RNA, 23 nt, Human
aaauaaaaagccaaaacccucaa

SEQ ID NO: 934315 - RNA, 20 nt, Human
aacccguccucccccaacuc

SEQ ID NO: 934316 - RNA, 18 nt, Human
aacucacgcccgcugcag

SEQ ID NO: 934317 - RNA, 21 nt, Human
aaugcaaaggaaaacugcagu

SEQ ID NO: 934318 - RNA, 18 nt, Human
aggcgagucggcaacccg

SEQ ID NO: 934319 - RNA, 18 nt, Human
agugugucuauauauaug

SEQ ID NO: 934320 - RNA, 19 nt, Human
agugugucuauauauaugu

SEQ ID NO: 934321 - RNA, 19 nt, Human
augugccccuguagcaugu

SEQ ID NO: 934322 - RNA, 20 nt, Human
caaaacccucaaugcaaaga

SEQ ID NO: 934323 - RNA, 24 nt, Human
caaaacccucaaugcaaaggaaaa

SEQ ID NO: 934324 - RNA, 20 nt, Human
caaaauguuuugaccugaaa

SEQ ID NO: 934325 - RNA, 18 nt, Human
cacgcccgcugcagcugc

SEQ ID NO: 934326 - RNA, 22 nt, Human
cagaaaaugugccccuguagca

SEQ ID NO: 934327 - RNA, 20 nt, Human
cccguccucccccaacucac

SEQ ID NO: 934328 - RNA, 21 nt, Human
cggcaacccguccucccccaa

SEQ ID NO: 934329 - RNA, 20 nt, Human
cucaaugcaaaggaaaacug

SEQ ID NO: 934330 - RNA, 18 nt, Human
cucccccaacucacgccc

SEQ ID NO: 934331 - RNA, 18 nt, Human
cuucuggucuuaacucuu

SEQ ID NO: 934332 - RNA, 22 nt, Human
gcccaccgcggacuccagggcg

SEQ ID NO: 934333 - RNA, 18 nt, Human
uaaaaagccaaaacccuc

SEQ ID NO: 934334 - RNA, 28 nt, Human
uaaaaagccaaaacccucaaugcaaagg

SEQ ID NO: 934335 - RNA, 20 nt, Human
uaaccacagaaaaugugccc

SEQ ID NO: 934336 - RNA, 19 nt, Human
uaacucuucugaauuacac

SEQ ID NO: 934337 - RNA, 23 nt, Human
uacaaauaaaaagccaaaacccu

SEQ ID NO: 934338 - RNA, 18 nt, Human
uagcauguuuuuaaaugg

SEQ ID NO: 934339 - RNA, 24 nt, Human
uauauauauguauacgucucuaca

SEQ ID NO: 934340 - RNA, 20 nt, Human
ucggacaccggauacaggcc

SEQ ID NO: 934341 - RNA, 29 nt, Human
ucucgcccaccgcggacuccagggcgcga

SEQ ID NO: 934342 - RNA, 18 nt, Human
ugucuauauauauguaua

SEQ ID NO: 934343 - RNA, 20 nt, Human
ugucuuguuucuccuagguc

SEQ ID NO: 934344 - RNA, 22 nt, Human
ugucuuguuucuccuaggucaa

SEQ ID NO: 934345 - RNA, 18 nt, Human
ugugucuauauauaugua

SEQ ID NO: 934346 - RNA, 19 nt, Human
ugugucuauauauauguau

SEQ ID NO: 934347 - RNA, 21 nt, Human
ugugucuauauauauguauac

SEQ ID NO: 934348 - RNA, 20 nt, Human
uguuuucugucuuguuucuc

SEQ ID NO: 934349 - RNA, 27 nt, Human
uuccaguacuucuggucuuaacucuuc

SEQ ID NO: 934350 - RNA, 23 nt, Human
uuuacaaauaaaaagccaaaacc

SEQ ID NO: 934351 - RNA, 27 nt, Human
uuuacaaauaaaaagccaaaacccuca

SEQ ID NO: 934352 - RNA, 24 nt, Human
aaaaaaaaaaaaaaagcaaucuuc

SEQ ID NO: 934353 - RNA, 25 nt, Human
aaaaaaaaaaagcaaucuucuagga

SEQ ID NO: 934354 - RNA, 23 nt, Human
aaaguacagaucauuuguaccaa

SEQ ID NO: 934355 - RNA, 19 nt, Human
aacacggucaaaccccguc

SEQ ID NO: 934356 - RNA, 20 nt, Human
aacacggucaaaccccgucu

SEQ ID NO: 934357 - RNA, 21 nt, Human
aacacggucaaaccccgucuc

SEQ ID NO: 934358 - RNA, 24 nt, Human
aacagagcaagauucugucucaaa

SEQ ID NO: 934359 - RNA, 19 nt, Human
aauacaaaaaauuagccgg

SEQ ID NO: 934360 - RNA, 24 nt, Human
acagagcaagauucugucucaaaa

SEQ ID NO: 934361 - RNA, 24 nt, Human
accccgucucuacuaaaaauacaa

SEQ ID NO: 934362 - RNA, 24 nt, Human
accgcgccacugcacuccagccug

SEQ ID NO: 934363 - RNA, 24 nt, Human
acugcacuccagccugggcaacag

SEQ ID NO: 934364 - RNA, 24 nt, Human
acugcacuccagccugggcaacag

SEQ ID NO: 934365 - RNA, 25 nt, Human
agagaaaccaauauucacugaaggg

SEQ ID NO: 934366 - RNA, 24 nt, Human
agagcuugcagugagccgagaccg

SEQ ID NO: 934367 - RNA, 24 nt, Human
agcacuuugggaggcugaggcagg

SEQ ID NO: 934368 - RNA, 23 nt, Human
agccggaugugguggcgggugcc

SEQ ID NO: 934369 - RNA, 24 nt, Human
agccugggcaacagagcaagauuc

SEQ ID NO: 934370 - RNA, 23 nt, Human
agccuguaaucccagcacuuugg

SEQ ID NO: 934371 - RNA, 24 nt, Human
agccuguaaucccagcacuuuggg

SEQ ID NO: 934372 - RNA, 21 nt, Human
aggcagagcuugcagugagcc

SEQ ID NO: 934373 - RNA, 24 nt, Human
aggcagagcuugcagugagccgag

SEQ ID NO: 934374 - RNA, 22 nt, Human
aggcaggagaauggcgugaacc

SEQ ID NO: 934375 - RNA, 24 nt, Human
aggcaggagaauggcgugaaccug

SEQ ID NO: 934376 - RNA, 20 nt, Human
aggcaggcggaucacaaggu

SEQ ID NO: 934377 - RNA, 26 nt, Human
aggcaggcggaucacaaggucaggag

SEQ ID NO: 934378 - RNA, 24 nt, Human
aggcggaucacaaggucaggagau

SEQ ID NO: 934379 - RNA, 19 nt, Human
aggcugaggcaggagaaug

SEQ ID NO: 934380 - RNA, 19 nt, Human
aggcugaggcaggcggauc

SEQ ID NO: 934381 - RNA, 21 nt, Human
aggcugaggcaggcggaucac

SEQ ID NO: 934382 - RNA, 24 nt, Human
caagaccauccuggcuaacacggu

SEQ ID NO: 934383 - RNA, 24 nt, Human
caagccuguaaucccagcacuuug

SEQ ID NO: 934384 - RNA, 19 nt, Human
cacugcacuccagccuggg

SEQ ID NO: 934385 - RNA, 21 nt, Human
cacugcacuccagccugggca

SEQ ID NO: 934386 - RNA, 22 nt, Human
cacugcacuccagccugggcaa

SEQ ID NO: 934387 - RNA, 23 nt, Human
cacugcacuccagccugggcaac

SEQ ID NO: 934388 - RNA, 24 nt, Human
cacugcacuccagccugggcaaca

SEQ ID NO: 934389 - RNA, 26 nt, Human
cacugcacuccagccugggcaacaga

SEQ ID NO: 934390 - RNA, 24 nt, Human
cagcacuuugggaggcugaggcag

SEQ ID NO: 934391 - RNA, 26 nt, Human
cagcacuuugggaggcugaggcaggc

SEQ ID NO: 934392 - RNA, 24 nt, Human
cagcuacucgggaggcugaggcag

SEQ ID NO: 934393 - RNA, 20 nt, Human
caguuaaaaaaaaaaaaaaa

SEQ ID NO: 934394 - RNA, 20 nt, Human
ccacugcacuccagccuggg

SEQ ID NO: 934395 - RNA, 20 nt, Human
ccacugcacuccagccuggg

SEQ ID NO: 934396 - RNA, 21 nt, Human
ccacugcacuccagccugggc

SEQ ID NO: 934397 - RNA, 23 nt, Human
ccacugcacuccagccugggcaa

SEQ ID NO: 934398 - RNA, 24 nt, Human
ccacugcacuccagccugggcaac

SEQ ID NO: 934399 - RNA, 24 nt, Human
cccaagccuguaaucccagcacuu

SEQ ID NO: 934400 - RNA, 19 nt, Human
ccguauuucuaagaguaaa

SEQ ID NO: 934401 - RNA, 23 nt, Human
ccuggcuaacacggucaaacccc

SEQ ID NO: 934402 - RNA, 24 nt, Human
ccuggcuaacacggucaaaccccg

SEQ ID NO: 934403 - RNA, 22 nt, Human
ccugggcaacagagcaagauuc

SEQ ID NO: 934404 - RNA, 19 nt, Human
ccuguagucccagcuacuc

SEQ ID NO: 934405 - RNA, 21 nt, Human
ccuguagucccagcuacucgg

SEQ ID NO: 934406 - RNA, 22 nt, Human
ccuguagucccagcuacucggg

SEQ ID NO: 934407 - RNA, 24 nt, Human
cgagaccgcgccacugcacuccag

SEQ ID NO: 934408 - RNA, 24 nt, Human
cgccacugcacuccagccugggca

SEQ ID NO: 934409 - RNA, 31 nt, Human
cucaaaaaaaaaaaaaaccucuccaggaaaa

SEQ ID NO: 934410 - RNA, 18 nt, Human
cuggcuaacacggucaaa

SEQ ID NO: 934411 - RNA, 23 nt, Human
cugucucaaaaaaaaaaaaaacc

SEQ ID NO: 934412 - RNA, 21 nt, Human
cuugcagugagccgagaccgc

SEQ ID NO: 934413 - RNA, 20 nt, Human
gaaccugggaggcagagcuu

SEQ ID NO: 934414 - RNA, 18 nt, Human
gagcuugcagugagccga

SEQ ID NO: 934415 - RNA, 24 nt, Human
gcacuccagccugggcaacagagc

SEQ ID NO: 934416 - RNA, 22 nt, Human
gccacugcacuccagccugggc

SEQ ID NO: 934417 - RNA, 24 nt, Human
gccacugcacuccagccugggcaa

SEQ ID NO: 934418 - RNA, 20 nt, Human
gccgagaccgcgccacugca

SEQ ID NO: 934419 - RNA, 22 nt, Human
gcugaggcaggagaauggcgug

SEQ ID NO: 934420 - RNA, 21 nt, Human
ggcccaagccuguaaucccag

SEQ ID NO: 934421 - RNA, 23 nt, Human
ggcgcgguggcccaagccuguaa

SEQ ID NO: 934422 - RNA, 23 nt, Human
gguggcccaagccuguaauccca

SEQ ID NO: 934423 - RNA, 24 nt, Human
gguggcccaagccuguaaucccag

SEQ ID NO: 934424 - RNA, 23 nt, Human
guuaaaaaaaaaaaaaaagcaau

SEQ ID NO: 934425 - RNA, 24 nt, Human
uaacacggucaaaccccgucucua

SEQ ID NO: 934426 - RNA, 19 nt, Human
uaacuuguaaaaauucauc

SEQ ID NO: 934427 - RNA, 18 nt, Human
uaauacuggaacuacagu

SEQ ID NO: 934428 - RNA, 26 nt, Human
uacaguuaaaaaaaaaaaaaaagcaa

SEQ ID NO: 934429 - RNA, 21 nt, Human
uagccggaugugguggcgggu

SEQ ID NO: 934430 - RNA, 22 nt, Human
uagccggaugugguggcgggug

SEQ ID NO: 934431 - RNA, 19 nt, Human
uaugaaauauagcuacaaa

SEQ ID NO: 934432 - RNA, 18 nt, Human
ucacaaggucaggagauc

SEQ ID NO: 934433 - RNA, 24 nt, Human
ucacaaggucaggagaucaagacc

SEQ ID NO: 934434 - RNA, 19 nt, Human
uccaggaaaucaauaguca

SEQ ID NO: 934435 - RNA, 25 nt, Human
uccuaacuguaguuuaaaguacaga

SEQ ID NO: 934436 - RNA, 22 nt, Human
ucucuacuaaaaauacaaaaaa

SEQ ID NO: 934437 - RNA, 22 nt, Human
ucugucucaaaaaaaaaaaaaa

SEQ ID NO: 934438 - RNA, 22 nt, Human
ugagccgagaccgcgccacugc

SEQ ID NO: 934439 - RNA, 23 nt, Human
ugaggcaggagaauggcgugaac

SEQ ID NO: 934440 - RNA, 24 nt, Human
ugaggcaggagaauggcgugaacc

SEQ ID NO: 934441 - RNA, 25 nt, Human
ugaggcaggagaauggcgugaaccu

SEQ ID NO: 934442 - RNA, 24 nt, Human
ugaggcaggcggaucacaagguca

SEQ ID NO: 934443 - RNA, 25 nt, Human
ugaggcaggcggaucacaaggucag

SEQ ID NO: 934444 - RNA, 24 nt, Human
ugccuguagucccagcuacucggg

SEQ ID NO: 934445 - RNA, 22 nt, Human
uggcccaagccuguaaucccag

SEQ ID NO: 934446 - RNA, 24 nt, Human
uggcccaagccuguaaucccagca

SEQ ID NO: 934447 - RNA, 24 nt, Human
uggcgggugccuguagucccagcu

SEQ ID NO: 934448 - RNA, 23 nt, Human
uggcugggcgcgguggcccaagc

SEQ ID NO: 934449 - RNA, 18 nt, Human
ugggaggcugaggcaggc

SEQ ID NO: 934450 - RNA, 20 nt, Human
ugggaggcugaggcaggcgg

SEQ ID NO: 934451 - RNA, 24 nt, Human
ugggaggcugaggcaggcggauca

SEQ ID NO: 934452 - RNA, 24 nt, Human
ugguggcgggugccuguaguccca

SEQ ID NO: 934453 - RNA, 24 nt, Human
uguuuggagcuguacgacaaugga

SEQ ID NO: 934454 - RNA, 20 nt, Human
uuaaaguacagaucauuugu

SEQ ID NO: 934455 - RNA, 18 nt, Human
uugcagugagccgagacc

SEQ ID NO: 934456 - RNA, 18 nt, Human
uugcagugagccgagacc

SEQ ID NO: 934457 - RNA, 22 nt, Human
uugcagugagccgagaccgcgc

SEQ ID NO: 934458 - RNA, 25 nt, Human
uugggaggcugaggcaggcggauca

SEQ ID NO: 934459 - RNA, 20 nt, Human
uuuuccacaaauccguucug

SEQ ID NO: 934460 - RNA, 24 nt, Human
aaaaagcaggaguagcaacaccac

SEQ ID NO: 934461 - RNA, 25 nt, Human
aaaagggcaagcguggcagcacagg

SEQ ID NO: 934462 - RNA, 20 nt, Human
aaacaggaaucaacuuuagc

SEQ ID NO: 934463 - RNA, 20 nt, Human
aaacaucccaguaccacuaa

SEQ ID NO: 934464 - RNA, 20 nt, Human
aaagaagacagaggagaagg

SEQ ID NO: 934465 - RNA, 20 nt, Human
aaagacagagucucggucug

SEQ ID NO: 934466 - RNA, 19 nt, Human
aaagugcugggauuacagg

SEQ ID NO: 934467 - RNA, 20 nt, Human
aaagugcugggauuacaggg

SEQ ID NO: 934468 - RNA, 24 nt, Human
aaagugcugggauuacagggguga

SEQ ID NO: 934469 - RNA, 24 nt, Human
aaagugcugggauuacagguguga

SEQ ID NO: 934470 - RNA, 18 nt, Human
aaauucacuccccagccc

SEQ ID NO: 934471 - RNA, 25 nt, Human
aacaaaaaaccccaauguaucaccc

SEQ ID NO: 934472 - RNA, 22 nt, Human
aacagacacaagacguuacaag

SEQ ID NO: 934473 - RNA, 20 nt, Human
aacucuucucucucccacuc

SEQ ID NO: 934474 - RNA, 22 nt, Human
aacucuucucucucccacucug

SEQ ID NO: 934475 - RNA, 22 nt, Human
aagaauacagcaaaaugugaau

SEQ ID NO: 934476 - RNA, 27 nt, Human
aagcaaucccccugccucagcuuccca

SEQ ID NO: 934477 - RNA, 24 nt, Human
aagcaggugaaucaagagggcaag

SEQ ID NO: 934478 - RNA, 24 nt, Human
aagcuuacgcugaaagcaccucag

SEQ ID NO: 934479 - RNA, 19 nt, Human
aagcuuguggagcuuguca

SEQ ID NO: 934480 - RNA, 18 nt, Human
aaggaauccuaagacaga

SEQ ID NO: 934481 - RNA, 20 nt, Human
aaguagcugggacuacaggc

SEQ ID NO: 934482 - RNA, 24 nt, Human
aaguagcugggacuacaggcaugu

SEQ ID NO: 934483 - RNA, 25 nt, Human
aaguagcugggacuacaggcaugug

SEQ ID NO: 934484 - RNA, 18 nt, Human
aagugcugggauuacagg

SEQ ID NO: 934485 - RNA, 18 nt, Human
aagugcugggauuacagg

SEQ ID NO: 934486 - RNA, 21 nt, Human
aagugcugggauuacaggggu

SEQ ID NO: 934487 - RNA, 19 nt, Human
aagugcugggauuacaggu

SEQ ID NO: 934488 - RNA, 23 nt, Human
aauucacuccccagccaccuccc

SEQ ID NO: 934489 - RNA, 20 nt, Human
acaaagcaugucccaggagc

SEQ ID NO: 934490 - RNA, 19 nt, Human
acacacgguuuccccaccu

SEQ ID NO: 934491 - RNA, 19 nt, Human
acagacacaagacguuaca

SEQ ID NO: 934492 - RNA, 24 nt, Human
accacagaaccaagggggcugugg

SEQ ID NO: 934493 - RNA, 21 nt, Human
accacgcccccugguggcaaa

SEQ ID NO: 934494 - RNA, 20 nt, Human
acccgccaccacuccacucc

SEQ ID NO: 934495 - RNA, 19 nt, Human
acccuaaacaucccaguac

SEQ ID NO: 934496 - RNA, 22 nt, Human
acccuaaacaucccaguaccac

SEQ ID NO: 934497 - RNA, 24 nt, Human
accguguuggccaggcuggucuug

SEQ ID NO: 934498 - RNA, 21 nt, Human
accugccugccaaugccucca

SEQ ID NO: 934499 - RNA, 20 nt, Human
accuuggccacccgccacca

SEQ ID NO: 934500 - RNA, 28 nt, Human
acgcaccccuccccggccugggcggcgg

SEQ ID NO: 934501 - RNA, 18 nt, Human
acgggguuucaccguguu

SEQ ID NO: 934502 - RNA, 23 nt, Human
acgggguuucaccguguuggcca

SEQ ID NO: 934503 - RNA, 24 nt, Human
acgggguuucaccguguuggccag

SEQ ID NO: 934504 - RNA, 23 nt, Human
acguuacaaggaucacacccugc

SEQ ID NO: 934505 - RNA, 25 nt, Human
acuauguugcccagacuggucuuga

SEQ ID NO: 934506 - RNA, 21 nt, Human
acucugguccuuccaucagaa

SEQ ID NO: 934507 - RNA, 19 nt, Human
agagacgggguuucaccgu

SEQ ID NO: 934508 - RNA, 21 nt, Human
agagcuccuucccaccugccu

SEQ ID NO: 934509 - RNA, 19 nt, Human
agaggagaagguaggagca

SEQ ID NO: 934510 - RNA, 19 nt, Human
agauaggagcuuggaccag

SEQ ID NO: 934511 - RNA, 20 nt, Human
agauaggagcuuggaccagg

SEQ ID NO: 934512 - RNA, 18 nt, Human
agcacaguucuaccuacc

SEQ ID NO: 934513 - RNA, 22 nt, Human
agcauccagucacuuuggagac

SEQ ID NO: 934514 - RNA, 23 nt, Human
agcugcaagaauacagcaaaaug

SEQ ID NO: 934515 - RNA, 21 nt, Human
agcugguuccgcuacgaccuc

SEQ ID NO: 934516 - RNA, 21 nt, Human
agcuguuacuaccuuaaguau

SEQ ID NO: 934517 - RNA, 21 nt, Human
agcuugucagggaccugggcu

SEQ ID NO: 934518 - RNA, 18 nt, Human
aggagcacagaaucugua

SEQ ID NO: 934519 - RNA, 20 nt, Human
agggggcugugggcgugggg

SEQ ID NO: 934520 - RNA, 20 nt, Human
agggggcugugggcgugggg

SEQ ID NO: 934521 - RNA, 22 nt, Human
agggggcugugggcgugggggu

SEQ ID NO: 934522 - RNA, 19 nt, Human
aguaacggggguuggggaa

SEQ ID NO: 934523 - RNA, 18 nt, Human
aguacccaaacgcccuuc

SEQ ID NO: 934524 - RNA, 18 nt, Human
aguaccucgcaaagugag

SEQ ID NO: 934525 - RNA, 20 nt, Human
aguagagacgggguuucacc

SEQ ID NO: 934526 - RNA, 21 nt, Human
aguagagacgggguuucaccg

SEQ ID NO: 934527 - RNA, 23 nt, Human
aguugagagccaccgccuggggg

SEQ ID NO: 934528 - RNA, 26 nt, Human
auaacggacagccuggcuagcccaca

SEQ ID NO: 934529 - RNA, 19 nt, Human
auccacacacagccucccu

SEQ ID NO: 934530 - RNA, 21 nt, Human
aucccccugccucagcuuccc

SEQ ID NO: 934531 - RNA, 19 nt, Human
auccuuauacgccuuccuc

SEQ ID NO: 934532 - RNA, 20 nt, Human
augaacaaguuucacccaag

SEQ ID NO: 934533 - RNA, 24 nt, Human
augagacagcacagaaccuucuua

SEQ ID NO: 934534 - RNA, 23 nt, Human
auggcaggcaggcagcacaguuc

SEQ ID NO: 934535 - RNA, 22 nt, Human
auggugcugggucacugccacu

SEQ ID NO: 934536 - RNA, 21 nt, Human
auucagaguuugacuuuacuc

SEQ ID NO: 934537 - RNA, 24 nt, Human
auuuuuguauuuuuaguagagacg

SEQ ID NO: 934538 - RNA, 21 nt, Human
caaaaacaccccugaaauuuc

SEQ ID NO: 934539 - RNA, 24 nt, Human
caaagugcugggauuacaggggug

SEQ ID NO: 934540 - RNA, 24 nt, Human
caaagugcugggauuacaggugug

SEQ ID NO: 934541 - RNA, 21 nt, Human
caacucuucucucucccacuc

SEQ ID NO: 934542 - RNA, 22 nt, Human
caacucuucucucucccacucc

SEQ ID NO: 934543 - RNA, 19 nt, Human
caaggaugucacccuaaac

SEQ ID NO: 934544 - RNA, 18 nt, Human
caaguccuuccgacacau

SEQ ID NO: 934545 - RNA, 20 nt, Human
caagugauucuccugccuga

SEQ ID NO: 934546 - RNA, 21 nt, Human
caagugauucuccugccugag

SEQ ID NO: 934547 - RNA, 22 nt, Human
caaguggucucuggguacccaa

SEQ ID NO: 934548 - RNA, 22 nt, Human
caauaccaguacacacaucaaa

SEQ ID NO: 934549 - RNA, 21 nt, Human
cacaagcuagugggaggggag

SEQ ID NO: 934550 - RNA, 21 nt, Human
cacacaauucuaacacaucca

SEQ ID NO: 934551 - RNA, 22 nt, Human
cacacaauucuaacacauccac

SEQ ID NO: 934552 - RNA, 23 nt, Human
cacacaucaaaaacaacuuacuc

SEQ ID NO: 934553 - RNA, 20 nt, Human
cacagaaucuguacuaucca

SEQ ID NO: 934554 - RNA, 24 nt, Human
caccacaccuggcuaauuuuugua

SEQ ID NO: 934555 - RNA, 24 nt, Human
cacccaaacacauccugugcccac

SEQ ID NO: 934556 - RNA, 25 nt, Human
cacccaaacacauccugugcccacc

SEQ ID NO: 934557 - RNA, 25 nt, Human
cacccccccacaaaaaaauacacug

SEQ ID NO: 934558 - RNA, 24 nt, Human
caccccuccccggccugggcggcg

SEQ ID NO: 934559 - RNA, 21 nt, Human
cacccgccaccacuccacucc

SEQ ID NO: 934560 - RNA, 21 nt, Human
caccguguuggccaggcuggu

SEQ ID NO: 934561 - RNA, 23 nt, Human
caccguguuggccaggcuggucu

SEQ ID NO: 934562 - RNA, 24 nt, Human
caccguguuggccaggcuggucuu

SEQ ID NO: 934563 - RNA, 23 nt, Human
caccugccauggccucccaaagu

SEQ ID NO: 934564 - RNA, 24 nt, Human
cacuauguugcccagacuggucuu

SEQ ID NO: 934565 - RNA, 27 nt, Human
cacuauguugcccagacuggucuugaa

SEQ ID NO: 934566 - RNA, 21 nt, Human
cacugcaaccucugccuccug

SEQ ID NO: 934567 - RNA, 23 nt, Human
cacugcaaccucugccuccuggg

SEQ ID NO: 934568 - RNA, 19 nt, Human
cagaggcaugugugugaag

SEQ ID NO: 934569 - RNA, 20 nt, Human
cagccaccucccgagccucg

SEQ ID NO: 934570 - RNA, 18 nt, Human
cagcuggcucuguggaaa

SEQ ID NO: 934571 - RNA, 19 nt, Human
cagggaccugggcuuguca

SEQ ID NO: 934572 - RNA, 24 nt, Human
cauacaggaagaagggcagacucc

SEQ ID NO: 934573 - RNA, 21 nt, Human
cauccuuauacgccuuccucc

SEQ ID NO: 934574 - RNA, 19 nt, Human
cauugcacaccguucccac

SEQ ID NO: 934575 - RNA, 18 nt, Human
cauuugugggcugaugau

SEQ ID NO: 934576 - RNA, 19 nt, Human
ccaaagugcugggauuaca

SEQ ID NO: 934577 - RNA, 20 nt, Human
ccaaagugcugggauuacag

SEQ ID NO: 934578 - RNA, 21 nt, Human
ccaaagugcugggauuacagg

SEQ ID NO: 934579 - RNA, 21 nt, Human
ccaaagugcugggauuacagg

SEQ ID NO: 934580 - RNA, 21 nt, Human
ccaaagugcugggauuacagg

SEQ ID NO: 934581 - RNA, 24 nt, Human
ccaaagugcugggauuacaggggu

SEQ ID NO: 934582 - RNA, 24 nt, Human
ccaaagugcugggauuacaggugu

SEQ ID NO: 934583 - RNA, 23 nt, Human
ccaaguagcugggacuacaggca

SEQ ID NO: 934584 - RNA, 20 nt, Human
ccaccacaccuggcuaauuu

SEQ ID NO: 934585 - RNA, 24 nt, Human
ccaccugccugccaaugccuccag

SEQ ID NO: 934586 - RNA, 20 nt, Human
ccacgcccccugguggcaaa

SEQ ID NO: 934587 - RNA, 24 nt, Human
ccacuccacuccuuuuccacacac

SEQ ID NO: 934588 - RNA, 19 nt, Human
ccacugcaccuggccuugg

SEQ ID NO: 934589 - RNA, 19 nt, Human
ccacugcaccuggccuugg

SEQ ID NO: 934590 - RNA, 19 nt, Human
ccacugcaccuggccuugg

SEQ ID NO: 934591 - RNA, 20 nt, Human
ccacugcaccuggccuuggu

SEQ ID NO: 934592 - RNA, 21 nt, Human
ccacugcaccuggccuuggug

SEQ ID NO: 934593 - RNA, 20 nt, Human
ccagaaaauucacuccccag

SEQ ID NO: 934594 - RNA, 18 nt, Human
ccagcaaccuucccacag

SEQ ID NO: 934595 - RNA, 21 nt, Human
ccagcugauggugaagccuca

SEQ ID NO: 934596 - RNA, 22 nt, Human
cccaaacgcccuucgcucaguc

SEQ ID NO: 934597 - RNA, 23 nt, Human
cccaaacgcccuucgcucagucc

SEQ ID NO: 934598 - RNA, 18 nt, Human
cccacagagacaguaacg

SEQ ID NO: 934599 - RNA, 23 nt, Human
cccauggugcggaagaauggagc

SEQ ID NO: 934600 - RNA, 21 nt, Human
ccccaaagacccaggguccuc

SEQ ID NO: 934601 - RNA, 22 nt, Human
ccccacaaaaaaauacacugua

SEQ ID NO: 934602 - RNA, 24 nt, Human
cccccugccucagcuucccaaagu

SEQ ID NO: 934603 - RNA, 18 nt, Human
ccccuccccggccugggc

SEQ ID NO: 934604 - RNA, 19 nt, Human
ccgccaccacuccacuccu

SEQ ID NO: 934605 - RNA, 21 nt, Human
ccuaaauccaaggcucagucu

SEQ ID NO: 934606 - RNA, 24 nt, Human
ccuacagcuggggcauccuuauac

SEQ ID NO: 934607 - RNA, 22 nt, Human
ccucaagagcagugccuggccc

SEQ ID NO: 934608 - RNA, 23 nt, Human
ccuccaacgcuccagcccaggca

SEQ ID NO: 934609 - RNA, 24 nt, Human
ccuccuggguucaagugauucucc

SEQ ID NO: 934610 - RNA, 22 nt, Human
ccucugccuccuggguucaagu

SEQ ID NO: 934611 - RNA, 21 nt, Human
ccugacacuaacgcaccccuc

SEQ ID NO: 934612 - RNA, 21 nt, Human
ccugaccucaagugauccacc

SEQ ID NO: 934613 - RNA, 23 nt, Human
ccugaccucaagugauccaccug

SEQ ID NO: 934614 - RNA, 23 nt, Human
ccugaccucaagugauccaccug

SEQ ID NO: 934615 - RNA, 23 nt, Human
ccugccaaugccuccaacgcucc

SEQ ID NO: 934616 - RNA, 20 nt, Human
ccuggacucaagcaaucccc

SEQ ID NO: 934617 - RNA, 23 nt, Human
ccuggguucaagugauucuccuc

SEQ ID NO: 934618 - RNA, 23 nt, Human
ccuggguucaagugauucuccug

SEQ ID NO: 934619 - RNA, 19 nt, Human
ccugugaacacugcaguga

SEQ ID NO: 934620 - RNA, 21 nt, Human
ccuugacaaccccucuuauug

SEQ ID NO: 934621 - RNA, 19 nt, Human
cgcagaacuaggagacugc

SEQ ID NO: 934622 - RNA, 23 nt, Human
cgccuuccagaaaauucacuccc

SEQ ID NO: 934623 - RNA, 23 nt, Human
cggcggcgacggcaguacccaaa

SEQ ID NO: 934624 - RNA, 24 nt, Human
cguguuggccaggcuggucuugaa

SEQ ID NO: 934625 - RNA, 22 nt, Human
cuaacgcaccccuccccggccu

SEQ ID NO: 934626 - RNA, 21 nt, Human
cuaagacaaaaauagagaacc

SEQ ID NO: 934627 - RNA, 23 nt, Human
cuaauuuuuguauuuuuaguaga

SEQ ID NO: 934628 - RNA, 21 nt, Human
cucaaacaccuauugaacgcu

SEQ ID NO: 934629 - RNA, 24 nt, Human
cucaagcaaucccccugccucagc

SEQ ID NO: 934630 - RNA, 20 nt, Human
cucacaaaguccacucacca

SEQ ID NO: 934631 - RNA, 24 nt, Human
cucacugcaaccucugccuccugg

SEQ ID NO: 934632 - RNA, 20 nt, Human
cucagggagagucucuuuau

SEQ ID NO: 934633 - RNA, 24 nt, Human
cuccagcaccucaagagcagugcc

SEQ ID NO: 934634 - RNA, 20 nt, Human
cuccuggguucaagugauuc

SEQ ID NO: 934635 - RNA, 21 nt, Human
cuccuggguucaagugauucu

SEQ ID NO: 934636 - RNA, 22 nt, Human
cugacacuaacgcaccccuccc

SEQ ID NO: 934637 - RNA, 24 nt, Human
cugaguugaccaaguagcugggac

SEQ ID NO: 934638 - RNA, 19 nt, Human
cugcaaccucugccuccug

SEQ ID NO: 934639 - RNA, 23 nt, Human
cugcaaccucugccuccuggguu

SEQ ID NO: 934640 - RNA, 24 nt, Human
cugcaaccucugccuccuggguuc

SEQ ID NO: 934641 - RNA, 20 nt, Human
cugcagugagagcuccuucc

SEQ ID NO: 934642 - RNA, 23 nt, Human
cugccucagcuucccaaagugcu

SEQ ID NO: 934643 - RNA, 24 nt, Human
cugccucagcuucccaaagugcug

SEQ ID NO: 934644 - RNA, 23 nt, Human
cugccuccuggguucaagugauu

SEQ ID NO: 934645 - RNA, 23 nt, Human
cuggaguggcuugaucucagcuc

SEQ ID NO: 934646 - RNA, 26 nt, Human
cugucacccaggcuggaguggcuuga

SEQ ID NO: 934647 - RNA, 18 nt, Human
cugugcccaccacagaac

SEQ ID NO: 934648 - RNA, 20 nt, Human
cuugucagggaccugggcuu

SEQ ID NO: 934649 - RNA, 25 nt, Human
gaaauuucugaacaaugagacaaag

SEQ ID NO: 934650 - RNA, 22 nt, Human
gaaggaauauccaaauucaaaa

SEQ ID NO: 934651 - RNA, 21 nt, Human
gacaacuccaggaggcacgag

SEQ ID NO: 934652 - RNA, 22 nt, Human
gacacuaacgcaccccuccccg

SEQ ID NO: 934653 - RNA, 24 nt, Human
gaccaaguagcugggacuacaggc

SEQ ID NO: 934654 - RNA, 22 nt, Human
gaccucaagugauccaccugcc

SEQ ID NO: 934655 - RNA, 21 nt, Human
gacuccaaguccuuccgacac

SEQ ID NO: 934656 - RNA, 20 nt, Human
gacuuuacucacacccaaac

SEQ ID NO: 934657 - RNA, 24 nt, Human
gagacgggguuucaccguguuggc

SEQ ID NO: 934658 - RNA, 22 nt, Human
gagagaugggaucucacuaugu

SEQ ID NO: 934659 - RNA, 19 nt, Human
gagcuugucagggaccugg

SEQ ID NO: 934660 - RNA, 20 nt, Human
gauaaggaauccuaagacag

SEQ ID NO: 934661 - RNA, 19 nt, Human
gauuacaggggugagcuac

SEQ ID NO: 934662 - RNA, 18 nt, Human
gauuacaggugugagcca

SEQ ID NO: 934663 - RNA, 22 nt, Human
gauuacaggugugagccacugc

SEQ ID NO: 934664 - RNA, 23 nt, Human
gauuacaggugugagccacugca

SEQ ID NO: 934665 - RNA, 22 nt, Human
gcaaccucugccuccuggguuc

SEQ ID NO: 934666 - RNA, 21 nt, Human
gcaguacccaaacgcccuucg

SEQ ID NO: 934667 - RNA, 19 nt, Human
gcagugcuuccaagugcgc

SEQ ID NO: 934668 - RNA, 23 nt, Human
gccacccgccaccacuccacucc

SEQ ID NO: 934669 - RNA, 24 nt, Human
gccucagcuucccaaagugcuggg

SEQ ID NO: 934670 - RNA, 18 nt, Human
gccugggggugcaagcuc

SEQ ID NO: 934671 - RNA, 20 nt, Human
gcucgguuuucaaugagaca

SEQ ID NO: 934672 - RNA, 20 nt, Human
gcugaugaugacauacagga

SEQ ID NO: 934673 - RNA, 23 nt, Human
gcuggucuugaacuccugaccuc

SEQ ID NO: 934674 - RNA, 20 nt, Human
gcuuacgcugaaagcaccuc

SEQ ID NO: 934675 - RNA, 19 nt, Human
ggacuacaggcaugugcca

SEQ ID NO: 934676 - RNA, 23 nt, Human
ggaggggaguguggaagaagccg

SEQ ID NO: 934677 - RNA, 19 nt, Human
ggcauuugaggaugcagaa

SEQ ID NO: 934678 - RNA, 20 nt, Human
ggcuagcucuccucccagga

SEQ ID NO: 934679 - RNA, 24 nt, Human
ggcuggucuugaacuccugaccuc

SEQ ID NO: 934680 - RNA, 18 nt, Human
gggcggcggcgacggcag

SEQ ID NO: 934681 - RNA, 20 nt, Human
gggcggcggcgacggcagua

SEQ ID NO: 934682 - RNA, 23 nt, Human
gggguuucaccguguuggccagg

SEQ ID NO: 934683 - RNA, 22 nt, Human
ggguuucaccguguuggccagg

SEQ ID NO: 934684 - RNA, 19 nt, Human
ggucuugaacuccugaccu

SEQ ID NO: 934685 - RNA, 23 nt, Human
guagagacgggguuucaccgugu

SEQ ID NO: 934686 - RNA, 24 nt, Human
gugauccaccugccauggccuccc

SEQ ID NO: 934687 - RNA, 19 nt, Human
guuuccccaccuugccccu

SEQ ID NO: 934688 - RNA, 21 nt, Human
uaaaauaccaacccaauagca

SEQ ID NO: 934689 - RNA, 22 nt, Human
uaaagacagagucucggucugu

SEQ ID NO: 934690 - RNA, 19 nt, Human
uaacagacacaagacguua

SEQ ID NO: 934691 - RNA, 24 nt, Human
uaagacaaaaauagagaaccccaa

SEQ ID NO: 934692 - RNA, 22 nt, Human
uaaggagggagagcagccccca

SEQ ID NO: 934693 - RNA, 24 nt, Human
uaauuuuuguauuuuuaguagaga

SEQ ID NO: 934694 - RNA, 21 nt, Human
uacaaaaacaccccugaaauu

SEQ ID NO: 934695 - RNA, 22 nt, Human
uacaggcaugugccaccacacc

SEQ ID NO: 934696 - RNA, 23 nt, Human
uacaggggugagcuacggcgccu

SEQ ID NO: 934697 - RNA, 22 nt, Human
uacaggugugagccacugcacc

SEQ ID NO: 934698 - RNA, 22 nt, Human
uacaggugugagccacugcacc

SEQ ID NO: 934699 - RNA, 23 nt, Human
uacaggugugagccacugcaccu

SEQ ID NO: 934700 - RNA, 19 nt, Human
uaccaguacacacaucaaa

SEQ ID NO: 934701 - RNA, 19 nt, Human
uaccuuaaguauacauugg

SEQ ID NO: 934702 - RNA, 20 nt, Human
uagcucuccucccaggaggu

SEQ ID NO: 934703 - RNA, 22 nt, Human
uagcuucaguguuucacugagc

SEQ ID NO: 934704 - RNA, 21 nt, Human
uaguagagacgggguuucacc

SEQ ID NO: 934705 - RNA, 24 nt, Human
uaguagagacgggguuucaccgug

SEQ ID NO: 934706 - RNA, 21 nt, Human
uaugcaaacaaaaaaccccaa

SEQ ID NO: 934707 - RNA, 19 nt, Human
uauguugcccagacugguc

SEQ ID NO: 934708 - RNA, 20 nt, Human
uauguugcccagacuggucu

SEQ ID NO: 934709 - RNA, 23 nt, Human
uauguugcccagacuggucuuga

SEQ ID NO: 934710 - RNA, 24 nt, Human
uauguugcccagacuggucuugaa

SEQ ID NO: 934711 - RNA, 19 nt, Human
ucaagugauucuccugccu

SEQ ID NO: 934712 - RNA, 21 nt, Human
ucacccaggcuggaguggcuu

SEQ ID NO: 934713 - RNA, 24 nt, Human
ucaccguguuggccaggcuggucu

SEQ ID NO: 934714 - RNA, 21 nt, Human
ucacgccagaugggaagagga

SEQ ID NO: 934715 - RNA, 23 nt, Human
ucacuccccagccaccucccgag

SEQ ID NO: 934716 - RNA, 24 nt, Human
ucacuccccagccaccucccgagc

SEQ ID NO: 934717 - RNA, 23 nt, Human
ucacugcaaccucugccuccugg

SEQ ID NO: 934718 - RNA, 24 nt, Human
ucacugcaaccucugccuccuggg

SEQ ID NO: 934719 - RNA, 27 nt, Human
ucacugcaaccucugccuccuggguuc

SEQ ID NO: 934720 - RNA, 25 nt, Human
ucacugccacugaaugcauuugugg

SEQ ID NO: 934721 - RNA, 21 nt, Human
uccacacacgguuuccccacc

SEQ ID NO: 934722 - RNA, 18 nt, Human
uccagcccaggcagugcu

SEQ ID NO: 934723 - RNA, 23 nt, Human
ucccaaagugcugggauuacagg

SEQ ID NO: 934724 - RNA, 23 nt, Human
ucccaaagugcugggauuacagg

SEQ ID NO: 934725 - RNA, 19 nt, Human
ucccaggagguucacuggg

SEQ ID NO: 934726 - RNA, 19 nt, Human
ucccauuagcuucaguguu

SEQ ID NO: 934727 - RNA, 19 nt, Human
uccccaaagacccaggguc

SEQ ID NO: 934728 - RNA, 21 nt, Human
uccccagccaccucccgagcc

SEQ ID NO: 934729 - RNA, 23 nt, Human
uccccagccaccucccgagccuc

SEQ ID NO: 934730 - RNA, 21 nt, Human
uccccggccugggcggcggcg

SEQ ID NO: 934731 - RNA, 22 nt, Human
ucccggcgccuuuaaagucgcc

SEQ ID NO: 934732 - RNA, 20 nt, Human
uccuaaauccaaggcucagu

SEQ ID NO: 934733 - RNA, 20 nt, Human
uccuagucuaccuuggccac

SEQ ID NO: 934734 - RNA, 21 nt, Human
uccuggguucaagugauucuc

SEQ ID NO: 934735 - RNA, 24 nt, Human
uccuggguucaagugauucuccug

SEQ ID NO: 934736 - RNA, 24 nt, Human
ucggucugucacccaggcuggagu

SEQ ID NO: 934737 - RNA, 22 nt, Human
ucuagauuauuauuuuuuugag

SEQ ID NO: 934738 - RNA, 19 nt, Human
ucucacuauguugcccaga

SEQ ID NO: 934739 - RNA, 26 nt, Human
ucucacuauguugcccagacuggucu

SEQ ID NO: 934740 - RNA, 23 nt, Human
ucucggucugucacccaggcugg

SEQ ID NO: 934741 - RNA, 24 nt, Human
ucucggucugucacccaggcugga

SEQ ID NO: 934742 - RNA, 27 nt, Human
ucucuggguacccacucuuccuagucu

SEQ ID NO: 934743 - RNA, 19 nt, Human
ucugucacccaggcuggag

SEQ ID NO: 934744 - RNA, 22 nt, Human
ucugucacccaggcuggagugg

SEQ ID NO: 934745 - RNA, 19 nt, Human
ucuguggaaacuccuuacc

SEQ ID NO: 934746 - RNA, 23 nt, Human
ucuuccagcugauggugaagccu

SEQ ID NO: 934747 - RNA, 21 nt, Human
ucuugaacuccugaccucaag

SEQ ID NO: 934748 - RNA, 23 nt, Human
ucuugaacuccuggacucaagca

SEQ ID NO: 934749 - RNA, 23 nt, Human
ugaaagcaccucagggagagucu

SEQ ID NO: 934750 - RNA, 18 nt, Human
ugaaaggaagguaaggaa

SEQ ID NO: 934751 - RNA, 25 nt, Human
ugaacuccuggacucaagcaauccc

SEQ ID NO: 934752 - RNA, 19 nt, Human
ugaaucccuggccuggcag

SEQ ID NO: 934753 - RNA, 18 nt, Human
ugaaugcauuugugggcu

SEQ ID NO: 934754 - RNA, 18 nt, Human
ugacagucuguuaauaac

SEQ ID NO: 934755 - RNA, 19 nt, Human
ugaccucaagugauccacc

SEQ ID NO: 934756 - RNA, 22 nt, Human
ugacuggcucgguuuucaauga

SEQ ID NO: 934757 - RNA, 19 nt, Human
ugagaggcaacagcacaca

SEQ ID NO: 934758 - RNA, 22 nt, Human
ugagcacuucuuauggauccca

SEQ ID NO: 934759 - RNA, 18 nt, Human
ugauggugcugggucacu

SEQ ID NO: 934760 - RNA, 21 nt, Human
ugcacaccguucccacucuau

SEQ ID NO: 934761 - RNA, 22 nt, Human
ugcaccagcaaccuucccacag

SEQ ID NO: 934762 - RNA, 24 nt, Human
ugcagaaaauugaacuaagacaaa

SEQ ID NO: 934763 - RNA, 21 nt, Human
ugccaaugccuccaacgcucc

SEQ ID NO: 934764 - RNA, 24 nt, Human
ugcccagacuggucuugaacuccu

SEQ ID NO: 934765 - RNA, 24 nt, Human
ugccucagcuucccaaagugcugg

SEQ ID NO: 934766 - RNA, 22 nt, Human
ugccuccuggguucaagugauu

SEQ ID NO: 934767 - RNA, 18 nt, Human
ugccugugaacacugcag

SEQ ID NO: 934768 - RNA, 24 nt, Human
ugcugggauuacaggugugagcca

SEQ ID NO: 934769 - RNA, 24 nt, Human
uggaaacuccuuaccgacauccgu

SEQ ID NO: 934770 - RNA, 24 nt, Human
uggagaaagaaaacuggguggcua

SEQ ID NO: 934771 - RNA, 24 nt, Human
uggcaggaauaaacaaagcauguc

SEQ ID NO: 934772 - RNA, 20 nt, Human
uggcauuugaggaugcagaa

SEQ ID NO: 934773 - RNA, 24 nt, Human
uggccaggcuggucuugaacuccu

SEQ ID NO: 934774 - RNA, 18 nt, Human
uggccagggcuagcucuc

SEQ ID NO: 934775 - RNA, 24 nt, Human
uggcuugaucucagcucacugcaa

SEQ ID NO: 934776 - RNA, 18 nt, Human
ugggaagaggaguuaacu

SEQ ID NO: 934777 - RNA, 23 nt, Human
ugggaagaggaguuaacuucuga

SEQ ID NO: 934778 - RNA, 18 nt, Human
ugggacuacaggcaugug

SEQ ID NO: 934779 - RNA, 21 nt, Human
ugggacuacaggcaugugcca

SEQ ID NO: 934780 - RNA, 22 nt, Human
ugggacuacaggcaugugccac

SEQ ID NO: 934781 - RNA, 24 nt, Human
ugggacuacaggcaugugccacca

SEQ ID NO: 934782 - RNA, 18 nt, Human
ugggaucucacuauguug

SEQ ID NO: 934783 - RNA, 23 nt, Human
ugggaucucacuauguugcccag

SEQ ID NO: 934784 - RNA, 18 nt, Human
ugggauuacaggggugag

SEQ ID NO: 934785 - RNA, 19 nt, Human
ugggauuacaggggugagc

SEQ ID NO: 934786 - RNA, 19 nt, Human
ugggauuacaggggugagc

SEQ ID NO: 934787 - RNA, 22 nt, Human
ugggauuacaggggugagcuac

SEQ ID NO: 934788 - RNA, 22 nt, Human
ugggauuacaggggugagcuac

SEQ ID NO: 934789 - RNA, 19 nt, Human
ugggauuacaggugugagc

SEQ ID NO: 934790 - RNA, 21 nt, Human
ugggauuacaggugugagcca

SEQ ID NO: 934791 - RNA, 22 nt, Human
ugggauuacaggugugagccac

SEQ ID NO: 934792 - RNA, 22 nt, Human
ugggauuacaggugugagccac

SEQ ID NO: 934793 - RNA, 24 nt, Human
ugggauuacaggugugagccacug

SEQ ID NO: 934794 - RNA, 19 nt, Human
uggggaauagggcugcuga

SEQ ID NO: 934795 - RNA, 21 nt, Human
ugggguuggcauuugaggaug

SEQ ID NO: 934796 - RNA, 23 nt, Human
uggguucaagugauucuccugcc

SEQ ID NO: 934797 - RNA, 24 nt, Human
uggguucaagugauucuccugccu

SEQ ID NO: 934798 - RNA, 21 nt, Human
uguauuuuuaguagagacggg

SEQ ID NO: 934799 - RNA, 20 nt, Human
ugucacccuaaacaucccag

SEQ ID NO: 934800 - RNA, 23 nt, Human
ugugcagaagacagucccaguuc

SEQ ID NO: 934801 - RNA, 22 nt, Human
uguucugacaacuccaggaggc

SEQ ID NO: 934802 - RNA, 21 nt, Human
uguuggcaccauucaauggag

SEQ ID NO: 934803 - RNA, 18 nt, Human
uuaguagagacgggguuu

SEQ ID NO: 934804 - RNA, 22 nt, Human
uuaguagagacgggguuucacc

SEQ ID NO: 934805 - RNA, 24 nt, Human
uuaguagagacgggguuucaccgu

SEQ ID NO: 934806 - RNA, 25 nt, Human
uucaagugauucuccugccugaguu

SEQ ID NO: 934807 - RNA, 20 nt, Human
uuccagaaaauucacucccc

SEQ ID NO: 934808 - RNA, 19 nt, Human
uuccugguuacaccuguuu

SEQ ID NO: 934809 - RNA, 22 nt, Human
uugccccuguugugcuuacaua

SEQ ID NO: 934810 - RNA, 23 nt, Human
uuguauuuuuaguagagacgggg

SEQ ID NO: 934811 - RNA, 23 nt, Human
uuuaaaauaccaacccaauagca

SEQ ID NO: 934812 - RNA, 24 nt, Human
uuucaccguguuggccaggcuggu

SEQ ID NO: 934813 - RNA, 20 nt, Human
uuucauggcagaccccaugg

SEQ ID NO: 934814 - RNA, 22 nt, Human
uuucauggcagaccccauggcu

SEQ ID NO: 934815 - RNA, 24 nt, Human
uuuccccaccuugccccuguugug

SEQ ID NO: 934816 - RNA, 24 nt, Human
uuuuaagaucugcugucaucuugg

SEQ ID NO: 934817 - RNA, 21 nt, Human
uuuuccugguuacaccuguuu

SEQ ID NO: 934818 - RNA, 21 nt, Human
uuuugagagaugggaucucac

SEQ ID NO: 934819 - RNA, 24 nt, Human
uuuuuaguagagacgggguuucac

SEQ ID NO: 934820 - RNA, 20 nt, Human
uuuuuguauuuuuaguagag

SEQ ID NO: 934821 - RNA, 19 nt, Human
aaaaugaggaaggagugga

SEQ ID NO: 934822 - RNA, 20 nt, Human
acagugcugggggcacugcu

SEQ ID NO: 934823 - RNA, 21 nt, Human
agcaaaaugaggaaggagugg

SEQ ID NO: 934824 - RNA, 20 nt, Human
agcagcgucccaguccuggc

SEQ ID NO: 934825 - RNA, 20 nt, Human
aggcagccacgagccagaga

SEQ ID NO: 934826 - RNA, 18 nt, Human
agggcgggcccugguguc

SEQ ID NO: 934827 - RNA, 18 nt, Human
cacgagccagagaggagc

SEQ ID NO: 934828 - RNA, 21 nt, Human
cagugcugggggcacugcugg

SEQ ID NO: 934829 - RNA, 18 nt, Human
ccagcagcagcgucccag

SEQ ID NO: 934830 - RNA, 18 nt, Human
ccagcagcagcgucccag

SEQ ID NO: 934831 - RNA, 23 nt, Human
ccagcccagccccucaccgaccc

SEQ ID NO: 934832 - RNA, 20 nt, Human
ccgucugcaacacucagaag

SEQ ID NO: 934833 - RNA, 18 nt, Human
ccuggcagggcuggccca

SEQ ID NO: 934834 - RNA, 24 nt, Human
ccugggagacgacaggcucccucu

SEQ ID NO: 934835 - RNA, 25 nt, Human
ccugguguccagcccagccccucac

SEQ ID NO: 934836 - RNA, 21 nt, Human
cuagaaucagcagcaaaauga

SEQ ID NO: 934837 - RNA, 25 nt, Human
cuccugccacaggcuggccugaugg

SEQ ID NO: 934838 - RNA, 27 nt, Human
gaaaaagcucaaccuguuuuguuuggg

SEQ ID NO: 934839 - RNA, 20 nt, Human
gcaacacucagaaggcagcc

SEQ ID NO: 934840 - RNA, 18 nt, Human
gcaagguggggacagugc

SEQ ID NO: 934841 - RNA, 20 nt, Human
ggacccagggcagggagcag

SEQ ID NO: 934842 - RNA, 24 nt, Human
ggaggacacagucugggacccagg

SEQ ID NO: 934843 - RNA, 19 nt, Human
ggcacugcuggcuccacug

SEQ ID NO: 934844 - RNA, 18 nt, Human
gggccaggcgccagcagc

SEQ ID NO: 934845 - RNA, 22 nt, Human
gggcuggcccaggccccccuuc

SEQ ID NO: 934846 - RNA, 20 nt, Human
gguucugggcccuagcaagg

SEQ ID NO: 934847 - RNA, 20 nt, Human
guggggacagugcugggggc

SEQ ID NO: 934848 - RNA, 24 nt, Human
uccagcccagccccucaccgaccc

SEQ ID NO: 934849 - RNA, 24 nt, Human
ucuccugccacaggcuggccugau

SEQ ID NO: 934850 - RNA, 21 nt, Human
ugaggaaggaguggagcucag

SEQ ID NO: 934851 - RNA, 19 nt, Human
ugaggggaggaaaaagcuc

SEQ ID NO: 934852 - RNA, 20 nt, Human
uggaggacacagucugggac

SEQ ID NO: 934853 - RNA, 21 nt, Human
uggcagggcuggcccaggccc

SEQ ID NO: 934854 - RNA, 21 nt, Human
uggcuccacuggcagggcagg

SEQ ID NO: 934855 - RNA, 20 nt, Human
uuuuuuuuuuugaacagaac

SEQ ID NO: 934856 - RNA, 24 nt, Human
aaaaagaaaaaaagaugaggaaaa

SEQ ID NO: 934857 - RNA, 20 nt, Human
aacaugguaaaacccugucu

SEQ ID NO: 934858 - RNA, 21 nt, Human
aacaugguaaaacccugucuc

SEQ ID NO: 934859 - RNA, 24 nt, Human
aagaaccuuuauuuaaccuaccaa

SEQ ID NO: 934860 - RNA, 24 nt, Human
aaucacuugaacccgggaggcaga

SEQ ID NO: 934861 - RNA, 19 nt, Human
acaaaaaguacaugaccuc

SEQ ID NO: 934862 - RNA, 24 nt, Human
acagagagagacucugccucaaaa

SEQ ID NO: 934863 - RNA, 18 nt, Human
acagagcaggagaggaaa

SEQ ID NO: 934864 - RNA, 21 nt, Human
acagccaggcugcccaaagcc

SEQ ID NO: 934865 - RNA, 21 nt, Human
accaaacuaaaagagcaauaa

SEQ ID NO: 934866 - RNA, 24 nt, Human
accaacaugguaaaacccugucuc

SEQ ID NO: 934867 - RNA, 24 nt, Human
acccugucucuacuaaaaauacaa

SEQ ID NO: 934868 - RNA, 24 nt, Human
accugaggucaggaguuugagacc

SEQ ID NO: 934869 - RNA, 20 nt, Human
acugcaguugguggcucaga

SEQ ID NO: 934870 - RNA, 22 nt, Human
acuucagccugggggacagaga

SEQ ID NO: 934871 - RNA, 21 nt, Human
acuuguaggcuuuauuuccuc

SEQ ID NO: 934872 - RNA, 22 nt, Human
agaaucacuugaacccgggagg

SEQ ID NO: 934873 - RNA, 26 nt, Human
agaauccucugcugccaccucugcuc

SEQ ID NO: 934874 - RNA, 18 nt, Human
agagcaauaaaauaaaaa

SEQ ID NO: 934875 - RNA, 18 nt, Human
agagguugcagugagcug

SEQ ID NO: 934876 - RNA, 22 nt, Human
agagguugcagugagcugagau

SEQ ID NO: 934877 - RNA, 23 nt, Human
agagguugcagugagcugagauc

SEQ ID NO: 934878 - RNA, 24 nt, Human
agagguugcagugagcugagauca

SEQ ID NO: 934879 - RNA, 20 nt, Human
agagguugcagugagcuggc

SEQ ID NO: 934880 - RNA, 24 nt, Human
agcacuuugggaggccgaggcagg

SEQ ID NO: 934881 - RNA, 23 nt, Human
agccaggugugguggugggugcc

SEQ ID NO: 934882 - RNA, 24 nt, Human
agccugggggacagagagagacuc

SEQ ID NO: 934883 - RNA, 19 nt, Human
aggaauggaaucaaaauau

SEQ ID NO: 934884 - RNA, 20 nt, Human
aggaguuugagaccagccug

SEQ ID NO: 934885 - RNA, 20 nt, Human
aggcagagguugcagugagc

SEQ ID NO: 934886 - RNA, 24 nt, Human
aggcagagguugcagugagcugag

SEQ ID NO: 934887 - RNA, 18 nt, Human
aggcaggagaaucacuug

SEQ ID NO: 934888 - RNA, 24 nt, Human
aggcaggagaaucacuugaacccg

SEQ ID NO: 934889 - RNA, 18 nt, Human
aggcagguggaucaccug

SEQ ID NO: 934890 - RNA, 22 nt, Human
aggcagguggaucaccugaggu

SEQ ID NO: 934891 - RNA, 26 nt, Human
aggcagguggaucaccugaggucagg

SEQ ID NO: 934892 - RNA, 21 nt, Human
aggccgaggcagguggaucac

SEQ ID NO: 934893 - RNA, 24 nt, Human
aggcugaggcaggagaaucacuug

SEQ ID NO: 934894 - RNA, 18 nt, Human
aggcugugugucgccgug

SEQ ID NO: 934895 - RNA, 22 nt, Human
agguggaucaccugaggucagg

SEQ ID NO: 934896 - RNA, 24 nt, Human
aggugugguggugggugccuguaa

SEQ ID NO: 934897 - RNA, 21 nt, Human
agugaaaaaggaaaacccaaa

SEQ ID NO: 934898 - RNA, 21 nt, Human
agugaaaaaggaaaacccaaa

SEQ ID NO: 934899 - RNA, 24 nt, Human
aguggcucacgccuguaaucccag

SEQ ID NO: 934900 - RNA, 24 nt, Human
auaggccgggcgcaguggcucacg

SEQ ID NO: 934901 - RNA, 20 nt, Human
aucaccugaggucaggaguu

SEQ ID NO: 934902 - RNA, 24 nt, Human
aucaccugaggucaggaguuugag

SEQ ID NO: 934903 - RNA, 24 nt, Human
aucaugccgcugcacuucagccug

SEQ ID NO: 934904 - RNA, 22 nt, Human
auuaauuucacacuuguaggcu

SEQ ID NO: 934905 - RNA, 22 nt, Human
caaaaaaaagaaaaaaagauga

SEQ ID NO: 934906 - RNA, 21 nt, Human
caaaaaacugcagaacucuac

SEQ ID NO: 934907 - RNA, 19 nt, Human
caaagucuucauugcugac

SEQ ID NO: 934908 - RNA, 24 nt, Human
caacaugguaaaacccugucucua

SEQ ID NO: 934909 - RNA, 22 nt, Human
cacagccaggcugcccaaagcc

SEQ ID NO: 934910 - RNA, 23 nt, Human
cacauaaaaauaaaucugacauu

SEQ ID NO: 934911 - RNA, 23 nt, Human
caccugaggucaggaguuugaga

SEQ ID NO: 934912 - RNA, 24 nt, Human
cacgccuguaaucccagcacuuug

SEQ ID NO: 934913 - RNA, 19 nt, Human
cacuagccggaaaaagcuc

SEQ ID NO: 934914 - RNA, 24 nt, Human
cacugaccaauacagagaaaaggg

SEQ ID NO: 934915 - RNA, 26 nt, Human
cacuucagccugggggacagagagag

SEQ ID NO: 934916 - RNA, 24 nt, Human
cagcacuuugggaggccgaggcag

SEQ ID NO: 934917 - RNA, 26 nt, Human
cagcacuuugggaggccgaggcaggu

SEQ ID NO: 934918 - RNA, 23 nt, Human
cagcauacacagggauccacaua

SEQ ID NO: 934919 - RNA, 22 nt, Human
cagccugggggacagagagaga

SEQ ID NO: 934920 - RNA, 24 nt, Human
cagcuacucaggaggcugaggcag

SEQ ID NO: 934921 - RNA, 23 nt, Human
caggaaggguuagaagaauagug

SEQ ID NO: 934922 - RNA, 24 nt, Human
caggaggcugaggcaggagaauca

SEQ ID NO: 934923 - RNA, 18 nt, Human
caggcugcccaaagccaa

SEQ ID NO: 934924 - RNA, 21 nt, Human
caggcugcccaaagccaaagg

SEQ ID NO: 934925 - RNA, 24 nt, Human
cagguggaucaccugaggucagga

SEQ ID NO: 934926 - RNA, 20 nt, Human
cccaaagccaaaggagccac

SEQ ID NO: 934927 - RNA, 19 nt, Human
ccgcugcacuucagccugg

SEQ ID NO: 934928 - RNA, 22 nt, Human
ccgcugcacuucagccuggggg

SEQ ID NO: 934929 - RNA, 24 nt, Human
ccgcugcacuucagccugggggac

SEQ ID NO: 934930 - RNA, 21 nt, Human
ccucugcugccaccucugcuc

SEQ ID NO: 934931 - RNA, 22 nt, Human
ccugaccaacaugguaaaaccc

SEQ ID NO: 934932 - RNA, 24 nt, Human
ccugaccaacaugguaaaacccug

SEQ ID NO: 934933 - RNA, 22 nt, Human
ccugaggucaggaguuugagac

SEQ ID NO: 934934 - RNA, 22 nt, Human
ccuguaaucccagcacuuuggg

SEQ ID NO: 934935 - RNA, 21 nt, Human
ccuguaaucccagcuacucag

SEQ ID NO: 934936 - RNA, 22 nt, Human
ccuguaaucccagcuacucagg

SEQ ID NO: 934937 - RNA, 20 nt, Human
cgaggcagguggaucaccug

SEQ ID NO: 934938 - RNA, 24 nt, Human
cgaggcagguggaucaccugaggu

SEQ ID NO: 934939 - RNA, 26 nt, Human
cgaggcagguggaucaccugagguca

SEQ ID NO: 934940 - RNA, 23 nt, Human
cgccuguaaucccagcacuuugg

SEQ ID NO: 934941 - RNA, 25 nt, Human
cgcugcacuucagccugggggacag

SEQ ID NO: 934942 - RNA, 24 nt, Human
cggaugcauuuaaaauucuggggu

SEQ ID NO: 934943 - RNA, 24 nt, Human
cgggaggcagagguugcagugagc

SEQ ID NO: 934944 - RNA, 20 nt, Human
cuaaaugucuaccauaaauu

SEQ ID NO: 934945 - RNA, 23 nt, Human
cuaauucauucauaaccugagua

SEQ ID NO: 934946 - RNA, 20 nt, Human
cuaguucugguucugucccu

SEQ ID NO: 934947 - RNA, 20 nt, Human
cucaaaaaaaagaaaaaaag

SEQ ID NO: 934948 - RNA, 24 nt, Human
cucaaaaggauauccaacugaugc

SEQ ID NO: 934949 - RNA, 22 nt, Human
cucacgccuguaaucccagcac

SEQ ID NO: 934950 - RNA, 24 nt, Human
cucacgccuguaaucccagcacuu

SEQ ID NO: 934951 - RNA, 24 nt, Human
cucagaauccucugcugccaccuc

SEQ ID NO: 934952 - RNA, 22 nt, Human
cucaggcucuaguucugguucu

SEQ ID NO: 934953 - RNA, 20 nt, Human
cugcacuucagccuggggga

SEQ ID NO: 934954 - RNA, 18 nt, Human
cugcccaaagccaaagga

SEQ ID NO: 934955 - RNA, 22 nt, Human
cugcuccucaaguggaugcucc

SEQ ID NO: 934956 - RNA, 21 nt, Human
gaaaaaggaaaacccaaauau

SEQ ID NO: 934957 - RNA, 24 nt, Human
gaucaccugaggucaggaguuuga

SEQ ID NO: 934958 - RNA, 23 nt, Human
gcaggagaaucacuugaacccgg

SEQ ID NO: 934959 - RNA, 20 nt, Human
gcgcaguggcucacgccugu

SEQ ID NO: 934960 - RNA, 24 nt, Human
gcugcacuucagccugggggacag

SEQ ID NO: 934961 - RNA, 24 nt, Human
ggaaaacccaaauauuugugaaag

SEQ ID NO: 934962 - RNA, 19 nt, Human
ggaaagauucucugugaag

SEQ ID NO: 934963 - RNA, 21 nt, Human
ggaaauaggccgggcgcagug

SEQ ID NO: 934964 - RNA, 22 nt, Human
ggaucaccugaggucaggaguu

SEQ ID NO: 934965 - RNA, 23 nt, Human
ggcgcaguggcucacgccuguaa

SEQ ID NO: 934966 - RNA, 23 nt, Human
ggcucagaauccucugcugccac

SEQ ID NO: 934967 - RNA, 21 nt, Human
gggaaagaauaauucuucaga

SEQ ID NO: 934968 - RNA, 22 nt, Human
ggggacagagagagacucugcc

SEQ ID NO: 934969 - RNA, 19 nt, Human
ggucaggaguuugagacca

SEQ ID NO: 934970 - RNA, 24 nt, Human
gguggugggugccuguaaucccag

SEQ ID NO: 934971 - RNA, 23 nt, Human
guggugggugccuguaaucccag

SEQ ID NO: 934972 - RNA, 24 nt, Human
guugcagugagcugagaucaugcc

SEQ ID NO: 934973 - RNA, 24 nt, Human
uaaaagagcaauaaaauaaaaaua

SEQ ID NO: 934974 - RNA, 21 nt, Human
uaaaauagaauguucugagug

SEQ ID NO: 934975 - RNA, 25 nt, Human
uaaauaauauacuuaaaauagaaug

SEQ ID NO: 934976 - RNA, 19 nt, Human
uaauacugaaaaacugaga

SEQ ID NO: 934977 - RNA, 21 nt, Human
uagcaaggguucacuucaaag

SEQ ID NO: 934978 - RNA, 19 nt, Human
uagugcaacauaaaauaau

SEQ ID NO: 934979 - RNA, 22 nt, Human
uaucacagaagcacuagccgga

SEQ ID NO: 934980 - RNA, 18 nt, Human
ucaggcucuaguucuggu

SEQ ID NO: 934981 - RNA, 23 nt, Human
uccacagccaggcugcccaaagc

SEQ ID NO: 934982 - RNA, 21 nt, Human
uccacauaaaaauaaaucuga

SEQ ID NO: 934983 - RNA, 24 nt, Human
uccacauaaaaauaaaucugacau

SEQ ID NO: 934984 - RNA, 20 nt, Human
uccucugcugccaccucugc

SEQ ID NO: 934985 - RNA, 18 nt, Human
uccugcugcucugggugc

SEQ ID NO: 934986 - RNA, 23 nt, Human
uccugcugcucugggugcccuuu

SEQ ID NO: 934987 - RNA, 22 nt, Human
ucucuacuaaaaauacaaaaaa

SEQ ID NO: 934988 - RNA, 22 nt, Human
ucucuguaauacugaaaaacug

SEQ ID NO: 934989 - RNA, 24 nt, Human
ucugaucaauuuguccauaguucu

SEQ ID NO: 934990 - RNA, 22 nt, Human
ucugccucaaaaaaaagaaaaa

SEQ ID NO: 934991 - RNA, 24 nt, Human
ucugccucaaaaaaaagaaaaaaa

SEQ ID NO: 934992 - RNA, 20 nt, Human
ucuguaguucagcauacaca

SEQ ID NO: 934993 - RNA, 21 nt, Human
ugaaaguguaagacggaugca

SEQ ID NO: 934994 - RNA, 19 nt, Human
ugaagacccaaaauugagg

SEQ ID NO: 934995 - RNA, 26 nt, Human
ugaagacccaaaauugaggacugguu

SEQ ID NO: 934996 - RNA, 24 nt, Human
ugaccaacaugguaaaacccuguc

SEQ ID NO: 934997 - RNA, 23 nt, Human
ugagaccagccugaccaacaugg

SEQ ID NO: 934998 - RNA, 24 nt, Human
ugagaccagccugaccaacauggu

SEQ ID NO: 934999 - RNA, 22 nt, Human
ugaggaacugccaacaauaaau

SEQ ID NO: 935000 - RNA, 20 nt, Human
ugaggcaggagaaucacuug

SEQ ID NO: 935001 - RNA, 24 nt, Human
ugaggcaggagaaucacuugaacc

SEQ ID NO: 935002 - RNA, 25 nt, Human
ugaggcaggagaaucacuugaaccc

SEQ ID NO: 935003 - RNA, 18 nt, Human
ugaggucaggaguuugag

SEQ ID NO: 935004 - RNA, 19 nt, Human
ugagugaaaaaggaaaacc

SEQ ID NO: 935005 - RNA, 18 nt, Human
ugcccaaagccaaaggag

SEQ ID NO: 935006 - RNA, 23 nt, Human
ugccgcugcacuucagccugggg

SEQ ID NO: 935007 - RNA, 24 nt, Human
ugccuguaaucccagcuacucagg

SEQ ID NO: 935008 - RNA, 23 nt, Human
uggaucaccugaggucaggaguu

SEQ ID NO: 935009 - RNA, 24 nt, Human
uggaucaccugaggucaggaguuu

SEQ ID NO: 935010 - RNA, 27 nt, Human
uggaucaccugaggucaggaguuugag

SEQ ID NO: 935011 - RNA, 23 nt, Human
uggcauguuuuacaaucaguggc

SEQ ID NO: 935012 - RNA, 22 nt, Human
uggcucacgccuguaaucccag

SEQ ID NO: 935013 - RNA, 24 nt, Human
uggcucacgccuguaaucccagca

SEQ ID NO: 935014 - RNA, 24 nt, Human
ugggaggccgaggcagguggauca

SEQ ID NO: 935015 - RNA, 26 nt, Human
ugggggacagagagagacucugccuc

SEQ ID NO: 935016 - RNA, 22 nt, Human
uggguugggcucaggcucuagu

SEQ ID NO: 935017 - RNA, 24 nt, Human
uggugggugccuguaaucccagcu

SEQ ID NO: 935018 - RNA, 24 nt, Human
ugguggugggugccuguaauccca

SEQ ID NO: 935019 - RNA, 24 nt, Human
uuaccaagaaccuuuauuuaaccu

SEQ ID NO: 935020 - RNA, 24 nt, Human
uuagccaggugugguggugggugc

SEQ ID NO: 935021 - RNA, 20 nt, Human
uucugguucugucccucauc

SEQ ID NO: 935022 - RNA, 24 nt, Human
uugaggacugguuuuauaacucua

SEQ ID NO: 935023 - RNA, 18 nt, Human
uugcagugagcugagauc

SEQ ID NO: 935024 - RNA, 20 nt, Human
uugcagugagcugagaucau

SEQ ID NO: 935025 - RNA, 21 nt, Human
uugcagugagcugagaucaug

SEQ ID NO: 935026 - RNA, 25 nt, Human
uugggaggccgaggcagguggauca

SEQ ID NO: 935027 - RNA, 22 nt, Human
uugugagugaaaaaggaaaacc

SEQ ID NO: 935028 - RNA, 26 nt, Human
uuuccauaucacagaagcacuagccg

SEQ ID NO: 935029 - RNA, 22 nt, Human
uuugcucucuguaauacugaaa

SEQ ID NO: 935030 - RNA, 22 nt, Human
uuuguaaacuucaaaaaacugc

SEQ ID NO: 935031 - RNA, 19 nt, Human
uuuguccauaguucuggaa

SEQ ID NO: 935032 - RNA, 22 nt, Human
aaaaaaaaaaaaaaaagcaaaa

SEQ ID NO: 935033 - RNA, 26 nt, Human
aaaaaaaaaaaaaaaagcaaaauuaa

SEQ ID NO: 935034 - RNA, 23 nt, Human
aaaaaaaaagaaaccccaaaaaa

SEQ ID NO: 935035 - RNA, 20 nt, Human
aaaaaaaagaaaccccaaaa

SEQ ID NO: 935036 - RNA, 24 nt, Human
aaaaaaaagcaaaauuaaacugaa

SEQ ID NO: 935037 - RNA, 23 nt, Human
aaaaaagcaaaauuaaacugaaa

SEQ ID NO: 935038 - RNA, 30 nt, Human
aaaaagaaaccccaaaaaaacaaaaacaaa

SEQ ID NO: 935039 - RNA, 22 nt, Human
aaacaaaaacaaaaaaaaucaa

SEQ ID NO: 935040 - RNA, 23 nt, Human
aaacaaaaacaaaaaaaaucaaa

SEQ ID NO: 935041 - RNA, 24 nt, Human
aaacaagacauuacuuagugcuga

SEQ ID NO: 935042 - RNA, 20 nt, Human
aaagccuaagguaguaaaaa

SEQ ID NO: 935043 - RNA, 22 nt, Human
aaauagaaaaaaaggugacaag

SEQ ID NO: 935044 - RNA, 23 nt, Human
aaccccaaaaaaacaaaaacaaa

SEQ ID NO: 935045 - RNA, 24 nt, Human
aacuucaaaaacaucuacgaaaaa

SEQ ID NO: 935046 - RNA, 20 nt, Human
aagauuccacaaugcuuucc

SEQ ID NO: 935047 - RNA, 19 nt, Human
aagcaaaauuaaacugaaa

SEQ ID NO: 935048 - RNA, 23 nt, Human
aauaaguuccaagccaggagaaa

SEQ ID NO: 935049 - RNA, 22 nt, Human
aaugauaacagcauggaaaaaa

SEQ ID NO: 935050 - RNA, 21 nt, Human
acaaagcuucgcucacaagaa

SEQ ID NO: 935051 - RNA, 22 nt, Human
acaacucugccuuuacauaugc

SEQ ID NO: 935052 - RNA, 19 nt, Human
accccaaaaaaacaaaaac

SEQ ID NO: 935053 - RNA, 24 nt, Human
accccaaaaaaacaaaaacaaaaa

SEQ ID NO: 935054 - RNA, 28 nt, Human
accccaaaaaaacaaaaacaaaaaaaau

SEQ ID NO: 935055 - RNA, 18 nt, Human
acguaugucaacuaaguu

SEQ ID NO: 935056 - RNA, 23 nt, Human
acuaaguacaucaauuucaaaaa

SEQ ID NO: 935057 - RNA, 22 nt, Human
acuaaguugaaaggaaaaaaaa

SEQ ID NO: 935058 - RNA, 19 nt, Human
agaaaccccaaaaaaacaa

SEQ ID NO: 935059 - RNA, 23 nt, Human
agaaaucacuuuguugucuuaag

SEQ ID NO: 935060 - RNA, 19 nt, Human
agcauggaaaaaaaaaaga

SEQ ID NO: 935061 - RNA, 24 nt, Human
aggaaugauaacagcauuacaacg

SEQ ID NO: 935062 - RNA, 21 nt, Human
auagaaaauauacaugaccau

SEQ ID NO: 935063 - RNA, 23 nt, Human
auauacaugaccauucugucuac

SEQ ID NO: 935064 - RNA, 18 nt, Human
augaaucuugaaacuaag

SEQ ID NO: 935065 - RNA, 25 nt, Human
auuucauuuuauaaccaaggaauga

SEQ ID NO: 935066 - RNA, 27 nt, Human
auuucauuuuauaaccaaggaaugaaa

SEQ ID NO: 935067 - RNA, 26 nt, Human
caaaaaaaaucaaacucuggucccca

SEQ ID NO: 935068 - RNA, 26 nt, Human
caaaaaaacaaaaacaaaaaaaauca

SEQ ID NO: 935069 - RNA, 28 nt, Human
caaaaaaacaaaaacaaaaaaaaucaaa

SEQ ID NO: 935070 - RNA, 23 nt, Human
cacaaacaagacauuacuuagug

SEQ ID NO: 935071 - RNA, 24 nt, Human
cacuaguuuuccuuuuuaaggcac

SEQ ID NO: 935072 - RNA, 21 nt, Human
cagcauggaaaaaaaaaagaa

SEQ ID NO: 935073 - RNA, 21 nt, Human
caugaccauucugucuacaua

SEQ ID NO: 935074 - RNA, 24 nt, Human
caugucaacuucaaaaacaucuac

SEQ ID NO: 935075 - RNA, 24 nt, Human
ccaaaaaaacaaaaacaaaaaaaa

SEQ ID NO: 935076 - RNA, 23 nt, Human
ccaaaucuuaauuacaaacuaag

SEQ ID NO: 935077 - RNA, 23 nt, Human
ccaagccaggagaaacaaaaacu

SEQ ID NO: 935078 - RNA, 23 nt, Human
cccauauaacagugugcccuaaa

SEQ ID NO: 935079 - RNA, 25 nt, Human
cccauauaacagugugcccuaaaca

SEQ ID NO: 935080 - RNA, 18 nt, Human
ccccaaaaaaacaaaaac

SEQ ID NO: 935081 - RNA, 22 nt, Human
ccccaaaaaaacaaaaacaaaa

SEQ ID NO: 935082 - RNA, 25 nt, Human
ccccaaaaaaacaaaaacaaaaaaa

SEQ ID NO: 935083 - RNA, 19 nt, Human
cccuaaacaaccaauuccu

SEQ ID NO: 935084 - RNA, 21 nt, Human
cgaaaaauauucagccacaaa

SEQ ID NO: 935085 - RNA, 24 nt, Human
cuaaagauguaaaaacucaacuaa

SEQ ID NO: 935086 - RNA, 24 nt, Human
cugcuuuauucuuucaauaucaug

SEQ ID NO: 935087 - RNA, 25 nt, Human
gaaaaaaaaaagaaaccccaaaaaa

SEQ ID NO: 935088 - RNA, 21 nt, Human
gaaaaauauucagccacaaac

SEQ ID NO: 935089 - RNA, 19 nt, Human
gaaacaaaaacuuaaccuu

SEQ ID NO: 935090 - RNA, 20 nt, Human
gaaaccccaaaaaaacaaaa

SEQ ID NO: 935091 - RNA, 21 nt, Human
gauacgucccacaagagugug

SEQ ID NO: 935092 - RNA, 21 nt, Human
gcacaugcucagaaauccaca

SEQ ID NO: 935093 - RNA, 24 nt, Human
ggaaaaaaaaaagaaaccccaaaa

SEQ ID NO: 935094 - RNA, 22 nt, Human
uaacagugugcccuaaacaacc

SEQ ID NO: 935095 - RNA, 20 nt, Human
uaaccaaggaaugauaacag

SEQ ID NO: 935096 - RNA, 22 nt, Human
uaacuaaugccuacauucauaa

SEQ ID NO: 935097 - RNA, 19 nt, Human
uaacugaaucuagaccaga

SEQ ID NO: 935098 - RNA, 24 nt, Human
uaagguaguaaaaacuaaaaaugc

SEQ ID NO: 935099 - RNA, 19 nt, Human
uacacaccccugccuaaac

SEQ ID NO: 935100 - RNA, 27 nt, Human
uacauagauaacagaaucuaugaaucu

SEQ ID NO: 935101 - RNA, 20 nt, Human
uagaaaaaaaggugacaagc

SEQ ID NO: 935102 - RNA, 21 nt, Human
uagaacagaugaaauauagca

SEQ ID NO: 935103 - RNA, 19 nt, Human
ucaaaauaaguuccaagcc

SEQ ID NO: 935104 - RNA, 20 nt, Human
ucaaaauaaguuccaagcca

SEQ ID NO: 935105 - RNA, 18 nt, Human
uccaagccaggagaaaca

SEQ ID NO: 935106 - RNA, 24 nt, Human
ucugucuacauagauaacagaauc

SEQ ID NO: 935107 - RNA, 21 nt, Human
ugaccuguagauucugagcca

SEQ ID NO: 935108 - RNA, 19 nt, Human
ugcucagaaauccacaacc

SEQ ID NO: 935109 - RNA, 27 nt, Human
ugcuuuauucuuucaauaucauguauc

SEQ ID NO: 935110 - RNA, 22 nt, Human
uggaaaaaaaaaagaaacccca

SEQ ID NO: 935111 - RNA, 24 nt, Human
uggaaaaaaaaaagaaaccccaaa

SEQ ID NO: 935112 - RNA, 21 nt, Human
uguacgaaaagguuaagauuc

SEQ ID NO: 935113 - RNA, 23 nt, Human
uucaaaaacaucuacgaaaaaua

SEQ ID NO: 935114 - RNA, 25 nt, Human
uuccaagccaggagaaacaaaaacu

SEQ ID NO: 935115 - RNA, 18 nt, Human
uuccuuuuuaaggcacgu

SEQ ID NO: 935116 - RNA, 23 nt, Human
uugaaaggaaaaaaaaaaaaaaa

SEQ ID NO: 935117 - RNA, 20 nt, Human
uuuuacacaccccugccuaa

SEQ ID NO: 935118 - RNA, 20 nt, Human
uuuuuuuuuuuuuuuuuguu

SEQ ID NO: 935119 - RNA, 20 nt, Human
uuuuuuuuuuuuuuuuuugg

SEQ ID NO: 935120 - RNA, 22 nt, Human
aaaaaaacagucuucgaaaaca

SEQ ID NO: 935121 - RNA, 19 nt, Human
aaacuuagcaggacaggca

SEQ ID NO: 935122 - RNA, 23 nt, Human
acaggcaagaaagcaacacuaug

SEQ ID NO: 935123 - RNA, 23 nt, Human
agaaaaacacacaaaaaccugga

SEQ ID NO: 935124 - RNA, 22 nt, Human
aggcaagaaagcaacacuauga

SEQ ID NO: 935125 - RNA, 24 nt, Human
auaaagaaaaacacacaaaaaccu

SEQ ID NO: 935126 - RNA, 23 nt, Human
caaaauaaugagguggcaggagc

SEQ ID NO: 935127 - RNA, 21 nt, Human
cacuuuuguuuccuuuaaagg

SEQ ID NO: 935128 - RNA, 21 nt, Human
caguaaaaacaauaugguauu

SEQ ID NO: 935129 - RNA, 24 nt, Human
caucauauucaaauaaaaaugcca

SEQ ID NO: 935130 - RNA, 22 nt, Human
cauuuccuuccuauauuauuuc

SEQ ID NO: 935131 - RNA, 18 nt, Human
ccauacuacucacuauuu

SEQ ID NO: 935132 - RNA, 20 nt, Human
cucccaaacuauaaagugaa

SEQ ID NO: 935133 - RNA, 19 nt, Human
gcaaguaaaaacuuagcag

SEQ ID NO: 935134 - RNA, 19 nt, Human
uaaaaaugccauaguguau

SEQ ID NO: 935135 - RNA, 19 nt, Human
uaaacugagagagaaacug

SEQ ID NO: 935136 - RNA, 27 nt, Human
uaaaucauuaaacugagagagaaacug

SEQ ID NO: 935137 - RNA, 20 nt, Human
uaagguacacaucuuaucuu

SEQ ID NO: 935138 - RNA, 19 nt, Human
uagcaggacaggcaagaaa

SEQ ID NO: 935139 - RNA, 21 nt, Human
uauaauuuacagaaagcaagu

SEQ ID NO: 935140 - RNA, 23 nt, Human
uaucuuguauccauggacgcucc

SEQ ID NO: 935141 - RNA, 19 nt, Human
uaugacaguaaaaacaaua

SEQ ID NO: 935142 - RNA, 21 nt, Human
ucauguaauuaccaaagcucu

SEQ ID NO: 935143 - RNA, 19 nt, Human
ugacaguaaaaacaauaug

SEQ ID NO: 935144 - RNA, 19 nt, Human
ugacaguaaaaacaauaug

SEQ ID NO: 935145 - RNA, 22 nt, Human
ugacaguaaaaacaauauggua

SEQ ID NO: 935146 - RNA, 18 nt, Human
ugaugaaaaaaacagucu

SEQ ID NO: 935147 - RNA, 19 nt, Human
uggaaagagaauauaaaag

SEQ ID NO: 935148 - RNA, 21 nt, Human
uuagaaccucaguauucuuaa

SEQ ID NO: 935149 - RNA, 23 nt, Human
uuggcucacagaacuaaagaaag

SEQ ID NO: 935150 - RNA, 18 nt, Human
acgugaaaagcaaagcug

SEQ ID NO: 935151 - RNA, 20 nt, Human
agaacgcaggcccguccccu

SEQ ID NO: 935152 - RNA, 23 nt, Human
aggagcaagccacauuguccuca

SEQ ID NO: 935153 - RNA, 19 nt, Human
caaaaaggagcaagccaca

SEQ ID NO: 935154 - RNA, 28 nt, Human
caaaaaggagcaagccacauuguccuca

SEQ ID NO: 935155 - RNA, 26 nt, Human
caaauguuuuauugaguguagacauc

SEQ ID NO: 935156 - RNA, 19 nt, Human
cagcggcagcgagagaaag

SEQ ID NO: 935157 - RNA, 24 nt, Human
ccacauuguccucacugucaaaug

SEQ ID NO: 935158 - RNA, 27 nt, Human
ccagcggcagcgagagaaagguccuuu

SEQ ID NO: 935159 - RNA, 22 nt, Human
ccugccggcagcuggaggcggg

SEQ ID NO: 935160 - RNA, 22 nt, Human
ccuuuuggaaguuguauguuuu

SEQ ID NO: 935161 - RNA, 21 nt, Human
cggcagcgagagaaagguccu

SEQ ID NO: 935162 - RNA, 18 nt, Human
cggcagcuggaggcgggg

SEQ ID NO: 935163 - RNA, 20 nt, Human
cugaaaagcuucuacaauuu

SEQ ID NO: 935164 - RNA, 20 nt, Human
cuguucacauuuagugaacc

SEQ ID NO: 935165 - RNA, 18 nt, Human
gaacgcaggcccgucccc

SEQ ID NO: 935166 - RNA, 20 nt, Human
gaacgcaggcccguccccuc

SEQ ID NO: 935167 - RNA, 23 nt, Human
gaggaaggaggagagaacgcaga

SEQ ID NO: 935168 - RNA, 23 nt, Human
gcauuucaugggggggggggggu

SEQ ID NO: 935169 - RNA, 18 nt, Human
gccggcagcuggaggcgg

SEQ ID NO: 935170 - RNA, 19 nt, Human
ggaggaaggaggagagaac

SEQ ID NO: 935171 - RNA, 23 nt, Human
uaaaaaucagaugccuuuuggaa

SEQ ID NO: 935172 - RNA, 18 nt, Human
uacuguaaaacaugcauu

SEQ ID NO: 935173 - RNA, 22 nt, Human
ucaaagauucccaucuccccaa

SEQ ID NO: 935174 - RNA, 19 nt, Human
ugaaguaucaugagaguaa

SEQ ID NO: 935175 - RNA, 23 nt, Human
ugucgcauugguuuucagaaauu

SEQ ID NO: 935176 - RNA, 18 nt, Human
ugugucaggcuuggcaua

SEQ ID NO: 935177 - RNA, 19 nt, Human
uucacauuuagugaaccug

SEQ ID NO: 935178 - RNA, 18 nt, Human
uuuuuuuuuuuuuuuuug

SEQ ID NO: 935179 - RNA, 24 nt, Human
uuuuuuuuuuuuuuuuuugguuuu

SEQ ID NO: 935180 - RNA, 23 nt, Human
aaacauggacagcaucuccccca

SEQ ID NO: 935181 - RNA, 22 nt, Human
aacgagaaagcaaaugaauacc

SEQ ID NO: 935182 - RNA, 24 nt, Human
agauuuaggagaagccagaagucu

SEQ ID NO: 935183 - RNA, 20 nt, Human
agcagguuuagcagccaaag

SEQ ID NO: 935184 - RNA, 19 nt, Human
aggcaggagggguaagccu

SEQ ID NO: 935185 - RNA, 21 nt, Human
aggcaggagggguaagccuag

SEQ ID NO: 935186 - RNA, 23 nt, Human
aggcaggagggguaagccuaggg

SEQ ID NO: 935187 - RNA, 18 nt, Human
aggcaggggaagggaggc

SEQ ID NO: 935188 - RNA, 18 nt, Human
aggcaggggaagggaggc

SEQ ID NO: 935189 - RNA, 25 nt, Human
aggcaggggaagggaggcaggaggg

SEQ ID NO: 935190 - RNA, 20 nt, Human
aggggaagggaggcaggagg

SEQ ID NO: 935191 - RNA, 26 nt, Human
cacccgaggcccucgcauuuccguuc

SEQ ID NO: 935192 - RNA, 19 nt, Human
cagcagcaggcaggggaag

SEQ ID NO: 935193 - RNA, 24 nt, Human
cagcagguuuagcagccaaagccc

SEQ ID NO: 935194 - RNA, 25 nt, Human
caggccuaguggauagacagggucc

SEQ ID NO: 935195 - RNA, 19 nt, Human
ccagaagucuuccuuucaa

SEQ ID NO: 935196 - RNA, 21 nt, Human
ccccuagaaacauggacagca

SEQ ID NO: 935197 - RNA, 18 nt, Human
gaagggaggcaggagggg

SEQ ID NO: 935198 - RNA, 18 nt, Human
ggaagggaggcaggaggg

SEQ ID NO: 935199 - RNA, 20 nt, Human
ggaaguccaggauggcagcu

SEQ ID NO: 935200 - RNA, 18 nt, Human
ggacagcaucucccccag

SEQ ID NO: 935201 - RNA, 18 nt, Human
ggaggcaggagggguaag

SEQ ID NO: 935202 - RNA, 27 nt, Human
ggaggcaggagggguaagccuagggug

SEQ ID NO: 935203 - RNA, 19 nt, Human
gggaaaagaaccugaaagc

SEQ ID NO: 935204 - RNA, 22 nt, Human
gggaagggaggcaggaggggua

SEQ ID NO: 935205 - RNA, 22 nt, Human
uaagccuaggguguucccuagg

SEQ ID NO: 935206 - RNA, 20 nt, Human
ucaaagggaaaauggggaaa

SEQ ID NO: 935207 - RNA, 22 nt, Human
ucagggaaguccaggauggcag

SEQ ID NO: 935208 - RNA, 24 nt, Human
uccccuuacccagagaacggagau

SEQ ID NO: 935209 - RNA, 21 nt, Human
ugaauaccccuagaaacaugg

SEQ ID NO: 935210 - RNA, 22 nt, Human
uggcagcugaaggcagcagguu

SEQ ID NO: 935211 - RNA, 21 nt, Human
uucaaagggaaaauggggaaa

SEQ ID NO: 935212 - RNA, 22 nt, Human
uucaaagggaaaauggggaaaa

SEQ ID NO: 935213 - RNA, 21 nt, Human
uuccguuccucaugacagagg

SEQ ID NO: 935214 - RNA, 24 nt, Human
uuccguuccucaugacagaggcuu

SEQ ID NO: 935215 - RNA, 22 nt, Human
uuuuuuuuuuuuuuuuuuucag

SEQ ID NO: 935216 - RNA, 26 nt, Human
aaaaaauagacacaacaaauggaaga

SEQ ID NO: 935217 - RNA, 27 nt, Human
accaaauauauaaaaaauagacacaau

SEQ ID NO: 935218 - RNA, 19 nt, Human
acugcacuccagccugcag

SEQ ID NO: 935219 - RNA, 18 nt, Human
acugcagcugaaaagaca

SEQ ID NO: 935220 - RNA, 18 nt, Human
acugcagcugaaaagaca

SEQ ID NO: 935221 - RNA, 19 nt, Human
agacagaagucuggggcca

SEQ ID NO: 935222 - RNA, 21 nt, Human
agacagaagucuggggccagc

SEQ ID NO: 935223 - RNA, 19 nt, Human
agacagaagucuggggcgc

SEQ ID NO: 935224 - RNA, 22 nt, Human
agacagaagucuggggcgcagu

SEQ ID NO: 935225 - RNA, 19 nt, Human
agccugcagccccgagccu

SEQ ID NO: 935226 - RNA, 19 nt, Human
agcgcugucccacugcacu

SEQ ID NO: 935227 - RNA, 18 nt, Human
caacaaauggaagaguau

SEQ ID NO: 935228 - RNA, 18 nt, Human
cacugcacuccagccugc

SEQ ID NO: 935229 - RNA, 19 nt, Human
cacugcacuccagccugca

SEQ ID NO: 935230 - RNA, 21 nt, Human
cacugcacuccagccugcagc

SEQ ID NO: 935231 - RNA, 25 nt, Human
cacugcacuccagccugcagccccg

SEQ ID NO: 935232 - RNA, 18 nt, Human
cagccccgagccuucacu

SEQ ID NO: 935233 - RNA, 18 nt, Human
cagccccgagccuucacu

SEQ ID NO: 935234 - RNA, 18 nt, Human
ccacugcacuccagccug

SEQ ID NO: 935235 - RNA, 18 nt, Human
ccacugcacuccagccug

SEQ ID NO: 935236 - RNA, 18 nt, Human
ccacugcacuccagccug

SEQ ID NO: 935237 - RNA, 19 nt, Human
ccacugcacuccagccugc

SEQ ID NO: 935238 - RNA, 22 nt, Human
ccacugcacuccagccugcagc

SEQ ID NO: 935239 - RNA, 24 nt, Human
cccacugcacuccagccugcagcc

SEQ ID NO: 935240 - RNA, 20 nt, Human
ccuucacugcagcugaaaag

SEQ ID NO: 935241 - RNA, 20 nt, Human
ccuucacugcagcugaaaag

SEQ ID NO: 935242 - RNA, 23 nt, Human
cugaaaagacagaagucuggggc

SEQ ID NO: 935243 - RNA, 21 nt, Human
gaaaagacagaagucuggggc

SEQ ID NO: 935244 - RNA, 21 nt, Human
gaauacugaauacauucaguu

SEQ ID NO: 935245 - RNA, 24 nt, Human
gcugucccacugcacuccagccug

SEQ ID NO: 935246 - RNA, 21 nt, Human
uaacacaaaugacaaauagau

SEQ ID NO: 935247 - RNA, 25 nt, Human
uaagacuuccuuuaugugacaaguu

SEQ ID NO: 935248 - RNA, 23 nt, Human
uaauguucauauuagaggugaca

SEQ ID NO: 935249 - RNA, 25 nt, Human
uaauuucaaauauaacacaaaugac

SEQ ID NO: 935250 - RNA, 22 nt, Human
uacaaaaaaaauaugcucugcc

SEQ ID NO: 935251 - RNA, 22 nt, Human
uagaaaaaaacuaccucaaacu

SEQ ID NO: 935252 - RNA, 18 nt, Human
uagaaaacaguuaaaauu

SEQ ID NO: 935253 - RNA, 20 nt, Human
uauuuggaauuuucaaaaaa

SEQ ID NO: 935254 - RNA, 22 nt, Human
ucccacugcacuccagccugca

SEQ ID NO: 935255 - RNA, 19 nt, Human
ucuccgcaccagcgcuguc

SEQ ID NO: 935256 - RNA, 21 nt, Human
ucugcagccccgagccuucac

SEQ ID NO: 935257 - RNA, 22 nt, Human
ugaauacugaauacauucaguu

SEQ ID NO: 935258 - RNA, 24 nt, Human
ugacaauuagaaaacaguuaaaau

SEQ ID NO: 935259 - RNA, 19 nt, Human
ugcagccccgagccuucac

SEQ ID NO: 935260 - RNA, 21 nt, Human
uggaaaaagcauaauuucuaa

SEQ ID NO: 935261 - RNA, 18 nt, Human
uggaauuuucaaaaaauc

SEQ ID NO: 935262 - RNA, 23 nt, Human
ugucccacugcacuccagccugc

SEQ ID NO: 935263 - RNA, 20 nt, Human
uucacugcagcugaaaagac

SEQ ID NO: 935264 - RNA, 20 nt, Human
uucacugcagcugaaaagac

SEQ ID NO: 935265 - RNA, 22 nt, Human
uugaauacugaauacauucagu

SEQ ID NO: 935266 - RNA, 22 nt, Human
uuggaauuuucaaaaaauacca

SEQ ID NO: 935267 - RNA, 24 nt, Human
aaagugcugggauuauaggcauga

SEQ ID NO: 935268 - RNA, 23 nt, Human
aacacugauuuuucuuuuucucu

SEQ ID NO: 935269 - RNA, 23 nt, Human
aacuccuaggcucaggcaauccu

SEQ ID NO: 935270 - RNA, 23 nt, Human
aagggcuccccaccugccaccuu

SEQ ID NO: 935271 - RNA, 19 nt, Human
aagugcugggauuauaggc

SEQ ID NO: 935272 - RNA, 21 nt, Human
aagugcugggauuauaggcau

SEQ ID NO: 935273 - RNA, 22 nt, Human
acaagacauagcuaacauccaa

SEQ ID NO: 935274 - RNA, 18 nt, Human
acucugauuacuagaaug

SEQ ID NO: 935275 - RNA, 18 nt, Human
agacagggucuugcuaug

SEQ ID NO: 935276 - RNA, 19 nt, Human
agacagggucuugcuaugu

SEQ ID NO: 935277 - RNA, 23 nt, Human
agacagggucuugcuauguugcc

SEQ ID NO: 935278 - RNA, 24 nt, Human
agcuggucucaaacuccugggcuc

SEQ ID NO: 935279 - RNA, 23 nt, Human
aggcaauccucccacucggccuc

SEQ ID NO: 935280 - RNA, 20 nt, Human
agugugcuuccugccucagc

SEQ ID NO: 935281 - RNA, 30 nt, Human
aucucaauuagauauuuuuguucccaaucu

SEQ ID NO: 935282 - RNA, 24 nt, Human
auggggucucaccauggugcccag

SEQ ID NO: 935283 - RNA, 30 nt, Human
auucaauaacuaucaacauuucuaaacacc

SEQ ID NO: 935284 - RNA, 24 nt, Human
caaacuccugggcuccagugugcu

SEQ ID NO: 935285 - RNA, 24 nt, Human
caaagugcugggauuauaggcaug

SEQ ID NO: 935286 - RNA, 23 nt, Human
cacaggcuucagccaccaugccc

SEQ ID NO: 935287 - RNA, 21 nt, Human
caccagaaggguaaagggcuc

SEQ ID NO: 935288 - RNA, 22 nt, Human
caccagaaggguaaagggcucc

SEQ ID NO: 935289 - RNA, 30 nt, Human
caccauggugcccaggcugguuuaaacucc

SEQ ID NO: 935290 - RNA, 24 nt, Human
cacugauuuuucuuuuucucuuuu

SEQ ID NO: 935291 - RNA, 24 nt, Human
cagggucuugcuauguugcccaag

SEQ ID NO: 935292 - RNA, 21 nt, Human
caguauuaauuaauaagucaa

SEQ ID NO: 935293 - RNA, 24 nt, Human
cagugaaauaaaaauugcuucuaa

SEQ ID NO: 935294 - RNA, 23 nt, Human
cauggugcccaggcugguuuaaa

SEQ ID NO: 935295 - RNA, 24 nt, Human
cauuagagaguugaucuuuggcua

SEQ ID NO: 935296 - RNA, 24 nt, Human
ccaaagugcugggauuauaggcau

SEQ ID NO: 935297 - RNA, 25 nt, Human
ccaaccccgccuccucaggauacgc

SEQ ID NO: 935298 - RNA, 19 nt, Human
ccauuagcaccauuagaga

SEQ ID NO: 935299 - RNA, 24 nt, Human
ccugccucagccucccaaagugcu

SEQ ID NO: 935300 - RNA, 23 nt, Human
ccugggcuccagugugcuucccc

SEQ ID NO: 935301 - RNA, 18 nt, Human
cgguagcaaaacacccag

SEQ ID NO: 935302 - RNA, 26 nt, Human
cuaauacucagaaacaucuacuuagc

SEQ ID NO: 935303 - RNA, 23 nt, Human
cuagagcuccgcccacguuaguc

SEQ ID NO: 935304 - RNA, 22 nt, Human
cucacaagacauagcuaacauc

SEQ ID NO: 935305 - RNA, 23 nt, Human
cucaggcaauccucccacucggc

SEQ ID NO: 935306 - RNA, 19 nt, Human
cuccccaccugccaccuug

SEQ ID NO: 935307 - RNA, 19 nt, Human
cugauuuuucuuuuucucu

SEQ ID NO: 935308 - RNA, 24 nt, Human
cugccucagccucccaaagugcug

SEQ ID NO: 935309 - RNA, 24 nt, Human
cugcuaauguuugugaaaggcaaa

SEQ ID NO: 935310 - RNA, 26 nt, Human
cuuccugccucagccucccaaagugc

SEQ ID NO: 935311 - RNA, 21 nt, Human
gauuauaggcaugagccauug

SEQ ID NO: 935312 - RNA, 24 nt, Human
gauuauaggcaugagccauugugc

SEQ ID NO: 935313 - RNA, 18 nt, Human
gauuccugauauuuauau

SEQ ID NO: 935314 - RNA, 22 nt, Human
gcaauccucccacucggccucc

SEQ ID NO: 935315 - RNA, 21 nt, Human
gcuucagccaccaugcccgga

SEQ ID NO: 935316 - RNA, 23 nt, Human
ggaucuucgccuaggccaacccc

SEQ ID NO: 935317 - RNA, 22 nt, Human
ggcaaucgaaacaagggaggaa

SEQ ID NO: 935318 - RNA, 22 nt, Human
ggggucucaccauggugcccag

SEQ ID NO: 935319 - RNA, 22 nt, Human
gggucucaccauggugcccagg

SEQ ID NO: 935320 - RNA, 19 nt, Human
ggucacgguagcaaaacac

SEQ ID NO: 935321 - RNA, 24 nt, Human
gucacguucagcaacagcuucacu

SEQ ID NO: 935322 - RNA, 25 nt, Human
gucucaaacuccugggcuccagugu

SEQ ID NO: 935323 - RNA, 22 nt, Human
gugcuuccugccucagccuccc

SEQ ID NO: 935324 - RNA, 18 nt, Human
guucagcaacagcuucac

SEQ ID NO: 935325 - RNA, 26 nt, Human
uaaacggucacgguagcaaaacaccc

SEQ ID NO: 935326 - RNA, 23 nt, Human
uaagaaacauuuuaaauaauaga

SEQ ID NO: 935327 - RNA, 24 nt, Human
uaauagagauggggucucaccaug

SEQ ID NO: 935328 - RNA, 26 nt, Human
uaauagagauggggucucaccauggu

SEQ ID NO: 935329 - RNA, 20 nt, Human
uagagauggggucucaccau

SEQ ID NO: 935330 - RNA, 21 nt, Human
uagcaccauuagagaguugau

SEQ ID NO: 935331 - RNA, 22 nt, Human
uaggccaaccccgccuccucag

SEQ ID NO: 935332 - RNA, 21 nt, Human
uagugcuuaaaauuggaauuu

SEQ ID NO: 935333 - RNA, 23 nt, Human
uauguugcccaagcuggucucaa

SEQ ID NO: 935334 - RNA, 24 nt, Human
uauguugcccaagcuggucucaaa

SEQ ID NO: 935335 - RNA, 22 nt, Human
uauuucagcaacgauagugguc

SEQ ID NO: 935336 - RNA, 25 nt, Human
ucacaagaguccacagcgcaccaag

SEQ ID NO: 935337 - RNA, 20 nt, Human
ucacaggcuucagccaccau

SEQ ID NO: 935338 - RNA, 20 nt, Human
ucagaaacaucuacuuagca

SEQ ID NO: 935339 - RNA, 24 nt, Human
ucccaaagugcugggauuauaggc

SEQ ID NO: 935340 - RNA, 18 nt, Human
uccuaggcucaggcaauc

SEQ ID NO: 935341 - RNA, 24 nt, Human
uccuaggcucaggcaauccuccca

SEQ ID NO: 935342 - RNA, 23 nt, Human
uccucccacucggccucccaaca

SEQ ID NO: 935343 - RNA, 21 nt, Human
uccugcagguaauaacacuga

SEQ ID NO: 935344 - RNA, 23 nt, Human
ucuaauacucagaaacaucuacu

SEQ ID NO: 935345 - RNA, 21 nt, Human
ucucaaacuccugggcuccag

SEQ ID NO: 935346 - RNA, 25 nt, Human
ucucuuucagacagaucuaugaaau

SEQ ID NO: 935347 - RNA, 18 nt, Human
ucuugcuauguugcccaa

SEQ ID NO: 935348 - RNA, 23 nt, Human
ucuugcuauguugcccaagcugg

SEQ ID NO: 935349 - RNA, 24 nt, Human
ucuugcuauguugcccaagcuggu

SEQ ID NO: 935350 - RNA, 23 nt, Human
ugcccaggcugguuuaaacuccu

SEQ ID NO: 935351 - RNA, 24 nt, Human
ugccucagccucccaaagugcugg

SEQ ID NO: 935352 - RNA, 24 nt, Human
ugcuauguugcccaagcuggucuc

SEQ ID NO: 935353 - RNA, 27 nt, Human
ugcuauguugcccaagcuggucucaaa

SEQ ID NO: 935354 - RNA, 21 nt, Human
ugggaucacaggcuucagcca

SEQ ID NO: 935355 - RNA, 22 nt, Human
ugggaucacaggcuucagccac

SEQ ID NO: 935356 - RNA, 24 nt, Human
ugggaucacaggcuucagccacca

SEQ ID NO: 935357 - RNA, 18 nt, Human
ugggauuauaggcaugag

SEQ ID NO: 935358 - RNA, 19 nt, Human
ugggauuauaggcaugagc

SEQ ID NO: 935359 - RNA, 21 nt, Human
ugggauuauaggcaugagcca

SEQ ID NO: 935360 - RNA, 21 nt, Human
ugggauuauaggcaugagcca

SEQ ID NO: 935361 - RNA, 21 nt, Human
ugggauuauaggcaugagcca

SEQ ID NO: 935362 - RNA, 22 nt, Human
ugggauuauaggcaugagccau

SEQ ID NO: 935363 - RNA, 23 nt, Human
ugggauuauaggcaugagccauu

SEQ ID NO: 935364 - RNA, 24 nt, Human
ugggauuauaggcaugagccauug

SEQ ID NO: 935365 - RNA, 24 nt, Human
uggggucucaccauggugcccagg

SEQ ID NO: 935366 - RNA, 20 nt, Human
uguuauacaaauauaagaua

SEQ ID NO: 935367 - RNA, 24 nt, Human
uuaacuucaccagaaggguaaagg

SEQ ID NO: 935368 - RNA, 22 nt, Human
uuaguacugaagacuuccuaaa

SEQ ID NO: 935369 - RNA, 24 nt, Human
uucaaauguuuuuuaauauccugc

SEQ ID NO: 935370 - RNA, 20 nt, Human
uucuuuaggugugagguugg

SEQ ID NO: 935371 - RNA, 27 nt, Human
uucuuuaggugugagguuggacaaaua

SEQ ID NO: 935372 - RNA, 21 nt, Human
uuuuguucccaaucucuuuca

SEQ ID NO: 935373 - RNA, 19 nt, Human
aaaaaagaaaggaaaauca

SEQ ID NO: 935374 - RNA, 23 nt, Human
aaugaugaaagcuaucagaagaa

SEQ ID NO: 935375 - RNA, 18 nt, Human
ccacagaugcuguggcag

SEQ ID NO: 935376 - RNA, 18 nt, Human
cccauagaucgcccagac

SEQ ID NO: 935377 - RNA, 22 nt, Human
ccuaggcggcgcgcagcagccc

SEQ ID NO: 935378 - RNA, 20 nt, Human
cgcccagacaccuaggcggc

SEQ ID NO: 935379 - RNA, 21 nt, Human
cuuagaaaaaaagaaaggaaa

SEQ ID NO: 935380 - RNA, 22 nt, Human
cuuagaaaaaaagaaaggaaaa

SEQ ID NO: 935381 - RNA, 22 nt, Human
ugagcauagccacagaugcugu

SEQ ID NO: 935382 - RNA, 18 nt, Human
acugaaguccaccgcacu

SEQ ID NO: 935383 - RNA, 20 nt, Human
caccgcacugucuccucaaa

SEQ ID NO: 935384 - RNA, 19 nt, Human
cccagcgcugcuucgggau

SEQ ID NO: 935385 - RNA, 24 nt, Human
cgcacugucuccucaaaguugcgg

SEQ ID NO: 935386 - RNA, 22 nt, Human
ugaaguccaccgcacugucucc

SEQ ID NO: 935387 - RNA, 22 nt, Human
ugcccgcacuuacgcucccagc

SEQ ID NO: 935388 - RNA, 26 nt, Human
ugucuccucaaaguugcguucccaaa

SEQ ID NO: 935389 - RNA, 22 nt, Human
aaauaaugacccccaagugccc

SEQ ID NO: 935390 - RNA, 23 nt, Human
aacacaccgcgcugccaccggug

SEQ ID NO: 935391 - RNA, 22 nt, Human
aagacagaaaaguggccugaac

SEQ ID NO: 935392 - RNA, 24 nt, Human
aagagaccccacguuggcaaaggc

SEQ ID NO: 935393 - RNA, 19 nt, Human
aaggaagauguuuacgcug

SEQ ID NO: 935394 - RNA, 24 nt, Human
acaaacccgauguaaaaggcacca

SEQ ID NO: 935395 - RNA, 19 nt, Human
acgcggccaggucuguggg

SEQ ID NO: 935396 - RNA, 19 nt, Human
agacagaaaaguggccuga

SEQ ID NO: 935397 - RNA, 21 nt, Human
agccacaguaggcuaauagcc

SEQ ID NO: 935398 - RNA, 19 nt, Human
agugcugaaguuagaagag

SEQ ID NO: 935399 - RNA, 25 nt, Human
caaaggccccccaggcgaugaucuu

SEQ ID NO: 935400 - RNA, 19 nt, Human
caacacaccauggaaggag

SEQ ID NO: 935401 - RNA, 24 nt, Human
caagugcccucgccucuuccugcu

SEQ ID NO: 935402 - RNA, 26 nt, Human
caccagcaccucacaugggacucagu

SEQ ID NO: 935403 - RNA, 18 nt, Human
caccgcgcugccaccggu

SEQ ID NO: 935404 - RNA, 20 nt, Human
ccaguccauuaaccaugggg

SEQ ID NO: 935405 - RNA, 20 nt, Human
ccccacguuggcaaaggccc

SEQ ID NO: 935406 - RNA, 27 nt, Human
cccccaagugcccucgccucuuccugc

SEQ ID NO: 935407 - RNA, 23 nt, Human
ccgcgguggcggcggccccagcc

SEQ ID NO: 935408 - RNA, 21 nt, Human
ccucucaguucuaggcacucu

SEQ ID NO: 935409 - RNA, 22 nt, Human
cggggaguuccaaaugaguucc

SEQ ID NO: 935410 - RNA, 19 nt, Human
cgguggcggcggccccagc

SEQ ID NO: 935411 - RNA, 21 nt, Human
cguggugaacuaucaagguca

SEQ ID NO: 935412 - RNA, 19 nt, Human
cucaaauaaugacccccaa

SEQ ID NO: 935413 - RNA, 18 nt, Human
cucgucugaaggaagaug

SEQ ID NO: 935414 - RNA, 21 nt, Human
cucuagaaggaaggggaaccc

SEQ ID NO: 935415 - RNA, 19 nt, Human
cuugcccugugcgccucga

SEQ ID NO: 935416 - RNA, 24 nt, Human
gaacaaacccgauguaaaaggcac

SEQ ID NO: 935417 - RNA, 19 nt, Human
gauccagcaggcgcggagc

SEQ ID NO: 935418 - RNA, 19 nt, Human
gccccagcccgagaaggcu

SEQ ID NO: 935419 - RNA, 20 nt, Human
gccccccaggcgaugaucug

SEQ ID NO: 935420 - RNA, 21 nt, Human
gggaacccuucccccaguauc

SEQ ID NO: 935421 - RNA, 18 nt, Human
gggaagggaauaaucgga

SEQ ID NO: 935422 - RNA, 25 nt, Human
uaaaaagcauccuaacuuaaaaaca

SEQ ID NO: 935423 - RNA, 19 nt, Human
uaaaagacagaaaaguggc

SEQ ID NO: 935424 - RNA, 27 nt, Human
uaaaauaaaaacuggugaccaguccau

SEQ ID NO: 935425 - RNA, 30 nt, Human
uaacaacaguaaccaaauaaaagacagaag

SEQ ID NO: 935426 - RNA, 21 nt, Human
uaaucggaagcgaggcuccua

SEQ ID NO: 935427 - RNA, 22 nt, Human
uagaagagaccccacguuggca

SEQ ID NO: 935428 - RNA, 18 nt, Human
ucccccaguaucaauuuc

SEQ ID NO: 935429 - RNA, 23 nt, Human
ucccuuuucugcucuagaaggaa

SEQ ID NO: 935430 - RNA, 24 nt, Human
uccuaugcaggcagcuacccucuc

SEQ ID NO: 935431 - RNA, 24 nt, Human
ucgccaugugguaggaggucuuac

SEQ ID NO: 935432 - RNA, 25 nt, Human
ugaauaauauugggaagggaauaau

SEQ ID NO: 935433 - RNA, 21 nt, Human
ugacccccaagugcccucgcc

SEQ ID NO: 935434 - RNA, 19 nt, Human
ugcauccacgauccagcag

SEQ ID NO: 935435 - RNA, 20 nt, Human
ugccgcgguggcggcggccc

SEQ ID NO: 935436 - RNA, 22 nt, Human
ugccgcgguggcggcggcccca

SEQ ID NO: 935437 - RNA, 20 nt, Human
uggaaggagaacaaacccga

SEQ ID NO: 935438 - RNA, 21 nt, Human
uggaaggagaacaaacccgau

SEQ ID NO: 935439 - RNA, 20 nt, Human
uggcaacugugaaugaauag

SEQ ID NO: 935440 - RNA, 18 nt, Human
uggcggcggccccagccc

SEQ ID NO: 935441 - RNA, 24 nt, Human
uggcuaagucuggaugaauaauau

SEQ ID NO: 935442 - RNA, 25 nt, Human
ugggaaacaagacuuacgaucucaa

SEQ ID NO: 935443 - RNA, 19 nt, Human
ugggaagggaauaaucgga

SEQ ID NO: 935444 - RNA, 28 nt, Human
uggggagaagcugugguguucacugccc

SEQ ID NO: 935445 - RNA, 23 nt, Human
uguuaaaaagcauccuaacuuaa

SEQ ID NO: 935446 - RNA, 18 nt, Human
uucacugccucucuagca

SEQ ID NO: 935447 - RNA, 22 nt, Human
accuuggagccacggaggcagc

SEQ ID NO: 935448 - RNA, 19 nt, Human
acguacacacguguacaca

SEQ ID NO: 935449 - RNA, 19 nt, Human
agaagccucggagcccaga

SEQ ID NO: 935450 - RNA, 21 nt, Human
agaagccucggagcccagagc

SEQ ID NO: 935451 - RNA, 23 nt, Human
agagcaugcccuugccacgccag

SEQ ID NO: 935452 - RNA, 22 nt, Human
aggaggccacggaggccugggc

SEQ ID NO: 935453 - RNA, 29 nt, Human
aggcagaaaggggagggaggagggacccc

SEQ ID NO: 935454 - RNA, 19 nt, Human
aggcagcaugaccccagca

SEQ ID NO: 935455 - RNA, 18 nt, Human
aggccucagcgcacccag

SEQ ID NO: 935456 - RNA, 18 nt, Human
agggaggacccugguucc

SEQ ID NO: 935457 - RNA, 19 nt, Human
aggugcacaggagaaaagc

SEQ ID NO: 935458 - RNA, 23 nt, Human
aguguuuguggacgagcgcccac

SEQ ID NO: 935459 - RNA, 19 nt, Human
auccgcugccucucagcca

SEQ ID NO: 935460 - RNA, 28 nt, Human
cacacgcauacacacguacacacgugua

SEQ ID NO: 935461 - RNA, 19 nt, Human
cacaggaggaggccacgga

SEQ ID NO: 935462 - RNA, 20 nt, Human
caccccucgccuucagccuc

SEQ ID NO: 935463 - RNA, 19 nt, Human
cacgaggcagccacggccc

SEQ ID NO: 935464 - RNA, 21 nt, Human
cacgaggcagccacggcccag

SEQ ID NO: 935465 - RNA, 29 nt, Human
cacgcauacacacguacacacguguacac

SEQ ID NO: 935466 - RNA, 25 nt, Human
cacgugcacaccacaggcggccacg

SEQ ID NO: 935467 - RNA, 23 nt, Human
cagcacccggguuccaggccccc

SEQ ID NO: 935468 - RNA, 22 nt, Human
cagcaucgcugccuggauccgc

SEQ ID NO: 935469 - RNA, 19 nt, Human
caggagaaaagcaaaaaac

SEQ ID NO: 935470 - RNA, 21 nt, Human
cccacgcacaccgggucaccg

SEQ ID NO: 935471 - RNA, 23 nt, Human
ccccacgcacaccgggucaccgg

SEQ ID NO: 935472 - RNA, 21 nt, Human
cccccuugaggggcagcucag

SEQ ID NO: 935473 - RNA, 18 nt, Human
cccugccuggaccacacc

SEQ ID NO: 935474 - RNA, 21 nt, Human
ccgcugccucucagccacgga

SEQ ID NO: 935475 - RNA, 21 nt, Human
ccucucagccacggaguguuu

SEQ ID NO: 935476 - RNA, 23 nt, Human
ccugagggacacacugccccaga

SEQ ID NO: 935477 - RNA, 19 nt, Human
ccuggauccgcugccucuc

SEQ ID NO: 935478 - RNA, 19 nt, Human
ccuugagggcaaggccggg

SEQ ID NO: 935479 - RNA, 24 nt, Human
cgagaggacgcgccgcacacagcg

SEQ ID NO: 935480 - RNA, 21 nt, Human
cgagaugucccugccuggacc

SEQ ID NO: 935481 - RNA, 21 nt, Human
cggaggcagcaugaccccagc

SEQ ID NO: 935482 - RNA, 21 nt, Human
cgugcacaccacaggcggcca

SEQ ID NO: 935483 - RNA, 23 nt, Human
cgugcacaccacaggcggccacg

SEQ ID NO: 935484 - RNA, 19 nt, Human
gaaaggggagggaggaccc

SEQ ID NO: 935485 - RNA, 21 nt, Human
gaccacaccauggcuggguga

SEQ ID NO: 935486 - RNA, 23 nt, Human
gaccccaucauccacguguccuc

SEQ ID NO: 935487 - RNA, 20 nt, Human
gagagcagcgcggggccggc

SEQ ID NO: 935488 - RNA, 22 nt, Human
gagggacacacugccccagagc

SEQ ID NO: 935489 - RNA, 21 nt, Human
gaggggcagcucagugaucuc

SEQ ID NO: 935490 - RNA, 23 nt, Human
gaguguuuguggacgagcgccca

SEQ ID NO: 935491 - RNA, 19 nt, Human
gcccacacgagcugcgggg

SEQ ID NO: 935492 - RNA, 19 nt, Human
gcccggagccacuccgccc

SEQ ID NO: 935493 - RNA, 18 nt, Human
gccgcacacagcgcgagg

SEQ ID NO: 935494 - RNA, 20 nt, Human
gccgggcacguggcuccugg

SEQ ID NO: 935495 - RNA, 21 nt, Human
gcgcacccagggcccacggag

SEQ ID NO: 935496 - RNA, 24 nt, Human
gcguacacacacgcauacacacgu

SEQ ID NO: 935497 - RNA, 20 nt, Human
ggagagcagcgcggggccgg

SEQ ID NO: 935498 - RNA, 18 nt, Human
ggagcuuggugggccaga

SEQ ID NO: 935499 - RNA, 21 nt, Human
ggaggacccugguuccugagg

SEQ ID NO: 935500 - RNA, 18 nt, Human
ggcaaggccgggcacgug

SEQ ID NO: 935501 - RNA, 18 nt, Human
ggccagaggccacggggc

SEQ ID NO: 935502 - RNA, 21 nt, Human
ggccaguaaagggugugcggu

SEQ ID NO: 935503 - RNA, 32 nt, Human
guacacacgcgcguacacacgcguacacacag

SEQ ID NO: 935504 - RNA, 23 nt, Human
gugaaaggaaggcucggaggaga

SEQ ID NO: 935505 - RNA, 22 nt, Human
guguuuguggacgagcgcccac

SEQ ID NO: 935506 - RNA, 28 nt, Human
uacacacacgcauacacacguacacacg

SEQ ID NO: 935507 - RNA, 31 nt, Human
uacacacgcguacacacacgcauacacacgg

SEQ ID NO: 935508 - RNA, 18 nt, Human
uacacauggagaugaggc

SEQ ID NO: 935509 - RNA, 19 nt, Human
ucgccuucagccucgccag

SEQ ID NO: 935510 - RNA, 22 nt, Human
ucucugaccccaucauccacgu

SEQ ID NO: 935511 - RNA, 21 nt, Human
ucuggagaagccucggagccc

SEQ ID NO: 935512 - RNA, 22 nt, Human
ugagggcaaggccgggcacgug

SEQ ID NO: 935513 - RNA, 23 nt, Human
ugcacaggagaaaagcaaaaaac

SEQ ID NO: 935514 - RNA, 18 nt, Human
ugccacgccagccagcuc

SEQ ID NO: 935515 - RNA, 20 nt, Human
ugcucgugaagaugacccuc

SEQ ID NO: 935516 - RNA, 22 nt, Human
ugcuggggccuccuccaccccu

SEQ ID NO: 935517 - RNA, 22 nt, Human
uggagaagccucggagcccaga

SEQ ID NO: 935518 - RNA, 18 nt, Human
ugggaaggggucgcggcg

SEQ ID NO: 935519 - RNA, 22 nt, Human
uggugggccagaggccacgggg

SEQ ID NO: 935520 - RNA, 24 nt, Human
uguacacauggagaugaggcugug

SEQ ID NO: 935521 - RNA, 18 nt, Human
ugugaaaggaaggcucgg

SEQ ID NO: 935522 - RNA, 30 nt, Human
uguguacacacgcgcguacacacgcguaca

SEQ ID NO: 935523 - RNA, 19 nt, Human
uguuuguggacgagcgccc

SEQ ID NO: 935524 - RNA, 23 nt, Human
uuuuuuuuuuuuuggaagccuca

SEQ ID NO: 935525 - RNA, 18 nt, Human
uuuuuuuuuuuuuuuuug

SEQ ID NO: 935526 - RNA, 22 nt, Human
acuccugucucaggaaugggga

SEQ ID NO: 935527 - RNA, 23 nt, Human
acuccugucucaggaauggggau

SEQ ID NO: 935528 - RNA, 18 nt, Human
aggaauggggauagaugg

SEQ ID NO: 935529 - RNA, 21 nt, Human
cccugcacacccgcuccgcgg

SEQ ID NO: 935530 - RNA, 25 nt, Human
cucaggaauggggauagaugggagg

SEQ ID NO: 935531 - RNA, 19 nt, Human
cuccugucucaggaauggg

SEQ ID NO: 935532 - RNA, 22 nt, Human
uuggaugugagggccaaaaggg

SEQ ID NO: 935533 - RNA, 20 nt, Human
uuuuuuuuuuuuuuuuuggu

SEQ ID NO: 935534 - RNA, 20 nt, Human
uuuuuuuuuuuuuuuuuugg

SEQ ID NO: 935535 - RNA, 19 nt, Human
uaccacagagugaaaaaca

SEQ ID NO: 935536 - RNA, 21 nt, Human
aaccaguaucgccaggcgcug

SEQ ID NO: 935537 - RNA, 18 nt, Human
aagcgagagggcuggugg

SEQ ID NO: 935538 - RNA, 20 nt, Human
aagcgagagggcuggugggg

SEQ ID NO: 935539 - RNA, 19 nt, Human
aggaagaggggcggcagag

SEQ ID NO: 935540 - RNA, 20 nt, Human
aggcagggacagggaggggu

SEQ ID NO: 935541 - RNA, 22 nt, Human
aggcagggacagggaggggucg

SEQ ID NO: 935542 - RNA, 21 nt, Human
cacgcgcggcguuuaaagggc

SEQ ID NO: 935543 - RNA, 21 nt, Human
cagucccgggaggcuugggaa

SEQ ID NO: 935544 - RNA, 24 nt, Human
ccagggaugggauuccacugaaaa

SEQ ID NO: 935545 - RNA, 18 nt, Human
ccccgcggguuggccggg

SEQ ID NO: 935546 - RNA, 19 nt, Human
cccucugcucugcgcgggg

SEQ ID NO: 935547 - RNA, 22 nt, Human
cccugagccccagcaggugccc

SEQ ID NO: 935548 - RNA, 18 nt, Human
cccuguguuagaagcgag

SEQ ID NO: 935549 - RNA, 22 nt, Human
ccuaacaucccugagccccagc

SEQ ID NO: 935550 - RNA, 23 nt, Human
cgagagggcuggugggggugcgu

SEQ ID NO: 935551 - RNA, 23 nt, Human
cgagggcccccacccacaggaug

SEQ ID NO: 935552 - RNA, 19 nt, Human
cgccccagggcaguggcag

SEQ ID NO: 935553 - RNA, 23 nt, Human
cgccccagggcaguggcagggcu

SEQ ID NO: 935554 - RNA, 28 nt, Human
cgccccgcggguuggccggggugagggc

SEQ ID NO: 935555 - RNA, 19 nt, Human
cgcgaaacgaagacgccga

SEQ ID NO: 935556 - RNA, 25 nt, Human
cucgucccuaacaucccugagcccc

SEQ ID NO: 935557 - RNA, 25 nt, Human
cuggaacucgucccuaacaucccug

SEQ ID NO: 935558 - RNA, 23 nt, Human
cuggcccaguggccccaggcccu

SEQ ID NO: 935559 - RNA, 22 nt, Human
gaagagugggaaccaggggaac

SEQ ID NO: 935560 - RNA, 23 nt, Human
gcccuggcagcuggcgucuuccg

SEQ ID NO: 935561 - RNA, 23 nt, Human
gcgaaacgaagacgccgaggcac

SEQ ID NO: 935562 - RNA, 22 nt, Human
ggcagaaugauccugcccccaa

SEQ ID NO: 935563 - RNA, 21 nt, Human
ggcagagcagggaggcaggga

SEQ ID NO: 935564 - RNA, 19 nt, Human
ggccccaggcccuggcagc

SEQ ID NO: 935565 - RNA, 21 nt, Human
ggcuggugggggugcguggac

SEQ ID NO: 935566 - RNA, 22 nt, Human
gggcaguggcagggcuggaacu

SEQ ID NO: 935567 - RNA, 19 nt, Human
ggguuggccggggugaggg

SEQ ID NO: 935568 - RNA, 20 nt, Human
gucgagggcccccacccaca

SEQ ID NO: 935569 - RNA, 22 nt, Human
uaucgccaggcgcuggcccagu

SEQ ID NO: 935570 - RNA, 24 nt, Human
ucagcgcucucgggacugggcgug

SEQ ID NO: 935571 - RNA, 22 nt, Human
uccacugaaaacaaaccguccu

SEQ ID NO: 935572 - RNA, 19 nt, Human
ucccugagccccagcaggu

SEQ ID NO: 935573 - RNA, 20 nt, Human
ugccaugacaggcgccacaa

SEQ ID NO: 935574 - RNA, 21 nt, Human
ugcccuguguuagaagcgaga

SEQ ID NO: 935575 - RNA, 19 nt, Human
uggccccaggcccuggcag

SEQ ID NO: 935576 - RNA, 29 nt, Human
uggugggggugcguggacaaggggccgac

SEQ ID NO: 935577 - RNA, 18 nt, Human
uguguuagaagcgagagg

SEQ ID NO: 935578 - RNA, 24 nt, Human
uuccuuuauugcaaacauguccca

SEQ ID NO: 935579 - RNA, 21 nt, Human
uugcaaacaugucccaguccc

SEQ ID NO: 935580 - RNA, 22 nt, Human
uuuccaugagaugccugccaug

SEQ ID NO: 935581 - RNA, 20 nt, Human
uuuuuuuuuuuuuuuuccau

SEQ ID NO: 935582 - RNA, 24 nt, Human
uuuuuuuuuuuuuuuuuuuccaug

SEQ ID NO: 935583 - RNA, 29 nt, Human
uuuuuuuuuuuuuuuuuuuuccaugagaa

SEQ ID NO: 935584 - RNA, 19 nt, Human
aaacaggaaagaaacaccu

SEQ ID NO: 935585 - RNA, 22 nt, Human
aaacaggaaagaaacaccugcc

SEQ ID NO: 935586 - RNA, 27 nt, Human
aaacaggaaagaaacaccugccccugg

SEQ ID NO: 935587 - RNA, 23 nt, Human
aaagagacaccuucaaaaucagg

SEQ ID NO: 935588 - RNA, 24 nt, Human
aaagugcugggauuacaggcauga

SEQ ID NO: 935589 - RNA, 19 nt, Human
aagaaacgggcacugccuu

SEQ ID NO: 935590 - RNA, 20 nt, Human
aagacaaacaggaaagaaac

SEQ ID NO: 935591 - RNA, 19 nt, Human
aagugcugggauuacaggc

SEQ ID NO: 935592 - RNA, 21 nt, Human
aagugcugggauuacaggcau

SEQ ID NO: 935593 - RNA, 26 nt, Human
aagugcugggauuacaggcaugagcc

SEQ ID NO: 935594 - RNA, 20 nt, Human
acaagggagaagacaaaucc

SEQ ID NO: 935595 - RNA, 24 nt, Human
acccagcacccacaggcgcuccag

SEQ ID NO: 935596 - RNA, 22 nt, Human
acccagcgacaaaggugaaggu

SEQ ID NO: 935597 - RNA, 25 nt, Human
accccagggaagcgcgugggccuug

SEQ ID NO: 935598 - RNA, 24 nt, Human
acccccaccaccacacccagcuaa

SEQ ID NO: 935599 - RNA, 25 nt, Human
acccccaccaccacacccagcuaau

SEQ ID NO: 935600 - RNA, 22 nt, Human
acgccagggggcaggcaaggac

SEQ ID NO: 935601 - RNA, 18 nt, Human
acgggguuucaccguguu

SEQ ID NO: 935602 - RNA, 19 nt, Human
acgggguuucaccguguua

SEQ ID NO: 935603 - RNA, 20 nt, Human
acgggguuucaccguguuag

SEQ ID NO: 935604 - RNA, 24 nt, Human
acgggguuucaccguguuagccag

SEQ ID NO: 935605 - RNA, 21 nt, Human
acucaggcacucagggaagcc

SEQ ID NO: 935606 - RNA, 18 nt, Human
acucagggaagccaacgg

SEQ ID NO: 935607 - RNA, 18 nt, Human
agacacaagacaaacagg

SEQ ID NO: 935608 - RNA, 19 nt, Human
agacccaaggcacacacga

SEQ ID NO: 935609 - RNA, 21 nt, Human
agagaagggcccuugucagcg

SEQ ID NO: 935610 - RNA, 18 nt, Human
agagcaccccggcuccuc

SEQ ID NO: 935611 - RNA, 22 nt, Human
agagggaguggaaucagggcag

SEQ ID NO: 935612 - RNA, 19 nt, Human
agcacuuagcgcccgcacu

SEQ ID NO: 935613 - RNA, 22 nt, Human
agcagccacacccagcacccac

SEQ ID NO: 935614 - RNA, 23 nt, Human
agcccggaaccaccccacagaca

SEQ ID NO: 935615 - RNA, 24 nt, Human
agcgcccgcacuaugggaacccac

SEQ ID NO: 935616 - RNA, 19 nt, Human
agcggccucaugggcaggc

SEQ ID NO: 935617 - RNA, 20 nt, Human
aggaacaaggcguguuugcc

SEQ ID NO: 935618 - RNA, 21 nt, Human
aggacuucccggaagaggagg

SEQ ID NO: 935619 - RNA, 23 nt, Human
aggacuucccggaagaggagggc

SEQ ID NO: 935620 - RNA, 18 nt, Human
aggagcugcugugggcag

SEQ ID NO: 935621 - RNA, 23 nt, Human
aggcagcccccccagcccggaac

SEQ ID NO: 935622 - RNA, 19 nt, Human
aggccgggaagcagccaca

SEQ ID NO: 935623 - RNA, 25 nt, Human
aggcuggagugcaguggcgcgaucu

SEQ ID NO: 935624 - RNA, 21 nt, Human
aggggcacccacggcugaaga

SEQ ID NO: 935625 - RNA, 20 nt, Human
aguaccuuuccagaaacucc

SEQ ID NO: 935626 - RNA, 20 nt, Human
aguagagacgggguuucacc

SEQ ID NO: 935627 - RNA, 20 nt, Human
agugcaguggcgcgaucucg

SEQ ID NO: 935628 - RNA, 23 nt, Human
agugcaguggcgcgaucucggcu

SEQ ID NO: 935629 - RNA, 24 nt, Human
agugcaguggcgcgaucucggcuc

SEQ ID NO: 935630 - RNA, 19 nt, Human
auagaaccuccagaagacu

SEQ ID NO: 935631 - RNA, 23 nt, Human
caaaaccaaauuuacaugagcgu

SEQ ID NO: 935632 - RNA, 20 nt, Human
caaacaggaaagaaacaccc

SEQ ID NO: 935633 - RNA, 22 nt, Human
caaacaggaaagaaacaccugc

SEQ ID NO: 935634 - RNA, 24 nt, Human
caaagugcugggauuacaggcaug

SEQ ID NO: 935635 - RNA, 21 nt, Human
caagacacaagacaaacagga

SEQ ID NO: 935636 - RNA, 23 nt, Human
caagacacaagacaaacaggaaa

SEQ ID NO: 935637 - RNA, 22 nt, Human
caagccucgcagccugagggca

SEQ ID NO: 935638 - RNA, 22 nt, Human
cacaagacaaacaggaaagaaa

SEQ ID NO: 935639 - RNA, 27 nt, Human
cacaagacaaacaggaaagaaacaccu

SEQ ID NO: 935640 - RNA, 18 nt, Human
cacaggcgcccaccccca

SEQ ID NO: 935641 - RNA, 20 nt, Human
caccaagcugaacugggaag

SEQ ID NO: 935642 - RNA, 24 nt, Human
caccagucugcugccucagccucc

SEQ ID NO: 935643 - RNA, 23 nt, Human
cacccaucaccucaguaaacccc

SEQ ID NO: 935644 - RNA, 22 nt, Human
caccccggcuccuccugagggc

SEQ ID NO: 935645 - RNA, 22 nt, Human
caccccugagcacagggcccaa

SEQ ID NO: 935646 - RNA, 18 nt, Human
caccguguuagccaggau

SEQ ID NO: 935647 - RNA, 24 nt, Human
caccguguuagccaggaugguguc

SEQ ID NO: 935648 - RNA, 19 nt, Human
caccucccggguucacacc

SEQ ID NO: 935649 - RNA, 23 nt, Human
caccugccucagccucccaaagu

SEQ ID NO: 935650 - RNA, 19 nt, Human
caccuucaaaaucaggugc

SEQ ID NO: 935651 - RNA, 19 nt, Human
cagagcaccccggcuccuc

SEQ ID NO: 935652 - RNA, 26 nt, Human
cagagcaccccggcuccuccugaggg

SEQ ID NO: 935653 - RNA, 24 nt, Human
cagcacccacaggcgcuccagagc

SEQ ID NO: 935654 - RNA, 24 nt, Human
cagcagcugagacccaaggcacac

SEQ ID NO: 935655 - RNA, 18 nt, Human
cagcagggcccggccaug

SEQ ID NO: 935656 - RNA, 26 nt, Human
cagcccccccagcccggaaccacccc

SEQ ID NO: 935657 - RNA, 22 nt, Human
caggcugcgugucagcagcuga

SEQ ID NO: 935658 - RNA, 18 nt, Human
cagggcccaaugucagga

SEQ ID NO: 935659 - RNA, 18 nt, Human
caggugggggccgccucu

SEQ ID NO: 935660 - RNA, 19 nt, Human
caguagagaagggcccuug

SEQ ID NO: 935661 - RNA, 24 nt, Human
cauggaugaaagagacaccuucaa

SEQ ID NO: 935662 - RNA, 23 nt, Human
ccaaagugcugggauuacaggca

SEQ ID NO: 935663 - RNA, 24 nt, Human
ccaaagugcugggauuacaggcau

SEQ ID NO: 935664 - RNA, 18 nt, Human
ccacacccagcacccaca

SEQ ID NO: 935665 - RNA, 22 nt, Human
ccacacccagcacccacaggcg

SEQ ID NO: 935666 - RNA, 20 nt, Human
ccacccccaccaccacaccc

SEQ ID NO: 935667 - RNA, 22 nt, Human
ccacccccaccaccacacccag

SEQ ID NO: 935668 - RNA, 23 nt, Human
ccacccccaccaccacacccagc

SEQ ID NO: 935669 - RNA, 26 nt, Human
ccaccugccucagccucccaaagugc

SEQ ID NO: 935670 - RNA, 20 nt, Human
ccagcacccacaggcgcucc

SEQ ID NO: 935671 - RNA, 23 nt, Human
ccagcacccacaggcgcuccaga

SEQ ID NO: 935672 - RNA, 21 nt, Human
ccagccccagacuccaccccu

SEQ ID NO: 935673 - RNA, 20 nt, Human
ccagccggccccacaagucc

SEQ ID NO: 935674 - RNA, 21 nt, Human
ccaggggcacccacggcugaa

SEQ ID NO: 935675 - RNA, 24 nt, Human
cccaaagugcugggauuacaggca

SEQ ID NO: 935676 - RNA, 24 nt, Human
cccacaaguccucaggcccacugg

SEQ ID NO: 935677 - RNA, 20 nt, Human
cccacaggcgcuccagagca

SEQ ID NO: 935678 - RNA, 21 nt, Human
cccaccaagcugaacugggaa

SEQ ID NO: 935679 - RNA, 21 nt, Human
cccacccccaccaccacaccc

SEQ ID NO: 935680 - RNA, 21 nt, Human
cccacggcugaagaaacgggc

SEQ ID NO: 935681 - RNA, 22 nt, Human
cccaggcuggagugcaguggcg

SEQ ID NO: 935682 - RNA, 22 nt, Human
ccccacaaguccucaggcccac

SEQ ID NO: 935683 - RNA, 18 nt, Human
cccccagcccggaaccac

SEQ ID NO: 935684 - RNA, 21 nt, Human
cccccagcccggaaccacccc

SEQ ID NO: 935685 - RNA, 22 nt, Human
ccccccagcccggaaccacccc

SEQ ID NO: 935686 - RNA, 21 nt, Human
cccccccagcccggaaccacc

SEQ ID NO: 935687 - RNA, 22 nt, Human
ccccucugaccucugcuggcuu

SEQ ID NO: 935688 - RNA, 18 nt, Human
ccccugagcacagggccc

SEQ ID NO: 935689 - RNA, 19 nt, Human
ccccugagcacagggccca

SEQ ID NO: 935690 - RNA, 20 nt, Human
ccccugggaggaaagaaccc

SEQ ID NO: 935691 - RNA, 20 nt, Human
cccgagccacgcgaaugacu

SEQ ID NO: 935692 - RNA, 20 nt, Human
cccggaaccaccccacagac

SEQ ID NO: 935693 - RNA, 18 nt, Human
cccucugggaacaagccu

SEQ ID NO: 935694 - RNA, 28 nt, Human
ccucacccagccccagacuccaccccug

SEQ ID NO: 935695 - RNA, 19 nt, Human
ccucccggguucacaccag

SEQ ID NO: 935696 - RNA, 20 nt, Human
ccucgcagccugagggcagg

SEQ ID NO: 935697 - RNA, 19 nt, Human
ccugaccucgugauccacc

SEQ ID NO: 935698 - RNA, 21 nt, Human
ccugaccucgugauccaccug

SEQ ID NO: 935699 - RNA, 19 nt, Human
ccuugagcaccaaaaccaa

SEQ ID NO: 935700 - RNA, 24 nt, Human
cgcccacccccaccaccacaccca

SEQ ID NO: 935701 - RNA, 24 nt, Human
cgcucugucgcccaggcuggagug

SEQ ID NO: 935702 - RNA, 23 nt, Human
cggccccacaaguccucaggccc

SEQ ID NO: 935703 - RNA, 20 nt, Human
cggcccggaggacuucccgg

SEQ ID NO: 935704 - RNA, 18 nt, Human
cggcugaagaaacgggca

SEQ ID NO: 935705 - RNA, 19 nt, Human
cggcugaagaaacgggcac

SEQ ID NO: 935706 - RNA, 24 nt, Human
cgggcgcagcggcaggaccaggcu

SEQ ID NO: 935707 - RNA, 22 nt, Human
cgucggugcccucacccagccc

SEQ ID NO: 935708 - RNA, 24 nt, Human
cgugauccaccugccucagccucc

SEQ ID NO: 935709 - RNA, 21 nt, Human
cuaauuuuuuguauuuuuuag

SEQ ID NO: 935710 - RNA, 20 nt, Human
cucacccagccccagacucc

SEQ ID NO: 935711 - RNA, 24 nt, Human
cucacugcaagcuccaccucccgg

SEQ ID NO: 935712 - RNA, 23 nt, Human
cucagccucccacguagcuggga

SEQ ID NO: 935713 - RNA, 24 nt, Human
cuccugaccucgugauccaccugc

SEQ ID NO: 935714 - RNA, 24 nt, Human
cucgcucugucgcccaggcuggag

SEQ ID NO: 935715 - RNA, 20 nt, Human
cucugcccaggccccuccuc

SEQ ID NO: 935716 - RNA, 18 nt, Human
cugacccagcgacaaagg

SEQ ID NO: 935717 - RNA, 24 nt, Human
cugcaagcuccaccucccggguuc

SEQ ID NO: 935718 - RNA, 24 nt, Human
cugcagacagacagccagagagcg

SEQ ID NO: 935719 - RNA, 23 nt, Human
cugccucagccucccaaagugcu

SEQ ID NO: 935720 - RNA, 24 nt, Human
cugccucagccucccaaagugcug

SEQ ID NO: 935721 - RNA, 23 nt, Human
cugccucagccucccacguagcu

SEQ ID NO: 935722 - RNA, 19 nt, Human
gaaagaaacaccugccccu

SEQ ID NO: 935723 - RNA, 24 nt, Human
gaacaaggcguguuugccucccac

SEQ ID NO: 935724 - RNA, 22 nt, Human
gaccucgugauccaccugccuc

SEQ ID NO: 935725 - RNA, 24 nt, Human
gaccucgugauccaccugccucag

SEQ ID NO: 935726 - RNA, 24 nt, Human
gagacgggguuucaccguguuagc

SEQ ID NO: 935727 - RNA, 18 nt, Human
gagcaccccggcuccucc

SEQ ID NO: 935728 - RNA, 18 nt, Human
gagcaggaacaaggcgug

SEQ ID NO: 935729 - RNA, 18 nt, Human
gagccaccgugccccgcc

SEQ ID NO: 935730 - RNA, 19 nt, Human
gagcugcugugggcaggcg

SEQ ID NO: 935731 - RNA, 21 nt, Human
gaggacuucccggaagaggag

SEQ ID NO: 935732 - RNA, 19 nt, Human
gagggcugcaggcgcugcc

SEQ ID NO: 935733 - RNA, 21 nt, Human
gagggggaggaggaccucccg

SEQ ID NO: 935734 - RNA, 18 nt, Human
gauuacaggcaugagcca

SEQ ID NO: 935735 - RNA, 21 nt, Human
gauuacaggcaugagccaccg

SEQ ID NO: 935736 - RNA, 24 nt, Human
gauuacaggcaugagccaccgugc

SEQ ID NO: 935737 - RNA, 21 nt, Human
gcaaaggaggcagccccccca

SEQ ID NO: 935738 - RNA, 19 nt, Human
gcaugagccaccgugcccc

SEQ ID NO: 935739 - RNA, 21 nt, Human
gcccacccccaccaccacacc

SEQ ID NO: 935740 - RNA, 19 nt, Human
gcccaggcuggagugcagu

SEQ ID NO: 935741 - RNA, 20 nt, Human
gcccaggcuggagugcagug

SEQ ID NO: 935742 - RNA, 22 nt, Human
gccccagacuccaccccugagc

SEQ ID NO: 935743 - RNA, 19 nt, Human
gcccucugggaacaagccu

SEQ ID NO: 935744 - RNA, 23 nt, Human
gcgcccgcacuaugggaacccac

SEQ ID NO: 935745 - RNA, 25 nt, Human
gcucugucgcccaggcuggagugca

SEQ ID NO: 935746 - RNA, 19 nt, Human
gcuggagugcaguggcgcg

SEQ ID NO: 935747 - RNA, 19 nt, Human
gcuugggcuggcagagacc

SEQ ID NO: 935748 - RNA, 24 nt, Human
ggagaagacaaauccuuuugagaa

SEQ ID NO: 935749 - RNA, 24 nt, Human
ggauuacaggcaugagccaccgug

SEQ ID NO: 935750 - RNA, 24 nt, Human
gggaagcagccacacccagcaccc

SEQ ID NO: 935751 - RNA, 20 nt, Human
gggcaagcaccgccagggcc

SEQ ID NO: 935752 - RNA, 19 nt, Human
gggcacaggugggggccgc

SEQ ID NO: 935753 - RNA, 22 nt, Human
gggcacugcagacagacagcca

SEQ ID NO: 935754 - RNA, 22 nt, Human
gggcaggaaggugagggcugca

SEQ ID NO: 935755 - RNA, 23 nt, Human
gggccaagcagggaagagggagu

SEQ ID NO: 935756 - RNA, 19 nt, Human
ggggaggcagagccagggg

SEQ ID NO: 935757 - RNA, 22 nt, Human
ggggaggcagagccaggggcac

SEQ ID NO: 935758 - RNA, 22 nt, Human
ggggcacccacggcugaagaaa

SEQ ID NO: 935759 - RNA, 23 nt, Human
gggguuucaccguguuagccagg

SEQ ID NO: 935760 - RNA, 22 nt, Human
ggguuucaccguguuagccagg

SEQ ID NO: 935761 - RNA, 23 nt, Human
guagagacgggguuucaccgugu

SEQ ID NO: 935762 - RNA, 22 nt, Human
guagcugggaucacaggcgccc

SEQ ID NO: 935763 - RNA, 24 nt, Human
gugauccaccugccucagccuccc

SEQ ID NO: 935764 - RNA, 20 nt, Human
guuuugggggauccccgggg

SEQ ID NO: 935765 - RNA, 22 nt, Human
uaaggccaagcucucaagacac

SEQ ID NO: 935766 - RNA, 25 nt, Human
uaauuuuuuguauuuuuuaguagag

SEQ ID NO: 935767 - RNA, 26 nt, Human
uaauuuuuuguauuuuuuaguagaga

SEQ ID NO: 935768 - RNA, 24 nt, Human
uacaggcaugagccaccgugcccc

SEQ ID NO: 935769 - RNA, 21 nt, Human
uaguagagacgggguuucacc

SEQ ID NO: 935770 - RNA, 24 nt, Human
uaguagagacgggguuucaccgug

SEQ ID NO: 935771 - RNA, 26 nt, Human
uaguagagacgggguuucaccguguu

SEQ ID NO: 935772 - RNA, 26 nt, Human
uaguagagacgggguuucaccguugg

SEQ ID NO: 935773 - RNA, 22 nt, Human
ucaccguguuagccaggauggu

SEQ ID NO: 935774 - RNA, 24 nt, Human
ucacugcaagcuccaccucccggg

SEQ ID NO: 935775 - RNA, 23 nt, Human
ucagagcugcgggggcacaggug

SEQ ID NO: 935776 - RNA, 21 nt, Human
ucagcagcugagacccaaggc

SEQ ID NO: 935777 - RNA, 28 nt, Human
ucagggcagcgacagcugugugggucgg

SEQ ID NO: 935778 - RNA, 18 nt, Human
ucauaucaaaccaaaccc

SEQ ID NO: 935779 - RNA, 21 nt, Human
uccacacggacgccagggggc

SEQ ID NO: 935780 - RNA, 21 nt, Human
uccagaaacucccaaaauuau

SEQ ID NO: 935781 - RNA, 24 nt, Human
ucccaaagugcugggauuacaggc

SEQ ID NO: 935782 - RNA, 18 nt, Human
ucccagguccaggcccuc

SEQ ID NO: 935783 - RNA, 18 nt, Human
ucccagguccaggcccuc

SEQ ID NO: 935784 - RNA, 23 nt, Human
ucccagguccaggcccucugccc

SEQ ID NO: 935785 - RNA, 19 nt, Human
uccccggggaggcagagcc

SEQ ID NO: 935786 - RNA, 23 nt, Human
ucccggaucucaucugcaggcuc

SEQ ID NO: 935787 - RNA, 20 nt, Human
ucccggguucacaccagucu

SEQ ID NO: 935788 - RNA, 22 nt, Human
uccggcagcuuccccuccaccc

SEQ ID NO: 935789 - RNA, 22 nt, Human
ucgcccaggcuggagugcagug

SEQ ID NO: 935790 - RNA, 24 nt, Human
ucgcucugucgcccaggcuggagu

SEQ ID NO: 935791 - RNA, 19 nt, Human
ucucgcucugucgcccagg

SEQ ID NO: 935792 - RNA, 22 nt, Human
ucucgcucugucgcccaggcug

SEQ ID NO: 935793 - RNA, 23 nt, Human
ucucgcucugucgcccaggcugg

SEQ ID NO: 935794 - RNA, 24 nt, Human
ucucgcucugucgcccaggcugga

SEQ ID NO: 935795 - RNA, 26 nt, Human
ucucgcucugucgcccaggcuggagu

SEQ ID NO: 935796 - RNA, 27 nt, Human
ucucgcucugucgcccaggcuggagug

SEQ ID NO: 935797 - RNA, 22 nt, Human
ucugcaggcuccagagcaggcu

SEQ ID NO: 935798 - RNA, 18 nt, Human
ucuuuuuuuuuuuuuuuu

SEQ ID NO: 935799 - RNA, 24 nt, Human
ucuuuuuuuuuuuuuuuuuuuuga

SEQ ID NO: 935800 - RNA, 22 nt, Human
ugagauggagucucgcucuguc

SEQ ID NO: 935801 - RNA, 24 nt, Human
ugagcgcaggagagggggaggagg

SEQ ID NO: 935802 - RNA, 19 nt, Human
ugaucccagguccaggccc

SEQ ID NO: 935803 - RNA, 22 nt, Human
ugcaguggcgcgaucucggcuc

SEQ ID NO: 935804 - RNA, 20 nt, Human
ugcccaggccccuccucagc

SEQ ID NO: 935805 - RNA, 25 nt, Human
ugccccgccuauucuucuuuuaaac

SEQ ID NO: 935806 - RNA, 24 nt, Human
ugccucagccucccaaagugcugg

SEQ ID NO: 935807 - RNA, 24 nt, Human
ugccucagccucccacguagcugg

SEQ ID NO: 935808 - RNA, 24 nt, Human
uggagucucgcucugucgcccagg

SEQ ID NO: 935809 - RNA, 23 nt, Human
uggagugcaguggcgcgaucucg

SEQ ID NO: 935810 - RNA, 24 nt, Human
uggagugcaguggcgcgaucucgg

SEQ ID NO: 935811 - RNA, 25 nt, Human
uggcaggcgggccgucccacuuccu

SEQ ID NO: 935812 - RNA, 22 nt, Human
ugggaaaagccccuuguggacg

SEQ ID NO: 935813 - RNA, 22 nt, Human
ugggaucacaggcgcccacccc

SEQ ID NO: 935814 - RNA, 25 nt, Human
ugggaucacaggcgcccacccccac

SEQ ID NO: 935815 - RNA, 18 nt, Human
ugggauuacaggcaugag

SEQ ID NO: 935816 - RNA, 21 nt, Human
ugggauuacaggcaugagcca

SEQ ID NO: 935817 - RNA, 22 nt, Human
ugggauuacaggcaugagccac

SEQ ID NO: 935818 - RNA, 23 nt, Human
ugggauuacaggcaugagccacc

SEQ ID NO: 935819 - RNA, 23 nt, Human
ugggauuacaggcaugagccacc

SEQ ID NO: 935820 - RNA, 24 nt, Human
ugggauuacaggcaugagccaccg

SEQ ID NO: 935821 - RNA, 22 nt, Human
ugggccuugaucccagguccag

SEQ ID NO: 935822 - RNA, 21 nt, Human
ugucgcccaggcuggagugca

SEQ ID NO: 935823 - RNA, 18 nt, Human
uuaguagagacgggguuu

SEQ ID NO: 935824 - RNA, 22 nt, Human
uuaguagagacgggguuucacc

SEQ ID NO: 935825 - RNA, 24 nt, Human
uuaguagagacgggguuucaccgu

SEQ ID NO: 935826 - RNA, 19 nt, Human
uucaggugagucaaaacca

SEQ ID NO: 935827 - RNA, 20 nt, Human
uucccggaagaggagggccc

SEQ ID NO: 935828 - RNA, 19 nt, Human
uugagaaauccuaguaccu

SEQ ID NO: 935829 - RNA, 19 nt, Human
uuucaccguguuagccagg

SEQ ID NO: 935830 - RNA, 24 nt, Human
uuuuuaguagagacgggguuucac

SEQ ID NO: 935831 - RNA, 22 nt, Human
uuuuuguauuuuuuaguagaga

SEQ ID NO: 935832 - RNA, 23 nt, Human
uuuuuuaguagagacgggguuuc

SEQ ID NO: 935833 - RNA, 25 nt, Human
uuuuuuguauuuuuuaguagagacg

SEQ ID NO: 935834 - RNA, 25 nt, Human
uuuuuuuuuuuugagauggagucuc

SEQ ID NO: 935835 - RNA, 22 nt, Human
uuuuuuuuuuuuuugagaugga

SEQ ID NO: 935836 - RNA, 18 nt, Human
uuuuuuuuuuuuuuuuug

SEQ ID NO: 935837 - RNA, 21 nt, Human
aaaaaaaagucaaauauaaaa

SEQ ID NO: 935838 - RNA, 19 nt, Human
aaaaacacacagaagugaa

SEQ ID NO: 935839 - RNA, 19 nt, Human
aaaauacucuagccugguc

SEQ ID NO: 935840 - RNA, 18 nt, Human
aaacaaacaaaaccccaa

SEQ ID NO: 935841 - RNA, 22 nt, Human
aaacagugugacaaaauuaaac

SEQ ID NO: 935842 - RNA, 20 nt, Human
aaagaaauaugaggcucaaa

SEQ ID NO: 935843 - RNA, 22 nt, Human
aacaaaaccccaaauacucuaa

SEQ ID NO: 935844 - RNA, 22 nt, Human
aacauuuuuuguuuccuuuuga

SEQ ID NO: 935845 - RNA, 19 nt, Human
aaguaucaaagaaauauga

SEQ ID NO: 935846 - RNA, 23 nt, Human
aaugcuauuaaaaaaaagucaaa

SEQ ID NO: 935847 - RNA, 20 nt, Human
acuaaaacauacuguaaacg

SEQ ID NO: 935848 - RNA, 19 nt, Human
agaaaaacauucacuucua

SEQ ID NO: 935849 - RNA, 21 nt, Human
agacaucagacuuucuagaac

SEQ ID NO: 935850 - RNA, 23 nt, Human
auagaaaauaucugguacccuua

SEQ ID NO: 935851 - RNA, 22 nt, Human
aucugucaacccacaauuauuc

SEQ ID NO: 935852 - RNA, 18 nt, Human
auggcucuugcagcaggu

SEQ ID NO: 935853 - RNA, 25 nt, Human
auuucaaucugaacauaaauguuug

SEQ ID NO: 935854 - RNA, 23 nt, Human
caaaugcaucacugauuuucagc

SEQ ID NO: 935855 - RNA, 26 nt, Human
caacauggaaugauuucaguucuccu

SEQ ID NO: 935856 - RNA, 21 nt, Human
caacuaaaacauacuguaaac

SEQ ID NO: 935857 - RNA, 21 nt, Human
caaucugaacauaaauguuug

SEQ ID NO: 935858 - RNA, 20 nt, Human
caauuugcccauaaauguau

SEQ ID NO: 935859 - RNA, 23 nt, Human
cagcuuagaaaauacucuagccu

SEQ ID NO: 935860 - RNA, 24 nt, Human
cauaaaguuuagaucaagaaauua

SEQ ID NO: 935861 - RNA, 19 nt, Human
ccccaaauacucuaaauuc

SEQ ID NO: 935862 - RNA, 20 nt, Human
ccuacagucugacagagcua

SEQ ID NO: 935863 - RNA, 22 nt, Human
ccucuauuucaaguaucaaaga

SEQ ID NO: 935864 - RNA, 18 nt, Human
cuagaacuggcccaacug

SEQ ID NO: 935865 - RNA, 18 nt, Human
cucacagagcauuagaaa

SEQ ID NO: 935866 - RNA, 20 nt, Human
cuguacuaaaagcuggacuu

SEQ ID NO: 935867 - RNA, 21 nt, Human
cuuagaaaauacucuagccug

SEQ ID NO: 935868 - RNA, 23 nt, Human
cuucacugcuauauaaauuuacu

SEQ ID NO: 935869 - RNA, 20 nt, Human
gauccuacagucugacagag

SEQ ID NO: 935870 - RNA, 18 nt, Human
gcuauuaaaaaaaaguca

SEQ ID NO: 935871 - RNA, 20 nt, Human
ggacuuuuaaaaaacuagua

SEQ ID NO: 935872 - RNA, 19 nt, Human
gugaaaagugcuauuuucc

SEQ ID NO: 935873 - RNA, 25 nt, Human
uaaaagacugcugcaauauaaagca

SEQ ID NO: 935874 - RNA, 21 nt, Human
uaaaauguccaccagaaggca

SEQ ID NO: 935875 - RNA, 18 nt, Human
uaacugauaaugcaaagc

SEQ ID NO: 935876 - RNA, 19 nt, Human
uagaacuggcccaacugua

SEQ ID NO: 935877 - RNA, 22 nt, Human
uagguaugauacugccaacuaa

SEQ ID NO: 935878 - RNA, 19 nt, Human
uaucaaagaaauaugaggc

SEQ ID NO: 935879 - RNA, 23 nt, Human
uaugaaaugugcauuuccgauaa

SEQ ID NO: 935880 - RNA, 22 nt, Human
uaugugugucugucuacgugua

SEQ ID NO: 935881 - RNA, 22 nt, Human
ucaaagaaauaugaggcucaaa

SEQ ID NO: 935882 - RNA, 25 nt, Human
ucaaagaaauaugaggcucaaaauc

SEQ ID NO: 935883 - RNA, 20 nt, Human
uccggcgcugagugcagcca

SEQ ID NO: 935884 - RNA, 24 nt, Human
ucugacagagcuagcacagcuacu

SEQ ID NO: 935885 - RNA, 18 nt, Human
ucuuucugucccacaaga

SEQ ID NO: 935886 - RNA, 23 nt, Human
ugaaaggugcauauauuaccuua

SEQ ID NO: 935887 - RNA, 22 nt, Human
ugaggcucaaaaucucucuagg

SEQ ID NO: 935888 - RNA, 28 nt, Human
ugauuauuuguaaacaaacaaaacccca

SEQ ID NO: 935889 - RNA, 20 nt, Human
ugcagccaggcgccccggcc

SEQ ID NO: 935890 - RNA, 20 nt, Human
ugcuuuacuuacucgaacac

SEQ ID NO: 935891 - RNA, 21 nt, Human
uggaaucaacgcuaugaaaac

SEQ ID NO: 935892 - RNA, 20 nt, Human
ugguuuuggagaaaaaaguc

SEQ ID NO: 935893 - RNA, 22 nt, Human
uguaaacaaacaaaaccccaaa

SEQ ID NO: 935894 - RNA, 18 nt, Human
uguaaacgaugaguuaua

SEQ ID NO: 935895 - RNA, 18 nt, Human
uguaauucuucacugcua

SEQ ID NO: 935896 - RNA, 19 nt, Human
uguaugugugucugucuac

SEQ ID NO: 935897 - RNA, 20 nt, Human
uuaaaguuucagagugagcu

SEQ ID NO: 935898 - RNA, 21 nt, Human
uuaacagauuaaacauuaagu

SEQ ID NO: 935899 - RNA, 21 nt, Human
uuagaaaaugccucaaaguua

SEQ ID NO: 935900 - RNA, 22 nt, Human
uuggccucacagagcauuagaa

SEQ ID NO: 935901 - RNA, 22 nt, Human
uuucuagcuuuaacucaaaaau

SEQ ID NO: 935902 - RNA, 24 nt, Human
uuucugaaaggugcauauauuacc

SEQ ID NO: 935903 - RNA, 18 nt, Human
aaaaugccagcccggugg

SEQ ID NO: 935904 - RNA, 20 nt, Human
accaucccaaacugcaguga

SEQ ID NO: 935905 - RNA, 24 nt, Human
agaaacacuuuccuggagcccagg

SEQ ID NO: 935906 - RNA, 22 nt, Human
agcugccagcccuccugaccuc

SEQ ID NO: 935907 - RNA, 21 nt, Human
aggccccugacccagcccccu

SEQ ID NO: 935908 - RNA, 23 nt, Human
caagagagguggaggauguggcg

SEQ ID NO: 935909 - RNA, 24 nt, Human
cacaaaaugccagcccgguggccc

SEQ ID NO: 935910 - RNA, 21 nt, Human
cacacagacgagaugcaggga

SEQ ID NO: 935911 - RNA, 19 nt, Human
cacccugggcacacagacg

SEQ ID NO: 935912 - RNA, 18 nt, Human
cagcccugacugacccca

SEQ ID NO: 935913 - RNA, 24 nt, Human
caggccccugacccagcccccuua

SEQ ID NO: 935914 - RNA, 20 nt, Human
cagggacagcaacagggaag

SEQ ID NO: 935915 - RNA, 21 nt, Human
cccaaacugcagugaccccug

SEQ ID NO: 935916 - RNA, 23 nt, Human
cccggacacccugggcacacaga

SEQ ID NO: 935917 - RNA, 20 nt, Human
cccgguggcccucggacgcu

SEQ ID NO: 935918 - RNA, 21 nt, Human
ccucccagaaacacuuuccug

SEQ ID NO: 935919 - RNA, 23 nt, Human
ccucccagaaacacuuuccugga

SEQ ID NO: 935920 - RNA, 25 nt, Human
ccucccagaaacacuuuccuggagc

SEQ ID NO: 935921 - RNA, 22 nt, Human
cugcagugaccccugccccagc

SEQ ID NO: 935922 - RNA, 21 nt, Human
gacccagcccccuuaagccag

SEQ ID NO: 935923 - RNA, 22 nt, Human
gaugcagggacagcaacaggga

SEQ ID NO: 935924 - RNA, 20 nt, Human
gcagggagcggaaggugggc

SEQ ID NO: 935925 - RNA, 24 nt, Human
gccccagcccugacugaccccacu

SEQ ID NO: 935926 - RNA, 19 nt, Human
gcguucagcugccagcccu

SEQ ID NO: 935927 - RNA, 21 nt, Human
gcguucagcugccagcccucc

SEQ ID NO: 935928 - RNA, 28 nt, Human
gcugggacccuagucucagcuccccggg

SEQ ID NO: 935929 - RNA, 21 nt, Human
gcuugacccuggcccggcaac

SEQ ID NO: 935930 - RNA, 20 nt, Human
ggacccuagucucagcuccc

SEQ ID NO: 935931 - RNA, 23 nt, Human
uagaaaauacagcauucaaccau

SEQ ID NO: 935932 - RNA, 22 nt, Human
ucccagaaacacuuuccuggag

SEQ ID NO: 935933 - RNA, 21 nt, Human
uccccggacacccugggcaca

SEQ ID NO: 935934 - RNA, 21 nt, Human
uccgcgccgucggagcccucc

SEQ ID NO: 935935 - RNA, 19 nt, Human
uccuggagcccaggaagga

SEQ ID NO: 935936 - RNA, 24 nt, Human
ucggagcccuccgcuugacccugg

SEQ ID NO: 935937 - RNA, 19 nt, Human
ugacccagcccccuuaagc

SEQ ID NO: 935938 - RNA, 26 nt, Human
ugacccagcccccuuaagccagccag

SEQ ID NO: 935939 - RNA, 21 nt, Human
ugaccccacuucuuguggcca

SEQ ID NO: 935940 - RNA, 18 nt, Human
ugaccccugccccagccc

SEQ ID NO: 935941 - RNA, 18 nt, Human
ugaccucccagaaacacu

SEQ ID NO: 935942 - RNA, 24 nt, Human
ugaccucccagaaacacuuuccug

SEQ ID NO: 935943 - RNA, 23 nt, Human
ugccaggccccugacccagcccc

SEQ ID NO: 935944 - RNA, 21 nt, Human
ugccccagcccugacugaccc

SEQ ID NO: 935945 - RNA, 22 nt, Human
uggaggauguggcggaggcugu

SEQ ID NO: 935946 - RNA, 25 nt, Human
uggcagggagcggaaggugggcagc

SEQ ID NO: 935947 - RNA, 19 nt, Human
uggccaaagguuucugggc

SEQ ID NO: 935948 - RNA, 28 nt, Human
uggcccggcaacgcucgcuggaccaaga

SEQ ID NO: 935949 - RNA, 23 nt, Human
ugguggcagggagcggaaggugg

SEQ ID NO: 935950 - RNA, 21 nt, Human
ugugcugggacccuagucuca

SEQ ID NO: 935951 - RNA, 23 nt, Human
uguggccaaagguuucugggcug

SEQ ID NO: 935952 - RNA, 25 nt, Human
aaaaaaaaaaaaucaaugguuaagc

SEQ ID NO: 935953 - RNA, 23 nt, Human
aaaaauuagccaaaaauuuguga

SEQ ID NO: 935954 - RNA, 23 nt, Human
aaaaugcugacaucauuuauaau

SEQ ID NO: 935955 - RNA, 24 nt, Human
aaacaaaaauaaguugguaaacac

SEQ ID NO: 935956 - RNA, 20 nt, Human
aaaccagucuuuaauuuuca

SEQ ID NO: 935957 - RNA, 18 nt, Human
aaagguauguaauuauua

SEQ ID NO: 935958 - RNA, 20 nt, Human
aaauaaccaagggccuccag

SEQ ID NO: 935959 - RNA, 19 nt, Human
aacacacuucugauaagua

SEQ ID NO: 935960 - RNA, 23 nt, Human
aacacacuucugauaaguauggg

SEQ ID NO: 935961 - RNA, 21 nt, Human
aacagaaaagaagugcacuga

SEQ ID NO: 935962 - RNA, 23 nt, Human
aacauuaauacacaucaccauuu

SEQ ID NO: 935963 - RNA, 24 nt, Human
aacuaguggaacugagcuuuacaa

SEQ ID NO: 935964 - RNA, 19 nt, Human
aagaacaccacagaauuga

SEQ ID NO: 935965 - RNA, 25 nt, Human
aagaagugcacugagguuuaccccc

SEQ ID NO: 935966 - RNA, 18 nt, Human
aagugcacugagguuuac

SEQ ID NO: 935967 - RNA, 24 nt, Human
aagugcuuuuaguauuaaaguuuu

SEQ ID NO: 935968 - RNA, 23 nt, Human
aauacugaggccaacagaaaaga

SEQ ID NO: 935969 - RNA, 18 nt, Human
aauauacuccacuugaaa

SEQ ID NO: 935970 - RNA, 24 nt, Human
aauccaguaauacugaggccaaca

SEQ ID NO: 935971 - RNA, 24 nt, Human
aaugaugcaaagaaacugaagucu

SEQ ID NO: 935972 - RNA, 19 nt, Human
acaaagcaucucuaccuuu

SEQ ID NO: 935973 - RNA, 22 nt, Human
acaagaagcagcaauucuucaa

SEQ ID NO: 935974 - RNA, 20 nt, Human
acagaaaagaagugcacuga

SEQ ID NO: 935975 - RNA, 24 nt, Human
acauauauacacacaaacauauua

SEQ ID NO: 935976 - RNA, 23 nt, Human
accauauauacaauccaaacacu

SEQ ID NO: 935977 - RNA, 23 nt, Human
accaucuuuuauguucuuugcca

SEQ ID NO: 935978 - RNA, 27 nt, Human
acccaaauacagagguugccaaaucug

SEQ ID NO: 935979 - RNA, 18 nt, Human
acuuccagaguuuuccuu

SEQ ID NO: 935980 - RNA, 22 nt, Human
agaacacuaucagauaguuucc

SEQ ID NO: 935981 - RNA, 20 nt, Human
aggaagcaagaauguagaau

SEQ ID NO: 935982 - RNA, 24 nt, Human
aggaggcggcgguggucguggcgg

SEQ ID NO: 935983 - RNA, 24 nt, Human
aggcauuccuauaauuagccauau

SEQ ID NO: 935984 - RNA, 30 nt, Human
aggcggcggcgacacaggcgguggcggugg

SEQ ID NO: 935985 - RNA, 18 nt, Human
aggcgguggcgguggcug

SEQ ID NO: 935986 - RNA, 21 nt, Human
aggcgguggcgguggcugcag

SEQ ID NO: 935987 - RNA, 22 nt, Human
aggcgguggcgguggcugcagg

SEQ ID NO: 935988 - RNA, 20 nt, Human
aggcgguggcgguggcugcc

SEQ ID NO: 935989 - RNA, 23 nt, Human
agugcacugcagaaugaccaaug

SEQ ID NO: 935990 - RNA, 22 nt, Human
auaaaaagcaaauuucaucaca

SEQ ID NO: 935991 - RNA, 24 nt, Human
auaaccaagggccuccagaggccc

SEQ ID NO: 935992 - RNA, 24 nt, Human
aucacuguaagacuugguaaaaaa

SEQ ID NO: 935993 - RNA, 20 nt, Human
aucugucuagcuugaggccu

SEQ ID NO: 935994 - RNA, 23 nt, Human
augauaagugaaaugaaccuccu

SEQ ID NO: 935995 - RNA, 18 nt, Human
augaugauaaaugcaugu

SEQ ID NO: 935996 - RNA, 20 nt, Human
auuauauuuccugaaacucc

SEQ ID NO: 935997 - RNA, 25 nt, Human
auucuuuucucaggcccucccuguu

SEQ ID NO: 935998 - RNA, 19 nt, Human
auuuguaaaaagaugagga

SEQ ID NO: 935999 - RNA, 19 nt, Human
caacagaaaagaagugcac

SEQ ID NO: 936000 - RNA, 19 nt, Human
caacuaaaaagagauggca

SEQ ID NO: 936001 - RNA, 23 nt, Human
caagaacaccacagaauugagga

SEQ ID NO: 936002 - RNA, 21 nt, Human
cacagaauugaggaauauguu

SEQ ID NO: 936003 - RNA, 21 nt, Human
cagacaguauaaauauauggu

SEQ ID NO: 936004 - RNA, 22 nt, Human
cagaguuuuccuucaacuaaaa

SEQ ID NO: 936005 - RNA, 23 nt, Human
cagcaauucuucaauccaguaau

SEQ ID NO: 936006 - RNA, 23 nt, Human
caggauaaccacucuuauggggg

SEQ ID NO: 936007 - RNA, 23 nt, Human
caggucagaacucuuguaaaaug

SEQ ID NO: 936008 - RNA, 18 nt, Human
ccaacagaaaagaagugc

SEQ ID NO: 936009 - RNA, 23 nt, Human
ccagaguuuuccuucaacuaaaa

SEQ ID NO: 936010 - RNA, 21 nt, Human
ccauccaggucagaacucuug

SEQ ID NO: 936011 - RNA, 21 nt, Human
cccacagaacuauaaccacac

SEQ ID NO: 936012 - RNA, 21 nt, Human
ccccuguucuuccuuuugccc

SEQ ID NO: 936013 - RNA, 21 nt, Human
ccuauggaagcuucauuagac

SEQ ID NO: 936014 - RNA, 22 nt, Human
ccucucucucaauaaacgcaaa

SEQ ID NO: 936015 - RNA, 23 nt, Human
cggcucggagcagagcgcguacc

SEQ ID NO: 936016 - RNA, 18 nt, Human
cuauaaccacacaucccc

SEQ ID NO: 936017 - RNA, 19 nt, Human
cucucgcacuaaguuuuua

SEQ ID NO: 936018 - RNA, 25 nt, Human
cucuguggauuucaaucagguuccc

SEQ ID NO: 936019 - RNA, 24 nt, Human
cuuauacuuccacuucccuuuaaa

SEQ ID NO: 936020 - RNA, 20 nt, Human
cuuugaguccuuuacauuuu

SEQ ID NO: 936021 - RNA, 19 nt, Human
gagcggcgguggcggcgau

SEQ ID NO: 936022 - RNA, 18 nt, Human
gaggcacauauauacaca

SEQ ID NO: 936023 - RNA, 27 nt, Human
gaggcggcggcgacacaggcgguggcg

SEQ ID NO: 936024 - RNA, 30 nt, Human
gaggcggcggcgacacaggcgguggcggug

SEQ ID NO: 936025 - RNA, 21 nt, Human
gaggcggcgguggucguggcg

SEQ ID NO: 936026 - RNA, 18 nt, Human
gaugcaaagaaacugaag

SEQ ID NO: 936027 - RNA, 19 nt, Human
gcccccucccauucuuuuc

SEQ ID NO: 936028 - RNA, 19 nt, Human
gcggcgguggcggcgaugc

SEQ ID NO: 936029 - RNA, 23 nt, Human
gcgguggcgguggcugcagggca

SEQ ID NO: 936030 - RNA, 23 nt, Human
ggaagcuucauuagacuuacuaa

SEQ ID NO: 936031 - RNA, 20 nt, Human
ggagaaaacugaggcucaga

SEQ ID NO: 936032 - RNA, 18 nt, Human
ggcggagcggcgguggcg

SEQ ID NO: 936033 - RNA, 20 nt, Human
ggcggagcggcgguggcggc

SEQ ID NO: 936034 - RNA, 30 nt, Human
ggcggcgacacaggcgguggcgguggcugg

SEQ ID NO: 936035 - RNA, 19 nt, Human
ggcucggagcagagcgcgu

SEQ ID NO: 936036 - RNA, 20 nt, Human
gggccuccagaggccccugu

SEQ ID NO: 936037 - RNA, 19 nt, Human
gugcuuugaguaugaaguu

SEQ ID NO: 936038 - RNA, 19 nt, Human
guggcggagcggcgguggc

SEQ ID NO: 936039 - RNA, 22 nt, Human
guggcggagcggcgguggcggc

SEQ ID NO: 936040 - RNA, 25 nt, Human
guggcggagcggcgguggcggcgau

SEQ ID NO: 936041 - RNA, 22 nt, Human
uaaaaaaaaaaaaaaaucaaug

SEQ ID NO: 936042 - RNA, 24 nt, Human
uaaaaagaugaggacacacauuaa

SEQ ID NO: 936043 - RNA, 23 nt, Human
uaaaauaaucacuguaagacuug

SEQ ID NO: 936044 - RNA, 24 nt, Human
uaaaccacauaaggucuaguguuc

SEQ ID NO: 936045 - RNA, 18 nt, Human
uaaagagcauauucuaca

SEQ ID NO: 936046 - RNA, 19 nt, Human
uaaccacucuuaugggggc

SEQ ID NO: 936047 - RNA, 21 nt, Human
uaauagcccccucccauucuu

SEQ ID NO: 936048 - RNA, 23 nt, Human
uaaugauaagugaaaugaaccuc

SEQ ID NO: 936049 - RNA, 21 nt, Human
uacaaaccaaggcuguccucu

SEQ ID NO: 936050 - RNA, 19 nt, Human
uacaagauacaaaauauuu

SEQ ID NO: 936051 - RNA, 22 nt, Human
uacugcaugauuuggggaaagg

SEQ ID NO: 936052 - RNA, 24 nt, Human
uagacaaagacaucuagauuuaga

SEQ ID NO: 936053 - RNA, 21 nt, Human
uagcaccauauauacaaucca

SEQ ID NO: 936054 - RNA, 23 nt, Human
uagcaccauauauacaauccaaa

SEQ ID NO: 936055 - RNA, 20 nt, Human
uagcagaaacccauuucuuu

SEQ ID NO: 936056 - RNA, 22 nt, Human
uaguuuucauuaaucaugaugg

SEQ ID NO: 936057 - RNA, 22 nt, Human
uauauacaauccaaacacugca

SEQ ID NO: 936058 - RNA, 19 nt, Human
uauaugguugaacuaacau

SEQ ID NO: 936059 - RNA, 25 nt, Human
uaucucaaguuccacuuccaguagc

SEQ ID NO: 936060 - RNA, 19 nt, Human
uauuaacauguauggcaga

SEQ ID NO: 936061 - RNA, 23 nt, Human
ucaaaaaaaauuagacaaagaca

SEQ ID NO: 936062 - RNA, 19 nt, Human
ucaaugaugauaaaugcau

SEQ ID NO: 936063 - RNA, 21 nt, Human
ucacuugucugcauagagguc

SEQ ID NO: 936064 - RNA, 21 nt, Human
ucauacagccggucccgaggc

SEQ ID NO: 936065 - RNA, 23 nt, Human
ucauuggugaccaaaaucuggug

SEQ ID NO: 936066 - RNA, 20 nt, Human
uccaaacccaaguaaccaaa

SEQ ID NO: 936067 - RNA, 19 nt, Human
uccaggauaaccacucuua

SEQ ID NO: 936068 - RNA, 20 nt, Human
ucuuuucucaggcccucccu

SEQ ID NO: 936069 - RNA, 28 nt, Human
ugaaccuccuaacaagaagcagcaauuc

SEQ ID NO: 936070 - RNA, 23 nt, Human
ugaacuaacauuaauacacauca

SEQ ID NO: 936071 - RNA, 19 nt, Human
ugacaaaauuauuucuccc

SEQ ID NO: 936072 - RNA, 23 nt, Human
ugaccaaaaucuggugacaccau

SEQ ID NO: 936073 - RNA, 18 nt, Human
ugagcaggcaaauaacca

SEQ ID NO: 936074 - RNA, 20 nt, Human
ugaugcaaagaaacugaagu

SEQ ID NO: 936075 - RNA, 18 nt, Human
ugcaaaggagaaaacuga

SEQ ID NO: 936076 - RNA, 24 nt, Human
ugcacaagacaaaggcaacauuuu

SEQ ID NO: 936077 - RNA, 19 nt, Human
uggcagacacuacuucaug

SEQ ID NO: 936078 - RNA, 21 nt, Human
uggcagacacuacuucaugua

SEQ ID NO: 936079 - RNA, 21 nt, Human
uggcgguggcugcagggcagg

SEQ ID NO: 936080 - RNA, 26 nt, Human
uggcugcagggcaggaggcggcggug

SEQ ID NO: 936081 - RNA, 19 nt, Human
ugggaaaaaaauuacaaga

SEQ ID NO: 936082 - RNA, 18 nt, Human
ugggaaggaaaaaaaaaa

SEQ ID NO: 936083 - RNA, 20 nt, Human
ugggcuggcugcuucuaggu

SEQ ID NO: 936084 - RNA, 21 nt, Human
ugguaaaaaaaaaaaaaaauu

SEQ ID NO: 936085 - RNA, 20 nt, Human
uggucguggcggagcggcgg

SEQ ID NO: 936086 - RNA, 20 nt, Human
ugugacugcaugccugggcu

SEQ ID NO: 936087 - RNA, 23 nt, Human
ugugugaccaagaacaccacaga

SEQ ID NO: 936088 - RNA, 26 nt, Human
uuaauagcccccucccauucuuuucu

SEQ ID NO: 936089 - RNA, 19 nt, Human
uucaaaauuaucuagaccu

SEQ ID NO: 936090 - RNA, 22 nt, Human
uucauuagcagaaacccauuuc

SEQ ID NO: 936091 - RNA, 18 nt, Human
uugguggagcaguaauca

SEQ ID NO: 936092 - RNA, 19 nt, Human
uuucuccucaguacacaau

SEQ ID NO: 936093 - RNA, 21 nt, Human
agguaaucuugguuauucugg

SEQ ID NO: 936094 - RNA, 18 nt, Human
uuuuuuuuuuuuuuuuug

SEQ ID NO: 936095 - RNA, 21 nt, Human
aaaagcuacccccaccaaccc

SEQ ID NO: 936096 - RNA, 22 nt, Human
aaaccccucuucagccugugcu

SEQ ID NO: 936097 - RNA, 22 nt, Human
aaguccuccuugagcaccuuuc

SEQ ID NO: 936098 - RNA, 23 nt, Human
aaguccuccuugagcaccuuucc

SEQ ID NO: 936099 - RNA, 18 nt, Human
aauagagaauugucuaga

SEQ ID NO: 936100 - RNA, 20 nt, Human
aauggaggagcaaagaggga

SEQ ID NO: 936101 - RNA, 18 nt, Human
agaaaccccucuucagcc

SEQ ID NO: 936102 - RNA, 21 nt, Human
agagggaaaagcuacccccac

SEQ ID NO: 936103 - RNA, 23 nt, Human
agcgcuggugacgccaggagaaa

SEQ ID NO: 936104 - RNA, 21 nt, Human
caaaccggacagaccggggca

SEQ ID NO: 936105 - RNA, 23 nt, Human
caccaacccagcgcuggugacgc

SEQ ID NO: 936106 - RNA, 23 nt, Human
cacccagcagccgcugccgccau

SEQ ID NO: 936107 - RNA, 18 nt, Human
ccagcgcuggugacgcca

SEQ ID NO: 936108 - RNA, 22 nt, Human
ccaggagaaagcgauccucucc

SEQ ID NO: 936109 - RNA, 27 nt, Human
ccccgccgcgcggccgccgcagccgca

SEQ ID NO: 936110 - RNA, 24 nt, Human
cccgccgcgcggccgccgcagccg

SEQ ID NO: 936111 - RNA, 26 nt, Human
cccgccgcgcggccgccgcagccgca

SEQ ID NO: 936112 - RNA, 24 nt, Human
cccgggccgcggcgcgcucauggg

SEQ ID NO: 936113 - RNA, 22 nt, Human
cccggggccccgccgcgcggcc

SEQ ID NO: 936114 - RNA, 22 nt, Human
ccgcgcggccgccgcagccgca

SEQ ID NO: 936115 - RNA, 20 nt, Human
cgccgcgcggccgccgcagc

SEQ ID NO: 936116 - RNA, 20 nt, Human
cucuccggaugggacgaaca

SEQ ID NO: 936117 - RNA, 22 nt, Human
cuugagcaccuuucccagguua

SEQ ID NO: 936118 - RNA, 23 nt, Human
cuuuaaugauugccagaauugcc

SEQ ID NO: 936119 - RNA, 21 nt, Human
gaggagcaaagagggaaaagc

SEQ ID NO: 936120 - RNA, 22 nt, Human
gccagcccgggccgcggcgcgc

SEQ ID NO: 936121 - RNA, 19 nt, Human
gccgcagccgcacccgcac

SEQ ID NO: 936122 - RNA, 18 nt, Human
gccgcgcggccgccgcag

SEQ ID NO: 936123 - RNA, 19 nt, Human
gcucccgcucccgcauccu

SEQ ID NO: 936124 - RNA, 19 nt, Human
ggccuccagcugcucaccc

SEQ ID NO: 936125 - RNA, 21 nt, Human
ggccuccagcugcucacccag

SEQ ID NO: 936126 - RNA, 23 nt, Human
uaagcuguaaacgcuucacauga

SEQ ID NO: 936127 - RNA, 21 nt, Human
ucaagaauggaggagcaaaga

SEQ ID NO: 936128 - RNA, 22 nt, Human
ucaagaauggaggagcaaagag

SEQ ID NO: 936129 - RNA, 18 nt, Human
ucccagguuagaaacccc

SEQ ID NO: 936130 - RNA, 19 nt, Human
ucccagugccacgcugcgu

SEQ ID NO: 936131 - RNA, 24 nt, Human
uccucggggccgcgcgccccgcuc

SEQ ID NO: 936132 - RNA, 22 nt, Human
uccuugagcaccuuucccaggu

SEQ ID NO: 936133 - RNA, 21 nt, Human
ugaguuaggcaagcgcuuuuu

SEQ ID NO: 936134 - RNA, 24 nt, Human
ugcaaaccggacagaccggggcag

SEQ ID NO: 936135 - RNA, 22 nt, Human
ugccgccauuaaaaagcaacgg

SEQ ID NO: 936136 - RNA, 19 nt, Human
uguaaacgcuucacaugac

SEQ ID NO: 936137 - RNA, 19 nt, Human
uuaagauagaaaucuaugc

SEQ ID NO: 936138 - RNA, 18 nt, Human
uugcccagcauagcuuca

SEQ ID NO: 936139 - RNA, 20 nt, Human
uuuaagauagaaaucuaugc

SEQ ID NO: 936140 - RNA, 24 nt, Human
aaacaaaacauccaaaugacccaa

SEQ ID NO: 936141 - RNA, 22 nt, Human
aaagggagggagggcagagagg

SEQ ID NO: 936142 - RNA, 19 nt, Human
aaagugccuggguucagag

SEQ ID NO: 936143 - RNA, 22 nt, Human
aaaugacccaagauaaccacac

SEQ ID NO: 936144 - RNA, 21 nt, Human
aagaugaccagaacacacuga

SEQ ID NO: 936145 - RNA, 26 nt, Human
aagaugaccagaacacacugagagua

SEQ ID NO: 936146 - RNA, 19 nt, Human
aaucugaauuguuccagcu

SEQ ID NO: 936147 - RNA, 21 nt, Human
aaucugaauuguuccagcucc

SEQ ID NO: 936148 - RNA, 18 nt, Human
acacauguacacagcccc

SEQ ID NO: 936149 - RNA, 24 nt, Human
acagaaacaaacaaaacauccaaa

SEQ ID NO: 936150 - RNA, 21 nt, Human
accuagaagcacagaaagcuc

SEQ ID NO: 936151 - RNA, 22 nt, Human
agagagguguugcucagccuuc

SEQ ID NO: 936152 - RNA, 24 nt, Human
aggcauuaggacaggccccaaacu

SEQ ID NO: 936153 - RNA, 21 nt, Human
augacccaagauaaccacacc

SEQ ID NO: 936154 - RNA, 19 nt, Human
caaaacauccaaaugaccc

SEQ ID NO: 936155 - RNA, 27 nt, Human
caaacaaaacauccaaaugacccaaga

SEQ ID NO: 936156 - RNA, 24 nt, Human
caaaggcagaauucuuuaggacaa

SEQ ID NO: 936157 - RNA, 24 nt, Human
cacaaauuuaaaaaaauuuaacac

SEQ ID NO: 936158 - RNA, 23 nt, Human
cacacagaaacaaacaaaacauc

SEQ ID NO: 936159 - RNA, 24 nt, Human
cacacagaaacaaacaaaacaucc

SEQ ID NO: 936160 - RNA, 21 nt, Human
cacagaaagcucagcccuuac

SEQ ID NO: 936161 - RNA, 26 nt, Human
cacagccccacggccaacccuccaga

SEQ ID NO: 936162 - RNA, 24 nt, Human
cacagccccacggccaacccuccu

SEQ ID NO: 936163 - RNA, 21 nt, Human
cagccccacggccaacccucc

SEQ ID NO: 936164 - RNA, 23 nt, Human
cagccuucagccugacccccagu

SEQ ID NO: 936165 - RNA, 21 nt, Human
caggguuuccuuagcaucagg

SEQ ID NO: 936166 - RNA, 23 nt, Human
cagucugacacacagaaacaaac

SEQ ID NO: 936167 - RNA, 18 nt, Human
ccaagauaaccacaccau

SEQ ID NO: 936168 - RNA, 23 nt, Human
ccacagcuacugguuccucuugc

SEQ ID NO: 936169 - RNA, 20 nt, Human
ccagaacacacugagaguac

SEQ ID NO: 936170 - RNA, 22 nt, Human
cccacggccaacccuccagaag

SEQ ID NO: 936171 - RNA, 21 nt, Human
ccccugggcacacacaugguc

SEQ ID NO: 936172 - RNA, 19 nt, Human
cggccaacccuccagaagc

SEQ ID NO: 936173 - RNA, 23 nt, Human
cuacaacuaagccacaagaugac

SEQ ID NO: 936174 - RNA, 23 nt, Human
cucagccuucagccugaccccca

SEQ ID NO: 936175 - RNA, 19 nt, Human
gaagcacagaaagcucagc

SEQ ID NO: 936176 - RNA, 23 nt, Human
gagaugggacaaagggagggagg

SEQ ID NO: 936177 - RNA, 21 nt, Human
gaggagcuugaaguagcagca

SEQ ID NO: 936178 - RNA, 20 nt, Human
gcaguaggaggcaagcagag

SEQ ID NO: 936179 - RNA, 20 nt, Human
gcaguaggaggcaagcagag

SEQ ID NO: 936180 - RNA, 20 nt, Human
gccaacccuccagaagcugg

SEQ ID NO: 936181 - RNA, 21 nt, Human
gccaacccuccagaagcuggg

SEQ ID NO: 936182 - RNA, 24 nt, Human
gcgggugaaucugaauuguuccag

SEQ ID NO: 936183 - RNA, 19 nt, Human
ggagaugggacaaagggag

SEQ ID NO: 936184 - RNA, 22 nt, Human
ggagaugggacaaagggaggga

SEQ ID NO: 936185 - RNA, 22 nt, Human
ggagggagggcagagagguguu

SEQ ID NO: 936186 - RNA, 20 nt, Human
ggcagagagguguugcucag

SEQ ID NO: 936187 - RNA, 19 nt, Human
gggagaugggacaaaggga

SEQ ID NO: 936188 - RNA, 24 nt, Human
ggguguccggucucaauugcucca

SEQ ID NO: 936189 - RNA, 18 nt, Human
ggguguguguggugaugu

SEQ ID NO: 936190 - RNA, 23 nt, Human
gugcaguaggaggcaagcagagg

SEQ ID NO: 936191 - RNA, 21 nt, Human
guucagaggugcccauuccuu

SEQ ID NO: 936192 - RNA, 24 nt, Human
uaauuugcuacaauccugucacaa

SEQ ID NO: 936193 - RNA, 19 nt, Human
uacacagccccacggccaa

SEQ ID NO: 936194 - RNA, 19 nt, Human
uacagucugacacacagaa

SEQ ID NO: 936195 - RNA, 20 nt, Human
uacuaauccagguuaggcac

SEQ ID NO: 936196 - RNA, 26 nt, Human
uagaaauacaggccuaaaugaugcca

SEQ ID NO: 936197 - RNA, 21 nt, Human
uagcagcaauacauguaggag

SEQ ID NO: 936198 - RNA, 21 nt, Human
uaggacaggccccaaacugag

SEQ ID NO: 936199 - RNA, 22 nt, Human
uaggacaggccccaaacugaga

SEQ ID NO: 936200 - RNA, 19 nt, Human
uaggaggcaagcagaggca

SEQ ID NO: 936201 - RNA, 23 nt, Human
uauauacucaacgguaauuugaa

SEQ ID NO: 936202 - RNA, 18 nt, Human
ucagagccucagcugaaa

SEQ ID NO: 936203 - RNA, 21 nt, Human
ucagauagucugauccucucc

SEQ ID NO: 936204 - RNA, 22 nt, Human
uccagcuccaccuagaagcaca

SEQ ID NO: 936205 - RNA, 23 nt, Human
ucccaucuccccuugggaaaauc

SEQ ID NO: 936206 - RNA, 19 nt, Human
uccugggugcugagugugc

SEQ ID NO: 936207 - RNA, 18 nt, Human
uccuuagcaucagggcgg

SEQ ID NO: 936208 - RNA, 25 nt, Human
ucuacaacuaagccacaagaugacc

SEQ ID NO: 936209 - RNA, 18 nt, Human
ucucagaaggccaaacau

SEQ ID NO: 936210 - RNA, 24 nt, Human
ucuccuuugaaaugcaauggagac

SEQ ID NO: 936211 - RNA, 22 nt, Human
ugacacacagaaacaaacaaaa

SEQ ID NO: 936212 - RNA, 21 nt, Human
ugacacugucccaucuccccu

SEQ ID NO: 936213 - RNA, 18 nt, Human
ugacccaagauaaccaca

SEQ ID NO: 936214 - RNA, 20 nt, Human
ugcaguaggaggcaagcaga

SEQ ID NO: 936215 - RNA, 23 nt, Human
ugcaguaggaggcaagcagaggc

SEQ ID NO: 936216 - RNA, 19 nt, Human
ugcccauuccuuucccaca

SEQ ID NO: 936217 - RNA, 20 nt, Human
ugcccauuccuuucccacag

SEQ ID NO: 936218 - RNA, 22 nt, Human
ugcccuugggaaagaggaauga

SEQ ID NO: 936219 - RNA, 20 nt, Human
uggaggagcuugaaguagca

SEQ ID NO: 936220 - RNA, 18 nt, Human
uuccagcuccaccuagaa

SEQ ID NO: 936221 - RNA, 21 nt, Human
uuucucagaaggccaaacauu

SEQ ID NO: 936222 - RNA, 23 nt, Human
uuuuuuuuuuuuuuuuuuaaaug

SEQ ID NO: 936223 - RNA, 19 nt, Human
aaaaaagccucgaggcccc

SEQ ID NO: 936224 - RNA, 23 nt, Human
aagcacacccccucuccuaggcc

SEQ ID NO: 936225 - RNA, 22 nt, Human
aaugccauuuccugcgagcagc

SEQ ID NO: 936226 - RNA, 18 nt, Human
accuccucuuccuccccc

SEQ ID NO: 936227 - RNA, 23 nt, Human
agaaaaaaagccucgaggccccg

SEQ ID NO: 936228 - RNA, 20 nt, Human
agagaugaugagaauuuuga

SEQ ID NO: 936229 - RNA, 18 nt, Human
agaggcgaggccaaaacc

SEQ ID NO: 936230 - RNA, 22 nt, Human
agccggcgaccucuccuaccuc

SEQ ID NO: 936231 - RNA, 22 nt, Human
agccuuguuuguggcaauucua

SEQ ID NO: 936232 - RNA, 24 nt, Human
agcggucgcgccacgacccggagc

SEQ ID NO: 936233 - RNA, 26 nt, Human
aguuuuccaacacauaucccagaucu

SEQ ID NO: 936234 - RNA, 19 nt, Human
aucucuuccuccucccuca

SEQ ID NO: 936235 - RNA, 19 nt, Human
caaaguuuuuuugaguucu

SEQ ID NO: 936236 - RNA, 23 nt, Human
caagucucuuuccucucccgcuc

SEQ ID NO: 936237 - RNA, 25 nt, Human
caagucucuuuccucucccgcuccu

SEQ ID NO: 936238 - RNA, 19 nt, Human
caccacaaaauuucauaaa

SEQ ID NO: 936239 - RNA, 19 nt, Human
caccccccuccuucuccac

SEQ ID NO: 936240 - RNA, 19 nt, Human
caccccccuccuucuccac

SEQ ID NO: 936241 - RNA, 18 nt, Human
cacccccucuccuaggcc

SEQ ID NO: 936242 - RNA, 21 nt, Human
cagcaccaccucaugcugcug

SEQ ID NO: 936243 - RNA, 19 nt, Human
cagcgccccccgagcagcc

SEQ ID NO: 936244 - RNA, 24 nt, Human
cauuauggcacagugaacauaagg

SEQ ID NO: 936245 - RNA, 18 nt, Human
ccccaaaagugcgugggg

SEQ ID NO: 936246 - RNA, 21 nt, Human
ccccccuccuucuccaccucc

SEQ ID NO: 936247 - RNA, 23 nt, Human
cccggagccgccagcaccaccuc

SEQ ID NO: 936248 - RNA, 20 nt, Human
cccucaagcacacccccucu

SEQ ID NO: 936249 - RNA, 22 nt, Human
cccucaagcacacccccucucc

SEQ ID NO: 936250 - RNA, 18 nt, Human
cccugggacccaggaguc

SEQ ID NO: 936251 - RNA, 20 nt, Human
ccgaccccugggacccagga

SEQ ID NO: 936252 - RNA, 19 nt, Human
ccgcguccucucggcugga

SEQ ID NO: 936253 - RNA, 23 nt, Human
ccgcucaggcccaauuccgaccc

SEQ ID NO: 936254 - RNA, 22 nt, Human
ccggcgaccucuccuaccuccc

SEQ ID NO: 936255 - RNA, 25 nt, Human
ccuaggccgcagcauagcaaccgaa

SEQ ID NO: 936256 - RNA, 23 nt, Human
ccucaagcacacccccucuccua

SEQ ID NO: 936257 - RNA, 19 nt, Human
ccucaugcugcugggcagc

SEQ ID NO: 936258 - RNA, 19 nt, Human
ccuccgaccccgcggccaa

SEQ ID NO: 936259 - RNA, 20 nt, Human
ccuccuccucuaucucuucc

SEQ ID NO: 936260 - RNA, 21 nt, Human
ccuccuucuccaccuccucuu

SEQ ID NO: 936261 - RNA, 21 nt, Human
ccuggccccaauccuccgacc

SEQ ID NO: 936262 - RNA, 24 nt, Human
cgaccccugggacccaggaguccu

SEQ ID NO: 936263 - RNA, 19 nt, Human
cgaccucuccuaccucccu

SEQ ID NO: 936264 - RNA, 18 nt, Human
cgaggccaaaacccugcc

SEQ ID NO: 936265 - RNA, 25 nt, Human
cgaggccaaaacccugccucgcuag

SEQ ID NO: 936266 - RNA, 20 nt, Human
cgcggccaaagccaagucuc

SEQ ID NO: 936267 - RNA, 22 nt, Human
cggaaaagcgcacugcgcggcg

SEQ ID NO: 936268 - RNA, 21 nt, Human
cggcggcggcagcaacaggag

SEQ ID NO: 936269 - RNA, 22 nt, Human
cuccuccuccucuaucucuucc

SEQ ID NO: 936270 - RNA, 23 nt, Human
cucuaucucuuccuccucccuca

SEQ ID NO: 936271 - RNA, 21 nt, Human
cuuuuugcuuucaugauacag

SEQ ID NO: 936272 - RNA, 22 nt, Human
gagguggcagggaggcgggcag

SEQ ID NO: 936273 - RNA, 20 nt, Human
gcaccaccacaaaauuucau

SEQ ID NO: 936274 - RNA, 26 nt, Human
gcacugcgcggcgugagcuggcgggu

SEQ ID NO: 936275 - RNA, 26 nt, Human
gcagcggucgcgccacgacccggagc

SEQ ID NO: 936276 - RNA, 21 nt, Human
gcauagcaaccgaacauggcg

SEQ ID NO: 936277 - RNA, 22 nt, Human
gccacgacccggagccgccagc

SEQ ID NO: 936278 - RNA, 22 nt, Human
gccgcagcggucgcgccacgac

SEQ ID NO: 936279 - RNA, 20 nt, Human
gcgcggcgugagcuggcggg

SEQ ID NO: 936280 - RNA, 21 nt, Human
gcgugggggagggggccuggc

SEQ ID NO: 936281 - RNA, 19 nt, Human
ggaggcgaucucgcgagag

SEQ ID NO: 936282 - RNA, 19 nt, Human
ggcagggaggcgggcagcc

SEQ ID NO: 936283 - RNA, 25 nt, Human
guggccaggagcggcggcggcagca

SEQ ID NO: 936284 - RNA, 20 nt, Human
uaaaaugccauuuccugcga

SEQ ID NO: 936285 - RNA, 20 nt, Human
uaauccacacccccaaaagu

SEQ ID NO: 936286 - RNA, 18 nt, Human
uaccucagcgccccccga

SEQ ID NO: 936287 - RNA, 23 nt, Human
uaccucagcgccccccgagcagc

SEQ ID NO: 936288 - RNA, 19 nt, Human
uacuucuuuuugcuuucau

SEQ ID NO: 936289 - RNA, 23 nt, Human
uacuucuuuuugcuuucaugaua

SEQ ID NO: 936290 - RNA, 22 nt, Human
uaggccgcagcauagcaaccga

SEQ ID NO: 936291 - RNA, 19 nt, Human
ucccucaagcacacccccu

SEQ ID NO: 936292 - RNA, 19 nt, Human
ucccugcagggaugagaua

SEQ ID NO: 936293 - RNA, 22 nt, Human
uccucuaucucuuccuccuccc

SEQ ID NO: 936294 - RNA, 18 nt, Human
uccuucuccaccuccucu

SEQ ID NO: 936295 - RNA, 18 nt, Human
ucuaucucuuccuccucc

SEQ ID NO: 936296 - RNA, 21 nt, Human
ucucggcuggagaaaaaaagc

SEQ ID NO: 936297 - RNA, 21 nt, Human
ugcgugggggagggggccugg

SEQ ID NO: 936298 - RNA, 22 nt, Human
ugcgugggggagggggccuggc

SEQ ID NO: 936299 - RNA, 20 nt, Human
uggcagggaggcgggcagcc

SEQ ID NO: 936300 - RNA, 19 nt, Human
ugggggagggggccuggcc

SEQ ID NO: 936301 - RNA, 19 nt, Human
uggugguggggcgcgagga

SEQ ID NO: 936302 - RNA, 23 nt, Human
uguccacacaaagucuucguaua

SEQ ID NO: 936303 - RNA, 21 nt, Human
ugugugagagugcaagaggag

SEQ ID NO: 936304 - RNA, 19 nt, Human
ugugugugagagugcaaga

SEQ ID NO: 936305 - RNA, 21 nt, Human
uuccaacacauaucccagauc

SEQ ID NO: 936306 - RNA, 21 nt, Human
uuccgaccccugggacccagg

SEQ ID NO: 936307 - RNA, 18 nt, Human
uugcauggcaccaccaca

SEQ ID NO: 936308 - RNA, 20 nt, Human
uuguaaaaugccauuuccug

SEQ ID NO: 936309 - RNA, 20 nt, Human
uuuuucagagcugacuccuc

SEQ ID NO: 936310 - RNA, 20 nt, Human
uuuuuuuucagagcugacuc

SEQ ID NO: 936311 - RNA, 23 nt, Human
uuuuuuuuuuuuuuuuuuuucag

SEQ ID NO: 936312 - RNA, 19 nt, Human
aaaaucucuccgaacugcc

SEQ ID NO: 936313 - RNA, 19 nt, Human
aaagaauggcgggagaaag

SEQ ID NO: 936314 - RNA, 24 nt, Human
aaaggaaccauccagcaaaagaaa

SEQ ID NO: 936315 - RNA, 21 nt, Human
aacacggagccccaggaacuu

SEQ ID NO: 936316 - RNA, 22 nt, Human
aacccagugucaccacaaacua

SEQ ID NO: 936317 - RNA, 20 nt, Human
aacgugcuuggcacucagga

SEQ ID NO: 936318 - RNA, 20 nt, Human
aacuguaucacuguaagaua

SEQ ID NO: 936319 - RNA, 24 nt, Human
aacuguaucacuguaagauauuga

SEQ ID NO: 936320 - RNA, 22 nt, Human
aagaacacauugcuacuggccc

SEQ ID NO: 936321 - RNA, 25 nt, Human
aagcaaagagagaguauggaaucac

SEQ ID NO: 936322 - RNA, 23 nt, Human
aagcugcauaaaggaaccaucca

SEQ ID NO: 936323 - RNA, 20 nt, Human
aaggaaggggcccuguggca

SEQ ID NO: 936324 - RNA, 20 nt, Human
acacacacacacacacagaa

SEQ ID NO: 936325 - RNA, 20 nt, Human
acagguaggagguucguagg

SEQ ID NO: 936326 - RNA, 18 nt, Human
accucacucagccagggg

SEQ ID NO: 936327 - RNA, 23 nt, Human
accucacucagccagggggugaa

SEQ ID NO: 936328 - RNA, 24 nt, Human
agaaaggcaaaugcucaucaaagg

SEQ ID NO: 936329 - RNA, 23 nt, Human
agacaggagaccucagaaaaaga

SEQ ID NO: 936330 - RNA, 25 nt, Human
agacagggccaagcugcauaaagga

SEQ ID NO: 936331 - RNA, 22 nt, Human
agaugcuaggaauuaagaacac

SEQ ID NO: 936332 - RNA, 21 nt, Human
agcaaaagaaaaagggcccca

SEQ ID NO: 936333 - RNA, 24 nt, Human
agcucggggccgcccagccgggcc

SEQ ID NO: 936334 - RNA, 23 nt, Human
aggaaauaggaaaucaggaacuu

SEQ ID NO: 936335 - RNA, 19 nt, Human
aggagauaagucauuacuu

SEQ ID NO: 936336 - RNA, 21 nt, Human
aggcaggaagagaugggcauc

SEQ ID NO: 936337 - RNA, 20 nt, Human
aggcuggccaacagguagga

SEQ ID NO: 936338 - RNA, 19 nt, Human
agggaaaggcugccuugcg

SEQ ID NO: 936339 - RNA, 20 nt, Human
agggagguauuuucuuagug

SEQ ID NO: 936340 - RNA, 20 nt, Human
aguaucguguguauauguau

SEQ ID NO: 936341 - RNA, 26 nt, Human
agugcacacacacacacacacagaau

SEQ ID NO: 936342 - RNA, 18 nt, Human
augcuaggaauuaagaac

SEQ ID NO: 936343 - RNA, 19 nt, Human
caacccaagcuaguccagg

SEQ ID NO: 936344 - RNA, 18 nt, Human
caagaagcaaggaguccu

SEQ ID NO: 936345 - RNA, 31 nt, Human
caauauauauuauauacacacguacauaugg

SEQ ID NO: 936346 - RNA, 27 nt, Human
cacacacacacagaaugacagaaagga

SEQ ID NO: 936347 - RNA, 19 nt, Human
cacacacagaaugacagaa

SEQ ID NO: 936348 - RNA, 23 nt, Human
cacucccccuuaucuccugggga

SEQ ID NO: 936349 - RNA, 26 nt, Human
cagaaaggacuggaauacacgcccua

SEQ ID NO: 936350 - RNA, 20 nt, Human
cagcaaaagaaaaagggccc

SEQ ID NO: 936351 - RNA, 24 nt, Human
cagcggccgcaaacgccgcuucug

SEQ ID NO: 936352 - RNA, 22 nt, Human
cagggccaagcugcauaaagga

SEQ ID NO: 936353 - RNA, 19 nt, Human
cauaguguggccggcaggg

SEQ ID NO: 936354 - RNA, 20 nt, Human
cauaguguggccggcagggc

SEQ ID NO: 936355 - RNA, 23 nt, Human
caucaaaccuccccauaaaaucc

SEQ ID NO: 936356 - RNA, 19 nt, Human
ccaaagggaaaggcugccu

SEQ ID NO: 936357 - RNA, 27 nt, Human
cccacuuaccucggggacccuagcaaa

SEQ ID NO: 936358 - RNA, 18 nt, Human
ccccagcucauccuccca

SEQ ID NO: 936359 - RNA, 19 nt, Human
ccccccgccaccgccgccg

SEQ ID NO: 936360 - RNA, 20 nt, Human
cccccgccaccgccgccggg

SEQ ID NO: 936361 - RNA, 23 nt, Human
ccccgccaccgccgccgggcgga

SEQ ID NO: 936362 - RNA, 23 nt, Human
cccgcgccucagcagcccggggc

SEQ ID NO: 936363 - RNA, 18 nt, Human
cccgcuccuccacagcgc

SEQ ID NO: 936364 - RNA, 19 nt, Human
cccgcuccuccacagcgcc

SEQ ID NO: 936365 - RNA, 20 nt, Human
ccgccaccgccgccgggcgg

SEQ ID NO: 936366 - RNA, 18 nt, Human
ccucggggacccuagcaa

SEQ ID NO: 936367 - RNA, 28 nt, Human
ccugaacugcaacacggagccccaggaa

SEQ ID NO: 936368 - RNA, 20 nt, Human
ccugggcucccccuccuucc

SEQ ID NO: 936369 - RNA, 24 nt, Human
cgcguccccgcgccucagcagccc

SEQ ID NO: 936370 - RNA, 23 nt, Human
cgcuccguuccucacacuccccc

SEQ ID NO: 936371 - RNA, 21 nt, Human
cgcuggcccugcgaccugcgc

SEQ ID NO: 936372 - RNA, 25 nt, Human
cggagccccaggaacuucuggaaag

SEQ ID NO: 936373 - RNA, 21 nt, Human
cggggacccuagcaaaaauca

SEQ ID NO: 936374 - RNA, 20 nt, Human
cguccccgcgccucagcagc

SEQ ID NO: 936375 - RNA, 25 nt, Human
cucagaaaaagaauggcgggagaaa

SEQ ID NO: 936376 - RNA, 23 nt, Human
cuccccauaaaauccuaggaaag

SEQ ID NO: 936377 - RNA, 22 nt, Human
cucgcgcauaguguggccggca

SEQ ID NO: 936378 - RNA, 22 nt, Human
cucuuccaccacucuguagccu

SEQ ID NO: 936379 - RNA, 21 nt, Human
cugcagcggccgcaaacgccg

SEQ ID NO: 936380 - RNA, 24 nt, Human
cugcauaaaggaaccauccagcaa

SEQ ID NO: 936381 - RNA, 19 nt, Human
cugcgaccugcgcggcugc

SEQ ID NO: 936382 - RNA, 20 nt, Human
cuggcccuuucuaguggcaa

SEQ ID NO: 936383 - RNA, 19 nt, Human
cuuaccucggggacccuag

SEQ ID NO: 936384 - RNA, 18 nt, Human
cuugcgugcacacgugug

SEQ ID NO: 936385 - RNA, 22 nt, Human
gaagaaaaagugcaggcgaaga

SEQ ID NO: 936386 - RNA, 23 nt, Human
gaagaaaaagugcaggcgaagag

SEQ ID NO: 936387 - RNA, 22 nt, Human
gacccuagcaaaaaucaauagc

SEQ ID NO: 936388 - RNA, 24 nt, Human
gagauguguguguguccucuucca

SEQ ID NO: 936389 - RNA, 18 nt, Human
gagcucggggccgcccag

SEQ ID NO: 936390 - RNA, 19 nt, Human
gaguucaucucuacccucc

SEQ ID NO: 936391 - RNA, 21 nt, Human
gauagugaaagcaaagagaga

SEQ ID NO: 936392 - RNA, 21 nt, Human
gauuuaaaaggaaauaggaaa

SEQ ID NO: 936393 - RNA, 21 nt, Human
gcaacacggagccccaggaac

SEQ ID NO: 936394 - RNA, 20 nt, Human
gcauaaaggaaccauccagc

SEQ ID NO: 936395 - RNA, 21 nt, Human
gccaaccucaucuucugucac

SEQ ID NO: 936396 - RNA, 24 nt, Human
gccacagagcucggggccgcccag

SEQ ID NO: 936397 - RNA, 26 nt, Human
gcgggagaaaggaggagggagguucc

SEQ ID NO: 936398 - RNA, 19 nt, Human
gcucauccucccagggagg

SEQ ID NO: 936399 - RNA, 25 nt, Human
gcucccgcuccuccacagcgccacc

SEQ ID NO: 936400 - RNA, 24 nt, Human
ggaagaaaaagugcaggcgaagag

SEQ ID NO: 936401 - RNA, 25 nt, Human
ggagacaggagaccucagaaaaaga

SEQ ID NO: 936402 - RNA, 19 nt, Human
ggagguuccuuccccacuu

SEQ ID NO: 936403 - RNA, 22 nt, Human
ggaguuccugggauuuuuuggg

SEQ ID NO: 936404 - RNA, 22 nt, Human
ggccggcucgcgcauagugugg

SEQ ID NO: 936405 - RNA, 19 nt, Human
gggaaggagugggagacag

SEQ ID NO: 936406 - RNA, 24 nt, Human
gggagaaaggaggagggagguucc

SEQ ID NO: 936407 - RNA, 23 nt, Human
gggccggcucgcgcauagugugg

SEQ ID NO: 936408 - RNA, 22 nt, Human
gggccguccucgcggacgcugg

SEQ ID NO: 936409 - RNA, 21 nt, Human
ggggacccuagcaaaaaucaa

SEQ ID NO: 936410 - RNA, 20 nt, Human
guggguaggggacaaacagu

SEQ ID NO: 936411 - RNA, 23 nt, Human
uaaaaggaaauaggaaaucagga

SEQ ID NO: 936412 - RNA, 20 nt, Human
uaagaaaaaucucuccgaac

SEQ ID NO: 936413 - RNA, 20 nt, Human
uaagaacacauugcuacugu

SEQ ID NO: 936414 - RNA, 20 nt, Human
uaccugggcucccccuccuu

SEQ ID NO: 936415 - RNA, 24 nt, Human
uaccugggcucccccuccuuccuu

SEQ ID NO: 936416 - RNA, 18 nt, Human
uaguggcaauuucaccac

SEQ ID NO: 936417 - RNA, 19 nt, Human
uauauacacacguacauau

SEQ ID NO: 936418 - RNA, 26 nt, Human
uauauacacacguacauauggaccca

SEQ ID NO: 936419 - RNA, 22 nt, Human
ucacucagccagggggugaagc

SEQ ID NO: 936420 - RNA, 24 nt, Human
ucagccagggggugaagcuuuuua

SEQ ID NO: 936421 - RNA, 20 nt, Human
ucauauuaucacauacaaua

SEQ ID NO: 936422 - RNA, 23 nt, Human
uccaugcugagcuaacccaguug

SEQ ID NO: 936423 - RNA, 21 nt, Human
uccccauaaaauccuaggaaa

SEQ ID NO: 936424 - RNA, 20 nt, Human
uccccgcgccucagcagccc

SEQ ID NO: 936425 - RNA, 18 nt, Human
ucccgaaggccgccgacc

SEQ ID NO: 936426 - RNA, 22 nt, Human
ucccugggauagugaaagcaaa

SEQ ID NO: 936427 - RNA, 24 nt, Human
uccugaacugcaacacggagcccc

SEQ ID NO: 936428 - RNA, 18 nt, Human
ucggcgccccgcuuucuc

SEQ ID NO: 936429 - RNA, 18 nt, Human
ucucuggggagaaaggca

SEQ ID NO: 936430 - RNA, 19 nt, Human
ucugaaucagacucagucc

SEQ ID NO: 936431 - RNA, 18 nt, Human
ugaauaugaacauuacaa

SEQ ID NO: 936432 - RNA, 22 nt, Human
ugacacagaacccacccaguuu

SEQ ID NO: 936433 - RNA, 20 nt, Human
ugagcuaacccagugucacc

SEQ ID NO: 936434 - RNA, 22 nt, Human
ugagugggcugggagcaggcag

SEQ ID NO: 936435 - RNA, 20 nt, Human
ugcacacacacacacacaca

SEQ ID NO: 936436 - RNA, 21 nt, Human
ugcauuuggcucuggcugcuc

SEQ ID NO: 936437 - RNA, 23 nt, Human
uggcucuggcugcucagugaguu

SEQ ID NO: 936438 - RNA, 19 nt, Human
uggggaagaaaaagugcag

SEQ ID NO: 936439 - RNA, 20 nt, Human
uguaaauacaaaacuguauc

SEQ ID NO: 936440 - RNA, 23 nt, Human
uguggccggcagggcccggcgcc

SEQ ID NO: 936441 - RNA, 18 nt, Human
uuagugguuuuuucuuuc

SEQ ID NO: 936442 - RNA, 19 nt, Human
uuauauuauucgcuccguu

SEQ ID NO: 936443 - RNA, 22 nt, Human
uuauugaggucugaucagcugc

SEQ ID NO: 936444 - RNA, 23 nt, Human
uucaccacauuuaucuagccaaa

SEQ ID NO: 936445 - RNA, 22 nt, Human
uucccgaaggccgccgaccccc

SEQ ID NO: 936446 - RNA, 23 nt, Human
uuggguggguaggggacaaacag

SEQ ID NO: 936447 - RNA, 19 nt, Human
uuuaaaaggaaauaggaaa

SEQ ID NO: 936448 - RNA, 21 nt, Human
uuucucggccgcgcucccgcu

SEQ ID NO: 936449 - RNA, 23 nt, Human
uuugguuuuaauaaggcacaguu

SEQ ID NO: 936450 - RNA, 20 nt, Human
uuuuugguuuugaucauguc

SEQ ID NO: 936451 - RNA, 20 nt, Human
uuuuuugguuuugaucaugu

SEQ ID NO: 936452 - RNA, 20 nt, Human
uuuuuuuuuuuuuuuuuugg

SEQ ID NO: 936453 - RNA, 22 nt, Human
aaaaaaaacaaaacaaaacacc

SEQ ID NO: 936454 - RNA, 25 nt, Human
aaaaaaacaaaacaaaacaccacag

SEQ ID NO: 936455 - RNA, 26 nt, Human
aaaaaaacaaaacaaaacaccacaga

SEQ ID NO: 936456 - RNA, 23 nt, Human
aaaacaaaacaaaacaccacaga

SEQ ID NO: 936457 - RNA, 21 nt, Human
aaaacaaaacaccacagauca

SEQ ID NO: 936458 - RNA, 20 nt, Human
aaacaaaacaccacagauca

SEQ ID NO: 936459 - RNA, 21 nt, Human
aaacaaaacaccacagaucaa

SEQ ID NO: 936460 - RNA, 19 nt, Human
aaaggggaaaucuucccca

SEQ ID NO: 936461 - RNA, 19 nt, Human
aagucagucccagccagaa

SEQ ID NO: 936462 - RNA, 20 nt, Human
aauaaacuccugaaaccaug

SEQ ID NO: 936463 - RNA, 25 nt, Human
accucuuccuuuuccugggguucaa

SEQ ID NO: 936464 - RNA, 26 nt, Human
agaaaacauucuuuuaaaauacugaa

SEQ ID NO: 936465 - RNA, 22 nt, Human
agaagagccacccuggccccug

SEQ ID NO: 936466 - RNA, 19 nt, Human
agagccaaggagggguggg

SEQ ID NO: 936467 - RNA, 19 nt, Human
agcagaaauggaagauuuc

SEQ ID NO: 936468 - RNA, 19 nt, Human
agccccaguuggguggugg

SEQ ID NO: 936469 - RNA, 19 nt, Human
aggaaguucuggccacuuc

SEQ ID NO: 936470 - RNA, 19 nt, Human
agggagagauggguccggg

SEQ ID NO: 936471 - RNA, 18 nt, Human
agggguggggagagaaga

SEQ ID NO: 936472 - RNA, 19 nt, Human
auggccaagucagucccag

SEQ ID NO: 936473 - RNA, 26 nt, Human
auuacaaaaauauuuugcaagccaaa

SEQ ID NO: 936474 - RNA, 21 nt, Human
caaaacaaaacaccacagauc

SEQ ID NO: 936475 - RNA, 19 nt, Human
caacacaugacagacagcc

SEQ ID NO: 936476 - RNA, 18 nt, Human
caagcucaggucuagaag

SEQ ID NO: 936477 - RNA, 25 nt, Human
cacaagacccaaccauggacuucaa

SEQ ID NO: 936478 - RNA, 21 nt, Human
cacagaaggcugcacuaccag

SEQ ID NO: 936479 - RNA, 19 nt, Human
cacagcugcaccauccccc

SEQ ID NO: 936480 - RNA, 28 nt, Human
caccacagaucaaguuuucuaacaccuc

SEQ ID NO: 936481 - RNA, 19 nt, Human
caccaucccccuggcuguc

SEQ ID NO: 936482 - RNA, 18 nt, Human
caccuguaggaccuccag

SEQ ID NO: 936483 - RNA, 23 nt, Human
cagaggguuuugucuccaguccu

SEQ ID NO: 936484 - RNA, 24 nt, Human
cagaucaaguuuucuaacaccuca

SEQ ID NO: 936485 - RNA, 22 nt, Human
cagcaaccucaccaagccugga

SEQ ID NO: 936486 - RNA, 24 nt, Human
caggacaacaaacuguuaaaccuc

SEQ ID NO: 936487 - RNA, 18 nt, Human
caggcuggacuuaccaca

SEQ ID NO: 936488 - RNA, 19 nt, Human
caggcuggacuuaccacag

SEQ ID NO: 936489 - RNA, 22 nt, Human
cagguugccaggcuaaagcuaa

SEQ ID NO: 936490 - RNA, 25 nt, Human
ccaagaaaacauucuuuuaaaauac

SEQ ID NO: 936491 - RNA, 18 nt, Human
ccacagaucaaguuuucu

SEQ ID NO: 936492 - RNA, 22 nt, Human
ccaggacaacaaacuguuaaac

SEQ ID NO: 936493 - RNA, 23 nt, Human
cccacauggugauggacggaggc

SEQ ID NO: 936494 - RNA, 23 nt, Human
cccagggagucuuggagggaccc

SEQ ID NO: 936495 - RNA, 23 nt, Human
ccccagagagcugggucuaugcu

SEQ ID NO: 936496 - RNA, 18 nt, Human
ccccugggucccagagcc

SEQ ID NO: 936497 - RNA, 27 nt, Human
ccccugggucccagagccugcaccgcc

SEQ ID NO: 936498 - RNA, 20 nt, Human
cccugggcccggucaggccc

SEQ ID NO: 936499 - RNA, 21 nt, Human
cccugggcccggucaggcccu

SEQ ID NO: 936500 - RNA, 21 nt, Human
ccgcggcuucucugcgagcga

SEQ ID NO: 936501 - RNA, 22 nt, Human
ccucagacuucacaagacccaa

SEQ ID NO: 936502 - RNA, 22 nt, Human
ccucuggccaaccuucugggac

SEQ ID NO: 936503 - RNA, 23 nt, Human
ccuggccccugggucccagagcc

SEQ ID NO: 936504 - RNA, 20 nt, Human
ccuguuuccuucccagcagu

SEQ ID NO: 936505 - RNA, 18 nt, Human
cgccccagcccuccggga

SEQ ID NO: 936506 - RNA, 23 nt, Human
cgccccagcccuccgggaacugg

SEQ ID NO: 936507 - RNA, 20 nt, Human
cuccaagaauuaaaaaauaa

SEQ ID NO: 936508 - RNA, 28 nt, Human
cuuaaaauaaacuccugaaaccaugcuc

SEQ ID NO: 936509 - RNA, 24 nt, Human
cuucacaagacccaaccauggacu

SEQ ID NO: 936510 - RNA, 21 nt, Human
cuuuagccuagggauggggga

SEQ ID NO: 936511 - RNA, 26 nt, Human
gaaaucuuccccacucuagggcacuc

SEQ ID NO: 936512 - RNA, 20 nt, Human
gaccucuuccuuuuccuggg

SEQ ID NO: 936513 - RNA, 19 nt, Human
gaccugauccuucuugccc

SEQ ID NO: 936514 - RNA, 26 nt, Human
gagccugcaccgccccagcccuccgg

SEQ ID NO: 936515 - RNA, 20 nt, Human
gagggguccucuccuccucc

SEQ ID NO: 936516 - RNA, 20 nt, Human
gaggugguggaggucagggg

SEQ ID NO: 936517 - RNA, 20 nt, Human
gcaacacaguugggccccag

SEQ ID NO: 936518 - RNA, 19 nt, Human
gccaaccuucugggacaga

SEQ ID NO: 936519 - RNA, 26 nt, Human
gccuuauucccuuauuucccccucca

SEQ ID NO: 936520 - RNA, 18 nt, Human
gcuuagugcuagcuggag

SEQ ID NO: 936521 - RNA, 18 nt, Human
ggagagccaaggaggggg

SEQ ID NO: 936522 - RNA, 18 nt, Human
ggagagccaaggaggggu

SEQ ID NO: 936523 - RNA, 22 nt, Human
gggaacuggguuggcugugcuc

SEQ ID NO: 936524 - RNA, 18 nt, Human
gggacaagaaagcgcgua

SEQ ID NO: 936525 - RNA, 23 nt, Human
gggagcucuggccaaagcugucc

SEQ ID NO: 936526 - RNA, 25 nt, Human
gggaugggggcggucacuaaagggg

SEQ ID NO: 936527 - RNA, 23 nt, Human
ggguuccagaguuuuuuuccagc

SEQ ID NO: 936528 - RNA, 18 nt, Human
gguucccuggcugguuug

SEQ ID NO: 936529 - RNA, 18 nt, Human
gguucugggacuuggagg

SEQ ID NO: 936530 - RNA, 28 nt, Human
gucccagagccugcaccgccccagcccu

SEQ ID NO: 936531 - RNA, 24 nt, Human
guccggguggagcaacacaguugg

SEQ ID NO: 936532 - RNA, 24 nt, Human
gucuagaagggagagauggguccg

SEQ ID NO: 936533 - RNA, 23 nt, Human
guggagcaacacaguugggcccc

SEQ ID NO: 936534 - RNA, 27 nt, Human
gugugugcaugcgugugcacacguaug

SEQ ID NO: 936535 - RNA, 27 nt, Human
guugccaggcuaaagcuaaagcuauac

SEQ ID NO: 936536 - RNA, 22 nt, Human
uaaaagagagggagacgaaggu

SEQ ID NO: 936537 - RNA, 24 nt, Human
uacagccugagccagaaaucccuu

SEQ ID NO: 936538 - RNA, 18 nt, Human
uaccacagcggggucaca

SEQ ID NO: 936539 - RNA, 19 nt, Human
uaccacagcggggucacag

SEQ ID NO: 936540 - RNA, 25 nt, Human
uacccagaaaucuuuauuacaaaaa

SEQ ID NO: 936541 - RNA, 23 nt, Human
uaugagaggugguggggaggggu

SEQ ID NO: 936542 - RNA, 23 nt, Human
ucaacacaugacagacagccaag

SEQ ID NO: 936543 - RNA, 19 nt, Human
ucacagaaggcugcacuac

SEQ ID NO: 936544 - RNA, 19 nt, Human
uccaggacucauggcucuu

SEQ ID NO: 936545 - RNA, 22 nt, Human
uccagggaguggcugaccugau

SEQ ID NO: 936546 - RNA, 23 nt, Human
ucccagaugccacacgggagcuc

SEQ ID NO: 936547 - RNA, 23 nt, Human
uccuccccacccuggaagaucag

SEQ ID NO: 936548 - RNA, 19 nt, Human
ucgcuguaagaaaaucccu

SEQ ID NO: 936549 - RNA, 26 nt, Human
ucuccagggaguggcugaccugaucc

SEQ ID NO: 936550 - RNA, 20 nt, Human
ucuccuccccacccuggaag

SEQ ID NO: 936551 - RNA, 20 nt, Human
ucucuggguaaaagagaggg

SEQ ID NO: 936552 - RNA, 21 nt, Human
ucucuggguaaaagagaggga

SEQ ID NO: 936553 - RNA, 20 nt, Human
ugaaaauggcaccaagaaaa

SEQ ID NO: 936554 - RNA, 18 nt, Human
ugaauaaauagggcuugc

SEQ ID NO: 936555 - RNA, 18 nt, Human
ugagaggugguggggagg

SEQ ID NO: 936556 - RNA, 24 nt, Human
ugcaugcgugugcacacguaugug

SEQ ID NO: 936557 - RNA, 20 nt, Human
ugcuagcuggaggggcaagc

SEQ ID NO: 936558 - RNA, 20 nt, Human
uggaagaucaggcuucggag

SEQ ID NO: 936559 - RNA, 21 nt, Human
uggaagaucaggcuucggagc

SEQ ID NO: 936560 - RNA, 20 nt, Human
uggcagcaaccucaccaagc

SEQ ID NO: 936561 - RNA, 22 nt, Human
uggccccugggucccagagccu

SEQ ID NO: 936562 - RNA, 24 nt, Human
uggcucccagaugccacacgggag

SEQ ID NO: 936563 - RNA, 19 nt, Human
ugggcaucccaaggccagg

SEQ ID NO: 936564 - RNA, 25 nt, Human
ugggguucaauacacaagguaugug

SEQ ID NO: 936565 - RNA, 20 nt, Human
ugggguucugggacuuggag

SEQ ID NO: 936566 - RNA, 19 nt, Human
uggguaaaagagagggaga

SEQ ID NO: 936567 - RNA, 18 nt, Human
ugggugguggugguagug

SEQ ID NO: 936568 - RNA, 22 nt, Human
uggguuggcugugcucaucacg

SEQ ID NO: 936569 - RNA, 20 nt, Human
ugguagugguggugguggug

SEQ ID NO: 936570 - RNA, 19 nt, Human
ugguggaggucaggggagg

SEQ ID NO: 936571 - RNA, 19 nt, Human
ugguggaggugguggaggu

SEQ ID NO: 936572 - RNA, 22 nt, Human
ugguggugguaguggugguggu

SEQ ID NO: 936573 - RNA, 20 nt, Human
ugguggugguggagguggug

SEQ ID NO: 936574 - RNA, 22 nt, Human
uggugguggugguggagguggu

SEQ ID NO: 936575 - RNA, 18 nt, Human
uggugguggugguggugg

SEQ ID NO: 936576 - RNA, 20 nt, Human
uggugguggugguggugguc

SEQ ID NO: 936577 - RNA, 20 nt, Human
uggugguggugguggugguc

SEQ ID NO: 936578 - RNA, 20 nt, Human
uggugguggugguggugguc

SEQ ID NO: 936579 - RNA, 20 nt, Human
uggugguggugguggugguc

SEQ ID NO: 936580 - RNA, 20 nt, Human
ugguggugguggugguggug

SEQ ID NO: 936581 - RNA, 20 nt, Human
ugguggugguggugguggug

SEQ ID NO: 936582 - RNA, 20 nt, Human
ugguggugguggugguggug

SEQ ID NO: 936583 - RNA, 20 nt, Human
ugguggugguggugguggug

SEQ ID NO: 936584 - RNA, 21 nt, Human
ugucuccaguccuuugggagg

SEQ ID NO: 936585 - RNA, 21 nt, Human
ugugugcaugcgugugcacac

SEQ ID NO: 936586 - RNA, 21 nt, Human
ugugugcaugcgugugcacac

SEQ ID NO: 936587 - RNA, 24 nt, Human
ugugugugugcaugcgugugcaca

SEQ ID NO: 936588 - RNA, 21 nt, Human
uguuuuaagaaaaaaaacaaa

SEQ ID NO: 936589 - RNA, 24 nt, Human
uguuuuaagaaaaaaaacaaaaca

SEQ ID NO: 936590 - RNA, 21 nt, Human
uuaaaaaauaaaauaaaauga

SEQ ID NO: 936591 - RNA, 23 nt, Human
uugaaaucaccaggugaccaucc

SEQ ID NO: 936592 - RNA, 18 nt, Human
uugggugguggugguagu

SEQ ID NO: 936593 - RNA, 22 nt, Human
uuuggaauuuggaacuagccug

SEQ ID NO: 936594 - RNA, 19 nt, Human
aaccgauuccccuccaccc

SEQ ID NO: 936595 - RNA, 18 nt, Human
aagcaagugaaaauugau

SEQ ID NO: 936596 - RNA, 22 nt, Human
aagcacacucuuccuggaaacc

SEQ ID NO: 936597 - RNA, 21 nt, Human
aagcagauauucauuacaaua

SEQ ID NO: 936598 - RNA, 28 nt, Human
acacaacuucaaccaagaagggaacgcc

SEQ ID NO: 936599 - RNA, 23 nt, Human
acacagcugccucugcgccgccu

SEQ ID NO: 936600 - RNA, 20 nt, Human
acacaggaaaucugcagccc

SEQ ID NO: 936601 - RNA, 19 nt, Human
acaggugucugcccccggg

SEQ ID NO: 936602 - RNA, 23 nt, Human
accauguagagacauaagcaaua

SEQ ID NO: 936603 - RNA, 23 nt, Human
accggagguuucucuucaaacau

SEQ ID NO: 936604 - RNA, 24 nt, Human
acugcuaaacugcgcugacuacgg

SEQ ID NO: 936605 - RNA, 21 nt, Human
acuggauuuuuccacaaaucu

SEQ ID NO: 936606 - RNA, 21 nt, Human
agacacacaauuaaagucaga

SEQ ID NO: 936607 - RNA, 21 nt, Human
agagagaaguaauuuuggaaa

SEQ ID NO: 936608 - RNA, 21 nt, Human
agcacacucuuccuggaaacc

SEQ ID NO: 936609 - RNA, 20 nt, Human
aggaguuagaaauuacaagu

SEQ ID NO: 936610 - RNA, 20 nt, Human
aggggcagggccggucggcu

SEQ ID NO: 936611 - RNA, 19 nt, Human
augcucgcagcccucuccg

SEQ ID NO: 936612 - RNA, 20 nt, Human
auuccugacaacauccgugg

SEQ ID NO: 936613 - RNA, 22 nt, Human
auuuguucuuccugguuguggu

SEQ ID NO: 936614 - RNA, 20 nt, Human
caaguaggcauaugcuuccu

SEQ ID NO: 936615 - RNA, 22 nt, Human
cacaacuucaaccaagaaggug

SEQ ID NO: 936616 - RNA, 21 nt, Human
cacagcugccucugcgccgcc

SEQ ID NO: 936617 - RNA, 19 nt, Human
cagcugccucugcgccgcc

SEQ ID NO: 936618 - RNA, 20 nt, Human
cagcugccucugcgccgccu

SEQ ID NO: 936619 - RNA, 19 nt, Human
caguaggccguguucccuc

SEQ ID NO: 936620 - RNA, 24 nt, Human
ccacacagcugccucugcgccgcc

SEQ ID NO: 936621 - RNA, 25 nt, Human
ccacacaggaaaucugcagcccaca

SEQ ID NO: 936622 - RNA, 21 nt, Human
ccagcuuccccggccacuccu

SEQ ID NO: 936623 - RNA, 23 nt, Human
cccacacagcugccucugcgccg

SEQ ID NO: 936624 - RNA, 21 nt, Human
cccacacaggaaaucugcagc

SEQ ID NO: 936625 - RNA, 21 nt, Human
ccccacagguccgggacgugc

SEQ ID NO: 936626 - RNA, 18 nt, Human
ccccugaaucacucugcu

SEQ ID NO: 936627 - RNA, 24 nt, Human
ccgaaaguggcagaugacaagcac

SEQ ID NO: 936628 - RNA, 21 nt, Human
ccgccucgaacgugcuggcua

SEQ ID NO: 936629 - RNA, 21 nt, Human
ccuggaggagccagcgggggc

SEQ ID NO: 936630 - RNA, 23 nt, Human
cgcugaaccccacacaggaaauc

SEQ ID NO: 936631 - RNA, 19 nt, Human
cggcugguuucucacuucc

SEQ ID NO: 936632 - RNA, 23 nt, Human
cgugguucauuaagugaucccgg

SEQ ID NO: 936633 - RNA, 22 nt, Human
cucacaccggagguuucucuuc

SEQ ID NO: 936634 - RNA, 20 nt, Human
cuccccugaggccccugagg

SEQ ID NO: 936635 - RNA, 22 nt, Human
cugcagcccacacagcugccuc

SEQ ID NO: 936636 - RNA, 23 nt, Human
cugguuucucacuucccuuccag

SEQ ID NO: 936637 - RNA, 23 nt, Human
cuucccuuccaggcucuacgcag

SEQ ID NO: 936638 - RNA, 25 nt, Human
cuugggcugacagguguggcugacg

SEQ ID NO: 936639 - RNA, 18 nt, Human
gaaaugcucgcagcccuc

SEQ ID NO: 936640 - RNA, 20 nt, Human
gaaccgauuccccuccaccc

SEQ ID NO: 936641 - RNA, 20 nt, Human
gagagaaguaauuuuggaaa

SEQ ID NO: 936642 - RNA, 24 nt, Human
gaggagccagcgggggccuggcag

SEQ ID NO: 936643 - RNA, 21 nt, Human
gaucauccuggucaaugaagu

SEQ ID NO: 936644 - RNA, 21 nt, Human
gcaaaggugaggucaggggag

SEQ ID NO: 936645 - RNA, 22 nt, Human
gccacuccugcacaguggaucc

SEQ ID NO: 936646 - RNA, 22 nt, Human
gcugaaccccacacaggaaauc

SEQ ID NO: 936647 - RNA, 18 nt, Human
ggaaaugcucgcagcccu

SEQ ID NO: 936648 - RNA, 24 nt, Human
gggaagggcgggauggaggugcgu

SEQ ID NO: 936649 - RNA, 19 nt, Human
gugaauuguccuauuucug

SEQ ID NO: 936650 - RNA, 21 nt, Human
gugaauuguccuauuucuggg

SEQ ID NO: 936651 - RNA, 23 nt, Human
gugcaggucgcccugaucuccuc

SEQ ID NO: 936652 - RNA, 23 nt, Human
gugccgggcggccucacugagug

SEQ ID NO: 936653 - RNA, 18 nt, Human
uaacuggauuuuuccaca

SEQ ID NO: 936654 - RNA, 21 nt, Human
uaacuuugcaaaggugagguc

SEQ ID NO: 936655 - RNA, 24 nt, Human
uacaauaccauguagagacauaag

SEQ ID NO: 936656 - RNA, 22 nt, Human
uagagagaaguaauuuuggaaa

SEQ ID NO: 936657 - RNA, 22 nt, Human
ucacagguaagcauucacgggg

SEQ ID NO: 936658 - RNA, 22 nt, Human
ucaguaggccguguucccucug

SEQ ID NO: 936659 - RNA, 21 nt, Human
uccccucucuggggccccaca

SEQ ID NO: 936660 - RNA, 21 nt, Human
ucccuuccaggcucuacgcag

SEQ ID NO: 936661 - RNA, 21 nt, Human
uccgaguugcccugaucuccu

SEQ ID NO: 936662 - RNA, 20 nt, Human
ucggcugguuucucacuucc

SEQ ID NO: 936663 - RNA, 23 nt, Human
ucucacaccggagguuucucuuc

SEQ ID NO: 936664 - RNA, 24 nt, Human
ucucacaccggagguuucucuuca

SEQ ID NO: 936665 - RNA, 19 nt, Human
ucuccgaguugcccugauc

SEQ ID NO: 936666 - RNA, 23 nt, Human
ucugcagcccacacagcugccuc

SEQ ID NO: 936667 - RNA, 19 nt, Human
ucuggggccccacaggucc

SEQ ID NO: 936668 - RNA, 23 nt, Human
ugacaagcacacucuuccuggaa

SEQ ID NO: 936669 - RNA, 23 nt, Human
ugacaagcacacucuuccuggaa

SEQ ID NO: 936670 - RNA, 19 nt, Human
ugccagccucaagugggca

SEQ ID NO: 936671 - RNA, 23 nt, Human
ugcccugaucuccuucucuccca

SEQ ID NO: 936672 - RNA, 19 nt, Human
ugccuggaggagccagcgg

SEQ ID NO: 936673 - RNA, 21 nt, Human
ugccuggaggagccagcgggg

SEQ ID NO: 936674 - RNA, 19 nt, Human
ugcucaaugcccagauuug

SEQ ID NO: 936675 - RNA, 20 nt, Human
ugcugugggaagggcgggau

SEQ ID NO: 936676 - RNA, 20 nt, Human
uggaggagccagcgggggcc

SEQ ID NO: 936677 - RNA, 23 nt, Human
uggcaggguucgugugcucccgg

SEQ ID NO: 936678 - RNA, 18 nt, Human
ugggaagggcgggaugga

SEQ ID NO: 936679 - RNA, 19 nt, Human
uggggugggggcuccccug

SEQ ID NO: 936680 - RNA, 21 nt, Human
uggggugggggcuccccugag

SEQ ID NO: 936681 - RNA, 24 nt, Human
uggggugggggcuccccugaggcc

SEQ ID NO: 936682 - RNA, 24 nt, Human
ugugaucauccuggucaaugaagu

SEQ ID NO: 936683 - RNA, 19 nt, Human
uguucccucugguagggcc

SEQ ID NO: 936684 - RNA, 24 nt, Human
uucccuuccaggcucuacgcagug

SEQ ID NO: 936685 - RNA, 26 nt, Human
uucucccaaugauaaacucucucaaa

SEQ ID NO: 936686 - RNA, 23 nt, Human
uugaugaaccgauuccccuccac

SEQ ID NO: 936687 - RNA, 20 nt, Human
uuuaagcaagugaaaauuga

SEQ ID NO: 936688 - RNA, 19 nt, Human
uuuuccacaaaucucucuu

SEQ ID NO: 936689 - RNA, 20 nt, Human
uuuuccacaaaucucucuuu

SEQ ID NO: 936690 - RNA, 19 nt, Human
aaaaaucccuucuuagcaa

SEQ ID NO: 936691 - RNA, 23 nt, Human
aaaagagagacaaguaguuaaaa

SEQ ID NO: 936692 - RNA, 24 nt, Human
aaaagagagacaaguaguuaaaaa

SEQ ID NO: 936693 - RNA, 18 nt, Human
aaauguccuuauaaggag

SEQ ID NO: 936694 - RNA, 18 nt, Human
aagcaaaacagaaagucc

SEQ ID NO: 936695 - RNA, 19 nt, Human
aagcaaaacagaaaguccg

SEQ ID NO: 936696 - RNA, 20 nt, Human
aagcaaaacagaaaguccga

SEQ ID NO: 936697 - RNA, 18 nt, Human
aagcuccuucuagaagcc

SEQ ID NO: 936698 - RNA, 22 nt, Human
aaguaguuaaaacucuugauac

SEQ ID NO: 936699 - RNA, 20 nt, Human
aauaacaaagaugcugagaa

SEQ ID NO: 936700 - RNA, 23 nt, Human
aauaacaaagaugcugagaaaaa

SEQ ID NO: 936701 - RNA, 19 nt, Human
aauaauagagaguaaauac

SEQ ID NO: 936702 - RNA, 20 nt, Human
acaaaaucugccuuaggcug

SEQ ID NO: 936703 - RNA, 22 nt, Human
acacaaggagcuggaaaucuua

SEQ ID NO: 936704 - RNA, 20 nt, Human
acaguggauagaguucugga

SEQ ID NO: 936705 - RNA, 23 nt, Human
accgccaagggucuucuagucuc

SEQ ID NO: 936706 - RNA, 19 nt, Human
agaagccaaggcggagacg

SEQ ID NO: 936707 - RNA, 19 nt, Human
agacaaaacaaaaucugcc

SEQ ID NO: 936708 - RNA, 20 nt, Human
agagcaguaggagguugcgg

SEQ ID NO: 936709 - RNA, 20 nt, Human
agaggaagagcaguaggagg

SEQ ID NO: 936710 - RNA, 22 nt, Human
agaggaagagcaguaggagguu

SEQ ID NO: 936711 - RNA, 18 nt, Human
agagggagagaggaagag

SEQ ID NO: 936712 - RNA, 21 nt, Human
agauagagucaguacagacaa

SEQ ID NO: 936713 - RNA, 18 nt, Human
agcaguaggagguugcgg

SEQ ID NO: 936714 - RNA, 22 nt, Human
agcaguaggagguugcggguaa

SEQ ID NO: 936715 - RNA, 18 nt, Human
agcuugagaaaacuggcg

SEQ ID NO: 936716 - RNA, 18 nt, Human
agucuguggcgccgacag

SEQ ID NO: 936717 - RNA, 22 nt, Human
auaacaaagaugcugagaaaaa

SEQ ID NO: 936718 - RNA, 25 nt, Human
augacaacagcauaaaauccuucuu

SEQ ID NO: 936719 - RNA, 22 nt, Human
auugauggucugacaagucuuc

SEQ ID NO: 936720 - RNA, 18 nt, Human
caaaaucugccuuaggcu

SEQ ID NO: 936721 - RNA, 18 nt, Human
caacacaccuacaccccc

SEQ ID NO: 936722 - RNA, 19 nt, Human
caagacagauuuugcaaac

SEQ ID NO: 936723 - RNA, 20 nt, Human
caaucacuugcaacuuuagc

SEQ ID NO: 936724 - RNA, 23 nt, Human
caccccccgcugccagagcugcu

SEQ ID NO: 936725 - RNA, 23 nt, Human
caccuacaccccccgcugccaga

SEQ ID NO: 936726 - RNA, 23 nt, Human
cagcagcccagcagcagcgccgc

SEQ ID NO: 936727 - RNA, 20 nt, Human
cagcuucaaccucccuaaga

SEQ ID NO: 936728 - RNA, 23 nt, Human
caggaagcuccuucuagaagccu

SEQ ID NO: 936729 - RNA, 18 nt, Human
caguccauucacaagaca

SEQ ID NO: 936730 - RNA, 27 nt, Human
caguguagugcaacacaccuacacccc

SEQ ID NO: 936731 - RNA, 21 nt, Human
cauaaaauccuucuuugcucc

SEQ ID NO: 936732 - RNA, 23 nt, Human
cauuuuucuuuaaaagcaaaaca

SEQ ID NO: 936733 - RNA, 18 nt, Human
ccaagagauugauggucu

SEQ ID NO: 936734 - RNA, 20 nt, Human
ccaagggucuucuagucucc

SEQ ID NO: 936735 - RNA, 22 nt, Human
ccaagggucuucuagucuccgg

SEQ ID NO: 936736 - RNA, 22 nt, Human
ccaccgccaagggucuucuagu

SEQ ID NO: 936737 - RNA, 22 nt, Human
ccagucuuccacaauccaugcc

SEQ ID NO: 936738 - RNA, 21 nt, Human
cccaagagauugauggucuga

SEQ ID NO: 936739 - RNA, 24 nt, Human
ccccgcugccagagcugcuucuca

SEQ ID NO: 936740 - RNA, 20 nt, Human
cccuaagagagggagagagg

SEQ ID NO: 936741 - RNA, 24 nt, Human
ccuggccuucuggacgcccagaag

SEQ ID NO: 936742 - RNA, 19 nt, Human
cgcccagaagccaaggcgg

SEQ ID NO: 936743 - RNA, 19 nt, Human
cuacaaauuuguuuuuccc

SEQ ID NO: 936744 - RNA, 20 nt, Human
cuacaccccccgcugccaga

SEQ ID NO: 936745 - RNA, 22 nt, Human
cuccgcgccagcccagcagccc

SEQ ID NO: 936746 - RNA, 18 nt, Human
cuucagcagcucauccag

SEQ ID NO: 936747 - RNA, 23 nt, Human
gaaacuccaccacgaccccacuu

SEQ ID NO: 936748 - RNA, 19 nt, Human
gagaaacuccaccacgacc

SEQ ID NO: 936749 - RNA, 21 nt, Human
gaggagaaacuccaccacgac

SEQ ID NO: 936750 - RNA, 21 nt, Human
gauacuucagaguugcuacaa

SEQ ID NO: 936751 - RNA, 23 nt, Human
gcagauagagucaguacagacaa

SEQ ID NO: 936752 - RNA, 19 nt, Human
ggggaugcuuacaaaugca

SEQ ID NO: 936753 - RNA, 20 nt, Human
guggcagauagagucaguac

SEQ ID NO: 936754 - RNA, 19 nt, Human
guguagugcaacacaccua

SEQ ID NO: 936755 - RNA, 21 nt, Human
uacauacauacauucugugug

SEQ ID NO: 936756 - RNA, 21 nt, Human
uagguaauauuaucaagacac

SEQ ID NO: 936757 - RNA, 24 nt, Human
uauuacauacauacauucugugug

SEQ ID NO: 936758 - RNA, 24 nt, Human
ucauaccuccaucaucaaaaaacc

SEQ ID NO: 936759 - RNA, 23 nt, Human
uccucggcugggguuugcagagc

SEQ ID NO: 936760 - RNA, 20 nt, Human
ucugcaggucccaggcuuuc

SEQ ID NO: 936761 - RNA, 22 nt, Human
ucuuaaauauguugcccagucu

SEQ ID NO: 936762 - RNA, 21 nt, Human
ucuuuaaaagcaaaacagaaa

SEQ ID NO: 936763 - RNA, 26 nt, Human
ugaaacaaagucaacauugcugcauu

SEQ ID NO: 936764 - RNA, 21 nt, Human
ugacauggcaucugcaggucc

SEQ ID NO: 936765 - RNA, 20 nt, Human
ugagaaaaaugacaacagca

SEQ ID NO: 936766 - RNA, 19 nt, Human
ugagagguggaggagaaac

SEQ ID NO: 936767 - RNA, 22 nt, Human
ugagagguggaggagaaacucc

SEQ ID NO: 936768 - RNA, 18 nt, Human
ugagcagaacagcuagug

SEQ ID NO: 936769 - RNA, 25 nt, Human
ugcauuaaaaauucauauaugagca

SEQ ID NO: 936770 - RNA, 23 nt, Human
ugcccaauaauagagaguaaaua

SEQ ID NO: 936771 - RNA, 21 nt, Human
ugcccagcgccggcccucacg

SEQ ID NO: 936772 - RNA, 23 nt, Human
uggcaucugcaggucccaggcuu

SEQ ID NO: 936773 - RNA, 22 nt, Human
uuacauacauacauucugugug

SEQ ID NO: 936774 - RNA, 21 nt, Human
uuauaucauuccugaaggcau

SEQ ID NO: 936775 - RNA, 19 nt, Human
uucagguccucggcugggg

SEQ ID NO: 936776 - RNA, 22 nt, Human
uugcugcauuaaaaauucauau

SEQ ID NO: 936777 - RNA, 22 nt, Human
uugggggaugcuuacaaaugca

SEQ ID NO: 936778 - RNA, 25 nt, Human
uuugcaaacauuaaagcaucuaaca

SEQ ID NO: 936779 - RNA, 22 nt, Human
uuuguugagagagagauuccag

SEQ ID NO: 936780 - RNA, 26 nt, Human
uuuuguccgcuucaugcugcccuugu

SEQ ID NO: 936781 - RNA, 21 nt, Human
uuuuuggcucuugaagauuga

SEQ ID NO: 936782 - RNA, 24 nt, Human
aaaaccaacaaggcuaaaucagaa

SEQ ID NO: 936783 - RNA, 19 nt, Human
aaaagcccaucccugguua

SEQ ID NO: 936784 - RNA, 25 nt, Human
aaacacaaucuacuuggauucgugc

SEQ ID NO: 936785 - RNA, 18 nt, Human
aaagagacaccugccuuc

SEQ ID NO: 936786 - RNA, 19 nt, Human
aaagcagcuguucccuaug

SEQ ID NO: 936787 - RNA, 21 nt, Human
aaagcagcuguucccuauggg

SEQ ID NO: 936788 - RNA, 22 nt, Human
aaagcagcuguucccuaugguu

SEQ ID NO: 936789 - RNA, 24 nt, Human
aaagcccugcucuguguccuacuu

SEQ ID NO: 936790 - RNA, 23 nt, Human
aaaguauaaugggcuccacaaug

SEQ ID NO: 936791 - RNA, 21 nt, Human
aacagaacagaacaacaugag

SEQ ID NO: 936792 - RNA, 24 nt, Human
aacagcuccccccacacuccacca

SEQ ID NO: 936793 - RNA, 18 nt, Human
aacauugucagggaacau

SEQ ID NO: 936794 - RNA, 19 nt, Human
aaccucuggagauaaugug

SEQ ID NO: 936795 - RNA, 26 nt, Human
aacucuucccaauagauuuucuuuca

SEQ ID NO: 936796 - RNA, 18 nt, Human
aagaaaacagcacggaga

SEQ ID NO: 936797 - RNA, 26 nt, Human
aagaaaacagcacggagaagucucau

SEQ ID NO: 936798 - RNA, 19 nt, Human
aagaguguggagacuuugg

SEQ ID NO: 936799 - RNA, 21 nt, Human
aagaucucacccaucuggaau

SEQ ID NO: 936800 - RNA, 21 nt, Human
aagcaaacuguccccuuccau

SEQ ID NO: 936801 - RNA, 23 nt, Human
aagcagguggucugggagccaga

SEQ ID NO: 936802 - RNA, 23 nt, Human
aagcuaccaccaaagaaacacag

SEQ ID NO: 936803 - RNA, 24 nt, Human
aaggagucuuggccaacacgaagc

SEQ ID NO: 936804 - RNA, 24 nt, Human
aaggcacugaaguaauuguacaga

SEQ ID NO: 936805 - RNA, 22 nt, Human
aagggccuggcugcuacucccu

SEQ ID NO: 936806 - RNA, 19 nt, Human
aaggggaugagcuggggga

SEQ ID NO: 936807 - RNA, 29 nt, Human
aaucagaaaguggaaugcaaagggacccc

SEQ ID NO: 936808 - RNA, 20 nt, Human
aaugaucaagccccuaaaac

SEQ ID NO: 936809 - RNA, 23 nt, Human
acaaagacaaggaggagcagaga

SEQ ID NO: 936810 - RNA, 23 nt, Human
acacaaaaaagcaaagaacaccu

SEQ ID NO: 936811 - RNA, 22 nt, Human
acacuccaccacuaaccucucu

SEQ ID NO: 936812 - RNA, 23 nt, Human
acagaacaacaugaggaacagag

SEQ ID NO: 936813 - RNA, 21 nt, Human
accacaaccccaugccuuacc

SEQ ID NO: 936814 - RNA, 28 nt, Human
accagacacucauucuccgaacauuccu

SEQ ID NO: 936815 - RNA, 19 nt, Human
acccaguaauuaugugugg

SEQ ID NO: 936816 - RNA, 22 nt, Human
acccccucccacugaccacaca

SEQ ID NO: 936817 - RNA, 22 nt, Human
acccuagaucuccaggccugau

SEQ ID NO: 936818 - RNA, 18 nt, Human
accucagagcuccugagc

SEQ ID NO: 936819 - RNA, 19 nt, Human
accugccccuuuggaaccc

SEQ ID NO: 936820 - RNA, 19 nt, Human
accuugggauagcuuguga

SEQ ID NO: 936821 - RNA, 21 nt, Human
acucauggguccuaguuauac

SEQ ID NO: 936822 - RNA, 22 nt, Human
acugauaccucuauguacucua

SEQ ID NO: 936823 - RNA, 19 nt, Human
acugccauucacacaaaag

SEQ ID NO: 936824 - RNA, 23 nt, Human
acuggcucugggaggcagcaggg

SEQ ID NO: 936825 - RNA, 24 nt, Human
agaacagaacaacaugaggaacag

SEQ ID NO: 936826 - RNA, 24 nt, Human
agaacagcuccccccacacuccac

SEQ ID NO: 936827 - RNA, 19 nt, Human
agaagagucugcucaugug

SEQ ID NO: 936828 - RNA, 18 nt, Human
agaagccaaggcaauggu

SEQ ID NO: 936829 - RNA, 19 nt, Human
agaagccaaggcaauggua

SEQ ID NO: 936830 - RNA, 19 nt, Human
agaaggagggcaggggagc

SEQ ID NO: 936831 - RNA, 25 nt, Human
agacauguauacauggaaaaccucc

SEQ ID NO: 936832 - RNA, 20 nt, Human
agaccagccuucaagaugga

SEQ ID NO: 936833 - RNA, 23 nt, Human
agacccccugggggugguggugu

SEQ ID NO: 936834 - RNA, 24 nt, Human
agagguacauacucaaacuccccc

SEQ ID NO: 936835 - RNA, 21 nt, Human
agagucauauuaaaaccaaca

SEQ ID NO: 936836 - RNA, 20 nt, Human
agaugagcaaauccucauca

SEQ ID NO: 936837 - RNA, 22 nt, Human
agcagaacacacaucuccucca

SEQ ID NO: 936838 - RNA, 20 nt, Human
agcagagaaguucccugcag

SEQ ID NO: 936839 - RNA, 20 nt, Human
agcagccucuggacuccggc

SEQ ID NO: 936840 - RNA, 20 nt, Human
agcccaugccaauggaagca

SEQ ID NO: 936841 - RNA, 20 nt, Human
agccccccguggaacacagg

SEQ ID NO: 936842 - RNA, 20 nt, Human
agccccuaaaacucuuccca

SEQ ID NO: 936843 - RNA, 20 nt, Human
agcuccccccacacuccacc

SEQ ID NO: 936844 - RNA, 19 nt, Human
aggaaucugcugaguacag

SEQ ID NO: 936845 - RNA, 24 nt, Human
aggaguaaacaaaucugaaucuca

SEQ ID NO: 936846 - RNA, 20 nt, Human
aggaugaauaaacaugaugg

SEQ ID NO: 936847 - RNA, 19 nt, Human
agggguuacauccuacagg

SEQ ID NO: 936848 - RNA, 21 nt, Human
agggugccaccucagagcucc

SEQ ID NO: 936849 - RNA, 21 nt, Human
aguaaauggugacaaucacaa

SEQ ID NO: 936850 - RNA, 24 nt, Human
agucuuggccaacacgaagcugag

SEQ ID NO: 936851 - RNA, 25 nt, Human
agugagaaaaaaccgguuuaaaucc

SEQ ID NO: 936852 - RNA, 21 nt, Human
agugcuccaaaucuaccccuu

SEQ ID NO: 936853 - RNA, 21 nt, Human
aguuacugugcuuuugcuuuu

SEQ ID NO: 936854 - RNA, 19 nt, Human
aguucaaacaugaucccag

SEQ ID NO: 936855 - RNA, 18 nt, Human
auaagcccaaaggcacug

SEQ ID NO: 936856 - RNA, 21 nt, Human
auaaggggaugagcuggggga

SEQ ID NO: 936857 - RNA, 21 nt, Human
aucacuucuagacauguauac

SEQ ID NO: 936858 - RNA, 24 nt, Human
aucaggaagaaaguacuaaauuuc

SEQ ID NO: 936859 - RNA, 26 nt, Human
auccacuccacacuacugcaccaugg

SEQ ID NO: 936860 - RNA, 21 nt, Human
aucucuugcugcuccccgugu

SEQ ID NO: 936861 - RNA, 23 nt, Human
augaucccagcuccacaagaucu

SEQ ID NO: 936862 - RNA, 24 nt, Human
augccaauggaagcaacuuuuguc

SEQ ID NO: 936863 - RNA, 19 nt, Human
augggccuggagaucuggg

SEQ ID NO: 936864 - RNA, 21 nt, Human
augguaagaaaagcccugcuc

SEQ ID NO: 936865 - RNA, 19 nt, Human
augguuccauuuccccagc

SEQ ID NO: 936866 - RNA, 24 nt, Human
auguuggccugcucagugggggca

SEQ ID NO: 936867 - RNA, 24 nt, Human
auucccacaaagagaggccuacug

SEQ ID NO: 936868 - RNA, 22 nt, Human
auuugagaugacaugacuaucc

SEQ ID NO: 936869 - RNA, 20 nt, Human
caaacucccccgcccccuuc

SEQ ID NO: 936870 - RNA, 24 nt, Human
caaacucccccgcccccuucuuuu

SEQ ID NO: 936871 - RNA, 25 nt, Human
caaacucccccgcccccuucuuuuu

SEQ ID NO: 936872 - RNA, 23 nt, Human
caaagaacaccugacauuauuca

SEQ ID NO: 936873 - RNA, 24 nt, Human
caaaggcagaucccugcaagacaa

SEQ ID NO: 936874 - RNA, 21 nt, Human
caaaugucuggugccagaggc

SEQ ID NO: 936875 - RNA, 18 nt, Human
caacacgaagcugagugc

SEQ ID NO: 936876 - RNA, 21 nt, Human
caacaggagaccccucagaag

SEQ ID NO: 936877 - RNA, 23 nt, Human
caacaggagaccccucagaaggu

SEQ ID NO: 936878 - RNA, 21 nt, Human
caacaggcaccacuuuccagc

SEQ ID NO: 936879 - RNA, 21 nt, Human
caagacaaagccaaggccuug

SEQ ID NO: 936880 - RNA, 24 nt, Human
caagacaaagccaaggccuugcau

SEQ ID NO: 936881 - RNA, 18 nt, Human
caagccgaggcgcggcgc

SEQ ID NO: 936882 - RNA, 20 nt, Human
caagcuguuacccauccuuu

SEQ ID NO: 936883 - RNA, 22 nt, Human
caaggaauuaucauuuccuuca

SEQ ID NO: 936884 - RNA, 20 nt, Human
caaugguagaggccacaacu

SEQ ID NO: 936885 - RNA, 20 nt, Human
cacaaccccaugccuuaccc

SEQ ID NO: 936886 - RNA, 23 nt, Human
cacacuccaccacuaaccucucu

SEQ ID NO: 936887 - RNA, 18 nt, Human
cacaggcuaagaaggagc

SEQ ID NO: 936888 - RNA, 20 nt, Human
cacaucuccuccacuccuaa

SEQ ID NO: 936889 - RNA, 24 nt, Human
caccaaagaaacacagggguuaca

SEQ ID NO: 936890 - RNA, 21 nt, Human
caccacaaccccaugccuuac

SEQ ID NO: 936891 - RNA, 24 nt, Human
caccacaaccccaugccuuaccca

SEQ ID NO: 936892 - RNA, 20 nt, Human
cacccccucccacugaccac

SEQ ID NO: 936893 - RNA, 23 nt, Human
cacccccucccacugaccacaca

SEQ ID NO: 936894 - RNA, 20 nt, Human
cacucugcccucuaagccuc

SEQ ID NO: 936895 - RNA, 21 nt, Human
cacuucaaggccaccagacac

SEQ ID NO: 936896 - RNA, 23 nt, Human
cacuucaaggccaccagacacuc

SEQ ID NO: 936897 - RNA, 23 nt, Human
cagaacacacaucuccuccacuc

SEQ ID NO: 936898 - RNA, 23 nt, Human
cagacugcaaaugucuggugcca

SEQ ID NO: 936899 - RNA, 22 nt, Human
cagagcacccacacaccaaagg

SEQ ID NO: 936900 - RNA, 23 nt, Human
cagagcagugacccccaagagcc

SEQ ID NO: 936901 - RNA, 23 nt, Human
cagcaccugcacaguuggcuugc

SEQ ID NO: 936902 - RNA, 19 nt, Human
cagcagagcagugaccccc

SEQ ID NO: 936903 - RNA, 21 nt, Human
cagcagagcagugacccccaa

SEQ ID NO: 936904 - RNA, 21 nt, Human
cagcaggaauggacguccccu

SEQ ID NO: 936905 - RNA, 25 nt, Human
cagccucuggacuccggcaguuccc

SEQ ID NO: 936906 - RNA, 22 nt, Human
cagccuguacagaccaaacaca

SEQ ID NO: 936907 - RNA, 23 nt, Human
cagccuguacagaccaaacacaa

SEQ ID NO: 936908 - RNA, 19 nt, Human
cagcuccagagcccaugcc

SEQ ID NO: 936909 - RNA, 20 nt, Human
cagcuccagagcccaugcca

SEQ ID NO: 936910 - RNA, 20 nt, Human
cagcuggggcauugggcugg

SEQ ID NO: 936911 - RNA, 21 nt, Human
caggauaagggccuggcugcu

SEQ ID NO: 936912 - RNA, 23 nt, Human
cagggacaggguggacacugaga

SEQ ID NO: 936913 - RNA, 20 nt, Human
caggucagcccaagcccugc

SEQ ID NO: 936914 - RNA, 27 nt, Human
cauagcggggugaacagaacagaacaa

SEQ ID NO: 936915 - RNA, 22 nt, Human
caucaguaaauggugacaauca

SEQ ID NO: 936916 - RNA, 23 nt, Human
cauccucgguucugaguauucac

SEQ ID NO: 936917 - RNA, 18 nt, Human
caucucaccacccagagc

SEQ ID NO: 936918 - RNA, 20 nt, Human
caucuggaauggaagugacc

SEQ ID NO: 936919 - RNA, 21 nt, Human
caugaacuacauuaauuaccc

SEQ ID NO: 936920 - RNA, 21 nt, Human
caugcaaaagcccaucccugg

SEQ ID NO: 936921 - RNA, 28 nt, Human
cauggaaugacaccacucugcccucuaa

SEQ ID NO: 936922 - RNA, 25 nt, Human
cauugcacauauggaucccuuugcc

SEQ ID NO: 936923 - RNA, 22 nt, Human
ccaaacagagcccacaucuaug

SEQ ID NO: 936924 - RNA, 22 nt, Human
ccaaagaaagcuaccaccaaag

SEQ ID NO: 936925 - RNA, 22 nt, Human
ccaagagauccacaaacucaga

SEQ ID NO: 936926 - RNA, 20 nt, Human
ccaagccgaggcgcggcgcg

SEQ ID NO: 936927 - RNA, 22 nt, Human
ccacaaacucagaacaaaagca

SEQ ID NO: 936928 - RNA, 22 nt, Human
ccacaaccccaugccuuaccca

SEQ ID NO: 936929 - RNA, 21 nt, Human
ccacacuccaccacuaaccuc

SEQ ID NO: 936930 - RNA, 23 nt, Human
ccacagagagggccagcacuaaa

SEQ ID NO: 936931 - RNA, 18 nt, Human
ccaccuggugaugaaaug

SEQ ID NO: 936932 - RNA, 19 nt, Human
ccacucugcccucuaagcc

SEQ ID NO: 936933 - RNA, 22 nt, Human
ccagcaggaauggacguccccu

SEQ ID NO: 936934 - RNA, 25 nt, Human
cccacugaccacacaaaaaagcaaa

SEQ ID NO: 936935 - RNA, 19 nt, Human
cccagaaaggaugcaaugu

SEQ ID NO: 936936 - RNA, 19 nt, Human
cccaguggaugugaagaug

SEQ ID NO: 936937 - RNA, 20 nt, Human
ccccagaaaccaaagggacc

SEQ ID NO: 936938 - RNA, 22 nt, Human
ccccaguggaccaccccugagc

SEQ ID NO: 936939 - RNA, 18 nt, Human
ccccaugccuuacccagg

SEQ ID NO: 936940 - RNA, 19 nt, Human
ccccaugccuuacccagga

SEQ ID NO: 936941 - RNA, 21 nt, Human
ccccugaaggagguugcaggg

SEQ ID NO: 936942 - RNA, 18 nt, Human
ccccugguuggcccagau

SEQ ID NO: 936943 - RNA, 18 nt, Human
ccccuucccgcgggggcc

SEQ ID NO: 936944 - RNA, 22 nt, Human
cccgcacugggcuggccucccc

SEQ ID NO: 936945 - RNA, 21 nt, Human
cccgcaucgccggcgcggccg

SEQ ID NO: 936946 - RNA, 19 nt, Human
cccucaugaacagugaggu

SEQ ID NO: 936947 - RNA, 18 nt, Human
cccugcaguuccaccccc

SEQ ID NO: 936948 - RNA, 22 nt, Human
cccugcucuguguccuacuugg

SEQ ID NO: 936949 - RNA, 18 nt, Human
cccugggccucacuucug

SEQ ID NO: 936950 - RNA, 22 nt, Human
cccuuguaucugccccagugga

SEQ ID NO: 936951 - RNA, 18 nt, Human
cccuuuaggguuuugugg

SEQ ID NO: 936952 - RNA, 20 nt, Human
ccgggacuggggcgggcgcg

SEQ ID NO: 936953 - RNA, 24 nt, Human
ccuaaagugcuccaaaucuacccc

SEQ ID NO: 936954 - RNA, 18 nt, Human
ccuacuguggccuucuag

SEQ ID NO: 936955 - RNA, 24 nt, Human
ccuaggagccuuaguuuccucauc

SEQ ID NO: 936956 - RNA, 19 nt, Human
ccuaugguuugcuguuugg

SEQ ID NO: 936957 - RNA, 23 nt, Human
ccucagaaggugcagagcccccc

SEQ ID NO: 936958 - RNA, 22 nt, Human
ccuccagacugcccuggggccu

SEQ ID NO: 936959 - RNA, 20 nt, Human
ccucccacuccccagcaccu

SEQ ID NO: 936960 - RNA, 19 nt, Human
ccucccacugaccacacaa

SEQ ID NO: 936961 - RNA, 19 nt, Human
ccugagcccaguuacugcc

SEQ ID NO: 936962 - RNA, 21 nt, Human
ccugagcccaguuacugccau

SEQ ID NO: 936963 - RNA, 18 nt, Human
ccugcaguuccacccccu

SEQ ID NO: 936964 - RNA, 18 nt, Human
ccugcaguuccacccccu

SEQ ID NO: 936965 - RNA, 22 nt, Human
ccugccccuuuggaacccagga

SEQ ID NO: 936966 - RNA, 21 nt, Human
ccugggccuuuuggagcagca

SEQ ID NO: 936967 - RNA, 20 nt, Human
ccuggggagcugggaaugug

SEQ ID NO: 936968 - RNA, 22 nt, Human
ccuucaagauggagcuuccuag

SEQ ID NO: 936969 - RNA, 20 nt, Human
cgcgaugggcaucugucucc

SEQ ID NO: 936970 - RNA, 19 nt, Human
cuaaagacugagcucuguc

SEQ ID NO: 936971 - RNA, 23 nt, Human
cuaccaccaaagaaacacagggg

SEQ ID NO: 936972 - RNA, 20 nt, Human
cucaaacucccccgcccccu

SEQ ID NO: 936973 - RNA, 18 nt, Human
cucauagaaucugagucu

SEQ ID NO: 936974 - RNA, 22 nt, Human
cuccagacugcccuggggccuu

SEQ ID NO: 936975 - RNA, 18 nt, Human
cucccacuccccagcacc

SEQ ID NO: 936976 - RNA, 20 nt, Human
cucccuccacccucauccug

SEQ ID NO: 936977 - RNA, 19 nt, Human
cuccggcaguuccccaucc

SEQ ID NO: 936978 - RNA, 19 nt, Human
cuccugagcccaguuacug

SEQ ID NO: 936979 - RNA, 20 nt, Human
cuccugagcccaguuacugc

SEQ ID NO: 936980 - RNA, 22 nt, Human
cugaccacacaaaaaagcaaag

SEQ ID NO: 936981 - RNA, 19 nt, Human
cugccuaaagugcuccaaa

SEQ ID NO: 936982 - RNA, 22 nt, Human
cugcuccccguguugugcugug

SEQ ID NO: 936983 - RNA, 18 nt, Human
cuggaagaauuuaaugag

SEQ ID NO: 936984 - RNA, 19 nt, Human
cuggccggccagugaaugc

SEQ ID NO: 936985 - RNA, 18 nt, Human
cuggccuugcguuccugu

SEQ ID NO: 936986 - RNA, 18 nt, Human
cuggcugcuacucccugg

SEQ ID NO: 936987 - RNA, 22 nt, Human
cuggcugucacucauggcccug

SEQ ID NO: 936988 - RNA, 22 nt, Human
cuucagccuguacagaccaaac

SEQ ID NO: 936989 - RNA, 21 nt, Human
cuucccagaagaacuggcauc

SEQ ID NO: 936990 - RNA, 22 nt, Human
cuucuagaggcccaaggacccc

SEQ ID NO: 936991 - RNA, 22 nt, Human
cuucuugaauucucugccccuc

SEQ ID NO: 936992 - RNA, 22 nt, Human
cuugcugcuccccguguugugc

SEQ ID NO: 936993 - RNA, 18 nt, Human
gaaauguccuauggaaag

SEQ ID NO: 936994 - RNA, 22 nt, Human
gaacacacaucuccuccacucc

SEQ ID NO: 936995 - RNA, 23 nt, Human
gaacacagggccaccagucuucc

SEQ ID NO: 936996 - RNA, 22 nt, Human
gaaguucccugcaguuccaccc

SEQ ID NO: 936997 - RNA, 18 nt, Human
gacugcuucucccaaugc

SEQ ID NO: 936998 - RNA, 19 nt, Human
gacuugcccacauuagcaa

SEQ ID NO: 936999 - RNA, 20 nt, Human
gagacuggcuuuccugggga

SEQ ID NO: 937000 - RNA, 21 nt, Human
gagagcagggggcuucagccu

SEQ ID NO: 937001 - RNA, 21 nt, Human
gagcacccacacaccaaagga

SEQ ID NO: 937002 - RNA, 24 nt, Human
gagcccaguuacugccauucacac

SEQ ID NO: 937003 - RNA, 18 nt, Human
gagccgagggaggccagc

SEQ ID NO: 937004 - RNA, 22 nt, Human
gagccucaaucuuuuccaugac

SEQ ID NO: 937005 - RNA, 22 nt, Human
gaggagccuuccagaccccagc

SEQ ID NO: 937006 - RNA, 24 nt, Human
gaggccacaacucuuugucuuuga

SEQ ID NO: 937007 - RNA, 19 nt, Human
gcaaagaacaccuuuauca

SEQ ID NO: 937008 - RNA, 18 nt, Human
gcaaugguagaggccaca

SEQ ID NO: 937009 - RNA, 19 nt, Human
gcacggagaagucucauug

SEQ ID NO: 937010 - RNA, 21 nt, Human
gcagaucccugcaagacaaag

SEQ ID NO: 937011 - RNA, 20 nt, Human
gcagguuaggugugaggaug

SEQ ID NO: 937012 - RNA, 22 nt, Human
gccacaacagcauguuggccug

SEQ ID NO: 937013 - RNA, 22 nt, Human
gccuaagaccuauucacugucc

SEQ ID NO: 937014 - RNA, 19 nt, Human
gcgcggccgcuggcugugc

SEQ ID NO: 937015 - RNA, 21 nt, Human
gcgcggcgcgaacugaggcgg

SEQ ID NO: 937016 - RNA, 19 nt, Human
gcgggcagcucagccccuu

SEQ ID NO: 937017 - RNA, 18 nt, Human
gcucuguguccuacuugg

SEQ ID NO: 937018 - RNA, 19 nt, Human
gcuuguggguguacuucug

SEQ ID NO: 937019 - RNA, 20 nt, Human
ggacacagcuggccggccag

SEQ ID NO: 937020 - RNA, 19 nt, Human
ggaccccugguuggcccag

SEQ ID NO: 937021 - RNA, 23 nt, Human
ggacuggggcgggcgcggggugg

SEQ ID NO: 937022 - RNA, 18 nt, Human
ggagccagaaauccaagg

SEQ ID NO: 937023 - RNA, 25 nt, Human
ggagccagaaauccaaggccuugcu

SEQ ID NO: 937024 - RNA, 25 nt, Human
ggaggccagcaggcccagugggggu

SEQ ID NO: 937025 - RNA, 18 nt, Human
ggagguugcagggggcag

SEQ ID NO: 937026 - RNA, 24 nt, Human
ggaguggaggaugaauaaacauga

SEQ ID NO: 937027 - RNA, 22 nt, Human
ggcaucaggaagaaaguacuaa

SEQ ID NO: 937028 - RNA, 24 nt, Human
ggcccaggcuggggaagggguaca

SEQ ID NO: 937029 - RNA, 25 nt, Human
ggcggcggcgggcagcucagccccu

SEQ ID NO: 937030 - RNA, 24 nt, Human
ggcuuuccuggggagcugggaaug

SEQ ID NO: 937031 - RNA, 19 nt, Human
gggaggccagcaggcccag

SEQ ID NO: 937032 - RNA, 18 nt, Human
ggggaaggccagcugggg

SEQ ID NO: 937033 - RNA, 28 nt, Human
ggggagacccccugggggucaggagccu

SEQ ID NO: 937034 - RNA, 18 nt, Human
gggguuccuuugcuugcc

SEQ ID NO: 937035 - RNA, 22 nt, Human
ggguggggagacccccuggggg

SEQ ID NO: 937036 - RNA, 21 nt, Human
gggugggguggggagaccccc

SEQ ID NO: 937037 - RNA, 21 nt, Human
guacagaccaaacacaaucua

SEQ ID NO: 937038 - RNA, 18 nt, Human
guccagacugcaaauguc

SEQ ID NO: 937039 - RNA, 21 nt, Human
guccagacugcaaaugucugg

SEQ ID NO: 937040 - RNA, 26 nt, Human
guccuguucaugcuuccucuugggcu

SEQ ID NO: 937041 - RNA, 20 nt, Human
gugcuccaaaucuaccccuu

SEQ ID NO: 937042 - RNA, 20 nt, Human
guggagaaauuuccugggcu

SEQ ID NO: 937043 - RNA, 18 nt, Human
guggccccgcaucgccgg

SEQ ID NO: 937044 - RNA, 23 nt, Human
guggcucuggcaagcuguuaccc

SEQ ID NO: 937045 - RNA, 19 nt, Human
guggugguguuggcuccgg

SEQ ID NO: 937046 - RNA, 18 nt, Human
guuuccuuuuuuuccuuu

SEQ ID NO: 937047 - RNA, 20 nt, Human
uaaacaugaugggucagagg

SEQ ID NO: 937048 - RNA, 24 nt, Human
uaaagugaggagccuuccagaccc

SEQ ID NO: 937049 - RNA, 24 nt, Human
uaaagugcuccaaaucuaccccuu

SEQ ID NO: 937050 - RNA, 21 nt, Human
uaacaggauaagggccuggcu

SEQ ID NO: 937051 - RNA, 18 nt, Human
uaagaaaagcccugcucu

SEQ ID NO: 937052 - RNA, 30 nt, Human
uaagaaaauagcauacagcaggcagauuuu

SEQ ID NO: 937053 - RNA, 21 nt, Human
uaaggaaggugcguggguuuc

SEQ ID NO: 937054 - RNA, 22 nt, Human
uaauguacagucaaaaaauaua

SEQ ID NO: 937055 - RNA, 21 nt, Human
uaauuacccugagcuccaggc

SEQ ID NO: 937056 - RNA, 23 nt, Human
uacaggcuccuugcaggcugggg

SEQ ID NO: 937057 - RNA, 18 nt, Human
uaccaccaaagaaacaca

SEQ ID NO: 937058 - RNA, 27 nt, Human
uaccccuucuaauguugaugagggaga

SEQ ID NO: 937059 - RNA, 23 nt, Human
uacuaaggaaggugcguggguuu

SEQ ID NO: 937060 - RNA, 18 nt, Human
uagcauucaggaaucugc

SEQ ID NO: 937061 - RNA, 24 nt, Human
uaucaaacacccaaacuguacaag

SEQ ID NO: 937062 - RNA, 22 nt, Human
uaucuuaggaaaacaugaaucu

SEQ ID NO: 937063 - RNA, 20 nt, Human
uaucuuguuugucucuucca

SEQ ID NO: 937064 - RNA, 26 nt, Human
uaugacccuuucuccuccacauccaa

SEQ ID NO: 937065 - RNA, 18 nt, Human
uauucugccugaccccuc

SEQ ID NO: 937066 - RNA, 19 nt, Human
uauuuuguuuucucuucuc

SEQ ID NO: 937067 - RNA, 23 nt, Human
ucaaaaaauauaucugauauuca

SEQ ID NO: 937068 - RNA, 23 nt, Human
ucaaaggcagaucccugcaagac

SEQ ID NO: 937069 - RNA, 21 nt, Human
ucaaugucucuggaucugggu

SEQ ID NO: 937070 - RNA, 19 nt, Human
ucacaaacccuccuuuaga

SEQ ID NO: 937071 - RNA, 23 nt, Human
ucaccccuuccugagcagaaaaa

SEQ ID NO: 937072 - RNA, 27 nt, Human
ucacccuguaaaugggguggggugggg

SEQ ID NO: 937073 - RNA, 19 nt, Human
ucagaaaguggaaugcaaa

SEQ ID NO: 937074 - RNA, 20 nt, Human
ucagagcuccugagcccagu

SEQ ID NO: 937075 - RNA, 19 nt, Human
ucaugagagaucuacaugg

SEQ ID NO: 937076 - RNA, 24 nt, Human
uccaagaaucugcagagcuaugga

SEQ ID NO: 937077 - RNA, 19 nt, Human
uccaagccuugccacaucc

SEQ ID NO: 937078 - RNA, 23 nt, Human
uccacaaacucagaacaaaagca

SEQ ID NO: 937079 - RNA, 18 nt, Human
uccacaagaucucaccca

SEQ ID NO: 937080 - RNA, 19 nt, Human
uccacaagaucucacccau

SEQ ID NO: 937081 - RNA, 18 nt, Human
uccacacuacugcaccau

SEQ ID NO: 937082 - RNA, 22 nt, Human
uccacacuacugcaccaugguu

SEQ ID NO: 937083 - RNA, 19 nt, Human
uccaccacaaccccaugcc

SEQ ID NO: 937084 - RNA, 24 nt, Human
uccaccacaaccccaugccuuacc

SEQ ID NO: 937085 - RNA, 21 nt, Human
uccacuccacacuacugcacc

SEQ ID NO: 937086 - RNA, 20 nt, Human
ucccaaggcagugagguacc

SEQ ID NO: 937087 - RNA, 21 nt, Human
ucccagaagaacuggcaucag

SEQ ID NO: 937088 - RNA, 19 nt, Human
ucccagggugggagcuuuu

SEQ ID NO: 937089 - RNA, 18 nt, Human
ucccccagacugcuucuc

SEQ ID NO: 937090 - RNA, 20 nt, Human
ucccccagacugcuucuccc

SEQ ID NO: 937091 - RNA, 22 nt, Human
ucccccgcccccuucuuuuuga

SEQ ID NO: 937092 - RNA, 21 nt, Human
ucccugcaguuccacccccuc

SEQ ID NO: 937093 - RNA, 19 nt, Human
ucccugcuguucagucuau

SEQ ID NO: 937094 - RNA, 26 nt, Human
ucccuggaguugagcgggaaccuugg

SEQ ID NO: 937095 - RNA, 21 nt, Human
ucccuggggauccuggcccag

SEQ ID NO: 937096 - RNA, 20 nt, Human
uccuaauagugcccccucca

SEQ ID NO: 937097 - RNA, 22 nt, Human
uccuaugacccuuucuccucca

SEQ ID NO: 937098 - RNA, 23 nt, Human
uccugcuuuagagaaugguuggg

SEQ ID NO: 937099 - RNA, 21 nt, Human
uccuggggagcugggaaugug

SEQ ID NO: 937100 - RNA, 21 nt, Human
uccuugcaucuuccccaaaca

SEQ ID NO: 937101 - RNA, 23 nt, Human
uccuuguuuuacuuggcugugau

SEQ ID NO: 937102 - RNA, 24 nt, Human
uccuuguuuuacuuggcugugauu

SEQ ID NO: 937103 - RNA, 19 nt, Human
uccuuuagaaugcuggaag

SEQ ID NO: 937104 - RNA, 20 nt, Human
ucuaaagcuccauggacucc

SEQ ID NO: 937105 - RNA, 19 nt, Human
ucuagaggcccaaggaccu

SEQ ID NO: 937106 - RNA, 18 nt, Human
ucuauggcaaagcagcug

SEQ ID NO: 937107 - RNA, 27 nt, Human
ucucaccacccagagcaguucucagau

SEQ ID NO: 937108 - RNA, 20 nt, Human
ucucccugcuguucagucua

SEQ ID NO: 937109 - RNA, 23 nt, Human
ucuccuccacuccuaaggagaag

SEQ ID NO: 937110 - RNA, 19 nt, Human
ucucuucuggaggugggca

SEQ ID NO: 937111 - RNA, 19 nt, Human
ucugcugaguacagcugug

SEQ ID NO: 937112 - RNA, 20 nt, Human
ucuggggcuagaccagccuu

SEQ ID NO: 937113 - RNA, 24 nt, Human
ucuguagugagaaaaaaccggggc

SEQ ID NO: 937114 - RNA, 19 nt, Human
ucuguccaccacaacccca

SEQ ID NO: 937115 - RNA, 18 nt, Human
ucuguugguuccuuugca

SEQ ID NO: 937116 - RNA, 22 nt, Human
ucuucaggcucacccaucucuc

SEQ ID NO: 937117 - RNA, 22 nt, Human
ucuuccagaauguuacuccugg

SEQ ID NO: 937118 - RNA, 19 nt, Human
ucuugaauucucugccccu

SEQ ID NO: 937119 - RNA, 23 nt, Human
ucuugggcucacccaugucuucc

SEQ ID NO: 937120 - RNA, 24 nt, Human
ugaaaggaaaagaggcagccccau

SEQ ID NO: 937121 - RNA, 18 nt, Human
ugaaauauucauagaguc

SEQ ID NO: 937122 - RNA, 20 nt, Human
ugaaaugugugcacuggaaa

SEQ ID NO: 937123 - RNA, 19 nt, Human
ugaacagaacagaacaaca

SEQ ID NO: 937124 - RNA, 22 nt, Human
ugaaugcccuuugaugaccuuu

SEQ ID NO: 937125 - RNA, 23 nt, Human
ugaccacacaaaaaagcaaagaa

SEQ ID NO: 937126 - RNA, 23 nt, Human
ugacccccaagagccucaaucuu

SEQ ID NO: 937127 - RNA, 20 nt, Human
ugaccuguuuacccagccca

SEQ ID NO: 937128 - RNA, 23 nt, Human
ugacguaucuguuccacucuagu

SEQ ID NO: 937129 - RNA, 20 nt, Human
ugacuuaggaacagcguccu

SEQ ID NO: 937130 - RNA, 22 nt, Human
ugacuucauccaagaaucugca

SEQ ID NO: 937131 - RNA, 19 nt, Human
ugagaugggcagcuuaucc

SEQ ID NO: 937132 - RNA, 23 nt, Human
ugagcucuguccaccacaacccc

SEQ ID NO: 937133 - RNA, 24 nt, Human
ugaggaacagagcacauuuuuuuu

SEQ ID NO: 937134 - RNA, 18 nt, Human
ugagguaagagcuccugu

SEQ ID NO: 937135 - RNA, 23 nt, Human
ugagugcaucucucuaaagcucc

SEQ ID NO: 937136 - RNA, 19 nt, Human
ugaguggauuucaguuggu

SEQ ID NO: 937137 - RNA, 20 nt, Human
ugaguggauuucaguuggug

SEQ ID NO: 937138 - RNA, 20 nt, Human
ugaucucuacaagacaucuc

SEQ ID NO: 937139 - RNA, 23 nt, Human
ugaugaccuguuuacccagccca

SEQ ID NO: 937140 - RNA, 21 nt, Human
ugcaaguuuguuucucccuga

SEQ ID NO: 937141 - RNA, 22 nt, Human
ugcaggccauugggauucaugg

SEQ ID NO: 937142 - RNA, 21 nt, Human
ugcagguuaggugugaggaug

SEQ ID NO: 937143 - RNA, 21 nt, Human
ugcaucuuccccaaacagagc

SEQ ID NO: 937144 - RNA, 20 nt, Human
ugccacauccuugucccaug

SEQ ID NO: 937145 - RNA, 23 nt, Human
ugccaggaaaaaauaaaaggccc

SEQ ID NO: 937146 - RNA, 23 nt, Human
ugccauuaccugccccuuuggaa

SEQ ID NO: 937147 - RNA, 22 nt, Human
ugcccaguggaugugaagaugu

SEQ ID NO: 937148 - RNA, 19 nt, Human
ugccccagggagguggucc

SEQ ID NO: 937149 - RNA, 18 nt, Human
ugccugaccccucagaag

SEQ ID NO: 937150 - RNA, 23 nt, Human
ugcucagugggggcacuugggug

SEQ ID NO: 937151 - RNA, 24 nt, Human
ugcucagugggggcacuugggugg

SEQ ID NO: 937152 - RNA, 23 nt, Human
ugcucucaugagagaucuacaug

SEQ ID NO: 937153 - RNA, 18 nt, Human
uggaaaauaaucaaaucu

SEQ ID NO: 937154 - RNA, 24 nt, Human
uggaagcaacuuuugucggcuccu

SEQ ID NO: 937155 - RNA, 19 nt, Human
uggaaugacaccacucugc

SEQ ID NO: 937156 - RNA, 19 nt, Human
uggaauggaagugaccuga

SEQ ID NO: 937157 - RNA, 21 nt, Human
uggaauggaagugaccugaaa

SEQ ID NO: 937158 - RNA, 27 nt, Human
uggaauggaagugaccugaaauccauu

SEQ ID NO: 937159 - RNA, 20 nt, Human
uggaggugggcaggugggau

SEQ ID NO: 937160 - RNA, 21 nt, Human
uggaggugggcaggugggaug

SEQ ID NO: 937161 - RNA, 19 nt, Human
uggauuuacuuuuccuauu

SEQ ID NO: 937162 - RNA, 18 nt, Human
uggcaauggggaguggag

SEQ ID NO: 937163 - RNA, 22 nt, Human
uggcagacagcagguucuuccu

SEQ ID NO: 937164 - RNA, 18 nt, Human
uggcuccgcucgggcucc

SEQ ID NO: 937165 - RNA, 23 nt, Human
uggcucugggaggcagcaggguc

SEQ ID NO: 937166 - RNA, 18 nt, Human
ugggauagcuugugaggg

SEQ ID NO: 937167 - RNA, 23 nt, Human
uggggcuagaccagccuucaaga

SEQ ID NO: 937168 - RNA, 21 nt, Human
ugggggaaaucaucacuggcc

SEQ ID NO: 937169 - RNA, 21 nt, Human
uggggguggguccccgggguc

SEQ ID NO: 937170 - RNA, 19 nt, Human
uggguuccaguuuccuggc

SEQ ID NO: 937171 - RNA, 22 nt, Human
ugguagaggccacaacucuuug

SEQ ID NO: 937172 - RNA, 24 nt, Human
uggugaggacuuacagcaagagcu

SEQ ID NO: 937173 - RNA, 24 nt, Human
uguauacauggaaaaccuccaaca

SEQ ID NO: 937174 - RNA, 23 nt, Human
uguauucauaagcccaaaggcac

SEQ ID NO: 937175 - RNA, 19 nt, Human
ugucacagaagugaccauu

SEQ ID NO: 937176 - RNA, 21 nt, Human
ugucccuggacuucuggacag

SEQ ID NO: 937177 - RNA, 23 nt, Human
uguggcuaggguaaagugaggag

SEQ ID NO: 937178 - RNA, 21 nt, Human
ugugucagaagaaacuggagg

SEQ ID NO: 937179 - RNA, 19 nt, Human
uguuguuugcuuugagcuu

SEQ ID NO: 937180 - RNA, 22 nt, Human
uuaaaaccaacaaggcuaaauc

SEQ ID NO: 937181 - RNA, 23 nt, Human
uuacuggacugauaccucuaugu

SEQ ID NO: 937182 - RNA, 20 nt, Human
uuagauaucucugcugugcu

SEQ ID NO: 937183 - RNA, 23 nt, Human
uuauaugcccaguggaugugaag

SEQ ID NO: 937184 - RNA, 20 nt, Human
uucaguuggugaaugcccuu

SEQ ID NO: 937185 - RNA, 18 nt, Human
uuccaaagaaagcuacca

SEQ ID NO: 937186 - RNA, 21 nt, Human
uuccaaagaaagcuaccacca

SEQ ID NO: 937187 - RNA, 21 nt, Human
uuccuaauagugcccccucca

SEQ ID NO: 937188 - RNA, 23 nt, Human
uuccuauuuccuuguuuuacuug

SEQ ID NO: 937189 - RNA, 21 nt, Human
uuccuggccuugcguuccugu

SEQ ID NO: 937190 - RNA, 23 nt, Human
uuccugggcuucucauuacuucc

SEQ ID NO: 937191 - RNA, 22 nt, Human
uuccuggggagcugggaaugug

SEQ ID NO: 937192 - RNA, 19 nt, Human
uuccuugcaucuuccccaa

SEQ ID NO: 937193 - RNA, 20 nt, Human
uucucauagaaucugagucu

SEQ ID NO: 937194 - RNA, 23 nt, Human
uucucauagaaucugagucucau

SEQ ID NO: 937195 - RNA, 24 nt, Human
uucuuuaggaaggaguucaaauuu

SEQ ID NO: 937196 - RNA, 22 nt, Human
uugagggccaaagcuguaccuu

SEQ ID NO: 937197 - RNA, 25 nt, Human
uugaugaccuuuucccaucucuucu

SEQ ID NO: 937198 - RNA, 23 nt, Human
uugcaggcuggggaaggccagcu

SEQ ID NO: 937199 - RNA, 20 nt, Human
uugcuggguuaccccaacau

SEQ ID NO: 937200 - RNA, 21 nt, Human
uuggucucaugcaauauuaua

SEQ ID NO: 937201 - RNA, 24 nt, Human
uugguucccucucauugacucacu

SEQ ID NO: 937202 - RNA, 22 nt, Human
uuucaagguggcugcuggguug

SEQ ID NO: 937203 - RNA, 22 nt, Human
uuugccugaguuuccuuuuuuu

SEQ ID NO: 937204 - RNA, 24 nt, Human
aaaaaagcacugguccuaccucuu

SEQ ID NO: 937205 - RNA, 24 nt, Human
aaaaaagcacugguccuaccucuu

SEQ ID NO: 937206 - RNA, 19 nt, Human
aaaagaaacaaaaaagcac

SEQ ID NO: 937207 - RNA, 19 nt, Human
aaaagaaacaaaaaagcac

SEQ ID NO: 937208 - RNA, 21 nt, Human
aaagaaacaaaaaagcacugg

SEQ ID NO: 937209 - RNA, 21 nt, Human
aaagaaacaaaaaagcacugg

SEQ ID NO: 937210 - RNA, 23 nt, Human
aacaaaaaagcacugguccuacc

SEQ ID NO: 937211 - RNA, 23 nt, Human
aacaaaaaagcacugguccuacc

SEQ ID NO: 937212 - RNA, 26 nt, Human
aagaaacaaaaaagcacugguccuac

SEQ ID NO: 937213 - RNA, 26 nt, Human
aagaaacaaaaaagcacugguccuac

SEQ ID NO: 937214 - RNA, 23 nt, Human
aagucccaguacauccucuaccc

SEQ ID NO: 937215 - RNA, 19 nt, Human
acaaacaucagcuuaugcc

SEQ ID NO: 937216 - RNA, 19 nt, Human
acaaacaucagcuuaugcc

SEQ ID NO: 937217 - RNA, 22 nt, Human
acaaacaucagcuuaugccucc

SEQ ID NO: 937218 - RNA, 22 nt, Human
acaaacaucagcuuaugccucc

SEQ ID NO: 937219 - RNA, 23 nt, Human
acaagcgaaaggcccugcccaca

SEQ ID NO: 937220 - RNA, 21 nt, Human
acuccagaggguaugaccagc

SEQ ID NO: 937221 - RNA, 21 nt, Human
acuccagaggguaugaccagc

SEQ ID NO: 937222 - RNA, 20 nt, Human
agaccuucccacccacccaa

SEQ ID NO: 937223 - RNA, 24 nt, Human
agcccgagccggagcggagcggcg

SEQ ID NO: 937224 - RNA, 24 nt, Human
agcccgaggcgagccggagcccga

SEQ ID NO: 937225 - RNA, 18 nt, Human
aggaagaggggggcgagg

SEQ ID NO: 937226 - RNA, 19 nt, Human
aggaagaggggggcgaggg

SEQ ID NO: 937227 - RNA, 25 nt, Human
aggcagcaccaggccucucagcaca

SEQ ID NO: 937228 - RNA, 19 nt, Human
aggcugagugggaaccuug

SEQ ID NO: 937229 - RNA, 30 nt, Human
aggggcugcagggggcaguggggaggaggg

SEQ ID NO: 937230 - RNA, 23 nt, Human
aggggcuguuguucagccuugca

SEQ ID NO: 937231 - RNA, 21 nt, Human
auaucucaggggcugcagggg

SEQ ID NO: 937232 - RNA, 19 nt, Human
aucagcuuaugccucccca

SEQ ID NO: 937233 - RNA, 19 nt, Human
aucagcuuaugccucccca

SEQ ID NO: 937234 - RNA, 22 nt, Human
auggugccaaggggcuuggccu

SEQ ID NO: 937235 - RNA, 25 nt, Human
caaaaaagcacugguccuaccucuu

SEQ ID NO: 937236 - RNA, 24 nt, Human
caaaaauaacaaaagaaacaaaaa

SEQ ID NO: 937237 - RNA, 24 nt, Human
caaaaauaacaaaagaaacaaaaa

SEQ ID NO: 937238 - RNA, 19 nt, Human
caaaagaaacaaaaaagca

SEQ ID NO: 937239 - RNA, 20 nt, Human
caaggggcuuggccugaguc

SEQ ID NO: 937240 - RNA, 21 nt, Human
caaguggggagggauagugag

SEQ ID NO: 937241 - RNA, 21 nt, Human
cacagcccccugcgagguagg

SEQ ID NO: 937242 - RNA, 21 nt, Human
cacagcccccugcgagguagg

SEQ ID NO: 937243 - RNA, 18 nt, Human
cacauaucagggaagcaa

SEQ ID NO: 937244 - RNA, 24 nt, Human
caccaggccucucagcacaggccu

SEQ ID NO: 937245 - RNA, 25 nt, Human
cagcccgaggcgagccggagcccga

SEQ ID NO: 937246 - RNA, 19 nt, Human
caggaccuucaggggcugg

SEQ ID NO: 937247 - RNA, 18 nt, Human
caggagccacaggggccu

SEQ ID NO: 937248 - RNA, 18 nt, Human
cagugggugccccaggcc

SEQ ID NO: 937249 - RNA, 21 nt, Human
ccacccaaccaaaaauaacaa

SEQ ID NO: 937250 - RNA, 25 nt, Human
ccacccacccacccaaaaauaacaa

SEQ ID NO: 937251 - RNA, 19 nt, Human
cccaaaaauaacaaaagaa

SEQ ID NO: 937252 - RNA, 20 nt, Human
cccaaaaauaacaaaagaaa

SEQ ID NO: 937253 - RNA, 20 nt, Human
cccaaccaaaaauaacaaaa

SEQ ID NO: 937254 - RNA, 18 nt, Human
cccacaugcagagggggc

SEQ ID NO: 937255 - RNA, 23 nt, Human
cccacccaaaaauaacaaaagaa

SEQ ID NO: 937256 - RNA, 25 nt, Human
cccacccaaccaaaaauaacaaaag

SEQ ID NO: 937257 - RNA, 25 nt, Human
cccacccacccaaaaauaacaaaag

SEQ ID NO: 937258 - RNA, 18 nt, Human
ccccagagccagccgucc

SEQ ID NO: 937259 - RNA, 27 nt, Human
ccccaggaccuucaggggcugggccag

SEQ ID NO: 937260 - RNA, 19 nt, Human
cccccagagccagccgucc

SEQ ID NO: 937261 - RNA, 19 nt, Human
cccccggagcccgagccca

SEQ ID NO: 937262 - RNA, 23 nt, Human
cccccggagcccgagcccagccc

SEQ ID NO: 937263 - RNA, 21 nt, Human
ccccggagcccgagcccagcc

SEQ ID NO: 937264 - RNA, 22 nt, Human
cccugcucuaacacugccccuc

SEQ ID NO: 937265 - RNA, 22 nt, Human
cccugcucuaacacugccccuc

SEQ ID NO: 937266 - RNA, 21 nt, Human
cccuggggaggacagucagug

SEQ ID NO: 937267 - RNA, 19 nt, Human
ccgucccggggcccggcgg

SEQ ID NO: 937268 - RNA, 21 nt, Human
ccuccccacagcccccugcga

SEQ ID NO: 937269 - RNA, 21 nt, Human
ccuccccacagcccccugcga

SEQ ID NO: 937270 - RNA, 23 nt, Human
ccucugaacuccagaggguauga

SEQ ID NO: 937271 - RNA, 23 nt, Human
ccucugaacuccagaggguauga

SEQ ID NO: 937272 - RNA, 22 nt, Human
ccugaccaggagcacaggggcc

SEQ ID NO: 937273 - RNA, 19 nt, Human
ccugcccacaguggaaggg

SEQ ID NO: 937274 - RNA, 20 nt, Human
ccuggggaggacagucagug

SEQ ID NO: 937275 - RNA, 24 nt, Human
ccuucccacccacccacccaaaaa

SEQ ID NO: 937276 - RNA, 19 nt, Human
cgagccggagcccgagccg

SEQ ID NO: 937277 - RNA, 18 nt, Human
cgagccggagcggagcgg

SEQ ID NO: 937278 - RNA, 20 nt, Human
cggagcggcgcggcgcggag

SEQ ID NO: 937279 - RNA, 21 nt, Human
cggagcggcgcggcgcggagc

SEQ ID NO: 937280 - RNA, 22 nt, Human
cgggcagccugaccaggagcac

SEQ ID NO: 937281 - RNA, 21 nt, Human
cgucccggggcccggcggcgg

SEQ ID NO: 937282 - RNA, 24 nt, Human
cguuuauuuacaaagcgcuuuaca

SEQ ID NO: 937283 - RNA, 19 nt, Human
cucacucaucccugccaaa

SEQ ID NO: 937284 - RNA, 20 nt, Human
cuccagugcuugccccaugg

SEQ ID NO: 937285 - RNA, 21 nt, Human
cuccccacagcccccugcgag

SEQ ID NO: 937286 - RNA, 21 nt, Human
cuccccacagcccccugcgag

SEQ ID NO: 937287 - RNA, 24 nt, Human
cucucugcagggccucacucaucc

SEQ ID NO: 937288 - RNA, 18 nt, Human
cugcaacagugggucagg

SEQ ID NO: 937289 - RNA, 24 nt, Human
cugccccuccccacaacgggcagc

SEQ ID NO: 937290 - RNA, 24 nt, Human
cugccccuccccacaacgggcagc

SEQ ID NO: 937291 - RNA, 21 nt, Human
cuggcccugagugugcagugg

SEQ ID NO: 937292 - RNA, 21 nt, Human
cugguccuaccucuuccucug

SEQ ID NO: 937293 - RNA, 21 nt, Human
cugguccuaccucuuccucug

SEQ ID NO: 937294 - RNA, 24 nt, Human
cuugcuaagcuccuccuuggccca

SEQ ID NO: 937295 - RNA, 23 nt, Human
gaauggggguguggccugcccca

SEQ ID NO: 937296 - RNA, 23 nt, Human
gaauggggguguggccugcccca

SEQ ID NO: 937297 - RNA, 21 nt, Human
gaccugcuuccccaggaccuu

SEQ ID NO: 937298 - RNA, 21 nt, Human
gagaccuucccacccacccaa

SEQ ID NO: 937299 - RNA, 23 nt, Human
gagcaagauagcccagcauccac

SEQ ID NO: 937300 - RNA, 20 nt, Human
gagccggagcccgagccgga

SEQ ID NO: 937301 - RNA, 26 nt, Human
gagccggagcggagcggcgcggcgcg

SEQ ID NO: 937302 - RNA, 22 nt, Human
gagcgggacuggcgcccggaau

SEQ ID NO: 937303 - RNA, 21 nt, Human
gaggcacggaaugggggugug

SEQ ID NO: 937304 - RNA, 21 nt, Human
gaggcacggaaugggggugug

SEQ ID NO: 937305 - RNA, 19 nt, Human
gcacagcaguaauaggcag

SEQ ID NO: 937306 - RNA, 21 nt, Human
gcagugggugccccaggccag

SEQ ID NO: 937307 - RNA, 26 nt, Human
gcagugggugccccaggccagggccc

SEQ ID NO: 937308 - RNA, 23 nt, Human
gcccgagccggagcggagcggcg

SEQ ID NO: 937309 - RNA, 18 nt, Human
gccucacucaucccugcc

SEQ ID NO: 937310 - RNA, 20 nt, Human
gccugaccaggagcacaggg

SEQ ID NO: 937311 - RNA, 18 nt, Human
gccugagucccccagagc

SEQ ID NO: 937312 - RNA, 20 nt, Human
ggaguguguuugggcagagc

SEQ ID NO: 937313 - RNA, 18 nt, Human
ggcaggcugagugggaac

SEQ ID NO: 937314 - RNA, 18 nt, Human
ggcugagugggaaccuug

SEQ ID NO: 937315 - RNA, 18 nt, Human
gggaaccuuggccuggga

SEQ ID NO: 937316 - RNA, 18 nt, Human
gggagggauagugagcaa

SEQ ID NO: 937317 - RNA, 19 nt, Human
gggcacagcaguaauaggc

SEQ ID NO: 937318 - RNA, 21 nt, Human
gggcacagcaguaauaggcag

SEQ ID NO: 937319 - RNA, 26 nt, Human
gggcaggcugagugggaaccuuggcc

SEQ ID NO: 937320 - RNA, 19 nt, Human
gguccuaccucuuccucug

SEQ ID NO: 937321 - RNA, 19 nt, Human
gguccuaccucuuccucug

SEQ ID NO: 937322 - RNA, 23 nt, Human
gguggggcugggcugcagacuug

SEQ ID NO: 937323 - RNA, 18 nt, Human
gucaguagucauaucuac

SEQ ID NO: 937324 - RNA, 18 nt, Human
gucaguagucauaucuac

SEQ ID NO: 937325 - RNA, 23 nt, Human
guuuauuuacaaagcgcuuuaca

SEQ ID NO: 937326 - RNA, 19 nt, Human
uaacaaaagaaacaaaaaa

SEQ ID NO: 937327 - RNA, 19 nt, Human
uaacaaaagaaacaaaaaa

SEQ ID NO: 937328 - RNA, 22 nt, Human
uaacaaaagaaacaaaaaagca

SEQ ID NO: 937329 - RNA, 22 nt, Human
uaacaaaagaaacaaaaaagca

SEQ ID NO: 937330 - RNA, 23 nt, Human
uaacaaaagaaacaaaaaagcac

SEQ ID NO: 937331 - RNA, 23 nt, Human
uaacaaaagaaacaaaaaagcac

SEQ ID NO: 937332 - RNA, 25 nt, Human
uacaaagcgcuuuacaaacaucagc

SEQ ID NO: 937333 - RNA, 25 nt, Human
uacaaagcgcuuuacaaacaucagc

SEQ ID NO: 937334 - RNA, 23 nt, Human
uacaguuuacagauggggaaauu

SEQ ID NO: 937335 - RNA, 23 nt, Human
uacaguuuacagauggggaaauu

SEQ ID NO: 937336 - RNA, 24 nt, Human
ucagagcacauaucagggaagcaa

SEQ ID NO: 937337 - RNA, 22 nt, Human
ucagggaagcaaguggggaggg

SEQ ID NO: 937338 - RNA, 18 nt, Human
ucccacccacccaaccaa

SEQ ID NO: 937339 - RNA, 22 nt, Human
uccccaggaccuucaggggcug

SEQ ID NO: 937340 - RNA, 23 nt, Human
uccccaggaccuucaggggcugg

SEQ ID NO: 937341 - RNA, 24 nt, Human
uccccaggaccuucaggggcuggg

SEQ ID NO: 937342 - RNA, 20 nt, Human
ucccccagagccagccgucc

SEQ ID NO: 937343 - RNA, 19 nt, Human
ucgccgcccgucccggggc

SEQ ID NO: 937344 - RNA, 23 nt, Human
ucuaacacugccccuccccacaa

SEQ ID NO: 937345 - RNA, 23 nt, Human
ucuaacacugccccuccccacaa

SEQ ID NO: 937346 - RNA, 22 nt, Human
ucuuccucgccaguccaggaug

SEQ ID NO: 937347 - RNA, 18 nt, Human
ugagucccccagagccag

SEQ ID NO: 937348 - RNA, 23 nt, Human
ugcagagggggcaggcugagugg

SEQ ID NO: 937349 - RNA, 19 nt, Human
ugcagugggugccccaggc

SEQ ID NO: 937350 - RNA, 22 nt, Human
ugccaaaagccaggauggugcc

SEQ ID NO: 937351 - RNA, 20 nt, Human
ugccaaggggcuuggccuga

SEQ ID NO: 937352 - RNA, 21 nt, Human
ugccaagucccaguacauccu

SEQ ID NO: 937353 - RNA, 18 nt, Human
ugccccaggccagggccc

SEQ ID NO: 937354 - RNA, 19 nt, Human
ugccccauuuuaaagagac

SEQ ID NO: 937355 - RNA, 19 nt, Human
ugccccauuuuaaagagac

SEQ ID NO: 937356 - RNA, 21 nt, Human
uggaagggggagcaagauagc

SEQ ID NO: 937357 - RNA, 24 nt, Human
uggcauucagagagcacguuuauu

SEQ ID NO: 937358 - RNA, 24 nt, Human
uggcauucagagagcacguuuauu

SEQ ID NO: 937359 - RNA, 21 nt, Human
uggcccugagugugcaguggg

SEQ ID NO: 937360 - RNA, 21 nt, Human
uggccugagucccccagagcc

SEQ ID NO: 937361 - RNA, 19 nt, Human
ugggaguguguuugggcag

SEQ ID NO: 937362 - RNA, 19 nt, Human
ugggaugcucucugcaggg

SEQ ID NO: 937363 - RNA, 23 nt, Human
uggggaggacagucagugugccc

SEQ ID NO: 937364 - RNA, 23 nt, Human
uggggaggagggcgcugcaguuc

SEQ ID NO: 937365 - RNA, 24 nt, Human
uggggaggagggcgcugcaguucc

SEQ ID NO: 937366 - RNA, 19 nt, Human
ugggugccccaggccaggg

SEQ ID NO: 937367 - RNA, 20 nt, Human
uggugccaaggggcuuggcc

SEQ ID NO: 937368 - RNA, 19 nt, Human
ugucacuggcccaagcuga

SEQ ID NO: 937369 - RNA, 24 nt, Human
ugugcagugggugccccaggccag

SEQ ID NO: 937370 - RNA, 21 nt, Human
uuuaaagagaccuucccaccc

SEQ ID NO: 937371 - RNA, 21 nt, Human
uuuaaagagaccuucccaccc

SEQ ID NO: 937372 - RNA, 18 nt, Human
uuugggcagagcaggagg

SEQ ID NO: 937373 - RNA, 22 nt, Human
uuuuaaagagaccuucccaccc

SEQ ID NO: 937374 - RNA, 22 nt, Human
uuuuaaagagaccuucccaccc

SEQ ID NO: 937375 - RNA, 26 nt, Human
uuuuuuuuuuuggcauucagagagca

SEQ ID NO: 937376 - RNA, 26 nt, Human
uuuuuuuuuuuggcauucagagagca

SEQ ID NO: 937377 - RNA, 18 nt, Human
uuuuuuuuuuuuuuuuug

SEQ ID NO: 937378 - RNA, 18 nt, Human
uuuuuuuuuuuuuuuuug

SEQ ID NO: 937379 - RNA, 18 nt, Human
uuuuuuuuuuuuuuuuug

SEQ ID NO: 937380 - RNA, 23 nt, Human
uuuuuuuuuuuuuuuuuggcauu

SEQ ID NO: 937381 - RNA, 22 nt, Human
uuuuuuuuuuuuuuuuuuuggc

SEQ ID NO: 937382 - RNA, 22 nt, Human
uuuuuuuuuuuuuuuuuuuggc

SEQ ID NO: 937383 - RNA, 26 nt, Human
uuuuuuuuuuuuuuuuuuuuuugggg

SEQ ID NO: 937384 - RNA, 20 nt, Human
aagaaaucaauccaggcaac

SEQ ID NO: 937385 - RNA, 18 nt, Human
acgccgccagcugccucg

SEQ ID NO: 937386 - RNA, 23 nt, Human
acgccgcgcgccggcccgcgaac

SEQ ID NO: 937387 - RNA, 24 nt, Human
agcagcagcgccucgcuggccugc

SEQ ID NO: 937388 - RNA, 20 nt, Human
agccagccuccgaacggcga

SEQ ID NO: 937389 - RNA, 22 nt, Human
aguuacugacaugucagccuca

SEQ ID NO: 937390 - RNA, 24 nt, Human
auggcuaugggaagcaggugauac

SEQ ID NO: 937391 - RNA, 20 nt, Human
auuuaaagucuugccuguuc

SEQ ID NO: 937392 - RNA, 18 nt, Human
caagcgacauacucgaaa

SEQ ID NO: 937393 - RNA, 18 nt, Human
cagagcccuccaugcgac

SEQ ID NO: 937394 - RNA, 21 nt, Human
cagagcccuccaugcgacgcc

SEQ ID NO: 937395 - RNA, 24 nt, Human
cagcacggccccgcacgccgcgcg

SEQ ID NO: 937396 - RNA, 18 nt, Human
cagcagcgccucgcuggc

SEQ ID NO: 937397 - RNA, 18 nt, Human
ccaacuaacacguggagu

SEQ ID NO: 937398 - RNA, 24 nt, Human
cccaagacuuugcaaucuccauuu

SEQ ID NO: 937399 - RNA, 20 nt, Human
cccagcagguagagcgccag

SEQ ID NO: 937400 - RNA, 18 nt, Human
cccaugaagagcagcagc

SEQ ID NO: 937401 - RNA, 20 nt, Human
ccccgcacgccgcgcgccgg

SEQ ID NO: 937402 - RNA, 19 nt, Human
cccgcgaacgccccagccg

SEQ ID NO: 937403 - RNA, 22 nt, Human
cccgcucgcccgcaccgccccc

SEQ ID NO: 937404 - RNA, 19 nt, Human
ccgccgcccgccgcgcgcc

SEQ ID NO: 937405 - RNA, 19 nt, Human
ccgccgccgcccgccgcgc

SEQ ID NO: 937406 - RNA, 24 nt, Human
ccgccgccgcccgccgcgcgccca

SEQ ID NO: 937407 - RNA, 21 nt, Human
ccgccgccgcggccgccgccg

SEQ ID NO: 937408 - RNA, 24 nt, Human
ccgccgccgcggccgccgccgccc

SEQ ID NO: 937409 - RNA, 19 nt, Human
ccgcucgcccgcaccgccc

SEQ ID NO: 937410 - RNA, 21 nt, Human
ccggagggcccagcgugccag

SEQ ID NO: 937411 - RNA, 22 nt, Human
ccucagaaaccgcacauggccu

SEQ ID NO: 937412 - RNA, 22 nt, Human
ccucccagcagaacggcgcccc

SEQ ID NO: 937413 - RNA, 21 nt, Human
cggcccgcgaacgccccagcc

SEQ ID NO: 937414 - RNA, 19 nt, Human
cggccgccgccgcccgccg

SEQ ID NO: 937415 - RNA, 19 nt, Human
cuccagcagcuccgucagc

SEQ ID NO: 937416 - RNA, 18 nt, Human
cuccucccggagggccca

SEQ ID NO: 937417 - RNA, 20 nt, Human
cugcgcgcccucccagcaga

SEQ ID NO: 937418 - RNA, 22 nt, Human
gcagcagcgccucgcuggccug

SEQ ID NO: 937419 - RNA, 25 nt, Human
gcagcagcgccucgcuggccugcgc

SEQ ID NO: 937420 - RNA, 24 nt, Human
gcagcggcgcccgcucgcccgcac

SEQ ID NO: 937421 - RNA, 18 nt, Human
gccagcugccucgccccg

SEQ ID NO: 937422 - RNA, 19 nt, Human
gcccgcucgcccgcaccgc

SEQ ID NO: 937423 - RNA, 22 nt, Human
gcgcccucccagcagaacggcg

SEQ ID NO: 937424 - RNA, 19 nt, Human
ggcccaugaagagcagcag

SEQ ID NO: 937425 - RNA, 18 nt, Human
gggaacccagcuagagga

SEQ ID NO: 937426 - RNA, 20 nt, Human
gugaagucagacauuuuaug

SEQ ID NO: 937427 - RNA, 26 nt, Human
uaaguaacaguuuauuaauuuuuuuu

SEQ ID NO: 937428 - RNA, 24 nt, Human
uagagggaaagaagaaaucaaucc

SEQ ID NO: 937429 - RNA, 25 nt, Human
uauggcuaugggaagcaggugauac

SEQ ID NO: 937430 - RNA, 19 nt, Human
uccaugcgacgccgccagc

SEQ ID NO: 937431 - RNA, 21 nt, Human
uccaugcgacgccgccagcug

SEQ ID NO: 937432 - RNA, 19 nt, Human
ucccagcagaacggcgccc

SEQ ID NO: 937433 - RNA, 23 nt, Human
uccccaagacuuugcaaucucca

SEQ ID NO: 937434 - RNA, 21 nt, Human
ucgaaaucugcagcucuccuc

SEQ ID NO: 937435 - RNA, 21 nt, Human
ugacaagcgacauacucgaaa

SEQ ID NO: 937436 - RNA, 21 nt, Human
ugaguuucuguaaaaaaggga

SEQ ID NO: 937437 - RNA, 24 nt, Human
ugcaguaaggcacuuaccaagcuc

SEQ ID NO: 937438 - RNA, 18 nt, Human
ugccaggagacacgcugc

SEQ ID NO: 937439 - RNA, 22 nt, Human
ugccuguucucagugcacccca

SEQ ID NO: 937440 - RNA, 19 nt, Human
ugcgcgcccucccagcaga

SEQ ID NO: 937441 - RNA, 20 nt, Human
ugcgcgcccucccagcagaa

SEQ ID NO: 937442 - RNA, 22 nt, Human
uggccugcgcgcccucccagca

SEQ ID NO: 937443 - RNA, 21 nt, Human
uucacagagaccuugaaugac

SEQ ID NO: 937444 - RNA, 21 nt, Human
aaagcugcuuucacguccuuc

SEQ ID NO: 937445 - RNA, 19 nt, Human
aaagugcugggguuacagg

SEQ ID NO: 937446 - RNA, 23 nt, Human
aaagugcugggguuacaggcaua

SEQ ID NO: 937447 - RNA, 21 nt, Human
aaguagcugagaccacaggca

SEQ ID NO: 937448 - RNA, 25 nt, Human
aaguagcugagaccacaggcacgug

SEQ ID NO: 937449 - RNA, 22 nt, Human
aaguagcugggauuacaggcau

SEQ ID NO: 937450 - RNA, 24 nt, Human
aaguagcugggauuacaggcaugc

SEQ ID NO: 937451 - RNA, 21 nt, Human
aagugcugggguuacaggcau

SEQ ID NO: 937452 - RNA, 26 nt, Human
aagugcugggguuacaggcauaagcc

SEQ ID NO: 937453 - RNA, 21 nt, Human
acccaggcuggagugcagugu

SEQ ID NO: 937454 - RNA, 29 nt, Human
acccauuuccaccuucuccuauuuuccuu

SEQ ID NO: 937455 - RNA, 25 nt, Human
acccugcucucccuccuaacuccca

SEQ ID NO: 937456 - RNA, 18 nt, Human
acucugucacccaggcug

SEQ ID NO: 937457 - RNA, 25 nt, Human
acucugucacccaggcuggagugca

SEQ ID NO: 937458 - RNA, 19 nt, Human
acucuguugccuaggaugg

SEQ ID NO: 937459 - RNA, 19 nt, Human
acugcagccucaaacuccu

SEQ ID NO: 937460 - RNA, 25 nt, Human
acugccucaguuucccccaaaagcu

SEQ ID NO: 937461 - RNA, 18 nt, Human
agccuccaaaguagcugg

SEQ ID NO: 937462 - RNA, 24 nt, Human
aggcacccucauagcucacugcag

SEQ ID NO: 937463 - RNA, 18 nt, Human
aggcauaagccaccaagc

SEQ ID NO: 937464 - RNA, 21 nt, Human
aggcauaagccaccaagcccg

SEQ ID NO: 937465 - RNA, 21 nt, Human
agggaaggagcuugagaagaa

SEQ ID NO: 937466 - RNA, 24 nt, Human
aggugauccgcccaccucggccuc

SEQ ID NO: 937467 - RNA, 18 nt, Human
agugcagugucgcgaccu

SEQ ID NO: 937468 - RNA, 20 nt, Human
agugcagugucgcgaccuug

SEQ ID NO: 937469 - RNA, 24 nt, Human
agugcagugucgcgaccuuggcuc

SEQ ID NO: 937470 - RNA, 18 nt, Human
auagcucacugcagccuc

SEQ ID NO: 937471 - RNA, 21 nt, Human
auguucucuccccaccucccc

SEQ ID NO: 937472 - RNA, 24 nt, Human
auuuuccuuuuuuuuccuucuguu

SEQ ID NO: 937473 - RNA, 24 nt, Human
auuuuuguaauuuuaguagagaug

SEQ ID NO: 937474 - RNA, 25 nt, Human
caaacuccugggcucuggcgauccu

SEQ ID NO: 937475 - RNA, 22 nt, Human
caaaguagcugggauuacaggc

SEQ ID NO: 937476 - RNA, 24 nt, Human
caaaguagcugggauuacaggcau

SEQ ID NO: 937477 - RNA, 24 nt, Human
caaagugcugggguuacaggcaua

SEQ ID NO: 937478 - RNA, 23 nt, Human
caaccuccaccucccagguucaa

SEQ ID NO: 937479 - RNA, 21 nt, Human
caccaagcccggccgaccuuc

SEQ ID NO: 937480 - RNA, 22 nt, Human
cacccugcucucccuccuaacu

SEQ ID NO: 937481 - RNA, 24 nt, Human
caccucagccuccaaaguagcugg

SEQ ID NO: 937482 - RNA, 24 nt, Human
caccucggccucccaaagugcugg

SEQ ID NO: 937483 - RNA, 23 nt, Human
cacucugucacccaggcuggagu

SEQ ID NO: 937484 - RNA, 24 nt, Human
cacucugucacccaggcuggagug

SEQ ID NO: 937485 - RNA, 21 nt, Human
cacugcaaccuccaccuccca

SEQ ID NO: 937486 - RNA, 23 nt, Human
cagccucaaacuccugggcucug

SEQ ID NO: 937487 - RNA, 21 nt, Human
caugcccagcuaauuuuugua

SEQ ID NO: 937488 - RNA, 23 nt, Human
cauuugagggaucggguggggcu

SEQ ID NO: 937489 - RNA, 25 nt, Human
ccaaagccauggccaugcgcuccug

SEQ ID NO: 937490 - RNA, 19 nt, Human
ccaaaguagcugggauuac

SEQ ID NO: 937491 - RNA, 20 nt, Human
ccaaaguagcugggauuaca

SEQ ID NO: 937492 - RNA, 23 nt, Human
ccaaaguagcugggauuacaggc

SEQ ID NO: 937493 - RNA, 24 nt, Human
ccaaaguagcugggauuacaggca

SEQ ID NO: 937494 - RNA, 25 nt, Human
ccaaaguagcugggauuacaggcau

SEQ ID NO: 937495 - RNA, 23 nt, Human
ccaaagugcugggguuacaggca

SEQ ID NO: 937496 - RNA, 24 nt, Human
ccaaagugcugggguuacaggcau

SEQ ID NO: 937497 - RNA, 24 nt, Human
ccaagcgggggcuguccacugcgg

SEQ ID NO: 937498 - RNA, 18 nt, Human
ccaccccuccuucccagg

SEQ ID NO: 937499 - RNA, 26 nt, Human
ccaccucccagguucaagcaauucuu

SEQ ID NO: 937500 - RNA, 25 nt, Human
ccaccuccccuccagcucucaacuu

SEQ ID NO: 937501 - RNA, 22 nt, Human
ccagcgccgcugcguccuccuc

SEQ ID NO: 937502 - RNA, 22 nt, Human
ccaggagugaaccagggcuggc

SEQ ID NO: 937503 - RNA, 24 nt, Human
cccaaagugcugggguuacaggca

SEQ ID NO: 937504 - RNA, 21 nt, Human
cccagccugcugcugcccccu

SEQ ID NO: 937505 - RNA, 24 nt, Human
ccccaccucagccuccaaaguagc

SEQ ID NO: 937506 - RNA, 23 nt, Human
cccccaaaagcugcuuucacguc

SEQ ID NO: 937507 - RNA, 19 nt, Human
cccccagccagggugaggg

SEQ ID NO: 937508 - RNA, 20 nt, Human
cccccagccagggugagggc

SEQ ID NO: 937509 - RNA, 22 nt, Human
cccccagccagggugagggcuc

SEQ ID NO: 937510 - RNA, 22 nt, Human
cccccuucugggacccuaauuu

SEQ ID NO: 937511 - RNA, 24 nt, Human
cccucacaugcaugucguucccca

SEQ ID NO: 937512 - RNA, 20 nt, Human
cccuucccauuccacucgga

SEQ ID NO: 937513 - RNA, 23 nt, Human
ccuaggauggagcacagaggcac

SEQ ID NO: 937514 - RNA, 24 nt, Human
ccucccagguucaagcaauucucc

SEQ ID NO: 937515 - RNA, 24 nt, Human
ccuccuucccagggcuucucuugg

SEQ ID NO: 937516 - RNA, 25 nt, Human
ccuccuucccagggcuucucuuggg

SEQ ID NO: 937517 - RNA, 27 nt, Human
ccucgcccagcuccucgcccuccuucu

SEQ ID NO: 937518 - RNA, 24 nt, Human
ccugaccucaggugauccgcccac

SEQ ID NO: 937519 - RNA, 18 nt, Human
ccugcugcugcccccuuc

SEQ ID NO: 937520 - RNA, 22 nt, Human
ccugggcucuggcgauccuccc

SEQ ID NO: 937521 - RNA, 24 nt, Human
cgccucagccucccaaguagcuga

SEQ ID NO: 937522 - RNA, 24 nt, Human
cgccuccgacucuuucagcgauuu

SEQ ID NO: 937523 - RNA, 21 nt, Human
cggaaugacagcagcugggug

SEQ ID NO: 937524 - RNA, 24 nt, Human
cucaauaaccuccucaaccuccac

SEQ ID NO: 937525 - RNA, 24 nt, Human
cucacucugucacccaggcuggag

SEQ ID NO: 937526 - RNA, 24 nt, Human
cucacugcaaccuccaccucccag

SEQ ID NO: 937527 - RNA, 21 nt, Human
cucacugcagccucaaacucc

SEQ ID NO: 937528 - RNA, 24 nt, Human
cucacugcagccucaaacuccugg

SEQ ID NO: 937529 - RNA, 24 nt, Human
cucagccuccaaaguagcugggau

SEQ ID NO: 937530 - RNA, 21 nt, Human
cucccaaguagcugagaccac

SEQ ID NO: 937531 - RNA, 26 nt, Human
cuccccaccucagccuccaaaguagc

SEQ ID NO: 937532 - RNA, 23 nt, Human
cuccugggcucuggcgauccucc

SEQ ID NO: 937533 - RNA, 25 nt, Human
cucuccccaccuccccuccagcucu

SEQ ID NO: 937534 - RNA, 25 nt, Human
cucuccccaccuccccuccagcucu

SEQ ID NO: 937535 - RNA, 18 nt, Human
cucugcgcgggacuccuc

SEQ ID NO: 937536 - RNA, 19 nt, Human
cucugucuuccccacugcc

SEQ ID NO: 937537 - RNA, 23 nt, Human
cugcaaccuccaccucccagguu

SEQ ID NO: 937538 - RNA, 24 nt, Human
cugcaaccuccaccucccagguuc

SEQ ID NO: 937539 - RNA, 23 nt, Human
cugcagccucaaacuccugggcu

SEQ ID NO: 937540 - RNA, 21 nt, Human
cugccaggagugaaccagggc

SEQ ID NO: 937541 - RNA, 19 nt, Human
cugcccccuucugggaccc

SEQ ID NO: 937542 - RNA, 19 nt, Human
cugcccccuucugggaccc

SEQ ID NO: 937543 - RNA, 27 nt, Human
cuggcgauccucccgccucagccuccc

SEQ ID NO: 937544 - RNA, 20 nt, Human
cuggcugcucugugauguuc

SEQ ID NO: 937545 - RNA, 19 nt, Human
cugucacccaggcuggagu

SEQ ID NO: 937546 - RNA, 20 nt, Human
cuuaguagagaugggguguu

SEQ ID NO: 937547 - RNA, 24 nt, Human
cuucuccuuggagaaggccuucuu

SEQ ID NO: 937548 - RNA, 21 nt, Human
cuuggagaaggccuucuugaa

SEQ ID NO: 937549 - RNA, 24 nt, Human
gaccucaggugauccgcccaccuc

SEQ ID NO: 937550 - RNA, 19 nt, Human
gaccuuggcucacugcaac

SEQ ID NO: 937551 - RNA, 18 nt, Human
gagaucccgacuuggaca

SEQ ID NO: 937552 - RNA, 24 nt, Human
gauuacaggcaugcgcaaucaugc

SEQ ID NO: 937553 - RNA, 22 nt, Human
gcaaccuccaccucccagguuc

SEQ ID NO: 937554 - RNA, 20 nt, Human
gccucagccucccaaguagc

SEQ ID NO: 937555 - RNA, 21 nt, Human
gccucccaugggggcaaggau

SEQ ID NO: 937556 - RNA, 24 nt, Human
gcgauccucccgccucagccuccc

SEQ ID NO: 937557 - RNA, 19 nt, Human
gcgccgcugcguccuccuc

SEQ ID NO: 937558 - RNA, 20 nt, Human
gcgggacuccucaauaaccu

SEQ ID NO: 937559 - RNA, 19 nt, Human
gcugaccucucugucuucu

SEQ ID NO: 937560 - RNA, 22 nt, Human
gcuggcugcucugugauguucu

SEQ ID NO: 937561 - RNA, 23 nt, Human
gcuggucccgaacuccugaccuc

SEQ ID NO: 937562 - RNA, 24 nt, Human
ggauuacaggcaugcgcaaucaug

SEQ ID NO: 937563 - RNA, 19 nt, Human
ggcaaggauccccuuuagg

SEQ ID NO: 937564 - RNA, 24 nt, Human
ggcuggucccgaacuccugaccuc

SEQ ID NO: 937565 - RNA, 20 nt, Human
gggagaggcugaggggaagg

SEQ ID NO: 937566 - RNA, 19 nt, Human
gggggcaaggauccccuuu

SEQ ID NO: 937567 - RNA, 19 nt, Human
gggugccuccaagagccca

SEQ ID NO: 937568 - RNA, 24 nt, Human
gggugggugguguggggagaggcu

SEQ ID NO: 937569 - RNA, 19 nt, Human
ggguuacaggcauaagcca

SEQ ID NO: 937570 - RNA, 19 nt, Human
ggucccgaacuccugaccu

SEQ ID NO: 937571 - RNA, 20 nt, Human
gguuuucgcuuaguagagau

SEQ ID NO: 937572 - RNA, 18 nt, Human
guagcugggauuacaggc

SEQ ID NO: 937573 - RNA, 24 nt, Human
gugauccgcccaccucggccuccc

SEQ ID NO: 937574 - RNA, 23 nt, Human
gugccuccaagagcccauuugag

SEQ ID NO: 937575 - RNA, 21 nt, Human
guggcagggccggcacccugc

SEQ ID NO: 937576 - RNA, 21 nt, Human
gugggugguguggggagaggc

SEQ ID NO: 937577 - RNA, 24 nt, Human
uaauuuuuguaauuuuaguagaga

SEQ ID NO: 937578 - RNA, 20 nt, Human
uacaggcauaagccaccaag

SEQ ID NO: 937579 - RNA, 24 nt, Human
uacaggcaugcgcaaucaugccca

SEQ ID NO: 937580 - RNA, 24 nt, Human
uagcucacugcagccucaaacucc

SEQ ID NO: 937581 - RNA, 20 nt, Human
uaggauggagcacagaggca

SEQ ID NO: 937582 - RNA, 20 nt, Human
uaguagagaugggguguuug

SEQ ID NO: 937583 - RNA, 18 nt, Human
uaguagagauggguuuuc

SEQ ID NO: 937584 - RNA, 19 nt, Human
uaguagagauggguuuucg

SEQ ID NO: 937585 - RNA, 23 nt, Human
uaguagagauggguuuucgcuua

SEQ ID NO: 937586 - RNA, 21 nt, Human
ucaauaaccuccucaaccucc

SEQ ID NO: 937587 - RNA, 24 nt, Human
ucaauaaccuccucaaccuccacc

SEQ ID NO: 937588 - RNA, 24 nt, Human
ucacccaggcuggagugcaguguc

SEQ ID NO: 937589 - RNA, 24 nt, Human
ucacugcaaccuccaccucccagg

SEQ ID NO: 937590 - RNA, 25 nt, Human
ucacugcaaccuccaccucccaggu

SEQ ID NO: 937591 - RNA, 27 nt, Human
ucacugcaaccuccaccucccagguuc

SEQ ID NO: 937592 - RNA, 22 nt, Human
ucacugcaauuuccucugagau

SEQ ID NO: 937593 - RNA, 25 nt, Human
ucacugcaauuuccucuggggcccc

SEQ ID NO: 937594 - RNA, 26 nt, Human
ucacugcaauuuccucuggggcccuc

SEQ ID NO: 937595 - RNA, 25 nt, Human
ucacugcaauuuccucugggguccc

SEQ ID NO: 937596 - RNA, 26 nt, Human
ucacugcaauuuccucugggguccuc

SEQ ID NO: 937597 - RNA, 24 nt, Human
ucacugcagccucaaacuccuggg

SEQ ID NO: 937598 - RNA, 18 nt, Human
ucagccucccaaguagcu

SEQ ID NO: 937599 - RNA, 21 nt, Human
ucagccucccaaguagcugag

SEQ ID NO: 937600 - RNA, 18 nt, Human
ucaguuucccccaaaagc

SEQ ID NO: 937601 - RNA, 19 nt, Human
ucaguuucccccaaaagcu

SEQ ID NO: 937602 - RNA, 22 nt, Human
ucaguuuggccggcagcuucac

SEQ ID NO: 937603 - RNA, 24 nt, Human
uccaaaguagcugggauuacaggc

SEQ ID NO: 937604 - RNA, 24 nt, Human
ucccaaagugcugggguuacaggc

SEQ ID NO: 937605 - RNA, 24 nt, Human
ucccaaguagcugagaccacaggc

SEQ ID NO: 937606 - RNA, 23 nt, Human
ucccagccugcugcugcccccuu

SEQ ID NO: 937607 - RNA, 21 nt, Human
ucccagguucaagcaauucuc

SEQ ID NO: 937608 - RNA, 23 nt, Human
ucccagguucaagcaauucuccc

SEQ ID NO: 937609 - RNA, 18 nt, Human
uccccaccccuccuuccc

SEQ ID NO: 937610 - RNA, 18 nt, Human
uccccaccuccccuccag

SEQ ID NO: 937611 - RNA, 21 nt, Human
uccccaccuccccuccagcuc

SEQ ID NO: 937612 - RNA, 24 nt, Human
ucccccagggaucagggugagaau

SEQ ID NO: 937613 - RNA, 27 nt, Human
uccucccgccucagccucccaaguagc

SEQ ID NO: 937614 - RNA, 22 nt, Human
uccugggcucuggcgauccucc

SEQ ID NO: 937615 - RNA, 22 nt, Human
ucgcccagcuccucgcccuccu

SEQ ID NO: 937616 - RNA, 18 nt, Human
ucgcccucgcccagcucc

SEQ ID NO: 937617 - RNA, 18 nt, Human
ucggccucccaaagugcu

SEQ ID NO: 937618 - RNA, 23 nt, Human
ucggccucccaaagugcuggggu

SEQ ID NO: 937619 - RNA, 21 nt, Human
ucguccacgcgccgcaguguc

SEQ ID NO: 937620 - RNA, 18 nt, Human
ucuauuuuuccauucucc

SEQ ID NO: 937621 - RNA, 22 nt, Human
ucucacucugucacccaggcug

SEQ ID NO: 937622 - RNA, 23 nt, Human
ucucacucugucacccaggcugg

SEQ ID NO: 937623 - RNA, 24 nt, Human
ucucacucugucacccaggcugga

SEQ ID NO: 937624 - RNA, 26 nt, Human
ucucacucugucacccaggcuggagu

SEQ ID NO: 937625 - RNA, 27 nt, Human
ucucacucugucacccaggcuggagug

SEQ ID NO: 937626 - RNA, 19 nt, Human
ucucacucuguugccuagg

SEQ ID NO: 937627 - RNA, 23 nt, Human
ucucacucuguugccuaggaugg

SEQ ID NO: 937628 - RNA, 24 nt, Human
ucucacucuguugccuaggaugga

SEQ ID NO: 937629 - RNA, 24 nt, Human
ucugucacccaggcuggagugcag

SEQ ID NO: 937630 - RNA, 18 nt, Human
ucuuuccucuuugggcag

SEQ ID NO: 937631 - RNA, 18 nt, Human
ugaccucaggugauccgc

SEQ ID NO: 937632 - RNA, 21 nt, Human
ugaccucaggugauccgccca

SEQ ID NO: 937633 - RNA, 24 nt, Human
ugaccucaggugauccgcccaccu

SEQ ID NO: 937634 - RNA, 18 nt, Human
ugagaagaaacugccagg

SEQ ID NO: 937635 - RNA, 22 nt, Human
ugagaagaaacugccaggagug

SEQ ID NO: 937636 - RNA, 21 nt, Human
ugagaccacaggcacgugcca

SEQ ID NO: 937637 - RNA, 24 nt, Human
ugagaccacaggcacgugccacca

SEQ ID NO: 937638 - RNA, 22 nt, Human
ugagauggagucucacucuguc

SEQ ID NO: 937639 - RNA, 20 nt, Human
ugagucccccagggaucagg

SEQ ID NO: 937640 - RNA, 21 nt, Human
ugagucccccagggaucaggg

SEQ ID NO: 937641 - RNA, 24 nt, Human
ugauccgcccaccucggccuccca

SEQ ID NO: 937642 - RNA, 25 nt, Human
ugcagccucaaacuccugggcucug

SEQ ID NO: 937643 - RNA, 20 nt, Human
ugcagugucgcgaccuuggc

SEQ ID NO: 937644 - RNA, 19 nt, Human
ugcauaaacacaucagugu

SEQ ID NO: 937645 - RNA, 30 nt, Human
ugccccugggggugccuccaagagcccauu

SEQ ID NO: 937646 - RNA, 22 nt, Human
ugccucaguuucccccaaaagc

SEQ ID NO: 937647 - RNA, 24 nt, Human
ugcucaguuuggccggcagcuuca

SEQ ID NO: 937648 - RNA, 24 nt, Human
ugcucugucuuccccacugccuca

SEQ ID NO: 937649 - RNA, 18 nt, Human
ugcuggacccccagccag

SEQ ID NO: 937650 - RNA, 23 nt, Human
uggacccccagccagggugaggg

SEQ ID NO: 937651 - RNA, 24 nt, Human
uggagugcagugucgcgaccuugg

SEQ ID NO: 937652 - RNA, 19 nt, Human
uggcugcucugugauguuc

SEQ ID NO: 937653 - RNA, 21 nt, Human
uggcugcucugugauguucuc

SEQ ID NO: 937654 - RNA, 19 nt, Human
ugggaguggaguuccugga

SEQ ID NO: 937655 - RNA, 21 nt, Human
ugggaguggaguuccuggagg

SEQ ID NO: 937656 - RNA, 18 nt, Human
ugggauuacaggcaugcg

SEQ ID NO: 937657 - RNA, 19 nt, Human
ugggauuacaggcaugcgc

SEQ ID NO: 937658 - RNA, 19 nt, Human
ugggauuacaggcaugcgc

SEQ ID NO: 937659 - RNA, 20 nt, Human
ugggauuacaggcaugcgca

SEQ ID NO: 937660 - RNA, 20 nt, Human
ugggauuacaggcaugcgca

SEQ ID NO: 937661 - RNA, 23 nt, Human
ugggauuacaggcaugcgcaauc

SEQ ID NO: 937662 - RNA, 24 nt, Human
ugggauuacaggcaugcgcaauca

SEQ ID NO: 937663 - RNA, 20 nt, Human
ugggcucuggcgauccuccc

SEQ ID NO: 937664 - RNA, 24 nt, Human
ugggcucuggcgauccucccgccu

SEQ ID NO: 937665 - RNA, 18 nt, Human
ugggguuacaggcauaag

SEQ ID NO: 937666 - RNA, 22 nt, Human
ugggguuacaggcauaagccac

SEQ ID NO: 937667 - RNA, 24 nt, Human
ugggguuacaggcauaagccacca

SEQ ID NO: 937668 - RNA, 19 nt, Human
uggguggguggugugggga

SEQ ID NO: 937669 - RNA, 20 nt, Human
uggucccgaacuccugaccu

SEQ ID NO: 937670 - RNA, 24 nt, Human
ugugccaucccucacaugcauggu

SEQ ID NO: 937671 - RNA, 18 nt, Human
uguguccaagcgggggcu

SEQ ID NO: 937672 - RNA, 24 nt, Human
uguucucuccccaccuccccucca

SEQ ID NO: 937673 - RNA, 22 nt, Human
uguuugccaggcuggucccgaa

SEQ ID NO: 937674 - RNA, 19 nt, Human
uuacaggcauaagccacca

SEQ ID NO: 937675 - RNA, 25 nt, Human
uucaagcaauucuccccaccucagc

SEQ ID NO: 937676 - RNA, 19 nt, Human
uucccagggcuucucuugg

SEQ ID NO: 937677 - RNA, 23 nt, Human
uucuccccaccucagccuccaaa

SEQ ID NO: 937678 - RNA, 22 nt, Human
uucucuccccaccuccccucca

SEQ ID NO: 937679 - RNA, 20 nt, Human
uucucuggcagcgccuccga

SEQ ID NO: 937680 - RNA, 18 nt, Human
uugaccauucccuuccca

SEQ ID NO: 937681 - RNA, 24 nt, Human
uugccaggcuggucccgaacuccu

SEQ ID NO: 937682 - RNA, 21 nt, Human
uuuuaguagagauggguuuuc

SEQ ID NO: 937683 - RNA, 20 nt, Human
uuuuuguaauuuuaguagag

SEQ ID NO: 937684 - RNA, 22 nt, Human
agcaggaaagggaauucucuag

SEQ ID NO: 937685 - RNA, 20 nt, Human
aggaaagggaauucucuagc

SEQ ID NO: 937686 - RNA, 19 nt, Human
caaggggauggugguuggg

SEQ ID NO: 937687 - RNA, 22 nt, Human
ccacuagcucacuggggaugag

SEQ ID NO: 937688 - RNA, 18 nt, Human
cccucugcggccucccuu

SEQ ID NO: 937689 - RNA, 18 nt, Human
cucuccacuagcucacug

SEQ ID NO: 937690 - RNA, 24 nt, Human
gccucccuugcucccucuccacua

SEQ ID NO: 937691 - RNA, 20 nt, Human
guuuuuucccucugcggccu

SEQ ID NO: 937692 - RNA, 18 nt, Human
ucacuggggaugagcagg

SEQ ID NO: 937693 - RNA, 19 nt, Human
uccacuagcucacugggga

SEQ ID NO: 937694 - RNA, 22 nt, Human
ucugcggccucccuugcucccu

SEQ ID NO: 937695 - RNA, 18 nt, Human
uggggaugagcaggaaag

SEQ ID NO: 937696 - RNA, 24 nt, Human
ugguuggguggaggccuguagggg

SEQ ID NO: 937697 - RNA, 20 nt, Human
uuggguggaggccuguaggg

SEQ ID NO: 937698 - RNA, 25 nt, Human
aaagaggaaaaacuucuucaaagga

SEQ ID NO: 937699 - RNA, 21 nt, Human
aacgggccaaaaaagaggaaa

SEQ ID NO: 937700 - RNA, 22 nt, Human
aauaacaacgggccaaaaaaga

SEQ ID NO: 937701 - RNA, 21 nt, Human
accggaggucaauuucuguuu

SEQ ID NO: 937702 - RNA, 21 nt, Human
agagguaaagaagggauugua

SEQ ID NO: 937703 - RNA, 23 nt, Human
agcuaaacuauuuagcucuggga

SEQ ID NO: 937704 - RNA, 24 nt, Human
agguaagcuuagcagcuuuuaaug

SEQ ID NO: 937705 - RNA, 19 nt, Human
auuuuuaagguuuaauuag

SEQ ID NO: 937706 - RNA, 24 nt, Human
caaaaaagaggaaaaacuucuuca

SEQ ID NO: 937707 - RNA, 18 nt, Human
cagacuuccugaaguauc

SEQ ID NO: 937708 - RNA, 21 nt, Human
cagacuuccugaaguaucaac

SEQ ID NO: 937709 - RNA, 25 nt, Human
ccaaaaaagaggaaaaacuucuuca

SEQ ID NO: 937710 - RNA, 23 nt, Human
ccaagauuuccauagcaaagcca

SEQ ID NO: 937711 - RNA, 22 nt, Human
ccaccaagauuuccauagcaaa

SEQ ID NO: 937712 - RNA, 23 nt, Human
cuaauaacaacgggccaaaaaag

SEQ ID NO: 937713 - RNA, 23 nt, Human
cugaaacuuuggaaagucaauaa

SEQ ID NO: 937714 - RNA, 23 nt, Human
ggccaaaaaagaggaaaaacuuc

SEQ ID NO: 937715 - RNA, 23 nt, Human
guaauuccugaaacuuuggaaag

SEQ ID NO: 937716 - RNA, 24 nt, Human
uaaaaguaauuccugaaacuuugg

SEQ ID NO: 937717 - RNA, 23 nt, Human
uaacaacgggccaaaaaagagga

SEQ ID NO: 937718 - RNA, 18 nt, Human
uaccggaggucaauuucu

SEQ ID NO: 937719 - RNA, 21 nt, Human
uaucaacuacuagagguauua

SEQ ID NO: 937720 - RNA, 19 nt, Human
ucccauggcuuugauaugg

SEQ ID NO: 937721 - RNA, 21 nt, Human
ugaaaagcuacaccaccaaga

SEQ ID NO: 937722 - RNA, 18 nt, Human
ugaagccucccacucaau

SEQ ID NO: 937723 - RNA, 20 nt, Human
uuagcagcuuuuaaugaagu

SEQ ID NO: 937724 - RNA, 20 nt, Human
uucaauagucuggagcaguu

SEQ ID NO: 937725 - RNA, 25 nt, Human
uucaauagucuggagcaguugaagc

SEQ ID NO: 937726 - RNA, 24 nt, Human
uuuaagguuuaauuagguaauaag

SEQ ID NO: 937727 - RNA, 21 nt, Human
uuugugcugauuugcauacuu

SEQ ID NO: 937728 - RNA, 20 nt, Human
aaguggcugggaggccagga

SEQ ID NO: 937729 - RNA, 19 nt, Human
accuccggguccaggcacu

SEQ ID NO: 937730 - RNA, 22 nt, Human
acgggccacaggcagggcuggg

SEQ ID NO: 937731 - RNA, 19 nt, Human
aggaagcuggaggagggga

SEQ ID NO: 937732 - RNA, 19 nt, Human
aggaagcuggaggagggga

SEQ ID NO: 937733 - RNA, 22 nt, Human
aggaaguggcugggaggccagg

SEQ ID NO: 937734 - RNA, 20 nt, Human
aggaggggaggugcuggggc

SEQ ID NO: 937735 - RNA, 21 nt, Human
aggaggggaggugcuggggcc

SEQ ID NO: 937736 - RNA, 22 nt, Human
aggcagggcugggaguuggggg

SEQ ID NO: 937737 - RNA, 20 nt, Human
aggggaugggauccuguggg

SEQ ID NO: 937738 - RNA, 22 nt, Human
aggugacccucacccccggcuc

SEQ ID NO: 937739 - RNA, 22 nt, Human
augggauccuguggguaccuug

SEQ ID NO: 937740 - RNA, 23 nt, Human
augguggcccugggugguugggg

SEQ ID NO: 937741 - RNA, 21 nt, Human
caacaggugacccucaccccc

SEQ ID NO: 937742 - RNA, 22 nt, Human
caacaggugacccucacccccg

SEQ ID NO: 937743 - RNA, 19 nt, Human
cagggccccgagggggucc

SEQ ID NO: 937744 - RNA, 20 nt, Human
caugccaaguuccccauguc

SEQ ID NO: 937745 - RNA, 18 nt, Human
cccccggcucagggcccc

SEQ ID NO: 937746 - RNA, 21 nt, Human
ccccgaggggguccuggaaac

SEQ ID NO: 937747 - RNA, 24 nt, Human
cccgacaacaggugacccucaccc

SEQ ID NO: 937748 - RNA, 23 nt, Human
cccuugguccucaggccuggagc

SEQ ID NO: 937749 - RNA, 19 nt, Human
ccuguggguaccuuggccc

SEQ ID NO: 937750 - RNA, 20 nt, Human
cuacauggccacgugacgcc

SEQ ID NO: 937751 - RNA, 26 nt, Human
cuacauggccacgugacgccaucacc

SEQ ID NO: 937752 - RNA, 18 nt, Human
cugggaggccaggaagcu

SEQ ID NO: 937753 - RNA, 21 nt, Human
cuggggcccagggcugugcgg

SEQ ID NO: 937754 - RNA, 23 nt, Human
cugugagcauaucccugcauccu

SEQ ID NO: 937755 - RNA, 19 nt, Human
cugugugcgacgugcugca

SEQ ID NO: 937756 - RNA, 18 nt, Human
gaagcuggaggaggggag

SEQ ID NO: 937757 - RNA, 20 nt, Human
gacacuaggugagaauuggg

SEQ ID NO: 937758 - RNA, 22 nt, Human
gaggugcuggggcccagggcug

SEQ ID NO: 937759 - RNA, 24 nt, Human
gccaggaagcuggaggaggggagg

SEQ ID NO: 937760 - RNA, 19 nt, Human
gcucaaggagcggagguga

SEQ ID NO: 937761 - RNA, 23 nt, Human
gcuggaggaggggaggugcuggg

SEQ ID NO: 937762 - RNA, 21 nt, Human
gcugugcgggaggggauggga

SEQ ID NO: 937763 - RNA, 21 nt, Human
gggaggugcuggggcccaggg

SEQ ID NO: 937764 - RNA, 19 nt, Human
ggggaggugcuggggccca

SEQ ID NO: 937765 - RNA, 19 nt, Human
ggggaugggauccuguggg

SEQ ID NO: 937766 - RNA, 18 nt, Human
gggggcggcgggaggggg

SEQ ID NO: 937767 - RNA, 23 nt, Human
ggguaccuuggcccgugugccag

SEQ ID NO: 937768 - RNA, 20 nt, Human
gguggcccugggugguuggg

SEQ ID NO: 937769 - RNA, 20 nt, Human
ggugguugggggcggcggga

SEQ ID NO: 937770 - RNA, 24 nt, Human
ggugguugggggcggcgggagggg

SEQ ID NO: 937771 - RNA, 18 nt, Human
uagaaagugugugugaaa

SEQ ID NO: 937772 - RNA, 18 nt, Human
ucaccuccggguccaggc

SEQ ID NO: 937773 - RNA, 21 nt, Human
ucagggccccgaggggguccu

SEQ ID NO: 937774 - RNA, 21 nt, Human
uccgcaaaccgccgagucggg

SEQ ID NO: 937775 - RNA, 20 nt, Human
uccggugcaccgucccugcu

SEQ ID NO: 937776 - RNA, 19 nt, Human
uccuccgcaaaccgccgag

SEQ ID NO: 937777 - RNA, 20 nt, Human
uccuguggguaccuuggccc

SEQ ID NO: 937778 - RNA, 19 nt, Human
ucuccgcggccgugugcuc

SEQ ID NO: 937779 - RNA, 20 nt, Human
ucugaugguggcccugggug

SEQ ID NO: 937780 - RNA, 20 nt, Human
ugacgucguugcugcaucuc

SEQ ID NO: 937781 - RNA, 18 nt, Human
ugagaggguacuaggggu

SEQ ID NO: 937782 - RNA, 20 nt, Human
ugaggaaguggcugggaggc

SEQ ID NO: 937783 - RNA, 18 nt, Human
ugcucgaucccgccgucc

SEQ ID NO: 937784 - RNA, 22 nt, Human
uggaggaggggaggugcugggg

SEQ ID NO: 937785 - RNA, 23 nt, Human
ugggaguugggggagaaggagug

SEQ ID NO: 937786 - RNA, 18 nt, Human
ugggggcggcgggagggg

SEQ ID NO: 937787 - RNA, 22 nt, Human
ugucugugugcgacgugcugca

SEQ ID NO: 937788 - RNA, 18 nt, Human
ugugcgggaggggauggg

SEQ ID NO: 937789 - RNA, 26 nt, Human
ugugugaaagggcaugcgugcaugug

SEQ ID NO: 937790 - RNA, 21 nt, Human
ugugugacauuaauaugugug

SEQ ID NO: 937791 - RNA, 19 nt, Human
uugguccucaggccuggag

SEQ ID NO: 937792 - RNA, 24 nt, Human
uugguccucaggccuggagccucc

SEQ ID NO: 937793 - RNA, 25 nt, Human
uuuuuuuuuuuuuuuuuuuuuaagg

SEQ ID NO: 937794 - RNA, 22 nt, Human
aauuacuuuuuaaaaauccuuu

SEQ ID NO: 937795 - RNA, 20 nt, Human
agggagggaccacgaccgca

SEQ ID NO: 937796 - RNA, 21 nt, Human
aucugaagagcaagcacaaag

SEQ ID NO: 937797 - RNA, 19 nt, Human
uaagaaaugcaacaagagc

SEQ ID NO: 937798 - RNA, 22 nt, Human
uagaaaccaggcugcauaggga

SEQ ID NO: 937799 - RNA, 24 nt, Human
ugaauuguguuucagucacucugc

SEQ ID NO: 937800 - RNA, 18 nt, Human
ugcagaaaggaaugucag

SEQ ID NO: 937801 - RNA, 19 nt, Human
ugcugccacgcauggaaca

SEQ ID NO: 937802 - RNA, 22 nt, Human
ugucacgcuagaaaccaggcug

SEQ ID NO: 937803 - RNA, 24 nt, Human
uuuguggugccaccgcaguugcag

SEQ ID NO: 937804 - RNA, 20 nt, Human
aaagagaccucagggcccuc

SEQ ID NO: 937805 - RNA, 19 nt, Human
aaaguucugagauuacagg

SEQ ID NO: 937806 - RNA, 18 nt, Human
aacagcaucugagauaag

SEQ ID NO: 937807 - RNA, 25 nt, Human
aagucagcugcacagcuggaaccaa

SEQ ID NO: 937808 - RNA, 24 nt, Human
aagugauccaccugccucagccuc

SEQ ID NO: 937809 - RNA, 20 nt, Human
acagcuggaaccaagccgua

SEQ ID NO: 937810 - RNA, 25 nt, Human
accauguugcccaggcuggucucaa

SEQ ID NO: 937811 - RNA, 18 nt, Human
acuggguuucaccauguu

SEQ ID NO: 937812 - RNA, 19 nt, Human
acuggguuucaccauguug

SEQ ID NO: 937813 - RNA, 24 nt, Human
acuggguuucaccauguugcccag

SEQ ID NO: 937814 - RNA, 19 nt, Human
agauuacaggagugagcca

SEQ ID NO: 937815 - RNA, 24 nt, Human
agugauccaccugccucagccucc

SEQ ID NO: 937816 - RNA, 18 nt, Human
auaagaacaguugaagaa

SEQ ID NO: 937817 - RNA, 24 nt, Human
caaagguacccacugggauuuuaa

SEQ ID NO: 937818 - RNA, 24 nt, Human
caaaguucugagauuacaggagug

SEQ ID NO: 937819 - RNA, 26 nt, Human
caagcuccugagcucaagugauccaa

SEQ ID NO: 937820 - RNA, 22 nt, Human
caagugauccaccugccucagc

SEQ ID NO: 937821 - RNA, 24 nt, Human
caccauguugcccaggcuggucuc

SEQ ID NO: 937822 - RNA, 23 nt, Human
caccugccucagccucccaaagu

SEQ ID NO: 937823 - RNA, 23 nt, Human
cauguugcccaggcuggucucaa

SEQ ID NO: 937824 - RNA, 23 nt, Human
cauguugcccaggcuggucucaa

SEQ ID NO: 937825 - RNA, 24 nt, Human
cauguugcccaggcuggucucaag

SEQ ID NO: 937826 - RNA, 22 nt, Human
ccacagccagacaccucagggc

SEQ ID NO: 937827 - RNA, 19 nt, Human
ccaccugccucagccuccc

SEQ ID NO: 937828 - RNA, 23 nt, Human
ccacugcccaccagcaaggagcc

SEQ ID NO: 937829 - RNA, 21 nt, Human
ccacuugugccaccauacaaa

SEQ ID NO: 937830 - RNA, 20 nt, Human
ccuagagaguaguguggcug

SEQ ID NO: 937831 - RNA, 21 nt, Human
ccugagcucaagugauccacc

SEQ ID NO: 937832 - RNA, 22 nt, Human
ccugagcucaagugauccaccu

SEQ ID NO: 937833 - RNA, 23 nt, Human
ccugagcucaagugauccaccug

SEQ ID NO: 937834 - RNA, 22 nt, Human
ccugccucagccucccaaaguu

SEQ ID NO: 937835 - RNA, 23 nt, Human
cucaagugauccaccugccucag

SEQ ID NO: 937836 - RNA, 25 nt, Human
cucagccucccaaaguucugagauu

SEQ ID NO: 937837 - RNA, 21 nt, Human
cucccaaaguucugagauuac

SEQ ID NO: 937838 - RNA, 24 nt, Human
cuggguuucaccauguugcccagg

SEQ ID NO: 937839 - RNA, 18 nt, Human
cuugaccccugaggccua

SEQ ID NO: 937840 - RNA, 18 nt, Human
gaccucagggcccuccuc

SEQ ID NO: 937841 - RNA, 22 nt, Human
gagccacagccagacaccucag

SEQ ID NO: 937842 - RNA, 24 nt, Human
gagcucaagugauccaccugccuc

SEQ ID NO: 937843 - RNA, 18 nt, Human
gauuacaggagugagcca

SEQ ID NO: 937844 - RNA, 24 nt, Human
gauuacaggagugagccacagugc

SEQ ID NO: 937845 - RNA, 20 nt, Human
gcacagcuggaaccaagccg

SEQ ID NO: 937846 - RNA, 24 nt, Human
gcucaagugauccaccugccucag

SEQ ID NO: 937847 - RNA, 19 nt, Human
ggacagugggaaucuagaa

SEQ ID NO: 937848 - RNA, 22 nt, Human
ggccaaaucuugagccacagcc

SEQ ID NO: 937849 - RNA, 21 nt, Human
ggguuucaccauguugcccag

SEQ ID NO: 937850 - RNA, 22 nt, Human
ggguuucaccauguugcccagg

SEQ ID NO: 937851 - RNA, 24 nt, Human
gugagccacagugcccaggcuucu

SEQ ID NO: 937852 - RNA, 18 nt, Human
gugauccaccugccucag

SEQ ID NO: 937853 - RNA, 24 nt, Human
gugauccaccugccucagccuccc

SEQ ID NO: 937854 - RNA, 24 nt, Human
uacaggagugagccacagugccca

SEQ ID NO: 937855 - RNA, 23 nt, Human
uacuucagcaaacggaacccugg

SEQ ID NO: 937856 - RNA, 21 nt, Human
uagaaacuggguuucaccaug

SEQ ID NO: 937857 - RNA, 24 nt, Human
uauauggcucacguguuucuauug

SEQ ID NO: 937858 - RNA, 19 nt, Human
ucagccucccaaaguucug

SEQ ID NO: 937859 - RNA, 19 nt, Human
ucagggcccuccucugagc

SEQ ID NO: 937860 - RNA, 23 nt, Human
ucagggcccuccucugagcuccu

SEQ ID NO: 937861 - RNA, 18 nt, Human
uccuugaccccugaggcc

SEQ ID NO: 937862 - RNA, 22 nt, Human
uccuuugggagggucugcaugg

SEQ ID NO: 937863 - RNA, 23 nt, Human
ucucaagcuccugagcucaagug

SEQ ID NO: 937864 - RNA, 24 nt, Human
ucugagauaaggaacuuaguguuu

SEQ ID NO: 937865 - RNA, 26 nt, Human
ucuugagaaggcaguauccuuuggga

SEQ ID NO: 937866 - RNA, 21 nt, Human
ugagauuacaggagugagcca

SEQ ID NO: 937867 - RNA, 22 nt, Human
ugagauuacaggagugagccac

SEQ ID NO: 937868 - RNA, 19 nt, Human
ugaggccuagagaguaguc

SEQ ID NO: 937869 - RNA, 24 nt, Human
ugcccaggcuggucucaagcuccu

SEQ ID NO: 937870 - RNA, 28 nt, Human
ugcccaggcuggucucaagcuccugagc

SEQ ID NO: 937871 - RNA, 24 nt, Human
ugccucagccucccaaaguucuga

SEQ ID NO: 937872 - RNA, 21 nt, Human
uggacagugggaaucuagaac

SEQ ID NO: 937873 - RNA, 18 nt, Human
ugggauaacaccaguugg

SEQ ID NO: 937874 - RNA, 19 nt, Human
ugggauaacaccaguugga

SEQ ID NO: 937875 - RNA, 23 nt, Human
ugggauuuuaaaaucaguguuuu

SEQ ID NO: 937876 - RNA, 23 nt, Human
uggguuucaccauguugcccagg

SEQ ID NO: 937877 - RNA, 22 nt, Human
uuaguguuuuuuaaaaaguauu

SEQ ID NO: 937878 - RNA, 22 nt, Human
uuucaccauguugcccaggcug

SEQ ID NO: 937879 - RNA, 23 nt, Human
uuucaccauguugcccaggcugg

SEQ ID NO: 937880 - RNA, 24 nt, Human
uuucaccauguugcccaggcuggu

SEQ ID NO: 937881 - RNA, 22 nt, Human
aaaacaaaacuccagcaaggca

SEQ ID NO: 937882 - RNA, 30 nt, Human
aaaagaagacaguucagaaacagucagaaa

SEQ ID NO: 937883 - RNA, 19 nt, Human
aacagguuuaagcaauguc

SEQ ID NO: 937884 - RNA, 24 nt, Human
aaggggagacaaaaaacccaaaga

SEQ ID NO: 937885 - RNA, 23 nt, Human
aaguuccucagaugugucaucag

SEQ ID NO: 937886 - RNA, 26 nt, Human
acaaaacuccagcaaggcauaaauaa

SEQ ID NO: 937887 - RNA, 28 nt, Human
acccagaaagcacgugaauugagggguc

SEQ ID NO: 937888 - RNA, 20 nt, Human
acugcuuuugccagcaaagc

SEQ ID NO: 937889 - RNA, 23 nt, Human
agaaaauucccaauacuugcuaa

SEQ ID NO: 937890 - RNA, 21 nt, Human
agacaaaaaacccaaagaaca

SEQ ID NO: 937891 - RNA, 24 nt, Human
aggaaggagaccagguaaagaaga

SEQ ID NO: 937892 - RNA, 21 nt, Human
agugcauauauacaauaccag

SEQ ID NO: 937893 - RNA, 22 nt, Human
auaaucaccaagccccaaacac

SEQ ID NO: 937894 - RNA, 21 nt, Human
caaaacaaaacuccagcaagg

SEQ ID NO: 937895 - RNA, 23 nt, Human
caaagccaguaaaguaugacacu

SEQ ID NO: 937896 - RNA, 20 nt, Human
caacaaaacaaaacuccagc

SEQ ID NO: 937897 - RNA, 26 nt, Human
caagccccaaacacauacaaaacacu

SEQ ID NO: 937898 - RNA, 20 nt, Human
caauaccagaaaaguuuaga

SEQ ID NO: 937899 - RNA, 22 nt, Human
cacugcuaauagaaaauuccca

SEQ ID NO: 937900 - RNA, 20 nt, Human
caguacaaucacacagauca

SEQ ID NO: 937901 - RNA, 22 nt, Human
ccaaacuauguucagucuugca

SEQ ID NO: 937902 - RNA, 21 nt, Human
ccaagccccaaacacauacaa

SEQ ID NO: 937903 - RNA, 20 nt, Human
cucccugaggccaccggaug

SEQ ID NO: 937904 - RNA, 20 nt, Human
cugaggcagugcuuuuucca

SEQ ID NO: 937905 - RNA, 19 nt, Human
cuuaaaucuuucaccccca

SEQ ID NO: 937906 - RNA, 22 nt, Human
gaaaaacacuucuucaaaaucc

SEQ ID NO: 937907 - RNA, 18 nt, Human
gcagugcuuuuuccaugu

SEQ ID NO: 937908 - RNA, 26 nt, Human
gcucccugaggccaccggaugcuuuu

SEQ ID NO: 937909 - RNA, 24 nt, Human
gugcuuuuggaucugaacagagac

SEQ ID NO: 937910 - RNA, 24 nt, Human
guuaaaaauuggagcaacaaaaca

SEQ ID NO: 937911 - RNA, 24 nt, Human
uaaaacaccacugcuaauagaaaa

SEQ ID NO: 937912 - RNA, 22 nt, Human
uaagaaaacauaauuuuuagga

SEQ ID NO: 937913 - RNA, 22 nt, Human
uacaguaaaaguuaaaauugga

SEQ ID NO: 937914 - RNA, 22 nt, Human
uaccagaaaaguuuagauuggg

SEQ ID NO: 937915 - RNA, 22 nt, Human
uaugguuuaaaaggaauauugg

SEQ ID NO: 937916 - RNA, 18 nt, Human
uaugugcaugcaccaaug

SEQ ID NO: 937917 - RNA, 19 nt, Human
ucaaaauaaucaccaagcc

SEQ ID NO: 937918 - RNA, 24 nt, Human
ucaaagaacauaaauaaaaaguug

SEQ ID NO: 937919 - RNA, 22 nt, Human
ucuauaccugacauugggaaaa

SEQ ID NO: 937920 - RNA, 23 nt, Human
ucuucaggaauuguuuauuuggu

SEQ ID NO: 937921 - RNA, 21 nt, Human
ugaaaucacuggcauucagug

SEQ ID NO: 937922 - RNA, 27 nt, Human
ugaacagugcagauuauuaugaaacua

SEQ ID NO: 937923 - RNA, 22 nt, Human
ugauuuauccuuuugaaauuca

SEQ ID NO: 937924 - RNA, 20 nt, Human
ugcaacuuguggaaagagua

SEQ ID NO: 937925 - RNA, 19 nt, Human
ugcaaggggaugaacagug

SEQ ID NO: 937926 - RNA, 18 nt, Human
ugccagcaaagcucccuc

SEQ ID NO: 937927 - RNA, 19 nt, Human
ugcuuuuggaucugaacag

SEQ ID NO: 937928 - RNA, 23 nt, Human
ugggcuauaugaccauggccuuu

SEQ ID NO: 937929 - RNA, 18 nt, Human
uggguagcuauaaucaug

SEQ ID NO: 937930 - RNA, 24 nt, Human
ugucuugagucucuuaauucuucu

SEQ ID NO: 937931 - RNA, 21 nt, Human
uguuguuguuuuauuuuuugu

SEQ ID NO: 937932 - RNA, 21 nt, Human
uuaauauaugugcaugcacca

SEQ ID NO: 937933 - RNA, 22 nt, Human
uucaaaauaaucaccaagcccc

SEQ ID NO: 937934 - RNA, 30 nt, Human
uucaaaauccuacacuaugaaaaacugucc

SEQ ID NO: 937935 - RNA, 20 nt, Human
uuguuguuguuuuauuuuuu

SEQ ID NO: 937936 - RNA, 26 nt, Human
uuuaugguuuaaaaggaauauuggug

SEQ ID NO: 937937 - RNA, 20 nt, Human
uuuuauuuuuuguggguagc

SEQ ID NO: 937938 - RNA, 23 nt, Human
aaagccaggauaaccagggccaa

SEQ ID NO: 937939 - RNA, 19 nt, Human
aggauaaccagggccaaga

SEQ ID NO: 937940 - RNA, 23 nt, Human
aggauaaccagggccaagauaug

SEQ ID NO: 937941 - RNA, 19 nt, Human
aucugggcuuccuaguugu

SEQ ID NO: 937942 - RNA, 18 nt, Human
ccaggauaaccagggcca

SEQ ID NO: 937943 - RNA, 22 nt, Human
cuaacccauccaguccacuauc

SEQ ID NO: 937944 - RNA, 18 nt, Human
cugggcuuccuaguugua

SEQ ID NO: 937945 - RNA, 20 nt, Human
gacaauggagggaaagaagg

SEQ ID NO: 937946 - RNA, 24 nt, Human
gagcauacucagacaauggaggga

SEQ ID NO: 937947 - RNA, 19 nt, Human
uauagccuccaaagccagg

SEQ ID NO: 937948 - RNA, 21 nt, Human
ucagacaauggagggaaagaa

SEQ ID NO: 937949 - RNA, 23 nt, Human
uccaaagccaggauaaccagggc

SEQ ID NO: 937950 - RNA, 21 nt, Human
uccuaguuguacaccuggucc

SEQ ID NO: 937951 - RNA, 22 nt, Human
uccuccuaacccauccagucca

SEQ ID NO: 937952 - RNA, 21 nt, Human
uugacgaagguagugguuuau

SEQ ID NO: 937953 - RNA, 24 nt, Human
aaaaauagugagaaaaccaguguc

SEQ ID NO: 937954 - RNA, 24 nt, Human
agugagaaaaccagugucaaaucc

SEQ ID NO: 937955 - RNA, 18 nt, Human
ccagugucaaauccuacc

SEQ ID NO: 937956 - RNA, 19 nt, Human
ccuguguaauucguagagc

SEQ ID NO: 937957 - RNA, 21 nt, Human
cgugcagaaucucccaaaaau

SEQ ID NO: 937958 - RNA, 21 nt, Human
cucccaaaaauagugagaaaa

SEQ ID NO: 937959 - RNA, 20 nt, Human
uaagacaucuuagagacccg

SEQ ID NO: 937960 - RNA, 19 nt, Human
uaauucguagagcgauccc

SEQ ID NO: 937961 - RNA, 23 nt, Human
uagagacccgaaucccgcuuccu

SEQ ID NO: 937962 - RNA, 23 nt, Human
ucccaaaaauagugagaaaaccc

SEQ ID NO: 937963 - RNA, 21 nt, Human
ugaagggggugcgugacucgu

SEQ ID NO: 937964 - RNA, 18 nt, Human
ugacccucugaccugcau

SEQ ID NO: 937965 - RNA, 18 nt, Human
uuuuuuuuuuuuuuuuug

SEQ ID NO: 937966 - RNA, 19 nt, Human
aaugauuuguaucuccugg

SEQ ID NO: 937967 - RNA, 18 nt, Human
acagagcacauaaaaacc

SEQ ID NO: 937968 - RNA, 18 nt, Human
ccacagagcacauaaaaa

SEQ ID NO: 937969 - RNA, 19 nt, Human
gagcagagauaccaauccu

SEQ ID NO: 937970 - RNA, 20 nt, Human
gggugccagaaaucucacaa

SEQ ID NO: 937971 - RNA, 21 nt, Human
ggugccagaaaucucacaacu

SEQ ID NO: 937972 - RNA, 23 nt, Human
ucaaugauuuguaucuccugggu

SEQ ID NO: 937973 - RNA, 24 nt, Human
ucuaugaauggggugccagaaauc

SEQ ID NO: 937974 - RNA, 19 nt, Human
ucuccugggugcaguguca

SEQ ID NO: 937975 - RNA, 21 nt, Human
ugaaggccuuucagugacuca

SEQ ID NO: 937976 - RNA, 18 nt, Human
ugauuuguaucuccuggg

SEQ ID NO: 937977 - RNA, 22 nt, Human
ugccagaaaucucacaacucag

SEQ ID NO: 937978 - RNA, 22 nt, Human
aauaaauacuguuuacguacaa

SEQ ID NO: 937979 - RNA, 23 nt, Human
acacacacacacacacacacaca

SEQ ID NO: 937980 - RNA, 23 nt, Human
acacacacacacacacacacaca

SEQ ID NO: 937981 - RNA, 23 nt, Human
acacacacacacacacacacaca

SEQ ID NO: 937982 - RNA, 23 nt, Human
acacacacacacacacacacaca

SEQ ID NO: 937983 - RNA, 23 nt, Human
acacacacacacacacacacaca

SEQ ID NO: 937984 - RNA, 23 nt, Human
acacacacacacacacacacaca

SEQ ID NO: 937985 - RNA, 23 nt, Human
acacacacacacacacacacaca

SEQ ID NO: 937986 - RNA, 23 nt, Human
acacacacacacacacacacaca

SEQ ID NO: 937987 - RNA, 28 nt, Human
acacacacacacacacacacacaucaaa

SEQ ID NO: 937988 - RNA, 19 nt, Human
agggaaggcagacuucaga

SEQ ID NO: 937989 - RNA, 23 nt, Human
aucaacccugccaccaggucucc

SEQ ID NO: 937990 - RNA, 31 nt, Human
aucaaggucacacacacacacacacacacag

SEQ ID NO: 937991 - RNA, 31 nt, Human
caaggucacacacacacacacacacacacag

SEQ ID NO: 937992 - RNA, 20 nt, Human
cacacacacacacacacaca

SEQ ID NO: 937993 - RNA, 20 nt, Human
cacacacacacacacacaca

SEQ ID NO: 937994 - RNA, 20 nt, Human
cacacacacacacacacaca

SEQ ID NO: 937995 - RNA, 20 nt, Human
cacacacacacacacacaca

SEQ ID NO: 937996 - RNA, 20 nt, Human
cacacacacacacacacaca

SEQ ID NO: 937997 - RNA, 20 nt, Human
cacacacacacacacacaca

SEQ ID NO: 937998 - RNA, 20 nt, Human
cacacacacacacacacaca

SEQ ID NO: 937999 - RNA, 20 nt, Human
cacacacacacacacacaca

SEQ ID NO: 938000 - RNA, 20 nt, Human
cacacacacacacacacaca

SEQ ID NO: 938001 - RNA, 20 nt, Human
cacacacacacacacacaca

SEQ ID NO: 938002 - RNA, 20 nt, Human
cacacacacacacacacaca

SEQ ID NO: 938003 - RNA, 20 nt, Human
cacacacacacacacacaca

SEQ ID NO: 938004 - RNA, 20 nt, Human
cacacacacacacacacaca

SEQ ID NO: 938005 - RNA, 20 nt, Human
cacacacacacacacacaca

SEQ ID NO: 938006 - RNA, 20 nt, Human
cacacacacacacacacaca

SEQ ID NO: 938007 - RNA, 22 nt, Human
cacacacacacacacacacaca

SEQ ID NO: 938008 - RNA, 22 nt, Human
cacacacacacacacacacaca

SEQ ID NO: 938009 - RNA, 22 nt, Human
cacacacacacacacacacaca

SEQ ID NO: 938010 - RNA, 22 nt, Human
cacacacacacacacacacaca

SEQ ID NO: 938011 - RNA, 22 nt, Human
cacacacacacacacacacaca

SEQ ID NO: 938012 - RNA, 22 nt, Human
cacacacacacacacacacaca

SEQ ID NO: 938013 - RNA, 26 nt, Human
cacacacacacacacacacacacaca

SEQ ID NO: 938014 - RNA, 26 nt, Human
cacacacacacacacacacacacaca

SEQ ID NO: 938015 - RNA, 26 nt, Human
cacacacacacacacacacacacaca

SEQ ID NO: 938016 - RNA, 26 nt, Human
cacacacacacacacacacacacaca

SEQ ID NO: 938017 - RNA, 26 nt, Human
cacacacacacacacacacacacaca

SEQ ID NO: 938018 - RNA, 26 nt, Human
cacacacacacacacacacacacaca

SEQ ID NO: 938019 - RNA, 26 nt, Human
cacacacacacacacacacacacaca

SEQ ID NO: 938020 - RNA, 26 nt, Human
cacacacacacacacacacacacaca

SEQ ID NO: 938021 - RNA, 27 nt, Human
cacacacacacacacacacacacauca

SEQ ID NO: 938022 - RNA, 21 nt, Human
ccagucacgguaguaauuuau

SEQ ID NO: 938023 - RNA, 21 nt, Human
cccugccaccaggucuccuug

SEQ ID NO: 938024 - RNA, 23 nt, Human
cgguaguaauuuauaauaaauac

SEQ ID NO: 938025 - RNA, 21 nt, Human
ugagaucaacccugccaccag

SEQ ID NO: 938026 - RNA, 26 nt, Human
ugagaucaacccugccaccaggucuc

SEQ ID NO: 938027 - RNA, 24 nt, Human
uuuuuuuccaaugcauuuuauccu

SEQ ID NO: 938028 - RNA, 20 nt, Human
aacccugcccagacgccgcc

SEQ ID NO: 938029 - RNA, 21 nt, Human
acccgaacccugcccagacgc

SEQ ID NO: 938030 - RNA, 22 nt, Human
agcaggagguggaaggcgaggg

SEQ ID NO: 938031 - RNA, 22 nt, Human
aggagguggaaggcgagggaag

SEQ ID NO: 938032 - RNA, 23 nt, Human
cccagacgccgccgucgggaggc

SEQ ID NO: 938033 - RNA, 18 nt, Human
ccgcacccgaacccugcc

SEQ ID NO: 938034 - RNA, 22 nt, Human
ccgcacccgaacccugcccaga

SEQ ID NO: 938035 - RNA, 24 nt, Human
ccgcacccgaacccugcccagacg

SEQ ID NO: 938036 - RNA, 23 nt, Human
ccuccagcccagggggcgggggc

SEQ ID NO: 938037 - RNA, 20 nt, Human
cgccgccgucgggaggcaga

SEQ ID NO: 938038 - RNA, 25 nt, Human
cgggaggcagaauccggguuucugg

SEQ ID NO: 938039 - RNA, 22 nt, Human
cgugguuggcagaucucccagg

SEQ ID NO: 938040 - RNA, 19 nt, Human
gcacccgaacccugcccag

SEQ ID NO: 938041 - RNA, 20 nt, Human
gcagaucucccaggaggccu

SEQ ID NO: 938042 - RNA, 19 nt, Human
ggaaggaccacacacagcc

SEQ ID NO: 938043 - RNA, 20 nt, Human
ggaggcagaauccggguuuc

SEQ ID NO: 938044 - RNA, 20 nt, Human
gggaagucccaagggcugca

SEQ ID NO: 938045 - RNA, 21 nt, Human
gggaggcagaauccggguuuc

SEQ ID NO: 938046 - RNA, 18 nt, Human
gugggcgugguuggcaga

SEQ ID NO: 938047 - RNA, 18 nt, Human
ucccaagggcugcacugc

SEQ ID NO: 938048 - RNA, 22 nt, Human
ucccaggaggccucaggggucc

SEQ ID NO: 938049 - RNA, 21 nt, Human
ucuuuauuuugggaccaggga

SEQ ID NO: 938050 - RNA, 20 nt, Human
ugcccagacgccgccgucgg

SEQ ID NO: 938051 - RNA, 23 nt, Human
uggaaggcgagggaagucccaag

SEQ ID NO: 938052 - RNA, 23 nt, Human
ugguuggcagaucucccaggagg

SEQ ID NO: 938053 - RNA, 18 nt, Human
aagcagaugagcaggagg

SEQ ID NO: 938054 - RNA, 26 nt, Human
aaggaauccgauccggggaggcaagc

SEQ ID NO: 938055 - RNA, 24 nt, Human
accacagcgacagcuugugaagca

SEQ ID NO: 938056 - RNA, 18 nt, Human
acgccgcuguccggaggc

SEQ ID NO: 938057 - RNA, 18 nt, Human
aggaccacacacagcccu

SEQ ID NO: 938058 - RNA, 26 nt, Human
aggccacgaccugcgaaccgacacca

SEQ ID NO: 938059 - RNA, 19 nt, Human
aggcgguccucgcagucug

SEQ ID NO: 938060 - RNA, 25 nt, Human
agguaguggcgaggauaggcguagc

SEQ ID NO: 938061 - RNA, 20 nt, Human
aguacccgaacccugcccag

SEQ ID NO: 938062 - RNA, 23 nt, Human
augaggugggcguggucugcagg

SEQ ID NO: 938063 - RNA, 19 nt, Human
cacagcccugcagcucagg

SEQ ID NO: 938064 - RNA, 22 nt, Human
cacaggucugcgcccuccggcc

SEQ ID NO: 938065 - RNA, 19 nt, Human
caggguggggccagaccgc

SEQ ID NO: 938066 - RNA, 24 nt, Human
ccccguccgcccgccccgcgccug

SEQ ID NO: 938067 - RNA, 19 nt, Human
ccgcccgccccgcgccugc

SEQ ID NO: 938068 - RNA, 22 nt, Human
cgcggucagaucuagccacgcc

SEQ ID NO: 938069 - RNA, 22 nt, Human
cggaggcgaaauccggguuucc

SEQ ID NO: 938070 - RNA, 20 nt, Human
cgguggagcggggcuguagg

SEQ ID NO: 938071 - RNA, 22 nt, Human
cucuuuauuuugggaccaggga

SEQ ID NO: 938072 - RNA, 20 nt, Human
gaagcagaugagcaggaggu

SEQ ID NO: 938073 - RNA, 23 nt, Human
gagcaggagguggaaggcgagga

SEQ ID NO: 938074 - RNA, 20 nt, Human
gcagcucagggggcgcgggg

SEQ ID NO: 938075 - RNA, 20 nt, Human
gcaggucucccaggaggccu

SEQ ID NO: 938076 - RNA, 21 nt, Human
gccacgcccccgguggagcgg

SEQ ID NO: 938077 - RNA, 21 nt, Human
gccgaggcgguccucgcaguc

SEQ ID NO: 938078 - RNA, 20 nt, Human
gcggucagaucuagccacgc

SEQ ID NO: 938079 - RNA, 21 nt, Human
gcggucagaucuagccacgcc

SEQ ID NO: 938080 - RNA, 19 nt, Human
ggaaggaccacacacagcc

SEQ ID NO: 938081 - RNA, 21 nt, Human
ggguggggccagaccgcgcuc

SEQ ID NO: 938082 - RNA, 22 nt, Human
uacccgaacccugcccagacgc

SEQ ID NO: 938083 - RNA, 19 nt, Human
ucccauaccugagggcggg

SEQ ID NO: 938084 - RNA, 21 nt, Human
ugaggugggcguggucugcag

SEQ ID NO: 938085 - RNA, 23 nt, Human
ugaggugggcguggucugcaggu

SEQ ID NO: 938086 - RNA, 25 nt, Human
ugcccagacgccgcuguccggaggc

SEQ ID NO: 938087 - RNA, 19 nt, Human
ugggaagaacguuuuggag

SEQ ID NO: 938088 - RNA, 20 nt, Human
uguccggaggcgaaauccgg

SEQ ID NO: 938089 - RNA, 22 nt, Human
uuuccagggucgggagugaaca

SEQ ID NO: 938090 - RNA, 22 nt, Human
aaaaaaaaaaaaaaaagcugag

SEQ ID NO: 938091 - RNA, 25 nt, Human
aaaaaaaaaaagcugaguuggagga

SEQ ID NO: 938092 - RNA, 19 nt, Human
aaaaagacaagacacccaa

SEQ ID NO: 938093 - RNA, 25 nt, Human
aaaaaggcugcaacuucugcccuuu

SEQ ID NO: 938094 - RNA, 20 nt, Human
aaaaggcugcaacuucugcc

SEQ ID NO: 938095 - RNA, 26 nt, Human
aaacaggaaaaaaaaaaaagggaccc

SEQ ID NO: 938096 - RNA, 27 nt, Human
aaacaguaaaaggauacacuacaccag

SEQ ID NO: 938097 - RNA, 22 nt, Human
aaacauuguuuucuagaaugaa

SEQ ID NO: 938098 - RNA, 20 nt, Human
aaacccaaaagugucuaaug

SEQ ID NO: 938099 - RNA, 21 nt, Human
aaagaaccaaagaauuaaaau

SEQ ID NO: 938100 - RNA, 18 nt, Human
aaagacaaagcaguggca

SEQ ID NO: 938101 - RNA, 27 nt, Human
aaauauauauauuuuuuucugcaccag

SEQ ID NO: 938102 - RNA, 23 nt, Human
aaccaaaaguauuaaacuauucu

SEQ ID NO: 938103 - RNA, 19 nt, Human
aagaaagacaaaaaggcuc

SEQ ID NO: 938104 - RNA, 24 nt, Human
aaggcugcaacuucugcccuuuga

SEQ ID NO: 938105 - RNA, 20 nt, Human
accaugaaggaaaauaaggc

SEQ ID NO: 938106 - RNA, 20 nt, Human
agaaaaaaauucuuuuugaa

SEQ ID NO: 938107 - RNA, 21 nt, Human
agaaacagcaaagaaccaaag

SEQ ID NO: 938108 - RNA, 20 nt, Human
agaaagacaaagcagugggg

SEQ ID NO: 938109 - RNA, 20 nt, Human
agaagaaaaagauuccuaga

SEQ ID NO: 938110 - RNA, 22 nt, Human
agaagaaaaagauuccuagaag

SEQ ID NO: 938111 - RNA, 21 nt, Human
agacaugugauuaaauuuggg

SEQ ID NO: 938112 - RNA, 19 nt, Human
agaggagggaggggcgggg

SEQ ID NO: 938113 - RNA, 19 nt, Human
agcaggcaggcauggucag

SEQ ID NO: 938114 - RNA, 20 nt, Human
agguaacguggcaaaaaucc

SEQ ID NO: 938115 - RNA, 18 nt, Human
aggucaucauugggugaa

SEQ ID NO: 938116 - RNA, 21 nt, Human
aguguuuagauguaggcuuug

SEQ ID NO: 938117 - RNA, 21 nt, Human
augcauguaccuuguucucau

SEQ ID NO: 938118 - RNA, 27 nt, Human
caaaaucaaaugaaugcaucccccuuc

SEQ ID NO: 938119 - RNA, 21 nt, Human
caaaugaaugcaucccccuuc

SEQ ID NO: 938120 - RNA, 22 nt, Human
caagacacccaauauaauaaag

SEQ ID NO: 938121 - RNA, 21 nt, Human
cacaguaucagauuuggcaaa

SEQ ID NO: 938122 - RNA, 26 nt, Human
caccaagaagguaaugacucagcuuc

SEQ ID NO: 938123 - RNA, 20 nt, Human
caccaaugauaucccugacc

SEQ ID NO: 938124 - RNA, 21 nt, Human
cacugucacuugagauuugcc

SEQ ID NO: 938125 - RNA, 18 nt, Human
cagccgccgccgcucucg

SEQ ID NO: 938126 - RNA, 19 nt, Human
cagccgccgccgcucucgg

SEQ ID NO: 938127 - RNA, 19 nt, Human
cagcgccgccgccgccugu

SEQ ID NO: 938128 - RNA, 23 nt, Human
caguacauucagagagagcuuug

SEQ ID NO: 938129 - RNA, 22 nt, Human
cagugcaguuucuagaaccacu

SEQ ID NO: 938130 - RNA, 24 nt, Human
cauacaagcgacacucccaucuac

SEQ ID NO: 938131 - RNA, 21 nt, Human
caucauugggugaagaguuca

SEQ ID NO: 938132 - RNA, 19 nt, Human
ccagccgccgccgcucucg

SEQ ID NO: 938133 - RNA, 20 nt, Human
cccccgcaggcacuuuccgc

SEQ ID NO: 938134 - RNA, 18 nt, Human
cccgccccccgcaggcac

SEQ ID NO: 938135 - RNA, 19 nt, Human
cccgccgccgccgccgccg

SEQ ID NO: 938136 - RNA, 19 nt, Human
cccgcgccgagccccgggg

SEQ ID NO: 938137 - RNA, 23 nt, Human
cccgcuccgcgccggcucccggc

SEQ ID NO: 938138 - RNA, 20 nt, Human
cccgggcccgacgcgcuccc

SEQ ID NO: 938139 - RNA, 18 nt, Human
ccgacugcgcuccuccuc

SEQ ID NO: 938140 - RNA, 25 nt, Human
ccgcccgccgccgccgccgccgccg

SEQ ID NO: 938141 - RNA, 18 nt, Human
ccgccgccgccgccgccg

SEQ ID NO: 938142 - RNA, 24 nt, Human
ccgccgccgccgccgccgccgccg

SEQ ID NO: 938143 - RNA, 25 nt, Human
ccgccgccgccgccgccgccgccgg

SEQ ID NO: 938144 - RNA, 23 nt, Human
ccgccgccgccgccgccgccgga

SEQ ID NO: 938145 - RNA, 19 nt, Human
ccgccgccgcucucggccg

SEQ ID NO: 938146 - RNA, 20 nt, Human
ccgccgccgcucucggccgc

SEQ ID NO: 938147 - RNA, 22 nt, Human
ccgccgccgcucucggccgccc

SEQ ID NO: 938148 - RNA, 20 nt, Human
ccgccgcgcuccgacugcgc

SEQ ID NO: 938149 - RNA, 22 nt, Human
ccgccgcgcuccgacugcgcuc

SEQ ID NO: 938150 - RNA, 21 nt, Human
ccgcgccgagccccggggcgg

SEQ ID NO: 938151 - RNA, 19 nt, Human
ccgcgcgcucgcccgcccc

SEQ ID NO: 938152 - RNA, 21 nt, Human
ccgcgcgcucgcccgcccccc

SEQ ID NO: 938153 - RNA, 21 nt, Human
ccgcucagcgccgccgccgcc

SEQ ID NO: 938154 - RNA, 22 nt, Human
ccgcucagcgccgccgccgccu

SEQ ID NO: 938155 - RNA, 18 nt, Human
ccgcuccgcgccggcucc

SEQ ID NO: 938156 - RNA, 26 nt, Human
ccuauaauucaaacuaucaacucauu

SEQ ID NO: 938157 - RNA, 18 nt, Human
ccuccuccuccucacuca

SEQ ID NO: 938158 - RNA, 18 nt, Human
ccuccucuuccuccuccu

SEQ ID NO: 938159 - RNA, 20 nt, Human
ccuccucuuccuccuccucc

SEQ ID NO: 938160 - RNA, 21 nt, Human
ccuccucuuccuccuccuccu

SEQ ID NO: 938161 - RNA, 18 nt, Human
ccuccuucuccuccuccu

SEQ ID NO: 938162 - RNA, 20 nt, Human
ccuccuucuccuccuccucc

SEQ ID NO: 938163 - RNA, 21 nt, Human
ccuccuucuccuccuccuccu

SEQ ID NO: 938164 - RNA, 19 nt, Human
ccugugccgcgggcucggg

SEQ ID NO: 938165 - RNA, 24 nt, Human
cgaacggacaagugccucagcucg

SEQ ID NO: 938166 - RNA, 24 nt, Human
cgcaaauuuauucaaccaaccaaa

SEQ ID NO: 938167 - RNA, 20 nt, Human
cgccccccgcaggcacuuuc

SEQ ID NO: 938168 - RNA, 20 nt, Human
cgcccgggcccgacgcgcuc

SEQ ID NO: 938169 - RNA, 20 nt, Human
cgccgagccccggggcggcc

SEQ ID NO: 938170 - RNA, 20 nt, Human
cgccgccgccgccugugccg

SEQ ID NO: 938171 - RNA, 22 nt, Human
cgccgccgccugugccgcgggc

SEQ ID NO: 938172 - RNA, 20 nt, Human
cgccucugccgcugccgccg

SEQ ID NO: 938173 - RNA, 30 nt, Human
cgccucugccgcugccgccgcgcuccgacu

SEQ ID NO: 938174 - RNA, 19 nt, Human
cgcucagcgccgccgccgc

SEQ ID NO: 938175 - RNA, 24 nt, Human
cgcucgggacccggcgucccgcuc

SEQ ID NO: 938176 - RNA, 19 nt, Human
cgcucucggccgcccggcu

SEQ ID NO: 938177 - RNA, 19 nt, Human
cggcgccucugccgcugcc

SEQ ID NO: 938178 - RNA, 20 nt, Human
cggggggucucucugggcug

SEQ ID NO: 938179 - RNA, 24 nt, Human
cucccagccgccgccgcucucggc

SEQ ID NO: 938180 - RNA, 22 nt, Human
cuccuccuucuccuccuccucc

SEQ ID NO: 938181 - RNA, 19 nt, Human
cugccgcugccgccgcgcu

SEQ ID NO: 938182 - RNA, 23 nt, Human
cugcugaccucugacugugaugc

SEQ ID NO: 938183 - RNA, 19 nt, Human
cuucuccuccuccuccucc

SEQ ID NO: 938184 - RNA, 22 nt, Human
gaaacagcaaagaaccaaagaa

SEQ ID NO: 938185 - RNA, 18 nt, Human
gaaagacaaagcaguggc

SEQ ID NO: 938186 - RNA, 23 nt, Human
gaagucucucacaguaacugccu

SEQ ID NO: 938187 - RNA, 24 nt, Human
gacaggcaagcaaaggcgauuacc

SEQ ID NO: 938188 - RNA, 18 nt, Human
gagcccgcucagcgccgc

SEQ ID NO: 938189 - RNA, 22 nt, Human
gagcccgcucagcgccgccgcc

SEQ ID NO: 938190 - RNA, 19 nt, Human
gaggccggcgggcgggcgg

SEQ ID NO: 938191 - RNA, 23 nt, Human
gcaaagaaccaaagaauuaaaau

SEQ ID NO: 938192 - RNA, 19 nt, Human
gcauuuuguauccuuuucu

SEQ ID NO: 938193 - RNA, 22 nt, Human
gcccgggcccgacgcgcuccca

SEQ ID NO: 938194 - RNA, 18 nt, Human
gccgagugcgggcgcggg

SEQ ID NO: 938195 - RNA, 19 nt, Human
gccgagugcgggcgcgggg

SEQ ID NO: 938196 - RNA, 20 nt, Human
gccgcugccgccgcgcuccg

SEQ ID NO: 938197 - RNA, 20 nt, Human
gccggagaggagggaggggc

SEQ ID NO: 938198 - RNA, 18 nt, Human
gccggcucccgcucuggc

SEQ ID NO: 938199 - RNA, 21 nt, Human
gccugugccgcgggcucgggg

SEQ ID NO: 938200 - RNA, 18 nt, Human
gcgcuccuccucuuccuc

SEQ ID NO: 938201 - RNA, 22 nt, Human
gcucccagccgccgccgcucuc

SEQ ID NO: 938202 - RNA, 19 nt, Human
gcuccgcgccggcucccgc

SEQ ID NO: 938203 - RNA, 22 nt, Human
ggagaggagggaggggcggggg

SEQ ID NO: 938204 - RNA, 21 nt, Human
ggcggccggcaccgcgcgcuc

SEQ ID NO: 938205 - RNA, 23 nt, Human
ggcucccgcucuggcucccgcgc

SEQ ID NO: 938206 - RNA, 18 nt, Human
ggcucggggggucucucu

SEQ ID NO: 938207 - RNA, 18 nt, Human
gggcgggggggggggucc

SEQ ID NO: 938208 - RNA, 18 nt, Human
ggucaggucaucauuggg

SEQ ID NO: 938209 - RNA, 18 nt, Human
guaaauaaaucaaaacug

SEQ ID NO: 938210 - RNA, 22 nt, Human
gucaggcauuagaaaaguuauc

SEQ ID NO: 938211 - RNA, 21 nt, Human
gucaggucaucauugggugaa

SEQ ID NO: 938212 - RNA, 21 nt, Human
guccacugucacuugagauuu

SEQ ID NO: 938213 - RNA, 19 nt, Human
guccagguauaacauaguu

SEQ ID NO: 938214 - RNA, 23 nt, Human
gugccgcgggcucggggggucuc

SEQ ID NO: 938215 - RNA, 20 nt, Human
gugcgggcgcggggcgcggg

SEQ ID NO: 938216 - RNA, 24 nt, Human
guuucuuuguucuuuuucuuuuuu

SEQ ID NO: 938217 - RNA, 24 nt, Human
uaaaaaagaaagacaaaaaggcuc

SEQ ID NO: 938218 - RNA, 20 nt, Human
uaaacugacaacgguuucca

SEQ ID NO: 938219 - RNA, 22 nt, Human
uaacagaaagacaaagcagugg

SEQ ID NO: 938220 - RNA, 21 nt, Human
uaacauacaagcgacacuccc

SEQ ID NO: 938221 - RNA, 18 nt, Human
uaacuaacuguuucaacu

SEQ ID NO: 938222 - RNA, 24 nt, Human
uaacuuguauucugagggaggagc

SEQ ID NO: 938223 - RNA, 22 nt, Human
uaagacgaacggacaagugccu

SEQ ID NO: 938224 - RNA, 22 nt, Human
uaagcugggcgggggggggggu

SEQ ID NO: 938225 - RNA, 19 nt, Human
uaaggcacuuucuuuucuu

SEQ ID NO: 938226 - RNA, 20 nt, Human
uaaguuuuucucucauggcc

SEQ ID NO: 938227 - RNA, 23 nt, Human
uagaaacagcaaagaaccaaaga

SEQ ID NO: 938228 - RNA, 23 nt, Human
uauaaaacaagauagaaaaauac

SEQ ID NO: 938229 - RNA, 19 nt, Human
uaucaccucaaguguuuga

SEQ ID NO: 938230 - RNA, 19 nt, Human
uaucucagaauccuuuggg

SEQ ID NO: 938231 - RNA, 22 nt, Human
uaucucagaauccuuuggguua

SEQ ID NO: 938232 - RNA, 27 nt, Human
uauguaaaaucccaacuaaaacccaaa

SEQ ID NO: 938233 - RNA, 26 nt, Human
ucacaguaucagauuuggcaaauuug

SEQ ID NO: 938234 - RNA, 33 nt, Human
ucacccaaacaggaaaaaaaaaaaaaaaaaaag

SEQ ID NO: 938235 - RNA, 22 nt, Human
ucacgaggccggcgggcgggcg

SEQ ID NO: 938236 - RNA, 21 nt, Human
uccgcccgccgccgccgccgc

SEQ ID NO: 938237 - RNA, 20 nt, Human
uccuccuccuccuccucacu

SEQ ID NO: 938238 - RNA, 22 nt, Human
uccuccuccuccuccucacuca

SEQ ID NO: 938239 - RNA, 19 nt, Human
ucgcccgccccccgcaggc

SEQ ID NO: 938240 - RNA, 22 nt, Human
ucggggggucucucugggcugg

SEQ ID NO: 938241 - RNA, 22 nt, Human
ucuaaaauguccagguauaaca

SEQ ID NO: 938242 - RNA, 21 nt, Human
ucuguaaacugaaguuuagau

SEQ ID NO: 938243 - RNA, 21 nt, Human
ucuuccuccuccuccuucucc

SEQ ID NO: 938244 - RNA, 21 nt, Human
ucuuuuuuuuuauaacacuug

SEQ ID NO: 938245 - RNA, 18 nt, Human
ugaccaugaaggaaaaua

SEQ ID NO: 938246 - RNA, 19 nt, Human
ugacgacaggcaagcaaag

SEQ ID NO: 938247 - RNA, 22 nt, Human
ugagauuugccacgucugguac

SEQ ID NO: 938248 - RNA, 22 nt, Human
ugauaaacaucuaaaaugucca

SEQ ID NO: 938249 - RNA, 18 nt, Human
ugaugcugggaaggugug

SEQ ID NO: 938250 - RNA, 22 nt, Human
ugccgccgcgcuccgacugcgc

SEQ ID NO: 938251 - RNA, 21 nt, Human
ugccucagcucgcugcacuga

SEQ ID NO: 938252 - RNA, 23 nt, Human
ugcgggcgcggggcgcgggcugc

SEQ ID NO: 938253 - RNA, 19 nt, Human
ugcuucaacuacauaacua

SEQ ID NO: 938254 - RNA, 19 nt, Human
uggaagaggggacgaguug

SEQ ID NO: 938255 - RNA, 19 nt, Human
uggaucaaauacugguauu

SEQ ID NO: 938256 - RNA, 24 nt, Human
uggcgccggacgaggaggagccgg

SEQ ID NO: 938257 - RNA, 20 nt, Human
uggcucccgcgccgagcccc

SEQ ID NO: 938258 - RNA, 18 nt, Human
uggguuaacauugaagau

SEQ ID NO: 938259 - RNA, 19 nt, Human
uguaacagaaagacaaagc

SEQ ID NO: 938260 - RNA, 18 nt, Human
ugucuccccuucuuaaga

SEQ ID NO: 938261 - RNA, 19 nt, Human
ugugaugcugggaaggugu

SEQ ID NO: 938262 - RNA, 21 nt, Human
uguguaacagaaagacaaagc

SEQ ID NO: 938263 - RNA, 27 nt, Human
uguuucaaugcacuacacuuuaucuac

SEQ ID NO: 938264 - RNA, 24 nt, Human
uucaaaaguuuguucagagccaac

SEQ ID NO: 938265 - RNA, 21 nt, Human
uucaaugcacuacacuuuauc

SEQ ID NO: 938266 - RNA, 19 nt, Human
uucacauucuuuuaaaguu

SEQ ID NO: 938267 - RNA, 22 nt, Human
uucuccuccuccuccuccucac

SEQ ID NO: 938268 - RNA, 20 nt, Human
uuggcggcggaguucgccuc

SEQ ID NO: 938269 - RNA, 20 nt, Human
uugucucccucauaucuucu

SEQ ID NO: 938270 - RNA, 19 nt, Human
uuuuagguguaaaauaaag

SEQ ID NO: 938271 - RNA, 21 nt, Human
aaaacugaaccaaauuaaaau

SEQ ID NO: 938272 - RNA, 23 nt, Human
cagacuccucuuccagagaaagg

SEQ ID NO: 938273 - RNA, 19 nt, Human
ccuccggaaaacugaacca

SEQ ID NO: 938274 - RNA, 24 nt, Human
cuacaaugcagacuccucuucccc

SEQ ID NO: 938275 - RNA, 27 nt, Human
gcagacuccucuuccagagaaaggucu

SEQ ID NO: 938276 - RNA, 22 nt, Human
gccagggcucagcucgcccucc

SEQ ID NO: 938277 - RNA, 20 nt, Human
uggcggcggccagggcucag

SEQ ID NO: 938278 - RNA, 25 nt, Human
acccuaaagaugugugacccagagg

SEQ ID NO: 938279 - RNA, 20 nt, Human
agaugugugacccagagggu

SEQ ID NO: 938280 - RNA, 20 nt, Human
agcagcagguggcagagcca

SEQ ID NO: 938281 - RNA, 19 nt, Human
auuggccacugacccuaaa

SEQ ID NO: 938282 - RNA, 28 nt, Human
caaaugugccccauuggccacugacccu

SEQ ID NO: 938283 - RNA, 23 nt, Human
cagagccagaguugggcucaagc

SEQ ID NO: 938284 - RNA, 21 nt, Human
caggagcagcagguggcagag

SEQ ID NO: 938285 - RNA, 19 nt, Human
caggucacaggagcagcag

SEQ ID NO: 938286 - RNA, 18 nt, Human
cugucugggcuggugugu

SEQ ID NO: 938287 - RNA, 20 nt, Human
gagcagcagguggcagagcc

SEQ ID NO: 938288 - RNA, 19 nt, Human
ggagcagcagguggcagag

SEQ ID NO: 938289 - RNA, 26 nt, Human
gugacccagaggguccugaggagcca

SEQ ID NO: 938290 - RNA, 24 nt, Human
uaacccauggccggugucauccuc

SEQ ID NO: 938291 - RNA, 24 nt, Human
uacagauuaggaaacugagaugag

SEQ ID NO: 938292 - RNA, 21 nt, Human
ucagcccugacaggucacagg

SEQ ID NO: 938293 - RNA, 23 nt, Human
ugagaugagcagaggugaaguca

SEQ ID NO: 938294 - RNA, 18 nt, Human
ugcagcugucugggcugg

SEQ ID NO: 938295 - RNA, 19 nt, Human
uggcagagccagaguuggg

SEQ ID NO: 938296 - RNA, 21 nt, Human
ugucugggcugguguguuggc

SEQ ID NO: 938297 - RNA, 24 nt, Human
uugcagcugucugggcuggugugu

SEQ ID NO: 938298 - RNA, 18 nt, Human
aaaaggacaaaagaccag

SEQ ID NO: 938299 - RNA, 21 nt, Human
aaccauggcuugccucaccug

SEQ ID NO: 938300 - RNA, 18 nt, Human
aaccccaagaagcuucac

SEQ ID NO: 938301 - RNA, 22 nt, Human
aagaccaagcaggagagacuga

SEQ ID NO: 938302 - RNA, 23 nt, Human
aagccagggcaaggcacuagaga

SEQ ID NO: 938303 - RNA, 23 nt, Human
aagcuuccaaaccccacccugaa

SEQ ID NO: 938304 - RNA, 22 nt, Human
aaggagcaaggggugggagggg

SEQ ID NO: 938305 - RNA, 21 nt, Human
aaggggugggaggggagggaa

SEQ ID NO: 938306 - RNA, 22 nt, Human
accaggcucagagggagcagag

SEQ ID NO: 938307 - RNA, 20 nt, Human
agagacccacauccuuccca

SEQ ID NO: 938308 - RNA, 24 nt, Human
agcagccaucuucuccugcagcua

SEQ ID NO: 938309 - RNA, 21 nt, Human
agcugcccuaugcccacugcc

SEQ ID NO: 938310 - RNA, 19 nt, Human
aggagcuggaggcuggcca

SEQ ID NO: 938311 - RNA, 20 nt, Human
aggcaggacuucaaauaagc

SEQ ID NO: 938312 - RNA, 20 nt, Human
aggcaggggguagcguggga

SEQ ID NO: 938313 - RNA, 19 nt, Human
aggcauagagggcccgggg

SEQ ID NO: 938314 - RNA, 18 nt, Human
agggaauggggucagggg

SEQ ID NO: 938315 - RNA, 22 nt, Human
agggagcagagcucaauggggg

SEQ ID NO: 938316 - RNA, 23 nt, Human
agggcaaggcacuagagacccac

SEQ ID NO: 938317 - RNA, 27 nt, Human
aggggugggaggggagggaaugggguc

SEQ ID NO: 938318 - RNA, 22 nt, Human
aggugaaaccuggagagagaag

SEQ ID NO: 938319 - RNA, 21 nt, Human
auuguccggaagggagcaggg

SEQ ID NO: 938320 - RNA, 21 nt, Human
caaaccccacccugaagccaa

SEQ ID NO: 938321 - RNA, 21 nt, Human
caacucgucaggucccaccaa

SEQ ID NO: 938322 - RNA, 21 nt, Human
caagcaagccacucacccuac

SEQ ID NO: 938323 - RNA, 22 nt, Human
caagcaagccacucacccuaca

SEQ ID NO: 938324 - RNA, 21 nt, Human
caagccacucacccuacagcc

SEQ ID NO: 938325 - RNA, 23 nt, Human
cacacuggaaggugaaaccugga

SEQ ID NO: 938326 - RNA, 19 nt, Human
caccaagcaagccacucac

SEQ ID NO: 938327 - RNA, 20 nt, Human
cacccuacagcccagcaacc

SEQ ID NO: 938328 - RNA, 21 nt, Human
cagcaggggaaccuggacccu

SEQ ID NO: 938329 - RNA, 18 nt, Human
cagcucccucucccgccu

SEQ ID NO: 938330 - RNA, 22 nt, Human
caggaggucugaggagcuggag

SEQ ID NO: 938331 - RNA, 18 nt, Human
caggcucagagggagcag

SEQ ID NO: 938332 - RNA, 24 nt, Human
caggucccaccaagcaagccacuc

SEQ ID NO: 938333 - RNA, 22 nt, Human
caucuucuccugcagcuaagcc

SEQ ID NO: 938334 - RNA, 18 nt, Human
cauucaucuuggagacca

SEQ ID NO: 938335 - RNA, 20 nt, Human
cauuccagcccacccagcug

SEQ ID NO: 938336 - RNA, 24 nt, Human
cauuccagcccacccagcuggggg

SEQ ID NO: 938337 - RNA, 23 nt, Human
ccaaaauaaaaaaggacaaaaga

SEQ ID NO: 938338 - RNA, 23 nt, Human
ccaaaccccacccugaagccaaa

SEQ ID NO: 938339 - RNA, 20 nt, Human
ccaccacacgcaagcaccgg

SEQ ID NO: 938340 - RNA, 20 nt, Human
ccagcacgacuuccagaagc

SEQ ID NO: 938341 - RNA, 22 nt, Human
ccagcagcuagugaggaguucc

SEQ ID NO: 938342 - RNA, 20 nt, Human
cccacauccuucccaugcca

SEQ ID NO: 938343 - RNA, 18 nt, Human
cccacugcccggggcugc

SEQ ID NO: 938344 - RNA, 26 nt, Human
cccacugcccggggcugcccucccug

SEQ ID NO: 938345 - RNA, 19 nt, Human
cccugcacagcaggggaac

SEQ ID NO: 938346 - RNA, 21 nt, Human
ccuaugcccacugcccggggc

SEQ ID NO: 938347 - RNA, 21 nt, Human
ccuccaaagaugagcauucau

SEQ ID NO: 938348 - RNA, 30 nt, Human
ccucccaaggcaggggguagcgugggaauu

SEQ ID NO: 938349 - RNA, 25 nt, Human
ccucccuagcuucuaccuggcaccc

SEQ ID NO: 938350 - RNA, 25 nt, Human
ccugaagccaaaccccacccaggag

SEQ ID NO: 938351 - RNA, 24 nt, Human
ccugcagcuaagccagggcaaggc

SEQ ID NO: 938352 - RNA, 18 nt, Human
cggagccccagcagcuag

SEQ ID NO: 938353 - RNA, 25 nt, Human
cuagagacccacauccuucccaugc

SEQ ID NO: 938354 - RNA, 27 nt, Human
cuccaaagaugagcauucaucuuggag

SEQ ID NO: 938355 - RNA, 23 nt, Human
cugaaaaacaggaauguggugcu

SEQ ID NO: 938356 - RNA, 19 nt, Human
cugaagccaaaccccaccc

SEQ ID NO: 938357 - RNA, 22 nt, Human
cuuccaaaccccacccugaagc

SEQ ID NO: 938358 - RNA, 19 nt, Human
cuucuaccuggcacccucc

SEQ ID NO: 938359 - RNA, 22 nt, Human
cuucuaccuggcacccuccaaa

SEQ ID NO: 938360 - RNA, 19 nt, Human
gaaaaacaggaauguggug

SEQ ID NO: 938361 - RNA, 19 nt, Human
gaagcuuccaaaccccacc

SEQ ID NO: 938362 - RNA, 23 nt, Human
gaagggagcagggugggcggagc

SEQ ID NO: 938363 - RNA, 22 nt, Human
gaauuucccacacuucuaggcc

SEQ ID NO: 938364 - RNA, 18 nt, Human
gagaagacacuccccucc

SEQ ID NO: 938365 - RNA, 19 nt, Human
gagcagggugggcggagcc

SEQ ID NO: 938366 - RNA, 19 nt, Human
gaggucugaggagcuggag

SEQ ID NO: 938367 - RNA, 21 nt, Human
gcagcucccucucccgccucc

SEQ ID NO: 938368 - RNA, 20 nt, Human
gcaggagagacugaggcucc

SEQ ID NO: 938369 - RNA, 21 nt, Human
gccucaccugggagaccagca

SEQ ID NO: 938370 - RNA, 18 nt, Human
ggaaucaagcauguguaa

SEQ ID NO: 938371 - RNA, 19 nt, Human
ggacaaaagaccaggcuca

SEQ ID NO: 938372 - RNA, 22 nt, Human
ggaguuccauuccagcccaccc

SEQ ID NO: 938373 - RNA, 18 nt, Human
ggcuucacuugccccagu

SEQ ID NO: 938374 - RNA, 20 nt, Human
gggaggggagggaauggggu

SEQ ID NO: 938375 - RNA, 18 nt, Human
gggcggagccccagcagc

SEQ ID NO: 938376 - RNA, 19 nt, Human
gugcuaagaggccagggac

SEQ ID NO: 938377 - RNA, 19 nt, Human
ucaccaccacacgcaagca

SEQ ID NO: 938378 - RNA, 26 nt, Human
uccaaagaugagcauucaucuuggag

SEQ ID NO: 938379 - RNA, 25 nt, Human
ucccaccaagcaagccacucacccu

SEQ ID NO: 938380 - RNA, 18 nt, Human
ucccagggugcaaaggcu

SEQ ID NO: 938381 - RNA, 21 nt, Human
ucccggcgccgcggcaccgcc

SEQ ID NO: 938382 - RNA, 20 nt, Human
ucccucucccgccuccuccc

SEQ ID NO: 938383 - RNA, 22 nt, Human
ucuaggccagacaaggagcaag

SEQ ID NO: 938384 - RNA, 20 nt, Human
ucucccgccuccuccccagg

SEQ ID NO: 938385 - RNA, 21 nt, Human
ucuggcuucacuugccccagu

SEQ ID NO: 938386 - RNA, 21 nt, Human
ucuucauuguccggaagggag

SEQ ID NO: 938387 - RNA, 18 nt, Human
ugaaaaacaggaaugugg

SEQ ID NO: 938388 - RNA, 22 nt, Human
ugagaaugaggcaggacuucaa

SEQ ID NO: 938389 - RNA, 24 nt, Human
ugagcugcccuaugcccacugccc

SEQ ID NO: 938390 - RNA, 21 nt, Human
ugaggaguuccauuccagccc

SEQ ID NO: 938391 - RNA, 22 nt, Human
ugaggaguuccauuccagccca

SEQ ID NO: 938392 - RNA, 18 nt, Human
ugagucgggucccggcgc

SEQ ID NO: 938393 - RNA, 23 nt, Human
ugccccaguugagggccaagacc

SEQ ID NO: 938394 - RNA, 22 nt, Human
ugccucaccugggagaccagca

SEQ ID NO: 938395 - RNA, 23 nt, Human
uggcuugccucaccugggagacc

SEQ ID NO: 938396 - RNA, 22 nt, Human
ugggaggggagggaaugggguc

SEQ ID NO: 938397 - RNA, 19 nt, Human
uguccggaagggagcaggg

SEQ ID NO: 938398 - RNA, 21 nt, Human
uucccacacuucuaggccaga

SEQ ID NO: 938399 - RNA, 22 nt, Human
aaccccacgaaacccugaaagc

SEQ ID NO: 938400 - RNA, 27 nt, Human
aagcccccgacacaggcugggcagucc

SEQ ID NO: 938401 - RNA, 20 nt, Human
aagccgccuuccgggcaaac

SEQ ID NO: 938402 - RNA, 27 nt, Human
accccacccccucuccuugcugaccag

SEQ ID NO: 938403 - RNA, 22 nt, Human
accccacgaaacccugaaagcc

SEQ ID NO: 938404 - RNA, 21 nt, Human
accgcagcccccaggggaguu

SEQ ID NO: 938405 - RNA, 26 nt, Human
acgccgcuccaggagggagggaacgc

SEQ ID NO: 938406 - RNA, 23 nt, Human
acugcaauuaaauagaauggaaa

SEQ ID NO: 938407 - RNA, 21 nt, Human
acugcagaccuaccaagaccu

SEQ ID NO: 938408 - RNA, 23 nt, Human
agacggggcccagggcggggggc

SEQ ID NO: 938409 - RNA, 24 nt, Human
agccucgggcgcgaccucacacca

SEQ ID NO: 938410 - RNA, 24 nt, Human
agcucugcucucccggggacccca

SEQ ID NO: 938411 - RNA, 21 nt, Human
agcugugcggcucaggacccc

SEQ ID NO: 938412 - RNA, 19 nt, Human
aggaaggagguggcuggcc

SEQ ID NO: 938413 - RNA, 19 nt, Human
aggcagagccgggcugagg

SEQ ID NO: 938414 - RNA, 18 nt, Human
aggcagcucguaguggug

SEQ ID NO: 938415 - RNA, 20 nt, Human
aggcccccagcagggcccag

SEQ ID NO: 938416 - RNA, 18 nt, Human
agggcggggccauggaga

SEQ ID NO: 938417 - RNA, 22 nt, Human
caacccaggucaccaccggcag

SEQ ID NO: 938418 - RNA, 23 nt, Human
caagccucgggcgcgaccucaca

SEQ ID NO: 938419 - RNA, 20 nt, Human
caccaccggcagcugcugcc

SEQ ID NO: 938420 - RNA, 18 nt, Human
caccaugggaccccacuc

SEQ ID NO: 938421 - RNA, 19 nt, Human
caccaugggaccccacucc

SEQ ID NO: 938422 - RNA, 22 nt, Human
caccccacgucccuaugcccga

SEQ ID NO: 938423 - RNA, 20 nt, Human
caccuccgccuugcucagag

SEQ ID NO: 938424 - RNA, 24 nt, Human
caccuccgccuugcucagagaccu

SEQ ID NO: 938425 - RNA, 26 nt, Human
cacugcaauuaaauagaauggaauga

SEQ ID NO: 938426 - RNA, 24 nt, Human
cagagaccugcaccaugggacccc

SEQ ID NO: 938427 - RNA, 20 nt, Human
cagcgggcuggcuggacgcc

SEQ ID NO: 938428 - RNA, 23 nt, Human
cagcucaaacaccucacuagcgg

SEQ ID NO: 938429 - RNA, 22 nt, Human
caggaaggaggcgucugugaug

SEQ ID NO: 938430 - RNA, 23 nt, Human
caggcccgggacucccgcuggcc

SEQ ID NO: 938431 - RNA, 25 nt, Human
caugggaccccacuccauccucagg

SEQ ID NO: 938432 - RNA, 25 nt, Human
ccacuccauccucaggacgguucac

SEQ ID NO: 938433 - RNA, 21 nt, Human
ccacugaggcugccgcggcca

SEQ ID NO: 938434 - RNA, 24 nt, Human
ccagcagggcccagcgggcuggcu

SEQ ID NO: 938435 - RNA, 21 nt, Human
cccacccccacgggcucggga

SEQ ID NO: 938436 - RNA, 22 nt, Human
cccacccccacgggcucgggaa

SEQ ID NO: 938437 - RNA, 20 nt, Human
cccagcgucgcgcccuaacc

SEQ ID NO: 938438 - RNA, 19 nt, Human
cccagggcggggggcuggc

SEQ ID NO: 938439 - RNA, 23 nt, Human
ccccaagccggccucuccuccac

SEQ ID NO: 938440 - RNA, 23 nt, Human
ccccaccccaagccggccucucc

SEQ ID NO: 938441 - RNA, 21 nt, Human
ccccacccccucuccuugcug

SEQ ID NO: 938442 - RNA, 21 nt, Human
ccccacgaaacccugaaagcc

SEQ ID NO: 938443 - RNA, 25 nt, Human
ccccacgaaacccugaaagcccccg

SEQ ID NO: 938444 - RNA, 27 nt, Human
cccccgacacaggcugggcagucccag

SEQ ID NO: 938445 - RNA, 19 nt, Human
cccggccgccaucggccgc

SEQ ID NO: 938446 - RNA, 28 nt, Human
cccuccagaaccuuccgcggaaccccaa

SEQ ID NO: 938447 - RNA, 27 nt, Human
cccuggcugcugccacugauguuggcg

SEQ ID NO: 938448 - RNA, 20 nt, Human
ccgccgccaucuuccccucg

SEQ ID NO: 938449 - RNA, 20 nt, Human
ccgccgcucuccucacggcc

SEQ ID NO: 938450 - RNA, 21 nt, Human
ccgccgcucuccucacggccu

SEQ ID NO: 938451 - RNA, 22 nt, Human
ccggccucuccuccacaccucc

SEQ ID NO: 938452 - RNA, 23 nt, Human
ccggccucuccuccacaccuccg

SEQ ID NO: 938453 - RNA, 24 nt, Human
ccgggcaaaccccacgaaacccug

SEQ ID NO: 938454 - RNA, 20 nt, Human
ccuccagaaccuuccgcgga

SEQ ID NO: 938455 - RNA, 23 nt, Human
ccuccagaaccuuccgcggaacc

SEQ ID NO: 938456 - RNA, 20 nt, Human
ccucccggccgccaucggcc

SEQ ID NO: 938457 - RNA, 23 nt, Human
ccucgcagccgccgcucuccuca

SEQ ID NO: 938458 - RNA, 18 nt, Human
ccugaaagcccccgacac

SEQ ID NO: 938459 - RNA, 18 nt, Human
ccugcugcaggauggcag

SEQ ID NO: 938460 - RNA, 23 nt, Human
cgcacacgcggggagggcggggc

SEQ ID NO: 938461 - RNA, 19 nt, Human
cgccuuccgggcaaacccc

SEQ ID NO: 938462 - RNA, 19 nt, Human
cgcggaaccccacccccuc

SEQ ID NO: 938463 - RNA, 20 nt, Human
cggggggacacuguccuggg

SEQ ID NO: 938464 - RNA, 18 nt, Human
cggguacaagccucgggc

SEQ ID NO: 938465 - RNA, 20 nt, Human
cguuggggccauggaggccg

SEQ ID NO: 938466 - RNA, 23 nt, Human
cuaccaagaccccuccagaaccu

SEQ ID NO: 938467 - RNA, 18 nt, Human
cucccggccgccgccgcc

SEQ ID NO: 938468 - RNA, 19 nt, Human
cucccggccgccgccgcca

SEQ ID NO: 938469 - RNA, 23 nt, Human
cuccucacggccucccggccgcc

SEQ ID NO: 938470 - RNA, 24 nt, Human
cugaaagcccccgacacaggcugg

SEQ ID NO: 938471 - RNA, 19 nt, Human
cugcaggauggcaggcagc

SEQ ID NO: 938472 - RNA, 19 nt, Human
cugcugccacugauguugg

SEQ ID NO: 938473 - RNA, 19 nt, Human
cuggccggcagagucaggg

SEQ ID NO: 938474 - RNA, 24 nt, Human
cuggcgcacacgcggggagggcgg

SEQ ID NO: 938475 - RNA, 25 nt, Human
gaaccuuccgcggaaccccaccccc

SEQ ID NO: 938476 - RNA, 23 nt, Human
gacacaggcugggcagucccaga

SEQ ID NO: 938477 - RNA, 21 nt, Human
gagggcggggccauggagaag

SEQ ID NO: 938478 - RNA, 24 nt, Human
gagggcggggccauggagaaggca

SEQ ID NO: 938479 - RNA, 21 nt, Human
gcaggggucagaggcggcuca

SEQ ID NO: 938480 - RNA, 22 nt, Human
gccucuccuccacaccuccgcc

SEQ ID NO: 938481 - RNA, 19 nt, Human
gccuggcgcacacgcgggg

SEQ ID NO: 938482 - RNA, 24 nt, Human
gcgcucaggccggacaggaaggag

SEQ ID NO: 938483 - RNA, 24 nt, Human
gcggggagggcggggccauggaga

SEQ ID NO: 938484 - RNA, 18 nt, Human
gcugcaggauggcaggca

SEQ ID NO: 938485 - RNA, 19 nt, Human
gcuggacgccgcuccagga

SEQ ID NO: 938486 - RNA, 21 nt, Human
ggagguggcuggccuccccca

SEQ ID NO: 938487 - RNA, 19 nt, Human
ggaguugugucagaagcug

SEQ ID NO: 938488 - RNA, 21 nt, Human
ggcccuggcugcugccacuga

SEQ ID NO: 938489 - RNA, 18 nt, Human
gggacucccgcuggcccc

SEQ ID NO: 938490 - RNA, 18 nt, Human
gggggaggaaagccgccu

SEQ ID NO: 938491 - RNA, 20 nt, Human
ggucagaggcggcucagcug

SEQ ID NO: 938492 - RNA, 20 nt, Human
gugcggcucaggaccccacc

SEQ ID NO: 938493 - RNA, 21 nt, Human
guugugucagaagcugcggag

SEQ ID NO: 938494 - RNA, 19 nt, Human
uaccaagaccccuccagaa

SEQ ID NO: 938495 - RNA, 22 nt, Human
uagaauggaaugagcgcuccuc

SEQ ID NO: 938496 - RNA, 22 nt, Human
uauauacaaacacaauuuugua

SEQ ID NO: 938497 - RNA, 21 nt, Human
ucacggccucccggccgccgc

SEQ ID NO: 938498 - RNA, 23 nt, Human
ucacucggggggacacuguccug

SEQ ID NO: 938499 - RNA, 19 nt, Human
ucaggaccccaccuccgag

SEQ ID NO: 938500 - RNA, 20 nt, Human
ucaggggcuguagccggggc

SEQ ID NO: 938501 - RNA, 28 nt, Human
uccagaaccuuccgcggaaccccacccc

SEQ ID NO: 938502 - RNA, 21 nt, Human
ucccagaggaaggagguggcu

SEQ ID NO: 938503 - RNA, 20 nt, Human
ucccggccgccaucggccgc

SEQ ID NO: 938504 - RNA, 20 nt, Human
ucccuaugcccgaggcgcaa

SEQ ID NO: 938505 - RNA, 22 nt, Human
uccgccuugcucagagaccugc

SEQ ID NO: 938506 - RNA, 18 nt, Human
uccgcggaaccccacccc

SEQ ID NO: 938507 - RNA, 24 nt, Human
ucgcgcccuaacgacccgcaagug

SEQ ID NO: 938508 - RNA, 19 nt, Human
ugacugguuuggccgccgg

SEQ ID NO: 938509 - RNA, 21 nt, Human
ugauguuggcgccugcacccc

SEQ ID NO: 938510 - RNA, 20 nt, Human
ugccgcugucaacagacagu

SEQ ID NO: 938511 - RNA, 18 nt, Human
uggccccaggcgagacgg

SEQ ID NO: 938512 - RNA, 19 nt, Human
uggccucccccacccccac

SEQ ID NO: 938513 - RNA, 21 nt, Human
ugucagaagcugcggagucac

SEQ ID NO: 938514 - RNA, 19 nt, Human
uguccuggggggcgugggg

SEQ ID NO: 938515 - RNA, 22 nt, Human
uugccgcugucaacagacaguu

SEQ ID NO: 938516 - RNA, 22 nt, Human
uugcucagagaccugcaccaug

SEQ ID NO: 938517 - RNA, 24 nt, Human
uuugccgcugucaacagacaguuu

SEQ ID NO: 938518 - RNA, 18 nt, Human
uuuuuuuuuuuuuugccg

SEQ ID NO: 938519 - RNA, 20 nt, Human
uuuuuuuuuuuuuuuugccg

SEQ ID NO: 938520 - RNA, 18 nt, Human
uuuuuuuuuuuuuuuuug

SEQ ID NO: 938521 - RNA, 20 nt, Human
uuuuuuuuuuuuuuuuugcc

SEQ ID NO: 938522 - RNA, 22 nt, Human
aaaaauccacaaggagaaugca

SEQ ID NO: 938523 - RNA, 18 nt, Human
aaacuguaaagcacuuaa

SEQ ID NO: 938524 - RNA, 23 nt, Human
aaaugcauuuccuuaggugacaa

SEQ ID NO: 938525 - RNA, 21 nt, Human
aaccauaaaggcgaagggucc

SEQ ID NO: 938526 - RNA, 19 nt, Human
aagaaguuuccagcacuca

SEQ ID NO: 938527 - RNA, 19 nt, Human
aagccaaucaaagauggga

SEQ ID NO: 938528 - RNA, 21 nt, Human
aagggcccuacaaggaagagu

SEQ ID NO: 938529 - RNA, 22 nt, Human
aaugccaugaacacacauccua

SEQ ID NO: 938530 - RNA, 23 nt, Human
accccaucaccagcccggacacc

SEQ ID NO: 938531 - RNA, 19 nt, Human
acugaggaggaggaggcgg

SEQ ID NO: 938532 - RNA, 24 nt, Human
agaaaaaccugcuaacucuguauc

SEQ ID NO: 938533 - RNA, 22 nt, Human
agccaggaugucaacuguagug

SEQ ID NO: 938534 - RNA, 20 nt, Human
aggaugucaacuguagugaa

SEQ ID NO: 938535 - RNA, 22 nt, Human
aguaagagucuuacgaaaggga

SEQ ID NO: 938536 - RNA, 23 nt, Human
aguugggucacauugugcuggcu

SEQ ID NO: 938537 - RNA, 22 nt, Human
caaauaccaagccaaucaaaga

SEQ ID NO: 938538 - RNA, 18 nt, Human
caacuguagugaaccauc

SEQ ID NO: 938539 - RNA, 19 nt, Human
cagaagcuccaaauaccaa

SEQ ID NO: 938540 - RNA, 19 nt, Human
cagcacacauuguacagcc

SEQ ID NO: 938541 - RNA, 24 nt, Human
cagcccggacaccggcuccagcgg

SEQ ID NO: 938542 - RNA, 19 nt, Human
ccccaucaccagcccggac

SEQ ID NO: 938543 - RNA, 20 nt, Human
ccccaucaccagcccggaca

SEQ ID NO: 938544 - RNA, 18 nt, Human
cccggacuggaauggacu

SEQ ID NO: 938545 - RNA, 22 nt, Human
cccuuugcuggaucacuggccu

SEQ ID NO: 938546 - RNA, 20 nt, Human
cgaaagggaauuaaccccau

SEQ ID NO: 938547 - RNA, 19 nt, Human
cugcaaacaaugaaaacaa

SEQ ID NO: 938548 - RNA, 20 nt, Human
gaaaugcauauuuuuccccc

SEQ ID NO: 938549 - RNA, 19 nt, Human
gacaaaaaauccacaagga

SEQ ID NO: 938550 - RNA, 19 nt, Human
gaggagucccauguccuug

SEQ ID NO: 938551 - RNA, 24 nt, Human
gaucacuggccuuucuucaaaagg

SEQ ID NO: 938552 - RNA, 22 nt, Human
gcgcggcggggcgacggcgggg

SEQ ID NO: 938553 - RNA, 24 nt, Human
guuacugaggaggaggaggcgguu

SEQ ID NO: 938554 - RNA, 19 nt, Human
guuccuuguucauaagugc

SEQ ID NO: 938555 - RNA, 18 nt, Human
uaacagaagcuccaaaua

SEQ ID NO: 938556 - RNA, 25 nt, Human
uaaccccaucaccagcccggacacc

SEQ ID NO: 938557 - RNA, 18 nt, Human
uaauuugcuguacaauag

SEQ ID NO: 938558 - RNA, 25 nt, Human
uacaagaauuuagaaauauaaaaca

SEQ ID NO: 938559 - RNA, 24 nt, Human
uaccuaaaugaauaaggaaagggc

SEQ ID NO: 938560 - RNA, 18 nt, Human
uagaaugauuucuguucc

SEQ ID NO: 938561 - RNA, 20 nt, Human
uauaaaaguuaggaggcauu

SEQ ID NO: 938562 - RNA, 22 nt, Human
ucauucugauguggauuccuag

SEQ ID NO: 938563 - RNA, 24 nt, Human
ucauucugauguggauuccuaguc

SEQ ID NO: 938564 - RNA, 21 nt, Human
ucccacaaaaauaaaauaaaa

SEQ ID NO: 938565 - RNA, 23 nt, Human
uccgcugcaaacaaugaaaacaa

SEQ ID NO: 938566 - RNA, 20 nt, Human
uccuuuggauuugggauugu

SEQ ID NO: 938567 - RNA, 24 nt, Human
ucuauaauguuaacagaagcucca

SEQ ID NO: 938568 - RNA, 24 nt, Human
ucucuauaauguuaacagaagcug

SEQ ID NO: 938569 - RNA, 21 nt, Human
ucuuugauguccagugauccg

SEQ ID NO: 938570 - RNA, 25 nt, Human
ugaacugaaaaaggcuugcaucagc

SEQ ID NO: 938571 - RNA, 22 nt, Human
ugacaaaaaauccacaaggaga

SEQ ID NO: 938572 - RNA, 19 nt, Human
ugcaaaaagaaauacaggg

SEQ ID NO: 938573 - RNA, 21 nt, Human
uggaaguauuuuccugcuuag

SEQ ID NO: 938574 - RNA, 18 nt, Human
uggauuugggauuguggu

SEQ ID NO: 938575 - RNA, 24 nt, Human
uguacaauagagcuuuggaucuga

SEQ ID NO: 938576 - RNA, 26 nt, Human
uuaaccccaucaccagcccggacacc

SEQ ID NO: 938577 - RNA, 22 nt, Human
uuaagaacauaauuuauuuuau

SEQ ID NO: 938578 - RNA, 18 nt, Human
uuacugaggaggaggagg

SEQ ID NO: 938579 - RNA, 21 nt, Human
uugaaaaaaaaaaaguggaag

SEQ ID NO: 938580 - RNA, 26 nt, Human
uuuccagcacucaucaaaugcauuuc

SEQ ID NO: 938581 - RNA, 21 nt, Human
uuuuuugguaauuguuucuga

SEQ ID NO: 938582 - RNA, 22 nt, Human
aaacaaaaccacaacaauucaa

SEQ ID NO: 938583 - RNA, 22 nt, Human
aaauagugucuucuguaugcuu

SEQ ID NO: 938584 - RNA, 24 nt, Human
aagagacaaucauuucuguaacuc

SEQ ID NO: 938585 - RNA, 21 nt, Human
aagggcuaaaaacugagaacc

SEQ ID NO: 938586 - RNA, 21 nt, Human
aaguccaacuuccacgaccac

SEQ ID NO: 938587 - RNA, 23 nt, Human
aauauccuggaggagugggaggu

SEQ ID NO: 938588 - RNA, 18 nt, Human
acaaaaccacaacaauuc

SEQ ID NO: 938589 - RNA, 23 nt, Human
acaagagcucucaaauacaaaca

SEQ ID NO: 938590 - RNA, 19 nt, Human
acaccaugaccagcagguu

SEQ ID NO: 938591 - RNA, 25 nt, Human
acuagaauguaaagaugacgccagu

SEQ ID NO: 938592 - RNA, 22 nt, Human
acuucagcaauggggucaucca

SEQ ID NO: 938593 - RNA, 21 nt, Human
acuuguucauuuucaucugcu

SEQ ID NO: 938594 - RNA, 20 nt, Human
agaacaauugcucacgaugc

SEQ ID NO: 938595 - RNA, 21 nt, Human
agaacaggaauagggcucaga

SEQ ID NO: 938596 - RNA, 18 nt, Human
aggauggaauggcugcaa

SEQ ID NO: 938597 - RNA, 26 nt, Human
aggcuuuggaaguugucaugggagcu

SEQ ID NO: 938598 - RNA, 21 nt, Human
agggaauaaaaccucuggacu

SEQ ID NO: 938599 - RNA, 23 nt, Human
auugcucacagacgaugagacag

SEQ ID NO: 938600 - RNA, 24 nt, Human
caaauaggucauccaaaggcuaga

SEQ ID NO: 938601 - RNA, 18 nt, Human
caacucuuucucucuagg

SEQ ID NO: 938602 - RNA, 23 nt, Human
caagggcuaaaaacugagaacca

SEQ ID NO: 938603 - RNA, 20 nt, Human
cacccuccuccccaaacuac

SEQ ID NO: 938604 - RNA, 21 nt, Human
cacccuccuccccaaacuacu

SEQ ID NO: 938605 - RNA, 23 nt, Human
cacccuccuccccaaacuacucc

SEQ ID NO: 938606 - RNA, 24 nt, Human
cacuuauuucuucaguuguuccua

SEQ ID NO: 938607 - RNA, 20 nt, Human
cagcuaacaagagcucucaa

SEQ ID NO: 938608 - RNA, 24 nt, Human
cagcuaacaagagcucucaaauac

SEQ ID NO: 938609 - RNA, 21 nt, Human
cagcugcuucuauaaugauau

SEQ ID NO: 938610 - RNA, 18 nt, Human
cagugguuuucaaauagg

SEQ ID NO: 938611 - RNA, 21 nt, Human
cauccuugggguccaagccuu

SEQ ID NO: 938612 - RNA, 24 nt, Human
caugaccagcagguuccuaacacc

SEQ ID NO: 938613 - RNA, 20 nt, Human
ccacccuccuccccaaacua

SEQ ID NO: 938614 - RNA, 22 nt, Human
ccagcagguuccuaacaccuca

SEQ ID NO: 938615 - RNA, 21 nt, Human
ccagcugaccucauaggcacu

SEQ ID NO: 938616 - RNA, 24 nt, Human
ccagcugaccucauaggcacugga

SEQ ID NO: 938617 - RNA, 23 nt, Human
ccgcuaaagaaauccccaaauau

SEQ ID NO: 938618 - RNA, 22 nt, Human
ccuggaggagugggagguggcu

SEQ ID NO: 938619 - RNA, 19 nt, Human
ccuucagaugacucagcug

SEQ ID NO: 938620 - RNA, 19 nt, Human
ccuugggguccaagccuuc

SEQ ID NO: 938621 - RNA, 19 nt, Human
cgugcaaaguggagacugg

SEQ ID NO: 938622 - RNA, 23 nt, Human
cuaaaacuuucugagguaaacuu

SEQ ID NO: 938623 - RNA, 26 nt, Human
cuccaauacucuccguuuaacugucc

SEQ ID NO: 938624 - RNA, 20 nt, Human
cugucuuuuccaaugcccca

SEQ ID NO: 938625 - RNA, 20 nt, Human
cuugaggagaugcaggagga

SEQ ID NO: 938626 - RNA, 20 nt, Human
cuuguauucagugcaggguc

SEQ ID NO: 938627 - RNA, 22 nt, Human
gaagugacaguuuuauaaacug

SEQ ID NO: 938628 - RNA, 26 nt, Human
gagucagacaaguugucagauuuagc

SEQ ID NO: 938629 - RNA, 24 nt, Human
gcaaagggcuuccuauuucucuca

SEQ ID NO: 938630 - RNA, 19 nt, Human
gcauccuugggguccaagc

SEQ ID NO: 938631 - RNA, 19 nt, Human
gcucacagacgaugagaca

SEQ ID NO: 938632 - RNA, 18 nt, Human
ggaggacuagaauguaaa

SEQ ID NO: 938633 - RNA, 21 nt, Human
ggcagcuucauuuggccuucc

SEQ ID NO: 938634 - RNA, 18 nt, Human
ggcuuggaaauaauaaug

SEQ ID NO: 938635 - RNA, 24 nt, Human
ggugcuaugagaugugggggaggc

SEQ ID NO: 938636 - RNA, 23 nt, Human
guggcagcuucauuuggccuucc

SEQ ID NO: 938637 - RNA, 22 nt, Human
uaaaaaaacugaaaaaauuaaa

SEQ ID NO: 938638 - RNA, 27 nt, Human
uacucugugggguugaucagguucccc

SEQ ID NO: 938639 - RNA, 21 nt, Human
uagacugcugaaacuuguuca

SEQ ID NO: 938640 - RNA, 22 nt, Human
uaggccccugcuccuacagcuc

SEQ ID NO: 938641 - RNA, 24 nt, Human
uauuucauugcucggaguagaggg

SEQ ID NO: 938642 - RNA, 28 nt, Human
ucagcuggggugcucuccaauacucucc

SEQ ID NO: 938643 - RNA, 23 nt, Human
ucauuucuguaacuccagcuccu

SEQ ID NO: 938644 - RNA, 18 nt, Human
uccaaaggcuagacugcu

SEQ ID NO: 938645 - RNA, 22 nt, Human
uccaacuuccacgaccacuguc

SEQ ID NO: 938646 - RNA, 18 nt, Human
uccaaugccccaguggau

SEQ ID NO: 938647 - RNA, 21 nt, Human
uccauugcucaggaaacuauu

SEQ ID NO: 938648 - RNA, 23 nt, Human
ucccaaaggacugacaagaaacc

SEQ ID NO: 938649 - RNA, 19 nt, Human
uccgcuaaagaaaucccca

SEQ ID NO: 938650 - RNA, 20 nt, Human
uccuggaggagugggaggug

SEQ ID NO: 938651 - RNA, 21 nt, Human
uccuggaggagugggaggugg

SEQ ID NO: 938652 - RNA, 20 nt, Human
ucucccacaaaauguuacug

SEQ ID NO: 938653 - RNA, 23 nt, Human
ucuccguuuaacugucccauagu

SEQ ID NO: 938654 - RNA, 22 nt, Human
ucuguaacuguggucccaaggc

SEQ ID NO: 938655 - RNA, 24 nt, Human
ucuguaacuguggucccaaggcag

SEQ ID NO: 938656 - RNA, 24 nt, Human
ucugugggguugaugcaagugggc

SEQ ID NO: 938657 - RNA, 19 nt, Human
ucuucaguuguuccuaaaa

SEQ ID NO: 938658 - RNA, 23 nt, Human
ucuucaguuguuccuaaaacuuu

SEQ ID NO: 938659 - RNA, 21 nt, Human
ucuucuguaugcuucuuacca

SEQ ID NO: 938660 - RNA, 21 nt, Human
ucuuucucucuaggcuuccuu

SEQ ID NO: 938661 - RNA, 24 nt, Human
ucuuuuguuugucccuucuuccug

SEQ ID NO: 938662 - RNA, 21 nt, Human
ugaagcaccuggcuuacucug

SEQ ID NO: 938663 - RNA, 21 nt, Human
ugaagugacaguuuuauaaac

SEQ ID NO: 938664 - RNA, 21 nt, Human
ugacaagaaacccuguggcag

SEQ ID NO: 938665 - RNA, 23 nt, Human
ugacaagaaacccuguggcagcu

SEQ ID NO: 938666 - RNA, 24 nt, Human
ugacacaguacacaaucaagcccu

SEQ ID NO: 938667 - RNA, 19 nt, Human
ugaccucugcacugccaca

SEQ ID NO: 938668 - RNA, 20 nt, Human
ugacuaugaucuccuauccc

SEQ ID NO: 938669 - RNA, 21 nt, Human
ugagaccuacauugcauuggu

SEQ ID NO: 938670 - RNA, 19 nt, Human
ugagaugugggggaggcau

SEQ ID NO: 938671 - RNA, 23 nt, Human
ugaggggagccuugaggagaugc

SEQ ID NO: 938672 - RNA, 28 nt, Human
ugaggugacacaguacacaaucaagccc

SEQ ID NO: 938673 - RNA, 18 nt, Human
ugaggugguucuugccca

SEQ ID NO: 938674 - RNA, 22 nt, Human
ugaggugguucuugcccauucc

SEQ ID NO: 938675 - RNA, 20 nt, Human
ugcaaauuaugccucugagg

SEQ ID NO: 938676 - RNA, 19 nt, Human
ugcaagugggcuuuaguug

SEQ ID NO: 938677 - RNA, 21 nt, Human
ugcacugccacacuauaaucu

SEQ ID NO: 938678 - RNA, 23 nt, Human
ugccagggccugagaggaacacc

SEQ ID NO: 938679 - RNA, 18 nt, Human
ugcuucgcuaucugcauc

SEQ ID NO: 938680 - RNA, 19 nt, Human
uggaaaaguauguccucuc

SEQ ID NO: 938681 - RNA, 18 nt, Human
uggaggagugggaggugg

SEQ ID NO: 938682 - RNA, 19 nt, Human
uggagucaacagaacaauu

SEQ ID NO: 938683 - RNA, 21 nt, Human
uggagucaacagaacaauugc

SEQ ID NO: 938684 - RNA, 23 nt, Human
ugggcgcuugcuaggccccugcu

SEQ ID NO: 938685 - RNA, 21 nt, Human
ugggucaguggcauccuuggg

SEQ ID NO: 938686 - RNA, 18 nt, Human
uguaaagaugacuucugu

SEQ ID NO: 938687 - RNA, 23 nt, Human
ugucaugggagcugcuugaacac

SEQ ID NO: 938688 - RNA, 27 nt, Human
ugucaugggagcugcuugaacacgaag

SEQ ID NO: 938689 - RNA, 20 nt, Human
uguggucccaaggcaguucc

SEQ ID NO: 938690 - RNA, 21 nt, Human
ugugugugggguccuuccuuu

SEQ ID NO: 938691 - RNA, 22 nt, Human
uuacucugugggguugaugcaa

SEQ ID NO: 938692 - RNA, 19 nt, Human
uuacugcagccagcugaga

SEQ ID NO: 938693 - RNA, 22 nt, Human
uucagcaauggggucauccaaa

SEQ ID NO: 938694 - RNA, 20 nt, Human
uucagggacugccagggccu

SEQ ID NO: 938695 - RNA, 26 nt, Human
uucccaaaggacugacaagaaacccc

SEQ ID NO: 938696 - RNA, 19 nt, Human
uucccacccuccuccccaa

SEQ ID NO: 938697 - RNA, 19 nt, Human
uucccacccuccuccccaa

SEQ ID NO: 938698 - RNA, 20 nt, Human
uucccacccuccuccccaaa

SEQ ID NO: 938699 - RNA, 22 nt, Human
aacauauugcucuucuaacuuu

SEQ ID NO: 938700 - RNA, 20 nt, Human
aauuuccuuaaaaauuaaca

SEQ ID NO: 938701 - RNA, 23 nt, Human
agagaaggaaacauauugcucuu

SEQ ID NO: 938702 - RNA, 18 nt, Human
gagaaggaaacauauugc

SEQ ID NO: 938703 - RNA, 22 nt, Human
uccaaguagauuaucauaguaa

SEQ ID NO: 938704 - RNA, 18 nt, Human
aaaaaaucccucccccuc

SEQ ID NO: 938705 - RNA, 21 nt, Human
aaaaaucccucccccucaacc

SEQ ID NO: 938706 - RNA, 23 nt, Human
aagcaaaacaaugggggaccccu

SEQ ID NO: 938707 - RNA, 23 nt, Human
aaucccucccccucaaccaucac

SEQ ID NO: 938708 - RNA, 22 nt, Human
acagcgcuggcgagcuaggccc

SEQ ID NO: 938709 - RNA, 22 nt, Human
acaggcaaguggucaccagagc

SEQ ID NO: 938710 - RNA, 21 nt, Human
agagcucuagggagcagaggg

SEQ ID NO: 938711 - RNA, 18 nt, Human
agcagggggugcugcagg

SEQ ID NO: 938712 - RNA, 23 nt, Human
agccaccuuucaccuguaggccc

SEQ ID NO: 938713 - RNA, 18 nt, Human
aggcaaguggucaccaga

SEQ ID NO: 938714 - RNA, 22 nt, Human
aggcagggaagaggccccccaa

SEQ ID NO: 938715 - RNA, 26 nt, Human
aggcuuuguggaaucugagggcagcc

SEQ ID NO: 938716 - RNA, 24 nt, Human
agggaagaggccccccaaaaacac

SEQ ID NO: 938717 - RNA, 21 nt, Human
caaagcauuagcaccuccacc

SEQ ID NO: 938718 - RNA, 22 nt, Human
caccaacagcuaacuaaagugc

SEQ ID NO: 938719 - RNA, 21 nt, Human
cacuugggccaccugggccuu

SEQ ID NO: 938720 - RNA, 21 nt, Human
cagccgccuccgcacgcccgg

SEQ ID NO: 938721 - RNA, 20 nt, Human
caggcccugcccgcacuccu

SEQ ID NO: 938722 - RNA, 21 nt, Human
caggcccugcccgcacuccuc

SEQ ID NO: 938723 - RNA, 20 nt, Human
cauccccaaggcccauagaa

SEQ ID NO: 938724 - RNA, 19 nt, Human
cauuagcaccuccaccauc

SEQ ID NO: 938725 - RNA, 21 nt, Human
ccaagcugggccaccaagagc

SEQ ID NO: 938726 - RNA, 18 nt, Human
ccacugccgccuucccgc

SEQ ID NO: 938727 - RNA, 18 nt, Human
ccacugccgccuucccgc

SEQ ID NO: 938728 - RNA, 20 nt, Human
ccccacugcgcucccgucca

SEQ ID NO: 938729 - RNA, 21 nt, Human
ccccuucaaccacugccgccu

SEQ ID NO: 938730 - RNA, 18 nt, Human
cccguccaugaggagcac

SEQ ID NO: 938731 - RNA, 18 nt, Human
ccgcacgcccggcccucg

SEQ ID NO: 938732 - RNA, 25 nt, Human
ccucaucuuuccccuaccuucccca

SEQ ID NO: 938733 - RNA, 21 nt, Human
ccuccaccauccccaaggccc

SEQ ID NO: 938734 - RNA, 22 nt, Human
ccuccaccauccccaaggccca

SEQ ID NO: 938735 - RNA, 22 nt, Human
ccugcccgcacuccuccugggc

SEQ ID NO: 938736 - RNA, 22 nt, Human
ccuucaaccacugccgccuucc

SEQ ID NO: 938737 - RNA, 25 nt, Human
cgagggaggggagagaggcuuugug

SEQ ID NO: 938738 - RNA, 22 nt, Human
cgcuggggaagcaaaacaaugg

SEQ ID NO: 938739 - RNA, 18 nt, Human
cucaggacugucugguca

SEQ ID NO: 938740 - RNA, 22 nt, Human
cuccaggucaggcccugcccgc

SEQ ID NO: 938741 - RNA, 21 nt, Human
cucccccucaaccaucacucc

SEQ ID NO: 938742 - RNA, 18 nt, Human
cugccugggugggggugg

SEQ ID NO: 938743 - RNA, 19 nt, Human
cugggucucaggacugucu

SEQ ID NO: 938744 - RNA, 19 nt, Human
cuuccugccuggguggggg

SEQ ID NO: 938745 - RNA, 21 nt, Human
cuuccugccugggugggggug

SEQ ID NO: 938746 - RNA, 18 nt, Human
cuucugggucucaggacu

SEQ ID NO: 938747 - RNA, 18 nt, Human
gaaaaaaaucccuccccc

SEQ ID NO: 938748 - RNA, 19 nt, Human
gagcacagcgcuggcgagc

SEQ ID NO: 938749 - RNA, 18 nt, Human
gaggagcacagcgcuggc

SEQ ID NO: 938750 - RNA, 18 nt, Human
gagggaggggagagaggc

SEQ ID NO: 938751 - RNA, 23 nt, Human
gcaaaacaaugggggaccccuuc

SEQ ID NO: 938752 - RNA, 23 nt, Human
gcaaagcauuagcaccuccacca

SEQ ID NO: 938753 - RNA, 21 nt, Human
gcagggaagaggccccccaaa

SEQ ID NO: 938754 - RNA, 19 nt, Human
gcugcaggaggaaagugug

SEQ ID NO: 938755 - RNA, 24 nt, Human
gcuuccugccuggguggggguggg

SEQ ID NO: 938756 - RNA, 20 nt, Human
ggaagcaaaacaauggggga

SEQ ID NO: 938757 - RNA, 22 nt, Human
ggagcacagcgcuggcgagcua

SEQ ID NO: 938758 - RNA, 28 nt, Human
gggaagaggccccccaaaaacacagugg

SEQ ID NO: 938759 - RNA, 18 nt, Human
ggugcugcaggaggaaag

SEQ ID NO: 938760 - RNA, 21 nt, Human
gugugugcuggccaagcuggg

SEQ ID NO: 938761 - RNA, 19 nt, Human
uaaagugcuugacaggagc

SEQ ID NO: 938762 - RNA, 22 nt, Human
uaggccccaagcaaagcauuag

SEQ ID NO: 938763 - RNA, 28 nt, Human
uagggagcagaggggccccagaaggcag

SEQ ID NO: 938764 - RNA, 26 nt, Human
ucaacacugugccucaucuuuccccu

SEQ ID NO: 938765 - RNA, 21 nt, Human
uccugccuggguggggguggg

SEQ ID NO: 938766 - RNA, 19 nt, Human
ugaaaaaaaucccuccccc

SEQ ID NO: 938767 - RNA, 23 nt, Human
ugccgccuucccgccuccucagc

SEQ ID NO: 938768 - RNA, 25 nt, Human
ugccucaucuuuccccuaccuuccc

SEQ ID NO: 938769 - RNA, 20 nt, Human
ugccugggugggggugggac

SEQ ID NO: 938770 - RNA, 24 nt, Human
uggccaagcugggccaccaagagc

SEQ ID NO: 938771 - RNA, 20 nt, Human
uggcgagcuaggcccaggga

SEQ ID NO: 938772 - RNA, 18 nt, Human
ugggggugggacgaggga

SEQ ID NO: 938773 - RNA, 23 nt, Human
uuccccacugcgcucccguccau

SEQ ID NO: 938774 - RNA, 19 nt, Human
uugggccaccugggccuuc

SEQ ID NO: 938775 - RNA, 23 nt, Human
uuuccccuaccuuccccacugcg

SEQ ID NO: 938776 - RNA, 24 nt, Human
uuugaaaaaaaucccucccccuca

SEQ ID NO: 938777 - RNA, 21 nt, Human
aaaaaaacaaccuguacuagg

SEQ ID NO: 938778 - RNA, 23 nt, Human
aaaaaaacaaccuguacuaggcu

SEQ ID NO: 938779 - RNA, 24 nt, Human
aaaacaagacucagcaaaccaaag

SEQ ID NO: 938780 - RNA, 19 nt, Human
aaaaggaaaaccaaagaag

SEQ ID NO: 938781 - RNA, 20 nt, Human
aaaaggaaaaccaaagaagu

SEQ ID NO: 938782 - RNA, 21 nt, Human
aaaaggacaggguuagagaua

SEQ ID NO: 938783 - RNA, 21 nt, Human
aaacaagacucagcaaaccaa

SEQ ID NO: 938784 - RNA, 22 nt, Human
aaacagcaaaugaaggcaucug

SEQ ID NO: 938785 - RNA, 18 nt, Human
aaaccgagccaccccggc

SEQ ID NO: 938786 - RNA, 20 nt, Human
aaaccgagccaccccggcca

SEQ ID NO: 938787 - RNA, 23 nt, Human
aaagaaacuuaacacugaaaaag

SEQ ID NO: 938788 - RNA, 23 nt, Human
aaauuaauaauauucuaaaguau

SEQ ID NO: 938789 - RNA, 23 nt, Human
aagaaguggccaaggagaagaaa

SEQ ID NO: 938790 - RNA, 24 nt, Human
aagaaguggccaaggagaagaaau

SEQ ID NO: 938791 - RNA, 20 nt, Human
aagacaccaauuaacugaca

SEQ ID NO: 938792 - RNA, 23 nt, Human
aagagacuuacagaaaaggggca

SEQ ID NO: 938793 - RNA, 28 nt, Human
aagcagaacauagaaguaaaagggaccc

SEQ ID NO: 938794 - RNA, 20 nt, Human
aaggaccccuaagucgacga

SEQ ID NO: 938795 - RNA, 22 nt, Human
aagugaauaggcuauacaccua

SEQ ID NO: 938796 - RNA, 23 nt, Human
acaaaaaaggaaaaccaaagaag

SEQ ID NO: 938797 - RNA, 22 nt, Human
acaaaauggccuccccuccccc

SEQ ID NO: 938798 - RNA, 20 nt, Human
acaaagagaggaggaaaagc

SEQ ID NO: 938799 - RNA, 21 nt, Human
acauagccccaggaaaccgag

SEQ ID NO: 938800 - RNA, 24 nt, Human
accacaacacccuccaaacacuag

SEQ ID NO: 938801 - RNA, 21 nt, Human
accaugaggugguuggggagg

SEQ ID NO: 938802 - RNA, 18 nt, Human
acgcucccacgggcgagc

SEQ ID NO: 938803 - RNA, 21 nt, Human
acucagccucugcuagaaaug

SEQ ID NO: 938804 - RNA, 22 nt, Human
agaaagacaaaccacaacaccc

SEQ ID NO: 938805 - RNA, 26 nt, Human
agaaagacaaaccacaacacccucca

SEQ ID NO: 938806 - RNA, 25 nt, Human
agaacaaaaaaggaaaaccaaagaa

SEQ ID NO: 938807 - RNA, 20 nt, Human
agacaaaccacaacacccuc

SEQ ID NO: 938808 - RNA, 22 nt, Human
agacaaaccacaacacccucca

SEQ ID NO: 938809 - RNA, 23 nt, Human
agacaaaccacaacacccuccaa

SEQ ID NO: 938810 - RNA, 18 nt, Human
agagcaaaugagggggga

SEQ ID NO: 938811 - RNA, 22 nt, Human
agagcaaaugaggggggaagac

SEQ ID NO: 938812 - RNA, 20 nt, Human
agcaaaugaggggggaagac

SEQ ID NO: 938813 - RNA, 25 nt, Human
agccaagcaaaccacaaacauuuua

SEQ ID NO: 938814 - RNA, 21 nt, Human
aggaagggaacaaagagagga

SEQ ID NO: 938815 - RNA, 22 nt, Human
aggcucgagacggcgcgggcga

SEQ ID NO: 938816 - RNA, 22 nt, Human
agggacucaagcacauuaucca

SEQ ID NO: 938817 - RNA, 19 nt, Human
aggugguuggggagggaga

SEQ ID NO: 938818 - RNA, 20 nt, Human
aucaugcuauucacaauucu

SEQ ID NO: 938819 - RNA, 20 nt, Human
augcaguugagcugagcaag

SEQ ID NO: 938820 - RNA, 18 nt, Human
augguaauacaaguuuuc

SEQ ID NO: 938821 - RNA, 19 nt, Human
augguuuauguuuggauga

SEQ ID NO: 938822 - RNA, 18 nt, Human
caaaagguagccauaucc

SEQ ID NO: 938823 - RNA, 25 nt, Human
caaaauggccuccccuccccccuca

SEQ ID NO: 938824 - RNA, 25 nt, Human
caaaccacaacacccuccaaacacu

SEQ ID NO: 938825 - RNA, 22 nt, Human
caaagcccuaauauuaagcaaa

SEQ ID NO: 938826 - RNA, 22 nt, Human
caacaaauacauuaaucuaaca

SEQ ID NO: 938827 - RNA, 25 nt, Human
cacaggaucccaagagacuuacaga

SEQ ID NO: 938828 - RNA, 25 nt, Human
caccagaacaaaaaaggaaaaccaa

SEQ ID NO: 938829 - RNA, 21 nt, Human
cacgacacagaaagacuucuc

SEQ ID NO: 938830 - RNA, 22 nt, Human
cacuccuccuuccugcuuuucc

SEQ ID NO: 938831 - RNA, 21 nt, Human
cagcaagaagagaaaacgggg

SEQ ID NO: 938832 - RNA, 21 nt, Human
cagcuucuacacaggaucccu

SEQ ID NO: 938833 - RNA, 24 nt, Human
caggaaaccgagccaccccggcca

SEQ ID NO: 938834 - RNA, 22 nt, Human
cagucuguuauccaaaaauccc

SEQ ID NO: 938835 - RNA, 20 nt, Human
caguugagcugagcaaguac

SEQ ID NO: 938836 - RNA, 25 nt, Human
ccaccagaacaaaaaaggaaaacca

SEQ ID NO: 938837 - RNA, 22 nt, Human
ccagaacaaaaaaggaaaacca

SEQ ID NO: 938838 - RNA, 22 nt, Human
ccagcccguccgcccgguuccg

SEQ ID NO: 938839 - RNA, 23 nt, Human
ccaucuagaaauauuucaguuua

SEQ ID NO: 938840 - RNA, 19 nt, Human
ccccuaagucgacgagcuc

SEQ ID NO: 938841 - RNA, 27 nt, Human
ccccuaagucgacgagcucaguuacau

SEQ ID NO: 938842 - RNA, 21 nt, Human
ccccuccccccucagggcuuc

SEQ ID NO: 938843 - RNA, 22 nt, Human
cccgguuccggggagucggucc

SEQ ID NO: 938844 - RNA, 19 nt, Human
ccgagccaccccggccaga

SEQ ID NO: 938845 - RNA, 22 nt, Human
ccgcggcuccgcagccucuccc

SEQ ID NO: 938846 - RNA, 21 nt, Human
ccuaagaauaacaaccaguga

SEQ ID NO: 938847 - RNA, 23 nt, Human
ccucagggcuucucggccgggac

SEQ ID NO: 938848 - RNA, 18 nt, Human
ccuccuuccugcuuuucc

SEQ ID NO: 938849 - RNA, 22 nt, Human
cgagggcagcgaagaaggaccc

SEQ ID NO: 938850 - RNA, 19 nt, Human
cggccgggacgcucccacg

SEQ ID NO: 938851 - RNA, 23 nt, Human
cgggcgugaggacagucucucuc

SEQ ID NO: 938852 - RNA, 21 nt, Human
cucccagcccguccgcccggu

SEQ ID NO: 938853 - RNA, 19 nt, Human
cucgccgccggcggcccca

SEQ ID NO: 938854 - RNA, 18 nt, Human
cuuaaaacaagacucagc

SEQ ID NO: 938855 - RNA, 20 nt, Human
gaaaaaggcucgagacggcg

SEQ ID NO: 938856 - RNA, 20 nt, Human
gaaaagccuuucguuguccu

SEQ ID NO: 938857 - RNA, 22 nt, Human
gauaguuaagaugagaaacaaa

SEQ ID NO: 938858 - RNA, 18 nt, Human
gcaaugaagcaaaacuag

SEQ ID NO: 938859 - RNA, 24 nt, Human
gccugcucugccgucgaggaggcg

SEQ ID NO: 938860 - RNA, 19 nt, Human
ggaagcgugggaaaaaggc

SEQ ID NO: 938861 - RNA, 24 nt, Human
ggccaaggagaagaaaugguggca

SEQ ID NO: 938862 - RNA, 20 nt, Human
ggcgagggcagcgaagaagg

SEQ ID NO: 938863 - RNA, 22 nt, Human
gggagggagaagcaaauaaagc

SEQ ID NO: 938864 - RNA, 21 nt, Human
gguuccggggagucggucggg

SEQ ID NO: 938865 - RNA, 19 nt, Human
guuuaccuagcaaguuaca

SEQ ID NO: 938866 - RNA, 20 nt, Human
uaaaacaagacucagcaaac

SEQ ID NO: 938867 - RNA, 21 nt, Human
uaaaacaagacucagcaaacc

SEQ ID NO: 938868 - RNA, 24 nt, Human
uaaaacaagacucagcaaaccaaa

SEQ ID NO: 938869 - RNA, 19 nt, Human
uaaaacagcaaaugaaggc

SEQ ID NO: 938870 - RNA, 19 nt, Human
uaaaacagcaaaugaaggc

SEQ ID NO: 938871 - RNA, 27 nt, Human
uaaaacagcaaaugaaggcaucuggga

SEQ ID NO: 938872 - RNA, 19 nt, Human
uaaaauagguggcuuggau

SEQ ID NO: 938873 - RNA, 22 nt, Human
uaaagaaacuuaacacugaaaa

SEQ ID NO: 938874 - RNA, 19 nt, Human
uaaagcagcaugcagggag

SEQ ID NO: 938875 - RNA, 18 nt, Human
uaagaugagaaacaaaaa

SEQ ID NO: 938876 - RNA, 22 nt, Human
uacggccaacuccucacucggg

SEQ ID NO: 938877 - RNA, 21 nt, Human
uacuaggcuaccaagcugcua

SEQ ID NO: 938878 - RNA, 20 nt, Human
uagcagcauagcaaacuuca

SEQ ID NO: 938879 - RNA, 22 nt, Human
uauccaaaaaucccaguguuua

SEQ ID NO: 938880 - RNA, 20 nt, Human
uauuuagaaagugcagauuu

SEQ ID NO: 938881 - RNA, 19 nt, Human
uauuuuuaguggaaaauua

SEQ ID NO: 938882 - RNA, 23 nt, Human
ucagcaaaccaaagcuaucacuu

SEQ ID NO: 938883 - RNA, 23 nt, Human
ucagggcuucucggccgggacgc

SEQ ID NO: 938884 - RNA, 21 nt, Human
uccaaccuuaagucauggaau

SEQ ID NO: 938885 - RNA, 19 nt, Human
uccgcagccucucccagcc

SEQ ID NO: 938886 - RNA, 19 nt, Human
uccuccuuccugcuuuucc

SEQ ID NO: 938887 - RNA, 20 nt, Human
uccugcacaugcuuccaccu

SEQ ID NO: 938888 - RNA, 22 nt, Human
ucgggacaaaauggccuccccu

SEQ ID NO: 938889 - RNA, 24 nt, Human
ucucccagcccguccgcccgguuc

SEQ ID NO: 938890 - RNA, 20 nt, Human
ucucucucccgagcggaaac

SEQ ID NO: 938891 - RNA, 25 nt, Human
ugaaaccgaauuuguagcuaguacc

SEQ ID NO: 938892 - RNA, 23 nt, Human
ugaaagaacaaauaaaauaggug

SEQ ID NO: 938893 - RNA, 23 nt, Human
ugaagcaaaacuagaaaaaaugc

SEQ ID NO: 938894 - RNA, 19 nt, Human
ugaggcauauaaaauuguu

SEQ ID NO: 938895 - RNA, 22 nt, Human
ugauuuauacuucauuucccuu

SEQ ID NO: 938896 - RNA, 18 nt, Human
uggauagacaggaaggga

SEQ ID NO: 938897 - RNA, 19 nt, Human
uggccuccccucccccccc

SEQ ID NO: 938898 - RNA, 22 nt, Human
uggcggcguccagugccuccga

SEQ ID NO: 938899 - RNA, 18 nt, Human
uggcuuuuguuuguuucu

SEQ ID NO: 938900 - RNA, 18 nt, Human
ugggaggagcggcucggg

SEQ ID NO: 938901 - RNA, 24 nt, Human
ugguaauacaaguuuuccaaaagg

SEQ ID NO: 938902 - RNA, 24 nt, Human
uguacaaaauaaaauuguuaauuc

SEQ ID NO: 938903 - RNA, 22 nt, Human
uguacuaggcuaccaagcugcu

SEQ ID NO: 938904 - RNA, 20 nt, Human
uuaaaacaagacucagcaaa

SEQ ID NO: 938905 - RNA, 20 nt, Human
uuaaaauuaauaauauucua

SEQ ID NO: 938906 - RNA, 19 nt, Human
uuaaauaucaaggccacuu

SEQ ID NO: 938907 - RNA, 19 nt, Human
uuaguggaaaauuagggau

SEQ ID NO: 938908 - RNA, 23 nt, Human
uuccagauaaagggaagcaacaa

SEQ ID NO: 938909 - RNA, 20 nt, Human
uugcagaauagauuugaaau

SEQ ID NO: 938910 - RNA, 21 nt, Human
uuuaaaaaaacaaccuguacu

SEQ ID NO: 938911 - RNA, 20 nt, Human
uuucguuguccuuuuuccaa

SEQ ID NO: 938912 - RNA, 18 nt, Human
uuugucccuuucacucuu

SEQ ID NO: 938913 - RNA, 20 nt, Human
aaaaaaaaaaaaacuaccaa

SEQ ID NO: 938914 - RNA, 27 nt, Human
aaaaaaaaaaacccaaacuauuauauc

SEQ ID NO: 938915 - RNA, 21 nt, Human
aaaaaaaaaacuaccaagacc

SEQ ID NO: 938916 - RNA, 21 nt, Human
aaaacaagcuauauuagcuua

SEQ ID NO: 938917 - RNA, 20 nt, Human
aaaacugacaucuugguuca

SEQ ID NO: 938918 - RNA, 26 nt, Human
aaaauaagcagaagauuagcaauauu

SEQ ID NO: 938919 - RNA, 18 nt, Human
aaacaaauggaaugaaac

SEQ ID NO: 938920 - RNA, 21 nt, Human
aaacagcaaauuuggccaaag

SEQ ID NO: 938921 - RNA, 23 nt, Human
aaacagcaaauuuggccaaagca

SEQ ID NO: 938922 - RNA, 20 nt, Human
aaauacaaggcaacauuuuc

SEQ ID NO: 938923 - RNA, 21 nt, Human
aaaugcagaagauacaaauaa

SEQ ID NO: 938924 - RNA, 20 nt, Human
aacauauccccaauacaaaa

SEQ ID NO: 938925 - RNA, 25 nt, Human
aagaagaaaacaagucugucacuaa

SEQ ID NO: 938926 - RNA, 19 nt, Human
aagcaaaaaaaaaaaaccc

SEQ ID NO: 938927 - RNA, 19 nt, Human
aagcaaaaaaaaaaaaccc

SEQ ID NO: 938928 - RNA, 22 nt, Human
aagcaaaaaaaaaaaacccaaa

SEQ ID NO: 938929 - RNA, 19 nt, Human
aaggagaauauguaaugaa

SEQ ID NO: 938930 - RNA, 19 nt, Human
aauauuuuuaaagcugaau

SEQ ID NO: 938931 - RNA, 20 nt, Human
acaagauacaugaauauaua

SEQ ID NO: 938932 - RNA, 19 nt, Human
acccccgccccugucucca

SEQ ID NO: 938933 - RNA, 19 nt, Human
acgagcaguauuccugaag

SEQ ID NO: 938934 - RNA, 23 nt, Human
acgagcaguauuccugaagcuaa

SEQ ID NO: 938935 - RNA, 18 nt, Human
acgagcuuggccaaguau

SEQ ID NO: 938936 - RNA, 23 nt, Human
acuccacugugagagugcauuuu

SEQ ID NO: 938937 - RNA, 21 nt, Human
acucuauaaucuaguguacug

SEQ ID NO: 938938 - RNA, 20 nt, Human
acugaaaugcagaagauaca

SEQ ID NO: 938939 - RNA, 22 nt, Human
agcuaaauauuucuacaaacug

SEQ ID NO: 938940 - RNA, 22 nt, Human
aggcaggcucagggcuccccga

SEQ ID NO: 938941 - RNA, 19 nt, Human
aggcagggaggcguggugg

SEQ ID NO: 938942 - RNA, 19 nt, Human
aggcgugguggugagggag

SEQ ID NO: 938943 - RNA, 22 nt, Human
auagcuuuuauauaggaaaaga

SEQ ID NO: 938944 - RNA, 24 nt, Human
aucagauuacauaaauuauacaau

SEQ ID NO: 938945 - RNA, 21 nt, Human
augcagaauuucaacaaaaca

SEQ ID NO: 938946 - RNA, 22 nt, Human
auuccugaagcuaaauauuucu

SEQ ID NO: 938947 - RNA, 21 nt, Human
auuuugauugaguuauaacca

SEQ ID NO: 938948 - RNA, 18 nt, Human
caaaaaaaaaaaacccaa

SEQ ID NO: 938949 - RNA, 22 nt, Human
caaaaagcaauacuuaaaaacg

SEQ ID NO: 938950 - RNA, 21 nt, Human
caaaacacaaaccaucuggaa

SEQ ID NO: 938951 - RNA, 24 nt, Human
caaaacacaaaccaucuggaagcc

SEQ ID NO: 938952 - RNA, 23 nt, Human
caaaagcaauagauguaguuaug

SEQ ID NO: 938953 - RNA, 19 nt, Human
caaauuuucaggcagugau

SEQ ID NO: 938954 - RNA, 21 nt, Human
caagacccaaaggcaaccauc

SEQ ID NO: 938955 - RNA, 21 nt, Human
caaguuuuuccuuccuuccuu

SEQ ID NO: 938956 - RNA, 24 nt, Human
cacagaggcccaccaucaccuggc

SEQ ID NO: 938957 - RNA, 23 nt, Human
cacauuuucaaaucaagaaauug

SEQ ID NO: 938958 - RNA, 23 nt, Human
caccaggcaaucacauacuuccc

SEQ ID NO: 938959 - RNA, 18 nt, Human
caccuggccgcgccgugc

SEQ ID NO: 938960 - RNA, 23 nt, Human
caccuggccgcgccgugcaggcc

SEQ ID NO: 938961 - RNA, 23 nt, Human
cagaacauagcagcaaaaagcaa

SEQ ID NO: 938962 - RNA, 24 nt, Human
cagcauuuuuuuguaccucaaaac

SEQ ID NO: 938963 - RNA, 18 nt, Human
cagcccaggggcacggcc

SEQ ID NO: 938964 - RNA, 19 nt, Human
cagggcuccccgacuuccc

SEQ ID NO: 938965 - RNA, 21 nt, Human
ccaagaccucaaacgggaaaa

SEQ ID NO: 938966 - RNA, 19 nt, Human
ccacacggacccgggcgga

SEQ ID NO: 938967 - RNA, 22 nt, Human
cccccgaguucccuagcacagg

SEQ ID NO: 938968 - RNA, 26 nt, Human
ccccgccccugucuccaccuucccca

SEQ ID NO: 938969 - RNA, 19 nt, Human
ccccucccggagggagagc

SEQ ID NO: 938970 - RNA, 24 nt, Human
cccgggcggagggcugcgggggug

SEQ ID NO: 938971 - RNA, 21 nt, Human
ccgcgccgugcaggccucugc

SEQ ID NO: 938972 - RNA, 24 nt, Human
ccgcgccgugcaggccucugccgu

SEQ ID NO: 938973 - RNA, 28 nt, Human
ccuauggcugaugucaaaaccggggucc

SEQ ID NO: 938974 - RNA, 28 nt, Human
ccuccgcugccuccgcgccucccgcccg

SEQ ID NO: 938975 - RNA, 23 nt, Human
ccugauaguguagucucuuucag

SEQ ID NO: 938976 - RNA, 20 nt, Human
ccugccuccuugcggccgag

SEQ ID NO: 938977 - RNA, 19 nt, Human
ccuuccuucuuucuuucuc

SEQ ID NO: 938978 - RNA, 22 nt, Human
ccuucuacauaccaucauggcc

SEQ ID NO: 938979 - RNA, 25 nt, Human
ccuucuacauaccaucauggcccag

SEQ ID NO: 938980 - RNA, 21 nt, Human
cgagcagccuccgcugccucc

SEQ ID NO: 938981 - RNA, 26 nt, Human
cgccccugucuccaccuuccccaggc

SEQ ID NO: 938982 - RNA, 18 nt, Human
cgucuggagaaacacaga

SEQ ID NO: 938983 - RNA, 18 nt, Human
cuaaaauaagcaaaaaaa

SEQ ID NO: 938984 - RNA, 22 nt, Human
cuacauaccaucauggcccagc

SEQ ID NO: 938985 - RNA, 23 nt, Human
cuagcacaggcagugccccuccc

SEQ ID NO: 938986 - RNA, 18 nt, Human
cucugcccccgaguuccc

SEQ ID NO: 938987 - RNA, 21 nt, Human
cucugcgcggacccccgcccc

SEQ ID NO: 938988 - RNA, 22 nt, Human
cuugguucacucuauaaacagc

SEQ ID NO: 938989 - RNA, 24 nt, Human
gacccccgccccugucuccaccuu

SEQ ID NO: 938990 - RNA, 19 nt, Human
gagcagccuccgcugccuc

SEQ ID NO: 938991 - RNA, 19 nt, Human
gagccccccgccccaauuc

SEQ ID NO: 938992 - RNA, 23 nt, Human
gaguucccuagcacaggcagugc

SEQ ID NO: 938993 - RNA, 23 nt, Human
gcaauucauggaaagauugggga

SEQ ID NO: 938994 - RNA, 21 nt, Human
gcagggaggcgugguggugag

SEQ ID NO: 938995 - RNA, 24 nt, Human
gcaguacuugaaccauacuuuuaa

SEQ ID NO: 938996 - RNA, 23 nt, Human
gccaaguauucucugauucaaaa

SEQ ID NO: 938997 - RNA, 21 nt, Human
gcccaaacacaggaaacacug

SEQ ID NO: 938998 - RNA, 19 nt, Human
gcccaggggcacggccgcu

SEQ ID NO: 938999 - RNA, 19 nt, Human
ggacaauggcaaaacuagg

SEQ ID NO: 939000 - RNA, 19 nt, Human
ggacaugaauuuucauuuu

SEQ ID NO: 939001 - RNA, 21 nt, Human
ggacccccgccccugucucca

SEQ ID NO: 939002 - RNA, 21 nt, Human
ggauguggaguaaugcauaau

SEQ ID NO: 939003 - RNA, 25 nt, Human
ggcaccauguuuaaaaaaaaaaaaa

SEQ ID NO: 939004 - RNA, 22 nt, Human
ggcaggcucagggcuccccucu

SEQ ID NO: 939005 - RNA, 20 nt, Human
gggcggagggcugcgggggu

SEQ ID NO: 939006 - RNA, 19 nt, Human
ggggaugguaggcagggag

SEQ ID NO: 939007 - RNA, 24 nt, Human
gggggcuuuccaugugugcugaca

SEQ ID NO: 939008 - RNA, 18 nt, Human
gguccccuuucgucugga

SEQ ID NO: 939009 - RNA, 20 nt, Human
guccuguuucucugcccccg

SEQ ID NO: 939010 - RNA, 24 nt, Human
uaaaaaaaaaaaaaaaacuaccaa

SEQ ID NO: 939011 - RNA, 26 nt, Human
uaaaagcaaaaauaaacucuauaauc

SEQ ID NO: 939012 - RNA, 23 nt, Human
uaaaagcuauuuuuccuucucca

SEQ ID NO: 939013 - RNA, 28 nt, Human
uaaaauaagcaaaaaaaaaaaacccaaa

SEQ ID NO: 939014 - RNA, 20 nt, Human
uaaacaaacucaaauguuaa

SEQ ID NO: 939015 - RNA, 19 nt, Human
uaaagcauaaaagcaaaaa

SEQ ID NO: 939016 - RNA, 19 nt, Human
uaacaagaagaaaacaagu

SEQ ID NO: 939017 - RNA, 18 nt, Human
uaagcaaaaaaaaaaaac

SEQ ID NO: 939018 - RNA, 24 nt, Human
uaagcaacuaacaaaauacauuag

SEQ ID NO: 939019 - RNA, 18 nt, Human
uaaggugaccuuuuuggc

SEQ ID NO: 939020 - RNA, 19 nt, Human
uacaauacaauuggcuuua

SEQ ID NO: 939021 - RNA, 20 nt, Human
uaccucaaaacacaaaccau

SEQ ID NO: 939022 - RNA, 22 nt, Human
uagccuaacuuuagaggcaauc

SEQ ID NO: 939023 - RNA, 20 nt, Human
uaguuaauuaaaaguggcac

SEQ ID NO: 939024 - RNA, 21 nt, Human
uauacaaguuaugagagcauu

SEQ ID NO: 939025 - RNA, 24 nt, Human
uauacaaugcuuacauacuuuuga

SEQ ID NO: 939026 - RNA, 26 nt, Human
uaugaaaagacucaauaauacuacca

SEQ ID NO: 939027 - RNA, 21 nt, Human
uauuucagacuuuaaaggcug

SEQ ID NO: 939028 - RNA, 21 nt, Human
ucaaaacgccucgcgggggca

SEQ ID NO: 939029 - RNA, 18 nt, Human
ucaguauuuugggggagu

SEQ ID NO: 939030 - RNA, 19 nt, Human
uccaccuuccccaggccug

SEQ ID NO: 939031 - RNA, 18 nt, Human
uccccauaaaaagaagag

SEQ ID NO: 939032 - RNA, 24 nt, Human
uccccuuucgucuggagaaacaca

SEQ ID NO: 939033 - RNA, 18 nt, Human
ucgaagacuaacaggccc

SEQ ID NO: 939034 - RNA, 25 nt, Human
ucugcagauacugucauaauacuga

SEQ ID NO: 939035 - RNA, 24 nt, Human
ucugcccccgaguucccuagcacc

SEQ ID NO: 939036 - RNA, 19 nt, Human
ucuuucucucucuuugucc

SEQ ID NO: 939037 - RNA, 20 nt, Human
ucuuucuuucucucucuuuc

SEQ ID NO: 939038 - RNA, 21 nt, Human
ugaaaaauaagcagaagauua

SEQ ID NO: 939039 - RNA, 25 nt, Human
ugaaaaauaagcagaagauuagcaa

SEQ ID NO: 939040 - RNA, 24 nt, Human
ugaaaaaucuauuccugaggaaca

SEQ ID NO: 939041 - RNA, 24 nt, Human
ugaaaagacucaauaauacuacca

SEQ ID NO: 939042 - RNA, 18 nt, Human
ugaagauauuucugggcc

SEQ ID NO: 939043 - RNA, 23 nt, Human
ugaaguuaaugaagucuccuaaa

SEQ ID NO: 939044 - RNA, 19 nt, Human
ugacagacccuucuacaua

SEQ ID NO: 939045 - RNA, 21 nt, Human
ugacagacccuucuacauacc

SEQ ID NO: 939046 - RNA, 22 nt, Human
ugcauuuuuugauggauaaaac

SEQ ID NO: 939047 - RNA, 21 nt, Human
ugcccccgaguucccuagcac

SEQ ID NO: 939048 - RNA, 21 nt, Human
ugcgcggacccccgccccugu

SEQ ID NO: 939049 - RNA, 24 nt, Human
ugcggccgagcagccuccgcugcc

SEQ ID NO: 939050 - RNA, 19 nt, Human
uggaaaaauaaacuaaggu

SEQ ID NO: 939051 - RNA, 22 nt, Human
uggaaaaauaaacuaaggugac

SEQ ID NO: 939052 - RNA, 24 nt, Human
uggaagaaaucaguauuuuggggg

SEQ ID NO: 939053 - RNA, 23 nt, Human
uggaaucugcccgcugcuuuggg

SEQ ID NO: 939054 - RNA, 19 nt, Human
uggaaugaaacaucaacuc

SEQ ID NO: 939055 - RNA, 24 nt, Human
uggaaugaaacaucaacucuauuu

SEQ ID NO: 939056 - RNA, 21 nt, Human
uggaguaaugcauaaugucac

SEQ ID NO: 939057 - RNA, 21 nt, Human
uggauaaaacaaauggaauga

SEQ ID NO: 939058 - RNA, 23 nt, Human
uggggaaagagaaaaacuuugau

SEQ ID NO: 939059 - RNA, 19 nt, Human
ugggucaguaccagcaccu

SEQ ID NO: 939060 - RNA, 18 nt, Human
uggugagggaguugcugg

SEQ ID NO: 939061 - RNA, 21 nt, Human
ugguuauaaaauaauacugcu

SEQ ID NO: 939062 - RNA, 30 nt, Human
uguaaaacauauccccaauacaaaacugaa

SEQ ID NO: 939063 - RNA, 18 nt, Human
uguaacauuuacuguaga

SEQ ID NO: 939064 - RNA, 25 nt, Human
uguacauauguguauauaaaauaua

SEQ ID NO: 939065 - RNA, 23 nt, Human
ugucaaaacgccucgcgggggca

SEQ ID NO: 939066 - RNA, 20 nt, Human
uuaaaacuacuuugcacuuc

SEQ ID NO: 939067 - RNA, 19 nt, Human
uuaaauucagaaagacaua

SEQ ID NO: 939068 - RNA, 18 nt, Human
uuagcaauauuuuuauaa

SEQ ID NO: 939069 - RNA, 19 nt, Human
uucaaaauacuaaaauaag

SEQ ID NO: 939070 - RNA, 18 nt, Human
uuccuucuccauuucuua

SEQ ID NO: 939071 - RNA, 18 nt, Human
uugggggaguggacuuua

SEQ ID NO: 939072 - RNA, 20 nt, Human
uuuacagguaaaacuacucu

SEQ ID NO: 939073 - RNA, 18 nt, Human
uuuauguaaccugaaacc

SEQ ID NO: 939074 - RNA, 21 nt, Human
uuuccuuccuuccuucuuucu

SEQ ID NO: 939075 - RNA, 22 nt, Human
uuugcuuugcuagugauuuaaa

SEQ ID NO: 939076 - RNA, 20 nt, Human
aacagggcugcacgugggaa

SEQ ID NO: 939077 - RNA, 19 nt, Human
aacaggguucccgauguuu

SEQ ID NO: 939078 - RNA, 19 nt, Human
aagaaaacaggguucccga

SEQ ID NO: 939079 - RNA, 23 nt, Human
acacccaaggcuuuccccaaaug

SEQ ID NO: 939080 - RNA, 19 nt, Human
acaccgcugugccuggggu

SEQ ID NO: 939081 - RNA, 22 nt, Human
acacguacacgcgcgcgcacac

SEQ ID NO: 939082 - RNA, 28 nt, Human
accagccuugcccacccguccuuccccc

SEQ ID NO: 939083 - RNA, 18 nt, Human
acccagaagaaaacaggg

SEQ ID NO: 939084 - RNA, 18 nt, Human
acccguccuucccccacc

SEQ ID NO: 939085 - RNA, 22 nt, Human
agccacauggccuggaggcccc

SEQ ID NO: 939086 - RNA, 18 nt, Human
agcguagggagagcuggg

SEQ ID NO: 939087 - RNA, 22 nt, Human
aggaggcugaggcgccugaggu

SEQ ID NO: 939088 - RNA, 24 nt, Human
aggccccagagcuggacugaggug

SEQ ID NO: 939089 - RNA, 18 nt, Human
aggcggcggauguggggc

SEQ ID NO: 939090 - RNA, 22 nt, Human
agggagagagcgccacacagcg

SEQ ID NO: 939091 - RNA, 23 nt, Human
auguggggccacacguacacgcg

SEQ ID NO: 939092 - RNA, 20 nt, Human
caaaggcgcucagggcgcgg

SEQ ID NO: 939093 - RNA, 24 nt, Human
caaguuuacacugauuuacaccca

SEQ ID NO: 939094 - RNA, 22 nt, Human
cacacacgcagcggguggccag

SEQ ID NO: 939095 - RNA, 19 nt, Human
cacacagcggucaucucag

SEQ ID NO: 939096 - RNA, 23 nt, Human
cacagcagggcucaccccacacc

SEQ ID NO: 939097 - RNA, 23 nt, Human
cacaucuggcugggcaauggccc

SEQ ID NO: 939098 - RNA, 24 nt, Human
caccacaaggaggccacagcaggg

SEQ ID NO: 939099 - RNA, 18 nt, Human
cacccaaggcuuucccca

SEQ ID NO: 939100 - RNA, 18 nt, Human
cacccaaggcuuucccca

SEQ ID NO: 939101 - RNA, 23 nt, Human
cacccagaagaaaacaggguucc

SEQ ID NO: 939102 - RNA, 21 nt, Human
caccccacaccgcugcacaga

SEQ ID NO: 939103 - RNA, 20 nt, Human
caccugggagccagaggggc

SEQ ID NO: 939104 - RNA, 25 nt, Human
cacgcgcgcgcacacacacgcagcg

SEQ ID NO: 939105 - RNA, 21 nt, Human
cacugucggcugugggaccug

SEQ ID NO: 939106 - RNA, 20 nt, Human
cagaccccgagaagcacagg

SEQ ID NO: 939107 - RNA, 18 nt, Human
cagcguagggagagcugg

SEQ ID NO: 939108 - RNA, 21 nt, Human
cagcguagggagagcugggga

SEQ ID NO: 939109 - RNA, 19 nt, Human
cagcugcacgaggguuccc

SEQ ID NO: 939110 - RNA, 20 nt, Human
cagggcgcggcggcgggcgg

SEQ ID NO: 939111 - RNA, 22 nt, Human
cagggcugggaagcucugggcc

SEQ ID NO: 939112 - RNA, 22 nt, Human
cccacaccgcugcacagagagg

SEQ ID NO: 939113 - RNA, 22 nt, Human
cccagaagaaaacaggguuccc

SEQ ID NO: 939114 - RNA, 19 nt, Human
ccccacaccgcugcacaga

SEQ ID NO: 939115 - RNA, 25 nt, Human
ccccagaggcuccugcccggccccc

SEQ ID NO: 939116 - RNA, 19 nt, Human
ccccagggguuacugcagc

SEQ ID NO: 939117 - RNA, 22 nt, Human
cccccaccaccaucacccgagg

SEQ ID NO: 939118 - RNA, 21 nt, Human
ccccgggcccugggacuuccc

SEQ ID NO: 939119 - RNA, 22 nt, Human
cccggucuuuggcggccccagc

SEQ ID NO: 939120 - RNA, 18 nt, Human
cccuccugcucugcugug

SEQ ID NO: 939121 - RNA, 24 nt, Human
cccucugccccuuuggcagccccg

SEQ ID NO: 939122 - RNA, 20 nt, Human
cccuuucucccucuccucuc

SEQ ID NO: 939123 - RNA, 21 nt, Human
cccuuucucccucuccucucc

SEQ ID NO: 939124 - RNA, 19 nt, Human
ccguccuucccccaccacc

SEQ ID NO: 939125 - RNA, 23 nt, Human
ccuccaaguuuacacugauuuac

SEQ ID NO: 939126 - RNA, 18 nt, Human
ccuggaggccccagagcu

SEQ ID NO: 939127 - RNA, 20 nt, Human
ccuggaggccccagagcugg

SEQ ID NO: 939128 - RNA, 21 nt, Human
ccugggacuucccuuucuccc

SEQ ID NO: 939129 - RNA, 23 nt, Human
ccuguggagaagcagcaccuggg

SEQ ID NO: 939130 - RNA, 22 nt, Human
ccuugcccacccguccuucccc

SEQ ID NO: 939131 - RNA, 26 nt, Human
cgaggaggccgggggacgggggccgg

SEQ ID NO: 939132 - RNA, 27 nt, Human
cgcgcgcgcacacacacgcagcgggug

SEQ ID NO: 939133 - RNA, 20 nt, Human
cgcucagggcgcggcggcgg

SEQ ID NO: 939134 - RNA, 21 nt, Human
cgcucgggcccugcucugucc

SEQ ID NO: 939135 - RNA, 24 nt, Human
cggcggcgcggcgggcgcaggccc

SEQ ID NO: 939136 - RNA, 18 nt, Human
cggcucaacaugggugac

SEQ ID NO: 939137 - RNA, 24 nt, Human
cgggggacgggggccgaggaggcc

SEQ ID NO: 939138 - RNA, 18 nt, Human
cgggggccgaggaggccg

SEQ ID NO: 939139 - RNA, 18 nt, Human
cgggggccgaggaggccg

SEQ ID NO: 939140 - RNA, 23 nt, Human
cucauccucuguggaccccgggc

SEQ ID NO: 939141 - RNA, 23 nt, Human
cugggcccacccgggaaugcugg

SEQ ID NO: 939142 - RNA, 20 nt, Human
cuucccugcccucucccucc

SEQ ID NO: 939143 - RNA, 26 nt, Human
cuucgcaccgcgccucagcugcccuc

SEQ ID NO: 939144 - RNA, 18 nt, Human
gaagaaaacaggguuccc

SEQ ID NO: 939145 - RNA, 18 nt, Human
gagaagcagcaccuggga

SEQ ID NO: 939146 - RNA, 23 nt, Human
gagcggcucaacaugggugacac

SEQ ID NO: 939147 - RNA, 23 nt, Human
gccacauggccuggaggccccag

SEQ ID NO: 939148 - RNA, 18 nt, Human
gcccacccguccuucccc

SEQ ID NO: 939149 - RNA, 22 nt, Human
gccucagcugcccucggcccgg

SEQ ID NO: 939150 - RNA, 19 nt, Human
gccugggaagugcgugggg

SEQ ID NO: 939151 - RNA, 25 nt, Human
gccuugcccacccguccuuccccca

SEQ ID NO: 939152 - RNA, 20 nt, Human
gcgcgcgcggggcgcccggg

SEQ ID NO: 939153 - RNA, 19 nt, Human
gcgcggcggcgggcgcggg

SEQ ID NO: 939154 - RNA, 22 nt, Human
gcgcgggcgggcgcgcgcgggg

SEQ ID NO: 939155 - RNA, 20 nt, Human
gcugcccucggcccggcggc

SEQ ID NO: 939156 - RNA, 24 nt, Human
gcuggcgcucgggcccugcucugu

SEQ ID NO: 939157 - RNA, 23 nt, Human
gcugugggaccugcuggucuugg

SEQ ID NO: 939158 - RNA, 21 nt, Human
ggaacagccacauggccugga

SEQ ID NO: 939159 - RNA, 19 nt, Human
ggacggcccugccacaacc

SEQ ID NO: 939160 - RNA, 26 nt, Human
ggacgggggccgaggaggccggggga

SEQ ID NO: 939161 - RNA, 21 nt, Human
ggacugggccgugggaacagc

SEQ ID NO: 939162 - RNA, 18 nt, Human
ggcauccacccugcccag

SEQ ID NO: 939163 - RNA, 25 nt, Human
ggccacacguacacgcgcgcgcaca

SEQ ID NO: 939164 - RNA, 18 nt, Human
ggcccggcggcgcggcgg

SEQ ID NO: 939165 - RNA, 26 nt, Human
ggccugggaagugcguggggagggug

SEQ ID NO: 939166 - RNA, 18 nt, Human
ggcgcggcggcgggcgcg

SEQ ID NO: 939167 - RNA, 22 nt, Human
ggcgcggcggcgggcgcgggca

SEQ ID NO: 939168 - RNA, 20 nt, Human
gggcgcaggcccauggcggc

SEQ ID NO: 939169 - RNA, 22 nt, Human
ggggaacgcaccagccuugccc

SEQ ID NO: 939170 - RNA, 19 nt, Human
ggguucccugcaugcucug

SEQ ID NO: 939171 - RNA, 22 nt, Human
ggguuggggcaggcccgcgguc

SEQ ID NO: 939172 - RNA, 18 nt, Human
ggucaucucagguccuga

SEQ ID NO: 939173 - RNA, 21 nt, Human
ggucuuuggcggccccagcuc

SEQ ID NO: 939174 - RNA, 20 nt, Human
gguggccagucuuggugaug

SEQ ID NO: 939175 - RNA, 18 nt, Human
guggagaagcagcaccug

SEQ ID NO: 939176 - RNA, 24 nt, Human
uaaggaggcugaggcgccugaggu

SEQ ID NO: 939177 - RNA, 23 nt, Human
uauauauauauuucauguguaua

SEQ ID NO: 939178 - RNA, 24 nt, Human
uauuaaaaaauugaucaaccuuca

SEQ ID NO: 939179 - RNA, 24 nt, Human
uauuucauguguauacacagucga

SEQ ID NO: 939180 - RNA, 18 nt, Human
ucaaucuauaaaaaauac

SEQ ID NO: 939181 - RNA, 20 nt, Human
ucaggagcggcucaacaugg

SEQ ID NO: 939182 - RNA, 19 nt, Human
ucauggccagcuugacuca

SEQ ID NO: 939183 - RNA, 19 nt, Human
uccaccacccucugccccu

SEQ ID NO: 939184 - RNA, 20 nt, Human
uccaggguguuggagucccg

SEQ ID NO: 939185 - RNA, 18 nt, Human
uccccaaauguacaauaa

SEQ ID NO: 939186 - RNA, 18 nt, Human
ucccucuccucuccacca

SEQ ID NO: 939187 - RNA, 18 nt, Human
ucccugcaugcucugggc

SEQ ID NO: 939188 - RNA, 23 nt, Human
uccgaggugagggucugggagga

SEQ ID NO: 939189 - RNA, 20 nt, Human
ucgcaccgcgccucagcugc

SEQ ID NO: 939190 - RNA, 23 nt, Human
ucgcaccgcgccucagcugcccu

SEQ ID NO: 939191 - RNA, 19 nt, Human
ucgcccaucuucgcaccgc

SEQ ID NO: 939192 - RNA, 23 nt, Human
ucuaagugagacacacccagaag

SEQ ID NO: 939193 - RNA, 20 nt, Human
ucucccucuccucuccacca

SEQ ID NO: 939194 - RNA, 24 nt, Human
ucuccucuccaccacccucugccc

SEQ ID NO: 939195 - RNA, 23 nt, Human
ugaaaguauuaaaaaauugauca

SEQ ID NO: 939196 - RNA, 23 nt, Human
ugacaccgcugugccuggggugc

SEQ ID NO: 939197 - RNA, 19 nt, Human
ugagacacacccagaagaa

SEQ ID NO: 939198 - RNA, 22 nt, Human
ugagacacacccagaagaaaaa

SEQ ID NO: 939199 - RNA, 24 nt, Human
ugauuuacacccaaggcuuucccc

SEQ ID NO: 939200 - RNA, 18 nt, Human
ugcacagagaggcucucc

SEQ ID NO: 939201 - RNA, 20 nt, Human
ugcaugcucugggcacuguc

SEQ ID NO: 939202 - RNA, 25 nt, Human
ugcuggggcuggcgcucgggcccug

SEQ ID NO: 939203 - RNA, 18 nt, Human
ugcuggggguuggggcag

SEQ ID NO: 939204 - RNA, 20 nt, Human
uggaaggcggcggauguggg

SEQ ID NO: 939205 - RNA, 20 nt, Human
uggcagccccggucuuuggc

SEQ ID NO: 939206 - RNA, 21 nt, Human
uggccagucuuggugaugggg

SEQ ID NO: 939207 - RNA, 20 nt, Human
uggccuggaggccccagagc

SEQ ID NO: 939208 - RNA, 23 nt, Human
uggccugggaagugcguggggag

SEQ ID NO: 939209 - RNA, 19 nt, Human
uggcgggggacgggggccg

SEQ ID NO: 939210 - RNA, 18 nt, Human
ugggaagugcguggggag

SEQ ID NO: 939211 - RNA, 22 nt, Human
ugggagccagaggggccugugg

SEQ ID NO: 939212 - RNA, 23 nt, Human
uggggaggguguggccuuuagga

SEQ ID NO: 939213 - RNA, 20 nt, Human
uggggcaggcccgcgguccu

SEQ ID NO: 939214 - RNA, 21 nt, Human
uggguggcuuaggcagcagca

SEQ ID NO: 939215 - RNA, 19 nt, Human
uggucuuggcuccucaugg

SEQ ID NO: 939216 - RNA, 22 nt, Human
uguggagaagcagcaccuggga

SEQ ID NO: 939217 - RNA, 21 nt, Human
uguuggagucccgaauccagc

SEQ ID NO: 939218 - RNA, 21 nt, Human
uuggggcaggcccgcgguccu

SEQ ID NO: 939219 - RNA, 18 nt, Human
aagaagagaucgagagcu

SEQ ID NO: 939220 - RNA, 25 nt, Human
aagaagagaucgagagcugggguuu

SEQ ID NO: 939221 - RNA, 21 nt, Human
acagcgcaggggccacaggga

SEQ ID NO: 939222 - RNA, 18 nt, Human
acggggacggggcaacag

SEQ ID NO: 939223 - RNA, 23 nt, Human
agcgcaggggccacagggagaag

SEQ ID NO: 939224 - RNA, 22 nt, Human
agcgggugggcgcugagagccc

SEQ ID NO: 939225 - RNA, 21 nt, Human
aggggagagggggggacgggc

SEQ ID NO: 939226 - RNA, 21 nt, Human
agucggccaaggaaaagggga

SEQ ID NO: 939227 - RNA, 23 nt, Human
cagaggugggaggccugugcgag

SEQ ID NO: 939228 - RNA, 21 nt, Human
cagcagggaggggccagagga

SEQ ID NO: 939229 - RNA, 19 nt, Human
cagccccaccacaaacacc

SEQ ID NO: 939230 - RNA, 20 nt, Human
cagggagggccgagagggcg

SEQ ID NO: 939231 - RNA, 21 nt, Human
caggggccacagggagaagaa

SEQ ID NO: 939232 - RNA, 19 nt, Human
ccagaccagauggggagac

SEQ ID NO: 939233 - RNA, 20 nt, Human
ccagccccguccauccugcc

SEQ ID NO: 939234 - RNA, 20 nt, Human
ccgccugccccggcccccgc

SEQ ID NO: 939235 - RNA, 23 nt, Human
ccguggcgggggcgggcggagga

SEQ ID NO: 939236 - RNA, 18 nt, Human
ccugccgcccuccccacc

SEQ ID NO: 939237 - RNA, 22 nt, Human
ccugccgcccuccccaccccgc

SEQ ID NO: 939238 - RNA, 22 nt, Human
ccuguccuuccugggccccggc

SEQ ID NO: 939239 - RNA, 18 nt, Human
ccugugcgagcugcugug

SEQ ID NO: 939240 - RNA, 19 nt, Human
cgcccguccuccucgccuc

SEQ ID NO: 939241 - RNA, 21 nt, Human
cgccguccgcccguccuccuc

SEQ ID NO: 939242 - RNA, 19 nt, Human
cgcugccugguucuucggg

SEQ ID NO: 939243 - RNA, 20 nt, Human
cggccacagagggacagcag

SEQ ID NO: 939244 - RNA, 23 nt, Human
cgggugggcgcugagagcccggg

SEQ ID NO: 939245 - RNA, 19 nt, Human
cgugcacgcacgcugggug

SEQ ID NO: 939246 - RNA, 22 nt, Human
cguggcgggggcgggcggagga

SEQ ID NO: 939247 - RNA, 22 nt, Human
gagcugcugugugcggaggagc

SEQ ID NO: 939248 - RNA, 18 nt, Human
gcagggaggggccagagg

SEQ ID NO: 939249 - RNA, 22 nt, Human
gccccaccacaaacacccgacg

SEQ ID NO: 939250 - RNA, 20 nt, Human
ggacagggagggccgagagg

SEQ ID NO: 939251 - RNA, 20 nt, Human
ggagaagaagagaucgagag

SEQ ID NO: 939252 - RNA, 19 nt, Human
ggagacgagacagaggagg

SEQ ID NO: 939253 - RNA, 20 nt, Human
ggagaggggaggggagaggg

SEQ ID NO: 939254 - RNA, 19 nt, Human
ggaggagcgggugggcgcu

SEQ ID NO: 939255 - RNA, 20 nt, Human
ggaggccugugcgagcugcu

SEQ ID NO: 939256 - RNA, 23 nt, Human
ggaggggagaggggagagggggg

SEQ ID NO: 939257 - RNA, 21 nt, Human
ggccacagggagaagaagaga

SEQ ID NO: 939258 - RNA, 21 nt, Human
ggcccggccgugcagagcuca

SEQ ID NO: 939259 - RNA, 20 nt, Human
ggcggggugacggggacggg

SEQ ID NO: 939260 - RNA, 19 nt, Human
gggagaggggagagggggg

SEQ ID NO: 939261 - RNA, 24 nt, Human
ggggacagggagggccgagagggc

SEQ ID NO: 939262 - RNA, 21 nt, Human
ggggagacgagacagaggagg

SEQ ID NO: 939263 - RNA, 20 nt, Human
ggggagagggggggacgggc

SEQ ID NO: 939264 - RNA, 24 nt, Human
ggggagagggggggacgggcuucu

SEQ ID NO: 939265 - RNA, 22 nt, Human
ggggaggggagaggggagaggg

SEQ ID NO: 939266 - RNA, 23 nt, Human
ggggcaacagcgcaggggccaca

SEQ ID NO: 939267 - RNA, 21 nt, Human
ggggguccgccugccccggcc

SEQ ID NO: 939268 - RNA, 22 nt, Human
guccauccugccgcccucccca

SEQ ID NO: 939269 - RNA, 18 nt, Human
gugcaggagaggggaggg

SEQ ID NO: 939270 - RNA, 22 nt, Human
uaacaaaaaccaaaggcuacaa

SEQ ID NO: 939271 - RNA, 26 nt, Human
uagagucggccaaggaaaaggggaga

SEQ ID NO: 939272 - RNA, 23 nt, Human
ucacuugcaaacagguuccagac

SEQ ID NO: 939273 - RNA, 18 nt, Human
uccagaccagauggggag

SEQ ID NO: 939274 - RNA, 22 nt, Human
ucccugcaucaaucaacaggca

SEQ ID NO: 939275 - RNA, 19 nt, Human
uccgcccguccuccucgcc

SEQ ID NO: 939276 - RNA, 18 nt, Human
uccgccugccccggcccc

SEQ ID NO: 939277 - RNA, 19 nt, Human
ucucuacauuaacaaaaac

SEQ ID NO: 939278 - RNA, 21 nt, Human
ugcggaggagcgggugggcgc

SEQ ID NO: 939279 - RNA, 24 nt, Human
ugcugugugcggaggagcgggugg

SEQ ID NO: 939280 - RNA, 23 nt, Human
uucuggguggggacgacgggcug

SEQ ID NO: 939281 - RNA, 20 nt, Human
uuuggcccagagcacgguuc

SEQ ID NO: 939282 - RNA, 21 nt, Human
aaaaacccuauuauaguucag

SEQ ID NO: 939283 - RNA, 23 nt, Human
aaaaagacuucaacauuguacug

SEQ ID NO: 939284 - RNA, 19 nt, Human
aaaaaguuaaacaaagaca

SEQ ID NO: 939285 - RNA, 19 nt, Human
aaaaaguuaaacaaagaca

SEQ ID NO: 939286 - RNA, 22 nt, Human
aaacaaaagcaguuauagaacc

SEQ ID NO: 939287 - RNA, 19 nt, Human
aaacaauaaaacccacugu

SEQ ID NO: 939288 - RNA, 21 nt, Human
aaaccaccaaccaaaaaaaaa

SEQ ID NO: 939289 - RNA, 20 nt, Human
aaagaaauuguacuaccucu

SEQ ID NO: 939290 - RNA, 22 nt, Human
aacacugccagcaccaaggggu

SEQ ID NO: 939291 - RNA, 19 nt, Human
aacagcagaccugugguuc

SEQ ID NO: 939292 - RNA, 24 nt, Human
aacauggucacauauaggucauac

SEQ ID NO: 939293 - RNA, 21 nt, Human
aaccguacagugagacaaagc

SEQ ID NO: 939294 - RNA, 21 nt, Human
aagaacaguuaagaaaaucag

SEQ ID NO: 939295 - RNA, 24 nt, Human
aagaggcaggugacugcacaagca

SEQ ID NO: 939296 - RNA, 21 nt, Human
aaggagaacagcaucagccac

SEQ ID NO: 939297 - RNA, 24 nt, Human
aaggagaacagcaucagccaccaa

SEQ ID NO: 939298 - RNA, 19 nt, Human
aagguauaaaagcuuaaaa

SEQ ID NO: 939299 - RNA, 23 nt, Human
aagguuuuuauuccaaaacaguu

SEQ ID NO: 939300 - RNA, 18 nt, Human
aauuucacagcaauaaac

SEQ ID NO: 939301 - RNA, 20 nt, Human
acacaagaauaaagcugugg

SEQ ID NO: 939302 - RNA, 22 nt, Human
acagaauauaccaaucuacucc

SEQ ID NO: 939303 - RNA, 20 nt, Human
acagaguuuuuucuuuuuuu

SEQ ID NO: 939304 - RNA, 22 nt, Human
acaugaacccucucuauauucc

SEQ ID NO: 939305 - RNA, 24 nt, Human
accaaagccuacuuucugcacauu

SEQ ID NO: 939306 - RNA, 23 nt, Human
accacauguuuacaacccagaag

SEQ ID NO: 939307 - RNA, 21 nt, Human
accaccaaccaaaaaaaaaua

SEQ ID NO: 939308 - RNA, 26 nt, Human
acgcagcgggagagggggcgggggcg

SEQ ID NO: 939309 - RNA, 19 nt, Human
acugucuuaccgaauuuga

SEQ ID NO: 939310 - RNA, 25 nt, Human
agaaggcaucuuucaaaacaaaacu

SEQ ID NO: 939311 - RNA, 20 nt, Human
agaaucuggcucccgguaca

SEQ ID NO: 939312 - RNA, 22 nt, Human
agcacaagcgcugaaacaccuu

SEQ ID NO: 939313 - RNA, 22 nt, Human
agcacgagagagaagauaaaug

SEQ ID NO: 939314 - RNA, 18 nt, Human
agcagaccugugguucug

SEQ ID NO: 939315 - RNA, 20 nt, Human
agccaccaaaugugcugauc

SEQ ID NO: 939316 - RNA, 18 nt, Human
agccacugaaucauaaau

SEQ ID NO: 939317 - RNA, 21 nt, Human
agcgggagagggggcgggggc

SEQ ID NO: 939318 - RNA, 26 nt, Human
aggaaauuuauccaaaacaaaacaaa

SEQ ID NO: 939319 - RNA, 24 nt, Human
aggagcucuuuccagcauaauguc

SEQ ID NO: 939320 - RNA, 23 nt, Human
auaaaacauguuguccaaaaaaa

SEQ ID NO: 939321 - RNA, 20 nt, Human
auccaaaacaaaacaaaagc

SEQ ID NO: 939322 - RNA, 22 nt, Human
auguacuuuuauguuagugucu

SEQ ID NO: 939323 - RNA, 23 nt, Human
auuaaaccguacagugagacaaa

SEQ ID NO: 939324 - RNA, 23 nt, Human
caaaaacaauaaaacccacugua

SEQ ID NO: 939325 - RNA, 27 nt, Human
caaaaacaauaaaacccacuguaacua

SEQ ID NO: 939326 - RNA, 22 nt, Human
caaaacaaaacaaaagcaguua

SEQ ID NO: 939327 - RNA, 24 nt, Human
caaaacaaaacuugauuucuuuug

SEQ ID NO: 939328 - RNA, 25 nt, Human
caaaacaaaagcaguuauagaaccc

SEQ ID NO: 939329 - RNA, 26 nt, Human
caaaacaaaagcaguuauagaacccc

SEQ ID NO: 939330 - RNA, 25 nt, Human
caacagacagaggugaaaggucaaa

SEQ ID NO: 939331 - RNA, 24 nt, Human
caacaugacauaaaacagccccuc

SEQ ID NO: 939332 - RNA, 22 nt, Human
caaccucaagaggcaggugacu

SEQ ID NO: 939333 - RNA, 22 nt, Human
caagaggcaggugacugcacaa

SEQ ID NO: 939334 - RNA, 23 nt, Human
cacaagcgcugaaacaccccccu

SEQ ID NO: 939335 - RNA, 19 nt, Human
cacaugcauaugauagaau

SEQ ID NO: 939336 - RNA, 27 nt, Human
caccugaagaaaaacccuauuauaguu

SEQ ID NO: 939337 - RNA, 19 nt, Human
cacugaaucauaaaugcaa

SEQ ID NO: 939338 - RNA, 18 nt, Human
cagaaaauaaugcaacca

SEQ ID NO: 939339 - RNA, 19 nt, Human
cagcagaccugugguucug

SEQ ID NO: 939340 - RNA, 18 nt, Human
caggccgagaggugcaga

SEQ ID NO: 939341 - RNA, 22 nt, Human
cauauaggucauacuguacaaa

SEQ ID NO: 939342 - RNA, 19 nt, Human
ccaaaacaaaacaaaagca

SEQ ID NO: 939343 - RNA, 21 nt, Human
ccaaaacuacugucuuaccga

SEQ ID NO: 939344 - RNA, 21 nt, Human
ccaagggcaaugagcaaccuc

SEQ ID NO: 939345 - RNA, 22 nt, Human
ccagcauaauguccccaaacac

SEQ ID NO: 939346 - RNA, 21 nt, Human
ccaguaaucaauuuauuuucu

SEQ ID NO: 939347 - RNA, 20 nt, Human
cccaaacacugccagcacca

SEQ ID NO: 939348 - RNA, 18 nt, Human
cgaccgaggcgccggcag

SEQ ID NO: 939349 - RNA, 22 nt, Human
cgaccgaggcgccggcagguac

SEQ ID NO: 939350 - RNA, 20 nt, Human
cggcagcaguagcggcagua

SEQ ID NO: 939351 - RNA, 23 nt, Human
cgggagagggggcgggggcgguc

SEQ ID NO: 939352 - RNA, 21 nt, Human
cguguaaaccaccaaccaaaa

SEQ ID NO: 939353 - RNA, 24 nt, Human
cuccagaaaucuuauuuuuuaaaa

SEQ ID NO: 939354 - RNA, 18 nt, Human
gaagguaauuauuugguc

SEQ ID NO: 939355 - RNA, 21 nt, Human
gacacaauuuucugggccugu

SEQ ID NO: 939356 - RNA, 20 nt, Human
gaggugcagacgcgccggcc

SEQ ID NO: 939357 - RNA, 24 nt, Human
gcagaccugugguucuggucccag

SEQ ID NO: 939358 - RNA, 21 nt, Human
ggaagguaauuauuuggucuu

SEQ ID NO: 939359 - RNA, 21 nt, Human
ggagaacagcaucagccacca

SEQ ID NO: 939360 - RNA, 23 nt, Human
ggcgccggcagguacacuggcag

SEQ ID NO: 939361 - RNA, 20 nt, Human
gggagagggggcgggggcgg

SEQ ID NO: 939362 - RNA, 21 nt, Human
gggcaaaaaaguuccccaaaa

SEQ ID NO: 939363 - RNA, 19 nt, Human
ggugaaaggucaaaugagg

SEQ ID NO: 939364 - RNA, 18 nt, Human
uaaaaaaagauaaagcua

SEQ ID NO: 939365 - RNA, 22 nt, Human
uaaaaaguuaaacaaagacaaa

SEQ ID NO: 939366 - RNA, 23 nt, Human
uaaaacagccccucacacuguga

SEQ ID NO: 939367 - RNA, 19 nt, Human
uaaaaugccacaugaaccc

SEQ ID NO: 939368 - RNA, 21 nt, Human
uaaaaugccacaugaacccuc

SEQ ID NO: 939369 - RNA, 19 nt, Human
uaaauauacacacacacca

SEQ ID NO: 939370 - RNA, 27 nt, Human
uaaauauacacacacaccagcagguca

SEQ ID NO: 939371 - RNA, 21 nt, Human
uaaauccuucagucacaaaaa

SEQ ID NO: 939372 - RNA, 22 nt, Human
uaacauggucacauauagguca

SEQ ID NO: 939373 - RNA, 20 nt, Human
uaagaaaaaugccacccaca

SEQ ID NO: 939374 - RNA, 22 nt, Human
uaagauaucaccaaauuaaacc

SEQ ID NO: 939375 - RNA, 18 nt, Human
uaaggcaagaaugcagcc

SEQ ID NO: 939376 - RNA, 20 nt, Human
uaaggcaagaaugcagccug

SEQ ID NO: 939377 - RNA, 23 nt, Human
uacacacacaccagcaggucaug

SEQ ID NO: 939378 - RNA, 19 nt, Human
uacacugaaaaggguugac

SEQ ID NO: 939379 - RNA, 19 nt, Human
uaccaucagaaguaauuuc

SEQ ID NO: 939380 - RNA, 22 nt, Human
uagaaucuggcucccgguacag

SEQ ID NO: 939381 - RNA, 23 nt, Human
uagcaaaaugcuaaaaggccugg

SEQ ID NO: 939382 - RNA, 23 nt, Human
uagugucuguaaagagggauuua

SEQ ID NO: 939383 - RNA, 23 nt, Human
uauaaaagcuuaaaaugugcaau

SEQ ID NO: 939384 - RNA, 21 nt, Human
uauggacagugcugcaauaaa

SEQ ID NO: 939385 - RNA, 24 nt, Human
uauuaauacacaguaaguucuaga

SEQ ID NO: 939386 - RNA, 19 nt, Human
uauuuggucuuuucuucug

SEQ ID NO: 939387 - RNA, 22 nt, Human
ucacacugugaacacagggaua

SEQ ID NO: 939388 - RNA, 19 nt, Human
ucacuguaagucuuuaaca

SEQ ID NO: 939389 - RNA, 21 nt, Human
uccaaaacaaaacaaaagcag

SEQ ID NO: 939390 - RNA, 24 nt, Human
uccaaaacaguuauuuggcuagac

SEQ ID NO: 939391 - RNA, 19 nt, Human
uccaaagaaauuguacuac

SEQ ID NO: 939392 - RNA, 23 nt, Human
uccaaagaaauuguacuaccucu

SEQ ID NO: 939393 - RNA, 20 nt, Human
uccacaaauuaaccaaagcc

SEQ ID NO: 939394 - RNA, 22 nt, Human
uccacaaauuaaccaaagccua

SEQ ID NO: 939395 - RNA, 24 nt, Human
uccauaaaaaagacuucaacauug

SEQ ID NO: 939396 - RNA, 23 nt, Human
ucuagaaggcaucuuucaaaaca

SEQ ID NO: 939397 - RNA, 19 nt, Human
ucuuuucucuaaaaugcca

SEQ ID NO: 939398 - RNA, 21 nt, Human
ucuuuuguauuuacauuuuuu

SEQ ID NO: 939399 - RNA, 24 nt, Human
ugaaacaccuuuagaaacacuuuc

SEQ ID NO: 939400 - RNA, 19 nt, Human
ugaaagugacaauuuauua

SEQ ID NO: 939401 - RNA, 21 nt, Human
ugaagaguacagcagucugaa

SEQ ID NO: 939402 - RNA, 23 nt, Human
ugaauaaauccuucagucacaaa

SEQ ID NO: 939403 - RNA, 23 nt, Human
ugaccauuccaagaagauaaagg

SEQ ID NO: 939404 - RNA, 20 nt, Human
ugacuauacaauacucuggu

SEQ ID NO: 939405 - RNA, 22 nt, Human
ugacuauacaauacucugguac

SEQ ID NO: 939406 - RNA, 22 nt, Human
ugagacaaagccuugccaaagg

SEQ ID NO: 939407 - RNA, 18 nt, Human
ugcaaagauggaacagaa

SEQ ID NO: 939408 - RNA, 19 nt, Human
ugcaauaaaaaaaaucaac

SEQ ID NO: 939409 - RNA, 19 nt, Human
ugcacauuccaguuuuggc

SEQ ID NO: 939410 - RNA, 22 nt, Human
ugccacccacacaacaggaaau

SEQ ID NO: 939411 - RNA, 26 nt, Human
ugcugguggcugggcagcuuuccggg

SEQ ID NO: 939412 - RNA, 27 nt, Human
ugcugguggcugggcagcuuuccgggc

SEQ ID NO: 939413 - RNA, 20 nt, Human
ugggaagaaaggcuuaagau

SEQ ID NO: 939414 - RNA, 22 nt, Human
ugggacacaauuuucugggccu

SEQ ID NO: 939415 - RNA, 22 nt, Human
ugggcaaaaaaguuccccaaaa

SEQ ID NO: 939416 - RNA, 18 nt, Human
ugguuuguuuguuuuguu

SEQ ID NO: 939417 - RNA, 18 nt, Human
ugugguucugacugucca

SEQ ID NO: 939418 - RNA, 23 nt, Human
uguuagugucuguaaagagggau

SEQ ID NO: 939419 - RNA, 23 nt, Human
uuaauagcauuuuguuacaucaa

SEQ ID NO: 939420 - RNA, 20 nt, Human
uuacaauaugacaaucugcu

SEQ ID NO: 939421 - RNA, 22 nt, Human
uucacuguaggguuaaaaaugc

SEQ ID NO: 939422 - RNA, 18 nt, Human
uucagaaucugaccauuc

SEQ ID NO: 939423 - RNA, 19 nt, Human
uucccacaugaagaggaau

SEQ ID NO: 939424 - RNA, 23 nt, Human
uucugggccuguguugaaugagg

SEQ ID NO: 939425 - RNA, 25 nt, Human
uugcugguggcugggcagcuuuccg

SEQ ID NO: 939426 - RNA, 27 nt, Human
uugcugguggcugggcagcuuuccggg

SEQ ID NO: 939427 - RNA, 18 nt, Human
uugugaacugcaguugug

SEQ ID NO: 939428 - RNA, 20 nt, Human
uuguuuuguuuuuguaaaua

SEQ ID NO: 939429 - RNA, 25 nt, Human
uuuaaaaucccuuaacagcagaccu

SEQ ID NO: 939430 - RNA, 23 nt, Human
uuucacagcaauaaacuuauugg

SEQ ID NO: 939431 - RNA, 18 nt, Human
uuugugugaaauggaagg

SEQ ID NO: 939432 - RNA, 22 nt, Human
aaagcaggugacccgggagcac

SEQ ID NO: 939433 - RNA, 21 nt, Human
aagcaggugggcccaggcucc

SEQ ID NO: 939434 - RNA, 19 nt, Human
acgccagaucuuccucugg

SEQ ID NO: 939435 - RNA, 21 nt, Human
acuggcugugggaagugguuu

SEQ ID NO: 939436 - RNA, 20 nt, Human
acuuccaggaacaucuaggg

SEQ ID NO: 939437 - RNA, 22 nt, Human
agaagccaucccuggcugagcc

SEQ ID NO: 939438 - RNA, 25 nt, Human
agaagccaucccuggcugagcccug

SEQ ID NO: 939439 - RNA, 20 nt, Human
agagaaaagaauauuccggu

SEQ ID NO: 939440 - RNA, 24 nt, Human
agaggucaagagcagcagccucgg

SEQ ID NO: 939441 - RNA, 22 nt, Human
aggaaaaacugcauacgcagua

SEQ ID NO: 939442 - RNA, 21 nt, Human
aggugacccgggagcaccugc

SEQ ID NO: 939443 - RNA, 24 nt, Human
aucuuccucuggcaguucccacug

SEQ ID NO: 939444 - RNA, 24 nt, Human
augguaucaguggggauagggcac

SEQ ID NO: 939445 - RNA, 21 nt, Human
caacagcccagaagagaaaag

SEQ ID NO: 939446 - RNA, 21 nt, Human
caaccccccagaagcaggugg

SEQ ID NO: 939447 - RNA, 24 nt, Human
caaccccccagaagcaggugggcc

SEQ ID NO: 939448 - RNA, 22 nt, Human
caccacauugccagccgggaga

SEQ ID NO: 939449 - RNA, 24 nt, Human
cacuugaaaaaccaacagcccaga

SEQ ID NO: 939450 - RNA, 21 nt, Human
cagaaacucagcuucaccaca

SEQ ID NO: 939451 - RNA, 27 nt, Human
cagaagagaaaagaauauuccggucag

SEQ ID NO: 939452 - RNA, 23 nt, Human
cagagcaaugcccacuggacccc

SEQ ID NO: 939453 - RNA, 24 nt, Human
cagagcaaugcccacuggacccca

SEQ ID NO: 939454 - RNA, 26 nt, Human
cagaggcaacugaguuuuuuuuuuuu

SEQ ID NO: 939455 - RNA, 19 nt, Human
caggugggcccaggcucca

SEQ ID NO: 939456 - RNA, 23 nt, Human
cauuccaguccugcauuuccugg

SEQ ID NO: 939457 - RNA, 19 nt, Human
cauuggacagaaacucagc

SEQ ID NO: 939458 - RNA, 20 nt, Human
cauuggacagaaacucagcu

SEQ ID NO: 939459 - RNA, 21 nt, Human
ccaccaccuccaucuggccug

SEQ ID NO: 939460 - RNA, 23 nt, Human
ccaccuccaucuggccugcuccc

SEQ ID NO: 939461 - RNA, 22 nt, Human
ccacugcccccagcugcccuuc

SEQ ID NO: 939462 - RNA, 25 nt, Human
ccacugcccccagcugcccuuccca

SEQ ID NO: 939463 - RNA, 18 nt, Human
ccagcugcccuucccagg

SEQ ID NO: 939464 - RNA, 23 nt, Human
ccagguggaacaggcacaggcau

SEQ ID NO: 939465 - RNA, 21 nt, Human
ccaguccacagcguugcuacc

SEQ ID NO: 939466 - RNA, 23 nt, Human
cccaccccacagucagucaucgc

SEQ ID NO: 939467 - RNA, 23 nt, Human
cccacugucagcuagaagccauc

SEQ ID NO: 939468 - RNA, 21 nt, Human
cccagcugcccuucccagggg

SEQ ID NO: 939469 - RNA, 22 nt, Human
cccaggggcaacuucaccaaga

SEQ ID NO: 939470 - RNA, 19 nt, Human
ccccagaagcaggugggcc

SEQ ID NO: 939471 - RNA, 23 nt, Human
ccccagcgccaaggucaggccuc

SEQ ID NO: 939472 - RNA, 23 nt, Human
cccccagaagcaggugggcccag

SEQ ID NO: 939473 - RNA, 20 nt, Human
ccccccagaagcaggugggc

SEQ ID NO: 939474 - RNA, 26 nt, Human
cccgggagcaccugcgcgcugccgga

SEQ ID NO: 939475 - RNA, 19 nt, Human
ccgggguuucacuuccagg

SEQ ID NO: 939476 - RNA, 21 nt, Human
ccuccaucuggccugcucccc

SEQ ID NO: 939477 - RNA, 21 nt, Human
ccuggcacccaacuggagccc

SEQ ID NO: 939478 - RNA, 19 nt, Human
ccuuccuuccucucugucc

SEQ ID NO: 939479 - RNA, 23 nt, Human
cgcagagcagaggucaagagcag

SEQ ID NO: 939480 - RNA, 20 nt, Human
cgggagcaccugcgcgcugc

SEQ ID NO: 939481 - RNA, 20 nt, Human
cucccacugucagcuagaag

SEQ ID NO: 939482 - RNA, 24 nt, Human
cuccucccagaagguuucagggca

SEQ ID NO: 939483 - RNA, 22 nt, Human
cuggagcccgcuuuucagcuuu

SEQ ID NO: 939484 - RNA, 18 nt, Human
cuggcaccaccaccucca

SEQ ID NO: 939485 - RNA, 20 nt, Human
cuggccugcuccccaacccc

SEQ ID NO: 939486 - RNA, 26 nt, Human
cuucccaccgucgcugugcugcgggg

SEQ ID NO: 939487 - RNA, 23 nt, Human
cuuuuccaauccuuccuuccucu

SEQ ID NO: 939488 - RNA, 20 nt, Human
gaaaaaccaacagcccagaa

SEQ ID NO: 939489 - RNA, 19 nt, Human
gaauccaccuagagcuggc

SEQ ID NO: 939490 - RNA, 20 nt, Human
gacaggaggagccucuacuc

SEQ ID NO: 939491 - RNA, 20 nt, Human
gaguuuuuuuuuuuuuuuuu

SEQ ID NO: 939492 - RNA, 26 nt, Human
gcaacugaguuuuuuuuuuuuuuuuu

SEQ ID NO: 939493 - RNA, 18 nt, Human
gcacuugaaaaaccaaca

SEQ ID NO: 939494 - RNA, 24 nt, Human
ggaaaacagccgcagagcagaggu

SEQ ID NO: 939495 - RNA, 22 nt, Human
ggaccagagcaaugcccacugg

SEQ ID NO: 939496 - RNA, 21 nt, Human
ggagcaacccagcauugacag

SEQ ID NO: 939497 - RNA, 21 nt, Human
gggcaggaggcuggaccucaa

SEQ ID NO: 939498 - RNA, 19 nt, Human
ggggacuuuuccaauccuu

SEQ ID NO: 939499 - RNA, 22 nt, Human
gugggcccaggcuccaggccag

SEQ ID NO: 939500 - RNA, 19 nt, Human
ucacauuccaguccugcau

SEQ ID NO: 939501 - RNA, 26 nt, Human
ucacuuccaggaucucacuuuggcca

SEQ ID NO: 939502 - RNA, 21 nt, Human
ucacuugcagggagcugaaga

SEQ ID NO: 939503 - RNA, 25 nt, Human
uccacagcguugcuaccugucuccg

SEQ ID NO: 939504 - RNA, 27 nt, Human
uccacaggcaggacaggaccggggucc

SEQ ID NO: 939505 - RNA, 18 nt, Human
uccaggccagugccccca

SEQ ID NO: 939506 - RNA, 18 nt, Human
ucccacuggcugugggaa

SEQ ID NO: 939507 - RNA, 19 nt, Human
uccccaaccccccagaagc

SEQ ID NO: 939508 - RNA, 22 nt, Human
uccccaaccccccagaagcagg

SEQ ID NO: 939509 - RNA, 23 nt, Human
ucccuccacaggcaggacaggac

SEQ ID NO: 939510 - RNA, 25 nt, Human
ucuggccugcuccccaaccccccag

SEQ ID NO: 939511 - RNA, 23 nt, Human
ugaaaaaccaacagcccagaaga

SEQ ID NO: 939512 - RNA, 19 nt, Human
ugaagagccugucaucacc

SEQ ID NO: 939513 - RNA, 19 nt, Human
ugacgccagaucuuccucu

SEQ ID NO: 939514 - RNA, 25 nt, Human
ugaggcagggcaggaggcuggaccu

SEQ ID NO: 939515 - RNA, 23 nt, Human
ugagggggccaccguccaggugg

SEQ ID NO: 939516 - RNA, 21 nt, Human
ugcacuugaaaaaccaacagc

SEQ ID NO: 939517 - RNA, 19 nt, Human
uggaaaacagccgcagagc

SEQ ID NO: 939518 - RNA, 18 nt, Human
uggaagggaacuggcgcc

SEQ ID NO: 939519 - RNA, 23 nt, Human
uggacagaaacucagcuucacca

SEQ ID NO: 939520 - RNA, 22 nt, Human
uggaccucaaagcaggugaccc

SEQ ID NO: 939521 - RNA, 19 nt, Human
uggccugcuccccaacccc

SEQ ID NO: 939522 - RNA, 21 nt, Human
uggccugcuccccaacccccc

SEQ ID NO: 939523 - RNA, 19 nt, Human
uggcgccacugcccccagc

SEQ ID NO: 939524 - RNA, 21 nt, Human
uggcugagcccugcacuggcc

SEQ ID NO: 939525 - RNA, 19 nt, Human
uguccagaggcugccaggc

SEQ ID NO: 939526 - RNA, 23 nt, Human
ugucucagaaucuuccugcucau

SEQ ID NO: 939527 - RNA, 22 nt, Human
uguugcacuugaaaaaccaaca

SEQ ID NO: 939528 - RNA, 21 nt, Human
uuaauuuuuggaggaaaaacu

SEQ ID NO: 939529 - RNA, 20 nt, Human
uuccccacagcccccaggag

SEQ ID NO: 939530 - RNA, 24 nt, Human
uuccccaggcccggucacuugcag

SEQ ID NO: 939531 - RNA, 19 nt, Human
uucccuccacaggcaggac

SEQ ID NO: 939532 - RNA, 18 nt, Human
uuccuuggagcuguaugg

SEQ ID NO: 939533 - RNA, 23 nt, Human
aaagggaggaggugcuagcagag

SEQ ID NO: 939534 - RNA, 20 nt, Human
aaaggggcacggugggcagg

SEQ ID NO: 939535 - RNA, 18 nt, Human
aaccugggagcggggggc

SEQ ID NO: 939536 - RNA, 19 nt, Human
aaggugcccccuccugucc

SEQ ID NO: 939537 - RNA, 24 nt, Human
aauacaagcuggagggcagggcac

SEQ ID NO: 939538 - RNA, 22 nt, Human
acaaaggggcacggugggcagg

SEQ ID NO: 939539 - RNA, 23 nt, Human
acaccccaaagccacagacucaa

SEQ ID NO: 939540 - RNA, 19 nt, Human
acaggcaagagacagcacg

SEQ ID NO: 939541 - RNA, 22 nt, Human
acccacauuccccagagaagua

SEQ ID NO: 939542 - RNA, 23 nt, Human
agaagagcccucguuccaaagaa

SEQ ID NO: 939543 - RNA, 23 nt, Human
agaaggagauggggagcccagga

SEQ ID NO: 939544 - RNA, 22 nt, Human
agagugggugagcagagaggcc

SEQ ID NO: 939545 - RNA, 24 nt, Human
agcagagaggcccccaauccugga

SEQ ID NO: 939546 - RNA, 21 nt, Human
agccucuggcacggugggccu

SEQ ID NO: 939547 - RNA, 18 nt, Human
agcggcaggggaugaggg

SEQ ID NO: 939548 - RNA, 21 nt, Human
agcuggacggcucgagcuggg

SEQ ID NO: 939549 - RNA, 24 nt, Human
aggaagaagaaggagagaacccag

SEQ ID NO: 939550 - RNA, 21 nt, Human
aggcaagagacagcacgaggg

SEQ ID NO: 939551 - RNA, 21 nt, Human
aggcaguggggagaggaaagg

SEQ ID NO: 939552 - RNA, 19 nt, Human
agggagaggaggcaguggg

SEQ ID NO: 939553 - RNA, 19 nt, Human
agggcacaggugggacagg

SEQ ID NO: 939554 - RNA, 20 nt, Human
agggggcagcccagggacuu

SEQ ID NO: 939555 - RNA, 21 nt, Human
aucccagguccuggauccccu

SEQ ID NO: 939556 - RNA, 21 nt, Human
cacaggcccugaguguccucc

SEQ ID NO: 939557 - RNA, 21 nt, Human
caccagaggggaaccugggag

SEQ ID NO: 939558 - RNA, 22 nt, Human
caccccaaagccacagacucaa

SEQ ID NO: 939559 - RNA, 18 nt, Human
cagagggcggcaggagca

SEQ ID NO: 939560 - RNA, 20 nt, Human
cagcaggaagaagaaggaga

SEQ ID NO: 939561 - RNA, 25 nt, Human
cagcaggaagaagaaggagagaacc

SEQ ID NO: 939562 - RNA, 19 nt, Human
cagcaggcagaugggccag

SEQ ID NO: 939563 - RNA, 22 nt, Human
cagcauacaugggggugggagg

SEQ ID NO: 939564 - RNA, 19 nt, Human
cagcccagggacuuaaaua

SEQ ID NO: 939565 - RNA, 24 nt, Human
cagcccagggacuuaaauacaagc

SEQ ID NO: 939566 - RNA, 22 nt, Human
caggaagcagcugugccagagg

SEQ ID NO: 939567 - RNA, 20 nt, Human
caggcccugaguguccuccc

SEQ ID NO: 939568 - RNA, 20 nt, Human
caggcucaagacacaggccc

SEQ ID NO: 939569 - RNA, 19 nt, Human
cagggagaccaaagacuug

SEQ ID NO: 939570 - RNA, 21 nt, Human
caucuuggaaagucaccuaga

SEQ ID NO: 939571 - RNA, 21 nt, Human
ccagaaggagauggggagccc

SEQ ID NO: 939572 - RNA, 19 nt, Human
ccaggacaccccaaagcca

SEQ ID NO: 939573 - RNA, 18 nt, Human
ccagggcaguagaggccg

SEQ ID NO: 939574 - RNA, 21 nt, Human
cccaauccuggauggaaccca

SEQ ID NO: 939575 - RNA, 20 nt, Human
ccccaaagccacagacucaa

SEQ ID NO: 939576 - RNA, 24 nt, Human
cccccaauccuggauggaacccac

SEQ ID NO: 939577 - RNA, 22 nt, Human
cccgcccuagauauacucagau

SEQ ID NO: 939578 - RNA, 20 nt, Human
ccgccugacauggggacaaa

SEQ ID NO: 939579 - RNA, 23 nt, Human
ccuccugucccacuccaugugcc

SEQ ID NO: 939580 - RNA, 20 nt, Human
ccugagguccagcccagggc

SEQ ID NO: 939581 - RNA, 19 nt, Human
ccuggccacauuccucgcc

SEQ ID NO: 939582 - RNA, 21 nt, Human
ccuggccacauuccucgcccu

SEQ ID NO: 939583 - RNA, 18 nt, Human
ccuuagggacccugacag

SEQ ID NO: 939584 - RNA, 21 nt, Human
cuccgcccugccuggccacag

SEQ ID NO: 939585 - RNA, 22 nt, Human
cugcagccagggcaguagaggc

SEQ ID NO: 939586 - RNA, 20 nt, Human
cugcuacccgcccacccgcc

SEQ ID NO: 939587 - RNA, 23 nt, Human
cugcuacccgcccacccgcccua

SEQ ID NO: 939588 - RNA, 19 nt, Human
cuggacggcucgagcuggg

SEQ ID NO: 939589 - RNA, 22 nt, Human
cuggagggcagggcacaggugg

SEQ ID NO: 939590 - RNA, 20 nt, Human
cugucccacuccaugugccc

SEQ ID NO: 939591 - RNA, 21 nt, Human
cugucccacuccaugugcccc

SEQ ID NO: 939592 - RNA, 23 nt, Human
cuucucagggagaccaaagacuu

SEQ ID NO: 939593 - RNA, 21 nt, Human
cuugcaaaaacccucagcuca

SEQ ID NO: 939594 - RNA, 24 nt, Human
cuugcaaaaacccucagcucaccc

SEQ ID NO: 939595 - RNA, 22 nt, Human
gacuaggauccugggugcagag

SEQ ID NO: 939596 - RNA, 20 nt, Human
gagagaacccagugcagcau

SEQ ID NO: 939597 - RNA, 20 nt, Human
gaggugcuagcagagugagg

SEQ ID NO: 939598 - RNA, 23 nt, Human
gauccugggugcagaguggguga

SEQ ID NO: 939599 - RNA, 21 nt, Human
gcacaggugggacaggcaaga

SEQ ID NO: 939600 - RNA, 21 nt, Human
gcagcccagggacuuaaauac

SEQ ID NO: 939601 - RNA, 27 nt, Human
gcaggacagcaggaagaagaaggagag

SEQ ID NO: 939602 - RNA, 18 nt, Human
gcaggagcagucucccuc

SEQ ID NO: 939603 - RNA, 18 nt, Human
gccacauuccucgcccug

SEQ ID NO: 939604 - RNA, 19 nt, Human
gcggcaggggaugagggcc

SEQ ID NO: 939605 - RNA, 23 nt, Human
gcggggggcaccccaagggggca

SEQ ID NO: 939606 - RNA, 18 nt, Human
ggaaccugggagcggggg

SEQ ID NO: 939607 - RNA, 24 nt, Human
ggagaggaaagggugggcugcugg

SEQ ID NO: 939608 - RNA, 20 nt, Human
ggcacggugggcaggcagcg

SEQ ID NO: 939609 - RNA, 28 nt, Human
ggcaggacagcaggaagaagaaggagaa

SEQ ID NO: 939610 - RNA, 21 nt, Human
ggccggggagacccucaguuc

SEQ ID NO: 939611 - RNA, 19 nt, Human
gggaaagggaggaggugcu

SEQ ID NO: 939612 - RNA, 18 nt, Human
gggcaccccaagggggca

SEQ ID NO: 939613 - RNA, 20 nt, Human
gggcacggugggcaggcagc

SEQ ID NO: 939614 - RNA, 23 nt, Human
gggcaggggacuaggauccuggg

SEQ ID NO: 939615 - RNA, 20 nt, Human
gggcucagggcagcaggcag

SEQ ID NO: 939616 - RNA, 22 nt, Human
ggggagcccaggacaccccaaa

SEQ ID NO: 939617 - RNA, 22 nt, Human
ggugcccccuccugucccacuc

SEQ ID NO: 939618 - RNA, 22 nt, Human
guccagcccagggcccuggauc

SEQ ID NO: 939619 - RNA, 21 nt, Human
uaccuuggggaaagggaggag

SEQ ID NO: 939620 - RNA, 19 nt, Human
uaggaagggagaggaggca

SEQ ID NO: 939621 - RNA, 20 nt, Human
uaggaagggagaggaggcag

SEQ ID NO: 939622 - RNA, 19 nt, Human
uccaucuuuccccaagugg

SEQ ID NO: 939623 - RNA, 21 nt, Human
uccaucuuuccccaaguggcu

SEQ ID NO: 939624 - RNA, 18 nt, Human
ucuuuuuuuuuuuuuuuu

SEQ ID NO: 939625 - RNA, 25 nt, Human
ugacaccagaggggaaccugggaag

SEQ ID NO: 939626 - RNA, 22 nt, Human
ugacauggggacaaaggggcac

SEQ ID NO: 939627 - RNA, 23 nt, Human
ugagcagagaggcccccaauccu

SEQ ID NO: 939628 - RNA, 24 nt, Human
uggaucccagguccuggauccccu

SEQ ID NO: 939629 - RNA, 19 nt, Human
uggccacaggcccugagug

SEQ ID NO: 939630 - RNA, 19 nt, Human
uggccuccaugccuguccu

SEQ ID NO: 939631 - RNA, 23 nt, Human
ugggagcggggggcaccccaagg

SEQ ID NO: 939632 - RNA, 19 nt, Human
ugggagggacaccgacaga

SEQ ID NO: 939633 - RNA, 22 nt, Human
ugggcaggacagcaggaagaag

SEQ ID NO: 939634 - RNA, 19 nt, Human
ugggcugcugggccccugu

SEQ ID NO: 939635 - RNA, 18 nt, Human
ugggugagcagagaggcc

SEQ ID NO: 939636 - RNA, 18 nt, Human
uguaggaagggagaggag

SEQ ID NO: 939637 - RNA, 22 nt, Human
uguaggaagggagaggaggcag

SEQ ID NO: 939638 - RNA, 19 nt, Human
uuccaaagaaaggugugua

SEQ ID NO: 939639 - RNA, 20 nt, Human
uuccaaagaaagguguguag

SEQ ID NO: 939640 - RNA, 21 nt, Human
uuccaaagaaagguguguagg

SEQ ID NO: 939641 - RNA, 24 nt, Human
uucccuggugggcuccagagacgg

SEQ ID NO: 939642 - RNA, 24 nt, Human
uuccucgcccugggcacugacugc

SEQ ID NO: 939643 - RNA, 23 nt, Human
uugcuuucuugcaggaagcagcu

SEQ ID NO: 939644 - RNA, 27 nt, Human
uuuuuuuuuuuuuuuuuuuccuugggg

SEQ ID NO: 939645 - RNA, 25 nt, Human
uuuuuuuuuuuuuuuuuuucuuuuu

SEQ ID NO: 939646 - RNA, 20 nt, Human
acacggcuccuccucccgcu

SEQ ID NO: 939647 - RNA, 21 nt, Human
acgaacugacacccgcagagc

SEQ ID NO: 939648 - RNA, 20 nt, Human
agcuagacaguaaaaacaga

SEQ ID NO: 939649 - RNA, 24 nt, Human
aggaagccggacgaacugacaccc

SEQ ID NO: 939650 - RNA, 22 nt, Human
augaauacaaucuccaaaaucu

SEQ ID NO: 939651 - RNA, 24 nt, Human
augaauacaaucuccaaaaucugu

SEQ ID NO: 939652 - RNA, 19 nt, Human
caaaugcaaauagauauga

SEQ ID NO: 939653 - RNA, 25 nt, Human
caaaugcaaauagauaugaauacaa

SEQ ID NO: 939654 - RNA, 22 nt, Human
cacaagacaacauuuaacaaaa

SEQ ID NO: 939655 - RNA, 20 nt, Human
caguucguaguuaagggcac

SEQ ID NO: 939656 - RNA, 21 nt, Human
ccaaccccggugccgcucagc

SEQ ID NO: 939657 - RNA, 21 nt, Human
cccgcagagccgagggagaca

SEQ ID NO: 939658 - RNA, 19 nt, Human
cccgccgccgccgcugcug

SEQ ID NO: 939659 - RNA, 20 nt, Human
ccgcccgccgccgccgcugc

SEQ ID NO: 939660 - RNA, 23 nt, Human
ccgcccgccgccgccgcugcugc

SEQ ID NO: 939661 - RNA, 19 nt, Human
ccgccgccgccgcugcugc

SEQ ID NO: 939662 - RNA, 25 nt, Human
ccgccgcugcugcugucagccgccg

SEQ ID NO: 939663 - RNA, 18 nt, Human
ccgcucagugccagggca

SEQ ID NO: 939664 - RNA, 18 nt, Human
ccgcugcugcuccuccuc

SEQ ID NO: 939665 - RNA, 20 nt, Human
ccgcugcugcugucagccgc

SEQ ID NO: 939666 - RNA, 19 nt, Human
ccucccgcugcugcuccuc

SEQ ID NO: 939667 - RNA, 20 nt, Human
ccucccgcugcugcuccucc

SEQ ID NO: 939668 - RNA, 23 nt, Human
ccuccucccgcugcugcuccucc

SEQ ID NO: 939669 - RNA, 19 nt, Human
ccuccuccgcgccccaacc

SEQ ID NO: 939670 - RNA, 22 nt, Human
cgccccaaccccggugccgcuc

SEQ ID NO: 939671 - RNA, 19 nt, Human
cgccgcccgccgccgccgc

SEQ ID NO: 939672 - RNA, 19 nt, Human
cgccgcccgccgccgccgc

SEQ ID NO: 939673 - RNA, 26 nt, Human
cgcugcugcuccuccuccgcgcccca

SEQ ID NO: 939674 - RNA, 21 nt, Human
cgggagugaggggcugugagg

SEQ ID NO: 939675 - RNA, 20 nt, Human
cucccgcugcugcuccuccu

SEQ ID NO: 939676 - RNA, 21 nt, Human
cuccucccgcugcugcuccuu

SEQ ID NO: 939677 - RNA, 22 nt, Human
cugacacccgcagagccgaggg

SEQ ID NO: 939678 - RNA, 18 nt, Human
cugcugcuccuccuccgc

SEQ ID NO: 939679 - RNA, 20 nt, Human
gaacugacacccgcagagcc

SEQ ID NO: 939680 - RNA, 25 nt, Human
gaccuagaaaucaaaugcaaauaga

SEQ ID NO: 939681 - RNA, 20 nt, Human
gggcagcuagacaguaaaaa

SEQ ID NO: 939682 - RNA, 24 nt, Human
uaacaaaaauaaucacaucaauug

SEQ ID NO: 939683 - RNA, 19 nt, Human
uaguuucaugucucagcug

SEQ ID NO: 939684 - RNA, 18 nt, Human
uccgcgccccaaccccgg

SEQ ID NO: 939685 - RNA, 21 nt, Human
uccuccgcgccccaaccccgg

SEQ ID NO: 939686 - RNA, 18 nt, Human
uccuccucccgcugcugc

SEQ ID NO: 939687 - RNA, 24 nt, Human
uccuccucccgcugcugcuccucc

SEQ ID NO: 939688 - RNA, 22 nt, Human
ugccagggcacacggcuccucc

SEQ ID NO: 939689 - RNA, 22 nt, Human
ugccgcucagccucgaaacgcc

SEQ ID NO: 939690 - RNA, 23 nt, Human
aagacaacucacagugaagagaa

SEQ ID NO: 939691 - RNA, 21 nt, Human
aaguuguuccaaaaauccucu

SEQ ID NO: 939692 - RNA, 25 nt, Human
accuccccaccccucugacagagac

SEQ ID NO: 939693 - RNA, 18 nt, Human
agaacccccagcgccccc

SEQ ID NO: 939694 - RNA, 21 nt, Human
agacugaggagaccacacacg

SEQ ID NO: 939695 - RNA, 26 nt, Human
agggugcugaaacggucagaggugca

SEQ ID NO: 939696 - RNA, 22 nt, Human
aguaccaagugggaggaccaaa

SEQ ID NO: 939697 - RNA, 25 nt, Human
auaaagcaucaagauacaaguacca

SEQ ID NO: 939698 - RNA, 22 nt, Human
caaagacaacucacagugaaga

SEQ ID NO: 939699 - RNA, 23 nt, Human
caagugggaggaccaaagacaac

SEQ ID NO: 939700 - RNA, 25 nt, Human
cacagcuugccuggucagaccccuu

SEQ ID NO: 939701 - RNA, 23 nt, Human
cacagucugaguccaggaggccc

SEQ ID NO: 939702 - RNA, 26 nt, Human
cauugcugcaaucaguauaaaaacaa

SEQ ID NO: 939703 - RNA, 19 nt, Human
ccagcgcccccgcgcccuc

SEQ ID NO: 939704 - RNA, 20 nt, Human
ccccggacucgccgggaccc

SEQ ID NO: 939705 - RNA, 20 nt, Human
ccccucugacagagacugag

SEQ ID NO: 939706 - RNA, 23 nt, Human
ccccucugacagagacugaggag

SEQ ID NO: 939707 - RNA, 24 nt, Human
cccguaagaacccccagcgccccc

SEQ ID NO: 939708 - RNA, 21 nt, Human
ccgaggcuggccggcucgugc

SEQ ID NO: 939709 - RNA, 19 nt, Human
ccgcgcccucuccccgagg

SEQ ID NO: 939710 - RNA, 23 nt, Human
cgcgcccgggaaggagcugggug

SEQ ID NO: 939711 - RNA, 19 nt, Human
cgggaaggagcugggugca

SEQ ID NO: 939712 - RNA, 22 nt, Human
cucgugcgcccugggcgcagcu

SEQ ID NO: 939713 - RNA, 22 nt, Human
cucugcagauugggcuuugcag

SEQ ID NO: 939714 - RNA, 18 nt, Human
gaacccccagcgcccccg

SEQ ID NO: 939715 - RNA, 19 nt, Human
gacugaggagaccacacac

SEQ ID NO: 939716 - RNA, 19 nt, Human
gauuccuguuucccaccuc

SEQ ID NO: 939717 - RNA, 22 nt, Human
gcgcccugggcgcagcuggagg

SEQ ID NO: 939718 - RNA, 21 nt, Human
gcgcgcccgggaaggagcugg

SEQ ID NO: 939719 - RNA, 26 nt, Human
ggaccagugccaggcagcggggcaga

SEQ ID NO: 939720 - RNA, 23 nt, Human
ggagaccacacacguugaccucc

SEQ ID NO: 939721 - RNA, 21 nt, Human
ggccguugguggcuggcugca

SEQ ID NO: 939722 - RNA, 18 nt, Human
gggaaggagcugggugca

SEQ ID NO: 939723 - RNA, 18 nt, Human
gggaaggagcugggugca

SEQ ID NO: 939724 - RNA, 23 nt, Human
ggugcugaaacggucagaggugc

SEQ ID NO: 939725 - RNA, 18 nt, Human
uaaaaacaaaguuauucc

SEQ ID NO: 939726 - RNA, 20 nt, Human
ucauuuccacuccaacauuc

SEQ ID NO: 939727 - RNA, 23 nt, Human
uccccaccccucugacagagacu

SEQ ID NO: 939728 - RNA, 21 nt, Human
ucugacagagacugaggagac

SEQ ID NO: 939729 - RNA, 18 nt, Human
ucugaguccaggaggccc

SEQ ID NO: 939730 - RNA, 22 nt, Human
ugaaacggucagaggugcaggu

SEQ ID NO: 939731 - RNA, 23 nt, Human
ugaaacggucagaggugcaggug

SEQ ID NO: 939732 - RNA, 18 nt, Human
ugaagagaaacgcuugag

SEQ ID NO: 939733 - RNA, 22 nt, Human
ugcaaaggaccagugccaggca

SEQ ID NO: 939734 - RNA, 20 nt, Human
ugcaagggcaagggggccgu

SEQ ID NO: 939735 - RNA, 21 nt, Human
ugcaagggcaagggggccguu

SEQ ID NO: 939736 - RNA, 20 nt, Human
ugcgcccugggcgcagcugg

SEQ ID NO: 939737 - RNA, 21 nt, Human
uguuucccaccuccccacccc

SEQ ID NO: 939738 - RNA, 18 nt, Human
uucccaccuccccacccc

SEQ ID NO: 939739 - RNA, 21 nt, Human
uuuuuuuuuuaaguuguucca

SEQ ID NO: 939740 - RNA, 25 nt, Human
uuuuuuuuuuuuuuuuuuuuuaagg

SEQ ID NO: 939741 - RNA, 25 nt, Human
aaaaaaaaacaaaaaaaaaacaaaa

SEQ ID NO: 939742 - RNA, 21 nt, Human
aaaaaaaacaaaaaaaaacau

SEQ ID NO: 939743 - RNA, 24 nt, Human
aaaaaaacaaaaaaaaacaaaaaa

SEQ ID NO: 939744 - RNA, 25 nt, Human
aaaaaaacaaaaaaaaacauuugua

SEQ ID NO: 939745 - RNA, 28 nt, Human
aaaaaacccaaaaggcaaaugcuacugc

SEQ ID NO: 939746 - RNA, 19 nt, Human
aaaaauauguaaaaaggcc

SEQ ID NO: 939747 - RNA, 20 nt, Human
aaaaugaaagcuauugcaga

SEQ ID NO: 939748 - RNA, 20 nt, Human
aaauagaacuugcucacaaa

SEQ ID NO: 939749 - RNA, 26 nt, Human
aacaaacaaaaaacccaaaaggcaaa

SEQ ID NO: 939750 - RNA, 22 nt, Human
aacccaucucuuauaaagccua

SEQ ID NO: 939751 - RNA, 19 nt, Human
aaccuggugaaaccccguc

SEQ ID NO: 939752 - RNA, 20 nt, Human
aaccuggugaaaccccgucu

SEQ ID NO: 939753 - RNA, 21 nt, Human
aaccuggugaaaccccgucuc

SEQ ID NO: 939754 - RNA, 24 nt, Human
aaguccgagaaugaagggccccag

SEQ ID NO: 939755 - RNA, 24 nt, Human
aauggcgugaaccugggaggugga

SEQ ID NO: 939756 - RNA, 26 nt, Human
acaaaaaacccaaaaggcaaaugcua

SEQ ID NO: 939757 - RNA, 24 nt, Human
acagaacauucuguguucaucucu

SEQ ID NO: 939758 - RNA, 20 nt, Human
acagagcgagacuccgucuc

SEQ ID NO: 939759 - RNA, 23 nt, Human
acagagcgagacuccgucucaaa

SEQ ID NO: 939760 - RNA, 24 nt, Human
acagagcgagacuccgucucaaaa

SEQ ID NO: 939761 - RNA, 24 nt, Human
accacaaaauacaaagggcugcaa

SEQ ID NO: 939762 - RNA, 24 nt, Human
accccgucucuacuaaaaauacaa

SEQ ID NO: 939763 - RNA, 22 nt, Human
agaaaaaaaaaucuaaugaggg

SEQ ID NO: 939764 - RNA, 27 nt, Human
agacagaagugaaggggagcuaugauc

SEQ ID NO: 939765 - RNA, 24 nt, Human
agcacuuugggaggccgaggcggg

SEQ ID NO: 939766 - RNA, 24 nt, Human
agccgcggcagcgccuucacagcc

SEQ ID NO: 939767 - RNA, 24 nt, Human
agccugggugacagagcgagacuc

SEQ ID NO: 939768 - RNA, 23 nt, Human
aggcaaaaauaugugacaacagc

SEQ ID NO: 939769 - RNA, 21 nt, Human
aggcaggagaauggcgugaac

SEQ ID NO: 939770 - RNA, 22 nt, Human
aggcaggagaauggcgugaacc

SEQ ID NO: 939771 - RNA, 24 nt, Human
aggcaggagaauggcgugaaccug

SEQ ID NO: 939772 - RNA, 21 nt, Human
aggccgaggcgggcggaucac

SEQ ID NO: 939773 - RNA, 22 nt, Human
aggccgggcacgguggcucacg

SEQ ID NO: 939774 - RNA, 24 nt, Human
aggcgggcggaucacaaggucagg

SEQ ID NO: 939775 - RNA, 19 nt, Human
aggcugaggcaggagaaug

SEQ ID NO: 939776 - RNA, 24 nt, Human
agguggagcuugcagugagccgag

SEQ ID NO: 939777 - RNA, 24 nt, Human
agugcacuccagccugggugacag

SEQ ID NO: 939778 - RNA, 26 nt, Human
auaaagccuaugagaaaaugaaagcu

SEQ ID NO: 939779 - RNA, 23 nt, Human
auaacaaacaaaaaacccaaaag

SEQ ID NO: 939780 - RNA, 24 nt, Human
aucaagccagugcacuccagccug

SEQ ID NO: 939781 - RNA, 21 nt, Human
aucucuuccucugcucauacc

SEQ ID NO: 939782 - RNA, 20 nt, Human
augaaaauuuaaacacgcca

SEQ ID NO: 939783 - RNA, 18 nt, Human
augaagacuuuaaguagg

SEQ ID NO: 939784 - RNA, 19 nt, Human
auucuaaagcaaaaucagc

SEQ ID NO: 939785 - RNA, 25 nt, Human
caaaaaaaaacaaaaaaaaacaaaa

SEQ ID NO: 939786 - RNA, 21 nt, Human
cacagaggcaaaaauauguga

SEQ ID NO: 939787 - RNA, 18 nt, Human
cacagccacggccggcuc

SEQ ID NO: 939788 - RNA, 18 nt, Human
caccgccccggccccgcc

SEQ ID NO: 939789 - RNA, 24 nt, Human
cacgccuguaaucccagcacuuug

SEQ ID NO: 939790 - RNA, 22 nt, Human
cacuccagccugggugacagag

SEQ ID NO: 939791 - RNA, 23 nt, Human
cacuccagccugggugacagagc

SEQ ID NO: 939792 - RNA, 24 nt, Human
cacuccagccugggugacagagcg

SEQ ID NO: 939793 - RNA, 24 nt, Human
cagcacuuugggaggccgaggcgg

SEQ ID NO: 939794 - RNA, 21 nt, Human
cagcccccaccgccccggccc

SEQ ID NO: 939795 - RNA, 24 nt, Human
cagcuacucgggaggcugaggcag

SEQ ID NO: 939796 - RNA, 18 nt, Human
cagugagccgagaucaag

SEQ ID NO: 939797 - RNA, 22 nt, Human
cagugcacuccagccuggguga

SEQ ID NO: 939798 - RNA, 23 nt, Human
cagugcacuccagccugggugac

SEQ ID NO: 939799 - RNA, 24 nt, Human
cagugcacuccagccugggugaca

SEQ ID NO: 939800 - RNA, 25 nt, Human
cagugcacuccagccugggugacag

SEQ ID NO: 939801 - RNA, 21 nt, Human
cauucuguguucaucucuggc

SEQ ID NO: 939802 - RNA, 21 nt, Human
ccacgcccuccucgggcgagg

SEQ ID NO: 939803 - RNA, 21 nt, Human
ccagugcacuccagccugggu

SEQ ID NO: 939804 - RNA, 21 nt, Human
ccagugcacuccagccugggu

SEQ ID NO: 939805 - RNA, 22 nt, Human
ccagugcacuccagccugggug

SEQ ID NO: 939806 - RNA, 23 nt, Human
ccagugcacuccagccuggguga

SEQ ID NO: 939807 - RNA, 24 nt, Human
ccagugcacuccagccugggugac

SEQ ID NO: 939808 - RNA, 19 nt, Human
cccaccacgucaggcaccg

SEQ ID NO: 939809 - RNA, 18 nt, Human
ccccaccgccccggcccc

SEQ ID NO: 939810 - RNA, 18 nt, Human
cccgagcccgagugucgc

SEQ ID NO: 939811 - RNA, 24 nt, Human
cccucccgacagccgcggcagcgc

SEQ ID NO: 939812 - RNA, 23 nt, Human
ccgacagccgcggcagcgccuuc

SEQ ID NO: 939813 - RNA, 18 nt, Human
ccggaggaaaagcgaaga

SEQ ID NO: 939814 - RNA, 21 nt, Human
ccuauagucccagcuacucgg

SEQ ID NO: 939815 - RNA, 23 nt, Human
ccuggcuaaccuggugaaacccc

SEQ ID NO: 939816 - RNA, 24 nt, Human
ccuggcuaaccuggugaaaccccg

SEQ ID NO: 939817 - RNA, 22 nt, Human
ccugggugacagagcgagacuc

SEQ ID NO: 939818 - RNA, 22 nt, Human
ccuguaaucccagcacuuuggg

SEQ ID NO: 939819 - RNA, 24 nt, Human
cgagaccauccuggcuaaccuggu

SEQ ID NO: 939820 - RNA, 20 nt, Human
cgccccggccccgccgaccc

SEQ ID NO: 939821 - RNA, 23 nt, Human
cgccuauagucccagcuacucgg

SEQ ID NO: 939822 - RNA, 24 nt, Human
cgccuauagucccagcuacucggg

SEQ ID NO: 939823 - RNA, 23 nt, Human
cgccuguaaucccagcacuuugg

SEQ ID NO: 939824 - RNA, 26 nt, Human
cgcgccgcccucccgacagccgcggc

SEQ ID NO: 939825 - RNA, 21 nt, Human
cgggcgcuguccccacgcccu

SEQ ID NO: 939826 - RNA, 24 nt, Human
cguggugggcgccuauagucccag

SEQ ID NO: 939827 - RNA, 22 nt, Human
cuaaagcaaaaucagcagaagu

SEQ ID NO: 939828 - RNA, 20 nt, Human
cuauugcagaagugaaauuc

SEQ ID NO: 939829 - RNA, 22 nt, Human
cucacgccuguaaucccagcac

SEQ ID NO: 939830 - RNA, 24 nt, Human
cucacgccuguaaucccagcacuu

SEQ ID NO: 939831 - RNA, 21 nt, Human
cucagcccccaccgccccggc

SEQ ID NO: 939832 - RNA, 22 nt, Human
cucauaccacugaacccaucuc

SEQ ID NO: 939833 - RNA, 18 nt, Human
cuccgucucaaaaaaaaa

SEQ ID NO: 939834 - RNA, 23 nt, Human
cuuaugcuuaagaaaaaaaaauc

SEQ ID NO: 939835 - RNA, 19 nt, Human
cuugcagugagccgagauc

SEQ ID NO: 939836 - RNA, 20 nt, Human
gaccauccuggcuaaccugg

SEQ ID NO: 939837 - RNA, 18 nt, Human
gagcuugcagugagccga

SEQ ID NO: 939838 - RNA, 22 nt, Human
gagcuugcagugagccgagauc

SEQ ID NO: 939839 - RNA, 24 nt, Human
gaggcgggcggaucacaaggucag

SEQ ID NO: 939840 - RNA, 24 nt, Human
gcacuccagccugggugacagagc

SEQ ID NO: 939841 - RNA, 19 nt, Human
gccagugcacuccagccug

SEQ ID NO: 939842 - RNA, 23 nt, Human
gccuauagucccagcuacucggg

SEQ ID NO: 939843 - RNA, 24 nt, Human
gcuaaccuggugaaaccccgucuc

SEQ ID NO: 939844 - RNA, 22 nt, Human
gcugaggcaggagaauggcgug

SEQ ID NO: 939845 - RNA, 18 nt, Human
ggagcuugcagugagccg

SEQ ID NO: 939846 - RNA, 24 nt, Human
ggagcuugcagugagccgagauca

SEQ ID NO: 939847 - RNA, 21 nt, Human
ggcucacgccuguaaucccag

SEQ ID NO: 939848 - RNA, 24 nt, Human
gggcacgguggcucacgccuguaa

SEQ ID NO: 939849 - RNA, 24 nt, Human
gggcggaucacaaggucaggagau

SEQ ID NO: 939850 - RNA, 23 nt, Human
gguggcucacgccuguaauccca

SEQ ID NO: 939851 - RNA, 24 nt, Human
gguggcucacgccuguaaucccag

SEQ ID NO: 939852 - RNA, 22 nt, Human
uaaaagugcugccucaggaaca

SEQ ID NO: 939853 - RNA, 21 nt, Human
uaacaaacaaaaaacccaaaa

SEQ ID NO: 939854 - RNA, 22 nt, Human
uaaccuggugaaaccccgucuc

SEQ ID NO: 939855 - RNA, 24 nt, Human
uaaccuggugaaaccccgucucua

SEQ ID NO: 939856 - RNA, 22 nt, Human
uaagacagaagugaaggggagc

SEQ ID NO: 939857 - RNA, 20 nt, Human
uaagguaaccauucuaaagc

SEQ ID NO: 939858 - RNA, 21 nt, Human
uaauaacaaacaaaaaaccca

SEQ ID NO: 939859 - RNA, 21 nt, Human
uaauucuauaauuccauuggu

SEQ ID NO: 939860 - RNA, 21 nt, Human
uacaaucuguguuccuucugc

SEQ ID NO: 939861 - RNA, 24 nt, Human
uagccgggcgucguggugggcgcc

SEQ ID NO: 939862 - RNA, 23 nt, Human
uauuguauauauuuuugcaccuu

SEQ ID NO: 939863 - RNA, 20 nt, Human
ucaaaaaagcuaggcauaau

SEQ ID NO: 939864 - RNA, 18 nt, Human
ucacaaggucaggagauc

SEQ ID NO: 939865 - RNA, 24 nt, Human
ucacaaggucaggagaucgagacc

SEQ ID NO: 939866 - RNA, 23 nt, Human
uccagccugggugacagagcgag

SEQ ID NO: 939867 - RNA, 24 nt, Human
uccagccugggugacagagcgaga

SEQ ID NO: 939868 - RNA, 19 nt, Human
ucccucucugccucccucu

SEQ ID NO: 939869 - RNA, 25 nt, Human
ucgcgccgcccucccgacagccgcg

SEQ ID NO: 939870 - RNA, 24 nt, Human
ucucaaaaaaaaacaaaaaaaaac

SEQ ID NO: 939871 - RNA, 22 nt, Human
ucucuacuaaaaauacaaaaaa

SEQ ID NO: 939872 - RNA, 21 nt, Human
ucucuggucacaaacuccacu

SEQ ID NO: 939873 - RNA, 21 nt, Human
ucugcgagcagugccugauuc

SEQ ID NO: 939874 - RNA, 19 nt, Human
ucugcucauaccacugaac

SEQ ID NO: 939875 - RNA, 21 nt, Human
ugaaagaauauaaaugaagac

SEQ ID NO: 939876 - RNA, 24 nt, Human
ugaaccugggagguggagcuugca

SEQ ID NO: 939877 - RNA, 21 nt, Human
ugaacucacagaggcaaaaau

SEQ ID NO: 939878 - RNA, 27 nt, Human
ugagaaaaugaaagcuauugcagaagu

SEQ ID NO: 939879 - RNA, 24 nt, Human
ugaggcaggagaauggcgugaacc

SEQ ID NO: 939880 - RNA, 25 nt, Human
ugaggcaggagaauggcgugaaccu

SEQ ID NO: 939881 - RNA, 20 nt, Human
ugcacuccagccugggugac

SEQ ID NO: 939882 - RNA, 20 nt, Human
ugcuaauuaaaaacaaaaac

SEQ ID NO: 939883 - RNA, 22 nt, Human
uggcucacgccuguaaucccag

SEQ ID NO: 939884 - RNA, 24 nt, Human
uggcucacgccuguaaucccagca

SEQ ID NO: 939885 - RNA, 19 nt, Human
ugggaggccgaggcgggcg

SEQ ID NO: 939886 - RNA, 24 nt, Human
ugggaggccgaggcgggcggauca

SEQ ID NO: 939887 - RNA, 29 nt, Human
ugggagguggagcuugcagugacaacggu

SEQ ID NO: 939888 - RNA, 24 nt, Human
ugggagguggagcuugcagugagc

SEQ ID NO: 939889 - RNA, 24 nt, Human
uguaaaagcagauaaaauauuuaa

SEQ ID NO: 939890 - RNA, 20 nt, Human
uguaugaaaauuuaaacacg

SEQ ID NO: 939891 - RNA, 20 nt, Human
ugucuuuuaauuucuuaggc

SEQ ID NO: 939892 - RNA, 24 nt, Human
uguucacuauaucugcauuacaug

SEQ ID NO: 939893 - RNA, 21 nt, Human
uuaaaauacuguuaauucuau

SEQ ID NO: 939894 - RNA, 22 nt, Human
uuagaagugauacaauuucaac

SEQ ID NO: 939895 - RNA, 24 nt, Human
uuagccgggcgucguggugggcgc

SEQ ID NO: 939896 - RNA, 25 nt, Human
uuagccgggcgucguggugggcgcc

SEQ ID NO: 939897 - RNA, 22 nt, Human
uuaugcuuaagaaaaaaaaauc

SEQ ID NO: 939898 - RNA, 18 nt, Human
uugcagugagccgagauc

SEQ ID NO: 939899 - RNA, 21 nt, Human
uugcagugagccgagaucaag

SEQ ID NO: 939900 - RNA, 25 nt, Human
uugggaggccgaggcgggcggauca

SEQ ID NO: 939901 - RNA, 21 nt, Human
uuuaaguucagucuuaugcuu

SEQ ID NO: 939902 - RNA, 20 nt, Human
aacuuaauccuaccauccau

SEQ ID NO: 939903 - RNA, 22 nt, Human
aagugcuaauuuucccuuuaca

SEQ ID NO: 939904 - RNA, 23 nt, Human
aaugacuugagguuggagcuuaa

SEQ ID NO: 939905 - RNA, 21 nt, Human
aauuguccucccuacacuuaa

SEQ ID NO: 939906 - RNA, 19 nt, Human
acaacucccucuaacagug

SEQ ID NO: 939907 - RNA, 20 nt, Human
agaggcugaaaacugggcag

SEQ ID NO: 939908 - RNA, 21 nt, Human
aggaugagcuaggcaucugcu

SEQ ID NO: 939909 - RNA, 23 nt, Human
aucaagucugagaggcugagguu

SEQ ID NO: 939910 - RNA, 19 nt, Human
caccaucuugaucaugaga

SEQ ID NO: 939911 - RNA, 19 nt, Human
cacggcccagccccggucc

SEQ ID NO: 939912 - RNA, 24 nt, Human
cagaggcaggggaaaaauaaagga

SEQ ID NO: 939913 - RNA, 20 nt, Human
cagccgggacgccgccgcgg

SEQ ID NO: 939914 - RNA, 20 nt, Human
cagugguaacagaaaccaag

SEQ ID NO: 939915 - RNA, 21 nt, Human
cauaauagaaguucacagacu

SEQ ID NO: 939916 - RNA, 21 nt, Human
cauugcugcagucuuuggaga

SEQ ID NO: 939917 - RNA, 18 nt, Human
ccgcccguccuccggccg

SEQ ID NO: 939918 - RNA, 22 nt, Human
ccgccgcacggcccagccccgg

SEQ ID NO: 939919 - RNA, 18 nt, Human
ccgcugccgccgcacggc

SEQ ID NO: 939920 - RNA, 19 nt, Human
ccgggagccgccgccgccg

SEQ ID NO: 939921 - RNA, 22 nt, Human
ccuaaguugagaagggagaggc

SEQ ID NO: 939922 - RNA, 24 nt, Human
ccuauaaauaacccauuuuagcuu

SEQ ID NO: 939923 - RNA, 19 nt, Human
ccucuaacagugguaacag

SEQ ID NO: 939924 - RNA, 25 nt, Human
cgccgcccuaaguugagaagggaga

SEQ ID NO: 939925 - RNA, 18 nt, Human
cgccgcugccgccgcacg

SEQ ID NO: 939926 - RNA, 19 nt, Human
cgcgggcccgccgccgccc

SEQ ID NO: 939927 - RNA, 20 nt, Human
cgcgggcccgccgccgcccu

SEQ ID NO: 939928 - RNA, 19 nt, Human
cggagaagacucaagacug

SEQ ID NO: 939929 - RNA, 21 nt, Human
cuuccgggagccgccgccgcc

SEQ ID NO: 939930 - RNA, 24 nt, Human
gaagggaaggcagagaaaccuuua

SEQ ID NO: 939931 - RNA, 18 nt, Human
gcaagacugggugcgaga

SEQ ID NO: 939932 - RNA, 19 nt, Human
gccgcacggcccagccccg

SEQ ID NO: 939933 - RNA, 22 nt, Human
gccgccgccgccgccaucuugg

SEQ ID NO: 939934 - RNA, 24 nt, Human
gggaaaaauaaaggaaacagaaag

SEQ ID NO: 939935 - RNA, 25 nt, Human
gggaaaaauaaaggaaaccgguacc

SEQ ID NO: 939936 - RNA, 23 nt, Human
gggaaggcagagaaaccuuuaaa

SEQ ID NO: 939937 - RNA, 19 nt, Human
gguaacagaaaccaaggaa

SEQ ID NO: 939938 - RNA, 19 nt, Human
gugcucuauaccuuuauac

SEQ ID NO: 939939 - RNA, 25 nt, Human
guugagaagggagaggccaggccca

SEQ ID NO: 939940 - RNA, 22 nt, Human
uaaauaacccauuuuagcuuca

SEQ ID NO: 939941 - RNA, 23 nt, Human
uaaaugacuugagguuggagcuu

SEQ ID NO: 939942 - RNA, 26 nt, Human
uaacagaaaccaaggaaauuauaauc

SEQ ID NO: 939943 - RNA, 19 nt, Human
uaagaaccacaaaagugcu

SEQ ID NO: 939944 - RNA, 22 nt, Human
uaagaaccacaaaagugcuaau

SEQ ID NO: 939945 - RNA, 26 nt, Human
uaagaggcugaaaacugggcaacuaa

SEQ ID NO: 939946 - RNA, 23 nt, Human
uaaguugagaagggagaggccag

SEQ ID NO: 939947 - RNA, 24 nt, Human
uaaucuuuaagcaauggccccaua

SEQ ID NO: 939948 - RNA, 19 nt, Human
uauaccuuuauacaauacc

SEQ ID NO: 939949 - RNA, 19 nt, Human
ucaggcuaguaaggacuag

SEQ ID NO: 939950 - RNA, 25 nt, Human
uccccuggcgccgcugccgccgcac

SEQ ID NO: 939951 - RNA, 18 nt, Human
ucccugagggaaaagagu

SEQ ID NO: 939952 - RNA, 21 nt, Human
ucccuuaagaaccacaaaagu

SEQ ID NO: 939953 - RNA, 23 nt, Human
uccuguuaacuuucaggaccacc

SEQ ID NO: 939954 - RNA, 23 nt, Human
uccuuuucagcaaggucaaaagc

SEQ ID NO: 939955 - RNA, 24 nt, Human
ucuugaucaugagagcuuauuuaa

SEQ ID NO: 939956 - RNA, 24 nt, Human
ugaaaacugguggcagggacccca

SEQ ID NO: 939957 - RNA, 18 nt, Human
ugacagcauuuauaccac

SEQ ID NO: 939958 - RNA, 19 nt, Human
ugagaagggagaggccagg

SEQ ID NO: 939959 - RNA, 22 nt, Human
ugagaagggagaggccaggccc

SEQ ID NO: 939960 - RNA, 22 nt, Human
ugagguuggagcuuaaucuuuu

SEQ ID NO: 939961 - RNA, 21 nt, Human
uggaaugucaaaugaaacuua

SEQ ID NO: 939962 - RNA, 23 nt, Human
uggcagagaugaaaucauuucca

SEQ ID NO: 939963 - RNA, 23 nt, Human
uggccccauaaauauagacuaca

SEQ ID NO: 939964 - RNA, 22 nt, Human
ugggaggcggguggguagaagg

SEQ ID NO: 939965 - RNA, 21 nt, Human
uggugggaggcggguggguag

SEQ ID NO: 939966 - RNA, 20 nt, Human
uuauauguuccuuuucagca

SEQ ID NO: 939967 - RNA, 21 nt, Human
uucagcaaggucaaaagccaa

SEQ ID NO: 939968 - RNA, 23 nt, Human
uuccacucuucuuccuuuuuaaa

SEQ ID NO: 939969 - RNA, 20 nt, Human
aagaccccaagccucggggc

SEQ ID NO: 939970 - RNA, 19 nt, Human
aagcccagaaaggagcugg

SEQ ID NO: 939971 - RNA, 21 nt, Human
aagccucagaccccgacccca

SEQ ID NO: 939972 - RNA, 24 nt, Human
aaggagcuggguccagcccuuacc

SEQ ID NO: 939973 - RNA, 22 nt, Human
aaugcugucuccguuccauggg

SEQ ID NO: 939974 - RNA, 21 nt, Human
accggccccccacucccccgc

SEQ ID NO: 939975 - RNA, 25 nt, Human
acgcgcugcccgcucaugcucccgg

SEQ ID NO: 939976 - RNA, 18 nt, Human
acuacccaagcccagaaa

SEQ ID NO: 939977 - RNA, 20 nt, Human
agaaguagggguuuggcuuc

SEQ ID NO: 939978 - RNA, 24 nt, Human
agccuuaucccuccucaugcccac

SEQ ID NO: 939979 - RNA, 18 nt, Human
aggcaaaccccgaucucc

SEQ ID NO: 939980 - RNA, 18 nt, Human
aggcagcgcccaagccuc

SEQ ID NO: 939981 - RNA, 22 nt, Human
agugaugacaacagcuguagaa

SEQ ID NO: 939982 - RNA, 19 nt, Human
caagcccagaaaggagcug

SEQ ID NO: 939983 - RNA, 21 nt, Human
caagcccagaaaggagcuggg

SEQ ID NO: 939984 - RNA, 19 nt, Human
caccaccuugacguccacg

SEQ ID NO: 939985 - RNA, 21 nt, Human
caccaggcuagucuugcccac

SEQ ID NO: 939986 - RNA, 20 nt, Human
cacugacguaauccucugcc

SEQ ID NO: 939987 - RNA, 26 nt, Human
cagaaaggagcuggguccagcccuua

SEQ ID NO: 939988 - RNA, 24 nt, Human
cagauuaccggccccccacucccc

SEQ ID NO: 939989 - RNA, 22 nt, Human
cagcacaggcaggcgccacucu

SEQ ID NO: 939990 - RNA, 24 nt, Human
cagccuuaucccuccucaugccca

SEQ ID NO: 939991 - RNA, 18 nt, Human
cagcgccccgugugcccc

SEQ ID NO: 939992 - RNA, 21 nt, Human
ccaagcccagaaaggagcugg

SEQ ID NO: 939993 - RNA, 24 nt, Human
ccaccaggcuagucuugcccacgu

SEQ ID NO: 939994 - RNA, 22 nt, Human
ccagcaucaccaccuugacguc

SEQ ID NO: 939995 - RNA, 18 nt, Human
ccaggccaggugagugcu

SEQ ID NO: 939996 - RNA, 19 nt, Human
cccaagccucagaccccga

SEQ ID NO: 939997 - RNA, 23 nt, Human
cccacagucagcccaaugcuguc

SEQ ID NO: 939998 - RNA, 24 nt, Human
cccaccgugccuggccccuccgga

SEQ ID NO: 939999 - RNA, 20 nt, Human
ccccaagccucggggcggcc

SEQ ID NO: 940000 - RNA, 25 nt, Human
cccccacucccccgcccaccgugcc

SEQ ID NO: 940001 - RNA, 22 nt, Human
ccgaccccaaacggcgccaacc

SEQ ID NO: 940002 - RNA, 23 nt, Human
ccgaccccaaacggcgccaaccu

SEQ ID NO: 940003 - RNA, 18 nt, Human
ccggccccccacuccccc

SEQ ID NO: 940004 - RNA, 24 nt, Human
ccgugugcccccgcuguucggccc

SEQ ID NO: 940005 - RNA, 22 nt, Human
ccucaacagcgcagcacgccgc

SEQ ID NO: 940006 - RNA, 20 nt, Human
ccucagaccccgaccccaaa

SEQ ID NO: 940007 - RNA, 19 nt, Human
cgaccccaaacggcgccaa

SEQ ID NO: 940008 - RNA, 22 nt, Human
cgaccccaaacggcgccaaccu

SEQ ID NO: 940009 - RNA, 26 nt, Human
cgccaaccuacgacuccagacagcgc

SEQ ID NO: 940010 - RNA, 21 nt, Human
cggccccccacucccccgccc

SEQ ID NO: 940011 - RNA, 22 nt, Human
cgggaggcaaaccccgaucucc

SEQ ID NO: 940012 - RNA, 22 nt, Human
cgucaggguccugagcggggac

SEQ ID NO: 940013 - RNA, 18 nt, Human
cuaaagccucauaccuga

SEQ ID NO: 940014 - RNA, 30 nt, Human
cucagaccccgaccccaaacggcgccaacc

SEQ ID NO: 940015 - RNA, 20 nt, Human
cucccggggccgcuucagcc

SEQ ID NO: 940016 - RNA, 22 nt, Human
cuccuugcccagcaucaccacc

SEQ ID NO: 940017 - RNA, 21 nt, Human
cuggggucucccgcaacccgg

SEQ ID NO: 940018 - RNA, 23 nt, Human
cuggguccagcccuuacggggaa

SEQ ID NO: 940019 - RNA, 19 nt, Human
gacucagugaugacaacag

SEQ ID NO: 940020 - RNA, 21 nt, Human
gagcucguccacacucuggcc

SEQ ID NO: 940021 - RNA, 19 nt, Human
gcagcgccccgugugcccc

SEQ ID NO: 940022 - RNA, 23 nt, Human
gcccacguacuccuugcccagca

SEQ ID NO: 940023 - RNA, 24 nt, Human
gcccaggcagcgcccaagccucag

SEQ ID NO: 940024 - RNA, 22 nt, Human
gccgauuauccuucgaagaccc

SEQ ID NO: 940025 - RNA, 22 nt, Human
gcuccguucuggcugggaaucc

SEQ ID NO: 940026 - RNA, 22 nt, Human
ggcagaagccugggguccaaau

SEQ ID NO: 940027 - RNA, 19 nt, Human
gggagggcuagcaguucag

SEQ ID NO: 940028 - RNA, 18 nt, Human
guccacacucuggccugu

SEQ ID NO: 940029 - RNA, 22 nt, Human
guccugagcggggacgggaggc

SEQ ID NO: 940030 - RNA, 26 nt, Human
gugcuguccagggcagaagccugggg

SEQ ID NO: 940031 - RNA, 23 nt, Human
uaaacagacaaaagggagggcug

SEQ ID NO: 940032 - RNA, 21 nt, Human
uacccaagcccagaaaggagc

SEQ ID NO: 940033 - RNA, 21 nt, Human
uaccggccccccacucccccg

SEQ ID NO: 940034 - RNA, 24 nt, Human
uagaaguagggguuuggcuucugg

SEQ ID NO: 940035 - RNA, 18 nt, Human
ucaccuggaaggcagcca

SEQ ID NO: 940036 - RNA, 19 nt, Human
ucagaccccgaccccaaac

SEQ ID NO: 940037 - RNA, 24 nt, Human
uccaaaucagccuuaucccuccuc

SEQ ID NO: 940038 - RNA, 18 nt, Human
uccaccaggcuagucuug

SEQ ID NO: 940039 - RNA, 19 nt, Human
uccacgcccuuguccucug

SEQ ID NO: 940040 - RNA, 20 nt, Human
uccagggcagaagccugggg

SEQ ID NO: 940041 - RNA, 26 nt, Human
ucccaaccgaaccuggggucucccgc

SEQ ID NO: 940042 - RNA, 25 nt, Human
ucggcccaggcagcgcccaagccuc

SEQ ID NO: 940043 - RNA, 19 nt, Human
ucgggcucgagcucuggcc

SEQ ID NO: 940044 - RNA, 21 nt, Human
ugacaacagcuguagaaguag

SEQ ID NO: 940045 - RNA, 24 nt, Human
ugacaacagcuguagaaguagggg

SEQ ID NO: 940046 - RNA, 21 nt, Human
ugagaauuagauaaacagaca

SEQ ID NO: 940047 - RNA, 19 nt, Human
ugcacuucggcagcgcccc

SEQ ID NO: 940048 - RNA, 22 nt, Human
ugcccccgcuguucggccccgg

SEQ ID NO: 940049 - RNA, 25 nt, Human
ugccuggccccuccggaugcacuca

SEQ ID NO: 940050 - RNA, 18 nt, Human
uggcugggaaucccaacc

SEQ ID NO: 940051 - RNA, 19 nt, Human
uggcuucuggcccagaucc

SEQ ID NO: 940052 - RNA, 21 nt, Human
ugggccagcacaggcaggcgc

SEQ ID NO: 940053 - RNA, 18 nt, Human
uucuggaagagcucgucc

SEQ ID NO: 940054 - RNA, 22 nt, Human
aaaaagccagugggggcaggug

SEQ ID NO: 940055 - RNA, 19 nt, Human
aaagggcaaggaaaggucc

SEQ ID NO: 940056 - RNA, 21 nt, Human
aaagguccuggggcugaagug

SEQ ID NO: 940057 - RNA, 25 nt, Human
acccugagggugcugugaacaggga

SEQ ID NO: 940058 - RNA, 27 nt, Human
acccugagggugcugugaacagggaac

SEQ ID NO: 940059 - RNA, 23 nt, Human
accuuaagacccugagggugcug

SEQ ID NO: 940060 - RNA, 23 nt, Human
aggaaagguccuggggcugaagu

SEQ ID NO: 940061 - RNA, 22 nt, Human
agggaggaucagcucuggcagg

SEQ ID NO: 940062 - RNA, 22 nt, Human
aggggacuucugcagccagagg

SEQ ID NO: 940063 - RNA, 18 nt, Human
agggugcugugaacaggg

SEQ ID NO: 940064 - RNA, 21 nt, Human
auauaaaacagcuuuauuuga

SEQ ID NO: 940065 - RNA, 18 nt, Human
caaaaagccagugggggc

SEQ ID NO: 940066 - RNA, 18 nt, Human
caaaaagccagugggggc

SEQ ID NO: 940067 - RNA, 22 nt, Human
caaaagaucugguccugccccu

SEQ ID NO: 940068 - RNA, 23 nt, Human
caaggggcaccaaaaagccagug

SEQ ID NO: 940069 - RNA, 18 nt, Human
cagccagagggauuggga

SEQ ID NO: 940070 - RNA, 23 nt, Human
ccuagggaggaucagcucuggca

SEQ ID NO: 940071 - RNA, 18 nt, Human
ccugagggugcugugaac

SEQ ID NO: 940072 - RNA, 20 nt, Human
ccugccccuccucucauugg

SEQ ID NO: 940073 - RNA, 23 nt, Human
ccuuaagacccugagggugcugu

SEQ ID NO: 940074 - RNA, 19 nt, Human
cucaaugcccucaacccuc

SEQ ID NO: 940075 - RNA, 20 nt, Human
gaaagguccuggggcugaag

SEQ ID NO: 940076 - RNA, 24 nt, Human
gaacagucugauaucuggaaccaa

SEQ ID NO: 940077 - RNA, 19 nt, Human
gaccuuaagacccugaggg

SEQ ID NO: 940078 - RNA, 18 nt, Human
gcauggagggugcaggug

SEQ ID NO: 940079 - RNA, 18 nt, Human
ggaaccaaagggcaagga

SEQ ID NO: 940080 - RNA, 22 nt, Human
ggggacuucugcagccagaggg

SEQ ID NO: 940081 - RNA, 20 nt, Human
uaaaagagguauuugugaua

SEQ ID NO: 940082 - RNA, 20 nt, Human
ucaacccucagcucucaaaa

SEQ ID NO: 940083 - RNA, 22 nt, Human
ucucaaaagaucugguccugcc

SEQ ID NO: 940084 - RNA, 21 nt, Human
ucugcagccagagggauuggg

SEQ ID NO: 940085 - RNA, 24 nt, Human
ucuggaaccaaagggcaaggaaag

SEQ ID NO: 940086 - RNA, 18 nt, Human
uggacagauaaaagaggu

SEQ ID NO: 940087 - RNA, 18 nt, Human
uggcaggugggggugcug

SEQ ID NO: 940088 - RNA, 18 nt, Human
aaacaaauugaguaucca

SEQ ID NO: 940089 - RNA, 20 nt, Human
aagaaaaaacaaauugagua

SEQ ID NO: 940090 - RNA, 28 nt, Human
aauauaagaaguaaauccaauauuuuag

SEQ ID NO: 940091 - RNA, 21 nt, Human
auacucauuuucucuauaaga

SEQ ID NO: 940092 - RNA, 23 nt, Human
aucacauugggaaaucuuugauc

SEQ ID NO: 940093 - RNA, 21 nt, Human
caacaauugugugguuuguca

SEQ ID NO: 940094 - RNA, 23 nt, Human
cagagagguuuccuuccccuucc

SEQ ID NO: 940095 - RNA, 22 nt, Human
cccaagcccuggaacucccggg

SEQ ID NO: 940096 - RNA, 25 nt, Human
ccuuuagugccuacccuuuucuuca

SEQ ID NO: 940097 - RNA, 19 nt, Human
cgggagagcaggugucaga

SEQ ID NO: 940098 - RNA, 18 nt, Human
cuugauguucaguuucua

SEQ ID NO: 940099 - RNA, 23 nt, Human
cuuuagugccuacccuuuucuuc

SEQ ID NO: 940100 - RNA, 21 nt, Human
gcagaaaaagaaagacaugcc

SEQ ID NO: 940101 - RNA, 20 nt, Human
gcccuggaacucccgggcuc

SEQ ID NO: 940102 - RNA, 23 nt, Human
gcccuggaacucccgggcuccac

SEQ ID NO: 940103 - RNA, 20 nt, Human
ggugucagauuucagagagg

SEQ ID NO: 940104 - RNA, 20 nt, Human
gugucagauuucagagaggu

SEQ ID NO: 940105 - RNA, 23 nt, Human
uagaaauucuucuuucuguguuc

SEQ ID NO: 940106 - RNA, 21 nt, Human
uagaauucuucauuguguauc

SEQ ID NO: 940107 - RNA, 20 nt, Human
uagccaaauagaauucuuca

SEQ ID NO: 940108 - RNA, 21 nt, Human
uagcuaguacauuuuccccaa

SEQ ID NO: 940109 - RNA, 25 nt, Human
ucccaagcccuggaacucccgggcu

SEQ ID NO: 940110 - RNA, 27 nt, Human
ucccaagcccuggaacucccgggcucc

SEQ ID NO: 940111 - RNA, 21 nt, Human
ucuucuuucuguguucucccu

SEQ ID NO: 940112 - RNA, 18 nt, Human
ugaaagggccucagggau

SEQ ID NO: 940113 - RNA, 23 nt, Human
ugacagguaacuuguucugauuu

SEQ ID NO: 940114 - RNA, 19 nt, Human
uggaacucccgggcuccac

SEQ ID NO: 940115 - RNA, 23 nt, Human
ugggguucuugauguucaguuuc

SEQ ID NO: 940116 - RNA, 27 nt, Human
uggugggguucuugauguucaguuucu

SEQ ID NO: 940117 - RNA, 19 nt, Human
uuuuuuuuuuuuggaaccu

SEQ ID NO: 940118 - RNA, 24 nt, Human
uuuuuuuuuuuuuuuuggaaccuu

SEQ ID NO: 940119 - RNA, 24 nt, Human
uuuuuuuuuuuuuuuuuggaaccu

SEQ ID NO: 940120 - RNA, 28 nt, Human
uuuuuuuuuuuuuuuuuuuuuuuggggg

SEQ ID NO: 940121 - RNA, 20 nt, Human
aaaaagcaaaucuuaacuua

SEQ ID NO: 940122 - RNA, 23 nt, Human
aaaaggaaaaaaaaagacauacu

SEQ ID NO: 940123 - RNA, 21 nt, Human
aacaauaaagcuacuuaagug

SEQ ID NO: 940124 - RNA, 23 nt, Human
aaccccacuacggcacucaccuu

SEQ ID NO: 940125 - RNA, 26 nt, Human
aauaaacaguaaaacaucuguauuaa

SEQ ID NO: 940126 - RNA, 24 nt, Human
accacgcccugcccccuccacccc

SEQ ID NO: 940127 - RNA, 21 nt, Human
acccauucuuccuccucaagc

SEQ ID NO: 940128 - RNA, 24 nt, Human
acucaccuuaccucaccacgcccu

SEQ ID NO: 940129 - RNA, 22 nt, Human
agacauacuuuucccauaaaau

SEQ ID NO: 940130 - RNA, 28 nt, Human
aggaaaaaaaaagacauacuuuucccaa

SEQ ID NO: 940131 - RNA, 19 nt, Human
caacagcagaaccucuggg

SEQ ID NO: 940132 - RNA, 19 nt, Human
cacgcccugcccccuccac

SEQ ID NO: 940133 - RNA, 21 nt, Human
cacgcccugcccccuccaccc

SEQ ID NO: 940134 - RNA, 18 nt, Human
cacggucauccuccucug

SEQ ID NO: 940135 - RNA, 21 nt, Human
cagaaccucugggaaaggaac

SEQ ID NO: 940136 - RNA, 19 nt, Human
cccccuccaccccacugcg

SEQ ID NO: 940137 - RNA, 21 nt, Human
cccuccaccccacugcggccg

SEQ ID NO: 940138 - RNA, 22 nt, Human
ccucaccacgcccugcccccuc

SEQ ID NO: 940139 - RNA, 24 nt, Human
ccucaccacgcccugcccccucca

SEQ ID NO: 940140 - RNA, 20 nt, Human
cgcccugcccccuccacccc

SEQ ID NO: 940141 - RNA, 22 nt, Human
cgcccugcccccuccaccccac

SEQ ID NO: 940142 - RNA, 20 nt, Human
gaacucccagguggcagccc

SEQ ID NO: 940143 - RNA, 18 nt, Human
gacaacaaaggcauuuuc

SEQ ID NO: 940144 - RNA, 24 nt, Human
gcaaaaagcaaaucuuaacuuaca

SEQ ID NO: 940145 - RNA, 18 nt, Human
gcccccuccaccccacug

SEQ ID NO: 940146 - RNA, 20 nt, Human
gcccugcccccuccacccca

SEQ ID NO: 940147 - RNA, 19 nt, Human
gccuuuuuuuuuuuuuuuu

SEQ ID NO: 940148 - RNA, 24 nt, Human
gcugcauuuuacacaucucugauu

SEQ ID NO: 940149 - RNA, 23 nt, Human
ggcuccagggaaccccacuacgg

SEQ ID NO: 940150 - RNA, 22 nt, Human
guauccagaacucccagguggc

SEQ ID NO: 940151 - RNA, 18 nt, Human
uaaaauuccaggucuuac

SEQ ID NO: 940152 - RNA, 25 nt, Human
uaagaacauaaucuaaauuauaacc

SEQ ID NO: 940153 - RNA, 23 nt, Human
uccucaagcacggucauccuccu

SEQ ID NO: 940154 - RNA, 25 nt, Human
ugaauuagaaauaaacaguaaaaca

SEQ ID NO: 940155 - RNA, 22 nt, Human
ugacaacaaaggcauuuucuca

SEQ ID NO: 940156 - RNA, 21 nt, Human
ugauggcaacagcagaaccuc

SEQ ID NO: 940157 - RNA, 21 nt, Human
ugcaacuuggcaaaaagcaaa

SEQ ID NO: 940158 - RNA, 19 nt, Human
uggauacaacuuugcaacu

SEQ ID NO: 940159 - RNA, 22 nt, Human
uggcaaguacaacagguuaagg

SEQ ID NO: 940160 - RNA, 20 nt, Human
uggcagcccagugugggauu

SEQ ID NO: 940161 - RNA, 20 nt, Human
uuagaaauaaacaguaaaac

SEQ ID NO: 940162 - RNA, 24 nt, Human
uucccauaaaauuccaggucuuac

SEQ ID NO: 940163 - RNA, 19 nt, Human
uugaauuacaacaacauuu

SEQ ID NO: 940164 - RNA, 21 nt, Human
uuuuuuuuuuuuuuuuuuaca

SEQ ID NO: 940165 - RNA, 22 nt, Human
aagugcaggcgcccaguggugc

SEQ ID NO: 940166 - RNA, 23 nt, Human
agucuggcccccugcccggccuc

SEQ ID NO: 940167 - RNA, 21 nt, Human
auggcaacaaugacaaaagcc

SEQ ID NO: 940168 - RNA, 20 nt, Human
caagagaagcagaagccaua

SEQ ID NO: 940169 - RNA, 20 nt, Human
cacaggacccagaacccgcc

SEQ ID NO: 940170 - RNA, 23 nt, Human
cagggauacuucucccaaaguuc

SEQ ID NO: 940171 - RNA, 24 nt, Human
cagggauacuucucccaaaguucc

SEQ ID NO: 940172 - RNA, 20 nt, Human
ccgccgcgcccccggcggcc

SEQ ID NO: 940173 - RNA, 23 nt, Human
ccgccgcgcccgcugacgccgcc

SEQ ID NO: 940174 - RNA, 24 nt, Human
ccgccgcgcccgcugacgccgccu

SEQ ID NO: 940175 - RNA, 18 nt, Human
ccgcgcccccggcggccg

SEQ ID NO: 940176 - RNA, 19 nt, Human
ccggccucgcgcucugccg

SEQ ID NO: 940177 - RNA, 23 nt, Human
ccggcggccgcggaaacuccccc

SEQ ID NO: 940178 - RNA, 23 nt, Human
ccuccgccgcgcccgcugacgcc

SEQ ID NO: 940179 - RNA, 20 nt, Human
cgacuccgagucuggccccc

SEQ ID NO: 940180 - RNA, 19 nt, Human
cgccagugcucgcggcccc

SEQ ID NO: 940181 - RNA, 23 nt, Human
cgccucgacuccgagucuggccc

SEQ ID NO: 940182 - RNA, 19 nt, Human
cuccgagucuggcccccug

SEQ ID NO: 940183 - RNA, 22 nt, Human
gagcugaggcacacacaagaga

SEQ ID NO: 940184 - RNA, 18 nt, Human
gccgcgcccgcugacgcc

SEQ ID NO: 940185 - RNA, 18 nt, Human
gcggcugucgggcgcgcc

SEQ ID NO: 940186 - RNA, 22 nt, Human
uaagugcaggcgcccaguggug

SEQ ID NO: 940187 - RNA, 19 nt, Human
ugaccggucacaggaccca

SEQ ID NO: 940188 - RNA, 19 nt, Human
ugaggcacacacaagagaa

SEQ ID NO: 940189 - RNA, 19 nt, Human
uggcaacaaugacaaaagc

SEQ ID NO: 940190 - RNA, 22 nt, Human
uggcaacaaugacaaaagccua

SEQ ID NO: 940191 - RNA, 23 nt, Human
uggcaacaaugacaaaagccuaa

SEQ ID NO: 940192 - RNA, 18 nt, Human
uggugcugccuuuugaag

SEQ ID NO: 940193 - RNA, 22 nt, Human
uuggaagccuuaccaaauccug

SEQ ID NO: 940194 - RNA, 23 nt, Human
uuggaagccuuaccaaauccuga

SEQ ID NO: 940195 - RNA, 20 nt, Human
uuugaagugccacauguggg

SEQ ID NO: 940196 - RNA, 21 nt, Human
uuuuuuuuuuuuuugcaggua

SEQ ID NO: 940197 - RNA, 18 nt, Human
uuuuuuuuuuuuuuuuug

SEQ ID NO: 940198 - RNA, 21 nt, Human
uuuuuuuuuuuuuuuuugcag

SEQ ID NO: 940199 - RNA, 22 nt, Human
uuuuuuuuuuuuuuuuugcagg

SEQ ID NO: 940200 - RNA, 23 nt, Human
uuuuuuuuuuuuuuuuugcaggu

SEQ ID NO: 940201 - RNA, 19 nt, Human
aaaaaaaaaaaaaaaaaga

SEQ ID NO: 940202 - RNA, 23 nt, Human
aaaaaaaaaaaaaaaagaaagaa

SEQ ID NO: 940203 - RNA, 22 nt, Human
aaaaagaaauaaaguuacucuu

SEQ ID NO: 940204 - RNA, 18 nt, Human
aaaaucagcugggugugg

SEQ ID NO: 940205 - RNA, 19 nt, Human
aaaaucugacuuauuuuug

SEQ ID NO: 940206 - RNA, 19 nt, Human
aaacaaaaaaaguacucug

SEQ ID NO: 940207 - RNA, 21 nt, Human
aacauaccaauaauaacaaaa

SEQ ID NO: 940208 - RNA, 20 nt, Human
aacauagcaagaccccgucu

SEQ ID NO: 940209 - RNA, 19 nt, Human
aacauggugaaaccccauc

SEQ ID NO: 940210 - RNA, 20 nt, Human
aacauggugaaaccccaucu

SEQ ID NO: 940211 - RNA, 23 nt, Human
aacauggugaaaccccaucuaua

SEQ ID NO: 940212 - RNA, 20 nt, Human
aacucggcugggugcaguga

SEQ ID NO: 940213 - RNA, 18 nt, Human
aagaaagaaacucaaaua

SEQ ID NO: 940214 - RNA, 22 nt, Human
aagaaagaaacucaaauaacuc

SEQ ID NO: 940215 - RNA, 20 nt, Human
aagcugaggcggguggauca

SEQ ID NO: 940216 - RNA, 18 nt, Human
aaggacagcaaucuauca

SEQ ID NO: 940217 - RNA, 24 nt, Human
aaucacuugaaccugggaggcgga

SEQ ID NO: 940218 - RNA, 19 nt, Human
acaaagaaaggccagaugc

SEQ ID NO: 940219 - RNA, 24 nt, Human
acagagcgagacuccaucucaaaa

SEQ ID NO: 940220 - RNA, 18 nt, Human
accuucccgccccgcccu

SEQ ID NO: 940221 - RNA, 18 nt, Human
acgccacugcacuccagc

SEQ ID NO: 940222 - RNA, 28 nt, Human
acuccaucucaaaaaaaaaaaaaaaaaa

SEQ ID NO: 940223 - RNA, 18 nt, Human
acugcacuccagccugga

SEQ ID NO: 940224 - RNA, 23 nt, Human
acugcacuccagccuggagacag

SEQ ID NO: 940225 - RNA, 20 nt, Human
agauauugaaagcuuuaacc

SEQ ID NO: 940226 - RNA, 20 nt, Human
agcacuuugggaagcugagg

SEQ ID NO: 940227 - RNA, 18 nt, Human
agccugcagagaggcugg

SEQ ID NO: 940228 - RNA, 24 nt, Human
agccuggacaacauagcaagaccc

SEQ ID NO: 940229 - RNA, 23 nt, Human
agcugggugugguagugcacgcc

SEQ ID NO: 940230 - RNA, 21 nt, Human
aggagccaccgcccaccagcc

SEQ ID NO: 940231 - RNA, 18 nt, Human
aggauuuaguaagaaagc

SEQ ID NO: 940232 - RNA, 22 nt, Human
aggcaggagaaucacuugaacc

SEQ ID NO: 940233 - RNA, 24 nt, Human
aggcaggagaaucacuugaaccug

SEQ ID NO: 940234 - RNA, 21 nt, Human
aggcggagguugcagugagcc

SEQ ID NO: 940235 - RNA, 24 nt, Human
aggcggagguugcagugagccgag

SEQ ID NO: 940236 - RNA, 24 nt, Human
aggcggguggaucaugaggucaag

SEQ ID NO: 940237 - RNA, 22 nt, Human
aggcgugggaccugucgggggc

SEQ ID NO: 940238 - RNA, 24 nt, Human
aggcugaggcaggagaaucacuug

SEQ ID NO: 940239 - RNA, 24 nt, Human
aggcugaggugggaggauugcuug

SEQ ID NO: 940240 - RNA, 19 nt, Human
agguguggcacccgcccgc

SEQ ID NO: 940241 - RNA, 23 nt, Human
aguacuggggaggcugagguggg

SEQ ID NO: 940242 - RNA, 24 nt, Human
agugacucacaccuguaaucccag

SEQ ID NO: 940243 - RNA, 21 nt, Human
agugcacgccuguaaucccag

SEQ ID NO: 940244 - RNA, 19 nt, Human
aguuaaaaaauaaguccuu

SEQ ID NO: 940245 - RNA, 20 nt, Human
auagcaauuagaguugugcc

SEQ ID NO: 940246 - RNA, 21 nt, Human
auccuggccaacauggugaaa

SEQ ID NO: 940247 - RNA, 24 nt, Human
augacgccacugcacuccagccug

SEQ ID NO: 940248 - RNA, 21 nt, Human
auguuuuuuaaaaauaaaaac

SEQ ID NO: 940249 - RNA, 24 nt, Human
caacauagcaagaccccgucucua

SEQ ID NO: 940250 - RNA, 21 nt, Human
caacauggugaaaccccaucu

SEQ ID NO: 940251 - RNA, 23 nt, Human
caagagauaccauaugggauaca

SEQ ID NO: 940252 - RNA, 24 nt, Human
cacaccuguaaucccagcacuuug

SEQ ID NO: 940253 - RNA, 31 nt, Human
cacacgccaggcgucacucgggcuggcgccc

SEQ ID NO: 940254 - RNA, 21 nt, Human
caccugaaaaccaacuuuucc

SEQ ID NO: 940255 - RNA, 19 nt, Human
caccuguaaucccagcacu

SEQ ID NO: 940256 - RNA, 24 nt, Human
caccuguaaucccagcacuuuggg

SEQ ID NO: 940257 - RNA, 18 nt, Human
cacgccuguaaucccagc

SEQ ID NO: 940258 - RNA, 19 nt, Human
cacgccuguaaucccagcu

SEQ ID NO: 940259 - RNA, 22 nt, Human
cacuccagccuggagacagagc

SEQ ID NO: 940260 - RNA, 23 nt, Human
cacuccagccuggagacagagcg

SEQ ID NO: 940261 - RNA, 18 nt, Human
cacugcacuccagccugg

SEQ ID NO: 940262 - RNA, 19 nt, Human
cacugcacuccagccugga

SEQ ID NO: 940263 - RNA, 23 nt, Human
cacugcacuccagccuggagaca

SEQ ID NO: 940264 - RNA, 21 nt, Human
cacuugaaccugggaggcgga

SEQ ID NO: 940265 - RNA, 24 nt, Human
cagcacuuugggaagcugaggcgg

SEQ ID NO: 940266 - RNA, 19 nt, Human
cagcgcccugacugaccca

SEQ ID NO: 940267 - RNA, 24 nt, Human
cagcuacucgggaggcugaggcag

SEQ ID NO: 940268 - RNA, 21 nt, Human
caggagccaccgcccaccagc

SEQ ID NO: 940269 - RNA, 18 nt, Human
caggcgugggaccugucg

SEQ ID NO: 940270 - RNA, 25 nt, Human
cauagcaagaccccgucucuaugaa

SEQ ID NO: 940271 - RNA, 30 nt, Human
cauagcaagaccccgucucuaugaaaaaag

SEQ ID NO: 940272 - RNA, 18 nt, Human
ccaaaauaaaauauaaag

SEQ ID NO: 940273 - RNA, 22 nt, Human
ccaccgcaagagcgcgcgccca

SEQ ID NO: 940274 - RNA, 23 nt, Human
ccacguccaagguucccgcccuc

SEQ ID NO: 940275 - RNA, 19 nt, Human
ccacugcacuccagccugg

SEQ ID NO: 940276 - RNA, 20 nt, Human
ccacugcacuccagccugga

SEQ ID NO: 940277 - RNA, 21 nt, Human
ccacugcacuccagccuggag

SEQ ID NO: 940278 - RNA, 23 nt, Human
ccacugcacuccagccuggagac

SEQ ID NO: 940279 - RNA, 20 nt, Human
cccccaaguuacaacucuuc

SEQ ID NO: 940280 - RNA, 19 nt, Human
cccgcacagguguggcacc

SEQ ID NO: 940281 - RNA, 19 nt, Human
cccugacugacccagcccc

SEQ ID NO: 940282 - RNA, 22 nt, Human
ccgccccaaacugaggcggagg

SEQ ID NO: 940283 - RNA, 19 nt, Human
ccuacagucccaguacugg

SEQ ID NO: 940284 - RNA, 23 nt, Human
ccugcagagaggcugggcccagc

SEQ ID NO: 940285 - RNA, 22 nt, Human
ccugcgcaccuucccgccccgc

SEQ ID NO: 940286 - RNA, 23 nt, Human
ccuggacaacauagcaagacccc

SEQ ID NO: 940287 - RNA, 21 nt, Human
ccuggagacagagcgagacuc

SEQ ID NO: 940288 - RNA, 22 nt, Human
ccuggccaacauggugaaaccc

SEQ ID NO: 940289 - RNA, 23 nt, Human
ccuggccaacauggugaaacccc

SEQ ID NO: 940290 - RNA, 24 nt, Human
ccuggccaacauggugaaacccca

SEQ ID NO: 940291 - RNA, 19 nt, Human
ccugggaggcggagguugc

SEQ ID NO: 940292 - RNA, 21 nt, Human
ccuguaaucccagcuacucgg

SEQ ID NO: 940293 - RNA, 21 nt, Human
ccuucacaccuacaauccaaa

SEQ ID NO: 940294 - RNA, 24 nt, Human
cgagaccauccuggccaacauggu

SEQ ID NO: 940295 - RNA, 23 nt, Human
cgagacuccaucucaaaaaaaaa

SEQ ID NO: 940296 - RNA, 25 nt, Human
cgccacugcacuccagccuggagac

SEQ ID NO: 940297 - RNA, 19 nt, Human
cgccccgcccuugcccgca

SEQ ID NO: 940298 - RNA, 23 nt, Human
cgccuguaaucccagcuacucgg

SEQ ID NO: 940299 - RNA, 24 nt, Human
cgccuguaaucccagcuacucggg

SEQ ID NO: 940300 - RNA, 19 nt, Human
cggaggaaaggagacacag

SEQ ID NO: 940301 - RNA, 24 nt, Human
cgggaggcugaggcaggagaauca

SEQ ID NO: 940302 - RNA, 19 nt, Human
cgggggcuucacggcagcg

SEQ ID NO: 940303 - RNA, 23 nt, Human
cucaaaaaaaaaaaaaaaaaaaa

SEQ ID NO: 940304 - RNA, 22 nt, Human
cucaaggccagccuggacaaca

SEQ ID NO: 940305 - RNA, 22 nt, Human
cucacaccuguaaucccagcac

SEQ ID NO: 940306 - RNA, 24 nt, Human
cucacaccuguaaucccagcacuu

SEQ ID NO: 940307 - RNA, 19 nt, Human
cuccaucucaaaaaaaaaa

SEQ ID NO: 940308 - RNA, 21 nt, Human
cugaaaauacuguaguacaau

SEQ ID NO: 940309 - RNA, 23 nt, Human
cuggccaacauggugaaacccca

SEQ ID NO: 940310 - RNA, 21 nt, Human
gacccauuauaguugagauua

SEQ ID NO: 940311 - RNA, 23 nt, Human
gagaaucacuugaaccugggagg

SEQ ID NO: 940312 - RNA, 23 nt, Human
gagaugacgccacugcacuccag

SEQ ID NO: 940313 - RNA, 21 nt, Human
gaggcggguggaucaugaggu

SEQ ID NO: 940314 - RNA, 24 nt, Human
gaggugggaggauugcuugagccc

SEQ ID NO: 940315 - RNA, 21 nt, Human
gagguugcagugagccgagau

SEQ ID NO: 940316 - RNA, 23 nt, Human
gcacuccagccuggagacagagc

SEQ ID NO: 940317 - RNA, 19 nt, Human
gcagcgcggaaggccagcc

SEQ ID NO: 940318 - RNA, 23 nt, Human
gcaggagaaucacuugaaccugg

SEQ ID NO: 940319 - RNA, 20 nt, Human
gcaugauuaagaaaacauga

SEQ ID NO: 940320 - RNA, 22 nt, Human
gccaacauggugaaaccccauc

SEQ ID NO: 940321 - RNA, 22 nt, Human
gccaggcgucacucgggcuggc

SEQ ID NO: 940322 - RNA, 22 nt, Human
gcccaggagcucaaggccagcc

SEQ ID NO: 940323 - RNA, 24 nt, Human
gcgugacaaugacaaacagcaaag

SEQ ID NO: 940324 - RNA, 18 nt, Human
ggagguugcagugagccg

SEQ ID NO: 940325 - RNA, 20 nt, Human
ggagguugcagugagccgag

SEQ ID NO: 940326 - RNA, 22 nt, Human
ggagguugcagugagccgagau

SEQ ID NO: 940327 - RNA, 23 nt, Human
ggagguugcagugagccgagaug

SEQ ID NO: 940328 - RNA, 21 nt, Human
ggcugggugcagugacucaca

SEQ ID NO: 940329 - RNA, 21 nt, Human
gggaggcugaggugggaggau

SEQ ID NO: 940330 - RNA, 24 nt, Human
gggugcagugacucacaccuguaa

SEQ ID NO: 940331 - RNA, 24 nt, Human
gguagugcacgccuguaaucccag

SEQ ID NO: 940332 - RNA, 23 nt, Human
ggugugguagugcacgccuguaa

SEQ ID NO: 940333 - RNA, 20 nt, Human
gugacaaugacaaacagcaa

SEQ ID NO: 940334 - RNA, 18 nt, Human
gugcagugacucacaccu

SEQ ID NO: 940335 - RNA, 20 nt, Human
guguguccuaaaccuuuaac

SEQ ID NO: 940336 - RNA, 18 nt, Human
guuaaaaaauaaguccuu

SEQ ID NO: 940337 - RNA, 24 nt, Human
guugcagugagccgagaugacgcc

SEQ ID NO: 940338 - RNA, 18 nt, Human
guuuauugaacuucuugg

SEQ ID NO: 940339 - RNA, 18 nt, Human
uaaaacaaauuguuacaa

SEQ ID NO: 940340 - RNA, 22 nt, Human
uaaacaaaaaucuuaaacuaga

SEQ ID NO: 940341 - RNA, 18 nt, Human
uaaauucaaaauaaaagu

SEQ ID NO: 940342 - RNA, 22 nt, Human
uaagaaaacaugaucucccuaa

SEQ ID NO: 940343 - RNA, 20 nt, Human
uaagcugguuuauugaacuu

SEQ ID NO: 940344 - RNA, 21 nt, Human
uaaguagauacaaaauacaaa

SEQ ID NO: 940345 - RNA, 23 nt, Human
uaccaaaauaaaauauaaagcac

SEQ ID NO: 940346 - RNA, 19 nt, Human
uaccuaggcaggcguggga

SEQ ID NO: 940347 - RNA, 20 nt, Human
uagaaaaucaaacaucuaga

SEQ ID NO: 940348 - RNA, 23 nt, Human
uaggcaggcgugggaccugucgg

SEQ ID NO: 940349 - RNA, 23 nt, Human
uaugacacaauacuauuacagaa

SEQ ID NO: 940350 - RNA, 23 nt, Human
ucaaaaaaaaaaaaaaaaaaaaa

SEQ ID NO: 940351 - RNA, 24 nt, Human
ucaaauuaagacuuuuccaaaaca

SEQ ID NO: 940352 - RNA, 20 nt, Human
ucacggcagcgcggaaggcc

SEQ ID NO: 940353 - RNA, 24 nt, Human
ucacuugaaccugggaggcggagg

SEQ ID NO: 940354 - RNA, 25 nt, Human
ucacuugaaccugggaggcggaggu

SEQ ID NO: 940355 - RNA, 20 nt, Human
ucagcugggugugguagugc

SEQ ID NO: 940356 - RNA, 24 nt, Human
ucagcugggugugguagugcacgc

SEQ ID NO: 940357 - RNA, 24 nt, Human
ucaugaggucaagagaucgagacc

SEQ ID NO: 940358 - RNA, 19 nt, Human
ucauuuggcuuaauuuccu

SEQ ID NO: 940359 - RNA, 21 nt, Human
uccacaacaaaauuacuuaga

SEQ ID NO: 940360 - RNA, 22 nt, Human
uccagccuggagacagagcgag

SEQ ID NO: 940361 - RNA, 23 nt, Human
uccagccuggagacagagcgaga

SEQ ID NO: 940362 - RNA, 23 nt, Human
uccaucucaaaaaaaaaaaaaaa

SEQ ID NO: 940363 - RNA, 21 nt, Human
ucccaggagccaccgcccacc

SEQ ID NO: 940364 - RNA, 19 nt, Human
uccuguguuagcuagaagc

SEQ ID NO: 940365 - RNA, 25 nt, Human
ucgggaggcugaggcaggagaauca

SEQ ID NO: 940366 - RNA, 26 nt, Human
ucucaaauuaagacuuuuccaaaaca

SEQ ID NO: 940367 - RNA, 25 nt, Human
ugaaaaaacaaaaaaaguacucugg

SEQ ID NO: 940368 - RNA, 19 nt, Human
ugaaaccccaucuauacua

SEQ ID NO: 940369 - RNA, 24 nt, Human
ugaaccugggaggcggagguugca

SEQ ID NO: 940370 - RNA, 20 nt, Human
ugacaaacagcaaaguguca

SEQ ID NO: 940371 - RNA, 24 nt, Human
ugacaaugacaaacagcaaagugu

SEQ ID NO: 940372 - RNA, 22 nt, Human
ugacccagccccgccacgucca

SEQ ID NO: 940373 - RNA, 24 nt, Human
ugacucacaccuguaaucccagca

SEQ ID NO: 940374 - RNA, 23 nt, Human
ugagcccaggagcucaaggccag

SEQ ID NO: 940375 - RNA, 20 nt, Human
ugaggcaggagaaucacuug

SEQ ID NO: 940376 - RNA, 24 nt, Human
ugaggcaggagaaucacuugaacc

SEQ ID NO: 940377 - RNA, 25 nt, Human
ugaggcaggagaaucacuugaaccu

SEQ ID NO: 940378 - RNA, 19 nt, Human
ugaggcggguggaucauga

SEQ ID NO: 940379 - RNA, 24 nt, Human
ugaggcggguggaucaugagguca

SEQ ID NO: 940380 - RNA, 20 nt, Human
ugaggugggaggauugcuug

SEQ ID NO: 940381 - RNA, 23 nt, Human
ugaggugggaggauugcuugagc

SEQ ID NO: 940382 - RNA, 24 nt, Human
ugaggugggaggauugcuugagcc

SEQ ID NO: 940383 - RNA, 22 nt, Human
ugcuuucaguuaguuuuucacu

SEQ ID NO: 940384 - RNA, 24 nt, Human
ugcuuucaguuaguuuuucacugu

SEQ ID NO: 940385 - RNA, 23 nt, Human
uggaaguugauuuguuaacuugg

SEQ ID NO: 940386 - RNA, 24 nt, Human
uggccaacauggugaaaccccauc

SEQ ID NO: 940387 - RNA, 26 nt, Human
uggcuaagcugguuuauugaacuucu

SEQ ID NO: 940388 - RNA, 24 nt, Human
ugggaagcugaggcggguggauca

SEQ ID NO: 940389 - RNA, 29 nt, Human
ugggaggcggagguugcagugacaacggu

SEQ ID NO: 940390 - RNA, 24 nt, Human
ugggaggcggagguugcagugagc

SEQ ID NO: 940391 - RNA, 24 nt, Human
ugguagugcacgccuguaauccca

SEQ ID NO: 940392 - RNA, 21 nt, Human
uuacaaaugagauacaaauau

SEQ ID NO: 940393 - RNA, 19 nt, Human
uuacuuagauuucaugagg

SEQ ID NO: 940394 - RNA, 24 nt, Human
uuaguaauuaguuguuagauagcu

SEQ ID NO: 940395 - RNA, 21 nt, Human
uuauaguuaaauuauccaggu

SEQ ID NO: 940396 - RNA, 24 nt, Human
uucaugaggaaacauguauuugca

SEQ ID NO: 940397 - RNA, 24 nt, Human
uucucaaauuaagacuuuuccaaa

SEQ ID NO: 940398 - RNA, 19 nt, Human
uugaaagcuuuaaccccau

SEQ ID NO: 940399 - RNA, 23 nt, Human
uugaaauuaguaaaggcuaagaa

SEQ ID NO: 940400 - RNA, 24 nt, Human
uugaaccugggaggcggagguugc

SEQ ID NO: 940401 - RNA, 18 nt, Human
uugcagugagccgagaug

SEQ ID NO: 940402 - RNA, 20 nt, Human
uugcagugagccgagaugac

SEQ ID NO: 940403 - RNA, 24 nt, Human
uugcuugagcccaggagcucaagg

SEQ ID NO: 940404 - RNA, 25 nt, Human
uugggaagcugaggcggguggauca

SEQ ID NO: 940405 - RNA, 19 nt, Human
uuugaagcuuccuucauug

SEQ ID NO: 940406 - RNA, 21 nt, Human
aagcauccucaaacacaaagg

SEQ ID NO: 940407 - RNA, 18 nt, Human
acagagacacucucccuc

SEQ ID NO: 940408 - RNA, 19 nt, Human
acuacaacucggggccacg

SEQ ID NO: 940409 - RNA, 18 nt, Human
agucagugcaaaugucca

SEQ ID NO: 940410 - RNA, 19 nt, Human
caaacacaaagggcccagc

SEQ ID NO: 940411 - RNA, 25 nt, Human
cacaaagggcccagcaggcugagca

SEQ ID NO: 940412 - RNA, 21 nt, Human
caguccccugaggaguagggg

SEQ ID NO: 940413 - RNA, 19 nt, Human
ccacggggacccuacggga

SEQ ID NO: 940414 - RNA, 22 nt, Human
cccagcaggcugagcaaaagaa

SEQ ID NO: 940415 - RNA, 21 nt, Human
cccgacgaucacccgcggccg

SEQ ID NO: 940416 - RNA, 18 nt, Human
cccugagaaggcgccgag

SEQ ID NO: 940417 - RNA, 19 nt, Human
cccuggacaguccccugag

SEQ ID NO: 940418 - RNA, 19 nt, Human
ccuagggcugggcagucuc

SEQ ID NO: 940419 - RNA, 19 nt, Human
ccucugugggaauacugcc

SEQ ID NO: 940420 - RNA, 21 nt, Human
cgcccuggacaguccccugag

SEQ ID NO: 940421 - RNA, 21 nt, Human
cguggagacccgacgaucacc

SEQ ID NO: 940422 - RNA, 21 nt, Human
cucacuaccacugggcgcccu

SEQ ID NO: 940423 - RNA, 22 nt, Human
cuuuggcacggugccugggggc

SEQ ID NO: 940424 - RNA, 19 nt, Human
gaacagagacacucucccu

SEQ ID NO: 940425 - RNA, 21 nt, Human
gaacagagacacucucccuca

SEQ ID NO: 940426 - RNA, 19 nt, Human
gaguagggggcauccaguc

SEQ ID NO: 940427 - RNA, 19 nt, Human
gaucccagcuaccccucug

SEQ ID NO: 940428 - RNA, 18 nt, Human
ggcuggaaucauuaagca

SEQ ID NO: 940429 - RNA, 18 nt, Human
uaccacugggcgcccugg

SEQ ID NO: 940430 - RNA, 20 nt, Human
ucaaacacaaagggcccagc

SEQ ID NO: 940431 - RNA, 23 nt, Human
ucacuaccacugggcgcccugga

SEQ ID NO: 940432 - RNA, 19 nt, Human
ucagugcaaauguccaggg

SEQ ID NO: 940433 - RNA, 23 nt, Human
ucccagcuaccccucugugggaa

SEQ ID NO: 940434 - RNA, 24 nt, Human
uccgcgucagcgacccgggcgcgu

SEQ ID NO: 940435 - RNA, 20 nt, Human
uccucaaacacaaagggccc

SEQ ID NO: 940436 - RNA, 22 nt, Human
ucucggagacgccagccgaauu

SEQ ID NO: 940437 - RNA, 23 nt, Human
ucucugaacagucuccucagccc

SEQ ID NO: 940438 - RNA, 20 nt, Human
uggaaucauuaagcauccuc

SEQ ID NO: 940439 - RNA, 18 nt, Human
uggcacggugccuggggg

SEQ ID NO: 940440 - RNA, 22 nt, Human
uguccaggggucaagcucugga

SEQ ID NO: 940441 - RNA, 18 nt, Human
aaaagccagagcaggacg

SEQ ID NO: 940442 - RNA, 27 nt, Human
aaauaauccucccauagccccccugcc

SEQ ID NO: 940443 - RNA, 19 nt, Human
aagaugggcuggggagggg

SEQ ID NO: 940444 - RNA, 21 nt, Human
aaugagcaacgcggagcccac

SEQ ID NO: 940445 - RNA, 18 nt, Human
aauggcuguggggacagg

SEQ ID NO: 940446 - RNA, 21 nt, Human
acacugucaugaccaaaauca

SEQ ID NO: 940447 - RNA, 25 nt, Human
acaucagguccacuaggacgucggu

SEQ ID NO: 940448 - RNA, 19 nt, Human
accccaucccguggcucca

SEQ ID NO: 940449 - RNA, 21 nt, Human
acgaaacugagacuguccccc

SEQ ID NO: 940450 - RNA, 22 nt, Human
acgcggagcccacuccacuggc

SEQ ID NO: 940451 - RNA, 18 nt, Human
acuugaucccuguagugg

SEQ ID NO: 940452 - RNA, 20 nt, Human
agaaagcccaagaguccagc

SEQ ID NO: 940453 - RNA, 20 nt, Human
agaaggcaaaagccagagca

SEQ ID NO: 940454 - RNA, 23 nt, Human
agaggccagcaugccccccgccc

SEQ ID NO: 940455 - RNA, 22 nt, Human
agcaggcuggcaucaagaaggc

SEQ ID NO: 940456 - RNA, 21 nt, Human
agccccaggcaccgugcaucc

SEQ ID NO: 940457 - RNA, 19 nt, Human
agcccugcagcccccucca

SEQ ID NO: 940458 - RNA, 20 nt, Human
agcucccagaauggcugugg

SEQ ID NO: 940459 - RNA, 22 nt, Human
aggaaccccccucuuauugcuu

SEQ ID NO: 940460 - RNA, 19 nt, Human
aggcaaaagccagagcagg

SEQ ID NO: 940461 - RNA, 21 nt, Human
aggcaaaagccagagcaggac

SEQ ID NO: 940462 - RNA, 22 nt, Human
aggcaaaagccagagcaggacg

SEQ ID NO: 940463 - RNA, 18 nt, Human
aggcacacugucaugacc

SEQ ID NO: 940464 - RNA, 19 nt, Human
aggcaggacaagaaaucug

SEQ ID NO: 940465 - RNA, 19 nt, Human
aggcaggacaagaaaucug

SEQ ID NO: 940466 - RNA, 20 nt, Human
aggcuggcaucaagaaggca

SEQ ID NO: 940467 - RNA, 19 nt, Human
agggugggaggccccuucu

SEQ ID NO: 940468 - RNA, 18 nt, Human
aguguagacuccugaccu

SEQ ID NO: 940469 - RNA, 22 nt, Human
augagguguccgggcugggggu

SEQ ID NO: 940470 - RNA, 22 nt, Human
caaaagccagagcaggacgugg

SEQ ID NO: 940471 - RNA, 22 nt, Human
caaccaggacagucccaaggac

SEQ ID NO: 940472 - RNA, 21 nt, Human
caacgcggagcccacuccacu

SEQ ID NO: 940473 - RNA, 19 nt, Human
caagcacacccucgcuggc

SEQ ID NO: 940474 - RNA, 23 nt, Human
cacacugucaugaccaaaaucac

SEQ ID NO: 940475 - RNA, 24 nt, Human
cacaggcccuggagaaggggcaag

SEQ ID NO: 940476 - RNA, 23 nt, Human
caccaguagggaagggcgggcug

SEQ ID NO: 940477 - RNA, 23 nt, Human
cacccccaccccauaacccccau

SEQ ID NO: 940478 - RNA, 27 nt, Human
cacccccaccccauaacccccauucau

SEQ ID NO: 940479 - RNA, 20 nt, Human
cacccuccuucccaggccca

SEQ ID NO: 940480 - RNA, 19 nt, Human
caccgugcauccucagggc

SEQ ID NO: 940481 - RNA, 24 nt, Human
cacuccccacagugccugaggcug

SEQ ID NO: 940482 - RNA, 28 nt, Human
cagaagccaugggggcuucccccgaggg

SEQ ID NO: 940483 - RNA, 22 nt, Human
cagcacccuccuucccaggccc

SEQ ID NO: 940484 - RNA, 23 nt, Human
cagcccccuccacagcacccucc

SEQ ID NO: 940485 - RNA, 21 nt, Human
cagcccugaguccccaccccc

SEQ ID NO: 940486 - RNA, 24 nt, Human
cagcucccagaauggcugugggga

SEQ ID NO: 940487 - RNA, 18 nt, Human
cagcucccuucgggcugc

SEQ ID NO: 940488 - RNA, 18 nt, Human
caggacagucccaaggaa

SEQ ID NO: 940489 - RNA, 21 nt, Human
caggcgccuuggccggggagg

SEQ ID NO: 940490 - RNA, 18 nt, Human
caguaagaugggcugggg

SEQ ID NO: 940491 - RNA, 20 nt, Human
caguagggaagggcgggcug

SEQ ID NO: 940492 - RNA, 18 nt, Human
cagucccaaggacggaga

SEQ ID NO: 940493 - RNA, 20 nt, Human
caucaagaaggcaaaagccc

SEQ ID NO: 940494 - RNA, 22 nt, Human
cauccucagggcccguggccaa

SEQ ID NO: 940495 - RNA, 19 nt, Human
caugaccaaaaucacccca

SEQ ID NO: 940496 - RNA, 23 nt, Human
ccaggaaauccucuugcuaccuu

SEQ ID NO: 940497 - RNA, 19 nt, Human
ccaggacagucccaaggac

SEQ ID NO: 940498 - RNA, 19 nt, Human
ccaggcgccuuggccgggg

SEQ ID NO: 940499 - RNA, 21 nt, Human
ccaugggggcuucuagccugg

SEQ ID NO: 940500 - RNA, 19 nt, Human
cccaagaguccagccccac

SEQ ID NO: 940501 - RNA, 20 nt, Human
cccaaggacggagaccccgc

SEQ ID NO: 940502 - RNA, 18 nt, Human
cccacagugccugaggcu

SEQ ID NO: 940503 - RNA, 21 nt, Human
cccacccccaccccauaaccc

SEQ ID NO: 940504 - RNA, 24 nt, Human
cccacccccaccccauaaccccca

SEQ ID NO: 940505 - RNA, 26 nt, Human
cccacccccaccccauaacccccauu

SEQ ID NO: 940506 - RNA, 21 nt, Human
cccauagccccccugccagcc

SEQ ID NO: 940507 - RNA, 24 nt, Human
cccauccacagugcuaacauggaa

SEQ ID NO: 940508 - RNA, 23 nt, Human
ccccaccccaucccguggcucca

SEQ ID NO: 940509 - RNA, 24 nt, Human
ccccaccccaucccguggcuccaa

SEQ ID NO: 940510 - RNA, 18 nt, Human
ccccagccauuccuuccc

SEQ ID NO: 940511 - RNA, 19 nt, Human
ccccagcucccagaauggc

SEQ ID NO: 940512 - RNA, 18 nt, Human
ccccaggaaccccccucu

SEQ ID NO: 940513 - RNA, 22 nt, Human
cccccaccccaucccguggcuc

SEQ ID NO: 940514 - RNA, 19 nt, Human
cccccgaggaaccuccgug

SEQ ID NO: 940515 - RNA, 19 nt, Human
cccccugccagccccaucu

SEQ ID NO: 940516 - RNA, 22 nt, Human
ccccuucuccgcucccaccaag

SEQ ID NO: 940517 - RNA, 22 nt, Human
cccugaguccccacccccaccc

SEQ ID NO: 940518 - RNA, 23 nt, Human
ccgcuucugcuccugccgccccc

SEQ ID NO: 940519 - RNA, 24 nt, Human
ccggcagcggcggauccacuuccc

SEQ ID NO: 940520 - RNA, 21 nt, Human
ccggggaggagggggcaccag

SEQ ID NO: 940521 - RNA, 19 nt, Human
ccucagggcccguggccaa

SEQ ID NO: 940522 - RNA, 23 nt, Human
ccugcagcccccuccacagcacc

SEQ ID NO: 940523 - RNA, 27 nt, Human
ccugcagcccccuccacagcacccucc

SEQ ID NO: 940524 - RNA, 26 nt, Human
ccugccaccucuguggaacugcaggg

SEQ ID NO: 940525 - RNA, 21 nt, Human
ccuugagaccagguuccccag

SEQ ID NO: 940526 - RNA, 22 nt, Human
ccuuggccggggaggagggggc

SEQ ID NO: 940527 - RNA, 22 nt, Human
cgaaacugagacugucccccga

SEQ ID NO: 940528 - RNA, 19 nt, Human
cgcgauccgcagcucccuu

SEQ ID NO: 940529 - RNA, 23 nt, Human
cggcagcggcggauccacuuccc

SEQ ID NO: 940530 - RNA, 19 nt, Human
cggugcgcgcgggcgggcg

SEQ ID NO: 940531 - RNA, 23 nt, Human
cgugcauccucagggcccguggc

SEQ ID NO: 940532 - RNA, 22 nt, Human
cucagaggccagcaugcccccc

SEQ ID NO: 940533 - RNA, 21 nt, Human
cucccauagccccccugccag

SEQ ID NO: 940534 - RNA, 20 nt, Human
cuccccacagugccugaggc

SEQ ID NO: 940535 - RNA, 18 nt, Human
cucccccaccccaucccg

SEQ ID NO: 940536 - RNA, 19 nt, Human
cucccuggaaaucgccuag

SEQ ID NO: 940537 - RNA, 23 nt, Human
cuccgcucccaccaagaaagccc

SEQ ID NO: 940538 - RNA, 20 nt, Human
cucgccagguccaggcgccu

SEQ ID NO: 940539 - RNA, 22 nt, Human
cucgcgauccgcagcucccuuc

SEQ ID NO: 940540 - RNA, 22 nt, Human
cucugcacgaaccuaccccgac

SEQ ID NO: 940541 - RNA, 18 nt, Human
cugcuccugccgcccccg

SEQ ID NO: 940542 - RNA, 23 nt, Human
cugcuccugccgcccccgccccc

SEQ ID NO: 940543 - RNA, 18 nt, Human
cuuggccggggaggaggg

SEQ ID NO: 940544 - RNA, 19 nt, Human
cuuggccggggaggagggg

SEQ ID NO: 940545 - RNA, 23 nt, Human
gaaggcaggacaagaaaucuguu

SEQ ID NO: 940546 - RNA, 20 nt, Human
gaagggagcuggcacaggcc

SEQ ID NO: 940547 - RNA, 24 nt, Human
gacaggaauuucacaucaggucca

SEQ ID NO: 940548 - RNA, 18 nt, Human
gagaauucuuuaaauaac

SEQ ID NO: 940549 - RNA, 22 nt, Human
gagaccagguuccccagcuccc

SEQ ID NO: 940550 - RNA, 19 nt, Human
gaguccccacccccacccc

SEQ ID NO: 940551 - RNA, 19 nt, Human
gauacaaaaacauggagag

SEQ ID NO: 940552 - RNA, 23 nt, Human
gcacgaaacugagacuguccccc

SEQ ID NO: 940553 - RNA, 21 nt, Human
gcacgggcuggccgcagacgc

SEQ ID NO: 940554 - RNA, 19 nt, Human
gcagcccccuccacagcac

SEQ ID NO: 940555 - RNA, 24 nt, Human
gcaggaagccauucauuuuuuucu

SEQ ID NO: 940556 - RNA, 22 nt, Human
gcaugcacuccccacagugccu

SEQ ID NO: 940557 - RNA, 18 nt, Human
gccagaagccaugggggc

SEQ ID NO: 940558 - RNA, 23 nt, Human
gcccaccggcacaggagccccag

SEQ ID NO: 940559 - RNA, 27 nt, Human
gcccugcagcccccuccacagcacccu

SEQ ID NO: 940560 - RNA, 20 nt, Human
gcccuggagaaggggcaaga

SEQ ID NO: 940561 - RNA, 23 nt, Human
gccugcuggucagcccugcagcc

SEQ ID NO: 940562 - RNA, 20 nt, Human
gcgccuuggccggggaggag

SEQ ID NO: 940563 - RNA, 23 nt, Human
gcgggcgggggcggugcgcgcgg

SEQ ID NO: 940564 - RNA, 23 nt, Human
gcucccccaccccaucccguggc

SEQ ID NO: 940565 - RNA, 18 nt, Human
ggagccccaggcaccgug

SEQ ID NO: 940566 - RNA, 20 nt, Human
ggagcucagaggcaucuaga

SEQ ID NO: 940567 - RNA, 22 nt, Human
ggaggggaaugagguguccggg

SEQ ID NO: 940568 - RNA, 23 nt, Human
ggagggggcaccaguagggaagg

SEQ ID NO: 940569 - RNA, 19 nt, Human
ggagggucuguugcagcag

SEQ ID NO: 940570 - RNA, 20 nt, Human
ggcacaggagccccaggcac

SEQ ID NO: 940571 - RNA, 22 nt, Human
ggccucgcgauccgcagcuccc

SEQ ID NO: 940572 - RNA, 24 nt, Human
gggcaccaguagggaagggcgggc

SEQ ID NO: 940573 - RNA, 24 nt, Human
gggcggugcgcgcgggcgggcggg

SEQ ID NO: 940574 - RNA, 20 nt, Human
gggcuggggaggggcgcggg

SEQ ID NO: 940575 - RNA, 20 nt, Human
gggcuggggaggggcgcggg

SEQ ID NO: 940576 - RNA, 18 nt, Human
ggggaggggcgcggggag

SEQ ID NO: 940577 - RNA, 27 nt, Human
gguuguucuccagggcacuggggcgug

SEQ ID NO: 940578 - RNA, 21 nt, Human
gucagcccugcagcccccucc

SEQ ID NO: 940579 - RNA, 23 nt, Human
guccagcccugaguccccacccc

SEQ ID NO: 940580 - RNA, 18 nt, Human
gucccaaggacggagacc

SEQ ID NO: 940581 - RNA, 18 nt, Human
guccccacccccacccca

SEQ ID NO: 940582 - RNA, 20 nt, Human
gugggaggggaaugaggugu

SEQ ID NO: 940583 - RNA, 20 nt, Human
gugggguggccucaacuuuu

SEQ ID NO: 940584 - RNA, 21 nt, Human
uaccuggggcugauguccagc

SEQ ID NO: 940585 - RNA, 27 nt, Human
uagccugggcuggaagcccccaggaac

SEQ ID NO: 940586 - RNA, 23 nt, Human
uaggacagugaccagggccuguc

SEQ ID NO: 940587 - RNA, 24 nt, Human
ucaagaaggcaaaagccagagcag

SEQ ID NO: 940588 - RNA, 21 nt, Human
ucagaggccagcaugcccccc

SEQ ID NO: 940589 - RNA, 22 nt, Human
ucagggcccguggccaaccagg

SEQ ID NO: 940590 - RNA, 20 nt, Human
ucagggcccguggccaaccg

SEQ ID NO: 940591 - RNA, 22 nt, Human
ucagggcucucccuggaaaucg

SEQ ID NO: 940592 - RNA, 28 nt, Human
uccacagcacccuccuucccaggcccau

SEQ ID NO: 940593 - RNA, 20 nt, Human
uccacuaggacgucggucca

SEQ ID NO: 940594 - RNA, 20 nt, Human
uccagggcacuggggcgugu

SEQ ID NO: 940595 - RNA, 18 nt, Human
ucccaccaagaaagccca

SEQ ID NO: 940596 - RNA, 19 nt, Human
ucccaggcccauggggcuc

SEQ ID NO: 940597 - RNA, 23 nt, Human
uccccacccccaccccauaaccc

SEQ ID NO: 940598 - RNA, 24 nt, Human
uccccacccccaccccauaacccc

SEQ ID NO: 940599 - RNA, 21 nt, Human
uccggcagcggcggauccacu

SEQ ID NO: 940600 - RNA, 19 nt, Human
uccgggcugggggucgggg

SEQ ID NO: 940601 - RNA, 22 nt, Human
uccgugggccucgggcuggggg

SEQ ID NO: 940602 - RNA, 21 nt, Human
uccucccauagccccccugcc

SEQ ID NO: 940603 - RNA, 18 nt, Human
ucgguucuucccagguca

SEQ ID NO: 940604 - RNA, 22 nt, Human
ucuaaaaacaguggacacaagu

SEQ ID NO: 940605 - RNA, 25 nt, Human
ucugcuccugccgcccccgcccccg

SEQ ID NO: 940606 - RNA, 18 nt, Human
ugaaaagugguguuuguu

SEQ ID NO: 940607 - RNA, 19 nt, Human
ugaacucgguucuucccag

SEQ ID NO: 940608 - RNA, 24 nt, Human
ugagaagccauggcugcccugggu

SEQ ID NO: 940609 - RNA, 21 nt, Human
ugaucuguuaaaauaauccuc

SEQ ID NO: 940610 - RNA, 19 nt, Human
ugauuuggcuucauuuucu

SEQ ID NO: 940611 - RNA, 18 nt, Human
ugccagaagccauggggg

SEQ ID NO: 940612 - RNA, 19 nt, Human
ugccagccccaucucugca

SEQ ID NO: 940613 - RNA, 21 nt, Human
uggagcucagaggcaucuaga

SEQ ID NO: 940614 - RNA, 21 nt, Human
uggcacgggcuggccgcagac

SEQ ID NO: 940615 - RNA, 20 nt, Human
uggcacucgaggagggcggg

SEQ ID NO: 940616 - RNA, 23 nt, Human
ugggacaggcacacugucaugac

SEQ ID NO: 940617 - RNA, 21 nt, Human
ugggaggggaaugaggugucc

SEQ ID NO: 940618 - RNA, 19 nt, Human
uggggaggggcgcggggag

SEQ ID NO: 940619 - RNA, 21 nt, Human
uggggaggggcgcggggaggg

SEQ ID NO: 940620 - RNA, 24 nt, Human
ugggggucggggagcagucaucaa

SEQ ID NO: 940621 - RNA, 19 nt, Human
uguagugggaggggaauga

SEQ ID NO: 940622 - RNA, 18 nt, Human
uguccagcugccagaagc

SEQ ID NO: 940623 - RNA, 23 nt, Human
ugugcagcggggacagaggcuga

SEQ ID NO: 940624 - RNA, 20 nt, Human
uguugaacucgguucuuccc

SEQ ID NO: 940625 - RNA, 26 nt, Human
uuggaacugaaaccuguugguguaaa

SEQ ID NO: 940626 - RNA, 19 nt, Human
uuggccaaagggcaagacc

SEQ ID NO: 940627 - RNA, 21 nt, Human
aacaaaaauggacauaaaacu

SEQ ID NO: 940628 - RNA, 20 nt, Human
aacauuucaaacauuuggug

SEQ ID NO: 940629 - RNA, 26 nt, Human
aagaauggagguaauuucaagaaaaa

SEQ ID NO: 940630 - RNA, 24 nt, Human
aagcagagguugcagggagccaag

SEQ ID NO: 940631 - RNA, 25 nt, Human
aagcagagguugcagggagccaaga

SEQ ID NO: 940632 - RNA, 19 nt, Human
aagguacugacaaucaccu

SEQ ID NO: 940633 - RNA, 24 nt, Human
aaucaccugaacccaggaagcaga

SEQ ID NO: 940634 - RNA, 20 nt, Human
aauuuuguucuucuugucua

SEQ ID NO: 940635 - RNA, 20 nt, Human
acaaaacaagacccugucuc

SEQ ID NO: 940636 - RNA, 24 nt, Human
acaccguaacagcaaaacaugugc

SEQ ID NO: 940637 - RNA, 18 nt, Human
acugcacuccagccuggg

SEQ ID NO: 940638 - RNA, 23 nt, Human
acugcacuccagccugggugaca

SEQ ID NO: 940639 - RNA, 24 nt, Human
agagguugcagggagccaagauug

SEQ ID NO: 940640 - RNA, 20 nt, Human
agauuguuuacucugcaggu

SEQ ID NO: 940641 - RNA, 24 nt, Human
agccugggugacaaaacaagaccc

SEQ ID NO: 940642 - RNA, 21 nt, Human
aggaguuggagaccagccugg

SEQ ID NO: 940643 - RNA, 21 nt, Human
aggcaaaauuaagggaggaca

SEQ ID NO: 940644 - RNA, 18 nt, Human
aggccgaggggggcgaau

SEQ ID NO: 940645 - RNA, 23 nt, Human
agguacugacaaucaccugaacc

SEQ ID NO: 940646 - RNA, 22 nt, Human
aguccaggcacggcagcucaug

SEQ ID NO: 940647 - RNA, 24 nt, Human
auugccccacugcacuccagccug

SEQ ID NO: 940648 - RNA, 18 nt, Human
caaaacaugugcugcuga

SEQ ID NO: 940649 - RNA, 26 nt, Human
caaaauacccaaucuaguaguguaac

SEQ ID NO: 940650 - RNA, 18 nt, Human
cacuccagccugggugac

SEQ ID NO: 940651 - RNA, 19 nt, Human
cacuccagccugggugaca

SEQ ID NO: 940652 - RNA, 19 nt, Human
cacugcacuccagccuggg

SEQ ID NO: 940653 - RNA, 19 nt, Human
cacugcacuccagccuggg

SEQ ID NO: 940654 - RNA, 22 nt, Human
cacugcacuccagccuggguga

SEQ ID NO: 940655 - RNA, 23 nt, Human
cacugcacuccagccugggugac

SEQ ID NO: 940656 - RNA, 24 nt, Human
cacugcacuccagccugggugaca

SEQ ID NO: 940657 - RNA, 25 nt, Human
cacugcacuccagccugggugacaa

SEQ ID NO: 940658 - RNA, 26 nt, Human
cacugcacuccagccugggugacaaa

SEQ ID NO: 940659 - RNA, 21 nt, Human
cagcaaaacaugugcugcuga

SEQ ID NO: 940660 - RNA, 19 nt, Human
cagcacuuuggaggccgag

SEQ ID NO: 940661 - RNA, 24 nt, Human
caucugcaguuccagcuacucagg

SEQ ID NO: 940662 - RNA, 18 nt, Human
ccacugcacuccagccug

SEQ ID NO: 940663 - RNA, 20 nt, Human
ccacugcacuccagccuggg

SEQ ID NO: 940664 - RNA, 20 nt, Human
ccacugcacuccagccuggg

SEQ ID NO: 940665 - RNA, 20 nt, Human
ccacugcacuccagccuggg

SEQ ID NO: 940666 - RNA, 21 nt, Human
ccacugcacuccagccugggu

SEQ ID NO: 940667 - RNA, 21 nt, Human
ccacugcacuccagccugggu

SEQ ID NO: 940668 - RNA, 24 nt, Human
ccacugcacuccagccugggugac

SEQ ID NO: 940669 - RNA, 24 nt, Human
cccacugcacuccagccuggguga

SEQ ID NO: 940670 - RNA, 20 nt, Human
ccccacugcacuccagccug

SEQ ID NO: 940671 - RNA, 26 nt, Human
ccccacugcacuccagccugggugac

SEQ ID NO: 940672 - RNA, 19 nt, Human
cccugucucaaaaaaaaaa

SEQ ID NO: 940673 - RNA, 20 nt, Human
ccuauaauuccagcacuuug

SEQ ID NO: 940674 - RNA, 19 nt, Human
ccugaacugacacccaauc

SEQ ID NO: 940675 - RNA, 20 nt, Human
ccugaacugacacccaaucu

SEQ ID NO: 940676 - RNA, 24 nt, Human
cuaaauacgaacaguacaccguaa

SEQ ID NO: 940677 - RNA, 18 nt, Human
cucaggaggcugagguaa

SEQ ID NO: 940678 - RNA, 24 nt, Human
cucaugccuauaauuccagcacuu

SEQ ID NO: 940679 - RNA, 21 nt, Human
cugcaguuccagcuacucagg

SEQ ID NO: 940680 - RNA, 18 nt, Human
gagguugcagggagccaa

SEQ ID NO: 940681 - RNA, 23 nt, Human
gcagcucaugccuauaauuccag

SEQ ID NO: 940682 - RNA, 22 nt, Human
gcgaggaguuggagaccagccu

SEQ ID NO: 940683 - RNA, 20 nt, Human
ggaggacaaacauuuccaga

SEQ ID NO: 940684 - RNA, 21 nt, Human
gggaggacaaacauuuccaga

SEQ ID NO: 940685 - RNA, 27 nt, Human
uaacucaagagaauguaauuccugaua

SEQ ID NO: 940686 - RNA, 22 nt, Human
uaaggaacugcuauuuacgucc

SEQ ID NO: 940687 - RNA, 23 nt, Human
uaaggaacugcuauuuacguccu

SEQ ID NO: 940688 - RNA, 22 nt, Human
ucaugccuauaauuccagcacu

SEQ ID NO: 940689 - RNA, 24 nt, Human
uccagagaauggggaaaaaaccug

SEQ ID NO: 940690 - RNA, 24 nt, Human
uccagccugggugacaaaacaaga

SEQ ID NO: 940691 - RNA, 25 nt, Human
ucucaaaaaaaaaaagcaacauuuc

SEQ ID NO: 940692 - RNA, 21 nt, Human
ucugcaguuccagcuacucag

SEQ ID NO: 940693 - RNA, 22 nt, Human
ugacaaaacaagacccugucuc

SEQ ID NO: 940694 - RNA, 22 nt, Human
ugagauuguuuacucugcaggu

SEQ ID NO: 940695 - RNA, 23 nt, Human
ugccccacugcacuccagccugg

SEQ ID NO: 940696 - RNA, 23 nt, Human
ugccuauaauuccagcacuuugg

SEQ ID NO: 940697 - RNA, 22 nt, Human
uggaggccgaggggggcgaauu

SEQ ID NO: 940698 - RNA, 19 nt, Human
uggcgcacaucugcaguuc

SEQ ID NO: 940699 - RNA, 18 nt, Human
uuagccgggcaugguggc

SEQ ID NO: 940700 - RNA, 24 nt, Human
uucaauugacuauauaugcacaaa

SEQ ID NO: 940701 - RNA, 19 nt, Human
aaguagagggucugcaggg

SEQ ID NO: 940702 - RNA, 25 nt, Human
accaucccaccuuggaauccagaaa

SEQ ID NO: 940703 - RNA, 19 nt, Human
agaaagaggcgccgccuuc

SEQ ID NO: 940704 - RNA, 28 nt, Human
agaaagagugggacgugucacccauggc

SEQ ID NO: 940705 - RNA, 19 nt, Human
agagccggagugcuagggg

SEQ ID NO: 940706 - RNA, 18 nt, Human
agccagcagccugcagcc

SEQ ID NO: 940707 - RNA, 19 nt, Human
agccgcagaagccagcagc

SEQ ID NO: 940708 - RNA, 19 nt, Human
aggagaggggugggugggg

SEQ ID NO: 940709 - RNA, 22 nt, Human
aggcaccacggaugccccucca

SEQ ID NO: 940710 - RNA, 19 nt, Human
aggcaggagaggggugggu

SEQ ID NO: 940711 - RNA, 23 nt, Human
aggcaggagaggggugggugggg

SEQ ID NO: 940712 - RNA, 26 nt, Human
aggcaggagagggguggguggggggu

SEQ ID NO: 940713 - RNA, 21 nt, Human
agggaggccccagccccaggc

SEQ ID NO: 940714 - RNA, 23 nt, Human
aggggugggugggggguuggggg

SEQ ID NO: 940715 - RNA, 24 nt, Human
aggggugggugggggguugggggc

SEQ ID NO: 940716 - RNA, 21 nt, Human
agugucccugggccucugccu

SEQ ID NO: 940717 - RNA, 20 nt, Human
augguccgcagccucccacc

SEQ ID NO: 940718 - RNA, 21 nt, Human
cacagucccugccgaggcagg

SEQ ID NO: 940719 - RNA, 19 nt, Human
cacccauggccacccucaa

SEQ ID NO: 940720 - RNA, 21 nt, Human
cacccuggaaagcagcaaggg

SEQ ID NO: 940721 - RNA, 18 nt, Human
caccggggcugccugagg

SEQ ID NO: 940722 - RNA, 20 nt, Human
cagaagagaccuggaaaaug

SEQ ID NO: 940723 - RNA, 21 nt, Human
cagcaagcucaugcacgucag

SEQ ID NO: 940724 - RNA, 18 nt, Human
caggcucagagaccagcc

SEQ ID NO: 940725 - RNA, 18 nt, Human
caggcuccuggcucugag

SEQ ID NO: 940726 - RNA, 19 nt, Human
caguggcagggucgugggu

SEQ ID NO: 940727 - RNA, 23 nt, Human
cagugucccugggccucugccug

SEQ ID NO: 940728 - RNA, 21 nt, Human
ccacacugugcgaggaagaug

SEQ ID NO: 940729 - RNA, 22 nt, Human
ccacggaugccccuccaucaga

SEQ ID NO: 940730 - RNA, 21 nt, Human
ccaggcuccuggcucugaggu

SEQ ID NO: 940731 - RNA, 21 nt, Human
cccagccccaggcuccuggcc

SEQ ID NO: 940732 - RNA, 28 nt, Human
cccauggccacccucaacacacccugga

SEQ ID NO: 940733 - RNA, 23 nt, Human
cccaugguccgcagccucccacc

SEQ ID NO: 940734 - RNA, 23 nt, Human
ccccagccccaggcuccuggcuc

SEQ ID NO: 940735 - RNA, 22 nt, Human
ccccaugguccgcagccuccca

SEQ ID NO: 940736 - RNA, 18 nt, Human
ccgcagaagccagcagcc

SEQ ID NO: 940737 - RNA, 26 nt, Human
ccuccugggacagggagaccugaaau

SEQ ID NO: 940738 - RNA, 21 nt, Human
ccuggaaagcagcaagcucau

SEQ ID NO: 940739 - RNA, 25 nt, Human
ccuggccgcgaccccgaccccgcag

SEQ ID NO: 940740 - RNA, 23 nt, Human
cgaccccgaccccgcagccgcag

SEQ ID NO: 940741 - RNA, 19 nt, Human
cgguggcugggaacguugc

SEQ ID NO: 940742 - RNA, 20 nt, Human
cgucagugucccugggccuc

SEQ ID NO: 940743 - RNA, 19 nt, Human
cuaaacagcuaaacagggc

SEQ ID NO: 940744 - RNA, 18 nt, Human
cucacgccucgaucacag

SEQ ID NO: 940745 - RNA, 20 nt, Human
cuuggaaggcacuucugggg

SEQ ID NO: 940746 - RNA, 24 nt, Human
cuuggcccuggccgcgaccccgac

SEQ ID NO: 940747 - RNA, 19 nt, Human
gaaccuggcagccacggcg

SEQ ID NO: 940748 - RNA, 21 nt, Human
gagaggggugggugggggguu

SEQ ID NO: 940749 - RNA, 23 nt, Human
gagauaaccacuguggcucacgc

SEQ ID NO: 940750 - RNA, 21 nt, Human
gagggucugcaggggucaaag

SEQ ID NO: 940751 - RNA, 27 nt, Human
gaucaccaucccaccuuggaauccaga

SEQ ID NO: 940752 - RNA, 20 nt, Human
gcacgucagugucccugggc

SEQ ID NO: 940753 - RNA, 22 nt, Human
gcaggagagggguggguggggg

SEQ ID NO: 940754 - RNA, 20 nt, Human
gccccagccccaggcuccug

SEQ ID NO: 940755 - RNA, 19 nt, Human
gcccuggccgcgaccccga

SEQ ID NO: 940756 - RNA, 22 nt, Human
gccgccuucccuggaugaacuc

SEQ ID NO: 940757 - RNA, 22 nt, Human
gccgcgaccccgaccccgcagc

SEQ ID NO: 940758 - RNA, 18 nt, Human
ggaggccccagccccagg

SEQ ID NO: 940759 - RNA, 21 nt, Human
gggaagcuuggaaggcacuuc

SEQ ID NO: 940760 - RNA, 21 nt, Human
gggaauaucaguccugcccaa

SEQ ID NO: 940761 - RNA, 19 nt, Human
gggccgggugggcugcgcu

SEQ ID NO: 940762 - RNA, 18 nt, Human
ggggaagcuuggaaggca

SEQ ID NO: 940763 - RNA, 22 nt, Human
gggggcgccgccugcagggguu

SEQ ID NO: 940764 - RNA, 22 nt, Human
gggugggugggggguugggggc

SEQ ID NO: 940765 - RNA, 24 nt, Human
guagggggcgccgccugcaggggu

SEQ ID NO: 940766 - RNA, 19 nt, Human
guccugcucggaugcggag

SEQ ID NO: 940767 - RNA, 26 nt, Human
uaaaacacaaccagcuagucgucccg

SEQ ID NO: 940768 - RNA, 19 nt, Human
uaaccacuguggcucacgc

SEQ ID NO: 940769 - RNA, 21 nt, Human
uaagcuagaaggcaccacgga

SEQ ID NO: 940770 - RNA, 19 nt, Human
uaaugugguccauaguucc

SEQ ID NO: 940771 - RNA, 24 nt, Human
uaauuaacuucuggccgaaagccc

SEQ ID NO: 940772 - RNA, 23 nt, Human
uacaaugggaaaaggcugcuuca

SEQ ID NO: 940773 - RNA, 20 nt, Human
ucacccauggccacccucaa

SEQ ID NO: 940774 - RNA, 19 nt, Human
ucacuucaggaucagagau

SEQ ID NO: 940775 - RNA, 21 nt, Human
ucagagaccagccugcaggac

SEQ ID NO: 940776 - RNA, 23 nt, Human
ucagagauguggugaacacagca

SEQ ID NO: 940777 - RNA, 19 nt, Human
uccagaaaguucguggggg

SEQ ID NO: 940778 - RNA, 18 nt, Human
uccaucagaaagaguggg

SEQ ID NO: 940779 - RNA, 21 nt, Human
ucccugaagccgggggguuga

SEQ ID NO: 940780 - RNA, 20 nt, Human
ucccugccgaggcaggagag

SEQ ID NO: 940781 - RNA, 22 nt, Human
ucuacaaugggaaaaggcugcu

SEQ ID NO: 940782 - RNA, 20 nt, Human
ugacaggagggaagggauug

SEQ ID NO: 940783 - RNA, 23 nt, Human
ugaguccccaugguccgcagccu

SEQ ID NO: 940784 - RNA, 18 nt, Human
ugcaggagucggggagca

SEQ ID NO: 940785 - RNA, 21 nt, Human
ugcccugagcuuggagauaac

SEQ ID NO: 940786 - RNA, 18 nt, Human
ugcggaggggccgggugg

SEQ ID NO: 940787 - RNA, 23 nt, Human
ugcuagggguugggcgaaucucu

SEQ ID NO: 940788 - RNA, 26 nt, Human
ugcuagggguugggcgaaucucuggu

SEQ ID NO: 940789 - RNA, 24 nt, Human
ugcuuaaaacacaaccagcuaaac

SEQ ID NO: 940790 - RNA, 20 nt, Human
uggaaggcacuucugggguc

SEQ ID NO: 940791 - RNA, 18 nt, Human
uggcagggucguggguga

SEQ ID NO: 940792 - RNA, 20 nt, Human
uggcagggucgugggugaug

SEQ ID NO: 940793 - RNA, 21 nt, Human
uggcagggucgugggugaugu

SEQ ID NO: 940794 - RNA, 21 nt, Human
uggccacccucaacacacccu

SEQ ID NO: 940795 - RNA, 22 nt, Human
uggccgcgaccccgaccccgca

SEQ ID NO: 940796 - RNA, 21 nt, Human
ugggaaaaggcugcuucaaug

SEQ ID NO: 940797 - RNA, 24 nt, Human
uggggucccugaagccgggggguu

SEQ ID NO: 940798 - RNA, 21 nt, Human
uguggaucuugggggaagcuu

SEQ ID NO: 940799 - RNA, 19 nt, Human
uucccuggaugaacuccaa

SEQ ID NO: 940800 - RNA, 18 nt, Human
uucuggggucccugaagc

SEQ ID NO: 940801 - RNA, 23 nt, Human
uuggcccuggccgcgaccccgac

SEQ ID NO: 940802 - RNA, 21 nt, Human
uuuuuuuuuugcgguggcugg

SEQ ID NO: 940803 - RNA, 18 nt, Human
uuuuuuuuuuuuuugcgg

SEQ ID NO: 940804 - RNA, 18 nt, Human
uuuuuuuuuuuuuugcgg

SEQ ID NO: 940805 - RNA, 21 nt, Human
uuuuuuuuuuuuuuuuugcgg

SEQ ID NO: 940806 - RNA, 22 nt, Human
uuuuuuuuuuuuuuuuugcggu

SEQ ID NO: 940807 - RNA, 25 nt, Human
uuuuuuuuuuuuuuuuuugcggugg

SEQ ID NO: 940808 - RNA, 27 nt, Human
uuuuuuuuuuuuuuuuuuuuuuugggg

SEQ ID NO: 940809 - RNA, 23 nt, Human
aaaaauaacaggguuugcacagc

SEQ ID NO: 940810 - RNA, 18 nt, Human
aaacgacacagcucaagc

SEQ ID NO: 940811 - RNA, 22 nt, Human
aagcaaaauaguguguuaaaau

SEQ ID NO: 940812 - RNA, 22 nt, Human
aagcuaccaccaaaauauccag

SEQ ID NO: 940813 - RNA, 27 nt, Human
aauacaaaagcaaaauaguguguuaaa

SEQ ID NO: 940814 - RNA, 27 nt, Human
acaaaaagagaacgcaugcuguacagc

SEQ ID NO: 940815 - RNA, 26 nt, Human
acagcucaagcccauccucgcugccc

SEQ ID NO: 940816 - RNA, 18 nt, Human
acagggcccucuccagga

SEQ ID NO: 940817 - RNA, 19 nt, Human
acaggguuugcacagcucu

SEQ ID NO: 940818 - RNA, 22 nt, Human
acccagccagcaaccacaaaaa

SEQ ID NO: 940819 - RNA, 22 nt, Human
acuaaaauacaaaagcaaaaua

SEQ ID NO: 940820 - RNA, 19 nt, Human
agaaaaauaaguaagacaa

SEQ ID NO: 940821 - RNA, 21 nt, Human
agacacaagacaucuugagcu

SEQ ID NO: 940822 - RNA, 21 nt, Human
agagaaggggagggagacgau

SEQ ID NO: 940823 - RNA, 20 nt, Human
aggcaagguuuaugcuucag

SEQ ID NO: 940824 - RNA, 18 nt, Human
aggcuuucuccuagaaua

SEQ ID NO: 940825 - RNA, 20 nt, Human
aggguuugcacagcucuauu

SEQ ID NO: 940826 - RNA, 24 nt, Human
aucugcaugacagucucuagguac

SEQ ID NO: 940827 - RNA, 23 nt, Human
auuuuaggccuaaaaauaagauu

SEQ ID NO: 940828 - RNA, 22 nt, Human
caaaagaaaaauaaguaagaca

SEQ ID NO: 940829 - RNA, 21 nt, Human
caagcagaggccaucuagcca

SEQ ID NO: 940830 - RNA, 20 nt, Human
cacagcucaagcuuggugcu

SEQ ID NO: 940831 - RNA, 22 nt, Human
cagguucucccugguaccuucc

SEQ ID NO: 940832 - RNA, 21 nt, Human
ccaggaccucccagguucucc

SEQ ID NO: 940833 - RNA, 23 nt, Human
cccaccacccccccauauacaaa

SEQ ID NO: 940834 - RNA, 23 nt, Human
ccccaccacccccccauauacaa

SEQ ID NO: 940835 - RNA, 27 nt, Human
ccccaccacccccccauauacaaaggc

SEQ ID NO: 940836 - RNA, 18 nt, Human
ccccccaccaccccccca

SEQ ID NO: 940837 - RNA, 21 nt, Human
ccccccauauacaaaggccau

SEQ ID NO: 940838 - RNA, 20 nt, Human
cccugguaccuucccucccu

SEQ ID NO: 940839 - RNA, 22 nt, Human
cgacacagcucaagcuuggugc

SEQ ID NO: 940840 - RNA, 18 nt, Human
cguccugccagugugagg

SEQ ID NO: 940841 - RNA, 18 nt, Human
cuccuagaauauccaaaa

SEQ ID NO: 940842 - RNA, 20 nt, Human
cucuagggcagaaaucucuc

SEQ ID NO: 940843 - RNA, 25 nt, Human
gaagucuuuccgaugcugguuugau

SEQ ID NO: 940844 - RNA, 21 nt, Human
gcccauccucgcugcccccuc

SEQ ID NO: 940845 - RNA, 20 nt, Human
ggacagggcccucuccagga

SEQ ID NO: 940846 - RNA, 20 nt, Human
ggcagaaaucucucaacagc

SEQ ID NO: 940847 - RNA, 23 nt, Human
uaaauacaguacccagccagcaa

SEQ ID NO: 940848 - RNA, 18 nt, Human
uaacuaaaauacaaaagc

SEQ ID NO: 940849 - RNA, 22 nt, Human
uaagauuaccaagcagaggcca

SEQ ID NO: 940850 - RNA, 21 nt, Human
uaauuuuuuaaaauuacacag

SEQ ID NO: 940851 - RNA, 23 nt, Human
uacaagaaagaugaccaccaggu

SEQ ID NO: 940852 - RNA, 19 nt, Human
uagaauauccaaaaugcuc

SEQ ID NO: 940853 - RNA, 21 nt, Human
uagacagaaugucauguagua

SEQ ID NO: 940854 - RNA, 21 nt, Human
uaguauuuuaaaaacacagau

SEQ ID NO: 940855 - RNA, 19 nt, Human
ucacaugacagauauaaaa

SEQ ID NO: 940856 - RNA, 21 nt, Human
ucagggccauaacuuccaugg

SEQ ID NO: 940857 - RNA, 26 nt, Human
uccccccaccacccccccauauacaa

SEQ ID NO: 940858 - RNA, 18 nt, Human
ucccugguaccuucccuc

SEQ ID NO: 940859 - RNA, 22 nt, Human
ucccugguaccuucccucccuc

SEQ ID NO: 940860 - RNA, 19 nt, Human
ucuagguaccaagacugua

SEQ ID NO: 940861 - RNA, 22 nt, Human
ucucucaacagcucaagcccau

SEQ ID NO: 940862 - RNA, 18 nt, Human
ugacagauauaaaacuaa

SEQ ID NO: 940863 - RNA, 20 nt, Human
ugaugucauccucacacggg

SEQ ID NO: 940864 - RNA, 21 nt, Human
ugauuccugaucacccaacug

SEQ ID NO: 940865 - RNA, 22 nt, Human
ugcacagaccacgaaugcagcc

SEQ ID NO: 940866 - RNA, 20 nt, Human
ugcccccuccacgaaacgac

SEQ ID NO: 940867 - RNA, 19 nt, Human
ugcuauucucuacuucauu

SEQ ID NO: 940868 - RNA, 21 nt, Human
ugggacuagaagcuaccacca

SEQ ID NO: 940869 - RNA, 20 nt, Human
uggugcugggaagucuuucc

SEQ ID NO: 940870 - RNA, 18 nt, Human
uguccccccaccaccccc

SEQ ID NO: 940871 - RNA, 28 nt, Human
uuaccaagcagaggccaucuagccacac

SEQ ID NO: 940872 - RNA, 19 nt, Human
uuagguuacaguuacauga

SEQ ID NO: 940873 - RNA, 22 nt, Human
uuuaucagaaguaauacauuua

SEQ ID NO: 940874 - RNA, 20 nt, Human
uuucagggccauaacuucca

SEQ ID NO: 940875 - RNA, 25 nt, Human
aaaggaagggaggaagcgggggagg

SEQ ID NO: 940876 - RNA, 26 nt, Human
aaagugccccaguccuuccagcgguu

SEQ ID NO: 940877 - RNA, 18 nt, Human
aagagaggggggucuugc

SEQ ID NO: 940878 - RNA, 18 nt, Human
aagggaggaagcggggga

SEQ ID NO: 940879 - RNA, 28 nt, Human
aagugccccaguccuuccagcgguuuug

SEQ ID NO: 940880 - RNA, 20 nt, Human
acaagccagcaacaaggcac

SEQ ID NO: 940881 - RNA, 20 nt, Human
acaaggcacaggauggccac

SEQ ID NO: 940882 - RNA, 20 nt, Human
acccacagcugaaaacaggc

SEQ ID NO: 940883 - RNA, 19 nt, Human
agacaagccagcaacaagg

SEQ ID NO: 940884 - RNA, 23 nt, Human
aggaagggaggaagcgggggagg

SEQ ID NO: 940885 - RNA, 20 nt, Human
aggagcacagggcugagacg

SEQ ID NO: 940886 - RNA, 22 nt, Human
aggauggccacaagggggugcu

SEQ ID NO: 940887 - RNA, 22 nt, Human
aggcaguucuggggacugggga

SEQ ID NO: 940888 - RNA, 21 nt, Human
agggaaggugacaagggaggc

SEQ ID NO: 940889 - RNA, 19 nt, Human
agggaggaagcgggggagg

SEQ ID NO: 940890 - RNA, 26 nt, Human
agggaggaagcgggggaggggucuug

SEQ ID NO: 940891 - RNA, 22 nt, Human
agggaggaagggggaaaggaag

SEQ ID NO: 940892 - RNA, 24 nt, Human
agggggaaaggaagggaggaagcg

SEQ ID NO: 940893 - RNA, 18 nt, Human
agggggagggaggaaggg

SEQ ID NO: 940894 - RNA, 19 nt, Human
agggggagggaggaagggg

SEQ ID NO: 940895 - RNA, 21 nt, Human
agguccugccugcccacccag

SEQ ID NO: 940896 - RNA, 18 nt, Human
aguggggaagagaggggg

SEQ ID NO: 940897 - RNA, 19 nt, Human
caaagaaggaaauccggac

SEQ ID NO: 940898 - RNA, 18 nt, Human
cacccaggccccacaugc

SEQ ID NO: 940899 - RNA, 19 nt, Human
cacccaggccccacaugcc

SEQ ID NO: 940900 - RNA, 19 nt, Human
caccgccugucagcccugc

SEQ ID NO: 940901 - RNA, 18 nt, Human
ccacagcugaaaacaggc

SEQ ID NO: 940902 - RNA, 20 nt, Human
ccaccgggaacaaggcacag

SEQ ID NO: 940903 - RNA, 20 nt, Human
ccagaacagucccuuucuga

SEQ ID NO: 940904 - RNA, 24 nt, Human
ccagggcgcgugucugcauggcca

SEQ ID NO: 940905 - RNA, 20 nt, Human
cccaagggcugaggcccccc

SEQ ID NO: 940906 - RNA, 27 nt, Human
cccacagcugaaaacaggccggggucc

SEQ ID NO: 940907 - RNA, 23 nt, Human
cccaccgccugucagcccugccc

SEQ ID NO: 940908 - RNA, 25 nt, Human
ccccacaugccagggcgcgugucug

SEQ ID NO: 940909 - RNA, 25 nt, Human
ccccaccgccugucagcccugcccg

SEQ ID NO: 940910 - RNA, 20 nt, Human
cccggcgccucggggcgccc

SEQ ID NO: 940911 - RNA, 20 nt, Human
ccgccgccgacuccgccagg

SEQ ID NO: 940912 - RNA, 21 nt, Human
ccgccgcguccucccagcgcc

SEQ ID NO: 940913 - RNA, 24 nt, Human
ccucccagcgccgcguccccgccc

SEQ ID NO: 940914 - RNA, 23 nt, Human
ccucuggcucagggcuggcuccc

SEQ ID NO: 940915 - RNA, 20 nt, Human
ccugagugggcucugauggg

SEQ ID NO: 940916 - RNA, 18 nt, Human
ccuggugguggcagaacc

SEQ ID NO: 940917 - RNA, 20 nt, Human
cgcccaggcguccguuccca

SEQ ID NO: 940918 - RNA, 18 nt, Human
cgugggugaucugaagcc

SEQ ID NO: 940919 - RNA, 22 nt, Human
cugcccacccaggccccacaug

SEQ ID NO: 940920 - RNA, 21 nt, Human
gaaauccuccuggugguggca

SEQ ID NO: 940921 - RNA, 21 nt, Human
gaagggaggaagcgggggagg

SEQ ID NO: 940922 - RNA, 19 nt, Human
gagccgccccaccgccugu

SEQ ID NO: 940923 - RNA, 18 nt, Human
gauccagccacccagaac

SEQ ID NO: 940924 - RNA, 21 nt, Human
gccuuuaugaagggggaggga

SEQ ID NO: 940925 - RNA, 19 nt, Human
gcuauggaggcccugccag

SEQ ID NO: 940926 - RNA, 23 nt, Human
gcuauggaggcccugccagcccc

SEQ ID NO: 940927 - RNA, 22 nt, Human
ggacuggggagggggcgcuggc

SEQ ID NO: 940928 - RNA, 22 nt, Human
ggacuggggagggggcgcuggc

SEQ ID NO: 940929 - RNA, 24 nt, Human
ggagauccagccacccagaacagu

SEQ ID NO: 940930 - RNA, 20 nt, Human
ggagcuccgaacgcuggucc

SEQ ID NO: 940931 - RNA, 20 nt, Human
ggaggccaccgggaacaagg

SEQ ID NO: 940932 - RNA, 23 nt, Human
ggagggaggaagggggaaaggaa

SEQ ID NO: 940933 - RNA, 22 nt, Human
ggcagaaagugccccaguccuu

SEQ ID NO: 940934 - RNA, 19 nt, Human
ggccacaagggggugcugc

SEQ ID NO: 940935 - RNA, 21 nt, Human
ggccacccacagcugaaaaca

SEQ ID NO: 940936 - RNA, 21 nt, Human
ggcgcuggcugccucaggugu

SEQ ID NO: 940937 - RNA, 19 nt, Human
ggggaaaggaagggaggaa

SEQ ID NO: 940938 - RNA, 21 nt, Human
ggggugcugcuggcccagggc

SEQ ID NO: 940939 - RNA, 18 nt, Human
gggugggagggcccaggu

SEQ ID NO: 940940 - RNA, 21 nt, Human
gugcugcuggcccagggcuug

SEQ ID NO: 940941 - RNA, 20 nt, Human
uacccuggagauccagccac

SEQ ID NO: 940942 - RNA, 23 nt, Human
uauggaggcccugccagccccuc

SEQ ID NO: 940943 - RNA, 21 nt, Human
uccaaagaaggaaauccggac

SEQ ID NO: 940944 - RNA, 18 nt, Human
uccagccacccagaacag

SEQ ID NO: 940945 - RNA, 23 nt, Human
uccauccauucugccucuggcuc

SEQ ID NO: 940946 - RNA, 22 nt, Human
uccauucugccucuggcucagg

SEQ ID NO: 940947 - RNA, 24 nt, Human
ucccaagggcugaggccccccgag

SEQ ID NO: 940948 - RNA, 18 nt, Human
ucccagcgccgcgucccc

SEQ ID NO: 940949 - RNA, 21 nt, Human
ucuugaaauccuccugguggu

SEQ ID NO: 940950 - RNA, 24 nt, Human
ugccagccccuccuaguaguccaa

SEQ ID NO: 940951 - RNA, 18 nt, Human
ugccccaguccuuccagc

SEQ ID NO: 940952 - RNA, 23 nt, Human
ugccucuggcucagggcuggcuc

SEQ ID NO: 940953 - RNA, 20 nt, Human
ugccugcccacccaggcccc

SEQ ID NO: 940954 - RNA, 25 nt, Human
ugcucugucucagagcuccccuuca

SEQ ID NO: 940955 - RNA, 23 nt, Human
uggaggcccugccagccccuccu

SEQ ID NO: 940956 - RNA, 21 nt, Human
uggccacaagggggugcugcu

SEQ ID NO: 940957 - RNA, 18 nt, Human
uggcccagggcuuggcag

SEQ ID NO: 940958 - RNA, 20 nt, Human
uggcucagggcuggcuccag

SEQ ID NO: 940959 - RNA, 22 nt, Human
uggcuccaggcccccgucuccc

SEQ ID NO: 940960 - RNA, 20 nt, Human
uggggacuggggagggggcg

SEQ ID NO: 940961 - RNA, 22 nt, Human
uggggagggggcgcuggcugcc

SEQ ID NO: 940962 - RNA, 22 nt, Human
uggggcaauucugugcuaugga

SEQ ID NO: 940963 - RNA, 22 nt, Human
ugucucagagcuccccuucagg

SEQ ID NO: 940964 - RNA, 21 nt, Human
ugucugcauggccacccacag

SEQ ID NO: 940965 - RNA, 20 nt, Human
uucuggggacuggggagggg

SEQ ID NO: 940966 - RNA, 22 nt, Human
uucugggguggguguuugcucu

SEQ ID NO: 940967 - RNA, 22 nt, Human
uuuuuuuuuuuuuuuuuaccaa

SEQ ID NO: 940968 - RNA, 20 nt, Human
aaaagaaaaagaugcaaaag

SEQ ID NO: 940969 - RNA, 19 nt, Human
aaaaggaaaaaaugagaaa

SEQ ID NO: 940970 - RNA, 21 nt, Human
aaagcgaaaugaggugguggc

SEQ ID NO: 940971 - RNA, 23 nt, Human
aaagcgaaaugaggugguggcuu

SEQ ID NO: 940972 - RNA, 20 nt, Human
aaccagaguuuuuccuggag

SEQ ID NO: 940973 - RNA, 18 nt, Human
aacgugaauaaaggauaa

SEQ ID NO: 940974 - RNA, 22 nt, Human
aagaaaaagaugcaaaagaaaa

SEQ ID NO: 940975 - RNA, 21 nt, Human
aagaacuccuucacccacguc

SEQ ID NO: 940976 - RNA, 22 nt, Human
aagcagcaugguucccgugaga

SEQ ID NO: 940977 - RNA, 23 nt, Human
aagcagcaugguucccgugagaa

SEQ ID NO: 940978 - RNA, 23 nt, Human
aaguaguucagugcagguuacuu

SEQ ID NO: 940979 - RNA, 25 nt, Human
aaucuuuuuaaaaaggaaaaaauga

SEQ ID NO: 940980 - RNA, 24 nt, Human
aauguagaaaaaaaccgaaaaaga

SEQ ID NO: 940981 - RNA, 23 nt, Human
acacauucccaagcagcaugguu

SEQ ID NO: 940982 - RNA, 19 nt, Human
accaaauacaucaaggaaa

SEQ ID NO: 940983 - RNA, 24 nt, Human
accaucuaaauauccuuuuaucac

SEQ ID NO: 940984 - RNA, 21 nt, Human
acccacgucacacuuucuccu

SEQ ID NO: 940985 - RNA, 20 nt, Human
acucuguggccaugccgggu

SEQ ID NO: 940986 - RNA, 19 nt, Human
agaaaaugcauucuagcuc

SEQ ID NO: 940987 - RNA, 24 nt, Human
agaaaucacaauccugagccagug

SEQ ID NO: 940988 - RNA, 22 nt, Human
agaaggcaucacacacauuccc

SEQ ID NO: 940989 - RNA, 22 nt, Human
agagaaaaaaaaaaccuuuaga

SEQ ID NO: 940990 - RNA, 18 nt, Human
agaucacagaaaucacaa

SEQ ID NO: 940991 - RNA, 24 nt, Human
agcccaucuucuaaaagggggugc

SEQ ID NO: 940992 - RNA, 23 nt, Human
agcgauuccagcuuguuuccuuu

SEQ ID NO: 940993 - RNA, 19 nt, Human
agggguuguggaguggggg

SEQ ID NO: 940994 - RNA, 19 nt, Human
auaaaaucaugaggaucca

SEQ ID NO: 940995 - RNA, 21 nt, Human
auaaauauaagagccaagauc

SEQ ID NO: 940996 - RNA, 19 nt, Human
augacuccugucuucuguc

SEQ ID NO: 940997 - RNA, 23 nt, Human
caacagguacaaagaugguuaaa

SEQ ID NO: 940998 - RNA, 20 nt, Human
caagccccaagggauagagg

SEQ ID NO: 940999 - RNA, 19 nt, Human
caaggagcaaaugagaaaa

SEQ ID NO: 941000 - RNA, 25 nt, Human
cagcaugguucccgugagaaacuga

SEQ ID NO: 941001 - RNA, 24 nt, Human
cagccaaucuagaaaauaaaauca

SEQ ID NO: 941002 - RNA, 20 nt, Human
cauggcucaauaagaacucc

SEQ ID NO: 941003 - RNA, 26 nt, Human
ccaacaccuaagcuucugccugagcc

SEQ ID NO: 941004 - RNA, 24 nt, Human
ccaauccugccacuuaccugggaa

SEQ ID NO: 941005 - RNA, 20 nt, Human
ccaucagugaaggguuuuag

SEQ ID NO: 941006 - RNA, 18 nt, Human
ccaucuucuaaaaggggg

SEQ ID NO: 941007 - RNA, 23 nt, Human
cccaagggauagauguuuacaaa

SEQ ID NO: 941008 - RNA, 21 nt, Human
ccccgcacucccgccugagcc

SEQ ID NO: 941009 - RNA, 23 nt, Human
ccccgcacucccgccugagccag

SEQ ID NO: 941010 - RNA, 21 nt, Human
cccuaugcuguguaugacgcu

SEQ ID NO: 941011 - RNA, 22 nt, Human
ccgcacucccgccugagccagg

SEQ ID NO: 941012 - RNA, 19 nt, Human
ccucauuccaauccugcca

SEQ ID NO: 941013 - RNA, 20 nt, Human
ccugagcccacucaccacuu

SEQ ID NO: 941014 - RNA, 18 nt, Human
ccuguagccaguccaccu

SEQ ID NO: 941015 - RNA, 19 nt, Human
ccugucccaaggccaacac

SEQ ID NO: 941016 - RNA, 18 nt, Human
cgccugagccaggcccgc

SEQ ID NO: 941017 - RNA, 20 nt, Human
cuaggacauggauuuugcua

SEQ ID NO: 941018 - RNA, 22 nt, Human
cucauacggucccacacccagu

SEQ ID NO: 941019 - RNA, 23 nt, Human
cuguacuauuucuuccucccaug

SEQ ID NO: 941020 - RNA, 22 nt, Human
cuucugccugagcccacucacc

SEQ ID NO: 941021 - RNA, 22 nt, Human
cuuuuuaaaaaggaaaaaauga

SEQ ID NO: 941022 - RNA, 24 nt, Human
gaaccaugccuuuuggauuauguc

SEQ ID NO: 941023 - RNA, 24 nt, Human
gaacuccuucacccacgucacacu

SEQ ID NO: 941024 - RNA, 25 nt, Human
gaacuccuucacccacgucacacuu

SEQ ID NO: 941025 - RNA, 22 nt, Human
gaucauaaucaucgguaccuug

SEQ ID NO: 941026 - RNA, 24 nt, Human
gcaucacacacauucccaagcagc

SEQ ID NO: 941027 - RNA, 18 nt, Human
gcccuggaagcccaucuu

SEQ ID NO: 941028 - RNA, 20 nt, Human
gccgggccuguucccaaaaa

SEQ ID NO: 941029 - RNA, 22 nt, Human
gcucaauaagaacuccuucacc

SEQ ID NO: 941030 - RNA, 22 nt, Human
ggaaggacggguaugggauagg

SEQ ID NO: 941031 - RNA, 22 nt, Human
ggagcaaaugagaaaaccuguu

SEQ ID NO: 941032 - RNA, 19 nt, Human
gguaugggauaggaaaggg

SEQ ID NO: 941033 - RNA, 22 nt, Human
guacagcuccuauaacaaaaua

SEQ ID NO: 941034 - RNA, 20 nt, Human
uaacaaaauaacaaaacuga

SEQ ID NO: 941035 - RNA, 21 nt, Human
uaaccagaguuuuuccuggag

SEQ ID NO: 941036 - RNA, 21 nt, Human
uaacuacaacagguacaaaga

SEQ ID NO: 941037 - RNA, 20 nt, Human
uaagcuucugccugagccca

SEQ ID NO: 941038 - RNA, 20 nt, Human
uaagugugaacugucugugc

SEQ ID NO: 941039 - RNA, 25 nt, Human
uacuauuucuuccucccauggcuca

SEQ ID NO: 941040 - RNA, 24 nt, Human
uaggaaacugauucagcgauuguu

SEQ ID NO: 941041 - RNA, 19 nt, Human
uaugcuguguaugacgcuu

SEQ ID NO: 941042 - RNA, 21 nt, Human
uauuuuguucuuuugcuuuca

SEQ ID NO: 941043 - RNA, 22 nt, Human
ucacauguccaaaauagccagg

SEQ ID NO: 941044 - RNA, 19 nt, Human
ucacccagagggguugugg

SEQ ID NO: 941045 - RNA, 19 nt, Human
ucagaacaguugucuuugg

SEQ ID NO: 941046 - RNA, 22 nt, Human
ucauaaauaauauucacccaac

SEQ ID NO: 941047 - RNA, 22 nt, Human
uccagcuuguuuccuuuuggug

SEQ ID NO: 941048 - RNA, 18 nt, Human
ucccaaggccaacaccua

SEQ ID NO: 941049 - RNA, 23 nt, Human
uccucccauggcucaauaagaac

SEQ ID NO: 941050 - RNA, 24 nt, Human
ucucauaaauaauauucacccaac

SEQ ID NO: 941051 - RNA, 18 nt, Human
ucuucuaaaagggggugc

SEQ ID NO: 941052 - RNA, 18 nt, Human
ugagaaaaccuguugaga

SEQ ID NO: 941053 - RNA, 19 nt, Human
ugagaaaaggcaaacucag

SEQ ID NO: 941054 - RNA, 26 nt, Human
ugagauagaacugacuguaucauccu

SEQ ID NO: 941055 - RNA, 21 nt, Human
ugagccagugcucuccucaua

SEQ ID NO: 941056 - RNA, 20 nt, Human
ugaggugguggcuuugaugg

SEQ ID NO: 941057 - RNA, 24 nt, Human
ugauuggaauaaugaucauaauca

SEQ ID NO: 941058 - RNA, 19 nt, Human
ugcaaaagaaaaagaugca

SEQ ID NO: 941059 - RNA, 18 nt, Human
ugcaaaagaaaaaggcuc

SEQ ID NO: 941060 - RNA, 20 nt, Human
ugcaaaagaaaaaggcucug

SEQ ID NO: 941061 - RNA, 18 nt, Human
ugcagguuacuuuccuuc

SEQ ID NO: 941062 - RNA, 19 nt, Human
ugcaugcauccaucaguga

SEQ ID NO: 941063 - RNA, 22 nt, Human
ugccgggccuguucccaaaaac

SEQ ID NO: 941064 - RNA, 22 nt, Human
ugccugagcccacucaccacuu

SEQ ID NO: 941065 - RNA, 20 nt, Human
ugcuggccccgcacucccgc

SEQ ID NO: 941066 - RNA, 19 nt, Human
uggaggaaaaaauuuucac

SEQ ID NO: 941067 - RNA, 18 nt, Human
ugggaaggugacuuaggc

SEQ ID NO: 941068 - RNA, 18 nt, Human
ugggauaggaaagggacu

SEQ ID NO: 941069 - RNA, 20 nt, Human
ugggauaggaaagggacuaa

SEQ ID NO: 941070 - RNA, 24 nt, Human
uguggccaugccggguuuaggagu

SEQ ID NO: 941071 - RNA, 23 nt, Human
uuaaaaaggaaaaaaugagaaac

SEQ ID NO: 941072 - RNA, 22 nt, Human
uuaccgagcugucccaaggagc

SEQ ID NO: 941073 - RNA, 18 nt, Human
uuaucugugagauagaac

SEQ ID NO: 941074 - RNA, 18 nt, Human
uucacaggugaagaaacg

SEQ ID NO: 941075 - RNA, 22 nt, Human
uucccaagcagcaugguucccg

SEQ ID NO: 941076 - RNA, 22 nt, Human
uugaacagccguuaggauaaag

SEQ ID NO: 941077 - RNA, 20 nt, Human
uugauuaucugugagauaga

SEQ ID NO: 941078 - RNA, 23 nt, Human
uugcuuucagaacaguugucuuu

SEQ ID NO: 941079 - RNA, 19 nt, Human
uuggauuaugucaaaggaa

SEQ ID NO: 941080 - RNA, 19 nt, Human
uuggauuaugucaaaggaa

SEQ ID NO: 941081 - RNA, 18 nt, Human
uuucagaacaguugucuu

SEQ ID NO: 941082 - RNA, 18 nt, Human
uuuccuggagcgauucca

SEQ ID NO: 941083 - RNA, 21 nt, Human
uuucuugaaucuacaaugcga

SEQ ID NO: 941084 - RNA, 23 nt, Human
aaaaagaccccucucguaauauc

SEQ ID NO: 941085 - RNA, 18 nt, Human
aaacaagagcuucaugca

SEQ ID NO: 941086 - RNA, 18 nt, Human
agaggaaccgggaucuga

SEQ ID NO: 941087 - RNA, 23 nt, Human
cacaucgaaaacaagagcuucau

SEQ ID NO: 941088 - RNA, 21 nt, Human
cauuuucuucccuuagcuuca

SEQ ID NO: 941089 - RNA, 20 nt, Human
cccccacccaugcccggccu

SEQ ID NO: 941090 - RNA, 18 nt, Human
ccgagcuucuccuggaga

SEQ ID NO: 941091 - RNA, 22 nt, Human
cgcccccacccaugcccggccu

SEQ ID NO: 941092 - RNA, 23 nt, Human
cgcccccacccaugcccggccug

SEQ ID NO: 941093 - RNA, 23 nt, Human
cuagcaaaaacuuuaucaaaucc

SEQ ID NO: 941094 - RNA, 24 nt, Human
uaaaguaacauucagaauuucaug

SEQ ID NO: 941095 - RNA, 21 nt, Human
uaaguguuuucacuucauucu

SEQ ID NO: 941096 - RNA, 24 nt, Human
uacaaaaaacuguagauuuacaga

SEQ ID NO: 941097 - RNA, 22 nt, Human
ugagaaacauuuuccuaaauaa

SEQ ID NO: 941098 - RNA, 24 nt, Human
ugagaaacauuuuccuaaauaagu

SEQ ID NO: 941099 - RNA, 20 nt, Human
ugcaaucaugauaaaguaac

SEQ ID NO: 941100 - RNA, 27 nt, Human
uuaucccgcugccauugcuucucaaau

SEQ ID NO: 941101 - RNA, 18 nt, Human
uuuggcauuuucuucccu

SEQ ID NO: 941102 - RNA, 19 nt, Human
aaccaggaauggcggagug

SEQ ID NO: 941103 - RNA, 23 nt, Human
aaccucacaggagagcugcagcu

SEQ ID NO: 941104 - RNA, 23 nt, Human
aagaacgguucggagagaaccag

SEQ ID NO: 941105 - RNA, 22 nt, Human
acacccaggcuucccugaaggc

SEQ ID NO: 941106 - RNA, 21 nt, Human
accggcccugucugcuccccc

SEQ ID NO: 941107 - RNA, 22 nt, Human
accuccuuucuccccucuccug

SEQ ID NO: 941108 - RNA, 26 nt, Human
agcgacagaagcugccgagaacagga

SEQ ID NO: 941109 - RNA, 25 nt, Human
agcugcagcuguggggaccccaggg

SEQ ID NO: 941110 - RNA, 19 nt, Human
agguagaggugagcaccag

SEQ ID NO: 941111 - RNA, 18 nt, Human
aguccacuggugcccagu

SEQ ID NO: 941112 - RNA, 21 nt, Human
caacaaaaaugugggcugcca

SEQ ID NO: 941113 - RNA, 18 nt, Human
caagcccaggcagcuggg

SEQ ID NO: 941114 - RNA, 22 nt, Human
caccagcagcccagccgcgccc

SEQ ID NO: 941115 - RNA, 22 nt, Human
cacccuccaucccgugggagcc

SEQ ID NO: 941116 - RNA, 18 nt, Human
caccgggccacacccagg

SEQ ID NO: 941117 - RNA, 21 nt, Human
caccuccuuucuccccucucc

SEQ ID NO: 941118 - RNA, 19 nt, Human
cacuggguggaggagcggc

SEQ ID NO: 941119 - RNA, 19 nt, Human
cagaagcacuggguggagg

SEQ ID NO: 941120 - RNA, 19 nt, Human
cagaggggcugcuggggca

SEQ ID NO: 941121 - RNA, 19 nt, Human
cagcccagccgcgcccccu

SEQ ID NO: 941122 - RNA, 21 nt, Human
cagugucuuugggggcugugg

SEQ ID NO: 941123 - RNA, 21 nt, Human
ccaagauucccggaagcacca

SEQ ID NO: 941124 - RNA, 19 nt, Human
ccacacccaggcuucccug

SEQ ID NO: 941125 - RNA, 23 nt, Human
cccaggaacgggccauggggcga

SEQ ID NO: 941126 - RNA, 19 nt, Human
cccccuccucccgccugcc

SEQ ID NO: 941127 - RNA, 18 nt, Human
cccggcucaggugugagg

SEQ ID NO: 941128 - RNA, 23 nt, Human
ccgaggcccccagguggacgugg

SEQ ID NO: 941129 - RNA, 18 nt, Human
ccgcgcccccuccucccg

SEQ ID NO: 941130 - RNA, 20 nt, Human
ccgcggaguccaccacgggg

SEQ ID NO: 941131 - RNA, 21 nt, Human
ccggaagcaccagcagcccag

SEQ ID NO: 941132 - RNA, 20 nt, Human
ccggucacccaagcuuccag

SEQ ID NO: 941133 - RNA, 22 nt, Human
ccuccaucccgugggagccagg

SEQ ID NO: 941134 - RNA, 20 nt, Human
ccuccuuucuccccucuccu

SEQ ID NO: 941135 - RNA, 18 nt, Human
ccucugggcagccccgcc

SEQ ID NO: 941136 - RNA, 22 nt, Human
ccucugggcagccccgccacuc

SEQ ID NO: 941137 - RNA, 24 nt, Human
ccugucugcucccccggccucugg

SEQ ID NO: 941138 - RNA, 21 nt, Human
cgaggugguuccaggcacguc

SEQ ID NO: 941139 - RNA, 22 nt, Human
cgcugcccaucaaguauuccua

SEQ ID NO: 941140 - RNA, 24 nt, Human
cggaagcaccagcagcccagccgc

SEQ ID NO: 941141 - RNA, 18 nt, Human
cggccucugggcagcccc

SEQ ID NO: 941142 - RNA, 19 nt, Human
cgugcagaggggcugcugg

SEQ ID NO: 941143 - RNA, 23 nt, Human
cgugcaugcuccuccucgcaccc

SEQ ID NO: 941144 - RNA, 23 nt, Human
cucccccggccucugggcagccc

SEQ ID NO: 941145 - RNA, 25 nt, Human
cucuauauaaauaagaaaggccaac

SEQ ID NO: 941146 - RNA, 19 nt, Human
cugcacucuccaggguggg

SEQ ID NO: 941147 - RNA, 18 nt, Human
cugcagcuguggggaccc

SEQ ID NO: 941148 - RNA, 20 nt, Human
cuuccagagggagcaccggc

SEQ ID NO: 941149 - RNA, 23 nt, Human
gaagcuggagcaggaggccagug

SEQ ID NO: 941150 - RNA, 18 nt, Human
gaccaagauucccggaag

SEQ ID NO: 941151 - RNA, 18 nt, Human
gaccauccagguccucaa

SEQ ID NO: 941152 - RNA, 20 nt, Human
gagcaccagugcugugggca

SEQ ID NO: 941153 - RNA, 24 nt, Human
gagcugcagcuguggggaccccag

SEQ ID NO: 941154 - RNA, 21 nt, Human
gcaccagcagcccagccgcgc

SEQ ID NO: 941155 - RNA, 21 nt, Human
gcagcuguggggaccccaggg

SEQ ID NO: 941156 - RNA, 23 nt, Human
gccgcggaguccaccacgggggg

SEQ ID NO: 941157 - RNA, 22 nt, Human
gccuagccucccgaggccccca

SEQ ID NO: 941158 - RNA, 24 nt, Human
gcucccccggccucugggcagccc

SEQ ID NO: 941159 - RNA, 22 nt, Human
ggaccacacccuccaucccgug

SEQ ID NO: 941160 - RNA, 19 nt, Human
ggaggagcggccaauggcu

SEQ ID NO: 941161 - RNA, 19 nt, Human
gggcgaguccacuggugcc

SEQ ID NO: 941162 - RNA, 20 nt, Human
gggggcuguggcagggccgc

SEQ ID NO: 941163 - RNA, 19 nt, Human
gguccugggucccgggagg

SEQ ID NO: 941164 - RNA, 21 nt, Human
gguggaggagcggccaauggc

SEQ ID NO: 941165 - RNA, 26 nt, Human
gugcaccaccaccgggccacacccag

SEQ ID NO: 941166 - RNA, 19 nt, Human
gugucuuugggggcugugg

SEQ ID NO: 941167 - RNA, 18 nt, Human
guuccaggcacgucccua

SEQ ID NO: 941168 - RNA, 19 nt, Human
uaaauaagaaaggccaacc

SEQ ID NO: 941169 - RNA, 25 nt, Human
uaagaaaggccaaccaggcuccccg

SEQ ID NO: 941170 - RNA, 24 nt, Human
uacauuuacuguacaaagaacggu

SEQ ID NO: 941171 - RNA, 25 nt, Human
uagaggugagcaccagugcuguggg

SEQ ID NO: 941172 - RNA, 19 nt, Human
uagccucccgaggcccccu

SEQ ID NO: 941173 - RNA, 21 nt, Human
uccacguaggcggcacuggcc

SEQ ID NO: 941174 - RNA, 19 nt, Human
ucccccggccucugggcag

SEQ ID NO: 941175 - RNA, 18 nt, Human
ucccgggagggcuccuuc

SEQ ID NO: 941176 - RNA, 23 nt, Human
uccugagugcugcuugggcucug

SEQ ID NO: 941177 - RNA, 21 nt, Human
uccuggcaucugcacaggcgg

SEQ ID NO: 941178 - RNA, 21 nt, Human
uccugggucccgggagggcuc

SEQ ID NO: 941179 - RNA, 23 nt, Human
uccugggucccgggagggcuccu

SEQ ID NO: 941180 - RNA, 24 nt, Human
uccugggucccgggagggcuccuu

SEQ ID NO: 941181 - RNA, 22 nt, Human
uccuuucuccccucuccugagu

SEQ ID NO: 941182 - RNA, 18 nt, Human
ucuccagggugggcgaga

SEQ ID NO: 941183 - RNA, 22 nt, Human
ucugaccacaggaccacacccu

SEQ ID NO: 941184 - RNA, 23 nt, Human
ucuuugggggcuguggcagggcc

SEQ ID NO: 941185 - RNA, 22 nt, Human
ugcagaggggcugcuggggcag

SEQ ID NO: 941186 - RNA, 21 nt, Human
ugcaggaccauccagguccuc

SEQ ID NO: 941187 - RNA, 19 nt, Human
ugccgcacggccugaggac

SEQ ID NO: 941188 - RNA, 22 nt, Human
ugccgcggaguccaccacgggg

SEQ ID NO: 941189 - RNA, 18 nt, Human
ugccugggguucccuuac

SEQ ID NO: 941190 - RNA, 22 nt, Human
ugcuggccaugucgugccgcac

SEQ ID NO: 941191 - RNA, 22 nt, Human
uggacgaggugguuccaggcac

SEQ ID NO: 941192 - RNA, 19 nt, Human
uggcagggccgccugccug

SEQ ID NO: 941193 - RNA, 22 nt, Human
uggcaucugcacaggcggcccc

SEQ ID NO: 941194 - RNA, 19 nt, Human
ugggaagcaugugccgcgg

SEQ ID NO: 941195 - RNA, 19 nt, Human
uggggagggauuuggggag

SEQ ID NO: 941196 - RNA, 25 nt, Human
uggggccaggacagggaagcuggaa

SEQ ID NO: 941197 - RNA, 21 nt, Human
uggggcgaguccacuggugcc

SEQ ID NO: 941198 - RNA, 18 nt, Human
ugggggcuguggcagggc

SEQ ID NO: 941199 - RNA, 19 nt, Human
ugggggcuguggcagggcc

SEQ ID NO: 941200 - RNA, 20 nt, Human
ugggucccgggagggcuccu

SEQ ID NO: 941201 - RNA, 24 nt, Human
ugguaguucaugcaggccacggcc

SEQ ID NO: 941202 - RNA, 18 nt, Human
ugguuccaggcacguccc

SEQ ID NO: 941203 - RNA, 20 nt, Human
uucacaggaugccuugccau

SEQ ID NO: 941204 - RNA, 22 nt, Human
uuguucauaaucccaaacaagg

SEQ ID NO: 941205 - RNA, 19 nt, Human
uuugaggaggggccuagcc

SEQ ID NO: 941206 - RNA, 19 nt, Human
aaacaaggacuacgauaua

SEQ ID NO: 941207 - RNA, 24 nt, Human
aaagugcugggauuacaggcauga

SEQ ID NO: 941208 - RNA, 20 nt, Human
aacagguacuagcaacagca

SEQ ID NO: 941209 - RNA, 19 nt, Human
aagugcugggauuacaggc

SEQ ID NO: 941210 - RNA, 21 nt, Human
aagugcugggauuacaggcau

SEQ ID NO: 941211 - RNA, 26 nt, Human
aagugcugggauuacaggcaugagcc

SEQ ID NO: 941212 - RNA, 22 nt, Human
accgcgcccagcccacaugugc

SEQ ID NO: 941213 - RNA, 18 nt, Human
acgggguuucuccauguu

SEQ ID NO: 941214 - RNA, 20 nt, Human
acgggguuucuccauguugg

SEQ ID NO: 941215 - RNA, 24 nt, Human
acgggguuucuccauguuggucag

SEQ ID NO: 941216 - RNA, 19 nt, Human
acucacaucaacagcucac

SEQ ID NO: 941217 - RNA, 22 nt, Human
acuuuuauuuuagauucaggga

SEQ ID NO: 941218 - RNA, 22 nt, Human
acuuuucguugcccaggcugga

SEQ ID NO: 941219 - RNA, 24 nt, Human
acuuuucguugcccaggcuggagu

SEQ ID NO: 941220 - RNA, 23 nt, Human
agcccuuguuccucuucaccucc

SEQ ID NO: 941221 - RNA, 18 nt, Human
agcuccugaccuucaguc

SEQ ID NO: 941222 - RNA, 22 nt, Human
aggccagggaagggggacaggu

SEQ ID NO: 941223 - RNA, 21 nt, Human
aggccccaccaggccagggaa

SEQ ID NO: 941224 - RNA, 23 nt, Human
agggguuuuuuugucguuguuuu

SEQ ID NO: 941225 - RNA, 18 nt, Human
agggugggugcuggacag

SEQ ID NO: 941226 - RNA, 24 nt, Human
aggugauccgccugccucagccuc

SEQ ID NO: 941227 - RNA, 22 nt, Human
aguagagacgggguuucuccau

SEQ ID NO: 941228 - RNA, 21 nt, Human
aguagcugggauuacaggcau

SEQ ID NO: 941229 - RNA, 20 nt, Human
agugcaauggcgcgaucucg

SEQ ID NO: 941230 - RNA, 24 nt, Human
agugcaauggcgcgaucucggcuc

SEQ ID NO: 941231 - RNA, 18 nt, Human
agugcugggauuacaggc

SEQ ID NO: 941232 - RNA, 24 nt, Human
auucacuccacuauagcuccugac

SEQ ID NO: 941233 - RNA, 24 nt, Human
caaagugcugggauuacaggcaug

SEQ ID NO: 941234 - RNA, 21 nt, Human
caacagcucacaucauccuca

SEQ ID NO: 941235 - RNA, 23 nt, Human
caaccuccaccucccagguucaa

SEQ ID NO: 941236 - RNA, 22 nt, Human
caagcaauucuccugccucagc

SEQ ID NO: 941237 - RNA, 22 nt, Human
caccaggccagggaagggggac

SEQ ID NO: 941238 - RNA, 25 nt, Human
cacccucugacucauucacuccacu

SEQ ID NO: 941239 - RNA, 21 nt, Human
caccgcaaccuccaccuccca

SEQ ID NO: 941240 - RNA, 21 nt, Human
caccgcaaccuccaccuccca

SEQ ID NO: 941241 - RNA, 20 nt, Human
cagcagggccagauggggag

SEQ ID NO: 941242 - RNA, 23 nt, Human
cagcagguacgggauucccccuu

SEQ ID NO: 941243 - RNA, 21 nt, Human
caggccccaccaggccaggga

SEQ ID NO: 941244 - RNA, 23 nt, Human
cagguacuagcaacagcagggcc

SEQ ID NO: 941245 - RNA, 22 nt, Human
caggugauccgccugccucagc

SEQ ID NO: 941246 - RNA, 22 nt, Human
cagguggcaacguagcuucucc

SEQ ID NO: 941247 - RNA, 21 nt, Human
cagucuugccccaaagccagg

SEQ ID NO: 941248 - RNA, 23 nt, Human
ccaaagugcugggauuacaggca

SEQ ID NO: 941249 - RNA, 24 nt, Human
ccaaagugcugggauuacaggcau

SEQ ID NO: 941250 - RNA, 27 nt, Human
ccaccucccagguucaagcaauucuuu

SEQ ID NO: 941251 - RNA, 18 nt, Human
ccaggccagggaaggggg

SEQ ID NO: 941252 - RNA, 21 nt, Human
ccagggcagguuaggacacgg

SEQ ID NO: 941253 - RNA, 19 nt, Human
ccauguuggucaggcuggu

SEQ ID NO: 941254 - RNA, 22 nt, Human
ccauguuggucaggcuggucuc

SEQ ID NO: 941255 - RNA, 24 nt, Human
cccaaagugcugggauuacaggca

SEQ ID NO: 941256 - RNA, 21 nt, Human
cccaccaggccagggaagggg

SEQ ID NO: 941257 - RNA, 18 nt, Human
cccaggcuggagugcaau

SEQ ID NO: 941258 - RNA, 22 nt, Human
cccaggcuggagugcaauggcg

SEQ ID NO: 941259 - RNA, 23 nt, Human
cccagguucaagcaauucuccug

SEQ ID NO: 941260 - RNA, 19 nt, Human
ccccaaagccaggccccac

SEQ ID NO: 941261 - RNA, 23 nt, Human
cccccuucccccguggcucaguc

SEQ ID NO: 941262 - RNA, 23 nt, Human
ccccguggcucagucuugccccc

SEQ ID NO: 941263 - RNA, 18 nt, Human
cccgaccucaggugaucc

SEQ ID NO: 941264 - RNA, 21 nt, Human
cccgaccucaggugauccgcc

SEQ ID NO: 941265 - RNA, 23 nt, Human
cccgaccucaggugauccgccug

SEQ ID NO: 941266 - RNA, 23 nt, Human
cccgaguagcugggauuacaggc

SEQ ID NO: 941267 - RNA, 24 nt, Human
cccgaguagcugggauuacaggca

SEQ ID NO: 941268 - RNA, 26 nt, Human
cccguggcucagucuugccccaaagc

SEQ ID NO: 941269 - RNA, 20 nt, Human
cccucugacucauucacucc

SEQ ID NO: 941270 - RNA, 21 nt, Human
cccuuguuccucuucaccucc

SEQ ID NO: 941271 - RNA, 22 nt, Human
cccuuguuccucuucaccuccu

SEQ ID NO: 941272 - RNA, 23 nt, Human
ccgaguagcugggauuacaggca

SEQ ID NO: 941273 - RNA, 24 nt, Human
ccgaguagcugggauuacaggcau

SEQ ID NO: 941274 - RNA, 23 nt, Human
ccgcaaccuccaccucccagguu

SEQ ID NO: 941275 - RNA, 24 nt, Human
ccgcaaccuccaccucccagguuc

SEQ ID NO: 941276 - RNA, 26 nt, Human
ccgccugccucagccucccaaagugc

SEQ ID NO: 941277 - RNA, 24 nt, Human
ccucccagguucaagcaauucucc

SEQ ID NO: 941278 - RNA, 18 nt, Human
ccuccuaccacccucuga

SEQ ID NO: 941279 - RNA, 21 nt, Human
ccucuucaccuccuaccaccc

SEQ ID NO: 941280 - RNA, 24 nt, Human
ccugccucagccucccaaagugcu

SEQ ID NO: 941281 - RNA, 18 nt, Human
ccugggccccagcagggc

SEQ ID NO: 941282 - RNA, 18 nt, Human
cgaccucaggugauccgc

SEQ ID NO: 941283 - RNA, 20 nt, Human
cguugcccaggcuggagugc

SEQ ID NO: 941284 - RNA, 24 nt, Human
cuaauucuguauuuuuaguagaga

SEQ ID NO: 941285 - RNA, 26 nt, Human
cuaauucuguauuuuuaguagagacg

SEQ ID NO: 941286 - RNA, 24 nt, Human
cucaccgcaaccuccaccucccag

SEQ ID NO: 941287 - RNA, 24 nt, Human
cucagccucccgaguagcugggau

SEQ ID NO: 941288 - RNA, 23 nt, Human
cucaggugauccgccugccucag

SEQ ID NO: 941289 - RNA, 20 nt, Human
cuccagguaauaaauaacag

SEQ ID NO: 941290 - RNA, 24 nt, Human
cuccauguuggucaggcuggucuc

SEQ ID NO: 941291 - RNA, 26 nt, Human
cucccgaccucaggugauccgccugc

SEQ ID NO: 941292 - RNA, 24 nt, Human
cugccucagccucccaaagugcug

SEQ ID NO: 941293 - RNA, 23 nt, Human
cugccucagccucccgaguagcu

SEQ ID NO: 941294 - RNA, 23 nt, Human
cuguauuuuuaguagagacgggg

SEQ ID NO: 941295 - RNA, 19 nt, Human
cuuuucguugcccaggcug

SEQ ID NO: 941296 - RNA, 19 nt, Human
cuuuucguugcccaggcug

SEQ ID NO: 941297 - RNA, 21 nt, Human
cuuuucguugcccaggcugga

SEQ ID NO: 941298 - RNA, 24 nt, Human
cuuuucguugcccaggcuggagug

SEQ ID NO: 941299 - RNA, 23 nt, Human
gaccucaggugauccgccugccu

SEQ ID NO: 941300 - RNA, 24 nt, Human
gaccucaggugauccgccugccuc

SEQ ID NO: 941301 - RNA, 23 nt, Human
gagacgggguuucuccauguugg

SEQ ID NO: 941302 - RNA, 24 nt, Human
gagacgggguuucuccauguuggu

SEQ ID NO: 941303 - RNA, 19 nt, Human
gagggagguagacuaaaaa

SEQ ID NO: 941304 - RNA, 24 nt, Human
gaguagcugggauuacaggcaugc

SEQ ID NO: 941305 - RNA, 18 nt, Human
gauuacaggcaugagcca

SEQ ID NO: 941306 - RNA, 20 nt, Human
gauuacaggcaugagccacc

SEQ ID NO: 941307 - RNA, 22 nt, Human
gauuacaggcaugagccaccgc

SEQ ID NO: 941308 - RNA, 18 nt, Human
gauuacaggcaugcgcca

SEQ ID NO: 941309 - RNA, 22 nt, Human
gccaagacagaggaagcagcag

SEQ ID NO: 941310 - RNA, 21 nt, Human
gccccaaagccaggccccacc

SEQ ID NO: 941311 - RNA, 20 nt, Human
gccucagccucccgaguagc

SEQ ID NO: 941312 - RNA, 20 nt, Human
gcgcccagcccacaugugca

SEQ ID NO: 941313 - RNA, 19 nt, Human
gcuggagugcaauggcgcg

SEQ ID NO: 941314 - RNA, 23 nt, Human
gcuggucucaaacucccgaccuc

SEQ ID NO: 941315 - RNA, 21 nt, Human
ggaagggggacagguggcaac

SEQ ID NO: 941316 - RNA, 22 nt, Human
ggauuacaggcaugagccaccg

SEQ ID NO: 941317 - RNA, 19 nt, Human
ggauuacaggcaugcgcca

SEQ ID NO: 941318 - RNA, 23 nt, Human
ggcagaagugagauucaaaccua

SEQ ID NO: 941319 - RNA, 18 nt, Human
ggcugguccuggagaaca

SEQ ID NO: 941320 - RNA, 21 nt, Human
gggacagguggcaacguagcu

SEQ ID NO: 941321 - RNA, 19 nt, Human
gggccagggcagguuagga

SEQ ID NO: 941322 - RNA, 26 nt, Human
gggcuccagagucccagaucuuagcu

SEQ ID NO: 941323 - RNA, 20 nt, Human
ggggccagggcagguuagga

SEQ ID NO: 941324 - RNA, 24 nt, Human
gggguagggugggugcuggacagg

SEQ ID NO: 941325 - RNA, 23 nt, Human
gggguuucuccauguuggucagg

SEQ ID NO: 941326 - RNA, 22 nt, Human
ggguuucuccauguuggucagg

SEQ ID NO: 941327 - RNA, 19 nt, Human
gguaauaaauaacagguac

SEQ ID NO: 941328 - RNA, 24 nt, Human
ggugauccgccugccucagccucc

SEQ ID NO: 941329 - RNA, 24 nt, Human
gguuaggacacggccucucagagc

SEQ ID NO: 941330 - RNA, 23 nt, Human
guagagacgggguuucuccaugu

SEQ ID NO: 941331 - RNA, 18 nt, Human
guagcugggauuacaggc

SEQ ID NO: 941332 - RNA, 20 nt, Human
guagcugggauuacaggcau

SEQ ID NO: 941333 - RNA, 21 nt, Human
guaguacuugccaugugccag

SEQ ID NO: 941334 - RNA, 19 nt, Human
gucucaggcuuugggagcu

SEQ ID NO: 941335 - RNA, 18 nt, Human
gugauccgccugccucag

SEQ ID NO: 941336 - RNA, 24 nt, Human
gugauccgccugccucagccuccc

SEQ ID NO: 941337 - RNA, 24 nt, Human
uaacugacuugcccaaagugacac

SEQ ID NO: 941338 - RNA, 24 nt, Human
uacaggcaugagccaccgcgccca

SEQ ID NO: 941339 - RNA, 24 nt, Human
uacaggcaugcgccaccacacuca

SEQ ID NO: 941340 - RNA, 18 nt, Human
uacuugccaugugccagg

SEQ ID NO: 941341 - RNA, 21 nt, Human
uagccaagacagaggaagcag

SEQ ID NO: 941342 - RNA, 20 nt, Human
uagcuccugaccuucagucu

SEQ ID NO: 941343 - RNA, 24 nt, Human
uaguagagacgggguuucuccaug

SEQ ID NO: 941344 - RNA, 22 nt, Human
uauguaguacuugccaugugcc

SEQ ID NO: 941345 - RNA, 20 nt, Human
ucaacuuuuauuuuagauuc

SEQ ID NO: 941346 - RNA, 24 nt, Human
ucaacuuuuauuuuagauucaggg

SEQ ID NO: 941347 - RNA, 24 nt, Human
ucaccgcaaccuccaccucccagg

SEQ ID NO: 941348 - RNA, 27 nt, Human
ucaccgcaaccuccaccucccagguuc

SEQ ID NO: 941349 - RNA, 23 nt, Human
ucaccuccuaccacccucugacu

SEQ ID NO: 941350 - RNA, 24 nt, Human
ucaccuccuaccacccucugacuc

SEQ ID NO: 941351 - RNA, 24 nt, Human
ucacuuuucguugcccaggcugga

SEQ ID NO: 941352 - RNA, 20 nt, Human
ucagccucccgaguagcugg

SEQ ID NO: 941353 - RNA, 22 nt, Human
ucaggugauccgccugccucag

SEQ ID NO: 941354 - RNA, 18 nt, Human
ucauccucaggaaaacuc

SEQ ID NO: 941355 - RNA, 24 nt, Human
ucccaaagugcugggauuacaggc

SEQ ID NO: 941356 - RNA, 21 nt, Human
ucccagguucaagcaauucuc

SEQ ID NO: 941357 - RNA, 24 nt, Human
ucccagguucaagcaauucuccug

SEQ ID NO: 941358 - RNA, 22 nt, Human
ucccccguggcucagucuugcc

SEQ ID NO: 941359 - RNA, 26 nt, Human
ucccccuucccccguggcucagucuu

SEQ ID NO: 941360 - RNA, 24 nt, Human
ucccgaguagcugggauuacaggc

SEQ ID NO: 941361 - RNA, 24 nt, Human
uccggggccagggcagguuaggac

SEQ ID NO: 941362 - RNA, 20 nt, Human
ucucaggcuuugggagcucu

SEQ ID NO: 941363 - RNA, 24 nt, Human
ucuccugccucagccucccgagua

SEQ ID NO: 941364 - RNA, 22 nt, Human
ucuugggauaugguuagggguu

SEQ ID NO: 941365 - RNA, 20 nt, Human
ugaaaaugacaagcugguuc

SEQ ID NO: 941366 - RNA, 19 nt, Human
ugacucauucacuccacua

SEQ ID NO: 941367 - RNA, 21 nt, Human
ugagccaccgcgcccagccca

SEQ ID NO: 941368 - RNA, 18 nt, Human
ugcccaggcuggagugca

SEQ ID NO: 941369 - RNA, 21 nt, Human
ugcccaggcuggagugcaaug

SEQ ID NO: 941370 - RNA, 21 nt, Human
ugcccaggcuggagugcaaug

SEQ ID NO: 941371 - RNA, 24 nt, Human
ugccucagccucccaaagugcugg

SEQ ID NO: 941372 - RNA, 24 nt, Human
ugccucagccucccgaguagcugg

SEQ ID NO: 941373 - RNA, 23 nt, Human
ugcuuuauggggguagggugggu

SEQ ID NO: 941374 - RNA, 23 nt, Human
uggagugcaauggcgcgaucucg

SEQ ID NO: 941375 - RNA, 24 nt, Human
uggagugcaauggcgcgaucucgg

SEQ ID NO: 941376 - RNA, 18 nt, Human
ugggauuacaggcaugag

SEQ ID NO: 941377 - RNA, 19 nt, Human
ugggauuacaggcaugagc

SEQ ID NO: 941378 - RNA, 21 nt, Human
ugggauuacaggcaugagcca

SEQ ID NO: 941379 - RNA, 22 nt, Human
ugggauuacaggcaugagccac

SEQ ID NO: 941380 - RNA, 23 nt, Human
ugggauuacaggcaugagccacc

SEQ ID NO: 941381 - RNA, 24 nt, Human
ugggauuacaggcaugagccaccg

SEQ ID NO: 941382 - RNA, 24 nt, Human
ugggauuacaggcaugagccaccg

SEQ ID NO: 941383 - RNA, 26 nt, Human
ugggauuacaggcaugagccaccgcg

SEQ ID NO: 941384 - RNA, 18 nt, Human
ugggauuacaggcaugcg

SEQ ID NO: 941385 - RNA, 21 nt, Human
ugggauuacaggcaugcgcca

SEQ ID NO: 941386 - RNA, 22 nt, Human
ugggauuacaggcaugcgccac

SEQ ID NO: 941387 - RNA, 24 nt, Human
ugggauuacaggcaugcgccacca

SEQ ID NO: 941388 - RNA, 21 nt, Human
uggucaggcuggucucaaacu

SEQ ID NO: 941389 - RNA, 19 nt, Human
uggucucaaacucccgacc

SEQ ID NO: 941390 - RNA, 18 nt, Human
uuaguagagacgggguuu

SEQ ID NO: 941391 - RNA, 24 nt, Human
uuaguagagacgggguuucuccau

SEQ ID NO: 941392 - RNA, 21 nt, Human
uucaagcaauucuccugccuc

SEQ ID NO: 941393 - RNA, 24 nt, Human
uucaagcaauucuccugccucagc

SEQ ID NO: 941394 - RNA, 23 nt, Human
uucagggaguacaugugcagggg

SEQ ID NO: 941395 - RNA, 22 nt, Human
uucccugaaaaugacaagcugg

SEQ ID NO: 941396 - RNA, 18 nt, Human
uucguugcccaggcugga

SEQ ID NO: 941397 - RNA, 22 nt, Human
uucguugcccaggcuggagugc

SEQ ID NO: 941398 - RNA, 24 nt, Human
uucguugcccaggcuggagugcaa

SEQ ID NO: 941399 - RNA, 19 nt, Human
uucuguauuuuuaguagag

SEQ ID NO: 941400 - RNA, 20 nt, Human
uucuguauuuuuaguagaga

SEQ ID NO: 941401 - RNA, 19 nt, Human
uuucacuuuucguugccca

SEQ ID NO: 941402 - RNA, 21 nt, Human
uuucuccauguuggucaggcu

SEQ ID NO: 941403 - RNA, 18 nt, Human
uuuucguugcccaggcug

SEQ ID NO: 941404 - RNA, 22 nt, Human
uuuuuaguagagacgggguuuc

SEQ ID NO: 941405 - RNA, 24 nt, Human
uuuuuguuuuuuugagacagaguu

SEQ ID NO: 941406 - RNA, 18 nt, Human
uuuuuuuuuuuuuuuuug

SEQ ID NO: 941407 - RNA, 19 nt, Human
uuuuuuuuuuuuuuuuugu

SEQ ID NO: 941408 - RNA, 20 nt, Human
acuguugcucuaaagaugag

SEQ ID NO: 941409 - RNA, 18 nt, Human
agaggaacgcuaaggcug

SEQ ID NO: 941410 - RNA, 19 nt, Human
ccgccgccgccgccgccca

SEQ ID NO: 941411 - RNA, 22 nt, Human
ccugugccgcacagucuucucc

SEQ ID NO: 941412 - RNA, 24 nt, Human
cgccacagccgcgggcagagacgg

SEQ ID NO: 941413 - RNA, 18 nt, Human
cgccgccacagccgcggg

SEQ ID NO: 941414 - RNA, 18 nt, Human
cuggcggaggaggcguca

SEQ ID NO: 941415 - RNA, 22 nt, Human
gagcggggaugggcggggaagc

SEQ ID NO: 941416 - RNA, 18 nt, Human
ggacccgaccgccgaccu

SEQ ID NO: 941417 - RNA, 21 nt, Human
ggagcggggaugggcggggaa

SEQ ID NO: 941418 - RNA, 20 nt, Human
ggauccgccggcgccgccac

SEQ ID NO: 941419 - RNA, 24 nt, Human
gggagcggggaugggcggggaagc

SEQ ID NO: 941420 - RNA, 18 nt, Human
ggggaugggcggggaagc

SEQ ID NO: 941421 - RNA, 20 nt, Human
uaaaaacccaaagugcaggc

SEQ ID NO: 941422 - RNA, 22 nt, Human
uaaggcuggauccgccggcgcc

SEQ ID NO: 941423 - RNA, 24 nt, Human
ucaaccgagccgccgccgccgccg

SEQ ID NO: 941424 - RNA, 22 nt, Human
uccgccggcgccgccacagccg

SEQ ID NO: 941425 - RNA, 24 nt, Human
uccgccggcgccgccacagccgcg

SEQ ID NO: 941426 - RNA, 20 nt, Human
uccugggcucccgcgggcuc

SEQ ID NO: 941427 - RNA, 24 nt, Human
ugacuucucuuucuucaguuaaga

SEQ ID NO: 941428 - RNA, 22 nt, Human
ugcuguuuccugugccgcacag

SEQ ID NO: 941429 - RNA, 18 nt, Human
uguugugacuucucuuuc

SEQ ID NO: 941430 - RNA, 21 nt, Human
uguuugcuguuuccugugccg

SEQ ID NO: 941431 - RNA, 22 nt, Human
uucuccagucuuccuuuuguug

SEQ ID NO: 941432 - RNA, 24 nt, Human
aaaauccucccaucuugauaacuc

SEQ ID NO: 941433 - RNA, 18 nt, Human
aaagcgaaggagcaggga

SEQ ID NO: 941434 - RNA, 24 nt, Human
aacucgguucccuccccccuuagg

SEQ ID NO: 941435 - RNA, 19 nt, Human
acccuacuccuaaagacag

SEQ ID NO: 941436 - RNA, 20 nt, Human
acuccccagcugcgucccgg

SEQ ID NO: 941437 - RNA, 21 nt, Human
acuccuaaagacagagagaaa

SEQ ID NO: 941438 - RNA, 21 nt, Human
acuccuaaagacagagagaaa

SEQ ID NO: 941439 - RNA, 21 nt, Human
agaaaagaaaaauccucccau

SEQ ID NO: 941440 - RNA, 23 nt, Human
agcgaaggagcagggaggggaga

SEQ ID NO: 941441 - RNA, 25 nt, Human
agcuagccaauaggaagcaacacaa

SEQ ID NO: 941442 - RNA, 22 nt, Human
aggaaaaagcgaaggagcaggg

SEQ ID NO: 941443 - RNA, 19 nt, Human
aggagcagggaggggagag

SEQ ID NO: 941444 - RNA, 20 nt, Human
aggcggaggaaggcuggggc

SEQ ID NO: 941445 - RNA, 26 nt, Human
aggcggaggcggaggaagggggaccc

SEQ ID NO: 941446 - RNA, 22 nt, Human
aggcggccggcggugcgggagc

SEQ ID NO: 941447 - RNA, 24 nt, Human
aucccacccuacuccuaaagacag

SEQ ID NO: 941448 - RNA, 25 nt, Human
auuuuaacaguuuuuggcaaucuua

SEQ ID NO: 941449 - RNA, 20 nt, Human
cagccucccuccccauccca

SEQ ID NO: 941450 - RNA, 22 nt, Human
ccacccuacuccuaaagacaga

SEQ ID NO: 941451 - RNA, 19 nt, Human
ccccaucccacccuacucc

SEQ ID NO: 941452 - RNA, 22 nt, Human
cccggcugcggcugcguguccg

SEQ ID NO: 941453 - RNA, 21 nt, Human
cccggucccggcugcggcugc

SEQ ID NO: 941454 - RNA, 25 nt, Human
cccuccccaucccacccuacuccua

SEQ ID NO: 941455 - RNA, 20 nt, Human
ccggggccgggagaggagga

SEQ ID NO: 941456 - RNA, 21 nt, Human
cgcgcucuuuacgcccgaggc

SEQ ID NO: 941457 - RNA, 25 nt, Human
cugaugcccagccucccuccccauc

SEQ ID NO: 941458 - RNA, 21 nt, Human
cuugauaacucgguucccucc

SEQ ID NO: 941459 - RNA, 21 nt, Human
gaaaaagcgaaggagcaggga

SEQ ID NO: 941460 - RNA, 19 nt, Human
gccucccuccccaucccac

SEQ ID NO: 941461 - RNA, 20 nt, Human
gccucccuccccaucccacc

SEQ ID NO: 941462 - RNA, 19 nt, Human
gcugcugcggucggcacug

SEQ ID NO: 941463 - RNA, 21 nt, Human
ggagagaggcgcgggcggagc

SEQ ID NO: 941464 - RNA, 20 nt, Human
ggagaguaggagggcgaggg

SEQ ID NO: 941465 - RNA, 18 nt, Human
ggagcagggaggggagag

SEQ ID NO: 941466 - RNA, 19 nt, Human
ggaggaaggcuggggcugg

SEQ ID NO: 941467 - RNA, 20 nt, Human
ggaggagagagaggcggagg

SEQ ID NO: 941468 - RNA, 22 nt, Human
ggaggagagagaggcggaggcg

SEQ ID NO: 941469 - RNA, 25 nt, Human
ggaggaggaggagagagaggcggaa

SEQ ID NO: 941470 - RNA, 20 nt, Human
gggaagccacaggucggcuc

SEQ ID NO: 941471 - RNA, 23 nt, Human
gggcugcugcggucggcacuggc

SEQ ID NO: 941472 - RNA, 20 nt, Human
ggggccgggagaggaggagg

SEQ ID NO: 941473 - RNA, 19 nt, Human
uaaagacagagagaaaaga

SEQ ID NO: 941474 - RNA, 22 nt, Human
uacaauauauuacaaccaaacc

SEQ ID NO: 941475 - RNA, 19 nt, Human
uaggagggcgaggggaggc

SEQ ID NO: 941476 - RNA, 21 nt, Human
uccccagcugcgucccggucc

SEQ ID NO: 941477 - RNA, 20 nt, Human
ucccuccccaucccacccua

SEQ ID NO: 941478 - RNA, 21 nt, Human
ucccugacuccccagcugcgu

SEQ ID NO: 941479 - RNA, 20 nt, Human
ugacuccccagcugcguccc

SEQ ID NO: 941480 - RNA, 20 nt, Human
ugcgcgcgucccugacuccc

SEQ ID NO: 941481 - RNA, 21 nt, Human
ugcggucggcacuggcugcgg

SEQ ID NO: 941482 - RNA, 18 nt, Human
uggcagccggggccggga

SEQ ID NO: 941483 - RNA, 19 nt, Human
uggcagccggggccgggag

SEQ ID NO: 941484 - RNA, 20 nt, Human
uggcugcgcgcgucccugac

SEQ ID NO: 941485 - RNA, 23 nt, Human
ugucaugggaagccacaggucgg

SEQ ID NO: 941486 - RNA, 24 nt, Human
ugugaucccugaugcccagccucc

SEQ ID NO: 941487 - RNA, 26 nt, Human
aaaaaaagcaaagaaauaucgccaaa

SEQ ID NO: 941488 - RNA, 24 nt, Human
aaaaaagcaaagaaauaucgccaa

SEQ ID NO: 941489 - RNA, 23 nt, Human
aaaaugcuaaaaaauaaggcaua

SEQ ID NO: 941490 - RNA, 22 nt, Human
aaagaaaacccaagcaaaaucu

SEQ ID NO: 941491 - RNA, 21 nt, Human
aaagaaauaucgccaaagaaa

SEQ ID NO: 941492 - RNA, 19 nt, Human
aaauaaugaagacgcugac

SEQ ID NO: 941493 - RNA, 20 nt, Human
aacauuaaaaaagaaaaaaa

SEQ ID NO: 941494 - RNA, 22 nt, Human
aagcaaagaaauaucgccaaag

SEQ ID NO: 941495 - RNA, 26 nt, Human
aagcaaagaaauaucgccaaagaaaa

SEQ ID NO: 941496 - RNA, 18 nt, Human
aagggagaggugagaaga

SEQ ID NO: 941497 - RNA, 22 nt, Human
aagugggaaguggaggaggaag

SEQ ID NO: 941498 - RNA, 25 nt, Human
aaguuuucuuccugcaaacaauguu

SEQ ID NO: 941499 - RNA, 24 nt, Human
aauaagugggaaguggaggaggaa

SEQ ID NO: 941500 - RNA, 20 nt, Human
aauuccagugggcuuggucg

SEQ ID NO: 941501 - RNA, 22 nt, Human
acaucuaaaaauggaaaguugu

SEQ ID NO: 941502 - RNA, 22 nt, Human
accuuaaaaaaugcuaaaaaau

SEQ ID NO: 941503 - RNA, 23 nt, Human
acuuuuguugucuuuucaucuuu

SEQ ID NO: 941504 - RNA, 21 nt, Human
agaaagaaaacccaagcaaaa

SEQ ID NO: 941505 - RNA, 22 nt, Human
agaaguaaauacuaaaaaccug

SEQ ID NO: 941506 - RNA, 24 nt, Human
agaaguaaauacuaaaaaccuguu

SEQ ID NO: 941507 - RNA, 18 nt, Human
agacggaggguggcggag

SEQ ID NO: 941508 - RNA, 23 nt, Human
agaggaaagagaggggacuaagg

SEQ ID NO: 941509 - RNA, 25 nt, Human
agcaaagaaauaucgccaaagaaaa

SEQ ID NO: 941510 - RNA, 22 nt, Human
agcccagagaccucccggaccg

SEQ ID NO: 941511 - RNA, 18 nt, Human
agccgccgccgccgcagc

SEQ ID NO: 941512 - RNA, 21 nt, Human
agcucuaaauagauucaacga

SEQ ID NO: 941513 - RNA, 22 nt, Human
aggaagaggaaagagaggggac

SEQ ID NO: 941514 - RNA, 21 nt, Human
aggaaguggggggaggcuagg

SEQ ID NO: 941515 - RNA, 21 nt, Human
aggagcccggcuggagaagcc

SEQ ID NO: 941516 - RNA, 23 nt, Human
aggaggcuuuucucauucaagcc

SEQ ID NO: 941517 - RNA, 21 nt, Human
agggaacgggguaagggagag

SEQ ID NO: 941518 - RNA, 18 nt, Human
agggagaggugagaagag

SEQ ID NO: 941519 - RNA, 21 nt, Human
aucuaaaaauggaaaguuguu

SEQ ID NO: 941520 - RNA, 23 nt, Human
auuaucuuaccaugaagaaguaa

SEQ ID NO: 941521 - RNA, 19 nt, Human
auuuuuuuaagaaagaaaa

SEQ ID NO: 941522 - RNA, 18 nt, Human
caaaaccagccugaaaga

SEQ ID NO: 941523 - RNA, 22 nt, Human
caaaaccagccugaaagaccca

SEQ ID NO: 941524 - RNA, 23 nt, Human
caaaccaaaaccagccugaaaga

SEQ ID NO: 941525 - RNA, 22 nt, Human
caaauguccugagcaaaguuuu

SEQ ID NO: 941526 - RNA, 21 nt, Human
caaccuuaaaaaaugcuaaaa

SEQ ID NO: 941527 - RNA, 20 nt, Human
caagcaaaaucuauugcuua

SEQ ID NO: 941528 - RNA, 18 nt, Human
cacuuuauaacuccaucc

SEQ ID NO: 941529 - RNA, 20 nt, Human
cacuuuauaacuccauccca

SEQ ID NO: 941530 - RNA, 21 nt, Human
cagaguagccgagcacggagc

SEQ ID NO: 941531 - RNA, 21 nt, Human
cagccgccgccgccgcagccc

SEQ ID NO: 941532 - RNA, 19 nt, Human
cagccgccgccgccucccg

SEQ ID NO: 941533 - RNA, 20 nt, Human
cagccgccgccgccucccgg

SEQ ID NO: 941534 - RNA, 18 nt, Human
cagccugaaagacccaac

SEQ ID NO: 941535 - RNA, 23 nt, Human
caugaagaaguaaauacuaaaaa

SEQ ID NO: 941536 - RNA, 22 nt, Human
ccaaccuuaaaaaaugcuaaaa

SEQ ID NO: 941537 - RNA, 21 nt, Human
ccacagacuggcagccgccgc

SEQ ID NO: 941538 - RNA, 22 nt, Human
ccaugaagaaguaaauacuaaa

SEQ ID NO: 941539 - RNA, 20 nt, Human
cccaaccugcugagugcccc

SEQ ID NO: 941540 - RNA, 21 nt, Human
cccaaccuuaaaaaaugcuaa

SEQ ID NO: 941541 - RNA, 26 nt, Human
cccgcggcugggaagggaaggagggc

SEQ ID NO: 941542 - RNA, 18 nt, Human
ccgccgccgccucccggc

SEQ ID NO: 941543 - RNA, 21 nt, Human
ccgucuuccgucuucaauuuu

SEQ ID NO: 941544 - RNA, 25 nt, Human
ccucagcccagagaccucccggacc

SEQ ID NO: 941545 - RNA, 26 nt, Human
ccucccggaccgaugcuccuccagcc

SEQ ID NO: 941546 - RNA, 24 nt, Human
cgagcggaagggcgggcgccgagc

SEQ ID NO: 941547 - RNA, 23 nt, Human
cggcagaguagccgagcacggag

SEQ ID NO: 941548 - RNA, 21 nt, Human
cggcucagagaccugcgggag

SEQ ID NO: 941549 - RNA, 22 nt, Human
cucaaauguccugagcaaaguu

SEQ ID NO: 941550 - RNA, 21 nt, Human
cucccagagucuaauaaagca

SEQ ID NO: 941551 - RNA, 19 nt, Human
cugcugcuuugccaucucu

SEQ ID NO: 941552 - RNA, 24 nt, Human
cuucccaaggcuagggccguuccc

SEQ ID NO: 941553 - RNA, 24 nt, Human
cuugguccacagccuacagcaagu

SEQ ID NO: 941554 - RNA, 21 nt, Human
cuugguuacuuuucucuccca

SEQ ID NO: 941555 - RNA, 21 nt, Human
gaaacaucuaaaaauggaaag

SEQ ID NO: 941556 - RNA, 23 nt, Human
gaaauacauauugccauggugaa

SEQ ID NO: 941557 - RNA, 24 nt, Human
gaccauuuguguuagucagaaaua

SEQ ID NO: 941558 - RNA, 18 nt, Human
gacugcugcuuugccauc

SEQ ID NO: 941559 - RNA, 20 nt, Human
gagagagacggaggguggcg

SEQ ID NO: 941560 - RNA, 18 nt, Human
gaggaaguggggggaggc

SEQ ID NO: 941561 - RNA, 22 nt, Human
gaggagcccggcuggagaagcc

SEQ ID NO: 941562 - RNA, 18 nt, Human
gcccggcuggagaagccc

SEQ ID NO: 941563 - RNA, 19 nt, Human
gccgagcucucugugcccc

SEQ ID NO: 941564 - RNA, 18 nt, Human
gccgccucagcccagaga

SEQ ID NO: 941565 - RNA, 18 nt, Human
gccggcugacgaaaaagg

SEQ ID NO: 941566 - RNA, 19 nt, Human
gcuuacacagcagucucac

SEQ ID NO: 941567 - RNA, 22 nt, Human
gcuuuggcuucccaaggcuagg

SEQ ID NO: 941568 - RNA, 20 nt, Human
ggaagggaaggagggcggug

SEQ ID NO: 941569 - RNA, 21 nt, Human
ggaaguggaggaggaagagga

SEQ ID NO: 941570 - RNA, 19 nt, Human
ggagcugucgccgccucag

SEQ ID NO: 941571 - RNA, 24 nt, Human
ggaggaggaagaggaaagagaggg

SEQ ID NO: 941572 - RNA, 19 nt, Human
ggcagaguagccgagcacg

SEQ ID NO: 941573 - RNA, 19 nt, Human
gggaaggagggcggugucg

SEQ ID NO: 941574 - RNA, 19 nt, Human
gggaagggaaggagggcgg

SEQ ID NO: 941575 - RNA, 22 nt, Human
gggaaguggaggaggaagagga

SEQ ID NO: 941576 - RNA, 22 nt, Human
gguucuuuugcugguaagcuuu

SEQ ID NO: 941577 - RNA, 25 nt, Human
gugaagcucuaaauagauucaacga

SEQ ID NO: 941578 - RNA, 23 nt, Human
guggaggagcccggcuggagaag

SEQ ID NO: 941579 - RNA, 18 nt, Human
uaaaaaaaaaaagcaaag

SEQ ID NO: 941580 - RNA, 24 nt, Human
uaaaaaagaaaaaaauguuaagaa

SEQ ID NO: 941581 - RNA, 25 nt, Human
uacacagcagucucacaauaacuag

SEQ ID NO: 941582 - RNA, 22 nt, Human
uaccugaucugccucuaggggc

SEQ ID NO: 941583 - RNA, 19 nt, Human
uacuuuuuaaacaaacaga

SEQ ID NO: 941584 - RNA, 24 nt, Human
uaguaaagauuaaaagggcacagu

SEQ ID NO: 941585 - RNA, 19 nt, Human
uauccgggaucucucacgc

SEQ ID NO: 941586 - RNA, 24 nt, Human
ucacgcgcggcgcuucggcuuccc

SEQ ID NO: 941587 - RNA, 20 nt, Human
ucagcccagagaccucccgg

SEQ ID NO: 941588 - RNA, 21 nt, Human
uccagccggcugacgaaaaag

SEQ ID NO: 941589 - RNA, 19 nt, Human
ucccagagucuaauaaagc

SEQ ID NO: 941590 - RNA, 18 nt, Human
uccgcacccggcucagag

SEQ ID NO: 941591 - RNA, 25 nt, Human
uccuuccgcacccggcucagagacc

SEQ ID NO: 941592 - RNA, 21 nt, Human
ucucacgcgcggcgcuucggc

SEQ ID NO: 941593 - RNA, 18 nt, Human
ucuccuuucccucuacua

SEQ ID NO: 941594 - RNA, 18 nt, Human
ucucuuguuuguuuugag

SEQ ID NO: 941595 - RNA, 20 nt, Human
ucugaagcacuugguuacuu

SEQ ID NO: 941596 - RNA, 20 nt, Human
ugcugcuuugccaucucuug

SEQ ID NO: 941597 - RNA, 25 nt, Human
uggaaaguuguuaaaaaaaaaaagc

SEQ ID NO: 941598 - RNA, 22 nt, Human
uggaacuagaggagcugucgcc

SEQ ID NO: 941599 - RNA, 21 nt, Human
uggcagccgccgccgccuccc

SEQ ID NO: 941600 - RNA, 18 nt, Human
uggcggagcccaaaccgc

SEQ ID NO: 941601 - RNA, 19 nt, Human
ugggaagggaaggagggcg

SEQ ID NO: 941602 - RNA, 20 nt, Human
ugggaaguggaggaggaaga

SEQ ID NO: 941603 - RNA, 21 nt, Human
ugggcuuggucggacugcugc

SEQ ID NO: 941604 - RNA, 24 nt, Human
uguguuaaguaacguuuacaacaa

SEQ ID NO: 941605 - RNA, 26 nt, Human
uguuaaaaaaaaaaagcaaagaaaua

SEQ ID NO: 941606 - RNA, 22 nt, Human
uuaaaaaaaaaaagcaaagaaa

SEQ ID NO: 941607 - RNA, 30 nt, Human
uuccccagccgccgccgccgcagcccaacu

SEQ ID NO: 941608 - RNA, 19 nt, Human
uucugaagcacuugguuac

SEQ ID NO: 941609 - RNA, 21 nt, Human
uugaagaugcaccaggaggcu

SEQ ID NO: 941610 - RNA, 21 nt, Human
uugcugguaagcuuuagauau

SEQ ID NO: 941611 - RNA, 22 nt, Human
uuugaagaugcaccaggaggcu

SEQ ID NO: 941612 - RNA, 18 nt, Human
uuugaccucaaauguccu

SEQ ID NO: 941613 - RNA, 22 nt, Human
uuuuaaaaccuugggagaaaua

SEQ ID NO: 941614 - RNA, 23 nt, Human
uuuuaagggaaauacauauugcc

SEQ ID NO: 941615 - RNA, 20 nt, Human
agaugauacacugcugcaaa

SEQ ID NO: 941616 - RNA, 23 nt, Human
ccaagaguggaugugucccuucu

SEQ ID NO: 941617 - RNA, 24 nt, Human
cccaccaacuaaugaagcagcaac

SEQ ID NO: 941618 - RNA, 21 nt, Human
cgcuaauucucuucuccaucc

SEQ ID NO: 941619 - RNA, 22 nt, Human
guuagaaugcaucaacaaucua

SEQ ID NO: 941620 - RNA, 19 nt, Human
uaaggugccauuauugagu

SEQ ID NO: 941621 - RNA, 18 nt, Human
uaguagaugauacacugc

SEQ ID NO: 941622 - RNA, 18 nt, Human
uccaagaguggauguguc

SEQ ID NO: 941623 - RNA, 19 nt, Human
uccaagaguggaugugucc

SEQ ID NO: 941624 - RNA, 18 nt, Human
ugauacacugcugcaaac

SEQ ID NO: 941625 - RNA, 19 nt, Human
ugugucccuucucccacca

SEQ ID NO: 941626 - RNA, 22 nt, Human
uuaaucucaaaagcuucaagaa

SEQ ID NO: 941627 - RNA, 19 nt, Human
uuaguagaugauacacugc

SEQ ID NO: 941628 - RNA, 24 nt, Human
uuuauaaauguaaggugccauuau

SEQ ID NO: 941629 - RNA, 18 nt, Human
uuucauuuauuagcucug

SEQ ID NO: 941630 - RNA, 20 nt, Human
aaggaaacaggagagggccg

SEQ ID NO: 941631 - RNA, 19 nt, Human
aauauuuuccuuuuuuucc

SEQ ID NO: 941632 - RNA, 23 nt, Human
aggaaacaggagagggccgcggg

SEQ ID NO: 941633 - RNA, 22 nt, Human
aggggcacaguuauucuuacac

SEQ ID NO: 941634 - RNA, 20 nt, Human
caccagaagggaaggaguuu

SEQ ID NO: 941635 - RNA, 18 nt, Human
caccgucacugcuccugc

SEQ ID NO: 941636 - RNA, 22 nt, Human
caguggguuuuugucacaauuu

SEQ ID NO: 941637 - RNA, 19 nt, Human
cugcuccugcugccuccuc

SEQ ID NO: 941638 - RNA, 18 nt, Human
gcgugccgggaauccggc

SEQ ID NO: 941639 - RNA, 19 nt, Human
ggaaacaggagagggccgc

SEQ ID NO: 941640 - RNA, 18 nt, Human
ggaaggaaacaggagagg

SEQ ID NO: 941641 - RNA, 25 nt, Human
ggaguuuguaaccaagagaacccag

SEQ ID NO: 941642 - RNA, 23 nt, Human
uaaccaagagaacccaguggguu

SEQ ID NO: 941643 - RNA, 21 nt, Human
uagggugccaacacaauggga

SEQ ID NO: 941644 - RNA, 21 nt, Human
ucaaucuacacuucaauuuga

SEQ ID NO: 941645 - RNA, 20 nt, Human
ucacugcuccugcugccucc

SEQ ID NO: 941646 - RNA, 21 nt, Human
ucuacacuucaauuugaaagg

SEQ ID NO: 941647 - RNA, 18 nt, Human
ucuuucuuuuuagggugc

SEQ ID NO: 941648 - RNA, 27 nt, Human
ugcuccugcugccuccucguccucaau

SEQ ID NO: 941649 - RNA, 22 nt, Human
ugggaaggaaacaggagagggc

SEQ ID NO: 941650 - RNA, 18 nt, Human
uggguuuuugucacaauu

SEQ ID NO: 941651 - RNA, 22 nt, Human
ugugcacucuuagaggggcaca

SEQ ID NO: 941652 - RNA, 19 nt, Human
ugugugcgugugugugcac

SEQ ID NO: 941653 - RNA, 21 nt, Human
ugugugcgugugugugcacuc

SEQ ID NO: 941654 - RNA, 20 nt, Human
uuuuuuccuguuguuguuuu

SEQ ID NO: 941655 - RNA, 29 nt, Human
cagcaaaucucauccccacguggcaguuc

SEQ ID NO: 941656 - RNA, 20 nt, Human
cuguccccaaaguccagagc

SEQ ID NO: 941657 - RNA, 22 nt, Human
gcuggcuucacgugggcgggac

SEQ ID NO: 941658 - RNA, 20 nt, Human
guccagagcucaguuaggcu

SEQ ID NO: 941659 - RNA, 20 nt, Human
uaauaaaaauguggguuuua

SEQ ID NO: 941660 - RNA, 20 nt, Human
uccccgcagcagccgccgcu

SEQ ID NO: 941661 - RNA, 22 nt, Human
ugacagcuguccccaaagucca

SEQ ID NO: 941662 - RNA, 19 nt, Human
aggcaugggcagggguggg

SEQ ID NO: 941663 - RNA, 18 nt, Human
aggccggcaggucccaga

SEQ ID NO: 941664 - RNA, 19 nt, Human
cacccauaacagcuuuauu

SEQ ID NO: 941665 - RNA, 24 nt, Human
caggacaggcaugggcaggggugg

SEQ ID NO: 941666 - RNA, 24 nt, Human
cgugcaggacaggcaugggcaggg

SEQ ID NO: 941667 - RNA, 23 nt, Human
cugaaugacacccauaacagcuu

SEQ ID NO: 941668 - RNA, 21 nt, Human
gacaggcaugggcaggggugg

SEQ ID NO: 941669 - RNA, 22 nt, Human
gacggcgcugugggcccgagca

SEQ ID NO: 941670 - RNA, 22 nt, Human
ggacaggcaugggcaggggugg

SEQ ID NO: 941671 - RNA, 22 nt, Human
ggcgcugugggcccgagcagca

SEQ ID NO: 941672 - RNA, 19 nt, Human
gggcagggguggggcagcu

SEQ ID NO: 941673 - RNA, 20 nt, Human
ggggcagcuggcccgggagg

SEQ ID NO: 941674 - RNA, 22 nt, Human
gggguggggcagcuggcccggg

SEQ ID NO: 941675 - RNA, 19 nt, Human
uggcccgggaggccggcag

SEQ ID NO: 941676 - RNA, 24 nt, Human
uuuuuuuuuuccugaaugacaccc

SEQ ID NO: 941677 - RNA, 18 nt, Human
uuuuuuuuuuuuuuccug

SEQ ID NO: 941678 - RNA, 21 nt, Human
aaaagacaucagugguucuua

SEQ ID NO: 941679 - RNA, 20 nt, Human
aaaaucacuugggcccaggu

SEQ ID NO: 941680 - RNA, 27 nt, Human
aaaaugccaugcacagcagacaccauu

SEQ ID NO: 941681 - RNA, 20 nt, Human
aaaauuauuccaaacugugg

SEQ ID NO: 941682 - RNA, 18 nt, Human
aaacaccucucaggccac

SEQ ID NO: 941683 - RNA, 19 nt, Human
aaacagcaauuuuaugugg

SEQ ID NO: 941684 - RNA, 23 nt, Human
aaaugaaucuguaucaguaacuc

SEQ ID NO: 941685 - RNA, 20 nt, Human
aacaaacaccucucaggcca

SEQ ID NO: 941686 - RNA, 22 nt, Human
aaccaaagaagggcaaguuuug

SEQ ID NO: 941687 - RNA, 25 nt, Human
aaccaaagaagggcaaguuuuguac

SEQ ID NO: 941688 - RNA, 20 nt, Human
aagaagaaucaucaauggua

SEQ ID NO: 941689 - RNA, 25 nt, Human
aagaagggcaaguuuuguacuaaaa

SEQ ID NO: 941690 - RNA, 19 nt, Human
aagagggacggauugugaa

SEQ ID NO: 941691 - RNA, 18 nt, Human
aagauacuggaaaagcaa

SEQ ID NO: 941692 - RNA, 24 nt, Human
aagcacauagaaaauuaaaccaaa

SEQ ID NO: 941693 - RNA, 23 nt, Human
acaccuaaaagcacauagaaaau

SEQ ID NO: 941694 - RNA, 22 nt, Human
accaugcacaggguggccccac

SEQ ID NO: 941695 - RNA, 18 nt, Human
agacaaaauuugcacaca

SEQ ID NO: 941696 - RNA, 18 nt, Human
agcugacucagugaacug

SEQ ID NO: 941697 - RNA, 22 nt, Human
agcugccugugugaagugacgu

SEQ ID NO: 941698 - RNA, 18 nt, Human
aggcccauucauucccgc

SEQ ID NO: 941699 - RNA, 22 nt, Human
aggguggccccacaacaaacac

SEQ ID NO: 941700 - RNA, 19 nt, Human
auaaaauggugcuaaaggc

SEQ ID NO: 941701 - RNA, 20 nt, Human
augcaguuuauugaacaaac

SEQ ID NO: 941702 - RNA, 18 nt, Human
caaauaaaauggugcuaa

SEQ ID NO: 941703 - RNA, 23 nt, Human
caagagaaccuuucucagcugcc

SEQ ID NO: 941704 - RNA, 18 nt, Human
cacaacaaacaccucuca

SEQ ID NO: 941705 - RNA, 22 nt, Human
caccauauuaaccaccaggagg

SEQ ID NO: 941706 - RNA, 22 nt, Human
cacugugcauugagugcaagau

SEQ ID NO: 941707 - RNA, 21 nt, Human
cagcuuuugugggaaguugau

SEQ ID NO: 941708 - RNA, 22 nt, Human
cauucuagaucccaaucaguug

SEQ ID NO: 941709 - RNA, 18 nt, Human
ccaaacuguggaagagug

SEQ ID NO: 941710 - RNA, 19 nt, Human
ccaccgcucgcccgcuucg

SEQ ID NO: 941711 - RNA, 21 nt, Human
cccacaacaaacaccucucag

SEQ ID NO: 941712 - RNA, 21 nt, Human
ccccacaacaaacaccucuca

SEQ ID NO: 941713 - RNA, 24 nt, Human
ccuugcaucucacagcugagggac

SEQ ID NO: 941714 - RNA, 19 nt, Human
cgacuacauuaaacagcaa

SEQ ID NO: 941715 - RNA, 20 nt, Human
cucaccaucagaggcccauu

SEQ ID NO: 941716 - RNA, 18 nt, Human
cucuauauaaggcaagag

SEQ ID NO: 941717 - RNA, 27 nt, Human
gaccccgucaccucucaccaucagagg

SEQ ID NO: 941718 - RNA, 21 nt, Human
gacuauauagaaccucaaagu

SEQ ID NO: 941719 - RNA, 21 nt, Human
ggaaaaacgaaacaaucccca

SEQ ID NO: 941720 - RNA, 18 nt, Human
ggaugucacugaauggaa

SEQ ID NO: 941721 - RNA, 22 nt, Human
guacuaaaaucacuugggccca

SEQ ID NO: 941722 - RNA, 19 nt, Human
guaguaagggcuaccuaca

SEQ ID NO: 941723 - RNA, 18 nt, Human
gucagcuuuugugggaag

SEQ ID NO: 941724 - RNA, 19 nt, Human
uaaaauggugcuaaaggca

SEQ ID NO: 941725 - RNA, 29 nt, Human
uaagagacccaaaaaagucaggggagucc

SEQ ID NO: 941726 - RNA, 21 nt, Human
uaagcuagaagcauaguuuaa

SEQ ID NO: 941727 - RNA, 23 nt, Human
uaccaaaaccacagugaaugcca

SEQ ID NO: 941728 - RNA, 26 nt, Human
uaccagaagaauucgaccaauaugag

SEQ ID NO: 941729 - RNA, 24 nt, Human
uagaagguuccacugagauaagaa

SEQ ID NO: 941730 - RNA, 25 nt, Human
uaggaaaaacgaaacaauccccaua

SEQ ID NO: 941731 - RNA, 22 nt, Human
uaggcucaaauaaauacucucc

SEQ ID NO: 941732 - RNA, 24 nt, Human
uauaaaauuauuccaaacugugga

SEQ ID NO: 941733 - RNA, 20 nt, Human
uauguaagagacccaaaaag

SEQ ID NO: 941734 - RNA, 19 nt, Human
uauuauggaggcugcaagg

SEQ ID NO: 941735 - RNA, 18 nt, Human
ucacacugugcauugagu

SEQ ID NO: 941736 - RNA, 27 nt, Human
ucagaaaacaugucuagacguuugcaa

SEQ ID NO: 941737 - RNA, 21 nt, Human
ucauuuguuuaauccuuuaaa

SEQ ID NO: 941738 - RNA, 26 nt, Human
ucucacagcugagggaccccgucacc

SEQ ID NO: 941739 - RNA, 27 nt, Human
ucucaggccacuaauaugaauaguccc

SEQ ID NO: 941740 - RNA, 21 nt, Human
ucugcaauuuugggcuccauc

SEQ ID NO: 941741 - RNA, 23 nt, Human
ugaagaacucaauagagauuugc

SEQ ID NO: 941742 - RNA, 23 nt, Human
ugacuauauagaaccucaaaguu

SEQ ID NO: 941743 - RNA, 23 nt, Human
ugacuuaagagaaauagaagccu

SEQ ID NO: 941744 - RNA, 21 nt, Human
ugauaaagaauuccguuccaa

SEQ ID NO: 941745 - RNA, 22 nt, Human
ugauaguaacuuaucaccuucu

SEQ ID NO: 941746 - RNA, 20 nt, Human
ugcccuggggccucaugcac

SEQ ID NO: 941747 - RNA, 19 nt, Human
ugcucugacauuuauaagc

SEQ ID NO: 941748 - RNA, 19 nt, Human
uggccccacaacaaacacc

SEQ ID NO: 941749 - RNA, 22 nt, Human
uguacuaaaaucacuugggccc

SEQ ID NO: 941750 - RNA, 22 nt, Human
uuaaaaaaugcucugacauuua

SEQ ID NO: 941751 - RNA, 18 nt, Human
uuaaagucuuccaucgac

SEQ ID NO: 941752 - RNA, 23 nt, Human
uucauuuguuuaauccuuuaaaa

SEQ ID NO: 941753 - RNA, 22 nt, Human
uuccaaaggaauuaagaccgca

SEQ ID NO: 941754 - RNA, 19 nt, Human
uuccacugagauaagaaaa

SEQ ID NO: 941755 - RNA, 27 nt, Human
uuucacagcucuagcgggggugcuacu

SEQ ID NO: 941756 - RNA, 22 nt, Human
uuuucuugaacauacacuuugu

SEQ ID NO: 941757 - RNA, 18 nt, Human
uuuuuuuuuuggaagagg

SEQ ID NO: 941758 - RNA, 21 nt, Human
aacagucaaugacugcagaac

SEQ ID NO: 941759 - RNA, 18 nt, Human
aacuguucaguguuucuu

SEQ ID NO: 941760 - RNA, 21 nt, Human
aagcuuguaauggaagugaaa

SEQ ID NO: 941761 - RNA, 24 nt, Human
aaugguaggaaguaaggcaaauac

SEQ ID NO: 941762 - RNA, 25 nt, Human
acaggagaccccugauuaacaacaa

SEQ ID NO: 941763 - RNA, 23 nt, Human
acccagguuggagugcaguggug

SEQ ID NO: 941764 - RNA, 24 nt, Human
agcgauucuccugccucagccucc

SEQ ID NO: 941765 - RNA, 20 nt, Human
aggaaagugguuguagagug

SEQ ID NO: 941766 - RNA, 25 nt, Human
agguuggagugcaguggugcgaucu

SEQ ID NO: 941767 - RNA, 20 nt, Human
agugcaguggugcgaucucg

SEQ ID NO: 941768 - RNA, 23 nt, Human
agugcaguggugcgaucucggcu

SEQ ID NO: 941769 - RNA, 24 nt, Human
agugcaguggugcgaucucggcuc

SEQ ID NO: 941770 - RNA, 21 nt, Human
augcugcuuuaaggaaguaag

SEQ ID NO: 941771 - RNA, 25 nt, Human
auggaacccauggauauggagggcu

SEQ ID NO: 941772 - RNA, 21 nt, Human
caaaaaaccacuauuaaaaug

SEQ ID NO: 941773 - RNA, 19 nt, Human
caaaagaucacaggaacuu

SEQ ID NO: 941774 - RNA, 20 nt, Human
caaccucugcuucccggguu

SEQ ID NO: 941775 - RNA, 22 nt, Human
caagcgauucuccugccucagc

SEQ ID NO: 941776 - RNA, 23 nt, Human
caaugacugcagaacuuucuggc

SEQ ID NO: 941777 - RNA, 22 nt, Human
cacacaccaagcacaggagacc

SEQ ID NO: 941778 - RNA, 24 nt, Human
cacccagguuggagugcaguggug

SEQ ID NO: 941779 - RNA, 23 nt, Human
cacugcaaccucugcuucccggg

SEQ ID NO: 941780 - RNA, 19 nt, Human
cagcagcuccuuccaggcg

SEQ ID NO: 941781 - RNA, 18 nt, Human
ccccacacaccaagcaca

SEQ ID NO: 941782 - RNA, 19 nt, Human
ccccacacaccaagcacag

SEQ ID NO: 941783 - RNA, 20 nt, Human
cccggguucaagcgauucuc

SEQ ID NO: 941784 - RNA, 23 nt, Human
cccggguucaagcgauucuccug

SEQ ID NO: 941785 - RNA, 24 nt, Human
cucacugcaaccucugcuucccgg

SEQ ID NO: 941786 - RNA, 24 nt, Human
cugcaaccucugcuucccggguuc

SEQ ID NO: 941787 - RNA, 20 nt, Human
cugccucagccuccccagua

SEQ ID NO: 941788 - RNA, 24 nt, Human
cuucccggguucaagcgauucucc

SEQ ID NO: 941789 - RNA, 24 nt, Human
cuugcucugucacccagguuggag

SEQ ID NO: 941790 - RNA, 21 nt, Human
gaaguaaggauagaacucagg

SEQ ID NO: 941791 - RNA, 21 nt, Human
gaucacaggaacuucaagaga

SEQ ID NO: 941792 - RNA, 24 nt, Human
gcgauucuccugccucagccuccc

SEQ ID NO: 941793 - RNA, 19 nt, Human
gcucugucacccagguugg

SEQ ID NO: 941794 - RNA, 21 nt, Human
ggcggcugcgcggucucgggc

SEQ ID NO: 941795 - RNA, 21 nt, Human
gguauaaccaaaggucccacu

SEQ ID NO: 941796 - RNA, 19 nt, Human
uaaaaccuccuucuccuaa

SEQ ID NO: 941797 - RNA, 25 nt, Human
uaauaagcuuucaucucuuuuauuc

SEQ ID NO: 941798 - RNA, 18 nt, Human
uagagugauuuaaucacu

SEQ ID NO: 941799 - RNA, 22 nt, Human
ucacccagguuggagugcagug

SEQ ID NO: 941800 - RNA, 20 nt, Human
ucaccugccuuccuacccca

SEQ ID NO: 941801 - RNA, 24 nt, Human
ucacugcaaccucugcuucccggg

SEQ ID NO: 941802 - RNA, 18 nt, Human
ucaguaacuacagguaua

SEQ ID NO: 941803 - RNA, 24 nt, Human
ucaguaacuacagguauaaccaaa

SEQ ID NO: 941804 - RNA, 20 nt, Human
uccagcagcuccuuccaggc

SEQ ID NO: 941805 - RNA, 21 nt, Human
uccagcagcuccuuccaggcg

SEQ ID NO: 941806 - RNA, 20 nt, Human
uccauguugguugaauccac

SEQ ID NO: 941807 - RNA, 20 nt, Human
uccccaguauuugcaaacuu

SEQ ID NO: 941808 - RNA, 21 nt, Human
ucccggguucaagcgauucuc

SEQ ID NO: 941809 - RNA, 24 nt, Human
ucccggguucaagcgauucuccug

SEQ ID NO: 941810 - RNA, 21 nt, Human
ucccucggccuguccagcagc

SEQ ID NO: 941811 - RNA, 25 nt, Human
uccuaagugauuuuccauaaucugc

SEQ ID NO: 941812 - RNA, 24 nt, Human
ucggccuguccagcagcuccuucc

SEQ ID NO: 941813 - RNA, 27 nt, Human
ucuccugccucagccuccccaguauuu

SEQ ID NO: 941814 - RNA, 24 nt, Human
ucugucacccagguuggagugcag

SEQ ID NO: 941815 - RNA, 23 nt, Human
ucuugcucugucacccagguugg

SEQ ID NO: 941816 - RNA, 24 nt, Human
ucuugcucugucacccagguugga

SEQ ID NO: 941817 - RNA, 22 nt, Human
ugagauggagucuugcucuguc

SEQ ID NO: 941818 - RNA, 22 nt, Human
ugcaguggugcgaucucggcuc

SEQ ID NO: 941819 - RNA, 19 nt, Human
ugccucagccuccccagua

SEQ ID NO: 941820 - RNA, 24 nt, Human
ugcucugucacccagguuggagug

SEQ ID NO: 941821 - RNA, 19 nt, Human
uggagucuugcucugucac

SEQ ID NO: 941822 - RNA, 23 nt, Human
uggagugcaguggugcgaucucg

SEQ ID NO: 941823 - RNA, 24 nt, Human
uggagugcaguggugcgaucucgg

SEQ ID NO: 941824 - RNA, 19 nt, Human
uggauauggagggcugacc

SEQ ID NO: 941825 - RNA, 19 nt, Human
ugugaauaauaagcuuuca

SEQ ID NO: 941826 - RNA, 18 nt, Human
uucaaaagaucacaggaa

SEQ ID NO: 941827 - RNA, 21 nt, Human
uucaagcgauucuccugccuc

SEQ ID NO: 941828 - RNA, 23 nt, Human
uucaagcgauucuccugccucag

SEQ ID NO: 941829 - RNA, 24 nt, Human
uucaagcgauucuccugccucagc

SEQ ID NO: 941830 - RNA, 21 nt, Human
uucggagaaucuucaacagaa

SEQ ID NO: 941831 - RNA, 21 nt, Human
uugagauggagucuugcucug

SEQ ID NO: 941832 - RNA, 24 nt, Human
uugcucugucacccagguuggagu

SEQ ID NO: 941833 - RNA, 23 nt, Human
uuugcaaacuugugaauaauaag

SEQ ID NO: 941834 - RNA, 19 nt, Human
aagagcggcugcuagagac

SEQ ID NO: 941835 - RNA, 18 nt, Human
acgaucugcuccagcucg

SEQ ID NO: 941836 - RNA, 21 nt, Human
agcacagcccuacccagaggg

SEQ ID NO: 941837 - RNA, 26 nt, Human
agccccucagcacagcccuacccagg

SEQ ID NO: 941838 - RNA, 19 nt, Human
cagccccucagcacagccc

SEQ ID NO: 941839 - RNA, 20 nt, Human
cagccccucagcacagcccu

SEQ ID NO: 941840 - RNA, 19 nt, Human
ccccgcccagccccucagc

SEQ ID NO: 941841 - RNA, 23 nt, Human
ccccgcccagccccucagcacag

SEQ ID NO: 941842 - RNA, 23 nt, Human
cgagcccggcccuucugggccgg

SEQ ID NO: 941843 - RNA, 25 nt, Human
cgcccagccccucagcacagcccua

SEQ ID NO: 941844 - RNA, 23 nt, Human
cggcucgaggccugacacggcag

SEQ ID NO: 941845 - RNA, 22 nt, Human
cgggcccugggcuggccuggga

SEQ ID NO: 941846 - RNA, 18 nt, Human
cuccccgcccagccccuc

SEQ ID NO: 941847 - RNA, 20 nt, Human
gcaggggagggcuccaggug

SEQ ID NO: 941848 - RNA, 24 nt, Human
gcggacacggccugugcuccccgc

SEQ ID NO: 941849 - RNA, 22 nt, Human
gcuucgggcccugggcuggccu

SEQ ID NO: 941850 - RNA, 20 nt, Human
ggacacggccugugcucccc

SEQ ID NO: 941851 - RNA, 19 nt, Human
ggcaggggagggcuccagg

SEQ ID NO: 941852 - RNA, 20 nt, Human
ggccugugcuccccgcccag

SEQ ID NO: 941853 - RNA, 21 nt, Human
ggcugaucucaagggucagug

SEQ ID NO: 941854 - RNA, 21 nt, Human
uccccgcccagccccucagca

SEQ ID NO: 941855 - RNA, 22 nt, Human
ucccgcgagccguacccagagg

SEQ ID NO: 941856 - RNA, 20 nt, Human
ugaccgagcccggcccuucu

SEQ ID NO: 941857 - RNA, 18 nt, Human
uggccugggacgggaagg

SEQ ID NO: 941858 - RNA, 24 nt, Human
ugggcaggggagggcuccaggugg

SEQ ID NO: 941859 - RNA, 18 nt, Human
ugggggcgggugggcagg

SEQ ID NO: 941860 - RNA, 18 nt, Human
uucaaggaaggacgaucc

SEQ ID NO: 941861 - RNA, 24 nt, Human
uucgggcccugggcuggccuggga

SEQ ID NO: 941862 - RNA, 18 nt, Human
aaaagcucccaacaauga

SEQ ID NO: 941863 - RNA, 27 nt, Human
aaacuggcuuugaccccaaaugaaccc

SEQ ID NO: 941864 - RNA, 22 nt, Human
aaagaugucucaucuaaaagcu

SEQ ID NO: 941865 - RNA, 19 nt, Human
aacaauaacccccuucccc

SEQ ID NO: 941866 - RNA, 19 nt, Human
aacaauaacccccuucccc

SEQ ID NO: 941867 - RNA, 19 nt, Human
aacccccuuccccaaaaag

SEQ ID NO: 941868 - RNA, 24 nt, Human
aacccccuuccccaaaaagaauca

SEQ ID NO: 941869 - RNA, 26 nt, Human
aacccccuuccccaaaaagaaucaca

SEQ ID NO: 941870 - RNA, 24 nt, Human
aagaaaaagcucacaucuaucuag

SEQ ID NO: 941871 - RNA, 20 nt, Human
aaucauccaaaucaaagcua

SEQ ID NO: 941872 - RNA, 23 nt, Human
aauuaaacuugaguaaaagccug

SEQ ID NO: 941873 - RNA, 21 nt, Human
acccugagacaagcuaaucuu

SEQ ID NO: 941874 - RNA, 19 nt, Human
acuucccacccugagacaa

SEQ ID NO: 941875 - RNA, 19 nt, Human
acuugaggagaaggaaggg

SEQ ID NO: 941876 - RNA, 21 nt, Human
agacaagcuaaucuuaucaga

SEQ ID NO: 941877 - RNA, 19 nt, Human
agcagcauuuggcuuuaag

SEQ ID NO: 941878 - RNA, 18 nt, Human
agccaaaggaacaauaac

SEQ ID NO: 941879 - RNA, 23 nt, Human
agccaaaggaacaauaacccccu

SEQ ID NO: 941880 - RNA, 23 nt, Human
agucaaugcugggaaguaacagg

SEQ ID NO: 941881 - RNA, 24 nt, Human
aucccauuuuuaugaaagcuccau

SEQ ID NO: 941882 - RNA, 27 nt, Human
caaaggaacaauaacccccuuccccaa

SEQ ID NO: 941883 - RNA, 19 nt, Human
caaagugcugauauuaugu

SEQ ID NO: 941884 - RNA, 19 nt, Human
caacgucaauugaaaauag

SEQ ID NO: 941885 - RNA, 22 nt, Human
cagagcagaguacagauguguc

SEQ ID NO: 941886 - RNA, 21 nt, Human
cagcauccaaagugcaaagaa

SEQ ID NO: 941887 - RNA, 24 nt, Human
cagcauccaaagugcaaagaaaaa

SEQ ID NO: 941888 - RNA, 23 nt, Human
cauucagucagccuggccccacc

SEQ ID NO: 941889 - RNA, 23 nt, Human
ccauacuaacccuucuaccccug

SEQ ID NO: 941890 - RNA, 18 nt, Human
cccaaaaagaaucacaac

SEQ ID NO: 941891 - RNA, 25 nt, Human
cccaaaaagaaucacaaccaauucc

SEQ ID NO: 941892 - RNA, 24 nt, Human
cccaucacuaguucuguccucaau

SEQ ID NO: 941893 - RNA, 20 nt, Human
cccugcccucccacuuccca

SEQ ID NO: 941894 - RNA, 21 nt, Human
cccugcccucccacuucccac

SEQ ID NO: 941895 - RNA, 20 nt, Human
ccucccacuucccacccuga

SEQ ID NO: 941896 - RNA, 19 nt, Human
ccucuggucuaauccuuuc

SEQ ID NO: 941897 - RNA, 21 nt, Human
ccuuauagccuacucuuuauu

SEQ ID NO: 941898 - RNA, 23 nt, Human
ccuuuagaaguugggcuccacug

SEQ ID NO: 941899 - RNA, 22 nt, Human
cucaugaauacuuguuuauuuc

SEQ ID NO: 941900 - RNA, 22 nt, Human
gaacccaaaguucagccagcgg

SEQ ID NO: 941901 - RNA, 20 nt, Human
gaguuguacuuucacauuua

SEQ ID NO: 941902 - RNA, 22 nt, Human
gcggcacaucagagauaaauac

SEQ ID NO: 941903 - RNA, 24 nt, Human
gcugggucacauuuucacccucau

SEQ ID NO: 941904 - RNA, 19 nt, Human
gugcaaagaaaaaaugacu

SEQ ID NO: 941905 - RNA, 26 nt, Human
uaaaagaaaaacuggcuuugacccca

SEQ ID NO: 941906 - RNA, 24 nt, Human
uaaaucacuuaaauuccaugacuc

SEQ ID NO: 941907 - RNA, 24 nt, Human
uaagaauaauuuuaacagaagaaa

SEQ ID NO: 941908 - RNA, 23 nt, Human
uaagggucaauacgaagucaaac

SEQ ID NO: 941909 - RNA, 22 nt, Human
ucaauuuuaaaagaaaaacugg

SEQ ID NO: 941910 - RNA, 19 nt, Human
ucagccuggccccaccugg

SEQ ID NO: 941911 - RNA, 18 nt, Human
uccaaagugcaaagaaaa

SEQ ID NO: 941912 - RNA, 24 nt, Human
uccaaagugcaaagaaaaaaugac

SEQ ID NO: 941913 - RNA, 21 nt, Human
uccaugacucauccuauucaa

SEQ ID NO: 941914 - RNA, 20 nt, Human
ucccaacaaugaccagcaca

SEQ ID NO: 941915 - RNA, 18 nt, Human
ucuaccccuggaaagaug

SEQ ID NO: 941916 - RNA, 21 nt, Human
ucuaugagcagcauuuggcuu

SEQ ID NO: 941917 - RNA, 21 nt, Human
ucuggucuaauccuuucuuuu

SEQ ID NO: 941918 - RNA, 21 nt, Human
ugagacaagcuaaucuuauca

SEQ ID NO: 941919 - RNA, 19 nt, Human
ugaguaaaagccuggagaa

SEQ ID NO: 941920 - RNA, 22 nt, Human
ugaguaaaagccuggagaaugc

SEQ ID NO: 941921 - RNA, 20 nt, Human
ugaguacaggaggcugcaga

SEQ ID NO: 941922 - RNA, 20 nt, Human
ugcaaagaaaaaaugacugu

SEQ ID NO: 941923 - RNA, 20 nt, Human
ugcccugcccucccacuucc

SEQ ID NO: 941924 - RNA, 22 nt, Human
ugcccugcccucccacuuccca

SEQ ID NO: 941925 - RNA, 23 nt, Human
uggcuuuaagccaaaggaacaau

SEQ ID NO: 941926 - RNA, 23 nt, Human
uggcuuugaccccaaaugaaccc

SEQ ID NO: 941927 - RNA, 23 nt, Human
ugggaaaaauuucagcauccaaa

SEQ ID NO: 941928 - RNA, 18 nt, Human
uguaauuuuccugcuggg

SEQ ID NO: 941929 - RNA, 21 nt, Human
uguuaguugggaugccaaagg

SEQ ID NO: 941930 - RNA, 24 nt, Human
uuagaaggaggcauccuaaauccu

SEQ ID NO: 941931 - RNA, 19 nt, Human
uugaccuuuagaaguuggg

SEQ ID NO: 941932 - RNA, 20 nt, Human
uuuuccaaauauuaucccaa

SEQ ID NO: 941933 - RNA, 25 nt, Human
aaaacuccuggcucaagcgauccaa

SEQ ID NO: 941934 - RNA, 21 nt, Human
aaagauacuucauaccccucc

SEQ ID NO: 941935 - RNA, 19 nt, Human
aaagugcugggaguacagg

SEQ ID NO: 941936 - RNA, 22 nt, Human
aaccaaacccuuacacaagauc

SEQ ID NO: 941937 - RNA, 18 nt, Human
aacccagaugaguugcag

SEQ ID NO: 941938 - RNA, 21 nt, Human
aagaaaacacacagagauuaa

SEQ ID NO: 941939 - RNA, 22 nt, Human
aagacaccacacuggccugaaa

SEQ ID NO: 941940 - RNA, 24 nt, Human
aagacaccacacuggccugaaaug

SEQ ID NO: 941941 - RNA, 27 nt, Human
aagauacuucauaccccuccuccaaaa

SEQ ID NO: 941942 - RNA, 24 nt, Human
aagcgauccaccugccucggccuc

SEQ ID NO: 941943 - RNA, 25 nt, Human
aagcgauccaccugccucggccucc

SEQ ID NO: 941944 - RNA, 19 nt, Human
aaggcaccaugucaaagau

SEQ ID NO: 941945 - RNA, 20 nt, Human
acacuacagaaggaauaaac

SEQ ID NO: 941946 - RNA, 19 nt, Human
acaggcgcaagacaccaca

SEQ ID NO: 941947 - RNA, 20 nt, Human
accccuccuccaaaaccaaa

SEQ ID NO: 941948 - RNA, 20 nt, Human
accugucuccuguuuauacc

SEQ ID NO: 941949 - RNA, 25 nt, Human
acucugucacccuggcuggaaugca

SEQ ID NO: 941950 - RNA, 19 nt, Human
acuucauaccccuccucca

SEQ ID NO: 941951 - RNA, 20 nt, Human
agaaaaaaagaaucugugca

SEQ ID NO: 941952 - RNA, 25 nt, Human
agaaaacacacagagauuaauacac

SEQ ID NO: 941953 - RNA, 27 nt, Human
agaaaacacacagagauuaauacacua

SEQ ID NO: 941954 - RNA, 18 nt, Human
agcggcuuucagaauucc

SEQ ID NO: 941955 - RNA, 21 nt, Human
aggcauuuuauuuuaccauua

SEQ ID NO: 941956 - RNA, 19 nt, Human
aguagcugggacuacaggc

SEQ ID NO: 941957 - RNA, 23 nt, Human
aguagcugggacuacaggcacgu

SEQ ID NO: 941958 - RNA, 18 nt, Human
auaccccuccuccaaaac

SEQ ID NO: 941959 - RNA, 19 nt, Human
auaccccuccuccaaaacc

SEQ ID NO: 941960 - RNA, 20 nt, Human
augggauuucaccaucuugg

SEQ ID NO: 941961 - RNA, 19 nt, Human
caaaaccaaagaaaacaca

SEQ ID NO: 941962 - RNA, 20 nt, Human
caaaaccaaagaaaacacac

SEQ ID NO: 941963 - RNA, 24 nt, Human
caaagugcugggaguacaggcgca

SEQ ID NO: 941964 - RNA, 23 nt, Human
cacaagacuccauaaccaaaccc

SEQ ID NO: 941965 - RNA, 25 nt, Human
cacaaucaaaucuguuuacuugccc

SEQ ID NO: 941966 - RNA, 23 nt, Human
cacacagagauuaauacacuaca

SEQ ID NO: 941967 - RNA, 23 nt, Human
caccugccucggccucccaaagu

SEQ ID NO: 941968 - RNA, 25 nt, Human
cagaaaaaaagaaucugugcagacc

SEQ ID NO: 941969 - RNA, 19 nt, Human
cagcaggccccgcgcuccg

SEQ ID NO: 941970 - RNA, 20 nt, Human
cagccuucugcgcacaaccc

SEQ ID NO: 941971 - RNA, 19 nt, Human
cagcggcuuucagaauucc

SEQ ID NO: 941972 - RNA, 20 nt, Human
cagcggcuuucagaauuccc

SEQ ID NO: 941973 - RNA, 26 nt, Human
caggaagaggccuguagagaacccca

SEQ ID NO: 941974 - RNA, 24 nt, Human
cauaaccaaacccuuacacaagau

SEQ ID NO: 941975 - RNA, 19 nt, Human
cauaagauuguccaguaga

SEQ ID NO: 941976 - RNA, 23 nt, Human
cauaccccuccuccaaaaccaaa

SEQ ID NO: 941977 - RNA, 20 nt, Human
ccaaaaccaaagaaaacaca

SEQ ID NO: 941978 - RNA, 19 nt, Human
ccaaagugcugggaguaca

SEQ ID NO: 941979 - RNA, 19 nt, Human
ccaaagugcugggaguaca

SEQ ID NO: 941980 - RNA, 21 nt, Human
ccaacgccccuggcuuacgcu

SEQ ID NO: 941981 - RNA, 24 nt, Human
ccaccuuccaggcuuaagugauuc

SEQ ID NO: 941982 - RNA, 21 nt, Human
ccagcggcuuucagaauuccc

SEQ ID NO: 941983 - RNA, 21 nt, Human
cccaagucauuccuaaggcac

SEQ ID NO: 941984 - RNA, 23 nt, Human
cccagggagcagugcacucucau

SEQ ID NO: 941985 - RNA, 18 nt, Human
cccccaacgccccuggcu

SEQ ID NO: 941986 - RNA, 21 nt, Human
ccgcacggcccccaacgcccc

SEQ ID NO: 941987 - RNA, 20 nt, Human
ccuggcucaagcgauccacc

SEQ ID NO: 941988 - RNA, 19 nt, Human
ccugucuccuguuuauacc

SEQ ID NO: 941989 - RNA, 24 nt, Human
ccuuccaggcuuaagugauucucc

SEQ ID NO: 941990 - RNA, 23 nt, Human
cgcagcgcuccucucuccagcag

SEQ ID NO: 941991 - RNA, 21 nt, Human
cgcgcccgacccgcacggccc

SEQ ID NO: 941992 - RNA, 25 nt, Human
cggaagcuuuauccuggcagucaca

SEQ ID NO: 941993 - RNA, 23 nt, Human
cgggcguggcacgcgcccgaccc

SEQ ID NO: 941994 - RNA, 21 nt, Human
cuaaggcaccaugucaaagau

SEQ ID NO: 941995 - RNA, 21 nt, Human
cucaagcgauccaccugccuc

SEQ ID NO: 941996 - RNA, 20 nt, Human
cuccaaaaccaaagaaaacc

SEQ ID NO: 941997 - RNA, 23 nt, Human
cugccucggccucccaaagugcu

SEQ ID NO: 941998 - RNA, 22 nt, Human
cuggccgcugcgcgcgguccgc

SEQ ID NO: 941999 - RNA, 23 nt, Human
cuuaagugauucucccaccucag

SEQ ID NO: 942000 - RNA, 25 nt, Human
cuuaagugauucucccaccucaggc

SEQ ID NO: 942001 - RNA, 19 nt, Human
cuuuaguucucuuggaaac

SEQ ID NO: 942002 - RNA, 20 nt, Human
gaguagcugggacuacaggc

SEQ ID NO: 942003 - RNA, 27 nt, Human
gaguagcugggacuacaggcacgugua

SEQ ID NO: 942004 - RNA, 21 nt, Human
gaucauucagacagacaacuu

SEQ ID NO: 942005 - RNA, 22 nt, Human
gaucauucagacagacaacuua

SEQ ID NO: 942006 - RNA, 24 nt, Human
gcaaugaaagaccaagcagguaga

SEQ ID NO: 942007 - RNA, 24 nt, Human
gccuaguagguuuggcacaagacu

SEQ ID NO: 942008 - RNA, 24 nt, Human
gcgauccaccugccucggccuccc

SEQ ID NO: 942009 - RNA, 23 nt, Human
gcgcaagacaccacacuggccug

SEQ ID NO: 942010 - RNA, 24 nt, Human
gcucaagcgauccaccugccucgg

SEQ ID NO: 942011 - RNA, 19 nt, Human
ggcacaagacuccauaacc

SEQ ID NO: 942012 - RNA, 23 nt, Human
ggcucaagcgauccaccugccuc

SEQ ID NO: 942013 - RNA, 18 nt, Human
gggauuucaccaucuugg

SEQ ID NO: 942014 - RNA, 21 nt, Human
gggcguggcacgcgcccgacc

SEQ ID NO: 942015 - RNA, 21 nt, Human
guagagaugggauuucaccau

SEQ ID NO: 942016 - RNA, 22 nt, Human
guagauggugaagggcuaaugg

SEQ ID NO: 942017 - RNA, 21 nt, Human
gucaaagauacuucauacccc

SEQ ID NO: 942018 - RNA, 23 nt, Human
uaaccaaacccuuacacaagauc

SEQ ID NO: 942019 - RNA, 26 nt, Human
uaagacucuaggauuaucuugaguua

SEQ ID NO: 942020 - RNA, 18 nt, Human
uaagugauucucccaccu

SEQ ID NO: 942021 - RNA, 20 nt, Human
uaagugauucucccaccuca

SEQ ID NO: 942022 - RNA, 19 nt, Human
uaauacacuacagaaggaa

SEQ ID NO: 942023 - RNA, 24 nt, Human
uacagaaggaauaaacauuuuaga

SEQ ID NO: 942024 - RNA, 21 nt, Human
uaccccuccuccaaaaccaaa

SEQ ID NO: 942025 - RNA, 21 nt, Human
uacugacagaaaaaaagaauc

SEQ ID NO: 942026 - RNA, 22 nt, Human
uaguagguuuggcacaagacuc

SEQ ID NO: 942027 - RNA, 24 nt, Human
uauagaguagcugggacuacaggc

SEQ ID NO: 942028 - RNA, 23 nt, Human
ucaaagauacuucauaccccucc

SEQ ID NO: 942029 - RNA, 21 nt, Human
ucacaacaggaagaggccugu

SEQ ID NO: 942030 - RNA, 24 nt, Human
ucacugcaacuuccaccuuccagg

SEQ ID NO: 942031 - RNA, 20 nt, Human
ucagacagacaacuuaaaaa

SEQ ID NO: 942032 - RNA, 19 nt, Human
ucauaccccuccuccaaaa

SEQ ID NO: 942033 - RNA, 21 nt, Human
ucauaccccuccuccaaaacc

SEQ ID NO: 942034 - RNA, 20 nt, Human
uccaaaaccaaagaaaacac

SEQ ID NO: 942035 - RNA, 22 nt, Human
uccaaaaccaaagaaaacacac

SEQ ID NO: 942036 - RNA, 25 nt, Human
uccaaaaccaaagaaaacacacaga

SEQ ID NO: 942037 - RNA, 18 nt, Human
uccagauuaaguucugca

SEQ ID NO: 942038 - RNA, 20 nt, Human
uccauaaccaaacccuuaca

SEQ ID NO: 942039 - RNA, 24 nt, Human
ucccaaagugcugggaguacaggc

SEQ ID NO: 942040 - RNA, 21 nt, Human
uccgcagcgcuccucucucca

SEQ ID NO: 942041 - RNA, 18 nt, Human
ucggccucccaaagugcu

SEQ ID NO: 942042 - RNA, 22 nt, Human
ucucacucugucacccuggcug

SEQ ID NO: 942043 - RNA, 24 nt, Human
ucucacucugucacccuggcugga

SEQ ID NO: 942044 - RNA, 22 nt, Human
ugaaaugcuuuaagacucuagg

SEQ ID NO: 942045 - RNA, 24 nt, Human
ugaaaugcuuuaagacucuaggau

SEQ ID NO: 942046 - RNA, 18 nt, Human
ugaguugcaguucccagc

SEQ ID NO: 942047 - RNA, 22 nt, Human
ugccccagccuucugcgcacaa

SEQ ID NO: 942048 - RNA, 21 nt, Human
ugccucggccucccaaagugc

SEQ ID NO: 942049 - RNA, 24 nt, Human
ugccucggccucccaaagugcugg

SEQ ID NO: 942050 - RNA, 22 nt, Human
ugcugggaguacaggcgcaaga

SEQ ID NO: 942051 - RNA, 24 nt, Human
ugcugggaguacaggcgcaagaca

SEQ ID NO: 942052 - RNA, 23 nt, Human
uggcacaagacuccauaaccaaa

SEQ ID NO: 942053 - RNA, 24 nt, Human
ugggauuucaccaucuuggccaag

SEQ ID NO: 942054 - RNA, 18 nt, Human
uuaauacacuacagaagg

SEQ ID NO: 942055 - RNA, 25 nt, Human
uuagggcucggucucuggccgcugc

SEQ ID NO: 942056 - RNA, 18 nt, Human
uuagucuuagcaaugaaa

SEQ ID NO: 942057 - RNA, 23 nt, Human
uuccaggcuuaagugauucuccc

SEQ ID NO: 942058 - RNA, 23 nt, Human
uucucuuggaaacauaagauugu

SEQ ID NO: 942059 - RNA, 26 nt, Human
uuguagagaugggauuucaccaucuu

SEQ ID NO: 942060 - RNA, 21 nt, Human
uuucaccaucuuggccaagcu

SEQ ID NO: 942061 - RNA, 24 nt, Human
uuuguagagaugggauuucaccau

SEQ ID NO: 942062 - RNA, 24 nt, Human
uuuuuuguagagaugggauuucac

SEQ ID NO: 942063 - RNA, 22 nt, Human
aaaacacuucccacuuaaucaa

SEQ ID NO: 942064 - RNA, 21 nt, Human
aaacaaaaccgcacaugcccu

SEQ ID NO: 942065 - RNA, 22 nt, Human
aaacaaaaccgcacaugcccuc

SEQ ID NO: 942066 - RNA, 26 nt, Human
aaccgcacaugcccucauauucccca

SEQ ID NO: 942067 - RNA, 22 nt, Human
aaucucacgcccagaaaacaaa

SEQ ID NO: 942068 - RNA, 18 nt, Human
acaguuucuggaaugcau

SEQ ID NO: 942069 - RNA, 23 nt, Human
acuuuaagaagcacuggaaggua

SEQ ID NO: 942070 - RNA, 18 nt, Human
agacagucuuaccuagaa

SEQ ID NO: 942071 - RNA, 19 nt, Human
aggcaggacuccggaacuc

SEQ ID NO: 942072 - RNA, 19 nt, Human
augcaaagccucggccgug

SEQ ID NO: 942073 - RNA, 19 nt, Human
caaaaccgcacaugcccuc

SEQ ID NO: 942074 - RNA, 22 nt, Human
caagcuucugggcugucuuccu

SEQ ID NO: 942075 - RNA, 19 nt, Human
cauccucccuucaccgcac

SEQ ID NO: 942076 - RNA, 18 nt, Human
ccaacuccgccauccucc

SEQ ID NO: 942077 - RNA, 18 nt, Human
ccaucccucccuccaucc

SEQ ID NO: 942078 - RNA, 23 nt, Human
cccucccuccauccuggccccgg

SEQ ID NO: 942079 - RNA, 22 nt, Human
ccgcacaugcccucauauuccc

SEQ ID NO: 942080 - RNA, 21 nt, Human
ccuccauccuggccccggcuc

SEQ ID NO: 942081 - RNA, 22 nt, Human
ccucuccgggacucuaaaaauc

SEQ ID NO: 942082 - RNA, 19 nt, Human
cgcggcuaacccucgcccc

SEQ ID NO: 942083 - RNA, 18 nt, Human
cuuucuccaucccucccu

SEQ ID NO: 942084 - RNA, 24 nt, Human
cuuucuccaucccucccuccaucc

SEQ ID NO: 942085 - RNA, 22 nt, Human
gcagcuuucuccaucccucccu

SEQ ID NO: 942086 - RNA, 18 nt, Human
ggcagcuuucuccauccc

SEQ ID NO: 942087 - RNA, 20 nt, Human
gggaaccgcaaaagguacca

SEQ ID NO: 942088 - RNA, 22 nt, Human
gggaaccgcaaaagguaccaac

SEQ ID NO: 942089 - RNA, 21 nt, Human
gggucugaggcaggacuccgg

SEQ ID NO: 942090 - RNA, 19 nt, Human
gggugggcagcuuucucca

SEQ ID NO: 942091 - RNA, 24 nt, Human
gucagcgggugggcagcuuucucc

SEQ ID NO: 942092 - RNA, 23 nt, Human
uaagaguccuucagcggaggcuc

SEQ ID NO: 942093 - RNA, 19 nt, Human
uaaucaacagguuuuccuc

SEQ ID NO: 942094 - RNA, 20 nt, Human
uaccaacuccgccauccucc

SEQ ID NO: 942095 - RNA, 18 nt, Human
uagcaagcuucugggcug

SEQ ID NO: 942096 - RNA, 24 nt, Human
ucaaaacacuucccacuuaaucaa

SEQ ID NO: 942097 - RNA, 25 nt, Human
ucaacagguuuuccucuuaaaaucc

SEQ ID NO: 942098 - RNA, 24 nt, Human
ucaagacagucuuaccuagaacaa

SEQ ID NO: 942099 - RNA, 21 nt, Human
ucccacuuaaucaacagguuu

SEQ ID NO: 942100 - RNA, 18 nt, Human
ucugaggcaggacuccgg

SEQ ID NO: 942101 - RNA, 18 nt, Human
ugaauagcaagcuucugg

SEQ ID NO: 942102 - RNA, 23 nt, Human
ugggaaccgcaaaagguaccaac

SEQ ID NO: 942103 - RNA, 21 nt, Human
aaaauacagcacggggcucac

SEQ ID NO: 942104 - RNA, 24 nt, Human
acagacgcuuuuccaauauucucu

SEQ ID NO: 942105 - RNA, 20 nt, Human
acagcacggggcucacagac

SEQ ID NO: 942106 - RNA, 23 nt, Human
accucaacccccuuaguuacaga

SEQ ID NO: 942107 - RNA, 19 nt, Human
acgccugggcucucagcug

SEQ ID NO: 942108 - RNA, 22 nt, Human
agaaaucccaggagcccgaagc

SEQ ID NO: 942109 - RNA, 22 nt, Human
agcccgaagccuccuuaagccu

SEQ ID NO: 942110 - RNA, 24 nt, Human
aggcagaguggagagaaacaacuc

SEQ ID NO: 942111 - RNA, 21 nt, Human
cagacgcuuuuccaauauucu

SEQ ID NO: 942112 - RNA, 18 nt, Human
ccaacaaggcugggaccc

SEQ ID NO: 942113 - RNA, 21 nt, Human
ccaacaaggcugggacccaaa

SEQ ID NO: 942114 - RNA, 21 nt, Human
cccuuaguuacagaaaaacuc

SEQ ID NO: 942115 - RNA, 24 nt, Human
ccgcggacgccugggcucucagcu

SEQ ID NO: 942116 - RNA, 24 nt, Human
ccuccuuaagccugcgguagaaac

SEQ ID NO: 942117 - RNA, 24 nt, Human
cgcaaucuaacgucuacaauaacc

SEQ ID NO: 942118 - RNA, 18 nt, Human
cuccagggguugaaaucc

SEQ ID NO: 942119 - RNA, 22 nt, Human
cucuggcugagccagagucucc

SEQ ID NO: 942120 - RNA, 21 nt, Human
cugcugaacaaugacaucguu

SEQ ID NO: 942121 - RNA, 18 nt, Human
gagggccaggagcgcgga

SEQ ID NO: 942122 - RNA, 23 nt, Human
gcaaucuaacgucuacaauaacc

SEQ ID NO: 942123 - RNA, 22 nt, Human
uacaauaaccucaacccccuua

SEQ ID NO: 942124 - RNA, 22 nt, Human
uacagagaugaggcagagugga

SEQ ID NO: 942125 - RNA, 22 nt, Human
uauuacaaaauacagcacgggg

SEQ ID NO: 942126 - RNA, 25 nt, Human
uccauggcugacaacccaacaaggc

SEQ ID NO: 942127 - RNA, 25 nt, Human
uccuuaagccugcgguagaaacugc

SEQ ID NO: 942128 - RNA, 24 nt, Human
ucuacaauaaccucaacccccuua

SEQ ID NO: 942129 - RNA, 21 nt, Human
ucucagcugcugaacaaugac

SEQ ID NO: 942130 - RNA, 18 nt, Human
uggcugagccagagucuc

SEQ ID NO: 942131 - RNA, 25 nt, Human
aagcacacgacauuaugaauauuaa

SEQ ID NO: 942132 - RNA, 22 nt, Human
aagcagcacacacuucaaagcc

SEQ ID NO: 942133 - RNA, 24 nt, Human
aagcagcacacacuucaaagccca

SEQ ID NO: 942134 - RNA, 20 nt, Human
aagcucuacuggguagcuga

SEQ ID NO: 942135 - RNA, 28 nt, Human
aggcaggagagucgagagcgcgaacccg

SEQ ID NO: 942136 - RNA, 22 nt, Human
auaaaugcauuuuaauaccuug

SEQ ID NO: 942137 - RNA, 20 nt, Human
aucugauacggaauacagga

SEQ ID NO: 942138 - RNA, 23 nt, Human
cauuaugaauauuaaaaauaaag

SEQ ID NO: 942139 - RNA, 19 nt, Human
ccgcuccgccgcgcagcug

SEQ ID NO: 942140 - RNA, 21 nt, Human
ccuacacgcagcgccgaggga

SEQ ID NO: 942141 - RNA, 20 nt, Human
cgagagcgcgaacccggggc

SEQ ID NO: 942142 - RNA, 21 nt, Human
cgggagauacgcucgcuuucc

SEQ ID NO: 942143 - RNA, 20 nt, Human
cgggagggagccgccucgug

SEQ ID NO: 942144 - RNA, 25 nt, Human
cugucaguggcaacggcucgggaga

SEQ ID NO: 942145 - RNA, 21 nt, Human
cuucaagcucuacuggguagc

SEQ ID NO: 942146 - RNA, 22 nt, Human
gagggaggggucgggggcugcc

SEQ ID NO: 942147 - RNA, 21 nt, Human
gcaaacaaaaaaggcaauuca

SEQ ID NO: 942148 - RNA, 20 nt, Human
gcggacugggccugagggcg

SEQ ID NO: 942149 - RNA, 19 nt, Human
gcucuuacucagaugggag

SEQ ID NO: 942150 - RNA, 18 nt, Human
ggagaaagaugaaaggag

SEQ ID NO: 942151 - RNA, 25 nt, Human
gggaagcggggagaaagaugaaagg

SEQ ID NO: 942152 - RNA, 18 nt, Human
gggcgcggccuacacgca

SEQ ID NO: 942153 - RNA, 21 nt, Human
gguaaugagaacacacacgaa

SEQ ID NO: 942154 - RNA, 28 nt, Human
guaaugagaacacacacgaaccaccuac

SEQ ID NO: 942155 - RNA, 22 nt, Human
uaagcagcacacacuucaaagc

SEQ ID NO: 942156 - RNA, 20 nt, Human
uacaggaagauacugguaaa

SEQ ID NO: 942157 - RNA, 21 nt, Human
ucaguggcaacggcucgggag

SEQ ID NO: 942158 - RNA, 23 nt, Human
ucuacuggguagcugaguaaaua

SEQ ID NO: 942159 - RNA, 22 nt, Human
ugagaacacacacgaaccaccu

SEQ ID NO: 942160 - RNA, 21 nt, Human
ugaguaaauagcguccaaugu

SEQ ID NO: 942161 - RNA, 20 nt, Human
ugaugugcauaucuaucaua

SEQ ID NO: 942162 - RNA, 25 nt, Human
uuuuuugaauuuauaaaugcauuuu

SEQ ID NO: 942163 - RNA, 24 nt, Human
uuuuuuuuuuuuuuuuuugaauuu

SEQ ID NO: 942164 - RNA, 20 nt, Human
uuuuuuuuuuuuuuuuuugg

SEQ ID NO: 942165 - RNA, 22 nt, Human
aaagagcugacccaugccguag

SEQ ID NO: 942166 - RNA, 24 nt, Human
aaagagcugacccaugccguaggc

SEQ ID NO: 942167 - RNA, 18 nt, Human
aaaucuucaguacucuuc

SEQ ID NO: 942168 - RNA, 20 nt, Human
aagagagguggguuaggggu

SEQ ID NO: 942169 - RNA, 18 nt, Human
agaaagagcugacccaug

SEQ ID NO: 942170 - RNA, 20 nt, Human
agaaagagcugacccaugcc

SEQ ID NO: 942171 - RNA, 19 nt, Human
aggcggagguggcagaaag

SEQ ID NO: 942172 - RNA, 19 nt, Human
caaaguaagaguuggagaa

SEQ ID NO: 942173 - RNA, 23 nt, Human
caggcccccaaggucuggaaagg

SEQ ID NO: 942174 - RNA, 22 nt, Human
cccaaggucuggaaacccaaaa

SEQ ID NO: 942175 - RNA, 19 nt, Human
ccccaaggucuggaaaccc

SEQ ID NO: 942176 - RNA, 23 nt, Human
ccgcaaagaggugaggaccgcga

SEQ ID NO: 942177 - RNA, 18 nt, Human
ccucaggccugcucuauu

SEQ ID NO: 942178 - RNA, 25 nt, Human
cucgaaccuggccucaaggcacggc

SEQ ID NO: 942179 - RNA, 21 nt, Human
cugcucuauucuugccuccgc

SEQ ID NO: 942180 - RNA, 21 nt, Human
gcugacccaugccguaggcac

SEQ ID NO: 942181 - RNA, 21 nt, Human
gggggccgcuuuccccacggu

SEQ ID NO: 942182 - RNA, 20 nt, Human
uaccuuuaucucucgaaccu

SEQ ID NO: 942183 - RNA, 18 nt, Human
ucaacugccuauucucau

SEQ ID NO: 942184 - RNA, 21 nt, Human
ucacccgcaaagaggugagga

SEQ ID NO: 942185 - RNA, 20 nt, Human
uccccgaguuugccucaggc

SEQ ID NO: 942186 - RNA, 22 nt, Human
ucuggaaacccaaaagguaacu

SEQ ID NO: 942187 - RNA, 23 nt, Human
ugccucaggcccccaaggucugg

SEQ ID NO: 942188 - RNA, 19 nt, Human
uggaaacccaaaagguaac

SEQ ID NO: 942189 - RNA, 24 nt, Human
uggcagaaagagcugacccaugcc

SEQ ID NO: 942190 - RNA, 24 nt, Human
uggguuagggguucguccccgagu

SEQ ID NO: 942191 - RNA, 23 nt, Human
uuguuguuuguuuguuuucuuuu

SEQ ID NO: 942192 - RNA, 20 nt, Human
uuguuuguuuguuuucuuuu

SEQ ID NO: 942193 - RNA, 24 nt, Human
uuuguuuguuuucuuuuucacccc

SEQ ID NO: 942194 - RNA, 19 nt, Human
uuuguuuucuuuuucaccc

SEQ ID NO: 942195 - RNA, 27 nt, Human
caaaagacauuccugaaaccggggccc

SEQ ID NO: 942196 - RNA, 23 nt, Human
cagcagccucauggauaaggucu

SEQ ID NO: 942197 - RNA, 19 nt, Human
gggggucccgggguggggg

SEQ ID NO: 942198 - RNA, 22 nt, Human
uaaaagagaagaucaagagggu

SEQ ID NO: 942199 - RNA, 27 nt, Human
ucaaugguaugugucccaaucuccuuc

SEQ ID NO: 942200 - RNA, 22 nt, Human
ucccaaucuccuucuuccucuu

SEQ ID NO: 942201 - RNA, 21 nt, Human
ucccggggugggggccggccu

SEQ ID NO: 942202 - RNA, 19 nt, Human
ugguaugugucccaaucuc

SEQ ID NO: 942203 - RNA, 24 nt, Human
ugucccaaucuccuucuuccucuu

SEQ ID NO: 942204 - RNA, 22 nt, Human
uuuuuuaacaacaaaucaaugg

SEQ ID NO: 942205 - RNA, 24 nt, Human
aaaaaaaaaaaaaaauuagccggg

SEQ ID NO: 942206 - RNA, 19 nt, Human
aaaaaaaaaaaaaauuagc

SEQ ID NO: 942207 - RNA, 18 nt, Human
aaaacagagggagagguc

SEQ ID NO: 942208 - RNA, 26 nt, Human
aaaaggaagugguuuccuguccccag

SEQ ID NO: 942209 - RNA, 27 nt, Human
aaaaggaagugguuuccuguccccagu

SEQ ID NO: 942210 - RNA, 21 nt, Human
aacaugguaagaacccugucu

SEQ ID NO: 942211 - RNA, 21 nt, Human
aaccagugcugugugaaggca

SEQ ID NO: 942212 - RNA, 24 nt, Human
aaucgcuugaacccaggaggcgga

SEQ ID NO: 942213 - RNA, 22 nt, Human
acccaacacucccucuccacaa

SEQ ID NO: 942214 - RNA, 24 nt, Human
acccugucucuacuaaaaauacaa

SEQ ID NO: 942215 - RNA, 28 nt, Human
agaaaacuccagcaggcaaguagaaucc

SEQ ID NO: 942216 - RNA, 18 nt, Human
agacagagcuuggugggg

SEQ ID NO: 942217 - RNA, 21 nt, Human
agaccaauguuucccacccag

SEQ ID NO: 942218 - RNA, 25 nt, Human
agagaaccgguggcaaggaccacca

SEQ ID NO: 942219 - RNA, 18 nt, Human
agaucaggaguuugagac

SEQ ID NO: 942220 - RNA, 18 nt, Human
agauccugagaguuuccu

SEQ ID NO: 942221 - RNA, 28 nt, Human
agcaaaaaacagagggagaggggacccc

SEQ ID NO: 942222 - RNA, 21 nt, Human
agcccuucccagaccucccaa

SEQ ID NO: 942223 - RNA, 23 nt, Human
agccgggcgugguggcacacgcc

SEQ ID NO: 942224 - RNA, 28 nt, Human
agccuccagcacuggugucagcagcccu

SEQ ID NO: 942225 - RNA, 25 nt, Human
agccuggccaacaugguaagaaccc

SEQ ID NO: 942226 - RNA, 26 nt, Human
aggaagacacccaacacucccucucc

SEQ ID NO: 942227 - RNA, 22 nt, Human
aggacagucaguugcccaaagc

SEQ ID NO: 942228 - RNA, 20 nt, Human
aggaguuugagaccagccug

SEQ ID NO: 942229 - RNA, 23 nt, Human
aggcagcaaaaaacagagggaga

SEQ ID NO: 942230 - RNA, 23 nt, Human
aggcaugggaggcacuuuggaag

SEQ ID NO: 942231 - RNA, 21 nt, Human
aggcggagguugcagugagcc

SEQ ID NO: 942232 - RNA, 24 nt, Human
aggcggagguugcagugagccgag

SEQ ID NO: 942233 - RNA, 22 nt, Human
agguuguguuuuuuuuuuuucu

SEQ ID NO: 942234 - RNA, 26 nt, Human
aguggcucaacacccuguaaucccag

SEQ ID NO: 942235 - RNA, 22 nt, Human
augcaguugggacuugaacuca

SEQ ID NO: 942236 - RNA, 25 nt, Human
caacaugguaagaacccugucucua

SEQ ID NO: 942237 - RNA, 23 nt, Human
caacuuccagggcauacaaccag

SEQ ID NO: 942238 - RNA, 18 nt, Human
caaguuccuugcccucuc

SEQ ID NO: 942239 - RNA, 31 nt, Human
cacaacuuccagggcauacaaccagcacauu

SEQ ID NO: 942240 - RNA, 24 nt, Human
cacaucucuugagaucaggaguuu

SEQ ID NO: 942241 - RNA, 21 nt, Human
caccaccagcagggugagggg

SEQ ID NO: 942242 - RNA, 23 nt, Human
cacccuguaaucccagaacuuug

SEQ ID NO: 942243 - RNA, 19 nt, Human
cacgccugcaaucccagcu

SEQ ID NO: 942244 - RNA, 18 nt, Human
cacugcacuccagccgag

SEQ ID NO: 942245 - RNA, 18 nt, Human
cacugcacuccagccgag

SEQ ID NO: 942246 - RNA, 23 nt, Human
cacugcacuccagccgagacuca

SEQ ID NO: 942247 - RNA, 19 nt, Human
cagaacuuugggaggccgg

SEQ ID NO: 942248 - RNA, 25 nt, Human
cagaacuuugggaggccggaggcag

SEQ ID NO: 942249 - RNA, 22 nt, Human
cagaccccaagacugcugggag

SEQ ID NO: 942250 - RNA, 22 nt, Human
cagcagugacucccaggaauau

SEQ ID NO: 942251 - RNA, 18 nt, Human
cauacaaccagcacauga

SEQ ID NO: 942252 - RNA, 22 nt, Human
caucucaggcagaaaacuccag

SEQ ID NO: 942253 - RNA, 24 nt, Human
caucucuugagaucaggaguuuga

SEQ ID NO: 942254 - RNA, 24 nt, Human
cauuauuggcugagucagaguggc

SEQ ID NO: 942255 - RNA, 19 nt, Human
ccacugcacuccagccgag

SEQ ID NO: 942256 - RNA, 19 nt, Human
ccacugcacuccagccgag

SEQ ID NO: 942257 - RNA, 21 nt, Human
ccacugcacuccagccgagac

SEQ ID NO: 942258 - RNA, 22 nt, Human
ccaggaggcggagguugcagug

SEQ ID NO: 942259 - RNA, 23 nt, Human
ccaguggugugguggcccauccc

SEQ ID NO: 942260 - RNA, 19 nt, Human
cccaaagccaugcaguugg

SEQ ID NO: 942261 - RNA, 22 nt, Human
cccacccagaccccaagacugc

SEQ ID NO: 942262 - RNA, 19 nt, Human
cccaggaagacacccaaca

SEQ ID NO: 942263 - RNA, 20 nt, Human
ccccagugauuuccagcccu

SEQ ID NO: 942264 - RNA, 23 nt, Human
cccuccuucuucccuggacuucc

SEQ ID NO: 942265 - RNA, 23 nt, Human
cccuguaaucccagaacuuuggg

SEQ ID NO: 942266 - RNA, 24 nt, Human
ccuaccuuauuguaaucucaccac

SEQ ID NO: 942267 - RNA, 21 nt, Human
ccugcaaucccagcuacucgg

SEQ ID NO: 942268 - RNA, 23 nt, Human
ccuggccaacaugguaagaaccc

SEQ ID NO: 942269 - RNA, 25 nt, Human
ccuggccaacaugguaagaacccug

SEQ ID NO: 942270 - RNA, 23 nt, Human
cgccugcaaucccagcuacucgg

SEQ ID NO: 942271 - RNA, 27 nt, Human
cggaaggccgaggcacaggaaucgcuu

SEQ ID NO: 942272 - RNA, 26 nt, Human
cggcugggcagguggcuggcuugcug

SEQ ID NO: 942273 - RNA, 20 nt, Human
cgugguggcacacgccugca

SEQ ID NO: 942274 - RNA, 21 nt, Human
cucagaaaccuccuucuaucc

SEQ ID NO: 942275 - RNA, 22 nt, Human
cugguagagaccaauguuuccc

SEQ ID NO: 942276 - RNA, 18 nt, Human
cuugcccucucugggcua

SEQ ID NO: 942277 - RNA, 23 nt, Human
cuugcccucucugggcuacacuu

SEQ ID NO: 942278 - RNA, 21 nt, Human
gaacaagagcccaucagagga

SEQ ID NO: 942279 - RNA, 22 nt, Human
gaagacacccaacacucccucu

SEQ ID NO: 942280 - RNA, 21 nt, Human
gaggcggagguugcagugagc

SEQ ID NO: 942281 - RNA, 23 nt, Human
gagguugcagugagccgagauug

SEQ ID NO: 942282 - RNA, 22 nt, Human
gcacuggugucagcagccccuc

SEQ ID NO: 942283 - RNA, 25 nt, Human
gccaacaugguaagaacccugucuc

SEQ ID NO: 942284 - RNA, 22 nt, Human
gcuggggcccuccuucuucccu

SEQ ID NO: 942285 - RNA, 22 nt, Human
ggaacaagagcccaucagagga

SEQ ID NO: 942286 - RNA, 25 nt, Human
ggaagacacccaacacucccucucc

SEQ ID NO: 942287 - RNA, 18 nt, Human
ggaggcaggccacaucuc

SEQ ID NO: 942288 - RNA, 22 nt, Human
ggagguugcagugagccgagau

SEQ ID NO: 942289 - RNA, 24 nt, Human
ggagguugcagugagccgagauug

SEQ ID NO: 942290 - RNA, 20 nt, Human
gggagagauggugucagcag

SEQ ID NO: 942291 - RNA, 24 nt, Human
gggcgugguggcacacgccugcaa

SEQ ID NO: 942292 - RNA, 18 nt, Human
ggggagagguggggcagg

SEQ ID NO: 942293 - RNA, 18 nt, Human
ggggcggccgaagguugu

SEQ ID NO: 942294 - RNA, 24 nt, Human
gguggcacacgccugcaaucccag

SEQ ID NO: 942295 - RNA, 20 nt, Human
guagagaccaauguuuccca

SEQ ID NO: 942296 - RNA, 19 nt, Human
guugcagugagccgagauu

SEQ ID NO: 942297 - RNA, 20 nt, Human
uaaggcuggggcccuccuuc

SEQ ID NO: 942298 - RNA, 24 nt, Human
uaaggcuggggcccuccuucuucc

SEQ ID NO: 942299 - RNA, 24 nt, Human
uacaaaaaaaaaaaaaaaaaaaaa

SEQ ID NO: 942300 - RNA, 24 nt, Human
uacacugccaucuccacauuaccu

SEQ ID NO: 942301 - RNA, 25 nt, Human
uacacugccaucuccacauuaccuc

SEQ ID NO: 942302 - RNA, 23 nt, Human
uaccgaaagggaaucugggccuc

SEQ ID NO: 942303 - RNA, 24 nt, Human
uagccggaacaagagcccaucaga

SEQ ID NO: 942304 - RNA, 22 nt, Human
uagccgggcgugguggcacacg

SEQ ID NO: 942305 - RNA, 19 nt, Human
uccagcaggcaaguagaau

SEQ ID NO: 942306 - RNA, 18 nt, Human
uccccaggaagacaccca

SEQ ID NO: 942307 - RNA, 21 nt, Human
uccuagccggaacaagagccc

SEQ ID NO: 942308 - RNA, 24 nt, Human
ucgcuugaacccaggaggcggagg

SEQ ID NO: 942309 - RNA, 23 nt, Human
ucucuacuaaaaauacaaaaaaa

SEQ ID NO: 942310 - RNA, 23 nt, Human
ucucuugagaucaggaguuugag

SEQ ID NO: 942311 - RNA, 24 nt, Human
ucuugagaucaggaguuugagacc

SEQ ID NO: 942312 - RNA, 19 nt, Human
ugacaguaaagcaggugga

SEQ ID NO: 942313 - RNA, 23 nt, Human
ugagaccagccuggccaacaugg

SEQ ID NO: 942314 - RNA, 24 nt, Human
ugagaccagccuggccaacauggu

SEQ ID NO: 942315 - RNA, 22 nt, Human
ugagccgagauugcaccacugc

SEQ ID NO: 942316 - RNA, 18 nt, Human
ugagguagauacacugcc

SEQ ID NO: 942317 - RNA, 19 nt, Human
ugagguagauacacugcca

SEQ ID NO: 942318 - RNA, 20 nt, Human
ugauggugguaggcauggga

SEQ ID NO: 942319 - RNA, 25 nt, Human
ugauuuccagcccuucccagaccuc

SEQ ID NO: 942320 - RNA, 20 nt, Human
ugcccaaagccaugcaguug

SEQ ID NO: 942321 - RNA, 21 nt, Human
ugccuggcgcuuuacaugccu

SEQ ID NO: 942322 - RNA, 19 nt, Human
uggagacagagcuuggugg

SEQ ID NO: 942323 - RNA, 21 nt, Human
uggcaaggaccaccaccagca

SEQ ID NO: 942324 - RNA, 25 nt, Human
uggccaacaugguaagaacccuguc

SEQ ID NO: 942325 - RNA, 23 nt, Human
ugggagagauggugucagcagug

SEQ ID NO: 942326 - RNA, 21 nt, Human
ugggaggccggaggcaggcca

SEQ ID NO: 942327 - RNA, 25 nt, Human
ugguaggcaugggaggcacuuugga

SEQ ID NO: 942328 - RNA, 23 nt, Human
uggugucagcagugacucccagg

SEQ ID NO: 942329 - RNA, 18 nt, Human
uguaaucucaccacugcu

SEQ ID NO: 942330 - RNA, 27 nt, Human
ugucuuacucauucugacaguaaagca

SEQ ID NO: 942331 - RNA, 18 nt, Human
uuagccgggcgugguggc

SEQ ID NO: 942332 - RNA, 19 nt, Human
uuagccgggcgugguggca

SEQ ID NO: 942333 - RNA, 24 nt, Human
uuagccgggcgugguggcacacgc

SEQ ID NO: 942334 - RNA, 23 nt, Human
uucccuggacuuccaggagaaca

SEQ ID NO: 942335 - RNA, 24 nt, Human
uugaacccaggaggcggagguugc

SEQ ID NO: 942336 - RNA, 18 nt, Human
uugcagugagccgagauu

SEQ ID NO: 942337 - RNA, 19 nt, Human
uugcagugagccgagauug

SEQ ID NO: 942338 - RNA, 20 nt, Human
uugcagugagccgagauugc

SEQ ID NO: 942339 - RNA, 22 nt, Human
uugcagugagccgagauugcac

SEQ ID NO: 942340 - RNA, 26 nt, Human
uuuaaugauuucuucucugucuuacu

SEQ ID NO: 942341 - RNA, 22 nt, Human
uuuccuguccccagugauuucc

SEQ ID NO: 942342 - RNA, 25 nt, Human
uuuuuuuuuuggagacagagcuugg

SEQ ID NO: 942343 - RNA, 24 nt, Human
uuuuuuuuuuuuggagacagagcu

SEQ ID NO: 942344 - RNA, 18 nt, Human
uuuuuuuuuuuuuuuuug

SEQ ID NO: 942345 - RNA, 21 nt, Human
aagcaggugccuggggaaugc

SEQ ID NO: 942346 - RNA, 24 nt, Human
aagcguggacagagcugaggacac

SEQ ID NO: 942347 - RNA, 24 nt, Human
agccccuuacccggcaaaggcccg

SEQ ID NO: 942348 - RNA, 19 nt, Human
aggccagauauaauacaca

SEQ ID NO: 942349 - RNA, 19 nt, Human
auauauguauauguauaca

SEQ ID NO: 942350 - RNA, 21 nt, Human
cacggcggcgacacacgggag

SEQ ID NO: 942351 - RNA, 21 nt, Human
cacuauauaacgaggccagau

SEQ ID NO: 942352 - RNA, 21 nt, Human
cggcaaaggcccgguuggggc

SEQ ID NO: 942353 - RNA, 22 nt, Human
cuggcccgggccggugguggcu

SEQ ID NO: 942354 - RNA, 21 nt, Human
cuucauauauauuauauauau

SEQ ID NO: 942355 - RNA, 24 nt, Human
cuucauauauauuauauauaugua

SEQ ID NO: 942356 - RNA, 19 nt, Human
gaagcguggacagagcuga

SEQ ID NO: 942357 - RNA, 18 nt, Human
gaggacacggacggacag

SEQ ID NO: 942358 - RNA, 19 nt, Human
gcccugggcugggggcugc

SEQ ID NO: 942359 - RNA, 20 nt, Human
gcguggacaaguggcgucgc

SEQ ID NO: 942360 - RNA, 24 nt, Human
ggcucuguugcgggcgcacgacgc

SEQ ID NO: 942361 - RNA, 19 nt, Human
guauauguauacauauaua

SEQ ID NO: 942362 - RNA, 23 nt, Human
gugguggcugcguggacaagugg

SEQ ID NO: 942363 - RNA, 20 nt, Human
guucccaacauauauacauu

SEQ ID NO: 942364 - RNA, 21 nt, Human
uaagaacacuagucgucuuaa

SEQ ID NO: 942365 - RNA, 23 nt, Human
uaauuuaugcuucuaucuucccu

SEQ ID NO: 942366 - RNA, 22 nt, Human
uauauauauguauauguauaca

SEQ ID NO: 942367 - RNA, 23 nt, Human
uauauauauguauauguauacau

SEQ ID NO: 942368 - RNA, 25 nt, Human
uauauauuauauauauguauaugua

SEQ ID NO: 942369 - RNA, 21 nt, Human
uauauguauacauauauauac

SEQ ID NO: 942370 - RNA, 22 nt, Human
uauauguauacauauauauaca

SEQ ID NO: 942371 - RNA, 24 nt, Human
uauauguauacauauauauacacu

SEQ ID NO: 942372 - RNA, 24 nt, Human
uauauguauauguauacauauaua

SEQ ID NO: 942373 - RNA, 22 nt, Human
uauguauauguauacauauaua

SEQ ID NO: 942374 - RNA, 24 nt, Human
uauguauauguauacauauauaua

SEQ ID NO: 942375 - RNA, 18 nt, Human
uccucaagcaggugccug

SEQ ID NO: 942376 - RNA, 21 nt, Human
ugaggacacggacggacaggc

SEQ ID NO: 942377 - RNA, 20 nt, Human
uggcagggacuggcccgggc

SEQ ID NO: 942378 - RNA, 23 nt, Human
uggcagggacuggcccgggccgg

SEQ ID NO: 942379 - RNA, 24 nt, Human
ugguggcugcguggacaaguggcc

SEQ ID NO: 942380 - RNA, 19 nt, Human
uguauacauauauauacac

SEQ ID NO: 942381 - RNA, 25 nt, Human
uguauacauauauauacacuauaua

SEQ ID NO: 942382 - RNA, 21 nt, Human
uguauauguauacauauauau

SEQ ID NO: 942383 - RNA, 19 nt, Human
ugugaagcaauauacuaau

SEQ ID NO: 942384 - RNA, 30 nt, Human
uuuuacagucauauguacaggaaguugcuu

SEQ ID NO: 942385 - RNA, 22 nt, Human
aaagggaggcauugggagugau

SEQ ID NO: 942386 - RNA, 27 nt, Human
aaagggccuguggggugggcaccugcc

SEQ ID NO: 942387 - RNA, 18 nt, Human
aaguucccuccaagccac

SEQ ID NO: 942388 - RNA, 18 nt, Human
aaguugagaggggagaag

SEQ ID NO: 942389 - RNA, 18 nt, Human
accagccacagcuguggu

SEQ ID NO: 942390 - RNA, 23 nt, Human
acugacccauuuuaacuggcccc

SEQ ID NO: 942391 - RNA, 28 nt, Human
agacagccucagggaaggggggaacgcc

SEQ ID NO: 942392 - RNA, 19 nt, Human
agagucugagccaacucag

SEQ ID NO: 942393 - RNA, 19 nt, Human
agggguggugcuaaucugg

SEQ ID NO: 942394 - RNA, 24 nt, Human
auguccaaaugggggugugggugg

SEQ ID NO: 942395 - RNA, 18 nt, Human
caaggggaggccaguugu

SEQ ID NO: 942396 - RNA, 18 nt, Human
cagcagcaguguccaggg

SEQ ID NO: 942397 - RNA, 21 nt, Human
caggaaagggccuguggggug

SEQ ID NO: 942398 - RNA, 20 nt, Human
caggugaaggggugaguaug

SEQ ID NO: 942399 - RNA, 23 nt, Human
cauaaggccagccacugugccag

SEQ ID NO: 942400 - RNA, 23 nt, Human
caucucugcuucaaugaacucgg

SEQ ID NO: 942401 - RNA, 20 nt, Human
ccaacccaagagugagaggg

SEQ ID NO: 942402 - RNA, 18 nt, Human
ccagagcauccuaaucua

SEQ ID NO: 942403 - RNA, 22 nt, Human
ccaggaauaccagagcauccua

SEQ ID NO: 942404 - RNA, 22 nt, Human
cccauagcauccaacccaagag

SEQ ID NO: 942405 - RNA, 18 nt, Human
cccuagaguggaggaacc

SEQ ID NO: 942406 - RNA, 23 nt, Human
ccugucaagccccaggucucagc

SEQ ID NO: 942407 - RNA, 27 nt, Human
ccuguggggugggcaccugcccucucu

SEQ ID NO: 942408 - RNA, 21 nt, Human
cucacauuuuauugagaacag

SEQ ID NO: 942409 - RNA, 22 nt, Human
cuccaugguccaggaaagggcc

SEQ ID NO: 942410 - RNA, 19 nt, Human
cuggaagacuucaauguua

SEQ ID NO: 942411 - RNA, 23 nt, Human
cuggaagacuucaauguuagucu

SEQ ID NO: 942412 - RNA, 20 nt, Human
cuggcagggucuagggcagg

SEQ ID NO: 942413 - RNA, 22 nt, Human
cuguggagacccuaaagaugga

SEQ ID NO: 942414 - RNA, 19 nt, Human
cuguuaggcccuggcccug

SEQ ID NO: 942415 - RNA, 23 nt, Human
gaaagggccuguggggugggcac

SEQ ID NO: 942416 - RNA, 19 nt, Human
gaaguucccuccaagccac

SEQ ID NO: 942417 - RNA, 20 nt, Human
gaaguucccuccaagccacu

SEQ ID NO: 942418 - RNA, 18 nt, Human
gaauggggaaagcaggca

SEQ ID NO: 942419 - RNA, 24 nt, Human
gagaacagugggcaggggggccgg

SEQ ID NO: 942420 - RNA, 19 nt, Human
gcaccugcccucucuggga

SEQ ID NO: 942421 - RNA, 19 nt, Human
gcagcaggcuccuccagga

SEQ ID NO: 942422 - RNA, 22 nt, Human
ggaaagggaggcauugggagug

SEQ ID NO: 942423 - RNA, 24 nt, Human
ggcagggcccuuucugggcagggc

SEQ ID NO: 942424 - RNA, 20 nt, Human
gggaagcaggugugagaaag

SEQ ID NO: 942425 - RNA, 19 nt, Human
gggcaugaggucugguggg

SEQ ID NO: 942426 - RNA, 23 nt, Human
gggcaugaggucugguggggguu

SEQ ID NO: 942427 - RNA, 23 nt, Human
gggccgaggggaagaaacacugu

SEQ ID NO: 942428 - RNA, 19 nt, Human
ggggggcugggagaggagu

SEQ ID NO: 942429 - RNA, 24 nt, Human
ggggguaggaggggacaagacagg

SEQ ID NO: 942430 - RNA, 23 nt, Human
gggguaggaggggacaagacagg

SEQ ID NO: 942431 - RNA, 21 nt, Human
gggguggugcuaaucuggggg

SEQ ID NO: 942432 - RNA, 22 nt, Human
gggguuggggccagagauccag

SEQ ID NO: 942433 - RNA, 22 nt, Human
ggguaaggggccagacagguuu

SEQ ID NO: 942434 - RNA, 26 nt, Human
ggguaggaggggacaagacagggcua

SEQ ID NO: 942435 - RNA, 24 nt, Human
ggguggugcuaaucuggggguagg

SEQ ID NO: 942436 - RNA, 18 nt, Human
ggguuggggccagagauc

SEQ ID NO: 942437 - RNA, 24 nt, Human
ggugugagaaagggugaugaccca

SEQ ID NO: 942438 - RNA, 18 nt, Human
gugaaggggugaguaugg

SEQ ID NO: 942439 - RNA, 20 nt, Human
uaaggggccagacagguuuc

SEQ ID NO: 942440 - RNA, 19 nt, Human
uaaucuggggguaggaggg

SEQ ID NO: 942441 - RNA, 22 nt, Human
uaggcccuggcccugauuccag

SEQ ID NO: 942442 - RNA, 24 nt, Human
ucaagccccaggucucagccaugc

SEQ ID NO: 942443 - RNA, 20 nt, Human
ucagggaaggggcucaggau

SEQ ID NO: 942444 - RNA, 20 nt, Human
uccaggaaagggccuguggg

SEQ ID NO: 942445 - RNA, 22 nt, Human
uccagggcaugaggucuggugg

SEQ ID NO: 942446 - RNA, 19 nt, Human
uccaugguccaggaaaggg

SEQ ID NO: 942447 - RNA, 21 nt, Human
ucccauagcauccaacccaag

SEQ ID NO: 942448 - RNA, 19 nt, Human
ucccuccaagccacuucuc

SEQ ID NO: 942449 - RNA, 23 nt, Human
ucccuccugaggaaggcagaggc

SEQ ID NO: 942450 - RNA, 19 nt, Human
ucgagguuucuggaagacu

SEQ ID NO: 942451 - RNA, 20 nt, Human
ucuaaggagcgcaggccugu

SEQ ID NO: 942452 - RNA, 23 nt, Human
ucucgaaguaucuagcccagcuc

SEQ ID NO: 942453 - RNA, 20 nt, Human
ucugagccaacucagcagca

SEQ ID NO: 942454 - RNA, 21 nt, Human
ucugggggaagagcccccuuu

SEQ ID NO: 942455 - RNA, 23 nt, Human
ugagaggcaaggcacgagucugg

SEQ ID NO: 942456 - RNA, 19 nt, Human
ugagaggggagaagccuca

SEQ ID NO: 942457 - RNA, 25 nt, Human
ugagagggguggugcuaaucugggg

SEQ ID NO: 942458 - RNA, 26 nt, Human
ugagagggguggugcuaaucuggggg

SEQ ID NO: 942459 - RNA, 18 nt, Human
ugagccaacucagcagca

SEQ ID NO: 942460 - RNA, 19 nt, Human
ugagccaacucagcagcag

SEQ ID NO: 942461 - RNA, 20 nt, Human
ugaggccaggagagccccuc

SEQ ID NO: 942462 - RNA, 24 nt, Human
ugcagcaggcuccuccaggaaagg

SEQ ID NO: 942463 - RNA, 21 nt, Human
ugcccagauccuccugcccgc

SEQ ID NO: 942464 - RNA, 19 nt, Human
ugcccgccucugcuugcug

SEQ ID NO: 942465 - RNA, 18 nt, Human
uggagauugaggccagga

SEQ ID NO: 942466 - RNA, 21 nt, Human
uggaggaaccucaaggggagg

SEQ ID NO: 942467 - RNA, 20 nt, Human
ugggaucccucagcaggaga

SEQ ID NO: 942468 - RNA, 21 nt, Human
ugggggaaguaaucccccugg

SEQ ID NO: 942469 - RNA, 18 nt, Human
uggggguguggguggggg

SEQ ID NO: 942470 - RNA, 19 nt, Human
uggggguguggguggggga

SEQ ID NO: 942471 - RNA, 18 nt, Human
uggggguuggggccagag

SEQ ID NO: 942472 - RNA, 23 nt, Human
uggggguuggggccagagaucca

SEQ ID NO: 942473 - RNA, 20 nt, Human
uggguaaggggccagacagg

SEQ ID NO: 942474 - RNA, 24 nt, Human
ugggugggggaaguaaucccccug

SEQ ID NO: 942475 - RNA, 21 nt, Human
ugguggggguuggggccagag

SEQ ID NO: 942476 - RNA, 23 nt, Human
ugguggggguuggggccagagau

SEQ ID NO: 942477 - RNA, 18 nt, Human
ugugaaaggcucagugcc

SEQ ID NO: 942478 - RNA, 22 nt, Human
uguggggugggcaccugcccuc

SEQ ID NO: 942479 - RNA, 23 nt, Human
uucuuuuaccccucaaaagaaau

SEQ ID NO: 942480 - RNA, 19 nt, Human
uugugaaaggcucagugcc

SEQ ID NO: 942481 - RNA, 21 nt, Human
uuuauugagaacagugggcag

SEQ ID NO: 942482 - RNA, 18 nt, Human
uuuucuggcagggucuag

SEQ ID NO: 942483 - RNA, 22 nt, Human
aaauggccaguacagaaggggc

SEQ ID NO: 942484 - RNA, 19 nt, Human
aagaggcucuggccugcuc

SEQ ID NO: 942485 - RNA, 20 nt, Human
aagcaaaagaggcucuggcc

SEQ ID NO: 942486 - RNA, 19 nt, Human
aaggccccaaggaccuugc

SEQ ID NO: 942487 - RNA, 21 nt, Human
aaguggcccucgaagaaaggu

SEQ ID NO: 942488 - RNA, 25 nt, Human
acagcacaugagggucuggggucug

SEQ ID NO: 942489 - RNA, 18 nt, Human
agagcaggaagaggggcu

SEQ ID NO: 942490 - RNA, 21 nt, Human
agcagaagccccaucccagga

SEQ ID NO: 942491 - RNA, 24 nt, Human
agcucacuccccaucuugccccug

SEQ ID NO: 942492 - RNA, 20 nt, Human
aggaagcaaaagaggcucug

SEQ ID NO: 942493 - RNA, 18 nt, Human
aggaaugugggagaggcc

SEQ ID NO: 942494 - RNA, 21 nt, Human
aggcagaggucuuggcuuccu

SEQ ID NO: 942495 - RNA, 19 nt, Human
aggcaggaggcagcucugg

SEQ ID NO: 942496 - RNA, 21 nt, Human
aggcaggaggcagcucugggg

SEQ ID NO: 942497 - RNA, 23 nt, Human
aggcaggggacaaaaugucaggu

SEQ ID NO: 942498 - RNA, 19 nt, Human
agggagaacaccaccagga

SEQ ID NO: 942499 - RNA, 22 nt, Human
aggucgcucgggcucauggggg

SEQ ID NO: 942500 - RNA, 24 nt, Human
agugccaggcaggaggcagcucug

SEQ ID NO: 942501 - RNA, 19 nt, Human
augcagggagaacaccacc

SEQ ID NO: 942502 - RNA, 20 nt, Human
augccgcagucuccuugagu

SEQ ID NO: 942503 - RNA, 18 nt, Human
auucacugcuccuucucc

SEQ ID NO: 942504 - RNA, 23 nt, Human
caaaugccaaagugcacugagga

SEQ ID NO: 942505 - RNA, 21 nt, Human
cacagcacaugagggucuggg

SEQ ID NO: 942506 - RNA, 18 nt, Human
cacaggcuuggcccuggc

SEQ ID NO: 942507 - RNA, 20 nt, Human
caccgugcaaaugccaaagu

SEQ ID NO: 942508 - RNA, 20 nt, Human
cacuggccugggcuccugac

SEQ ID NO: 942509 - RNA, 23 nt, Human
cagaaggggccaggcacacagca

SEQ ID NO: 942510 - RNA, 23 nt, Human
cagagaggaaccagcuggaccug

SEQ ID NO: 942511 - RNA, 19 nt, Human
cagcucacuccccaucuug

SEQ ID NO: 942512 - RNA, 20 nt, Human
cagcucacuccccaucuugc

SEQ ID NO: 942513 - RNA, 20 nt, Human
caggagcaaagccagcaacu

SEQ ID NO: 942514 - RNA, 23 nt, Human
caggagcuaggcgaggcuuugcg

SEQ ID NO: 942515 - RNA, 18 nt, Human
caggaggggaguguggcg

SEQ ID NO: 942516 - RNA, 19 nt, Human
caguacagaaggggccagg

SEQ ID NO: 942517 - RNA, 23 nt, Human
cauaagcaucguggacguaugug

SEQ ID NO: 942518 - RNA, 19 nt, Human
cauagccugucuccuccag

SEQ ID NO: 942519 - RNA, 21 nt, Human
ccaggaggggaguguggcggc

SEQ ID NO: 942520 - RNA, 21 nt, Human
ccaggccccaucucacuggcc

SEQ ID NO: 942521 - RNA, 20 nt, Human
ccaggugcuguggaccugcu

SEQ ID NO: 942522 - RNA, 23 nt, Human
ccaguacagaaggggccaggcac

SEQ ID NO: 942523 - RNA, 24 nt, Human
ccaguacagaaggggccaggcaca

SEQ ID NO: 942524 - RNA, 21 nt, Human
cccaggugcuguggaccugcu

SEQ ID NO: 942525 - RNA, 21 nt, Human
ccccaaggaccuugcugccuu

SEQ ID NO: 942526 - RNA, 19 nt, Human
ccccugagcucccuggcuc

SEQ ID NO: 942527 - RNA, 26 nt, Human
ccccuggaguugagucacaggcuugg

SEQ ID NO: 942528 - RNA, 18 nt, Human
ccccuggucucugaccuc

SEQ ID NO: 942529 - RNA, 27 nt, Human
cccgccaggcucaggggccuggaguca

SEQ ID NO: 942530 - RNA, 19 nt, Human
cccggccuccccuggucuc

SEQ ID NO: 942531 - RNA, 18 nt, Human
cccguccacaccaacacc

SEQ ID NO: 942532 - RNA, 20 nt, Human
cccuccuggcugcagcugca

SEQ ID NO: 942533 - RNA, 18 nt, Human
cccugagcucccuggcuc

SEQ ID NO: 942534 - RNA, 24 nt, Human
ccggccuccccuggucucugaccu

SEQ ID NO: 942535 - RNA, 25 nt, Human
ccgugcaaaugccaaagugcacuga

SEQ ID NO: 942536 - RNA, 19 nt, Human
ccucgaagaaaggucgcuc

SEQ ID NO: 942537 - RNA, 22 nt, Human
ccucuuggcaaccugugccugg

SEQ ID NO: 942538 - RNA, 25 nt, Human
ccugagcucccuggcuccccagaag

SEQ ID NO: 942539 - RNA, 18 nt, Human
ccugggcccgcuccccuc

SEQ ID NO: 942540 - RNA, 21 nt, Human
ccuuggcaccuggcaugccca

SEQ ID NO: 942541 - RNA, 20 nt, Human
cucccaccgcccuggugcug

SEQ ID NO: 942542 - RNA, 20 nt, Human
cuccuccaagaaggccccaa

SEQ ID NO: 942543 - RNA, 24 nt, Human
cuccuccaagaaggccccaaggac

SEQ ID NO: 942544 - RNA, 21 nt, Human
cuccugggcccgcuccccucc

SEQ ID NO: 942545 - RNA, 18 nt, Human
cugcccaggugcugugga

SEQ ID NO: 942546 - RNA, 20 nt, Human
cugcgccccguccacaccaa

SEQ ID NO: 942547 - RNA, 21 nt, Human
cuggcuccugggcccgcuccc

SEQ ID NO: 942548 - RNA, 22 nt, Human
cuuggcccuggccacaaauggc

SEQ ID NO: 942549 - RNA, 18 nt, Human
gaaagccggaauccagga

SEQ ID NO: 942550 - RNA, 21 nt, Human
gaagcaaaagaggcucuggcc

SEQ ID NO: 942551 - RNA, 24 nt, Human
gagcaggaagaggggcuuccccga

SEQ ID NO: 942552 - RNA, 22 nt, Human
gagcugcacuccuggaacaggc

SEQ ID NO: 942553 - RNA, 18 nt, Human
gcagaggucuuggcuucc

SEQ ID NO: 942554 - RNA, 23 nt, Human
gccaaagugcacugaggagaggg

SEQ ID NO: 942555 - RNA, 24 nt, Human
gccaguacagaaggggccaggcac

SEQ ID NO: 942556 - RNA, 20 nt, Human
gccggaauccaggaagcugg

SEQ ID NO: 942557 - RNA, 18 nt, Human
gccgggugggguggcagc

SEQ ID NO: 942558 - RNA, 24 nt, Human
gccuggcuccugggcccgcucccc

SEQ ID NO: 942559 - RNA, 22 nt, Human
gcuguggaccugcugagacggg

SEQ ID NO: 942560 - RNA, 25 nt, Human
ggagaacaccaccaggacuggcugc

SEQ ID NO: 942561 - RNA, 22 nt, Human
ggagaucugcgccccguccaca

SEQ ID NO: 942562 - RNA, 24 nt, Human
gggccaagccauguaggcagggga

SEQ ID NO: 942563 - RNA, 18 nt, Human
gggcccgcuccccuccug

SEQ ID NO: 942564 - RNA, 21 nt, Human
ggucagaggccagccccagga

SEQ ID NO: 942565 - RNA, 20 nt, Human
uaccuaaugugacacagaca

SEQ ID NO: 942566 - RNA, 19 nt, Human
uaggguguccucauagcuc

SEQ ID NO: 942567 - RNA, 22 nt, Human
ucacaggcuuggcccuggcccc

SEQ ID NO: 942568 - RNA, 18 nt, Human
ucacuggccugggcuccu

SEQ ID NO: 942569 - RNA, 23 nt, Human
ucagcucacuccccaucuugccc

SEQ ID NO: 942570 - RNA, 23 nt, Human
uccaggccccaucucacuggccu

SEQ ID NO: 942571 - RNA, 27 nt, Human
ucccccgcggggaggaaugugggagag

SEQ ID NO: 942572 - RNA, 25 nt, Human
ucgaagaaaggucgcucgggcucau

SEQ ID NO: 942573 - RNA, 23 nt, Human
ucggugaaguaggggucuuccuc

SEQ ID NO: 942574 - RNA, 22 nt, Human
ucuccuccaggaaggcagaggu

SEQ ID NO: 942575 - RNA, 19 nt, Human
ucucugaccucugcccagg

SEQ ID NO: 942576 - RNA, 19 nt, Human
ugaaguaggggucuuccuc

SEQ ID NO: 942577 - RNA, 24 nt, Human
ugacacagacaaggcuccaggccc

SEQ ID NO: 942578 - RNA, 21 nt, Human
ugagcucccuggcuccccaga

SEQ ID NO: 942579 - RNA, 23 nt, Human
ugaggagaggggagggucuguga

SEQ ID NO: 942580 - RNA, 22 nt, Human
ugagucacaggcuuggcccugg

SEQ ID NO: 942581 - RNA, 24 nt, Human
ugagugagcccgggagcagaagcc

SEQ ID NO: 942582 - RNA, 20 nt, Human
ugccaugaggcggcugggag

SEQ ID NO: 942583 - RNA, 23 nt, Human
ugcccaggugcuguggaccugcu

SEQ ID NO: 942584 - RNA, 21 nt, Human
ugccccuggaguugagucaca

SEQ ID NO: 942585 - RNA, 19 nt, Human
ugccuggcgccgcccgugu

SEQ ID NO: 942586 - RNA, 18 nt, Human
ugccugggccgcagccac

SEQ ID NO: 942587 - RNA, 22 nt, Human
uggcagcccagccacggagggc

SEQ ID NO: 942588 - RNA, 23 nt, Human
uggcagcccagccacggagggca

SEQ ID NO: 942589 - RNA, 22 nt, Human
uggcgccgcccguguauuccug

SEQ ID NO: 942590 - RNA, 22 nt, Human
uggcggcagugccaggcaggag

SEQ ID NO: 942591 - RNA, 21 nt, Human
uggcuccugggcccgcucccc

SEQ ID NO: 942592 - RNA, 19 nt, Human
uggcugcagcugcaccaag

SEQ ID NO: 942593 - RNA, 19 nt, Human
uggggguccaaaggugugg

SEQ ID NO: 942594 - RNA, 23 nt, Human
uggggguccaaaggugugggggu

SEQ ID NO: 942595 - RNA, 25 nt, Human
uggggguccaaagguguggggguca

SEQ ID NO: 942596 - RNA, 24 nt, Human
uguccccugagcucccuggcuccc

SEQ ID NO: 942597 - RNA, 18 nt, Human
uguggcggcagugccagg

SEQ ID NO: 942598 - RNA, 18 nt, Human
ugugggggucagaggcca

SEQ ID NO: 942599 - RNA, 23 nt, Human
uucacugcuccuucuccaugggc

SEQ ID NO: 942600 - RNA, 22 nt, Human
uuugugcacccacaugugcacg

SEQ ID NO: 942601 - RNA, 20 nt, Human
uuuuuuuuuuuuuuuuccac

SEQ ID NO: 942602 - RNA, 22 nt, Human
aaaacaccagcaaaggcuauaa

SEQ ID NO: 942603 - RNA, 19 nt, Human
aaacacgccccccuccccc

SEQ ID NO: 942604 - RNA, 21 nt, Human
aaacacgccccccuccccccc

SEQ ID NO: 942605 - RNA, 23 nt, Human
aaaccgaugaccccuggcccccg

SEQ ID NO: 942606 - RNA, 19 nt, Human
aacagaacaaaaaccccuu

SEQ ID NO: 942607 - RNA, 19 nt, Human
aacaugccugugggccggg

SEQ ID NO: 942608 - RNA, 20 nt, Human
aaccgaugaccccuggcccc

SEQ ID NO: 942609 - RNA, 22 nt, Human
aacgcaagaagcaagaacuccu

SEQ ID NO: 942610 - RNA, 24 nt, Human
aacgggacaaaggaagaaaagggg

SEQ ID NO: 942611 - RNA, 21 nt, Human
aagcagggaggcaggguuaca

SEQ ID NO: 942612 - RNA, 18 nt, Human
aagccagauggagcaaag

SEQ ID NO: 942613 - RNA, 18 nt, Human
aagccgcaucagcgugug

SEQ ID NO: 942614 - RNA, 22 nt, Human
aagcgguggagggaaggccaga

SEQ ID NO: 942615 - RNA, 21 nt, Human
aagggcgcaaagaauuuacag

SEQ ID NO: 942616 - RNA, 24 nt, Human
aaucaccugugaucaugauaucaa

SEQ ID NO: 942617 - RNA, 20 nt, Human
aaugcuauaaccaacaggau

SEQ ID NO: 942618 - RNA, 19 nt, Human
acaaaggaagaaaaggggc

SEQ ID NO: 942619 - RNA, 28 nt, Human
acagaggagagcuggggaccacccacaa

SEQ ID NO: 942620 - RNA, 24 nt, Human
acauguccauggccugggcugcag

SEQ ID NO: 942621 - RNA, 24 nt, Human
accacccacagcggacgggagagc

SEQ ID NO: 942622 - RNA, 23 nt, Human
acccuaaaaauacacagguggca

SEQ ID NO: 942623 - RNA, 22 nt, Human
acccugauaagaaccagaauga

SEQ ID NO: 942624 - RNA, 21 nt, Human
agaaacacgccccccuccccc

SEQ ID NO: 942625 - RNA, 22 nt, Human
agacugcaggcuguaggcacca

SEQ ID NO: 942626 - RNA, 26 nt, Human
agagagacagacguggagaacucaca

SEQ ID NO: 942627 - RNA, 18 nt, Human
agaggagagcuggggacc

SEQ ID NO: 942628 - RNA, 22 nt, Human
agaggccucguuuuugcugagg

SEQ ID NO: 942629 - RNA, 20 nt, Human
agagugguaagccagaugga

SEQ ID NO: 942630 - RNA, 22 nt, Human
agcaggaauggcagacccccuc

SEQ ID NO: 942631 - RNA, 24 nt, Human
agcaggaguuugggugagauugug

SEQ ID NO: 942632 - RNA, 20 nt, Human
agcagggaggcaggguuaca

SEQ ID NO: 942633 - RNA, 24 nt, Human
agcccagagaugguugcaggaggu

SEQ ID NO: 942634 - RNA, 23 nt, Human
agcuugcugguggaggcuugcug

SEQ ID NO: 942635 - RNA, 23 nt, Human
aggcaccacgcacgguucagagc

SEQ ID NO: 942636 - RNA, 19 nt, Human
aggcugcacuggugggugu

SEQ ID NO: 942637 - RNA, 18 nt, Human
aggcuggcagccaagggc

SEQ ID NO: 942638 - RNA, 21 nt, Human
aggggcuggacagacaccauu

SEQ ID NO: 942639 - RNA, 22 nt, Human
aggugaguggccucgggggguu

SEQ ID NO: 942640 - RNA, 19 nt, Human
aggugcccggggccugggc

SEQ ID NO: 942641 - RNA, 24 nt, Human
aguauagaaaugucuagcaauagu

SEQ ID NO: 942642 - RNA, 25 nt, Human
auaaagcuucaaaccaagaagaugg

SEQ ID NO: 942643 - RNA, 19 nt, Human
aucacaauuaguuuuuuga

SEQ ID NO: 942644 - RNA, 22 nt, Human
aucacuuugguuggguguacac

SEQ ID NO: 942645 - RNA, 25 nt, Human
caaaauaaaaacaauacacauucca

SEQ ID NO: 942646 - RNA, 21 nt, Human
caaaauaaccacaugaacacc

SEQ ID NO: 942647 - RNA, 22 nt, Human
caaaccgaugaccccuggcccc

SEQ ID NO: 942648 - RNA, 22 nt, Human
caaagcgguggagggaaggcca

SEQ ID NO: 942649 - RNA, 24 nt, Human
caaccuggggcuugcucccgcccc

SEQ ID NO: 942650 - RNA, 18 nt, Human
caacgcaagaagcaagaa

SEQ ID NO: 942651 - RNA, 21 nt, Human
cacagaccagccugaaacaaa

SEQ ID NO: 942652 - RNA, 22 nt, Human
cacagccuuccuggugcacugg

SEQ ID NO: 942653 - RNA, 19 nt, Human
caccacgcacgguucagag

SEQ ID NO: 942654 - RNA, 20 nt, Human
caccacgcacgguucagagc

SEQ ID NO: 942655 - RNA, 21 nt, Human
caccagcaaaggcuauaacca

SEQ ID NO: 942656 - RNA, 21 nt, Human
caccucccucacacccuggcc

SEQ ID NO: 942657 - RNA, 19 nt, Human
cacgccccccuccccccca

SEQ ID NO: 942658 - RNA, 22 nt, Human
cagaaacacgccccccuccccc

SEQ ID NO: 942659 - RNA, 21 nt, Human
cagagcacuccggaagagcuu

SEQ ID NO: 942660 - RNA, 21 nt, Human
cagaggagagcuggggaccac

SEQ ID NO: 942661 - RNA, 22 nt, Human
cagccgcccauucuguucaccc

SEQ ID NO: 942662 - RNA, 18 nt, Human
caggcaggguaggcuggc

SEQ ID NO: 942663 - RNA, 22 nt, Human
caggcccgaggcccgucgggag

SEQ ID NO: 942664 - RNA, 19 nt, Human
cagggaggcaggguuacag

SEQ ID NO: 942665 - RNA, 25 nt, Human
caugaacaccuaauauacagguuuc

SEQ ID NO: 942666 - RNA, 24 nt, Human
cauguccauggccugggcugcagc

SEQ ID NO: 942667 - RNA, 24 nt, Human
ccacacagccuuccuggugcacug

SEQ ID NO: 942668 - RNA, 18 nt, Human
ccacagaggagagcuggg

SEQ ID NO: 942669 - RNA, 26 nt, Human
ccagaaacacgccccccuccccccca

SEQ ID NO: 942670 - RNA, 23 nt, Human
ccagacccacacagccuuccugg

SEQ ID NO: 942671 - RNA, 22 nt, Human
cccaaccaagggcacaaucacu

SEQ ID NO: 942672 - RNA, 18 nt, Human
cccagaaacacgcccccc

SEQ ID NO: 942673 - RNA, 22 nt, Human
cccagagcacuccggaagagcu

SEQ ID NO: 942674 - RNA, 19 nt, Human
cccaugcuggggcccgggg

SEQ ID NO: 942675 - RNA, 21 nt, Human
cccaugcuggggcccgggggc

SEQ ID NO: 942676 - RNA, 24 nt, Human
ccccggaugccucugcaccucccu

SEQ ID NO: 942677 - RNA, 24 nt, Human
cccgaggcccgucgggagcagacc

SEQ ID NO: 942678 - RNA, 23 nt, Human
cccuggcccccgagagacguugu

SEQ ID NO: 942679 - RNA, 27 nt, Human
cccugggcucugguuucuuccgaucgg

SEQ ID NO: 942680 - RNA, 19 nt, Human
ccgccccggaugccucugc

SEQ ID NO: 942681 - RNA, 18 nt, Human
ccgcgccccccaaccaag

SEQ ID NO: 942682 - RNA, 19 nt, Human
ccgcuccuguuugcuucug

SEQ ID NO: 942683 - RNA, 20 nt, Human
ccucagggacguccuggcuc

SEQ ID NO: 942684 - RNA, 24 nt, Human
ccugcaccugucacaaccuggggc

SEQ ID NO: 942685 - RNA, 20 nt, Human
ccugcgcugggcaugggccc

SEQ ID NO: 942686 - RNA, 23 nt, Human
ccugcgcugggcaugggcccaag

SEQ ID NO: 942687 - RNA, 25 nt, Human
cucuaaauagcgggcugcccggucu

SEQ ID NO: 942688 - RNA, 21 nt, Human
cucuuaccgggcugguuccuc

SEQ ID NO: 942689 - RNA, 19 nt, Human
cugcaccugucacaaccug

SEQ ID NO: 942690 - RNA, 18 nt, Human
cuggcagccaagggcagu

SEQ ID NO: 942691 - RNA, 22 nt, Human
cuggcaucacccuaggccaugu

SEQ ID NO: 942692 - RNA, 22 nt, Human
cugggcccugucugagcuugga

SEQ ID NO: 942693 - RNA, 24 nt, Human
cuggggcuugcucccgccccggau

SEQ ID NO: 942694 - RNA, 19 nt, Human
cugguggaggcuugcugga

SEQ ID NO: 942695 - RNA, 23 nt, Human
cugguggaggcuugcuggagagg

SEQ ID NO: 942696 - RNA, 23 nt, Human
cuguccuggguaguugggggagg

SEQ ID NO: 942697 - RNA, 24 nt, Human
cuugcagaggccucguuuuugcug

SEQ ID NO: 942698 - RNA, 19 nt, Human
gaaauccccguuucuuuuc

SEQ ID NO: 942699 - RNA, 21 nt, Human
gaccccagugacgggacaacc

SEQ ID NO: 942700 - RNA, 21 nt, Human
gagagugguaagccagaugga

SEQ ID NO: 942701 - RNA, 20 nt, Human
gagcaggaaagggccccagg

SEQ ID NO: 942702 - RNA, 27 nt, Human
gaggcaggguuacagucucccaagggg

SEQ ID NO: 942703 - RNA, 25 nt, Human
gcaagaagcaagaacuccuaaggaa

SEQ ID NO: 942704 - RNA, 21 nt, Human
gcagcgggggagggcuccccg

SEQ ID NO: 942705 - RNA, 23 nt, Human
gcaggaggugcccggggccuggg

SEQ ID NO: 942706 - RNA, 20 nt, Human
gccccccucccccccaugcc

SEQ ID NO: 942707 - RNA, 18 nt, Human
gcccgggggccuucucag

SEQ ID NO: 942708 - RNA, 20 nt, Human
gcccucuuccccaccagucc

SEQ ID NO: 942709 - RNA, 20 nt, Human
gccgcuccuguuugcuucug

SEQ ID NO: 942710 - RNA, 22 nt, Human
gccugggcugcagccgggggca

SEQ ID NO: 942711 - RNA, 20 nt, Human
gcucagaagauguccuggcc

SEQ ID NO: 942712 - RNA, 19 nt, Human
gcucccagagcacuccgga

SEQ ID NO: 942713 - RNA, 18 nt, Human
gcugcagcgggggagggc

SEQ ID NO: 942714 - RNA, 25 nt, Human
gcuugcagaggccucguuuuugcug

SEQ ID NO: 942715 - RNA, 18 nt, Human
ggacagagggaggggcug

SEQ ID NO: 942716 - RNA, 20 nt, Human
ggaccaggaagcagggaggc

SEQ ID NO: 942717 - RNA, 19 nt, Human
ggagagaaaugguuugcuu

SEQ ID NO: 942718 - RNA, 25 nt, Human
ggagcagaccuguagcuccccggag

SEQ ID NO: 942719 - RNA, 18 nt, Human
ggagggaaggccagaggc

SEQ ID NO: 942720 - RNA, 20 nt, Human
ggaggugcccggggccuggg

SEQ ID NO: 942721 - RNA, 23 nt, Human
ggauggccccgaccggguggccc

SEQ ID NO: 942722 - RNA, 21 nt, Human
ggcagacccccucucaaacac

SEQ ID NO: 942723 - RNA, 23 nt, Human
ggcaggcccagaaacacgccccc

SEQ ID NO: 942724 - RNA, 23 nt, Human
ggcugcagccgggggcagcuugg

SEQ ID NO: 942725 - RNA, 22 nt, Human
ggcugcagcgggggagggcucc

SEQ ID NO: 942726 - RNA, 23 nt, Human
ggcuggcagccaagggcaguguc

SEQ ID NO: 942727 - RNA, 18 nt, Human
ggcuugcagaggccucgu

SEQ ID NO: 942728 - RNA, 21 nt, Human
gggacccaggaaacccgccuc

SEQ ID NO: 942729 - RNA, 24 nt, Human
gggcaggcccagaaacacgccccc

SEQ ID NO: 942730 - RNA, 22 nt, Human
gggcaugggcccaagccaaggg

SEQ ID NO: 942731 - RNA, 19 nt, Human
gggcugcagcgggggaggg

SEQ ID NO: 942732 - RNA, 20 nt, Human
gggcugcagcgggggagggc

SEQ ID NO: 942733 - RNA, 21 nt, Human
ggggcacagaccagccugaaa

SEQ ID NO: 942734 - RNA, 21 nt, Human
ggguaggcuggcagccaaggg

SEQ ID NO: 942735 - RNA, 22 nt, Human
ggguaggcuggcagccaagggc

SEQ ID NO: 942736 - RNA, 24 nt, Human
ggguaggcuggcagccaagggcag

SEQ ID NO: 942737 - RNA, 19 nt, Human
gguaggcuggcagccaagg

SEQ ID NO: 942738 - RNA, 23 nt, Human
ggugcccggggccugggcugcag

SEQ ID NO: 942739 - RNA, 22 nt, Human
gguggcaggacuaguacacuga

SEQ ID NO: 942740 - RNA, 22 nt, Human
ggugggugguggugggugggcu

SEQ ID NO: 942741 - RNA, 19 nt, Human
gguguggaggugggacgug

SEQ ID NO: 942742 - RNA, 18 nt, Human
guagguaaaauaaaaaca

SEQ ID NO: 942743 - RNA, 22 nt, Human
guccauggccugggcugcagcc

SEQ ID NO: 942744 - RNA, 25 nt, Human
guccuuuuucucugcuuucugagug

SEQ ID NO: 942745 - RNA, 20 nt, Human
gucuaccugcaccugucaca

SEQ ID NO: 942746 - RNA, 21 nt, Human
guggaggugggacgugggcuc

SEQ ID NO: 942747 - RNA, 22 nt, Human
guugucuuucccagagguuugu

SEQ ID NO: 942748 - RNA, 21 nt, Human
uaaaaacaccagcaaaggcua

SEQ ID NO: 942749 - RNA, 22 nt, Human
uaaaaacaccagcaaaggcuau

SEQ ID NO: 942750 - RNA, 26 nt, Human
uaaaaacaccagcaaaggcuauaacc

SEQ ID NO: 942751 - RNA, 23 nt, Human
uaaaauaaaaacagaacaaaaac

SEQ ID NO: 942752 - RNA, 23 nt, Human
uaaauacaaaauaaccacaugaa

SEQ ID NO: 942753 - RNA, 18 nt, Human
uaacaugggcaaaugaga

SEQ ID NO: 942754 - RNA, 26 nt, Human
uaauugauuugcauacugaacaacac

SEQ ID NO: 942755 - RNA, 19 nt, Human
uacaaaauaaccacaugaa

SEQ ID NO: 942756 - RNA, 21 nt, Human
uacacugaagcuaaauaguac

SEQ ID NO: 942757 - RNA, 25 nt, Human
uagaagauggaagaaccuuggggac

SEQ ID NO: 942758 - RNA, 21 nt, Human
uagcgggcugcccggucuucc

SEQ ID NO: 942759 - RNA, 24 nt, Human
uagcuuuaaauuguugcuguuuaa

SEQ ID NO: 942760 - RNA, 18 nt, Human
uaggacagagggaagugg

SEQ ID NO: 942761 - RNA, 19 nt, Human
uaggugggguaggaugcag

SEQ ID NO: 942762 - RNA, 22 nt, Human
uaugcccgcgccccccaaccaa

SEQ ID NO: 942763 - RNA, 21 nt, Human
ucagcgugugcccucuuaccg

SEQ ID NO: 942764 - RNA, 18 nt, Human
uccaagagaaaugaaugc

SEQ ID NO: 942765 - RNA, 22 nt, Human
uccaaggcucggggcccaugcu

SEQ ID NO: 942766 - RNA, 18 nt, Human
uccaccugugagcagagu

SEQ ID NO: 942767 - RNA, 20 nt, Human
uccacgcacugcccuugcca

SEQ ID NO: 942768 - RNA, 19 nt, Human
uccagacugcaggcuguag

SEQ ID NO: 942769 - RNA, 21 nt, Human
uccagaguucaggaccaucuc

SEQ ID NO: 942770 - RNA, 22 nt, Human
uccauggccugggcugcagccg

SEQ ID NO: 942771 - RNA, 22 nt, Human
ucccugccagcugacugaggga

SEQ ID NO: 942772 - RNA, 21 nt, Human
ucggggcccaugcuggggccc

SEQ ID NO: 942773 - RNA, 19 nt, Human
ucuccagaguucaggacca

SEQ ID NO: 942774 - RNA, 23 nt, Human
ucuccagaguucaggaccaucuc

SEQ ID NO: 942775 - RNA, 23 nt, Human
ucuccaggugacuucauagcuuu

SEQ ID NO: 942776 - RNA, 22 nt, Human
ucugacacagggcguggccacu

SEQ ID NO: 942777 - RNA, 19 nt, Human
ucugcaccuccccggccuu

SEQ ID NO: 942778 - RNA, 21 nt, Human
ucugcaccucccucacacccu

SEQ ID NO: 942779 - RNA, 23 nt, Human
ucuggaccaggaagcagggaggc

SEQ ID NO: 942780 - RNA, 24 nt, Human
ucuggugcggggcggucugagggc

SEQ ID NO: 942781 - RNA, 21 nt, Human
ugaacaacacgcuauuugaaa

SEQ ID NO: 942782 - RNA, 22 nt, Human
ugaauacauauuuauuagauaa

SEQ ID NO: 942783 - RNA, 24 nt, Human
ugaaucaccugugaucaugauauc

SEQ ID NO: 942784 - RNA, 19 nt, Human
ugagagggcugcagcgggg

SEQ ID NO: 942785 - RNA, 20 nt, Human
ugcccggggccugggcugca

SEQ ID NO: 942786 - RNA, 21 nt, Human
ugcccggggccugggcugcag

SEQ ID NO: 942787 - RNA, 24 nt, Human
ugccugcagguacauacuggugca

SEQ ID NO: 942788 - RNA, 21 nt, Human
ugccugcuggcucccugucca

SEQ ID NO: 942789 - RNA, 21 nt, Human
ugcucccgccccggaugccuc

SEQ ID NO: 942790 - RNA, 24 nt, Human
uggaagaaccuuggggacacugga

SEQ ID NO: 942791 - RNA, 20 nt, Human
uggagagguggcaggagagg

SEQ ID NO: 942792 - RNA, 19 nt, Human
uggagcaaagcgguggagg

SEQ ID NO: 942793 - RNA, 20 nt, Human
uggagcacagggacagaggg

SEQ ID NO: 942794 - RNA, 21 nt, Human
uggagggaaggccagaggcug

SEQ ID NO: 942795 - RNA, 21 nt, Human
uggagggaggcucuggaccag

SEQ ID NO: 942796 - RNA, 18 nt, Human
uggcggcagaaacaugcc

SEQ ID NO: 942797 - RNA, 24 nt, Human
ugggaccccagugacgggacaacc

SEQ ID NO: 942798 - RNA, 19 nt, Human
ugggccgagcuugcuggug

SEQ ID NO: 942799 - RNA, 19 nt, Human
ugggguaucuuggcuuaua

SEQ ID NO: 942800 - RNA, 19 nt, Human
ugggugguggugggugggc

SEQ ID NO: 942801 - RNA, 19 nt, Human
uggguguguuuaugugugu

SEQ ID NO: 942802 - RNA, 25 nt, Human
uggguguguuuauguguguacgugu

SEQ ID NO: 942803 - RNA, 18 nt, Human
uggugcacuggugcaccc

SEQ ID NO: 942804 - RNA, 18 nt, Human
uggugggugguggugggu

SEQ ID NO: 942805 - RNA, 20 nt, Human
ugguggugggugggcugguc

SEQ ID NO: 942806 - RNA, 23 nt, Human
ugguggugggugggcuggucuca

SEQ ID NO: 942807 - RNA, 22 nt, Human
uguccuggguaguugggggagg

SEQ ID NO: 942808 - RNA, 24 nt, Human
uguccuggguaguugggggaggug

SEQ ID NO: 942809 - RNA, 21 nt, Human
ugucuggggcaggcccagaaa

SEQ ID NO: 942810 - RNA, 23 nt, Human
uuacuucaggcugcacugguggg

SEQ ID NO: 942811 - RNA, 19 nt, Human
uuauaggucaggggucaaa

SEQ ID NO: 942812 - RNA, 21 nt, Human
uuauaggucaggggucaaacc

SEQ ID NO: 942813 - RNA, 24 nt, Human
uucaaaccaagaagauggggguga

SEQ ID NO: 942814 - RNA, 22 nt, Human
uucacaaagauauuuacaaaag

SEQ ID NO: 942815 - RNA, 18 nt, Human
uugaaaaaaccucgacaa

SEQ ID NO: 942816 - RNA, 18 nt, Human
uugcugguggaggcuugc

SEQ ID NO: 942817 - RNA, 21 nt, Human
uuggagcaaaguuagaaguug

SEQ ID NO: 942818 - RNA, 23 nt, Human
uuggagguggagccucagggacg

SEQ ID NO: 942819 - RNA, 23 nt, Human
uugguuggguguacaccugcucu

SEQ ID NO: 942820 - RNA, 22 nt, Human
uuuaaaaaaaaagaagacucgg

SEQ ID NO: 942821 - RNA, 19 nt, Human
uuuacagaugggaccccag

SEQ ID NO: 942822 - RNA, 22 nt, Human
uuuacagaugggaccccaguga

SEQ ID NO: 942823 - RNA, 18 nt, Human
uuucugaguguguuuaug

SEQ ID NO: 942824 - RNA, 20 nt, Human
uuugcaagacuagaaaucac

SEQ ID NO: 942825 - RNA, 21 nt, Human
uuugucauugaguccagguau

SEQ ID NO: 942826 - RNA, 18 nt, Human
aaaaagccuguuccacag

SEQ ID NO: 942827 - RNA, 19 nt, Human
aaaaauacagcaacuugau

SEQ ID NO: 942828 - RNA, 20 nt, Human
aacaaaauacuucaccaaaa

SEQ ID NO: 942829 - RNA, 21 nt, Human
aacacugcaugguucugauca

SEQ ID NO: 942830 - RNA, 19 nt, Human
aaccaacacugggaagaca

SEQ ID NO: 942831 - RNA, 21 nt, Human
aacuuacgacuuuuuaaaagu

SEQ ID NO: 942832 - RNA, 18 nt, Human
aaggacccagaaauucag

SEQ ID NO: 942833 - RNA, 24 nt, Human
aaguucucaacacccaagaaaaug

SEQ ID NO: 942834 - RNA, 23 nt, Human
acaacaauguuaccagcuaccaa

SEQ ID NO: 942835 - RNA, 21 nt, Human
acacacacacacacguacagc

SEQ ID NO: 942836 - RNA, 18 nt, Human
acacacacacguacagcc

SEQ ID NO: 942837 - RNA, 22 nt, Human
acagaaaacaagacacaauuua

SEQ ID NO: 942838 - RNA, 18 nt, Human
acagaaucucuucaagua

SEQ ID NO: 942839 - RNA, 22 nt, Human
acugaaugcagagguuggaccg

SEQ ID NO: 942840 - RNA, 18 nt, Human
agaaaaagacagcccagg

SEQ ID NO: 942841 - RNA, 22 nt, Human
agaaaccuauggagcagauacu

SEQ ID NO: 942842 - RNA, 27 nt, Human
agaaauaaucccuucaauggcguuaug

SEQ ID NO: 942843 - RNA, 18 nt, Human
agacaagcagcacuuaac

SEQ ID NO: 942844 - RNA, 22 nt, Human
agacaagcagcacuuaacuccc

SEQ ID NO: 942845 - RNA, 22 nt, Human
agcccugugggcgagcaacccc

SEQ ID NO: 942846 - RNA, 24 nt, Human
agcgggguuuugaggcugcccagg

SEQ ID NO: 942847 - RNA, 21 nt, Human
aggaggaaaguauucuagucu

SEQ ID NO: 942848 - RNA, 21 nt, Human
aggcacaguuagaacaagauu

SEQ ID NO: 942849 - RNA, 20 nt, Human
agggauagaaaauuaccugu

SEQ ID NO: 942850 - RNA, 22 nt, Human
aggggucugcuggagaaaaaga

SEQ ID NO: 942851 - RNA, 19 nt, Human
aguacauaagaaauugaaa

SEQ ID NO: 942852 - RNA, 20 nt, Human
aucuccuguguugcugcugu

SEQ ID NO: 942853 - RNA, 21 nt, Human
augcauguuucuugaagaguu

SEQ ID NO: 942854 - RNA, 22 nt, Human
caaaaagaagaugaacuacuaa

SEQ ID NO: 942855 - RNA, 19 nt, Human
caacacccaagaaaaugca

SEQ ID NO: 942856 - RNA, 25 nt, Human
cacacggucaucaacaauugugccc

SEQ ID NO: 942857 - RNA, 18 nt, Human
cacaggauuuauacucag

SEQ ID NO: 942858 - RNA, 20 nt, Human
cacaggcuuugcccugcggg

SEQ ID NO: 942859 - RNA, 23 nt, Human
caccaaaaaucgaaagaacccca

SEQ ID NO: 942860 - RNA, 20 nt, Human
cacccauaggaacagaaaac

SEQ ID NO: 942861 - RNA, 21 nt, Human
cacuugcuagugcugugaaug

SEQ ID NO: 942862 - RNA, 21 nt, Human
cagaaaacaagacacaauuua

SEQ ID NO: 942863 - RNA, 24 nt, Human
cagaugcagguggugggcccagag

SEQ ID NO: 942864 - RNA, 23 nt, Human
cagauucaauguagguuaaagug

SEQ ID NO: 942865 - RNA, 21 nt, Human
cagcccaggagagugcaacag

SEQ ID NO: 942866 - RNA, 21 nt, Human
cagccuggguucccagaagcc

SEQ ID NO: 942867 - RNA, 22 nt, Human
cagcugcaaggacccagaaauu

SEQ ID NO: 942868 - RNA, 22 nt, Human
cagcuucccgucaugaucagga

SEQ ID NO: 942869 - RNA, 20 nt, Human
cagcuuuagcuccaggacuc

SEQ ID NO: 942870 - RNA, 21 nt, Human
caguuugcagaguggaaaaac

SEQ ID NO: 942871 - RNA, 18 nt, Human
caucaaguaugucaguug

SEQ ID NO: 942872 - RNA, 21 nt, Human
caucacagcugcaaggaccca

SEQ ID NO: 942873 - RNA, 18 nt, Human
cauggcuccugcacagcu

SEQ ID NO: 942874 - RNA, 23 nt, Human
cauucuggcauggugggaagggc

SEQ ID NO: 942875 - RNA, 19 nt, Human
ccacaguuguagacagcuu

SEQ ID NO: 942876 - RNA, 20 nt, Human
ccagcggcagcggcgccuuc

SEQ ID NO: 942877 - RNA, 24 nt, Human
ccagcggcagcggcgccuucgcuu

SEQ ID NO: 942878 - RNA, 18 nt, Human
ccaggacucuuccggcgu

SEQ ID NO: 942879 - RNA, 21 nt, Human
ccaggcgcagcuggagcgcgg

SEQ ID NO: 942880 - RNA, 26 nt, Human
cccagaagccucugaagucaugccac

SEQ ID NO: 942881 - RNA, 25 nt, Human
ccgcaguaggaaccguccgcuccag

SEQ ID NO: 942882 - RNA, 20 nt, Human
ccgccgcuuccucauggccc

SEQ ID NO: 942883 - RNA, 21 nt, Human
ccgccgcuuccucauggcccu

SEQ ID NO: 942884 - RNA, 22 nt, Human
ccgggccggggccgggccaggc

SEQ ID NO: 942885 - RNA, 21 nt, Human
ccugaaauucugagguuuugg

SEQ ID NO: 942886 - RNA, 24 nt, Human
cgcgggccgcaguggcugccgccg

SEQ ID NO: 942887 - RNA, 19 nt, Human
cucacaggguucaaaccaa

SEQ ID NO: 942888 - RNA, 18 nt, Human
cucagguuccacagccuu

SEQ ID NO: 942889 - RNA, 19 nt, Human
cuccaggccacagggagcu

SEQ ID NO: 942890 - RNA, 18 nt, Human
cucucgggccccucucac

SEQ ID NO: 942891 - RNA, 23 nt, Human
cucugggauggugaggccacagg

SEQ ID NO: 942892 - RNA, 21 nt, Human
cugaaaaauacagcaacuuga

SEQ ID NO: 942893 - RNA, 23 nt, Human
cugaucuugaaugacaaaacaug

SEQ ID NO: 942894 - RNA, 22 nt, Human
cugcucucuaccgaaucaaucc

SEQ ID NO: 942895 - RNA, 21 nt, Human
cugcucuucaccaccaggccc

SEQ ID NO: 942896 - RNA, 18 nt, Human
cuggagcgcgggcagacg

SEQ ID NO: 942897 - RNA, 21 nt, Human
cuuggggcuugggaggugggg

SEQ ID NO: 942898 - RNA, 19 nt, Human
gaaaacacauuuaauuuca

SEQ ID NO: 942899 - RNA, 19 nt, Human
gaaacugaccuauuacacu

SEQ ID NO: 942900 - RNA, 19 nt, Human
gagaugaugggggcacagg

SEQ ID NO: 942901 - RNA, 19 nt, Human
gagccuuuugaugccuuuc

SEQ ID NO: 942902 - RNA, 18 nt, Human
gagcuccuaacugaaugc

SEQ ID NO: 942903 - RNA, 21 nt, Human
gaggagggccucaggcccugc

SEQ ID NO: 942904 - RNA, 22 nt, Human
gaggcagcccugugggcgagca

SEQ ID NO: 942905 - RNA, 19 nt, Human
gagggucuacccauggacu

SEQ ID NO: 942906 - RNA, 19 nt, Human
gcacuugggguguaaaaag

SEQ ID NO: 942907 - RNA, 20 nt, Human
gcagaugcagguggugggcc

SEQ ID NO: 942908 - RNA, 21 nt, Human
gcagcacuugcuagugcugug

SEQ ID NO: 942909 - RNA, 28 nt, Human
gcagcccugugggcgagcaaccccaugc

SEQ ID NO: 942910 - RNA, 20 nt, Human
gcccaggggguguacacgcu

SEQ ID NO: 942911 - RNA, 18 nt, Human
gccgcuuccucauggccc

SEQ ID NO: 942912 - RNA, 21 nt, Human
gccuuuugaugccuuucuaga

SEQ ID NO: 942913 - RNA, 23 nt, Human
gcgcagcuggagcgcgggcagac

SEQ ID NO: 942914 - RNA, 23 nt, Human
gcgggguuuugaggcugcccagg

SEQ ID NO: 942915 - RNA, 21 nt, Human
gcucugugccuggcucuucug

SEQ ID NO: 942916 - RNA, 20 nt, Human
ggaagggcgagaagaggagg

SEQ ID NO: 942917 - RNA, 18 nt, Human
ggagggagggggccaaag

SEQ ID NO: 942918 - RNA, 24 nt, Human
ggcaaaagagagugaguuucuucc

SEQ ID NO: 942919 - RNA, 18 nt, Human
ggcacaggcuuugcccug

SEQ ID NO: 942920 - RNA, 25 nt, Human
ggccggggccgggccaggcgcagcu

SEQ ID NO: 942921 - RNA, 19 nt, Human
gggaagggcgagaagagga

SEQ ID NO: 942922 - RNA, 20 nt, Human
gggaagggcgagaagaggag

SEQ ID NO: 942923 - RNA, 19 nt, Human
gggcacaggcuuugcccug

SEQ ID NO: 942924 - RNA, 20 nt, Human
gggcacaggcuuugcccugc

SEQ ID NO: 942925 - RNA, 23 nt, Human
gggccgggccaggcgcagcugga

SEQ ID NO: 942926 - RNA, 18 nt, Human
gggcucacaaaccagaaa

SEQ ID NO: 942927 - RNA, 24 nt, Human
ggucagguccaugagggcagggau

SEQ ID NO: 942928 - RNA, 19 nt, Human
gucacucagcuucccguca

SEQ ID NO: 942929 - RNA, 22 nt, Human
gugcagagcacccggugucaag

SEQ ID NO: 942930 - RNA, 25 nt, Human
gugggcgagcaaccccaugcacuug

SEQ ID NO: 942931 - RNA, 23 nt, Human
uaaaauggacagaugaucucccc

SEQ ID NO: 942932 - RNA, 19 nt, Human
uacaguggugggucuuuug

SEQ ID NO: 942933 - RNA, 20 nt, Human
uacuaagcauuguaaggcuc

SEQ ID NO: 942934 - RNA, 19 nt, Human
uaggaacagaaaacaagac

SEQ ID NO: 942935 - RNA, 21 nt, Human
uaggcuaagagauguuucuga

SEQ ID NO: 942936 - RNA, 23 nt, Human
uagggagggagggggccaaaguc

SEQ ID NO: 942937 - RNA, 21 nt, Human
uauuucaaauuaggcuaagag

SEQ ID NO: 942938 - RNA, 23 nt, Human
ucacagcugcaaggacccagaaa

SEQ ID NO: 942939 - RNA, 20 nt, Human
ucacagguuaguuagcgcug

SEQ ID NO: 942940 - RNA, 20 nt, Human
ucacgagucuugugccaaaa

SEQ ID NO: 942941 - RNA, 18 nt, Human
ucagucuguugagccuuu

SEQ ID NO: 942942 - RNA, 23 nt, Human
ucagucuguugagccuuuugaug

SEQ ID NO: 942943 - RNA, 23 nt, Human
uccacaucuugcacuuucaucca

SEQ ID NO: 942944 - RNA, 18 nt, Human
uccaggacucuuccggcg

SEQ ID NO: 942945 - RNA, 25 nt, Human
uccccggggcuucgcuccuccgcgg

SEQ ID NO: 942946 - RNA, 19 nt, Human
uccggcguggucaagccuc

SEQ ID NO: 942947 - RNA, 18 nt, Human
uccugucucagaagggcu

SEQ ID NO: 942948 - RNA, 20 nt, Human
ucuaccgaaucaauccucca

SEQ ID NO: 942949 - RNA, 19 nt, Human
ucucagaguuaggcuaucc

SEQ ID NO: 942950 - RNA, 20 nt, Human
ucuccaggccacagggagcu

SEQ ID NO: 942951 - RNA, 18 nt, Human
ucucucaccaggcacagg

SEQ ID NO: 942952 - RNA, 19 nt, Human
ucugaccacugccccaaga

SEQ ID NO: 942953 - RNA, 19 nt, Human
ucugcagguaacauaaccu

SEQ ID NO: 942954 - RNA, 20 nt, Human
ucugggccaagcagccucua

SEQ ID NO: 942955 - RNA, 25 nt, Human
ugaaaaauacagcaacuugauacaa

SEQ ID NO: 942956 - RNA, 21 nt, Human
ugaaacauccagcccagaaac

SEQ ID NO: 942957 - RNA, 18 nt, Human
ugaaagaaaagacaaacu

SEQ ID NO: 942958 - RNA, 26 nt, Human
ugaaauuaaaaacagaaaccuaugga

SEQ ID NO: 942959 - RNA, 21 nt, Human
ugaacauuuguacacucugga

SEQ ID NO: 942960 - RNA, 21 nt, Human
ugacaaaacauguucaacuga

SEQ ID NO: 942961 - RNA, 23 nt, Human
ugacagguggaucccacacuggu

SEQ ID NO: 942962 - RNA, 19 nt, Human
ugagaugaugggggcacag

SEQ ID NO: 942963 - RNA, 21 nt, Human
ugagaugaugggggcacaggc

SEQ ID NO: 942964 - RNA, 18 nt, Human
ugcccaggacugcucuuc

SEQ ID NO: 942965 - RNA, 21 nt, Human
ugccuggcccucucugucuca

SEQ ID NO: 942966 - RNA, 19 nt, Human
ugcuagugcugugaaugaa

SEQ ID NO: 942967 - RNA, 19 nt, Human
uggaaaaacccaaggaaaa

SEQ ID NO: 942968 - RNA, 18 nt, Human
uggaauccuuggcgugcc

SEQ ID NO: 942969 - RNA, 21 nt, Human
uggagcagauacugugacagu

SEQ ID NO: 942970 - RNA, 18 nt, Human
uggcauggugggaagggc

SEQ ID NO: 942971 - RNA, 18 nt, Human
uggcauugucauucagcc

SEQ ID NO: 942972 - RNA, 21 nt, Human
uggcuccugcacagcugauca

SEQ ID NO: 942973 - RNA, 21 nt, Human
ugggucuuuuggucguuuuga

SEQ ID NO: 942974 - RNA, 24 nt, Human
uggugccugaaauucugagguuuu

SEQ ID NO: 942975 - RNA, 24 nt, Human
uguaaaaagccuguuccacagcug

SEQ ID NO: 942976 - RNA, 21 nt, Human
ugucaugagagucgcugggga

SEQ ID NO: 942977 - RNA, 19 nt, Human
ugugauucaugugaagagc

SEQ ID NO: 942978 - RNA, 28 nt, Human
uguuccacaucuugcacuuucauccaaa

SEQ ID NO: 942979 - RNA, 19 nt, Human
uuaguccuagggagagagg

SEQ ID NO: 942980 - RNA, 24 nt, Human
uuaguccuagggagagaggugagu

SEQ ID NO: 942981 - RNA, 24 nt, Human
uuaugaacauuuguacacucugga

SEQ ID NO: 942982 - RNA, 20 nt, Human
uucaaaccaacacugggaag

SEQ ID NO: 942983 - RNA, 22 nt, Human
uuccucagguuccacagccuua

SEQ ID NO: 942984 - RNA, 18 nt, Human
uuccugggagaggacgug

SEQ ID NO: 942985 - RNA, 18 nt, Human
uugacccuacucucucau

SEQ ID NO: 942986 - RNA, 22 nt, Human
uuggaaaacacauuuaauuuca

SEQ ID NO: 942987 - RNA, 23 nt, Human
uuggaaaacacauuuaauuucaa

SEQ ID NO: 942988 - RNA, 23 nt, Human
uuggugggccccacccuggcagu

SEQ ID NO: 942989 - RNA, 22 nt, Human
aaaaaacccaagccugggagug

SEQ ID NO: 942990 - RNA, 19 nt, Human
aaaccuauagaaaaaaccc

SEQ ID NO: 942991 - RNA, 18 nt, Human
agacagggagggcucaug

SEQ ID NO: 942992 - RNA, 22 nt, Human
agccugggaguguccuggggag

SEQ ID NO: 942993 - RNA, 19 nt, Human
agcuguuuccuccuuuggg

SEQ ID NO: 942994 - RNA, 21 nt, Human
agggaggaaaagggcggcugc

SEQ ID NO: 942995 - RNA, 18 nt, Human
aguaacuccaccugcaga

SEQ ID NO: 942996 - RNA, 22 nt, Human
aguauggggaaaccccugugcu

SEQ ID NO: 942997 - RNA, 22 nt, Human
caccaguaacaaugaugagcuu

SEQ ID NO: 942998 - RNA, 21 nt, Human
cacuggcugggaugcguuggg

SEQ ID NO: 942999 - RNA, 22 nt, Human
cagggucagcaccaccugccuc

SEQ ID NO: 943000 - RNA, 19 nt, Human
caggguccccucccugugg

SEQ ID NO: 943001 - RNA, 19 nt, Human
caguaacuccaccugcaga

SEQ ID NO: 943002 - RNA, 19 nt, Human
ccaaaccuauagaaaaaac

SEQ ID NO: 943003 - RNA, 18 nt, Human
ccaccaguaacaaugaug

SEQ ID NO: 943004 - RNA, 21 nt, Human
ccaccugccucugggaauagg

SEQ ID NO: 943005 - RNA, 24 nt, Human
ccaguaacaaugaugagcuuagcc

SEQ ID NO: 943006 - RNA, 21 nt, Human
ccaguaacaaugaugagcuuu

SEQ ID NO: 943007 - RNA, 19 nt, Human
cccaccaguaacaaugaug

SEQ ID NO: 943008 - RNA, 21 nt, Human
cccucagcuucucuggguucc

SEQ ID NO: 943009 - RNA, 22 nt, Human
cccucccuguggccccccgcca

SEQ ID NO: 943010 - RNA, 19 nt, Human
ccgcuaccgcccccucagc

SEQ ID NO: 943011 - RNA, 18 nt, Human
ccgcugggggguggcauc

SEQ ID NO: 943012 - RNA, 21 nt, Human
ccucccuguggccccccgcca

SEQ ID NO: 943013 - RNA, 19 nt, Human
ccugcugccagcuuuccuc

SEQ ID NO: 943014 - RNA, 21 nt, Human
cgccugcugccagcuuuccuc

SEQ ID NO: 943015 - RNA, 20 nt, Human
cuacccucuggccugggcag

SEQ ID NO: 943016 - RNA, 20 nt, Human
cuggggcagcgaugcccuuc

SEQ ID NO: 943017 - RNA, 19 nt, Human
gaaaaaacccaagccuggg

SEQ ID NO: 943018 - RNA, 22 nt, Human
gaggaaaagggcggcugcggcg

SEQ ID NO: 943019 - RNA, 20 nt, Human
gaguguccuggggaggggag

SEQ ID NO: 943020 - RNA, 21 nt, Human
gccugggaguguccuggggag

SEQ ID NO: 943021 - RNA, 21 nt, Human
gcgcggcugggaaggaggcgg

SEQ ID NO: 943022 - RNA, 19 nt, Human
gcggcgggaagaggcuggg

SEQ ID NO: 943023 - RNA, 18 nt, Human
gcguugggggaggaggcg

SEQ ID NO: 943024 - RNA, 23 nt, Human
gcucuacccucuggccugggcag

SEQ ID NO: 943025 - RNA, 21 nt, Human
ggaaaccccugugcucuaccc

SEQ ID NO: 943026 - RNA, 19 nt, Human
ggaggaggcgccugcugcc

SEQ ID NO: 943027 - RNA, 21 nt, Human
ggaggggagguaguaugggga

SEQ ID NO: 943028 - RNA, 22 nt, Human
ggaguguccuggggaggggagg

SEQ ID NO: 943029 - RNA, 18 nt, Human
ggcugggaaggaggcggu

SEQ ID NO: 943030 - RNA, 18 nt, Human
gggagggcucauggggaa

SEQ ID NO: 943031 - RNA, 23 nt, Human
gggaguguccuggggaggggagg

SEQ ID NO: 943032 - RNA, 18 nt, Human
gggcacacgcgcgggagu

SEQ ID NO: 943033 - RNA, 22 nt, Human
gggcagugcagacagggagggc

SEQ ID NO: 943034 - RNA, 20 nt, Human
ggggaggaggcgccugcugc

SEQ ID NO: 943035 - RNA, 20 nt, Human
ggucuggaggaagccgcgcg

SEQ ID NO: 943036 - RNA, 19 nt, Human
guggcauccaggguugggu

SEQ ID NO: 943037 - RNA, 18 nt, Human
uaagggagggaggaaaag

SEQ ID NO: 943038 - RNA, 18 nt, Human
uagaaaaaacccaagccu

SEQ ID NO: 943039 - RNA, 18 nt, Human
ucaccugcugguggccau

SEQ ID NO: 943040 - RNA, 26 nt, Human
ucaggguccccucccuguggcccccc

SEQ ID NO: 943041 - RNA, 22 nt, Human
uccaggguugggugcccggcuu

SEQ ID NO: 943042 - RNA, 19 nt, Human
ucgucgccgucgccgccgc

SEQ ID NO: 943043 - RNA, 24 nt, Human
ucgucgccgucgccgccgcuaccg

SEQ ID NO: 943044 - RNA, 24 nt, Human
ucgucgucgucgccgucgccgccg

SEQ ID NO: 943045 - RNA, 18 nt, Human
ucucuggguuccgcugcc

SEQ ID NO: 943046 - RNA, 23 nt, Human
ugcggcgggaagaggcugggcac

SEQ ID NO: 943047 - RNA, 19 nt, Human
ugcugguggccauugcucc

SEQ ID NO: 943048 - RNA, 20 nt, Human
uggcacuggcugggaugcgu

SEQ ID NO: 943049 - RNA, 18 nt, Human
uggcauccaggguugggu

SEQ ID NO: 943050 - RNA, 24 nt, Human
uggcauccaggguugggugcccgg

SEQ ID NO: 943051 - RNA, 23 nt, Human
uggcugggaugcguugggggagg

SEQ ID NO: 943052 - RNA, 21 nt, Human
uguccuggggaggggagguag

SEQ ID NO: 943053 - RNA, 19 nt, Human
uguuuccuccuuuggguua

SEQ ID NO: 943054 - RNA, 23 nt, Human
uuuugggauccaaucucuuuauu

SEQ ID NO: 943055 - RNA, 19 nt, Human
uuuuuuuuuuuugggaucc

SEQ ID NO: 943056 - RNA, 22 nt, Human
aaaaagugcaaaauuuguaauu

SEQ ID NO: 943057 - RNA, 19 nt, Human
aaacaaaaagugcaaaauu

SEQ ID NO: 943058 - RNA, 27 nt, Human
aaacagcuaaauaugcagguccaaaca

SEQ ID NO: 943059 - RNA, 20 nt, Human
aaacugccacauucacuccg

SEQ ID NO: 943060 - RNA, 20 nt, Human
aacauggcauaaaacuuccc

SEQ ID NO: 943061 - RNA, 20 nt, Human
aacauggcauaaaacuuccu

SEQ ID NO: 943062 - RNA, 19 nt, Human
aacuagacuucugacgcug

SEQ ID NO: 943063 - RNA, 21 nt, Human
aagaauucccaaccuccugcc

SEQ ID NO: 943064 - RNA, 24 nt, Human
aagcaucuaacauucaaacaaaaa

SEQ ID NO: 943065 - RNA, 19 nt, Human
aagugcuucccuaggugac

SEQ ID NO: 943066 - RNA, 20 nt, Human
aaugacaguaacaaacaaga

SEQ ID NO: 943067 - RNA, 25 nt, Human
acagcugccuauaaaacuagacuuc

SEQ ID NO: 943068 - RNA, 22 nt, Human
agccgacgccggcgcgagagca

SEQ ID NO: 943069 - RNA, 22 nt, Human
augaagguggagcaaacacugc

SEQ ID NO: 943070 - RNA, 18 nt, Human
auucugauucuaaagaaa

SEQ ID NO: 943071 - RNA, 19 nt, Human
caacuucacacuaagcauc

SEQ ID NO: 943072 - RNA, 21 nt, Human
caccauguaacccuucuaacc

SEQ ID NO: 943073 - RNA, 23 nt, Human
cacucaucuccuucagcauccca

SEQ ID NO: 943074 - RNA, 20 nt, Human
cacuccgaagcccacucauc

SEQ ID NO: 943075 - RNA, 22 nt, Human
ccacagauaaagcacauguucc

SEQ ID NO: 943076 - RNA, 24 nt, Human
cgcggcguuccuuccagaagcgcc

SEQ ID NO: 943077 - RNA, 19 nt, Human
cugauguuccauccuguuu

SEQ ID NO: 943078 - RNA, 22 nt, Human
cugcacuaauauuuacaccaug

SEQ ID NO: 943079 - RNA, 20 nt, Human
cugccauccacugauguucc

SEQ ID NO: 943080 - RNA, 26 nt, Human
cuuaaaauaucuauuugauauguaca

SEQ ID NO: 943081 - RNA, 22 nt, Human
gauuacuuuugccauaaaagaa

SEQ ID NO: 943082 - RNA, 18 nt, Human
gccgacgccggcgcgaga

SEQ ID NO: 943083 - RNA, 19 nt, Human
gccggcgcgagagcagggg

SEQ ID NO: 943084 - RNA, 25 nt, Human
gcugcaccgcugacaucacaggaca

SEQ ID NO: 943085 - RNA, 19 nt, Human
gcuugcguaucaacuucac

SEQ ID NO: 943086 - RNA, 22 nt, Human
uaaaacuagacuucugacgcug

SEQ ID NO: 943087 - RNA, 18 nt, Human
uaaaagcaaggcaauuca

SEQ ID NO: 943088 - RNA, 18 nt, Human
uaacagcaagaauuccca

SEQ ID NO: 943089 - RNA, 21 nt, Human
uaacauggcauaaaacuuccc

SEQ ID NO: 943090 - RNA, 18 nt, Human
uaauaaugagguggcaca

SEQ ID NO: 943091 - RNA, 19 nt, Human
uaauuauuuuuaacagcaa

SEQ ID NO: 943092 - RNA, 21 nt, Human
uagauaauaaugagguggcac

SEQ ID NO: 943093 - RNA, 18 nt, Human
uauaaaacuagacuucug

SEQ ID NO: 943094 - RNA, 21 nt, Human
ucccaaccuccugccauccac

SEQ ID NO: 943095 - RNA, 21 nt, Human
ucccuacuuuagugguuucca

SEQ ID NO: 943096 - RNA, 23 nt, Human
ucccuaggugacccuaccuagcc

SEQ ID NO: 943097 - RNA, 18 nt, Human
uccgcgcccguccgacug

SEQ ID NO: 943098 - RNA, 18 nt, Human
ugaauauugugaugugac

SEQ ID NO: 943099 - RNA, 18 nt, Human
ugacaguaacaaacaaga

SEQ ID NO: 943100 - RNA, 21 nt, Human
ugacauggcucaaauguacaa

SEQ ID NO: 943101 - RNA, 19 nt, Human
ugauauguacaaaccacau

SEQ ID NO: 943102 - RNA, 19 nt, Human
ugauucuaaagaaaaggaa

SEQ ID NO: 943103 - RNA, 24 nt, Human
ugggaaugacaguaacaaacaaga

SEQ ID NO: 943104 - RNA, 21 nt, Human
uguacaaaaauaaacauaggg

SEQ ID NO: 943105 - RNA, 24 nt, Human
uguuccauccuguuugagguucua

SEQ ID NO: 943106 - RNA, 22 nt, Human
uuagcuuaacugcacuaauauu

SEQ ID NO: 943107 - RNA, 19 nt, Human
uucuaaagaaaaggaaugg

SEQ ID NO: 943108 - RNA, 23 nt, Human
uucuacauuaaaacaugauuacu

SEQ ID NO: 943109 - RNA, 25 nt, Human
aagaauaaaaacaaaccgaaaaaga

SEQ ID NO: 943110 - RNA, 20 nt, Human
acaaaccgaaaaagaggggc

SEQ ID NO: 943111 - RNA, 24 nt, Human
acaaaccgaaaaagaggggcaggg

SEQ ID NO: 943112 - RNA, 18 nt, Human
acucguagcuccuucccu

SEQ ID NO: 943113 - RNA, 24 nt, Human
agaauaaaaacaaaccgaaaaaga

SEQ ID NO: 943114 - RNA, 22 nt, Human
cccgcccgcccgcucuucccuc

SEQ ID NO: 943115 - RNA, 23 nt, Human
cccgcccgcucuucccuccgccc

SEQ ID NO: 943116 - RNA, 22 nt, Human
cccgcucuucccuccgccccac

SEQ ID NO: 943117 - RNA, 23 nt, Human
cccuccgccccacgacccgaacc

SEQ ID NO: 943118 - RNA, 20 nt, Human
ccgcucuucccuccgcccca

SEQ ID NO: 943119 - RNA, 21 nt, Human
ccucccgcccgcccgcucuuc

SEQ ID NO: 943120 - RNA, 21 nt, Human
ccuccgccccacgacccgaac

SEQ ID NO: 943121 - RNA, 24 nt, Human
cgcggcggcggcggcggcucggcu

SEQ ID NO: 943122 - RNA, 21 nt, Human
cuccgccccacgacccgaacc

SEQ ID NO: 943123 - RNA, 19 nt, Human
gccccacgacccgaaccuc

SEQ ID NO: 943124 - RNA, 20 nt, Human
gcccgcccgcucuucccucc

SEQ ID NO: 943125 - RNA, 19 nt, Human
gcggcggcggcggcggcuc

SEQ ID NO: 943126 - RNA, 20 nt, Human
gcgucuggcgccggcgccuu

SEQ ID NO: 943127 - RNA, 22 nt, Human
ggcggcggcggcggcucggcug

SEQ ID NO: 943128 - RNA, 21 nt, Human
gggggcgcggcggcggcggcg

SEQ ID NO: 943129 - RNA, 21 nt, Human
ucccuuguaaaaaugaaagaa

SEQ ID NO: 943130 - RNA, 22 nt, Human
ucccuuguaaaaaugaaagaau

SEQ ID NO: 943131 - RNA, 18 nt, Human
ucgcuggcuccgcggccu

SEQ ID NO: 943132 - RNA, 19 nt, Human
ucgcuggcuccgcggccuc

SEQ ID NO: 943133 - RNA, 25 nt, Human
ucggcggcuacucguagcuccuucc

SEQ ID NO: 943134 - RNA, 24 nt, Human
aaaaacaguaagagcagaagccgg

SEQ ID NO: 943135 - RNA, 22 nt, Human
aaccgaugcaaugguugccaca

SEQ ID NO: 943136 - RNA, 19 nt, Human
aagcugcaugugauugcac

SEQ ID NO: 943137 - RNA, 24 nt, Human
aagcuuaaucaccaagacagaaug

SEQ ID NO: 943138 - RNA, 22 nt, Human
aauaaaaacaguaagagcagaa

SEQ ID NO: 943139 - RNA, 18 nt, Human
acccaggccauaagcagc

SEQ ID NO: 943140 - RNA, 21 nt, Human
agcagcuugccugacuucagg

SEQ ID NO: 943141 - RNA, 20 nt, Human
agcauuggccaccaaaaaua

SEQ ID NO: 943142 - RNA, 20 nt, Human
augaaagaacuucaucuaca

SEQ ID NO: 943143 - RNA, 21 nt, Human
augaaguuggauugcagugcu

SEQ ID NO: 943144 - RNA, 20 nt, Human
auuacaacugggugguuacu

SEQ ID NO: 943145 - RNA, 21 nt, Human
caaaauaucugauacuuuggu

SEQ ID NO: 943146 - RNA, 26 nt, Human
caaccgaugcaaugguugccacaaaa

SEQ ID NO: 943147 - RNA, 25 nt, Human
caauaauuuuuccucucagaagcuu

SEQ ID NO: 943148 - RNA, 21 nt, Human
cacccaggccauaagcagcag

SEQ ID NO: 943149 - RNA, 19 nt, Human
caugacacccaggccauaa

SEQ ID NO: 943150 - RNA, 22 nt, Human
ccauaaaucuucaggagucugu

SEQ ID NO: 943151 - RNA, 22 nt, Human
ccauuaauuuuuucuucugcaa

SEQ ID NO: 943152 - RNA, 21 nt, Human
cugggggucauuaucuuccga

SEQ ID NO: 943153 - RNA, 20 nt, Human
cuuccugcuguucaucauca

SEQ ID NO: 943154 - RNA, 23 nt, Human
cuuccugcuguucaucaucaagu

SEQ ID NO: 943155 - RNA, 20 nt, Human
gaaugauuuggggcagucuu

SEQ ID NO: 943156 - RNA, 22 nt, Human
gcccuuacccuuagaugaggau

SEQ ID NO: 943157 - RNA, 22 nt, Human
gcucgauaaccagggaaagcua

SEQ ID NO: 943158 - RNA, 21 nt, Human
gguaaaaucuuuuccuuauaa

SEQ ID NO: 943159 - RNA, 20 nt, Human
guaguacaggcuggagcccu

SEQ ID NO: 943160 - RNA, 19 nt, Human
gucccauuaauuuuuucuu

SEQ ID NO: 943161 - RNA, 20 nt, Human
uaaaaacaguaagagcagaa

SEQ ID NO: 943162 - RNA, 22 nt, Human
uaaaaacaguaagagcagaagc

SEQ ID NO: 943163 - RNA, 24 nt, Human
uaaaaacaguaagagcagaagcug

SEQ ID NO: 943164 - RNA, 20 nt, Human
uaacagagcuggaaucacug

SEQ ID NO: 943165 - RNA, 22 nt, Human
uaauaugggacaaauuuuucuu

SEQ ID NO: 943166 - RNA, 18 nt, Human
uaaugugugcaaaauauc

SEQ ID NO: 943167 - RNA, 21 nt, Human
uagcaacuccuguaaggcuuc

SEQ ID NO: 943168 - RNA, 21 nt, Human
uagccauggccuacuugaaca

SEQ ID NO: 943169 - RNA, 18 nt, Human
uaggaaugauuuggggca

SEQ ID NO: 943170 - RNA, 22 nt, Human
uauaaacaucacauucauccuc

SEQ ID NO: 943171 - RNA, 18 nt, Human
uccaaguguaguacaggc

SEQ ID NO: 943172 - RNA, 19 nt, Human
ucccuagugcugagauaca

SEQ ID NO: 943173 - RNA, 20 nt, Human
uccuguaaggcuuccugcug

SEQ ID NO: 943174 - RNA, 20 nt, Human
ucuacauauuuaaaugaagu

SEQ ID NO: 943175 - RNA, 23 nt, Human
ucugcaaccgaugcaaugguugc

SEQ ID NO: 943176 - RNA, 21 nt, Human
ucugcaauuauucugauuauu

SEQ ID NO: 943177 - RNA, 27 nt, Human
ucuguacuugaggcacgaccggggucc

SEQ ID NO: 943178 - RNA, 24 nt, Human
ucuucuauuguaucugcaaccgau

SEQ ID NO: 943179 - RNA, 24 nt, Human
ugaaagaacuucaucuacauuuac

SEQ ID NO: 943180 - RNA, 21 nt, Human
ugacauuuuuuuuuuguuuug

SEQ ID NO: 943181 - RNA, 23 nt, Human
ugagauacacauuccaaccauaa

SEQ ID NO: 943182 - RNA, 24 nt, Human
ugagauacacauuccaaccauaaa

SEQ ID NO: 943183 - RNA, 20 nt, Human
ugcacacuuaauaacuuuua

SEQ ID NO: 943184 - RNA, 23 nt, Human
ugcacaguccccacugucugccu

SEQ ID NO: 943185 - RNA, 23 nt, Human
ugcagagacaucucaaccuuuug

SEQ ID NO: 943186 - RNA, 23 nt, Human
ugccaugacacccaggccauaag

SEQ ID NO: 943187 - RNA, 27 nt, Human
ugccaugacacccaggccauaagcagc

SEQ ID NO: 943188 - RNA, 23 nt, Human
uggaaauugggugcaaaaucugu

SEQ ID NO: 943189 - RNA, 20 nt, Human
uggagcccuuacccuuagau

SEQ ID NO: 943190 - RNA, 18 nt, Human
uggccaccaaaaauaguc

SEQ ID NO: 943191 - RNA, 20 nt, Human
ugggugcaaaaucuguagcc

SEQ ID NO: 943192 - RNA, 26 nt, Human
uguucaucaucaaguugagauacaca

SEQ ID NO: 943193 - RNA, 24 nt, Human
uuaauagucccauuaauuuuuucu

SEQ ID NO: 943194 - RNA, 24 nt, Human
uuagcaacuccuguaaggcuuccu

SEQ ID NO: 943195 - RNA, 18 nt, Human
uuccucucagaagcuuga

SEQ ID NO: 943196 - RNA, 21 nt, Human
uuggaauuauuuggaccaauu

SEQ ID NO: 943197 - RNA, 20 nt, Human
uuggccaccaaaaauagucu

SEQ ID NO: 943198 - RNA, 21 nt, Human
uuucaccauacuauccaaaua

SEQ ID NO: 943199 - RNA, 21 nt, Human
uuuggucagaauauaaacauc

SEQ ID NO: 943200 - RNA, 20 nt, Human
uuuuaccacagugggacagc

SEQ ID NO: 943201 - RNA, 18 nt, Human
uuuugcaugguacguaac

SEQ ID NO: 943202 - RNA, 23 nt, Human
uuuuucaccauacuauccaaaua

SEQ ID NO: 943203 - RNA, 22 nt, Human
caccccccgccaccgucgccac

SEQ ID NO: 943204 - RNA, 18 nt, Human
caccugcggccacuugcu

SEQ ID NO: 943205 - RNA, 24 nt, Human
ccaccccccgccaccgucgccacc

SEQ ID NO: 943206 - RNA, 21 nt, Human
cccaccccccgccaccgucgc

SEQ ID NO: 943207 - RNA, 18 nt, Human
ccccccgccaccgucgcc

SEQ ID NO: 943208 - RNA, 21 nt, Human
cccccgccaccgucgccaccu

SEQ ID NO: 943209 - RNA, 21 nt, Human
ccccgccaccgucgccaccug

SEQ ID NO: 943210 - RNA, 19 nt, Human
ccccggaacaguaggccgg

SEQ ID NO: 943211 - RNA, 20 nt, Human
ccccggaacaguaggccgga

SEQ ID NO: 943212 - RNA, 20 nt, Human
ccuggauuaccucacacccc

SEQ ID NO: 943213 - RNA, 25 nt, Human
cgaccccuggauuaccucacacccc

SEQ ID NO: 943214 - RNA, 21 nt, Human
cucacaccccaccccccgcca

SEQ ID NO: 943215 - RNA, 21 nt, Human
cucacaccccaccccccgcca

SEQ ID NO: 943216 - RNA, 24 nt, Human
ggccggacugcagcuuuaguuuuc

SEQ ID NO: 943217 - RNA, 21 nt, Human
gucgccaccugcggccacuug

SEQ ID NO: 943218 - RNA, 23 nt, Human
uaccucacaccccaccccccgcc

SEQ ID NO: 943219 - RNA, 24 nt, Human
uaccucacaccccaccccccgcca

SEQ ID NO: 943220 - RNA, 22 nt, Human
ucagccuccucuuccgcgaccc

SEQ ID NO: 943221 - RNA, 20 nt, Human
uccccgggugggggcucccg

SEQ ID NO: 943222 - RNA, 18 nt, Human
ucucagccuccucuuccg

SEQ ID NO: 943223 - RNA, 20 nt, Human
uuaccucacaccccaccccc

SEQ ID NO: 943224 - RNA, 19 nt, Human
uuuugacccucucagccuc

SEQ ID NO: 943225 - RNA, 27 nt, Human
aaaaaaaaacaaaaaaacaacaacaaa

SEQ ID NO: 943226 - RNA, 22 nt, Human
aaaaaaaaacagagaaaccuca

SEQ ID NO: 943227 - RNA, 23 nt, Human
aaaaaaaaacagagaaaccucaa

SEQ ID NO: 943228 - RNA, 24 nt, Human
aaaaaaaacaaaaaaacaacaaca

SEQ ID NO: 943229 - RNA, 22 nt, Human
aaaaaaaacagagaaaccucaa

SEQ ID NO: 943230 - RNA, 27 nt, Human
aaaaaaaacagagaaaccucaaucaua

SEQ ID NO: 943231 - RNA, 19 nt, Human
aaaaaaacagagaaaccuc

SEQ ID NO: 943232 - RNA, 24 nt, Human
aaaaaacaaaaaaacaacaacaaa

SEQ ID NO: 943233 - RNA, 26 nt, Human
aaaaaacaaaaaaacaacaacaaaaa

SEQ ID NO: 943234 - RNA, 25 nt, Human
aaaaaacaacaacaaaaaaaaacac

SEQ ID NO: 943235 - RNA, 24 nt, Human
aaaaacaacaacaaaaaaaaacac

SEQ ID NO: 943236 - RNA, 23 nt, Human
aaaaacagaaucuuacaaaugug

SEQ ID NO: 943237 - RNA, 22 nt, Human
aaaaacauuugagaaagaacaa

SEQ ID NO: 943238 - RNA, 21 nt, Human
aaaaauuuuugaaugacaaaa

SEQ ID NO: 943239 - RNA, 24 nt, Human
aaaacaaaaaaacaacaacaaaaa

SEQ ID NO: 943240 - RNA, 26 nt, Human
aaaacaaaaaaacaacaacaaaaaag

SEQ ID NO: 943241 - RNA, 26 nt, Human
aaaagaaaaaacauuugagaaagaag

SEQ ID NO: 943242 - RNA, 18 nt, Human
aaacagaacaaaguucca

SEQ ID NO: 943243 - RNA, 21 nt, Human
aaacagaaucuuacaaaugug

SEQ ID NO: 943244 - RNA, 19 nt, Human
aaacuuagaagugccaaca

SEQ ID NO: 943245 - RNA, 19 nt, Human
aaaguagucuccugccuuu

SEQ ID NO: 943246 - RNA, 18 nt, Human
aacaaaaaaacaacaaca

SEQ ID NO: 943247 - RNA, 22 nt, Human
aacaaaaaaacaacaacaaaaa

SEQ ID NO: 943248 - RNA, 18 nt, Human
aacaaaaguacuuuauau

SEQ ID NO: 943249 - RNA, 19 nt, Human
aacacagugaaacccuguc

SEQ ID NO: 943250 - RNA, 20 nt, Human
aacacagugaaacccugucu

SEQ ID NO: 943251 - RNA, 21 nt, Human
aacacagugaaacccugucuc

SEQ ID NO: 943252 - RNA, 24 nt, Human
aacuguauuuuucaaauagccuag

SEQ ID NO: 943253 - RNA, 22 nt, Human
aauuauuuugcugacauuagaa

SEQ ID NO: 943254 - RNA, 23 nt, Human
acaaauuuuuuaaaagaaaagaa

SEQ ID NO: 943255 - RNA, 20 nt, Human
acagagcgagacuccaucuc

SEQ ID NO: 943256 - RNA, 22 nt, Human
accacuguacuccagcuugggc

SEQ ID NO: 943257 - RNA, 24 nt, Human
accacuguacuccagcuugggcga

SEQ ID NO: 943258 - RNA, 24 nt, Human
acccugucucuacuaaaaauacaa

SEQ ID NO: 943259 - RNA, 24 nt, Human
acuccauaacuuuuacugaaauaa

SEQ ID NO: 943260 - RNA, 22 nt, Human
acuccaucuccaaaaaaaaaca

SEQ ID NO: 943261 - RNA, 24 nt, Human
acuguacuccagcuugggcgacag

SEQ ID NO: 943262 - RNA, 26 nt, Human
acuguacuccagcuugggcgacagag

SEQ ID NO: 943263 - RNA, 22 nt, Human
agaaaagaaaaacauuacucau

SEQ ID NO: 943264 - RNA, 19 nt, Human
agagaacagcaaaugcaga

SEQ ID NO: 943265 - RNA, 19 nt, Human
agagauaaaaaaugugucc

SEQ ID NO: 943266 - RNA, 18 nt, Human
agaggaaggaauaggaug

SEQ ID NO: 943267 - RNA, 18 nt, Human
agaguauagagguaaaaa

SEQ ID NO: 943268 - RNA, 24 nt, Human
agcacuuugggaggcugaggcagg

SEQ ID NO: 943269 - RNA, 23 nt, Human
agccaggcgugguggugggugcc

SEQ ID NO: 943270 - RNA, 24 nt, Human
agccuguaaucccagcacuuuggg

SEQ ID NO: 943271 - RNA, 24 nt, Human
agcuugggcgacagagcgagacuc

SEQ ID NO: 943272 - RNA, 24 nt, Human
aggagcaguggcucaagccuguaa

SEQ ID NO: 943273 - RNA, 22 nt, Human
aggcaaagaaauuaacagucau

SEQ ID NO: 943274 - RNA, 19 nt, Human
aggcagagcuugcagugag

SEQ ID NO: 943275 - RNA, 22 nt, Human
aggcagaucaugaggucaggag

SEQ ID NO: 943276 - RNA, 18 nt, Human
aggcaggagaauggugug

SEQ ID NO: 943277 - RNA, 22 nt, Human
aggcaggagaauggugugaacc

SEQ ID NO: 943278 - RNA, 24 nt, Human
aggcaggagaauggugugaaccug

SEQ ID NO: 943279 - RNA, 24 nt, Human
aggcaggcagaucaugaggucagg

SEQ ID NO: 943280 - RNA, 21 nt, Human
aggcugaggcaggcagaucau

SEQ ID NO: 943281 - RNA, 19 nt, Human
agggaugacuucauuuacc

SEQ ID NO: 943282 - RNA, 24 nt, Human
agguacugaaaauuauccaauacu

SEQ ID NO: 943283 - RNA, 19 nt, Human
agguugaggcaggagaaug

SEQ ID NO: 943284 - RNA, 21 nt, Human
aguaaaaaaaaaaaaaaaaaa

SEQ ID NO: 943285 - RNA, 23 nt, Human
aguauuagaggcaguaguuagga

SEQ ID NO: 943286 - RNA, 18 nt, Human
agucccagccauucggga

SEQ ID NO: 943287 - RNA, 24 nt, Human
aguggcucaagccuguaaucccag

SEQ ID NO: 943288 - RNA, 25 nt, Human
aguuauggagucuugaguucuaaga

SEQ ID NO: 943289 - RNA, 25 nt, Human
auagagguaaaaaaaaaaacagaga

SEQ ID NO: 943290 - RNA, 18 nt, Human
auagaggucaagagaugg

SEQ ID NO: 943291 - RNA, 27 nt, Human
auagaggucaagagauggaaucaaaga

SEQ ID NO: 943292 - RNA, 23 nt, Human
aucaagaagagaguuuugguucu

SEQ ID NO: 943293 - RNA, 24 nt, Human
auugcaccacuguacuccagcuug

SEQ ID NO: 943294 - RNA, 27 nt, Human
caaaaaguuaccagaauuuuagcaaua

SEQ ID NO: 943295 - RNA, 24 nt, Human
caagaccauccuggcuaacacagu

SEQ ID NO: 943296 - RNA, 21 nt, Human
caaggauugcgcagguacuga

SEQ ID NO: 943297 - RNA, 19 nt, Human
cacuguacuccagcuuggg

SEQ ID NO: 943298 - RNA, 20 nt, Human
cacuguacuccagcuugggc

SEQ ID NO: 943299 - RNA, 21 nt, Human
cacuguacuccagcuugggcg

SEQ ID NO: 943300 - RNA, 22 nt, Human
cacuguacuccagcuugggcga

SEQ ID NO: 943301 - RNA, 23 nt, Human
cacuguacuccagcuugggcgac

SEQ ID NO: 943302 - RNA, 24 nt, Human
cacuguacuccagcuugggcgaca

SEQ ID NO: 943303 - RNA, 24 nt, Human
cagcacuuugggaggcugaggcag

SEQ ID NO: 943304 - RNA, 25 nt, Human
cagcacuuugggaggcugaggcagg

SEQ ID NO: 943305 - RNA, 24 nt, Human
cagccauucgggagguugaggcag

SEQ ID NO: 943306 - RNA, 18 nt, Human
cagcuuacuggggaaagu

SEQ ID NO: 943307 - RNA, 22 nt, Human
caggcagaucaugaggucagga

SEQ ID NO: 943308 - RNA, 22 nt, Human
caggugacauuagagaaaaaga

SEQ ID NO: 943309 - RNA, 20 nt, Human
caguaguuaggaauagauac

SEQ ID NO: 943310 - RNA, 18 nt, Human
caguguccaccaaagucu

SEQ ID NO: 943311 - RNA, 23 nt, Human
caucaaaauaauucacuucaaca

SEQ ID NO: 943312 - RNA, 20 nt, Human
ccacuguacuccagcuuggg

SEQ ID NO: 943313 - RNA, 20 nt, Human
ccacuguacuccagcuuggg

SEQ ID NO: 943314 - RNA, 21 nt, Human
ccacuguacuccagcuugggc

SEQ ID NO: 943315 - RNA, 21 nt, Human
ccacuguacuccagcuugggc

SEQ ID NO: 943316 - RNA, 23 nt, Human
ccacuguacuccagcuugggcga

SEQ ID NO: 943317 - RNA, 24 nt, Human
ccacuguacuccagcuugggcgac

SEQ ID NO: 943318 - RNA, 20 nt, Human
ccagaagcaaaaggaguugg

SEQ ID NO: 943319 - RNA, 19 nt, Human
ccaggagcaguggcucaag

SEQ ID NO: 943320 - RNA, 19 nt, Human
ccaggagcaguggcucaag

SEQ ID NO: 943321 - RNA, 22 nt, Human
ccaucuccaaaaaaaaacaaaa

SEQ ID NO: 943322 - RNA, 20 nt, Human
cccauuauacuuccauuuug

SEQ ID NO: 943323 - RNA, 22 nt, Human
ccuccagguaggaagaacaaag

SEQ ID NO: 943324 - RNA, 21 nt, Human
ccugcaagcaucugauuuuac

SEQ ID NO: 943325 - RNA, 22 nt, Human
ccuggcuaacacagugaaaccc

SEQ ID NO: 943326 - RNA, 24 nt, Human
ccuggcuaacacagugaaacccug

SEQ ID NO: 943327 - RNA, 20 nt, Human
ccuguaaucccagcacuuug

SEQ ID NO: 943328 - RNA, 22 nt, Human
ccuguagucccagccauucggg

SEQ ID NO: 943329 - RNA, 24 nt, Human
cgagacuccaucuccaaaaaaaaa

SEQ ID NO: 943330 - RNA, 24 nt, Human
cgauauguuuuccaagugaauaua

SEQ ID NO: 943331 - RNA, 26 nt, Human
cgcggccgcgucgacguaccaauacc

SEQ ID NO: 943332 - RNA, 19 nt, Human
cuaaaaauacaaaaaguua

SEQ ID NO: 943333 - RNA, 20 nt, Human
cuagaaaauuguccccccac

SEQ ID NO: 943334 - RNA, 24 nt, Human
cucaagccuguaaucccagcacuu

SEQ ID NO: 943335 - RNA, 23 nt, Human
cuccaaaaaaaaacaaaaaaaca

SEQ ID NO: 943336 - RNA, 25 nt, Human
cuccaaaaaaaaacaaaaaaacaac

SEQ ID NO: 943337 - RNA, 18 nt, Human
cugaagcaggagcauuca

SEQ ID NO: 943338 - RNA, 23 nt, Human
cugaccucagagaaauauaacac

SEQ ID NO: 943339 - RNA, 24 nt, Human
cugaccucagagaaauauaacaca

SEQ ID NO: 943340 - RNA, 18 nt, Human
cuggcuaacacagugaaa

SEQ ID NO: 943341 - RNA, 24 nt, Human
cuggcuaacacagugaaacccugu

SEQ ID NO: 943342 - RNA, 18 nt, Human
gaaaauguugacucagau

SEQ ID NO: 943343 - RNA, 19 nt, Human
gaaacccugucucuacuaa

SEQ ID NO: 943344 - RNA, 20 nt, Human
gaaccugggaggcagagcuu

SEQ ID NO: 943345 - RNA, 21 nt, Human
gacccauaacuccauaacuuu

SEQ ID NO: 943346 - RNA, 23 nt, Human
gagauugcaccacuguacuccag

SEQ ID NO: 943347 - RNA, 25 nt, Human
gcggccgcgucgacguaccaauacc

SEQ ID NO: 943348 - RNA, 24 nt, Human
gcuaacacagugaaacccugucuc

SEQ ID NO: 943349 - RNA, 23 nt, Human
ggcaggcagaucaugaggucagg

SEQ ID NO: 943350 - RNA, 21 nt, Human
ggcuucaauuugaagccuaag

SEQ ID NO: 943351 - RNA, 25 nt, Human
guaaaaaaaaaaaaaaaaaaccggu

SEQ ID NO: 943352 - RNA, 26 nt, Human
guaaaaaaaaaaaaaaaaaaccgguu

SEQ ID NO: 943353 - RNA, 18 nt, Human
guaaauauuaacacugcu

SEQ ID NO: 943354 - RNA, 24 nt, Human
guacuccagcuugggcgacagagc

SEQ ID NO: 943355 - RNA, 25 nt, Human
guuauuugagcaggacccuucuguu

SEQ ID NO: 943356 - RNA, 22 nt, Human
guuuacuucuugcuuaguggag

SEQ ID NO: 943357 - RNA, 28 nt, Human
uaaaaagagacauaagaguauagaggua

SEQ ID NO: 943358 - RNA, 22 nt, Human
uaaacacaguauacaaaagccu

SEQ ID NO: 943359 - RNA, 25 nt, Human
uaaacagaacaaaguuccaaccuac

SEQ ID NO: 943360 - RNA, 23 nt, Human
uaaacagaagccuaucuuuugaa

SEQ ID NO: 943361 - RNA, 21 nt, Human
uaaagugccaaaguucugucu

SEQ ID NO: 943362 - RNA, 22 nt, Human
uaacaaguuaguaauuaguauu

SEQ ID NO: 943363 - RNA, 21 nt, Human
uaacacagugaaacccugucu

SEQ ID NO: 943364 - RNA, 22 nt, Human
uaacacagugaaacccugucuc

SEQ ID NO: 943365 - RNA, 24 nt, Human
uaacacagugaaacccugucucua

SEQ ID NO: 943366 - RNA, 24 nt, Human
uaacauacaaaaaguaaaacuuag

SEQ ID NO: 943367 - RNA, 18 nt, Human
uaccuuaauauagucugg

SEQ ID NO: 943368 - RNA, 22 nt, Human
uacuccagcuugggcgacagag

SEQ ID NO: 943369 - RNA, 24 nt, Human
uacuccagcuugggcgacagagcg

SEQ ID NO: 943370 - RNA, 21 nt, Human
uacuggauguuggccaggagc

SEQ ID NO: 943371 - RNA, 18 nt, Human
uagaaaaucaaauccuuc

SEQ ID NO: 943372 - RNA, 22 nt, Human
uagagaaaacagaaguacuuac

SEQ ID NO: 943373 - RNA, 26 nt, Human
uagagguaaaaaaaaaaacagagaaa

SEQ ID NO: 943374 - RNA, 21 nt, Human
uagcauuaguaacaaguuagu

SEQ ID NO: 943375 - RNA, 19 nt, Human
uaguaaaaaaaaaaaaaaa

SEQ ID NO: 943376 - RNA, 26 nt, Human
uaguaguaaaaaaaaaaaaaaaaaac

SEQ ID NO: 943377 - RNA, 21 nt, Human
uauagagguaaaaaaaaaaac

SEQ ID NO: 943378 - RNA, 20 nt, Human
ucaacaucuaauuucucagg

SEQ ID NO: 943379 - RNA, 21 nt, Human
ucacucaaugcuccuuugaaa

SEQ ID NO: 943380 - RNA, 18 nt, Human
ucacuggcucaacuguau

SEQ ID NO: 943381 - RNA, 18 nt, Human
ucaugaggucaggagauc

SEQ ID NO: 943382 - RNA, 24 nt, Human
ucaugaggucaggagaucaagacc

SEQ ID NO: 943383 - RNA, 22 nt, Human
ucauggaauauucaagguacaa

SEQ ID NO: 943384 - RNA, 24 nt, Human
ucauuugaagacaaacaggguuac

SEQ ID NO: 943385 - RNA, 18 nt, Human
uccagcuugggcgacaga

SEQ ID NO: 943386 - RNA, 23 nt, Human
uccagcuugggcgacagagcgag

SEQ ID NO: 943387 - RNA, 24 nt, Human
uccagcuugggcgacagagcgaga

SEQ ID NO: 943388 - RNA, 21 nt, Human
uccagguaggaagaacaaaga

SEQ ID NO: 943389 - RNA, 23 nt, Human
uccagguaggaagaacaaagaaa

SEQ ID NO: 943390 - RNA, 19 nt, Human
uccaucuccaaaaaaaaac

SEQ ID NO: 943391 - RNA, 23 nt, Human
ucuccugccuuuagcugaaaauc

SEQ ID NO: 943392 - RNA, 21 nt, Human
ucucuacuaaaaauacaaaaa

SEQ ID NO: 943393 - RNA, 19 nt, Human
ucugcucugucaccaccug

SEQ ID NO: 943394 - RNA, 20 nt, Human
ucugcucugucaccaccugg

SEQ ID NO: 943395 - RNA, 24 nt, Human
ugaaauaccacucaugcauuuguu

SEQ ID NO: 943396 - RNA, 18 nt, Human
ugacucagauguuuuucc

SEQ ID NO: 943397 - RNA, 21 nt, Human
ugagagaacagcaaaugcaga

SEQ ID NO: 943398 - RNA, 19 nt, Human
ugaggaagacagaaaacaa

SEQ ID NO: 943399 - RNA, 21 nt, Human
ugaggaagacagaaaacaaug

SEQ ID NO: 943400 - RNA, 23 nt, Human
ugaggcaggagaauggugugaac

SEQ ID NO: 943401 - RNA, 24 nt, Human
ugaggcaggagaauggugugaacc

SEQ ID NO: 943402 - RNA, 25 nt, Human
ugaggcaggagaauggugugaaccu

SEQ ID NO: 943403 - RNA, 18 nt, Human
ugaggcaggcagaucaug

SEQ ID NO: 943404 - RNA, 24 nt, Human
ugaggcaggcagaucaugagguca

SEQ ID NO: 943405 - RNA, 18 nt, Human
ugagguaucgagccaaaa

SEQ ID NO: 943406 - RNA, 19 nt, Human
ugauuuaaauaaaagaaaa

SEQ ID NO: 943407 - RNA, 22 nt, Human
ugcaccacuguacuccagcuug

SEQ ID NO: 943408 - RNA, 23 nt, Human
ugccuguagucccagccauucgg

SEQ ID NO: 943409 - RNA, 24 nt, Human
ugccuguagucccagccauucggg

SEQ ID NO: 943410 - RNA, 22 nt, Human
ugcuauaaaaagagacauaaga

SEQ ID NO: 943411 - RNA, 19 nt, Human
ugcugggaccucacagugu

SEQ ID NO: 943412 - RNA, 19 nt, Human
ugcuucaacuguuacaggc

SEQ ID NO: 943413 - RNA, 20 nt, Human
ugcuucaacuguuacaggcc

SEQ ID NO: 943414 - RNA, 22 nt, Human
uggcucaagccuguaaucccag

SEQ ID NO: 943415 - RNA, 24 nt, Human
uggcucaagccuguaaucccagca

SEQ ID NO: 943416 - RNA, 26 nt, Human
uggcugaccucagagaaauauaacac

SEQ ID NO: 943417 - RNA, 20 nt, Human
ugggaggcugaggcaggcag

SEQ ID NO: 943418 - RNA, 24 nt, Human
ugggaggcugaggcaggcagauca

SEQ ID NO: 943419 - RNA, 20 nt, Human
ugggcgacagagcgagacuc

SEQ ID NO: 943420 - RNA, 18 nt, Human
uggggguggacuggggga

SEQ ID NO: 943421 - RNA, 24 nt, Human
ugguggugggugccuguaguccca

SEQ ID NO: 943422 - RNA, 19 nt, Human
uguagaaaaucaaauccuu

SEQ ID NO: 943423 - RNA, 21 nt, Human
uguagaaaaucaaauccuuca

SEQ ID NO: 943424 - RNA, 20 nt, Human
uguguaaacacaguauacaa

SEQ ID NO: 943425 - RNA, 21 nt, Human
uguuucaacaucuaauuucuc

SEQ ID NO: 943426 - RNA, 22 nt, Human
uuaaaugcucauuaaaaacuug

SEQ ID NO: 943427 - RNA, 20 nt, Human
uuagaagacacagccucaag

SEQ ID NO: 943428 - RNA, 20 nt, Human
uuagaugcuucaacuguuac

SEQ ID NO: 943429 - RNA, 21 nt, Human
uuagccaggcguggugguggg

SEQ ID NO: 943430 - RNA, 24 nt, Human
uuaggcuccuucucuaaauccuga

SEQ ID NO: 943431 - RNA, 19 nt, Human
uucaacaaaugguaauuac

SEQ ID NO: 943432 - RNA, 21 nt, Human
uucugcucugucaccaccugg

SEQ ID NO: 943433 - RNA, 22 nt, Human
uucugcucugucaccaccuggg

SEQ ID NO: 943434 - RNA, 23 nt, Human
uugcaccacuguacuccagcuug

SEQ ID NO: 943435 - RNA, 23 nt, Human
uugcugggaccucacaguguucu

SEQ ID NO: 943436 - RNA, 25 nt, Human
uugggaggcugaggcaggcagauca

SEQ ID NO: 943437 - RNA, 21 nt, Human
uuuauccuaagcgauauguuu

SEQ ID NO: 943438 - RNA, 21 nt, Human
uuuuccaaaaauauuaaccaa

SEQ ID NO: 943439 - RNA, 23 nt, Human
aaaaaaaaaaaaaaaagaaagaa

SEQ ID NO: 943440 - RNA, 24 nt, Human
aaaaaaauacuaccauucuccccc

SEQ ID NO: 943441 - RNA, 19 nt, Human
aaaaaacaaaaacaaaagg

SEQ ID NO: 943442 - RNA, 23 nt, Human
aaaaaauacuaccauucuccccc

SEQ ID NO: 943443 - RNA, 25 nt, Human
aaaaauaauaugaaaggggagccgg

SEQ ID NO: 943444 - RNA, 24 nt, Human
aaaagaaagaaaauagaaaaaaaa

SEQ ID NO: 943445 - RNA, 24 nt, Human
aaaagggaaacaaauucauugcaa

SEQ ID NO: 943446 - RNA, 22 nt, Human
aaacaaaaggcuaaacuuaaaa

SEQ ID NO: 943447 - RNA, 18 nt, Human
aaagaaagaaaauagaaa

SEQ ID NO: 943448 - RNA, 21 nt, Human
aacagguaauuaaaaaauuua

SEQ ID NO: 943449 - RNA, 22 nt, Human
aaccaaaaaacaaaaacaaaag

SEQ ID NO: 943450 - RNA, 22 nt, Human
aagaaagaaaauagaaaaaaaa

SEQ ID NO: 943451 - RNA, 21 nt, Human
aagcaaaaaaaagggaaacaa

SEQ ID NO: 943452 - RNA, 32 nt, Human
acacauacacacacacaccauaguacacacgg

SEQ ID NO: 943453 - RNA, 22 nt, Human
agaaagaaaauagaaaaaaaaa

SEQ ID NO: 943454 - RNA, 27 nt, Human
agaaagaaaauagaaaaaaagggaccc

SEQ ID NO: 943455 - RNA, 22 nt, Human
agacauccucagaaucgcaauc

SEQ ID NO: 943456 - RNA, 19 nt, Human
agguaaacaaaauagauuu

SEQ ID NO: 943457 - RNA, 20 nt, Human
agucuuuguacuguauuuuu

SEQ ID NO: 943458 - RNA, 21 nt, Human
aguucagaugugcaauacuuc

SEQ ID NO: 943459 - RNA, 26 nt, Human
auacacacacacaccauaguacacag

SEQ ID NO: 943460 - RNA, 25 nt, Human
caaaaacaaaaggcuaaacuuaaaa

SEQ ID NO: 943461 - RNA, 21 nt, Human
caaaaucagggagaaacguac

SEQ ID NO: 943462 - RNA, 20 nt, Human
caaagcaagaaauaaaucac

SEQ ID NO: 943463 - RNA, 24 nt, Human
caaagcaagaaauaaaucacauuu

SEQ ID NO: 943464 - RNA, 18 nt, Human
caaccaaaaaacaaaaac

SEQ ID NO: 943465 - RNA, 23 nt, Human
caaccaaaaaacaaaaacaaaag

SEQ ID NO: 943466 - RNA, 19 nt, Human
caagaauccaacuuugcau

SEQ ID NO: 943467 - RNA, 20 nt, Human
caagacacccuggccaaugc

SEQ ID NO: 943468 - RNA, 21 nt, Human
cacacacacaccacacacaua

SEQ ID NO: 943469 - RNA, 23 nt, Human
cacacacacaccacacacauaca

SEQ ID NO: 943470 - RNA, 22 nt, Human
cacagcugauaaaaaaaaaaaa

SEQ ID NO: 943471 - RNA, 23 nt, Human
caccacacacauacacacacaca

SEQ ID NO: 943472 - RNA, 26 nt, Human
caccacacacauacacacacacaccc

SEQ ID NO: 943473 - RNA, 25 nt, Human
cacccuucccccccauuuuuuuucc

SEQ ID NO: 943474 - RNA, 22 nt, Human
caccuucucucccuccuuuuca

SEQ ID NO: 943475 - RNA, 23 nt, Human
cagcagacacuuucuggcacccc

SEQ ID NO: 943476 - RNA, 22 nt, Human
cagcuacuccuggaaaagaagg

SEQ ID NO: 943477 - RNA, 27 nt, Human
caggaccggacacccccucgggcacag

SEQ ID NO: 943478 - RNA, 22 nt, Human
ccaaaaaaaaaaaaaaaaaaaa

SEQ ID NO: 943479 - RNA, 23 nt, Human
ccaaaaaaaaaaaaaaaaaaaaa

SEQ ID NO: 943480 - RNA, 23 nt, Human
ccaaaaucagggagaaacguaca

SEQ ID NO: 943481 - RNA, 23 nt, Human
ccaaccaaaaaacaaaaacaaaa

SEQ ID NO: 943482 - RNA, 21 nt, Human
ccacacacauacacacacaca

SEQ ID NO: 943483 - RNA, 26 nt, Human
ccacacacauacacacacacaccaua

SEQ ID NO: 943484 - RNA, 24 nt, Human
cccccucgggcacaggguggaggc

SEQ ID NO: 943485 - RNA, 23 nt, Human
cccuuugauacaguagguaaaca

SEQ ID NO: 943486 - RNA, 23 nt, Human
cgaaaaugugcagaucuguaaca

SEQ ID NO: 943487 - RNA, 20 nt, Human
cgccgcgccugccgcggccc

SEQ ID NO: 943488 - RNA, 24 nt, Human
cggcuguugaccaaaaaaaaaaaa

SEQ ID NO: 943489 - RNA, 20 nt, Human
cucaaagcaagaaauaaauc

SEQ ID NO: 943490 - RNA, 21 nt, Human
cucccccagacuccccuuuga

SEQ ID NO: 943491 - RNA, 18 nt, Human
cucccuccuuuucaucca

SEQ ID NO: 943492 - RNA, 23 nt, Human
cuccuggaaaagaaggaaaaaaa

SEQ ID NO: 943493 - RNA, 22 nt, Human
cugccaaccaaaaaacaaaaac

SEQ ID NO: 943494 - RNA, 22 nt, Human
cugccgcggccccgucggggcu

SEQ ID NO: 943495 - RNA, 20 nt, Human
cugcuccuucauaugguucu

SEQ ID NO: 943496 - RNA, 21 nt, Human
cuggacuucucuuccccuucc

SEQ ID NO: 943497 - RNA, 19 nt, Human
cuuccucuccuccugcucc

SEQ ID NO: 943498 - RNA, 21 nt, Human
cuuggcggcuggacuucucuu

SEQ ID NO: 943499 - RNA, 21 nt, Human
gaaaauaauaaagaaauucac

SEQ ID NO: 943500 - RNA, 19 nt, Human
gaaauaugcaucaaccaag

SEQ ID NO: 943501 - RNA, 20 nt, Human
gaacccgaucuuaauuucca

SEQ ID NO: 943502 - RNA, 22 nt, Human
gaacccgaucuuaauuuccagc

SEQ ID NO: 943503 - RNA, 21 nt, Human
gaauagcagauucugggauau

SEQ ID NO: 943504 - RNA, 19 nt, Human
gagcuaaauaccugaaaau

SEQ ID NO: 943505 - RNA, 20 nt, Human
gcacaggguggaggcagggg

SEQ ID NO: 943506 - RNA, 20 nt, Human
gccaaccaaaaaacaaaaac

SEQ ID NO: 943507 - RNA, 18 nt, Human
gcccugaaucacauuuac

SEQ ID NO: 943508 - RNA, 19 nt, Human
gccgcggccccgucggggc

SEQ ID NO: 943509 - RNA, 28 nt, Human
gcuguugaccaaaaaaaaaaaaaaaaaa

SEQ ID NO: 943510 - RNA, 20 nt, Human
gggaaggcugggcuuggcgg

SEQ ID NO: 943511 - RNA, 23 nt, Human
ggguggaggcaggggacgccggc

SEQ ID NO: 943512 - RNA, 19 nt, Human
guacacacgaaaaugugca

SEQ ID NO: 943513 - RNA, 18 nt, Human
gugcgcagagcgcggccg

SEQ ID NO: 943514 - RNA, 19 nt, Human
uaaaacacacacacaccac

SEQ ID NO: 943515 - RNA, 18 nt, Human
uaaaaucgguuacugcca

SEQ ID NO: 943516 - RNA, 27 nt, Human
uaaacaaaaugaagcaaaaaaaaggga

SEQ ID NO: 943517 - RNA, 21 nt, Human
uaacaagaauccaacuuugca

SEQ ID NO: 943518 - RNA, 22 nt, Human
uagaaaaaaaaaaaaaaaaacc

SEQ ID NO: 943519 - RNA, 20 nt, Human
ucacuaaacaacaggcccua

SEQ ID NO: 943520 - RNA, 21 nt, Human
ucagucaugggguugcccuuc

SEQ ID NO: 943521 - RNA, 20 nt, Human
uccaacuuugcauagacauc

SEQ ID NO: 943522 - RNA, 21 nt, Human
uccacaaauaucagcagacac

SEQ ID NO: 943523 - RNA, 25 nt, Human
ucccaagacacccuggccaaugcaa

SEQ ID NO: 943524 - RNA, 21 nt, Human
ucgccgcgccugccgcggccc

SEQ ID NO: 943525 - RNA, 22 nt, Human
ucugcagacacaggggugcugg

SEQ ID NO: 943526 - RNA, 20 nt, Human
ucuuccucuccuccugcucc

SEQ ID NO: 943527 - RNA, 23 nt, Human
ugaagagacaaugauuaaacgca

SEQ ID NO: 943528 - RNA, 20 nt, Human
ugcagaucuguaacauuuuu

SEQ ID NO: 943529 - RNA, 22 nt, Human
ugccaaccaaaaaacaaaaaca

SEQ ID NO: 943530 - RNA, 27 nt, Human
ugccaaccaaaaaacaaaaacaaaagg

SEQ ID NO: 943531 - RNA, 22 nt, Human
uggaacagcugaguuuugaagg

SEQ ID NO: 943532 - RNA, 20 nt, Human
uggaacuagaaaaacggcug

SEQ ID NO: 943533 - RNA, 19 nt, Human
uggcagaaaaggaacccga

SEQ ID NO: 943534 - RNA, 18 nt, Human
uggugggugucaagcugc

SEQ ID NO: 943535 - RNA, 24 nt, Human
uguugaccaaaaaaaaaaaaaaaa

SEQ ID NO: 943536 - RNA, 22 nt, Human
uuaaaacuuggaacuagaaaaa

SEQ ID NO: 943537 - RNA, 18 nt, Human
uuaaaagucuuaaaauga

SEQ ID NO: 943538 - RNA, 23 nt, Human
uuacugccaaccaaaaaacaaaa

SEQ ID NO: 943539 - RNA, 23 nt, Human
uugaaggcacucugcagacacag

SEQ ID NO: 943540 - RNA, 23 nt, Human
uugaccaaaaaaaaaaaaaaaaa

SEQ ID NO: 943541 - RNA, 21 nt, Human
uugcuucuggaggaacacccu

SEQ ID NO: 943542 - RNA, 22 nt, Human
uuucauccacccuuccccccca

SEQ ID NO: 943543 - RNA, 21 nt, Human
uuugugcgcagagcgcggccg

SEQ ID NO: 943544 - RNA, 20 nt, Human
uuuuccaggcugaaacuuuu

SEQ ID NO: 943545 - RNA, 22 nt, Human
uuuugugcgcagagcgcggccg

SEQ ID NO: 943546 - RNA, 19 nt, Human
cccacgcagcgcuagaccg

SEQ ID NO: 943547 - RNA, 19 nt, Human
ucuauacauacaaaguaca

SEQ ID NO: 943548 - RNA, 18 nt, Human
uuuuuuuuuuuuuuuuug

SEQ ID NO: 943549 - RNA, 21 nt, Human
agagcagcuuuauuaucaugg

SEQ ID NO: 943550 - RNA, 21 nt, Human
cacccgcagcgguccuggagg

SEQ ID NO: 943551 - RNA, 18 nt, Human
ccacccgcagcgguccug

SEQ ID NO: 943552 - RNA, 23 nt, Human
ccacccgcagcgguccuggaggc

SEQ ID NO: 943553 - RNA, 22 nt, Human
cccugcgccuggaggucucccc

SEQ ID NO: 943554 - RNA, 18 nt, Human
cccuggccguccuucccu

SEQ ID NO: 943555 - RNA, 20 nt, Human
ccuggaggcaccacgcagcu

SEQ ID NO: 943556 - RNA, 24 nt, Human
cgccuggaggucuccccugaccgu

SEQ ID NO: 943557 - RNA, 26 nt, Human
cgccuggaggucuccccugaccgucc

SEQ ID NO: 943558 - RNA, 23 nt, Human
cguccuucccugcgccuggaggu

SEQ ID NO: 943559 - RNA, 25 nt, Human
cugcgccuggaggucuccccugacc

SEQ ID NO: 943560 - RNA, 24 nt, Human
cuggggauagaacggguuccucuc

SEQ ID NO: 943561 - RNA, 18 nt, Human
ggggauagaacggguucc

SEQ ID NO: 943562 - RNA, 21 nt, Human
gggggcuggggucuuccacug

SEQ ID NO: 943563 - RNA, 18 nt, Human
uagaacggguuccucucc

SEQ ID NO: 943564 - RNA, 25 nt, Human
uccuucccugcgccuggaggucucc

SEQ ID NO: 943565 - RNA, 21 nt, Human
ugggggcuggggucuuccacu

SEQ ID NO: 943566 - RNA, 21 nt, Human
uuuugggagagcagcuuuauu

SEQ ID NO: 943567 - RNA, 24 nt, Human
uuuuuuuuuuuugggagagcagcu

SEQ ID NO: 943568 - RNA, 24 nt, Human
uuuuuuuuuuuuuuuuuuuuuggg

SEQ ID NO: 943569 - RNA, 21 nt, Human
aaaauagcaauaaucaaaaag

SEQ ID NO: 943570 - RNA, 23 nt, Human
aaacagugaauccccaaaucaga

SEQ ID NO: 943571 - RNA, 18 nt, Human
aacagcuuuugucugugu

SEQ ID NO: 943572 - RNA, 19 nt, Human
aaguagcaacauucuguaa

SEQ ID NO: 943573 - RNA, 23 nt, Human
aauagcaauaaucaaaaagguaa

SEQ ID NO: 943574 - RNA, 26 nt, Human
acuuuacuuccuguaacaacugcagu

SEQ ID NO: 943575 - RNA, 25 nt, Human
agagaagacucccaucugcuguaga

SEQ ID NO: 943576 - RNA, 19 nt, Human
aguuuugaugcaacagcuu

SEQ ID NO: 943577 - RNA, 28 nt, Human
ccugaaaaauccuucucacaauguccuu

SEQ ID NO: 943578 - RNA, 27 nt, Human
ccugugcucgcuuuccugcucucuccc

SEQ ID NO: 943579 - RNA, 22 nt, Human
cgccuuaugcccugaaagacaa

SEQ ID NO: 943580 - RNA, 20 nt, Human
cuaaaagagaagacucccau

SEQ ID NO: 943581 - RNA, 21 nt, Human
cucacaauguccuauugcacu

SEQ ID NO: 943582 - RNA, 26 nt, Human
cucgcuuuccugcucucucccuuuuu

SEQ ID NO: 943583 - RNA, 19 nt, Human
cuguccaaccagaaccagu

SEQ ID NO: 943584 - RNA, 24 nt, Human
gaauaaauuauuguuuuguaugga

SEQ ID NO: 943585 - RNA, 22 nt, Human
gaggaaaaagaacacccuuuau

SEQ ID NO: 943586 - RNA, 21 nt, Human
ggaguuucugggugugcuaac

SEQ ID NO: 943587 - RNA, 23 nt, Human
gggaaaagcauugaccuuggaag

SEQ ID NO: 943588 - RNA, 21 nt, Human
gucucuaccuacugaacuaca

SEQ ID NO: 943589 - RNA, 21 nt, Human
uaaaaauagcaauaaucaaaa

SEQ ID NO: 943590 - RNA, 21 nt, Human
uaaaaauagcaauaaucaaaa

SEQ ID NO: 943591 - RNA, 22 nt, Human
uaaaaauagcaauaaucaaaaa

SEQ ID NO: 943592 - RNA, 19 nt, Human
uaaacuaguagaugaaucc

SEQ ID NO: 943593 - RNA, 18 nt, Human
uaaucaaaaagguaaucu

SEQ ID NO: 943594 - RNA, 21 nt, Human
uagaaauuacuccuaaagucc

SEQ ID NO: 943595 - RNA, 21 nt, Human
uaggagagugggucaauuucc

SEQ ID NO: 943596 - RNA, 20 nt, Human
ucaaaacacuuuguauacug

SEQ ID NO: 943597 - RNA, 19 nt, Human
ucagaaacucaaaacacuu

SEQ ID NO: 943598 - RNA, 23 nt, Human
uccucugaaacagugaaucccca

SEQ ID NO: 943599 - RNA, 24 nt, Human
uccucugaaacagugaauccccaa

SEQ ID NO: 943600 - RNA, 21 nt, Human
ucucuaccuacugaacuacag

SEQ ID NO: 943601 - RNA, 21 nt, Human
ucugcuguagacagaggaaau

SEQ ID NO: 943602 - RNA, 24 nt, Human
ugaaaaauccuucucacaaugucc

SEQ ID NO: 943603 - RNA, 23 nt, Human
ugaaacagugaauccccaaauca

SEQ ID NO: 943604 - RNA, 22 nt, Human
ugcucucucccuuuuugcucuc

SEQ ID NO: 943605 - RNA, 22 nt, Human
ugggguuaaaaacaaaaagccc

SEQ ID NO: 943606 - RNA, 22 nt, Human
uuacuuccuguaacaacugcag

SEQ ID NO: 943607 - RNA, 24 nt, Human
uucccuauguacauagagaugugg

SEQ ID NO: 943608 - RNA, 19 nt, Human
uuuuuuuuuuuuuuucuaa

SEQ ID NO: 943609 - RNA, 18 nt, Human
aaaaaaaagcaguccugg

SEQ ID NO: 943610 - RNA, 21 nt, Human
aaccaccaaggagcuguggac

SEQ ID NO: 943611 - RNA, 24 nt, Human
aagcgccgggagcugcggggagcu

SEQ ID NO: 943612 - RNA, 22 nt, Human
acacagaguccacuggcucaau

SEQ ID NO: 943613 - RNA, 20 nt, Human
acacagugaacccagcaccc

SEQ ID NO: 943614 - RNA, 21 nt, Human
acagugaacccagcacccagu

SEQ ID NO: 943615 - RNA, 19 nt, Human
acagugggcaucuggggcc

SEQ ID NO: 943616 - RNA, 20 nt, Human
accuggucugcucagaaggc

SEQ ID NO: 943617 - RNA, 20 nt, Human
acggagauccaugguggcgg

SEQ ID NO: 943618 - RNA, 18 nt, Human
agaaagacccaauagaag

SEQ ID NO: 943619 - RNA, 20 nt, Human
agaggcaggguuggagcugc

SEQ ID NO: 943620 - RNA, 19 nt, Human
agaguccacuggcucaaug

SEQ ID NO: 943621 - RNA, 23 nt, Human
agaugucccaaagcccugaaggc

SEQ ID NO: 943622 - RNA, 23 nt, Human
agcuguggacaagcggacucagg

SEQ ID NO: 943623 - RNA, 18 nt, Human
aggcaggguuggagcugc

SEQ ID NO: 943624 - RNA, 18 nt, Human
aggcaguggguggggaag

SEQ ID NO: 943625 - RNA, 21 nt, Human
aggcaguggguggggaagggg

SEQ ID NO: 943626 - RNA, 23 nt, Human
aggccagcgcccgggggccucca

SEQ ID NO: 943627 - RNA, 18 nt, Human
aggcucaguucugggucc

SEQ ID NO: 943628 - RNA, 21 nt, Human
aggcuggggugcaggugcagg

SEQ ID NO: 943629 - RNA, 18 nt, Human
agggaccuaggagaggag

SEQ ID NO: 943630 - RNA, 19 nt, Human
agggaccuaggagaggagg

SEQ ID NO: 943631 - RNA, 22 nt, Human
aggggacagaggcaggguugga

SEQ ID NO: 943632 - RNA, 19 nt, Human
aggugcuuaauaaaugcuu

SEQ ID NO: 943633 - RNA, 24 nt, Human
aucaagagagggagcacaucgugg

SEQ ID NO: 943634 - RNA, 24 nt, Human
aucccgggcacaaggagaagaccc

SEQ ID NO: 943635 - RNA, 22 nt, Human
aucugaacugggugagggccug

SEQ ID NO: 943636 - RNA, 20 nt, Human
caagaugucccaaagcccuu

SEQ ID NO: 943637 - RNA, 21 nt, Human
caagccccgccccagcaucuu

SEQ ID NO: 943638 - RNA, 19 nt, Human
caagguaccuggucugcuc

SEQ ID NO: 943639 - RNA, 20 nt, Human
cacagugggcaucuggggcc

SEQ ID NO: 943640 - RNA, 20 nt, Human
caccaugccugaguacaugg

SEQ ID NO: 943641 - RNA, 20 nt, Human
caccgcugugugugcagaag

SEQ ID NO: 943642 - RNA, 21 nt, Human
cacgaaaacagcugcaaccac

SEQ ID NO: 943643 - RNA, 22 nt, Human
cacggcucagagagcugccugg

SEQ ID NO: 943644 - RNA, 19 nt, Human
cacugcgcggggauccucc

SEQ ID NO: 943645 - RNA, 22 nt, Human
cacuggccaagccccgccccag

SEQ ID NO: 943646 - RNA, 20 nt, Human
cagcaggggcgggcagaggc

SEQ ID NO: 943647 - RNA, 19 nt, Human
cagcugcaaccacaacaaa

SEQ ID NO: 943648 - RNA, 20 nt, Human
caggcgcagcugggggccaa

SEQ ID NO: 943649 - RNA, 24 nt, Human
caguucugggucccagcugcuccu

SEQ ID NO: 943650 - RNA, 20 nt, Human
caucguguccccuccgaguc

SEQ ID NO: 943651 - RNA, 21 nt, Human
caucuggccuucuguguccuu

SEQ ID NO: 943652 - RNA, 18 nt, Human
caugguggcggggcugug

SEQ ID NO: 943653 - RNA, 18 nt, Human
cauguguacaucugugug

SEQ ID NO: 943654 - RNA, 21 nt, Human
ccacaacaaagcacaacuguc

SEQ ID NO: 943655 - RNA, 19 nt, Human
ccacacaccggugcagcca

SEQ ID NO: 943656 - RNA, 19 nt, Human
ccaggcucaguucuggguc

SEQ ID NO: 943657 - RNA, 19 nt, Human
cccacagaggagaugaaac

SEQ ID NO: 943658 - RNA, 23 nt, Human
cccacuuuuauugauaguguaca

SEQ ID NO: 943659 - RNA, 24 nt, Human
cccagcauagcccaaucccgggca

SEQ ID NO: 943660 - RNA, 19 nt, Human
ccccgccccagcaucccuc

SEQ ID NO: 943661 - RNA, 19 nt, Human
ccccgccuccccaccgcug

SEQ ID NO: 943662 - RNA, 18 nt, Human
cccugaaggccccagggc

SEQ ID NO: 943663 - RNA, 19 nt, Human
cccugagcuuuucugucgg

SEQ ID NO: 943664 - RNA, 24 nt, Human
cccugcgcugcucgggacgccggg

SEQ ID NO: 943665 - RNA, 18 nt, Human
ccgggagcugcggggagc

SEQ ID NO: 943666 - RNA, 21 nt, Human
ccucccugaaggcacuggcca

SEQ ID NO: 943667 - RNA, 19 nt, Human
ccuggaagcgccgggagcu

SEQ ID NO: 943668 - RNA, 18 nt, Human
ccuggccaaggagggagu

SEQ ID NO: 943669 - RNA, 20 nt, Human
cgggcugggcgcggccgggc

SEQ ID NO: 943670 - RNA, 18 nt, Human
cggggcugggaauggcgg

SEQ ID NO: 943671 - RNA, 25 nt, Human
cucagaaagacccaauagaagauca

SEQ ID NO: 943672 - RNA, 18 nt, Human
cucgggacgccgggcugg

SEQ ID NO: 943673 - RNA, 21 nt, Human
cucugaaccucagaaagaccc

SEQ ID NO: 943674 - RNA, 20 nt, Human
cugaaccucagaaagaccca

SEQ ID NO: 943675 - RNA, 24 nt, Human
cugaaccucagaaagacccaauag

SEQ ID NO: 943676 - RNA, 19 nt, Human
cugaauuugcuaggggaca

SEQ ID NO: 943677 - RNA, 22 nt, Human
cugcaaccacaacaaagcacaa

SEQ ID NO: 943678 - RNA, 25 nt, Human
cugcaaccacaacaaagcacaacca

SEQ ID NO: 943679 - RNA, 22 nt, Human
cugcccaccccacgcuugugca

SEQ ID NO: 943680 - RNA, 22 nt, Human
cugccggggccucgguggggag

SEQ ID NO: 943681 - RNA, 24 nt, Human
cugggaauggcgggccgggccucu

SEQ ID NO: 943682 - RNA, 21 nt, Human
cugggucccagcugcuccucc

SEQ ID NO: 943683 - RNA, 20 nt, Human
cugugugaccuggaggaagu

SEQ ID NO: 943684 - RNA, 19 nt, Human
cuuugagcacagacgcagg

SEQ ID NO: 943685 - RNA, 19 nt, Human
gaaaacagcugcaaccaca

SEQ ID NO: 943686 - RNA, 21 nt, Human
gaaaacagcugcaaccacaac

SEQ ID NO: 943687 - RNA, 26 nt, Human
gaaggcagacgaaugugcggaggcca

SEQ ID NO: 943688 - RNA, 18 nt, Human
gaaggccccaggggccaa

SEQ ID NO: 943689 - RNA, 24 nt, Human
gaaggugguggggcagcaggggcg

SEQ ID NO: 943690 - RNA, 20 nt, Human
gaaguucucccagcugccac

SEQ ID NO: 943691 - RNA, 23 nt, Human
gaaguucucccagcugccacccu

SEQ ID NO: 943692 - RNA, 19 nt, Human
gaguacauggugguaccca

SEQ ID NO: 943693 - RNA, 19 nt, Human
gcagccugguucuaggugg

SEQ ID NO: 943694 - RNA, 19 nt, Human
gccaacuugugugugugcu

SEQ ID NO: 943695 - RNA, 18 nt, Human
gcgcggccgggcaaggag

SEQ ID NO: 943696 - RNA, 21 nt, Human
gcgggcagaggccaggacugg

SEQ ID NO: 943697 - RNA, 21 nt, Human
gcuaggggacaaagguggggc

SEQ ID NO: 943698 - RNA, 19 nt, Human
gcucgggacgccgggcugg

SEQ ID NO: 943699 - RNA, 19 nt, Human
ggacaagaugucccaaagc

SEQ ID NO: 943700 - RNA, 21 nt, Human
ggagggaccuaggagaggagg

SEQ ID NO: 943701 - RNA, 18 nt, Human
ggagggggugcagaggca

SEQ ID NO: 943702 - RNA, 18 nt, Human
ggcagcaggggcgggcag

SEQ ID NO: 943703 - RNA, 22 nt, Human
ggcugggagagaaguucuccca

SEQ ID NO: 943704 - RNA, 22 nt, Human
gggcagaggccaggacugggga

SEQ ID NO: 943705 - RNA, 20 nt, Human
gggccucuggcacggcucag

SEQ ID NO: 943706 - RNA, 20 nt, Human
gggcgcggccgggcaaggag

SEQ ID NO: 943707 - RNA, 18 nt, Human
gggcugggagagaaguuc

SEQ ID NO: 943708 - RNA, 26 nt, Human
ggggaaggggacagaggcaggguugg

SEQ ID NO: 943709 - RNA, 19 nt, Human
ggggcagcaggggcgggca

SEQ ID NO: 943710 - RNA, 18 nt, Human
ggggcugugccuggguga

SEQ ID NO: 943711 - RNA, 24 nt, Human
gggggugggagggggugcagaggc

SEQ ID NO: 943712 - RNA, 18 nt, Human
ggugcagaggcagcugaa

SEQ ID NO: 943713 - RNA, 21 nt, Human
gguggggaaggggacagaggc

SEQ ID NO: 943714 - RNA, 18 nt, Human
ggugguggggcagcaggg

SEQ ID NO: 943715 - RNA, 19 nt, Human
ggugguggggcagcagggg

SEQ ID NO: 943716 - RNA, 18 nt, Human
gguguuaugccaggagag

SEQ ID NO: 943717 - RNA, 21 nt, Human
guagagggcagccugguucua

SEQ ID NO: 943718 - RNA, 24 nt, Human
guggggcagcaggggcgggcagag

SEQ ID NO: 943719 - RNA, 24 nt, Human
guggguggggaaggggacagaggc

SEQ ID NO: 943720 - RNA, 20 nt, Human
guguguacuuguauauacau

SEQ ID NO: 943721 - RNA, 23 nt, Human
uaaaaaaaagcaguccuggccug

SEQ ID NO: 943722 - RNA, 23 nt, Human
uaagagcugaugacaagggccuu

SEQ ID NO: 943723 - RNA, 19 nt, Human
uaagguuccuuagggcccu

SEQ ID NO: 943724 - RNA, 20 nt, Human
uacacggagauccauggugg

SEQ ID NO: 943725 - RNA, 21 nt, Human
uagcuugcuucugccacccac

SEQ ID NO: 943726 - RNA, 21 nt, Human
uauauacaugggcauggugua

SEQ ID NO: 943727 - RNA, 21 nt, Human
uauauacaugggcauggugua

SEQ ID NO: 943728 - RNA, 20 nt, Human
ucccaaagcccugaaggccc

SEQ ID NO: 943729 - RNA, 21 nt, Human
ucccaaagcccugaaggcccc

SEQ ID NO: 943730 - RNA, 23 nt, Human
ucccagcugccacccaaaccaag

SEQ ID NO: 943731 - RNA, 24 nt, Human
ucccagcugccacccaaaccaagc

SEQ ID NO: 943732 - RNA, 20 nt, Human
ucccagcugcuccuccccgc

SEQ ID NO: 943733 - RNA, 21 nt, Human
ucccaggcucaguucuggguc

SEQ ID NO: 943734 - RNA, 19 nt, Human
uccuaggacacagugaacc

SEQ ID NO: 943735 - RNA, 19 nt, Human
uccuccccgccuccccacc

SEQ ID NO: 943736 - RNA, 18 nt, Human
ucuaaguggugggcgugg

SEQ ID NO: 943737 - RNA, 21 nt, Human
ucuagggagaggguugaggac

SEQ ID NO: 943738 - RNA, 18 nt, Human
ugaaaccaccaaggagcu

SEQ ID NO: 943739 - RNA, 20 nt, Human
ugaaccucagaaagacccaa

SEQ ID NO: 943740 - RNA, 18 nt, Human
ugaaggccccaggggcca

SEQ ID NO: 943741 - RNA, 21 nt, Human
ugacgcagcaauccucacccc

SEQ ID NO: 943742 - RNA, 19 nt, Human
ugagaaggcagacgaaugu

SEQ ID NO: 943743 - RNA, 20 nt, Human
ugagcacagacgcaggcagg

SEQ ID NO: 943744 - RNA, 25 nt, Human
ugcagaaggugguggggcagcaggg

SEQ ID NO: 943745 - RNA, 23 nt, Human
ugccaggagagaggagaccuuuc

SEQ ID NO: 943746 - RNA, 18 nt, Human
ugccggggccucgguggg

SEQ ID NO: 943747 - RNA, 19 nt, Human
ugcucaucguguccccucc

SEQ ID NO: 943748 - RNA, 19 nt, Human
ugcugugugaccuggagga

SEQ ID NO: 943749 - RNA, 21 nt, Human
uggaucugaacugggugaggg

SEQ ID NO: 943750 - RNA, 22 nt, Human
uggccacgcccccuucagacac

SEQ ID NO: 943751 - RNA, 19 nt, Human
uggcggggcugugccuggg

SEQ ID NO: 943752 - RNA, 21 nt, Human
ugggagcagaggaggaaggcg

SEQ ID NO: 943753 - RNA, 20 nt, Human
ugggagcauuaaaaaaaagc

SEQ ID NO: 943754 - RNA, 18 nt, Human
ugggagggggugcagagg

SEQ ID NO: 943755 - RNA, 22 nt, Human
ugggagggggugcagaggcagc

SEQ ID NO: 943756 - RNA, 21 nt, Human
ugggugagggccuggccaagg

SEQ ID NO: 943757 - RNA, 18 nt, Human
ugguggggcagcaggggc

SEQ ID NO: 943758 - RNA, 20 nt, Human
ugguggggcagcaggggcgg

SEQ ID NO: 943759 - RNA, 23 nt, Human
ugguuuauggguucaaaacccac

SEQ ID NO: 943760 - RNA, 23 nt, Human
ugucaggcgcagcugggggccaa

SEQ ID NO: 943761 - RNA, 30 nt, Human
ugucccaaagcccugaaggccccaggggcc

SEQ ID NO: 943762 - RNA, 19 nt, Human
ugugaacaagacugcugcc

SEQ ID NO: 943763 - RNA, 18 nt, Human
ugugcagaaggugguggg

SEQ ID NO: 943764 - RNA, 18 nt, Human
ugugcagaaggugguggg

SEQ ID NO: 943765 - RNA, 18 nt, Human
ugugcagaaggugguggg

SEQ ID NO: 943766 - RNA, 19 nt, Human
ugugcagaagguggugggg

SEQ ID NO: 943767 - RNA, 20 nt, Human
ugugcagaaggugguggggc

SEQ ID NO: 943768 - RNA, 18 nt, Human
uguguacaucugugugua

SEQ ID NO: 943769 - RNA, 18 nt, Human
uguguacuuguauauaca

SEQ ID NO: 943770 - RNA, 20 nt, Human
uguguacuuguauauacaug

SEQ ID NO: 943771 - RNA, 20 nt, Human
uguguacuuguauauacaug

SEQ ID NO: 943772 - RNA, 20 nt, Human
uguguguacaucugugugua

SEQ ID NO: 943773 - RNA, 23 nt, Human
uucucaucuggccuucugugucc

SEQ ID NO: 943774 - RNA, 18 nt, Human
uucucccagcugccaccc

SEQ ID NO: 943775 - RNA, 19 nt, Human
uucugggucccagcugcuc

SEQ ID NO: 943776 - RNA, 18 nt, Human
uucugucggaucccuccc

SEQ ID NO: 943777 - RNA, 24 nt, Human
uucuguguccuuuucauccugagg

SEQ ID NO: 943778 - RNA, 21 nt, Human
uugaggcugcagagauguguc

SEQ ID NO: 943779 - RNA, 22 nt, Human
uugugugugugcuggggguggg

SEQ ID NO: 943780 - RNA, 18 nt, Human
uuuuuuuuuuuuuuuuug

SEQ ID NO: 943781 - RNA, 18 nt, Human
aaaauccagugaaaccaa

SEQ ID NO: 943782 - RNA, 22 nt, Human
agaaguaaaauccagugaaacc

SEQ ID NO: 943783 - RNA, 18 nt, Human
cgggagcagcuggucugg

SEQ ID NO: 943784 - RNA, 18 nt, Human
gaagcacauacugaagaa

SEQ ID NO: 943785 - RNA, 19 nt, Human
uccagugaaaccaaacgaa

SEQ ID NO: 943786 - RNA, 19 nt, Human
uccccgggagcagcugguc

SEQ ID NO: 943787 - RNA, 19 nt, Human
uggucugggucugggcaca

SEQ ID NO: 943788 - RNA, 19 nt, Human
aaagcuccccacccaccuc

SEQ ID NO: 943789 - RNA, 21 nt, Human
aaggagccuggcuucgugcug

SEQ ID NO: 943790 - RNA, 19 nt, Human
accucagccagccacuguc

SEQ ID NO: 943791 - RNA, 20 nt, Human
accugcuuuguuaaaauggc

SEQ ID NO: 943792 - RNA, 23 nt, Human
accuucccacccaagucugaagc

SEQ ID NO: 943793 - RNA, 18 nt, Human
acuagcaucucccaucug

SEQ ID NO: 943794 - RNA, 20 nt, Human
aggcaaggcauacacaauuc

SEQ ID NO: 943795 - RNA, 21 nt, Human
auagccaucuuucaccuuccc

SEQ ID NO: 943796 - RNA, 19 nt, Human
cagcugccucuccaaaagg

SEQ ID NO: 943797 - RNA, 18 nt, Human
caggggcaaggccagauc

SEQ ID NO: 943798 - RNA, 21 nt, Human
caucccguggacucaggggcu

SEQ ID NO: 943799 - RNA, 21 nt, Human
caugcuguagacugaaauugc

SEQ ID NO: 943800 - RNA, 18 nt, Human
cauggauccuugucccug

SEQ ID NO: 943801 - RNA, 19 nt, Human
cccacagcacuugguggcc

SEQ ID NO: 943802 - RNA, 21 nt, Human
cccacccaccucagccagcca

SEQ ID NO: 943803 - RNA, 18 nt, Human
ccccacagcacuuggugg

SEQ ID NO: 943804 - RNA, 20 nt, Human
ccccacccaccucagccagc

SEQ ID NO: 943805 - RNA, 24 nt, Human
cuagcaucucccaucugacauucc

SEQ ID NO: 943806 - RNA, 25 nt, Human
cuagcaucucccaucugacauuccc

SEQ ID NO: 943807 - RNA, 21 nt, Human
cucaaggaaaagcuccccacc

SEQ ID NO: 943808 - RNA, 22 nt, Human
cucucuggagacagaauuccag

SEQ ID NO: 943809 - RNA, 19 nt, Human
cugaaacccaugauucccc

SEQ ID NO: 943810 - RNA, 19 nt, Human
gcgugcaccuuuuugcagc

SEQ ID NO: 943811 - RNA, 24 nt, Human
ggcgugcaccuuuuugcagcugcc

SEQ ID NO: 943812 - RNA, 21 nt, Human
gggcgugcaccuuuuugcagc

SEQ ID NO: 943813 - RNA, 20 nt, Human
gucuggaauccucuggggca

SEQ ID NO: 943814 - RNA, 20 nt, Human
uagccaucuuucaccuuccc

SEQ ID NO: 943815 - RNA, 23 nt, Human
ucacaggucuuuuucauggaucc

SEQ ID NO: 943816 - RNA, 23 nt, Human
ucacauagaaauauuuagaaugc

SEQ ID NO: 943817 - RNA, 23 nt, Human
uccaaaagggcuggcuucuuagg

SEQ ID NO: 943818 - RNA, 24 nt, Human
ucucuggagacagaauuccagucu

SEQ ID NO: 943819 - RNA, 19 nt, Human
ucugucuuugacccaaaca

SEQ ID NO: 943820 - RNA, 26 nt, Human
ucuuucaccuucccacccaagucuga

SEQ ID NO: 943821 - RNA, 28 nt, Human
uggaauccucuggggcacagccuacugc

SEQ ID NO: 943822 - RNA, 18 nt, Human
uggacucaggggcaaggc

SEQ ID NO: 943823 - RNA, 23 nt, Human
uggcuucuuaggaccaacagucu

SEQ ID NO: 943824 - RNA, 26 nt, Human
uguuucauucuuucuuuccuauccca

SEQ ID NO: 943825 - RNA, 28 nt, Human
uuauaccaaaaggaaauguaauggaacc

SEQ ID NO: 943826 - RNA, 18 nt, Human
uucauggauccuuguccc

SEQ ID NO: 943827 - RNA, 21 nt, Human
uugacccaaacagcuggguuu

SEQ ID NO: 943828 - RNA, 19 nt, Human
uugguggccuucuguucca

SEQ ID NO: 943829 - RNA, 21 nt, Human
aaacguagcuccgcagguccu

SEQ ID NO: 943830 - RNA, 18 nt, Human
aaauucugcagcuggugg

SEQ ID NO: 943831 - RNA, 18 nt, Human
aacacagcccgcacuccc

SEQ ID NO: 943832 - RNA, 21 nt, Human
aagaggaacugccccucccca

SEQ ID NO: 943833 - RNA, 19 nt, Human
accagcugcuccacaugcc

SEQ ID NO: 943834 - RNA, 22 nt, Human
agaaagcucauagaucucgucu

SEQ ID NO: 943835 - RNA, 24 nt, Human
agaaaucccuguucuccuggaguu

SEQ ID NO: 943836 - RNA, 18 nt, Human
agacauucaggcaucaga

SEQ ID NO: 943837 - RNA, 19 nt, Human
agagguuguucagcuuggg

SEQ ID NO: 943838 - RNA, 23 nt, Human
agcugguggagccugugccacgu

SEQ ID NO: 943839 - RNA, 21 nt, Human
agcuguaggaccucucucugu

SEQ ID NO: 943840 - RNA, 22 nt, Human
aggagaccaagagaugucuagg

SEQ ID NO: 943841 - RNA, 19 nt, Human
aggcagccggaagcccgcg

SEQ ID NO: 943842 - RNA, 20 nt, Human
agggaagaggggggcacagg

SEQ ID NO: 943843 - RNA, 19 nt, Human
agggccuuggugcugucag

SEQ ID NO: 943844 - RNA, 18 nt, Human
agggggaggguggcaggc

SEQ ID NO: 943845 - RNA, 23 nt, Human
agguagagguuguucagcuuggg

SEQ ID NO: 943846 - RNA, 19 nt, Human
agguaggugaggugcugag

SEQ ID NO: 943847 - RNA, 24 nt, Human
aguguuuguggcaacacagcccgc

SEQ ID NO: 943848 - RNA, 20 nt, Human
auggcgcuggcccggagcag

SEQ ID NO: 943849 - RNA, 22 nt, Human
augggaguccuugagucuggag

SEQ ID NO: 943850 - RNA, 24 nt, Human
augguggguccaucaccgggcagg

SEQ ID NO: 943851 - RNA, 21 nt, Human
cacugugacacaggcccccug

SEQ ID NO: 943852 - RNA, 18 nt, Human
cagauccucauuggcgcu

SEQ ID NO: 943853 - RNA, 23 nt, Human
cagcccaggugcggcgguagcgg

SEQ ID NO: 943854 - RNA, 19 nt, Human
cagccccuagggagcuggg

SEQ ID NO: 943855 - RNA, 22 nt, Human
cagcugguggagccugugccac

SEQ ID NO: 943856 - RNA, 25 nt, Human
caggcgccuaccaccugccagcccu

SEQ ID NO: 943857 - RNA, 23 nt, Human
caggggaccguaucuguuuccca

SEQ ID NO: 943858 - RNA, 21 nt, Human
caggggcccacuccaccacca

SEQ ID NO: 943859 - RNA, 24 nt, Human
caguguuuguggcaacacagcccg

SEQ ID NO: 943860 - RNA, 21 nt, Human
caguugagggcuuggggauau

SEQ ID NO: 943861 - RNA, 18 nt, Human
cauaauucuugaacacag

SEQ ID NO: 943862 - RNA, 23 nt, Human
caucaccugcacccagcgggaca

SEQ ID NO: 943863 - RNA, 20 nt, Human
ccagcccaggugcggcggua

SEQ ID NO: 943864 - RNA, 23 nt, Human
cccacuccaccaccagaggugca

SEQ ID NO: 943865 - RNA, 18 nt, Human
cccaggaagggugugggg

SEQ ID NO: 943866 - RNA, 26 nt, Human
cccaguacaggcagccggaagcccgc

SEQ ID NO: 943867 - RNA, 21 nt, Human
ccccacccacccucaggccag

SEQ ID NO: 943868 - RNA, 23 nt, Human
ccccagaggaagccacugcagcu

SEQ ID NO: 943869 - RNA, 24 nt, Human
ccccuccccacccacccucaggcc

SEQ ID NO: 943870 - RNA, 20 nt, Human
cccgcgcagccagcccaggu

SEQ ID NO: 943871 - RNA, 18 nt, Human
cccuccccacccacccuc

SEQ ID NO: 943872 - RNA, 21 nt, Human
cccugggacugaaugggcccc

SEQ ID NO: 943873 - RNA, 22 nt, Human
cccuuggagggccaccagcucc

SEQ ID NO: 943874 - RNA, 20 nt, Human
ccgaaggccccccuccccca

SEQ ID NO: 943875 - RNA, 21 nt, Human
ccgcgcagccagcccaggugc

SEQ ID NO: 943876 - RNA, 19 nt, Human
ccuacggagcccuccaggg

SEQ ID NO: 943877 - RNA, 21 nt, Human
ccuacggagcccuccagggcc

SEQ ID NO: 943878 - RNA, 22 nt, Human
ccuccccacccacccucaggcc

SEQ ID NO: 943879 - RNA, 23 nt, Human
ccucguacugagcccugcaaaac

SEQ ID NO: 943880 - RNA, 25 nt, Human
ccuguccggcuugggugucacacca

SEQ ID NO: 943881 - RNA, 22 nt, Human
ccuugagucuggagauggcacu

SEQ ID NO: 943882 - RNA, 19 nt, Human
ccuugcccaggacuccagc

SEQ ID NO: 943883 - RNA, 24 nt, Human
cgaaggccccccucccccacacgg

SEQ ID NO: 943884 - RNA, 19 nt, Human
cgagagucgcucaaagucc

SEQ ID NO: 943885 - RNA, 19 nt, Human
cgccuaccaccugccagcc

SEQ ID NO: 943886 - RNA, 29 nt, Human
cgcucaaaguccuccugagagauuguucc

SEQ ID NO: 943887 - RNA, 19 nt, Human
cgcugcaggguggaugcug

SEQ ID NO: 943888 - RNA, 21 nt, Human
cgcugcaggguggaugcugcc

SEQ ID NO: 943889 - RNA, 18 nt, Human
cguagcuccgcagguccu

SEQ ID NO: 943890 - RNA, 18 nt, Human
cguggggugaggaggccg

SEQ ID NO: 943891 - RNA, 18 nt, Human
cucaaaguccuccugaga

SEQ ID NO: 943892 - RNA, 23 nt, Human
cuccaaguggucgaaaagcaagg

SEQ ID NO: 943893 - RNA, 19 nt, Human
cuuguccagcaccugugca

SEQ ID NO: 943894 - RNA, 18 nt, Human
gaaagaggaacugccccu

SEQ ID NO: 943895 - RNA, 20 nt, Human
gaagaggcuggggagagacc

SEQ ID NO: 943896 - RNA, 20 nt, Human
gaagaggggggcacagggcu

SEQ ID NO: 943897 - RNA, 19 nt, Human
gaagggaaaauugcccgag

SEQ ID NO: 943898 - RNA, 20 nt, Human
gaaugaacuuguccagcacc

SEQ ID NO: 943899 - RNA, 21 nt, Human
gagaccuacggagcccuccag

SEQ ID NO: 943900 - RNA, 21 nt, Human
gaggaagagaggagaccaaga

SEQ ID NO: 943901 - RNA, 20 nt, Human
gaggaggccgggggucuugc

SEQ ID NO: 943902 - RNA, 19 nt, Human
gaggguggcaggcucuugg

SEQ ID NO: 943903 - RNA, 18 nt, Human
gauggcgcuggcccggag

SEQ ID NO: 943904 - RNA, 20 nt, Human
gcagccggaagcccgcgcag

SEQ ID NO: 943905 - RNA, 18 nt, Human
gcccacuccaccaccaga

SEQ ID NO: 943906 - RNA, 23 nt, Human
gcccacuccaccaccagaggugc

SEQ ID NO: 943907 - RNA, 21 nt, Human
gcccaguacaggcagccggaa

SEQ ID NO: 943908 - RNA, 18 nt, Human
gccuaccaccugccagcc

SEQ ID NO: 943909 - RNA, 21 nt, Human
gccucguacugagcccugcaa

SEQ ID NO: 943910 - RNA, 19 nt, Human
gcggccgucaggcaaccug

SEQ ID NO: 943911 - RNA, 20 nt, Human
gcgugggggugggugaagcc

SEQ ID NO: 943912 - RNA, 25 nt, Human
gcucagcaccaucaccugcacccag

SEQ ID NO: 943913 - RNA, 22 nt, Human
gcucaggcugggggccaagagg

SEQ ID NO: 943914 - RNA, 20 nt, Human
gcugcaggguggaugcugcc

SEQ ID NO: 943915 - RNA, 21 nt, Human
gcugggggccaagaggggcag

SEQ ID NO: 943916 - RNA, 18 nt, Human
gcuguaggggcccgggac

SEQ ID NO: 943917 - RNA, 21 nt, Human
gcuuuuugcccaggccugggc

SEQ ID NO: 943918 - RNA, 18 nt, Human
ggaaggguguggggauuc

SEQ ID NO: 943919 - RNA, 19 nt, Human
ggacaacgcggcucccggg

SEQ ID NO: 943920 - RNA, 18 nt, Human
ggacucaggacugacugg

SEQ ID NO: 943921 - RNA, 19 nt, Human
ggagauggcagaauggcga

SEQ ID NO: 943922 - RNA, 24 nt, Human
ggcccacuccaccaccagaggugc

SEQ ID NO: 943923 - RNA, 20 nt, Human
ggcccggagcagguacccug

SEQ ID NO: 943924 - RNA, 22 nt, Human
ggccugggcugcucauugggag

SEQ ID NO: 943925 - RNA, 22 nt, Human
ggcugggggccaagaggggcag

SEQ ID NO: 943926 - RNA, 21 nt, Human
gggaagaggggggcacagggc

SEQ ID NO: 943927 - RNA, 18 nt, Human
gggacugaaugggccccu

SEQ ID NO: 943928 - RNA, 19 nt, Human
gggcagggaagaggggggc

SEQ ID NO: 943929 - RNA, 21 nt, Human
gggccaccagcuccugcagcc

SEQ ID NO: 943930 - RNA, 18 nt, Human
ggggaaggaagaggcugg

SEQ ID NO: 943931 - RNA, 22 nt, Human
ggggagcugguguggaugggac

SEQ ID NO: 943932 - RNA, 22 nt, Human
ggggaggguggcaggcucuugg

SEQ ID NO: 943933 - RNA, 21 nt, Human
gggguuugugaagggguuggg

SEQ ID NO: 943934 - RNA, 22 nt, Human
ggguaaggagacauucaggcau

SEQ ID NO: 943935 - RNA, 24 nt, Human
ggguauuggaguggcucacaguug

SEQ ID NO: 943936 - RNA, 24 nt, Human
gguggguccaucaccgggcagggg

SEQ ID NO: 943937 - RNA, 18 nt, Human
gugaagggguuggggggg

SEQ ID NO: 943938 - RNA, 22 nt, Human
gugacccuguccggcuugggug

SEQ ID NO: 943939 - RNA, 21 nt, Human
guggcaggcucuugggacaac

SEQ ID NO: 943940 - RNA, 19 nt, Human
gugucacaccaggggccca

SEQ ID NO: 943941 - RNA, 21 nt, Human
guguuuguggcaacacagccc

SEQ ID NO: 943942 - RNA, 27 nt, Human
guugcugagaccuacggagcccuccaa

SEQ ID NO: 943943 - RNA, 18 nt, Human
uaccuucaccuggucucu

SEQ ID NO: 943944 - RNA, 19 nt, Human
uaggggcccgggacggcuc

SEQ ID NO: 943945 - RNA, 22 nt, Human
uauagcacaucuauccugugcc

SEQ ID NO: 943946 - RNA, 21 nt, Human
uauccugugccgugggcaugg

SEQ ID NO: 943947 - RNA, 22 nt, Human
ucacaguugagggcuuggggau

SEQ ID NO: 943948 - RNA, 21 nt, Human
ucagcguguugaaauucugca

SEQ ID NO: 943949 - RNA, 23 nt, Human
ucaggcugggggccaagaggggc

SEQ ID NO: 943950 - RNA, 20 nt, Human
uccaccagcugcuccacaug

SEQ ID NO: 943951 - RNA, 18 nt, Human
uccaggagggccuuggug

SEQ ID NO: 943952 - RNA, 20 nt, Human
ucccgggcauaagaaagcuc

SEQ ID NO: 943953 - RNA, 24 nt, Human
ucccugggacugaaugggccccug

SEQ ID NO: 943954 - RNA, 19 nt, Human
uccucggagccacagcugg

SEQ ID NO: 943955 - RNA, 25 nt, Human
ucggagccacagcuggcauggggga

SEQ ID NO: 943956 - RNA, 21 nt, Human
ucguacugagcccugcaaaac

SEQ ID NO: 943957 - RNA, 19 nt, Human
ucugcagcugguggagccu

SEQ ID NO: 943958 - RNA, 24 nt, Human
ucugcagcugguggagccugugcc

SEQ ID NO: 943959 - RNA, 18 nt, Human
ucugcucccugggacuga

SEQ ID NO: 943960 - RNA, 21 nt, Human
ucugucaggcgccuaccaccu

SEQ ID NO: 943961 - RNA, 20 nt, Human
ucuguuucccaggaagggug

SEQ ID NO: 943962 - RNA, 24 nt, Human
ugaaugaacuuguccagcaccugu

SEQ ID NO: 943963 - RNA, 23 nt, Human
ugagaccuacggagcccuccagg

SEQ ID NO: 943964 - RNA, 22 nt, Human
ugaggaagagaggagaccaaga

SEQ ID NO: 943965 - RNA, 24 nt, Human
ugcaaaacguagcuccgcaggucc

SEQ ID NO: 943966 - RNA, 19 nt, Human
ugcaggaaggccaggccca

SEQ ID NO: 943967 - RNA, 20 nt, Human
ugcagggacaccagguccuu

SEQ ID NO: 943968 - RNA, 20 nt, Human
ugccaucagcguguugaaau

SEQ ID NO: 943969 - RNA, 18 nt, Human
uggaaggugugcaggaag

SEQ ID NO: 943970 - RNA, 22 nt, Human
uggcaggcucuugggacaacgc

SEQ ID NO: 943971 - RNA, 23 nt, Human
uggcaggcucuugggacaacgcg

SEQ ID NO: 943972 - RNA, 19 nt, Human
uggcgaagcuggcacccag

SEQ ID NO: 943973 - RNA, 21 nt, Human
uggcgauggggcagggaagag

SEQ ID NO: 943974 - RNA, 18 nt, Human
uggggcagggaagagggg

SEQ ID NO: 943975 - RNA, 23 nt, Human
ugggggaagggagugaggaagag

SEQ ID NO: 943976 - RNA, 23 nt, Human
uggggggccagggccaccagggc

SEQ ID NO: 943977 - RNA, 22 nt, Human
ugggggugggugaagcccaugg

SEQ ID NO: 943978 - RNA, 28 nt, Human
ugggguuugugaagggguuggggggguc

SEQ ID NO: 943979 - RNA, 23 nt, Human
uggguaaggagacauucaggcau

SEQ ID NO: 943980 - RNA, 19 nt, Human
uggucgaaaagcaaggaca

SEQ ID NO: 943981 - RNA, 24 nt, Human
ugguguggaugggacaggagcucc

SEQ ID NO: 943982 - RNA, 20 nt, Human
uguaggggcccgggacggcu

SEQ ID NO: 943983 - RNA, 23 nt, Human
ugugccgugggcauggguaagga

SEQ ID NO: 943984 - RNA, 20 nt, Human
uguggggauucagucugggu

SEQ ID NO: 943985 - RNA, 19 nt, Human
ugugggggccaagucaggg

SEQ ID NO: 943986 - RNA, 19 nt, Human
uguugaaauucugcagcug

SEQ ID NO: 943987 - RNA, 19 nt, Human
uguugggguuugugaaggg

SEQ ID NO: 943988 - RNA, 22 nt, Human
uguugggguuugugaagggguu

SEQ ID NO: 943989 - RNA, 24 nt, Human
uucccaggaaggguguggggauuc

SEQ ID NO: 943990 - RNA, 18 nt, Human
uugagggcuuggggauau

SEQ ID NO: 943991 - RNA, 21 nt, Human
uugcgcuuuuugcccaggccu

SEQ ID NO: 943992 - RNA, 23 nt, Human
uuguugugggaggcaaggagcuc

SEQ ID NO: 943993 - RNA, 22 nt, Human
aaaacccuuggcgaaaugccag

SEQ ID NO: 943994 - RNA, 21 nt, Human
aaaauaaaaauuaccagaaga

SEQ ID NO: 943995 - RNA, 19 nt, Human
aaacaacccaaauggugaa

SEQ ID NO: 943996 - RNA, 21 nt, Human
aaacacaaggggcgcuucaac

SEQ ID NO: 943997 - RNA, 22 nt, Human
aaacaucagccuggaaacaggu

SEQ ID NO: 943998 - RNA, 23 nt, Human
aaacgucuccaccaaaaaagucc

SEQ ID NO: 943999 - RNA, 20 nt, Human
aaagagcuucccugaacccc

SEQ ID NO: 944000 - RNA, 24 nt, Human
aacagaaccagacucugucucaaa

SEQ ID NO: 944001 - RNA, 25 nt, Human
aaccagacucugucucaaaaaaaaa

SEQ ID NO: 944002 - RNA, 29 nt, Human
aacccaaauggugaaccuggagaacccuu

SEQ ID NO: 944003 - RNA, 24 nt, Human
aaccccaccucuacuaaaaccacc

SEQ ID NO: 944004 - RNA, 21 nt, Human
aagacuccaaagguaaacuga

SEQ ID NO: 944005 - RNA, 20 nt, Human
aagcaagacuuugugcaaaa

SEQ ID NO: 944006 - RNA, 20 nt, Human
aagcuuccugauaggagucc

SEQ ID NO: 944007 - RNA, 23 nt, Human
aaggaagcgccauagagacaggc

SEQ ID NO: 944008 - RNA, 20 nt, Human
aaggagggcagggguccagg

SEQ ID NO: 944009 - RNA, 20 nt, Human
aagugccuagcuuccugggg

SEQ ID NO: 944010 - RNA, 21 nt, Human
aauaccacucagaucaguggc

SEQ ID NO: 944011 - RNA, 24 nt, Human
aaucacuugaaccccagaggcgga

SEQ ID NO: 944012 - RNA, 18 nt, Human
aaugugaccuugugcuua

SEQ ID NO: 944013 - RNA, 18 nt, Human
aaugugugcugcuauauc

SEQ ID NO: 944014 - RNA, 18 nt, Human
acacagacagacgugugg

SEQ ID NO: 944015 - RNA, 22 nt, Human
acacaggaucuucucugucucc

SEQ ID NO: 944016 - RNA, 26 nt, Human
acaccagaaacaucagccuggaaaca

SEQ ID NO: 944017 - RNA, 24 nt, Human
acagaaccagacucugucucaaaa

SEQ ID NO: 944018 - RNA, 22 nt, Human
acaggagaaucacuugaacccc

SEQ ID NO: 944019 - RNA, 25 nt, Human
acaggaucuucucugucuccuaaag

SEQ ID NO: 944020 - RNA, 20 nt, Human
accccacacucaguagcaag

SEQ ID NO: 944021 - RNA, 23 nt, Human
accuuguaacauaagccccuccc

SEQ ID NO: 944022 - RNA, 21 nt, Human
accuuugaugacaugaagaug

SEQ ID NO: 944023 - RNA, 24 nt, Human
acucaguagcaagaugaggcuuca

SEQ ID NO: 944024 - RNA, 21 nt, Human
acuccaugccccacagggcug

SEQ ID NO: 944025 - RNA, 23 nt, Human
acucccacaaaucggucgaagag

SEQ ID NO: 944026 - RNA, 18 nt, Human
acugcacuccagccuggg

SEQ ID NO: 944027 - RNA, 24 nt, Human
acugcacuccagccugggaaacag

SEQ ID NO: 944028 - RNA, 24 nt, Human
agaaacgcuagcaauuacacacca

SEQ ID NO: 944029 - RNA, 22 nt, Human
agaagcccuucugggcuuccac

SEQ ID NO: 944030 - RNA, 18 nt, Human
agacaggagaaucacuug

SEQ ID NO: 944031 - RNA, 23 nt, Human
agacaggagaaucacuugaaccc

SEQ ID NO: 944032 - RNA, 19 nt, Human
agacaggcugucagcuggg

SEQ ID NO: 944033 - RNA, 19 nt, Human
agacuguucuugcccuuuu

SEQ ID NO: 944034 - RNA, 23 nt, Human
agagaaacacacaggaucuucuc

SEQ ID NO: 944035 - RNA, 25 nt, Human
agagaugggcagugccucuaccccc

SEQ ID NO: 944036 - RNA, 18 nt, Human
agaucaaaaucuugaccc

SEQ ID NO: 944037 - RNA, 24 nt, Human
agccuggccaagauggugaaaccc

SEQ ID NO: 944038 - RNA, 24 nt, Human
agccugggaaacagaaccagacuc

SEQ ID NO: 944039 - RNA, 21 nt, Human
agcuagugguuaguaguuugc

SEQ ID NO: 944040 - RNA, 21 nt, Human
aggagggugcccagggcagaa

SEQ ID NO: 944041 - RNA, 24 nt, Human
aggcggauguugcagugagcugag

SEQ ID NO: 944042 - RNA, 24 nt, Human
aggcggguggaucacgaggucagg

SEQ ID NO: 944043 - RNA, 24 nt, Human
aggcugagacaggagaaucacuug

SEQ ID NO: 944044 - RNA, 23 nt, Human
aguggcucacgccuguaauccca

SEQ ID NO: 944045 - RNA, 24 nt, Human
aucccaccacugcacuccagccug

SEQ ID NO: 944046 - RNA, 22 nt, Human
auucuguggagagaagguggag

SEQ ID NO: 944047 - RNA, 24 nt, Human
caacacuuugggaggccuaggcgg

SEQ ID NO: 944048 - RNA, 21 nt, Human
caagaugaggcuucauucuug

SEQ ID NO: 944049 - RNA, 19 nt, Human
caauuacacaccagaaaca

SEQ ID NO: 944050 - RNA, 24 nt, Human
cacacaggaucuucucugucuccu

SEQ ID NO: 944051 - RNA, 23 nt, Human
cacaccagaaacaucagccugga

SEQ ID NO: 944052 - RNA, 22 nt, Human
caccaaccaggggcuguccuuu

SEQ ID NO: 944053 - RNA, 22 nt, Human
caccaggcccuggccacacuag

SEQ ID NO: 944054 - RNA, 24 nt, Human
caccuucccucucaugugaucacc

SEQ ID NO: 944055 - RNA, 24 nt, Human
cacgccuguaaucccaacacuuug

SEQ ID NO: 944056 - RNA, 26 nt, Human
cacuagcuggucagcacuguguacgc

SEQ ID NO: 944057 - RNA, 18 nt, Human
cacugcacuccagccugg

SEQ ID NO: 944058 - RNA, 19 nt, Human
cacugcacuccagccuggg

SEQ ID NO: 944059 - RNA, 19 nt, Human
cacugcacuccagccuggg

SEQ ID NO: 944060 - RNA, 24 nt, Human
cacugcacuccagccugggaaaca

SEQ ID NO: 944061 - RNA, 22 nt, Human
cagcugccugucaagcuuccug

SEQ ID NO: 944062 - RNA, 21 nt, Human
cagcuugcagaagcccuucug

SEQ ID NO: 944063 - RNA, 24 nt, Human
caggaucuucucugucuccuaaag

SEQ ID NO: 944064 - RNA, 19 nt, Human
cagggcagaaacgucucca

SEQ ID NO: 944065 - RNA, 25 nt, Human
cagguaggcacauggacacguacca

SEQ ID NO: 944066 - RNA, 20 nt, Human
cagugagcugagaucccacc

SEQ ID NO: 944067 - RNA, 21 nt, Human
cauagccaggcacccaggucc

SEQ ID NO: 944068 - RNA, 23 nt, Human
ccaacauauaaacaacccaaaug

SEQ ID NO: 944069 - RNA, 21 nt, Human
ccaacuaaggcccugaacauu

SEQ ID NO: 944070 - RNA, 23 nt, Human
ccacagcugugagccuucucaag

SEQ ID NO: 944071 - RNA, 18 nt, Human
ccacagggcuggugcugc

SEQ ID NO: 944072 - RNA, 20 nt, Human
ccacagggcuggugcugcug

SEQ ID NO: 944073 - RNA, 27 nt, Human
ccaccacugcacuccagccugggaaac

SEQ ID NO: 944074 - RNA, 19 nt, Human
ccacugcacuccagccugg

SEQ ID NO: 944075 - RNA, 20 nt, Human
ccacugcacuccagccuggg

SEQ ID NO: 944076 - RNA, 24 nt, Human
ccacugcacuccagccugggaaac

SEQ ID NO: 944077 - RNA, 21 nt, Human
ccagcuucaagugcaggaaga

SEQ ID NO: 944078 - RNA, 19 nt, Human
ccauggaggcagagaugga

SEQ ID NO: 944079 - RNA, 24 nt, Human
cccaagauaauccccacccccugc

SEQ ID NO: 944080 - RNA, 19 nt, Human
cccaccucuacuaaaacca

SEQ ID NO: 944081 - RNA, 26 nt, Human
cccaugcaccuucaccagguggccua

SEQ ID NO: 944082 - RNA, 22 nt, Human
ccccaagauaauccccaccccc

SEQ ID NO: 944083 - RNA, 24 nt, Human
ccccagccugccguagacacagcc

SEQ ID NO: 944084 - RNA, 27 nt, Human
ccccaugcaccuucaccagguggccua

SEQ ID NO: 944085 - RNA, 24 nt, Human
cccugccauuuaagucaucaccuu

SEQ ID NO: 944086 - RNA, 19 nt, Human
cccuugcugaggcccuguc

SEQ ID NO: 944087 - RNA, 21 nt, Human
ccgaggccucagcauuuuucu

SEQ ID NO: 944088 - RNA, 19 nt, Human
ccuaaagguagccauggag

SEQ ID NO: 944089 - RNA, 19 nt, Human
ccugaaacuuccuggccac

SEQ ID NO: 944090 - RNA, 21 nt, Human
ccugaaacuuccuggccacca

SEQ ID NO: 944091 - RNA, 24 nt, Human
ccuggccaagauggugaaacccca

SEQ ID NO: 944092 - RNA, 21 nt, Human
ccuguaauuccagcuacuugg

SEQ ID NO: 944093 - RNA, 22 nt, Human
ccuguaauuccagcuacuuggg

SEQ ID NO: 944094 - RNA, 21 nt, Human
ccuugccuucgccuuucuucc

SEQ ID NO: 944095 - RNA, 18 nt, Human
cgaagcaagacuuugugc

SEQ ID NO: 944096 - RNA, 24 nt, Human
cgccuguaaucccaacacuuuggg

SEQ ID NO: 944097 - RNA, 24 nt, Human
cggaaggagaggcuauauccccag

SEQ ID NO: 944098 - RNA, 25 nt, Human
cuaaaaccacacaaaaaaauuagcc

SEQ ID NO: 944099 - RNA, 21 nt, Human
cuaaagguagccauggaggca

SEQ ID NO: 944100 - RNA, 24 nt, Human
cuaggcggguggaucacgagguca

SEQ ID NO: 944101 - RNA, 22 nt, Human
cucacgccuguaaucccaacac

SEQ ID NO: 944102 - RNA, 24 nt, Human
cucacgccuguaaucccaacacuu

SEQ ID NO: 944103 - RNA, 23 nt, Human
cuccccaagauaauccccacccc

SEQ ID NO: 944104 - RNA, 18 nt, Human
cucccuggcacuugagag

SEQ ID NO: 944105 - RNA, 19 nt, Human
cucugucucaaaaaaaaaa

SEQ ID NO: 944106 - RNA, 19 nt, Human
cugaaccccacacucagua

SEQ ID NO: 944107 - RNA, 21 nt, Human
cugaaccccacacucaguagc

SEQ ID NO: 944108 - RNA, 22 nt, Human
cugaaccccacacucaguagca

SEQ ID NO: 944109 - RNA, 21 nt, Human
cugcacugaugcccagcugcc

SEQ ID NO: 944110 - RNA, 19 nt, Human
cugcauuacguggaagugu

SEQ ID NO: 944111 - RNA, 27 nt, Human
cuggccaagauggugaaaccccaccuc

SEQ ID NO: 944112 - RNA, 23 nt, Human
cuggggugcccagauccccucgu

SEQ ID NO: 944113 - RNA, 20 nt, Human
cuguaagacacugaaauugc

SEQ ID NO: 944114 - RNA, 19 nt, Human
cuuauaagccagaaaucgc

SEQ ID NO: 944115 - RNA, 21 nt, Human
cuuccaccuccugaccuccca

SEQ ID NO: 944116 - RNA, 20 nt, Human
cuugccuucgccuuucuucc

SEQ ID NO: 944117 - RNA, 23 nt, Human
cuugccuucgccuuucuuccucc

SEQ ID NO: 944118 - RNA, 19 nt, Human
gaagguggagaagagaugg

SEQ ID NO: 944119 - RNA, 20 nt, Human
gacaccacauucucugugcu

SEQ ID NO: 944120 - RNA, 21 nt, Human
gagcagaaaaaaggagggcag

SEQ ID NO: 944121 - RNA, 21 nt, Human
gaucacagagaaugugaccuu

SEQ ID NO: 944122 - RNA, 22 nt, Human
gaucacgaggucaggaguucaa

SEQ ID NO: 944123 - RNA, 24 nt, Human
gaucacgaggucaggaguucaaga

SEQ ID NO: 944124 - RNA, 22 nt, Human
gauguugcagugagcugagauc

SEQ ID NO: 944125 - RNA, 19 nt, Human
gcacugaugcccagcugcc

SEQ ID NO: 944126 - RNA, 24 nt, Human
gccaagauggugaaaccccaccuc

SEQ ID NO: 944127 - RNA, 18 nt, Human
gcggauguugcagugagc

SEQ ID NO: 944128 - RNA, 21 nt, Human
gcugcucccuggcacuugaga

SEQ ID NO: 944129 - RNA, 20 nt, Human
gcuuggccggagcuggggag

SEQ ID NO: 944130 - RNA, 24 nt, Human
ggaaacaggucugcgaucugcagg

SEQ ID NO: 944131 - RNA, 18 nt, Human
ggaaagaauggucuugac

SEQ ID NO: 944132 - RNA, 20 nt, Human
ggaaauucuucucccaaguc

SEQ ID NO: 944133 - RNA, 23 nt, Human
ggaagacuccaaagguaaacuga

SEQ ID NO: 944134 - RNA, 18 nt, Human
ggauguugcagugagcug

SEQ ID NO: 944135 - RNA, 23 nt, Human
ggauguugcagugagcugagauc

SEQ ID NO: 944136 - RNA, 23 nt, Human
ggcacaguggcucacgccuguaa

SEQ ID NO: 944137 - RNA, 18 nt, Human
ggcaggagggugcccagg

SEQ ID NO: 944138 - RNA, 23 nt, Human
ggccaagauggugaaaccccacc

SEQ ID NO: 944139 - RNA, 21 nt, Human
ggcgggucccuguaauuccag

SEQ ID NO: 944140 - RNA, 21 nt, Human
ggcugggcacaguggcucacg

SEQ ID NO: 944141 - RNA, 18 nt, Human
gggcacaguggcucacgc

SEQ ID NO: 944142 - RNA, 21 nt, Human
gggcaggagggugcccagggc

SEQ ID NO: 944143 - RNA, 21 nt, Human
gggggucuuaugggcaauggc

SEQ ID NO: 944144 - RNA, 23 nt, Human
gguggaucacgaggucaggaguu

SEQ ID NO: 944145 - RNA, 24 nt, Human
gguggcgggucccuguaauuccag

SEQ ID NO: 944146 - RNA, 22 nt, Human
guccgcuguccucucuuuucuc

SEQ ID NO: 944147 - RNA, 21 nt, Human
guccucucuuuucucucgcuc

SEQ ID NO: 944148 - RNA, 20 nt, Human
gucucaaaaaaaaaaaaaag

SEQ ID NO: 944149 - RNA, 19 nt, Human
gugagcagaaaaaaggagg

SEQ ID NO: 944150 - RNA, 22 nt, Human
gugaucuggccaacuggacaug

SEQ ID NO: 944151 - RNA, 23 nt, Human
guggaucacgaggucaggaguuc

SEQ ID NO: 944152 - RNA, 19 nt, Human
guugcagugagcugagauc

SEQ ID NO: 944153 - RNA, 20 nt, Human
uaaaacaaucaacguuucca

SEQ ID NO: 944154 - RNA, 21 nt, Human
uaaaacacaaggggcgcuuca

SEQ ID NO: 944155 - RNA, 21 nt, Human
uaaacacagacagacgugugg

SEQ ID NO: 944156 - RNA, 19 nt, Human
uaagaauacuucacaaggc

SEQ ID NO: 944157 - RNA, 21 nt, Human
uaagaauacuucacaaggcua

SEQ ID NO: 944158 - RNA, 22 nt, Human
uaagaauacuucacaaggcuaa

SEQ ID NO: 944159 - RNA, 21 nt, Human
uaauccccacccccugccauu

SEQ ID NO: 944160 - RNA, 24 nt, Human
uacuaaaaccacacaaaaaaauua

SEQ ID NO: 944161 - RNA, 23 nt, Human
uacuggggccaacuaaggcccug

SEQ ID NO: 944162 - RNA, 18 nt, Human
uagaacaucacauauguc

SEQ ID NO: 944163 - RNA, 22 nt, Human
uagcaaaugauggcuuggccgg

SEQ ID NO: 944164 - RNA, 24 nt, Human
uagccaggcacccagguccaagca

SEQ ID NO: 944165 - RNA, 21 nt, Human
uagccgggcgugguggcgggu

SEQ ID NO: 944166 - RNA, 20 nt, Human
uagugcuagugcaaaucaaa

SEQ ID NO: 944167 - RNA, 18 nt, Human
uaguuugcuuuguggaaa

SEQ ID NO: 944168 - RNA, 19 nt, Human
ucaaaacugcaagaccaug

SEQ ID NO: 944169 - RNA, 19 nt, Human
ucaccagguggccuaaaga

SEQ ID NO: 944170 - RNA, 21 nt, Human
ucacgaggucaggaguucaag

SEQ ID NO: 944171 - RNA, 24 nt, Human
ucacgaggucaggaguucaagacc

SEQ ID NO: 944172 - RNA, 19 nt, Human
ucagaucaguggcuccucu

SEQ ID NO: 944173 - RNA, 19 nt, Human
ucaggagcuccugaucuug

SEQ ID NO: 944174 - RNA, 23 nt, Human
ucaggagcuccugaucuugcuug

SEQ ID NO: 944175 - RNA, 21 nt, Human
uccacacacaaggugagggca

SEQ ID NO: 944176 - RNA, 18 nt, Human
uccaccaucccagccaga

SEQ ID NO: 944177 - RNA, 23 nt, Human
uccaccuuccuuuggaggcacca

SEQ ID NO: 944178 - RNA, 22 nt, Human
uccaguguaaaaauacgugggc

SEQ ID NO: 944179 - RNA, 21 nt, Human
ucccagcuguaacaaaggaag

SEQ ID NO: 944180 - RNA, 18 nt, Human
ucccagggcacagacugu

SEQ ID NO: 944181 - RNA, 21 nt, Human
uccccaucuaacacuaucgua

SEQ ID NO: 944182 - RNA, 18 nt, Human
ucccgguggcuacucuuu

SEQ ID NO: 944183 - RNA, 23 nt, Human
ucccgguggcuacucuuugucuu

SEQ ID NO: 944184 - RNA, 21 nt, Human
ucccuguaauuccagcuacuu

SEQ ID NO: 944185 - RNA, 23 nt, Human
ucccuguaauuccagcuacuugg

SEQ ID NO: 944186 - RNA, 24 nt, Human
ucccuguaauuccagcuacuuggg

SEQ ID NO: 944187 - RNA, 21 nt, Human
uccugaucuugcuuggucaau

SEQ ID NO: 944188 - RNA, 20 nt, Human
ucuccugucuccuaucucau

SEQ ID NO: 944189 - RNA, 22 nt, Human
ucucuuuucaucggaaggagag

SEQ ID NO: 944190 - RNA, 20 nt, Human
ucucuuuucucucgcucuuc

SEQ ID NO: 944191 - RNA, 22 nt, Human
ucugucucaaaaaaaaaaaaaa

SEQ ID NO: 944192 - RNA, 19 nt, Human
ucugucucccuccucaaac

SEQ ID NO: 944193 - RNA, 20 nt, Human
ucuuccuuucucuuuucauc

SEQ ID NO: 944194 - RNA, 21 nt, Human
ucuuccuuucucuuuucaucg

SEQ ID NO: 944195 - RNA, 19 nt, Human
ucuuugucuucuuacccca

SEQ ID NO: 944196 - RNA, 18 nt, Human
ugaaaaugugugcugcua

SEQ ID NO: 944197 - RNA, 19 nt, Human
ugaaaccccaccucuacua

SEQ ID NO: 944198 - RNA, 20 nt, Human
ugacaccacauucucugugc

SEQ ID NO: 944199 - RNA, 19 nt, Human
ugacugcaaacaucgcccc

SEQ ID NO: 944200 - RNA, 24 nt, Human
ugagacaggagaaucacuugaacc

SEQ ID NO: 944201 - RNA, 22 nt, Human
ugagaucccaccacugcacucc

SEQ ID NO: 944202 - RNA, 24 nt, Human
ugagaucccaccacugcacuccag

SEQ ID NO: 944203 - RNA, 19 nt, Human
ugagcagaaaaaaggaggg

SEQ ID NO: 944204 - RNA, 22 nt, Human
ugagcagaaaaaaggagggcag

SEQ ID NO: 944205 - RNA, 23 nt, Human
ugaggcuucauucuuggaaugca

SEQ ID NO: 944206 - RNA, 25 nt, Human
ugauaccagugagaaaaucugcucc

SEQ ID NO: 944207 - RNA, 23 nt, Human
ugaucacagagaaugugaccuug

SEQ ID NO: 944208 - RNA, 21 nt, Human
ugaucuccugucuccuaucuc

SEQ ID NO: 944209 - RNA, 21 nt, Human
ugaucuggccaacuggacaug

SEQ ID NO: 944210 - RNA, 24 nt, Human
ugcacacacauguacacacacaca

SEQ ID NO: 944211 - RNA, 19 nt, Human
ugccaggggccgcaugcca

SEQ ID NO: 944212 - RNA, 19 nt, Human
ugcccagauccccucguuc

SEQ ID NO: 944213 - RNA, 22 nt, Human
ugcccagcucugcaaacauucu

SEQ ID NO: 944214 - RNA, 22 nt, Human
uggaaaaaaaacccaacccuau

SEQ ID NO: 944215 - RNA, 18 nt, Human
uggaaagugaucuggcca

SEQ ID NO: 944216 - RNA, 19 nt, Human
uggagagaagguggagaag

SEQ ID NO: 944217 - RNA, 21 nt, Human
uggaggcagagauggaggcag

SEQ ID NO: 944218 - RNA, 22 nt, Human
uggaucacgaggucaggaguuc

SEQ ID NO: 944219 - RNA, 22 nt, Human
uggccaccaggccaccaggccc

SEQ ID NO: 944220 - RNA, 19 nt, Human
uggccggagcuggggaggu

SEQ ID NO: 944221 - RNA, 21 nt, Human
uggcgguuccuggggugccca

SEQ ID NO: 944222 - RNA, 21 nt, Human
uggcucacgccuguaauccca

SEQ ID NO: 944223 - RNA, 24 nt, Human
uggcucacgccuguaaucccaaca

SEQ ID NO: 944224 - RNA, 19 nt, Human
uggcugggcacaguggcuc

SEQ ID NO: 944225 - RNA, 19 nt, Human
uggcuuggccggagcuggg

SEQ ID NO: 944226 - RNA, 24 nt, Human
ugggaggccuaggcggguggauca

SEQ ID NO: 944227 - RNA, 24 nt, Human
ugggaggcugagacaggagaauca

SEQ ID NO: 944228 - RNA, 20 nt, Human
ugggggugguggggagacag

SEQ ID NO: 944229 - RNA, 23 nt, Human
ugggugacuaauauccagaaauc

SEQ ID NO: 944230 - RNA, 22 nt, Human
uggugagggaagagaggauugu

SEQ ID NO: 944231 - RNA, 24 nt, Human
ugguggcgggucccuguaauucca

SEQ ID NO: 944232 - RNA, 22 nt, Human
uguaaguucagaaccaaacguu

SEQ ID NO: 944233 - RNA, 21 nt, Human
uguggagagaagguggagaag

SEQ ID NO: 944234 - RNA, 18 nt, Human
uguugcagugagcugaga

SEQ ID NO: 944235 - RNA, 23 nt, Human
uguuugcauucacagaacuguuc

SEQ ID NO: 944236 - RNA, 18 nt, Human
uuagccgggcgugguggc

SEQ ID NO: 944237 - RNA, 22 nt, Human
uuauaacuaaaaucaaaagucc

SEQ ID NO: 944238 - RNA, 21 nt, Human
uucagaaccaaacguugaauc

SEQ ID NO: 944239 - RNA, 25 nt, Human
uucccugaaccccacacucaguagc

SEQ ID NO: 944240 - RNA, 18 nt, Human
uuccuggccaccaggcca

SEQ ID NO: 944241 - RNA, 18 nt, Human
uucuaggcauacagggag

SEQ ID NO: 944242 - RNA, 24 nt, Human
uucucccaaguccuccaaggagaa

SEQ ID NO: 944243 - RNA, 21 nt, Human
uucuucaccaauacguacagg

SEQ ID NO: 944244 - RNA, 19 nt, Human
uugcagugagcugagaucc

SEQ ID NO: 944245 - RNA, 22 nt, Human
uugcagugagcugagaucccac

SEQ ID NO: 944246 - RNA, 20 nt, Human
uugcagugagcugagauccg

SEQ ID NO: 944247 - RNA, 25 nt, Human
uugggaggcugagacaggagaauca

SEQ ID NO: 944248 - RNA, 19 nt, Human
uuguaacauaagccccucc

SEQ ID NO: 944249 - RNA, 21 nt, Human
uugugagcagaaaaaaggagg

SEQ ID NO: 944250 - RNA, 23 nt, Human
uugugcaucuugugcucaguuaa

SEQ ID NO: 944251 - RNA, 22 nt, Human
uuuuggcugggcacaguggcuc

SEQ ID NO: 944252 - RNA, 23 nt, Human
aaaaccccaagccacaccaagaa

SEQ ID NO: 944253 - RNA, 18 nt, Human
aaacaggaagccuaaaaa

SEQ ID NO: 944254 - RNA, 19 nt, Human
aaacaggaagccuaaaaac

SEQ ID NO: 944255 - RNA, 21 nt, Human
aagccacaccaagaaaaauga

SEQ ID NO: 944256 - RNA, 23 nt, Human
acagacaaccucauagcuggugc

SEQ ID NO: 944257 - RNA, 19 nt, Human
agagaggggagggcggggu

SEQ ID NO: 944258 - RNA, 20 nt, Human
aggaagccuaaaaaccccaa

SEQ ID NO: 944259 - RNA, 18 nt, Human
aggagggagaacagaggg

SEQ ID NO: 944260 - RNA, 25 nt, Human
auaaaacaggaagccuaaaaacccc

SEQ ID NO: 944261 - RNA, 19 nt, Human
ccaagccacaccaagaaaa

SEQ ID NO: 944262 - RNA, 23 nt, Human
ccacaccaagaaaaaugagagag

SEQ ID NO: 944263 - RNA, 21 nt, Human
ccccaagccacaccaagaaaa

SEQ ID NO: 944264 - RNA, 18 nt, Human
cccuuugauggcuugggu

SEQ ID NO: 944265 - RNA, 19 nt, Human
ccuaaaaaccccaagccac

SEQ ID NO: 944266 - RNA, 24 nt, Human
ccuaaaaaccccaagccacaccaa

SEQ ID NO: 944267 - RNA, 19 nt, Human
ccucauagcuggugcaccu

SEQ ID NO: 944268 - RNA, 24 nt, Human
cuaaaaaccccaagccacaccaag

SEQ ID NO: 944269 - RNA, 21 nt, Human
gcggagggaacuuaaugcaca

SEQ ID NO: 944270 - RNA, 24 nt, Human
ggagaacagaggguggaaggcaag

SEQ ID NO: 944271 - RNA, 19 nt, Human
uaaaaaccccaagccacac

SEQ ID NO: 944272 - RNA, 22 nt, Human
uaaaaaccccaagccacaccaa

SEQ ID NO: 944273 - RNA, 21 nt, Human
uaaaacaggaagccuaaaaac

SEQ ID NO: 944274 - RNA, 19 nt, Human
uacagacaaccucauagcu

SEQ ID NO: 944275 - RNA, 19 nt, Human
uacaggcccuuugauggcu

SEQ ID NO: 944276 - RNA, 20 nt, Human
uagcuggugcaccacacacc

SEQ ID NO: 944277 - RNA, 18 nt, Human
ucauagcuggugcaccac

SEQ ID NO: 944278 - RNA, 21 nt, Human
uccuagguauguacaggcccu

SEQ ID NO: 944279 - RNA, 21 nt, Human
ugagagaggggagggcggggu

SEQ ID NO: 944280 - RNA, 19 nt, Human
uggccgggacaacucaugg

SEQ ID NO: 944281 - RNA, 18 nt, Human
uggugcaccacacacacg

SEQ ID NO: 944282 - RNA, 20 nt, Human
uguuuauuucucaagaugug

SEQ ID NO: 944283 - RNA, 24 nt, Human
uguuuauuucucaagaugugcaca

SEQ ID NO: 944284 - RNA, 21 nt, Human
aaaauaucugcuagaaacuug

SEQ ID NO: 944285 - RNA, 26 nt, Human
aaacaccugauuuuccauuagaaaua

SEQ ID NO: 944286 - RNA, 21 nt, Human
aaccuccagccccgcaggcuc

SEQ ID NO: 944287 - RNA, 21 nt, Human
acaaguuacuggcaaagagaa

SEQ ID NO: 944288 - RNA, 25 nt, Human
auaaacgaacauuaauuguaccaca

SEQ ID NO: 944289 - RNA, 22 nt, Human
auauguaaauacaauuugaauc

SEQ ID NO: 944290 - RNA, 25 nt, Human
auauucauuauauucagagaguuuu

SEQ ID NO: 944291 - RNA, 22 nt, Human
aucuuuguuuuguuuacccagu

SEQ ID NO: 944292 - RNA, 23 nt, Human
augaggcauuuguuaaaaaccca

SEQ ID NO: 944293 - RNA, 23 nt, Human
auuaaaaugacucuaaugccuaa

SEQ ID NO: 944294 - RNA, 19 nt, Human
auuaccauuagauugcauu

SEQ ID NO: 944295 - RNA, 21 nt, Human
caaauaagaaaacugccucuu

SEQ ID NO: 944296 - RNA, 19 nt, Human
caacaaauuuccaagacaa

SEQ ID NO: 944297 - RNA, 22 nt, Human
caaccuccagccccgcaggcuc

SEQ ID NO: 944298 - RNA, 22 nt, Human
caagccuccacccggcccgcgc

SEQ ID NO: 944299 - RNA, 18 nt, Human
cacacccccgcgcccgcc

SEQ ID NO: 944300 - RNA, 23 nt, Human
caccguacagcggcagccugggc

SEQ ID NO: 944301 - RNA, 29 nt, Human
cagcaagaaauggagcgaggagggacccc

SEQ ID NO: 944302 - RNA, 25 nt, Human
cagcgccgccggcuccggggcuccc

SEQ ID NO: 944303 - RNA, 21 nt, Human
caggaacacgaacucucagau

SEQ ID NO: 944304 - RNA, 18 nt, Human
cauugacagcagauaucc

SEQ ID NO: 944305 - RNA, 22 nt, Human
cauuuugccauccuaauacuca

SEQ ID NO: 944306 - RNA, 24 nt, Human
ccagcaagaaauggagcgaggaca

SEQ ID NO: 944307 - RNA, 19 nt, Human
ccaggacacacacgggcca

SEQ ID NO: 944308 - RNA, 19 nt, Human
ccaguaucaggucauauga

SEQ ID NO: 944309 - RNA, 19 nt, Human
ccccucuggccccagcgcc

SEQ ID NO: 944310 - RNA, 27 nt, Human
ccccucuggccccagcgccgccggcuc

SEQ ID NO: 944311 - RNA, 19 nt, Human
ccccuucgccuccgccgcc

SEQ ID NO: 944312 - RNA, 20 nt, Human
ccccuucgccuccgccgcca

SEQ ID NO: 944313 - RNA, 19 nt, Human
cccgagaggccggggcggg

SEQ ID NO: 944314 - RNA, 22 nt, Human
cccggcccgcgcgaacccuggc

SEQ ID NO: 944315 - RNA, 21 nt, Human
cccucgggcucaccguacagc

SEQ ID NO: 944316 - RNA, 21 nt, Human
cccucuggccccagcgccgcc

SEQ ID NO: 944317 - RNA, 27 nt, Human
ccgccaccuccgccaccucccguccgg

SEQ ID NO: 944318 - RNA, 18 nt, Human
ccgccccuucgccuccgc

SEQ ID NO: 944319 - RNA, 25 nt, Human
ccgccgccaccuccgccaccucccg

SEQ ID NO: 944320 - RNA, 18 nt, Human
ccgcgcccgccuaggugc

SEQ ID NO: 944321 - RNA, 21 nt, Human
ccuauggguuaaaaaacaagg

SEQ ID NO: 944322 - RNA, 20 nt, Human
ccuccgccaccucccguccg

SEQ ID NO: 944323 - RNA, 24 nt, Human
ccuccgccgccaccuccgccaccu

SEQ ID NO: 944324 - RNA, 20 nt, Human
ccuccuguccaccucacuaa

SEQ ID NO: 944325 - RNA, 19 nt, Human
ccucugccccacggcuccc

SEQ ID NO: 944326 - RNA, 21 nt, Human
ccugggccaggccgccaggac

SEQ ID NO: 944327 - RNA, 22 nt, Human
cgccaggacacacacgggccag

SEQ ID NO: 944328 - RNA, 23 nt, Human
cgcccgccuaggugcuggcccgg

SEQ ID NO: 944329 - RNA, 21 nt, Human
cgccuaggugcuggcccgggc

SEQ ID NO: 944330 - RNA, 20 nt, Human
cggcagccugggccaggccg

SEQ ID NO: 944331 - RNA, 23 nt, Human
cggcucccgagaggccggggcgg

SEQ ID NO: 944332 - RNA, 18 nt, Human
cgggacccagauccgccu

SEQ ID NO: 944333 - RNA, 24 nt, Human
cucaccaacaauauguccugucuu

SEQ ID NO: 944334 - RNA, 25 nt, Human
cucaccaacaauauguccugucuua

SEQ ID NO: 944335 - RNA, 21 nt, Human
cucauagccucugagaucuuu

SEQ ID NO: 944336 - RNA, 22 nt, Human
cucugccccacggcucccgaga

SEQ ID NO: 944337 - RNA, 21 nt, Human
cuggccugcacacccccgcgc

SEQ ID NO: 944338 - RNA, 23 nt, Human
cuggggcuccgcagccucugccc

SEQ ID NO: 944339 - RNA, 21 nt, Human
cuucuggggcuccgcagccuc

SEQ ID NO: 944340 - RNA, 19 nt, Human
gaggggcccgggccgggcc

SEQ ID NO: 944341 - RNA, 20 nt, Human
gaggggcccgggccgggccu

SEQ ID NO: 944342 - RNA, 21 nt, Human
gagguccccuccuguccaccu

SEQ ID NO: 944343 - RNA, 22 nt, Human
gauccgccucccucgggcucac

SEQ ID NO: 944344 - RNA, 19 nt, Human
gccuccgccgccaccuccg

SEQ ID NO: 944345 - RNA, 19 nt, Human
gcucccgagaggccggggc

SEQ ID NO: 944346 - RNA, 19 nt, Human
ggccaggcccgcgucccgc

SEQ ID NO: 944347 - RNA, 20 nt, Human
ggcucaccguacagcggcag

SEQ ID NO: 944348 - RNA, 23 nt, Human
guaucaggucauaugaccacuau

SEQ ID NO: 944349 - RNA, 23 nt, Human
guuaaguaagucccuuucaaucc

SEQ ID NO: 944350 - RNA, 24 nt, Human
uaaaaaacaaggguggugugagaa

SEQ ID NO: 944351 - RNA, 23 nt, Human
uaagacaugauaaaaaacggcca

SEQ ID NO: 944352 - RNA, 19 nt, Human
uaauacauuuugccauccu

SEQ ID NO: 944353 - RNA, 21 nt, Human
uaccaaacagaaguuugugaa

SEQ ID NO: 944354 - RNA, 20 nt, Human
uagccucugagaucuuuccu

SEQ ID NO: 944355 - RNA, 22 nt, Human
uauauaaauuaguguccgauga

SEQ ID NO: 944356 - RNA, 22 nt, Human
uaugaccacuauaaaacaaggg

SEQ ID NO: 944357 - RNA, 21 nt, Human
uaugaccacuauaaaacaagu

SEQ ID NO: 944358 - RNA, 25 nt, Human
uauuuauaaaacuucacuccuauau

SEQ ID NO: 944359 - RNA, 21 nt, Human
ucaaccuccagccccgcaggc

SEQ ID NO: 944360 - RNA, 23 nt, Human
uccagcaagaaauggagcgagga

SEQ ID NO: 944361 - RNA, 22 nt, Human
uccagccccgcaggcuccgcga

SEQ ID NO: 944362 - RNA, 20 nt, Human
ucccgaggggcccgggccgg

SEQ ID NO: 944363 - RNA, 22 nt, Human
ucccgggacccagauccgccuc

SEQ ID NO: 944364 - RNA, 24 nt, Human
ucccguccggccccucuggccccc

SEQ ID NO: 944365 - RNA, 26 nt, Human
ucccucgggcucaccguacagcggca

SEQ ID NO: 944366 - RNA, 19 nt, Human
uccgcagccucugccccac

SEQ ID NO: 944367 - RNA, 21 nt, Human
uccgccgccaccuccgccacc

SEQ ID NO: 944368 - RNA, 22 nt, Human
uccgccucccucgggcucaccg

SEQ ID NO: 944369 - RNA, 21 nt, Human
uccggccccucuggccccagc

SEQ ID NO: 944370 - RNA, 20 nt, Human
ucgccuccgccgccaccucc

SEQ ID NO: 944371 - RNA, 25 nt, Human
ucuugcugaaggcuuuggagcucau

SEQ ID NO: 944372 - RNA, 24 nt, Human
ugacuugugaauauuaagccaccu

SEQ ID NO: 944373 - RNA, 25 nt, Human
ugacuugugaauauuaagccaccuu

SEQ ID NO: 944374 - RNA, 24 nt, Human
ugaggcauuuguuaaaaacccauu

SEQ ID NO: 944375 - RNA, 24 nt, Human
ugcaugccagauuacuuuucuaca

SEQ ID NO: 944376 - RNA, 21 nt, Human
ugcauuccuggaacacaaucu

SEQ ID NO: 944377 - RNA, 22 nt, Human
ugccccacggcucccgagaggc

SEQ ID NO: 944378 - RNA, 21 nt, Human
ugcuaagaucauaaacgaaca

SEQ ID NO: 944379 - RNA, 18 nt, Human
uggcugguagacccuucu

SEQ ID NO: 944380 - RNA, 21 nt, Human
ugguagacccuucuggggcuc

SEQ ID NO: 944381 - RNA, 18 nt, Human
uggugugagagcugggga

SEQ ID NO: 944382 - RNA, 27 nt, Human
uguuaaaaacccauuuguaaauuccuc

SEQ ID NO: 944383 - RNA, 21 nt, Human
uuaaauauuaucucaccaaca

SEQ ID NO: 944384 - RNA, 22 nt, Human
uuaaauauuaucucaccaacaa

SEQ ID NO: 944385 - RNA, 21 nt, Human
uucauuuuauacaaugaagau

SEQ ID NO: 944386 - RNA, 22 nt, Human
uuccaaauuauguauguauagu

SEQ ID NO: 944387 - RNA, 21 nt, Human
uucccgggacccagauccgcc

SEQ ID NO: 944388 - RNA, 24 nt, Human
aaaaaaaacgauaaugaaaaaaaa

SEQ ID NO: 944389 - RNA, 30 nt, Human
aaaaauaaaaaaaacgauaaugaaaaaaaa

SEQ ID NO: 944390 - RNA, 24 nt, Human
aacgaaaaacaaaaguaaagagga

SEQ ID NO: 944391 - RNA, 22 nt, Human
aacucugaaauuacauagaaaa

SEQ ID NO: 944392 - RNA, 24 nt, Human
aagaaaaaagaagagagaggggca

SEQ ID NO: 944393 - RNA, 27 nt, Human
aagaaaaaagaagagagaggggcauag

SEQ ID NO: 944394 - RNA, 21 nt, Human
aagaagagagaggggcauaga

SEQ ID NO: 944395 - RNA, 23 nt, Human
aaugaaaaaaaacacaacauaaa

SEQ ID NO: 944396 - RNA, 18 nt, Human
acaacauaaacccccuac

SEQ ID NO: 944397 - RNA, 23 nt, Human
acaacauaaacccccuacucacc

SEQ ID NO: 944398 - RNA, 22 nt, Human
acgauaaugaaaaaaaacacaa

SEQ ID NO: 944399 - RNA, 23 nt, Human
acgauaaugaaaaaaaacacaac

SEQ ID NO: 944400 - RNA, 24 nt, Human
acucugaaauuacauagaaaaaag

SEQ ID NO: 944401 - RNA, 19 nt, Human
agcaguaacuauucagcug

SEQ ID NO: 944402 - RNA, 20 nt, Human
aggauauacuuagcaauguc

SEQ ID NO: 944403 - RNA, 24 nt, Human
agugcuucacaaaaauaaaaaaaa

SEQ ID NO: 944404 - RNA, 19 nt, Human
aucuucgcagucgcuagaa

SEQ ID NO: 944405 - RNA, 22 nt, Human
auuacaacuguaguuuucaguc

SEQ ID NO: 944406 - RNA, 23 nt, Human
auuacaacuguaguuuucaguca

SEQ ID NO: 944407 - RNA, 30 nt, Human
caacaaacgaaaaacaaaaguaaagaggaa

SEQ ID NO: 944408 - RNA, 21 nt, Human
caagaaaaaagaagagagaaa

SEQ ID NO: 944409 - RNA, 22 nt, Human
caaguugcaagauaauaccuua

SEQ ID NO: 944410 - RNA, 18 nt, Human
caccugaaagcuuuauua

SEQ ID NO: 944411 - RNA, 21 nt, Human
cagccuggaaaaguauacagg

SEQ ID NO: 944412 - RNA, 22 nt, Human
cgaaaaacaaaaguaaagagga

SEQ ID NO: 944413 - RNA, 21 nt, Human
cuaucuucgcagucgcuagaa

SEQ ID NO: 944414 - RNA, 21 nt, Human
gaaaaacaaaaguaaagagga

SEQ ID NO: 944415 - RNA, 18 nt, Human
gcaggcugcuuaaccuuc

SEQ ID NO: 944416 - RNA, 26 nt, Human
gucagcuccagaguccuccuccccuc

SEQ ID NO: 944417 - RNA, 28 nt, Human
uaaaaaaaacgauaaugaaaaaaaacac

SEQ ID NO: 944418 - RNA, 22 nt, Human
uaaaaaauacauaaaaauacaa

SEQ ID NO: 944419 - RNA, 19 nt, Human
uaaacccccuacucaccaa

SEQ ID NO: 944420 - RNA, 21 nt, Human
uaaauagcaagugcuucacaa

SEQ ID NO: 944421 - RNA, 20 nt, Human
uaagauaguccacugaaaaa

SEQ ID NO: 944422 - RNA, 24 nt, Human
uaagauaguccacugaaaacuuau

SEQ ID NO: 944423 - RNA, 24 nt, Human
uacauagaaaaaagacaaaauauu

SEQ ID NO: 944424 - RNA, 22 nt, Human
uaguuuucagucaacuacacuu

SEQ ID NO: 944425 - RNA, 18 nt, Human
uauucagcuggguaauau

SEQ ID NO: 944426 - RNA, 24 nt, Human
uauuuugucccauuuacaccuuca

SEQ ID NO: 944427 - RNA, 24 nt, Human
ucaaaccaguugagugcuuucugu

SEQ ID NO: 944428 - RNA, 21 nt, Human
ucugaaauuacauagaaaaaa

SEQ ID NO: 944429 - RNA, 23 nt, Human
ugaaaaaaaacacaacauaaacc

SEQ ID NO: 944430 - RNA, 19 nt, Human
ugcuaagugcccuuuguuc

SEQ ID NO: 944431 - RNA, 19 nt, Human
uggaagacuuauuacaacu

SEQ ID NO: 944432 - RNA, 20 nt, Human
ugucaagggauaagauaguc

SEQ ID NO: 944433 - RNA, 18 nt, Human
ugucccauuuacaccuuc

SEQ ID NO: 944434 - RNA, 24 nt, Human
uucuguaacaccugaaagcuuuau

SEQ ID NO: 944435 - RNA, 21 nt, Human
aaaaaaaaaaaaaaaaccaac

SEQ ID NO: 944436 - RNA, 26 nt, Human
aaaaaaaaaaccaacaacaaaaaaga

SEQ ID NO: 944437 - RNA, 23 nt, Human
aaaaaaaaccaacaacaaaaaaa

SEQ ID NO: 944438 - RNA, 20 nt, Human
aaaagcaacucuuaucaagg

SEQ ID NO: 944439 - RNA, 21 nt, Human
aaacuaguggucaaggacuaa

SEQ ID NO: 944440 - RNA, 22 nt, Human
aacaugaaaacagcucaagaaa

SEQ ID NO: 944441 - RNA, 22 nt, Human
aacuccuaaaaaaaaaaagcaa

SEQ ID NO: 944442 - RNA, 23 nt, Human
aagcaacucuuaucaaggauuaa

SEQ ID NO: 944443 - RNA, 19 nt, Human
aagucugucucaaaaccag

SEQ ID NO: 944444 - RNA, 23 nt, Human
acaaaaaaaaaaacaccauuuca

SEQ ID NO: 944445 - RNA, 21 nt, Human
acacuaacgagcaaaaauaua

SEQ ID NO: 944446 - RNA, 23 nt, Human
acagacaggaaauaaacaacaug

SEQ ID NO: 944447 - RNA, 21 nt, Human
acaggaaauaaacaacaugaa

SEQ ID NO: 944448 - RNA, 24 nt, Human
acaggaaauaaacaacaugaaaac

SEQ ID NO: 944449 - RNA, 23 nt, Human
acugucagguaaaaacauacauc

SEQ ID NO: 944450 - RNA, 22 nt, Human
agacaggaaauaaacaacauga

SEQ ID NO: 944451 - RNA, 22 nt, Human
aggaaauaaacaacaugaaaac

SEQ ID NO: 944452 - RNA, 19 nt, Human
caacaaaaaaaaaaacacc

SEQ ID NO: 944453 - RNA, 30 nt, Human
caacaaaaaaaaaaacaccauuucacagaa

SEQ ID NO: 944454 - RNA, 25 nt, Human
caagaaauacacuaacgagcaaaaa

SEQ ID NO: 944455 - RNA, 24 nt, Human
cagacaggaaauaaacaacaugaa

SEQ ID NO: 944456 - RNA, 23 nt, Human
cagcucaagaaauacacuaacga

SEQ ID NO: 944457 - RNA, 20 nt, Human
cauggcucagacaccuaccc

SEQ ID NO: 944458 - RNA, 22 nt, Human
ccaaaauggagauggcaucaaa

SEQ ID NO: 944459 - RNA, 25 nt, Human
ccaaguuaaaaaaaaaaaaaaaaaa

SEQ ID NO: 944460 - RNA, 24 nt, Human
cccccuauuaauauuuagaaaaac

SEQ ID NO: 944461 - RNA, 23 nt, Human
cccccuauuuccugaauaaaagu

SEQ ID NO: 944462 - RNA, 19 nt, Human
ccugaauaaaagugacauc

SEQ ID NO: 944463 - RNA, 25 nt, Human
cuaacuccuaaaaaaaaaaagcaac

SEQ ID NO: 944464 - RNA, 26 nt, Human
cuagaaaauuccugaagaaaauuuca

SEQ ID NO: 944465 - RNA, 23 nt, Human
cucccccuauuuccugaauaaaa

SEQ ID NO: 944466 - RNA, 27 nt, Human
cuccuaaaaaaaaaaagcaacucuuau

SEQ ID NO: 944467 - RNA, 24 nt, Human
cuguagcuacuuuagaccuggguu

SEQ ID NO: 944468 - RNA, 24 nt, Human
gaaaacagcucaagaaauacacua

SEQ ID NO: 944469 - RNA, 25 nt, Human
gaaaacagcucaagaaauacacuaa

SEQ ID NO: 944470 - RNA, 18 nt, Human
gagaagaaaaaaggggag

SEQ ID NO: 944471 - RNA, 21 nt, Human
gcaggcgagccgggggaaucc

SEQ ID NO: 944472 - RNA, 19 nt, Human
gcauccuggaaagucaggu

SEQ ID NO: 944473 - RNA, 22 nt, Human
ggcaggcgagccgggggaaucc

SEQ ID NO: 944474 - RNA, 24 nt, Human
gguuacuagaaaauuccugaagaa

SEQ ID NO: 944475 - RNA, 23 nt, Human
uaacaggccugcuggugaaacaa

SEQ ID NO: 944476 - RNA, 20 nt, Human
uaacugaagaaaccaagagg

SEQ ID NO: 944477 - RNA, 19 nt, Human
uaagaagaaaaauaaucac

SEQ ID NO: 944478 - RNA, 22 nt, Human
uacaaguuauugauucacucuu

SEQ ID NO: 944479 - RNA, 22 nt, Human
uagcauaagaagaaaaauaauc

SEQ ID NO: 944480 - RNA, 23 nt, Human
uauauggggaaagaggaacgugu

SEQ ID NO: 944481 - RNA, 24 nt, Human
ucccaaguuaaaaaaaaaaaaaaa

SEQ ID NO: 944482 - RNA, 26 nt, Human
ucccaaguuaaaaaaaaaaaaaaaaa

SEQ ID NO: 944483 - RNA, 27 nt, Human
ucccaaguuaaaaaaaaaaaaaaaaaa

SEQ ID NO: 944484 - RNA, 22 nt, Human
ucucaaaaccaguguuaaauca

SEQ ID NO: 944485 - RNA, 21 nt, Human
ugaaaacagcucaagaaauac

SEQ ID NO: 944486 - RNA, 18 nt, Human
ugaauaaaagugacaucu

SEQ ID NO: 944487 - RNA, 22 nt, Human
uggcucagacaccuaccucauu

SEQ ID NO: 944488 - RNA, 24 nt, Human
uggcucuauuccuuacucacucua

SEQ ID NO: 944489 - RNA, 25 nt, Human
uggucccaaguuaaaaaaaaaaaaa

SEQ ID NO: 944490 - RNA, 22 nt, Human
uuaaaugagucugaaaaacuug

SEQ ID NO: 944491 - RNA, 21 nt, Human
uucacagacaggaaauaaaca

SEQ ID NO: 944492 - RNA, 22 nt, Human
uugcgggaggggcggggaggcu

SEQ ID NO: 944493 - RNA, 24 nt, Human
uugcgggaggggcggggaggcugc

SEQ ID NO: 944494 - RNA, 22 nt, Human
aaugacccaaggcucauugggg

SEQ ID NO: 944495 - RNA, 25 nt, Human
aucauuguaaauauuuucagccauu

SEQ ID NO: 944496 - RNA, 19 nt, Human
aucuucugcaucuucugcu

SEQ ID NO: 944497 - RNA, 23 nt, Human
caaaggcaauacccugcuacuug

SEQ ID NO: 944498 - RNA, 21 nt, Human
cauuguaaauauuuucagcca

SEQ ID NO: 944499 - RNA, 18 nt, Human
ccagcuaaaaucugaaau

SEQ ID NO: 944500 - RNA, 18 nt, Human
cccacacauucaggcggc

SEQ ID NO: 944501 - RNA, 21 nt, Human
ccuccaugaauaaacaggagu

SEQ ID NO: 944502 - RNA, 28 nt, Human
cgcaacagcucacuugaaagugcuagaa

SEQ ID NO: 944503 - RNA, 23 nt, Human
cugcaaagccaaucaagaagugu

SEQ ID NO: 944504 - RNA, 23 nt, Human
gaaagugcuagaaucagaggaua

SEQ ID NO: 944505 - RNA, 21 nt, Human
uaaagaagccauaagccaccc

SEQ ID NO: 944506 - RNA, 20 nt, Human
uaaguuacgcagaucccaua

SEQ ID NO: 944507 - RNA, 24 nt, Human
uagcauuacauucaacagaaacau

SEQ ID NO: 944508 - RNA, 22 nt, Human
ucauugggguuccagcuaaaau

SEQ ID NO: 944509 - RNA, 23 nt, Human
ucauuguaaauauuuucagccau

SEQ ID NO: 944510 - RNA, 20 nt, Human
uccagauuuuauauucuuca

SEQ ID NO: 944511 - RNA, 26 nt, Human
ucuucugcugauuguucuuccccaau

SEQ ID NO: 944512 - RNA, 20 nt, Human
ugagcaaaugacccaaggcu

SEQ ID NO: 944513 - RNA, 20 nt, Human
uguggagaccaguggaccug

SEQ ID NO: 944514 - RNA, 20 nt, Human
uugaagccagaauaguuuca

SEQ ID NO: 944515 - RNA, 21 nt, Human
uuuaagauccuugucccucca

SEQ ID NO: 944516 - RNA, 21 nt, Human
uuuuaaguuacgcagauccca

SEQ ID NO: 944517 - RNA, 26 nt, Human
aaaaauaggaaacuugauuuagacaa

SEQ ID NO: 944518 - RNA, 22 nt, Human
aaaagacaagauagccaugaca

SEQ ID NO: 944519 - RNA, 23 nt, Human
aacaugcaaaagaaacauccaag

SEQ ID NO: 944520 - RNA, 18 nt, Human
aggcaaaaauugaacagc

SEQ ID NO: 944521 - RNA, 19 nt, Human
agugguuaauucccaacug

SEQ ID NO: 944522 - RNA, 21 nt, Human
auaaauacacaauuguauaaa

SEQ ID NO: 944523 - RNA, 25 nt, Human
aucaauguguucaauaagugacuuu

SEQ ID NO: 944524 - RNA, 27 nt, Human
auugaauugagugguuaauucccaacu

SEQ ID NO: 944525 - RNA, 20 nt, Human
caacugaguugcaugacucu

SEQ ID NO: 944526 - RNA, 19 nt, Human
caaggcaaaaauugaacag

SEQ ID NO: 944527 - RNA, 23 nt, Human
caauuguauaaaaagggaaugau

SEQ ID NO: 944528 - RNA, 22 nt, Human
cacuuuauaaaauaaaccugaa

SEQ ID NO: 944529 - RNA, 18 nt, Human
cauuaggaacaauaugca

SEQ ID NO: 944530 - RNA, 21 nt, Human
cauuaggaacaauaugcaauc

SEQ ID NO: 944531 - RNA, 21 nt, Human
cauugaaucccagccuauuug

SEQ ID NO: 944532 - RNA, 21 nt, Human
cuaggcaacaugcaaaagaaa

SEQ ID NO: 944533 - RNA, 18 nt, Human
gcaucucaaaccuugcua

SEQ ID NO: 944534 - RNA, 24 nt, Human
uaaaagaaagggguacuaaugccu

SEQ ID NO: 944535 - RNA, 21 nt, Human
uaauacacacugacauagcca

SEQ ID NO: 944536 - RNA, 18 nt, Human
uaauaugugagaagagga

SEQ ID NO: 944537 - RNA, 18 nt, Human
uacacacugacauagcca

SEQ ID NO: 944538 - RNA, 20 nt, Human
uauaaacaaaaaugcccaaa

SEQ ID NO: 944539 - RNA, 22 nt, Human
uauaggggauaaucaaagggaa

SEQ ID NO: 944540 - RNA, 19 nt, Human
uauauauauucaucacucu

SEQ ID NO: 944541 - RNA, 25 nt, Human
uauucuauuuacuugcucauuuuca

SEQ ID NO: 944542 - RNA, 22 nt, Human
ucaaaagacaagauagccauga

SEQ ID NO: 944543 - RNA, 20 nt, Human
ucaauguguucaauaaguga

SEQ ID NO: 944544 - RNA, 22 nt, Human
ugccaaugggucaaaaauauca

SEQ ID NO: 944545 - RNA, 18 nt, Human
ugcuagcaaaagagguga

SEQ ID NO: 944546 - RNA, 27 nt, Human
uggcucagaaacaacauauuuagguac

SEQ ID NO: 944547 - RNA, 21 nt, Human
ugggucaaaaauaucaugaca

SEQ ID NO: 944548 - RNA, 19 nt, Human
uucaaaagacaagauagcc

SEQ ID NO: 944549 - RNA, 23 nt, Human
uucaucacucuaguuuguaauga

SEQ ID NO: 944550 - RNA, 21 nt, Human
uuuggugaaauuucaucauug

SEQ ID NO: 944551 - RNA, 21 nt, Human
uuuuuuuuuuuuuuuuucauu

SEQ ID NO: 944552 - RNA, 24 nt, Human
aaaaaaccaacaaaacaguucugc

SEQ ID NO: 944553 - RNA, 23 nt, Human
aaaaaccuagauauaacacuuuc

SEQ ID NO: 944554 - RNA, 25 nt, Human
aaaggcucugguagauaaaggacuc

SEQ ID NO: 944555 - RNA, 22 nt, Human
aacaaucuggaugcauuaauca

SEQ ID NO: 944556 - RNA, 18 nt, Human
aaccaaucuagacuccuu

SEQ ID NO: 944557 - RNA, 24 nt, Human
aagaagcaauaaagguacauacaa

SEQ ID NO: 944558 - RNA, 20 nt, Human
aagagcacccucaaugaguu

SEQ ID NO: 944559 - RNA, 21 nt, Human
aagcagcaaccuucugaagca

SEQ ID NO: 944560 - RNA, 19 nt, Human
aagucaauccugugggcaa

SEQ ID NO: 944561 - RNA, 18 nt, Human
acaaaacaguucugcuca

SEQ ID NO: 944562 - RNA, 19 nt, Human
acaaaacaguucugcucau

SEQ ID NO: 944563 - RNA, 22 nt, Human
acaaaaccaaucuagacuccuu

SEQ ID NO: 944564 - RNA, 22 nt, Human
accauccaaacaacaugaacaa

SEQ ID NO: 944565 - RNA, 23 nt, Human
acccagaccccgaauuacccccc

SEQ ID NO: 944566 - RNA, 18 nt, Human
agacaaacaaagcagcaa

SEQ ID NO: 944567 - RNA, 21 nt, Human
agcugcgcggcaccagaaccc

SEQ ID NO: 944568 - RNA, 22 nt, Human
agucuuauuccacacaguuuua

SEQ ID NO: 944569 - RNA, 21 nt, Human
auaccauccaaacaacaugaa

SEQ ID NO: 944570 - RNA, 22 nt, Human
caaagcagcaaccuucugaagc

SEQ ID NO: 944571 - RNA, 19 nt, Human
caacaaaacaguucugcuc

SEQ ID NO: 944572 - RNA, 24 nt, Human
caacuucaguuuuaaaaaccuaga

SEQ ID NO: 944573 - RNA, 21 nt, Human
caaugaguucuacugacauuu

SEQ ID NO: 944574 - RNA, 18 nt, Human
caauuagacaaacaaagc

SEQ ID NO: 944575 - RNA, 19 nt, Human
cacauaaucgggacaggag

SEQ ID NO: 944576 - RNA, 24 nt, Human
cagaacccagaccccgaauuaccc

SEQ ID NO: 944577 - RNA, 20 nt, Human
cagaccccgaauuacccccc

SEQ ID NO: 944578 - RNA, 21 nt, Human
cagccccagcccgaacggcuu

SEQ ID NO: 944579 - RNA, 23 nt, Human
cagguucuaaccuggaaauacua

SEQ ID NO: 944580 - RNA, 23 nt, Human
ccagaacccagaccccgaauuac

SEQ ID NO: 944581 - RNA, 26 nt, Human
ccagcccgaacggcuucccggagccc

SEQ ID NO: 944582 - RNA, 19 nt, Human
cccccgcgcgagugccucc

SEQ ID NO: 944583 - RNA, 22 nt, Human
cccgaauuaccccccgcgcgag

SEQ ID NO: 944584 - RNA, 24 nt, Human
cccgcgcgagugccuccgccccgc

SEQ ID NO: 944585 - RNA, 21 nt, Human
cccggagcccaacgcagccac

SEQ ID NO: 944586 - RNA, 21 nt, Human
ccgcgcgagugccuccgcccc

SEQ ID NO: 944587 - RNA, 18 nt, Human
ccgcggccgacagcccca

SEQ ID NO: 944588 - RNA, 21 nt, Human
cgaacggcuucccggagccca

SEQ ID NO: 944589 - RNA, 23 nt, Human
cgagugccuccgccccgcggccg

SEQ ID NO: 944590 - RNA, 30 nt, Human
cgcugaaaccacacacaccugauaaaacaa

SEQ ID NO: 944591 - RNA, 20 nt, Human
cggcaccagaacccagaccc

SEQ ID NO: 944592 - RNA, 25 nt, Human
cuccgccccgcggccgacagcccca

SEQ ID NO: 944593 - RNA, 23 nt, Human
cucugguagauaaaggacuccau

SEQ ID NO: 944594 - RNA, 20 nt, Human
gaagaucuacccuauaaaaa

SEQ ID NO: 944595 - RNA, 20 nt, Human
gagcccaacgcagccaccac

SEQ ID NO: 944596 - RNA, 20 nt, Human
gauaccauccaaacaacaug

SEQ ID NO: 944597 - RNA, 23 nt, Human
gcaauaaagguacauacaaugaa

SEQ ID NO: 944598 - RNA, 20 nt, Human
gcccgaacggcuucccggag

SEQ ID NO: 944599 - RNA, 24 nt, Human
gcggcaccagaacccagaccccga

SEQ ID NO: 944600 - RNA, 22 nt, Human
guacauacaaugaaucuguaua

SEQ ID NO: 944601 - RNA, 22 nt, Human
uaaaacaaaaccaaucuagacu

SEQ ID NO: 944602 - RNA, 19 nt, Human
uaacaaagcaaaucugucc

SEQ ID NO: 944603 - RNA, 19 nt, Human
uaacaagaaguagaggcca

SEQ ID NO: 944604 - RNA, 22 nt, Human
uaacaagaaguagaggccaagu

SEQ ID NO: 944605 - RNA, 18 nt, Human
uaaccuaaaucguggcgg

SEQ ID NO: 944606 - RNA, 25 nt, Human
uaagaagcaauaaagguacauacaa

SEQ ID NO: 944607 - RNA, 22 nt, Human
uacagcaaggacccuuaagaag

SEQ ID NO: 944608 - RNA, 21 nt, Human
uacauacaaugaaucuguaua

SEQ ID NO: 944609 - RNA, 25 nt, Human
uagcuuuacuguaacauacagcaau

SEQ ID NO: 944610 - RNA, 24 nt, Human
uauggaaaccaagcuauaugcaau

SEQ ID NO: 944611 - RNA, 19 nt, Human
ucagcagcuggcaagagca

SEQ ID NO: 944612 - RNA, 21 nt, Human
uccuuaacaagaaguagaggc

SEQ ID NO: 944613 - RNA, 22 nt, Human
ucgauaccauccaaacaacaug

SEQ ID NO: 944614 - RNA, 20 nt, Human
ucgggacaggaggaaauuga

SEQ ID NO: 944615 - RNA, 25 nt, Human
ucuauacuacuacugcuaacaaaga

SEQ ID NO: 944616 - RNA, 23 nt, Human
ugaacaauuuuuaaacugacuaa

SEQ ID NO: 944617 - RNA, 19 nt, Human
ugagucaauuagacaaaca

SEQ ID NO: 944618 - RNA, 26 nt, Human
ugccuccgccccgcggccgacagccc

SEQ ID NO: 944619 - RNA, 21 nt, Human
uggcaaaagucuuauuccaca

SEQ ID NO: 944620 - RNA, 23 nt, Human
ugugacauuagaaaucaaaguuu

SEQ ID NO: 944621 - RNA, 21 nt, Human
uguucucuccagauagcuuua

SEQ ID NO: 944622 - RNA, 21 nt, Human
uuagacaaacaaagcagcaac

SEQ ID NO: 944623 - RNA, 21 nt, Human
uuaguccauaugaaaaggacu

SEQ ID NO: 944624 - RNA, 23 nt, Human
uucugcucauuuacaaaugaguc

SEQ ID NO: 944625 - RNA, 21 nt, Human
uuucugguuuucgauaccauc

SEQ ID NO: 944626 - RNA, 23 nt, Human
aaaaaaauaaaaacauaaaagaa

SEQ ID NO: 944627 - RNA, 26 nt, Human
aaaccgcagaucuagagccaguagca

SEQ ID NO: 944628 - RNA, 20 nt, Human
aaggcgccggcgaccucagc

SEQ ID NO: 944629 - RNA, 23 nt, Human
acccuacccaccucuuuucuccc

SEQ ID NO: 944630 - RNA, 23 nt, Human
accucuuuucucccucccucccu

SEQ ID NO: 944631 - RNA, 23 nt, Human
acucagucucaacagucuacaga

SEQ ID NO: 944632 - RNA, 23 nt, Human
agacaggaggcaggguagagggg

SEQ ID NO: 944633 - RNA, 18 nt, Human
agccaggaaaaaaauaaa

SEQ ID NO: 944634 - RNA, 21 nt, Human
agcugacccuuuccuggccuc

SEQ ID NO: 944635 - RNA, 26 nt, Human
aggaaaaaaauaaaaacauaaaagaa

SEQ ID NO: 944636 - RNA, 21 nt, Human
aggcaagacguccgaacgacc

SEQ ID NO: 944637 - RNA, 19 nt, Human
aggcgccggcgaccucagc

SEQ ID NO: 944638 - RNA, 25 nt, Human
caccucuuuucucccucccucccug

SEQ ID NO: 944639 - RNA, 19 nt, Human
cagucaggguacccuggac

SEQ ID NO: 944640 - RNA, 19 nt, Human
caucuaaaaagaaaaaggc

SEQ ID NO: 944641 - RNA, 22 nt, Human
caucuaaaaagaaaaaggcgcc

SEQ ID NO: 944642 - RNA, 24 nt, Human
caucuccuggggaaggcccacaug

SEQ ID NO: 944643 - RNA, 19 nt, Human
ccaggaaaaaaauaaaaac

SEQ ID NO: 944644 - RNA, 22 nt, Human
ccauacaaaagggaaaaaaaau

SEQ ID NO: 944645 - RNA, 20 nt, Human
cccaccucuuuucucccucc

SEQ ID NO: 944646 - RNA, 23 nt, Human
cccuuuccuggccuccuucccau

SEQ ID NO: 944647 - RNA, 22 nt, Human
ccgaacacuuaacaggaucauc

SEQ ID NO: 944648 - RNA, 24 nt, Human
ccucagcugcagguugcuucccca

SEQ ID NO: 944649 - RNA, 19 nt, Human
cuccuucccaucuaaaaag

SEQ ID NO: 944650 - RNA, 22 nt, Human
cugcugaggcgaaggaacaaag

SEQ ID NO: 944651 - RNA, 25 nt, Human
gacccuuuccuggccuccuucccau

SEQ ID NO: 944652 - RNA, 22 nt, Human
gaucuguaacccuacccaccuc

SEQ ID NO: 944653 - RNA, 20 nt, Human
gcgcacaaaaauaaaaggga

SEQ ID NO: 944654 - RNA, 19 nt, Human
gggcaugaaaaaccacaac

SEQ ID NO: 944655 - RNA, 20 nt, Human
gggcaugaaaaaccacaacc

SEQ ID NO: 944656 - RNA, 22 nt, Human
guagagggcaugaaaaaccaca

SEQ ID NO: 944657 - RNA, 18 nt, Human
uaguccauacaaaaggga

SEQ ID NO: 944658 - RNA, 18 nt, Human
uauaaccuggaucuguaa

SEQ ID NO: 944659 - RNA, 23 nt, Human
uccccauccagacgaccuuaaau

SEQ ID NO: 944660 - RNA, 18 nt, Human
ugaaaaaccacaaccagg

SEQ ID NO: 944661 - RNA, 24 nt, Human
uggcacagcuuggcacauaggaaa

SEQ ID NO: 944662 - RNA, 21 nt, Human
ugggccagaguaguuauaacc

SEQ ID NO: 944663 - RNA, 20 nt, Human
uggggaaggcccacauggua

SEQ ID NO: 944664 - RNA, 20 nt, Human
uggggaagugggacugugcc

SEQ ID NO: 944665 - RNA, 21 nt, Human
uggggagauggggaaguggga

SEQ ID NO: 944666 - RNA, 21 nt, Human
uucccaucuaaaaagaaaaag

SEQ ID NO: 944667 - RNA, 20 nt, Human
uuuguaguccauacaaaagg

SEQ ID NO: 944668 - RNA, 25 nt, Human
aaagacaucacaacaaaugacagag

SEQ ID NO: 944669 - RNA, 19 nt, Human
aaaggagccagauuuggca

SEQ ID NO: 944670 - RNA, 20 nt, Human
aaggagagaccgaagcagca

SEQ ID NO: 944671 - RNA, 20 nt, Human
aaggagccagauuuggcaac

SEQ ID NO: 944672 - RNA, 20 nt, Human
aaggugggagggagaacccu

SEQ ID NO: 944673 - RNA, 18 nt, Human
accacuucuugugcuccu

SEQ ID NO: 944674 - RNA, 24 nt, Human
accacuucuugugcuccuugucau

SEQ ID NO: 944675 - RNA, 23 nt, Human
acccuaagaucuauuaacagcac

SEQ ID NO: 944676 - RNA, 19 nt, Human
acuggaguauaaacaaucc

SEQ ID NO: 944677 - RNA, 21 nt, Human
aggaaugugaggggcugaugg

SEQ ID NO: 944678 - RNA, 21 nt, Human
augacagagguggcuuuggug

SEQ ID NO: 944679 - RNA, 22 nt, Human
caacaaaugacagagguggcuu

SEQ ID NO: 944680 - RNA, 24 nt, Human
caacuagacugaaaaucuuccaaa

SEQ ID NO: 944681 - RNA, 25 nt, Human
caagaaaagacaucacaacaaauga

SEQ ID NO: 944682 - RNA, 18 nt, Human
caccaggcaacccacaua

SEQ ID NO: 944683 - RNA, 21 nt, Human
caccuacagcaucucaaaccc

SEQ ID NO: 944684 - RNA, 18 nt, Human
cacuauguacacuggagu

SEQ ID NO: 944685 - RNA, 22 nt, Human
cacuguccucuccggucuguuc

SEQ ID NO: 944686 - RNA, 19 nt, Human
caucucucucucucucucu

SEQ ID NO: 944687 - RNA, 18 nt, Human
ccaagaaaagacaucaca

SEQ ID NO: 944688 - RNA, 21 nt, Human
ccaagaaaagacaucacaaca

SEQ ID NO: 944689 - RNA, 23 nt, Human
ccauucaccaggcaacccacaua

SEQ ID NO: 944690 - RNA, 18 nt, Human
ccccagaaccuccaacaa

SEQ ID NO: 944691 - RNA, 23 nt, Human
cgccccagaaccuccaacaaggu

SEQ ID NO: 944692 - RNA, 18 nt, Human
cucucucucucucucucu

SEQ ID NO: 944693 - RNA, 18 nt, Human
cuugucaucucucucucu

SEQ ID NO: 944694 - RNA, 21 nt, Human
gcagcaguagcgguucugcgc

SEQ ID NO: 944695 - RNA, 25 nt, Human
gccaagaaaagacaucacaacaaau

SEQ ID NO: 944696 - RNA, 21 nt, Human
gccccagaaccuccaacaagg

SEQ ID NO: 944697 - RNA, 20 nt, Human
gcuacauuacacuauguacc

SEQ ID NO: 944698 - RNA, 21 nt, Human
gcugauggaccacaacauagg

SEQ ID NO: 944699 - RNA, 21 nt, Human
uacacaaaauggcgccuccgc

SEQ ID NO: 944700 - RNA, 22 nt, Human
uacagcaucucaaaccccuagg

SEQ ID NO: 944701 - RNA, 25 nt, Human
uagacugaaaaucuuccaaaauucu

SEQ ID NO: 944702 - RNA, 22 nt, Human
uauacacaaggcuuuugccaag

SEQ ID NO: 944703 - RNA, 24 nt, Human
uccaaaagguucaaauuuuauuuu

SEQ ID NO: 944704 - RNA, 22 nt, Human
ugccaagaaaagacaucacaac

SEQ ID NO: 944705 - RNA, 24 nt, Human
ugccaagaaaagacaucacaacaa

SEQ ID NO: 944706 - RNA, 22 nt, Human
uggcuuuggugucacauaccac

SEQ ID NO: 944707 - RNA, 21 nt, Human
uuagcacacagcuccaaaagg

SEQ ID NO: 944708 - RNA, 23 nt, Human
uuuuuuuuuuuuuuuucucaagg

SEQ ID NO: 944709 - RNA, 25 nt, Human
aaaaauuuauaaagaaaugugacaa

SEQ ID NO: 944710 - RNA, 25 nt, Human
aaaacaguaucuuaauacaagcuuu

SEQ ID NO: 944711 - RNA, 21 nt, Human
aaacaaaaaaacaaccuguac

SEQ ID NO: 944712 - RNA, 19 nt, Human
aaacucuuucaaagguuca

SEQ ID NO: 944713 - RNA, 27 nt, Human
aaagggccuaaaaugacccuauaaaaa

SEQ ID NO: 944714 - RNA, 21 nt, Human
aaauaucugcuuuaucauaca

SEQ ID NO: 944715 - RNA, 22 nt, Human
acaaaugcugugguauuaaaaa

SEQ ID NO: 944716 - RNA, 24 nt, Human
auaaaaacaauguccuuuuaacau

SEQ ID NO: 944717 - RNA, 26 nt, Human
caaaaaaacaaccuguacaaucucuu

SEQ ID NO: 944718 - RNA, 21 nt, Human
caacuucacccccuccuaaag

SEQ ID NO: 944719 - RNA, 22 nt, Human
cauacaacuucacccccuccua

SEQ ID NO: 944720 - RNA, 26 nt, Human
ccaaacuuuaccaauaagccuucuca

SEQ ID NO: 944721 - RNA, 24 nt, Human
ccccaaacuuuaccaauaagccuu

SEQ ID NO: 944722 - RNA, 23 nt, Human
ccuaaaaugacccuauaaaaaca

SEQ ID NO: 944723 - RNA, 22 nt, Human
ccuuuuauuuuuucaguauauu

SEQ ID NO: 944724 - RNA, 24 nt, Human
cucuguacaguuuuucaacaaaau

SEQ ID NO: 944725 - RNA, 23 nt, Human
cuuuaccaauaagccuucucaaa

SEQ ID NO: 944726 - RNA, 24 nt, Human
gcuuuaaaaaaauuuauaaagaaa

SEQ ID NO: 944727 - RNA, 25 nt, Human
gggcacuuugaaaauguuaaaguuu

SEQ ID NO: 944728 - RNA, 23 nt, Human
guagcacuuucuuuugcauaaaa

SEQ ID NO: 944729 - RNA, 21 nt, Human
gugucuuuguacacagucugg

SEQ ID NO: 944730 - RNA, 26 nt, Human
uaaaacccugaggugaaagguuauua

SEQ ID NO: 944731 - RNA, 25 nt, Human
uaaaauaucugcuuuaucauacaac

SEQ ID NO: 944732 - RNA, 22 nt, Human
uaagaaguuaagcaaugccuuu

SEQ ID NO: 944733 - RNA, 23 nt, Human
uaagauuaaacucuuucaaaggu

SEQ ID NO: 944734 - RNA, 24 nt, Human
uaagcaaugccuuuauccccaaac

SEQ ID NO: 944735 - RNA, 18 nt, Human
uacaacuucacccccucc

SEQ ID NO: 944736 - RNA, 21 nt, Human
uaccaguagccauuuuagacu

SEQ ID NO: 944737 - RNA, 18 nt, Human
uagaauguuaguaaagug

SEQ ID NO: 944738 - RNA, 18 nt, Human
uagacugucaaccuggau

SEQ ID NO: 944739 - RNA, 24 nt, Human
uaggguaaagcucaagagcauguc

SEQ ID NO: 944740 - RNA, 24 nt, Human
uauguguaaaucuacacauguaug

SEQ ID NO: 944741 - RNA, 22 nt, Human
ucacccccuccuaaagugucua

SEQ ID NO: 944742 - RNA, 24 nt, Human
uccccaaacuuuaccaauaagccu

SEQ ID NO: 944743 - RNA, 21 nt, Human
uguaaagcugcucuguacagu

SEQ ID NO: 944744 - RNA, 18 nt, Human
ugucuaaaaugauuagga

SEQ ID NO: 944745 - RNA, 18 nt, Human
ugugguauuaaaaaggau

SEQ ID NO: 944746 - RNA, 21 nt, Human
uguguaaaucuacacauguau

SEQ ID NO: 944747 - RNA, 21 nt, Human
uuaccaauaagccuucucaaa

SEQ ID NO: 944748 - RNA, 22 nt, Human
uucaaagguucaaacaaaaaaa

SEQ ID NO: 944749 - RNA, 18 nt, Human
uucaacuaggguaaagcu

SEQ ID NO: 944750 - RNA, 22 nt, Human
uucauuuuguauuaaacuguag

SEQ ID NO: 944751 - RNA, 27 nt, Human
uuuauaaacaauucuguaaugaaauga

SEQ ID NO: 944752 - RNA, 24 nt, Human
uuuccauaucaacuuagucaaagg

SEQ ID NO: 944753 - RNA, 24 nt, Human
uuuuucaacaaaugaacuuuuaua

SEQ ID NO: 944754 - RNA, 19 nt, Human
aaaaaaagaaaaaaaugca

SEQ ID NO: 944755 - RNA, 19 nt, Human
aaaaagaaaaaaaugcaca

SEQ ID NO: 944756 - RNA, 22 nt, Human
aaaaaugcacaaucuuuggaac

SEQ ID NO: 944757 - RNA, 25 nt, Human
aaagaaaaaaaugcacaaucuuugg

SEQ ID NO: 944758 - RNA, 20 nt, Human
aaaggaaaaauacauauuca

SEQ ID NO: 944759 - RNA, 19 nt, Human
aaccagaauugccugucaa

SEQ ID NO: 944760 - RNA, 23 nt, Human
aagcagccgugcuggggcacacc

SEQ ID NO: 944761 - RNA, 19 nt, Human
aagcgucuuuuuaauucuc

SEQ ID NO: 944762 - RNA, 21 nt, Human
acagcuuucuuuuccaccccc

SEQ ID NO: 944763 - RNA, 20 nt, Human
acaguuuaaaaaaaaaaaga

SEQ ID NO: 944764 - RNA, 27 nt, Human
accacaguuuaaaaaaaaaaagaaaaa

SEQ ID NO: 944765 - RNA, 21 nt, Human
accguuuuccuuccuuuuucu

SEQ ID NO: 944766 - RNA, 18 nt, Human
agaaaaaaaugcacaauc

SEQ ID NO: 944767 - RNA, 18 nt, Human
agaccagaaacucagaag

SEQ ID NO: 944768 - RNA, 21 nt, Human
agaucucuuccacuucugcuu

SEQ ID NO: 944769 - RNA, 23 nt, Human
aggaaaaauacauauucaaagaa

SEQ ID NO: 944770 - RNA, 22 nt, Human
auagaguuccucuacuaguaaa

SEQ ID NO: 944771 - RNA, 21 nt, Human
cacagccaaccagaauugccu

SEQ ID NO: 944772 - RNA, 23 nt, Human
cacagcuuucuuuuccacccccc

SEQ ID NO: 944773 - RNA, 20 nt, Human
ccaccccccuccccccccaa

SEQ ID NO: 944774 - RNA, 23 nt, Human
ccaccccccuccccccccaaucu

SEQ ID NO: 944775 - RNA, 19 nt, Human
ccccccuccccccccaauc

SEQ ID NO: 944776 - RNA, 20 nt, Human
ccuccuugacugccucuucc

SEQ ID NO: 944777 - RNA, 18 nt, Human
ccuuccuccuugacugcc

SEQ ID NO: 944778 - RNA, 22 nt, Human
cuagaagaauauccuguugcag

SEQ ID NO: 944779 - RNA, 21 nt, Human
cuauagaguuccucuacuagu

SEQ ID NO: 944780 - RNA, 23 nt, Human
cuccuaaugucucuccuuccucc

SEQ ID NO: 944781 - RNA, 18 nt, Human
cuggggcacaccuccaca

SEQ ID NO: 944782 - RNA, 20 nt, Human
cugucugcugauuucugauc

SEQ ID NO: 944783 - RNA, 23 nt, Human
cuuccuccuugacugccucuucc

SEQ ID NO: 944784 - RNA, 27 nt, Human
cuuuuccaccccccuccccccccaauc

SEQ ID NO: 944785 - RNA, 22 nt, Human
gcacggacauacagacauggaa

SEQ ID NO: 944786 - RNA, 22 nt, Human
gcuuucuuuuccaccccccucc

SEQ ID NO: 944787 - RNA, 19 nt, Human
ggcuccuaaugucucuccu

SEQ ID NO: 944788 - RNA, 23 nt, Human
uaaaaaaaaaaagaaaaaaaugc

SEQ ID NO: 944789 - RNA, 19 nt, Human
uaagcacggacauacagac

SEQ ID NO: 944790 - RNA, 19 nt, Human
uagccaggccucaugaacu

SEQ ID NO: 944791 - RNA, 27 nt, Human
uauccuguugcagaaagaucucuucca

SEQ ID NO: 944792 - RNA, 24 nt, Human
uauuuuuuuuuuuuuuuaccacag

SEQ ID NO: 944793 - RNA, 19 nt, Human
uccaccccccucccccccc

SEQ ID NO: 944794 - RNA, 21 nt, Human
uccacuucugcuuguccccca

SEQ ID NO: 944795 - RNA, 22 nt, Human
uccuaaugucucuccuuccucc

SEQ ID NO: 944796 - RNA, 20 nt, Human
ucuagcuauuuaaggguggg

SEQ ID NO: 944797 - RNA, 25 nt, Human
ucuccuuccuccuugacugccucuu

SEQ ID NO: 944798 - RNA, 19 nt, Human
ucugucugcugauuucuga

SEQ ID NO: 944799 - RNA, 25 nt, Human
ucuuuuccaccccccucccccccca

SEQ ID NO: 944800 - RNA, 20 nt, Human
ugaucagaugcauuuaucgg

SEQ ID NO: 944801 - RNA, 20 nt, Human
uggaacaaaagaauuaaagg

SEQ ID NO: 944802 - RNA, 22 nt, Human
uggaacaaaagaauuaaaggca

SEQ ID NO: 944803 - RNA, 21 nt, Human
uggggggcugucccauuugca

SEQ ID NO: 944804 - RNA, 21 nt, Human
ugucaaagaccagaaacucag

SEQ ID NO: 944805 - RNA, 22 nt, Human
ugucccccagucauucagcacc

SEQ ID NO: 944806 - RNA, 24 nt, Human
uuccaccccccuccccccccaauc

SEQ ID NO: 944807 - RNA, 18 nt, Human
uuccagccacagccaacc

SEQ ID NO: 944808 - RNA, 20 nt, Human
uuguuuguuuguuuguuuuu

SEQ ID NO: 944809 - RNA, 18 nt, Human
uuuguaagcacaaauucc

SEQ ID NO: 944810 - RNA, 22 nt, Human
aaaaauccaugauuguucagcc

SEQ ID NO: 944811 - RNA, 23 nt, Human
aaacuuggcuugcagauacuggg

SEQ ID NO: 944812 - RNA, 19 nt, Human
agggagcugccgugcaggg

SEQ ID NO: 944813 - RNA, 21 nt, Human
caucugcuguuuccacacuuc

SEQ ID NO: 944814 - RNA, 21 nt, Human
cuuugcccaugaagcuggaag

SEQ ID NO: 944815 - RNA, 19 nt, Human
gucaauaauuuccuaaagc

SEQ ID NO: 944816 - RNA, 19 nt, Human
uaagaacaccuuucuguac

SEQ ID NO: 944817 - RNA, 23 nt, Human
ucacuugguauucccgaaugccu

SEQ ID NO: 944818 - RNA, 23 nt, Human
uccaaacuuggcuugcagauacu

SEQ ID NO: 944819 - RNA, 18 nt, Human
ucuguucuucacucuucc

SEQ ID NO: 944820 - RNA, 22 nt, Human
ugcccaugaagcuggaagggag

SEQ ID NO: 944821 - RNA, 18 nt, Human
uggaagggagcugccgug

SEQ ID NO: 944822 - RNA, 20 nt, Human
uggcccacuagaaacagcaa

SEQ ID NO: 944823 - RNA, 18 nt, Human
uuuuucuggcccacuaga

SEQ ID NO: 944824 - RNA, 24 nt, Human
acaaaaaaagugaugguuccccca

SEQ ID NO: 944825 - RNA, 19 nt, Human
agcaauaguaaagggcagg

SEQ ID NO: 944826 - RNA, 19 nt, Human
aggcuccaucagcaauagu

SEQ ID NO: 944827 - RNA, 23 nt, Human
cacacaaaaaaagugaugguucc

SEQ ID NO: 944828 - RNA, 18 nt, Human
cccccaggcuccaucagc

SEQ ID NO: 944829 - RNA, 24 nt, Human
guagagauuucuuuuuccaggccc

SEQ ID NO: 944830 - RNA, 19 nt, Human
ucccccaggcuccaucagc

SEQ ID NO: 944831 - RNA, 28 nt, Human
ugaguaucuccaagaauucauuucuuuu

SEQ ID NO: 944832 - RNA, 22 nt, Human
uucauuucuauucaguaaagau

SEQ ID NO: 944833 - RNA, 22 nt, Human
uucccccaggcuccaucagcaa

SEQ ID NO: 944834 - RNA, 21 nt, Human
auaaagcugcagccacaagug

SEQ ID NO: 944835 - RNA, 19 nt, Human
caaacccggcgggcggccg

SEQ ID NO: 944836 - RNA, 18 nt, Human
cacgcuguguggcucucu

SEQ ID NO: 944837 - RNA, 18 nt, Human
cgcuguguggcucucucc

SEQ ID NO: 944838 - RNA, 21 nt, Human
gcagccacaagugggcucugc

SEQ ID NO: 944839 - RNA, 24 nt, Human
gcugcagccacaagugggcucugc

SEQ ID NO: 944840 - RNA, 18 nt, Human
ucuccagccacgaguccu

SEQ ID NO: 944841 - RNA, 18 nt, Human
ugcaauauaauuuggcau

SEQ ID NO: 944842 - RNA, 21 nt, Human
uggcauaaagcugcagccaca

SEQ ID NO: 944843 - RNA, 23 nt, Human
uguggacagguuuauugaagcug

SEQ ID NO: 944844 - RNA, 21 nt, Human
uucauuguggacagguuuauu

SEQ ID NO: 944845 - RNA, 23 nt, Human
uugaagcugagcaguuuccccau

SEQ ID NO: 944846 - RNA, 21 nt, Human
uuuuuuuuuuuuuuuuucauu

SEQ ID NO: 944847 - RNA, 19 nt, Human
aaacagaugugugauagag

SEQ ID NO: 944848 - RNA, 24 nt, Human
aaagugcugggaugacaggcguga

SEQ ID NO: 944849 - RNA, 26 nt, Human
aagaaggaaggaaggaaggaagcaaa

SEQ ID NO: 944850 - RNA, 22 nt, Human
aagaggaggaggaggagcgggg

SEQ ID NO: 944851 - RNA, 20 nt, Human
aaggguuuuucaagccagca

SEQ ID NO: 944852 - RNA, 24 nt, Human
aagugauccgccugccucagccuc

SEQ ID NO: 944853 - RNA, 18 nt, Human
accauguuggcugggcug

SEQ ID NO: 944854 - RNA, 20 nt, Human
accauguuggcugggcuggu

SEQ ID NO: 944855 - RNA, 23 nt, Human
accauguuggcugggcuggucuc

SEQ ID NO: 944856 - RNA, 19 nt, Human
agaggaggaggaggagcgg

SEQ ID NO: 944857 - RNA, 21 nt, Human
agaggaggaggaggagcgggg

SEQ ID NO: 944858 - RNA, 19 nt, Human
agccauugcugaaggguau

SEQ ID NO: 944859 - RNA, 18 nt, Human
aggaagaggaggaggagg

SEQ ID NO: 944860 - RNA, 18 nt, Human
aggaagaggaggaggagg

SEQ ID NO: 944861 - RNA, 19 nt, Human
aggaaggaagaaggaagga

SEQ ID NO: 944862 - RNA, 24 nt, Human
aggaaggaaggaagcaaaggaugg

SEQ ID NO: 944863 - RNA, 18 nt, Human
aggaggaagaggaggagg

SEQ ID NO: 944864 - RNA, 19 nt, Human
aggaggaggaggaagagga

SEQ ID NO: 944865 - RNA, 20 nt, Human
aggaggaggaggagcggggc

SEQ ID NO: 944866 - RNA, 22 nt, Human
aggaggaggaggaggaagagga

SEQ ID NO: 944867 - RNA, 21 nt, Human
aggaguaagcgcggagaguug

SEQ ID NO: 944868 - RNA, 18 nt, Human
agggagagacggggcagg

SEQ ID NO: 944869 - RNA, 23 nt, Human
agggcuggggcgcggggcugggc

SEQ ID NO: 944870 - RNA, 26 nt, Human
agggcuggggcgcggggcugggcgag

SEQ ID NO: 944871 - RNA, 23 nt, Human
aguagccauugcugaaggguaua

SEQ ID NO: 944872 - RNA, 24 nt, Human
caaagugcugggaugacaggcgug

SEQ ID NO: 944873 - RNA, 22 nt, Human
caagugauccgccugccucagc

SEQ ID NO: 944874 - RNA, 19 nt, Human
caggcaggcucugggaagu

SEQ ID NO: 944875 - RNA, 24 nt, Human
caucaagugauccgccugccucag

SEQ ID NO: 944876 - RNA, 22 nt, Human
ccaaagugcugggaugacaggc

SEQ ID NO: 944877 - RNA, 24 nt, Human
ccaaagugcugggaugacaggcgu

SEQ ID NO: 944878 - RNA, 23 nt, Human
cccacaagacagauugcagccgc

SEQ ID NO: 944879 - RNA, 22 nt, Human
cccacuggagccuuccccgggc

SEQ ID NO: 944880 - RNA, 18 nt, Human
ccccgggcgccggggcuc

SEQ ID NO: 944881 - RNA, 26 nt, Human
ccgccugccucagccucccaaagugc

SEQ ID NO: 944882 - RNA, 24 nt, Human
ccugccucagccucccaaagugcu

SEQ ID NO: 944883 - RNA, 22 nt, Human
cgagaaaaacagaugugugaua

SEQ ID NO: 944884 - RNA, 21 nt, Human
cgccggggcucccucgggcgg

SEQ ID NO: 944885 - RNA, 26 nt, Human
cgccggggcucccucgggcgggcgcc

SEQ ID NO: 944886 - RNA, 20 nt, Human
cgggcucggguugggcuggg

SEQ ID NO: 944887 - RNA, 19 nt, Human
cugcagccgcuggaaggag

SEQ ID NO: 944888 - RNA, 24 nt, Human
cugccucagccucccaaagugcug

SEQ ID NO: 944889 - RNA, 19 nt, Human
cugggaccauguuggcugg

SEQ ID NO: 944890 - RNA, 22 nt, Human
cugggcuggucucacacuucug

SEQ ID NO: 944891 - RNA, 20 nt, Human
cugucaucaagugauccgcc

SEQ ID NO: 944892 - RNA, 20 nt, Human
cuguggggcuggagcuggag

SEQ ID NO: 944893 - RNA, 19 nt, Human
gaagaggaggaggaggagc

SEQ ID NO: 944894 - RNA, 19 nt, Human
gaccauguuggcugggcug

SEQ ID NO: 944895 - RNA, 21 nt, Human
gauccgccugccucagccucc

SEQ ID NO: 944896 - RNA, 18 nt, Human
gcaauuguucguccuucu

SEQ ID NO: 944897 - RNA, 20 nt, Human
gcagccgcuggaaggagggg

SEQ ID NO: 944898 - RNA, 18 nt, Human
gccccgggagggcgaccu

SEQ ID NO: 944899 - RNA, 24 nt, Human
gcgggagccaggggaggaaggaag

SEQ ID NO: 944900 - RNA, 18 nt, Human
gcgggcuguggggcugga

SEQ ID NO: 944901 - RNA, 19 nt, Human
gcgggcuguggggcuggag

SEQ ID NO: 944902 - RNA, 21 nt, Human
ggacccgagagccgcugagua

SEQ ID NO: 944903 - RNA, 18 nt, Human
ggagagacggggcagggc

SEQ ID NO: 944904 - RNA, 23 nt, Human
ggagaguuggggcugggggcugc

SEQ ID NO: 944905 - RNA, 18 nt, Human
ggaggaggaagaggagga

SEQ ID NO: 944906 - RNA, 18 nt, Human
ggaggaggaggaagagga

SEQ ID NO: 944907 - RNA, 23 nt, Human
ggcaaggguuuuucaagccagca

SEQ ID NO: 944908 - RNA, 21 nt, Human
ggcuggggcgcggggcugggc

SEQ ID NO: 944909 - RNA, 24 nt, Human
gggcaaggguuuuucaagccagca

SEQ ID NO: 944910 - RNA, 21 nt, Human
gggcagggcuggggcgcgggg

SEQ ID NO: 944911 - RNA, 21 nt, Human
gggcagggcuggggcgcgggg

SEQ ID NO: 944912 - RNA, 23 nt, Human
gggcgcgggccggcagcggggaa

SEQ ID NO: 944913 - RNA, 18 nt, Human
gggcggaggagcgcgggc

SEQ ID NO: 944914 - RNA, 20 nt, Human
gggcugggggcugcagccgc

SEQ ID NO: 944915 - RNA, 18 nt, Human
gggcuguggggcuggagc

SEQ ID NO: 944916 - RNA, 20 nt, Human
ggugccuagagaggaggagg

SEQ ID NO: 944917 - RNA, 24 nt, Human
gucaucaagugauccgccugccuc

SEQ ID NO: 944918 - RNA, 18 nt, Human
gugauccgccugccucag

SEQ ID NO: 944919 - RNA, 24 nt, Human
gugauccgccugccucagccuccc

SEQ ID NO: 944920 - RNA, 19 nt, Human
uagagaacaguagccacca

SEQ ID NO: 944921 - RNA, 22 nt, Human
ucaagugauccgccugccucag

SEQ ID NO: 944922 - RNA, 24 nt, Human
ucccaaagugcugggaugacaggc

SEQ ID NO: 944923 - RNA, 19 nt, Human
uccccgggcgccggggcuc

SEQ ID NO: 944924 - RNA, 18 nt, Human
ucgccgggccgggcaggg

SEQ ID NO: 944925 - RNA, 23 nt, Human
ucuaguagccauugcugaagggu

SEQ ID NO: 944926 - RNA, 24 nt, Human
ugccucagccucccaaagugcugg

SEQ ID NO: 944927 - RNA, 24 nt, Human
uggcugggcuggucucacacuucu

SEQ ID NO: 944928 - RNA, 19 nt, Human
ugggaugacaggcgugagg

SEQ ID NO: 944929 - RNA, 22 nt, Human
ugggaugacaggcgugaggcac

SEQ ID NO: 944930 - RNA, 22 nt, Human
ugggaugacaggcgugaggcac

SEQ ID NO: 944931 - RNA, 24 nt, Human
ugggaugacaggcgugaggcacug

SEQ ID NO: 944932 - RNA, 22 nt, Human
uggggcucccgcggcgagucug

SEQ ID NO: 944933 - RNA, 22 nt, Human
uggggcuggagcuggagccggg

SEQ ID NO: 944934 - RNA, 24 nt, Human
uggggcugggggcugcagccgcug

SEQ ID NO: 944935 - RNA, 21 nt, Human
uguucguccuucuaguagcca

SEQ ID NO: 944936 - RNA, 19 nt, Human
cagccacccccaaguacau

SEQ ID NO: 944937 - RNA, 22 nt, Human
cguaaaagaacuaauauuugca

SEQ ID NO: 944938 - RNA, 24 nt, Human
uaaaagaacuaauauuugcaaaga

SEQ ID NO: 944939 - RNA, 27 nt, Human
uagccaggagcagccacccccaaguac

SEQ ID NO: 944940 - RNA, 18 nt, Human
uggaaagcaaaagaauca

SEQ ID NO: 944941 - RNA, 29 nt, Human
aaaaaaaaaaaaaaaagccaccacaaaga

SEQ ID NO: 944942 - RNA, 18 nt, Human
aaaaacacacacccagag

SEQ ID NO: 944943 - RNA, 25 nt, Human
aaaacacacacccagaguugcauuc

SEQ ID NO: 944944 - RNA, 22 nt, Human
aaacauggagcacgaaagacaa

SEQ ID NO: 944945 - RNA, 20 nt, Human
aaguguggagcacagagacc

SEQ ID NO: 944946 - RNA, 18 nt, Human
aauucuguauuggaaacu

SEQ ID NO: 944947 - RNA, 19 nt, Human
acccugaaaugggaacaaa

SEQ ID NO: 944948 - RNA, 24 nt, Human
acccugaaaugggaacaaaggagg

SEQ ID NO: 944949 - RNA, 18 nt, Human
agccccucccacccccuc

SEQ ID NO: 944950 - RNA, 23 nt, Human
aggacaccagccccucccacccc

SEQ ID NO: 944951 - RNA, 18 nt, Human
aggggagugggaacuagc

SEQ ID NO: 944952 - RNA, 25 nt, Human
aucuucccugaggccccagugguca

SEQ ID NO: 944953 - RNA, 24 nt, Human
auggagcacgaaagacaagugugg

SEQ ID NO: 944954 - RNA, 26 nt, Human
caaacaauccaaaaaaaaaaaaaaaa

SEQ ID NO: 944955 - RNA, 19 nt, Human
caaggugcaagaggcagag

SEQ ID NO: 944956 - RNA, 28 nt, Human
cacacacacacaugcaagacaguuugug

SEQ ID NO: 944957 - RNA, 23 nt, Human
cacugcuucgagcccccacaaaa

SEQ ID NO: 944958 - RNA, 25 nt, Human
cagacacacacacacaugcaagaca

SEQ ID NO: 944959 - RNA, 18 nt, Human
cagccccucccacccccu

SEQ ID NO: 944960 - RNA, 21 nt, Human
caggaggcugcugagacuggg

SEQ ID NO: 944961 - RNA, 24 nt, Human
caucugccaaguacggauccuaac

SEQ ID NO: 944962 - RNA, 27 nt, Human
ccaaaaaaaaaaaaaaaagccaccaca

SEQ ID NO: 944963 - RNA, 21 nt, Human
ccacaaaaacacacacccaga

SEQ ID NO: 944964 - RNA, 22 nt, Human
ccagacacacacacacaugcaa

SEQ ID NO: 944965 - RNA, 22 nt, Human
cccacaaaaacacacacccaga

SEQ ID NO: 944966 - RNA, 21 nt, Human
cccacaaaaacacacacccuc

SEQ ID NO: 944967 - RNA, 23 nt, Human
cccacccccucaaggugcaagag

SEQ ID NO: 944968 - RNA, 23 nt, Human
ccccacaaaaacacacacccaga

SEQ ID NO: 944969 - RNA, 18 nt, Human
cccuguuguggccucaaa

SEQ ID NO: 944970 - RNA, 24 nt, Human
ccggccugguuaugaaaucaggag

SEQ ID NO: 944971 - RNA, 20 nt, Human
ccugccgaggaagugggguu

SEQ ID NO: 944972 - RNA, 20 nt, Human
cucaaguuccucuaagccuu

SEQ ID NO: 944973 - RNA, 20 nt, Human
gagcccccacaaaaacacac

SEQ ID NO: 944974 - RNA, 19 nt, Human
gaucaugggaagugaucug

SEQ ID NO: 944975 - RNA, 24 nt, Human
gcuucgagcccccacaaaaacaca

SEQ ID NO: 944976 - RNA, 28 nt, Human
gguaaccagacacacacacacaugcagu

SEQ ID NO: 944977 - RNA, 24 nt, Human
guaaccagacacacacacacaugc

SEQ ID NO: 944978 - RNA, 18 nt, Human
guggccucaaacagugaa

SEQ ID NO: 944979 - RNA, 21 nt, Human
uauuggaaacugcucagcugc

SEQ ID NO: 944980 - RNA, 19 nt, Human
ucagggccucaguuuccua

SEQ ID NO: 944981 - RNA, 21 nt, Human
ucaucugccaaguacggaucc

SEQ ID NO: 944982 - RNA, 25 nt, Human
uccaaaaaaaaaaaaaaaagccacc

SEQ ID NO: 944983 - RNA, 21 nt, Human
ucccugucauccuucgacagg

SEQ ID NO: 944984 - RNA, 21 nt, Human
ucucagggccucaguuuccua

SEQ ID NO: 944985 - RNA, 19 nt, Human
uggaagaaauguguaagug

SEQ ID NO: 944986 - RNA, 22 nt, Human
uggauucgaaguagggaacccc

SEQ ID NO: 944987 - RNA, 22 nt, Human
ugggaagugaucugaaugaguc

SEQ ID NO: 944988 - RNA, 23 nt, Human
uucaaacauggagcacgaaagac

SEQ ID NO: 944989 - RNA, 25 nt, Human
uucacagaaggucgggguaaccaga

SEQ ID NO: 944990 - RNA, 20 nt, Human
uuuguggaacccugaaaugg

SEQ ID NO: 944991 - RNA, 24 nt, Human
aaaaaacaaagcagaaaaaaacac

SEQ ID NO: 944992 - RNA, 20 nt, Human
aaaacaaagcagaaaaaaac

SEQ ID NO: 944993 - RNA, 21 nt, Human
aaacagcaaacugaaaaaaca

SEQ ID NO: 944994 - RNA, 28 nt, Human
aagcagaaaaaaacacaguuccauccaa

SEQ ID NO: 944995 - RNA, 18 nt, Human
acaaagcagaaaaaaaca

SEQ ID NO: 944996 - RNA, 21 nt, Human
acaaagcagaaaaaaacacag

SEQ ID NO: 944997 - RNA, 25 nt, Human
acaaagcagaaaaaaacacaguucc

SEQ ID NO: 944998 - RNA, 20 nt, Human
acugaaaaaacaaagcagaa

SEQ ID NO: 944999 - RNA, 21 nt, Human
auggcuacagaaacagcaaac

SEQ ID NO: 945000 - RNA, 19 nt, Human
caaacugaaaaaacaaagc

SEQ ID NO: 945001 - RNA, 24 nt, Human
cacagaauacaauauggcuacaga

SEQ ID NO: 945002 - RNA, 19 nt, Human
cacaguuccauccaauuug

SEQ ID NO: 945003 - RNA, 19 nt, Human
cagaaaaaaacacaguucc

SEQ ID NO: 945004 - RNA, 19 nt, Human
cagaaacagcaaacugaaa

SEQ ID NO: 945005 - RNA, 19 nt, Human
cagaaacagcaaacugaaa

SEQ ID NO: 945006 - RNA, 23 nt, Human
cugaaaaaacaaagcagaaaaaa

SEQ ID NO: 945007 - RNA, 18 nt, Human
gcuacagaaacagcaaac

SEQ ID NO: 945008 - RNA, 27 nt, Human
ggcuacagaaacagcaaacugaaaaaa

SEQ ID NO: 945009 - RNA, 21 nt, Human
uaagcuugauggaagaagucu

SEQ ID NO: 945010 - RNA, 19 nt, Human
uacaauauggcuacagaaa

SEQ ID NO: 945011 - RNA, 24 nt, Human
uacagaaacagcaaacugaaaaaa

SEQ ID NO: 945012 - RNA, 21 nt, Human
ugaaaaaacaaagcagaaaaa

SEQ ID NO: 945013 - RNA, 26 nt, Human
ugaaaaaacaaagcagaaaaaaaagg

SEQ ID NO: 945014 - RNA, 26 nt, Human
ugaaaaaacaaagcagaaaaaaacac

SEQ ID NO: 945015 - RNA, 18 nt, Human
uggcuacagaaacagcaa

SEQ ID NO: 945016 - RNA, 23 nt, Human
uggcuacagaaacagcaaacuga

SEQ ID NO: 945017 - RNA, 21 nt, Human
aagaauagcuauccuucauac

SEQ ID NO: 945018 - RNA, 19 nt, Human
agagauucucuguuuucaa

SEQ ID NO: 945019 - RNA, 24 nt, Human
agagccguuucccucugugccucc

SEQ ID NO: 945020 - RNA, 22 nt, Human
ccuccgccucgucccugccaug

SEQ ID NO: 945021 - RNA, 19 nt, Human
ccuccucgggcugcgagag

SEQ ID NO: 945022 - RNA, 18 nt, Human
ccucgaccgccgccgccg

SEQ ID NO: 945023 - RNA, 21 nt, Human
ccucgaccgccgccgccgccc

SEQ ID NO: 945024 - RNA, 24 nt, Human
ccuucauacaauacuagguuuuau

SEQ ID NO: 945025 - RNA, 26 nt, Human
cuagugaugacuguagugugccuuuu

SEQ ID NO: 945026 - RNA, 20 nt, Human
cuccgcgccugacccuccuc

SEQ ID NO: 945027 - RNA, 21 nt, Human
cuccucgaccgccgccgccgc

SEQ ID NO: 945028 - RNA, 20 nt, Human
gcuuagaaagcagaauugcc

SEQ ID NO: 945029 - RNA, 24 nt, Human
uaacugaaauguauauaaaaauaa

SEQ ID NO: 945030 - RNA, 22 nt, Human
uacucagcuugggucauauuca

SEQ ID NO: 945031 - RNA, 18 nt, Human
uagaaagcagaauugccu

SEQ ID NO: 945032 - RNA, 18 nt, Human
ucagguuugcuaaaugcu

SEQ ID NO: 945033 - RNA, 22 nt, Human
ucccucugugccucccucggaa

SEQ ID NO: 945034 - RNA, 22 nt, Human
uccucgaccgccgccgccgccc

SEQ ID NO: 945035 - RNA, 19 nt, Human
ucuggcuuaacuccucgcc

SEQ ID NO: 945036 - RNA, 20 nt, Human
ugccaugggagcuccucgac

SEQ ID NO: 945037 - RNA, 18 nt, Human
ugcuuagaaagcagaauu

SEQ ID NO: 945038 - RNA, 24 nt, Human
aaaaaggaacauggaaaauuccac

SEQ ID NO: 945039 - RNA, 20 nt, Human
aaaagauccaaauuagaggu

SEQ ID NO: 945040 - RNA, 25 nt, Human
aaacaaaaagauccaaauuagaggu

SEQ ID NO: 945041 - RNA, 26 nt, Human
aaacaccccagagauggggccugagc

SEQ ID NO: 945042 - RNA, 20 nt, Human
aaaggaacauggaaaauucc

SEQ ID NO: 945043 - RNA, 23 nt, Human
aagugaguuguguggcucagccu

SEQ ID NO: 945044 - RNA, 18 nt, Human
accugggccauaacggag

SEQ ID NO: 945045 - RNA, 20 nt, Human
agcuaaaccuucugacuacc

SEQ ID NO: 945046 - RNA, 21 nt, Human
agcuaaaccuucugacuacca

SEQ ID NO: 945047 - RNA, 24 nt, Human
aggcaggcuuagcagcuaagggag

SEQ ID NO: 945048 - RNA, 22 nt, Human
auccaaauuagagguaaaaagg

SEQ ID NO: 945049 - RNA, 21 nt, Human
caaaaacaaaaagauccaaau

SEQ ID NO: 945050 - RNA, 23 nt, Human
cacacgcuguagaccacggccag

SEQ ID NO: 945051 - RNA, 18 nt, Human
cacgcacccucgcucacc

SEQ ID NO: 945052 - RNA, 23 nt, Human
cacgcuguagaccacggccagug

SEQ ID NO: 945053 - RNA, 21 nt, Human
cagcagcugcaggauaugggc

SEQ ID NO: 945054 - RNA, 22 nt, Human
cagcagcugcaggauaugggcu

SEQ ID NO: 945055 - RNA, 19 nt, Human
cagcuaagggaggcugggg

SEQ ID NO: 945056 - RNA, 20 nt, Human
caggcgcaauaccugcccug

SEQ ID NO: 945057 - RNA, 23 nt, Human
caggcgcaauaccugcccugggc

SEQ ID NO: 945058 - RNA, 22 nt, Human
cauggccugcaugaugcuggag

SEQ ID NO: 945059 - RNA, 19 nt, Human
ccaagcaggcgcaauaccu

SEQ ID NO: 945060 - RNA, 23 nt, Human
ccacacgcuguagaccacggcca

SEQ ID NO: 945061 - RNA, 22 nt, Human
ccacacucaccucacccuuaac

SEQ ID NO: 945062 - RNA, 20 nt, Human
ccaucccaccccugggcaag

SEQ ID NO: 945063 - RNA, 21 nt, Human
cccaaaaaccugggcuggguc

SEQ ID NO: 945064 - RNA, 24 nt, Human
cccagccuaggccugucugcuggc

SEQ ID NO: 945065 - RNA, 21 nt, Human
ccccagccuaggccugucugc

SEQ ID NO: 945066 - RNA, 23 nt, Human
cccccaaacaccccagagauggg

SEQ ID NO: 945067 - RNA, 26 nt, Human
ccccugggcaaggcaggcuuagcagc

SEQ ID NO: 945068 - RNA, 19 nt, Human
cccgcccgcaccgcguucg

SEQ ID NO: 945069 - RNA, 22 nt, Human
cccugcugcagcagcugcagga

SEQ ID NO: 945070 - RNA, 19 nt, Human
ccgccgcgcaccacgcacc

SEQ ID NO: 945071 - RNA, 22 nt, Human
ccgcgcaccacgcacccucgcu

SEQ ID NO: 945072 - RNA, 22 nt, Human
ccugacccccaaacaccccaga

SEQ ID NO: 945073 - RNA, 22 nt, Human
ccugcucccugacccccaaaca

SEQ ID NO: 945074 - RNA, 21 nt, Human
ccugcugcuccuugagcgcca

SEQ ID NO: 945075 - RNA, 24 nt, Human
cugcagcagcugcaggauaugggc

SEQ ID NO: 945076 - RNA, 25 nt, Human
cugcagcagcugcaggauaugggcu

SEQ ID NO: 945077 - RNA, 23 nt, Human
cugggcccagcuaaaccuucuga

SEQ ID NO: 945078 - RNA, 19 nt, Human
cuucagugccaucccaccc

SEQ ID NO: 945079 - RNA, 23 nt, Human
gaccacggccagugcucccuggu

SEQ ID NO: 945080 - RNA, 21 nt, Human
ggguacaggugugccagcagc

SEQ ID NO: 945081 - RNA, 24 nt, Human
ggucagcagcugucagcgccugcu

SEQ ID NO: 945082 - RNA, 19 nt, Human
uaccugcccugggcccagc

SEQ ID NO: 945083 - RNA, 18 nt, Human
ucagcgccugcuggaagg

SEQ ID NO: 945084 - RNA, 21 nt, Human
ucagggucaugcuccaggcau

SEQ ID NO: 945085 - RNA, 21 nt, Human
ucagugccaucccaccccugg

SEQ ID NO: 945086 - RNA, 19 nt, Human
uccaaauuagagguaaaaa

SEQ ID NO: 945087 - RNA, 21 nt, Human
ucccugacccccaaacacccc

SEQ ID NO: 945088 - RNA, 22 nt, Human
ucguuccgccgccgccgcgcac

SEQ ID NO: 945089 - RNA, 21 nt, Human
ugaaaaagcuuuuggcgcacc

SEQ ID NO: 945090 - RNA, 22 nt, Human
ugacccccaaacaccccagaga

SEQ ID NO: 945091 - RNA, 18 nt, Human
ugagcgccacacucaccu

SEQ ID NO: 945092 - RNA, 23 nt, Human
ugagggaaaggagcacaggcugg

SEQ ID NO: 945093 - RNA, 23 nt, Human
ugcagcagcugcaggauaugggc

SEQ ID NO: 945094 - RNA, 18 nt, Human
ugccaaggucagaugcca

SEQ ID NO: 945095 - RNA, 23 nt, Human
ugccccagccuaggccugucugc

SEQ ID NO: 945096 - RNA, 24 nt, Human
ugcggcgggcgccccgcccgcacc

SEQ ID NO: 945097 - RNA, 24 nt, Human
ugggagagcgggcaggguggcugc

SEQ ID NO: 945098 - RNA, 19 nt, Human
ugggcuugcugggccuggc

SEQ ID NO: 945099 - RNA, 22 nt, Human
uguguggcucagccugcaggaa

SEQ ID NO: 945100 - RNA, 24 nt, Human
uguuuuucaaaaacaaaaagaucc

SEQ ID NO: 945101 - RNA, 20 nt, Human
uuucacacacauacagcacc

SEQ ID NO: 945102 - RNA, 21 nt, Human
gagaauagaagaauuuaagaa

SEQ ID NO: 945103 - RNA, 22 nt, Human
guaccuuuuaauuugcuccugg

SEQ ID NO: 945104 - RNA, 22 nt, Human
aaaaaauucaggaaacacagaa

SEQ ID NO: 945105 - RNA, 20 nt, Human
aaaacauuucagccaagacu

SEQ ID NO: 945106 - RNA, 22 nt, Human
aaacaaguaaacccgucccaga

SEQ ID NO: 945107 - RNA, 23 nt, Human
aaacugaagucacgcuaaccuua

SEQ ID NO: 945108 - RNA, 23 nt, Human
accacacagauauaaaacuaugg

SEQ ID NO: 945109 - RNA, 28 nt, Human
aucacccuguucaaaaacaaguaaaccc

SEQ ID NO: 945110 - RNA, 20 nt, Human
augcagggggcacgugcucc

SEQ ID NO: 945111 - RNA, 21 nt, Human
caaauugagagaacucucuga

SEQ ID NO: 945112 - RNA, 22 nt, Human
caccauauaaaaaauucaggaa

SEQ ID NO: 945113 - RNA, 26 nt, Human
caccauauaaaaaauucaggaaacca

SEQ ID NO: 945114 - RNA, 22 nt, Human
caucacccuguucaaaaacaag

SEQ ID NO: 945115 - RNA, 22 nt, Human
cccaucacccuguucaaaaaca

SEQ ID NO: 945116 - RNA, 19 nt, Human
cccucuucacucuacucaa

SEQ ID NO: 945117 - RNA, 23 nt, Human
cuccccucuucacucuacucaag

SEQ ID NO: 945118 - RNA, 21 nt, Human
gaaaugcaacuguucguugug

SEQ ID NO: 945119 - RNA, 23 nt, Human
gacacagcucugccuguugcaaa

SEQ ID NO: 945120 - RNA, 23 nt, Human
gcucugacgcacagcacugcugu

SEQ ID NO: 945121 - RNA, 22 nt, Human
guccaggcaagccuguccucag

SEQ ID NO: 945122 - RNA, 20 nt, Human
gucccagagccucuccaggg

SEQ ID NO: 945123 - RNA, 19 nt, Human
uaaauaaaacauuucagcc

SEQ ID NO: 945124 - RNA, 23 nt, Human
uaaauaaaacauuucagccaaga

SEQ ID NO: 945125 - RNA, 25 nt, Human
uacaauacuauuaaugucacaaacu

SEQ ID NO: 945126 - RNA, 23 nt, Human
uagugucauccuuagucaaaacu

SEQ ID NO: 945127 - RNA, 20 nt, Human
uauauauuuauauauauaua

SEQ ID NO: 945128 - RNA, 20 nt, Human
uaugccucccaaacaauauu

SEQ ID NO: 945129 - RNA, 22 nt, Human
ucccgugccgguacaaaacacc

SEQ ID NO: 945130 - RNA, 18 nt, Human
uccucagcuggcucugac

SEQ ID NO: 945131 - RNA, 23 nt, Human
ucugaaaugcaacuguucguugu

SEQ ID NO: 945132 - RNA, 20 nt, Human
ugagagaacucucugaaaug

SEQ ID NO: 945133 - RNA, 21 nt, Human
ugcgucaucaagagaaagaga

SEQ ID NO: 945134 - RNA, 18 nt, Human
uggcugggcuggcugggc

SEQ ID NO: 945135 - RNA, 18 nt, Human
uggcugggcuggcugggc

SEQ ID NO: 945136 - RNA, 23 nt, Human
uggcugggcuggcugggcuggcu

SEQ ID NO: 945137 - RNA, 23 nt, Human
ugugugcagauuugcaguccaga

SEQ ID NO: 945138 - RNA, 25 nt, Human
aaaaaaaaacaacaacaacaaauga

SEQ ID NO: 945139 - RNA, 21 nt, Human
aaacaacaacaacaaaugaaa

SEQ ID NO: 945140 - RNA, 22 nt, Human
aacaaaugaaaauauaaaaccc

SEQ ID NO: 945141 - RNA, 18 nt, Human
acacugaaaggucgaagg

SEQ ID NO: 945142 - RNA, 24 nt, Human
cacacugaaaggucgaaggaacau

SEQ ID NO: 945143 - RNA, 20 nt, Human
cccaugagauauuuauauaa

SEQ ID NO: 945144 - RNA, 19 nt, Human
cuuaaaaaaaaacaacaac

SEQ ID NO: 945145 - RNA, 22 nt, Human
uaaaaccccaugagauauuuau

SEQ ID NO: 945146 - RNA, 18 nt, Human
ugaaaauauaaaacccca

SEQ ID NO: 945147 - RNA, 24 nt, Human
uugagugacaaagcagucuuuuuc

SEQ ID NO: 945148 - RNA, 19 nt, Human
aaaaaaaagaaaaagaaaa

SEQ ID NO: 945149 - RNA, 19 nt, Human
aaaaaaccaaaacucaacc

SEQ ID NO: 945150 - RNA, 24 nt, Human
aaaaaaccaaaacucaaccaaaua

SEQ ID NO: 945151 - RNA, 26 nt, Human
aaaaaagaaaaagaaaaaaccaaaag

SEQ ID NO: 945152 - RNA, 22 nt, Human
aaaaaccaaaacucaaccaaau

SEQ ID NO: 945153 - RNA, 23 nt, Human
aaaagaaaaagaaaaaaccaaaa

SEQ ID NO: 945154 - RNA, 18 nt, Human
aacaaagccauccauugc

SEQ ID NO: 945155 - RNA, 22 nt, Human
aacaaagccauccauugcauga

SEQ ID NO: 945156 - RNA, 19 nt, Human
aagcucagggcagcucaug

SEQ ID NO: 945157 - RNA, 24 nt, Human
aagguaccgcucauccccuccuug

SEQ ID NO: 945158 - RNA, 18 nt, Human
acccaggacacucucccu

SEQ ID NO: 945159 - RNA, 21 nt, Human
agagaaggacagccuguagua

SEQ ID NO: 945160 - RNA, 19 nt, Human
agagaggauagcaaggggg

SEQ ID NO: 945161 - RNA, 20 nt, Human
agagggcauucuggcugggg

SEQ ID NO: 945162 - RNA, 19 nt, Human
agcacuuugccaguugauu

SEQ ID NO: 945163 - RNA, 18 nt, Human
aggagugguacuuguggu

SEQ ID NO: 945164 - RNA, 18 nt, Human
aggcugcccccaccagcc

SEQ ID NO: 945165 - RNA, 23 nt, Human
auagcaacauuauuuucaaacac

SEQ ID NO: 945166 - RNA, 26 nt, Human
auaguggauuccagaguuuacacccc

SEQ ID NO: 945167 - RNA, 22 nt, Human
aucuucaaaguaagaagcaacc

SEQ ID NO: 945168 - RNA, 20 nt, Human
augguaauuaacauauuuuu

SEQ ID NO: 945169 - RNA, 21 nt, Human
auuaaacuguaagaauacaau

SEQ ID NO: 945170 - RNA, 26 nt, Human
auuuuuggaaaaaaaaagaaaaagaa

SEQ ID NO: 945171 - RNA, 24 nt, Human
caaccaaauaggugauagcaacau

SEQ ID NO: 945172 - RNA, 22 nt, Human
caaccugaaucccaacuugaaa

SEQ ID NO: 945173 - RNA, 21 nt, Human
caaggcaggucaaccacagcc

SEQ ID NO: 945174 - RNA, 18 nt, Human
cacccaggacacucuccc

SEQ ID NO: 945175 - RNA, 19 nt, Human
caccuccccaacgaccaaa

SEQ ID NO: 945176 - RNA, 19 nt, Human
caccuccccaacgaccaaa

SEQ ID NO: 945177 - RNA, 21 nt, Human
cacucggucugcguauccagg

SEQ ID NO: 945178 - RNA, 21 nt, Human
cacucggucugcguauccagg

SEQ ID NO: 945179 - RNA, 19 nt, Human
cagagcuguguguccucug

SEQ ID NO: 945180 - RNA, 27 nt, Human
caggaaaaugccucaaccugaauccca

SEQ ID NO: 945181 - RNA, 21 nt, Human
ccaacgaccaaagcucagggc

SEQ ID NO: 945182 - RNA, 23 nt, Human
ccacauguccucuucgccccuca

SEQ ID NO: 945183 - RNA, 20 nt, Human
ccaccagccugagaaggagu

SEQ ID NO: 945184 - RNA, 20 nt, Human
cccaccagccugagaaggag

SEQ ID NO: 945185 - RNA, 18 nt, Human
ccccaaggcaggucaacc

SEQ ID NO: 945186 - RNA, 24 nt, Human
ccccaaggcaggucaaccacagcc

SEQ ID NO: 945187 - RNA, 22 nt, Human
ccccuaugacagcauuuuaccc

SEQ ID NO: 945188 - RNA, 20 nt, Human
ccccugagacugcugccccu

SEQ ID NO: 945189 - RNA, 21 nt, Human
ccccugagacugcugccccua

SEQ ID NO: 945190 - RNA, 18 nt, Human
cuaggaaacaaaagugau

SEQ ID NO: 945191 - RNA, 21 nt, Human
cuccauuugagccaccucccc

SEQ ID NO: 945192 - RNA, 24 nt, Human
cuccauuugagccaccuccccaac

SEQ ID NO: 945193 - RNA, 24 nt, Human
cugaaucccaacuugaaauacuaa

SEQ ID NO: 945194 - RNA, 24 nt, Human
cuucgccccucagcccugcucccc

SEQ ID NO: 945195 - RNA, 18 nt, Human
gaaaggaaauacagauca

SEQ ID NO: 945196 - RNA, 20 nt, Human
gaaggacagccuguaguaca

SEQ ID NO: 945197 - RNA, 24 nt, Human
gaguuggucuuuagagcuucuucu

SEQ ID NO: 945198 - RNA, 20 nt, Human
gcaggaaaaugccucaaccu

SEQ ID NO: 945199 - RNA, 18 nt, Human
gcaugaaggaugcccaaa

SEQ ID NO: 945200 - RNA, 22 nt, Human
gccagagaggauagcaaggggg

SEQ ID NO: 945201 - RNA, 20 nt, Human
gccucgucugccccaggcac

SEQ ID NO: 945202 - RNA, 23 nt, Human
gcucauggccauggcuuaucacu

SEQ ID NO: 945203 - RNA, 18 nt, Human
ggaaaaaaaaagaaaaag

SEQ ID NO: 945204 - RNA, 19 nt, Human
ggccauggcuuaucacuuu

SEQ ID NO: 945205 - RNA, 20 nt, Human
ggucucccaagguaccgcuc

SEQ ID NO: 945206 - RNA, 19 nt, Human
guaagaagcaaccacucuu

SEQ ID NO: 945207 - RNA, 23 nt, Human
gucuugaggggcaaaaagcuuuu

SEQ ID NO: 945208 - RNA, 25 nt, Human
guguagcuguuuuggaaagaagggc

SEQ ID NO: 945209 - RNA, 22 nt, Human
uaaguugaacacuuaacuuuaa

SEQ ID NO: 945210 - RNA, 20 nt, Human
uagcaaaaaaccuaacuugg

SEQ ID NO: 945211 - RNA, 21 nt, Human
uagcuguuuuggaaagaaggg

SEQ ID NO: 945212 - RNA, 24 nt, Human
ucaaccacagccgcuggcuccauu

SEQ ID NO: 945213 - RNA, 21 nt, Human
ucagcccugcuccccaaggca

SEQ ID NO: 945214 - RNA, 18 nt, Human
ucagggcagcucauggcc

SEQ ID NO: 945215 - RNA, 19 nt, Human
uccccaacgaccaaagcuc

SEQ ID NO: 945216 - RNA, 27 nt, Human
uccccacaagagggaagagacaaaggc

SEQ ID NO: 945217 - RNA, 18 nt, Human
ucuacauuaggugguaca

SEQ ID NO: 945218 - RNA, 19 nt, Human
ucuccagauauauuccacu

SEQ ID NO: 945219 - RNA, 19 nt, Human
ucucccaagguaccgcuca

SEQ ID NO: 945220 - RNA, 21 nt, Human
ucucuucuaggaaacaaaagu

SEQ ID NO: 945221 - RNA, 22 nt, Human
ucuugaggggcaaaaagcuuuu

SEQ ID NO: 945222 - RNA, 23 nt, Human
ugaaaauucuaguccagauaaca

SEQ ID NO: 945223 - RNA, 20 nt, Human
ugaaguauaacaacuuuggc

SEQ ID NO: 945224 - RNA, 19 nt, Human
uggaaaaaaaaagaaaaag

SEQ ID NO: 945225 - RNA, 20 nt, Human
uggaaaaaaaaagaaaaaga

SEQ ID NO: 945226 - RNA, 18 nt, Human
uggaaagaagggcacugg

SEQ ID NO: 945227 - RNA, 23 nt, Human
uggauuccagaguuuacaccccc

SEQ ID NO: 945228 - RNA, 19 nt, Human
uggcugacacccaggacac

SEQ ID NO: 945229 - RNA, 21 nt, Human
uucuucuuuuggucaacaaag

SEQ ID NO: 945230 - RNA, 22 nt, Human
uuggaaagaagggcacuggagg

SEQ ID NO: 945231 - RNA, 22 nt, Human
uugggcacaauagugcuggaug

SEQ ID NO: 945232 - RNA, 22 nt, Human
uuucuuguagaauagcuucuac

SEQ ID NO: 945233 - RNA, 18 nt, Human
acuguaaaugcuggggac

SEQ ID NO: 945234 - RNA, 24 nt, Human
cacaccaagcaggcaaagccuaaa

SEQ ID NO: 945235 - RNA, 19 nt, Human
caccaagcaggcaaagccu

SEQ ID NO: 945236 - RNA, 20 nt, Human
caccagcgauggugggacuc

SEQ ID NO: 945237 - RNA, 26 nt, Human
ccaccagcgauggugggacucccuuu

SEQ ID NO: 945238 - RNA, 20 nt, Human
ccuaaauacagggcaggacu

SEQ ID NO: 945239 - RNA, 21 nt, Human
gagcagggacccugggauacc

SEQ ID NO: 945240 - RNA, 20 nt, Human
gugauguaccauuccagccc

SEQ ID NO: 945241 - RNA, 19 nt, Human
uacaucacaccaagcaggc

SEQ ID NO: 945242 - RNA, 20 nt, Human
ugaaaaggagauguguucuu

SEQ ID NO: 945243 - RNA, 21 nt, Human
ugaaaaggagauguguucuug

SEQ ID NO: 945244 - RNA, 19 nt, Human
ugggauaccaccagcgaug

SEQ ID NO: 945245 - RNA, 21 nt, Human
acagggaaaacgcgacaggug

SEQ ID NO: 945246 - RNA, 19 nt, Human
caccgugggaaaugccccu

SEQ ID NO: 945247 - RNA, 22 nt, Human
gaaaugccccuccgccagcucu

SEQ ID NO: 945248 - RNA, 20 nt, Human
gcaacacagggaaaacgcga

SEQ ID NO: 945249 - RNA, 27 nt, Human
gcguggggugggcagagcaugcuggga

SEQ ID NO: 945250 - RNA, 24 nt, Human
aaguaauaaaaauuuauugagaau

SEQ ID NO: 945251 - RNA, 21 nt, Human
aaucacugagaaaucacgcac

SEQ ID NO: 945252 - RNA, 19 nt, Human
agaaaucacgcacuguccc

SEQ ID NO: 945253 - RNA, 24 nt, Human
aggccggcggcacuggaggucaga

SEQ ID NO: 945254 - RNA, 22 nt, Human
agggagggaacaacacuguagg

SEQ ID NO: 945255 - RNA, 23 nt, Human
agggagggaacaacacuguagga

SEQ ID NO: 945256 - RNA, 27 nt, Human
agggguucagggaaccggugugggggg

SEQ ID NO: 945257 - RNA, 20 nt, Human
agucuucagucuuccuuaau

SEQ ID NO: 945258 - RNA, 20 nt, Human
aucacgcacuguccccaaca

SEQ ID NO: 945259 - RNA, 24 nt, Human
cacgcacuguccccaacagcccca

SEQ ID NO: 945260 - RNA, 22 nt, Human
cagccuugagggagggaacaac

SEQ ID NO: 945261 - RNA, 20 nt, Human
ccaguuaacacagggaggag

SEQ ID NO: 945262 - RNA, 22 nt, Human
ccucaaaaacuggagaagcaga

SEQ ID NO: 945263 - RNA, 22 nt, Human
cggugugggggaccaucgcaug

SEQ ID NO: 945264 - RNA, 18 nt, Human
gcacuguccccaacagcc

SEQ ID NO: 945265 - RNA, 21 nt, Human
gccucuaccccgcuccggcuu

SEQ ID NO: 945266 - RNA, 21 nt, Human
gucagaagggggugccggccc

SEQ ID NO: 945267 - RNA, 21 nt, Human
ucacgcacuguccccaacagc

SEQ ID NO: 945268 - RNA, 25 nt, Human
ucagaagggggugccggcccgccuc

SEQ ID NO: 945269 - RNA, 23 nt, Human
ucagggaaccggugugggggacc

SEQ ID NO: 945270 - RNA, 21 nt, Human
uccacuuccucugggggugga

SEQ ID NO: 945271 - RNA, 24 nt, Human
uccucuggggguggaguucuugac

SEQ ID NO: 945272 - RNA, 23 nt, Human
ucugaucuugaggccggcggcac

SEQ ID NO: 945273 - RNA, 22 nt, Human
ugccggcccgccucuaccccgc

SEQ ID NO: 945274 - RNA, 19 nt, Human
ugcuggaccccuggcuggc

SEQ ID NO: 945275 - RNA, 22 nt, Human
uggaccccuggcuggcuccuuc

SEQ ID NO: 945276 - RNA, 23 nt, Human
uggagaagcagauccacuuccuc

SEQ ID NO: 945277 - RNA, 25 nt, Human
uguccccaacagccccaguuaacac

SEQ ID NO: 945278 - RNA, 23 nt, Human
uuuuuuuuuuuuuuuuuuucagg

SEQ ID NO: 945279 - RNA, 23 nt, Human
aaaaggccagacagcucacugca

SEQ ID NO: 945280 - RNA, 27 nt, Human
aaaaggccagacagcucacugcacugc

SEQ ID NO: 945281 - RNA, 21 nt, Human
aagcuuuauguuaaaguauga

SEQ ID NO: 945282 - RNA, 19 nt, Human
cacugcacugccaggcugc

SEQ ID NO: 945283 - RNA, 25 nt, Human
ccagacagcucacugcacugccagg

SEQ ID NO: 945284 - RNA, 22 nt, Human
cguacauucucuuugcagcaua

SEQ ID NO: 945285 - RNA, 19 nt, Human
cuacaaaauuuaagucuuu

SEQ ID NO: 945286 - RNA, 23 nt, Human
cucacugcacugccaggcugcac

SEQ ID NO: 945287 - RNA, 20 nt, Human
uaaccaaggaucaaggacaa

SEQ ID NO: 945288 - RNA, 21 nt, Human
ucaauccguacauucucuuug

SEQ ID NO: 945289 - RNA, 22 nt, Human
ucacugcacugccaggcugcac

SEQ ID NO: 945290 - RNA, 18 nt, Human
uuaaaguaugaacagcau

SEQ ID NO: 945291 - RNA, 24 nt, Human
uuuaaacaagccuaagaagguaag

SEQ ID NO: 945292 - RNA, 18 nt, Human
uuuuuuuuuuuuuuuuug

SEQ ID NO: 945293 - RNA, 19 nt, Human
uuuuuuuuuuuuuuuuugc

SEQ ID NO: 945294 - RNA, 24 nt, Human
uuuuuuuuuuuuuuuuugcauuaa

SEQ ID NO: 945295 - RNA, 19 nt, Human
accagauccccguucggau

SEQ ID NO: 945296 - RNA, 24 nt, Human
acccagugaggcacgacgugguuu

SEQ ID NO: 945297 - RNA, 26 nt, Human
acccagugaggcacgacgugguuuac

SEQ ID NO: 945298 - RNA, 20 nt, Human
agacuucuggguuggguucc

SEQ ID NO: 945299 - RNA, 19 nt, Human
agguuggagaugcagagcu

SEQ ID NO: 945300 - RNA, 18 nt, Human
cacauucagaaaugaggu

SEQ ID NO: 945301 - RNA, 22 nt, Human
cacccucgauuccaccagaucc

SEQ ID NO: 945302 - RNA, 24 nt, Human
cagagcuccaaggggacguccggg

SEQ ID NO: 945303 - RNA, 21 nt, Human
caggagaugggcgccccucuu

SEQ ID NO: 945304 - RNA, 23 nt, Human
caggccccugggccuugcacugg

SEQ ID NO: 945305 - RNA, 21 nt, Human
ccccugggccuugcacuggcu

SEQ ID NO: 945306 - RNA, 23 nt, Human
cccucgauuccaccagauccccg

SEQ ID NO: 945307 - RNA, 23 nt, Human
cgguguccuccacagcaggccuc

SEQ ID NO: 945308 - RNA, 23 nt, Human
gagggagcacgguguccuccaca

SEQ ID NO: 945309 - RNA, 25 nt, Human
gccggaauccagagcaggucccggu

SEQ ID NO: 945310 - RNA, 18 nt, Human
ggaauccagagcaggucc

SEQ ID NO: 945311 - RNA, 22 nt, Human
ggcuugggcggccgcggugugg

SEQ ID NO: 945312 - RNA, 20 nt, Human
uaagcaggacccagugaggc

SEQ ID NO: 945313 - RNA, 26 nt, Human
uccaccagauccccguucggaucuga

SEQ ID NO: 945314 - RNA, 21 nt, Human
uccagguuggagaugcagagc

SEQ ID NO: 945315 - RNA, 19 nt, Human
ucccucuggucuuucaccc

SEQ ID NO: 945316 - RNA, 19 nt, Human
uccgggccggaauccagag

SEQ ID NO: 945317 - RNA, 21 nt, Human
ucggaauucuuuagggcacag

SEQ ID NO: 945318 - RNA, 23 nt, Human
ucugagucggaauucuuuagggc

SEQ ID NO: 945319 - RNA, 20 nt, Human
ucuggguuggguuccagguu

SEQ ID NO: 945320 - RNA, 24 nt, Human
ugagagcaagaaggcuggaaaugc

SEQ ID NO: 945321 - RNA, 25 nt, Human
ugagagcaagaaggcuggaaaugca

SEQ ID NO: 945322 - RNA, 20 nt, Human
aaaaaagccaguguaguagg

SEQ ID NO: 945323 - RNA, 24 nt, Human
aaaaacaagcaggaguugaguggc

SEQ ID NO: 945324 - RNA, 18 nt, Human
aacuccuggguucuccuu

SEQ ID NO: 945325 - RNA, 21 nt, Human
aagcaggaguugaguggcugg

SEQ ID NO: 945326 - RNA, 22 nt, Human
aagcugaaggggucuagaagcu

SEQ ID NO: 945327 - RNA, 18 nt, Human
aaggauacuguggaaagg

SEQ ID NO: 945328 - RNA, 22 nt, Human
acccugaggauguagcuagugc

SEQ ID NO: 945329 - RNA, 18 nt, Human
acuucuuauggccaaaga

SEQ ID NO: 945330 - RNA, 22 nt, Human
agaagccacuacugggccaaug

SEQ ID NO: 945331 - RNA, 21 nt, Human
agacagccagagacaggggag

SEQ ID NO: 945332 - RNA, 19 nt, Human
agagcuagaagccacuacu

SEQ ID NO: 945333 - RNA, 25 nt, Human
aguuagcagaaucuugauucuugcu

SEQ ID NO: 945334 - RNA, 18 nt, Human
caaagacccagcuguuuc

SEQ ID NO: 945335 - RNA, 18 nt, Human
caagcaggaguugagugg

SEQ ID NO: 945336 - RNA, 22 nt, Human
cacuacugggccaaugcuaaag

SEQ ID NO: 945337 - RNA, 28 nt, Human
ccuauggccaaaggaaaaaccggggucc

SEQ ID NO: 945338 - RNA, 20 nt, Human
ccucugaaauaaugagcaga

SEQ ID NO: 945339 - RNA, 20 nt, Human
cgcuucuuugaaacuccugg

SEQ ID NO: 945340 - RNA, 20 nt, Human
cuaaaaaagccaguguagua

SEQ ID NO: 945341 - RNA, 27 nt, Human
cuaaaguuucugucucuaagccuaaaa

SEQ ID NO: 945342 - RNA, 27 nt, Human
cuacugggccaaugcuaaaguuucugu

SEQ ID NO: 945343 - RNA, 20 nt, Human
cuccugaguuucuuccuucu

SEQ ID NO: 945344 - RNA, 22 nt, Human
cugaaggggucuagaagcuuac

SEQ ID NO: 945345 - RNA, 23 nt, Human
cugcucgagacagccagagacag

SEQ ID NO: 945346 - RNA, 21 nt, Human
cuguggaaagggauggcgggg

SEQ ID NO: 945347 - RNA, 23 nt, Human
cuguuuggcaaccaagacucuaa

SEQ ID NO: 945348 - RNA, 21 nt, Human
gaguugaguggcugggguggg

SEQ ID NO: 945349 - RNA, 20 nt, Human
gccaaaggaaaaacaagcag

SEQ ID NO: 945350 - RNA, 21 nt, Human
ggaguugaguggcuggggugg

SEQ ID NO: 945351 - RNA, 24 nt, Human
ggaguugaguggcugggguggggu

SEQ ID NO: 945352 - RNA, 18 nt, Human
gggaggagggaagaagga

SEQ ID NO: 945353 - RNA, 22 nt, Human
guaaaccuuccuauggccaaag

SEQ ID NO: 945354 - RNA, 18 nt, Human
guaguagggcccuuauca

SEQ ID NO: 945355 - RNA, 19 nt, Human
uacacaaugguuuauuaaa

SEQ ID NO: 945356 - RNA, 21 nt, Human
uacccugaggauguagcuagu

SEQ ID NO: 945357 - RNA, 18 nt, Human
uagcagaaaggaagagga

SEQ ID NO: 945358 - RNA, 22 nt, Human
uagccaggcuagcagaaaggaa

SEQ ID NO: 945359 - RNA, 20 nt, Human
ucuaagccuaaaaaagccag

SEQ ID NO: 945360 - RNA, 22 nt, Human
ucuaagggccccugccuucuuc

SEQ ID NO: 945361 - RNA, 18 nt, Human
ucuccaguggucccaguc

SEQ ID NO: 945362 - RNA, 22 nt, Human
ugcucgagacagccagagacag

SEQ ID NO: 945363 - RNA, 21 nt, Human
uggcugggguggggugcaggc

SEQ ID NO: 945364 - RNA, 22 nt, Human
ugggguggggugcaggcaaugg

SEQ ID NO: 945365 - RNA, 20 nt, Human
uuacuccugaguuucuuccu

SEQ ID NO: 945366 - RNA, 19 nt, Human
uugaguggcuggggugggg

SEQ ID NO: 945367 - RNA, 19 nt, Human
aaguuuguuuuuauuuuuc

SEQ ID NO: 945368 - RNA, 27 nt, Human
agguacugaagaucagcgaugcaaacu

SEQ ID NO: 945369 - RNA, 18 nt, Human
auggucugaacugaguug

SEQ ID NO: 945370 - RNA, 27 nt, Human
caaacucauuagggaggagauggucug

SEQ ID NO: 945371 - RNA, 21 nt, Human
cuuagcggcagugaaucucuu

SEQ ID NO: 945372 - RNA, 18 nt, Human
gggcucuagagacugaga

SEQ ID NO: 945373 - RNA, 19 nt, Human
gugaagguacugaagauca

SEQ ID NO: 945374 - RNA, 19 nt, Human
ucugaacugaguuggagac

SEQ ID NO: 945375 - RNA, 20 nt, Human
ugcuuaaggagcaaaucagc

SEQ ID NO: 945376 - RNA, 24 nt, Human
ugguaagugccuugucccggggcg

SEQ ID NO: 945377 - RNA, 25 nt, Human
uucuagacauccauuuuucagcuuc

SEQ ID NO: 945378 - RNA, 18 nt, Human
acaaccaaccuacccccc

SEQ ID NO: 945379 - RNA, 18 nt, Human
accucccuccccacccag

SEQ ID NO: 945380 - RNA, 22 nt, Human
accucccuccccacccagugcc

SEQ ID NO: 945381 - RNA, 21 nt, Human
auuccuuuuuuuuuuuuugag

SEQ ID NO: 945382 - RNA, 22 nt, Human
caaccuaccccccaccuucaag

SEQ ID NO: 945383 - RNA, 19 nt, Human
caccucccuccccacccag

SEQ ID NO: 945384 - RNA, 23 nt, Human
caccucccuccccacccagugcc

SEQ ID NO: 945385 - RNA, 21 nt, Human
cacggcuccuccaccucccuc

SEQ ID NO: 945386 - RNA, 22 nt, Human
cacggcuccuccaccucccucc

SEQ ID NO: 945387 - RNA, 18 nt, Human
cauccugguugggauugc

SEQ ID NO: 945388 - RNA, 26 nt, Human
caucuuuauugggaagacucugaaca

SEQ ID NO: 945389 - RNA, 21 nt, Human
cccacauguggggacagaggc

SEQ ID NO: 945390 - RNA, 22 nt, Human
ccuacuggagaaggugccccca

SEQ ID NO: 945391 - RNA, 18 nt, Human
cuccaccucccuccccac

SEQ ID NO: 945392 - RNA, 20 nt, Human
cuccccacccagugccccuc

SEQ ID NO: 945393 - RNA, 18 nt, Human
cucccuccccacccagug

SEQ ID NO: 945394 - RNA, 22 nt, Human
cugaacaaccaaccuacccccc

SEQ ID NO: 945395 - RNA, 22 nt, Human
gaacaaccaaccuaccccccac

SEQ ID NO: 945396 - RNA, 20 nt, Human
gaauuccuuuuuuuuuuuuu

SEQ ID NO: 945397 - RNA, 23 nt, Human
gagcuucucgccaaggcugaaua

SEQ ID NO: 945398 - RNA, 23 nt, Human
gcacggcuccuccaccucccucc

SEQ ID NO: 945399 - RNA, 20 nt, Human
gcacgggagccaugucccuu

SEQ ID NO: 945400 - RNA, 23 nt, Human
gcccggggcugcggggcgcgggg

SEQ ID NO: 945401 - RNA, 18 nt, Human
gcggggcgcggggccggg

SEQ ID NO: 945402 - RNA, 27 nt, Human
ggaagacucugaacaaccaaccuaccc

SEQ ID NO: 945403 - RNA, 25 nt, Human
ggagcuucucgccaaggcugaauau

SEQ ID NO: 945404 - RNA, 18 nt, Human
ggcuccuccaccucccuc

SEQ ID NO: 945405 - RNA, 21 nt, Human
gggaagacucugaacaaccaa

SEQ ID NO: 945406 - RNA, 20 nt, Human
gggagggagggccaggaauc

SEQ ID NO: 945407 - RNA, 20 nt, Human
gggcccgggcggccgggagg

SEQ ID NO: 945408 - RNA, 18 nt, Human
ucccuuuuccucuccgga

SEQ ID NO: 945409 - RNA, 21 nt, Human
uccggacucaguuuccucauc

SEQ ID NO: 945410 - RNA, 21 nt, Human
uccuccaccucccuccccacc

SEQ ID NO: 945411 - RNA, 21 nt, Human
ucugaacaaccaaccuacccc

SEQ ID NO: 945412 - RNA, 22 nt, Human
ugaacaaccaaccuacccccca

SEQ ID NO: 945413 - RNA, 23 nt, Human
ugaacaaccaaccuaccccccac

SEQ ID NO: 945414 - RNA, 23 nt, Human
ugcaacggagcuucucgccaagg

SEQ ID NO: 945415 - RNA, 24 nt, Human
uuccuuuuuuuuuuuuugaggcuc

SEQ ID NO: 945416 - RNA, 27 nt, Human
aaaaagacacccaccacguaaaaaacu

SEQ ID NO: 945417 - RNA, 21 nt, Human
acuuugugcccagcuuggggc

SEQ ID NO: 945418 - RNA, 20 nt, Human
agacacccaccacguaaaaa

SEQ ID NO: 945419 - RNA, 23 nt, Human
aggaagauuuuuuuacaaaaaga

SEQ ID NO: 945420 - RNA, 19 nt, Human
aggguuucugaggguuggc

SEQ ID NO: 945421 - RNA, 19 nt, Human
caaaaagacacccaccacg

SEQ ID NO: 945422 - RNA, 19 nt, Human
caaguguagaugggagggc

SEQ ID NO: 945423 - RNA, 21 nt, Human
cagaaugcaccucagugaccc

SEQ ID NO: 945424 - RNA, 21 nt, Human
cagguaacggcgccuuugccc

SEQ ID NO: 945425 - RNA, 22 nt, Human
ccagaaugcaccucagugaccc

SEQ ID NO: 945426 - RNA, 19 nt, Human
ccccaucgucugucugucc

SEQ ID NO: 945427 - RNA, 22 nt, Human
cccgcaguggcgucccuggagc

SEQ ID NO: 945428 - RNA, 20 nt, Human
cccuggagcccagaaugcac

SEQ ID NO: 945429 - RNA, 20 nt, Human
ccucuuguucagaugggagu

SEQ ID NO: 945430 - RNA, 22 nt, Human
ccugacgcccaggccagcaggc

SEQ ID NO: 945431 - RNA, 21 nt, Human
cgcccugacgcccaggccagc

SEQ ID NO: 945432 - RNA, 24 nt, Human
cuagguuuucuggccucaggcucu

SEQ ID NO: 945433 - RNA, 24 nt, Human
cucagugacccgccaacucucaga

SEQ ID NO: 945434 - RNA, 23 nt, Human
cuccagcggcuggaugcuccagg

SEQ ID NO: 945435 - RNA, 18 nt, Human
cugcuguauggcuucuuc

SEQ ID NO: 945436 - RNA, 18 nt, Human
cugguuuauugugagggu

SEQ ID NO: 945437 - RNA, 24 nt, Human
gagcugcuguauggcuucuuccag

SEQ ID NO: 945438 - RNA, 23 nt, Human
gccucaggcucugcauaaaccuc

SEQ ID NO: 945439 - RNA, 20 nt, Human
gcuucuuccuucuuuccuuc

SEQ ID NO: 945440 - RNA, 24 nt, Human
ggaguaggaggugccucagcuucu

SEQ ID NO: 945441 - RNA, 23 nt, Human
ggcagaaagucccuagguuuucu

SEQ ID NO: 945442 - RNA, 22 nt, Human
guaaaaaacuacuuugugccca

SEQ ID NO: 945443 - RNA, 20 nt, Human
uauugugaggguuucugagg

SEQ ID NO: 945444 - RNA, 24 nt, Human
uccaaguacuuuauugaugcgccc

SEQ ID NO: 945445 - RNA, 19 nt, Human
ucccgggaucccccaggcu

SEQ ID NO: 945446 - RNA, 18 nt, Human
ucccuagguuuucuggcc

SEQ ID NO: 945447 - RNA, 19 nt, Human
ucgcuuucccgggaucccc

SEQ ID NO: 945448 - RNA, 21 nt, Human
ugaugagcugcuguauggcuu

SEQ ID NO: 945449 - RNA, 21 nt, Human
ugccucagcuucuuggggcag

SEQ ID NO: 945450 - RNA, 22 nt, Human
ugcuguauggcuucuuccagau

SEQ ID NO: 945451 - RNA, 26 nt, Human
ugcuucuuccuucuuuccuucugaaa

SEQ ID NO: 945452 - RNA, 21 nt, Human
ugcuuugagcugcuucuuucu

SEQ ID NO: 945453 - RNA, 25 nt, Human
uggaagagccgagauggagaggucu

SEQ ID NO: 945454 - RNA, 25 nt, Human
uggagcccagaaugcaccucagaac

SEQ ID NO: 945455 - RNA, 24 nt, Human
uggccagagcccagggacaaggaa

SEQ ID NO: 945456 - RNA, 21 nt, Human
ugggagggcaguagguggaga

SEQ ID NO: 945457 - RNA, 18 nt, Human
uucuuggggcagaaaguc

SEQ ID NO: 945458 - RNA, 25 nt, Human
uuugcuucuuccuucuuuccuucug

SEQ ID NO: 945459 - RNA, 25 nt, Human
uuuuuuuuuuugagcacaaaacugg

SEQ ID NO: 945460 - RNA, 23 nt, Human
uuuuuuuuuuuuuuuuuuuuggg

SEQ ID NO: 945461 - RNA, 22 nt, Human
aaaaaaaaaaacaaaacaaaaa

SEQ ID NO: 945462 - RNA, 21 nt, Human
aaaaaaaacaaaacaaaaaca

SEQ ID NO: 945463 - RNA, 23 nt, Human
aaaaacaaaacaaaaacaaaagc

SEQ ID NO: 945464 - RNA, 22 nt, Human
aaaacaaaacaaaaacaaaagc

SEQ ID NO: 945465 - RNA, 26 nt, Human
aaacaaaaaaaaaaacaaaacaaaaa

SEQ ID NO: 945466 - RNA, 18 nt, Human
aaacaaaaacaaaagcaa

SEQ ID NO: 945467 - RNA, 19 nt, Human
aaacaaauuccuaaacaaa

SEQ ID NO: 945468 - RNA, 20 nt, Human
aaacaaauuccuaaacaaaa

SEQ ID NO: 945469 - RNA, 19 nt, Human
aaacagacuaaggacccuc

SEQ ID NO: 945470 - RNA, 22 nt, Human
aacaaaacaaaaacaaaagcaa

SEQ ID NO: 945471 - RNA, 18 nt, Human
aaccaaagacagcugucc

SEQ ID NO: 945472 - RNA, 27 nt, Human
aaccacaacaucagauacaggaccuuc

SEQ ID NO: 945473 - RNA, 28 nt, Human
aaccacaacaucagauacaggaccuucu

SEQ ID NO: 945474 - RNA, 20 nt, Human
aagaaaaaaugcaaaauagc

SEQ ID NO: 945475 - RNA, 18 nt, Human
acaaaaaaaaaaacaaaa

SEQ ID NO: 945476 - RNA, 19 nt, Human
acaaaaaaaaaaacaaaac

SEQ ID NO: 945477 - RNA, 26 nt, Human
acaaaaacaaaagcaaaauaaaagcu

SEQ ID NO: 945478 - RNA, 21 nt, Human
acaaaacaaaaacaaaagcaa

SEQ ID NO: 945479 - RNA, 25 nt, Human
acaaaacaaaaacaaaagcaaaaua

SEQ ID NO: 945480 - RNA, 26 nt, Human
acaaaacaaaaacaaaagcaaaauaa

SEQ ID NO: 945481 - RNA, 21 nt, Human
acaccauuaccaucacaaccc

SEQ ID NO: 945482 - RNA, 18 nt, Human
acccguuucuucucuggc

SEQ ID NO: 945483 - RNA, 22 nt, Human
agaggcuguaaacccaugaagg

SEQ ID NO: 945484 - RNA, 18 nt, Human
agauuucugaagcuggug

SEQ ID NO: 945485 - RNA, 20 nt, Human
agauuucugaagcuggugaa

SEQ ID NO: 945486 - RNA, 18 nt, Human
aggcaauuuuauagcacu

SEQ ID NO: 945487 - RNA, 21 nt, Human
aggcaauuuuauagcacugaa

SEQ ID NO: 945488 - RNA, 23 nt, Human
auauucucauccacuucuuguug

SEQ ID NO: 945489 - RNA, 23 nt, Human
auucucaagagaagauuaacccu

SEQ ID NO: 945490 - RNA, 25 nt, Human
caaaaaaaaaaacaaaacaaaaaca

SEQ ID NO: 945491 - RNA, 20 nt, Human
caaaauaaaagcucuacuug

SEQ ID NO: 945492 - RNA, 20 nt, Human
caaaggucagauuucugaag

SEQ ID NO: 945493 - RNA, 20 nt, Human
caaauuccuaaacaaaagcc

SEQ ID NO: 945494 - RNA, 21 nt, Human
caacaaaauauucucauccac

SEQ ID NO: 945495 - RNA, 28 nt, Human
cauuuuguuguccugcauguaaguuuua

SEQ ID NO: 945496 - RNA, 24 nt, Human
ccacaccauuaccaucacaacccu

SEQ ID NO: 945497 - RNA, 19 nt, Human
ccacauuuuucuuuuaccu

SEQ ID NO: 945498 - RNA, 25 nt, Human
ccaucugaauuaaugcucucuguau

SEQ ID NO: 945499 - RNA, 20 nt, Human
cccacaccauuaccaucaca

SEQ ID NO: 945500 - RNA, 21 nt, Human
cccagcaccaacuccagcgcu

SEQ ID NO: 945501 - RNA, 20 nt, Human
ccgguguuggcagaggcugg

SEQ ID NO: 945502 - RNA, 25 nt, Human
ccuaagaaauuaacagauugucaga

SEQ ID NO: 945503 - RNA, 24 nt, Human
ccuaaugaaaugacacgugcugcu

SEQ ID NO: 945504 - RNA, 21 nt, Human
ccuccuggccccagccugucc

SEQ ID NO: 945505 - RNA, 30 nt, Human
ccucuugaaacaaauuccuaaacaaaagcu

SEQ ID NO: 945506 - RNA, 23 nt, Human
ccuggagcccccaaauguaucuu

SEQ ID NO: 945507 - RNA, 22 nt, Human
cggccgggcugagagugggggc

SEQ ID NO: 945508 - RNA, 23 nt, Human
cuacgccugcuggaaagcaaacc

SEQ ID NO: 945509 - RNA, 19 nt, Human
cucccucaucccuuguucc

SEQ ID NO: 945510 - RNA, 19 nt, Human
cucuggcucaaucaucucc

SEQ ID NO: 945511 - RNA, 19 nt, Human
cugaaacucaaaucaaguu

SEQ ID NO: 945512 - RNA, 21 nt, Human
cugcccgauuaaaaacagucc

SEQ ID NO: 945513 - RNA, 19 nt, Human
cuggccccagccuguccca

SEQ ID NO: 945514 - RNA, 19 nt, Human
cuuccaacgugggauguuc

SEQ ID NO: 945515 - RNA, 19 nt, Human
cuugggcugguaucacuuu

SEQ ID NO: 945516 - RNA, 22 nt, Human
gaaggaggcgagagggaaaagg

SEQ ID NO: 945517 - RNA, 20 nt, Human
gacccaggacaaucucgagc

SEQ ID NO: 945518 - RNA, 18 nt, Human
gagcccccaaauguaucu

SEQ ID NO: 945519 - RNA, 24 nt, Human
gauuaacccucgcgagauuuccau

SEQ ID NO: 945520 - RNA, 19 nt, Human
gccccagccugucccaggu

SEQ ID NO: 945521 - RNA, 20 nt, Human
gcgcggccgggcugagagug

SEQ ID NO: 945522 - RNA, 21 nt, Human
ggaaagcaaaccaaagacagc

SEQ ID NO: 945523 - RNA, 24 nt, Human
gggaaaacaaaaaaaaaaacaaaa

SEQ ID NO: 945524 - RNA, 18 nt, Human
gggaaaaggccauccgcg

SEQ ID NO: 945525 - RNA, 18 nt, Human
ggguuucccagcaccaac

SEQ ID NO: 945526 - RNA, 24 nt, Human
ggucagauuucugaagcuggugaa

SEQ ID NO: 945527 - RNA, 25 nt, Human
guccuggagcccccaaauguaucuu

SEQ ID NO: 945528 - RNA, 24 nt, Human
gugggggcggggcggaaggaggcg

SEQ ID NO: 945529 - RNA, 22 nt, Human
guucuugggcugguaucacuuu

SEQ ID NO: 945530 - RNA, 23 nt, Human
uaaacaaaagccuuccuggugga

SEQ ID NO: 945531 - RNA, 20 nt, Human
uaaacccaugaaggucaaca

SEQ ID NO: 945532 - RNA, 20 nt, Human
uagaagauuuuccugcuugc

SEQ ID NO: 945533 - RNA, 22 nt, Human
ucaaaucaaguuuaaagcucaa

SEQ ID NO: 945534 - RNA, 22 nt, Human
ucaaaucaaguuuaaagcucaa

SEQ ID NO: 945535 - RNA, 24 nt, Human
ucaaaucaaguuuaaagcucaagu

SEQ ID NO: 945536 - RNA, 24 nt, Human
ucaaucaucuccuucacgcucucc

SEQ ID NO: 945537 - RNA, 23 nt, Human
ucccuuguuccucuugaaacaaa

SEQ ID NO: 945538 - RNA, 20 nt, Human
uccuggccccagccuguccc

SEQ ID NO: 945539 - RNA, 21 nt, Human
ugacccaggacaaucagcgcg

SEQ ID NO: 945540 - RNA, 19 nt, Human
ugacccaggacaaucucga

SEQ ID NO: 945541 - RNA, 21 nt, Human
ugcagaaacugaaacauggua

SEQ ID NO: 945542 - RNA, 24 nt, Human
uggaaagcaaaccaaagacagcug

SEQ ID NO: 945543 - RNA, 25 nt, Human
uggaagcgucggcuuguuccggaga

SEQ ID NO: 945544 - RNA, 27 nt, Human
uggauaucuuucaucauuuuguugucc

SEQ ID NO: 945545 - RNA, 21 nt, Human
ugggggaaaacaaaaaaaaaa

SEQ ID NO: 945546 - RNA, 22 nt, Human
ugggggaaaacaaaaaaaaaaa

SEQ ID NO: 945547 - RNA, 23 nt, Human
ugggggcggggcggaaggaggcg

SEQ ID NO: 945548 - RNA, 21 nt, Human
uggugaagauugggcagcauu

SEQ ID NO: 945549 - RNA, 24 nt, Human
uguuguccuucguucguuuucugu

SEQ ID NO: 945550 - RNA, 18 nt, Human
uguuuagagacagaggcu

SEQ ID NO: 945551 - RNA, 23 nt, Human
uguuuuuuauuuaaaucuacaug

SEQ ID NO: 945552 - RNA, 18 nt, Human
uuaaaucuacaugcagaa

SEQ ID NO: 945553 - RNA, 20 nt, Human
uuaacagauugucagaaaca

SEQ ID NO: 945554 - RNA, 20 nt, Human
uucucauccacuucuuguug

SEQ ID NO: 945555 - RNA, 21 nt, Human
uucugccuccuggccccagcc

SEQ ID NO: 945556 - RNA, 20 nt, Human
uuucccagcaccaacuccag

SEQ ID NO: 945557 - RNA, 21 nt, Human
uuucucccucaucccuuguuc

SEQ ID NO: 945558 - RNA, 22 nt, Human
uuucucccucaucccuuguucc

SEQ ID NO: 945559 - RNA, 26 nt, Human
uuuucaaugauacuuacaaugggcuc

SEQ ID NO: 945560 - RNA, 26 nt, Human
aaaaagucaaaacggugucacggaug

SEQ ID NO: 945561 - RNA, 18 nt, Human
aaaagaaacaacucaccc

SEQ ID NO: 945562 - RNA, 19 nt, Human
aaacaaaaagucaaaacgg

SEQ ID NO: 945563 - RNA, 20 nt, Human
aaacaaaaagucaaaacggu

SEQ ID NO: 945564 - RNA, 21 nt, Human
aacacaaaaccucuuaaaacg

SEQ ID NO: 945565 - RNA, 24 nt, Human
aagcaaacaaacacaaaaccucuu

SEQ ID NO: 945566 - RNA, 25 nt, Human
aagcaaacaaacacaaaaccucuua

SEQ ID NO: 945567 - RNA, 26 nt, Human
aagcaaacaaacacaaaaccucuuaa

SEQ ID NO: 945568 - RNA, 23 nt, Human
acacaaaaccucuuaaaacggca

SEQ ID NO: 945569 - RNA, 21 nt, Human
agaaaaaaacaaaaagucaaa

SEQ ID NO: 945570 - RNA, 22 nt, Human
agcaaagugggcaggcguggga

SEQ ID NO: 945571 - RNA, 18 nt, Human
agcuacgaguucuauucu

SEQ ID NO: 945572 - RNA, 19 nt, Human
aggccgaagucgagagaaa

SEQ ID NO: 945573 - RNA, 21 nt, Human
aggcucccccuccccccaccc

SEQ ID NO: 945574 - RNA, 24 nt, Human
aguaaguagcagcuuccaaaguuc

SEQ ID NO: 945575 - RNA, 22 nt, Human
auucgcaggcucccccuccccc

SEQ ID NO: 945576 - RNA, 27 nt, Human
auucgcaggcucccccuccccccaccc

SEQ ID NO: 945577 - RNA, 21 nt, Human
caaacaaacacaaaaccucuu

SEQ ID NO: 945578 - RNA, 21 nt, Human
caaggcgaucagugccgcugg

SEQ ID NO: 945579 - RNA, 23 nt, Human
cacccggacacggauuugugaga

SEQ ID NO: 945580 - RNA, 20 nt, Human
cagaaaaagacuuaucaaaa

SEQ ID NO: 945581 - RNA, 19 nt, Human
cagagucugggcgcucucc

SEQ ID NO: 945582 - RNA, 23 nt, Human
cagcuuccaaaguucugcgcccu

SEQ ID NO: 945583 - RNA, 19 nt, Human
caggcaggcaaacaggcca

SEQ ID NO: 945584 - RNA, 24 nt, Human
caggcucccccuccccccaccccu

SEQ ID NO: 945585 - RNA, 24 nt, Human
ccaccugcgggugagaacaagggc

SEQ ID NO: 945586 - RNA, 21 nt, Human
cccaugagucugcugcguggc

SEQ ID NO: 945587 - RNA, 19 nt, Human
ccccagagcuuggcccacc

SEQ ID NO: 945588 - RNA, 24 nt, Human
cccccuccccccaccccuucuucc

SEQ ID NO: 945589 - RNA, 19 nt, Human
ccccuccagggcagggggg

SEQ ID NO: 945590 - RNA, 18 nt, Human
ccccugcccgcccucucc

SEQ ID NO: 945591 - RNA, 23 nt, Human
ccccugcccgcccucuccaccug

SEQ ID NO: 945592 - RNA, 19 nt, Human
ccgcccucuccaccugccc

SEQ ID NO: 945593 - RNA, 20 nt, Human
ccgcccucuccaccugcccc

SEQ ID NO: 945594 - RNA, 18 nt, Human
ccuccagggcaggggggg

SEQ ID NO: 945595 - RNA, 24 nt, Human
ccuccccccaccccuucuucccac

SEQ ID NO: 945596 - RNA, 19 nt, Human
ccugcccgcccucuccacc

SEQ ID NO: 945597 - RNA, 18 nt, Human
cgacugccaggcaugagg

SEQ ID NO: 945598 - RNA, 21 nt, Human
cgcaggcucccccucccccca

SEQ ID NO: 945599 - RNA, 25 nt, Human
cgccucccaaaagacccagugggaa

SEQ ID NO: 945600 - RNA, 27 nt, Human
cuaaucgcccucuucuugccacuuucu

SEQ ID NO: 945601 - RNA, 22 nt, Human
cuccccccaccccuucuuccca

SEQ ID NO: 945602 - RNA, 24 nt, Human
cuccccccaccccuucuucccaca

SEQ ID NO: 945603 - RNA, 21 nt, Human
cuggggcagaaaaagacuuau

SEQ ID NO: 945604 - RNA, 26 nt, Human
cugggucucuccccugcccgcccucu

SEQ ID NO: 945605 - RNA, 19 nt, Human
cugggucuuugucccaggg

SEQ ID NO: 945606 - RNA, 21 nt, Human
cuucccacaaugacaaaacug

SEQ ID NO: 945607 - RNA, 21 nt, Human
cuucgcaccgucggucucccc

SEQ ID NO: 945608 - RNA, 19 nt, Human
cuucuugccacuuucugcu

SEQ ID NO: 945609 - RNA, 22 nt, Human
gagcacuuuuguggcguaaacc

SEQ ID NO: 945610 - RNA, 21 nt, Human
gagcgguugccgcgggggcag

SEQ ID NO: 945611 - RNA, 24 nt, Human
gaggacuuucagagggcgagggag

SEQ ID NO: 945612 - RNA, 21 nt, Human
gcaggcgugggagcgguugcc

SEQ ID NO: 945613 - RNA, 18 nt, Human
gccacuuucugcugaguu

SEQ ID NO: 945614 - RNA, 20 nt, Human
gcccgcccucuccaccugcc

SEQ ID NO: 945615 - RNA, 19 nt, Human
gcccucuccaccugccccc

SEQ ID NO: 945616 - RNA, 21 nt, Human
ggccacuggggcagaaaaaga

SEQ ID NO: 945617 - RNA, 18 nt, Human
gggcacagccgggcuagc

SEQ ID NO: 945618 - RNA, 19 nt, Human
gggugagaacaagggccuu

SEQ ID NO: 945619 - RNA, 18 nt, Human
gugagaccccaugagucu

SEQ ID NO: 945620 - RNA, 22 nt, Human
guuaaauaagaaaaaaacaaaa

SEQ ID NO: 945621 - RNA, 24 nt, Human
uaaaagaaacaacucaccccguuc

SEQ ID NO: 945622 - RNA, 22 nt, Human
uaaaccgugcagucacgagcua

SEQ ID NO: 945623 - RNA, 19 nt, Human
uaagaaaaaaacaaaaagu

SEQ ID NO: 945624 - RNA, 22 nt, Human
uaagaaaaaaacaaaaagucaa

SEQ ID NO: 945625 - RNA, 21 nt, Human
uccaaguaaguagcagcuucc

SEQ ID NO: 945626 - RNA, 26 nt, Human
uccagggcagggggggagcaggagaa

SEQ ID NO: 945627 - RNA, 19 nt, Human
uccccccaccccuucuucc

SEQ ID NO: 945628 - RNA, 22 nt, Human
uccccccaccccuucuucccac

SEQ ID NO: 945629 - RNA, 18 nt, Human
ucccccuccccccacccc

SEQ ID NO: 945630 - RNA, 20 nt, Human
uccccugcccgcccucucca

SEQ ID NO: 945631 - RNA, 20 nt, Human
ucuauucugggucuuugucc

SEQ ID NO: 945632 - RNA, 21 nt, Human
ucuucuugccacuuucugcug

SEQ ID NO: 945633 - RNA, 21 nt, Human
ugggaaaugcacuaaaagaaa

SEQ ID NO: 945634 - RNA, 18 nt, Human
ugggagcgcacccggaca

SEQ ID NO: 945635 - RNA, 22 nt, Human
uucgcaggcucccccucccccc

SEQ ID NO: 945636 - RNA, 19 nt, Human
uugccgcgggggcagaggg

SEQ ID NO: 945637 - RNA, 20 nt, Human
uuuaucgccccuccccucca

SEQ ID NO: 945638 - RNA, 20 nt, Human
uuuuuuuuuuuuuuuuuaac

SEQ ID NO: 945639 - RNA, 21 nt, Human
aacccaaaaccacuuaaaaac

SEQ ID NO: 945640 - RNA, 23 nt, Human
ccaaauuggcuuugaacccaaaa

SEQ ID NO: 945641 - RNA, 19 nt, Human
cggcccggaacagcuccag

SEQ ID NO: 945642 - RNA, 19 nt, Human
ggcaaaacagaaucauaaa

SEQ ID NO: 945643 - RNA, 23 nt, Human
ucggcagcugcgcggcccggaac

SEQ ID NO: 945644 - RNA, 23 nt, Human
aaacacuuaacgucacugaaaaa

SEQ ID NO: 945645 - RNA, 20 nt, Human
aagaaccaaguuuugaguca

SEQ ID NO: 945646 - RNA, 22 nt, Human
aagcgccaguuucuucuagaac

SEQ ID NO: 945647 - RNA, 19 nt, Human
caaaucauugaagcuccuu

SEQ ID NO: 945648 - RNA, 23 nt, Human
cacacaguuacuugacaaucacc

SEQ ID NO: 945649 - RNA, 25 nt, Human
cacgcaggaaucaggcuagaucauc

SEQ ID NO: 945650 - RNA, 19 nt, Human
cccacacaguuacuugaca

SEQ ID NO: 945651 - RNA, 19 nt, Human
ccgccugcagcugacuaga

SEQ ID NO: 945652 - RNA, 19 nt, Human
ccucuguaccuucucuucc

SEQ ID NO: 945653 - RNA, 19 nt, Human
ccuugccggcauccuccuu

SEQ ID NO: 945654 - RNA, 19 nt, Human
cgcagcuccgcuacggccg

SEQ ID NO: 945655 - RNA, 23 nt, Human
cgcccuugcucccaugggcucca

SEQ ID NO: 945656 - RNA, 19 nt, Human
cggcauccuccuugccucu

SEQ ID NO: 945657 - RNA, 18 nt, Human
cucgggcucuguggagug

SEQ ID NO: 945658 - RNA, 19 nt, Human
cuguaccuucucuucccau

SEQ ID NO: 945659 - RNA, 21 nt, Human
cuugcaacacgugaggcagcc

SEQ ID NO: 945660 - RNA, 18 nt, Human
gaaggaggacggcggggc

SEQ ID NO: 945661 - RNA, 22 nt, Human
gagaaacacuuaacgucacuga

SEQ ID NO: 945662 - RNA, 21 nt, Human
gccuggcuucccgccugcagc

SEQ ID NO: 945663 - RNA, 21 nt, Human
gcuggcaccaccugcggcugc

SEQ ID NO: 945664 - RNA, 18 nt, Human
ggaauuaggaaacuggca

SEQ ID NO: 945665 - RNA, 22 nt, Human
ggagcggcccguuccucccucg

SEQ ID NO: 945666 - RNA, 23 nt, Human
guggaguggcuggcaccaccugc

SEQ ID NO: 945667 - RNA, 18 nt, Human
gugugaacgggauguacc

SEQ ID NO: 945668 - RNA, 27 nt, Human
uaacgucacugaaaaagaaauccaugc

SEQ ID NO: 945669 - RNA, 18 nt, Human
ucagucccgcuucuagcu

SEQ ID NO: 945670 - RNA, 20 nt, Human
ucccaugggcuccacccgcc

SEQ ID NO: 945671 - RNA, 19 nt, Human
ucccaugugugaacgggau

SEQ ID NO: 945672 - RNA, 25 nt, Human
ucuccagugagauggaauuaggaaa

SEQ ID NO: 945673 - RNA, 18 nt, Human
ugaaaaagaaauccaugg

SEQ ID NO: 945674 - RNA, 21 nt, Human
ugccugcccaccuggcacagc

SEQ ID NO: 945675 - RNA, 18 nt, Human
uggcggggagcggcccgu

SEQ ID NO: 945676 - RNA, 22 nt, Human
uggcucaaaacuguucuugcaa

SEQ ID NO: 945677 - RNA, 21 nt, Human
uuccucccucgcaggccuugc

SEQ ID NO: 945678 - RNA, 18 nt, Human
aaagauauauauuuucua

SEQ ID NO: 945679 - RNA, 21 nt, Human
aaagcacugaguaaaucuuuu

SEQ ID NO: 945680 - RNA, 22 nt, Human
aagagucuguuuuagacacauu

SEQ ID NO: 945681 - RNA, 22 nt, Human
aagcaggaaaggaagaagggac

SEQ ID NO: 945682 - RNA, 23 nt, Human
aagcccucccacacugcgcagcc

SEQ ID NO: 945683 - RNA, 18 nt, Human
aagugccaguggcccggc

SEQ ID NO: 945684 - RNA, 23 nt, Human
aaugccgcuaacgcuuacaaauu

SEQ ID NO: 945685 - RNA, 19 nt, Human
acaagagucuguuuuagac

SEQ ID NO: 945686 - RNA, 24 nt, Human
acacucuccaggccaggagagcua

SEQ ID NO: 945687 - RNA, 18 nt, Human
acuaaaauaaaguaccca

SEQ ID NO: 945688 - RNA, 20 nt, Human
acuaaaauaaaguacccaaa

SEQ ID NO: 945689 - RNA, 22 nt, Human
agaagcaagugccaguggcccg

SEQ ID NO: 945690 - RNA, 24 nt, Human
agacauuucucagaauccaaacaa

SEQ ID NO: 945691 - RNA, 20 nt, Human
agaguuccuucuauuuccuu

SEQ ID NO: 945692 - RNA, 22 nt, Human
agcaagugccaguggcccggcg

SEQ ID NO: 945693 - RNA, 25 nt, Human
aggaaggagaguuaggguguaauga

SEQ ID NO: 945694 - RNA, 23 nt, Human
aguugcugggcugcggucguggg

SEQ ID NO: 945695 - RNA, 20 nt, Human
augaaucagaggcuaauuuu

SEQ ID NO: 945696 - RNA, 25 nt, Human
caaccuauuagaggccagaaacaau

SEQ ID NO: 945697 - RNA, 20 nt, Human
caaguuguccaaaugcauug

SEQ ID NO: 945698 - RNA, 21 nt, Human
caauaaagucaggguuuggug

SEQ ID NO: 945699 - RNA, 21 nt, Human
caauagaucauugagagaacc

SEQ ID NO: 945700 - RNA, 24 nt, Human
cacugcgcagcccaggcuucaggu

SEQ ID NO: 945701 - RNA, 18 nt, Human
cagaaaauccucacuuca

SEQ ID NO: 945702 - RNA, 22 nt, Human
cagaaacaaugggaagcccaga

SEQ ID NO: 945703 - RNA, 21 nt, Human
cagaaucucuggugauuacau

SEQ ID NO: 945704 - RNA, 24 nt, Human
cagaugucucuaauucuacaucuu

SEQ ID NO: 945705 - RNA, 22 nt, Human
cauuagaguguaucuuauucaa

SEQ ID NO: 945706 - RNA, 22 nt, Human
ccaaccuauuagaggccagaaa

SEQ ID NO: 945707 - RNA, 19 nt, Human
ccacacugcgcagcccagg

SEQ ID NO: 945708 - RNA, 23 nt, Human
ccucacuucaaacagaaacuaga

SEQ ID NO: 945709 - RNA, 21 nt, Human
ccucugcaaguucggaauggg

SEQ ID NO: 945710 - RNA, 18 nt, Human
ccuucuauuuccuguucc

SEQ ID NO: 945711 - RNA, 23 nt, Human
cgcgaagcccucccacacugcgc

SEQ ID NO: 945712 - RNA, 18 nt, Human
cuaaaacuucccaaccua

SEQ ID NO: 945713 - RNA, 23 nt, Human
cuaauucuacaucuucuacuagc

SEQ ID NO: 945714 - RNA, 23 nt, Human
cuacgguccucugcaaguucgga

SEQ ID NO: 945715 - RNA, 25 nt, Human
cuucagguugcguuugcgaguugcu

SEQ ID NO: 945716 - RNA, 19 nt, Human
gaaaggggaacagaagggg

SEQ ID NO: 945717 - RNA, 25 nt, Human
gaaaugaauucucuguuauagugaa

SEQ ID NO: 945718 - RNA, 19 nt, Human
gaacagaaggggaagagug

SEQ ID NO: 945719 - RNA, 20 nt, Human
gaagcccucccacacugcgc

SEQ ID NO: 945720 - RNA, 18 nt, Human
gacuugaugaaaaaaggc

SEQ ID NO: 945721 - RNA, 24 nt, Human
gcaaaaacuucaaccuacuuaaag

SEQ ID NO: 945722 - RNA, 21 nt, Human
gcacugaaauugcauaaaaca

SEQ ID NO: 945723 - RNA, 24 nt, Human
gcuacgguccucugcaaguucgga

SEQ ID NO: 945724 - RNA, 24 nt, Human
gcugcggucgugggugggacucgc

SEQ ID NO: 945725 - RNA, 20 nt, Human
gggcugcggucguggguggg

SEQ ID NO: 945726 - RNA, 18 nt, Human
gugaauuuuguguccuau

SEQ ID NO: 945727 - RNA, 24 nt, Human
guuacaucaaguuguccaaaugca

SEQ ID NO: 945728 - RNA, 18 nt, Human
uaaaauaaaguacccaaa

SEQ ID NO: 945729 - RNA, 23 nt, Human
uaaaauaaaguacccaaaucuug

SEQ ID NO: 945730 - RNA, 18 nt, Human
uaaauacauacauaugua

SEQ ID NO: 945731 - RNA, 21 nt, Human
uaacauaaaccagucauuuca

SEQ ID NO: 945732 - RNA, 18 nt, Human
uagauaauucagaaaauc

SEQ ID NO: 945733 - RNA, 24 nt, Human
uagcacugaaauugcauaaaacac

SEQ ID NO: 945734 - RNA, 26 nt, Human
uagcacugaaauugcauaaaacacgc

SEQ ID NO: 945735 - RNA, 23 nt, Human
uagcucagcuucuucuccugugu

SEQ ID NO: 945736 - RNA, 20 nt, Human
uauacauauaucuaugcauu

SEQ ID NO: 945737 - RNA, 19 nt, Human
uauaucacccugacuugau

SEQ ID NO: 945738 - RNA, 28 nt, Human
uaugcauuuauaaauacauacauauggu

SEQ ID NO: 945739 - RNA, 24 nt, Human
uauuguuugagccaaggaaggaga

SEQ ID NO: 945740 - RNA, 21 nt, Human
ucaaacagaaacuagaguucc

SEQ ID NO: 945741 - RNA, 20 nt, Human
ucaagcaggaaaggaagaaa

SEQ ID NO: 945742 - RNA, 24 nt, Human
ucagaauccaaacaaagaaugcaa

SEQ ID NO: 945743 - RNA, 19 nt, Human
uccaaaauaucaaaauaag

SEQ ID NO: 945744 - RNA, 22 nt, Human
ucccaaccuauuagaggccaga

SEQ ID NO: 945745 - RNA, 20 nt, Human
uccucacuucaaacagaaac

SEQ ID NO: 945746 - RNA, 19 nt, Human
uccuucuauuuccuguucc

SEQ ID NO: 945747 - RNA, 20 nt, Human
ucuccuguguuuuuacugua

SEQ ID NO: 945748 - RNA, 22 nt, Human
ucucuaauucuacaucuucuac

SEQ ID NO: 945749 - RNA, 18 nt, Human
ugaaaggggaacagaagg

SEQ ID NO: 945750 - RNA, 19 nt, Human
ugacuugaugaaaaaaggc

SEQ ID NO: 945751 - RNA, 19 nt, Human
ugagaagaugcuugaacug

SEQ ID NO: 945752 - RNA, 23 nt, Human
ugagaagaugcuugaacugaaga

SEQ ID NO: 945753 - RNA, 18 nt, Human
ugcaaaaacuucaaccua

SEQ ID NO: 945754 - RNA, 20 nt, Human
ugcaaaaacuucaaccuacu

SEQ ID NO: 945755 - RNA, 21 nt, Human
ugccuuugcaaaaacuucaac

SEQ ID NO: 945756 - RNA, 20 nt, Human
ugcgaguugcugggcugcgg

SEQ ID NO: 945757 - RNA, 21 nt, Human
ugcuugaacugaagaacaaaa

SEQ ID NO: 945758 - RNA, 22 nt, Human
ugggaagcccagacauuucuca

SEQ ID NO: 945759 - RNA, 19 nt, Human
ugggugggacucgccgcag

SEQ ID NO: 945760 - RNA, 21 nt, Human
uuaaagcaaggugaagaugcc

SEQ ID NO: 945761 - RNA, 21 nt, Human
uuacuguaccuggcucaaagu

SEQ ID NO: 945762 - RNA, 24 nt, Human
uuccuguuccaauagcucagcuuc

SEQ ID NO: 945763 - RNA, 25 nt, Human
uuucugaauucuccuaagugaguua

SEQ ID NO: 945764 - RNA, 20 nt, Human
uuuuugguuccagucuuugg

SEQ ID NO: 945765 - RNA, 22 nt, Human
uuuuuuuuuuuuuuuuugacag

SEQ ID NO: 945766 - RNA, 27 nt, Human
uuuuuuuuuuuuuuuuuuuuuuugggg

SEQ ID NO: 945767 - RNA, 22 nt, Human
aaaaagaaagacaugauuuuaa

SEQ ID NO: 945768 - RNA, 18 nt, Human
aaaaguagccaggcaggc

SEQ ID NO: 945769 - RNA, 25 nt, Human
aaacagcgcaacguguacacucgga

SEQ ID NO: 945770 - RNA, 22 nt, Human
acagggcgcaaugcagaggcaa

SEQ ID NO: 945771 - RNA, 20 nt, Human
agcacauacucucgagcuug

SEQ ID NO: 945772 - RNA, 24 nt, Human
agcuccuucacucccuccuuguca

SEQ ID NO: 945773 - RNA, 22 nt, Human
agcuugcuguuccagacgcugg

SEQ ID NO: 945774 - RNA, 23 nt, Human
aggccuccguguuaauacagucg

SEQ ID NO: 945775 - RNA, 18 nt, Human
agguucccgguccgccuc

SEQ ID NO: 945776 - RNA, 23 nt, Human
caaacagcgcaacguguacacuc

SEQ ID NO: 945777 - RNA, 19 nt, Human
cagcacauacucucgagcu

SEQ ID NO: 945778 - RNA, 23 nt, Human
cagcgcaccguguagcgcacuuc

SEQ ID NO: 945779 - RNA, 18 nt, Human
caggagagcugagugacg

SEQ ID NO: 945780 - RNA, 20 nt, Human
caggggcacaggagagcuga

SEQ ID NO: 945781 - RNA, 24 nt, Human
ccagcgaggggcguggcucuuggg

SEQ ID NO: 945782 - RNA, 24 nt, Human
ccccgcccagcccgccuaggguga

SEQ ID NO: 945783 - RNA, 20 nt, Human
ccuggucaucugccagcggg

SEQ ID NO: 945784 - RNA, 21 nt, Human
cgacagcacagagcuacaauc

SEQ ID NO: 945785 - RNA, 20 nt, Human
cgcacagacuacacgcacac

SEQ ID NO: 945786 - RNA, 25 nt, Human
cgcacagcccuuggcaagcaccacg

SEQ ID NO: 945787 - RNA, 23 nt, Human
cgcaggggcacaggagagcugag

SEQ ID NO: 945788 - RNA, 23 nt, Human
cgccuagggugagacgcaggggc

SEQ ID NO: 945789 - RNA, 28 nt, Human
cuccgaggccgcggugguggggcaaauc

SEQ ID NO: 945790 - RNA, 25 nt, Human
cuccgcacagcccuuggcaagcacc

SEQ ID NO: 945791 - RNA, 19 nt, Human
gagugacggccgauacccc

SEQ ID NO: 945792 - RNA, 24 nt, Human
gcaaugcagaggcaacggagccac

SEQ ID NO: 945793 - RNA, 18 nt, Human
gcagccuggccugccucu

SEQ ID NO: 945794 - RNA, 21 nt, Human
gccugccccgcccagcccgcc

SEQ ID NO: 945795 - RNA, 21 nt, Human
gcgguggugggaggacuuggc

SEQ ID NO: 945796 - RNA, 20 nt, Human
gcucuggggcgccagcgagg

SEQ ID NO: 945797 - RNA, 20 nt, Human
gcucuugggguggugcagcc

SEQ ID NO: 945798 - RNA, 21 nt, Human
gggcuuguuuuuaacuuucuc

SEQ ID NO: 945799 - RNA, 19 nt, Human
guccuggucaucugccagc

SEQ ID NO: 945800 - RNA, 24 nt, Human
uaauacagucguacacucuauaac

SEQ ID NO: 945801 - RNA, 23 nt, Human
uaggggucccucucgcagagccu

SEQ ID NO: 945802 - RNA, 21 nt, Human
uaucuggccacggcccaggcc

SEQ ID NO: 945803 - RNA, 22 nt, Human
ucucgagcuugcuguuccagac

SEQ ID NO: 945804 - RNA, 24 nt, Human
ucugcagcugcugagguucccggu

SEQ ID NO: 945805 - RNA, 18 nt, Human
ugagacgcaggggcacag

SEQ ID NO: 945806 - RNA, 23 nt, Human
ugcaaacuccuaucuggccacgg

SEQ ID NO: 945807 - RNA, 18 nt, Human
ugccagcgggguuccugc

SEQ ID NO: 945808 - RNA, 21 nt, Human
uggcaagcaccacggcucugg

SEQ ID NO: 945809 - RNA, 22 nt, Human
ugggaggacuuggcgggaacua

SEQ ID NO: 945810 - RNA, 23 nt, Human
uggggcgccagcgaggggcgugg

SEQ ID NO: 945811 - RNA, 19 nt, Human
ugggguggugcagccuggc

SEQ ID NO: 945812 - RNA, 22 nt, Human
ugguaggggucccucucgcaga

SEQ ID NO: 945813 - RNA, 22 nt, Human
ugucacauuagcccaguuucuc

SEQ ID NO: 945814 - RNA, 19 nt, Human
ugucaggcaccagagacug

SEQ ID NO: 945815 - RNA, 22 nt, Human
uguggagaacaaaggaggccug

SEQ ID NO: 945816 - RNA, 24 nt, Human
uguuccagacgcugguacagcugg

SEQ ID NO: 945817 - RNA, 21 nt, Human
aaacaaaaccgcaggcagcgg

SEQ ID NO: 945818 - RNA, 22 nt, Human
aacagaaacaaaaccgcaggcc

SEQ ID NO: 945819 - RNA, 20 nt, Human
aacauggagaaaccccgucu

SEQ ID NO: 945820 - RNA, 21 nt, Human
aacauggagaaaccccgucuc

SEQ ID NO: 945821 - RNA, 24 nt, Human
aagcaaucuuccugccuuggccuc

SEQ ID NO: 945822 - RNA, 25 nt, Human
aagcaaucuuccugccuuggccucc

SEQ ID NO: 945823 - RNA, 25 nt, Human
aagcaguccuccugcuucagccucc

SEQ ID NO: 945824 - RNA, 18 nt, Human
aagcgacacagucuugca

SEQ ID NO: 945825 - RNA, 24 nt, Human
aaucgcuugaacccaggaggugga

SEQ ID NO: 945826 - RNA, 21 nt, Human
acacacagaccauucccgauc

SEQ ID NO: 945827 - RNA, 24 nt, Human
acacuggccagaauccccaguccc

SEQ ID NO: 945828 - RNA, 24 nt, Human
accccgucucuacuaaaaauacaa

SEQ ID NO: 945829 - RNA, 19 nt, Human
acuacaggugcgugccacc

SEQ ID NO: 945830 - RNA, 18 nt, Human
agacccgaagagagacag

SEQ ID NO: 945831 - RNA, 21 nt, Human
agacccgaagagagacaggcg

SEQ ID NO: 945832 - RNA, 19 nt, Human
agcugauaacacacagacc

SEQ ID NO: 945833 - RNA, 21 nt, Human
agcugggcgugguggcacaug

SEQ ID NO: 945834 - RNA, 19 nt, Human
aggcagcggguggggggag

SEQ ID NO: 945835 - RNA, 20 nt, Human
aggcagcggguggggggagc

SEQ ID NO: 945836 - RNA, 23 nt, Human
aggcaggagaaucgcuugaaccc

SEQ ID NO: 945837 - RNA, 24 nt, Human
aggcaggagaaucgcuugaaccca

SEQ ID NO: 945838 - RNA, 22 nt, Human
aggcagguggauuaccugaggg

SEQ ID NO: 945839 - RNA, 22 nt, Human
aggcagguggauuaccugaggu

SEQ ID NO: 945840 - RNA, 20 nt, Human
aggcugaggcaggagaaucg

SEQ ID NO: 945841 - RNA, 24 nt, Human
aggcugaggcaggagaaucgcuug

SEQ ID NO: 945842 - RNA, 18 nt, Human
aggcuggagugcaguggc

SEQ ID NO: 945843 - RNA, 18 nt, Human
aguaguugggacuacagg

SEQ ID NO: 945844 - RNA, 22 nt, Human
aguccuccugcuucagccuccc

SEQ ID NO: 945845 - RNA, 20 nt, Human
agugcaguggcucaaucacg

SEQ ID NO: 945846 - RNA, 23 nt, Human
agugcaguggcucaaucacggcu

SEQ ID NO: 945847 - RNA, 24 nt, Human
auugcacuccagccugggcaacaa

SEQ ID NO: 945848 - RNA, 19 nt, Human
caaaauuagcugggcgugg

SEQ ID NO: 945849 - RNA, 24 nt, Human
caacauggagaaaccccgucucua

SEQ ID NO: 945850 - RNA, 22 nt, Human
caagcaguccuccugcuucagc

SEQ ID NO: 945851 - RNA, 27 nt, Human
caagcaguccuccugcuucagccuccc

SEQ ID NO: 945852 - RNA, 24 nt, Human
caaggcagguggauuaccugaggu

SEQ ID NO: 945853 - RNA, 20 nt, Human
cacacagaccauucccgauc

SEQ ID NO: 945854 - RNA, 20 nt, Human
cacaugucuguaaucccagc

SEQ ID NO: 945855 - RNA, 24 nt, Human
caccaacauuauagcauuauuacu

SEQ ID NO: 945856 - RNA, 24 nt, Human
cacuccagccugggcaacaagagc

SEQ ID NO: 945857 - RNA, 23 nt, Human
cacuguggccgaggcuggagugc

SEQ ID NO: 945858 - RNA, 24 nt, Human
cagccugaccaacauggagaaacc

SEQ ID NO: 945859 - RNA, 19 nt, Human
cagcggguggggggagcug

SEQ ID NO: 945860 - RNA, 20 nt, Human
cagcggguggggggagcugg

SEQ ID NO: 945861 - RNA, 24 nt, Human
cagcuacucgggaggcugaggcag

SEQ ID NO: 945862 - RNA, 19 nt, Human
cagcugauaacacacagac

SEQ ID NO: 945863 - RNA, 18 nt, Human
cauugcacuccagccugg

SEQ ID NO: 945864 - RNA, 19 nt, Human
cauugcacuccagccuggg

SEQ ID NO: 945865 - RNA, 21 nt, Human
cauugcacuccagccugggca

SEQ ID NO: 945866 - RNA, 24 nt, Human
cauugcacuccagccugggcaaca

SEQ ID NO: 945867 - RNA, 20 nt, Human
ccaccacacuuggcuaauuu

SEQ ID NO: 945868 - RNA, 20 nt, Human
ccauugcacuccagccuggg

SEQ ID NO: 945869 - RNA, 21 nt, Human
ccauugcacuccagccugggc

SEQ ID NO: 945870 - RNA, 23 nt, Human
ccauugcacuccagccugggcaa

SEQ ID NO: 945871 - RNA, 24 nt, Human
ccauugcacuccagccugggcaac

SEQ ID NO: 945872 - RNA, 23 nt, Human
ccccgcugcgcccaagggcccga

SEQ ID NO: 945873 - RNA, 23 nt, Human
cccgagacccgaagagagacagg

SEQ ID NO: 945874 - RNA, 23 nt, Human
cccgaguaguugggacuacaggu

SEQ ID NO: 945875 - RNA, 24 nt, Human
cccgaguaguugggacuacaggug

SEQ ID NO: 945876 - RNA, 22 nt, Human
ccuauaauuggggggccaaggc

SEQ ID NO: 945877 - RNA, 19 nt, Human
ccuccugcuucagccuccc

SEQ ID NO: 945878 - RNA, 23 nt, Human
ccugaccaacauggagaaacccc

SEQ ID NO: 945879 - RNA, 24 nt, Human
ccugaccaacauggagaaaccccg

SEQ ID NO: 945880 - RNA, 22 nt, Human
ccugaggucgggaauucgagac

SEQ ID NO: 945881 - RNA, 18 nt, Human
ccuguguugcccaggcug

SEQ ID NO: 945882 - RNA, 20 nt, Human
ccuguguugcccaggcuggu

SEQ ID NO: 945883 - RNA, 24 nt, Human
ccuguguugcccaggcuggucucg

SEQ ID NO: 945884 - RNA, 19 nt, Human
cgcaggcagcggguggggg

SEQ ID NO: 945885 - RNA, 24 nt, Human
cgcgcgccccgcugcgcccaaggg

SEQ ID NO: 945886 - RNA, 24 nt, Human
cggggucuuccuguguugcccagg

SEQ ID NO: 945887 - RNA, 24 nt, Human
cggguggggggagcuggagguugg

SEQ ID NO: 945888 - RNA, 20 nt, Human
cucagcucaagcaguccucc

SEQ ID NO: 945889 - RNA, 19 nt, Human
cuccgucucaaaaaaaaaa

SEQ ID NO: 945890 - RNA, 25 nt, Human
cuccugggcugaagcaaucuuccug

SEQ ID NO: 945891 - RNA, 19 nt, Human
cugccuuggccucccagag

SEQ ID NO: 945892 - RNA, 22 nt, Human
cugcgcccaagggcccgagacc

SEQ ID NO: 945893 - RNA, 21 nt, Human
cugcuucagccucccgaguag

SEQ ID NO: 945894 - RNA, 23 nt, Human
cuggccagaauccccagucccca

SEQ ID NO: 945895 - RNA, 22 nt, Human
cugggcugaagcaaucuuccug

SEQ ID NO: 945896 - RNA, 21 nt, Human
cuguaaucccagcuacucggg

SEQ ID NO: 945897 - RNA, 22 nt, Human
cuuccugccuuggccucccaga

SEQ ID NO: 945898 - RNA, 23 nt, Human
gaacuccugggcugaagcaaucu

SEQ ID NO: 945899 - RNA, 21 nt, Human
gagaaaccccgucucuacuaa

SEQ ID NO: 945900 - RNA, 23 nt, Human
gagaaucgcuugaacccaggagg

SEQ ID NO: 945901 - RNA, 23 nt, Human
gagaccagccugaccaacaugga

SEQ ID NO: 945902 - RNA, 23 nt, Human
gagacggggucuuccuguguugc

SEQ ID NO: 945903 - RNA, 18 nt, Human
gauuaccugaggucggga

SEQ ID NO: 945904 - RNA, 24 nt, Human
gauuaccugaggucgggaauucga

SEQ ID NO: 945905 - RNA, 20 nt, Human
gcagcggguggggggagcug

SEQ ID NO: 945906 - RNA, 21 nt, Human
gcagcggguggggggagcugg

SEQ ID NO: 945907 - RNA, 22 nt, Human
gcaggagaaucgcuugaaccca

SEQ ID NO: 945908 - RNA, 19 nt, Human
gccauugcacuccagccug

SEQ ID NO: 945909 - RNA, 22 nt, Human
gccauugcacuccagccugggc

SEQ ID NO: 945910 - RNA, 24 nt, Human
gccauugcacuccagccugggcaa

SEQ ID NO: 945911 - RNA, 19 nt, Human
gcucaaucacggcucacug

SEQ ID NO: 945912 - RNA, 25 nt, Human
gcuggagugcaguggcucaaucacg

SEQ ID NO: 945913 - RNA, 24 nt, Human
ggagguugugccauugcacuccag

SEQ ID NO: 945914 - RNA, 21 nt, Human
ggcacaugucuguaaucccag

SEQ ID NO: 945915 - RNA, 19 nt, Human
ggcuggagugcaguggcuc

SEQ ID NO: 945916 - RNA, 23 nt, Human
ggggccaaggcagguggauuacc

SEQ ID NO: 945917 - RNA, 22 nt, Human
gggucuuccuguguugcccagg

SEQ ID NO: 945918 - RNA, 20 nt, Human
ggguggggggagcuggaggu

SEQ ID NO: 945919 - RNA, 19 nt, Human
gguaauguccaguuccuug

SEQ ID NO: 945920 - RNA, 24 nt, Human
gguggcacaugucuguaaucccag

SEQ ID NO: 945921 - RNA, 18 nt, Human
guagagacggggucuucc

SEQ ID NO: 945922 - RNA, 21 nt, Human
guagagacggggucuuccugu

SEQ ID NO: 945923 - RNA, 23 nt, Human
guggcacaugucuguaaucccag

SEQ ID NO: 945924 - RNA, 18 nt, Human
uaaaaauacaaaauuagc

SEQ ID NO: 945925 - RNA, 19 nt, Human
uaaaaauacaaaauuagcu

SEQ ID NO: 945926 - RNA, 25 nt, Human
uaaauucuacacaugaaggcaaacg

SEQ ID NO: 945927 - RNA, 25 nt, Human
uaauuuuuauguuuuuuugguagag

SEQ ID NO: 945928 - RNA, 26 nt, Human
uaauuuuuauguuuuuuugguagaga

SEQ ID NO: 945929 - RNA, 18 nt, Human
uacacaugaaggcaaacg

SEQ ID NO: 945930 - RNA, 21 nt, Human
uacaggugcgugccaccacac

SEQ ID NO: 945931 - RNA, 22 nt, Human
uagcugggcgugguggcacaug

SEQ ID NO: 945932 - RNA, 19 nt, Human
ucacuguaaccuuggacuc

SEQ ID NO: 945933 - RNA, 23 nt, Human
ucagccucccgaguaguugggac

SEQ ID NO: 945934 - RNA, 23 nt, Human
ucccgaguaguugggacuacagg

SEQ ID NO: 945935 - RNA, 24 nt, Human
uccuguguugcccaggcuggucuc

SEQ ID NO: 945936 - RNA, 24 nt, Human
ucgcuugaacccaggagguggagg

SEQ ID NO: 945937 - RNA, 24 nt, Human
ucgggaggcugaggcaggagaauc

SEQ ID NO: 945938 - RNA, 21 nt, Human
ucucgaacuccugggcugaag

SEQ ID NO: 945939 - RNA, 22 nt, Human
ucucuacuaaaaauacaaaauu

SEQ ID NO: 945940 - RNA, 21 nt, Human
ucuguaaucccagcuacucgg

SEQ ID NO: 945941 - RNA, 19 nt, Human
ucuuccuguguugcccagg

SEQ ID NO: 945942 - RNA, 23 nt, Human
ucuuccuguguugcccaggcugg

SEQ ID NO: 945943 - RNA, 24 nt, Human
ucuuccuguguugcccaggcuggu

SEQ ID NO: 945944 - RNA, 23 nt, Human
ugaagcaaucuuccugccuuggc

SEQ ID NO: 945945 - RNA, 20 nt, Human
ugacagaaauuacacuggcc

SEQ ID NO: 945946 - RNA, 20 nt, Human
ugaggcaggagaaucgcuug

SEQ ID NO: 945947 - RNA, 24 nt, Human
ugaggcaggagaaucgcuugaacc

SEQ ID NO: 945948 - RNA, 25 nt, Human
ugaggcaggagaaucgcuugaaccc

SEQ ID NO: 945949 - RNA, 24 nt, Human
ugagguaauguccaguuccuugcc

SEQ ID NO: 945950 - RNA, 19 nt, Human
ugcacuccagccugggcaa

SEQ ID NO: 945951 - RNA, 22 nt, Human
ugcacuccagccugggcaacaa

SEQ ID NO: 945952 - RNA, 24 nt, Human
ugcauaacaacaguaaauucuaca

SEQ ID NO: 945953 - RNA, 24 nt, Human
ugccauugcacuccagccugggca

SEQ ID NO: 945954 - RNA, 24 nt, Human
ugcccaggcuggucucgaacuccu

SEQ ID NO: 945955 - RNA, 28 nt, Human
ugcccaggcuggucucgaacuccugggc

SEQ ID NO: 945956 - RNA, 21 nt, Human
ugccuuggccucccagagggu

SEQ ID NO: 945957 - RNA, 20 nt, Human
ugcuucagccucccgaguag

SEQ ID NO: 945958 - RNA, 18 nt, Human
uggaauugcagaugugag

SEQ ID NO: 945959 - RNA, 21 nt, Human
uggaauugcagaugugaggua

SEQ ID NO: 945960 - RNA, 24 nt, Human
uggagugcaguggcucaaucacgg

SEQ ID NO: 945961 - RNA, 24 nt, Human
uggauuaccugaggucgggaauuc

SEQ ID NO: 945962 - RNA, 21 nt, Human
uggcacaugucuguaauccca

SEQ ID NO: 945963 - RNA, 21 nt, Human
uggccagaauccccagucccc

SEQ ID NO: 945964 - RNA, 21 nt, Human
ugggacuacaggugcgugcca

SEQ ID NO: 945965 - RNA, 22 nt, Human
ugggacuacaggugcgugccac

SEQ ID NO: 945966 - RNA, 24 nt, Human
ugggacuacaggugcgugccacca

SEQ ID NO: 945967 - RNA, 22 nt, Human
ugguagagacggggucuuccug

SEQ ID NO: 945968 - RNA, 23 nt, Human
ugguagagacggggucuuccugu

SEQ ID NO: 945969 - RNA, 24 nt, Human
ugguggcacaugucuguaauccca

SEQ ID NO: 945970 - RNA, 23 nt, Human
ugucuguaaucccagcuacucgg

SEQ ID NO: 945971 - RNA, 24 nt, Human
ugucuguaaucccagcuacucggg

SEQ ID NO: 945972 - RNA, 21 nt, Human
uguggccgaggcuggagugca

SEQ ID NO: 945973 - RNA, 22 nt, Human
uguggcucacaccuauaauugg

SEQ ID NO: 945974 - RNA, 24 nt, Human
uguguugcccaggcuggucucgaa

SEQ ID NO: 945975 - RNA, 22 nt, Human
uguugcccaggcuggucucgaa

SEQ ID NO: 945976 - RNA, 18 nt, Human
uuagcugggcgugguggc

SEQ ID NO: 945977 - RNA, 20 nt, Human
uuagcugggcgugguggcac

SEQ ID NO: 945978 - RNA, 21 nt, Human
uuagcugggcgugguggcaca

SEQ ID NO: 945979 - RNA, 24 nt, Human
uucccgaucccagaggugcauuuc

SEQ ID NO: 945980 - RNA, 23 nt, Human
uugaaaauauaauuugcauaaca

SEQ ID NO: 945981 - RNA, 24 nt, Human
uugaacccaggagguggagguugu

SEQ ID NO: 945982 - RNA, 23 nt, Human
uugguagagacggggucuuccug

SEQ ID NO: 945983 - RNA, 23 nt, Human
uugugccauugcacuccagccug

SEQ ID NO: 945984 - RNA, 23 nt, Human
uuucaggauucauucuauuucau

SEQ ID NO: 945985 - RNA, 24 nt, Human
uuuuauguuuuuuugguagagacg

SEQ ID NO: 945986 - RNA, 22 nt, Human
uuuuuaagcgacacagucuugc

SEQ ID NO: 945987 - RNA, 19 nt, Human
uuuuugguagagacggggu

SEQ ID NO: 945988 - RNA, 18 nt, Human
uuuuuugguagagacggg

SEQ ID NO: 945989 - RNA, 25 nt, Human
aacacaauuauuuacaugcaauacu

SEQ ID NO: 945990 - RNA, 18 nt, Human
accccgcgcgcgcuccgc

SEQ ID NO: 945991 - RNA, 24 nt, Human
cacuuauggcacagcuaucagaga

SEQ ID NO: 945992 - RNA, 20 nt, Human
ccaccaugcccgggcccggc

SEQ ID NO: 945993 - RNA, 23 nt, Human
ccacgcucgcggcaaccaacccc

SEQ ID NO: 945994 - RNA, 18 nt, Human
cccgcgcgcgcuccgcgg

SEQ ID NO: 945995 - RNA, 20 nt, Human
cccgcgcgcgcuccgcggug

SEQ ID NO: 945996 - RNA, 22 nt, Human
cccgggcccggcggccuucucc

SEQ ID NO: 945997 - RNA, 24 nt, Human
ccgccagugcccucgccagggacc

SEQ ID NO: 945998 - RNA, 22 nt, Human
ccgcugagcagcgccgcggucc

SEQ ID NO: 945999 - RNA, 19 nt, Human
ccuucuccggccuugcgga

SEQ ID NO: 946000 - RNA, 20 nt, Human
cgccagggaccagggaggag

SEQ ID NO: 946001 - RNA, 19 nt, Human
cgcggcaaccaaccccgcg

SEQ ID NO: 946002 - RNA, 22 nt, Human
cgcgguccacgcucccccacgc

SEQ ID NO: 946003 - RNA, 24 nt, Human
cucccccacgcucgcggcaaccaa

SEQ ID NO: 946004 - RNA, 19 nt, Human
cuccggccuugcggacccc

SEQ ID NO: 946005 - RNA, 22 nt, Human
cuccggccuugcggaccccggc

SEQ ID NO: 946006 - RNA, 20 nt, Human
gaaaagaaauguacaaaaca

SEQ ID NO: 946007 - RNA, 24 nt, Human
gcacagcuaucagagagcaucagg

SEQ ID NO: 946008 - RNA, 19 nt, Human
gccgccgccagugcccucg

SEQ ID NO: 946009 - RNA, 18 nt, Human
ggaaggcagccccaccgc

SEQ ID NO: 946010 - RNA, 18 nt, Human
ggcccggcggccuucucc

SEQ ID NO: 946011 - RNA, 23 nt, Human
gggcccggcggccuucuccggcc

SEQ ID NO: 946012 - RNA, 19 nt, Human
uauuaaacaacuguaaaca

SEQ ID NO: 946013 - RNA, 22 nt, Human
ugaaaagaaauguacaaaacac

SEQ ID NO: 946014 - RNA, 22 nt, Human
uguaaacacuucacuguaaaaa

SEQ ID NO: 946015 - RNA, 25 nt, Human
uguaaacacuucacuguaaaaaucc

SEQ ID NO: 946016 - RNA, 19 nt, Human
uguaaauagaaucuaugcu

SEQ ID NO: 946017 - RNA, 22 nt, Human
uguaaauagaaucuaugcuaca

SEQ ID NO: 946018 - RNA, 23 nt, Human
uucuccggccuugcggaccccgg

SEQ ID NO: 946019 - RNA, 24 nt, Human
aaacuauuauuuuuaaagggcuuu

SEQ ID NO: 946020 - RNA, 21 nt, Human
acccauagcugguccaggugc

SEQ ID NO: 946021 - RNA, 23 nt, Human
cacagaacuacccauagcugguc

SEQ ID NO: 946022 - RNA, 21 nt, Human
cagaacuacccauagcugguc

SEQ ID NO: 946023 - RNA, 21 nt, Human
cagagcccucaguggggcucu

SEQ ID NO: 946024 - RNA, 22 nt, Human
cauuucagacuucgaaugguca

SEQ ID NO: 946025 - RNA, 20 nt, Human
ccgcccuuuuuuuuuuuuuc

SEQ ID NO: 946026 - RNA, 24 nt, Human
ccuuuuuuuuuuuuuuuacuauaa

SEQ ID NO: 946027 - RNA, 22 nt, Human
cgcugcagagcccucagugggg

SEQ ID NO: 946028 - RNA, 23 nt, Human
cugauugaugguccgcccuuuuu

SEQ ID NO: 946029 - RNA, 27 nt, Human
gaugguccgcccuuuuuuuuuuuuuuu

SEQ ID NO: 946030 - RNA, 23 nt, Human
gggguugcugucacuccgcugca

SEQ ID NO: 946031 - RNA, 19 nt, Human
gguccgcccuuuuuuuuuu

SEQ ID NO: 946032 - RNA, 21 nt, Human
guccaggugccucgggugucc

SEQ ID NO: 946033 - RNA, 21 nt, Human
uaaaaaugaaacucccccccc

SEQ ID NO: 946034 - RNA, 22 nt, Human
uagcugguccaggugccucggg

SEQ ID NO: 946035 - RNA, 21 nt, Human
ucucuggugccucaucuuugg

SEQ ID NO: 946036 - RNA, 24 nt, Human
ucucuggugccucaucuuuggggu

SEQ ID NO: 946037 - RNA, 18 nt, Human
ugccucggguguccaggc

SEQ ID NO: 946038 - RNA, 19 nt, Human
ugcugucacuccgcugcag

SEQ ID NO: 946039 - RNA, 25 nt, Human
ugguccgcccuuuuuuuuuuuuuuu

SEQ ID NO: 946040 - RNA, 18 nt, Human
uggugccucaucuuuggg

SEQ ID NO: 946041 - RNA, 25 nt, Human
uguuccacccacagaacuacccauu

SEQ ID NO: 946042 - RNA, 23 nt, Human
uuucuugcugcgugcugauugau

SEQ ID NO: 946043 - RNA, 21 nt, Human
aaaauacauacacccauucca

SEQ ID NO: 946044 - RNA, 19 nt, Human
aaagagagagagagaggga

SEQ ID NO: 946045 - RNA, 24 nt, Human
aagaaaacaaaacauugacauuaa

SEQ ID NO: 946046 - RNA, 24 nt, Human
aagcauauggguuugaaaaucaga

SEQ ID NO: 946047 - RNA, 19 nt, Human
aauaagccagugcugaacc

SEQ ID NO: 946048 - RNA, 23 nt, Human
agagaauuuucccccuuacauca

SEQ ID NO: 946049 - RNA, 18 nt, Human
agagggagagggagacac

SEQ ID NO: 946050 - RNA, 23 nt, Human
agagggagagggagacacucgca

SEQ ID NO: 946051 - RNA, 20 nt, Human
agcccuuugcuuuaucagga

SEQ ID NO: 946052 - RNA, 18 nt, Human
aggaagaggaggaggagg

SEQ ID NO: 946053 - RNA, 18 nt, Human
aggaagaggaggaggagg

SEQ ID NO: 946054 - RNA, 28 nt, Human
aggaagaggaggaggaggaggagaggag

SEQ ID NO: 946055 - RNA, 18 nt, Human
aggaggaagaggaggagg

SEQ ID NO: 946056 - RNA, 19 nt, Human
aggaggaggaggaagagga

SEQ ID NO: 946057 - RNA, 18 nt, Human
aguggccuuggcugugga

SEQ ID NO: 946058 - RNA, 21 nt, Human
caccaagacuaacaaucaaca

SEQ ID NO: 946059 - RNA, 21 nt, Human
cagcacagauagaauuugaca

SEQ ID NO: 946060 - RNA, 22 nt, Human
cagucgccaggacuacggugac

SEQ ID NO: 946061 - RNA, 21 nt, Human
cagugguucucaaguuuuucu

SEQ ID NO: 946062 - RNA, 25 nt, Human
caugauauaauccacaauuuuagaa

SEQ ID NO: 946063 - RNA, 24 nt, Human
cauuaccauuuuuauccuucuaaa

SEQ ID NO: 946064 - RNA, 22 nt, Human
cauuuaaccuuucugugccuua

SEQ ID NO: 946065 - RNA, 21 nt, Human
cauuucacaacuccaaaaagu

SEQ ID NO: 946066 - RNA, 24 nt, Human
ccaagacuaacaaucaacaauaaa

SEQ ID NO: 946067 - RNA, 21 nt, Human
cccuuacaucauuagugguua

SEQ ID NO: 946068 - RNA, 18 nt, Human
cccuuugcuuuaucagga

SEQ ID NO: 946069 - RNA, 23 nt, Human
ccuccugcauucaauauaacaaa

SEQ ID NO: 946070 - RNA, 19 nt, Human
cuaccauaaaaugccagaa

SEQ ID NO: 946071 - RNA, 18 nt, Human
cuacccccgccuccugca

SEQ ID NO: 946072 - RNA, 19 nt, Human
cucauuauauuaaccagcc

SEQ ID NO: 946073 - RNA, 24 nt, Human
cugaaacuaagggaaaaaauucau

SEQ ID NO: 946074 - RNA, 24 nt, Human
gagcaccaaucuuuuucccacuua

SEQ ID NO: 946075 - RNA, 21 nt, Human
gagggagagggagacacucgc

SEQ ID NO: 946076 - RNA, 22 nt, Human
gagggagagggagacacucgca

SEQ ID NO: 946077 - RNA, 21 nt, Human
ggagaugguggugguggggag

SEQ ID NO: 946078 - RNA, 18 nt, Human
ggaggaggaagaggagga

SEQ ID NO: 946079 - RNA, 18 nt, Human
ggaggaggaggaagagga

SEQ ID NO: 946080 - RNA, 22 nt, Human
ggaggaggaggaggagaggagu

SEQ ID NO: 946081 - RNA, 22 nt, Human
gggaggaggaggaggaagagga

SEQ ID NO: 946082 - RNA, 23 nt, Human
ggggaggaggaggaggaagagga

SEQ ID NO: 946083 - RNA, 26 nt, Human
gggugauggagauggugguggugggg

SEQ ID NO: 946084 - RNA, 24 nt, Human
ggugguggggaggaggaggaggaa

SEQ ID NO: 946085 - RNA, 23 nt, Human
gguggugguggggaggaggagga

SEQ ID NO: 946086 - RNA, 20 nt, Human
guccaaaaaauguuaguuau

SEQ ID NO: 946087 - RNA, 20 nt, Human
gugguggggaggaggaggag

SEQ ID NO: 946088 - RNA, 18 nt, Human
guuguuggugggugaugg

SEQ ID NO: 946089 - RNA, 24 nt, Human
uaaauuuucaacuuaagcccaaua

SEQ ID NO: 946090 - RNA, 28 nt, Human
uaacucacaaaagagagagagagaggga

SEQ ID NO: 946091 - RNA, 24 nt, Human
uaagaagcaaauaauuuguuuacg

SEQ ID NO: 946092 - RNA, 22 nt, Human
uaagcuggaaaaauacgcuuua

SEQ ID NO: 946093 - RNA, 22 nt, Human
uaagcuggaaaaauacgcuuua

SEQ ID NO: 946094 - RNA, 22 nt, Human
uacacaugaaaucauacaccaa

SEQ ID NO: 946095 - RNA, 22 nt, Human
uaccauaaaaugccagaaugac

SEQ ID NO: 946096 - RNA, 22 nt, Human
uagaacguaucucaaagacuug

SEQ ID NO: 946097 - RNA, 24 nt, Human
uagaaucauuuacuuuguucuugg

SEQ ID NO: 946098 - RNA, 22 nt, Human
uagcuuaaaagugaacaugucu

SEQ ID NO: 946099 - RNA, 21 nt, Human
uauaaacuacccccgccuccu

SEQ ID NO: 946100 - RNA, 18 nt, Human
uauaagaaaacaaaacau

SEQ ID NO: 946101 - RNA, 20 nt, Human
uauaagaaaacaaaacauug

SEQ ID NO: 946102 - RNA, 20 nt, Human
uauauaagcacauacacaua

SEQ ID NO: 946103 - RNA, 21 nt, Human
uauccuucuaaaauagaauca

SEQ ID NO: 946104 - RNA, 18 nt, Human
ucauuauauuaaccagcc

SEQ ID NO: 946105 - RNA, 24 nt, Human
uccaaaaaguuaauguucagcaca

SEQ ID NO: 946106 - RNA, 23 nt, Human
ucuacaaaauacauauuuaaucc

SEQ ID NO: 946107 - RNA, 20 nt, Human
ucucuaccauaaaaugccag

SEQ ID NO: 946108 - RNA, 23 nt, Human
ugaaaucauacaccaagacuaac

SEQ ID NO: 946109 - RNA, 24 nt, Human
ugcuauaacucacaaaagagagag

SEQ ID NO: 946110 - RNA, 23 nt, Human
ugcuuuaucaggagcaccaaucu

SEQ ID NO: 946111 - RNA, 18 nt, Human
uggccuuggcuguggauu

SEQ ID NO: 946112 - RNA, 23 nt, Human
uggugguggggaggaggaggagg

SEQ ID NO: 946113 - RNA, 19 nt, Human
uguaaaaaacauagaacug

SEQ ID NO: 946114 - RNA, 18 nt, Human
ugugguguuguugguggg

SEQ ID NO: 946115 - RNA, 24 nt, Human
uguucagcacagauagaauuugac

SEQ ID NO: 946116 - RNA, 22 nt, Human
uuaaauuuucaacuuaagccca

SEQ ID NO: 946117 - RNA, 18 nt, Human
uuccauuguauucccagc

SEQ ID NO: 946118 - RNA, 20 nt, Human
uuccauuguauucccagccc

SEQ ID NO: 946119 - RNA, 23 nt, Human
uuguauucccagcccuuugcuuu

SEQ ID NO: 946120 - RNA, 22 nt, Human
uuuauccuucuaaaauagaauc

SEQ ID NO: 946121 - RNA, 23 nt, Human
uuucccacuuaaaauauuuuuca

SEQ ID NO: 946122 - RNA, 18 nt, Human
uuuuuuuuuuuuuuuuug

SEQ ID NO: 946123 - RNA, 18 nt, Human
aacaaaccucacaaauua

SEQ ID NO: 946124 - RNA, 22 nt, Human
aacccucuccugccuuuugcug

SEQ ID NO: 946125 - RNA, 24 nt, Human
aagaaccagucuccuacaaaccuc

SEQ ID NO: 946126 - RNA, 25 nt, Human
aagcaauucucccaccucagccucc

SEQ ID NO: 946127 - RNA, 19 nt, Human
aagcccaggaagccagcag

SEQ ID NO: 946128 - RNA, 18 nt, Human
aaggcacagaauggccug

SEQ ID NO: 946129 - RNA, 19 nt, Human
aaguagcugggacuacagg

SEQ ID NO: 946130 - RNA, 20 nt, Human
aaguagcugggacuacaggu

SEQ ID NO: 946131 - RNA, 18 nt, Human
aaguuaaaguuuguucca

SEQ ID NO: 946132 - RNA, 18 nt, Human
aaugcaguggugcgaucg

SEQ ID NO: 946133 - RNA, 23 nt, Human
aaugcaguggugcgaucguagcu

SEQ ID NO: 946134 - RNA, 22 nt, Human
acaaaaacccucuccugccuuu

SEQ ID NO: 946135 - RNA, 24 nt, Human
acaaagcaaagucauggaacagag

SEQ ID NO: 946136 - RNA, 24 nt, Human
acacaaagcaaagucauggaacag

SEQ ID NO: 946137 - RNA, 24 nt, Human
acacaguauaguauaggcucaaag

SEQ ID NO: 946138 - RNA, 18 nt, Human
acagaaagaaaaccuaua

SEQ ID NO: 946139 - RNA, 19 nt, Human
acagaauguguaccaauga

SEQ ID NO: 946140 - RNA, 18 nt, Human
accaccaggaagaaggga

SEQ ID NO: 946141 - RNA, 22 nt, Human
accagucuccuacaaaccucaa

SEQ ID NO: 946142 - RNA, 23 nt, Human
accucagccucccaaguagcugg

SEQ ID NO: 946143 - RNA, 23 nt, Human
accucuuccuucccucaagacag

SEQ ID NO: 946144 - RNA, 22 nt, Human
acuauguugcccaggcuggcag

SEQ ID NO: 946145 - RNA, 21 nt, Human
agaaaaucuagaguuuccaga

SEQ ID NO: 946146 - RNA, 28 nt, Human
agaaagaaaaccuauauuaaucucuaac

SEQ ID NO: 946147 - RNA, 23 nt, Human
agaacagaccucuuccuucccuc

SEQ ID NO: 946148 - RNA, 22 nt, Human
agaagaaccagucuccuacaaa

SEQ ID NO: 946149 - RNA, 18 nt, Human
agacaaggucucacugua

SEQ ID NO: 946150 - RNA, 26 nt, Human
agacagauggcaaggugaaugcucuu

SEQ ID NO: 946151 - RNA, 22 nt, Human
agcuccugggcucaagcaauuc

SEQ ID NO: 946152 - RNA, 21 nt, Human
aggaagaagggaugugcagaa

SEQ ID NO: 946153 - RNA, 22 nt, Human
agggaugugcagaacacgucug

SEQ ID NO: 946154 - RNA, 23 nt, Human
aguagcugggacuacagguguga

SEQ ID NO: 946155 - RNA, 18 nt, Human
aguauccauccuucaaga

SEQ ID NO: 946156 - RNA, 19 nt, Human
auagaacuuaaaaaaaaaa

SEQ ID NO: 946157 - RNA, 27 nt, Human
aucauaugcuuaauuugccaacuugaa

SEQ ID NO: 946158 - RNA, 25 nt, Human
caaaaaauucuccaaaaguacaaua

SEQ ID NO: 946159 - RNA, 24 nt, Human
caagaacacaaaccagauucuguc

SEQ ID NO: 946160 - RNA, 27 nt, Human
caagcaauucucccaccucagccuccc

SEQ ID NO: 946161 - RNA, 30 nt, Human
caauacagaacagaccucuuccuucccucu

SEQ ID NO: 946162 - RNA, 21 nt, Human
cacaaagcaaagucauggaac

SEQ ID NO: 946163 - RNA, 20 nt, Human
cacaacuguacagauaaaac

SEQ ID NO: 946164 - RNA, 18 nt, Human
cacuauguugcccaggcu

SEQ ID NO: 946165 - RNA, 19 nt, Human
cacuauguugcccaggcug

SEQ ID NO: 946166 - RNA, 21 nt, Human
cacuauguugcccaggcuggc

SEQ ID NO: 946167 - RNA, 22 nt, Human
cacuauguugcccaggcuggca

SEQ ID NO: 946168 - RNA, 28 nt, Human
cagaaaaaugccuacaaaaaauucucca

SEQ ID NO: 946169 - RNA, 22 nt, Human
cagaaacccagucccacugacu

SEQ ID NO: 946170 - RNA, 20 nt, Human
cagaacagaccucuuccuuc

SEQ ID NO: 946171 - RNA, 25 nt, Human
cagaacaguugcugaaacauccgaa

SEQ ID NO: 946172 - RNA, 26 nt, Human
caggaaaaucaguagcuuacuagaag

SEQ ID NO: 946173 - RNA, 19 nt, Human
caguggcgacacacaggag

SEQ ID NO: 946174 - RNA, 19 nt, Human
cauaacugccuucccaccu

SEQ ID NO: 946175 - RNA, 26 nt, Human
cauacacaguauaguauaggcucaaa

SEQ ID NO: 946176 - RNA, 23 nt, Human
cauaucuugcacaacuguacaga

SEQ ID NO: 946177 - RNA, 22 nt, Human
ccaacuugaaaacagcagcaua

SEQ ID NO: 946178 - RNA, 20 nt, Human
ccagcagcuguggccucucc

SEQ ID NO: 946179 - RNA, 22 nt, Human
cccaaguagcugggacuacagg

SEQ ID NO: 946180 - RNA, 23 nt, Human
cccaaguagcugggacuacaggu

SEQ ID NO: 946181 - RNA, 23 nt, Human
cccaccucagccucccaaguagc

SEQ ID NO: 946182 - RNA, 22 nt, Human
cccacugacuuuuaguaagucc

SEQ ID NO: 946183 - RNA, 24 nt, Human
cucaagcaauucucccaccucagc

SEQ ID NO: 946184 - RNA, 20 nt, Human
cucacaaauuacuacaaauc

SEQ ID NO: 946185 - RNA, 24 nt, Human
cucagccccuuucugucucucucc

SEQ ID NO: 946186 - RNA, 24 nt, Human
cucagccucccaaguagcugggac

SEQ ID NO: 946187 - RNA, 21 nt, Human
cucauagaacuuaaaaaaaaa

SEQ ID NO: 946188 - RNA, 18 nt, Human
cuccuggcucccugccgg

SEQ ID NO: 946189 - RNA, 21 nt, Human
cuccugggcucaagcaauucu

SEQ ID NO: 946190 - RNA, 23 nt, Human
cuccugggcucaagcaauucucc

SEQ ID NO: 946191 - RNA, 19 nt, Human
cuggugcuccaggaaauag

SEQ ID NO: 946192 - RNA, 22 nt, Human
cuuaaaaaaaaaacaaaaaccc

SEQ ID NO: 946193 - RNA, 19 nt, Human
cuuggcuacagaaacccag

SEQ ID NO: 946194 - RNA, 18 nt, Human
gacuacaggugugagcca

SEQ ID NO: 946195 - RNA, 18 nt, Human
gacuacaggugugagcca

SEQ ID NO: 946196 - RNA, 24 nt, Human
gcagaaagcccuuucuucaaacau

SEQ ID NO: 946197 - RNA, 21 nt, Human
ggaaccgugaaagucacuuuc

SEQ ID NO: 946198 - RNA, 24 nt, Human
ggacuacaggugugagccaagaug

SEQ ID NO: 946199 - RNA, 22 nt, Human
gggaugguaccaccaggaagaa

SEQ ID NO: 946200 - RNA, 22 nt, Human
ggugcauuuuauaauacagaaa

SEQ ID NO: 946201 - RNA, 24 nt, Human
gguggcaguggcgacacacaggag

SEQ ID NO: 946202 - RNA, 19 nt, Human
uaaaguuuguuccauccag

SEQ ID NO: 946203 - RNA, 21 nt, Human
uaaauauggaugccuaugaua

SEQ ID NO: 946204 - RNA, 21 nt, Human
uaaauuaugugcccauccaag

SEQ ID NO: 946205 - RNA, 25 nt, Human
uaaauuaugugcccauccccugaag

SEQ ID NO: 946206 - RNA, 21 nt, Human
uaaggcaauacagaacagacc

SEQ ID NO: 946207 - RNA, 21 nt, Human
uacaaaccucaaucaacuuaa

SEQ ID NO: 946208 - RNA, 22 nt, Human
uacaguacaaugacaagacaga

SEQ ID NO: 946209 - RNA, 22 nt, Human
uacuacaaaucugacagaaaaa

SEQ ID NO: 946210 - RNA, 21 nt, Human
uagaagaaccagucuccuaca

SEQ ID NO: 946211 - RNA, 19 nt, Human
uagaaugcaguggugcgau

SEQ ID NO: 946212 - RNA, 28 nt, Human
uagcuccugggcucaagcaauucucccu

SEQ ID NO: 946213 - RNA, 21 nt, Human
uaguuuugggauuuuaucaua

SEQ ID NO: 946214 - RNA, 20 nt, Human
uauagagauaaagucuucug

SEQ ID NO: 946215 - RNA, 22 nt, Human
uauccauccuucaagacuaaag

SEQ ID NO: 946216 - RNA, 18 nt, Human
uauguugcccaggcuggc

SEQ ID NO: 946217 - RNA, 20 nt, Human
uauguugcccaggcuggcag

SEQ ID NO: 946218 - RNA, 21 nt, Human
uauguugcccaggcuggcaga

SEQ ID NO: 946219 - RNA, 24 nt, Human
ucaacugucauaacugccuuccca

SEQ ID NO: 946220 - RNA, 29 nt, Human
ucaaugccauaaauccacauucucauaga

SEQ ID NO: 946221 - RNA, 18 nt, Human
ucagccucccaaguagcu

SEQ ID NO: 946222 - RNA, 20 nt, Human
ucagccucccaaguagcugg

SEQ ID NO: 946223 - RNA, 24 nt, Human
uccaagaacacaaaccagauucug

SEQ ID NO: 946224 - RNA, 21 nt, Human
uccauccuucaagacuaaaga

SEQ ID NO: 946225 - RNA, 23 nt, Human
ucccaaguagcugggacuacagg

SEQ ID NO: 946226 - RNA, 21 nt, Human
uccugggcucaagcaauucuc

SEQ ID NO: 946227 - RNA, 23 nt, Human
uccugggcucaagcaauucuccc

SEQ ID NO: 946228 - RNA, 24 nt, Human
uccugggcucaagcaauucuccca

SEQ ID NO: 946229 - RNA, 21 nt, Human
ucuacagaaacagucaagucu

SEQ ID NO: 946230 - RNA, 18 nt, Human
ucucacuauguugcccag

SEQ ID NO: 946231 - RNA, 19 nt, Human
ucucacuauguugcccagg

SEQ ID NO: 946232 - RNA, 23 nt, Human
ucucacuauguugcccaggcugg

SEQ ID NO: 946233 - RNA, 25 nt, Human
ucucacuauguugcccaggcuggca

SEQ ID NO: 946234 - RNA, 24 nt, Human
ucucacuguaucacuaaggcuaga

SEQ ID NO: 946235 - RNA, 20 nt, Human
ucuccaguauccauccuucc

SEQ ID NO: 946236 - RNA, 23 nt, Human
ucucccaccucagccucccaagu

SEQ ID NO: 946237 - RNA, 26 nt, Human
ucucccaccucagccucccaaguagc

SEQ ID NO: 946238 - RNA, 21 nt, Human
ucuccuggcucccugccggug

SEQ ID NO: 946239 - RNA, 25 nt, Human
ucugucucagccccuuucugucucu

SEQ ID NO: 946240 - RNA, 21 nt, Human
ucugucucucuccuggcuccc

SEQ ID NO: 946241 - RNA, 18 nt, Human
ucuuuuuuugagacaagg

SEQ ID NO: 946242 - RNA, 24 nt, Human
ugaagucucacuauguugcccagg

SEQ ID NO: 946243 - RNA, 20 nt, Human
ugacagauguggguaugaca

SEQ ID NO: 946244 - RNA, 19 nt, Human
ugagacaaggucucacugu

SEQ ID NO: 946245 - RNA, 22 nt, Human
ugcaguggugcgaucguagcuc

SEQ ID NO: 946246 - RNA, 20 nt, Human
ugcauuuuauaauacagaaa

SEQ ID NO: 946247 - RNA, 18 nt, Human
ugcuccaggaaauaggga

SEQ ID NO: 946248 - RNA, 22 nt, Human
uggaacagagggaaaaggcaca

SEQ ID NO: 946249 - RNA, 20 nt, Human
uggagauugugggagaagaa

SEQ ID NO: 946250 - RNA, 21 nt, Human
uggcaguggcgacacacagga

SEQ ID NO: 946251 - RNA, 18 nt, Human
ugggacuacaggugugag

SEQ ID NO: 946252 - RNA, 19 nt, Human
ugggacuacaggugugagc

SEQ ID NO: 946253 - RNA, 20 nt, Human
ugggacuacaggugugagcc

SEQ ID NO: 946254 - RNA, 21 nt, Human
ugggacuacaggugugagcca

SEQ ID NO: 946255 - RNA, 21 nt, Human
ugggacuacaggugugagcca

SEQ ID NO: 946256 - RNA, 27 nt, Human
ugggacuacaggugugagccaagaugu

SEQ ID NO: 946257 - RNA, 23 nt, Human
uguaccaaugaauaaaugaauac

SEQ ID NO: 946258 - RNA, 24 nt, Human
uguaucacuaaggcuagaaugcag

SEQ ID NO: 946259 - RNA, 22 nt, Human
ugucuggcuuuuugugugugug

SEQ ID NO: 946260 - RNA, 21 nt, Human
ugugcccauccaagaacacaa

SEQ ID NO: 946261 - RNA, 22 nt, Human
uuaaucucuaacaaaccucaca

SEQ ID NO: 946262 - RNA, 21 nt, Human
uugaaaacagcagcauacaga

SEQ ID NO: 946263 - RNA, 23 nt, Human
uuuauuuccacacauacacagua

SEQ ID NO: 946264 - RNA, 18 nt, Human
uuugagugugaaaccauu

SEQ ID NO: 946265 - RNA, 23 nt, Human
uuuucuuuuuuugagacaagguc

SEQ ID NO: 946266 - RNA, 26 nt, Human
uuuucuuuuuuugagacaaggucuca

SEQ ID NO: 946267 - RNA, 23 nt, Human
agaaaugggaucaagggcugauu

SEQ ID NO: 946268 - RNA, 24 nt, Human
agcuauguuuuaagagaaaauaca

SEQ ID NO: 946269 - RNA, 20 nt, Human
auuuuaaggugagccugaga

SEQ ID NO: 946270 - RNA, 21 nt, Human
cagccggggcuauucgggggc

SEQ ID NO: 946271 - RNA, 27 nt, Human
cccuucggcgcugcgcuccagccgcgc

SEQ ID NO: 946272 - RNA, 20 nt, Human
ccucuggcagcagauucuag

SEQ ID NO: 946273 - RNA, 19 nt, Human
cugcgcuccagccgcgccg

SEQ ID NO: 946274 - RNA, 23 nt, Human
cuuacugcuauuuccaacuauau

SEQ ID NO: 946275 - RNA, 23 nt, Human
gagguucaguucaaauuuuauuu

SEQ ID NO: 946276 - RNA, 24 nt, Human
gcagcagauucuaguagcugauuu

SEQ ID NO: 946277 - RNA, 22 nt, Human
gccuuggguccugcgagguggc

SEQ ID NO: 946278 - RNA, 24 nt, Human
gcgcugcgcuccagccgcgccggu

SEQ ID NO: 946279 - RNA, 19 nt, Human
ggcccggcgcgcguggccu

SEQ ID NO: 946280 - RNA, 23 nt, Human
ggccuuggguccugcgagguggc

SEQ ID NO: 946281 - RNA, 25 nt, Human
guggcagccggggcuauucgggggc

SEQ ID NO: 946282 - RNA, 21 nt, Human
uaaggugagccugagaguggc

SEQ ID NO: 946283 - RNA, 30 nt, Human
uagcagguccucggaacuuucugaagcuuu

SEQ ID NO: 946284 - RNA, 22 nt, Human
uaugcugcaagcagguaaacaa

SEQ ID NO: 946285 - RNA, 21 nt, Human
uauuauaaugggaaagcuuac

SEQ ID NO: 946286 - RNA, 19 nt, Human
ucggcgcugcgcuccagcc

SEQ ID NO: 946287 - RNA, 19 nt, Human
ucugaagcuucucccuuau

SEQ ID NO: 946288 - RNA, 20 nt, Human
ugucuaaauugcccagaaau

SEQ ID NO: 946289 - RNA, 18 nt, Human
uuaaauuacaggaaagcu

SEQ ID NO: 946290 - RNA, 23 nt, Human
uuagcagguccucggaacuuucu

SEQ ID NO: 946291 - RNA, 19 nt, Human
aacuugauagccacaugcc

SEQ ID NO: 946292 - RNA, 21 nt, Human
aaguuaaucuuaagagacuga

SEQ ID NO: 946293 - RNA, 23 nt, Human
acauucaaaaaaaugugcacaaa

SEQ ID NO: 946294 - RNA, 26 nt, Human
acugcugaaauaucauugaagaggaa

SEQ ID NO: 946295 - RNA, 18 nt, Human
agaaaaagagagcaagaa

SEQ ID NO: 946296 - RNA, 26 nt, Human
agacaggaaguagucaaaggggaccc

SEQ ID NO: 946297 - RNA, 21 nt, Human
caucgggcuagcacaaaccuc

SEQ ID NO: 946298 - RNA, 20 nt, Human
cccaaggcucucaagccacc

SEQ ID NO: 946299 - RNA, 21 nt, Human
ccccaaggcucucaagccacc

SEQ ID NO: 946300 - RNA, 19 nt, Human
ccccucccccugcuuccca

SEQ ID NO: 946301 - RNA, 23 nt, Human
ccccugccccucccccugcuucc

SEQ ID NO: 946302 - RNA, 22 nt, Human
cccugccccucccccugcuucc

SEQ ID NO: 946303 - RNA, 23 nt, Human
ccuaauuuccccaaggcucucaa

SEQ ID NO: 946304 - RNA, 21 nt, Human
cuagcacaaaccucuugaagg

SEQ ID NO: 946305 - RNA, 24 nt, Human
cugauggcuucccaccuuccuuca

SEQ ID NO: 946306 - RNA, 20 nt, Human
cugcgguaucaucuuugauu

SEQ ID NO: 946307 - RNA, 20 nt, Human
gauccuguccucuugccuuc

SEQ ID NO: 946308 - RNA, 22 nt, Human
gcccugcgguaucaucuuugau

SEQ ID NO: 946309 - RNA, 27 nt, Human
ggaaauuauaaagggcagccgguaccc

SEQ ID NO: 946310 - RNA, 24 nt, Human
gggaaacugcugaaauaucauuga

SEQ ID NO: 946311 - RNA, 21 nt, Human
gucccaauaugguagagaggg

SEQ ID NO: 946312 - RNA, 19 nt, Human
uaagugcccgguggaggca

SEQ ID NO: 946313 - RNA, 23 nt, Human
uauaaagggcagcaauaaucaag

SEQ ID NO: 946314 - RNA, 18 nt, Human
uauuuuaucuuccugcuc

SEQ ID NO: 946315 - RNA, 18 nt, Human
ucucugaauuuguccugg

SEQ ID NO: 946316 - RNA, 21 nt, Human
ucugauggcuucccaccuucc

SEQ ID NO: 946317 - RNA, 22 nt, Human
ugaaauaucauugaagaggaaa

SEQ ID NO: 946318 - RNA, 25 nt, Human
ugaagaggaaauuauaaagggcagc

SEQ ID NO: 946319 - RNA, 22 nt, Human
ugagccccugccccucccccug

SEQ ID NO: 946320 - RNA, 18 nt, Human
ugauggcuucccaccuuc

SEQ ID NO: 946321 - RNA, 19 nt, Human
ugcuaaauagagccaugua

SEQ ID NO: 946322 - RNA, 19 nt, Human
ugcugugucuugagagauc

SEQ ID NO: 946323 - RNA, 20 nt, Human
ugggagaugagccugggacg

SEQ ID NO: 946324 - RNA, 18 nt, Human
ugguagagaggggcuggg

SEQ ID NO: 946325 - RNA, 22 nt, Human
ugugcacaaaacuaggaccaag

SEQ ID NO: 946326 - RNA, 19 nt, Human
uucugagccccugccccuc

SEQ ID NO: 946327 - RNA, 21 nt, Human
uugaagggucccaauauggua

SEQ ID NO: 946328 - RNA, 18 nt, Human
uugcuaaauagagccaug

SEQ ID NO: 946329 - RNA, 21 nt, Human
uugcucuagaauauuguucug

SEQ ID NO: 946330 - RNA, 19 nt, Human
acaaagcaaugauaaaccc

SEQ ID NO: 946331 - RNA, 21 nt, Human
agcaaugauaaacccggcacg

SEQ ID NO: 946332 - RNA, 24 nt, Human
caaagcaaugauaaacccggcacg

SEQ ID NO: 946333 - RNA, 19 nt, Human
ucaguccuuacaaauaaca

SEQ ID NO: 946334 - RNA, 19 nt, Human
ugaaggguuuuguacauuu

SEQ ID NO: 946335 - RNA, 22 nt, Human
aacccccucccugggaauccac

SEQ ID NO: 946336 - RNA, 21 nt, Human
aaggaagacuugggcagggag

SEQ ID NO: 946337 - RNA, 20 nt, Human
acagcggagaggcucuugga

SEQ ID NO: 946338 - RNA, 24 nt, Human
acccaagcugagccaaugaacccc

SEQ ID NO: 946339 - RNA, 18 nt, Human
accgcccuaccgccgaga

SEQ ID NO: 946340 - RNA, 20 nt, Human
accuucacccagucuggggg

SEQ ID NO: 946341 - RNA, 18 nt, Human
agaugcggcaucugcgcc

SEQ ID NO: 946342 - RNA, 23 nt, Human
agcccccaggaccugggccaaga

SEQ ID NO: 946343 - RNA, 23 nt, Human
caaugaacccccucccugggaau

SEQ ID NO: 946344 - RNA, 20 nt, Human
cacccagucugggggacugg

SEQ ID NO: 946345 - RNA, 21 nt, Human
cacggcacucucuuggguccu

SEQ ID NO: 946346 - RNA, 21 nt, Human
cagagccagggcccaaggguc

SEQ ID NO: 946347 - RNA, 24 nt, Human
cagcagcccccaggaccugggcca

SEQ ID NO: 946348 - RNA, 22 nt, Human
cagcccccaggaccugggccaa

SEQ ID NO: 946349 - RNA, 22 nt, Human
cagcuguaccuucacccagucu

SEQ ID NO: 946350 - RNA, 18 nt, Human
cagggcccaagggucuuu

SEQ ID NO: 946351 - RNA, 28 nt, Human
cagguaacaggcucugcccccugaaagg

SEQ ID NO: 946352 - RNA, 22 nt, Human
cagugcuggacugaagaccaga

SEQ ID NO: 946353 - RNA, 18 nt, Human
ccacagaagacugggccc

SEQ ID NO: 946354 - RNA, 19 nt, Human
cccacagaagacugggccc

SEQ ID NO: 946355 - RNA, 23 nt, Human
cccaggaccugggccaagacggg

SEQ ID NO: 946356 - RNA, 23 nt, Human
ccccacagaagacugggcccccu

SEQ ID NO: 946357 - RNA, 25 nt, Human
cccccaggaccugggccaagacggg

SEQ ID NO: 946358 - RNA, 19 nt, Human
cccccucccugggaauccc

SEQ ID NO: 946359 - RNA, 25 nt, Human
ccgaaaggagccagcuguaccuuca

SEQ ID NO: 946360 - RNA, 23 nt, Human
ccgagaccugcauguccgcgucu

SEQ ID NO: 946361 - RNA, 20 nt, Human
ccucccugggaauccacacc

SEQ ID NO: 946362 - RNA, 23 nt, Human
cgucaguggggugacaaugucag

SEQ ID NO: 946363 - RNA, 20 nt, Human
cgucuugugacgggugugug

SEQ ID NO: 946364 - RNA, 18 nt, Human
cucacacugggcgacagc

SEQ ID NO: 946365 - RNA, 22 nt, Human
cucccuguggccuuggucucac

SEQ ID NO: 946366 - RNA, 18 nt, Human
cucgcaccuuccucagau

SEQ ID NO: 946367 - RNA, 20 nt, Human
cugcgcccgggggcggccgg

SEQ ID NO: 946368 - RNA, 18 nt, Human
cuggacccauuccuucug

SEQ ID NO: 946369 - RNA, 20 nt, Human
cuggugcuggguucagcagc

SEQ ID NO: 946370 - RNA, 20 nt, Human
cugugcaccccacagaagac

SEQ ID NO: 946371 - RNA, 19 nt, Human
gagccagcccuaugggugg

SEQ ID NO: 946372 - RNA, 20 nt, Human
gcccgggggcggccgggggg

SEQ ID NO: 946373 - RNA, 19 nt, Human
gccggggggcggcgcgggg

SEQ ID NO: 946374 - RNA, 19 nt, Human
gcgcggggccggcggccau

SEQ ID NO: 946375 - RNA, 22 nt, Human
ggaaagcaggugccggcgcacc

SEQ ID NO: 946376 - RNA, 24 nt, Human
ggagcaaggccagcucacgaagga

SEQ ID NO: 946377 - RNA, 21 nt, Human
ggcaaggauccacccuaugga

SEQ ID NO: 946378 - RNA, 18 nt, Human
ggcgcagcuccggaaggc

SEQ ID NO: 946379 - RNA, 22 nt, Human
gggacuagaguggcagaugggc

SEQ ID NO: 946380 - RNA, 20 nt, Human
gggauggggagcaaggccag

SEQ ID NO: 946381 - RNA, 21 nt, Human
gggcagggaggaucagggacg

SEQ ID NO: 946382 - RNA, 19 nt, Human
gggcgacagcggagaggcu

SEQ ID NO: 946383 - RNA, 22 nt, Human
gggggcggcgcggggccggcgg

SEQ ID NO: 946384 - RNA, 23 nt, Human
ggguccucuuccaggcucacacu

SEQ ID NO: 946385 - RNA, 22 nt, Human
ggugugugggaagccgcccgcc

SEQ ID NO: 946386 - RNA, 19 nt, Human
gucuugugacgggugugug

SEQ ID NO: 946387 - RNA, 24 nt, Human
gugcuggacugaagaccagagaag

SEQ ID NO: 946388 - RNA, 21 nt, Human
uaacaggcucugcccugaccc

SEQ ID NO: 946389 - RNA, 18 nt, Human
uagagauggggaugggca

SEQ ID NO: 946390 - RNA, 22 nt, Human
uaggcgcagcuccggaaggcag

SEQ ID NO: 946391 - RNA, 22 nt, Human
ucagagccagggcccaaggguc

SEQ ID NO: 946392 - RNA, 20 nt, Human
ucagaugcggcaucugcgcc

SEQ ID NO: 946393 - RNA, 18 nt, Human
ucccugggaauccacacc

SEQ ID NO: 946394 - RNA, 21 nt, Human
uccucuuccaggcucacacug

SEQ ID NO: 946395 - RNA, 23 nt, Human
uccuucugggcagggagggcuuc

SEQ ID NO: 946396 - RNA, 25 nt, Human
ucgucaguggggugacaaugucaga

SEQ ID NO: 946397 - RNA, 20 nt, Human
ucucuuggguccucuuccag

SEQ ID NO: 946398 - RNA, 22 nt, Human
ucugcgcccgggggcggccggg

SEQ ID NO: 946399 - RNA, 27 nt, Human
ucugcgcccgggggcggccggggggcg

SEQ ID NO: 946400 - RNA, 20 nt, Human
ugacaaugucagaguugucu

SEQ ID NO: 946401 - RNA, 21 nt, Human
ugacccaagcugagccaauga

SEQ ID NO: 946402 - RNA, 20 nt, Human
ugagcugcagggacuagagu

SEQ ID NO: 946403 - RNA, 18 nt, Human
ugaggcacuugggggaug

SEQ ID NO: 946404 - RNA, 23 nt, Human
ugcauucacgcaggacguugagc

SEQ ID NO: 946405 - RNA, 18 nt, Human
ugcuggagggagggaggc

SEQ ID NO: 946406 - RNA, 22 nt, Human
uggacccauuccuucugggcag

SEQ ID NO: 946407 - RNA, 19 nt, Human
ugugcaucuugcuuccggg

SEQ ID NO: 946408 - RNA, 19 nt, Human
uuucucagagccagggccc

SEQ ID NO: 946409 - RNA, 21 nt, Human
aaacccccaggccucacccag

SEQ ID NO: 946410 - RNA, 18 nt, Human
aaccagcaggugaggagg

SEQ ID NO: 946411 - RNA, 18 nt, Human
acagaaacacuaaaaacg

SEQ ID NO: 946412 - RNA, 19 nt, Human
acucccgagcacccacacc

SEQ ID NO: 946413 - RNA, 21 nt, Human
agacagaaacacuaaaaacga

SEQ ID NO: 946414 - RNA, 23 nt, Human
agacagaaacacuaaaaacgauc

SEQ ID NO: 946415 - RNA, 18 nt, Human
aggaagcccccaaccagc

SEQ ID NO: 946416 - RNA, 22 nt, Human
auccuguucaccuucacacuca

SEQ ID NO: 946417 - RNA, 24 nt, Human
augagcuuccaagaccaagagcac

SEQ ID NO: 946418 - RNA, 18 nt, Human
caccagcaaacaguggca

SEQ ID NO: 946419 - RNA, 22 nt, Human
cacgcuuacggggccaaggugg

SEQ ID NO: 946420 - RNA, 23 nt, Human
cacggagaccaccagcaaacagu

SEQ ID NO: 946421 - RNA, 20 nt, Human
cacugccacguaucauuccu

SEQ ID NO: 946422 - RNA, 24 nt, Human
cacugccacguaucauuccugcaa

SEQ ID NO: 946423 - RNA, 23 nt, Human
cagcgggcuucacuuccucacuc

SEQ ID NO: 946424 - RNA, 19 nt, Human
caguggcagccgggggccc

SEQ ID NO: 946425 - RNA, 25 nt, Human
cauccuguucaccuucacacucacu

SEQ ID NO: 946426 - RNA, 18 nt, Human
ccacacgagccccuccuu

SEQ ID NO: 946427 - RNA, 18 nt, Human
ccccaggccucacccagg

SEQ ID NO: 946428 - RNA, 23 nt, Human
cccccaaccagcaggugaggagg

SEQ ID NO: 946429 - RNA, 25 nt, Human
cccccaggccucacccaggguguuc

SEQ ID NO: 946430 - RNA, 25 nt, Human
cccgcggucagagagcgcugcugac

SEQ ID NO: 946431 - RNA, 21 nt, Human
cccgugacacccgcggucaga

SEQ ID NO: 946432 - RNA, 22 nt, Human
ccgagcacccacaccaccugcu

SEQ ID NO: 946433 - RNA, 19 nt, Human
ccucucaggacaccaggau

SEQ ID NO: 946434 - RNA, 21 nt, Human
ccugacagacacuggccuggg

SEQ ID NO: 946435 - RNA, 26 nt, Human
ccugcaagagccucucaggacaccag

SEQ ID NO: 946436 - RNA, 19 nt, Human
ccuggggccacacgagccc

SEQ ID NO: 946437 - RNA, 18 nt, Human
cggucagagagcgcugcu

SEQ ID NO: 946438 - RNA, 21 nt, Human
cucccgagcacccacaccacc

SEQ ID NO: 946439 - RNA, 21 nt, Human
cugccaggccauccuguucac

SEQ ID NO: 946440 - RNA, 22 nt, Human
cugcuuccuuugagaaaugccc

SEQ ID NO: 946441 - RNA, 18 nt, Human
gaagcccccaaccagcag

SEQ ID NO: 946442 - RNA, 22 nt, Human
gagcagaccacgcuuacggggc

SEQ ID NO: 946443 - RNA, 24 nt, Human
gccauccuguucaccuucacacuc

SEQ ID NO: 946444 - RNA, 21 nt, Human
gccuggggccacacgagcccc

SEQ ID NO: 946445 - RNA, 18 nt, Human
ggaagcccccaaccagca

SEQ ID NO: 946446 - RNA, 20 nt, Human
uccacucccgagcacccaca

SEQ ID NO: 946447 - RNA, 19 nt, Human
ugacgucaccuccacuccc

SEQ ID NO: 946448 - RNA, 23 nt, Human
ugacuggaagcugagcagaccac

SEQ ID NO: 946449 - RNA, 21 nt, Human
ugagacagaaacacuaaaaac

SEQ ID NO: 946450 - RNA, 23 nt, Human
uggaagcugagcagaccacgcuu

SEQ ID NO: 946451 - RNA, 19 nt, Human
uucacacucacugaauccc

SEQ ID NO: 946452 - RNA, 26 nt, Human
uuuucggaaacccccaggccucaccc

SEQ ID NO: 946453 - RNA, 23 nt, Human
aaaaggcagcguuagaauaucau

SEQ ID NO: 946454 - RNA, 27 nt, Human
acucuauagaacauucaugcuagaaag

SEQ ID NO: 946455 - RNA, 22 nt, Human
agaaacacaauucauauaacaa

SEQ ID NO: 946456 - RNA, 22 nt, Human
aggaaaaaacaucucaaaauau

SEQ ID NO: 946457 - RNA, 22 nt, Human
aucaaacccaccacuuucaaua

SEQ ID NO: 946458 - RNA, 18 nt, Human
caagagcaaaugaagaaa

SEQ ID NO: 946459 - RNA, 24 nt, Human
caccaugcuaaauuugaucuccuc

SEQ ID NO: 946460 - RNA, 22 nt, Human
ccaugcuaaauuugaucuccuc

SEQ ID NO: 946461 - RNA, 19 nt, Human
cucuaaaaugagaagagaa

SEQ ID NO: 946462 - RNA, 21 nt, Human
gaugcaagagcaaaugaagaa

SEQ ID NO: 946463 - RNA, 22 nt, Human
gaugcaagagcaaaugaagaaa

SEQ ID NO: 946464 - RNA, 24 nt, Human
ggaaaaaacaucucaaaauauaga

SEQ ID NO: 946465 - RNA, 22 nt, Human
guaaggaaaaaacaucucaaaa

SEQ ID NO: 946466 - RNA, 21 nt, Human
uaaacaaugaucauuuuuuuc

SEQ ID NO: 946467 - RNA, 20 nt, Human
uaaggaaaaaacaucucaaa

SEQ ID NO: 946468 - RNA, 23 nt, Human
uagaacauucaugcuagaaacac

SEQ ID NO: 946469 - RNA, 24 nt, Human
uagaauaucaucaagcuucaaaua

SEQ ID NO: 946470 - RNA, 22 nt, Human
uagcaauguagaugcaagagca

SEQ ID NO: 946471 - RNA, 22 nt, Human
uauagaacauucaugcuagaaa

SEQ ID NO: 946472 - RNA, 25 nt, Human
ucugaagaacaccuuuuugauuuuc

SEQ ID NO: 946473 - RNA, 26 nt, Human
ucugaagaacaccuuuuugauuuucu

SEQ ID NO: 946474 - RNA, 18 nt, Human
ugagaagagaaaaggcag

SEQ ID NO: 946475 - RNA, 23 nt, Human
uguaaggaaaaaacaucucaaaa

SEQ ID NO: 946476 - RNA, 19 nt, Human
uguuauaagaauucuagau

SEQ ID NO: 946477 - RNA, 23 nt, Human
uucccagaguaaaaggauuuuac

SEQ ID NO: 946478 - RNA, 20 nt, Human
uuuaaacuuuugaguuguag

SEQ ID NO: 946479 - RNA, 23 nt, Human
uuuauuuguacuguguuucugau

SEQ ID NO: 946480 - RNA, 21 nt, Human
uuucccagaguaaaaggauuu

SEQ ID NO: 946481 - RNA, 19 nt, Human
uuuguacuguguuucugau

SEQ ID NO: 946482 - RNA, 21 nt, Human
uuuuauagauaaaaugucucu

SEQ ID NO: 946483 - RNA, 19 nt, Human
uuuuguggguuucuaaaua

SEQ ID NO: 946484 - RNA, 24 nt, Human
uuuuguggguuucuaaauaaaaag

SEQ ID NO: 946485 - RNA, 21 nt, Human
aaaacuggagagccagucuuu

SEQ ID NO: 946486 - RNA, 18 nt, Human
aaccagaggaauccccau

SEQ ID NO: 946487 - RNA, 24 nt, Human
acagagauaaauagcucuuuuuca

SEQ ID NO: 946488 - RNA, 21 nt, Human
auaaaaauggagacaaagacc

SEQ ID NO: 946489 - RNA, 26 nt, Human
auuuuacuuugcacaugcagucucug

SEQ ID NO: 946490 - RNA, 18 nt, Human
cauaggacuacaaauaca

SEQ ID NO: 946491 - RNA, 20 nt, Human
cauauugcacaaaaguccuu

SEQ ID NO: 946492 - RNA, 18 nt, Human
ccucuagcggagccgguu

SEQ ID NO: 946493 - RNA, 19 nt, Human
cgccuggaggugugggcag

SEQ ID NO: 946494 - RNA, 19 nt, Human
cggcucgguccucuagcgg

SEQ ID NO: 946495 - RNA, 23 nt, Human
cuccuguaaugaaaaugccacag

SEQ ID NO: 946496 - RNA, 22 nt, Human
cuggauuaaauauuacaacaac

SEQ ID NO: 946497 - RNA, 31 nt, Human
cuucuucccuuuuuuuuuuuuuuuguuuuuu

SEQ ID NO: 946498 - RNA, 19 nt, Human
gucuuagauuauguuaaaa

SEQ ID NO: 946499 - RNA, 26 nt, Human
uaaacucuccuguaaugaaaaugcca

SEQ ID NO: 946500 - RNA, 19 nt, Human
uacaguauuggacaucuga

SEQ ID NO: 946501 - RNA, 18 nt, Human
uacuucaggacccaguug

SEQ ID NO: 946502 - RNA, 18 nt, Human
uacuucaggacccaguug

SEQ ID NO: 946503 - RNA, 18 nt, Human
uagaauguugaauaccau

SEQ ID NO: 946504 - RNA, 24 nt, Human
uauuucccaucucagcccuccaaa

SEQ ID NO: 946505 - RNA, 21 nt, Human
ucacaguagccugaggaaugc

SEQ ID NO: 946506 - RNA, 18 nt, Human
ucagcacccagcgggcga

SEQ ID NO: 946507 - RNA, 21 nt, Human
uccaaacuuaaccauggaaac

SEQ ID NO: 946508 - RNA, 21 nt, Human
ucuggagauacacgaggagac

SEQ ID NO: 946509 - RNA, 22 nt, Human
ucugucuuagauuauguuaaaa

SEQ ID NO: 946510 - RNA, 20 nt, Human
ugaggaaugcuaaacuguag

SEQ ID NO: 946511 - RNA, 26 nt, Human
ugauaaaaauggagacaaagaccaua

SEQ ID NO: 946512 - RNA, 21 nt, Human
ugauuugucauugagauagga

SEQ ID NO: 946513 - RNA, 22 nt, Human
ugcacaugcagucucuggagau

SEQ ID NO: 946514 - RNA, 21 nt, Human
uguacagaaauauuggcuuca

SEQ ID NO: 946515 - RNA, 18 nt, Human
ugucauugagauaggaua

SEQ ID NO: 946516 - RNA, 24 nt, Human
uuaaaaaugcagaaccauggccga

SEQ ID NO: 946517 - RNA, 19 nt, Human
uucccaucucagcccucca

SEQ ID NO: 946518 - RNA, 19 nt, Human
uuggacaucugauauauac

SEQ ID NO: 946519 - RNA, 24 nt, Human
uuuuuuuuuuuguuuuuugcuuuu

SEQ ID NO: 946520 - RNA, 22 nt, Human
uuuuuuuuuuuuuaaaacugga

SEQ ID NO: 946521 - RNA, 29 nt, Human
uuuuuuuuuuuuuuguuuuuugcuuuuag

SEQ ID NO: 946522 - RNA, 33 nt, Human
aaaaaaagagaacauucauuaugaaaaaugcug

SEQ ID NO: 946523 - RNA, 22 nt, Human
aaaaaagaagucaagagcugcg

SEQ ID NO: 946524 - RNA, 19 nt, Human
aaaaagaagucaagagcug

SEQ ID NO: 946525 - RNA, 22 nt, Human
aaacaugcgauauguuagaagc

SEQ ID NO: 946526 - RNA, 24 nt, Human
aaauaucucuuuaaaacagugacc

SEQ ID NO: 946527 - RNA, 19 nt, Human
aagcagauguauaaguuug

SEQ ID NO: 946528 - RNA, 21 nt, Human
aaguuccguagagaugaaugu

SEQ ID NO: 946529 - RNA, 23 nt, Human
aaucgcuagggccuuagacuccu

SEQ ID NO: 946530 - RNA, 23 nt, Human
augaaccaauguggcagaugccc

SEQ ID NO: 946531 - RNA, 21 nt, Human
caaagccuaaugcauggcauu

SEQ ID NO: 946532 - RNA, 24 nt, Human
caacagaaguacuuuguauaacug

SEQ ID NO: 946533 - RNA, 25 nt, Human
caauucuaaagggccaaacaugaga

SEQ ID NO: 946534 - RNA, 28 nt, Human
cagaccauguaacacacauuaaaaauua

SEQ ID NO: 946535 - RNA, 18 nt, Human
cauauacauaguagaaua

SEQ ID NO: 946536 - RNA, 21 nt, Human
ccaaaucuuaacauaaacaug

SEQ ID NO: 946537 - RNA, 23 nt, Human
ccaauucuaaagggccaaacaug

SEQ ID NO: 946538 - RNA, 23 nt, Human
cuaauuuauuacauccuucccua

SEQ ID NO: 946539 - RNA, 30 nt, Human
cuaccuggagauaugcaaaaucuggucauu

SEQ ID NO: 946540 - RNA, 23 nt, Human
cuggcagauacuguauguauuuu

SEQ ID NO: 946541 - RNA, 22 nt, Human
cuuaacaagaauauaaucaaug

SEQ ID NO: 946542 - RNA, 24 nt, Human
gaaccaauguggcagaugcccaaa

SEQ ID NO: 946543 - RNA, 20 nt, Human
gacuccuugcuucuuccccu

SEQ ID NO: 946544 - RNA, 21 nt, Human
gcagauacuguauguauuuug

SEQ ID NO: 946545 - RNA, 19 nt, Human
ggccaaacaugagacgucc

SEQ ID NO: 946546 - RNA, 22 nt, Human
gucauaaaaaugagcaaaauca

SEQ ID NO: 946547 - RNA, 27 nt, Human
uaaaaaguuaucacaacucuuacagua

SEQ ID NO: 946548 - RNA, 25 nt, Human
uaaaaaugagcaaaaucaauuuucu

SEQ ID NO: 946549 - RNA, 25 nt, Human
uaauacuauuccauacauauacaua

SEQ ID NO: 946550 - RNA, 23 nt, Human
uaaucaaugagauaacacuuucu

SEQ ID NO: 946551 - RNA, 21 nt, Human
uaauuuauuacauccuucccu

SEQ ID NO: 946552 - RNA, 19 nt, Human
uacaaaaaagaagucaaga

SEQ ID NO: 946553 - RNA, 25 nt, Human
uacauaguagaauaaaaaguuauca

SEQ ID NO: 946554 - RNA, 23 nt, Human
uaccaaaaaaaagagaacauuca

SEQ ID NO: 946555 - RNA, 20 nt, Human
uaguagcaaguuuucuuagc

SEQ ID NO: 946556 - RNA, 20 nt, Human
uauuaccaaaaaaaagagaa

SEQ ID NO: 946557 - RNA, 26 nt, Human
uauuacuacaaaugaucuaaaguuuu

SEQ ID NO: 946558 - RNA, 23 nt, Human
ucagagcuuuuauugucagauaa

SEQ ID NO: 946559 - RNA, 22 nt, Human
uccugggaaaaaccuucucugg

SEQ ID NO: 946560 - RNA, 23 nt, Human
ucugauuauaaauggaaugacau

SEQ ID NO: 946561 - RNA, 22 nt, Human
ugaaccaauguggcagaugccc

SEQ ID NO: 946562 - RNA, 24 nt, Human
ugaaugugucuucacaaaaguucc

SEQ ID NO: 946563 - RNA, 21 nt, Human
ugcgauauguuagaagcagau

SEQ ID NO: 946564 - RNA, 19 nt, Human
ugcuucuuccccucaucuc

SEQ ID NO: 946565 - RNA, 19 nt, Human
ugggaaaaaccuucucugg

SEQ ID NO: 946566 - RNA, 21 nt, Human
uguggcagaugcccaaaucgc

SEQ ID NO: 946567 - RNA, 23 nt, Human
uuccuguugcuggcuuauaacua

SEQ ID NO: 946568 - RNA, 20 nt, Human
uugcuggcuuauaacuagag

SEQ ID NO: 946569 - RNA, 20 nt, Human
uuuacagaauauacuggcag

SEQ ID NO: 946570 - RNA, 25 nt, Human
uuuauauaacacauauuaugcugcu

SEQ ID NO: 946571 - RNA, 19 nt, Human
uuucugaauaugaaccaau

SEQ ID NO: 946572 - RNA, 24 nt, Human
uuuuguacugccuuuugauuaaga

SEQ ID NO: 946573 - RNA, 23 nt, Human
acacagcacuccccacugggucu

SEQ ID NO: 946574 - RNA, 20 nt, Human
acccucaccacagccugggg

SEQ ID NO: 946575 - RNA, 19 nt, Human
agacccaggagacacagca

SEQ ID NO: 946576 - RNA, 21 nt, Human
agccaggagcacugggccagc

SEQ ID NO: 946577 - RNA, 24 nt, Human
aggcggggugggggcaggaggggc

SEQ ID NO: 946578 - RNA, 25 nt, Human
aggcggggugggggcaggaggggcc

SEQ ID NO: 946579 - RNA, 18 nt, Human
aggggccagguugggucu

SEQ ID NO: 946580 - RNA, 23 nt, Human
aggggccagguugggucugggcc

SEQ ID NO: 946581 - RNA, 21 nt, Human
caagagcccccagccaggagc

SEQ ID NO: 946582 - RNA, 22 nt, Human
cagcagcagggacucaagucag

SEQ ID NO: 946583 - RNA, 20 nt, Human
cagcauggcuccugggggga

SEQ ID NO: 946584 - RNA, 18 nt, Human
cagccaggagcacugggc

SEQ ID NO: 946585 - RNA, 22 nt, Human
caggagacacagcacuccccac

SEQ ID NO: 946586 - RNA, 18 nt, Human
caggagcccccgaucggc

SEQ ID NO: 946587 - RNA, 24 nt, Human
caggagggacucuggagggcagua

SEQ ID NO: 946588 - RNA, 22 nt, Human
caggcaugugcccugacagccc

SEQ ID NO: 946589 - RNA, 18 nt, Human
caguagcgccaggagccc

SEQ ID NO: 946590 - RNA, 23 nt, Human
ccaacaccugaagggaacccaga

SEQ ID NO: 946591 - RNA, 22 nt, Human
cccacugggucuaggaccgucu

SEQ ID NO: 946592 - RNA, 20 nt, Human
ccccacccuggcugccgaaa

SEQ ID NO: 946593 - RNA, 24 nt, Human
cccgcccugcaccuggaggcccgc

SEQ ID NO: 946594 - RNA, 19 nt, Human
cccugccgacaccaacacc

SEQ ID NO: 946595 - RNA, 22 nt, Human
ccgggggcgcagcgccuccccu

SEQ ID NO: 946596 - RNA, 21 nt, Human
ccugacagcccugccgacacc

SEQ ID NO: 946597 - RNA, 22 nt, Human
ccuggaguuccugcuuggccac

SEQ ID NO: 946598 - RNA, 22 nt, Human
cgacaccaacaccugaagggaa

SEQ ID NO: 946599 - RNA, 19 nt, Human
cggggugggggcaggaggg

SEQ ID NO: 946600 - RNA, 22 nt, Human
cucucagacccucaccacagcc

SEQ ID NO: 946601 - RNA, 21 nt, Human
cugcaccuggaggcccgcccu

SEQ ID NO: 946602 - RNA, 19 nt, Human
cugcaccuggaguuccugc

SEQ ID NO: 946603 - RNA, 22 nt, Human
cugccgaaaggggggcgugcac

SEQ ID NO: 946604 - RNA, 22 nt, Human
cugggccccacccuggcugccg

SEQ ID NO: 946605 - RNA, 22 nt, Human
cuguuccccaccaaaggcuugu

SEQ ID NO: 946606 - RNA, 21 nt, Human
gaggggccagguugggucugg

SEQ ID NO: 946607 - RNA, 21 nt, Human
gaguucuguguuugauucugg

SEQ ID NO: 946608 - RNA, 22 nt, Human
gauucugggguacagacagcuc

SEQ ID NO: 946609 - RNA, 18 nt, Human
gcagacccaggagacaca

SEQ ID NO: 946610 - RNA, 21 nt, Human
gcagacccaggagacacagca

SEQ ID NO: 946611 - RNA, 20 nt, Human
gcgcagcgccuccccuacag

SEQ ID NO: 946612 - RNA, 24 nt, Human
gcggcggggucugugcugcugggg

SEQ ID NO: 946613 - RNA, 20 nt, Human
gcggggugggggcaggaggg

SEQ ID NO: 946614 - RNA, 23 nt, Human
gcggggugggggcaggaggggcc

SEQ ID NO: 946615 - RNA, 20 nt, Human
ggacucaagucagacggcag

SEQ ID NO: 946616 - RNA, 26 nt, Human
ggagacacagcacuccccacuggguc

SEQ ID NO: 946617 - RNA, 19 nt, Human
ggagggacucuggagggca

SEQ ID NO: 946618 - RNA, 19 nt, Human
ggcaggagggacucuggag

SEQ ID NO: 946619 - RNA, 21 nt, Human
gggcaggaggggccagguugg

SEQ ID NO: 946620 - RNA, 20 nt, Human
gggccccacccuggcugccg

SEQ ID NO: 946621 - RNA, 19 nt, Human
gggggcaggaggggccagg

SEQ ID NO: 946622 - RNA, 21 nt, Human
gggggucagcgacccaaaggc

SEQ ID NO: 946623 - RNA, 21 nt, Human
ggggugggggcaggaggggcc

SEQ ID NO: 946624 - RNA, 21 nt, Human
gggucugggccccacccuggc

SEQ ID NO: 946625 - RNA, 22 nt, Human
ggugggggcaggaggggccagg

SEQ ID NO: 946626 - RNA, 23 nt, Human
gguucuguuccccaccaaaggcu

SEQ ID NO: 946627 - RNA, 24 nt, Human
uaaaacagaaauuggguccugcca

SEQ ID NO: 946628 - RNA, 23 nt, Human
uacacgaugcggagguucuguuc

SEQ ID NO: 946629 - RNA, 23 nt, Human
uccagcauggcuccuggggggac

SEQ ID NO: 946630 - RNA, 22 nt, Human
ugaacauauaaaacagaaauug

SEQ ID NO: 946631 - RNA, 19 nt, Human
ugcacugcagcagcaggga

SEQ ID NO: 946632 - RNA, 19 nt, Human
ugcccugacagcccugccg

SEQ ID NO: 946633 - RNA, 23 nt, Human
uggccacgggugggcagacccag

SEQ ID NO: 946634 - RNA, 20 nt, Human
uggcuccuggggggaccccu

SEQ ID NO: 946635 - RNA, 20 nt, Human
ugggccccacccuggcugcc

SEQ ID NO: 946636 - RNA, 19 nt, Human
uggggaccccagccggcca

SEQ ID NO: 946637 - RNA, 25 nt, Human
uggggaggaggccccagcgaggcuc

SEQ ID NO: 946638 - RNA, 21 nt, Human
ugggggcaggaggggccaggu

SEQ ID NO: 946639 - RNA, 19 nt, Human
ugucuggggcccauuggcu

SEQ ID NO: 946640 - RNA, 20 nt, Human
ugucuggggcccauuggcug

SEQ ID NO: 946641 - RNA, 20 nt, Human
uguuccccaccaaaggcuug

SEQ ID NO: 946642 - RNA, 20 nt, Human
uugggucugggccccacccu

SEQ ID NO: 946643 - RNA, 25 nt, Human
uuuccagguuuaaaguucaugaaca

SEQ ID NO: 946644 - RNA, 23 nt, Human
uuuuuuuuuuuuuuuuuugcuuu

SEQ ID NO: 946645 - RNA, 25 nt, Human
uuuuuuuuuuuuuuuuuugcuuuaa

SEQ ID NO: 946646 - RNA, 20 nt, Human
uuuuuuuuuuuuuuuuuugg

SEQ ID NO: 946647 - RNA, 24 nt, Human
aaaaguaucacuaaagguggcugg

SEQ ID NO: 946648 - RNA, 24 nt, Human
aaaccgagcuugcuggacagaaga

SEQ ID NO: 946649 - RNA, 23 nt, Human
aacaccugaaugucuuuucuuug

SEQ ID NO: 946650 - RNA, 19 nt, Human
acacgcacacauaugucuc

SEQ ID NO: 946651 - RNA, 23 nt, Human
acgcacacauaugucuccauaca

SEQ ID NO: 946652 - RNA, 23 nt, Human
agugguucccuuugcucugugga

SEQ ID NO: 946653 - RNA, 24 nt, Human
agugguucccuuugcucuguggau

SEQ ID NO: 946654 - RNA, 25 nt, Human
aucccuuuauuuuuuuuuuuaaaag

SEQ ID NO: 946655 - RNA, 21 nt, Human
augaacugugaauuugggucc

SEQ ID NO: 946656 - RNA, 21 nt, Human
caaccucuaaauucccugugc

SEQ ID NO: 946657 - RNA, 20 nt, Human
cacugguaagugacguauuc

SEQ ID NO: 946658 - RNA, 20 nt, Human
cagaagaugcuacaaccucu

SEQ ID NO: 946659 - RNA, 18 nt, Human
cagagcacagugcuuucc

SEQ ID NO: 946660 - RNA, 21 nt, Human
cagagcacagugcuuuccauu

SEQ ID NO: 946661 - RNA, 27 nt, Human
cauccacacgcacacauaugucuccau

SEQ ID NO: 946662 - RNA, 22 nt, Human
cuccgggcagcagggagccuuc

SEQ ID NO: 946663 - RNA, 18 nt, Human
gaacaugaccaaguuaug

SEQ ID NO: 946664 - RNA, 21 nt, Human
gagaaacaccugaaugucuuu

SEQ ID NO: 946665 - RNA, 21 nt, Human
gauguaccugcuccgggcagc

SEQ ID NO: 946666 - RNA, 28 nt, Human
uaagugacguauucaaaccccugaaagg

SEQ ID NO: 946667 - RNA, 27 nt, Human
uaauaacaguaacucuuuucaacaaaa

SEQ ID NO: 946668 - RNA, 28 nt, Human
uacauacauacauacauacuguaagauc

SEQ ID NO: 946669 - RNA, 21 nt, Human
uacauacuguaagaucaagua

SEQ ID NO: 946670 - RNA, 22 nt, Human
uagcagucuguugaaggaauca

SEQ ID NO: 946671 - RNA, 28 nt, Human
uccauacauacauacauacauacuguag

SEQ ID NO: 946672 - RNA, 18 nt, Human
ucccugugcuaguuguag

SEQ ID NO: 946673 - RNA, 18 nt, Human
uccgggcagcagggagcc

SEQ ID NO: 946674 - RNA, 22 nt, Human
ucuacaacagccauaucccuuu

SEQ ID NO: 946675 - RNA, 24 nt, Human
ugaaggaaucaucuguuauuagaa

SEQ ID NO: 946676 - RNA, 24 nt, Human
uggaaauaugcuuauuugacaguu

SEQ ID NO: 946677 - RNA, 20 nt, Human
uucuguguagccuuggccac

SEQ ID NO: 946678 - RNA, 19 nt, Human
uuuaaagaaugaaaaugcc

SEQ ID NO: 946679 - RNA, 20 nt, Human
uuuuuuuuuuuaaaaguauc

SEQ ID NO: 946680 - RNA, 20 nt, Human
uuuuuuuuuuuuuuuuuugg

SEQ ID NO: 946681 - RNA, 18 nt, Human
aagcaggaaagaaaugcg

SEQ ID NO: 946682 - RNA, 24 nt, Human
aagcaggaaagaaaugcggcagga

SEQ ID NO: 946683 - RNA, 22 nt, Human
cagcuuggaauucgcaagcagg

SEQ ID NO: 946684 - RNA, 23 nt, Human
caucccucucccuucaggugaga

SEQ ID NO: 946685 - RNA, 19 nt, Human
gaggagcuguggcuucggc

SEQ ID NO: 946686 - RNA, 20 nt, Human
ugcggcaggaggagcugugg

SEQ ID NO: 946687 - RNA, 19 nt, Human
uucgcaagcaggaaagagg

SEQ ID NO: 946688 - RNA, 19 nt, Human
aaagaaggaaaaaaagaaa

SEQ ID NO: 946689 - RNA, 18 nt, Human
aagaaggaaaaaaagaaa

SEQ ID NO: 946690 - RNA, 21 nt, Human
aaggagaaagaaagcagacaa

SEQ ID NO: 946691 - RNA, 24 nt, Human
acagagaagggaucaacuuuaaua

SEQ ID NO: 946692 - RNA, 21 nt, Human
acccaaaacuugguccacacu

SEQ ID NO: 946693 - RNA, 18 nt, Human
accgccacccucgccucg

SEQ ID NO: 946694 - RNA, 20 nt, Human
agaaggagaaagaaagcaga

SEQ ID NO: 946695 - RNA, 18 nt, Human
cacacucaagauacaaga

SEQ ID NO: 946696 - RNA, 20 nt, Human
cauaguagaaggagaaagaa

SEQ ID NO: 946697 - RNA, 21 nt, Human
ccccgcggcgucuccccuccc

SEQ ID NO: 946698 - RNA, 23 nt, Human
ccccugggccgccucgcuggcuc

SEQ ID NO: 946699 - RNA, 22 nt, Human
cccugggccgccucgcuggcuc

SEQ ID NO: 946700 - RNA, 26 nt, Human
ccgccacccucgccucgccgccgccc

SEQ ID NO: 946701 - RNA, 22 nt, Human
ccgccacucgcgcccgcucccc

SEQ ID NO: 946702 - RNA, 19 nt, Human
ccgcuucuucucccgggga

SEQ ID NO: 946703 - RNA, 22 nt, Human
ccuccgcuucuucucccgggga

SEQ ID NO: 946704 - RNA, 21 nt, Human
ccucgcuggcucucucccucc

SEQ ID NO: 946705 - RNA, 19 nt, Human
cgccccggcucuagcugcu

SEQ ID NO: 946706 - RNA, 21 nt, Human
cuccgccaaggucacggcccc

SEQ ID NO: 946707 - RNA, 18 nt, Human
cucgcuggcucucucccu

SEQ ID NO: 946708 - RNA, 21 nt, Human
cuugaacuuguuaaaaaggaa

SEQ ID NO: 946709 - RNA, 20 nt, Human
cuuugagagagagagagaga

SEQ ID NO: 946710 - RNA, 26 nt, Human
gcaacaucuuguucuaauguccucuu

SEQ ID NO: 946711 - RNA, 22 nt, Human
gcgggcugggugcaggcggugu

SEQ ID NO: 946712 - RNA, 18 nt, Human
gcugggugcaggcggugu

SEQ ID NO: 946713 - RNA, 20 nt, Human
ggcggcaagcggagcagcga

SEQ ID NO: 946714 - RNA, 21 nt, Human
guccacacucaagauacaaga

SEQ ID NO: 946715 - RNA, 22 nt, Human
ucacggccccgcggcgucuccc

SEQ ID NO: 946716 - RNA, 22 nt, Human
ucagugaacugugugucuaacu

SEQ ID NO: 946717 - RNA, 20 nt, Human
ucgccgccgcccgugcacag

SEQ ID NO: 946718 - RNA, 18 nt, Human
ucgcuggcucucucccuc

SEQ ID NO: 946719 - RNA, 18 nt, Human
ucucccuccuccgcuucu

SEQ ID NO: 946720 - RNA, 21 nt, Human
ucucccuccuccgcuucuucu

SEQ ID NO: 946721 - RNA, 25 nt, Human
ugagagagagagagagagaaagaag

SEQ ID NO: 946722 - RNA, 21 nt, Human
ugcccuccuccgccaagguca

SEQ ID NO: 946723 - RNA, 18 nt, Human
uggaauggaggcauugag

SEQ ID NO: 946724 - RNA, 28 nt, Human
uggaguaaaagguguuucuuccuagagg

SEQ ID NO: 946725 - RNA, 24 nt, Human
ugugcagugacuccagucugcauu

SEQ ID NO: 946726 - RNA, 18 nt, Human
uugagacggaagagucca

SEQ ID NO: 946727 - RNA, 19 nt, Human
uuggugaaaugaaacuuuc

SEQ ID NO: 946728 - RNA, 21 nt, Human
uuuuuuuuuuuuuuuugacag

SEQ ID NO: 946729 - RNA, 18 nt, Human
caagcguggucccugaac

SEQ ID NO: 946730 - RNA, 23 nt, Human
cagcaaguggaggggaaagccgg

SEQ ID NO: 946731 - RNA, 28 nt, Human
ggaggggaaagccggugauuccgucggg

SEQ ID NO: 946732 - RNA, 18 nt, Human
uagaauaugaucuuggca

SEQ ID NO: 946733 - RNA, 21 nt, Human
uccaggaguucccuucugagg

SEQ ID NO: 946734 - RNA, 19 nt, Human
ugcuucaguuccagaagga

SEQ ID NO: 946735 - RNA, 22 nt, Human
uggaggggaaagccggugauuu

SEQ ID NO: 946736 - RNA, 19 nt, Human
aaacaaaugccagcuguac

SEQ ID NO: 946737 - RNA, 19 nt, Human
aagacaagagucuauaaaa

SEQ ID NO: 946738 - RNA, 20 nt, Human
aagcaccugggcuaagcccc

SEQ ID NO: 946739 - RNA, 23 nt, Human
aagcaccugggcuaagcccccaa

SEQ ID NO: 946740 - RNA, 22 nt, Human
accccaagggaggaaguagggg

SEQ ID NO: 946741 - RNA, 18 nt, Human
acccuaagggcagaaaaa

SEQ ID NO: 946742 - RNA, 23 nt, Human
acgaagcaccugggcuaagcccc

SEQ ID NO: 946743 - RNA, 21 nt, Human
acuucgauucagaagggaggg

SEQ ID NO: 946744 - RNA, 21 nt, Human
agagaagggggucuggggcuu

SEQ ID NO: 946745 - RNA, 24 nt, Human
agcaccaccacccccacacucugc

SEQ ID NO: 946746 - RNA, 18 nt, Human
agcaugccccccgucccc

SEQ ID NO: 946747 - RNA, 19 nt, Human
agccagauucccugccucc

SEQ ID NO: 946748 - RNA, 22 nt, Human
aggcaugaagcugaaggugagg

SEQ ID NO: 946749 - RNA, 19 nt, Human
auccccugaccugcaugga

SEQ ID NO: 946750 - RNA, 19 nt, Human
cacccagcccugccccugc

SEQ ID NO: 946751 - RNA, 21 nt, Human
cacccccacacucugcaagag

SEQ ID NO: 946752 - RNA, 25 nt, Human
caccugggcuaagcccccaagggag

SEQ ID NO: 946753 - RNA, 19 nt, Human
cacucccccccucccccca

SEQ ID NO: 946754 - RNA, 18 nt, Human
cagauucccugccucccu

SEQ ID NO: 946755 - RNA, 21 nt, Human
cagcaccaccacccccacacu

SEQ ID NO: 946756 - RNA, 19 nt, Human
cagcaugccccccgucccc

SEQ ID NO: 946757 - RNA, 21 nt, Human
cagcuuuccuuccucuggagc

SEQ ID NO: 946758 - RNA, 21 nt, Human
cagggaccccucccauccccu

SEQ ID NO: 946759 - RNA, 21 nt, Human
caugaggccagcaugcccccc

SEQ ID NO: 946760 - RNA, 24 nt, Human
caugggcuaugcaaagaugagguu

SEQ ID NO: 946761 - RNA, 19 nt, Human
ccaccacccccacacucug

SEQ ID NO: 946762 - RNA, 21 nt, Human
ccagcaugccccccguccccc

SEQ ID NO: 946763 - RNA, 19 nt, Human
ccaucugaaaaacucaugu

SEQ ID NO: 946764 - RNA, 18 nt, Human
ccauuccugucuccuucc

SEQ ID NO: 946765 - RNA, 27 nt, Human
cccagcccugccccugcagccgguucc

SEQ ID NO: 946766 - RNA, 21 nt, Human
ccccaagggagcugccgcucc

SEQ ID NO: 946767 - RNA, 24 nt, Human
ccccacccagcccugccccugcag

SEQ ID NO: 946768 - RNA, 22 nt, Human
cccccaagcccaugaggccagc

SEQ ID NO: 946769 - RNA, 21 nt, Human
cccccaagggagcugccgcuc

SEQ ID NO: 946770 - RNA, 23 nt, Human
cccccaauuccaaagacaagagu

SEQ ID NO: 946771 - RNA, 27 nt, Human
cccccaauuccaaagacaagagucuau

SEQ ID NO: 946772 - RNA, 19 nt, Human
ccccccaauuccaaagaca

SEQ ID NO: 946773 - RNA, 23 nt, Human
cccccccuccccccaauuccaaa

SEQ ID NO: 946774 - RNA, 23 nt, Human
cccgugccucugcaccccaaggg

SEQ ID NO: 946775 - RNA, 24 nt, Human
ccucaugccgggccuggcuccuuc

SEQ ID NO: 946776 - RNA, 21 nt, Human
ccuccaaaaucuagugccugg

SEQ ID NO: 946777 - RNA, 24 nt, Human
ccuccaaaaucuagugccuggcuu

SEQ ID NO: 946778 - RNA, 25 nt, Human
ccucccauccccugaccugcaugga

SEQ ID NO: 946779 - RNA, 21 nt, Human
cgaagcaccugggcuaagccc

SEQ ID NO: 946780 - RNA, 23 nt, Human
cguggccaucugaaaaacucaug

SEQ ID NO: 946781 - RNA, 19 nt, Human
cuccacuuccccacucucc

SEQ ID NO: 946782 - RNA, 21 nt, Human
cucccuuggacccuggggacu

SEQ ID NO: 946783 - RNA, 23 nt, Human
cucuccguugcugccuccuuaga

SEQ ID NO: 946784 - RNA, 20 nt, Human
cugggguagucgcccccucc

SEQ ID NO: 946785 - RNA, 21 nt, Human
gagcggggggggcacuggggu

SEQ ID NO: 946786 - RNA, 28 nt, Human
gauugaaacacucccccccuccccccaa

SEQ ID NO: 946787 - RNA, 21 nt, Human
gcaccaccacccccacacucu

SEQ ID NO: 946788 - RNA, 21 nt, Human
gcagcaccaccacccccacac

SEQ ID NO: 946789 - RNA, 20 nt, Human
gccccugcacuuccgauugc

SEQ ID NO: 946790 - RNA, 22 nt, Human
gcccugccccugcagcaccacc

SEQ ID NO: 946791 - RNA, 22 nt, Human
gcuguacuacccuaagggcaga

SEQ ID NO: 946792 - RNA, 18 nt, Human
ggaagggaagggcucagg

SEQ ID NO: 946793 - RNA, 21 nt, Human
ggagcggggggggcacugggg

SEQ ID NO: 946794 - RNA, 22 nt, Human
ggagcggggggggcacuggggu

SEQ ID NO: 946795 - RNA, 25 nt, Human
ggcagaaaaagucuggugaccccca

SEQ ID NO: 946796 - RNA, 20 nt, Human
gggaagggaagggcucaggg

SEQ ID NO: 946797 - RNA, 21 nt, Human
gggaccccucccauccccuga

SEQ ID NO: 946798 - RNA, 22 nt, Human
gggcuaagcccccaagggagcu

SEQ ID NO: 946799 - RNA, 21 nt, Human
gggggucuggggcuucucccu

SEQ ID NO: 946800 - RNA, 22 nt, Human
gucuccuuccaagcccucaccg

SEQ ID NO: 946801 - RNA, 22 nt, Human
guguggaagaggcaugaagcug

SEQ ID NO: 946802 - RNA, 22 nt, Human
uaaacacagaacauauaacaga

SEQ ID NO: 946803 - RNA, 25 nt, Human
uaggcccccaagcccaugaggccag

SEQ ID NO: 946804 - RNA, 24 nt, Human
uauuauauuuuucauuaauaaaua

SEQ ID NO: 946805 - RNA, 22 nt, Human
ucagggaccccucccauccccu

SEQ ID NO: 946806 - RNA, 18 nt, Human
ucagguccucaugccggg

SEQ ID NO: 946807 - RNA, 25 nt, Human
ucauccucccucuccccgugccucu

SEQ ID NO: 946808 - RNA, 22 nt, Human
uccccccaauuccaaagacaag

SEQ ID NO: 946809 - RNA, 21 nt, Human
ucccccccuccccccaauucc

SEQ ID NO: 946810 - RNA, 18 nt, Human
ucccugccucccuccaac

SEQ ID NO: 946811 - RNA, 22 nt, Human
ucuccguugcugccuccuuaga

SEQ ID NO: 946812 - RNA, 18 nt, Human
ugaaacacucccccccuc

SEQ ID NO: 946813 - RNA, 22 nt, Human
ugaaacacucccccccuccccc

SEQ ID NO: 946814 - RNA, 18 nt, Human
ugaagcugaaggugaggc

SEQ ID NO: 946815 - RNA, 23 nt, Human
ugcaaagaugagguuuccuucuc

SEQ ID NO: 946816 - RNA, 22 nt, Human
ugcauggaaacgcuguguggaa

SEQ ID NO: 946817 - RNA, 18 nt, Human
ugccucugcaccccaagg

SEQ ID NO: 946818 - RNA, 18 nt, Human
uggaagaggcaugaagcu

SEQ ID NO: 946819 - RNA, 24 nt, Human
uggaagaggcaugaagcugaaggu

SEQ ID NO: 946820 - RNA, 25 nt, Human
uggaagaggcaugaagcugaaggug

SEQ ID NO: 946821 - RNA, 21 nt, Human
uggcuugggguaugaugguuc

SEQ ID NO: 946822 - RNA, 23 nt, Human
uguccuaaauugucucauccucc

SEQ ID NO: 946823 - RNA, 22 nt, Human
ugucucauccucccucuccccg

SEQ ID NO: 946824 - RNA, 19 nt, Human
ugucuccccccuccaauuu

SEQ ID NO: 946825 - RNA, 18 nt, Human
uguguggaagaggcauga

SEQ ID NO: 946826 - RNA, 20 nt, Human
uguguggaagaggcaugaag

SEQ ID NO: 946827 - RNA, 21 nt, Human
uuccaaagacaagagucuaua

SEQ ID NO: 946828 - RNA, 25 nt, Human
uugucucauccucccucuccccgug

SEQ ID NO: 946829 - RNA, 22 nt, Human
uuucuuuuuuuuuuuuuucuuu

SEQ ID NO: 946830 - RNA, 23 nt, Human
aaaaaacacacaacaaaccacca

SEQ ID NO: 946831 - RNA, 22 nt, Human
aaagaaacaaaauaacagacua

SEQ ID NO: 946832 - RNA, 19 nt, Human
aacagaaugagccccaccc

SEQ ID NO: 946833 - RNA, 21 nt, Human
aagugaaguuggccacaggug

SEQ ID NO: 946834 - RNA, 18 nt, Human
aaugacugacugccucac

SEQ ID NO: 946835 - RNA, 21 nt, Human
aaugacugacugccucacgaa

SEQ ID NO: 946836 - RNA, 22 nt, Human
acagcuggacuuacccugaagc

SEQ ID NO: 946837 - RNA, 18 nt, Human
accagcacuuaacauggc

SEQ ID NO: 946838 - RNA, 22 nt, Human
acucuggcuugcuggaagugaa

SEQ ID NO: 946839 - RNA, 20 nt, Human
acuuugggagauuucagucc

SEQ ID NO: 946840 - RNA, 19 nt, Human
agaagccugaggaagccug

SEQ ID NO: 946841 - RNA, 23 nt, Human
agaaguggguggucugccuuagc

SEQ ID NO: 946842 - RNA, 23 nt, Human
agaaugagccccacccccugcca

SEQ ID NO: 946843 - RNA, 20 nt, Human
agcacuuaacauggcaaaua

SEQ ID NO: 946844 - RNA, 18 nt, Human
agguguggagcuguggcc

SEQ ID NO: 946845 - RNA, 21 nt, Human
aucuugucuccuuucuccuuc

SEQ ID NO: 946846 - RNA, 22 nt, Human
aucuugucuccuuucuccuucc

SEQ ID NO: 946847 - RNA, 19 nt, Human
augcucucuguguguguau

SEQ ID NO: 946848 - RNA, 19 nt, Human
auugauggugagcuugugc

SEQ ID NO: 946849 - RNA, 22 nt, Human
auugauggugagcuugugcuuu

SEQ ID NO: 946850 - RNA, 18 nt, Human
auuucaacuaugacuacu

SEQ ID NO: 946851 - RNA, 23 nt, Human
caacagaaugagccccacccccu

SEQ ID NO: 946852 - RNA, 23 nt, Human
caagggccggggggagcgggggg

SEQ ID NO: 946853 - RNA, 21 nt, Human
caagucagugaagaaucugca

SEQ ID NO: 946854 - RNA, 19 nt, Human
cacaaaggcagcauggcac

SEQ ID NO: 946855 - RNA, 24 nt, Human
cacacaacaaaccaccaugguuaa

SEQ ID NO: 946856 - RNA, 18 nt, Human
cagaaguggguggucugc

SEQ ID NO: 946857 - RNA, 23 nt, Human
cagaaugagccccacccccugcc

SEQ ID NO: 946858 - RNA, 21 nt, Human
cagcagcagccacggcugcgc

SEQ ID NO: 946859 - RNA, 21 nt, Human
cagcaucaaccaaaugaacca

SEQ ID NO: 946860 - RNA, 26 nt, Human
cagcaucaaccaaaugaaccagccac

SEQ ID NO: 946861 - RNA, 20 nt, Human
cagcauggcacugccucgcc

SEQ ID NO: 946862 - RNA, 20 nt, Human
caggagggaguccagggacc

SEQ ID NO: 946863 - RNA, 20 nt, Human
caucccauggcaggugugga

SEQ ID NO: 946864 - RNA, 23 nt, Human
caucccauggcagguguggagcu

SEQ ID NO: 946865 - RNA, 20 nt, Human
cauggcacugccucgcccug

SEQ ID NO: 946866 - RNA, 20 nt, Human
caugucaauucuuccacauc

SEQ ID NO: 946867 - RNA, 19 nt, Human
cauuauauuuuggcaagau

SEQ ID NO: 946868 - RNA, 18 nt, Human
ccaaaugaaccagccacu

SEQ ID NO: 946869 - RNA, 23 nt, Human
ccaacagaaugagccccaccccc

SEQ ID NO: 946870 - RNA, 18 nt, Human
cccauggcagguguggag

SEQ ID NO: 946871 - RNA, 22 nt, Human
cccauggcagguguggagcugu

SEQ ID NO: 946872 - RNA, 23 nt, Human
ccccugcgcgcggcgcgccgccc

SEQ ID NO: 946873 - RNA, 18 nt, Human
cccgccacucagcagcag

SEQ ID NO: 946874 - RNA, 22 nt, Human
cccggcgccguggccgcucuuc

SEQ ID NO: 946875 - RNA, 23 nt, Human
ccuaagaucuucuaucugguguu

SEQ ID NO: 946876 - RNA, 22 nt, Human
ccuucaagggccggggggagcg

SEQ ID NO: 946877 - RNA, 19 nt, Human
ccuugcccaucucaauuca

SEQ ID NO: 946878 - RNA, 18 nt, Human
ccuuucacaacaaaagga

SEQ ID NO: 946879 - RNA, 20 nt, Human
cgaaaccugaacuaugucgg

SEQ ID NO: 946880 - RNA, 22 nt, Human
cgcgcggucgcgggugugcggg

SEQ ID NO: 946881 - RNA, 22 nt, Human
cuaacaaagauaaaugcacaaa

SEQ ID NO: 946882 - RNA, 24 nt, Human
cucacaauagcaccauuuccuaga

SEQ ID NO: 946883 - RNA, 20 nt, Human
cucauugaaaacucaucuuc

SEQ ID NO: 946884 - RNA, 20 nt, Human
cugcgcgcggcgcgccgccc

SEQ ID NO: 946885 - RNA, 22 nt, Human
cuguggccuugaaaugcucucu

SEQ ID NO: 946886 - RNA, 22 nt, Human
cuugcuggaagugaagaacaga

SEQ ID NO: 946887 - RNA, 18 nt, Human
gaaauaaaaaacacacaa

SEQ ID NO: 946888 - RNA, 24 nt, Human
gaagaucagugcccgaaaccugaa

SEQ ID NO: 946889 - RNA, 19 nt, Human
gagaacgcaggcgcccagc

SEQ ID NO: 946890 - RNA, 20 nt, Human
gagcuuugguuguaaaauuu

SEQ ID NO: 946891 - RNA, 18 nt, Human
gagggaguccagggaccu

SEQ ID NO: 946892 - RNA, 21 nt, Human
gccccuuuccacccgcagccc

SEQ ID NO: 946893 - RNA, 24 nt, Human
gccguggccgcucuucccaguccc

SEQ ID NO: 946894 - RNA, 18 nt, Human
gcgcgcggcgcgccgccc

SEQ ID NO: 946895 - RNA, 20 nt, Human
gcugcgcgcggucgcgggug

SEQ ID NO: 946896 - RNA, 24 nt, Human
gcuuugguuguaaaauuucaacua

SEQ ID NO: 946897 - RNA, 24 nt, Human
ggagaacgcaggcgcccagccucc

SEQ ID NO: 946898 - RNA, 19 nt, Human
ggccauaaucagcaucaac

SEQ ID NO: 946899 - RNA, 19 nt, Human
ggccggggggagcgggggg

SEQ ID NO: 946900 - RNA, 19 nt, Human
ggcucgccccuuuccaccc

SEQ ID NO: 946901 - RNA, 18 nt, Human
ggggggcccccgccacuc

SEQ ID NO: 946902 - RNA, 18 nt, Human
gugaagaaucugcaugca

SEQ ID NO: 946903 - RNA, 22 nt, Human
gugagaagccugaggaagccug

SEQ ID NO: 946904 - RNA, 20 nt, Human
uaaaaaacacacaacaaacc

SEQ ID NO: 946905 - RNA, 21 nt, Human
uaaaaaacacacaacaaacca

SEQ ID NO: 946906 - RNA, 22 nt, Human
uaaaaaacacacaacaaaccac

SEQ ID NO: 946907 - RNA, 24 nt, Human
uaaaaaacacacaacaaaccacca

SEQ ID NO: 946908 - RNA, 24 nt, Human
uaaaaagaaacaaaauaacagacu

SEQ ID NO: 946909 - RNA, 24 nt, Human
uaaaaagaaacaaaauaacagacu

SEQ ID NO: 946910 - RNA, 24 nt, Human
uaaaugcacaaaaguggaggaaga

SEQ ID NO: 946911 - RNA, 18 nt, Human
uaacaaagauaaaugcac

SEQ ID NO: 946912 - RNA, 19 nt, Human
uaacaaagauaaaugcaca

SEQ ID NO: 946913 - RNA, 19 nt, Human
uaacacugaaaacucagaa

SEQ ID NO: 946914 - RNA, 20 nt, Human
uaacacugaaaacucagaau

SEQ ID NO: 946915 - RNA, 21 nt, Human
uaagaucuucuaucugguguu

SEQ ID NO: 946916 - RNA, 27 nt, Human
uaauuaccagcacuuaacauggcaaau

SEQ ID NO: 946917 - RNA, 22 nt, Human
uaccccaaguucauuuauacau

SEQ ID NO: 946918 - RNA, 22 nt, Human
uagccuacuucugcagcaacau

SEQ ID NO: 946919 - RNA, 18 nt, Human
uauaguagugcuuugaaa

SEQ ID NO: 946920 - RNA, 19 nt, Human
ucaacaaaauacaacagac

SEQ ID NO: 946921 - RNA, 20 nt, Human
ucaacaguccuuggcauugg

SEQ ID NO: 946922 - RNA, 23 nt, Human
ucagcaucaaccaaaugaaccag

SEQ ID NO: 946923 - RNA, 27 nt, Human
ucaguccccuccuuccuuucacaacaa

SEQ ID NO: 946924 - RNA, 18 nt, Human
ucauugaaaacucaucuu

SEQ ID NO: 946925 - RNA, 18 nt, Human
uccaucuucugaaaagcu

SEQ ID NO: 946926 - RNA, 25 nt, Human
ucccagucccgggcgagaggggcuc

SEQ ID NO: 946927 - RNA, 19 nt, Human
ucgcccugccgccucgccc

SEQ ID NO: 946928 - RNA, 23 nt, Human
ucuccgccuucaagggccggggg

SEQ ID NO: 946929 - RNA, 19 nt, Human
ucuggaaucagaaacauga

SEQ ID NO: 946930 - RNA, 23 nt, Human
ucuggaaucagaaacaugaaagc

SEQ ID NO: 946931 - RNA, 18 nt, Human
ucuguguguguaugugug

SEQ ID NO: 946932 - RNA, 18 nt, Human
ucuuuugucaugacaagg

SEQ ID NO: 946933 - RNA, 21 nt, Human
ugacugccucacgaaagcucc

SEQ ID NO: 946934 - RNA, 22 nt, Human
ugagaagccugaggaagccugu

SEQ ID NO: 946935 - RNA, 24 nt, Human
ugauccuaacaaagauaaaugcac

SEQ ID NO: 946936 - RNA, 18 nt, Human
ugauggugagcuugugcu

SEQ ID NO: 946937 - RNA, 24 nt, Human
ugcacaaaaguggaggaagaucag

SEQ ID NO: 946938 - RNA, 22 nt, Human
ugccacauuaacaucccauggc

SEQ ID NO: 946939 - RNA, 20 nt, Human
ugcccuggauaaugcuggga

SEQ ID NO: 946940 - RNA, 22 nt, Human
ugccuuagccuacuucugcagc

SEQ ID NO: 946941 - RNA, 22 nt, Human
ugcucucuguguguguaugugu

SEQ ID NO: 946942 - RNA, 18 nt, Human
uggaaucagaaacaugaa

SEQ ID NO: 946943 - RNA, 21 nt, Human
uggaaucagaaacaugaaagc

SEQ ID NO: 946944 - RNA, 23 nt, Human
uggaaucagaaacaugaaagcug

SEQ ID NO: 946945 - RNA, 25 nt, Human
uggaaucagaaacaugaaagcugaa

SEQ ID NO: 946946 - RNA, 20 nt, Human
ugggcaaagagaaucacagg

SEQ ID NO: 946947 - RNA, 28 nt, Human
ugguaucuuauguauucaggacccaagu

SEQ ID NO: 946948 - RNA, 19 nt, Human
uggugagcuugugcuuuga

SEQ ID NO: 946949 - RNA, 25 nt, Human
uguaaacccuaauacagcaauccga

SEQ ID NO: 946950 - RNA, 18 nt, Human
uguguguguaugugugug

SEQ ID NO: 946951 - RNA, 19 nt, Human
uguguguguaugugugugc

SEQ ID NO: 946952 - RNA, 23 nt, Human
uguguguguaugugugugcugua

SEQ ID NO: 946953 - RNA, 22 nt, Human
uuagauuccuuuccguguagga

SEQ ID NO: 946954 - RNA, 18 nt, Human
uucaagucagugaagaau

SEQ ID NO: 946955 - RNA, 22 nt, Human
uucaagucagugaagaaucugc

SEQ ID NO: 946956 - RNA, 24 nt, Human
uucugcagcaacaugaauuuuccc

SEQ ID NO: 946957 - RNA, 27 nt, Human
uugguuucuguuuuuuguuuuuuuucu

SEQ ID NO: 946958 - RNA, 22 nt, Human
uuuaacacugaaaacucagaau

SEQ ID NO: 946959 - RNA, 20 nt, Human
uuuaaggaaugcagugagag

SEQ ID NO: 946960 - RNA, 20 nt, Human
uuucaguccccuccuuccuu

SEQ ID NO: 946961 - RNA, 24 nt, Human
uuuggacucaacugucucauuucc

SEQ ID NO: 946962 - RNA, 23 nt, Human
aaaaacacccaccauaagcacuc

SEQ ID NO: 946963 - RNA, 22 nt, Human
aaacggaaaggggcaauugugg

SEQ ID NO: 946964 - RNA, 21 nt, Human
aaagcagugccacccagaggc

SEQ ID NO: 946965 - RNA, 26 nt, Human
aacacaucucuuccugcugagcacgc

SEQ ID NO: 946966 - RNA, 23 nt, Human
aaccaagacacacagagaagccc

SEQ ID NO: 946967 - RNA, 23 nt, Human
aaccagcguuuuccuggagccca

SEQ ID NO: 946968 - RNA, 24 nt, Human
aaccucuggucauuaggacccguc

SEQ ID NO: 946969 - RNA, 22 nt, Human
aagcaagagucuggugccauuu

SEQ ID NO: 946970 - RNA, 22 nt, Human
aagcaguugucucccguccugc

SEQ ID NO: 946971 - RNA, 22 nt, Human
aagcccuggaggcugggaggcu

SEQ ID NO: 946972 - RNA, 20 nt, Human
aauuucuacccugacuucuc

SEQ ID NO: 946973 - RNA, 19 nt, Human
acaaaacaaaugcaacacu

SEQ ID NO: 946974 - RNA, 25 nt, Human
acaaaacaaaugcaacacucaaguc

SEQ ID NO: 946975 - RNA, 18 nt, Human
acagcucucggggaaugg

SEQ ID NO: 946976 - RNA, 20 nt, Human
acagggacaccaauguuggc

SEQ ID NO: 946977 - RNA, 21 nt, Human
accccaggauguagaagccuu

SEQ ID NO: 946978 - RNA, 21 nt, Human
acgugggcccccuggucccug

SEQ ID NO: 946979 - RNA, 20 nt, Human
acucugcuuuuccuccugcu

SEQ ID NO: 946980 - RNA, 27 nt, Human
agaggacagaguguuuggucucaccag

SEQ ID NO: 946981 - RNA, 22 nt, Human
agccagcuggcagggucagggc

SEQ ID NO: 946982 - RNA, 21 nt, Human
agcccacagccccacugccuc

SEQ ID NO: 946983 - RNA, 21 nt, Human
agccccgagaccaaaccccuc

SEQ ID NO: 946984 - RNA, 19 nt, Human
aggagggggugagggagaa

SEQ ID NO: 946985 - RNA, 22 nt, Human
aggcagccacaguccuggaggg

SEQ ID NO: 946986 - RNA, 23 nt, Human
aggcggauggggacaacagcagc

SEQ ID NO: 946987 - RNA, 21 nt, Human
agggagccugcagucuccaga

SEQ ID NO: 946988 - RNA, 21 nt, Human
aggguaaaggagggggugagg

SEQ ID NO: 946989 - RNA, 22 nt, Human
aggguaaaggagggggugaggg

SEQ ID NO: 946990 - RNA, 23 nt, Human
agugccgaguccuuuccugaaag

SEQ ID NO: 946991 - RNA, 23 nt, Human
auaccuccuuccccucucucucc

SEQ ID NO: 946992 - RNA, 29 nt, Human
aucccaggccuaaccagcguuuuccugac

SEQ ID NO: 946993 - RNA, 20 nt, Human
caaaacaaaugcaacacuca

SEQ ID NO: 946994 - RNA, 25 nt, Human
caaacccagagauaaaaugccaggg

SEQ ID NO: 946995 - RNA, 20 nt, Human
cacccucuggguccugguua

SEQ ID NO: 946996 - RNA, 19 nt, Human
cacugccuccuggcucugc

SEQ ID NO: 946997 - RNA, 24 nt, Human
cacugccuccuggcucugccccuc

SEQ ID NO: 946998 - RNA, 27 nt, Human
cagagcagcaaccaagacacacagaga

SEQ ID NO: 946999 - RNA, 25 nt, Human
cagcaaccaagacacacagagaagc

SEQ ID NO: 947000 - RNA, 19 nt, Human
cagcaguaauaaggcugug

SEQ ID NO: 947001 - RNA, 19 nt, Human
cagcccucuagaggccagg

SEQ ID NO: 947002 - RNA, 23 nt, Human
caggccccuguguugcccucgga

SEQ ID NO: 947003 - RNA, 18 nt, Human
caggggucccuccgcgcc

SEQ ID NO: 947004 - RNA, 22 nt, Human
caggucugugccagcacagccc

SEQ ID NO: 947005 - RNA, 26 nt, Human
cagucuccagaugggcaaaagcaaca

SEQ ID NO: 947006 - RNA, 24 nt, Human
ccaaaccccucuuugccgccagcc

SEQ ID NO: 947007 - RNA, 20 nt, Human
ccaaccuccccuccuccugu

SEQ ID NO: 947008 - RNA, 22 nt, Human
ccaacucugcuuuuccuccugc

SEQ ID NO: 947009 - RNA, 24 nt, Human
ccacagccccacugccuccuggcu

SEQ ID NO: 947010 - RNA, 21 nt, Human
ccacauuccuccagccccgcc

SEQ ID NO: 947011 - RNA, 19 nt, Human
ccagcaguaauaaggcugu

SEQ ID NO: 947012 - RNA, 21 nt, Human
ccagcaguaauaaggcugugu

SEQ ID NO: 947013 - RNA, 19 nt, Human
ccagggcucuucgcuccuc

SEQ ID NO: 947014 - RNA, 22 nt, Human
cccacagccucccaggagaguu

SEQ ID NO: 947015 - RNA, 26 nt, Human
cccacagccucccaggagaguucucu

SEQ ID NO: 947016 - RNA, 20 nt, Human
cccacauuccuccagccccg

SEQ ID NO: 947017 - RNA, 21 nt, Human
cccagaggcaggggagggccc

SEQ ID NO: 947018 - RNA, 20 nt, Human
cccagcugcugccccauggg

SEQ ID NO: 947019 - RNA, 20 nt, Human
ccccaaccuccccuccuccu

SEQ ID NO: 947020 - RNA, 19 nt, Human
ccccaccaggguacccagg

SEQ ID NO: 947021 - RNA, 21 nt, Human
ccccacgcuguccaucuuccc

SEQ ID NO: 947022 - RNA, 21 nt, Human
ccccacugccuccuggcucug

SEQ ID NO: 947023 - RNA, 19 nt, Human
ccccagggccaggcccucu

SEQ ID NO: 947024 - RNA, 24 nt, Human
ccccaggguuagagccgcuugucc

SEQ ID NO: 947025 - RNA, 20 nt, Human
cccccaaccuccccuccucc

SEQ ID NO: 947026 - RNA, 21 nt, Human
cccccacauuccuccagcccc

SEQ ID NO: 947027 - RNA, 19 nt, Human
ccccgagaccaaaccccuc

SEQ ID NO: 947028 - RNA, 18 nt, Human
ccccucucucuccugccu

SEQ ID NO: 947029 - RNA, 19 nt, Human
ccccucuuugccgccagcc

SEQ ID NO: 947030 - RNA, 20 nt, Human
cccucuagaggccaggcccc

SEQ ID NO: 947031 - RNA, 20 nt, Human
cccuggaggacccgcucucc

SEQ ID NO: 947032 - RNA, 20 nt, Human
ccgccgcgcugcugcugggc

SEQ ID NO: 947033 - RNA, 20 nt, Human
ccgccgcgcugcugcugggc

SEQ ID NO: 947034 - RNA, 22 nt, Human
ccgccgcgcugcugcugggcuc

SEQ ID NO: 947035 - RNA, 19 nt, Human
ccggcgccgccgcgcugcu

SEQ ID NO: 947036 - RNA, 24 nt, Human
ccuacuuccuucuccaccuguccc

SEQ ID NO: 947037 - RNA, 23 nt, Human
ccuccgcgccugcaaguugggac

SEQ ID NO: 947038 - RNA, 18 nt, Human
ccuccugcuccauucucc

SEQ ID NO: 947039 - RNA, 19 nt, Human
ccuccuuccccucucucuc

SEQ ID NO: 947040 - RNA, 18 nt, Human
ccucuagaggccaggccc

SEQ ID NO: 947041 - RNA, 23 nt, Human
ccugcauccccaccaggguaccc

SEQ ID NO: 947042 - RNA, 23 nt, Human
ccuggacaacauggccgccccca

SEQ ID NO: 947043 - RNA, 21 nt, Human
ccuggagcccaccccagggcc

SEQ ID NO: 947044 - RNA, 18 nt, Human
ccuggaggccguggaggg

SEQ ID NO: 947045 - RNA, 18 nt, Human
ccuggaggcugggaggcu

SEQ ID NO: 947046 - RNA, 20 nt, Human
ccugguuacgugggcccccu

SEQ ID NO: 947047 - RNA, 18 nt, Human
ccuuccucccuccccucu

SEQ ID NO: 947048 - RNA, 27 nt, Human
ccuuccuuccucccuccccucuguuuu

SEQ ID NO: 947049 - RNA, 21 nt, Human
cgacuccccagaguuuaaaga

SEQ ID NO: 947050 - RNA, 21 nt, Human
cgacuccugagcucugagccc

SEQ ID NO: 947051 - RNA, 25 nt, Human
cgagaccaaaccccucuuugccgcc

SEQ ID NO: 947052 - RNA, 21 nt, Human
cgcugcugcugggcuccagcc

SEQ ID NO: 947053 - RNA, 22 nt, Human
cgcuucaggcaccuaggagacc

SEQ ID NO: 947054 - RNA, 19 nt, Human
cggccuucccugcaucccc

SEQ ID NO: 947055 - RNA, 20 nt, Human
cgggacaccacuacauguga

SEQ ID NO: 947056 - RNA, 22 nt, Human
cgugcacucauuccuacuuccu

SEQ ID NO: 947057 - RNA, 19 nt, Human
cucacuuggagcccugggc

SEQ ID NO: 947058 - RNA, 20 nt, Human
cuccagccccgcccuccucc

SEQ ID NO: 947059 - RNA, 20 nt, Human
cuccugagcucugagcccac

SEQ ID NO: 947060 - RNA, 24 nt, Human
cucuccuauggcuuccuacagccc

SEQ ID NO: 947061 - RNA, 20 nt, Human
cucuccugccugcuccuccc

SEQ ID NO: 947062 - RNA, 22 nt, Human
cucucucuccugccugcuccuc

SEQ ID NO: 947063 - RNA, 19 nt, Human
cugccuccuggcucugccc

SEQ ID NO: 947064 - RNA, 20 nt, Human
cugccuccuggcucugcccc

SEQ ID NO: 947065 - RNA, 19 nt, Human
cugcuccucccucugggga

SEQ ID NO: 947066 - RNA, 20 nt, Human
cugcugagcacgcucauuuu

SEQ ID NO: 947067 - RNA, 20 nt, Human
cugcugccccaugggggcug

SEQ ID NO: 947068 - RNA, 23 nt, Human
cugcugggcuccagccucccggc

SEQ ID NO: 947069 - RNA, 21 nt, Human
cugguuccgacagcucucggg

SEQ ID NO: 947070 - RNA, 19 nt, Human
cuuccugcugagcacgcuc

SEQ ID NO: 947071 - RNA, 18 nt, Human
gaccaaaccccucuuugc

SEQ ID NO: 947072 - RNA, 23 nt, Human
gacccgcucucccuuucguccac

SEQ ID NO: 947073 - RNA, 21 nt, Human
gaccuauuucccguuccccuu

SEQ ID NO: 947074 - RNA, 20 nt, Human
gaggcagccacaguccugga

SEQ ID NO: 947075 - RNA, 18 nt, Human
gagggauagaggacagag

SEQ ID NO: 947076 - RNA, 18 nt, Human
gaucacuucugcuugcug

SEQ ID NO: 947077 - RNA, 23 nt, Human
gcaaccuaaaucuucaccuccuc

SEQ ID NO: 947078 - RNA, 23 nt, Human
gccagcccgggccccucaaucac

SEQ ID NO: 947079 - RNA, 23 nt, Human
gcccgggccccucaaucaccagc

SEQ ID NO: 947080 - RNA, 24 nt, Human
gcccgggccccucaaucaccagcc

SEQ ID NO: 947081 - RNA, 20 nt, Human
gcccugcccaugggcuucug

SEQ ID NO: 947082 - RNA, 21 nt, Human
gcccugggcugcgcugagcug

SEQ ID NO: 947083 - RNA, 21 nt, Human
gccuggacaacauggccgccc

SEQ ID NO: 947084 - RNA, 18 nt, Human
gcucacccacagccuccc

SEQ ID NO: 947085 - RNA, 19 nt, Human
gcucagcuccucucuggcu

SEQ ID NO: 947086 - RNA, 20 nt, Human
gcugcugcugggcuccagcc

SEQ ID NO: 947087 - RNA, 21 nt, Human
gcugcugggcuccagccuccc

SEQ ID NO: 947088 - RNA, 18 nt, Human
gcuggcagggucagggcc

SEQ ID NO: 947089 - RNA, 23 nt, Human
ggacaacagcagcagggucagaa

SEQ ID NO: 947090 - RNA, 19 nt, Human
ggagggggugagggagaag

SEQ ID NO: 947091 - RNA, 23 nt, Human
ggaggugcuccggguucccccuu

SEQ ID NO: 947092 - RNA, 19 nt, Human
ggcaaaagcaagagucugg

SEQ ID NO: 947093 - RNA, 21 nt, Human
ggcccccuggucccuguaagg

SEQ ID NO: 947094 - RNA, 28 nt, Human
ggcugagccacgguggcugguaagaaga

SEQ ID NO: 947095 - RNA, 18 nt, Human
gggccccucaaucaccag

SEQ ID NO: 947096 - RNA, 18 nt, Human
gggcuucugggccucacu

SEQ ID NO: 947097 - RNA, 21 nt, Human
ggggcuuuuucugauuuucau

SEQ ID NO: 947098 - RNA, 25 nt, Human
ggggggccggcccuguuucucaggg

SEQ ID NO: 947099 - RNA, 18 nt, Human
ggguaaaggaggggguga

SEQ ID NO: 947100 - RNA, 22 nt, Human
ggguuagaaaacggaaaggggc

SEQ ID NO: 947101 - RNA, 18 nt, Human
guccuggaggggccuggg

SEQ ID NO: 947102 - RNA, 18 nt, Human
gugagggagaaguuucuu

SEQ ID NO: 947103 - RNA, 22 nt, Human
gugccgaguccuuuccugaaag

SEQ ID NO: 947104 - RNA, 18 nt, Human
guuacgugggcccccugg

SEQ ID NO: 947105 - RNA, 20 nt, Human
uaagccccgagaccaaaccc

SEQ ID NO: 947106 - RNA, 22 nt, Human
uaagccccgagaccaaaccccu

SEQ ID NO: 947107 - RNA, 18 nt, Human
uagaacaucucucucagg

SEQ ID NO: 947108 - RNA, 26 nt, Human
uagaaguggaggugcuccgacaacgg

SEQ ID NO: 947109 - RNA, 25 nt, Human
uagaccaacucugcuuuuccuccug

SEQ ID NO: 947110 - RNA, 20 nt, Human
uagcgugaggaacacaucuc

SEQ ID NO: 947111 - RNA, 22 nt, Human
uagcgugaggaacacaucucuu

SEQ ID NO: 947112 - RNA, 24 nt, Human
ucaaacccagagauaaaaugccag

SEQ ID NO: 947113 - RNA, 21 nt, Human
ucagcuagaacaucucucuca

SEQ ID NO: 947114 - RNA, 22 nt, Human
ucagcuagaacaucucucucag

SEQ ID NO: 947115 - RNA, 18 nt, Human
uccaucuucccuagaagu

SEQ ID NO: 947116 - RNA, 18 nt, Human
ucccaggccuaaccagcg

SEQ ID NO: 947117 - RNA, 23 nt, Human
ucccaggccuaaccagcguuuuc

SEQ ID NO: 947118 - RNA, 23 nt, Human
ucccccuucguccccccagcccu

SEQ ID NO: 947119 - RNA, 26 nt, Human
ucccuggccagagcagcaaccaagac

SEQ ID NO: 947120 - RNA, 24 nt, Human
uccuccagccgccuggucucucuu

SEQ ID NO: 947121 - RNA, 22 nt, Human
uccuggaggggccugggccugg

SEQ ID NO: 947122 - RNA, 18 nt, Human
uccuggggacugggauuc

SEQ ID NO: 947123 - RNA, 23 nt, Human
ucgggguuagaaaacggaaaggg

SEQ ID NO: 947124 - RNA, 19 nt, Human
ucucccgccccccaaccuc

SEQ ID NO: 947125 - RNA, 20 nt, Human
ucucccucuucuccuucccc

SEQ ID NO: 947126 - RNA, 19 nt, Human
ucugaggguaaggaaggga

SEQ ID NO: 947127 - RNA, 19 nt, Human
ugaaaugucaggggucccu

SEQ ID NO: 947128 - RNA, 18 nt, Human
ugaaggcggauggggaca

SEQ ID NO: 947129 - RNA, 19 nt, Human
ugacaggaaaccagggcug

SEQ ID NO: 947130 - RNA, 20 nt, Human
ugaccuguguccccauucuc

SEQ ID NO: 947131 - RNA, 22 nt, Human
ugagcucugagcccacagcccc

SEQ ID NO: 947132 - RNA, 20 nt, Human
ugagcugcagggaggccgag

SEQ ID NO: 947133 - RNA, 25 nt, Human
ugaggguaaggaagggagccugcag

SEQ ID NO: 947134 - RNA, 18 nt, Human
ugaguaggcuucgugugg

SEQ ID NO: 947135 - RNA, 22 nt, Human
ugagugacaggaaaccagggcu

SEQ ID NO: 947136 - RNA, 25 nt, Human
ugagugacaggaaaccagggcugug

SEQ ID NO: 947137 - RNA, 25 nt, Human
ugaugcggaagagcagaggggugaa

SEQ ID NO: 947138 - RNA, 22 nt, Human
ugccagggcucuucgcuccucc

SEQ ID NO: 947139 - RNA, 20 nt, Human
ugccugcuccucccucuggu

SEQ ID NO: 947140 - RNA, 20 nt, Human
ugcggaagagcagaggggug

SEQ ID NO: 947141 - RNA, 23 nt, Human
ugcugcugggcuccagccucccg

SEQ ID NO: 947142 - RNA, 25 nt, Human
ugcugggaguggggcugccucccug

SEQ ID NO: 947143 - RNA, 23 nt, Human
ugcuuugggucuggggaccucug

SEQ ID NO: 947144 - RNA, 24 nt, Human
uggaggccguggaggggaggcagc

SEQ ID NO: 947145 - RNA, 18 nt, Human
uggcaggauacaggccuu

SEQ ID NO: 947146 - RNA, 23 nt, Human
uggcccagcugcugccccauggg

SEQ ID NO: 947147 - RNA, 22 nt, Human
uggccuccuggggguguuuccu

SEQ ID NO: 947148 - RNA, 18 nt, Human
ugggacgacgccggcgcc

SEQ ID NO: 947149 - RNA, 18 nt, Human
uggggcugccucccuggc

SEQ ID NO: 947150 - RNA, 23 nt, Human
ugguaagaagagcuccacccucu

SEQ ID NO: 947151 - RNA, 21 nt, Human
ugucucccgccccccaaccuc

SEQ ID NO: 947152 - RNA, 18 nt, Human
uuacgugggcccccuggu

SEQ ID NO: 947153 - RNA, 26 nt, Human
uuccuacuuccuucuccaccuguccc

SEQ ID NO: 947154 - RNA, 22 nt, Human
uuccugaauccgacuccccaga

SEQ ID NO: 947155 - RNA, 22 nt, Human
uucuccaccugucccagcugcu

SEQ ID NO: 947156 - RNA, 18 nt, Human
uugggucuggggaccucu

SEQ ID NO: 947157 - RNA, 19 nt, Human
uugguuuuuguuuuuugcu

SEQ ID NO: 947158 - RNA, 18 nt, Human
uugucauugguuuuuguu

SEQ ID NO: 947159 - RNA, 19 nt, Human
uuuaagccccgagaccaaa

SEQ ID NO: 947160 - RNA, 18 nt, Human
uuucauucuuuggaggga

SEQ ID NO: 947161 - RNA, 20 nt, Human
uuucucugccccggccuucc

SEQ ID NO: 947162 - RNA, 24 nt, Human
uuugguuaccaucuccaaaucuga

SEQ ID NO: 947163 - RNA, 22 nt, Human
uuuucauucuuuggagggauag

SEQ ID NO: 947164 - RNA, 24 nt, Human
aaaaaagaaauguaguguauaaaa

SEQ ID NO: 947165 - RNA, 19 nt, Human
aaaaugcugggauuacagg

SEQ ID NO: 947166 - RNA, 24 nt, Human
aaaaugcugggauuacaggccuga

SEQ ID NO: 947167 - RNA, 25 nt, Human
aaacagcugcaaaacagcuuugcau

SEQ ID NO: 947168 - RNA, 22 nt, Human
aaagaaagaaacuaucagucug

SEQ ID NO: 947169 - RNA, 26 nt, Human
aaaugcugggauuacaggccugagcc

SEQ ID NO: 947170 - RNA, 22 nt, Human
aacagcugcaaaacagcuuugc

SEQ ID NO: 947171 - RNA, 18 nt, Human
aacucaugaccucaaguu

SEQ ID NO: 947172 - RNA, 22 nt, Human
aagaaagccagcccugccuagg

SEQ ID NO: 947173 - RNA, 18 nt, Human
aagcagguauuuuuuuua

SEQ ID NO: 947174 - RNA, 24 nt, Human
aaugcugggauuacaggccugagc

SEQ ID NO: 947175 - RNA, 18 nt, Human
aauuuuugaaaagucgga

SEQ ID NO: 947176 - RNA, 19 nt, Human
acccaggcuggagugcagu

SEQ ID NO: 947177 - RNA, 23 nt, Human
acccaggcuggagugcaguggug

SEQ ID NO: 947178 - RNA, 25 nt, Human
accgcaguccccucuccgccgcgcc

SEQ ID NO: 947179 - RNA, 19 nt, Human
accuccccaaaggcgggaa

SEQ ID NO: 947180 - RNA, 20 nt, Human
acgggguuucacuguuuugg

SEQ ID NO: 947181 - RNA, 24 nt, Human
acgggguuucacuguuuuggccag

SEQ ID NO: 947182 - RNA, 24 nt, Human
acuguuuuggccaggcugguuucg

SEQ ID NO: 947183 - RNA, 23 nt, Human
agcaacaggacaucuuuaaggga

SEQ ID NO: 947184 - RNA, 23 nt, Human
agccagcgagcgagccggggacc

SEQ ID NO: 947185 - RNA, 22 nt, Human
agccggggaccagggcgggcua

SEQ ID NO: 947186 - RNA, 25 nt, Human
aggcuggagugcaguggugcgaucu

SEQ ID NO: 947187 - RNA, 23 nt, Human
agggcgggcuagcgggcggggga

SEQ ID NO: 947188 - RNA, 18 nt, Human
aguagcugggauuacagg

SEQ ID NO: 947189 - RNA, 20 nt, Human
agugcaguggugcgaucucg

SEQ ID NO: 947190 - RNA, 23 nt, Human
agugcaguggugcgaucucggcu

SEQ ID NO: 947191 - RNA, 24 nt, Human
agugcaguggugcgaucucggcuc

SEQ ID NO: 947192 - RNA, 21 nt, Human
auccccggccgcgucccccuc

SEQ ID NO: 947193 - RNA, 20 nt, Human
auccgcucauccccggccgc

SEQ ID NO: 947194 - RNA, 19 nt, Human
auuacaggugugcgccacc

SEQ ID NO: 947195 - RNA, 18 nt, Human
caaaaggagauaaagugg

SEQ ID NO: 947196 - RNA, 24 nt, Human
caaaaugcugggauuacaggccug

SEQ ID NO: 947197 - RNA, 22 nt, Human
caacacaacacauuucucccuu

SEQ ID NO: 947198 - RNA, 22 nt, Human
caacaggacaucuuuaagggaa

SEQ ID NO: 947199 - RNA, 23 nt, Human
caacuuccaccucccagguucaa

SEQ ID NO: 947200 - RNA, 22 nt, Human
caagcgauuuuccugccucagc

SEQ ID NO: 947201 - RNA, 19 nt, Human
caagguggcaguggaggcc

SEQ ID NO: 947202 - RNA, 21 nt, Human
caagucuuugacuuacauccu

SEQ ID NO: 947203 - RNA, 21 nt, Human
cacccaggcuggagugcagug

SEQ ID NO: 947204 - RNA, 22 nt, Human
cacccgcaauccgcucaucccc

SEQ ID NO: 947205 - RNA, 23 nt, Human
cacuauguucucuucccuccggu

SEQ ID NO: 947206 - RNA, 21 nt, Human
cacugcaacuuccaccuccca

SEQ ID NO: 947207 - RNA, 21 nt, Human
cacuguuuuggccaggcuggu

SEQ ID NO: 947208 - RNA, 24 nt, Human
cacuguuuuggccaggcugguuuc

SEQ ID NO: 947209 - RNA, 28 nt, Human
cagcacaaaaugaaaucauggggcccuu

SEQ ID NO: 947210 - RNA, 20 nt, Human
cagcuuccugaguagcuggg

SEQ ID NO: 947211 - RNA, 18 nt, Human
cagggagugcccgggaac

SEQ ID NO: 947212 - RNA, 22 nt, Human
ccaaaaugcugggauuacaggc

SEQ ID NO: 947213 - RNA, 24 nt, Human
ccaaaaugcugggauuacaggccu

SEQ ID NO: 947214 - RNA, 24 nt, Human
ccaccucccagguucaagcgauuu

SEQ ID NO: 947215 - RNA, 20 nt, Human
cccagguucaagcgauuuuc

SEQ ID NO: 947216 - RNA, 23 nt, Human
cccagguucaagcgauuuuccug

SEQ ID NO: 947217 - RNA, 24 nt, Human
ccccaaaggcgggaaucuucacuu

SEQ ID NO: 947218 - RNA, 23 nt, Human
cccccucgcgcgccuccaccgcg

SEQ ID NO: 947219 - RNA, 24 nt, Human
cccgccuacucagauugccaaaag

SEQ ID NO: 947220 - RNA, 19 nt, Human
cccucgcgcgccuccaccg

SEQ ID NO: 947221 - RNA, 19 nt, Human
cccugggugguccagaccu

SEQ ID NO: 947222 - RNA, 24 nt, Human
ccucccagguucaagcgauuuucc

SEQ ID NO: 947223 - RNA, 22 nt, Human
ccugaguagcugggauuacagg

SEQ ID NO: 947224 - RNA, 23 nt, Human
ccugaguagcugggauuacaggu

SEQ ID NO: 947225 - RNA, 24 nt, Human
ccugaguagcugggauuacaggug

SEQ ID NO: 947226 - RNA, 19 nt, Human
ccugccuagguuccccgcc

SEQ ID NO: 947227 - RNA, 24 nt, Human
ccugccucagcuuccugaguagcu

SEQ ID NO: 947228 - RNA, 18 nt, Human
ccugugcugcuacacaag

SEQ ID NO: 947229 - RNA, 20 nt, Human
ccuucucuucccuuuauauc

SEQ ID NO: 947230 - RNA, 20 nt, Human
ccuuuuucugcuuucagaga

SEQ ID NO: 947231 - RNA, 21 nt, Human
cgacucggagaaaagcagcgg

SEQ ID NO: 947232 - RNA, 20 nt, Human
cgagccggggaccagggcgg

SEQ ID NO: 947233 - RNA, 21 nt, Human
cgcgucccccucgcgcgccuc

SEQ ID NO: 947234 - RNA, 24 nt, Human
cgcucuugucacccaggcuggagu

SEQ ID NO: 947235 - RNA, 21 nt, Human
cggagaaaagcagcggcucac

SEQ ID NO: 947236 - RNA, 24 nt, Human
cgggguuucacuguuuuggccagg

SEQ ID NO: 947237 - RNA, 20 nt, Human
cuaagugugggcccugugcu

SEQ ID NO: 947238 - RNA, 24 nt, Human
cucacugcaacuuccaccucccag

SEQ ID NO: 947239 - RNA, 20 nt, Human
cucagcacaaaaugaaauca

SEQ ID NO: 947240 - RNA, 24 nt, Human
cucagcuuccugaguagcugggau

SEQ ID NO: 947241 - RNA, 21 nt, Human
cucuugucacccaggcuggag

SEQ ID NO: 947242 - RNA, 21 nt, Human
cugaguagcugggauuacagg

SEQ ID NO: 947243 - RNA, 24 nt, Human
cugaguagcugggauuacaggugu

SEQ ID NO: 947244 - RNA, 23 nt, Human
cugcaacuuccaccucccagguu

SEQ ID NO: 947245 - RNA, 24 nt, Human
cugcaacuuccaccucccagguuc

SEQ ID NO: 947246 - RNA, 28 nt, Human
cuggcuaauuuuguauuuuuaguagaga

SEQ ID NO: 947247 - RNA, 24 nt, Human
cugggugguccagaccuccccaaa

SEQ ID NO: 947248 - RNA, 23 nt, Human
cuguuuuaaagcuaagacaacac

SEQ ID NO: 947249 - RNA, 20 nt, Human
cuugagccaacuucgguagc

SEQ ID NO: 947250 - RNA, 21 nt, Human
cuugccagccaagguggcagu

SEQ ID NO: 947251 - RNA, 24 nt, Human
cuugccucagccucccaaaaugcu

SEQ ID NO: 947252 - RNA, 24 nt, Human
cuugucacccaggcuggagugcag

SEQ ID NO: 947253 - RNA, 21 nt, Human
gaacaucgccgggcgcgggac

SEQ ID NO: 947254 - RNA, 23 nt, Human
gaagaauuuuacuggaaccugga

SEQ ID NO: 947255 - RNA, 24 nt, Human
gaccucaaguuauccacuugccuc

SEQ ID NO: 947256 - RNA, 26 nt, Human
gaccucaaguuauccacuugccucag

SEQ ID NO: 947257 - RNA, 23 nt, Human
gacgcagcugaccgcaguccccc

SEQ ID NO: 947258 - RNA, 21 nt, Human
gagauaaaguggcucaauugg

SEQ ID NO: 947259 - RNA, 19 nt, Human
gaguagcugggauuacagg

SEQ ID NO: 947260 - RNA, 24 nt, Human
gaguagcugggauuacaggugugc

SEQ ID NO: 947261 - RNA, 18 nt, Human
gauuacaggccugagcca

SEQ ID NO: 947262 - RNA, 21 nt, Human
gauuacaggccugagccacca

SEQ ID NO: 947263 - RNA, 24 nt, Human
gauuacaggccugagccaccaugc

SEQ ID NO: 947264 - RNA, 18 nt, Human
gauuacaggugugcgcca

SEQ ID NO: 947265 - RNA, 21 nt, Human
gauuuuccugccucagcuucc

SEQ ID NO: 947266 - RNA, 22 nt, Human
gccgcacagccccaaguggacg

SEQ ID NO: 947267 - RNA, 21 nt, Human
gccgcgucccccucgcgcgcc

SEQ ID NO: 947268 - RNA, 24 nt, Human
gccucagcuuccugaguagcuggg

SEQ ID NO: 947269 - RNA, 21 nt, Human
gccuuuuucugcuuucagaga

SEQ ID NO: 947270 - RNA, 23 nt, Human
gcgauuuuccugccucagcuucc

SEQ ID NO: 947271 - RNA, 21 nt, Human
gcuagcgggcgggggauaagc

SEQ ID NO: 947272 - RNA, 21 nt, Human
gcucaauuggguuguccagau

SEQ ID NO: 947273 - RNA, 28 nt, Human
ggaccagggcgggcuagcgggcggggga

SEQ ID NO: 947274 - RNA, 21 nt, Human
ggaggcccugggugguccaga

SEQ ID NO: 947275 - RNA, 23 nt, Human
ggaguuucgcucuugucacccag

SEQ ID NO: 947276 - RNA, 24 nt, Human
ggauuacaggccugagccaccaug

SEQ ID NO: 947277 - RNA, 18 nt, Human
gggcgggcuagcgggcgg

SEQ ID NO: 947278 - RNA, 19 nt, Human
ggggcccuucuucaaacau

SEQ ID NO: 947279 - RNA, 23 nt, Human
gggguuucacuguuuuggccagg

SEQ ID NO: 947280 - RNA, 22 nt, Human
ggugagccuccuucucuucccu

SEQ ID NO: 947281 - RNA, 18 nt, Human
guagcugggauuacaggu

SEQ ID NO: 947282 - RNA, 19 nt, Human
guauuaaaguuaggcuggu

SEQ ID NO: 947283 - RNA, 24 nt, Human
guuauccacuugccucagccuccc

SEQ ID NO: 947284 - RNA, 24 nt, Human
uaaagcuaagacaacacaacacau

SEQ ID NO: 947285 - RNA, 30 nt, Human
uaacacuaaaaacaaauucuugagccaacc

SEQ ID NO: 947286 - RNA, 22 nt, Human
uaacugagaggggucuaaauau

SEQ ID NO: 947287 - RNA, 24 nt, Human
uaagcauuucuuaacugagagggg

SEQ ID NO: 947288 - RNA, 21 nt, Human
uacagaaugaucaagaaagua

SEQ ID NO: 947289 - RNA, 22 nt, Human
uacaggccugagccaccaugcc

SEQ ID NO: 947290 - RNA, 20 nt, Human
uacaggugugcgccaccaca

SEQ ID NO: 947291 - RNA, 19 nt, Human
uagcgggcgggggauaagc

SEQ ID NO: 947292 - RNA, 20 nt, Human
uaguagagacgggguuucac

SEQ ID NO: 947293 - RNA, 22 nt, Human
uaguagagacgggguuucacug

SEQ ID NO: 947294 - RNA, 26 nt, Human
uaguagagacgggguuucacuguuuu

SEQ ID NO: 947295 - RNA, 22 nt, Human
uaucacuaaagcaacaggacau

SEQ ID NO: 947296 - RNA, 18 nt, Human
uaugaaagaaagaaacua

SEQ ID NO: 947297 - RNA, 24 nt, Human
ucaaauuuuugaaaagucggaaaa

SEQ ID NO: 947298 - RNA, 24 nt, Human
ucacccaggcuggagugcaguggu

SEQ ID NO: 947299 - RNA, 24 nt, Human
ucacugcaacuuccaccucccagg

SEQ ID NO: 947300 - RNA, 25 nt, Human
ucacugcaacuuccaccucccaggu

SEQ ID NO: 947301 - RNA, 20 nt, Human
ucagcuuccugaguagcugg

SEQ ID NO: 947302 - RNA, 20 nt, Human
uccaaauggccggcaaauuu

SEQ ID NO: 947303 - RNA, 24 nt, Human
uccacuugccucagccucccaaaa

SEQ ID NO: 947304 - RNA, 24 nt, Human
uccaguagugacuuacagaugaaa

SEQ ID NO: 947305 - RNA, 24 nt, Human
ucccaaaaugcugggauuacaggc

SEQ ID NO: 947306 - RNA, 18 nt, Human
ucccagguucaagcgauu

SEQ ID NO: 947307 - RNA, 24 nt, Human
ucccagguucaagcgauuuuccug

SEQ ID NO: 947308 - RNA, 24 nt, Human
uccugaguagcugggauuacaggu

SEQ ID NO: 947309 - RNA, 22 nt, Human
ucgcucuugucacccaggcugg

SEQ ID NO: 947310 - RNA, 23 nt, Human
ucgcucuugucacccaggcugga

SEQ ID NO: 947311 - RNA, 22 nt, Human
ucucccuugccagccaaggugg

SEQ ID NO: 947312 - RNA, 18 nt, Human
ucuugucacccaggcugg

SEQ ID NO: 947313 - RNA, 19 nt, Human
ucuuugaacuuacugugua

SEQ ID NO: 947314 - RNA, 21 nt, Human
ugaaaagucggaaaaacugug

SEQ ID NO: 947315 - RNA, 25 nt, Human
ugaaagaaagaaacuaucagucugu

SEQ ID NO: 947316 - RNA, 22 nt, Human
ugaaagccuuaguuuuagccua

SEQ ID NO: 947317 - RNA, 24 nt, Human
ugaaaucauggggcccuucuucaa

SEQ ID NO: 947318 - RNA, 20 nt, Human
ugaccucaaguuauccacuu

SEQ ID NO: 947319 - RNA, 27 nt, Human
ugaccucaaguuauccacuugccucag

SEQ ID NO: 947320 - RNA, 26 nt, Human
ugagaggggucuaaauaucacuaaag

SEQ ID NO: 947321 - RNA, 18 nt, Human
ugauaugaaagaaagaaa

SEQ ID NO: 947322 - RNA, 22 nt, Human
ugcaguggugcgaucucggcuc

SEQ ID NO: 947323 - RNA, 21 nt, Human
ugcccgggaacaucgccgggc

SEQ ID NO: 947324 - RNA, 24 nt, Human
ugccucagccucccaaaaugcugg

SEQ ID NO: 947325 - RNA, 24 nt, Human
ugccucagcuuccugaguagcugg

SEQ ID NO: 947326 - RNA, 20 nt, Human
uggacgcagcugaccgcagu

SEQ ID NO: 947327 - RNA, 24 nt, Human
uggaggcccuggguggucgguagc

SEQ ID NO: 947328 - RNA, 23 nt, Human
uggagugcaguggugcgaucucg

SEQ ID NO: 947329 - RNA, 24 nt, Human
uggagugcaguggugcgaucucgg

SEQ ID NO: 947330 - RNA, 24 nt, Human
uggccaggcugguuucgaacucau

SEQ ID NO: 947331 - RNA, 29 nt, Human
uggcuaauuuuguauuuuuaguagagacg

SEQ ID NO: 947332 - RNA, 18 nt, Human
ugggauuacaggccugag

SEQ ID NO: 947333 - RNA, 21 nt, Human
ugggauuacaggccugagcca

SEQ ID NO: 947334 - RNA, 22 nt, Human
ugggauuacaggccugagccac

SEQ ID NO: 947335 - RNA, 24 nt, Human
ugggauuacaggccugagccacca

SEQ ID NO: 947336 - RNA, 25 nt, Human
ugggauuacaggccugagccaccau

SEQ ID NO: 947337 - RNA, 18 nt, Human
ugggauuacaggugugcg

SEQ ID NO: 947338 - RNA, 21 nt, Human
ugggauuacaggugugcgcca

SEQ ID NO: 947339 - RNA, 22 nt, Human
ugggauuacaggugugcgccac

SEQ ID NO: 947340 - RNA, 24 nt, Human
ugggauuacaggugugcgccacca

SEQ ID NO: 947341 - RNA, 25 nt, Human
ugggauuacaggugugcgccaccac

SEQ ID NO: 947342 - RNA, 21 nt, Human
uguauuuuuaguagagacggg

SEQ ID NO: 947343 - RNA, 22 nt, Human
ugugaacaucuuuauacaugug

SEQ ID NO: 947344 - RNA, 21 nt, Human
ugugauaugaaagaaagaaac

SEQ ID NO: 947345 - RNA, 21 nt, Human
uuaaagcuaagacaacacaac

SEQ ID NO: 947346 - RNA, 19 nt, Human
uuaaucagacaugauuaaa

SEQ ID NO: 947347 - RNA, 21 nt, Human
uuaguagagacgggguuucac

SEQ ID NO: 947348 - RNA, 21 nt, Human
uuaguagagacgggguuucac

SEQ ID NO: 947349 - RNA, 22 nt, Human
uuaguagagacgggguuucacu

SEQ ID NO: 947350 - RNA, 24 nt, Human
uuaguagagacgggguuucacugu

SEQ ID NO: 947351 - RNA, 18 nt, Human
uuagucacucuuaccaac

SEQ ID NO: 947352 - RNA, 21 nt, Human
uucaagcgauuuuccugccuc

SEQ ID NO: 947353 - RNA, 23 nt, Human
uucaagcgauuuuccugccucag

SEQ ID NO: 947354 - RNA, 24 nt, Human
uucaagcgauuuuccugccucagc

SEQ ID NO: 947355 - RNA, 18 nt, Human
uucauaauaauaaaaaag

SEQ ID NO: 947356 - RNA, 24 nt, Human
uucgcucuugucacccaggcugga

SEQ ID NO: 947357 - RNA, 21 nt, Human
uucggucagaagaauuuuacu

SEQ ID NO: 947358 - RNA, 24 nt, Human
uucucuauacaugugauaugaaag

SEQ ID NO: 947359 - RNA, 19 nt, Human
uucucugugaacaucuuua

SEQ ID NO: 947360 - RNA, 22 nt, Human
uucuugagccaacuucgguagc

SEQ ID NO: 947361 - RNA, 20 nt, Human
uugaaaagucggaaaaacug

SEQ ID NO: 947362 - RNA, 24 nt, Human
uugccucagccucccaaaaugcug

SEQ ID NO: 947363 - RNA, 23 nt, Human
uuguauuuuuaguagagacgggg

SEQ ID NO: 947364 - RNA, 23 nt, Human
uuucacuguuuuggccaggcugu

SEQ ID NO: 947365 - RNA, 24 nt, Human
uuucgcucuugucacccaggcugg

SEQ ID NO: 947366 - RNA, 22 nt, Human
uuugagcaagaaaacauaggau

SEQ ID NO: 947367 - RNA, 19 nt, Human
uuuuguauuuuuaguagag

SEQ ID NO: 947368 - RNA, 20 nt, Human
uuuuguauuuuuaguagaga

SEQ ID NO: 947369 - RNA, 24 nt, Human
uuuuuaguagagacgggguuucac

SEQ ID NO: 947370 - RNA, 20 nt, Human
aaaaaaaaaacaaacaggag

SEQ ID NO: 947371 - RNA, 24 nt, Human
aaaaaaacaaacaggagaacccaa

SEQ ID NO: 947372 - RNA, 24 nt, Human
aaaaaaacaaacaggagaacccaa

SEQ ID NO: 947373 - RNA, 24 nt, Human
aaaaaaagaaagaaaaccgcacaa

SEQ ID NO: 947374 - RNA, 25 nt, Human
aaaaaacaaacaggagaacccaaaa

SEQ ID NO: 947375 - RNA, 24 nt, Human
aaaaaagaaagaaaaccgcacaag

SEQ ID NO: 947376 - RNA, 25 nt, Human
aaacaaaaaguaaaacacagggacc

SEQ ID NO: 947377 - RNA, 18 nt, Human
aaacaaacaggagaaccc

SEQ ID NO: 947378 - RNA, 18 nt, Human
aaacaaacaggagaaccc

SEQ ID NO: 947379 - RNA, 23 nt, Human
aaacaaacaggagaacccaaaau

SEQ ID NO: 947380 - RNA, 27 nt, Human
aaagaaaaaaagaaagaaaaccgcaca

SEQ ID NO: 947381 - RNA, 18 nt, Human
aaaugcuaaaauagccaa

SEQ ID NO: 947382 - RNA, 23 nt, Human
aaauguaauuagaacagccacag

SEQ ID NO: 947383 - RNA, 20 nt, Human
aacugggaaaucuaaaaauc

SEQ ID NO: 947384 - RNA, 18 nt, Human
aagaaagaaaaccgcaca

SEQ ID NO: 947385 - RNA, 21 nt, Human
aagaaagaaaaccgcacaaga

SEQ ID NO: 947386 - RNA, 22 nt, Human
aagaguuacauuggaggaaugg

SEQ ID NO: 947387 - RNA, 24 nt, Human
aagcacagaucuaauggccauacc

SEQ ID NO: 947388 - RNA, 23 nt, Human
aaguauuuagcacaaugcuuggu

SEQ ID NO: 947389 - RNA, 24 nt, Human
aagucauucucuauggggcgggac

SEQ ID NO: 947390 - RNA, 21 nt, Human
aagugauagaaguuauguacu

SEQ ID NO: 947391 - RNA, 21 nt, Human
acauuagagaagccacauuaa

SEQ ID NO: 947392 - RNA, 18 nt, Human
acuuaauaaacauuuggg

SEQ ID NO: 947393 - RNA, 24 nt, Human
agaagucacuuugaaaugcuaaaa

SEQ ID NO: 947394 - RNA, 18 nt, Human
agcaccggggagcggggg

SEQ ID NO: 947395 - RNA, 24 nt, Human
agcuuguuuaaagugcagaaaucu

SEQ ID NO: 947396 - RNA, 22 nt, Human
aggugggagaaauggccugcuu

SEQ ID NO: 947397 - RNA, 21 nt, Human
auguaauuagaacagccacag

SEQ ID NO: 947398 - RNA, 22 nt, Human
caaagaaacuacauuagagaag

SEQ ID NO: 947399 - RNA, 22 nt, Human
caaagagcagagauaaaaagca

SEQ ID NO: 947400 - RNA, 20 nt, Human
caagcagcgaccccucaagg

SEQ ID NO: 947401 - RNA, 18 nt, Human
caauagcuagaauauugc

SEQ ID NO: 947402 - RNA, 20 nt, Human
cacauuaaaaaaaaagcuuc

SEQ ID NO: 947403 - RNA, 24 nt, Human
caggcccugauuuauaaaaacaag

SEQ ID NO: 947404 - RNA, 18 nt, Human
cauagaagucacuuugaa

SEQ ID NO: 947405 - RNA, 20 nt, Human
cauagaagucacuuugaaau

SEQ ID NO: 947406 - RNA, 24 nt, Human
cauguccaucaguagcucccaaac

SEQ ID NO: 947407 - RNA, 18 nt, Human
cauuggaggaauggagaa

SEQ ID NO: 947408 - RNA, 18 nt, Human
ccaaaaugaagggaaaaa

SEQ ID NO: 947409 - RNA, 20 nt, Human
ccaucaguagcucccaaacu

SEQ ID NO: 947410 - RNA, 18 nt, Human
ccccugggauaagagccc

SEQ ID NO: 947411 - RNA, 22 nt, Human
ccgcgcggugggcgugcgcgug

SEQ ID NO: 947412 - RNA, 22 nt, Human
ccucaagcagcgaccccucaag

SEQ ID NO: 947413 - RNA, 19 nt, Human
ccuugaggguguggaacug

SEQ ID NO: 947414 - RNA, 22 nt, Human
cgggggaagccgcgcggugggc

SEQ ID NO: 947415 - RNA, 22 nt, Human
cgugcgcgugcgcgugcgcgcg

SEQ ID NO: 947416 - RNA, 23 nt, Human
cucaaaauguaauuagaacagcc

SEQ ID NO: 947417 - RNA, 19 nt, Human
cucuccucagcaccgggga

SEQ ID NO: 947418 - RNA, 19 nt, Human
cugaaauucuugaguaaag

SEQ ID NO: 947419 - RNA, 23 nt, Human
cugcaccccaugccaauuaaguc

SEQ ID NO: 947420 - RNA, 20 nt, Human
gagaacccaaaaugaaggga

SEQ ID NO: 947421 - RNA, 20 nt, Human
gagcagagauaaaaagcaca

SEQ ID NO: 947422 - RNA, 20 nt, Human
gcauagaaaaaagaucugga

SEQ ID NO: 947423 - RNA, 22 nt, Human
gcggugggcgugcgcgugcgcg

SEQ ID NO: 947424 - RNA, 21 nt, Human
ggagaacccaaaaugaaggga

SEQ ID NO: 947425 - RNA, 21 nt, Human
ggcccugauuuauaaaaacaa

SEQ ID NO: 947426 - RNA, 22 nt, Human
ggcgugcgcgugcgcgugcgcg

SEQ ID NO: 947427 - RNA, 22 nt, Human
guaaaacacauacacauacaua

SEQ ID NO: 947428 - RNA, 23 nt, Human
guaaaacacauacacauacauaa

SEQ ID NO: 947429 - RNA, 19 nt, Human
uaaaaaaaaaacaaacagg

SEQ ID NO: 947430 - RNA, 23 nt, Human
uaaaaaaaaagcuucauagaagu

SEQ ID NO: 947431 - RNA, 22 nt, Human
uaaaaacuccauucagaacaga

SEQ ID NO: 947432 - RNA, 22 nt, Human
uaaaacugaaagcagugcuuaa

SEQ ID NO: 947433 - RNA, 23 nt, Human
uaagagcuuaacuaucaauaaug

SEQ ID NO: 947434 - RNA, 26 nt, Human
uaaguaacauccgaauuaaaaagucc

SEQ ID NO: 947435 - RNA, 18 nt, Human
uaccuugaggguguggaa

SEQ ID NO: 947436 - RNA, 21 nt, Human
uagaacagccacagcauccuc

SEQ ID NO: 947437 - RNA, 19 nt, Human
uagaauauccuaaaauauc

SEQ ID NO: 947438 - RNA, 23 nt, Human
uagaauauugcuauuucucaaug

SEQ ID NO: 947439 - RNA, 23 nt, Human
uagccaaguuugaggaacaaugc

SEQ ID NO: 947440 - RNA, 24 nt, Human
uauuccauuuauacuuacuuuuca

SEQ ID NO: 947441 - RNA, 18 nt, Human
ucaaaacaucuguaacua

SEQ ID NO: 947442 - RNA, 18 nt, Human
ucacuagagaugacaaac

SEQ ID NO: 947443 - RNA, 21 nt, Human
uccaucaguagcucccaaacu

SEQ ID NO: 947444 - RNA, 22 nt, Human
ucggaucgcucucuccucagca

SEQ ID NO: 947445 - RNA, 23 nt, Human
ucugaaauucuugaguaaaggag

SEQ ID NO: 947446 - RNA, 22 nt, Human
ucuguaacuaaaaagugcuguc

SEQ ID NO: 947447 - RNA, 23 nt, Human
ugaaaaaaacaacauucugaaaa

SEQ ID NO: 947448 - RNA, 20 nt, Human
ugaagggaaaaacuuagagc

SEQ ID NO: 947449 - RNA, 20 nt, Human
ugaugccuggacugcacccc

SEQ ID NO: 947450 - RNA, 19 nt, Human
ugcgcgugcgcgugcgcgc

SEQ ID NO: 947451 - RNA, 18 nt, Human
uggaguaucuacaugaaa

SEQ ID NO: 947452 - RNA, 25 nt, Human
uggggcgggacccagacauccaugu

SEQ ID NO: 947453 - RNA, 19 nt, Human
ugucugauuacgcauagaa

SEQ ID NO: 947454 - RNA, 22 nt, Human
uguguagucgguaaucaaagaa

SEQ ID NO: 947455 - RNA, 22 nt, Human
uuaaaaagaaaaaaagaaagaa

SEQ ID NO: 947456 - RNA, 23 nt, Human
uucaaaacuaguacacugaaacc

SEQ ID NO: 947457 - RNA, 19 nt, Human
uuuguuuaucauuucuccc

SEQ ID NO: 947458 - RNA, 24 nt, Human
uuuuccauuuguuuaucauuucuc

SEQ ID NO: 947459 - RNA, 21 nt, Human
aaaaaaaaaaaaaagaacagu

SEQ ID NO: 947460 - RNA, 18 nt, Human
aaacuagaauaauguucg

SEQ ID NO: 947461 - RNA, 26 nt, Human
aaagaacaguacauuucugucuacaa

SEQ ID NO: 947462 - RNA, 20 nt, Human
aaagagguucgccugccccu

SEQ ID NO: 947463 - RNA, 20 nt, Human
acacaggucauucagcuuua

SEQ ID NO: 947464 - RNA, 19 nt, Human
acagagccagcagucacca

SEQ ID NO: 947465 - RNA, 25 nt, Human
agcaagucugaaggagcgcagccuc

SEQ ID NO: 947466 - RNA, 19 nt, Human
agcagggacaaaagcuucc

SEQ ID NO: 947467 - RNA, 18 nt, Human
agggcugggaaagggcuu

SEQ ID NO: 947468 - RNA, 19 nt, Human
agguagcagagaguaggcg

SEQ ID NO: 947469 - RNA, 19 nt, Human
aggugcugcccgcauuaac

SEQ ID NO: 947470 - RNA, 20 nt, Human
agugguggagggcugggaaa

SEQ ID NO: 947471 - RNA, 21 nt, Human
caaagaaagagguucgccugc

SEQ ID NO: 947472 - RNA, 21 nt, Human
cagcagggacaaaagcuuccu

SEQ ID NO: 947473 - RNA, 21 nt, Human
cagugaggcccuccuuugucc

SEQ ID NO: 947474 - RNA, 21 nt, Human
ccacugaaagcuuuucacugu

SEQ ID NO: 947475 - RNA, 26 nt, Human
cccgcauuaacagcagggacaaaagc

SEQ ID NO: 947476 - RNA, 23 nt, Human
ccgggcagggcgggggacagccu

SEQ ID NO: 947477 - RNA, 21 nt, Human
ccuccagguucuccuugggcc

SEQ ID NO: 947478 - RNA, 22 nt, Human
ccuccuaauacauaagaaugaa

SEQ ID NO: 947479 - RNA, 18 nt, Human
cgcauuuuauuaaauaga

SEQ ID NO: 947480 - RNA, 19 nt, Human
cgugcagaaggccaggucc

SEQ ID NO: 947481 - RNA, 23 nt, Human
gcggcgguggcggcggcggcccu

SEQ ID NO: 947482 - RNA, 21 nt, Human
gcgguggcggcggcggcccgc

SEQ ID NO: 947483 - RNA, 18 nt, Human
ggaauacucucuccacuc

SEQ ID NO: 947484 - RNA, 19 nt, Human
ggcggcgguggcggcggcg

SEQ ID NO: 947485 - RNA, 19 nt, Human
ggcggcgguggcggcggcg

SEQ ID NO: 947486 - RNA, 19 nt, Human
gggccgggcagggcggggg

SEQ ID NO: 947487 - RNA, 18 nt, Human
uaacagcagggacaaaag

SEQ ID NO: 947488 - RNA, 22 nt, Human
uaagaaugaacguccagguagc

SEQ ID NO: 947489 - RNA, 19 nt, Human
uacaaaaugauucugcagc

SEQ ID NO: 947490 - RNA, 21 nt, Human
uccacucgccaggguggaagu

SEQ ID NO: 947491 - RNA, 21 nt, Human
uccaguuugaugaggugacag

SEQ ID NO: 947492 - RNA, 21 nt, Human
uccuccacugaaagcuuuuca

SEQ ID NO: 947493 - RNA, 26 nt, Human
ugccccugcuccacucgccagggugg

SEQ ID NO: 947494 - RNA, 18 nt, Human
uggccuccagguucuccu

SEQ ID NO: 947495 - RNA, 22 nt, Human
uggcggcggcggcccgcggggc

SEQ ID NO: 947496 - RNA, 22 nt, Human
uuaaaaaaaaaaaaaagaacag

SEQ ID NO: 947497 - RNA, 24 nt, Human
uuccaaguugcuguaggugcugcc

SEQ ID NO: 947498 - RNA, 22 nt, Human
uucccauguaaagaaagccaac

SEQ ID NO: 947499 - RNA, 19 nt, Human
uugcuguaggugcugcccg

SEQ ID NO: 947500 - RNA, 19 nt, Human
uuguccuccacugaaagcu

SEQ ID NO: 947501 - RNA, 23 nt, Human
uuguuuaaaaaaaaaaaaaagaa

SEQ ID NO: 947502 - RNA, 18 nt, Human
uuuagugguggccuccag

SEQ ID NO: 947503 - RNA, 23 nt, Human
aagcgauccaugauuauacccaa

SEQ ID NO: 947504 - RNA, 20 nt, Human
agcaggagggcguggcgagc

SEQ ID NO: 947505 - RNA, 20 nt, Human
caagcgauccaugauuauac

SEQ ID NO: 947506 - RNA, 22 nt, Human
ccuguagcugaagauugaggac

SEQ ID NO: 947507 - RNA, 20 nt, Human
ggcguggcgagcggggaaag

SEQ ID NO: 947508 - RNA, 22 nt, Human
guggcgagcggggaaagcaggg

SEQ ID NO: 947509 - RNA, 22 nt, Human
uccacucaaaguuacucauucc

SEQ ID NO: 947510 - RNA, 24 nt, Human
ugaggaaaugaggccggacggagg

SEQ ID NO: 947511 - RNA, 30 nt, Human
ugauuauacccacuauguuuguuucuucuu

SEQ ID NO: 947512 - RNA, 21 nt, Human
aaaaugccagaaaaaccugga

SEQ ID NO: 947513 - RNA, 24 nt, Human
aaacaaacgcauaugacauuuuac

SEQ ID NO: 947514 - RNA, 23 nt, Human
aaacagcacaaauguacguuacu

SEQ ID NO: 947515 - RNA, 19 nt, Human
aaaccuggaacagaaaaug

SEQ ID NO: 947516 - RNA, 19 nt, Human
aaagaaacauaauauccug

SEQ ID NO: 947517 - RNA, 20 nt, Human
aagcaggcgugggagcaggg

SEQ ID NO: 947518 - RNA, 25 nt, Human
acaccacgagguaaacgccgggacc

SEQ ID NO: 947519 - RNA, 18 nt, Human
acagacgaugugugcagc

SEQ ID NO: 947520 - RNA, 19 nt, Human
accaccacccccaacccgc

SEQ ID NO: 947521 - RNA, 18 nt, Human
accccaccaccaccccca

SEQ ID NO: 947522 - RNA, 20 nt, Human
accccaccaccacccccaac

SEQ ID NO: 947523 - RNA, 18 nt, Human
acucugaggagaggggug

SEQ ID NO: 947524 - RNA, 20 nt, Human
acucugaggagaggggugga

SEQ ID NO: 947525 - RNA, 19 nt, Human
acugcacccagagccuagg

SEQ ID NO: 947526 - RNA, 20 nt, Human
acugcacccagagccuagga

SEQ ID NO: 947527 - RNA, 23 nt, Human
agaaaaugccagaaaaaccugga

SEQ ID NO: 947528 - RNA, 21 nt, Human
agacaggagggagccucuugg

SEQ ID NO: 947529 - RNA, 22 nt, Human
agacggcccgcggcggccccgg

SEQ ID NO: 947530 - RNA, 23 nt, Human
agagaggaaggggaagaaaaggg

SEQ ID NO: 947531 - RNA, 19 nt, Human
agaggaaggggaagaaaag

SEQ ID NO: 947532 - RNA, 22 nt, Human
agaggaaggggaagaaaagggg

SEQ ID NO: 947533 - RNA, 23 nt, Human
agaggaaggggaagaaaagggga

SEQ ID NO: 947534 - RNA, 21 nt, Human
aggaaaugggucucgugcuga

SEQ ID NO: 947535 - RNA, 18 nt, Human
aggaaggggaagaaaagg

SEQ ID NO: 947536 - RNA, 18 nt, Human
aggaaggggaagaaaagg

SEQ ID NO: 947537 - RNA, 21 nt, Human
aggagggagccucuuggaggg

SEQ ID NO: 947538 - RNA, 23 nt, Human
aggcaaacacaccacgagguaaa

SEQ ID NO: 947539 - RNA, 19 nt, Human
agggagccucuuggagggc

SEQ ID NO: 947540 - RNA, 25 nt, Human
caaggcaaacacaccacgagguaaa

SEQ ID NO: 947541 - RNA, 21 nt, Human
cacaaaauugaaaacagcaca

SEQ ID NO: 947542 - RNA, 26 nt, Human
cacccaggcuguggccccuucagggc

SEQ ID NO: 947543 - RNA, 26 nt, Human
cacucaaucacccucuccaggggagc

SEQ ID NO: 947544 - RNA, 19 nt, Human
cagaaaaugccagaaaaac

SEQ ID NO: 947545 - RNA, 20 nt, Human
cagcaccccaccaccacccc

SEQ ID NO: 947546 - RNA, 19 nt, Human
cagccggggcaugaaaggc

SEQ ID NO: 947547 - RNA, 21 nt, Human
cagggcagcaugguacccguc

SEQ ID NO: 947548 - RNA, 19 nt, Human
ccacccaggcuguggcccc

SEQ ID NO: 947549 - RNA, 23 nt, Human
cccaccaccacccccaacccgcu

SEQ ID NO: 947550 - RNA, 19 nt, Human
cccaggucauaccuccugu

SEQ ID NO: 947551 - RNA, 24 nt, Human
ccccaccaccacccccaacccggu

SEQ ID NO: 947552 - RNA, 18 nt, Human
cccccaacccgcuagugc

SEQ ID NO: 947553 - RNA, 23 nt, Human
ccccgugcagaguuugugccucc

SEQ ID NO: 947554 - RNA, 22 nt, Human
ccgcacgcagcaucccagaccu

SEQ ID NO: 947555 - RNA, 18 nt, Human
ccgcagccggagccugag

SEQ ID NO: 947556 - RNA, 21 nt, Human
ccggugaucuccacacucaau

SEQ ID NO: 947557 - RNA, 19 nt, Human
ccugaggcugccagcaccc

SEQ ID NO: 947558 - RNA, 20 nt, Human
cgacccggagucuaggacac

SEQ ID NO: 947559 - RNA, 24 nt, Human
cgagcagggaccuuaagaagcagg

SEQ ID NO: 947560 - RNA, 19 nt, Human
cuaagacuuucccugaccc

SEQ ID NO: 947561 - RNA, 22 nt, Human
cuaagcagauacuacuguacuc

SEQ ID NO: 947562 - RNA, 23 nt, Human
cuacugcacccagagccuaggac

SEQ ID NO: 947563 - RNA, 26 nt, Human
cucacuacugcacccagaagguuuuc

SEQ ID NO: 947564 - RNA, 23 nt, Human
cuccacacucaaucacccucucc

SEQ ID NO: 947565 - RNA, 23 nt, Human
cucccucaucucuuaguucucag

SEQ ID NO: 947566 - RNA, 22 nt, Human
cuccugaggcugccagcacccc

SEQ ID NO: 947567 - RNA, 18 nt, Human
cucugggcucgcuaaaua

SEQ ID NO: 947568 - RNA, 21 nt, Human
cugaccccacccaggucauac

SEQ ID NO: 947569 - RNA, 20 nt, Human
cugccagcaccccaccacca

SEQ ID NO: 947570 - RNA, 23 nt, Human
cugccagcaccccaccaccaccc

SEQ ID NO: 947571 - RNA, 22 nt, Human
cuggagccgcagccggagccug

SEQ ID NO: 947572 - RNA, 20 nt, Human
cugggcucgcuaaauaggca

SEQ ID NO: 947573 - RNA, 24 nt, Human
gaaaaaagaaacauaauauccuga

SEQ ID NO: 947574 - RNA, 20 nt, Human
gaaaaugccagaaaaaccug

SEQ ID NO: 947575 - RNA, 23 nt, Human
gacuggcaaaaaugaaaaaagaa

SEQ ID NO: 947576 - RNA, 23 nt, Human
gagagaggaaggggaagaaaagg

SEQ ID NO: 947577 - RNA, 22 nt, Human
gagaggaaggggaagaaaaggg

SEQ ID NO: 947578 - RNA, 20 nt, Human
gagccgcagccggagccuga

SEQ ID NO: 947579 - RNA, 19 nt, Human
gagccugagccggacucug

SEQ ID NO: 947580 - RNA, 24 nt, Human
gccacagaggccuuucucgccccc

SEQ ID NO: 947581 - RNA, 18 nt, Human
gccagaaaaaccuggaac

SEQ ID NO: 947582 - RNA, 20 nt, Human
ggaacagaaaaugccagaaa

SEQ ID NO: 947583 - RNA, 20 nt, Human
ggaagaaaccuggaacagaa

SEQ ID NO: 947584 - RNA, 18 nt, Human
ggaggagaauaaagugcu

SEQ ID NO: 947585 - RNA, 23 nt, Human
ggaggagaauaaagugcucgugg

SEQ ID NO: 947586 - RNA, 21 nt, Human
ggccgagcagggaccuuaaga

SEQ ID NO: 947587 - RNA, 21 nt, Human
gggagagaggaaggggaagaa

SEQ ID NO: 947588 - RNA, 24 nt, Human
gucugccuuccacccaggcugugg

SEQ ID NO: 947589 - RNA, 25 nt, Human
guggagcagaggagcuuuauuagag

SEQ ID NO: 947590 - RNA, 21 nt, Human
uaaaacaaacgcauaugacca

SEQ ID NO: 947591 - RNA, 18 nt, Human
uaagacuuucccugaccc

SEQ ID NO: 947592 - RNA, 22 nt, Human
uacugcacccagagccuaggac

SEQ ID NO: 947593 - RNA, 22 nt, Human
uagcacaaaauugaaaacagca

SEQ ID NO: 947594 - RNA, 21 nt, Human
ucaagguggagcagaggagcu

SEQ ID NO: 947595 - RNA, 23 nt, Human
ucuccacacucaaucacccucuc

SEQ ID NO: 947596 - RNA, 20 nt, Human
ucuccaggggagcgaucgcu

SEQ ID NO: 947597 - RNA, 19 nt, Human
ucuuuucuuucuaaaccuu

SEQ ID NO: 947598 - RNA, 18 nt, Human
ugaaaacagcacaaaugu

SEQ ID NO: 947599 - RNA, 20 nt, Human
ugaaaacagcacaaauguaa

SEQ ID NO: 947600 - RNA, 20 nt, Human
ugaggagagggguggaagcc

SEQ ID NO: 947601 - RNA, 26 nt, Human
ugaggagagggguggaagccgggacu

SEQ ID NO: 947602 - RNA, 29 nt, Human
ugcagccggggcaugaaaggcccaaggcc

SEQ ID NO: 947603 - RNA, 18 nt, Human
ugccagcaccccaccacc

SEQ ID NO: 947604 - RNA, 25 nt, Human
ugcccugggcaaguguucuuuucuu

SEQ ID NO: 947605 - RNA, 26 nt, Human
ugccucccucaucucuuaguucucaa

SEQ ID NO: 947606 - RNA, 22 nt, Human
uggaacagaaaaugccagaaaa

SEQ ID NO: 947607 - RNA, 21 nt, Human
uggcaaaaaugaaaaaagaaa

SEQ ID NO: 947608 - RNA, 22 nt, Human
uugcacacacaguucccccgug

SEQ ID NO: 947609 - RNA, 21 nt, Human
aaacaguuccgccccaggaag

SEQ ID NO: 947610 - RNA, 22 nt, Human
aagcgauaaggguagggaggaa

SEQ ID NO: 947611 - RNA, 26 nt, Human
acccccccaccccacccuccacuggg

SEQ ID NO: 947612 - RNA, 19 nt, Human
agaggcuuagggcugcgac

SEQ ID NO: 947613 - RNA, 22 nt, Human
agggcugcgacccccccacccc

SEQ ID NO: 947614 - RNA, 23 nt, Human
cacauccuuccacagccagaccc

SEQ ID NO: 947615 - RNA, 18 nt, Human
cagccaacuuccagccag

SEQ ID NO: 947616 - RNA, 22 nt, Human
caggccgucugcacaaagcccu

SEQ ID NO: 947617 - RNA, 21 nt, Human
cauccuuccacagccagaccc

SEQ ID NO: 947618 - RNA, 18 nt, Human
cauuugaggccacacauc

SEQ ID NO: 947619 - RNA, 19 nt, Human
ccccagaggcucgguacag

SEQ ID NO: 947620 - RNA, 18 nt, Human
cccccaccccacccucca

SEQ ID NO: 947621 - RNA, 25 nt, Human
cccccaccccacccuccacugggac

SEQ ID NO: 947622 - RNA, 18 nt, Human
ccccccaccccacccucc

SEQ ID NO: 947623 - RNA, 25 nt, Human
ccccccaccccacccuccacuggga

SEQ ID NO: 947624 - RNA, 22 nt, Human
cccccccaccccacccuccacu

SEQ ID NO: 947625 - RNA, 23 nt, Human
cccccccaccccacccuccacug

SEQ ID NO: 947626 - RNA, 23 nt, Human
ccccuggcgagggcugugaaggc

SEQ ID NO: 947627 - RNA, 19 nt, Human
cccuaggucgccugggcuc

SEQ ID NO: 947628 - RNA, 18 nt, Human
ccugcccugaugcaggcc

SEQ ID NO: 947629 - RNA, 19 nt, Human
ccugggcucuguccuuucc

SEQ ID NO: 947630 - RNA, 22 nt, Human
cgacccccccaccccacccucc

SEQ ID NO: 947631 - RNA, 23 nt, Human
cgacccccccaccccacccucca

SEQ ID NO: 947632 - RNA, 23 nt, Human
cgucugcacaaagcccugggagc

SEQ ID NO: 947633 - RNA, 25 nt, Human
cugcgacccccccaccccacccucc

SEQ ID NO: 947634 - RNA, 19 nt, Human
cugcgacccccccaccccc

SEQ ID NO: 947635 - RNA, 25 nt, Human
cugggacggggaaaagcgaaacaac

SEQ ID NO: 947636 - RNA, 23 nt, Human
gacccccccaccccacccuccac

SEQ ID NO: 947637 - RNA, 20 nt, Human
gaggcggccuuuuuuuuuuu

SEQ ID NO: 947638 - RNA, 26 nt, Human
gcccuaggucgccugggcucuguccu

SEQ ID NO: 947639 - RNA, 21 nt, Human
gccugggcucuguccuuucca

SEQ ID NO: 947640 - RNA, 22 nt, Human
gcggccuuuuuuuuuuuuuuuu

SEQ ID NO: 947641 - RNA, 24 nt, Human
ggcggccuuuuuuuuuuuuuuuuu

SEQ ID NO: 947642 - RNA, 18 nt, Human
ggcugcgacccccccacc

SEQ ID NO: 947643 - RNA, 22 nt, Human
gguacagagacguagagaggga

SEQ ID NO: 947644 - RNA, 22 nt, Human
gguagggagauagugcccuagg

SEQ ID NO: 947645 - RNA, 19 nt, Human
uagggcggugugggcgggg

SEQ ID NO: 947646 - RNA, 18 nt, Human
ucccagaggcuuagggcu

SEQ ID NO: 947647 - RNA, 19 nt, Human
uggccgaggcggccuuuuu

SEQ ID NO: 947648 - RNA, 19 nt, Human
ugggcgggguagaagcgau

SEQ ID NO: 947649 - RNA, 23 nt, Human
ugggcucuguccuuuccaccccc

SEQ ID NO: 947650 - RNA, 22 nt, Human
ugggcugagaccccguccugcc

SEQ ID NO: 947651 - RNA, 23 nt, Human
uuuuuuuuuuuuuuguauuacgg

SEQ ID NO: 947652 - RNA, 25 nt, Human
uuuuuuuuuuuuuuuguauuacggg

SEQ ID NO: 947653 - RNA, 18 nt, Human
uuuuuuuuuuuuuuuuug

SEQ ID NO: 947654 - RNA, 23 nt, Human
uuuuuuuuuuuuuuuuuuguauu

SEQ ID NO: 947655 - RNA, 19 nt, Human
aagcagaaugcuacauaug

SEQ ID NO: 947656 - RNA, 23 nt, Human
accuacaggcagauauuuaaaga

SEQ ID NO: 947657 - RNA, 21 nt, Human
agagagcgugaggaacucaaa

SEQ ID NO: 947658 - RNA, 19 nt, Human
agcugauugacaaaaucca

SEQ ID NO: 947659 - RNA, 19 nt, Human
cccgagggaccggaggaaa

SEQ ID NO: 947660 - RNA, 22 nt, Human
cgagguaagaaccaucagcguc

SEQ ID NO: 947661 - RNA, 21 nt, Human
cggaggaaaaaaagaaggaga

SEQ ID NO: 947662 - RNA, 24 nt, Human
cgucgggcuggcugcugguccucc

SEQ ID NO: 947663 - RNA, 18 nt, Human
cgugucaggugcuugcuc

SEQ ID NO: 947664 - RNA, 23 nt, Human
cucuaaaacugugucaaagcaaa

SEQ ID NO: 947665 - RNA, 22 nt, Human
gcagagcuugcuuuuaccuaca

SEQ ID NO: 947666 - RNA, 18 nt, Human
ggaaaaaaagaaggagaa

SEQ ID NO: 947667 - RNA, 18 nt, Human
uaaagagagagagacaca

SEQ ID NO: 947668 - RNA, 18 nt, Human
uaaagagagagagacaca

SEQ ID NO: 947669 - RNA, 24 nt, Human
uauuuaaagagagagagacacauu

SEQ ID NO: 947670 - RNA, 21 nt, Human
ugaggaacucaaaagcaaaga

SEQ ID NO: 947671 - RNA, 23 nt, Human
ugauugacaaaauccauccaacu

SEQ ID NO: 947672 - RNA, 18 nt, Human
uuuuuuuuuuuuuuuuug

SEQ ID NO: 947673 - RNA, 21 nt, Human
uuuuuuuuuuuuuuuuugagg

SEQ ID NO: 947674 - RNA, 21 nt, Human
aaacaaguaucagacaaaggu

SEQ ID NO: 947675 - RNA, 18 nt, Human
acaggacagggcccuggg

SEQ ID NO: 947676 - RNA, 23 nt, Human
acagggcccuggguggggcuugc

SEQ ID NO: 947677 - RNA, 18 nt, Human
agacaaaggugguggcag

SEQ ID NO: 947678 - RNA, 20 nt, Human
aggcaaggcacgcacauccc

SEQ ID NO: 947679 - RNA, 21 nt, Human
aggcacgcacauccccaguga

SEQ ID NO: 947680 - RNA, 20 nt, Human
cagcaggcucagggucuccc

SEQ ID NO: 947681 - RNA, 25 nt, Human
cccccagcuucccuggaaacaagua

SEQ ID NO: 947682 - RNA, 19 nt, Human
ccgaaugacccuucuggcc

SEQ ID NO: 947683 - RNA, 23 nt, Human
cuucaggaagagaauccaguccc

SEQ ID NO: 947684 - RNA, 19 nt, Human
gcaguucccccagcuuccc

SEQ ID NO: 947685 - RNA, 19 nt, Human
ucagacaaaggugguggca

SEQ ID NO: 947686 - RNA, 23 nt, Human
ucagggucucccgccccgaauga

SEQ ID NO: 947687 - RNA, 22 nt, Human
ucaucuuuauuccaguuccuca

SEQ ID NO: 947688 - RNA, 23 nt, Human
uccaguuccucagauguggcagu

SEQ ID NO: 947689 - RNA, 25 nt, Human
ucccuggaaacaaguaucagacaaa

SEQ ID NO: 947690 - RNA, 25 nt, Human
uggaaacaaguaucagacaaaggug

SEQ ID NO: 947691 - RNA, 21 nt, Human
uuuauuccaguuccucagaug

SEQ ID NO: 947692 - RNA, 21 nt, Human
aaggcccuguuuucccugagg

SEQ ID NO: 947693 - RNA, 21 nt, Human
acccugaguggcacggggagc

SEQ ID NO: 947694 - RNA, 26 nt, Human
acccugaguggcacggggagcagcug

SEQ ID NO: 947695 - RNA, 18 nt, Human
agaccgaggauggggugg

SEQ ID NO: 947696 - RNA, 18 nt, Human
agaugcuggguccacccu

SEQ ID NO: 947697 - RNA, 21 nt, Human
aggcaguggcggggcggggac

SEQ ID NO: 947698 - RNA, 19 nt, Human
aggugcuccugagaugcug

SEQ ID NO: 947699 - RNA, 19 nt, Human
aguggcggggcggggaccu

SEQ ID NO: 947700 - RNA, 19 nt, Human
aucgcuggcuuucaccucu

SEQ ID NO: 947701 - RNA, 19 nt, Human
auggaauggcccauguccc

SEQ ID NO: 947702 - RNA, 18 nt, Human
cacccugaguggcacggg

SEQ ID NO: 947703 - RNA, 21 nt, Human
cagagcucagcguucucuaag

SEQ ID NO: 947704 - RNA, 19 nt, Human
ccacacgauggcuccugca

SEQ ID NO: 947705 - RNA, 23 nt, Human
ccccucugccgccauccccggac

SEQ ID NO: 947706 - RNA, 21 nt, Human
cccucugccgccauccccgga

SEQ ID NO: 947707 - RNA, 20 nt, Human
cccugagggggcccaggccu

SEQ ID NO: 947708 - RNA, 23 nt, Human
ccucucggaaacgcggcgucugg

SEQ ID NO: 947709 - RNA, 18 nt, Human
ccuuggggaggcaggcug

SEQ ID NO: 947710 - RNA, 19 nt, Human
cgggcacagagcugcgggg

SEQ ID NO: 947711 - RNA, 23 nt, Human
cucauggggaauggccugaggag

SEQ ID NO: 947712 - RNA, 21 nt, Human
cucuggugcagggguggaggc

SEQ ID NO: 947713 - RNA, 23 nt, Human
cugaggcggggcugggcuugucc

SEQ ID NO: 947714 - RNA, 21 nt, Human
cugccccuggcuucaucgcuu

SEQ ID NO: 947715 - RNA, 23 nt, Human
cugggaggggcagugggaagguu

SEQ ID NO: 947716 - RNA, 22 nt, Human
cugggcacgucauggaauggcc

SEQ ID NO: 947717 - RNA, 18 nt, Human
cuugccgggcacagagcu

SEQ ID NO: 947718 - RNA, 21 nt, Human
gagccucaguuucccuuuccg

SEQ ID NO: 947719 - RNA, 19 nt, Human
gagcuggccgugcuuggcg

SEQ ID NO: 947720 - RNA, 21 nt, Human
gaggcaggcugagcugguccc

SEQ ID NO: 947721 - RNA, 20 nt, Human
gauggcuccugcaaucugcc

SEQ ID NO: 947722 - RNA, 19 nt, Human
gcagugggaagguucuucu

SEQ ID NO: 947723 - RNA, 20 nt, Human
gccaguccuggggaaacuaa

SEQ ID NO: 947724 - RNA, 24 nt, Human
gccugggcacgucauggaauggcc

SEQ ID NO: 947725 - RNA, 22 nt, Human
gcgcccuggcgugugucuagcu

SEQ ID NO: 947726 - RNA, 21 nt, Human
gcuuggcgcccuggcgugugu

SEQ ID NO: 947727 - RNA, 20 nt, Human
ggagcagcuguggccggugc

SEQ ID NO: 947728 - RNA, 19 nt, Human
ggccggugcuccuuccuag

SEQ ID NO: 947729 - RNA, 19 nt, Human
gggaggggcagugggaagg

SEQ ID NO: 947730 - RNA, 22 nt, Human
gggaggggcagugggaagguuc

SEQ ID NO: 947731 - RNA, 23 nt, Human
gggcggggaccugcugcaaggga

SEQ ID NO: 947732 - RNA, 19 nt, Human
gggcugggcuuguccaugg

SEQ ID NO: 947733 - RNA, 19 nt, Human
ggggcgggacuggggguug

SEQ ID NO: 947734 - RNA, 19 nt, Human
ggggcugggcuuguccaug

SEQ ID NO: 947735 - RNA, 24 nt, Human
ggggguuguuuggcuguccugggc

SEQ ID NO: 947736 - RNA, 24 nt, Human
gggucgaggccaguugucgagaga

SEQ ID NO: 947737 - RNA, 24 nt, Human
gggugggugugggggacucauggg

SEQ ID NO: 947738 - RNA, 20 nt, Human
gucugggaggggcaguggga

SEQ ID NO: 947739 - RNA, 21 nt, Human
gugcagggguggaggccuguc

SEQ ID NO: 947740 - RNA, 19 nt, Human
gugggggacucauggggaa

SEQ ID NO: 947741 - RNA, 18 nt, Human
uaagagcaggcucuggug

SEQ ID NO: 947742 - RNA, 20 nt, Human
uccccacacgauggcuccug

SEQ ID NO: 947743 - RNA, 24 nt, Human
ucccccucugccgccauccccgga

SEQ ID NO: 947744 - RNA, 25 nt, Human
ucccccucugccgccauccccggac

SEQ ID NO: 947745 - RNA, 20 nt, Human
ucccugaggcggggcugggc

SEQ ID NO: 947746 - RNA, 23 nt, Human
ucccugaggcggggcugggguac

SEQ ID NO: 947747 - RNA, 19 nt, Human
ucccugagggggcccaggc

SEQ ID NO: 947748 - RNA, 21 nt, Human
ucccugagggggcccaggccu

SEQ ID NO: 947749 - RNA, 25 nt, Human
ucccugagggggcccaggccugcag

SEQ ID NO: 947750 - RNA, 22 nt, Human
ucccuuggggaggcaggcugag

SEQ ID NO: 947751 - RNA, 18 nt, Human
uccguuuuuuccuggggg

SEQ ID NO: 947752 - RNA, 18 nt, Human
uccuguagggaaaggccc

SEQ ID NO: 947753 - RNA, 24 nt, Human
ucugcugcguggacgucgcggucg

SEQ ID NO: 947754 - RNA, 25 nt, Human
ucuucgcaggcaguggcggggcggg

SEQ ID NO: 947755 - RNA, 21 nt, Human
ugagccucaguuucccuuucc

SEQ ID NO: 947756 - RNA, 21 nt, Human
ugcaagggacuggaggcugcc

SEQ ID NO: 947757 - RNA, 19 nt, Human
ugccccuggcuucaucgcu

SEQ ID NO: 947758 - RNA, 24 nt, Human
ugcugcguggacgucgcggucgga

SEQ ID NO: 947759 - RNA, 26 nt, Human
uggccugggcacgucauggaauggcc

SEQ ID NO: 947760 - RNA, 20 nt, Human
uggcuccugcaaucugccuc

SEQ ID NO: 947761 - RNA, 24 nt, Human
ugggaggggcagugggaagguucu

SEQ ID NO: 947762 - RNA, 18 nt, Human
ugggagggucgaggccag

SEQ ID NO: 947763 - RNA, 24 nt, Human
ugggagucucucgcaggucaucau

SEQ ID NO: 947764 - RNA, 19 nt, Human
uggggaaacuaagcucggg

SEQ ID NO: 947765 - RNA, 23 nt, Human
uggggaggcaggcugagcugguc

SEQ ID NO: 947766 - RNA, 24 nt, Human
uggggaggcaggcugagcuggucc

SEQ ID NO: 947767 - RNA, 19 nt, Human
uggggggcgggacuggggg

SEQ ID NO: 947768 - RNA, 22 nt, Human
ugggggugaggggaggcgcccc

SEQ ID NO: 947769 - RNA, 18 nt, Human
ugggguggguguggggga

SEQ ID NO: 947770 - RNA, 20 nt, Human
uggggugggugugggggacu

SEQ ID NO: 947771 - RNA, 21 nt, Human
uggggugggugugggggacuc

SEQ ID NO: 947772 - RNA, 26 nt, Human
uggggugggugugggggacucauggg

SEQ ID NO: 947773 - RNA, 20 nt, Human
uggucuucuaaggacacccu

SEQ ID NO: 947774 - RNA, 19 nt, Human
uggugcagggguggaggcc

SEQ ID NO: 947775 - RNA, 21 nt, Human
uguccugggcagcucuggcau

SEQ ID NO: 947776 - RNA, 21 nt, Human
uugccgggcacagagcugcgg

SEQ ID NO: 947777 - RNA, 19 nt, Human
uugcuccgugcucucccgg

SEQ ID NO: 947778 - RNA, 20 nt, Human
uuucacaacuguccugcgac

SEQ ID NO: 947779 - RNA, 21 nt, Human
uuuuuuuuuuucaaaagggcu

SEQ ID NO: 947780 - RNA, 21 nt, Human
uuuuuuuuuuuuucaaaaggg

SEQ ID NO: 947781 - RNA, 24 nt, Human
uuuuuuuuuuuuuuuucaaaaggg

SEQ ID NO: 947782 - RNA, 19 nt, Human
aaaauucaugucaaaaagg

SEQ ID NO: 947783 - RNA, 18 nt, Human
aaacaugcccaucagcac

SEQ ID NO: 947784 - RNA, 23 nt, Human
aaaccaaauaccaugucagaaaa

SEQ ID NO: 947785 - RNA, 20 nt, Human
aaaggaagaggggaauggag

SEQ ID NO: 947786 - RNA, 21 nt, Human
aaaguaacagauacccaaaac

SEQ ID NO: 947787 - RNA, 21 nt, Human
aacaugcccaucagcacaaaa

SEQ ID NO: 947788 - RNA, 22 nt, Human
aacuggacaugguggauaaauu

SEQ ID NO: 947789 - RNA, 22 nt, Human
aagccuucaaguucaacaaucc

SEQ ID NO: 947790 - RNA, 24 nt, Human
aagcgacaauaaagccggcggagc

SEQ ID NO: 947791 - RNA, 20 nt, Human
aauaaagaggcaaacaagaa

SEQ ID NO: 947792 - RNA, 21 nt, Human
accaaauaccaugucagaaaa

SEQ ID NO: 947793 - RNA, 20 nt, Human
acccaaaaccaaauaccaug

SEQ ID NO: 947794 - RNA, 18 nt, Human
acgccgccgccggcuucg

SEQ ID NO: 947795 - RNA, 23 nt, Human
acgccgccgccggcuucgcaggc

SEQ ID NO: 947796 - RNA, 18 nt, Human
agaagggggcgggcggcg

SEQ ID NO: 947797 - RNA, 23 nt, Human
agauacccaaaaccaaauacccc

SEQ ID NO: 947798 - RNA, 21 nt, Human
agauauccuuccuccgcgcgc

SEQ ID NO: 947799 - RNA, 20 nt, Human
aggcuuugacccuacaguuu

SEQ ID NO: 947800 - RNA, 27 nt, Human
aguaaccauuuaucagauuagagcagc

SEQ ID NO: 947801 - RNA, 20 nt, Human
auaguacacuggcaaaaaua

SEQ ID NO: 947802 - RNA, 28 nt, Human
augcagcauccuugaggagucgaaacuc

SEQ ID NO: 947803 - RNA, 21 nt, Human
caaaguaacagauacccaaaa

SEQ ID NO: 947804 - RNA, 22 nt, Human
caaauaggacugagguauagua

SEQ ID NO: 947805 - RNA, 24 nt, Human
cagaaaauaucauauaguaaccau

SEQ ID NO: 947806 - RNA, 21 nt, Human
ccaaacuggacaugguggaua

SEQ ID NO: 947807 - RNA, 21 nt, Human
ccaaaguaacagauacccaaa

SEQ ID NO: 947808 - RNA, 23 nt, Human
ccaaaguaacagauacccaaaac

SEQ ID NO: 947809 - RNA, 23 nt, Human
ccauuuaucagauuagagcagca

SEQ ID NO: 947810 - RNA, 18 nt, Human
ccccucacugaaaaucug

SEQ ID NO: 947811 - RNA, 23 nt, Human
ccccucuuuaaagccgcgcgcgc

SEQ ID NO: 947812 - RNA, 23 nt, Human
cccggcagcccggcucgcgcucg

SEQ ID NO: 947813 - RNA, 26 nt, Human
cccuccgcugcccccucuuuaaagcc

SEQ ID NO: 947814 - RNA, 20 nt, Human
cccucugucucgcccccgcc

SEQ ID NO: 947815 - RNA, 28 nt, Human
ccgccgccgccgccgcccggugccccgg

SEQ ID NO: 947816 - RNA, 21 nt, Human
ccgccgcgcuccgggcagcgu

SEQ ID NO: 947817 - RNA, 23 nt, Human
ccgccgcgcuccgggcagcgucc

SEQ ID NO: 947818 - RNA, 18 nt, Human
ccgcgcgcgcacacaccg

SEQ ID NO: 947819 - RNA, 21 nt, Human
ccgcugccgcugccgcugccg

SEQ ID NO: 947820 - RNA, 22 nt, Human
ccuccacccccgccccgccgcg

SEQ ID NO: 947821 - RNA, 22 nt, Human
ccugagugguuugauggacaga

SEQ ID NO: 947822 - RNA, 19 nt, Human
cgagcgaggccuucgaagu

SEQ ID NO: 947823 - RNA, 19 nt, Human
cgccacauaacgaagcgac

SEQ ID NO: 947824 - RNA, 26 nt, Human
cgcccccgcccccggcguuccggucu

SEQ ID NO: 947825 - RNA, 22 nt, Human
cgcccucucgcccggcagcccg

SEQ ID NO: 947826 - RNA, 24 nt, Human
cgcccucucgcccggcagcccggc

SEQ ID NO: 947827 - RNA, 19 nt, Human
cgccgccgccgccgccgcc

SEQ ID NO: 947828 - RNA, 20 nt, Human
cgccgccgccgccgccgccc

SEQ ID NO: 947829 - RNA, 22 nt, Human
cgcgccgccgccgccgccgccc

SEQ ID NO: 947830 - RNA, 20 nt, Human
cggggagacccuccgcugcc

SEQ ID NO: 947831 - RNA, 24 nt, Human
cgggucugcugcacgcguccgcug

SEQ ID NO: 947832 - RNA, 20 nt, Human
cuaguacaaacuagccugag

SEQ ID NO: 947833 - RNA, 21 nt, Human
cucccgggucugcugcacgcg

SEQ ID NO: 947834 - RNA, 21 nt, Human
cucgcggggcucggccucgcc

SEQ ID NO: 947835 - RNA, 24 nt, Human
cucggccucgcccucucgcccggc

SEQ ID NO: 947836 - RNA, 23 nt, Human
cucguccuccacccccgccccgc

SEQ ID NO: 947837 - RNA, 19 nt, Human
cugcccccucuuuaaagcc

SEQ ID NO: 947838 - RNA, 22 nt, Human
cugccgcugccgggccgacgcc

SEQ ID NO: 947839 - RNA, 25 nt, Human
cugccgggccgacgccuccgaccgc

SEQ ID NO: 947840 - RNA, 22 nt, Human
cuggcaaaaauaaagaggcaaa

SEQ ID NO: 947841 - RNA, 21 nt, Human
gaaaaagccccucacugaaaa

SEQ ID NO: 947842 - RNA, 21 nt, Human
gaccgcucucucguccuccac

SEQ ID NO: 947843 - RNA, 20 nt, Human
gagcagcggagugcggggag

SEQ ID NO: 947844 - RNA, 26 nt, Human
gagccugcagcgagcgaggccuucga

SEQ ID NO: 947845 - RNA, 20 nt, Human
gagugguuugauggacagag

SEQ ID NO: 947846 - RNA, 25 nt, Human
gcagcagaagaaaguuacuucuaaa

SEQ ID NO: 947847 - RNA, 20 nt, Human
gccaaaguaacagauaccca

SEQ ID NO: 947848 - RNA, 22 nt, Human
gccccgccgcgcuccgggcagc

SEQ ID NO: 947849 - RNA, 21 nt, Human
gcccucucgcccggcagcccg

SEQ ID NO: 947850 - RNA, 18 nt, Human
gcuaaccaaacuggacau

SEQ ID NO: 947851 - RNA, 21 nt, Human
gcucgcgcacggccucgggcc

SEQ ID NO: 947852 - RNA, 20 nt, Human
guggauaaauuauaaaacaa

SEQ ID NO: 947853 - RNA, 23 nt, Human
uaaaaauagaaacaaaacucuac

SEQ ID NO: 947854 - RNA, 23 nt, Human
uaaaguagcacaugaauguaagc

SEQ ID NO: 947855 - RNA, 18 nt, Human
uaacagauacccaaaacc

SEQ ID NO: 947856 - RNA, 21 nt, Human
uaacagauacccaaaaccaaa

SEQ ID NO: 947857 - RNA, 24 nt, Human
uaacagauacccaaaaccaaauac

SEQ ID NO: 947858 - RNA, 20 nt, Human
uaacgaagcgacaauaaagc

SEQ ID NO: 947859 - RNA, 28 nt, Human
uaacgaagcgacaauaaagccggcggag

SEQ ID NO: 947860 - RNA, 19 nt, Human
uaagacuagaagagacuug

SEQ ID NO: 947861 - RNA, 22 nt, Human
uacacuggcaaaaauaaagagg

SEQ ID NO: 947862 - RNA, 20 nt, Human
ucaaguucaacaauccaaau

SEQ ID NO: 947863 - RNA, 23 nt, Human
ucauaacaucauucuucauuugu

SEQ ID NO: 947864 - RNA, 19 nt, Human
ucauucuucauuugugaag

SEQ ID NO: 947865 - RNA, 22 nt, Human
ucccgggucugcugcacgcguc

SEQ ID NO: 947866 - RNA, 21 nt, Human
uccgcugccgcugccgcugcc

SEQ ID NO: 947867 - RNA, 18 nt, Human
ugcaaauauaaaaaaaaa

SEQ ID NO: 947868 - RNA, 19 nt, Human
ugccaaaguaacagauacc

SEQ ID NO: 947869 - RNA, 22 nt, Human
ugccccggcucgcgcacggccu

SEQ ID NO: 947870 - RNA, 18 nt, Human
ugcggggagacccuccgc

SEQ ID NO: 947871 - RNA, 19 nt, Human
uggacagagugauuggguc

SEQ ID NO: 947872 - RNA, 21 nt, Human
uggacagagugauugggucaa

SEQ ID NO: 947873 - RNA, 24 nt, Human
uggcaaaaauaaagaggcaaacaa

SEQ ID NO: 947874 - RNA, 25 nt, Human
uggcaaaaauaaagaggcaaacaag

SEQ ID NO: 947875 - RNA, 23 nt, Human
ugucaaaaaggaagaggggaaug

SEQ ID NO: 947876 - RNA, 21 nt, Human
ugucucgcccccgcccccggc

SEQ ID NO: 947877 - RNA, 18 nt, Human
aaauucagaaaugcuucc

SEQ ID NO: 947878 - RNA, 18 nt, Human
aacccuugcagaaaacac

SEQ ID NO: 947879 - RNA, 20 nt, Human
aaccuggccaagcuacccgg

SEQ ID NO: 947880 - RNA, 18 nt, Human
aagaagaaaugguuggug

SEQ ID NO: 947881 - RNA, 26 nt, Human
agaaaacacugaugcccaacacacug

SEQ ID NO: 947882 - RNA, 19 nt, Human
agacuugaaaugccauuga

SEQ ID NO: 947883 - RNA, 19 nt, Human
caaguuccaaggggcuggg

SEQ ID NO: 947884 - RNA, 23 nt, Human
cacaacccuugcagaaaacacug

SEQ ID NO: 947885 - RNA, 21 nt, Human
cacaaccuggccaagcuaccc

SEQ ID NO: 947886 - RNA, 21 nt, Human
cagcuccacuuggcaaauaau

SEQ ID NO: 947887 - RNA, 20 nt, Human
caggcucagcggcccggucc

SEQ ID NO: 947888 - RNA, 21 nt, Human
cccgucgcgccgcccgggccg

SEQ ID NO: 947889 - RNA, 18 nt, Human
ccgcccgggccgggccug

SEQ ID NO: 947890 - RNA, 25 nt, Human
ccgucgcgccgcccgggccgggccu

SEQ ID NO: 947891 - RNA, 19 nt, Human
ccucccgucgcgccgcccg

SEQ ID NO: 947892 - RNA, 18 nt, Human
ccuggggcgcgcgggcug

SEQ ID NO: 947893 - RNA, 18 nt, Human
ccugugcuguaaucaaga

SEQ ID NO: 947894 - RNA, 19 nt, Human
cugcgguuccucacaaccu

SEQ ID NO: 947895 - RNA, 19 nt, Human
cuugcagaaaacacugaug

SEQ ID NO: 947896 - RNA, 19 nt, Human
gccgcccgggccgggccug

SEQ ID NO: 947897 - RNA, 20 nt, Human
gcgggcugagccaaagggua

SEQ ID NO: 947898 - RNA, 25 nt, Human
ggcggcugcaggcucagcggcccgg

SEQ ID NO: 947899 - RNA, 22 nt, Human
gggcggcugcaggcucagcggc

SEQ ID NO: 947900 - RNA, 19 nt, Human
ggucuuccaaguuccaagg

SEQ ID NO: 947901 - RNA, 21 nt, Human
gucgcgccgcccgggccgggc

SEQ ID NO: 947902 - RNA, 18 nt, Human
uaaaugacagcuccacuu

SEQ ID NO: 947903 - RNA, 22 nt, Human
uaaaugacagcuccacuuggca

SEQ ID NO: 947904 - RNA, 22 nt, Human
ucacaacccuugcagaaaacac

SEQ ID NO: 947905 - RNA, 23 nt, Human
uccaaguuccaaggggcuggggu

SEQ ID NO: 947906 - RNA, 23 nt, Human
ucuacacccgauggagaaucgag

SEQ ID NO: 947907 - RNA, 23 nt, Human
ucuuccaaguuccaaggggcugg

SEQ ID NO: 947908 - RNA, 18 nt, Human
uggggcgcgcgggcugag

SEQ ID NO: 947909 - RNA, 19 nt, Human
uggggcgcgcgggcugagc

SEQ ID NO: 947910 - RNA, 24 nt, Human
ugugcuauggaccacgcacauaca

SEQ ID NO: 947911 - RNA, 18 nt, Human
uuaaaugacagcuccacu

SEQ ID NO: 947912 - RNA, 22 nt, Human
uuccccaacgaucaaguuccug

SEQ ID NO: 947913 - RNA, 25 nt, Human
aaacucaccagcaacuuccccucag

SEQ ID NO: 947914 - RNA, 20 nt, Human
aacagaacaaggcccaauag

SEQ ID NO: 947915 - RNA, 24 nt, Human
aacuuccccucagcuggcccucca

SEQ ID NO: 947916 - RNA, 24 nt, Human
aagcagaggccaggugucauaugg

SEQ ID NO: 947917 - RNA, 20 nt, Human
aaggaaggauuucuaacaau

SEQ ID NO: 947918 - RNA, 22 nt, Human
acacagugcugcugacagccag

SEQ ID NO: 947919 - RNA, 18 nt, Human
acaguaaaagacaggggc

SEQ ID NO: 947920 - RNA, 21 nt, Human
accacgaaggaccccagcccu

SEQ ID NO: 947921 - RNA, 21 nt, Human
acccagcucacuccccgcauc

SEQ ID NO: 947922 - RNA, 19 nt, Human
acggagccuuagcacacac

SEQ ID NO: 947923 - RNA, 24 nt, Human
acuuccccucagcuggcccuccau

SEQ ID NO: 947924 - RNA, 20 nt, Human
agacaagagccuggacacag

SEQ ID NO: 947925 - RNA, 22 nt, Human
agcucacuccccgcaucuucca

SEQ ID NO: 947926 - RNA, 19 nt, Human
aggcaggcacccccagccc

SEQ ID NO: 947927 - RNA, 27 nt, Human
aggggaagggagagguaagaguggcuu

SEQ ID NO: 947928 - RNA, 22 nt, Human
auccccucuaggauucccauug

SEQ ID NO: 947929 - RNA, 22 nt, Human
caacucugagaagcuggacaaa

SEQ ID NO: 947930 - RNA, 19 nt, Human
cacagcaacucugagaagc

SEQ ID NO: 947931 - RNA, 18 nt, Human
cagacaagagccuggaca

SEQ ID NO: 947932 - RNA, 21 nt, Human
cagacgggucucuccaagucu

SEQ ID NO: 947933 - RNA, 18 nt, Human
cagagggcuguaaggggc

SEQ ID NO: 947934 - RNA, 23 nt, Human
cagccaacacggccccgcccacc

SEQ ID NO: 947935 - RNA, 24 nt, Human
ccaagucugggugccuacgcaggg

SEQ ID NO: 947936 - RNA, 19 nt, Human
ccacccagcucacuccccg

SEQ ID NO: 947937 - RNA, 18 nt, Human
ccacgccugcuuccaaaa

SEQ ID NO: 947938 - RNA, 22 nt, Human
ccagcccacugcgacucccacc

SEQ ID NO: 947939 - RNA, 22 nt, Human
cccccagcccacugcgacuccc

SEQ ID NO: 947940 - RNA, 22 nt, Human
cccgcaucuuccauccccucua

SEQ ID NO: 947941 - RNA, 22 nt, Human
cccuacagugccuuaugcugcc

SEQ ID NO: 947942 - RNA, 24 nt, Human
cccuccaucaccaaugcggcaguc

SEQ ID NO: 947943 - RNA, 20 nt, Human
ccgugacaugcugagcugug

SEQ ID NO: 947944 - RNA, 19 nt, Human
ccucuagccagagggcugu

SEQ ID NO: 947945 - RNA, 27 nt, Human
ccucugcagaaaauguggccacugcuc

SEQ ID NO: 947946 - RNA, 21 nt, Human
ccucuugcugcuggcaaaggc

SEQ ID NO: 947947 - RNA, 21 nt, Human
ccuuaugcugcccucucccug

SEQ ID NO: 947948 - RNA, 22 nt, Human
ccuuaugcugcccucucccugu

SEQ ID NO: 947949 - RNA, 25 nt, Human
cucccaccacgaaggaccccagccc

SEQ ID NO: 947950 - RNA, 18 nt, Human
cuggaggccggcgucccu

SEQ ID NO: 947951 - RNA, 20 nt, Human
cuugcugcuggcaaaggccc

SEQ ID NO: 947952 - RNA, 18 nt, Human
gaaggaggggcugcggug

SEQ ID NO: 947953 - RNA, 24 nt, Human
gaaguuccugucaccuaagugcuc

SEQ ID NO: 947954 - RNA, 20 nt, Human
gaguaaaugccuugggaucu

SEQ ID NO: 947955 - RNA, 20 nt, Human
gcaggugggaggggaaggga

SEQ ID NO: 947956 - RNA, 18 nt, Human
gccucaggaggugcggaa

SEQ ID NO: 947957 - RNA, 21 nt, Human
gccugcuuccaaaaaugaucu

SEQ ID NO: 947958 - RNA, 19 nt, Human
gccuuaugcugcccucucc

SEQ ID NO: 947959 - RNA, 19 nt, Human
gcugagcuguggaaggagc

SEQ ID NO: 947960 - RNA, 18 nt, Human
ggaagggagagguaagag

SEQ ID NO: 947961 - RNA, 19 nt, Human
ggaccccagcccucucuca

SEQ ID NO: 947962 - RNA, 22 nt, Human
ggaguaaaugccuugggaucug

SEQ ID NO: 947963 - RNA, 22 nt, Human
ggauucccauuguccccuacuc

SEQ ID NO: 947964 - RNA, 18 nt, Human
ggcaggugggaggggaag

SEQ ID NO: 947965 - RNA, 20 nt, Human
ggccagcagguucuccaagc

SEQ ID NO: 947966 - RNA, 21 nt, Human
ggguucccuggccaccggggu

SEQ ID NO: 947967 - RNA, 19 nt, Human
gguucccuggccaccgggg

SEQ ID NO: 947968 - RNA, 18 nt, Human
guuccagagaacagaaca

SEQ ID NO: 947969 - RNA, 18 nt, Human
uaaagcgagacagaccaa

SEQ ID NO: 947970 - RNA, 24 nt, Human
uaacaauuagaaucauccagggcc

SEQ ID NO: 947971 - RNA, 18 nt, Human
uaaguaacuuacaguaaa

SEQ ID NO: 947972 - RNA, 21 nt, Human
uaagugcucaagcagaggccg

SEQ ID NO: 947973 - RNA, 24 nt, Human
uaccagaggauggagggcuuccuu

SEQ ID NO: 947974 - RNA, 24 nt, Human
uccaagcuguaucuagcccagagc

SEQ ID NO: 947975 - RNA, 23 nt, Human
uccccucagcuggcccuccauca

SEQ ID NO: 947976 - RNA, 21 nt, Human
ucccugugucugcuguuuccu

SEQ ID NO: 947977 - RNA, 25 nt, Human
ucuaacaauuagaaucauccagggc

SEQ ID NO: 947978 - RNA, 20 nt, Human
ucuagcccagagcauucauu

SEQ ID NO: 947979 - RNA, 21 nt, Human
ucuccaagucugggugccuac

SEQ ID NO: 947980 - RNA, 20 nt, Human
ucucgcuagcagggcccacc

SEQ ID NO: 947981 - RNA, 21 nt, Human
ucucucagccaacacggcccc

SEQ ID NO: 947982 - RNA, 21 nt, Human
ucucucgcuagcagggcccac

SEQ ID NO: 947983 - RNA, 19 nt, Human
ucuuugggaaggaagagga

SEQ ID NO: 947984 - RNA, 18 nt, Human
ugacaugcugagcugugg

SEQ ID NO: 947985 - RNA, 19 nt, Human
ugaccucucucgcuagcag

SEQ ID NO: 947986 - RNA, 22 nt, Human
ugcuggcaaaggcccaaguucu

SEQ ID NO: 947987 - RNA, 18 nt, Human
uggaaggagcgaaggagg

SEQ ID NO: 947988 - RNA, 20 nt, Human
uggaaggagcgaaggagggg

SEQ ID NO: 947989 - RNA, 23 nt, Human
uggaaggagcgaaggaggggcug

SEQ ID NO: 947990 - RNA, 19 nt, Human
uggaaguggguucccuggc

SEQ ID NO: 947991 - RNA, 18 nt, Human
ugggaggggcgacagaua

SEQ ID NO: 947992 - RNA, 24 nt, Human
uggguucccuggccaccgggguug

SEQ ID NO: 947993 - RNA, 18 nt, Human
uguccccuacuccagcac

SEQ ID NO: 947994 - RNA, 21 nt, Human
uuagcacacaccagcuggagg

SEQ ID NO: 947995 - RNA, 27 nt, Human
uuuuuuuuuucuaaaaccaaauguuua

SEQ ID NO: 947996 - RNA, 23 nt, Human
cccacgccagccgcugcuucucc

SEQ ID NO: 947997 - RNA, 26 nt, Human
cccugcacgagcgaggccggcaagac

SEQ ID NO: 947998 - RNA, 25 nt, Human
ccgggugugcccccugcugcggcgg

SEQ ID NO: 947999 - RNA, 21 nt, Human
cgcccagauacgccccugcac

SEQ ID NO: 948000 - RNA, 19 nt, Human
cgcccauuccccggauggc

SEQ ID NO: 948001 - RNA, 21 nt, Human
cgcccauuccccggauggcca

SEQ ID NO: 948002 - RNA, 24 nt, Human
cgcgcucaggcgcccagauacgcc

SEQ ID NO: 948003 - RNA, 23 nt, Human
cgcucaggcgcccagauacgccc

SEQ ID NO: 948004 - RNA, 22 nt, Human
cggcucccaaggcucccacgcc

SEQ ID NO: 948005 - RNA, 20 nt, Human
cgggugugcccccugcugcg

SEQ ID NO: 948006 - RNA, 23 nt, Human
uccccggauggcccacgccagcc

SEQ ID NO: 948007 - RNA, 20 nt, Human
ucuccgaaccagagcugacc

SEQ ID NO: 948008 - RNA, 23 nt, Human
aaacaaauacacaggauuugguc

SEQ ID NO: 948009 - RNA, 20 nt, Human
aaauccuucccaugcccucc

SEQ ID NO: 948010 - RNA, 19 nt, Human
aagaaacgcccaccaggcc

SEQ ID NO: 948011 - RNA, 23 nt, Human
aagccaaaaaaccacauaaguac

SEQ ID NO: 948012 - RNA, 23 nt, Human
agcaauuuaaucuuuuuguuuug

SEQ ID NO: 948013 - RNA, 19 nt, Human
cacccucaguccaagggcu

SEQ ID NO: 948014 - RNA, 20 nt, Human
caggggcggcgcggaggcgg

SEQ ID NO: 948015 - RNA, 19 nt, Human
ccaagcccgcaggggcggc

SEQ ID NO: 948016 - RNA, 19 nt, Human
ccccauuucccuccucucc

SEQ ID NO: 948017 - RNA, 20 nt, Human
ccccgccgcccccggcgccg

SEQ ID NO: 948018 - RNA, 20 nt, Human
ccugccaagcccgcaggggc

SEQ ID NO: 948019 - RNA, 21 nt, Human
ccuucccaugcccucccccca

SEQ ID NO: 948020 - RNA, 24 nt, Human
cgcagugcgggcgcgccgggcgcc

SEQ ID NO: 948021 - RNA, 22 nt, Human
cgcgccgggcgccugccaagcc

SEQ ID NO: 948022 - RNA, 22 nt, Human
cggccgagucuccggcgggaaa

SEQ ID NO: 948023 - RNA, 19 nt, Human
cggcuggcucggcgcgggg

SEQ ID NO: 948024 - RNA, 22 nt, Human
cgguaacaauauaucgguguua

SEQ ID NO: 948025 - RNA, 22 nt, Human
cguuugggguuccccgccgccc

SEQ ID NO: 948026 - RNA, 27 nt, Human
cuccccccaauuuuaaauaaauuaaaa

SEQ ID NO: 948027 - RNA, 19 nt, Human
cucggcggccccaucucgg

SEQ ID NO: 948028 - RNA, 18 nt, Human
gcagugcgggcgcgccgg

SEQ ID NO: 948029 - RNA, 19 nt, Human
gcgccugccaagcccgcag

SEQ ID NO: 948030 - RNA, 23 nt, Human
gcgcgcggacacaggacggacac

SEQ ID NO: 948031 - RNA, 21 nt, Human
gcgggcgcgccgggcgccugc

SEQ ID NO: 948032 - RNA, 23 nt, Human
gcggggaaggagucgggcagggg

SEQ ID NO: 948033 - RNA, 20 nt, Human
ggaaggagucgggcaggggg

SEQ ID NO: 948034 - RNA, 21 nt, Human
ggcagggggaugcaauagagg

SEQ ID NO: 948035 - RNA, 18 nt, Human
ggcgguugcauggcgagc

SEQ ID NO: 948036 - RNA, 23 nt, Human
gggcagggggaugcaauagaggg

SEQ ID NO: 948037 - RNA, 21 nt, Human
gguaacaauauaucgguguua

SEQ ID NO: 948038 - RNA, 18 nt, Human
uaaaagccaaaaaaccac

SEQ ID NO: 948039 - RNA, 25 nt, Human
ucagcgguaacaauauaucgguguu

SEQ ID NO: 948040 - RNA, 22 nt, Human
ucccacccucaguccaagggcu

SEQ ID NO: 948041 - RNA, 18 nt, Human
ucccaugcccucccccca

SEQ ID NO: 948042 - RNA, 18 nt, Human
ugcaauagaggggaaagg

SEQ ID NO: 948043 - RNA, 20 nt, Human
ugcaauagaggggaaagggc

SEQ ID NO: 948044 - RNA, 18 nt, Human
ugcggcgggcgccuacgc

SEQ ID NO: 948045 - RNA, 23 nt, Human
uugggguuccccgccgcccccgg

SEQ ID NO: 948046 - RNA, 21 nt, Human
aaccagcucaucuccagcccc

SEQ ID NO: 948047 - RNA, 19 nt, Human
aagcagaaauaauuuccaa

SEQ ID NO: 948048 - RNA, 18 nt, Human
acagcuucagcggccuca

SEQ ID NO: 948049 - RNA, 21 nt, Human
auacagauguugauuuacucu

SEQ ID NO: 948050 - RNA, 18 nt, Human
auauauguauauauagaa

SEQ ID NO: 948051 - RNA, 23 nt, Human
caaacaaauaguaaaacaacaua

SEQ ID NO: 948052 - RNA, 20 nt, Human
cagcggccucagcucagcuc

SEQ ID NO: 948053 - RNA, 20 nt, Human
cuacagcuucagcggccuca

SEQ ID NO: 948054 - RNA, 18 nt, Human
cuccagccccauccaucu

SEQ ID NO: 948055 - RNA, 22 nt, Human
cugugccccaaggccaaaccag

SEQ ID NO: 948056 - RNA, 21 nt, Human
cuucagcggccucagcucagc

SEQ ID NO: 948057 - RNA, 21 nt, Human
gaaaaaaaaauucugcaagga

SEQ ID NO: 948058 - RNA, 20 nt, Human
uaaauugguaacagugcuua

SEQ ID NO: 948059 - RNA, 21 nt, Human
uaccgcacggcagcaucagca

SEQ ID NO: 948060 - RNA, 19 nt, Human
uauauagaaaaaaaaauuc

SEQ ID NO: 948061 - RNA, 24 nt, Human
ucauccuuuauuuugaucaaaaca

SEQ ID NO: 948062 - RNA, 18 nt, Human
ucuccagccccauccauc

SEQ ID NO: 948063 - RNA, 19 nt, Human
ucugcaaggacauaugcua

SEQ ID NO: 948064 - RNA, 20 nt, Human
ugccccaaggccaaaccagc

SEQ ID NO: 948065 - RNA, 20 nt, Human
ugccuccagagacaaugauu

SEQ ID NO: 948066 - RNA, 18 nt, Human
aaaagcagacagugcucc

SEQ ID NO: 948067 - RNA, 21 nt, Human
acugcagguuacuggacugcu

SEQ ID NO: 948068 - RNA, 24 nt, Human
acugcaguucacagauaaacacuu

SEQ ID NO: 948069 - RNA, 18 nt, Human
agccaccucacaagccga

SEQ ID NO: 948070 - RNA, 18 nt, Human
aguucacagauaaacacu

SEQ ID NO: 948071 - RNA, 21 nt, Human
aucauacuuaacuaagagaca

SEQ ID NO: 948072 - RNA, 23 nt, Human
cagacagugcuccacuggguuaa

SEQ ID NO: 948073 - RNA, 21 nt, Human
caguucacagauaaacacuuc

SEQ ID NO: 948074 - RNA, 21 nt, Human
ccacuggguuaauaaaucaua

SEQ ID NO: 948075 - RNA, 18 nt, Human
ccuggguugccccgagga

SEQ ID NO: 948076 - RNA, 25 nt, Human
cgcccugcugcuccuacuggucaau

SEQ ID NO: 948077 - RNA, 22 nt, Human
cugcugcuccuacuggucagug

SEQ ID NO: 948078 - RNA, 21 nt, Human
guuaagugaaagagcaagcac

SEQ ID NO: 948079 - RNA, 26 nt, Human
uaacuaagagacaauacuuuaaauac

SEQ ID NO: 948080 - RNA, 21 nt, Human
uaccacaucauuaaaaacucc

SEQ ID NO: 948081 - RNA, 19 nt, Human
uggaacaccacagccgguc

SEQ ID NO: 948082 - RNA, 20 nt, Human
uucacagauaaacacuucac

SEQ ID NO: 948083 - RNA, 23 nt, Human
uuuuuugguagaacaaauucuaa

SEQ ID NO: 948084 - RNA, 24 nt, Human
uuuuuuuuugguagaacaaauucu

SEQ ID NO: 948085 - RNA, 22 nt, Human
aaaaauggagcacugaagagaa

SEQ ID NO: 948086 - RNA, 20 nt, Human
aaacuccaaacuccagccuc

SEQ ID NO: 948087 - RNA, 23 nt, Human
acccgggauccucucucuuugca

SEQ ID NO: 948088 - RNA, 19 nt, Human
accugcccugggggcuguc

SEQ ID NO: 948089 - RNA, 21 nt, Human
agaccucuggauccuuauucc

SEQ ID NO: 948090 - RNA, 26 nt, Human
agagaaacagaguuuggaccccugau

SEQ ID NO: 948091 - RNA, 23 nt, Human
agccuccaagcgggucaaacucc

SEQ ID NO: 948092 - RNA, 19 nt, Human
cacugaagagaaacagagu

SEQ ID NO: 948093 - RNA, 25 nt, Human
cagugacccuuccuccuauaugccc

SEQ ID NO: 948094 - RNA, 24 nt, Human
ccggagacagcagugacccuuccu

SEQ ID NO: 948095 - RNA, 25 nt, Human
ccuccuauaugcccgcugcugagag

SEQ ID NO: 948096 - RNA, 21 nt, Human
cugaacgagaccucuggaucc

SEQ ID NO: 948097 - RNA, 18 nt, Human
cugcugagagagccucca

SEQ ID NO: 948098 - RNA, 21 nt, Human
gauccucucucuuugcagcca

SEQ ID NO: 948099 - RNA, 18 nt, Human
ggagcacugaagagaaac

SEQ ID NO: 948100 - RNA, 19 nt, Human
uacccgggauccucucucu

SEQ ID NO: 948101 - RNA, 24 nt, Human
uacccgggauccucucucuuugca

SEQ ID NO: 948102 - RNA, 20 nt, Human
ucuaaggcacuaggaggugg

SEQ ID NO: 948103 - RNA, 19 nt, Human
ugaagagaaacagaguuug

SEQ ID NO: 948104 - RNA, 18 nt, Human
ugcccugggggcugucag

SEQ ID NO: 948105 - RNA, 19 nt, Human
ugcccugggggcugucagu

SEQ ID NO: 948106 - RNA, 24 nt, Human
ugguaaacaaaagcuuuauuauuu

SEQ ID NO: 948107 - RNA, 23 nt, Human
uuaaaaaaauggagcacugaaga

SEQ ID NO: 948108 - RNA, 24 nt, Human
uuuuuugguaaacaaaagcuuuau

SEQ ID NO: 948109 - RNA, 18 nt, Human
uuuuuuuuuuuuuuuuug

SEQ ID NO: 948110 - RNA, 18 nt, Human
uuuuuuuuuuuuuuuuug

SEQ ID NO: 948111 - RNA, 21 nt, Human
aaacaccacacugagcucaga

SEQ ID NO: 948112 - RNA, 18 nt, Human
aaagagcccguuccaaac

SEQ ID NO: 948113 - RNA, 22 nt, Human
aaagagcccguuccaaaccugc

SEQ ID NO: 948114 - RNA, 21 nt, Human
aaccccugugcaccaaacacc

SEQ ID NO: 948115 - RNA, 25 nt, Human
aaccccugugcaccaaacaccacac

SEQ ID NO: 948116 - RNA, 22 nt, Human
aaugccucugcccgacgguggg

SEQ ID NO: 948117 - RNA, 23 nt, Human
acagagcagugaggggcagagga

SEQ ID NO: 948118 - RNA, 19 nt, Human
accaaacaccacacugagc

SEQ ID NO: 948119 - RNA, 23 nt, Human
accuaagccuggagaaagagccc

SEQ ID NO: 948120 - RNA, 18 nt, Human
acgcccacgccaagacca

SEQ ID NO: 948121 - RNA, 20 nt, Human
acucgagcccagcagggacc

SEQ ID NO: 948122 - RNA, 22 nt, Human
agccaggagcccagguuguggc

SEQ ID NO: 948123 - RNA, 26 nt, Human
agcccagaacggcccuucccagcccc

SEQ ID NO: 948124 - RNA, 18 nt, Human
agccuaucccaaaaccug

SEQ ID NO: 948125 - RNA, 18 nt, Human
aggcagagugacaaugca

SEQ ID NO: 948126 - RNA, 19 nt, Human
aggcggugacguggcagag

SEQ ID NO: 948127 - RNA, 22 nt, Human
agggaccauuaggucucgggag

SEQ ID NO: 948128 - RNA, 18 nt, Human
aggguagguugggggcag

SEQ ID NO: 948129 - RNA, 21 nt, Human
agguuguggcaugggggacag

SEQ ID NO: 948130 - RNA, 23 nt, Human
augcugccuggcaccucgaggcc

SEQ ID NO: 948131 - RNA, 20 nt, Human
auuuggagucccuggagccc

SEQ ID NO: 948132 - RNA, 27 nt, Human
caaccccugugcaccaaacaccacacu

SEQ ID NO: 948133 - RNA, 21 nt, Human
caccaaacaccacacugagcu

SEQ ID NO: 948134 - RNA, 25 nt, Human
cacccccugccccagccccacggcu

SEQ ID NO: 948135 - RNA, 18 nt, Human
caccugugaucacggcug

SEQ ID NO: 948136 - RNA, 21 nt, Human
cacugagcucagaauccgggc

SEQ ID NO: 948137 - RNA, 19 nt, Human
cagagcagugaggggcaga

SEQ ID NO: 948138 - RNA, 23 nt, Human
cagauccuccccacagacccucc

SEQ ID NO: 948139 - RNA, 19 nt, Human
cagcacuaccaggcccggc

SEQ ID NO: 948140 - RNA, 24 nt, Human
cagcacuaccaggcccggcagcca

SEQ ID NO: 948141 - RNA, 19 nt, Human
caggcccggcagccagguc

SEQ ID NO: 948142 - RNA, 24 nt, Human
caguccccagggcgucagcugggg

SEQ ID NO: 948143 - RNA, 24 nt, Human
caucagucccacggccgcggugcg

SEQ ID NO: 948144 - RNA, 26 nt, Human
ccacgcccacgccaagaccaaccugc

SEQ ID NO: 948145 - RNA, 20 nt, Human
ccaggccaggugagcccaga

SEQ ID NO: 948146 - RNA, 19 nt, Human
ccaggcccccgaugccgug

SEQ ID NO: 948147 - RNA, 20 nt, Human
cccacagacccuccccucca

SEQ ID NO: 948148 - RNA, 20 nt, Human
cccacagauccuccccacag

SEQ ID NO: 948149 - RNA, 20 nt, Human
cccacgcccacgccaagacc

SEQ ID NO: 948150 - RNA, 28 nt, Human
cccacgcccacgccaagaccaaccugcu

SEQ ID NO: 948151 - RNA, 23 nt, Human
cccaggccaggugagcccagaac

SEQ ID NO: 948152 - RNA, 20 nt, Human
ccccacagacccuccccucc

SEQ ID NO: 948153 - RNA, 21 nt, Human
ccccacagacccuccccucca

SEQ ID NO: 948154 - RNA, 21 nt, Human
ccccacagauccuccccacag

SEQ ID NO: 948155 - RNA, 19 nt, Human
ccccaccucagcccuuccu

SEQ ID NO: 948156 - RNA, 27 nt, Human
ccccaccucagcccuuccucgcaggcc

SEQ ID NO: 948157 - RNA, 25 nt, Human
cccccagcccagcauacagagguac

SEQ ID NO: 948158 - RNA, 22 nt, Human
cccccugccccagccccacggc

SEQ ID NO: 948159 - RNA, 22 nt, Human
ccccugccccagccccacggcu

SEQ ID NO: 948160 - RNA, 21 nt, Human
cccgcaucagucccacggccg

SEQ ID NO: 948161 - RNA, 23 nt, Human
cccgcaucagucccacggccgcg

SEQ ID NO: 948162 - RNA, 20 nt, Human
cccgcgccccgcacaggccc

SEQ ID NO: 948163 - RNA, 23 nt, Human
cccgcgcgcuggcgacccagaga

SEQ ID NO: 948164 - RNA, 19 nt, Human
cccugccccagccccacgg

SEQ ID NO: 948165 - RNA, 22 nt, Human
cccuggagcccugcuguagccc

SEQ ID NO: 948166 - RNA, 20 nt, Human
ccgagccacgcgugggugcg

SEQ ID NO: 948167 - RNA, 19 nt, Human
ccgccccacccgggcuccg

SEQ ID NO: 948168 - RNA, 22 nt, Human
ccgcgcccacgcccacgccaag

SEQ ID NO: 948169 - RNA, 19 nt, Human
ccgcgccccgcacaggccc

SEQ ID NO: 948170 - RNA, 18 nt, Human
ccggccccaccucagccc

SEQ ID NO: 948171 - RNA, 22 nt, Human
ccggcgccggcuccagccgcgc

SEQ ID NO: 948172 - RNA, 20 nt, Human
ccgggcuccggugcgaagcc

SEQ ID NO: 948173 - RNA, 19 nt, Human
ccguaaaacugacgccccu

SEQ ID NO: 948174 - RNA, 21 nt, Human
cgacccagagacccuggaagc

SEQ ID NO: 948175 - RNA, 23 nt, Human
cgcaccgccccacccgggcuccg

SEQ ID NO: 948176 - RNA, 19 nt, Human
cgcaggccuggccggggca

SEQ ID NO: 948177 - RNA, 22 nt, Human
cgcaguccgcgcagacccgcgc

SEQ ID NO: 948178 - RNA, 23 nt, Human
cgccaagaccaaccugcugccgg

SEQ ID NO: 948179 - RNA, 20 nt, Human
cgcccccugccggccccacc

SEQ ID NO: 948180 - RNA, 23 nt, Human
cgcuugagagccggaagcuguuc

SEQ ID NO: 948181 - RNA, 25 nt, Human
cggaagcuguuccaggaggagggag

SEQ ID NO: 948182 - RNA, 19 nt, Human
cgggccugcagacucgagc

SEQ ID NO: 948183 - RNA, 18 nt, Human
cggugacguggcagagcu

SEQ ID NO: 948184 - RNA, 24 nt, Human
cucccaagcuggggucccggaggc

SEQ ID NO: 948185 - RNA, 22 nt, Human
cucccaggccaggugagcccag

SEQ ID NO: 948186 - RNA, 23 nt, Human
cucccgcgcccacgcccacgcca

SEQ ID NO: 948187 - RNA, 23 nt, Human
cucgcaggccuggccggggcaac

SEQ ID NO: 948188 - RNA, 20 nt, Human
cucgcuccccgcaguccgcg

SEQ ID NO: 948189 - RNA, 18 nt, Human
cugccccacagauccucc

SEQ ID NO: 948190 - RNA, 23 nt, Human
cuggggucccggaggcagaguga

SEQ ID NO: 948191 - RNA, 23 nt, Human
cuuggccauggccccugaccaac

SEQ ID NO: 948192 - RNA, 19 nt, Human
gaccauuaggucucgggag

SEQ ID NO: 948193 - RNA, 21 nt, Human
gacccagagacccuggaagcu

SEQ ID NO: 948194 - RNA, 20 nt, Human
gacgcucgcucgcccaucuc

SEQ ID NO: 948195 - RNA, 21 nt, Human
gacguggcagagcugccagca

SEQ ID NO: 948196 - RNA, 20 nt, Human
gagcagacgcucgcucgccc

SEQ ID NO: 948197 - RNA, 18 nt, Human
gagcccugcuguagccag

SEQ ID NO: 948198 - RNA, 19 nt, Human
gagcugccagcaggggccc

SEQ ID NO: 948199 - RNA, 19 nt, Human
gaggagggaggggccucgg

SEQ ID NO: 948200 - RNA, 22 nt, Human
gcacagagcagugaggggcaga

SEQ ID NO: 948201 - RNA, 18 nt, Human
gcacaggcccggugggca

SEQ ID NO: 948202 - RNA, 19 nt, Human
gcagcugacacccccugcc

SEQ ID NO: 948203 - RNA, 22 nt, Human
gcccacgcccacgccaagacca

SEQ ID NO: 948204 - RNA, 21 nt, Human
gcccccgaugccgugcccggc

SEQ ID NO: 948205 - RNA, 21 nt, Human
gcugcagcacuaccaggcccg

SEQ ID NO: 948206 - RNA, 20 nt, Human
ggcagagagggaaccacugg

SEQ ID NO: 948207 - RNA, 20 nt, Human
ggcaggaaggcccucgggau

SEQ ID NO: 948208 - RNA, 18 nt, Human
ggcaggccgacccuggcu

SEQ ID NO: 948209 - RNA, 18 nt, Human
ggcagggccuuggccaug

SEQ ID NO: 948210 - RNA, 21 nt, Human
ggccggccugccgagccacgc

SEQ ID NO: 948211 - RNA, 21 nt, Human
ggccugcagacucgagcccag

SEQ ID NO: 948212 - RNA, 24 nt, Human
gggacagaggaggugggaccuggc

SEQ ID NO: 948213 - RNA, 19 nt, Human
gggcagagagggaaccacu

SEQ ID NO: 948214 - RNA, 18 nt, Human
gggcaggccgacccuggc

SEQ ID NO: 948215 - RNA, 21 nt, Human
gggcccaagagacugcagcag

SEQ ID NO: 948216 - RNA, 20 nt, Human
ggggcggggaggggcugcag

SEQ ID NO: 948217 - RNA, 18 nt, Human
gggggcaguagcucacca

SEQ ID NO: 948218 - RNA, 23 nt, Human
ggguuagggcuggggccuccucg

SEQ ID NO: 948219 - RNA, 20 nt, Human
gugagcacguggugcgcccc

SEQ ID NO: 948220 - RNA, 18 nt, Human
gugcguggcagggccuug

SEQ ID NO: 948221 - RNA, 24 nt, Human
uacagagguacccgcaccgcccca

SEQ ID NO: 948222 - RNA, 21 nt, Human
uacugugcaccugcauccuca

SEQ ID NO: 948223 - RNA, 18 nt, Human
ucagccugcuccgggcug

SEQ ID NO: 948224 - RNA, 18 nt, Human
ucagucccacggccgcgg

SEQ ID NO: 948225 - RNA, 27 nt, Human
uccaaaccugccccacagauccucccc

SEQ ID NO: 948226 - RNA, 18 nt, Human
uccaggaggagggagggg

SEQ ID NO: 948227 - RNA, 23 nt, Human
ucccaaaaccuggcccugccucu

SEQ ID NO: 948228 - RNA, 27 nt, Human
ucccacggccgcggugcggucgucacc

SEQ ID NO: 948229 - RNA, 19 nt, Human
uccccacagacccuccccu

SEQ ID NO: 948230 - RNA, 18 nt, Human
uccccgagaucagucccc

SEQ ID NO: 948231 - RNA, 19 nt, Human
uccccgagaucagucccca

SEQ ID NO: 948232 - RNA, 23 nt, Human
ucccgcgcccacgcccacgccaa

SEQ ID NO: 948233 - RNA, 21 nt, Human
ucccgcugugcagcugacacc

SEQ ID NO: 948234 - RNA, 23 nt, Human
uccguaaaacugacgccccuggg

SEQ ID NO: 948235 - RNA, 19 nt, Human
ucgguuucucccggggcau

SEQ ID NO: 948236 - RNA, 23 nt, Human
ucugcccgcagcgcggguuaggg

SEQ ID NO: 948237 - RNA, 20 nt, Human
ugaccaaccccugugcacca

SEQ ID NO: 948238 - RNA, 18 nt, Human
ugacguggcagagcugcc

SEQ ID NO: 948239 - RNA, 24 nt, Human
ugagcccagaacggcccuucccag

SEQ ID NO: 948240 - RNA, 21 nt, Human
ugaguccguaaaacugacgcc

SEQ ID NO: 948241 - RNA, 18 nt, Human
ugcagcacuaccaggccc

SEQ ID NO: 948242 - RNA, 26 nt, Human
ugcagcagguuggugcucacaguggg

SEQ ID NO: 948243 - RNA, 22 nt, Human
ugcaguccaggcccccgaugcc

SEQ ID NO: 948244 - RNA, 19 nt, Human
ugccucugcccgacggugg

SEQ ID NO: 948245 - RNA, 22 nt, Human
ugccucugcccgacgguggggg

SEQ ID NO: 948246 - RNA, 23 nt, Human
ugcgcccccagcccagcauacag

SEQ ID NO: 948247 - RNA, 23 nt, Human
ugcuccgggcugaccugaagggc

SEQ ID NO: 948248 - RNA, 19 nt, Human
uggagucccuggagcccug

SEQ ID NO: 948249 - RNA, 22 nt, Human
uggagucccuggagcccugcug

SEQ ID NO: 948250 - RNA, 21 nt, Human
uggcagacccacagcucccaa

SEQ ID NO: 948251 - RNA, 18 nt, Human
uggccccugaccaacccc

SEQ ID NO: 948252 - RNA, 19 nt, Human
uggccccugaccaaccccu

SEQ ID NO: 948253 - RNA, 18 nt, Human
uggggagucaaggaguca

SEQ ID NO: 948254 - RNA, 20 nt, Human
ugggggacagaggagguggg

SEQ ID NO: 948255 - RNA, 21 nt, Human
ugggggcaguagcucaccagg

SEQ ID NO: 948256 - RNA, 23 nt, Human
ugugaucacggcugccuggcgcc

SEQ ID NO: 948257 - RNA, 21 nt, Human
ugugggagccaggcaggcggu

SEQ ID NO: 948258 - RNA, 22 nt, Human
uuaggucucgggaggaggcagc

SEQ ID NO: 948259 - RNA, 19 nt, Human
uuccugaggugaccuugag

SEQ ID NO: 948260 - RNA, 21 nt, Human
aaaagaacuuguugccaaagu

SEQ ID NO: 948261 - RNA, 19 nt, Human
aaacaaaugaacaacuagg

SEQ ID NO: 948262 - RNA, 19 nt, Human
aaccuacaagagaaguaga

SEQ ID NO: 948263 - RNA, 21 nt, Human
aaguagauuuuuuuaaagugc

SEQ ID NO: 948264 - RNA, 21 nt, Human
aaguauucagacaguuaccuu

SEQ ID NO: 948265 - RNA, 18 nt, Human
acggaaccagggcagggg

SEQ ID NO: 948266 - RNA, 24 nt, Human
agaaguagauuuuuuuaaagugcc

SEQ ID NO: 948267 - RNA, 18 nt, Human
agauuuuuuuaaagugcc

SEQ ID NO: 948268 - RNA, 20 nt, Human
agccgcaaaaccuacaagag

SEQ ID NO: 948269 - RNA, 21 nt, Human
caaauaccacggguaagggua

SEQ ID NO: 948270 - RNA, 22 nt, Human
caaauaccacggguaaggguaa

SEQ ID NO: 948271 - RNA, 23 nt, Human
cacaauaucacagcuggcacaaa

SEQ ID NO: 948272 - RNA, 22 nt, Human
cacagcuggcacaaaacugccu

SEQ ID NO: 948273 - RNA, 19 nt, Human
cacugcaucauaaaggcaa

SEQ ID NO: 948274 - RNA, 20 nt, Human
cagagaauucacaaaacaag

SEQ ID NO: 948275 - RNA, 20 nt, Human
caugacgggcccgcgggccu

SEQ ID NO: 948276 - RNA, 19 nt, Human
ccgcaaaaccuacaagaga

SEQ ID NO: 948277 - RNA, 21 nt, Human
ccuuuaaaaugugaaagcaag

SEQ ID NO: 948278 - RNA, 18 nt, Human
cgcaacggaaccagggca

SEQ ID NO: 948279 - RNA, 24 nt, Human
cuccaugacgggcccgcgggccuc

SEQ ID NO: 948280 - RNA, 20 nt, Human
gcauaugaacaguauucuuu

SEQ ID NO: 948281 - RNA, 22 nt, Human
ggcaggggccggggccgaaggg

SEQ ID NO: 948282 - RNA, 22 nt, Human
gggccggggccgaagggggcga

SEQ ID NO: 948283 - RNA, 25 nt, Human
gggccggggccgaagggggcgaggg

SEQ ID NO: 948284 - RNA, 18 nt, Human
gggcgaggggucgggggg

SEQ ID NO: 948285 - RNA, 21 nt, Human
uaagaguguugacaguauuca

SEQ ID NO: 948286 - RNA, 24 nt, Human
uaagaguguugacaguauucagag

SEQ ID NO: 948287 - RNA, 23 nt, Human
uaauucauguagcuuucuuccuu

SEQ ID NO: 948288 - RNA, 19 nt, Human
uagccgcaaaaccuacaag

SEQ ID NO: 948289 - RNA, 22 nt, Human
ucagaggggcgagguuucuuga

SEQ ID NO: 948290 - RNA, 21 nt, Human
ucauaaaguuuuuacuuggaa

SEQ ID NO: 948291 - RNA, 21 nt, Human
ugagaccaaguuucauaaagu

SEQ ID NO: 948292 - RNA, 19 nt, Human
ugguaugcacaauaucaca

SEQ ID NO: 948293 - RNA, 18 nt, Human
uuaaaauuuucuuuaaaa

SEQ ID NO: 948294 - RNA, 20 nt, Human
uuaauucauguagcuuucuu

SEQ ID NO: 948295 - RNA, 21 nt, Human
uuccaaagaaauuuucccaua

SEQ ID NO: 948296 - RNA, 24 nt, Human
uuugaaauuuuaaaauuuucuuua

SEQ ID NO: 948297 - RNA, 18 nt, Human
uuuuuuuuuuuuuuuuug

SEQ ID NO: 948298 - RNA, 26 nt, Human
aaacagcuggaaaccauaugcuacag

SEQ ID NO: 948299 - RNA, 21 nt, Human
aaccagaugaagauccguguc

SEQ ID NO: 948300 - RNA, 22 nt, Human
aaucccuacaacaaaaaccaag

SEQ ID NO: 948301 - RNA, 23 nt, Human
acugggccccuccugggcaaugg

SEQ ID NO: 948302 - RNA, 22 nt, Human
agaaacagcuggaaaccauaug

SEQ ID NO: 948303 - RNA, 24 nt, Human
agcacaccuggaauauaaaaaaca

SEQ ID NO: 948304 - RNA, 18 nt, Human
aggcacauucuuccucca

SEQ ID NO: 948305 - RNA, 20 nt, Human
aggcugaggaagcacagcug

SEQ ID NO: 948306 - RNA, 23 nt, Human
augguggugguggcggcgacacc

SEQ ID NO: 948307 - RNA, 24 nt, Human
caaaaaccaaggcucaaggaggug

SEQ ID NO: 948308 - RNA, 24 nt, Human
caaaacagccauaugacagagggc

SEQ ID NO: 948309 - RNA, 19 nt, Human
cagaaagaacaguaacaga

SEQ ID NO: 948310 - RNA, 22 nt, Human
cauggugacugggccccuccug

SEQ ID NO: 948311 - RNA, 20 nt, Human
ccauaugacagagggcugag

SEQ ID NO: 948312 - RNA, 21 nt, Human
ccaucccucacauauaaauac

SEQ ID NO: 948313 - RNA, 18 nt, Human
cgaugguggugguggcgg

SEQ ID NO: 948314 - RNA, 22 nt, Human
cggcucgggcugccuccagcag

SEQ ID NO: 948315 - RNA, 23 nt, Human
cuacaacaaaaaccaaggcucaa

SEQ ID NO: 948316 - RNA, 20 nt, Human
cucauggugacugggccccu

SEQ ID NO: 948317 - RNA, 22 nt, Human
cugaacugcagcuaugagacug

SEQ ID NO: 948318 - RNA, 21 nt, Human
cuggaauauaaaaaacauccc

SEQ ID NO: 948319 - RNA, 21 nt, Human
cuuggagccccgcagccaucc

SEQ ID NO: 948320 - RNA, 23 nt, Human
gacgcgggacucgugacuccgau

SEQ ID NO: 948321 - RNA, 18 nt, Human
gacggcggcggcucgggc

SEQ ID NO: 948322 - RNA, 22 nt, Human
gaggaagcacagcugaacugca

SEQ ID NO: 948323 - RNA, 21 nt, Human
gcaauggcaaugccacuggag

SEQ ID NO: 948324 - RNA, 20 nt, Human
ggcagcuucugcuuugucug

SEQ ID NO: 948325 - RNA, 19 nt, Human
ggccuuaucuugugauggu

SEQ ID NO: 948326 - RNA, 22 nt, Human
ggcucgggcugccuccagcagc

SEQ ID NO: 948327 - RNA, 19 nt, Human
ggcugaggaagcacagcug

SEQ ID NO: 948328 - RNA, 18 nt, Human
gggcugccuccagcagcc

SEQ ID NO: 948329 - RNA, 24 nt, Human
guggcagcuucugcuuugucugua

SEQ ID NO: 948330 - RNA, 24 nt, Human
guggcggcgacaccgacggcggcg

SEQ ID NO: 948331 - RNA, 18 nt, Human
guggugguggcggcgaca

SEQ ID NO: 948332 - RNA, 25 nt, Human
uaaauagucuaauacaccaauuucu

SEQ ID NO: 948333 - RNA, 21 nt, Human
uaaucccuacaacaaaaacca

SEQ ID NO: 948334 - RNA, 22 nt, Human
uaaucccuacaacaaaaaccaa

SEQ ID NO: 948335 - RNA, 18 nt, Human
uagcacugcaggacucau

SEQ ID NO: 948336 - RNA, 19 nt, Human
uagcacugcaggacucaug

SEQ ID NO: 948337 - RNA, 21 nt, Human
uaggcugaggaagcacagcug

SEQ ID NO: 948338 - RNA, 22 nt, Human
uaggcugaggaagcacagcuga

SEQ ID NO: 948339 - RNA, 19 nt, Human
uccguggcagcuucugcuu

SEQ ID NO: 948340 - RNA, 22 nt, Human
uccuccagguaaggcaagggag

SEQ ID NO: 948341 - RNA, 20 nt, Human
ugacugggccccuccugggc

SEQ ID NO: 948342 - RNA, 21 nt, Human
ugaggagauuuaaugucuuua

SEQ ID NO: 948343 - RNA, 25 nt, Human
ugcagaaagaacaguaacagacucc

SEQ ID NO: 948344 - RNA, 21 nt, Human
ugggcaauggcaaugccacug

SEQ ID NO: 948345 - RNA, 19 nt, Human
ugguggugguggcggcgac

SEQ ID NO: 948346 - RNA, 19 nt, Human
uucaaaggaacaaaacacc

SEQ ID NO: 948347 - RNA, 19 nt, Human
uucacagaaaauuaagcaa

SEQ ID NO: 948348 - RNA, 24 nt, Human
aaaaaagcagccaauauccaugua

SEQ ID NO: 948349 - RNA, 23 nt, Human
aaccauaauuggguuuagcauuu

SEQ ID NO: 948350 - RNA, 24 nt, Human
acugcagccacugucaauuuccug

SEQ ID NO: 948351 - RNA, 20 nt, Human
agccacugucaauuuccugg

SEQ ID NO: 948352 - RNA, 19 nt, Human
agccugaaaccuaugauca

SEQ ID NO: 948353 - RNA, 18 nt, Human
auaaaaggcaacauuugu

SEQ ID NO: 948354 - RNA, 24 nt, Human
aucaucccaaauauacacaaauua

SEQ ID NO: 948355 - RNA, 27 nt, Human
caagacacgcuguguaccaccuuacag

SEQ ID NO: 948356 - RNA, 21 nt, Human
cagccacugucaauuuccugg

SEQ ID NO: 948357 - RNA, 23 nt, Human
ccauaauauaauuuuacaucaua

SEQ ID NO: 948358 - RNA, 20 nt, Human
cuaacacuugucacaucuca

SEQ ID NO: 948359 - RNA, 23 nt, Human
uaaaaaaagcagccaauauccau

SEQ ID NO: 948360 - RNA, 21 nt, Human
uaaaagauuauucuaaaugcu

SEQ ID NO: 948361 - RNA, 19 nt, Human
uaauucuguucuggaggag

SEQ ID NO: 948362 - RNA, 20 nt, Human
uagcuccuaaauaucauccc

SEQ ID NO: 948363 - RNA, 21 nt, Human
uagcuccuaaauaucaucccu

SEQ ID NO: 948364 - RNA, 24 nt, Human
uauccauguaaacaguacauugug

SEQ ID NO: 948365 - RNA, 21 nt, Human
ucaauacugcagccacuguca

SEQ ID NO: 948366 - RNA, 26 nt, Human
uccuaaauaucaucccaaauauacac

SEQ ID NO: 948367 - RNA, 21 nt, Human
ucuguucuggaggaguuucuu

SEQ ID NO: 948368 - RNA, 22 nt, Human
uguaaaauuugauugauagcuc

SEQ ID NO: 948369 - RNA, 22 nt, Human
uuagcauuuucuccuaaaauuu

SEQ ID NO: 948370 - RNA, 19 nt, Human
uuucaaggcaaacaucaag

SEQ ID NO: 948371 - RNA, 24 nt, Human
aaacagcuucccaagaaaacaucc

SEQ ID NO: 948372 - RNA, 19 nt, Human
aaagaagcuucccagcucu

SEQ ID NO: 948373 - RNA, 23 nt, Human
aaauauaagcuacauacaauaua

SEQ ID NO: 948374 - RNA, 19 nt, Human
aacaguuaccaggaucacc

SEQ ID NO: 948375 - RNA, 22 nt, Human
aaggaccaaaacagcuucccaa

SEQ ID NO: 948376 - RNA, 20 nt, Human
aagucaauuuauagaugcuu

SEQ ID NO: 948377 - RNA, 24 nt, Human
aaucaucaaaaucauuucagcaaa

SEQ ID NO: 948378 - RNA, 25 nt, Human
aauugcuccccaacaguuagcucaa

SEQ ID NO: 948379 - RNA, 21 nt, Human
acauacaauauaaaccuagag

SEQ ID NO: 948380 - RNA, 21 nt, Human
acaugacaacucaccuagagc

SEQ ID NO: 948381 - RNA, 21 nt, Human
accaaauugcuccccaacagu

SEQ ID NO: 948382 - RNA, 19 nt, Human
acccacaugacaacucacc

SEQ ID NO: 948383 - RNA, 24 nt, Human
accccaacccagcccugagacacc

SEQ ID NO: 948384 - RNA, 19 nt, Human
accugagcaucaacuccca

SEQ ID NO: 948385 - RNA, 24 nt, Human
accuuguccaucuugcugcugucc

SEQ ID NO: 948386 - RNA, 20 nt, Human
acuuuggaccccaacccagc

SEQ ID NO: 948387 - RNA, 18 nt, Human
agaagacacuuuaaaagc

SEQ ID NO: 948388 - RNA, 22 nt, Human
agacaucucccuucccugcaaa

SEQ ID NO: 948389 - RNA, 20 nt, Human
aguuaaaaaaaauacaauga

SEQ ID NO: 948390 - RNA, 21 nt, Human
auggcgguauccaucuccaug

SEQ ID NO: 948391 - RNA, 21 nt, Human
caaaacagcuucccaagaaaa

SEQ ID NO: 948392 - RNA, 22 nt, Human
caacuaccaaauugcuccccaa

SEQ ID NO: 948393 - RNA, 21 nt, Human
caacucaccuagagccaaaag

SEQ ID NO: 948394 - RNA, 18 nt, Human
caagaaaacauccgaaaa

SEQ ID NO: 948395 - RNA, 24 nt, Human
caagaaaacauccgaaaauuccuu

SEQ ID NO: 948396 - RNA, 18 nt, Human
caaguuaaaaaaaauaca

SEQ ID NO: 948397 - RNA, 22 nt, Human
caaguuaaaaaaaauacaauga

SEQ ID NO: 948398 - RNA, 22 nt, Human
cacaaaagucaaaguuuguaua

SEQ ID NO: 948399 - RNA, 19 nt, Human
caccuagagccaaaagaag

SEQ ID NO: 948400 - RNA, 22 nt, Human
caccuuuucccuucaauccuug

SEQ ID NO: 948401 - RNA, 22 nt, Human
cagcucuccacuaagggcaggg

SEQ ID NO: 948402 - RNA, 18 nt, Human
caggaucaccuuuucccu

SEQ ID NO: 948403 - RNA, 19 nt, Human
caucuugcucucacgauua

SEQ ID NO: 948404 - RNA, 19 nt, Human
caucuugcugcuguccacu

SEQ ID NO: 948405 - RNA, 22 nt, Human
caugacaacucaccuagagcca

SEQ ID NO: 948406 - RNA, 23 nt, Human
caugucuguucuccccgugccga

SEQ ID NO: 948407 - RNA, 25 nt, Human
ccaucuccauggcgaccaccaucuc

SEQ ID NO: 948408 - RNA, 18 nt, Human
ccaugucuguucuccccg

SEQ ID NO: 948409 - RNA, 19 nt, Human
cccaacccagcccugagac

SEQ ID NO: 948410 - RNA, 26 nt, Human
cccaacccagcccugagaccgguucc

SEQ ID NO: 948411 - RNA, 24 nt, Human
cccacaugacaacucaccuagagc

SEQ ID NO: 948412 - RNA, 20 nt, Human
ccccaacccagcccugagac

SEQ ID NO: 948413 - RNA, 22 nt, Human
ccccaugccggccugcgcuucc

SEQ ID NO: 948414 - RNA, 20 nt, Human
ccuacaugucucagggcuga

SEQ ID NO: 948415 - RNA, 22 nt, Human
ccugagacaccuaguuaccaaa

SEQ ID NO: 948416 - RNA, 23 nt, Human
ccugagacaccuaguuaccaaag

SEQ ID NO: 948417 - RNA, 20 nt, Human
ccuuguccaucuugcugcug

SEQ ID NO: 948418 - RNA, 21 nt, Human
cgguucuccccaugccggccu

SEQ ID NO: 948419 - RNA, 22 nt, Human
cucaacuuacccacaugacaac

SEQ ID NO: 948420 - RNA, 18 nt, Human
cugcugcuuucuggaugg

SEQ ID NO: 948421 - RNA, 20 nt, Human
cuuacacuuuggaccccaac

SEQ ID NO: 948422 - RNA, 18 nt, Human
gaaucagacaucucccuu

SEQ ID NO: 948423 - RNA, 19 nt, Human
gcugcuuucuggauggcgg

SEQ ID NO: 948424 - RNA, 22 nt, Human
gcuggaugcaaaccuggcuggg

SEQ ID NO: 948425 - RNA, 24 nt, Human
ggaccaaaacagcuucccaagaaa

SEQ ID NO: 948426 - RNA, 20 nt, Human
guaugacggcugcugcuuuc

SEQ ID NO: 948427 - RNA, 23 nt, Human
uaaaaaauauaagcuacauacaa

SEQ ID NO: 948428 - RNA, 20 nt, Human
uacaaugagauagaagacac

SEQ ID NO: 948429 - RNA, 18 nt, Human
uaccaaauugcuccccaa

SEQ ID NO: 948430 - RNA, 21 nt, Human
uagaaucagacaucucccuuc

SEQ ID NO: 948431 - RNA, 20 nt, Human
uagcaauaccaucucaaacc

SEQ ID NO: 948432 - RNA, 26 nt, Human
uaguaaaaaauauaagcuacauacaa

SEQ ID NO: 948433 - RNA, 23 nt, Human
ucaacuuacccacaugacaacuc

SEQ ID NO: 948434 - RNA, 19 nt, Human
ucaauccuuguggcuucug

SEQ ID NO: 948435 - RNA, 21 nt, Human
ucagagccugggucugaaagg

SEQ ID NO: 948436 - RNA, 22 nt, Human
ucauuggggcaaguuaaaaaaa

SEQ ID NO: 948437 - RNA, 22 nt, Human
uccaaggaccaaaacagcuucc

SEQ ID NO: 948438 - RNA, 21 nt, Human
uccaucuccauggcgaccacc

SEQ ID NO: 948439 - RNA, 19 nt, Human
uccaucuugcugcuguccc

SEQ ID NO: 948440 - RNA, 20 nt, Human
ucccaagauaaccucaacuu

SEQ ID NO: 948441 - RNA, 19 nt, Human
uccgaaaauuccuucugau

SEQ ID NO: 948442 - RNA, 22 nt, Human
ucuuuccugcuuuccccauucc

SEQ ID NO: 948443 - RNA, 18 nt, Human
ugaaagguguuuccuaca

SEQ ID NO: 948444 - RNA, 23 nt, Human
ugcugcuguccacuuuggguucc

SEQ ID NO: 948445 - RNA, 18 nt, Human
uguccaucuugcugcugu

SEQ ID NO: 948446 - RNA, 23 nt, Human
ugucuuaucugucuugcugucca

SEQ ID NO: 948447 - RNA, 18 nt, Human
uuaaaagcuucuuuccug

SEQ ID NO: 948448 - RNA, 25 nt, Human
uuaaauuuagcaauaccaucucaaa

SEQ ID NO: 948449 - RNA, 23 nt, Human
uuaccaggaucaccuuuucccuu

SEQ ID NO: 948450 - RNA, 21 nt, Human
uuccccauuccgaccaucauu

SEQ ID NO: 948451 - RNA, 21 nt, Human
uucccuucaauccuuguggcu

SEQ ID NO: 948452 - RNA, 19 nt, Human
uugcugcuguccacuuugg

SEQ ID NO: 948453 - RNA, 18 nt, Human
uugcuguccaccuugucc

SEQ ID NO: 948454 - RNA, 20 nt, Human
aaaagcaaccuauaaaaggc

SEQ ID NO: 948455 - RNA, 23 nt, Human
aagcaaccuauaaaaggcucucg

SEQ ID NO: 948456 - RNA, 20 nt, Human
acaggaucuauuccacauag

SEQ ID NO: 948457 - RNA, 22 nt, Human
acuccacacuugcaugcccucc

SEQ ID NO: 948458 - RNA, 22 nt, Human
agacaacagucacaguuacuga

SEQ ID NO: 948459 - RNA, 19 nt, Human
agcaaagccaggcuacuac

SEQ ID NO: 948460 - RNA, 18 nt, Human
agucacaguuacugagca

SEQ ID NO: 948461 - RNA, 22 nt, Human
auuucuguauccuucacauccc

SEQ ID NO: 948462 - RNA, 20 nt, Human
cacagauggaaaaacaggau

SEQ ID NO: 948463 - RNA, 20 nt, Human
cauccagcuaaaaacagauc

SEQ ID NO: 948464 - RNA, 22 nt, Human
ccacagagaauauaagcucaga

SEQ ID NO: 948465 - RNA, 22 nt, Human
cgggaaaagcaaccuauaaaag

SEQ ID NO: 948466 - RNA, 18 nt, Human
gagcaaguaaauacucca

SEQ ID NO: 948467 - RNA, 22 nt, Human
gccgucagagcaaagccaggcu

SEQ ID NO: 948468 - RNA, 20 nt, Human
gucacaguuacugagcaagu

SEQ ID NO: 948469 - RNA, 21 nt, Human
uaaagagcaaaauaaaaggaa

SEQ ID NO: 948470 - RNA, 19 nt, Human
uagaagaaaaaucuaauac

SEQ ID NO: 948471 - RNA, 19 nt, Human
uagggucacaaucugggac

SEQ ID NO: 948472 - RNA, 20 nt, Human
uccguuaaauagaagaaaaa

SEQ ID NO: 948473 - RNA, 19 nt, Human
ucuaacucuuccacuagau

SEQ ID NO: 948474 - RNA, 22 nt, Human
ucucgggccgcgagaucgccgu

SEQ ID NO: 948475 - RNA, 18 nt, Human
ucuguauccuucacaucc

SEQ ID NO: 948476 - RNA, 20 nt, Human
ugauauggguugauucacag

SEQ ID NO: 948477 - RNA, 27 nt, Human
ugauucacagucauuucuguauccuuu

SEQ ID NO: 948478 - RNA, 19 nt, Human
ugcacauucaccaaaguca

SEQ ID NO: 948479 - RNA, 24 nt, Human
uggaaaaacaggaucuauuccaca

SEQ ID NO: 948480 - RNA, 21 nt, Human
ugggacacagauggaaaaaca

SEQ ID NO: 948481 - RNA, 25 nt, Human
ugucacaucuuccacagagaauaua

SEQ ID NO: 948482 - RNA, 24 nt, Human
uuaaagagcaaaauaaaaggaagu

SEQ ID NO: 948483 - RNA, 21 nt, Human
uuccacuagauuaucagcucc

SEQ ID NO: 948484 - RNA, 20 nt, Human
uugaugauauggguugauuu

SEQ ID NO: 948485 - RNA, 23 nt, Human
uuuaaagagcaaaauaaaaggaa

SEQ ID NO: 948486 - RNA, 21 nt, Human
uuuuuuuuuuuuacuaguaaa

SEQ ID NO: 948487 - RNA, 22 nt, Human
uuuuuuuuuuuuuuuuuacuag

SEQ ID NO: 948488 - RNA, 23 nt, Human
uuuuuuuuuuuuuuuuuuacuag

SEQ ID NO: 948489 - RNA, 24 nt, Human
aacagaauauuuccaaaacuuggg

SEQ ID NO: 948490 - RNA, 21 nt, Human
acccacagcgaccccagcucc

SEQ ID NO: 948491 - RNA, 20 nt, Human
acccgggccccucggagcuc

SEQ ID NO: 948492 - RNA, 23 nt, Human
cagcugccgcuccggcucccacu

SEQ ID NO: 948493 - RNA, 22 nt, Human
cccacgaccacggucagucgcc

SEQ ID NO: 948494 - RNA, 19 nt, Human
ccccucggagcuccccuuc

SEQ ID NO: 948495 - RNA, 18 nt, Human
ccgccgcgcucccuccgc

SEQ ID NO: 948496 - RNA, 21 nt, Human
ccgccgcgcucccuccgcugc

SEQ ID NO: 948497 - RNA, 18 nt, Human
ccgcgcucccuccgcugc

SEQ ID NO: 948498 - RNA, 22 nt, Human
ccugcggagagaacgcugccag

SEQ ID NO: 948499 - RNA, 20 nt, Human
cgacccgggccccucggagc

SEQ ID NO: 948500 - RNA, 23 nt, Human
cggagcccugggacggccuaaac

SEQ ID NO: 948501 - RNA, 23 nt, Human
cuucgcgacccacagcgacccca

SEQ ID NO: 948502 - RNA, 19 nt, Human
gacccacagcgaccccagc

SEQ ID NO: 948503 - RNA, 18 nt, Human
gaccugcggagagaacgc

SEQ ID NO: 948504 - RNA, 21 nt, Human
gagaacgcugccagcugccgc

SEQ ID NO: 948505 - RNA, 21 nt, Human
gcugcagcagcggccaccggg

SEQ ID NO: 948506 - RNA, 20 nt, Human
gucuccgagcccccgcgccg

SEQ ID NO: 948507 - RNA, 19 nt, Human
ucccaccugcugcccgagg

SEQ ID NO: 948508 - RNA, 20 nt, Human
ucccaccugcugcccgagga

SEQ ID NO: 948509 - RNA, 22 nt, Human
ucccacuucccaccugcugccc

SEQ ID NO: 948510 - RNA, 22 nt, Human
ucgcgacccacagcgaccccag

SEQ ID NO: 948511 - RNA, 22 nt, Human
ucgcgggccccgcgccgggcuc

SEQ ID NO: 948512 - RNA, 20 nt, Human
ucgugcaccaagcgcgcacg

SEQ ID NO: 948513 - RNA, 26 nt, Human
ugcugcccgaggaagacuuccgggag

SEQ ID NO: 948514 - RNA, 24 nt, Human
uggcgacccgggccccucggagcu

SEQ ID NO: 948515 - RNA, 20 nt, Human
uugugaauuucucuugcuuu

SEQ ID NO: 948516 - RNA, 20 nt, Human
acagccccaagagaugaggg

SEQ ID NO: 948517 - RNA, 21 nt, Human
agagugucagcuucagccucc

SEQ ID NO: 948518 - RNA, 20 nt, Human
aggggaagagaaugcucugg

SEQ ID NO: 948519 - RNA, 22 nt, Human
agugucagcuucagccucccag

SEQ ID NO: 948520 - RNA, 23 nt, Human
cagcagaggcugaaccagggaac

SEQ ID NO: 948521 - RNA, 19 nt, Human
cagccaaagagcaagccag

SEQ ID NO: 948522 - RNA, 22 nt, Human
ccccaagagaugaggggaagag

SEQ ID NO: 948523 - RNA, 18 nt, Human
ccucuguaacagugacuu

SEQ ID NO: 948524 - RNA, 21 nt, Human
ccucuguaacagugacuucuu

SEQ ID NO: 948525 - RNA, 21 nt, Human
gggaauugaaggucagccaaa

SEQ ID NO: 948526 - RNA, 21 nt, Human
ucccagcagaggcugaaccag

SEQ ID NO: 948527 - RNA, 19 nt, Human
uccuucaugagugaacucu

SEQ ID NO: 948528 - RNA, 25 nt, Human
ugagugaacucuuaccuaguccacc

SEQ ID NO: 948529 - RNA, 19 nt, Human
ugguucggagcccuggaga

SEQ ID NO: 948530 - RNA, 20 nt, Human
ugucagcuucagccucccag

SEQ ID NO: 948531 - RNA, 20 nt, Human
uuauugcagccaacacaggg

SEQ ID NO: 948532 - RNA, 21 nt, Human
uugcagccaacacaggguaac

SEQ ID NO: 948533 - RNA, 20 nt, Human
aaaaagacgagcagaccugg

SEQ ID NO: 948534 - RNA, 23 nt, Human
aaaaagacgagcagaccuggugu

SEQ ID NO: 948535 - RNA, 26 nt, Human
aacccaaagaaauguaccucccgagg

SEQ ID NO: 948536 - RNA, 20 nt, Human
aacccugaggaggcgagucc

SEQ ID NO: 948537 - RNA, 26 nt, Human
aagcaaauauaaaacacaaaaaagac

SEQ ID NO: 948538 - RNA, 22 nt, Human
agaaaaccuggaaaccgucuaa

SEQ ID NO: 948539 - RNA, 24 nt, Human
agcagcgcgcccaggcuccugugc

SEQ ID NO: 948540 - RNA, 18 nt, Human
agcgucaccugggagaaa

SEQ ID NO: 948541 - RNA, 20 nt, Human
augaagcaggugacuuaggg

SEQ ID NO: 948542 - RNA, 25 nt, Human
caacaccaugagcgcuggggacgga

SEQ ID NO: 948543 - RNA, 21 nt, Human
cacaaaaaagacgagcagacc

SEQ ID NO: 948544 - RNA, 19 nt, Human
caccugggagaaaaccugg

SEQ ID NO: 948545 - RNA, 23 nt, Human
caggucaggacguuucacagcag

SEQ ID NO: 948546 - RNA, 21 nt, Human
cuggggcuggcugggcuucug

SEQ ID NO: 948547 - RNA, 23 nt, Human
cuugguuuccucacugucaugug

SEQ ID NO: 948548 - RNA, 21 nt, Human
gcacuggagucuggggcuggc

SEQ ID NO: 948549 - RNA, 19 nt, Human
gcagaaucuaaaaaaaccc

SEQ ID NO: 948550 - RNA, 21 nt, Human
gcagcacagggaacccugagg

SEQ ID NO: 948551 - RNA, 18 nt, Human
gcuggcugggcuucuggc

SEQ ID NO: 948552 - RNA, 23 nt, Human
gcugggccggcugucaccgccag

SEQ ID NO: 948553 - RNA, 19 nt, Human
ggacagcucugcggugugu

SEQ ID NO: 948554 - RNA, 24 nt, Human
ggcugucaccgccagcugaggcgc

SEQ ID NO: 948555 - RNA, 19 nt, Human
gggcgucucuagaaaccca

SEQ ID NO: 948556 - RNA, 23 nt, Human
ggucaggacguuucacagcagcg

SEQ ID NO: 948557 - RNA, 22 nt, Human
guccuguacucccacucgugcc

SEQ ID NO: 948558 - RNA, 23 nt, Human
uauaaaacacaaaaaagacgagc

SEQ ID NO: 948559 - RNA, 25 nt, Human
uccucugucgccggaugggcucgac

SEQ ID NO: 948560 - RNA, 20 nt, Human
ugaagcaggugacuuagggg

SEQ ID NO: 948561 - RNA, 19 nt, Human
ugccuggacagcucugcgg

SEQ ID NO: 948562 - RNA, 20 nt, Human
ugggccggcugucaccgcca

SEQ ID NO: 948563 - RNA, 22 nt, Human
ugguggcgccacgcugggccgg

SEQ ID NO: 948564 - RNA, 23 nt, Human
ugugugguggcgccacgcugggc

SEQ ID NO: 948565 - RNA, 25 nt, Human
uuuuuuuuuugcggacaguaaaccg

SEQ ID NO: 948566 - RNA, 19 nt, Human
uuuuuuuuuuuuuugcgga

SEQ ID NO: 948567 - RNA, 22 nt, Human
uuuuuuuuuuuuuuuuuugcgg

SEQ ID NO: 948568 - RNA, 25 nt, Human
aaaaaaaaacaaaaacaaaaaccag

SEQ ID NO: 948569 - RNA, 23 nt, Human
aaaaaaacaaaaacaaaaaccag

SEQ ID NO: 948570 - RNA, 21 nt, Human
aaaacaaaaacaaaaaccaga

SEQ ID NO: 948571 - RNA, 23 nt, Human
aaacaaaaacaaaaaccagaugg

SEQ ID NO: 948572 - RNA, 24 nt, Human
aaacaaaaacaaaaaccagaugga

SEQ ID NO: 948573 - RNA, 25 nt, Human
aaacaaaaacaaaaaccagauggag

SEQ ID NO: 948574 - RNA, 21 nt, Human
aaacaaaaaccagauggagaa

SEQ ID NO: 948575 - RNA, 18 nt, Human
aacaaaaacaaaaaccag

SEQ ID NO: 948576 - RNA, 24 nt, Human
aaggggaggcgagggagguugcgc

SEQ ID NO: 948577 - RNA, 31 nt, Human
acaaaagcaugggggaaaaaaaaacaaaaaa

SEQ ID NO: 948578 - RNA, 21 nt, Human
agcgggcgcggcggggaccca

SEQ ID NO: 948579 - RNA, 21 nt, Human
agcggggcggcuguugcccuu

SEQ ID NO: 948580 - RNA, 18 nt, Human
aggcaggggagagggcug

SEQ ID NO: 948581 - RNA, 20 nt, Human
aggcaggggagagggcuggc

SEQ ID NO: 948582 - RNA, 20 nt, Human
aggcgguggcggcggcguug

SEQ ID NO: 948583 - RNA, 21 nt, Human
aggcgguggcggcggcguugg

SEQ ID NO: 948584 - RNA, 22 nt, Human
auggcgacauuuuucccuguuu

SEQ ID NO: 948585 - RNA, 22 nt, Human
caacaaauugaauccagcugaa

SEQ ID NO: 948586 - RNA, 18 nt, Human
cagaguaguugacaagca

SEQ ID NO: 948587 - RNA, 24 nt, Human
cagcagccaaacaaaagcaugggg

SEQ ID NO: 948588 - RNA, 22 nt, Human
cauuguggaaacccccuccccc

SEQ ID NO: 948589 - RNA, 21 nt, Human
ccccugggccgaggccgaccu

SEQ ID NO: 948590 - RNA, 19 nt, Human
cccgccgaggcggagcggg

SEQ ID NO: 948591 - RNA, 21 nt, Human
ccggcggcagcggcgaccgag

SEQ ID NO: 948592 - RNA, 26 nt, Human
ccucacauuguggaaacccccucccc

SEQ ID NO: 948593 - RNA, 25 nt, Human
cgacacagcaacggauacucgcccc

SEQ ID NO: 948594 - RNA, 19 nt, Human
cgacggcagucggagcgga

SEQ ID NO: 948595 - RNA, 23 nt, Human
cggagcggggcggcuguugcccu

SEQ ID NO: 948596 - RNA, 19 nt, Human
cggcggcagcggcgaccga

SEQ ID NO: 948597 - RNA, 26 nt, Human
cggcggcagcggcgaccgaggacgag

SEQ ID NO: 948598 - RNA, 21 nt, Human
cgguggcggcggcguuggggg

SEQ ID NO: 948599 - RNA, 23 nt, Human
cguucagggccggcggggguccc

SEQ ID NO: 948600 - RNA, 18 nt, Human
gaagaggcggaggagcug

SEQ ID NO: 948601 - RNA, 19 nt, Human
gccaaacaaaagcaugggg

SEQ ID NO: 948602 - RNA, 22 nt, Human
gcgcggcggggacccaggcuca

SEQ ID NO: 948603 - RNA, 22 nt, Human
gcggggcggaggcugcggggga

SEQ ID NO: 948604 - RNA, 19 nt, Human
gcgguggcggcggcguugg

SEQ ID NO: 948605 - RNA, 19 nt, Human
gcugcugcccgaagaggcg

SEQ ID NO: 948606 - RNA, 21 nt, Human
gcugcugcccgaagaggcgga

SEQ ID NO: 948607 - RNA, 23 nt, Human
ggagcucagcggcaucaacgggg

SEQ ID NO: 948608 - RNA, 18 nt, Human
ggagcuguuggagccgcu

SEQ ID NO: 948609 - RNA, 19 nt, Human
ggcgguggcggcggcguug

SEQ ID NO: 948610 - RNA, 20 nt, Human
ggcuucucaaacuaggaaga

SEQ ID NO: 948611 - RNA, 26 nt, Human
gggccgaggccgaccugcuccgggaa

SEQ ID NO: 948612 - RNA, 18 nt, Human
gggcggaggcugcggggg

SEQ ID NO: 948613 - RNA, 21 nt, Human
gggggucggcggcggcagcgg

SEQ ID NO: 948614 - RNA, 18 nt, Human
ggggucggcggcggcagc

SEQ ID NO: 948615 - RNA, 20 nt, Human
uacagcagccaaacaaaagc

SEQ ID NO: 948616 - RNA, 20 nt, Human
uauuuugguguaaagacagg

SEQ ID NO: 948617 - RNA, 18 nt, Human
ucccgccgcgaggcaggg

SEQ ID NO: 948618 - RNA, 21 nt, Human
ucggagcggagcgggcgcggc

SEQ ID NO: 948619 - RNA, 21 nt, Human
ucggaggcgguggcggcggcg

SEQ ID NO: 948620 - RNA, 22 nt, Human
ucggcggcgacggcagucggag

SEQ ID NO: 948621 - RNA, 23 nt, Human
ugcccgaagaggcggaggagcug

SEQ ID NO: 948622 - RNA, 23 nt, Human
ugcugcugcccgaagaggcggag

SEQ ID NO: 948623 - RNA, 23 nt, Human
uggcggcggcguugggggggugc

SEQ ID NO: 948624 - RNA, 20 nt, Human
uggcguucagggccggcggg

SEQ ID NO: 948625 - RNA, 26 nt, Human
uguaaagacaggaagcuggaaaauac

SEQ ID NO: 948626 - RNA, 24 nt, Human
ugucaauacuuuauuuugguguaa

SEQ ID NO: 948627 - RNA, 20 nt, Human
uuacagcagccaaacaaaag

SEQ ID NO: 948628 - RNA, 23 nt, Human
uucaaacucaaauacuuaaaaau

SEQ ID NO: 948629 - RNA, 19 nt, Human
uucuuguccaugucggagg

SEQ ID NO: 948630 - RNA, 20 nt, Human
uuggguuuagacucgccggc

SEQ ID NO: 948631 - RNA, 25 nt, Human
uuuaaaauuuucuugguucccccuc

SEQ ID NO: 948632 - RNA, 24 nt, Human
aaaaaaagaaaagucugacuauaa

SEQ ID NO: 948633 - RNA, 22 nt, Human
aaaacacaagaauaaaaaaagc

SEQ ID NO: 948634 - RNA, 24 nt, Human
aaaacacaagaauaaaaaaagcaa

SEQ ID NO: 948635 - RNA, 24 nt, Human
aaacaaauacagcugcuguuaaca

SEQ ID NO: 948636 - RNA, 19 nt, Human
aaacagagacugagaugug

SEQ ID NO: 948637 - RNA, 19 nt, Human
aaagaacugugcaaacaag

SEQ ID NO: 948638 - RNA, 22 nt, Human
aacaagcuuaaaacuacuuuuu

SEQ ID NO: 948639 - RNA, 27 nt, Human
aacacaagaauaaaaaaagcaauuauc

SEQ ID NO: 948640 - RNA, 27 nt, Human
aacacaagaauaaaaaaagcaauuauc

SEQ ID NO: 948641 - RNA, 21 nt, Human
aagaaagagaauaaaucaaaa

SEQ ID NO: 948642 - RNA, 23 nt, Human
acaguaaugagagaugcaguauc

SEQ ID NO: 948643 - RNA, 23 nt, Human
accuuaauagaguugguuucuug

SEQ ID NO: 948644 - RNA, 24 nt, Human
accuucaugacacuguguuuugua

SEQ ID NO: 948645 - RNA, 21 nt, Human
acuucaauaaccucagcacua

SEQ ID NO: 948646 - RNA, 21 nt, Human
agaagaaagagaauaaaucaa

SEQ ID NO: 948647 - RNA, 23 nt, Human
agaagaaagagaauaaaucaaaa

SEQ ID NO: 948648 - RNA, 27 nt, Human
agaauaaaaaaagcaauuaucagaaaa

SEQ ID NO: 948649 - RNA, 23 nt, Human
agacaagaggcaaggaggucaga

SEQ ID NO: 948650 - RNA, 24 nt, Human
agacaagaggcaaggaggucagaa

SEQ ID NO: 948651 - RNA, 21 nt, Human
agagaugcaguauccuuuugc

SEQ ID NO: 948652 - RNA, 22 nt, Human
agguggggucggccgacaggcc

SEQ ID NO: 948653 - RNA, 23 nt, Human
auaaacacaugcuaaauggauaa

SEQ ID NO: 948654 - RNA, 24 nt, Human
auaaauaaacugguuuucaagcau

SEQ ID NO: 948655 - RNA, 19 nt, Human
auaauuagauaaaacacau

SEQ ID NO: 948656 - RNA, 19 nt, Human
auuaacaaccaaaauaauu

SEQ ID NO: 948657 - RNA, 20 nt, Human
cacaagaauaaaaaaagcaa

SEQ ID NO: 948658 - RNA, 24 nt, Human
caggauguaauagauaccuuucca

SEQ ID NO: 948659 - RNA, 26 nt, Human
cagugacaaaagaucaaaaccaccaa

SEQ ID NO: 948660 - RNA, 20 nt, Human
cauagagccagccccaacga

SEQ ID NO: 948661 - RNA, 18 nt, Human
caucauggggcucauaag

SEQ ID NO: 948662 - RNA, 25 nt, Human
ccaacgauaauaauacacuauuuaa

SEQ ID NO: 948663 - RNA, 18 nt, Human
cccuggcucuuugggcuc

SEQ ID NO: 948664 - RNA, 20 nt, Human
ccuaaucccuggcucuuugg

SEQ ID NO: 948665 - RNA, 24 nt, Human
cuaugguucaagacaagaggcaag

SEQ ID NO: 948666 - RNA, 20 nt, Human
cuuacaagcuaggagaucac

SEQ ID NO: 948667 - RNA, 18 nt, Human
cuuaugacauacuacauu

SEQ ID NO: 948668 - RNA, 21 nt, Human
gagguggggucggccgacagg

SEQ ID NO: 948669 - RNA, 19 nt, Human
gggaaggggaagagaagaa

SEQ ID NO: 948670 - RNA, 21 nt, Human
ggugcgugaucugggggagga

SEQ ID NO: 948671 - RNA, 20 nt, Human
guucacuugaagucagauaa

SEQ ID NO: 948672 - RNA, 21 nt, Human
uaaaacacauaggaaagggua

SEQ ID NO: 948673 - RNA, 22 nt, Human
uaaaaccuugacccaaaugcca

SEQ ID NO: 948674 - RNA, 24 nt, Human
uaaaauaucacguacuuuuucccc

SEQ ID NO: 948675 - RNA, 22 nt, Human
uaaacacaugcuaaauggauaa

SEQ ID NO: 948676 - RNA, 21 nt, Human
uaacuucaauaaccucagcac

SEQ ID NO: 948677 - RNA, 19 nt, Human
uaauaauaagaaacacuuc

SEQ ID NO: 948678 - RNA, 20 nt, Human
uaauuccuaaucccuggcuc

SEQ ID NO: 948679 - RNA, 21 nt, Human
uacauaugaaaaaauaaacac

SEQ ID NO: 948680 - RNA, 21 nt, Human
uacuagaccaucucuaccucu

SEQ ID NO: 948681 - RNA, 30 nt, Human
uauaaaauaauaauaagaaacacuucugaa

SEQ ID NO: 948682 - RNA, 23 nt, Human
uauacaaauucugcguuugugug

SEQ ID NO: 948683 - RNA, 24 nt, Human
uaucagaaaauauugcacaacuuc

SEQ ID NO: 948684 - RNA, 20 nt, Human
ucaaucucaauaaaucagaa

SEQ ID NO: 948685 - RNA, 22 nt, Human
ucagcacuacaguaaugagaga

SEQ ID NO: 948686 - RNA, 21 nt, Human
ucaguuugcuuacaagcuagg

SEQ ID NO: 948687 - RNA, 20 nt, Human
ucccuggcucuuugggcuca

SEQ ID NO: 948688 - RNA, 24 nt, Human
ucugacuauaauacuugaugacac

SEQ ID NO: 948689 - RNA, 20 nt, Human
ucugcagccauccaggaauu

SEQ ID NO: 948690 - RNA, 21 nt, Human
ugacaaaagaucaaaaccacc

SEQ ID NO: 948691 - RNA, 18 nt, Human
ugacccaaaugccagcaa

SEQ ID NO: 948692 - RNA, 19 nt, Human
ugaggugaaccaauaaguc

SEQ ID NO: 948693 - RNA, 22 nt, Human
ugaucugggggaggagaaagca

SEQ ID NO: 948694 - RNA, 18 nt, Human
ugcaagaaacaaaggaga

SEQ ID NO: 948695 - RNA, 21 nt, Human
ugcaagaaacaaaggagaaau

SEQ ID NO: 948696 - RNA, 23 nt, Human
ugcaagaaacaaaggagaaauuc

SEQ ID NO: 948697 - RNA, 22 nt, Human
ugccagcaacuucagaaaagaa

SEQ ID NO: 948698 - RNA, 22 nt, Human
uggagcaauaacaagaucuaaa

SEQ ID NO: 948699 - RNA, 20 nt, Human
ugguucaagacaagaggcaa

SEQ ID NO: 948700 - RNA, 27 nt, Human
ugguucacuugaagucagauaagagac

SEQ ID NO: 948701 - RNA, 20 nt, Human
uguaauaucacugaggugaa

SEQ ID NO: 948702 - RNA, 21 nt, Human
uuaaaaagaccuaaggcaaug

SEQ ID NO: 948703 - RNA, 23 nt, Human
uuaacaaucuagaaaaaaagaaa

SEQ ID NO: 948704 - RNA, 22 nt, Human
uuaacacuuuacacaauuccua

SEQ ID NO: 948705 - RNA, 23 nt, Human
uuccauuuccaauggaaaaaaag

SEQ ID NO: 948706 - RNA, 20 nt, Human
uugacccaaaugccagcaac

SEQ ID NO: 948707 - RNA, 22 nt, Human
uuuaacuugacuuuccauuauc

SEQ ID NO: 948708 - RNA, 22 nt, Human
uuugucagucagcuagcaggau

SEQ ID NO: 948709 - RNA, 21 nt, Human
uuuuuuagcuguaauaucacu

SEQ ID NO: 948710 - RNA, 28 nt, Human
aaacgcaaaacacuuaaauacugugauc

SEQ ID NO: 948711 - RNA, 23 nt, Human
aacauucaaacuccccucauaca

SEQ ID NO: 948712 - RNA, 27 nt, Human
aaguguugaaaucugcacuaguauaga

SEQ ID NO: 948713 - RNA, 19 nt, Human
acagaacccuuaaggacac

SEQ ID NO: 948714 - RNA, 18 nt, Human
acagcccggaguacuagc

SEQ ID NO: 948715 - RNA, 21 nt, Human
acuuucauuccaaaagaagag

SEQ ID NO: 948716 - RNA, 24 nt, Human
agccgcgucgcugcgggagaaguc

SEQ ID NO: 948717 - RNA, 22 nt, Human
agcugcucaaucaaaucucuac

SEQ ID NO: 948718 - RNA, 18 nt, Human
agcuggguuaguucaugc

SEQ ID NO: 948719 - RNA, 21 nt, Human
auaagucacuuacuuucaaau

SEQ ID NO: 948720 - RNA, 25 nt, Human
auuuuuuuuuuuuuuauguuuuggc

SEQ ID NO: 948721 - RNA, 21 nt, Human
caaacuccccucauacaaggc

SEQ ID NO: 948722 - RNA, 18 nt, Human
caacucaacaacucuagg

SEQ ID NO: 948723 - RNA, 22 nt, Human
cacagcccggaguacuagcagg

SEQ ID NO: 948724 - RNA, 22 nt, Human
cacucucucuuucucucuugaa

SEQ ID NO: 948725 - RNA, 20 nt, Human
cagccgcgucgcugcgggag

SEQ ID NO: 948726 - RNA, 20 nt, Human
ccacucucucuuucucucuu

SEQ ID NO: 948727 - RNA, 22 nt, Human
ccacucucucuuucucucuuga

SEQ ID NO: 948728 - RNA, 26 nt, Human
ccccucauacaaggccauauaaaaau

SEQ ID NO: 948729 - RNA, 19 nt, Human
cuaggucuuaauugcaagc

SEQ ID NO: 948730 - RNA, 22 nt, Human
cucccuaaugauuggcagguca

SEQ ID NO: 948731 - RNA, 22 nt, Human
cugaauauccgcaccgaccccc

SEQ ID NO: 948732 - RNA, 24 nt, Human
gacugcuuuggaacagaaagggaa

SEQ ID NO: 948733 - RNA, 18 nt, Human
ggagaagucccuacccug

SEQ ID NO: 948734 - RNA, 22 nt, Human
ggcagauaaauaccagaucaaa

SEQ ID NO: 948735 - RNA, 26 nt, Human
uaacacuacagaacccuuaaggacac

SEQ ID NO: 948736 - RNA, 19 nt, Human
uacagaacccuuaaggaca

SEQ ID NO: 948737 - RNA, 19 nt, Human
uagguggcuguagcacuga

SEQ ID NO: 948738 - RNA, 23 nt, Human
uauuaagagguauaugaucugag

SEQ ID NO: 948739 - RNA, 25 nt, Human
uccaaaagaagagcugaauugaugc

SEQ ID NO: 948740 - RNA, 25 nt, Human
ucucuacauaacacuauaguaauua

SEQ ID NO: 948741 - RNA, 19 nt, Human
ugaauauccgcaccgaccc

SEQ ID NO: 948742 - RNA, 23 nt, Human
ugagugcuuccgggauacugcug

SEQ ID NO: 948743 - RNA, 23 nt, Human
ugccagaacauauuccaacucaa

SEQ ID NO: 948744 - RNA, 24 nt, Human
ugccagaacauauuccaacucaac

SEQ ID NO: 948745 - RNA, 22 nt, Human
ugcucaaucaaaucucuacaua

SEQ ID NO: 948746 - RNA, 20 nt, Human
ugcuuccgggauacugcugu

SEQ ID NO: 948747 - RNA, 19 nt, Human
uggcagagaaaacugagug

SEQ ID NO: 948748 - RNA, 20 nt, Human
uuggaacagaaagggaaaaa

SEQ ID NO: 948749 - RNA, 20 nt, Human
uuuaaagggaaauaaaccaa

SEQ ID NO: 948750 - RNA, 23 nt, Human
uuucaugacugaauauccgcacc

SEQ ID NO: 948751 - RNA, 22 nt, Human
uuuuauguuuuggcuauacuuu

SEQ ID NO: 948752 - RNA, 18 nt, Human
uuuuuuuuuuuuuuuuug

SEQ ID NO: 948753 - RNA, 21 nt, Human
aaaaaaaaacccuguaaaaac

SEQ ID NO: 948754 - RNA, 23 nt, Human
aaaaaaaacacaagaaacuucag

SEQ ID NO: 948755 - RNA, 21 nt, Human
aaaaaagcacucucaaacgua

SEQ ID NO: 948756 - RNA, 25 nt, Human
aaaaaagcacucucaaacguauacu

SEQ ID NO: 948757 - RNA, 22 nt, Human
aaaaacacaagaaacuucagau

SEQ ID NO: 948758 - RNA, 22 nt, Human
aaaaacaucacauauaauacag

SEQ ID NO: 948759 - RNA, 26 nt, Human
aaaaacaucacauauaauacaggaaa

SEQ ID NO: 948760 - RNA, 24 nt, Human
aaaaagaauggaaaaaaaaaacau

SEQ ID NO: 948761 - RNA, 24 nt, Human
aaaaaggaaaucuuaaauaaaggg

SEQ ID NO: 948762 - RNA, 23 nt, Human
aaacugauguggcaacccaaaau

SEQ ID NO: 948763 - RNA, 23 nt, Human
aagaucuccauaaaaguaaugcc

SEQ ID NO: 948764 - RNA, 23 nt, Human
aagcaguuuuaucacaaaaccag

SEQ ID NO: 948765 - RNA, 24 nt, Human
aagcaguuuuaucacaaaaccagg

SEQ ID NO: 948766 - RNA, 23 nt, Human
aauacagaaacuaugaaaaauuc

SEQ ID NO: 948767 - RNA, 21 nt, Human
aauaucuccauuaucucuggu

SEQ ID NO: 948768 - RNA, 25 nt, Human
acacacacacaaaauacacucaaua

SEQ ID NO: 948769 - RNA, 20 nt, Human
acacauccacacacacacaa

SEQ ID NO: 948770 - RNA, 21 nt, Human
acagaaacuaugaaaaauucc

SEQ ID NO: 948771 - RNA, 18 nt, Human
acagauaaaaacacauac

SEQ ID NO: 948772 - RNA, 18 nt, Human
acagauaaaaacacauac

SEQ ID NO: 948773 - RNA, 19 nt, Human
accaggguuauauucagug

SEQ ID NO: 948774 - RNA, 23 nt, Human
acuacaguuuauauaggaaaacu

SEQ ID NO: 948775 - RNA, 20 nt, Human
acuaccaauuuaauuuuucu

SEQ ID NO: 948776 - RNA, 21 nt, Human
agaaagaaaauugaacaacau

SEQ ID NO: 948777 - RNA, 22 nt, Human
agaaauuccaaaauuacagggg

SEQ ID NO: 948778 - RNA, 21 nt, Human
agaacuaauacaaaaaaaagc

SEQ ID NO: 948779 - RNA, 19 nt, Human
aggaauugaauauauaaaa

SEQ ID NO: 948780 - RNA, 20 nt, Human
aggcuaaagugcaaaauauc

SEQ ID NO: 948781 - RNA, 22 nt, Human
agguacuggaggucuacacccu

SEQ ID NO: 948782 - RNA, 24 nt, Human
auaacucucugcuuaaagacaaaa

SEQ ID NO: 948783 - RNA, 22 nt, Human
auacagaaacuaugaaaaauuc

SEQ ID NO: 948784 - RNA, 25 nt, Human
auggaagaaaauaccaugaaaagaa

SEQ ID NO: 948785 - RNA, 21 nt, Human
auuuuuuuaaaggaaagaaaa

SEQ ID NO: 948786 - RNA, 22 nt, Human
caaaaaaaaaaaaaaaaaaaaa

SEQ ID NO: 948787 - RNA, 23 nt, Human
caaaaaaaagcacucucaaacgu

SEQ ID NO: 948788 - RNA, 26 nt, Human
caaaacacacauccacacacacacaa

SEQ ID NO: 948789 - RNA, 21 nt, Human
caaaggauuacacaaccaaua

SEQ ID NO: 948790 - RNA, 28 nt, Human
caacaaagcuuucuggcucccaaacacc

SEQ ID NO: 948791 - RNA, 19 nt, Human
caaccaauaauuucacuaa

SEQ ID NO: 948792 - RNA, 22 nt, Human
cacacauccacacacacacaaa

SEQ ID NO: 948793 - RNA, 25 nt, Human
cacacauccacacacacacaaaaua

SEQ ID NO: 948794 - RNA, 21 nt, Human
cacuacauauuaaagcagggc

SEQ ID NO: 948795 - RNA, 26 nt, Human
cacucaauacccuaucaaauaccuag

SEQ ID NO: 948796 - RNA, 26 nt, Human
cagauuacaaaaaaaaaaaaaaaaaa

SEQ ID NO: 948797 - RNA, 22 nt, Human
cauggcacagauuacaaaaaaa

SEQ ID NO: 948798 - RNA, 19 nt, Human
ccagaaauuccaaaauuac

SEQ ID NO: 948799 - RNA, 21 nt, Human
ccccaaaacacacauccacac

SEQ ID NO: 948800 - RNA, 25 nt, Human
ccccguaccccaaaacacacaucca

SEQ ID NO: 948801 - RNA, 20 nt, Human
ccgcggacgccggcgccgcc

SEQ ID NO: 948802 - RNA, 26 nt, Human
ccgcggccggagcaagaccggggucc

SEQ ID NO: 948803 - RNA, 19 nt, Human
ccugccccagcccagggcu

SEQ ID NO: 948804 - RNA, 23 nt, Human
cgccgccgcacaauauggcgagc

SEQ ID NO: 948805 - RNA, 21 nt, Human
cggcuccugccccagcccagg

SEQ ID NO: 948806 - RNA, 20 nt, Human
cgggaaggagcgagcgagcg

SEQ ID NO: 948807 - RNA, 21 nt, Human
cuccugccccagcccagggcu

SEQ ID NO: 948808 - RNA, 24 nt, Human
cugaauuacaugccuuaaaauggu

SEQ ID NO: 948809 - RNA, 22 nt, Human
cugguauuuuaauggggaaaaa

SEQ ID NO: 948810 - RNA, 18 nt, Human
cugguugguagugauggc

SEQ ID NO: 948811 - RNA, 20 nt, Human
gaaaaaaaaagucagaauac

SEQ ID NO: 948812 - RNA, 20 nt, Human
gaauguaccuaaccccacug

SEQ ID NO: 948813 - RNA, 20 nt, Human
gagcucgggaaauacaacag

SEQ ID NO: 948814 - RNA, 18 nt, Human
gagggcgggaaggagcga

SEQ ID NO: 948815 - RNA, 19 nt, Human
gcccagggcuccgcuggcc

SEQ ID NO: 948816 - RNA, 22 nt, Human
gcuaaagugcaaaauaucucca

SEQ ID NO: 948817 - RNA, 21 nt, Human
gcuccugccccagcccagggc

SEQ ID NO: 948818 - RNA, 21 nt, Human
gcuggccccaaucugucaaaa

SEQ ID NO: 948819 - RNA, 19 nt, Human
gggaaaaaaaaaaacacaa

SEQ ID NO: 948820 - RNA, 21 nt, Human
gggaaaaagaauggaaaaaaa

SEQ ID NO: 948821 - RNA, 20 nt, Human
guacuggaggucuacacccu

SEQ ID NO: 948822 - RNA, 23 nt, Human
uaaaaaaauuuagaacuaaguac

SEQ ID NO: 948823 - RNA, 19 nt, Human
uaaaagagcgccaaauuua

SEQ ID NO: 948824 - RNA, 23 nt, Human
uaaagcagggcucaagcucuauu

SEQ ID NO: 948825 - RNA, 20 nt, Human
uaaauguggcuauguauaug

SEQ ID NO: 948826 - RNA, 21 nt, Human
uaacauuacaccagaaaagga

SEQ ID NO: 948827 - RNA, 18 nt, Human
uaagaaaaaaauuaggga

SEQ ID NO: 948828 - RNA, 20 nt, Human
uaagaauacagaaacuauga

SEQ ID NO: 948829 - RNA, 25 nt, Human
uaagcacaaagcuuauagucacaaa

SEQ ID NO: 948830 - RNA, 23 nt, Human
uacaaaaaaaagcacucucaaac

SEQ ID NO: 948831 - RNA, 18 nt, Human
uacccaaagccuucacac

SEQ ID NO: 948832 - RNA, 20 nt, Human
uaccccaaaacacacaucca

SEQ ID NO: 948833 - RNA, 22 nt, Human
uaccgggcugaagauuuaaaac

SEQ ID NO: 948834 - RNA, 21 nt, Human
uacuaccaauuuaauuuuucu

SEQ ID NO: 948835 - RNA, 21 nt, Human
uagaaugacuuuacccuacug

SEQ ID NO: 948836 - RNA, 23 nt, Human
uagagucuggagagagaugaaau

SEQ ID NO: 948837 - RNA, 23 nt, Human
uagguauauacuuuuugaaaccc

SEQ ID NO: 948838 - RNA, 23 nt, Human
uaucaaauaccuagaauuauauu

SEQ ID NO: 948839 - RNA, 19 nt, Human
uauugaaaacccuuuaggg

SEQ ID NO: 948840 - RNA, 18 nt, Human
ucaacaaaaucuaagcag

SEQ ID NO: 948841 - RNA, 22 nt, Human
ucaacaaagcuuucuggcuccc

SEQ ID NO: 948842 - RNA, 26 nt, Human
ucacauauaauacaggaaaugaaguu

SEQ ID NO: 948843 - RNA, 19 nt, Human
ucacuacauauuaaagcag

SEQ ID NO: 948844 - RNA, 22 nt, Human
uccacacacacacaaaauacac

SEQ ID NO: 948845 - RNA, 21 nt, Human
uccccguaccccaaaacacac

SEQ ID NO: 948846 - RNA, 25 nt, Human
ucccuuccaaaaaggaaaucuuaaa

SEQ ID NO: 948847 - RNA, 19 nt, Human
uccugggucaaaauggugc

SEQ ID NO: 948848 - RNA, 23 nt, Human
ucgccucuccccguaccccaaaa

SEQ ID NO: 948849 - RNA, 22 nt, Human
ugacagcagaacuaauacaaaa

SEQ ID NO: 948850 - RNA, 21 nt, Human
ugagccuuggguucuucauga

SEQ ID NO: 948851 - RNA, 18 nt, Human
ugccccagcccagggcuc

SEQ ID NO: 948852 - RNA, 21 nt, Human
uggaagaaaauaccaugaaaa

SEQ ID NO: 948853 - RNA, 18 nt, Human
uggcuacaaauaagaaaa

SEQ ID NO: 948854 - RNA, 19 nt, Human
uggcucccaaacacccaau

SEQ ID NO: 948855 - RNA, 21 nt, Human
ugucaucaacaaaaucuaagc

SEQ ID NO: 948856 - RNA, 23 nt, Human
uguggcuacaaauaagaaaaaaa

SEQ ID NO: 948857 - RNA, 20 nt, Human
uuccauaaaaugguaaaaaa

SEQ ID NO: 948858 - RNA, 20 nt, Human
uugugaauguaccuaacccc

SEQ ID NO: 948859 - RNA, 25 nt, Human
uuuaaaggaaagaaaaaaauacuga

SEQ ID NO: 948860 - RNA, 18 nt, Human
uuuacccuacuggcugac

SEQ ID NO: 948861 - RNA, 25 nt, Human
uuugaggggagcaggaaaaggacag

SEQ ID NO: 948862 - RNA, 22 nt, Human
aaaauaaacaaagcugggaggg

SEQ ID NO: 948863 - RNA, 18 nt, Human
aaacaaagcugggaggga

SEQ ID NO: 948864 - RNA, 21 nt, Human
aaagaaaacacugaaaagucu

SEQ ID NO: 948865 - RNA, 19 nt, Human
aaggagagaagagguagag

SEQ ID NO: 948866 - RNA, 19 nt, Human
aaggagagaagagguagag

SEQ ID NO: 948867 - RNA, 19 nt, Human
aauccacauucacaagaag

SEQ ID NO: 948868 - RNA, 25 nt, Human
agaaaacacugaaaagucuaaaagc

SEQ ID NO: 948869 - RNA, 24 nt, Human
agucaaggagagaagagguagagg

SEQ ID NO: 948870 - RNA, 21 nt, Human
augaagaaaacuuugugccca

SEQ ID NO: 948871 - RNA, 18 nt, Human
caaagcugggagggaaga

SEQ ID NO: 948872 - RNA, 19 nt, Human
caacaacccuguaaaaagg

SEQ ID NO: 948873 - RNA, 22 nt, Human
caacaacccuguaaaaaggaga

SEQ ID NO: 948874 - RNA, 21 nt, Human
caacccuguaaaaaggagacu

SEQ ID NO: 948875 - RNA, 19 nt, Human
caagaaauuuaaagacuug

SEQ ID NO: 948876 - RNA, 18 nt, Human
caagcuuguggagaacaa

SEQ ID NO: 948877 - RNA, 21 nt, Human
caaggagagaagagguagagg

SEQ ID NO: 948878 - RNA, 19 nt, Human
cacaaaauaaacaaagcug

SEQ ID NO: 948879 - RNA, 22 nt, Human
cauagcucaccaaguucucucc

SEQ ID NO: 948880 - RNA, 23 nt, Human
ccagcucaguccugacucaaccu

SEQ ID NO: 948881 - RNA, 20 nt, Human
ccagcuccucuucuucucuu

SEQ ID NO: 948882 - RNA, 21 nt, Human
ccagcugaucuuaacaaguua

SEQ ID NO: 948883 - RNA, 19 nt, Human
ccaguccuuucugcuaaag

SEQ ID NO: 948884 - RNA, 19 nt, Human
cccgcggcggagacaaggc

SEQ ID NO: 948885 - RNA, 24 nt, Human
cccgcggcggagacaaggcagaac

SEQ ID NO: 948886 - RNA, 18 nt, Human
ccguaucaaauuuccaga

SEQ ID NO: 948887 - RNA, 18 nt, Human
cuaauucauucugaaacc

SEQ ID NO: 948888 - RNA, 20 nt, Human
cuagucucaagaaauuuaaa

SEQ ID NO: 948889 - RNA, 20 nt, Human
cucaccccugacccgcggcc

SEQ ID NO: 948890 - RNA, 20 nt, Human
gaaaaagaaaacacugaaaa

SEQ ID NO: 948891 - RNA, 22 nt, Human
gaaaaagaaaacacugaaaagu

SEQ ID NO: 948892 - RNA, 19 nt, Human
ggagaacaaaguccuacag

SEQ ID NO: 948893 - RNA, 18 nt, Human
ggagagaagagguagagg

SEQ ID NO: 948894 - RNA, 20 nt, Human
ggcagaagaagacagucguu

SEQ ID NO: 948895 - RNA, 20 nt, Human
guggagaacaaaguccuaca

SEQ ID NO: 948896 - RNA, 19 nt, Human
uaaaaaggagacugagagu

SEQ ID NO: 948897 - RNA, 25 nt, Human
uaaaagcacaaaauaaacaaagcug

SEQ ID NO: 948898 - RNA, 26 nt, Human
uaacuuuaacaagaaagccagcugau

SEQ ID NO: 948899 - RNA, 22 nt, Human
uaaguuccugacuagccagcuc

SEQ ID NO: 948900 - RNA, 22 nt, Human
uacagugggcuggaaaaagaaa

SEQ ID NO: 948901 - RNA, 20 nt, Human
uacccacaagauuucuucac

SEQ ID NO: 948902 - RNA, 20 nt, Human
uacugaagaggagagccugg

SEQ ID NO: 948903 - RNA, 20 nt, Human
uagaagacaaagggucauau

SEQ ID NO: 948904 - RNA, 23 nt, Human
uagaagacaaagggucauauuau

SEQ ID NO: 948905 - RNA, 26 nt, Human
uagccagcuccucuucuucucuugac

SEQ ID NO: 948906 - RNA, 18 nt, Human
ucaaaaauaccaacuuga

SEQ ID NO: 948907 - RNA, 19 nt, Human
ucaaaaauaccaacuugau

SEQ ID NO: 948908 - RNA, 21 nt, Human
ucaaauuuccagaauacccac

SEQ ID NO: 948909 - RNA, 23 nt, Human
ucaaccucuucaaucuuuauuuc

SEQ ID NO: 948910 - RNA, 19 nt, Human
ucacaacaacccuguaaaa

SEQ ID NO: 948911 - RNA, 22 nt, Human
uggaaaaagaaaacacugaaaa

SEQ ID NO: 948912 - RNA, 21 nt, Human
uggaaguaaagucuggaggaa

SEQ ID NO: 948913 - RNA, 19 nt, Human
uggcagaagaagacagucg

SEQ ID NO: 948914 - RNA, 18 nt, Human
ugggcuggaaaaagaaaa

SEQ ID NO: 948915 - RNA, 24 nt, Human
ugggcuggaaaaagaaaacacuga

SEQ ID NO: 948916 - RNA, 22 nt, Human
uggugguuaaugaauaaguucc

SEQ ID NO: 948917 - RNA, 19 nt, Human
uguggagaacaaaguccua

SEQ ID NO: 948918 - RNA, 19 nt, Human
uuagggcugcaaaccaccc

SEQ ID NO: 948919 - RNA, 21 nt, Human
uugcuacacaaaugaagaaaa

SEQ ID NO: 948920 - RNA, 20 nt, Human
uuuuuaaaauaucacucccc

SEQ ID NO: 948921 - RNA, 26 nt, Human
aaaaagccacugcucuuuggagccaa

SEQ ID NO: 948922 - RNA, 22 nt, Human
aaaggccugcauggccuacaga

SEQ ID NO: 948923 - RNA, 23 nt, Human
aagccacugcucuuuggagccaa

SEQ ID NO: 948924 - RNA, 23 nt, Human
acccagacaccuagguucccagu

SEQ ID NO: 948925 - RNA, 24 nt, Human
agacccucaugaaguuucuugagg

SEQ ID NO: 948926 - RNA, 23 nt, Human
agagaaacccauccauccgcagg

SEQ ID NO: 948927 - RNA, 21 nt, Human
agagaagagauggaaggaggg

SEQ ID NO: 948928 - RNA, 24 nt, Human
agagacccucaugaaguuucuuga

SEQ ID NO: 948929 - RNA, 24 nt, Human
agagagcagccauacagacaccac

SEQ ID NO: 948930 - RNA, 19 nt, Human
agagauggaaggaggggga

SEQ ID NO: 948931 - RNA, 22 nt, Human
agauggaaggagggggagaggc

SEQ ID NO: 948932 - RNA, 20 nt, Human
aggagggggagaggccaaag

SEQ ID NO: 948933 - RNA, 21 nt, Human
aggagggggagaggccaaagg

SEQ ID NO: 948934 - RNA, 23 nt, Human
aggagggggagaggccaaagggu

SEQ ID NO: 948935 - RNA, 18 nt, Human
aggccuuuccaagcgcau

SEQ ID NO: 948936 - RNA, 20 nt, Human
agggacaguguggacucagg

SEQ ID NO: 948937 - RNA, 18 nt, Human
agggcaagagagagaaga

SEQ ID NO: 948938 - RNA, 22 nt, Human
auagggcaagagagagaagaga

SEQ ID NO: 948939 - RNA, 27 nt, Human
caaaaagccacugcucuuuggagccaa

SEQ ID NO: 948940 - RNA, 18 nt, Human
caaaggccugcauggccu

SEQ ID NO: 948941 - RNA, 20 nt, Human
cacagcagcuacacuggaac

SEQ ID NO: 948942 - RNA, 23 nt, Human
cacuccucuucucucggcagggg

SEQ ID NO: 948943 - RNA, 20 nt, Human
cacuggaaccacagugcaca

SEQ ID NO: 948944 - RNA, 19 nt, Human
caggagagagaguguaaug

SEQ ID NO: 948945 - RNA, 20 nt, Human
cagggacaguguggacucag

SEQ ID NO: 948946 - RNA, 23 nt, Human
caggugacagccccgcuccgccc

SEQ ID NO: 948947 - RNA, 19 nt, Human
cauacagacaccacaugug

SEQ ID NO: 948948 - RNA, 20 nt, Human
ccacauguguuccuccuggg

SEQ ID NO: 948949 - RNA, 21 nt, Human
ccacugcucuuuggagccaag

SEQ ID NO: 948950 - RNA, 23 nt, Human
ccccugcacaccgcgcccggccg

SEQ ID NO: 948951 - RNA, 22 nt, Human
cccgcggucuccucagcauccc

SEQ ID NO: 948952 - RNA, 21 nt, Human
cccggggccgcgccggacccu

SEQ ID NO: 948953 - RNA, 22 nt, Human
cccggggccgcgccggacccuc

SEQ ID NO: 948954 - RNA, 18 nt, Human
ccgcgcccggccggccga

SEQ ID NO: 948955 - RNA, 22 nt, Human
ccgcgcccggccggccgaggcg

SEQ ID NO: 948956 - RNA, 18 nt, Human
ccgcgucccuccucagcc

SEQ ID NO: 948957 - RNA, 19 nt, Human
ccucaugaaguuucuugag

SEQ ID NO: 948958 - RNA, 19 nt, Human
ccuccuggcuccacacaga

SEQ ID NO: 948959 - RNA, 19 nt, Human
cgcaucucauguuuucagc

SEQ ID NO: 948960 - RNA, 22 nt, Human
cgccucaccccugcacaccgcg

SEQ ID NO: 948961 - RNA, 25 nt, Human
cgcuccgcccuuugugagggacuca

SEQ ID NO: 948962 - RNA, 21 nt, Human
cggacccuccuccgcgucccu

SEQ ID NO: 948963 - RNA, 24 nt, Human
cugaggcaguggcagugggcucac

SEQ ID NO: 948964 - RNA, 26 nt, Human
cugcgacaaaggccugcauggccuac

SEQ ID NO: 948965 - RNA, 20 nt, Human
cuggaaccacagugcacaug

SEQ ID NO: 948966 - RNA, 24 nt, Human
cuggcgcgggcccgcggucuccuc

SEQ ID NO: 948967 - RNA, 21 nt, Human
cugggaagguuugcugcgaca

SEQ ID NO: 948968 - RNA, 21 nt, Human
cuggugcauaggagagggaaa

SEQ ID NO: 948969 - RNA, 19 nt, Human
cugguggcugguugugcug

SEQ ID NO: 948970 - RNA, 21 nt, Human
gagagaagagauggaaggagg

SEQ ID NO: 948971 - RNA, 19 nt, Human
gaggcaaaagaaguggcag

SEQ ID NO: 948972 - RNA, 25 nt, Human
gaggcaguggcagugggcucacagc

SEQ ID NO: 948973 - RNA, 20 nt, Human
gagggggagaggccaaaggg

SEQ ID NO: 948974 - RNA, 23 nt, Human
gagugugugugugugggaggcug

SEQ ID NO: 948975 - RNA, 19 nt, Human
gaucuccaggugacagccc

SEQ ID NO: 948976 - RNA, 18 nt, Human
gccauacagacaccacau

SEQ ID NO: 948977 - RNA, 19 nt, Human
gcuacacuggaaccacagu

SEQ ID NO: 948978 - RNA, 20 nt, Human
gcugguuuuacuuggcucaa

SEQ ID NO: 948979 - RNA, 19 nt, Human
gcuuagaugauuugauagc

SEQ ID NO: 948980 - RNA, 22 nt, Human
ggaaaugauaagaggaaauggc

SEQ ID NO: 948981 - RNA, 18 nt, Human
ggaaggagggggagaggc

SEQ ID NO: 948982 - RNA, 23 nt, Human
ggacaguguggacucagggccca

SEQ ID NO: 948983 - RNA, 21 nt, Human
ggagagagaguguaauggagu

SEQ ID NO: 948984 - RNA, 22 nt, Human
ggagaugaggcuccaggagaga

SEQ ID NO: 948985 - RNA, 19 nt, Human
ggcuugaaagaccugcucu

SEQ ID NO: 948986 - RNA, 23 nt, Human
ggggagaggccaaagggucggca

SEQ ID NO: 948987 - RNA, 19 nt, Human
guagaaagagagauagggc

SEQ ID NO: 948988 - RNA, 28 nt, Human
guagagagcagccauacagacaccacaa

SEQ ID NO: 948989 - RNA, 24 nt, Human
guaugggccauucucaaaaagcca

SEQ ID NO: 948990 - RNA, 19 nt, Human
gucacaagacccagacacc

SEQ ID NO: 948991 - RNA, 19 nt, Human
guguuguaauccugagggg

SEQ ID NO: 948992 - RNA, 22 nt, Human
uacagagaaacccauccauccg

SEQ ID NO: 948993 - RNA, 21 nt, Human
ucacaagacccagacaccuag

SEQ ID NO: 948994 - RNA, 20 nt, Human
ucccgaacccggagcggcuc

SEQ ID NO: 948995 - RNA, 21 nt, Human
ucccggggccgcgccggaccc

SEQ ID NO: 948996 - RNA, 25 nt, Human
ucccugcuggggcucuggacgggcc

SEQ ID NO: 948997 - RNA, 22 nt, Human
ucccuucauccagccgggccag

SEQ ID NO: 948998 - RNA, 22 nt, Human
ucugaggcaguggcagugggcu

SEQ ID NO: 948999 - RNA, 22 nt, Human
ugacagccccgcuccgcccuuu

SEQ ID NO: 949000 - RNA, 18 nt, Human
ugacauggagaugaggcu

SEQ ID NO: 949001 - RNA, 21 nt, Human
ugaggcaaaagaaguggcagc

SEQ ID NO: 949002 - RNA, 18 nt, Human
ugaggcaguggcaguggg

SEQ ID NO: 949003 - RNA, 18 nt, Human
ugagggggaaauggguga

SEQ ID NO: 949004 - RNA, 21 nt, Human
ugcuggggcucuggacgggcc

SEQ ID NO: 949005 - RNA, 21 nt, Human
uggaguuaguaagagacccuc

SEQ ID NO: 949006 - RNA, 18 nt, Human
uggcagugggcucacagc

SEQ ID NO: 949007 - RNA, 21 nt, Human
uggccuuaucaaaggcauaca

SEQ ID NO: 949008 - RNA, 20 nt, Human
ugucaaagugcuuugguugu

SEQ ID NO: 949009 - RNA, 21 nt, Human
ugucacaagacccagacaccu

SEQ ID NO: 949010 - RNA, 18 nt, Human
uguccagcaacagucuga

SEQ ID NO: 949011 - RNA, 19 nt, Human
ugugagggacucacccucc

SEQ ID NO: 949012 - RNA, 23 nt, Human
ugugcugguuuuacuuggcucaa

SEQ ID NO: 949013 - RNA, 23 nt, Human
uucacaguggcucccuucugagg

SEQ ID NO: 949014 - RNA, 26 nt, Human
uucacaguggcucccuucugaggcag

SEQ ID NO: 949015 - RNA, 21 nt, Human
uugguugucacaagacccaga

SEQ ID NO: 949016 - RNA, 22 nt, Human
uugguugucacaagacccagac

SEQ ID NO: 949017 - RNA, 24 nt, Human
uuuuuuuuuuuucugaaguagaaa

SEQ ID NO: 949018 - RNA, 27 nt, Human
uuuuuuuuuuuuuuuuuuuuucugggg

SEQ ID NO: 949019 - RNA, 21 nt, Human
caauucccuguuccccccacc

SEQ ID NO: 949020 - RNA, 21 nt, Human
ccccaauucccuguucccccc

SEQ ID NO: 949021 - RNA, 22 nt, Human
cccuguuccccccaccaagucc

SEQ ID NO: 949022 - RNA, 21 nt, Human
ccucccucccauccccaauuc

SEQ ID NO: 949023 - RNA, 22 nt, Human
gccucccucccauccccaauuc

SEQ ID NO: 949024 - RNA, 24 nt, Human
uagauuccaggcccagggacuccc

SEQ ID NO: 949025 - RNA, 21 nt, Human
uaucuuuauugccucccuccc

SEQ ID NO: 949026 - RNA, 21 nt, Human
uccccaauucccuguuccccc

SEQ ID NO: 949027 - RNA, 21 nt, Human
uuccaggcccagggacucccu

SEQ ID NO: 949028 - RNA, 22 nt, Human
aaaaagucagugccuaugagag

SEQ ID NO: 949029 - RNA, 23 nt, Human
aaguguuuccuggauauuauucc

SEQ ID NO: 949030 - RNA, 19 nt, Human
acugaccaccugcacuguu

SEQ ID NO: 949031 - RNA, 20 nt, Human
acuguuaaagaguaaaggaa

SEQ ID NO: 949032 - RNA, 18 nt, Human
agacaaaagcauagugac

SEQ ID NO: 949033 - RNA, 22 nt, Human
auaauaacaaaaagucagugcc

SEQ ID NO: 949034 - RNA, 23 nt, Human
auccuguucagaggucccuuuca

SEQ ID NO: 949035 - RNA, 23 nt, Human
aucucagccaggcagacagaggg

SEQ ID NO: 949036 - RNA, 24 nt, Human
auguaccacaccuacacacccuuc

SEQ ID NO: 949037 - RNA, 20 nt, Human
auugugugaucaaguguccu

SEQ ID NO: 949038 - RNA, 22 nt, Human
cacacaauagaagauuuguaua

SEQ ID NO: 949039 - RNA, 23 nt, Human
caccuacacacccuucacaacau

SEQ ID NO: 949040 - RNA, 20 nt, Human
cauacacauguaccacaccu

SEQ ID NO: 949041 - RNA, 25 nt, Human
cauacacauguaccacaccuacaca

SEQ ID NO: 949042 - RNA, 22 nt, Human
cauguaccacaccuacacaccc

SEQ ID NO: 949043 - RNA, 23 nt, Human
cauguaccacaccuacacacccu

SEQ ID NO: 949044 - RNA, 18 nt, Human
ccacaccuacacacccuu

SEQ ID NO: 949045 - RNA, 22 nt, Human
ccaccugcacuguuaaagagua

SEQ ID NO: 949046 - RNA, 24 nt, Human
ccaccugcacuguuaaagaguaaa

SEQ ID NO: 949047 - RNA, 21 nt, Human
ccccccaagauguuagauaag

SEQ ID NO: 949048 - RNA, 24 nt, Human
cugcgaguggcuccagcaaguguu

SEQ ID NO: 949049 - RNA, 18 nt, Human
cugcugcucuuuggaaaa

SEQ ID NO: 949050 - RNA, 19 nt, Human
gggcagcaguuggaaugaa

SEQ ID NO: 949051 - RNA, 22 nt, Human
gugacauacacauguaccacaa

SEQ ID NO: 949052 - RNA, 24 nt, Human
uaugagagacaaaagcauagugac

SEQ ID NO: 949053 - RNA, 21 nt, Human
ucaaaauauucuuucccccca

SEQ ID NO: 949054 - RNA, 23 nt, Human
ucacaacauuuuccacacaauag

SEQ ID NO: 949055 - RNA, 21 nt, Human
ucaucuccucgcuguccccaa

SEQ ID NO: 949056 - RNA, 22 nt, Human
ucucagccaggcagacagaggg

SEQ ID NO: 949057 - RNA, 26 nt, Human
ugacauacacauguaccacaccuaca

SEQ ID NO: 949058 - RNA, 24 nt, Human
ugagagacaaaagcauagugacca

SEQ ID NO: 949059 - RNA, 21 nt, Human
ugcacuguuaaagaguaaagg

SEQ ID NO: 949060 - RNA, 19 nt, Human
ugcccacaugcaucucagc

SEQ ID NO: 949061 - RNA, 20 nt, Human
uguaccacaccuacacaccc

SEQ ID NO: 949062 - RNA, 21 nt, Human
uguaccacaccuacacacccu

SEQ ID NO: 949063 - RNA, 24 nt, Human
uguauaagaucaaguuuauuauuu

SEQ ID NO: 949064 - RNA, 20 nt, Human
uuugcagaaauccuguucag

SEQ ID NO: 949065 - RNA, 21 nt, Human
uuugccacuuguuagugacau

SEQ ID NO: 949066 - RNA, 18 nt, Human
ccuagcagcggcuugaaa

SEQ ID NO: 949067 - RNA, 19 nt, Human
cucugcgcagauccucccc

SEQ ID NO: 949068 - RNA, 18 nt, Human
uuuauugagauccucccg

SEQ ID NO: 949069 - RNA, 24 nt, Human
uuugggugaugcugcggucucugc

SEQ ID NO: 949070 - RNA, 21 nt, Human
aaaacauuuggaacuuaagga

SEQ ID NO: 949071 - RNA, 18 nt, Human
accaauagcuuauuuccc

SEQ ID NO: 949072 - RNA, 21 nt, Human
accggaacccagggacgucug

SEQ ID NO: 949073 - RNA, 22 nt, Human
acuuuaaggagugucguucaga

SEQ ID NO: 949074 - RNA, 25 nt, Human
agcggaaaacauuuggaacuuaagg

SEQ ID NO: 949075 - RNA, 22 nt, Human
agcuuauuucccugggaaacag

SEQ ID NO: 949076 - RNA, 19 nt, Human
aggagugucguucagacac

SEQ ID NO: 949077 - RNA, 20 nt, Human
caaaacgaguauuaggaaug

SEQ ID NO: 949078 - RNA, 24 nt, Human
caucacauccuaucaccuuccuuc

SEQ ID NO: 949079 - RNA, 23 nt, Human
ccaaaaugaugguaaacuuuuuu

SEQ ID NO: 949080 - RNA, 20 nt, Human
ccuuccuucuauucuucugc

SEQ ID NO: 949081 - RNA, 22 nt, Human
ccuuccuucuauucuucugcuc

SEQ ID NO: 949082 - RNA, 18 nt, Human
cgacuccuccgcgaacac

SEQ ID NO: 949083 - RNA, 19 nt, Human
cuccgcgaacaccggaacc

SEQ ID NO: 949084 - RNA, 18 nt, Human
cuuggcuaucacaaauuc

SEQ ID NO: 949085 - RNA, 25 nt, Human
gcuauaucuuaaccucaauuuuuag

SEQ ID NO: 949086 - RNA, 21 nt, Human
ggaaaacauuuggaacuuaag

SEQ ID NO: 949087 - RNA, 19 nt, Human
uaacccagaacucaugcag

SEQ ID NO: 949088 - RNA, 21 nt, Human
uagcuauaucuuaaccucaau

SEQ ID NO: 949089 - RNA, 23 nt, Human
ucagacacuagcuauaucuuaac

SEQ ID NO: 949090 - RNA, 21 nt, Human
uccuccgcgaacaccggaacu

SEQ ID NO: 949091 - RNA, 21 nt, Human
uuagcggaaaacauuuggaac

SEQ ID NO: 949092 - RNA, 24 nt, Human
uuuuuuuuuuuuuuuuugauguug

SEQ ID NO: 949093 - RNA, 25 nt, Human
aaaagcuauaccugaaccggggccc

SEQ ID NO: 949094 - RNA, 30 nt, Human
aaacaucugagcaguuuaaguuaaaaauag

SEQ ID NO: 949095 - RNA, 20 nt, Human
aagcccagcugagcccggga

SEQ ID NO: 949096 - RNA, 18 nt, Human
aaguguccucccaagaca

SEQ ID NO: 949097 - RNA, 18 nt, Human
acaauguggaaacuuaca

SEQ ID NO: 949098 - RNA, 27 nt, Human
acacugccgaccuccuucccuaugggc

SEQ ID NO: 949099 - RNA, 19 nt, Human
acuuguggacacugaucuc

SEQ ID NO: 949100 - RNA, 22 nt, Human
agcaacaauguggaaacuuaca

SEQ ID NO: 949101 - RNA, 24 nt, Human
auaaaaagcuauaccugaacaaaa

SEQ ID NO: 949102 - RNA, 20 nt, Human
auggaucuuucuguccccac

SEQ ID NO: 949103 - RNA, 21 nt, Human
auggaucuuucuguccccacu

SEQ ID NO: 949104 - RNA, 18 nt, Human
cacugcucagcauguucc

SEQ ID NO: 949105 - RNA, 21 nt, Human
cagacaggcucacggcaugga

SEQ ID NO: 949106 - RNA, 18 nt, Human
caggauggaucuuucugu

SEQ ID NO: 949107 - RNA, 24 nt, Human
cauggaccaauguuuccacaacuc

SEQ ID NO: 949108 - RNA, 21 nt, Human
cauguggagucuaaggcccug

SEQ ID NO: 949109 - RNA, 21 nt, Human
ccacaggcagacaggcucacg

SEQ ID NO: 949110 - RNA, 24 nt, Human
ccucacacugccgaccuccuuccc

SEQ ID NO: 949111 - RNA, 19 nt, Human
cgacuagagaaugucaguu

SEQ ID NO: 949112 - RNA, 23 nt, Human
gaaacucagcaccauagcagcuc

SEQ ID NO: 949113 - RNA, 22 nt, Human
gcagacaggcucacggcaugga

SEQ ID NO: 949114 - RNA, 20 nt, Human
gcccacauggcgcaaacagg

SEQ ID NO: 949115 - RNA, 19 nt, Human
ggaagcucacguguccaca

SEQ ID NO: 949116 - RNA, 25 nt, Human
gggggucaaguuugggggugacugu

SEQ ID NO: 949117 - RNA, 18 nt, Human
guugggggucaaguuugg

SEQ ID NO: 949118 - RNA, 19 nt, Human
uaaaaagcuauaccugaac

SEQ ID NO: 949119 - RNA, 22 nt, Human
uaaaagaagcuagaugcagccc

SEQ ID NO: 949120 - RNA, 21 nt, Human
uaaaauagcuucagccuuuga

SEQ ID NO: 949121 - RNA, 18 nt, Human
uaauaaggaauuuagcac

SEQ ID NO: 949122 - RNA, 19 nt, Human
uacaaaacaauguaaacug

SEQ ID NO: 949123 - RNA, 18 nt, Human
uagcacugaaaauacacc

SEQ ID NO: 949124 - RNA, 25 nt, Human
uagcuucagccuuugaacauaacuu

SEQ ID NO: 949125 - RNA, 23 nt, Human
uccacaggcagacaggcucacgg

SEQ ID NO: 949126 - RNA, 22 nt, Human
ucgacuagagaaugucaguugu

SEQ ID NO: 949127 - RNA, 22 nt, Human
ugaacauucagaggagccacug

SEQ ID NO: 949128 - RNA, 18 nt, Human
ugaugcccacauggcgca

SEQ ID NO: 949129 - RNA, 24 nt, Human
ugcagaaacagcaacaauguggaa

SEQ ID NO: 949130 - RNA, 21 nt, Human
uggcugaugcccacauggcgc

SEQ ID NO: 949131 - RNA, 22 nt, Human
ugugauaaagcccagcugagcc

SEQ ID NO: 949132 - RNA, 19 nt, Human
uguggagucuaaggcccug

SEQ ID NO: 949133 - RNA, 28 nt, Human
uuagcacacacacuucuaauaaaagaag

SEQ ID NO: 949134 - RNA, 18 nt, Human
uugggggugacuguccug

SEQ ID NO: 949135 - RNA, 22 nt, Human
uuuaaaauauacaugacuaaua

SEQ ID NO: 949136 - RNA, 23 nt, Human
uuuauuccuaaaguuaaaaucag

SEQ ID NO: 949137 - RNA, 24 nt, Human
uuuuuuuuuuuuaaaagcuuuuaa

SEQ ID NO: 949138 - RNA, 24 nt, Human
uuuuuuuuuuuuuaaaagcuuuua

SEQ ID NO: 949139 - RNA, 26 nt, Human
uuuuuuuuuuuuuuuuaaaagcuuuu

SEQ ID NO: 949140 - RNA, 23 nt, Human
uuuuuuuuuuuuuuuuuuaaaag

SEQ ID NO: 949141 - RNA, 21 nt, Human
aagcagcaaggccagagugag

SEQ ID NO: 949142 - RNA, 23 nt, Human
aagcuucagcccaccaaggggca

SEQ ID NO: 949143 - RNA, 19 nt, Human
agagaagcagcaaggccag

SEQ ID NO: 949144 - RNA, 20 nt, Human
agagaagcagcaaggccaga

SEQ ID NO: 949145 - RNA, 19 nt, Human
agcagcaauagcuuccuuc

SEQ ID NO: 949146 - RNA, 25 nt, Human
aggcaggcacuugaaucagagcuca

SEQ ID NO: 949147 - RNA, 23 nt, Human
caauagcuuccuucugcauguuc

SEQ ID NO: 949148 - RNA, 22 nt, Human
cagcaaggccagagugaggucc

SEQ ID NO: 949149 - RNA, 23 nt, Human
ccucagggucugaagcuccuuca

SEQ ID NO: 949150 - RNA, 18 nt, Human
cucagagcaugauggaag

SEQ ID NO: 949151 - RNA, 19 nt, Human
cuccuccaugaagcuucag

SEQ ID NO: 949152 - RNA, 18 nt, Human
cuugaaucagagcucagc

SEQ ID NO: 949153 - RNA, 21 nt, Human
cuuguuuuccuggaaaccuug

SEQ ID NO: 949154 - RNA, 22 nt, Human
gcagcaauagcuuccuucugca

SEQ ID NO: 949155 - RNA, 22 nt, Human
gugagcagcaauagcuuccuuc

SEQ ID NO: 949156 - RNA, 19 nt, Human
uaacacucugaauuuguau

SEQ ID NO: 949157 - RNA, 19 nt, Human
ucagagcucagcaggccca

SEQ ID NO: 949158 - RNA, 19 nt, Human
ucagcaggcccaggauggc

SEQ ID NO: 949159 - RNA, 27 nt, Human
ucagcaggcccaggauggcugcagacu

SEQ ID NO: 949160 - RNA, 22 nt, Human
ucugcauguuccucagggucug

SEQ ID NO: 949161 - RNA, 22 nt, Human
uggaagaaagaaaaguucagga

SEQ ID NO: 949162 - RNA, 22 nt, Human
uggaagaaagaaaaguucagga

SEQ ID NO: 949163 - RNA, 26 nt, Human
uggcaagcuccuccuccaugaagcuu

SEQ ID NO: 949164 - RNA, 21 nt, Human
uucagcccaccaaggggcaga

SEQ ID NO: 949165 - RNA, 19 nt, Human
uuggauggcaagcuccucc

SEQ ID NO: 949166 - RNA, 23 nt, Human
aaaaaaaaaccagguucauggaa

SEQ ID NO: 949167 - RNA, 22 nt, Human
aaaaaaccagguucauggagcc

SEQ ID NO: 949168 - RNA, 22 nt, Human
aaaaaaccagguucauggagcg

SEQ ID NO: 949169 - RNA, 18 nt, Human
aaaaaaccaguguacagu

SEQ ID NO: 949170 - RNA, 22 nt, Human
aaaaaacccacagcugaguuaa

SEQ ID NO: 949171 - RNA, 19 nt, Human
aaaaaaccccauacagcua

SEQ ID NO: 949172 - RNA, 24 nt, Human
aaaaacaaacaagaacccacaaaa

SEQ ID NO: 949173 - RNA, 29 nt, Human
aaaacaaacaagaacccacaaaaaacccc

SEQ ID NO: 949174 - RNA, 22 nt, Human
aaacaaacaagaacccacaaaa

SEQ ID NO: 949175 - RNA, 19 nt, Human
aaacaagaacccacaaaaa

SEQ ID NO: 949176 - RNA, 21 nt, Human
aaacaagaacccacaaaaaac

SEQ ID NO: 949177 - RNA, 22 nt, Human
aaagaucacguccacuguaauc

SEQ ID NO: 949178 - RNA, 19 nt, Human
aaagggagggcuggaagcc

SEQ ID NO: 949179 - RNA, 21 nt, Human
aaaugcuaauauugcuaacug

SEQ ID NO: 949180 - RNA, 20 nt, Human
aacaaugucucgcaaagggc

SEQ ID NO: 949181 - RNA, 24 nt, Human
aacaccaaagaugacaauucaugc

SEQ ID NO: 949182 - RNA, 22 nt, Human
aacagcuuucuaaugaaaaggc

SEQ ID NO: 949183 - RNA, 21 nt, Human
aaccgaccgggccucggcccc

SEQ ID NO: 949184 - RNA, 21 nt, Human
aacugcaggaagaggcagaca

SEQ ID NO: 949185 - RNA, 23 nt, Human
aagaacccacaaaaaacccacag

SEQ ID NO: 949186 - RNA, 25 nt, Human
aagaacccacaaaaaacccacagcu

SEQ ID NO: 949187 - RNA, 21 nt, Human
acaaacaagaacccacaaaaa

SEQ ID NO: 949188 - RNA, 24 nt, Human
acaagaacccacaaaaaacccaca

SEQ ID NO: 949189 - RNA, 24 nt, Human
acacucacacagauacacuuauca

SEQ ID NO: 949190 - RNA, 21 nt, Human
accaccaauaaagagaaggug

SEQ ID NO: 949191 - RNA, 21 nt, Human
acuagacuacaaaucuaaaca

SEQ ID NO: 949192 - RNA, 20 nt, Human
agaaagguccauugacccuu

SEQ ID NO: 949193 - RNA, 21 nt, Human
agacaauguugaauacacuaa

SEQ ID NO: 949194 - RNA, 23 nt, Human
agacuagacuacaaaucuaaaca

SEQ ID NO: 949195 - RNA, 20 nt, Human
aggaagaaggcuuuucucau

SEQ ID NO: 949196 - RNA, 27 nt, Human
aggaagaaggcuuuucuccuccccugg

SEQ ID NO: 949197 - RNA, 24 nt, Human
aggcacugucacugcgcuuccuuc

SEQ ID NO: 949198 - RNA, 21 nt, Human
agggcuggaagccacacagau

SEQ ID NO: 949199 - RNA, 22 nt, Human
agugugcaacagcaaacacaag

SEQ ID NO: 949200 - RNA, 18 nt, Human
auagaguuuucuuaaaac

SEQ ID NO: 949201 - RNA, 20 nt, Human
auagaguuuucuuaaaacaa

SEQ ID NO: 949202 - RNA, 21 nt, Human
aucacacgggccgcgccagga

SEQ ID NO: 949203 - RNA, 19 nt, Human
aucacagguacuuucugua

SEQ ID NO: 949204 - RNA, 24 nt, Human
augccaaaaaacaaacaagaaccc

SEQ ID NO: 949205 - RNA, 21 nt, Human
auuccauucacugggagggaa

SEQ ID NO: 949206 - RNA, 27 nt, Human
auuccauucacugggagggaaggggau

SEQ ID NO: 949207 - RNA, 22 nt, Human
caaaaaacaaacaagaacccac

SEQ ID NO: 949208 - RNA, 24 nt, Human
caaaaaacaaacaagaacccacaa

SEQ ID NO: 949209 - RNA, 25 nt, Human
caaaaaacaaacaagaacccacaaa

SEQ ID NO: 949210 - RNA, 28 nt, Human
caaaaaacaccccugugagccggggccc

SEQ ID NO: 949211 - RNA, 21 nt, Human
caaacaagaacccacaaaaaa

SEQ ID NO: 949212 - RNA, 21 nt, Human
caaaugauuccaaaaaacacc

SEQ ID NO: 949213 - RNA, 22 nt, Human
caacagaauaaaaaaaaaccag

SEQ ID NO: 949214 - RNA, 19 nt, Human
caacccucucaacuccaaa

SEQ ID NO: 949215 - RNA, 25 nt, Human
caagaacccacaaaaaacccacagc

SEQ ID NO: 949216 - RNA, 19 nt, Human
caagggaaaaaaaccagug

SEQ ID NO: 949217 - RNA, 19 nt, Human
caauaaagagaaggugaca

SEQ ID NO: 949218 - RNA, 26 nt, Human
cacaagggaaaaaaaccaguguacag

SEQ ID NO: 949219 - RNA, 23 nt, Human
caccaaagaugacaauucaugcc

SEQ ID NO: 949220 - RNA, 21 nt, Human
cacccaaacuaaauuugugcu

SEQ ID NO: 949221 - RNA, 22 nt, Human
cacccccggaaccccggcucca

SEQ ID NO: 949222 - RNA, 26 nt, Human
cacgcccagagaugacagagucgccu

SEQ ID NO: 949223 - RNA, 23 nt, Human
cacucggaaugaucacacaaaaa

SEQ ID NO: 949224 - RNA, 18 nt, Human
cacugcgcuuccuuccuc

SEQ ID NO: 949225 - RNA, 21 nt, Human
cacugcgcuuccuuccucccg

SEQ ID NO: 949226 - RNA, 18 nt, Human
cacuugggaggagaggga

SEQ ID NO: 949227 - RNA, 23 nt, Human
cagcugccugaagcaaaggaaga

SEQ ID NO: 949228 - RNA, 23 nt, Human
cagcuugugcuauugcaaacaaa

SEQ ID NO: 949229 - RNA, 21 nt, Human
cauaauuaaaacuacacacac

SEQ ID NO: 949230 - RNA, 20 nt, Human
cauccugaaaccaggguuuc

SEQ ID NO: 949231 - RNA, 25 nt, Human
caugccaaaaaacaaacaagaaccc

SEQ ID NO: 949232 - RNA, 21 nt, Human
ccaaaaaacaaacaagaaccc

SEQ ID NO: 949233 - RNA, 25 nt, Human
ccaaaaaacaaacaagaacccacaa

SEQ ID NO: 949234 - RNA, 24 nt, Human
ccaaagaugacaauucaugccaaa

SEQ ID NO: 949235 - RNA, 18 nt, Human
ccacaggagcuugaacac

SEQ ID NO: 949236 - RNA, 21 nt, Human
ccagcccgcggccagcucgcc

SEQ ID NO: 949237 - RNA, 24 nt, Human
ccauccucuccgcccccacgcccc

SEQ ID NO: 949238 - RNA, 19 nt, Human
cccacagcugaguuaagau

SEQ ID NO: 949239 - RNA, 28 nt, Human
cccacgccccaaccgaccgggccucggc

SEQ ID NO: 949240 - RNA, 18 nt, Human
ccccaaccgaccgggccu

SEQ ID NO: 949241 - RNA, 21 nt, Human
ccccacgccccaaccgaccgg

SEQ ID NO: 949242 - RNA, 23 nt, Human
ccccacgccccaaccgaccgggc

SEQ ID NO: 949243 - RNA, 18 nt, Human
cccccggaaccccggcuc

SEQ ID NO: 949244 - RNA, 20 nt, Human
cccccggaaccccggcucca

SEQ ID NO: 949245 - RNA, 20 nt, Human
cccgcggccagcucgccaga

SEQ ID NO: 949246 - RNA, 20 nt, Human
cccugugagcuuucacaauc

SEQ ID NO: 949247 - RNA, 19 nt, Human
ccgcccccacgccccaacc

SEQ ID NO: 949248 - RNA, 23 nt, Human
ccggcaccaucacacgggccgcg

SEQ ID NO: 949249 - RNA, 19 nt, Human
ccuauuuuuuugaggggcu

SEQ ID NO: 949250 - RNA, 21 nt, Human
ccucacccccggaaccccggc

SEQ ID NO: 949251 - RNA, 21 nt, Human
ccuccuauugugacugcucgc

SEQ ID NO: 949252 - RNA, 22 nt, Human
ccugaaaccaggguuucgauga

SEQ ID NO: 949253 - RNA, 18 nt, Human
cgccuaacgccucggagg

SEQ ID NO: 949254 - RNA, 20 nt, Human
cgcggccagcucgccagauc

SEQ ID NO: 949255 - RNA, 21 nt, Human
cggcaaaaugagguaaccaaa

SEQ ID NO: 949256 - RNA, 23 nt, Human
cuaaaagaucacguccacuguaa

SEQ ID NO: 949257 - RNA, 24 nt, Human
cuauaucaucuguagcuaccacuu

SEQ ID NO: 949258 - RNA, 18 nt, Human
cucacaguuucugaaggc

SEQ ID NO: 949259 - RNA, 23 nt, Human
cucacaguuucugaaggcucuau

SEQ ID NO: 949260 - RNA, 25 nt, Human
cucggccccgucccgcaaccgguuc

SEQ ID NO: 949261 - RNA, 19 nt, Human
cugaagcaaaggaagaagg

SEQ ID NO: 949262 - RNA, 23 nt, Human
cuucagaauagacuagacuacaa

SEQ ID NO: 949263 - RNA, 18 nt, Human
gaagcaaaggaagaaggc

SEQ ID NO: 949264 - RNA, 21 nt, Human
gacuagauagaggcaacaaug

SEQ ID NO: 949265 - RNA, 22 nt, Human
gcaacacucggaaugaucacac

SEQ ID NO: 949266 - RNA, 24 nt, Human
gcagacaauguugaauacacuaaa

SEQ ID NO: 949267 - RNA, 23 nt, Human
gccaaaaaacaaacaagaaccca

SEQ ID NO: 949268 - RNA, 18 nt, Human
gccccaaccgaccgggcc

SEQ ID NO: 949269 - RNA, 24 nt, Human
gccccgggagauaucugcgagggg

SEQ ID NO: 949270 - RNA, 21 nt, Human
gccuaacgccucggaggcucc

SEQ ID NO: 949271 - RNA, 23 nt, Human
gcggauccucgcugggccgccgc

SEQ ID NO: 949272 - RNA, 18 nt, Human
ggcgcugucucuuaggac

SEQ ID NO: 949273 - RNA, 20 nt, Human
gggccucggccccgucccgc

SEQ ID NO: 949274 - RNA, 22 nt, Human
ggggguuaaaaaaacaccaaag

SEQ ID NO: 949275 - RNA, 20 nt, Human
guuguauuaaacuuuucuca

SEQ ID NO: 949276 - RNA, 20 nt, Human
uaaaaaaaaccccauacagc

SEQ ID NO: 949277 - RNA, 26 nt, Human
uaaaaaauguacaaacuuuguuaaaa

SEQ ID NO: 949278 - RNA, 22 nt, Human
uaaaagcacaugcuaaaagauc

SEQ ID NO: 949279 - RNA, 24 nt, Human
uaacacugaauggaaaacugacac

SEQ ID NO: 949280 - RNA, 21 nt, Human
uaagucacacagugcaaagaa

SEQ ID NO: 949281 - RNA, 18 nt, Human
uaagugacccacuuagga

SEQ ID NO: 949282 - RNA, 20 nt, Human
uacauuuauuaccaacaacc

SEQ ID NO: 949283 - RNA, 21 nt, Human
uacauuuauuaccaacaaccc

SEQ ID NO: 949284 - RNA, 18 nt, Human
uaccaacaacccucucaa

SEQ ID NO: 949285 - RNA, 21 nt, Human
uaccaacagggggacaaacaa

SEQ ID NO: 949286 - RNA, 18 nt, Human
uagauagaggcaacaaug

SEQ ID NO: 949287 - RNA, 26 nt, Human
uaguaacuuucauaaaaaauguacaa

SEQ ID NO: 949288 - RNA, 19 nt, Human
ucacaagugagucgguaga

SEQ ID NO: 949289 - RNA, 21 nt, Human
ucacccccggaaccccggcuc

SEQ ID NO: 949290 - RNA, 24 nt, Human
ucagugugcaacagcaaacacaag

SEQ ID NO: 949291 - RNA, 25 nt, Human
ucauacauuuauuaccaacaacccu

SEQ ID NO: 949292 - RNA, 22 nt, Human
ucauacgcugcgcauucauuuc

SEQ ID NO: 949293 - RNA, 23 nt, Human
ucauuccauucacugggagggaa

SEQ ID NO: 949294 - RNA, 21 nt, Human
uccgcccccacgccccaaccg

SEQ ID NO: 949295 - RNA, 24 nt, Human
uccucacccccggaaccccggcuc

SEQ ID NO: 949296 - RNA, 18 nt, Human
ucgccagauccgccgucc

SEQ ID NO: 949297 - RNA, 23 nt, Human
ucggaaugaucacacaaaaacca

SEQ ID NO: 949298 - RNA, 19 nt, Human
ucucauacacacguuagcu

SEQ ID NO: 949299 - RNA, 23 nt, Human
ucuccgcccccacgccccaaccg

SEQ ID NO: 949300 - RNA, 18 nt, Human
ucucuuaggacuuggacu

SEQ ID NO: 949301 - RNA, 22 nt, Human
ugaaggaagaacuagacaacuu

SEQ ID NO: 949302 - RNA, 20 nt, Human
ugaauggaaaacugacacag

SEQ ID NO: 949303 - RNA, 24 nt, Human
ugagaaaaugacucagcaaaugau

SEQ ID NO: 949304 - RNA, 18 nt, Human
ugaggaacacccaaacua

SEQ ID NO: 949305 - RNA, 24 nt, Human
ugagguaaccaaauguaccaacag

SEQ ID NO: 949306 - RNA, 23 nt, Human
ugauauaugauauugcaccuucu

SEQ ID NO: 949307 - RNA, 18 nt, Human
ugauccauccugaaacca

SEQ ID NO: 949308 - RNA, 25 nt, Human
ugauuugagaaaaugacucagcaaa

SEQ ID NO: 949309 - RNA, 28 nt, Human
ugcacacacaaaauuaagcuaaagaaaa

SEQ ID NO: 949310 - RNA, 24 nt, Human
ugcacacacucacacagauacacu

SEQ ID NO: 949311 - RNA, 21 nt, Human
ugcacugacaacccuaggggc

SEQ ID NO: 949312 - RNA, 22 nt, Human
ugcauuaaccaugugcauuuuu

SEQ ID NO: 949313 - RNA, 21 nt, Human
ugcccacaggagcuugaacac

SEQ ID NO: 949314 - RNA, 23 nt, Human
ugccugaagcaaaggaagaaggc

SEQ ID NO: 949315 - RNA, 18 nt, Human
ugcgaggggaggcuccgc

SEQ ID NO: 949316 - RNA, 25 nt, Human
uggaaacagcaaguuggagauuuaa

SEQ ID NO: 949317 - RNA, 20 nt, Human
uggaagaaagcuuugaagug

SEQ ID NO: 949318 - RNA, 19 nt, Human
ugggaggagagggaacagg

SEQ ID NO: 949319 - RNA, 19 nt, Human
ugggaggagagggaacagg

SEQ ID NO: 949320 - RNA, 25 nt, Human
uguaaaggaaaaaaaaguaucaaca

SEQ ID NO: 949321 - RNA, 25 nt, Human
uuaaauaacacaccagauuauacau

SEQ ID NO: 949322 - RNA, 20 nt, Human
uuaggcacugucacugcgcu

SEQ ID NO: 949323 - RNA, 30 nt, Human
uucaaaauuauucuaagaggcccaaauuuu

SEQ ID NO: 949324 - RNA, 20 nt, Human
uucaugggacuaguggucuu

SEQ ID NO: 949325 - RNA, 20 nt, Human
uuccaaaaaacaccccugug

SEQ ID NO: 949326 - RNA, 20 nt, Human
uuuggaguuccaaucacacg

SEQ ID NO: 949327 - RNA, 24 nt, Human
uuuggaguuccaaucacacgguua

SEQ ID NO: 949328 - RNA, 21 nt, Human
uuuuuauucaucaggaacagg

SEQ ID NO: 949329 - RNA, 19 nt, Human
aaaccaacuagaugggcag

SEQ ID NO: 949330 - RNA, 18 nt, Human
aacaaggacauggcucac

SEQ ID NO: 949331 - RNA, 21 nt, Human
aauagaaacugaugauguugg

SEQ ID NO: 949332 - RNA, 21 nt, Human
acaggacacaggcucagucac

SEQ ID NO: 949333 - RNA, 21 nt, Human
acgaagcuuggcugaucccau

SEQ ID NO: 949334 - RNA, 19 nt, Human
agcauggcugggcaggcag

SEQ ID NO: 949335 - RNA, 23 nt, Human
aggaaaagauggaacgaagggac

SEQ ID NO: 949336 - RNA, 19 nt, Human
aggagaugggggcacagcc

SEQ ID NO: 949337 - RNA, 20 nt, Human
aggguggggccacuagaccu

SEQ ID NO: 949338 - RNA, 19 nt, Human
aggguuagguccagggacc

SEQ ID NO: 949339 - RNA, 20 nt, Human
aggugacugcagcaaccuua

SEQ ID NO: 949340 - RNA, 18 nt, Human
auggaacgaagcuuggcu

SEQ ID NO: 949341 - RNA, 20 nt, Human
caccagcaggagggucagcc

SEQ ID NO: 949342 - RNA, 20 nt, Human
caccaggaugaaagcagggu

SEQ ID NO: 949343 - RNA, 18 nt, Human
caccuccacuguaguuaa

SEQ ID NO: 949344 - RNA, 20 nt, Human
cagccgauggagcauggcug

SEQ ID NO: 949345 - RNA, 20 nt, Human
caggacagaagcccugccga

SEQ ID NO: 949346 - RNA, 20 nt, Human
caggguccccaaaccaacua

SEQ ID NO: 949347 - RNA, 22 nt, Human
ccaggguccccaaaccaacuag

SEQ ID NO: 949348 - RNA, 22 nt, Human
ccagucucaaacaaggaacaag

SEQ ID NO: 949349 - RNA, 21 nt, Human
cccccaggguccaugguguuc

SEQ ID NO: 949350 - RNA, 24 nt, Human
cccccuaggcugcagcucugaccu

SEQ ID NO: 949351 - RNA, 23 nt, Human
ccccuaggcugcagcucugaccu

SEQ ID NO: 949352 - RNA, 23 nt, Human
cccuaggcugcagcucugaccuu

SEQ ID NO: 949353 - RNA, 26 nt, Human
cccugaggggcgucagacgggaggag

SEQ ID NO: 949354 - RNA, 24 nt, Human
ccucaggccucucaggcagaccuu

SEQ ID NO: 949355 - RNA, 24 nt, Human
ccugcagcuccaacccucuggccu

SEQ ID NO: 949356 - RNA, 21 nt, Human
cggccuggcuacucuggcugc

SEQ ID NO: 949357 - RNA, 23 nt, Human
cgggucccugcagcuccaacccu

SEQ ID NO: 949358 - RNA, 22 nt, Human
cuacucuggcugcaggccgagg

SEQ ID NO: 949359 - RNA, 24 nt, Human
cuccgggcacugcccucacagccg

SEQ ID NO: 949360 - RNA, 19 nt, Human
cuuccuggggccugcagcc

SEQ ID NO: 949361 - RNA, 19 nt, Human
gaccuuuaggaaaagaugg

SEQ ID NO: 949362 - RNA, 25 nt, Human
gagccagaccaagguguccagggaa

SEQ ID NO: 949363 - RNA, 22 nt, Human
gagcuucccaaaggaagcaaga

SEQ ID NO: 949364 - RNA, 21 nt, Human
gcagcaaccuuagagcuuccc

SEQ ID NO: 949365 - RNA, 20 nt, Human
gcaggguccccugaggggcg

SEQ ID NO: 949366 - RNA, 18 nt, Human
gcccccuaggcugcagcc

SEQ ID NO: 949367 - RNA, 18 nt, Human
gccuugggaugcaugagg

SEQ ID NO: 949368 - RNA, 18 nt, Human
gcuccucaggccucucag

SEQ ID NO: 949369 - RNA, 22 nt, Human
ggacauggcucacugguccuca

SEQ ID NO: 949370 - RNA, 22 nt, Human
ggccucucaggcagaccuuuuc

SEQ ID NO: 949371 - RNA, 19 nt, Human
ggccuggcuacucuggcug

SEQ ID NO: 949372 - RNA, 23 nt, Human
gggcaggggcugggcccaugggg

SEQ ID NO: 949373 - RNA, 21 nt, Human
ggggaggagaugggggcacag

SEQ ID NO: 949374 - RNA, 20 nt, Human
gggguggggaggagaugggg

SEQ ID NO: 949375 - RNA, 21 nt, Human
ggguagaucacagccugggga

SEQ ID NO: 949376 - RNA, 25 nt, Human
gggucccugcagcuccaacccucug

SEQ ID NO: 949377 - RNA, 19 nt, Human
ggguggggaggagaugggg

SEQ ID NO: 949378 - RNA, 21 nt, Human
ggguggggaggagaugggggc

SEQ ID NO: 949379 - RNA, 21 nt, Human
guuuauucaucacaauuaaca

SEQ ID NO: 949380 - RNA, 19 nt, Human
uacaagcaucucuagaaca

SEQ ID NO: 949381 - RNA, 18 nt, Human
uagaaacugaugauguug

SEQ ID NO: 949382 - RNA, 26 nt, Human
uagaacagaggcuguggguccaaacc

SEQ ID NO: 949383 - RNA, 18 nt, Human
uagaugggcaggggcugg

SEQ ID NO: 949384 - RNA, 24 nt, Human
uagcaugcaccaggguccccaaac

SEQ ID NO: 949385 - RNA, 21 nt, Human
uagcuggaaugauuggaaguu

SEQ ID NO: 949386 - RNA, 20 nt, Human
ucaaacaaggaacaaggaca

SEQ ID NO: 949387 - RNA, 21 nt, Human
ucacagggugucagggggaag

SEQ ID NO: 949388 - RNA, 23 nt, Human
ucagcccuuggcacaagagccag

SEQ ID NO: 949389 - RNA, 21 nt, Human
ucaggcagaccuuuucuguag

SEQ ID NO: 949390 - RNA, 22 nt, Human
ucauuugugagccaguaggcag

SEQ ID NO: 949391 - RNA, 18 nt, Human
uccacaggacagaagccc

SEQ ID NO: 949392 - RNA, 25 nt, Human
uccaccuccacuguaguuaaggcca

SEQ ID NO: 949393 - RNA, 18 nt, Human
ucccaaaggaagcaagug

SEQ ID NO: 949394 - RNA, 19 nt, Human
ucccugcagcuccaacccu

SEQ ID NO: 949395 - RNA, 24 nt, Human
uccuucagcccuuggcacaagagc

SEQ ID NO: 949396 - RNA, 19 nt, Human
ugaggggcgucagacggga

SEQ ID NO: 949397 - RNA, 20 nt, Human
ugagguggggguaaaugggc

SEQ ID NO: 949398 - RNA, 21 nt, Human
ugagguggggguaaaugggcu

SEQ ID NO: 949399 - RNA, 20 nt, Human
ugcaagaugaggaaggugac

SEQ ID NO: 949400 - RNA, 21 nt, Human
ugcaggguccccugaggggcg

SEQ ID NO: 949401 - RNA, 23 nt, Human
uggaaugauuggaaguuggccca

SEQ ID NO: 949402 - RNA, 24 nt, Human
uggagcauggcugggcaggcagac

SEQ ID NO: 949403 - RNA, 18 nt, Human
uggcagagaaauggagau

SEQ ID NO: 949404 - RNA, 23 nt, Human
ugggcaggggcugggcccauggg

SEQ ID NO: 949405 - RNA, 21 nt, Human
ugggcuccucaggccucucag

SEQ ID NO: 949406 - RNA, 20 nt, Human
uggggguaaaugggcuuggc

SEQ ID NO: 949407 - RNA, 20 nt, Human
ugggguggggaggagauggg

SEQ ID NO: 949408 - RNA, 20 nt, Human
ugggguggggaggagauggg

SEQ ID NO: 949409 - RNA, 26 nt, Human
ugggugaaggaaagucuuccgguccg

SEQ ID NO: 949410 - RNA, 27 nt, Human
ugucccuuccccuccugggaaguucca

SEQ ID NO: 949411 - RNA, 19 nt, Human
uguuccagaguccccugag

SEQ ID NO: 949412 - RNA, 19 nt, Human
uucagcaccugcaagauga

SEQ ID NO: 949413 - RNA, 18 nt, Human
uugguucagcaccugcaa

SEQ ID NO: 949414 - RNA, 23 nt, Human
aaaaacagaagagaacucaaaua

SEQ ID NO: 949415 - RNA, 24 nt, Human
aaaaacagaagagaacucaaauaa

SEQ ID NO: 949416 - RNA, 21 nt, Human
aacaagucuguaucucagagc

SEQ ID NO: 949417 - RNA, 20 nt, Human
aacauggugaaacccugucu

SEQ ID NO: 949418 - RNA, 21 nt, Human
aacauggugaaacccugucuc

SEQ ID NO: 949419 - RNA, 21 nt, Human
aaccagauaaugaaacaaacc

SEQ ID NO: 949420 - RNA, 22 nt, Human
aaccccacacuccuacugccuc

SEQ ID NO: 949421 - RNA, 21 nt, Human
aagaaaaaaucccuaccaucc

SEQ ID NO: 949422 - RNA, 19 nt, Human
aagaaaccaaaaccaagac

SEQ ID NO: 949423 - RNA, 23 nt, Human
aagaaccccacacuccuacugcc

SEQ ID NO: 949424 - RNA, 22 nt, Human
aagaaguuauuaaaucaaggug

SEQ ID NO: 949425 - RNA, 25 nt, Human
aagcaaggaaaaagaccacaugugg

SEQ ID NO: 949426 - RNA, 21 nt, Human
aagcugaccagguaggaaguu

SEQ ID NO: 949427 - RNA, 24 nt, Human
aauccacaaaggacaaaguccccu

SEQ ID NO: 949428 - RNA, 23 nt, Human
aauggcucaugccuguaaucuca

SEQ ID NO: 949429 - RNA, 24 nt, Human
aauggcucaugccuguaaucucag

SEQ ID NO: 949430 - RNA, 22 nt, Human
acaaagaagagguaagccaucc

SEQ ID NO: 949431 - RNA, 19 nt, Human
acaagguaaacagugaccc

SEQ ID NO: 949432 - RNA, 18 nt, Human
acacaguuacuaacagca

SEQ ID NO: 949433 - RNA, 21 nt, Human
acaccaaagcccagcugagca

SEQ ID NO: 949434 - RNA, 24 nt, Human
acaguaacaacaacaacaaauuaa

SEQ ID NO: 949435 - RNA, 21 nt, Human
accaaaaccaagacacaagga

SEQ ID NO: 949436 - RNA, 20 nt, Human
accacaauacaaaguagaca

SEQ ID NO: 949437 - RNA, 23 nt, Human
accagauaugggacaccugccau

SEQ ID NO: 949438 - RNA, 22 nt, Human
acccaaccuauccaaaacaacu

SEQ ID NO: 949439 - RNA, 20 nt, Human
acccaugcaaucuauaaaca

SEQ ID NO: 949440 - RNA, 23 nt, Human
acccugucucuacagaaaaacaa

SEQ ID NO: 949441 - RNA, 23 nt, Human
acuacuguacuccagcuugggca

SEQ ID NO: 949442 - RNA, 24 nt, Human
acuacuguacuccagcuugggcaa

SEQ ID NO: 949443 - RNA, 18 nt, Human
acuguacuccagcuuggg

SEQ ID NO: 949444 - RNA, 19 nt, Human
acuguacuccagcuugggc

SEQ ID NO: 949445 - RNA, 20 nt, Human
acuguacuccagcuugggca

SEQ ID NO: 949446 - RNA, 21 nt, Human
acuguacuccagcuugggcaa

SEQ ID NO: 949447 - RNA, 22 nt, Human
acuguacuccagcuugggcaac

SEQ ID NO: 949448 - RNA, 24 nt, Human
acuguacuccagcuugggcaacag

SEQ ID NO: 949449 - RNA, 25 nt, Human
acuguacuccagcuugggcaacaga

SEQ ID NO: 949450 - RNA, 23 nt, Human
agaauuucaagaccagccuaggc

SEQ ID NO: 949451 - RNA, 18 nt, Human
agagaauccuccagacca

SEQ ID NO: 949452 - RNA, 22 nt, Human
agaugucucuucuuggccaggu

SEQ ID NO: 949453 - RNA, 21 nt, Human
agcagcggagucacggcuaga

SEQ ID NO: 949454 - RNA, 18 nt, Human
agcaggaagggaaggaag

SEQ ID NO: 949455 - RNA, 22 nt, Human
agccuggccaacauggugaaac

SEQ ID NO: 949456 - RNA, 24 nt, Human
agccuggccaacauggugaaaccc

SEQ ID NO: 949457 - RNA, 24 nt, Human
agcuacuugggagguugagguggg

SEQ ID NO: 949458 - RNA, 23 nt, Human
agcugggugugauggcauaugcc

SEQ ID NO: 949459 - RNA, 18 nt, Human
agcuugggcaacagaguc

SEQ ID NO: 949460 - RNA, 24 nt, Human
agcuugggcaacagagucagaucu

SEQ ID NO: 949461 - RNA, 20 nt, Human
aggaagguaaauacaccaaa

SEQ ID NO: 949462 - RNA, 20 nt, Human
aggaauuugagaccagccug

SEQ ID NO: 949463 - RNA, 18 nt, Human
aggcaagugacugagggc

SEQ ID NO: 949464 - RNA, 19 nt, Human
aggcagagucuacgaagua

SEQ ID NO: 949465 - RNA, 19 nt, Human
aggcagguggaucacuuaa

SEQ ID NO: 949466 - RNA, 26 nt, Human
aggcagguggaucacuuaaggucagg

SEQ ID NO: 949467 - RNA, 22 nt, Human
aggcugggcgugguggcucacg

SEQ ID NO: 949468 - RNA, 19 nt, Human
agguagagugagcccuuuc

SEQ ID NO: 949469 - RNA, 24 nt, Human
aggugcaauggcucaugccuguaa

SEQ ID NO: 949470 - RNA, 25 nt, Human
agguggagguugcagugacaacggu

SEQ ID NO: 949471 - RNA, 20 nt, Human
agguggagguugcagugagc

SEQ ID NO: 949472 - RNA, 24 nt, Human
agguggagguugcagugagcugag

SEQ ID NO: 949473 - RNA, 22 nt, Human
agguggaucacuuaaggucagg

SEQ ID NO: 949474 - RNA, 23 nt, Human
aguaaaugauggugcaaauacac

SEQ ID NO: 949475 - RNA, 22 nt, Human
agugggaaguagucgcuguggg

SEQ ID NO: 949476 - RNA, 27 nt, Human
auaaaaccagauaaugaaacaaacccc

SEQ ID NO: 949477 - RNA, 19 nt, Human
auaaacauaccuaggacac

SEQ ID NO: 949478 - RNA, 24 nt, Human
auaaacauaccuaggacaccccau

SEQ ID NO: 949479 - RNA, 21 nt, Human
auaaccagauaugggacaccu

SEQ ID NO: 949480 - RNA, 23 nt, Human
aucaaaacaguaacaacaacaac

SEQ ID NO: 949481 - RNA, 19 nt, Human
augccuguaaucucagcac

SEQ ID NO: 949482 - RNA, 24 nt, Human
auucacuugaagucuaucaucuga

SEQ ID NO: 949483 - RNA, 24 nt, Human
auugcacuacuguacuccagcuug

SEQ ID NO: 949484 - RNA, 20 nt, Human
caaaacacauguauggggaa

SEQ ID NO: 949485 - RNA, 25 nt, Human
caaaauagacacugccuucagaggc

SEQ ID NO: 949486 - RNA, 19 nt, Human
caaagcaaggaaaaagacc

SEQ ID NO: 949487 - RNA, 22 nt, Human
caaagcaaggaaaaagaccaca

SEQ ID NO: 949488 - RNA, 19 nt, Human
caaauuuagcuaaucacug

SEQ ID NO: 949489 - RNA, 24 nt, Human
caacauggugaaacccugucucua

SEQ ID NO: 949490 - RNA, 23 nt, Human
caaccuauccaaaacaacuguca

SEQ ID NO: 949491 - RNA, 18 nt, Human
caaggcagaaaaguuacc

SEQ ID NO: 949492 - RNA, 21 nt, Human
caagguaaacagugacccacc

SEQ ID NO: 949493 - RNA, 19 nt, Human
cacagcacuggggcucagc

SEQ ID NO: 949494 - RNA, 23 nt, Human
cacgccuguaaucccagcauuuu

SEQ ID NO: 949495 - RNA, 28 nt, Human
cacuccuacugccucaacucccauuugu

SEQ ID NO: 949496 - RNA, 24 nt, Human
cagaaaaguaaaugauggugcaaa

SEQ ID NO: 949497 - RNA, 18 nt, Human
cagagcagcggagucacg

SEQ ID NO: 949498 - RNA, 24 nt, Human
cagauaaaauagauuuggaaacau

SEQ ID NO: 949499 - RNA, 18 nt, Human
cagauaaugaaacaaacc

SEQ ID NO: 949500 - RNA, 21 nt, Human
cagcaccgagcgagacccuga

SEQ ID NO: 949501 - RNA, 24 nt, Human
cagcacuuugggaggccaaggugg

SEQ ID NO: 949502 - RNA, 24 nt, Human
cagcagcaagcaggagauacugcu

SEQ ID NO: 949503 - RNA, 21 nt, Human
cagcuacuugggagguugagg

SEQ ID NO: 949504 - RNA, 24 nt, Human
cagcuacuugggagguugaggugg

SEQ ID NO: 949505 - RNA, 21 nt, Human
caggcagcuguaauaaagaaa

SEQ ID NO: 949506 - RNA, 19 nt, Human
caggcuuuuguuugugauc

SEQ ID NO: 949507 - RNA, 24 nt, Human
cagguggaucacuuaaggucagga

SEQ ID NO: 949508 - RNA, 19 nt, Human
caguaacaacaacaacaaa

SEQ ID NO: 949509 - RNA, 20 nt, Human
caugccuguaaucucagcac

SEQ ID NO: 949510 - RNA, 24 nt, Human
caugccuguaaucucagcacuuug

SEQ ID NO: 949511 - RNA, 23 nt, Human
cauucaucugcuuaauaaaacca

SEQ ID NO: 949512 - RNA, 21 nt, Human
ccaaaacaacugucaacggag

SEQ ID NO: 949513 - RNA, 18 nt, Human
ccacacuccuacugccuc

SEQ ID NO: 949514 - RNA, 22 nt, Human
cccaagaaccccacacuccuac

SEQ ID NO: 949515 - RNA, 23 nt, Human
cccaucacugguacauuguuugg

SEQ ID NO: 949516 - RNA, 25 nt, Human
ccccaucgucuucccaagaacccca

SEQ ID NO: 949517 - RNA, 24 nt, Human
ccuccagaccaucucaggcucgca

SEQ ID NO: 949518 - RNA, 23 nt, Human
ccucucaaaauagacacugccuu

SEQ ID NO: 949519 - RNA, 22 nt, Human
ccuggccaacauggugaaaccc

SEQ ID NO: 949520 - RNA, 24 nt, Human
ccuggccaacauggugaaacccug

SEQ ID NO: 949521 - RNA, 21 nt, Human
ccuguagucccagcuacuugg

SEQ ID NO: 949522 - RNA, 21 nt, Human
cgccuacucgaccccgggggc

SEQ ID NO: 949523 - RNA, 19 nt, Human
cggccccaaaucacagcag

SEQ ID NO: 949524 - RNA, 21 nt, Human
cggcuagagagaauccuccag

SEQ ID NO: 949525 - RNA, 20 nt, Human
cuacuguacuccagcuuggg

SEQ ID NO: 949526 - RNA, 21 nt, Human
cuacuguacuccagcuugggc

SEQ ID NO: 949527 - RNA, 24 nt, Human
cuacuguacuccagcuugggcaac

SEQ ID NO: 949528 - RNA, 26 nt, Human
cuaggcagguggaucacuuaagguca

SEQ ID NO: 949529 - RNA, 21 nt, Human
cucacgccuguaaucccagca

SEQ ID NO: 949530 - RNA, 21 nt, Human
cucacgccuguaaucccagca

SEQ ID NO: 949531 - RNA, 24 nt, Human
cucaugccuguaaucucagcacuu

SEQ ID NO: 949532 - RNA, 22 nt, Human
cuccagaccaucucaggcucgc

SEQ ID NO: 949533 - RNA, 19 nt, Human
cuccagcuugggcaacaga

SEQ ID NO: 949534 - RNA, 25 nt, Human
cucugaaugaagcuaacuaggguuc

SEQ ID NO: 949535 - RNA, 23 nt, Human
cugccuucagaggcagccauggg

SEQ ID NO: 949536 - RNA, 21 nt, Human
cuggcagucuuucaaaugccc

SEQ ID NO: 949537 - RNA, 24 nt, Human
cuggccaacauggugaaacccugu

SEQ ID NO: 949538 - RNA, 19 nt, Human
cuugagucugggaggugga

SEQ ID NO: 949539 - RNA, 18 nt, Human
gaagaaaccaaaaccaag

SEQ ID NO: 949540 - RNA, 23 nt, Human
gagaccagccuggccaacauggu

SEQ ID NO: 949541 - RNA, 20 nt, Human
gagagguggagaaaagagag

SEQ ID NO: 949542 - RNA, 19 nt, Human
gagcaggaagggaaggaag

SEQ ID NO: 949543 - RNA, 22 nt, Human
gagcuaccaaucccagacacuc

SEQ ID NO: 949544 - RNA, 23 nt, Human
gagcucaucuguugccacgaucu

SEQ ID NO: 949545 - RNA, 19 nt, Human
gagcugcugguguuuacuu

SEQ ID NO: 949546 - RNA, 18 nt, Human
gagggaugugguacucug

SEQ ID NO: 949547 - RNA, 23 nt, Human
gagguugcagugagcugagauug

SEQ ID NO: 949548 - RNA, 24 nt, Human
gaucacuuaaggucaggaauuuga

SEQ ID NO: 949549 - RNA, 24 nt, Human
gauggcuugagucugggaggugga

SEQ ID NO: 949550 - RNA, 18 nt, Human
gauugcuuuagcccagaa

SEQ ID NO: 949551 - RNA, 23 nt, Human
gcaaagcaaggaaaaagaccaca

SEQ ID NO: 949552 - RNA, 21 nt, Human
gcaguugggugccgugaaucc

SEQ ID NO: 949553 - RNA, 24 nt, Human
gccaacauggugaaacccugucuc

SEQ ID NO: 949554 - RNA, 21 nt, Human
gccgugaauccugguggugcu

SEQ ID NO: 949555 - RNA, 21 nt, Human
gcugggcgugguggcucacgc

SEQ ID NO: 949556 - RNA, 23 nt, Human
gcuguaaagagcaagcaggcagu

SEQ ID NO: 949557 - RNA, 20 nt, Human
gcuugagucugggaggugga

SEQ ID NO: 949558 - RNA, 19 nt, Human
ggaaaggaguuucucccac

SEQ ID NO: 949559 - RNA, 20 nt, Human
ggaauggucagucugugagg

SEQ ID NO: 949560 - RNA, 22 nt, Human
ggagguugaggugggaggaugg

SEQ ID NO: 949561 - RNA, 22 nt, Human
ggagguugcagugagcugagau

SEQ ID NO: 949562 - RNA, 24 nt, Human
ggagguugcagugagcugagauug

SEQ ID NO: 949563 - RNA, 21 nt, Human
ggaugcuguagacaaaggaau

SEQ ID NO: 949564 - RNA, 21 nt, Human
ggccaggugcaauggcucaug

SEQ ID NO: 949565 - RNA, 23 nt, Human
ggcgugguggcucacgccuguaa

SEQ ID NO: 949566 - RNA, 22 nt, Human
ggcucagcuguacuauaguuug

SEQ ID NO: 949567 - RNA, 21 nt, Human
ggcucaugccuguaaucucag

SEQ ID NO: 949568 - RNA, 18 nt, Human
gggaggccaaggugguag

SEQ ID NO: 949569 - RNA, 18 nt, Human
gggagguggagguugcag

SEQ ID NO: 949570 - RNA, 18 nt, Human
gggggaaaugcaggucuu

SEQ ID NO: 949571 - RNA, 25 nt, Human
gggguacacccaaccuauccaaaac

SEQ ID NO: 949572 - RNA, 25 nt, Human
gguauaggcugggcgugguggcuca

SEQ ID NO: 949573 - RNA, 19 nt, Human
gguggagguugcagugagc

SEQ ID NO: 949574 - RNA, 24 nt, Human
gguggcucacgccuguaaucccag

SEQ ID NO: 949575 - RNA, 26 nt, Human
gguucagugucgagauaaacauaccu

SEQ ID NO: 949576 - RNA, 22 nt, Human
guaaagcagcagcaagcaggag

SEQ ID NO: 949577 - RNA, 21 nt, Human
guaaucaugggcagaagaaug

SEQ ID NO: 949578 - RNA, 24 nt, Human
guacuccagcuugggcaacagagu

SEQ ID NO: 949579 - RNA, 19 nt, Human
gugaggcagagucuacgaa

SEQ ID NO: 949580 - RNA, 18 nt, Human
guggggaaagggugagag

SEQ ID NO: 949581 - RNA, 21 nt, Human
guugcagugagcugagauugc

SEQ ID NO: 949582 - RNA, 20 nt, Human
uaaauaacagacagaagcaa

SEQ ID NO: 949583 - RNA, 21 nt, Human
uaacauaaccagauaugggac

SEQ ID NO: 949584 - RNA, 22 nt, Human
uaacuugcccaaggcucacaca

SEQ ID NO: 949585 - RNA, 22 nt, Human
uacaauauguaaacuaaacaca

SEQ ID NO: 949586 - RNA, 23 nt, Human
uacaccaaagcccagcugagcaa

SEQ ID NO: 949587 - RNA, 19 nt, Human
uaccuuuaauuucaaacua

SEQ ID NO: 949588 - RNA, 20 nt, Human
uacuguacuccagcuugggc

SEQ ID NO: 949589 - RNA, 23 nt, Human
uacuguacuccagcuugggcaac

SEQ ID NO: 949590 - RNA, 24 nt, Human
uacuguacuccagcuugggcaaca

SEQ ID NO: 949591 - RNA, 28 nt, Human
uagcccaucacugguacauuguuugggg

SEQ ID NO: 949592 - RNA, 21 nt, Human
uagcucagacaaauaaugcaa

SEQ ID NO: 949593 - RNA, 22 nt, Human
uagcugggugugauggcauaug

SEQ ID NO: 949594 - RNA, 19 nt, Human
uaggauucauaugcuuuuc

SEQ ID NO: 949595 - RNA, 22 nt, Human
uagguucuggcugccucugugc

SEQ ID NO: 949596 - RNA, 20 nt, Human
uaucucagagcaagagacag

SEQ ID NO: 949597 - RNA, 26 nt, Human
ucaaaacaguaacaacaacaacaaag

SEQ ID NO: 949598 - RNA, 20 nt, Human
ucaaacuaugugaacauauu

SEQ ID NO: 949599 - RNA, 24 nt, Human
ucacagaggaggaaaaaguaguga

SEQ ID NO: 949600 - RNA, 21 nt, Human
ucacgccuguaaucccagcau

SEQ ID NO: 949601 - RNA, 21 nt, Human
ucacuugaagucuaucaucug

SEQ ID NO: 949602 - RNA, 22 nt, Human
ucagaacaagcccuugaccuau

SEQ ID NO: 949603 - RNA, 19 nt, Human
ucagagcagcggagucacg

SEQ ID NO: 949604 - RNA, 19 nt, Human
ucaggcucgcacuaccugg

SEQ ID NO: 949605 - RNA, 21 nt, Human
uccacaaaggacaaagucccc

SEQ ID NO: 949606 - RNA, 24 nt, Human
uccagcuugggcaacagagucaga

SEQ ID NO: 949607 - RNA, 18 nt, Human
ucccacaagacuucucag

SEQ ID NO: 949608 - RNA, 23 nt, Human
uccccagagcccugcuguaaaga

SEQ ID NO: 949609 - RNA, 19 nt, Human
ucuacagaaaaacaaaaau

SEQ ID NO: 949610 - RNA, 20 nt, Human
ucucaggcucgcacuaccug

SEQ ID NO: 949611 - RNA, 24 nt, Human
ucuguugccacgaucugcagcuug

SEQ ID NO: 949612 - RNA, 26 nt, Human
ugaagaaaccaaaaccaaggaaaagu

SEQ ID NO: 949613 - RNA, 22 nt, Human
ugaaggaaaguggacagcagag

SEQ ID NO: 949614 - RNA, 18 nt, Human
ugaaguauucacagagcc

SEQ ID NO: 949615 - RNA, 22 nt, Human
ugacauggaacuguugccaaca

SEQ ID NO: 949616 - RNA, 18 nt, Human
ugaccaauggcagauccu

SEQ ID NO: 949617 - RNA, 18 nt, Human
ugaccuucagagcagcgg

SEQ ID NO: 949618 - RNA, 23 nt, Human
ugagaccagccuggccaacaugg

SEQ ID NO: 949619 - RNA, 19 nt, Human
ugagagaacuggagacaag

SEQ ID NO: 949620 - RNA, 20 nt, Human
ugagggcuuccuaacucaag

SEQ ID NO: 949621 - RNA, 22 nt, Human
ugagguggagagauuccaguca

SEQ ID NO: 949622 - RNA, 18 nt, Human
ugaggugggaggauggcc

SEQ ID NO: 949623 - RNA, 21 nt, Human
ugaggugggaggauggcuuga

SEQ ID NO: 949624 - RNA, 22 nt, Human
ugaggugggaggauggcuugag

SEQ ID NO: 949625 - RNA, 18 nt, Human
ugagucugggagguggag

SEQ ID NO: 949626 - RNA, 21 nt, Human
ugaucagggcaauaaugacag

SEQ ID NO: 949627 - RNA, 24 nt, Human
ugauggcauaugccuguaguccca

SEQ ID NO: 949628 - RNA, 21 nt, Human
ugcaaagugcuucauauagcu

SEQ ID NO: 949629 - RNA, 20 nt, Human
ugcaaggcagaaaaguuacc

SEQ ID NO: 949630 - RNA, 22 nt, Human
ugcacuacuguacuccagcuug

SEQ ID NO: 949631 - RNA, 24 nt, Human
ugccuaucacaggcugagcccuuu

SEQ ID NO: 949632 - RNA, 23 nt, Human
ugccuguaaucucagcacuuugg

SEQ ID NO: 949633 - RNA, 23 nt, Human
ugccuguaaucucagcacuuugg

SEQ ID NO: 949634 - RNA, 24 nt, Human
ugccuguaaucucagcacuuuggg

SEQ ID NO: 949635 - RNA, 23 nt, Human
ugccuguagucccagcuacuugg

SEQ ID NO: 949636 - RNA, 24 nt, Human
ugccuguagucccagcuacuuggg

SEQ ID NO: 949637 - RNA, 21 nt, Human
ugccuguguguucaugacguc

SEQ ID NO: 949638 - RNA, 23 nt, Human
uggaucacuuaaggucaggaauu

SEQ ID NO: 949639 - RNA, 24 nt, Human
uggaucacuuaaggucaggaauuu

SEQ ID NO: 949640 - RNA, 27 nt, Human
uggaucacuuaaggucaggaauuugag

SEQ ID NO: 949641 - RNA, 18 nt, Human
uggaugaggugggcaucu

SEQ ID NO: 949642 - RNA, 24 nt, Human
uggccaacauggugaaacccuguc

SEQ ID NO: 949643 - RNA, 24 nt, Human
uggccaggugcaauggcucaugcc

SEQ ID NO: 949644 - RNA, 22 nt, Human
uggcucacgccuguaaucccag

SEQ ID NO: 949645 - RNA, 24 nt, Human
uggcucacgccuguaaucccagca

SEQ ID NO: 949646 - RNA, 24 nt, Human
uggcucaugccuguaaucucagca

SEQ ID NO: 949647 - RNA, 24 nt, Human
uggcuugagucugggagguggagg

SEQ ID NO: 949648 - RNA, 20 nt, Human
ugggagcaggaagggaagga

SEQ ID NO: 949649 - RNA, 19 nt, Human
ugggaggccaaggugguag

SEQ ID NO: 949650 - RNA, 24 nt, Human
ugggaggccaaggugguaggauug

SEQ ID NO: 949651 - RNA, 24 nt, Human
ugggagguggagguugcagugagc

SEQ ID NO: 949652 - RNA, 24 nt, Human
ugguggcucacgccuguaauccca

SEQ ID NO: 949653 - RNA, 21 nt, Human
uguaaagagcaagcaggcagu

SEQ ID NO: 949654 - RNA, 18 nt, Human
uguacaacagcagcuucc

SEQ ID NO: 949655 - RNA, 19 nt, Human
uguggggaaagggugagaa

SEQ ID NO: 949656 - RNA, 21 nt, Human
uguggggaaagggugagaggc

SEQ ID NO: 949657 - RNA, 18 nt, Human
uuagcugggugugauggc

SEQ ID NO: 949658 - RNA, 24 nt, Human
uuagcugggugugauggcauaugc

SEQ ID NO: 949659 - RNA, 21 nt, Human
uucacaaagaagagguaagcc

SEQ ID NO: 949660 - RNA, 22 nt, Human
uucaggcuuuuguuugugauca

SEQ ID NO: 949661 - RNA, 18 nt, Human
uuccuaggauucauaugc

SEQ ID NO: 949662 - RNA, 19 nt, Human
uugaaugccuaucacaggc

SEQ ID NO: 949663 - RNA, 24 nt, Human
uugagucugggagguggagguugc

SEQ ID NO: 949664 - RNA, 23 nt, Human
uugcacuacuguacuccagcuug

SEQ ID NO: 949665 - RNA, 19 nt, Human
uugcagugagcugagauug

SEQ ID NO: 949666 - RNA, 22 nt, Human
uugcagugagcugagauugcac

SEQ ID NO: 949667 - RNA, 19 nt, Human
uugcccaaggcucacacag

SEQ ID NO: 949668 - RNA, 22 nt, Human
uuuguuggagaagcugaaaaag

SEQ ID NO: 949669 - RNA, 18 nt, Human
uuuuguuugugaucaggg

SEQ ID NO: 949670 - RNA, 25 nt, Human
aacaagaaaauaaaacauggucacu

SEQ ID NO: 949671 - RNA, 21 nt, Human
aacauggucacucuuccaucc

SEQ ID NO: 949672 - RNA, 22 nt, Human
aacccagugcuccagagucaca

SEQ ID NO: 949673 - RNA, 24 nt, Human
aagaaaacaagaugaaaagaggug

SEQ ID NO: 949674 - RNA, 24 nt, Human
aagaaaacaagaugaaaagaggug

SEQ ID NO: 949675 - RNA, 20 nt, Human
aagacauauaaauuguucuc

SEQ ID NO: 949676 - RNA, 25 nt, Human
aagaugcuucuuccccucuuuuccc

SEQ ID NO: 949677 - RNA, 20 nt, Human
aagcucccgagcugcaagcc

SEQ ID NO: 949678 - RNA, 19 nt, Human
aagguguguaaagcucccg

SEQ ID NO: 949679 - RNA, 20 nt, Human
aaucucuaaucccuggcuuc

SEQ ID NO: 949680 - RNA, 27 nt, Human
acaauggagacaacccagugcuccaga

SEQ ID NO: 949681 - RNA, 19 nt, Human
accacccgaccccauccca

SEQ ID NO: 949682 - RNA, 18 nt, Human
accaguggcccaccacac

SEQ ID NO: 949683 - RNA, 20 nt, Human
acuucccguaacacccacca

SEQ ID NO: 949684 - RNA, 22 nt, Human
agaaaacaagaugaaaagaggu

SEQ ID NO: 949685 - RNA, 22 nt, Human
agaaaacaagaugaaaagaggu

SEQ ID NO: 949686 - RNA, 21 nt, Human
agagcucuugggucagacaug

SEQ ID NO: 949687 - RNA, 19 nt, Human
agccaauaaaaauaaacaa

SEQ ID NO: 949688 - RNA, 22 nt, Human
agccaggaucuucauacacaua

SEQ ID NO: 949689 - RNA, 18 nt, Human
agccugaguccccaggua

SEQ ID NO: 949690 - RNA, 19 nt, Human
aggaagacaauuucccuag

SEQ ID NO: 949691 - RNA, 18 nt, Human
aggaaggaggcagugagu

SEQ ID NO: 949692 - RNA, 19 nt, Human
aggaggaaggaggcaguga

SEQ ID NO: 949693 - RNA, 19 nt, Human
aggaggcagugaguggcgu

SEQ ID NO: 949694 - RNA, 19 nt, Human
aguccccagguacccuggc

SEQ ID NO: 949695 - RNA, 23 nt, Human
agugacaagaacaagaaaauaaa

SEQ ID NO: 949696 - RNA, 19 nt, Human
aguggcaacaccaggagga

SEQ ID NO: 949697 - RNA, 19 nt, Human
aguguggucccuggguuau

SEQ ID NO: 949698 - RNA, 20 nt, Human
auaaucgccaggacccaugc

SEQ ID NO: 949699 - RNA, 23 nt, Human
auacaauagugacaagaacaaga

SEQ ID NO: 949700 - RNA, 26 nt, Human
caagaacaagaaaauaaaacaugguc

SEQ ID NO: 949701 - RNA, 24 nt, Human
caagagcucuuucagauauagagc

SEQ ID NO: 949702 - RNA, 23 nt, Human
cacacugcuugguucauaguuaa

SEQ ID NO: 949703 - RNA, 23 nt, Human
cacacugcuugguucauaguuaa

SEQ ID NO: 949704 - RNA, 25 nt, Human
cacccucuccuuccaggcugggcua

SEQ ID NO: 949705 - RNA, 18 nt, Human
cagaaagccaucccccac

SEQ ID NO: 949706 - RNA, 19 nt, Human
cagccaguucucugcuguu

SEQ ID NO: 949707 - RNA, 20 nt, Human
cagccugaguccccagguac

SEQ ID NO: 949708 - RNA, 20 nt, Human
caguggccaccacacugcuu

SEQ ID NO: 949709 - RNA, 20 nt, Human
caguuucugagcccacagcu

SEQ ID NO: 949710 - RNA, 23 nt, Human
caucccaucuucuaaagcaguca

SEQ ID NO: 949711 - RNA, 19 nt, Human
cauuggggaaaggacuuga

SEQ ID NO: 949712 - RNA, 20 nt, Human
ccaacuuaugcccuggccuc

SEQ ID NO: 949713 - RNA, 21 nt, Human
ccacugggcauuggggaaagg

SEQ ID NO: 949714 - RNA, 19 nt, Human
ccaggugauucagccaggg

SEQ ID NO: 949715 - RNA, 19 nt, Human
cccaccacacugcuugguu

SEQ ID NO: 949716 - RNA, 23 nt, Human
cccaccacacugcuugguucaua

SEQ ID NO: 949717 - RNA, 23 nt, Human
cccauaaugacaauggagacaac

SEQ ID NO: 949718 - RNA, 20 nt, Human
cccaugcaggcaucuaucuc

SEQ ID NO: 949719 - RNA, 20 nt, Human
ccccacucacccucuccuuc

SEQ ID NO: 949720 - RNA, 22 nt, Human
ccccagguacccuggccaucca

SEQ ID NO: 949721 - RNA, 22 nt, Human
cccccacucacccucuccuucc

SEQ ID NO: 949722 - RNA, 21 nt, Human
ccccucuuuucccuauugacc

SEQ ID NO: 949723 - RNA, 20 nt, Human
ccccuuccccugaacuccca

SEQ ID NO: 949724 - RNA, 18 nt, Human
ccucaaggccacucucuc

SEQ ID NO: 949725 - RNA, 19 nt, Human
ccucaaggccacucucucu

SEQ ID NO: 949726 - RNA, 18 nt, Human
ccugcaccuuaaucucac

SEQ ID NO: 949727 - RNA, 25 nt, Human
ccugcaccuuaaucucacccagaag

SEQ ID NO: 949728 - RNA, 22 nt, Human
cgaccccaucccaucuucuaaa

SEQ ID NO: 949729 - RNA, 18 nt, Human
cuaaucccuggcuucuga

SEQ ID NO: 949730 - RNA, 23 nt, Human
cuauauuuucaagucaccagugg

SEQ ID NO: 949731 - RNA, 22 nt, Human
cucccacuaucucauuucuuga

SEQ ID NO: 949732 - RNA, 18 nt, Human
cuccucccaggagaccca

SEQ ID NO: 949733 - RNA, 22 nt, Human
cucuuccaucccauuucucaga

SEQ ID NO: 949734 - RNA, 22 nt, Human
cuguuuccucuucuuaagaugc

SEQ ID NO: 949735 - RNA, 22 nt, Human
cuguuuccucuucuuaagaugc

SEQ ID NO: 949736 - RNA, 24 nt, Human
cuuaugcccuggccuccuucugga

SEQ ID NO: 949737 - RNA, 19 nt, Human
cuugggccuaagcacgcug

SEQ ID NO: 949738 - RNA, 24 nt, Human
gaacucuaacauuauuggaagaaa

SEQ ID NO: 949739 - RNA, 24 nt, Human
gaacucuaacauuauuggaagaaa

SEQ ID NO: 949740 - RNA, 26 nt, Human
gacaauggagacaacccagugcucca

SEQ ID NO: 949741 - RNA, 25 nt, Human
gcccauaaugacaauggagacaacc

SEQ ID NO: 949742 - RNA, 25 nt, Human
gcuguuuccucuucuuaagaugcuu

SEQ ID NO: 949743 - RNA, 22 nt, Human
ggaagaaaacaagaugaaaaga

SEQ ID NO: 949744 - RNA, 22 nt, Human
ggaagaaaacaagaugaaaaga

SEQ ID NO: 949745 - RNA, 20 nt, Human
gggaaaggacuugaucagua

SEQ ID NO: 949746 - RNA, 20 nt, Human
gggcauuggggaaaggacuu

SEQ ID NO: 949747 - RNA, 18 nt, Human
uaaaauaaucgccaggac

SEQ ID NO: 949748 - RNA, 21 nt, Human
uaaaauaaucgccaggaccca

SEQ ID NO: 949749 - RNA, 21 nt, Human
uaaagcucccgagcugcaagc

SEQ ID NO: 949750 - RNA, 21 nt, Human
uaaucccuggcuucugaucuc

SEQ ID NO: 949751 - RNA, 23 nt, Human
uaaucgccaggacccaugcaggc

SEQ ID NO: 949752 - RNA, 25 nt, Human
uacacugagcagaguaaacagauga

SEQ ID NO: 949753 - RNA, 20 nt, Human
uacgguagucucaauucuuu

SEQ ID NO: 949754 - RNA, 23 nt, Human
ucaaaagacacagcuaaagccaa

SEQ ID NO: 949755 - RNA, 22 nt, Human
ucaccaguggccaccacacugc

SEQ ID NO: 949756 - RNA, 19 nt, Human
ucauaggucauccaacuua

SEQ ID NO: 949757 - RNA, 19 nt, Human
uccaaguccaccaguggcc

SEQ ID NO: 949758 - RNA, 24 nt, Human
uccccagguacccuggccauccac

SEQ ID NO: 949759 - RNA, 19 nt, Human
uccccucuuuucccuauug

SEQ ID NO: 949760 - RNA, 20 nt, Human
ucccuggcuucugaucucca

SEQ ID NO: 949761 - RNA, 22 nt, Human
ucccuggcuucugaucuccacc

SEQ ID NO: 949762 - RNA, 21 nt, Human
uccuuuagaccacccuuuuca

SEQ ID NO: 949763 - RNA, 23 nt, Human
ucuuaagaugcuucuuccccucu

SEQ ID NO: 949764 - RNA, 22 nt, Human
ucuuuauguuucucugucuucc

SEQ ID NO: 949765 - RNA, 20 nt, Human
ugaacaacagaacuucucaa

SEQ ID NO: 949766 - RNA, 22 nt, Human
ugacaggcugguucaagaacca

SEQ ID NO: 949767 - RNA, 18 nt, Human
ugagaugccuuguuuaaa

SEQ ID NO: 949768 - RNA, 18 nt, Human
ugagaugccuuguuuaaa

SEQ ID NO: 949769 - RNA, 23 nt, Human
ugagcagaguaaacagaugaugu

SEQ ID NO: 949770 - RNA, 19 nt, Human
ugcugggguuggacuuccc

SEQ ID NO: 949771 - RNA, 18 nt, Human
uggaagaaaacaagauga

SEQ ID NO: 949772 - RNA, 18 nt, Human
uggaagaaaacaagauga

SEQ ID NO: 949773 - RNA, 21 nt, Human
uggaagaaaacaagaugaaaa

SEQ ID NO: 949774 - RNA, 21 nt, Human
uggaagaaaacaagaugaaaa

SEQ ID NO: 949775 - RNA, 23 nt, Human
uggaagaaaacaagaugaaaaga

SEQ ID NO: 949776 - RNA, 23 nt, Human
uggaagaaaacaagaugaaaaga

SEQ ID NO: 949777 - RNA, 25 nt, Human
uggcuccccuccucccaggagaccc

SEQ ID NO: 949778 - RNA, 24 nt, Human
uggcuucugaucuccaccucuuuu

SEQ ID NO: 949779 - RNA, 22 nt, Human
ugucuucccaagagcucuuuca

SEQ ID NO: 949780 - RNA, 22 nt, Human
uguuaaggagacugucagugaa

SEQ ID NO: 949781 - RNA, 18 nt, Human
uuacacugagcagaguaa

SEQ ID NO: 949782 - RNA, 21 nt, Human
uuaccuagcaguuucugagcc

SEQ ID NO: 949783 - RNA, 19 nt, Human
uuccccugaacucccauaa

SEQ ID NO: 949784 - RNA, 23 nt, Human
uugagaguccucucuucuauccc

SEQ ID NO: 949785 - RNA, 21 nt, Human
uuugugacccauuugcuccca

SEQ ID NO: 949786 - RNA, 21 nt, Human
uuuuuuuuuuuuucacuuaug

SEQ ID NO: 949787 - RNA, 27 nt, Human
uuuuuuuuuuuuuuuuuucacuuaauu

SEQ ID NO: 949788 - RNA, 19 nt, Human
aacauggugacaccccauc

SEQ ID NO: 949789 - RNA, 20 nt, Human
aacauggugacaccccaucu

SEQ ID NO: 949790 - RNA, 21 nt, Human
aacauggugacaccccaucuc

SEQ ID NO: 949791 - RNA, 19 nt, Human
aagcaugcuauccuuuuuu

SEQ ID NO: 949792 - RNA, 18 nt, Human
aagcaugcuaucuuuuca

SEQ ID NO: 949793 - RNA, 25 nt, Human
aagcgauucucccgccucagccucc

SEQ ID NO: 949794 - RNA, 26 nt, Human
aagugauccuccccaucugggccucc

SEQ ID NO: 949795 - RNA, 23 nt, Human
aagugcuaggauuacauacauga

SEQ ID NO: 949796 - RNA, 26 nt, Human
aagugcuaggauuacauacaugagcc

SEQ ID NO: 949797 - RNA, 19 nt, Human
aagugcugggauuacaggc

SEQ ID NO: 949798 - RNA, 19 nt, Human
aagugcugggauuacaggc

SEQ ID NO: 949799 - RNA, 23 nt, Human
aagugcugggauuacaggcguga

SEQ ID NO: 949800 - RNA, 26 nt, Human
aagugcugggauuacaggcgugagcc

SEQ ID NO: 949801 - RNA, 18 nt, Human
acagagacagcucuauca

SEQ ID NO: 949802 - RNA, 18 nt, Human
acagagcagcuucacccc

SEQ ID NO: 949803 - RNA, 20 nt, Human
acaggguuucaccaucuugg

SEQ ID NO: 949804 - RNA, 24 nt, Human
acaggguuucaccaucuuggccag

SEQ ID NO: 949805 - RNA, 22 nt, Human
accauguuggccaggcuggucu

SEQ ID NO: 949806 - RNA, 18 nt, Human
acccucccaucuuccucu

SEQ ID NO: 949807 - RNA, 21 nt, Human
accucagccuacugagaagcu

SEQ ID NO: 949808 - RNA, 19 nt, Human
acgggguuucaccgugcug

SEQ ID NO: 949809 - RNA, 20 nt, Human
acgggguuucaccgugcugg

SEQ ID NO: 949810 - RNA, 24 nt, Human
acgggguuucaccgugcuggccag

SEQ ID NO: 949811 - RNA, 20 nt, Human
agaagcuggggccacaggug

SEQ ID NO: 949812 - RNA, 21 nt, Human
agaggcugggugugguggcuc

SEQ ID NO: 949813 - RNA, 20 nt, Human
agcacuuugggaggcugagg

SEQ ID NO: 949814 - RNA, 21 nt, Human
agcagagacgggguuucaccg

SEQ ID NO: 949815 - RNA, 18 nt, Human
agccuccagaguagcugg

SEQ ID NO: 949816 - RNA, 24 nt, Human
agccuggccaacauggugacaccc

SEQ ID NO: 949817 - RNA, 24 nt, Human
agcgauucucccgccucagccucc

SEQ ID NO: 949818 - RNA, 20 nt, Human
agcugggugugguggcacac

SEQ ID NO: 949819 - RNA, 20 nt, Human
aggcugggugugguggcuca

SEQ ID NO: 949820 - RNA, 22 nt, Human
aggcugggugugguggcucaca

SEQ ID NO: 949821 - RNA, 25 nt, Human
agggauauagaggcuggguguggug

SEQ ID NO: 949822 - RNA, 19 nt, Human
agguggagguugcagugag

SEQ ID NO: 949823 - RNA, 20 nt, Human
agguggagguugcagugagc

SEQ ID NO: 949824 - RNA, 24 nt, Human
agguggagguugcagugagcugag

SEQ ID NO: 949825 - RNA, 20 nt, Human
aggugugcaccaucaugacc

SEQ ID NO: 949826 - RNA, 22 nt, Human
aguagagacaggguuucaccau

SEQ ID NO: 949827 - RNA, 22 nt, Human
aguagagaugggguuucaccau

SEQ ID NO: 949828 - RNA, 19 nt, Human
aguagcugggacuacaggc

SEQ ID NO: 949829 - RNA, 21 nt, Human
aguagcugggacuacaggcau

SEQ ID NO: 949830 - RNA, 25 nt, Human
aguagcugggacuacaggcaugagc

SEQ ID NO: 949831 - RNA, 21 nt, Human
agugcaauggcgcaaucucag

SEQ ID NO: 949832 - RNA, 18 nt, Human
agugcugggauuacaggc

SEQ ID NO: 949833 - RNA, 24 nt, Human
auagaggcugggugugguggcuca

SEQ ID NO: 949834 - RNA, 24 nt, Human
auggcucacuguaggcuugaccuc

SEQ ID NO: 949835 - RNA, 18 nt, Human
augggguuucaccauguu

SEQ ID NO: 949836 - RNA, 22 nt, Human
augggguuucaccauguuggcc

SEQ ID NO: 949837 - RNA, 24 nt, Human
augggguuucaccauguuggccag

SEQ ID NO: 949838 - RNA, 25 nt, Human
auugugccccugcacuccagccuug

SEQ ID NO: 949839 - RNA, 23 nt, Human
caaacuccugaccucgugaucca

SEQ ID NO: 949840 - RNA, 24 nt, Human
cacaccuauaaucccagcacuuug

SEQ ID NO: 949841 - RNA, 23 nt, Human
cacagggccgcugccagauguuc

SEQ ID NO: 949842 - RNA, 21 nt, Human
caccacaaccuccgccucccg

SEQ ID NO: 949843 - RNA, 19 nt, Human
caccacauccggccaaagc

SEQ ID NO: 949844 - RNA, 25 nt, Human
caccacgcccagucaauuuugcacc

SEQ ID NO: 949845 - RNA, 24 nt, Human
caccaucuuggccaggcuaaucuc

SEQ ID NO: 949846 - RNA, 21 nt, Human
caccauguuggccaggcuggu

SEQ ID NO: 949847 - RNA, 23 nt, Human
caccauguuggccaggcuggucu

SEQ ID NO: 949848 - RNA, 24 nt, Human
caccauguuggccaggcuggucuu

SEQ ID NO: 949849 - RNA, 27 nt, Human
caccauguuggccaggcuggucuugaa

SEQ ID NO: 949850 - RNA, 19 nt, Human
caccccccggcugcccagg

SEQ ID NO: 949851 - RNA, 21 nt, Human
caccgugcuggccaggcugau

SEQ ID NO: 949852 - RNA, 24 nt, Human
caccgugcuggccaggcugaucuc

SEQ ID NO: 949853 - RNA, 19 nt, Human
caccuauaaucccagcacu

SEQ ID NO: 949854 - RNA, 24 nt, Human
caccuauaaucccagcacuuuggg

SEQ ID NO: 949855 - RNA, 24 nt, Human
caccucagccuacugagaagcugg

SEQ ID NO: 949856 - RNA, 23 nt, Human
cacuccagccuuggugacagagc

SEQ ID NO: 949857 - RNA, 22 nt, Human
cacuguaggcuugaccucccag

SEQ ID NO: 949858 - RNA, 20 nt, Human
cagagacgggguuucaccgu

SEQ ID NO: 949859 - RNA, 24 nt, Human
cagcacuuugggaggcugaggccg

SEQ ID NO: 949860 - RNA, 24 nt, Human
cagcagagacgggguuucaccgug

SEQ ID NO: 949861 - RNA, 26 nt, Human
cagcagagacgggguuucaccgugcu

SEQ ID NO: 949862 - RNA, 21 nt, Human
cagcuucaccccccggcugcc

SEQ ID NO: 949863 - RNA, 19 nt, Human
caggaggcugagacacgca

SEQ ID NO: 949864 - RNA, 21 nt, Human
caggcuaaucucaaacuccug

SEQ ID NO: 949865 - RNA, 24 nt, Human
caggguuucaccaucuuggccagg

SEQ ID NO: 949866 - RNA, 27 nt, Human
cauacaugagccaccacgccuggccag

SEQ ID NO: 949867 - RNA, 22 nt, Human
caucaugaccagccaauuuauu

SEQ ID NO: 949868 - RNA, 23 nt, Human
caucauguuguccaggcugcacc

SEQ ID NO: 949869 - RNA, 24 nt, Human
cauguuggccaggcuggucuugaa

SEQ ID NO: 949870 - RNA, 21 nt, Human
cauuaauuugaucccaagcag

SEQ ID NO: 949871 - RNA, 22 nt, Human
cauuaggaugcgugcucucuug

SEQ ID NO: 949872 - RNA, 21 nt, Human
cauuucaccguuuaugaagca

SEQ ID NO: 949873 - RNA, 18 nt, Human
ccacaaccuccgccuccc

SEQ ID NO: 949874 - RNA, 23 nt, Human
ccacaaccuccgccucccggguu

SEQ ID NO: 949875 - RNA, 24 nt, Human
ccacaaccuccgccucccggguuc

SEQ ID NO: 949876 - RNA, 22 nt, Human
ccacacucucucaagaaaaagg

SEQ ID NO: 949877 - RNA, 22 nt, Human
ccaccacgccuggccagcucug

SEQ ID NO: 949878 - RNA, 24 nt, Human
ccaccacgccuggccagcucuguc

SEQ ID NO: 949879 - RNA, 21 nt, Human
ccacgcccagucaauuuugca

SEQ ID NO: 949880 - RNA, 20 nt, Human
ccacuaaaaaaauacaaaaa

SEQ ID NO: 949881 - RNA, 24 nt, Human
ccagaguagcugggacuacaggca

SEQ ID NO: 949882 - RNA, 25 nt, Human
ccagaguagcugggacuacaggcau

SEQ ID NO: 949883 - RNA, 20 nt, Human
cccaggcucaagcaauccuc

SEQ ID NO: 949884 - RNA, 18 nt, Human
cccaggcuggagugcaau

SEQ ID NO: 949885 - RNA, 22 nt, Human
cccaggcuggagugcaauggcg

SEQ ID NO: 949886 - RNA, 24 nt, Human
ccccgaagugcugggauuacaggc

SEQ ID NO: 949887 - RNA, 21 nt, Human
ccccugcacuccagccuuggu

SEQ ID NO: 949888 - RNA, 24 nt, Human
cccgaagugcugggauuacaggcg

SEQ ID NO: 949889 - RNA, 23 nt, Human
cccgccucaaccccccgaagugc

SEQ ID NO: 949890 - RNA, 22 nt, Human
cccgcggucccagcugcucagg

SEQ ID NO: 949891 - RNA, 19 nt, Human
cccugcacuccagccuugg

SEQ ID NO: 949892 - RNA, 19 nt, Human
cccugcacuccagccuugg

SEQ ID NO: 949893 - RNA, 20 nt, Human
cccugcacuccagccuuggu

SEQ ID NO: 949894 - RNA, 24 nt, Human
cccugcacuccagccuuggugaca

SEQ ID NO: 949895 - RNA, 24 nt, Human
ccgaagugcugggauuacaggcgu

SEQ ID NO: 949896 - RNA, 24 nt, Human
ccgccucccggguucaagcgauuc

SEQ ID NO: 949897 - RNA, 24 nt, Human
ccucccaccucagccuacugagaa

SEQ ID NO: 949898 - RNA, 24 nt, Human
ccucccggguucaagcgauucucc

SEQ ID NO: 949899 - RNA, 19 nt, Human
ccugaccucgugauccacc

SEQ ID NO: 949900 - RNA, 21 nt, Human
ccugaccucgugauccaccug

SEQ ID NO: 949901 - RNA, 19 nt, Human
ccugcacuccagccuuggg

SEQ ID NO: 949902 - RNA, 19 nt, Human
ccuggccaacauggugaca

SEQ ID NO: 949903 - RNA, 24 nt, Human
ccuggccaacauggugacacccca

SEQ ID NO: 949904 - RNA, 19 nt, Human
ccugggucaagugauccuc

SEQ ID NO: 949905 - RNA, 22 nt, Human
ccuguugucuaggcuggagugc

SEQ ID NO: 949906 - RNA, 23 nt, Human
ccuugcccuguugucuaggcugg

SEQ ID NO: 949907 - RNA, 24 nt, Human
ccuugcccuguugucuaggcugga

SEQ ID NO: 949908 - RNA, 22 nt, Human
cgaagugcuaggauuacauaca

SEQ ID NO: 949909 - RNA, 24 nt, Human
cgaagugcugggauuacaggcgug

SEQ ID NO: 949910 - RNA, 19 nt, Human
cgcaagguggagguugcag

SEQ ID NO: 949911 - RNA, 24 nt, Human
cgcaagguggagguugcagugagc

SEQ ID NO: 949912 - RNA, 24 nt, Human
cgccucagccuccagaguagcugg

SEQ ID NO: 949913 - RNA, 24 nt, Human
cgcucuuguugcccaggcuggagu

SEQ ID NO: 949914 - RNA, 24 nt, Human
cgcugccagauguucacuguaggc

SEQ ID NO: 949915 - RNA, 21 nt, Human
cucaagcaauccucccaccuc

SEQ ID NO: 949916 - RNA, 25 nt, Human
cucaagcaauccucccaccucagcc

SEQ ID NO: 949917 - RNA, 22 nt, Human
cucacaccuauaaucccagcac

SEQ ID NO: 949918 - RNA, 24 nt, Human
cucacaccuauaaucccagcacuu

SEQ ID NO: 949919 - RNA, 24 nt, Human
cucaccacaaccuccgccucccgg

SEQ ID NO: 949920 - RNA, 24 nt, Human
cucagccuccagaguagcugggac

SEQ ID NO: 949921 - RNA, 25 nt, Human
cucccaggcucaagcaauccuccca

SEQ ID NO: 949922 - RNA, 25 nt, Human
cuccugaccucagugaucugcccgc

SEQ ID NO: 949923 - RNA, 24 nt, Human
cuccugaccucgugauccaccugc

SEQ ID NO: 949924 - RNA, 23 nt, Human
cugcacuccagccuuggugacag

SEQ ID NO: 949925 - RNA, 19 nt, Human
cuggucuugaacuccuggg

SEQ ID NO: 949926 - RNA, 19 nt, Human
cuugaacuccugggucaag

SEQ ID NO: 949927 - RNA, 21 nt, Human
cuugcccuguugucuaggcug

SEQ ID NO: 949928 - RNA, 24 nt, Human
cuugcccuguugucuaggcuggag

SEQ ID NO: 949929 - RNA, 24 nt, Human
cuuguugcccaggcuggagugcaa

SEQ ID NO: 949930 - RNA, 20 nt, Human
gaaggaaagacaggccacuc

SEQ ID NO: 949931 - RNA, 24 nt, Human
gaagugcugggauuacaggcguga

SEQ ID NO: 949932 - RNA, 23 nt, Human
gaccucagugaucugcccgccuc

SEQ ID NO: 949933 - RNA, 22 nt, Human
gaccucgugauccaccugccuc

SEQ ID NO: 949934 - RNA, 22 nt, Human
gaccucgugauccaccugccuc

SEQ ID NO: 949935 - RNA, 24 nt, Human
gaccucgugauccaccugccucgg

SEQ ID NO: 949936 - RNA, 21 nt, Human
gacuacaggcaugagccacca

SEQ ID NO: 949937 - RNA, 23 nt, Human
gagaccagccuggccaacauggu

SEQ ID NO: 949938 - RNA, 24 nt, Human
gagacgggguuucaccgugcuggc

SEQ ID NO: 949939 - RNA, 18 nt, Human
gagaugggguuucaccau

SEQ ID NO: 949940 - RNA, 24 nt, Human
gagaugggguuucaccauguuggc

SEQ ID NO: 949941 - RNA, 23 nt, Human
gagauugugccccugcacuccag

SEQ ID NO: 949942 - RNA, 22 nt, Human
gagcacccucccaucuuccucu

SEQ ID NO: 949943 - RNA, 21 nt, Human
gagguugcagugagcugagau

SEQ ID NO: 949944 - RNA, 23 nt, Human
gagguugcagugagcugagauug

SEQ ID NO: 949945 - RNA, 24 nt, Human
gaucucaucauguuguccaggcug

SEQ ID NO: 949946 - RNA, 18 nt, Human
gauuacaggcgugagcca

SEQ ID NO: 949947 - RNA, 21 nt, Human
gauuacaggcgugagccacca

SEQ ID NO: 949948 - RNA, 22 nt, Human
gauuacaggcgugagccaccac

SEQ ID NO: 949949 - RNA, 18 nt, Human
gauuacauacaugagcca

SEQ ID NO: 949950 - RNA, 24 nt, Human
gcacuccagccuuggugacagagc

SEQ ID NO: 949951 - RNA, 22 nt, Human
gcagugagcugagauugugccc

SEQ ID NO: 949952 - RNA, 24 nt, Human
gccaacauggugacaccccaucuc

SEQ ID NO: 949953 - RNA, 21 nt, Human
gccgagaguuugagaccagcc

SEQ ID NO: 949954 - RNA, 23 nt, Human
gccucaaccccccgaagugcugg

SEQ ID NO: 949955 - RNA, 23 nt, Human
gcuaaucucaaacuccugaccuc

SEQ ID NO: 949956 - RNA, 21 nt, Human
gcucacuguaggcuugaccuc

SEQ ID NO: 949957 - RNA, 24 nt, Human
gcucuuguugcccaggcuggagug

SEQ ID NO: 949958 - RNA, 23 nt, Human
gcugaucucguacuccugaccuc

SEQ ID NO: 949959 - RNA, 23 nt, Human
gcugccagauguucacuguaggc

SEQ ID NO: 949960 - RNA, 19 nt, Human
gcuggagugcaauggcgca

SEQ ID NO: 949961 - RNA, 20 nt, Human
gcugggggggugaugagcac

SEQ ID NO: 949962 - RNA, 19 nt, Human
ggacuacaggcaugagcca

SEQ ID NO: 949963 - RNA, 22 nt, Human
ggagguugcagugagcugagau

SEQ ID NO: 949964 - RNA, 24 nt, Human
ggagguugcagugagcugagauug

SEQ ID NO: 949965 - RNA, 24 nt, Human
ggagguugcagugagcuggcuagg

SEQ ID NO: 949966 - RNA, 19 nt, Human
ggauuacaggcgugagcca

SEQ ID NO: 949967 - RNA, 22 nt, Human
ggauuacauacaugagccacca

SEQ ID NO: 949968 - RNA, 20 nt, Human
ggcauuucgguacagagaca

SEQ ID NO: 949969 - RNA, 23 nt, Human
ggccacaggugugcaccaucaug

SEQ ID NO: 949970 - RNA, 21 nt, Human
ggcucacaccuauaaucccag

SEQ ID NO: 949971 - RNA, 18 nt, Human
ggcuggucuugaacuccu

SEQ ID NO: 949972 - RNA, 24 nt, Human
gggauauagaggcuggguguggug

SEQ ID NO: 949973 - RNA, 24 nt, Human
gggccacaggugugcaccaucaug

SEQ ID NO: 949974 - RNA, 24 nt, Human
ggggaucucaucauguuguccagg

SEQ ID NO: 949975 - RNA, 22 nt, Human
gggguuucaccauguuggccag

SEQ ID NO: 949976 - RNA, 23 nt, Human
gggguuucaccgugcuggccagg

SEQ ID NO: 949977 - RNA, 24 nt, Human
gggugugguggcucacaccuauaa

SEQ ID NO: 949978 - RNA, 18 nt, Human
ggguuucaccauguuggc

SEQ ID NO: 949979 - RNA, 22 nt, Human
ggguuucaccgugcuggccagg

SEQ ID NO: 949980 - RNA, 19 nt, Human
gguccucucuggucugcuu

SEQ ID NO: 949981 - RNA, 19 nt, Human
ggugcacagggccgcugcc

SEQ ID NO: 949982 - RNA, 19 nt, Human
gguggagguugcagugagc

SEQ ID NO: 949983 - RNA, 24 nt, Human
gguggcucacaccuauaaucccag

SEQ ID NO: 949984 - RNA, 23 nt, Human
guagagaugggguuucaccaugu

SEQ ID NO: 949985 - RNA, 22 nt, Human
gugauccaccugccucggccuc

SEQ ID NO: 949986 - RNA, 21 nt, Human
gugaucugcccgccucaaccc

SEQ ID NO: 949987 - RNA, 24 nt, Human
guugcagugagcugagauugugcc

SEQ ID NO: 949988 - RNA, 23 nt, Human
uaaaagggauauagaggcugggu

SEQ ID NO: 949989 - RNA, 25 nt, Human
uaauuuuuuuuuauuuuuaguagag

SEQ ID NO: 949990 - RNA, 26 nt, Human
uaauuuuuuuuuauuuuuaguagaga

SEQ ID NO: 949991 - RNA, 24 nt, Human
uacaggcaugagccaccacgccca

SEQ ID NO: 949992 - RNA, 23 nt, Human
uacaggcgugagccaccacaucc

SEQ ID NO: 949993 - RNA, 24 nt, Human
uacauacaugagccaccacgccug

SEQ ID NO: 949994 - RNA, 20 nt, Human
uagagacaggguuucaccau

SEQ ID NO: 949995 - RNA, 22 nt, Human
uagagaugggguuucaccaugu

SEQ ID NO: 949996 - RNA, 19 nt, Human
uagcugggugugguggcac

SEQ ID NO: 949997 - RNA, 22 nt, Human
uaggauuacauacaugagccac

SEQ ID NO: 949998 - RNA, 24 nt, Human
uaggauuacauacaugagccacca

SEQ ID NO: 949999 - RNA, 19 nt, Human
uaguagagacaggguuuca

SEQ ID NO: 950000 - RNA, 26 nt, Human
uaguagagacaggguuucaccaucuu

SEQ ID NO: 950001 - RNA, 24 nt, Human
uaguagagaugggguuucaccaug

SEQ ID NO: 950002 - RNA, 25 nt, Human
uaguagagaugggguuucaccaugu

SEQ ID NO: 950003 - RNA, 24 nt, Human
ucaccacaaccuccgccucccggg

SEQ ID NO: 950004 - RNA, 25 nt, Human
ucaccacaaccuccgccucccgggu

SEQ ID NO: 950005 - RNA, 27 nt, Human
ucaccacaaccuccgccucccggguuc

SEQ ID NO: 950006 - RNA, 20 nt, Human
ucacuguaggcguccagcag

SEQ ID NO: 950007 - RNA, 23 nt, Human
ucacuguaggcuugaccucccag

SEQ ID NO: 950008 - RNA, 24 nt, Human
ucacuguaggcuugaccucccagg

SEQ ID NO: 950009 - RNA, 22 nt, Human
ucagcagagacgggguuucacc

SEQ ID NO: 950010 - RNA, 24 nt, Human
ucagcagagacgggguuucaccgu

SEQ ID NO: 950011 - RNA, 27 nt, Human
ucagugaucugcccgccucaacccccc

SEQ ID NO: 950012 - RNA, 18 nt, Human
uccacuaaaaaaauacaa

SEQ ID NO: 950013 - RNA, 24 nt, Human
uccagaguagcugggacuacaggc

SEQ ID NO: 950014 - RNA, 19 nt, Human
uccaggcugcaccuggcuc

SEQ ID NO: 950015 - RNA, 18 nt, Human
ucccaggcucaagcaauc

SEQ ID NO: 950016 - RNA, 20 nt, Human
ucccaucuuccucuguccag

SEQ ID NO: 950017 - RNA, 21 nt, Human
ucccggguucaagcgauucuc

SEQ ID NO: 950018 - RNA, 24 nt, Human
ucccggguucaagcgauucucccg

SEQ ID NO: 950019 - RNA, 20 nt, Human
ucgaagugcuaggauuacau

SEQ ID NO: 950020 - RNA, 24 nt, Human
ucgaagugcuaggauuacauacau

SEQ ID NO: 950021 - RNA, 22 nt, Human
ucgcucuuguugcccaggcugg

SEQ ID NO: 950022 - RNA, 23 nt, Human
ucgcucuuguugcccaggcugga

SEQ ID NO: 950023 - RNA, 24 nt, Human
ucuacagaagauuguuggguccac

SEQ ID NO: 950024 - RNA, 19 nt, Human
ucuaucagguuuggauugg

SEQ ID NO: 950025 - RNA, 20 nt, Human
ucucauuaggaugcgugcuc

SEQ ID NO: 950026 - RNA, 24 nt, Human
ucucccgccucagccuccagagua

SEQ ID NO: 950027 - RNA, 18 nt, Human
ucucgaagugcuaggauu

SEQ ID NO: 950028 - RNA, 19 nt, Human
ucucgaagugcuaggauua

SEQ ID NO: 950029 - RNA, 20 nt, Human
ucugaaguuugcaguugggg

SEQ ID NO: 950030 - RNA, 21 nt, Human
ucugcccgccucaaccccccg

SEQ ID NO: 950031 - RNA, 20 nt, Human
ucuugaacuccugggucaag

SEQ ID NO: 950032 - RNA, 22 nt, Human
ucuuguugcccaggcuggagug

SEQ ID NO: 950033 - RNA, 24 nt, Human
ugaacuccugggucaagugauccu

SEQ ID NO: 950034 - RNA, 19 nt, Human
ugacaccccaucuccacua

SEQ ID NO: 950035 - RNA, 22 nt, Human
ugacaccccaucuccacuaaaa

SEQ ID NO: 950036 - RNA, 23 nt, Human
ugaccucagugaucugcccgccu

SEQ ID NO: 950037 - RNA, 24 nt, Human
ugaccucccaggcucaagcaaucc

SEQ ID NO: 950038 - RNA, 25 nt, Human
ugaccucccaggcucaagcaauccu

SEQ ID NO: 950039 - RNA, 24 nt, Human
ugagaagcuggggccacaggugug

SEQ ID NO: 950040 - RNA, 23 nt, Human
ugagaccagccuggccaacaugg

SEQ ID NO: 950041 - RNA, 22 nt, Human
ugagauugugccccugcacucc

SEQ ID NO: 950042 - RNA, 21 nt, Human
ugagcacccucccaucuuccu

SEQ ID NO: 950043 - RNA, 21 nt, Human
ugagcugagauugugccccug

SEQ ID NO: 950044 - RNA, 22 nt, Human
ugaguccuugacagagcagcuu

SEQ ID NO: 950045 - RNA, 19 nt, Human
ugcaccaucaugaccagcc

SEQ ID NO: 950046 - RNA, 24 nt, Human
ugcaccuggcucuaucugacgcuc

SEQ ID NO: 950047 - RNA, 18 nt, Human
ugcccaggcuggagugca

SEQ ID NO: 950048 - RNA, 21 nt, Human
ugcccaggcuggagugcaaug

SEQ ID NO: 950049 - RNA, 21 nt, Human
ugcccaggcuggagugcaaug

SEQ ID NO: 950050 - RNA, 21 nt, Human
ugccucggccucucgaagugc

SEQ ID NO: 950051 - RNA, 23 nt, Human
ugccucggccucucgaagugcua

SEQ ID NO: 950052 - RNA, 24 nt, Human
ugcuaggauuacauacaugagcca

SEQ ID NO: 950053 - RNA, 24 nt, Human
ugcugggauuacaggcgugagcca

SEQ ID NO: 950054 - RNA, 18 nt, Human
ugcugggggggugaugag

SEQ ID NO: 950055 - RNA, 18 nt, Human
uggagguugcagugagcu

SEQ ID NO: 950056 - RNA, 20 nt, Human
uggagguugcagugagcuga

SEQ ID NO: 950057 - RNA, 20 nt, Human
uggagguugcagugagcugg

SEQ ID NO: 950058 - RNA, 23 nt, Human
uggagugcaauggcgcaaucuca

SEQ ID NO: 950059 - RNA, 24 nt, Human
uggagugcaauggcgcaaucucag

SEQ ID NO: 950060 - RNA, 19 nt, Human
uggagugcauggugagauc

SEQ ID NO: 950061 - RNA, 24 nt, Human
uggccaggcugaucucguacuccu

SEQ ID NO: 950062 - RNA, 24 nt, Human
uggccaggcuggucuugaacuccu

SEQ ID NO: 950063 - RNA, 24 nt, Human
uggcgcaaucucagcucaccacaa

SEQ ID NO: 950064 - RNA, 24 nt, Human
uggcucacaccuauaaucccagca

SEQ ID NO: 950065 - RNA, 24 nt, Human
uggcucacuguaggcuugaccucc

SEQ ID NO: 950066 - RNA, 18 nt, Human
ugggacuacaggcaugag

SEQ ID NO: 950067 - RNA, 22 nt, Human
ugggacuacaggcaugagccac

SEQ ID NO: 950068 - RNA, 24 nt, Human
ugggacuacaggcaugagccacca

SEQ ID NO: 950069 - RNA, 24 nt, Human
ugggacuacaggcaugagccacca

SEQ ID NO: 950070 - RNA, 20 nt, Human
ugggaggcugaggccgagag

SEQ ID NO: 950071 - RNA, 18 nt, Human
ugggauuacaggcgugag

SEQ ID NO: 950072 - RNA, 19 nt, Human
ugggauuacaggcgugagc

SEQ ID NO: 950073 - RNA, 22 nt, Human
ugggauuacaggcgugagccac

SEQ ID NO: 950074 - RNA, 23 nt, Human
ugggauuacaggcgugagccacc

SEQ ID NO: 950075 - RNA, 24 nt, Human
ugggauuacaggcgugagccacca

SEQ ID NO: 950076 - RNA, 24 nt, Human
ugggguuucaccauguuggccagg

SEQ ID NO: 950077 - RNA, 24 nt, Human
uggugagaucauggcucacuguag

SEQ ID NO: 950078 - RNA, 23 nt, Human
ugucuaggcuggagugcauggug

SEQ ID NO: 950079 - RNA, 24 nt, Human
ugucugaguccuugacagagcagc

SEQ ID NO: 950080 - RNA, 21 nt, Human
ugugguggcacacucccgcgg

SEQ ID NO: 950081 - RNA, 20 nt, Human
uguugcccaggcuggagugc

SEQ ID NO: 950082 - RNA, 18 nt, Human
uuagcugggugugguggc

SEQ ID NO: 950083 - RNA, 20 nt, Human
uuagcugggugugguggcac

SEQ ID NO: 950084 - RNA, 24 nt, Human
uuaguagagacaggguuucaccau

SEQ ID NO: 950085 - RNA, 18 nt, Human
uuaguagagaugggguuu

SEQ ID NO: 950086 - RNA, 22 nt, Human
uuaguagagaugggguuucacc

SEQ ID NO: 950087 - RNA, 24 nt, Human
uuaguagagaugggguuucaccau

SEQ ID NO: 950088 - RNA, 23 nt, Human
uucaagcgauucucccgccucag

SEQ ID NO: 950089 - RNA, 24 nt, Human
uucaagcgauucucccgccucagc

SEQ ID NO: 950090 - RNA, 24 nt, Human
uucgcucuuguugcccaggcugga

SEQ ID NO: 950091 - RNA, 19 nt, Human
uugcagugagcugagauug

SEQ ID NO: 950092 - RNA, 22 nt, Human
uugcagugagcugagauugugc

SEQ ID NO: 950093 - RNA, 19 nt, Human
uuggauuggugcacagggc

SEQ ID NO: 950094 - RNA, 20 nt, Human
uuggauuggugcacagggcc

SEQ ID NO: 950095 - RNA, 18 nt, Human
uugggaggcugaggccga

SEQ ID NO: 950096 - RNA, 21 nt, Human
uugggaggcugaggccgagag

SEQ ID NO: 950097 - RNA, 18 nt, Human
uugguauuuuuaguagag

SEQ ID NO: 950098 - RNA, 21 nt, Human
uuucaccaucuuggccaggcu

SEQ ID NO: 950099 - RNA, 24 nt, Human
uuucaccauguuggccaggcuggu

SEQ ID NO: 950100 - RNA, 21 nt, Human
uuucaccgugcuggccaggcu

SEQ ID NO: 950101 - RNA, 24 nt, Human
uuucgcucuuguugcccaggcugg

SEQ ID NO: 950102 - RNA, 21 nt, Human
uuugguauuuuuaguagagau

SEQ ID NO: 950103 - RNA, 23 nt, Human
uuuuauuuuuaguagagacaggg

SEQ ID NO: 950104 - RNA, 24 nt, Human
uuuuuaguagagacaggguuucac

SEQ ID NO: 950105 - RNA, 24 nt, Human
uuuuuaguagagaugggguuucac

SEQ ID NO: 950106 - RNA, 19 nt, Human
uuuuuuuuagagggccuug

SEQ ID NO: 950107 - RNA, 24 nt, Human
uuuuuuuuauuuuuaguagagaca

SEQ ID NO: 950108 - RNA, 28 nt, Human
uuuuuuuuuauuuuuaguagagacaggg

SEQ ID NO: 950109 - RNA, 20 nt, Human
uuuuuuuuuuuagagggccu

SEQ ID NO: 950110 - RNA, 18 nt, Human
uuuuuuuuuuuuuuccug

SEQ ID NO: 950111 - RNA, 21 nt, Human
aaaaaaaaaaaaaaaaagcac

SEQ ID NO: 950112 - RNA, 23 nt, Human
aaaaaaaaaaaaaaaagcacaag

SEQ ID NO: 950113 - RNA, 26 nt, Human
aaaaaaaaaaagcacaaguaacuaag

SEQ ID NO: 950114 - RNA, 21 nt, Human
aaaaaagaaauacccaaaaga

SEQ ID NO: 950115 - RNA, 22 nt, Human
aaaaaagaaauacccaaaagaa

SEQ ID NO: 950116 - RNA, 25 nt, Human
aaaaaagccaccacucacugggggg

SEQ ID NO: 950117 - RNA, 22 nt, Human
aaaaccaaaacccuaaugcuga

SEQ ID NO: 950118 - RNA, 22 nt, Human
aaaacuauacucccauauuuca

SEQ ID NO: 950119 - RNA, 18 nt, Human
aaacaagauucacaugug

SEQ ID NO: 950120 - RNA, 24 nt, Human
aaacaagauucacaugugccaaaa

SEQ ID NO: 950121 - RNA, 20 nt, Human
aaagaaauacccaaaagaaa

SEQ ID NO: 950122 - RNA, 22 nt, Human
aaagccaccacucacugggaca

SEQ ID NO: 950123 - RNA, 24 nt, Human
aacugcauuauauuaugaaaacaa

SEQ ID NO: 950124 - RNA, 22 nt, Human
aagaaaaaaagccaccacucac

SEQ ID NO: 950125 - RNA, 21 nt, Human
aagcaaaacaagaaaacaaag

SEQ ID NO: 950126 - RNA, 21 nt, Human
aaggaauccaaagaaugcagu

SEQ ID NO: 950127 - RNA, 21 nt, Human
aaggaccuauauaauggaggc

SEQ ID NO: 950128 - RNA, 22 nt, Human
aagguggaaguaugguuuaucc

SEQ ID NO: 950129 - RNA, 20 nt, Human
aauaaaaauggagaaacuaa

SEQ ID NO: 950130 - RNA, 18 nt, Human
aauggaggcagcauucaa

SEQ ID NO: 950131 - RNA, 23 nt, Human
acaaaacaagauucacaugugcc

SEQ ID NO: 950132 - RNA, 21 nt, Human
acuuguaguuuugcccuugca

SEQ ID NO: 950133 - RNA, 19 nt, Human
agaaaacaaaguaugaaag

SEQ ID NO: 950134 - RNA, 20 nt, Human
agaaaauaaaaauggagaaa

SEQ ID NO: 950135 - RNA, 18 nt, Human
agccuggcagcauacacc

SEQ ID NO: 950136 - RNA, 23 nt, Human
aggaaaagaagaaauaauaaaaa

SEQ ID NO: 950137 - RNA, 22 nt, Human
augaaaugaaauccaagaagcu

SEQ ID NO: 950138 - RNA, 23 nt, Human
caaaaaagaaauacccaaaagaa

SEQ ID NO: 950139 - RNA, 25 nt, Human
caaaaaagaaauacccaaaagaaac

SEQ ID NO: 950140 - RNA, 25 nt, Human
caaaacaagauucacaugugccaaa

SEQ ID NO: 950141 - RNA, 19 nt, Human
caaaggccacugaucaaaa

SEQ ID NO: 950142 - RNA, 23 nt, Human
caagaaaacaaaguaugaaagua

SEQ ID NO: 950143 - RNA, 20 nt, Human
caaguguucucacccaaggu

SEQ ID NO: 950144 - RNA, 19 nt, Human
cacccaagucagagagcuc

SEQ ID NO: 950145 - RNA, 22 nt, Human
cagccuggcagcauacacccaa

SEQ ID NO: 950146 - RNA, 21 nt, Human
cauccccauaccaaaaccgga

SEQ ID NO: 950147 - RNA, 18 nt, Human
cccaaaagaaacaaaaac

SEQ ID NO: 950148 - RNA, 24 nt, Human
ccccauaccaaaaccggaugcucc

SEQ ID NO: 950149 - RNA, 22 nt, Human
cccuugcaaagauccaaaaaaa

SEQ ID NO: 950150 - RNA, 22 nt, Human
cccuuuggcaucagaaauccag

SEQ ID NO: 950151 - RNA, 21 nt, Human
ccuaaaaaggcguuuuucccc

SEQ ID NO: 950152 - RNA, 27 nt, Human
cgggcagaaaccgucaagauucauacu

SEQ ID NO: 950153 - RNA, 20 nt, Human
cuggaaggaccuauauaaug

SEQ ID NO: 950154 - RNA, 23 nt, Human
cuggaaggaccuauauaauggag

SEQ ID NO: 950155 - RNA, 23 nt, Human
cuuuuaauuuuaaacccaucauc

SEQ ID NO: 950156 - RNA, 19 nt, Human
gaaacaaaaaccaaaaccc

SEQ ID NO: 950157 - RNA, 21 nt, Human
gaaauccaagaagcuuuaacc

SEQ ID NO: 950158 - RNA, 22 nt, Human
gggcagaaaccgucaagauuca

SEQ ID NO: 950159 - RNA, 19 nt, Human
guggcccaaaggccacuga

SEQ ID NO: 950160 - RNA, 23 nt, Human
uaaacccaucaucagagaacaag

SEQ ID NO: 950161 - RNA, 22 nt, Human
uaaagcaaaacaagaaaacaaa

SEQ ID NO: 950162 - RNA, 23 nt, Human
uaacccuuuggcaucagaaaucc

SEQ ID NO: 950163 - RNA, 22 nt, Human
uacacaaaacaagauucacaug

SEQ ID NO: 950164 - RNA, 23 nt, Human
uacccaaaagaaacaaaaaccaa

SEQ ID NO: 950165 - RNA, 21 nt, Human
uagacugaaggaauccaaaga

SEQ ID NO: 950166 - RNA, 21 nt, Human
uaggcagaaacccagaaaugg

SEQ ID NO: 950167 - RNA, 19 nt, Human
uaugaaaacaaaaggaaaa

SEQ ID NO: 950168 - RNA, 19 nt, Human
uaugaaaguacccagccug

SEQ ID NO: 950169 - RNA, 22 nt, Human
uaugaaaguacccagccuggca

SEQ ID NO: 950170 - RNA, 19 nt, Human
uaugguuuauccugaacau

SEQ ID NO: 950171 - RNA, 19 nt, Human
uaugugggaaaauguaugc

SEQ ID NO: 950172 - RNA, 21 nt, Human
ucaaaaauaaaauaguggcug

SEQ ID NO: 950173 - RNA, 21 nt, Human
ucaagauucauacugcuguuu

SEQ ID NO: 950174 - RNA, 18 nt, Human
ucaaugaaaugaaaucca

SEQ ID NO: 950175 - RNA, 22 nt, Human
ucacacacacaaaaaacuuggc

SEQ ID NO: 950176 - RNA, 20 nt, Human
ucauaaggacucaacaaaaa

SEQ ID NO: 950177 - RNA, 24 nt, Human
uccaaaaaaaaaaaaaaaaagcac

SEQ ID NO: 950178 - RNA, 19 nt, Human
uccuaaggugaaagucacc

SEQ ID NO: 950179 - RNA, 24 nt, Human
ucugccauuaggacgggcagaaac

SEQ ID NO: 950180 - RNA, 19 nt, Human
ugaaaacaaaaggaaaaga

SEQ ID NO: 950181 - RNA, 23 nt, Human
ugaaaaccuguaacaaauuuaaa

SEQ ID NO: 950182 - RNA, 26 nt, Human
ugaaaugaaauccaagaagcuuuaac

SEQ ID NO: 950183 - RNA, 20 nt, Human
ugaacaugaaaaccuguaac

SEQ ID NO: 950184 - RNA, 21 nt, Human
ugccaaaaaagaaauacccaa

SEQ ID NO: 950185 - RNA, 24 nt, Human
ugccaauguggaaagaaaaaaagc

SEQ ID NO: 950186 - RNA, 18 nt, Human
ugcuuauuucuuacaugc

SEQ ID NO: 950187 - RNA, 21 nt, Human
uggaaguaugguuuauccuga

SEQ ID NO: 950188 - RNA, 18 nt, Human
uggagaugacugaguccu

SEQ ID NO: 950189 - RNA, 20 nt, Human
uggcuguauaucaaugaaau

SEQ ID NO: 950190 - RNA, 20 nt, Human
ugggacacccagagaauugg

SEQ ID NO: 950191 - RNA, 20 nt, Human
ugggagaagugaaugugcca

SEQ ID NO: 950192 - RNA, 24 nt, Human
ugugccaauguggaaagaaaaaaa

SEQ ID NO: 950193 - RNA, 20 nt, Human
uguggaaagaaaaaaagcca

SEQ ID NO: 950194 - RNA, 26 nt, Human
uuaaucucaaagaaacauaaguugug

SEQ ID NO: 950195 - RNA, 19 nt, Human
uucucacccaagguggaag

SEQ ID NO: 950196 - RNA, 21 nt, Human
uuuaauuuuaaacccaucauc

SEQ ID NO: 950197 - RNA, 22 nt, Human
aaagcucagccgggcugucgcc

SEQ ID NO: 950198 - RNA, 21 nt, Human
aacacugucgucgucuccacg

SEQ ID NO: 950199 - RNA, 20 nt, Human
aaccuggaguguggagaggc

SEQ ID NO: 950200 - RNA, 22 nt, Human
aagccaucucuccgcuguccca

SEQ ID NO: 950201 - RNA, 22 nt, Human
aauuacaagaaaaaaguugcaa

SEQ ID NO: 950202 - RNA, 22 nt, Human
acucugccaccccggcaggcgg

SEQ ID NO: 950203 - RNA, 22 nt, Human
agaaaaaaguugcaacuucagu

SEQ ID NO: 950204 - RNA, 24 nt, Human
agacaggcaggaaccgucucaggc

SEQ ID NO: 950205 - RNA, 19 nt, Human
agccaggggcugcagaggg

SEQ ID NO: 950206 - RNA, 26 nt, Human
aggcaggagaaggugcaagagggacc

SEQ ID NO: 950207 - RNA, 22 nt, Human
aucauggccuggcagcucuguc

SEQ ID NO: 950208 - RNA, 19 nt, Human
augacuggaaaggggccuu

SEQ ID NO: 950209 - RNA, 23 nt, Human
auucuugguggcggcaguauccg

SEQ ID NO: 950210 - RNA, 26 nt, Human
caaaagcaagucucuccaagucaaaa

SEQ ID NO: 950211 - RNA, 22 nt, Human
caacccccaagacaggcaggaa

SEQ ID NO: 950212 - RNA, 21 nt, Human
caacucacucugccaccccgg

SEQ ID NO: 950213 - RNA, 21 nt, Human
caaguuacaauaaacagucca

SEQ ID NO: 950214 - RNA, 23 nt, Human
caaguuacaauaaacaguccauu

SEQ ID NO: 950215 - RNA, 19 nt, Human
caccucacuaaagcucagc

SEQ ID NO: 950216 - RNA, 24 nt, Human
caccucauguccccuccuccagac

SEQ ID NO: 950217 - RNA, 20 nt, Human
cacggcgcgggcugcagcag

SEQ ID NO: 950218 - RNA, 19 nt, Human
cacggcuggcagaacugcc

SEQ ID NO: 950219 - RNA, 19 nt, Human
cacgggcggaaccaacaaa

SEQ ID NO: 950220 - RNA, 19 nt, Human
cacgugcccugauggagaa

SEQ ID NO: 950221 - RNA, 25 nt, Human
cacucugccaccccggcaggcggca

SEQ ID NO: 950222 - RNA, 24 nt, Human
cagaacauucuaauaaaaauauua

SEQ ID NO: 950223 - RNA, 26 nt, Human
cagacccccacagcccuggaugcccc

SEQ ID NO: 950224 - RNA, 20 nt, Human
cagccgccaggcccgaccac

SEQ ID NO: 950225 - RNA, 19 nt, Human
caggaggccguguccucac

SEQ ID NO: 950226 - RNA, 21 nt, Human
cauggccuggcagcucugucu

SEQ ID NO: 950227 - RNA, 23 nt, Human
cauguccccuccuccagaccccc

SEQ ID NO: 950228 - RNA, 18 nt, Human
ccacugccccccccaggc

SEQ ID NO: 950229 - RNA, 19 nt, Human
ccaggcccgaccacucgcg

SEQ ID NO: 950230 - RNA, 23 nt, Human
ccaggcccgaccacucgcgcgcc

SEQ ID NO: 950231 - RNA, 21 nt, Human
ccccacagcccuggaugcccc

SEQ ID NO: 950232 - RNA, 22 nt, Human
cccccacagcccuggaugcccc

SEQ ID NO: 950233 - RNA, 19 nt, Human
cccccaggcuggcaccacc

SEQ ID NO: 950234 - RNA, 18 nt, Human
ccccccgcugccccccgc

SEQ ID NO: 950235 - RNA, 19 nt, Human
cccccgcugccccccgccc

SEQ ID NO: 950236 - RNA, 23 nt, Human
ccccgccacgaugcagcaguggg

SEQ ID NO: 950237 - RNA, 20 nt, Human
ccccgccgccuacggacccg

SEQ ID NO: 950238 - RNA, 21 nt, Human
ccccgcugccccccgcccucg

SEQ ID NO: 950239 - RNA, 19 nt, Human
ccccuccuccagaccccca

SEQ ID NO: 950240 - RNA, 22 nt, Human
ccccuccuccagacccccacag

SEQ ID NO: 950241 - RNA, 24 nt, Human
cccucaagacacaaugggaccuag

SEQ ID NO: 950242 - RNA, 19 nt, Human
ccgagcugcgccgcgcugc

SEQ ID NO: 950243 - RNA, 21 nt, Human
ccgagcugcgccgcgcugcgc

SEQ ID NO: 950244 - RNA, 23 nt, Human
ccgccaggcccgaccacucgcgc

SEQ ID NO: 950245 - RNA, 19 nt, Human
ccgcgagccggcagacacu

SEQ ID NO: 950246 - RNA, 20 nt, Human
ccgcgcugcgcucccgaccu

SEQ ID NO: 950247 - RNA, 18 nt, Human
ccgugcgcgccgagcugc

SEQ ID NO: 950248 - RNA, 18 nt, Human
ccuagauuaaagagaagc

SEQ ID NO: 950249 - RNA, 18 nt, Human
ccuccaccaacccccaag

SEQ ID NO: 950250 - RNA, 23 nt, Human
ccuccuccagacccccacagccc

SEQ ID NO: 950251 - RNA, 21 nt, Human
cgccgggggcggccaggggcc

SEQ ID NO: 950252 - RNA, 23 nt, Human
cgccgggggcggccaggggccgc

SEQ ID NO: 950253 - RNA, 18 nt, Human
cgccugggagcuccuccg

SEQ ID NO: 950254 - RNA, 21 nt, Human
cgccugggagcuccuccgggc

SEQ ID NO: 950255 - RNA, 19 nt, Human
cgcgccgagcugcgccgcg

SEQ ID NO: 950256 - RNA, 29 nt, Human
cgcgcugcgcucccgaccggcgcugcccc

SEQ ID NO: 950257 - RNA, 19 nt, Human
cgcucagcucccugaggua

SEQ ID NO: 950258 - RNA, 27 nt, Human
cgcugcgcucccgaccggcgcugcccc

SEQ ID NO: 950259 - RNA, 28 nt, Human
cgcugcgcucccgaccggcgcugcccuu

SEQ ID NO: 950260 - RNA, 18 nt, Human
cggcgcgggcugcagcag

SEQ ID NO: 950261 - RNA, 23 nt, Human
cgucuccacgggcggaaccaaca

SEQ ID NO: 950262 - RNA, 19 nt, Human
cuaaagcucagccgggcug

SEQ ID NO: 950263 - RNA, 20 nt, Human
cucaccucauguccccuccu

SEQ ID NO: 950264 - RNA, 23 nt, Human
cuccacccuccaccaacccccaa

SEQ ID NO: 950265 - RNA, 21 nt, Human
cuccagcgggcagagcugagg

SEQ ID NO: 950266 - RNA, 25 nt, Human
cucugucccaggccugcccuggagc

SEQ ID NO: 950267 - RNA, 24 nt, Human
gaagaggcgcacccuucugcacuc

SEQ ID NO: 950268 - RNA, 19 nt, Human
gaaggaaggaaggagagag

SEQ ID NO: 950269 - RNA, 21 nt, Human
gaccccccgcugccccccgcc

SEQ ID NO: 950270 - RNA, 19 nt, Human
gacgggguccugagacaac

SEQ ID NO: 950271 - RNA, 23 nt, Human
gagacaacucacucugccacccc

SEQ ID NO: 950272 - RNA, 18 nt, Human
gaguuggggaaggaagga

SEQ ID NO: 950273 - RNA, 24 nt, Human
gaucacuuccuucuucccuuccac

SEQ ID NO: 950274 - RNA, 22 nt, Human
gcaagaagaggcugccauggug

SEQ ID NO: 950275 - RNA, 25 nt, Human
gcagcagacaguggcccgcacgggc

SEQ ID NO: 950276 - RNA, 19 nt, Human
gccacugccccccccaggc

SEQ ID NO: 950277 - RNA, 19 nt, Human
gcccguccagccgccaggc

SEQ ID NO: 950278 - RNA, 25 nt, Human
gcccuggaugccccauagcagcccu

SEQ ID NO: 950279 - RNA, 22 nt, Human
gccgagcugcgccgcgcugcgc

SEQ ID NO: 950280 - RNA, 24 nt, Human
gccgcgcugcgcucccgaccggcg

SEQ ID NO: 950281 - RNA, 19 nt, Human
gcgcucggggcgcacggcg

SEQ ID NO: 950282 - RNA, 20 nt, Human
gcggaaccaacaaaagcaag

SEQ ID NO: 950283 - RNA, 20 nt, Human
gcggccaggggccgcgggaa

SEQ ID NO: 950284 - RNA, 25 nt, Human
ggagaccccccgcugccccccgccc

SEQ ID NO: 950285 - RNA, 18 nt, Human
ggaguguggagaggcagg

SEQ ID NO: 950286 - RNA, 23 nt, Human
ggauaccucucaccucauguccc

SEQ ID NO: 950287 - RNA, 19 nt, Human
ggcagccaggggcugcaga

SEQ ID NO: 950288 - RNA, 23 nt, Human
ggccaggggccgcgggaagcccg

SEQ ID NO: 950289 - RNA, 20 nt, Human
ggcggaaccaacaaaagcaa

SEQ ID NO: 950290 - RNA, 18 nt, Human
ggcugcagagggucugug

SEQ ID NO: 950291 - RNA, 23 nt, Human
ggcugcgcucauggggggcggcg

SEQ ID NO: 950292 - RNA, 18 nt, Human
gggcagagcugagggcca

SEQ ID NO: 950293 - RNA, 18 nt, Human
gggcgcaggcggaaugcc

SEQ ID NO: 950294 - RNA, 22 nt, Human
gggggcggcggggagcgcgcgg

SEQ ID NO: 950295 - RNA, 18 nt, Human
gugaaggugacaaugcca

SEQ ID NO: 950296 - RNA, 23 nt, Human
uaaagagaagccaucucuccgcu

SEQ ID NO: 950297 - RNA, 22 nt, Human
uagcaaaacaauuacaagaaaa

SEQ ID NO: 950298 - RNA, 24 nt, Human
uagcuaccuuuauucucugagccu

SEQ ID NO: 950299 - RNA, 22 nt, Human
uccaccaacccccaagacaggc

SEQ ID NO: 950300 - RNA, 21 nt, Human
uccacccuccaccaaccccca

SEQ ID NO: 950301 - RNA, 24 nt, Human
uccacccuccaccaacccccaaga

SEQ ID NO: 950302 - RNA, 19 nt, Human
uccagccgccaggcccgac

SEQ ID NO: 950303 - RNA, 23 nt, Human
uccagccgccaggcccgaccacu

SEQ ID NO: 950304 - RNA, 26 nt, Human
ucccaggccugcccuggagcgccugc

SEQ ID NO: 950305 - RNA, 20 nt, Human
ucccgccgugcgcgccgagc

SEQ ID NO: 950306 - RNA, 25 nt, Human
ucucaccucauguccccuccuccag

SEQ ID NO: 950307 - RNA, 26 nt, Human
ucuccacgggcggaaccaacaaaagc

SEQ ID NO: 950308 - RNA, 21 nt, Human
ucugaaauuaucuuaguagca

SEQ ID NO: 950309 - RNA, 19 nt, Human
ugacgggguccugagacaa

SEQ ID NO: 950310 - RNA, 18 nt, Human
ugaggggccuccugucug

SEQ ID NO: 950311 - RNA, 19 nt, Human
ugcaagaagaggcugccau

SEQ ID NO: 950312 - RNA, 21 nt, Human
ugcagagggucugugacaccc

SEQ ID NO: 950313 - RNA, 22 nt, Human
ugcccgagcggucuucggaggc

SEQ ID NO: 950314 - RNA, 18 nt, Human
ugcccuggagcgccugca

SEQ ID NO: 950315 - RNA, 29 nt, Human
ugcccuggagcgccugcacgccggagucg

SEQ ID NO: 950316 - RNA, 19 nt, Human
ugccuccacccuccaccaa

SEQ ID NO: 950317 - RNA, 19 nt, Human
uggaaaggggccuuuggcc

SEQ ID NO: 950318 - RNA, 19 nt, Human
uggaugccccauagcagcc

SEQ ID NO: 950319 - RNA, 21 nt, Human
uggcacacagcagguggugcg

SEQ ID NO: 950320 - RNA, 20 nt, Human
uggccuggcagcucugucug

SEQ ID NO: 950321 - RNA, 21 nt, Human
ugucccaggccugcccuggag

SEQ ID NO: 950322 - RNA, 19 nt, Human
ugucccagggcgcaggcgg

SEQ ID NO: 950323 - RNA, 29 nt, Human
aaaaggcagaacaagagaacagugggcac

SEQ ID NO: 950324 - RNA, 27 nt, Human
aaagaaaaaaagcuauauacauaaggg

SEQ ID NO: 950325 - RNA, 21 nt, Human
aaagaaacuuuuacagauaca

SEQ ID NO: 950326 - RNA, 29 nt, Human
aacauuuuuauuuuuucaagggggggccc

SEQ ID NO: 950327 - RNA, 23 nt, Human
aacccaaaaauauauuucagagc

SEQ ID NO: 950328 - RNA, 19 nt, Human
aaccuauuucugcauuucc

SEQ ID NO: 950329 - RNA, 21 nt, Human
aagaaaaaaagcuauauacau

SEQ ID NO: 950330 - RNA, 25 nt, Human
aagagauugcugcugcugcugcugc

SEQ ID NO: 950331 - RNA, 23 nt, Human
aaucucccuuucuugccaauuga

SEQ ID NO: 950332 - RNA, 25 nt, Human
aaugcaagaugagaugcuaaccaaa

SEQ ID NO: 950333 - RNA, 27 nt, Human
acacaccagaacacauaguauuuacaa

SEQ ID NO: 950334 - RNA, 18 nt, Human
agaaacugcucaaccauc

SEQ ID NO: 950335 - RNA, 20 nt, Human
agacaaaaccuauuucugca

SEQ ID NO: 950336 - RNA, 20 nt, Human
agagcucacagagcuuaaaa

SEQ ID NO: 950337 - RNA, 19 nt, Human
aggccgcggaaccgcccag

SEQ ID NO: 950338 - RNA, 23 nt, Human
aggcuucugaaacauuaaaaaca

SEQ ID NO: 950339 - RNA, 18 nt, Human
augcaaccagacaaaacc

SEQ ID NO: 950340 - RNA, 23 nt, Human
caagaaagaaaaaaagcuauaua

SEQ ID NO: 950341 - RNA, 24 nt, Human
cacacugaaguaacccaaaaauau

SEQ ID NO: 950342 - RNA, 20 nt, Human
cacagagcuuaaaaagagca

SEQ ID NO: 950343 - RNA, 18 nt, Human
cagaaagcacauuuguuc

SEQ ID NO: 950344 - RNA, 24 nt, Human
caguagauccuugccucuuuauuu

SEQ ID NO: 950345 - RNA, 22 nt, Human
caugaacauuuuaaaaggcaga

SEQ ID NO: 950346 - RNA, 23 nt, Human
cauuuguucuccuagagcuauuc

SEQ ID NO: 950347 - RNA, 25 nt, Human
ccaaacagcccuuuagcugucuugu

SEQ ID NO: 950348 - RNA, 21 nt, Human
ccagaacacauaguauuuaca

SEQ ID NO: 950349 - RNA, 21 nt, Human
cccaaaaauauauuucagagc

SEQ ID NO: 950350 - RNA, 18 nt, Human
ccgccgccgccgcuucug

SEQ ID NO: 950351 - RNA, 21 nt, Human
ccuaccagacucucacguuua

SEQ ID NO: 950352 - RNA, 23 nt, Human
cgcuucuguugcuacuguuaagc

SEQ ID NO: 950353 - RNA, 19 nt, Human
cucaagaugaauucucaag

SEQ ID NO: 950354 - RNA, 21 nt, Human
cucaagaugaauucucaagaa

SEQ ID NO: 950355 - RNA, 27 nt, Human
cugcugcugcugccgccgccgccgcuu

SEQ ID NO: 950356 - RNA, 22 nt, Human
cuucuguugcuacuguuaagcc

SEQ ID NO: 950357 - RNA, 19 nt, Human
gaugaauucucaagaaaga

SEQ ID NO: 950358 - RNA, 20 nt, Human
gcugcugccgccgccgccgc

SEQ ID NO: 950359 - RNA, 22 nt, Human
gcugcugcugccgccgccgccg

SEQ ID NO: 950360 - RNA, 22 nt, Human
gcugcugcugcugccgccgccg

SEQ ID NO: 950361 - RNA, 22 nt, Human
ggaagagauugcugcugcugcu

SEQ ID NO: 950362 - RNA, 20 nt, Human
gguaacaggaaauugcauac

SEQ ID NO: 950363 - RNA, 20 nt, Human
uaaaaggcagaacaagagaa

SEQ ID NO: 950364 - RNA, 23 nt, Human
uaaaaggcagaacaagagaacag

SEQ ID NO: 950365 - RNA, 22 nt, Human
uaaauguguauuucagaaacug

SEQ ID NO: 950366 - RNA, 20 nt, Human
uaagccccuaggcccaggcc

SEQ ID NO: 950367 - RNA, 19 nt, Human
uacaaagaaacuuuuacag

SEQ ID NO: 950368 - RNA, 18 nt, Human
uauaugcaaccagacaaa

SEQ ID NO: 950369 - RNA, 21 nt, Human
ucucagacugcuuugccuacc

SEQ ID NO: 950370 - RNA, 23 nt, Human
ucucuaaacgccuguuccggccu

SEQ ID NO: 950371 - RNA, 21 nt, Human
ugcugcugcugcugcugcugc

SEQ ID NO: 950372 - RNA, 21 nt, Human
ugcugcugcugcugcugcugc

SEQ ID NO: 950373 - RNA, 21 nt, Human
ugcuuugccuaccagacucuc

SEQ ID NO: 950374 - RNA, 28 nt, Human
uggaauuuuaagacacaccagaacacau

SEQ ID NO: 950375 - RNA, 21 nt, Human
uguaaaaaguuaggcuucuga

SEQ ID NO: 950376 - RNA, 19 nt, Human
uugccaauugaucagaaug

SEQ ID NO: 950377 - RNA, 18 nt, Human
uugcuacuguuaagcccc

SEQ ID NO: 950378 - RNA, 19 nt, Human
uugucaaacacacugaagu

SEQ ID NO: 950379 - RNA, 20 nt, Human
uuuaaaaggcagaacaagag

SEQ ID NO: 950380 - RNA, 21 nt, Human
aaaaaagaaaaaaaauaaaag

SEQ ID NO: 950381 - RNA, 20 nt, Human
aaaccaacagcacuucugca

SEQ ID NO: 950382 - RNA, 20 nt, Human
aaccaacagcacuucugcag

SEQ ID NO: 950383 - RNA, 22 nt, Human
aaccaacagcacuucugcagcc

SEQ ID NO: 950384 - RNA, 22 nt, Human
aagcaaaaaagaaaaaaaauaa

SEQ ID NO: 950385 - RNA, 28 nt, Human
aagcaaaaaagaaaaaaaauaaaagcaa

SEQ ID NO: 950386 - RNA, 27 nt, Human
aaguacaaacacaaugucaucuaaaau

SEQ ID NO: 950387 - RNA, 20 nt, Human
acaaagguauaaaacucaaa

SEQ ID NO: 950388 - RNA, 23 nt, Human
acaaugaaagcaaaaaagaaaaa

SEQ ID NO: 950389 - RNA, 19 nt, Human
acagaaccacgagcagcaa

SEQ ID NO: 950390 - RNA, 18 nt, Human
acagacagaaccacgagc

SEQ ID NO: 950391 - RNA, 21 nt, Human
accaugaacggcaggcacaac

SEQ ID NO: 950392 - RNA, 24 nt, Human
acgccaaagagcagcaacuccccc

SEQ ID NO: 950393 - RNA, 22 nt, Human
agaaaaaaaauaaaagcaaugu

SEQ ID NO: 950394 - RNA, 22 nt, Human
agaaaccggaaacggaugagcu

SEQ ID NO: 950395 - RNA, 20 nt, Human
agaaccacgagcagcaacua

SEQ ID NO: 950396 - RNA, 22 nt, Human
agacagaaccacgagcagcaac

SEQ ID NO: 950397 - RNA, 18 nt, Human
agcaaaaaagaaaaaaaa

SEQ ID NO: 950398 - RNA, 19 nt, Human
agcaacagcaagggcacgg

SEQ ID NO: 950399 - RNA, 21 nt, Human
agcaucuucccgccgccgcca

SEQ ID NO: 950400 - RNA, 18 nt, Human
agccucacuuuucccugg

SEQ ID NO: 950401 - RNA, 23 nt, Human
agcugcacuaaagccuggggcag

SEQ ID NO: 950402 - RNA, 26 nt, Human
agcugggugggguauaaguuacaggg

SEQ ID NO: 950403 - RNA, 23 nt, Human
agggcagggccuggcguuggggg

SEQ ID NO: 950404 - RNA, 20 nt, Human
agggccccaagggcggaggc

SEQ ID NO: 950405 - RNA, 18 nt, Human
aggucaucggggaaggga

SEQ ID NO: 950406 - RNA, 25 nt, Human
aguacaguggugggguggucaggug

SEQ ID NO: 950407 - RNA, 21 nt, Human
agugguggggugcggugugug

SEQ ID NO: 950408 - RNA, 23 nt, Human
aucuuugagggggugugacccuu

SEQ ID NO: 950409 - RNA, 21 nt, Human
caacaaaguacaaacacaaug

SEQ ID NO: 950410 - RNA, 30 nt, Human
caacacaauucuuccacucuacacaacaag

SEQ ID NO: 950411 - RNA, 22 nt, Human
cacacagcauccaaaccaacag

SEQ ID NO: 950412 - RNA, 22 nt, Human
cacugaacugacucuuagaaac

SEQ ID NO: 950413 - RNA, 18 nt, Human
cagaaccacgagcagcaa

SEQ ID NO: 950414 - RNA, 19 nt, Human
cagaaccacgagcagcaac

SEQ ID NO: 950415 - RNA, 22 nt, Human
cauguugccaagauaaccugaa

SEQ ID NO: 950416 - RNA, 18 nt, Human
ccacgagcagcaacuacc

SEQ ID NO: 950417 - RNA, 21 nt, Human
ccaggccuaacaggguuggca

SEQ ID NO: 950418 - RNA, 23 nt, Human
ccccaagagccucacuuuucccu

SEQ ID NO: 950419 - RNA, 20 nt, Human
cccgccgccgccaccuccuc

SEQ ID NO: 950420 - RNA, 24 nt, Human
ccgccgccaccuccuccugcuuuc

SEQ ID NO: 950421 - RNA, 28 nt, Human
ccgccgccaccuccuccugcuuuccuca

SEQ ID NO: 950422 - RNA, 18 nt, Human
ccugcaaauccugccagg

SEQ ID NO: 950423 - RNA, 22 nt, Human
ccuggcguugggggcuuggguc

SEQ ID NO: 950424 - RNA, 24 nt, Human
cgccaaagagcagcaacucccccg

SEQ ID NO: 950425 - RNA, 20 nt, Human
cgccgaggccggcgccgcuc

SEQ ID NO: 950426 - RNA, 21 nt, Human
cgccgccgccaccuccuccug

SEQ ID NO: 950427 - RNA, 22 nt, Human
cgcuggucugagucccgcgggc

SEQ ID NO: 950428 - RNA, 22 nt, Human
cggacagacagaaccacgagca

SEQ ID NO: 950429 - RNA, 19 nt, Human
cggggcccggcuggcagag

SEQ ID NO: 950430 - RNA, 25 nt, Human
cucacuuuucccugguggcucugcc

SEQ ID NO: 950431 - RNA, 20 nt, Human
cugaacucucacuucuaacu

SEQ ID NO: 950432 - RNA, 22 nt, Human
cugacuguacaaugaaagcaaa

SEQ ID NO: 950433 - RNA, 21 nt, Human
cugccagagucaaggguuugc

SEQ ID NO: 950434 - RNA, 18 nt, Human
cugcccagcaacagcaag

SEQ ID NO: 950435 - RNA, 22 nt, Human
cugccugcaaauccugccagag

SEQ ID NO: 950436 - RNA, 19 nt, Human
cugcugccugcaaauccug

SEQ ID NO: 950437 - RNA, 23 nt, Human
cuucccgccgccgccaccuccuc

SEQ ID NO: 950438 - RNA, 24 nt, Human
cuugacaggcacacagcauccaaa

SEQ ID NO: 950439 - RNA, 23 nt, Human
cuugggucuccggcccggcggga

SEQ ID NO: 950440 - RNA, 18 nt, Human
gacagaaccacgagcagc

SEQ ID NO: 950441 - RNA, 21 nt, Human
gagcagcaucuucccgccgcc

SEQ ID NO: 950442 - RNA, 22 nt, Human
gagggggugugacccuugaggu

SEQ ID NO: 950443 - RNA, 24 nt, Human
gaucuuugagggggugugacccuu

SEQ ID NO: 950444 - RNA, 23 nt, Human
gcaaauccugccagagucaaggg

SEQ ID NO: 950445 - RNA, 23 nt, Human
gcacacagcauccaaaccaacag

SEQ ID NO: 950446 - RNA, 19 nt, Human
gccgccgccaccuccuccu

SEQ ID NO: 950447 - RNA, 22 nt, Human
gccucacuuaucugaacucuca

SEQ ID NO: 950448 - RNA, 22 nt, Human
gccucacuuaucugaacucuca

SEQ ID NO: 950449 - RNA, 21 nt, Human
gcggugugugcaucggugcac

SEQ ID NO: 950450 - RNA, 21 nt, Human
ggacagacagaaccacgagca

SEQ ID NO: 950451 - RNA, 19 nt, Human
ggcagcucccuuuccaaaa

SEQ ID NO: 950452 - RNA, 18 nt, Human
ggcagggccuggcguugg

SEQ ID NO: 950453 - RNA, 24 nt, Human
ggccaggccuaacaggguuggcag

SEQ ID NO: 950454 - RNA, 22 nt, Human
ggccuggccaccaucccagguc

SEQ ID NO: 950455 - RNA, 21 nt, Human
ggcggaggccgcgcuccccgc

SEQ ID NO: 950456 - RNA, 24 nt, Human
ggcuggcagaggggugcugccugc

SEQ ID NO: 950457 - RNA, 19 nt, Human
gggaagggaaaagugugcu

SEQ ID NO: 950458 - RNA, 26 nt, Human
gggcagggccuggcguugggggcuug

SEQ ID NO: 950459 - RNA, 20 nt, Human
gggcccggcuggcagagggg

SEQ ID NO: 950460 - RNA, 23 nt, Human
gggccuggcguugggggcuuggg

SEQ ID NO: 950461 - RNA, 21 nt, Human
guacaaugaaagcaaaaaaga

SEQ ID NO: 950462 - RNA, 25 nt, Human
guacaaugaaagcaaaaaagaaaaa

SEQ ID NO: 950463 - RNA, 21 nt, Human
uaaccugaaagaccaccauga

SEQ ID NO: 950464 - RNA, 22 nt, Human
uaacuugauucugagaaacgau

SEQ ID NO: 950465 - RNA, 22 nt, Human
uaacuugauucugagaaacgau

SEQ ID NO: 950466 - RNA, 21 nt, Human
uacacaacaaaguacaaacac

SEQ ID NO: 950467 - RNA, 20 nt, Human
uaccaugggugagaggaucu

SEQ ID NO: 950468 - RNA, 23 nt, Human
uaucugaacucucacuucuaacu

SEQ ID NO: 950469 - RNA, 23 nt, Human
ucacuuaucugaacucucacuuc

SEQ ID NO: 950470 - RNA, 23 nt, Human
ucacuuaucugaacucucacuuc

SEQ ID NO: 950471 - RNA, 24 nt, Human
ucagaguacagugguggggugcgg

SEQ ID NO: 950472 - RNA, 20 nt, Human
ucccagguaagcagggucaa

SEQ ID NO: 950473 - RNA, 21 nt, Human
ucccgccgccgccaccuccuc

SEQ ID NO: 950474 - RNA, 21 nt, Human
uccggcccggcgggagggccc

SEQ ID NO: 950475 - RNA, 18 nt, Human
uccuccugcuuuccucag

SEQ ID NO: 950476 - RNA, 25 nt, Human
ucuccccuucugagguguucaaagc

SEQ ID NO: 950477 - RNA, 25 nt, Human
ucuccccuucugagguguucaaagc

SEQ ID NO: 950478 - RNA, 23 nt, Human
ucuucccgccgccgccaccuccu

SEQ ID NO: 950479 - RNA, 18 nt, Human
ugaaagaccaccaugaac

SEQ ID NO: 950480 - RNA, 22 nt, Human
ugaaagcaaaaaagaaaaaaaa

SEQ ID NO: 950481 - RNA, 22 nt, Human
ugaacugacucuuagaaaccgg

SEQ ID NO: 950482 - RNA, 18 nt, Human
ugacaaaacugagcuggg

SEQ ID NO: 950483 - RNA, 22 nt, Human
ugacaggcacacagcauccaaa

SEQ ID NO: 950484 - RNA, 21 nt, Human
ugagcugggugggguauaagu

SEQ ID NO: 950485 - RNA, 28 nt, Human
ugagcugggugggguauaaguuacaggg

SEQ ID NO: 950486 - RNA, 20 nt, Human
ugagggggugugacccuuga

SEQ ID NO: 950487 - RNA, 23 nt, Human
ugagggggugugacccuugaggu

SEQ ID NO: 950488 - RNA, 23 nt, Human
ugcaucggugcacggacagacag

SEQ ID NO: 950489 - RNA, 21 nt, Human
ugcgugaugacuccgcagagc

SEQ ID NO: 950490 - RNA, 24 nt, Human
uggggcagcucccuuuccaaaagg

SEQ ID NO: 950491 - RNA, 22 nt, Human
uggggugcggugugugcaucgg

SEQ ID NO: 950492 - RNA, 22 nt, Human
ugggucuccggcccggcgggag

SEQ ID NO: 950493 - RNA, 22 nt, Human
uguacaaugaaagcaaaaaaga

SEQ ID NO: 950494 - RNA, 23 nt, Human
uguugccaagauaaccugaaaga

SEQ ID NO: 950495 - RNA, 19 nt, Human
uuacgccaaagagcagcau

SEQ ID NO: 950496 - RNA, 22 nt, Human
uucccugguggcucugccacug

SEQ ID NO: 950497 - RNA, 22 nt, Human
uucugagaaacgaucccuaauc

SEQ ID NO: 950498 - RNA, 22 nt, Human
uucugagaaacgaucccuaauc

SEQ ID NO: 950499 - RNA, 21 nt, Human
uuuccucagccgccgaggccg

SEQ ID NO: 950500 - RNA, 19 nt, Human
uuuuuuuuuuuuuuuugca

SEQ ID NO: 950501 - RNA, 18 nt, Human
uuuuuuuuuuuuuuuuug

SEQ ID NO: 950502 - RNA, 19 nt, Human
uuuuuuuuuuuuuuuuugc

SEQ ID NO: 950503 - RNA, 22 nt, Human
uuuuuuuuuuuuuuuuugcauu

SEQ ID NO: 950504 - RNA, 27 nt, Human
uuuuuuuuuuuuuuuuuuuuuuugggg

SEQ ID NO: 950505 - RNA, 19 nt, Human
cacaguaggagcugcucaa

SEQ ID NO: 950506 - RNA, 21 nt, Human
caccuguugucacuguccucc

SEQ ID NO: 950507 - RNA, 19 nt, Human
cacuguccuccucuccagg

SEQ ID NO: 950508 - RNA, 24 nt, Human
ccaaaccgaggugaccgucgcacg

SEQ ID NO: 950509 - RNA, 21 nt, Human
ccuguggcuccuuaaggaggc

SEQ ID NO: 950510 - RNA, 21 nt, Human
cgcacgcgccgccgccaccgg

SEQ ID NO: 950511 - RNA, 22 nt, Human
cgcacgcgccgccgccaccggg

SEQ ID NO: 950512 - RNA, 20 nt, Human
cggggccgacgaaucaccug

SEQ ID NO: 950513 - RNA, 21 nt, Human
gacgaaucaccugcccuggga

SEQ ID NO: 950514 - RNA, 18 nt, Human
gcuguuuccagcuggacu

SEQ ID NO: 950515 - RNA, 22 nt, Human
guugucacuguccuccucucca

SEQ ID NO: 950516 - RNA, 23 nt, Human
ucaccuguugucacuguccuccu

SEQ ID NO: 950517 - RNA, 20 nt, Human
uccaggauuccuuuuggggc

SEQ ID NO: 950518 - RNA, 22 nt, Human
ucgcacgcgccgccgccaccgg

SEQ ID NO: 950519 - RNA, 21 nt, Human
uggggccagguaccauccugu

SEQ ID NO: 950520 - RNA, 20 nt, Human
ugucacuguccuccucucca

SEQ ID NO: 950521 - RNA, 20 nt, Human
uuacauuguggaucugggau

SEQ ID NO: 950522 - RNA, 19 nt, Human
aagagaagaacacaaugaa

SEQ ID NO: 950523 - RNA, 21 nt, Human
aauaaaucuacuuacugcgaa

SEQ ID NO: 950524 - RNA, 25 nt, Human
aauaauaugagcagagcuaaaaaga

SEQ ID NO: 950525 - RNA, 24 nt, Human
acaaaagaaauuauauacagagga

SEQ ID NO: 950526 - RNA, 26 nt, Human
accacggauacuuauucuuucuuccu

SEQ ID NO: 950527 - RNA, 24 nt, Human
agaggagaauccuuuucuuccugu

SEQ ID NO: 950528 - RNA, 22 nt, Human
agcagcuuuguaugucuccucu

SEQ ID NO: 950529 - RNA, 21 nt, Human
agcuuuguaugucuccucuca

SEQ ID NO: 950530 - RNA, 19 nt, Human
caacugaaaaccaucuaac

SEQ ID NO: 950531 - RNA, 26 nt, Human
caccauuguuccuuugcaucuuccua

SEQ ID NO: 950532 - RNA, 20 nt, Human
caccccaacugaaaaccauc

SEQ ID NO: 950533 - RNA, 22 nt, Human
cacuguacauguauuagaaaga

SEQ ID NO: 950534 - RNA, 18 nt, Human
ccaucauuauccaaucua

SEQ ID NO: 950535 - RNA, 23 nt, Human
cuggguguccccggggaggcugg

SEQ ID NO: 950536 - RNA, 22 nt, Human
gagcuuaauuacgauaauucag

SEQ ID NO: 950537 - RNA, 18 nt, Human
gaggcuggcacuccagga

SEQ ID NO: 950538 - RNA, 20 nt, Human
gaguuuuguuuucuuucuuu

SEQ ID NO: 950539 - RNA, 19 nt, Human
gauauguguggcugugugu

SEQ ID NO: 950540 - RNA, 18 nt, Human
gggaggcuggcacuccag

SEQ ID NO: 950541 - RNA, 23 nt, Human
ggggaggcuggcacuccaggauu

SEQ ID NO: 950542 - RNA, 23 nt, Human
gguucuggguguccccggggagg

SEQ ID NO: 950543 - RNA, 18 nt, Human
gugugcacuguacaugua

SEQ ID NO: 950544 - RNA, 21 nt, Human
uaaaaagagugagcuugcaua

SEQ ID NO: 950545 - RNA, 23 nt, Human
uaaaaagagugagcuugcauaga

SEQ ID NO: 950546 - RNA, 24 nt, Human
uaaaaagagugagcuugcauagca

SEQ ID NO: 950547 - RNA, 21 nt, Human
uaaauacagcucuugcaaaac

SEQ ID NO: 950548 - RNA, 25 nt, Human
uacaacagaccaauaagaacagaca

SEQ ID NO: 950549 - RNA, 22 nt, Human
uacagccaucauuauccaaucu

SEQ ID NO: 950550 - RNA, 22 nt, Human
uaccugcauacuuuaaugcaua

SEQ ID NO: 950551 - RNA, 18 nt, Human
uagaaagaugaaauaaga

SEQ ID NO: 950552 - RNA, 19 nt, Human
uagcaaugcacaaaagaaa

SEQ ID NO: 950553 - RNA, 22 nt, Human
uauaaacaugcauuuuuuucuc

SEQ ID NO: 950554 - RNA, 21 nt, Human
uauuucuacaccccaacugaa

SEQ ID NO: 950555 - RNA, 22 nt, Human
uccucuugcuuauuguaauucu

SEQ ID NO: 950556 - RNA, 18 nt, Human
ucuuuuuuauauacuccu

SEQ ID NO: 950557 - RNA, 21 nt, Human
ugagcagagcuaaaaagagug

SEQ ID NO: 950558 - RNA, 23 nt, Human
ugcacaaaagaaauuauauacag

SEQ ID NO: 950559 - RNA, 24 nt, Human
ugcaucuuccuauuucuacacccc

SEQ ID NO: 950560 - RNA, 19 nt, Human
uggcguaaacuucacuucu

SEQ ID NO: 950561 - RNA, 22 nt, Human
ugggucaauuacaaugacaggu

SEQ ID NO: 950562 - RNA, 22 nt, Human
uggguguccccggggaggcugg

SEQ ID NO: 950563 - RNA, 23 nt, Human
uguccacuuacaaggucugguuu

SEQ ID NO: 950564 - RNA, 20 nt, Human
ugugggauauguguggcugu

SEQ ID NO: 950565 - RNA, 19 nt, Human
uguuuagagucaucacuuc

SEQ ID NO: 950566 - RNA, 24 nt, Human
uucaaaaugggucaaacguauuuu

SEQ ID NO: 950567 - RNA, 22 nt, Human
uucaauuuccuuauucaaaaug

SEQ ID NO: 950568 - RNA, 19 nt, Human
uuucuuuuuuuaagcaaau

SEQ ID NO: 950569 - RNA, 23 nt, Human
uuuggcuauacauuggguggcgu

SEQ ID NO: 950570 - RNA, 21 nt, Human
uuuuguucguuuccuugggga

SEQ ID NO: 950571 - RNA, 22 nt, Human
aaacacaggccaagacccacac

SEQ ID NO: 950572 - RNA, 21 nt, Human
aaccugguggugggaguggau

SEQ ID NO: 950573 - RNA, 19 nt, Human
agaaacacaggccaagacc

SEQ ID NO: 950574 - RNA, 25 nt, Human
agagaaacacaggccaagacccaca

SEQ ID NO: 950575 - RNA, 23 nt, Human
agcagccacugcuguccuccaca

SEQ ID NO: 950576 - RNA, 21 nt, Human
agggagaacucucuggaggcu

SEQ ID NO: 950577 - RNA, 20 nt, Human
caaucguggagggagaacuc

SEQ ID NO: 950578 - RNA, 19 nt, Human
cacagaggagaaagcagug

SEQ ID NO: 950579 - RNA, 20 nt, Human
caccacagcccaggucuugu

SEQ ID NO: 950580 - RNA, 21 nt, Human
cacugcuguccuccacaaagg

SEQ ID NO: 950581 - RNA, 21 nt, Human
cagcagccacugcuguccucc

SEQ ID NO: 950582 - RNA, 18 nt, Human
cagcaggcagggcugcuc

SEQ ID NO: 950583 - RNA, 19 nt, Human
ccacacaccacagcccagg

SEQ ID NO: 950584 - RNA, 20 nt, Human
cccacacaccacagcccagg

SEQ ID NO: 950585 - RNA, 25 nt, Human
cccagccuugaacccuuuguuuggc

SEQ ID NO: 950586 - RNA, 19 nt, Human
cccagcugcagagaaacac

SEQ ID NO: 950587 - RNA, 18 nt, Human
ccucaggccaaaacaacc

SEQ ID NO: 950588 - RNA, 22 nt, Human
cgcuagacccagccuugaaccc

SEQ ID NO: 950589 - RNA, 22 nt, Human
gaagagcagcaggcagggcugc

SEQ ID NO: 950590 - RNA, 18 nt, Human
gagcagcaggcagggcug

SEQ ID NO: 950591 - RNA, 27 nt, Human
gcucccugagggcuccaggucagcuuu

SEQ ID NO: 950592 - RNA, 23 nt, Human
ggugggggaagagcagcaggcag

SEQ ID NO: 950593 - RNA, 22 nt, Human
guccugcugcucgugccgaauu

SEQ ID NO: 950594 - RNA, 22 nt, Human
gugggaguggauggcacagagg

SEQ ID NO: 950595 - RNA, 25 nt, Human
ucaguggcauucauaauuauuuucu

SEQ ID NO: 950596 - RNA, 24 nt, Human
ucccgucugggaagucucagggac

SEQ ID NO: 950597 - RNA, 23 nt, Human
ucucccagcagccacugcugucc

SEQ ID NO: 950598 - RNA, 21 nt, Human
ucucuggaggcuugggaaggu

SEQ ID NO: 950599 - RNA, 19 nt, Human
ucuuguggguggacaggag

SEQ ID NO: 950600 - RNA, 25 nt, Human
ugaccuacggucucauaccucccuu

SEQ ID NO: 950601 - RNA, 20 nt, Human
ugagguagggccucagugcc

SEQ ID NO: 950602 - RNA, 19 nt, Human
ugccucaguggcauucaua

SEQ ID NO: 950603 - RNA, 23 nt, Human
ugccucaguggcauucauaauua

SEQ ID NO: 950604 - RNA, 23 nt, Human
ugcuccucaggccaaaacaaccu

SEQ ID NO: 950605 - RNA, 19 nt, Human
uggguggacaggagaagug

SEQ ID NO: 950606 - RNA, 18 nt, Human
ugguggugggaguggaug

SEQ ID NO: 950607 - RNA, 20 nt, Human
ugguggugggaguggauggc

SEQ ID NO: 950608 - RNA, 22 nt, Human
uguccuugucccgagcacuuug

SEQ ID NO: 950609 - RNA, 19 nt, Human
uguggguggacaggagaag

SEQ ID NO: 950610 - RNA, 23 nt, Human
uguggguggacaggagaaguggu

SEQ ID NO: 950611 - RNA, 23 nt, Human
uguuuugcucccugagggcucca

SEQ ID NO: 950612 - RNA, 21 nt, Human
uugaacccuuuguuuggcaug

SEQ ID NO: 950613 - RNA, 19 nt, Human
uugcucccugagggcucca

SEQ ID NO: 950614 - RNA, 24 nt, Human
uugggaagguggaccccagcugca

SEQ ID NO: 950615 - RNA, 21 nt, Human
uuucuuaagcucauagugaca

SEQ ID NO: 950616 - RNA, 24 nt, Human
uuuuuuuuuuuuuuucaagucuuu

SEQ ID NO: 950617 - RNA, 24 nt, Human
uuuuuuuuuuuuuuuuuuuucaag

SEQ ID NO: 950618 - RNA, 23 nt, Human
cagaagaaagaagcucaucagau

SEQ ID NO: 950619 - RNA, 20 nt, Human
gaugccagaagaaagaagcu

SEQ ID NO: 950620 - RNA, 22 nt, Human
uuuaggagaaaaucacagaaaa

SEQ ID NO: 950621 - RNA, 22 nt, Human
uuuuuuuucagucuaugucuga

SEQ ID NO: 950622 - RNA, 19 nt, Human
aaaucaggauuacugagac

SEQ ID NO: 950623 - RNA, 21 nt, Human
aagaaaacacauuguuacaaa

SEQ ID NO: 950624 - RNA, 22 nt, Human
aagccuggguucuaaaucagga

SEQ ID NO: 950625 - RNA, 18 nt, Human
aaggacuucuuugcagac

SEQ ID NO: 950626 - RNA, 19 nt, Human
aaguaaggacaaacacacc

SEQ ID NO: 950627 - RNA, 24 nt, Human
acaaaaagccuggguucuaaauca

SEQ ID NO: 950628 - RNA, 18 nt, Human
acauuguuacaaaaagcc

SEQ ID NO: 950629 - RNA, 21 nt, Human
agacaaauagucucaucaaag

SEQ ID NO: 950630 - RNA, 18 nt, Human
agaccaggcagcagucgg

SEQ ID NO: 950631 - RNA, 21 nt, Human
aguaaagauucaucaccuaaa

SEQ ID NO: 950632 - RNA, 19 nt, Human
caagaaaacacauuguuac

SEQ ID NO: 950633 - RNA, 19 nt, Human
cacauuguuacaaaaagcc

SEQ ID NO: 950634 - RNA, 20 nt, Human
cagucggcuuccuccugccc

SEQ ID NO: 950635 - RNA, 23 nt, Human
ccaggcagcagucggcuuccucc

SEQ ID NO: 950636 - RNA, 21 nt, Human
ccaguccuagagacuugaaag

SEQ ID NO: 950637 - RNA, 27 nt, Human
ccuccugccccaacugccggguccuuc

SEQ ID NO: 950638 - RNA, 19 nt, Human
gaccaggcagcagucggcu

SEQ ID NO: 950639 - RNA, 25 nt, Human
ggacaaacacaccaacauauuucuu

SEQ ID NO: 950640 - RNA, 21 nt, Human
guaaagauucaucaccuaaag

SEQ ID NO: 950641 - RNA, 25 nt, Human
uaaaaguaccauaauacagacccau

SEQ ID NO: 950642 - RNA, 18 nt, Human
uaaggacaaacacaccaa

SEQ ID NO: 950643 - RNA, 24 nt, Human
uaguaaagauucaucaccuaaagu

SEQ ID NO: 950644 - RNA, 23 nt, Human
uagucucaucaaaaaagggcuaa

SEQ ID NO: 950645 - RNA, 25 nt, Human
uagucucaucaaaaaagggcuaaaa

SEQ ID NO: 950646 - RNA, 22 nt, Human
ucuaaaucaggauuacugagac

SEQ ID NO: 950647 - RNA, 18 nt, Human
uuaaagcauagaacaauu

SEQ ID NO: 950648 - RNA, 23 nt, Human
uucaucaccuaaagugguaagcu

SEQ ID NO: 950649 - RNA, 22 nt, Human
uuuggauaucugaaauauaaac

SEQ ID NO: 950650 - RNA, 25 nt, Human
aaacccucucugagccugaguuucc

SEQ ID NO: 950651 - RNA, 22 nt, Human
aagaaagcagggagaggauggg

SEQ ID NO: 950652 - RNA, 21 nt, Human
aagcaggagguaauggcaugg

SEQ ID NO: 950653 - RNA, 18 nt, Human
acacagacaggcuguggg

SEQ ID NO: 950654 - RNA, 18 nt, Human
acagacacagacaggcug

SEQ ID NO: 950655 - RNA, 23 nt, Human
acagauccuuacuuaggacacca

SEQ ID NO: 950656 - RNA, 18 nt, Human
accucaaguccugcccag

SEQ ID NO: 950657 - RNA, 18 nt, Human
accucagagguaaagaaa

SEQ ID NO: 950658 - RNA, 19 nt, Human
acucacacaggcuuacaca

SEQ ID NO: 950659 - RNA, 24 nt, Human
agacaggcugugggggaaaccaga

SEQ ID NO: 950660 - RNA, 19 nt, Human
agaggacagacacagacag

SEQ ID NO: 950661 - RNA, 18 nt, Human
agcacuauuuggucccug

SEQ ID NO: 950662 - RNA, 20 nt, Human
agcagggagaggaugggcaa

SEQ ID NO: 950663 - RNA, 21 nt, Human
aggacaccaccucccagccac

SEQ ID NO: 950664 - RNA, 24 nt, Human
aggaggauuuaagaacacagaggg

SEQ ID NO: 950665 - RNA, 18 nt, Human
aggcaaagagugagcagg

SEQ ID NO: 950666 - RNA, 22 nt, Human
agggagaggaugggcaaauagg

SEQ ID NO: 950667 - RNA, 18 nt, Human
aguaaugaaggaguggga

SEQ ID NO: 950668 - RNA, 23 nt, Human
agugagcaggaacagguucccuc

SEQ ID NO: 950669 - RNA, 22 nt, Human
auaggaacagcuccggucugca

SEQ ID NO: 950670 - RNA, 23 nt, Human
auccaaccucagagguaaagaaa

SEQ ID NO: 950671 - RNA, 25 nt, Human
auccacagggagaauccaaccucag

SEQ ID NO: 950672 - RNA, 22 nt, Human
augagaaggagaaggcaaagag

SEQ ID NO: 950673 - RNA, 20 nt, Human
augguuccagucccaacacc

SEQ ID NO: 950674 - RNA, 18 nt, Human
caaacacacccucugcuc

SEQ ID NO: 950675 - RNA, 24 nt, Human
cacacaacucacacaggcuuacac

SEQ ID NO: 950676 - RNA, 23 nt, Human
cacacacucuccuaggcaaacac

SEQ ID NO: 950677 - RNA, 21 nt, Human
cacacagcugcccacacacac

SEQ ID NO: 950678 - RNA, 20 nt, Human
cacacaggcuuacacacagc

SEQ ID NO: 950679 - RNA, 23 nt, Human
cacacauauauaagacacaggaa

SEQ ID NO: 950680 - RNA, 19 nt, Human
cacacccaccccaguuguu

SEQ ID NO: 950681 - RNA, 23 nt, Human
cacaccccaaauccaugcaacca

SEQ ID NO: 950682 - RNA, 22 nt, Human
cacagccugauaaggaagcagg

SEQ ID NO: 950683 - RNA, 18 nt, Human
cacccaccccaguuguua

SEQ ID NO: 950684 - RNA, 22 nt, Human
caccccaaauccaugcaaccau

SEQ ID NO: 950685 - RNA, 24 nt, Human
caccccaguuguuagcccaaggau

SEQ ID NO: 950686 - RNA, 19 nt, Human
caccugcucacacccaccc

SEQ ID NO: 950687 - RNA, 24 nt, Human
cacuacaugcaugcaguguccaug

SEQ ID NO: 950688 - RNA, 19 nt, Human
cagaauuauucccaggaga

SEQ ID NO: 950689 - RNA, 19 nt, Human
cagcugcccacacacacuc

SEQ ID NO: 950690 - RNA, 24 nt, Human
caggcacauuagguggaaaaaccc

SEQ ID NO: 950691 - RNA, 23 nt, Human
caguaggaagauacuaucuuccu

SEQ ID NO: 950692 - RNA, 24 nt, Human
cauagcacaccccaaauccaugca

SEQ ID NO: 950693 - RNA, 23 nt, Human
caucuuggcagggaauccucacu

SEQ ID NO: 950694 - RNA, 22 nt, Human
ccacagggagaauccaaccuca

SEQ ID NO: 950695 - RNA, 24 nt, Human
ccacugcuucugggaugacuccug

SEQ ID NO: 950696 - RNA, 22 nt, Human
cccacacacacucuccuaggca

SEQ ID NO: 950697 - RNA, 25 nt, Human
cccacggugacaaugcacccaggag

SEQ ID NO: 950698 - RNA, 19 nt, Human
cccagaauuaacacacagc

SEQ ID NO: 950699 - RNA, 21 nt, Human
ccccagaaucaaucacuccuc

SEQ ID NO: 950700 - RNA, 21 nt, Human
cccucugcucuaaguacaggg

SEQ ID NO: 950701 - RNA, 24 nt, Human
ccucauagcacaccccaaauccau

SEQ ID NO: 950702 - RNA, 19 nt, Human
ccuccaggccauuuccacc

SEQ ID NO: 950703 - RNA, 19 nt, Human
ccucucugagccugaguuu

SEQ ID NO: 950704 - RNA, 24 nt, Human
ccuuauuggguagcuacccauggu

SEQ ID NO: 950705 - RNA, 23 nt, Human
cuacugaccggacgguccuuccu

SEQ ID NO: 950706 - RNA, 25 nt, Human
cucacuuuccucccugaugaucgcc

SEQ ID NO: 950707 - RNA, 24 nt, Human
cucaugcacaccuuugcacaccuc

SEQ ID NO: 950708 - RNA, 21 nt, Human
cuccugguuucucucugccuu

SEQ ID NO: 950709 - RNA, 18 nt, Human
cucuccgcaccccagaau

SEQ ID NO: 950710 - RNA, 24 nt, Human
cucuccuaggcaaacacacccucc

SEQ ID NO: 950711 - RNA, 18 nt, Human
cugcaacauauuauucug

SEQ ID NO: 950712 - RNA, 20 nt, Human
cugcuucugggaugacuccu

SEQ ID NO: 950713 - RNA, 21 nt, Human
cuuccuacugggcugugcccc

SEQ ID NO: 950714 - RNA, 20 nt, Human
gaacauacacacaacucacc

SEQ ID NO: 950715 - RNA, 19 nt, Human
gaaggagaaggcaaagagu

SEQ ID NO: 950716 - RNA, 19 nt, Human
gagaaggagaaggcaaaga

SEQ ID NO: 950717 - RNA, 20 nt, Human
gagaaggagaaggcaaagag

SEQ ID NO: 950718 - RNA, 19 nt, Human
gagcaggaacagguucccu

SEQ ID NO: 950719 - RNA, 19 nt, Human
gaggaugggcaaauaggaa

SEQ ID NO: 950720 - RNA, 19 nt, Human
gaggcuccuuccaccugcu

SEQ ID NO: 950721 - RNA, 22 nt, Human
gcaguguccaugaaggagcaca

SEQ ID NO: 950722 - RNA, 23 nt, Human
gcccacacacacucuccuaggca

SEQ ID NO: 950723 - RNA, 20 nt, Human
gcccuagaggcuuggacccu

SEQ ID NO: 950724 - RNA, 20 nt, Human
gcuuacacacagcugcccac

SEQ ID NO: 950725 - RNA, 19 nt, Human
gguaaagaaagcagggaga

SEQ ID NO: 950726 - RNA, 21 nt, Human
gucaaacugucucuacaaagc

SEQ ID NO: 950727 - RNA, 21 nt, Human
uacugggcugugccccuagac

SEQ ID NO: 950728 - RNA, 24 nt, Human
uagcccaaggauggcccuagaggc

SEQ ID NO: 950729 - RNA, 21 nt, Human
uaggaagauacuaucuuccua

SEQ ID NO: 950730 - RNA, 21 nt, Human
uaugcccacuacaugcaugca

SEQ ID NO: 950731 - RNA, 19 nt, Human
ucaaacugucucuacaaag

SEQ ID NO: 950732 - RNA, 24 nt, Human
ucacacaggcuuacacacagcugc

SEQ ID NO: 950733 - RNA, 18 nt, Human
ucauccucuccgcacccc

SEQ ID NO: 950734 - RNA, 22 nt, Human
ucauccucuccgcaccccagaa

SEQ ID NO: 950735 - RNA, 22 nt, Human
uccaugaaggagcacacacaua

SEQ ID NO: 950736 - RNA, 20 nt, Human
uccaugcaaccaugcaucca

SEQ ID NO: 950737 - RNA, 30 nt, Human
ucccaacaccacguguacagggaucuucag

SEQ ID NO: 950738 - RNA, 19 nt, Human
ucccaaggauaacaccacc

SEQ ID NO: 950739 - RNA, 20 nt, Human
ucccagccacugcuucuggg

SEQ ID NO: 950740 - RNA, 20 nt, Human
ucccuguuuuucagcugcgu

SEQ ID NO: 950741 - RNA, 23 nt, Human
uccucauccucuccgcaccccag

SEQ ID NO: 950742 - RNA, 24 nt, Human
ucuacaaagcuccgauaccaagca

SEQ ID NO: 950743 - RNA, 18 nt, Human
ucuccagagagcagaauu

SEQ ID NO: 950744 - RNA, 23 nt, Human
ucugcaacauauuauucuggccc

SEQ ID NO: 950745 - RNA, 18 nt, Human
ugaaggagugggauuggu

SEQ ID NO: 950746 - RNA, 19 nt, Human
ugaaggagugggauuggug

SEQ ID NO: 950747 - RNA, 20 nt, Human
ugaccggacgguccuuccuu

SEQ ID NO: 950748 - RNA, 21 nt, Human
ugccuacugaccggacggucc

SEQ ID NO: 950749 - RNA, 21 nt, Human
ugcuauaauaguuuuuugggg

SEQ ID NO: 950750 - RNA, 22 nt, Human
uggcagggaauccucacuuucc

SEQ ID NO: 950751 - RNA, 22 nt, Human
uggccacccacggugacaaugc

SEQ ID NO: 950752 - RNA, 18 nt, Human
uggccaggaguaaugaag

SEQ ID NO: 950753 - RNA, 18 nt, Human
ugugguaggcagggaagc

SEQ ID NO: 950754 - RNA, 24 nt, Human
uuaacacacagccugauaaggaag

SEQ ID NO: 950755 - RNA, 22 nt, Human
uucagacaggaggauuuaagaa

SEQ ID NO: 950756 - RNA, 18 nt, Human
uuccucauccucuccgca

SEQ ID NO: 950757 - RNA, 23 nt, Human
uuccucauccucuccgcacccca

SEQ ID NO: 950758 - RNA, 27 nt, Human
uuggggcagaaggauugcaggauccac

SEQ ID NO: 950759 - RNA, 19 nt, Human
uuuuuuuuuuuuuuuuuaa

SEQ ID NO: 950760 - RNA, 24 nt, Human
aaauugcugggauuacaggcauga

SEQ ID NO: 950761 - RNA, 22 nt, Human
aacacccuccccuuuuucucug

SEQ ID NO: 950762 - RNA, 24 nt, Human
aacagcagccauggccuguccccc

SEQ ID NO: 950763 - RNA, 27 nt, Human
aagcgaaaagacagagaaaggggaccc

SEQ ID NO: 950764 - RNA, 20 nt, Human
aaggaccuguccaaggcugc

SEQ ID NO: 950765 - RNA, 20 nt, Human
aagucuuugagggaaagaga

SEQ ID NO: 950766 - RNA, 22 nt, Human
acagcacagcagcuauccacag

SEQ ID NO: 950767 - RNA, 19 nt, Human
acaggcacccgccaccacg

SEQ ID NO: 950768 - RNA, 18 nt, Human
accaugagugcuacaaag

SEQ ID NO: 950769 - RNA, 21 nt, Human
acccacugccugaggucauuu

SEQ ID NO: 950770 - RNA, 24 nt, Human
acccaggcugcagugcaauggugu

SEQ ID NO: 950771 - RNA, 22 nt, Human
acccugccccuaacucuucaac

SEQ ID NO: 950772 - RNA, 20 nt, Human
acggcauggaaaugucagcc

SEQ ID NO: 950773 - RNA, 19 nt, Human
acucaggacagcacagcag

SEQ ID NO: 950774 - RNA, 18 nt, Human
acucuguagcccaggcug

SEQ ID NO: 950775 - RNA, 22 nt, Human
acucuguagcccaggcuggagu

SEQ ID NO: 950776 - RNA, 20 nt, Human
acugcaaacugugccuccug

SEQ ID NO: 950777 - RNA, 22 nt, Human
acuggggggggccuggugccag

SEQ ID NO: 950778 - RNA, 23 nt, Human
agaaagccucaaagucuaccuga

SEQ ID NO: 950779 - RNA, 20 nt, Human
agaagcaugccaccaugccc

SEQ ID NO: 950780 - RNA, 24 nt, Human
agacagagaaaggcagggugggga

SEQ ID NO: 950781 - RNA, 22 nt, Human
agagaaggaagccaaggcucug

SEQ ID NO: 950782 - RNA, 19 nt, Human
agagaugggguuucaccgu

SEQ ID NO: 950783 - RNA, 21 nt, Human
agagugcugggauuauaggug

SEQ ID NO: 950784 - RNA, 24 nt, Human
agagugcugggauuauagguguga

SEQ ID NO: 950785 - RNA, 18 nt, Human
agccuccagacuagcugg

SEQ ID NO: 950786 - RNA, 18 nt, Human
agcuccgccuccuggguu

SEQ ID NO: 950787 - RNA, 23 nt, Human
aggaagccaaggcucugaggggu

SEQ ID NO: 950788 - RNA, 21 nt, Human
aggaaggcgugugggaccagg

SEQ ID NO: 950789 - RNA, 25 nt, Human
aggcaggguggggaagaggaagaca

SEQ ID NO: 950790 - RNA, 28 nt, Human
aggcaggguggggaagaggaagacauuu

SEQ ID NO: 950791 - RNA, 25 nt, Human
aggcuggagugcaguggcacgaucu

SEQ ID NO: 950792 - RNA, 20 nt, Human
agggaggcggaggccccugg

SEQ ID NO: 950793 - RNA, 24 nt, Human
agggaugggguuucauuauguugg

SEQ ID NO: 950794 - RNA, 21 nt, Human
aggugcacaugugaaaugacc

SEQ ID NO: 950795 - RNA, 21 nt, Human
aggugugagccaccgcgccca

SEQ ID NO: 950796 - RNA, 18 nt, Human
aguagcugggauuacaga

SEQ ID NO: 950797 - RNA, 21 nt, Human
agugcaauggugugaucucag

SEQ ID NO: 950798 - RNA, 24 nt, Human
agugcaauggugugaucucagcuc

SEQ ID NO: 950799 - RNA, 21 nt, Human
agugcaguggcacgaucucag

SEQ ID NO: 950800 - RNA, 23 nt, Human
agugcaguggcacgaucucagcu

SEQ ID NO: 950801 - RNA, 24 nt, Human
agugcaguggcacgaucucagcuc

SEQ ID NO: 950802 - RNA, 22 nt, Human
agugcugggauuauagguguga

SEQ ID NO: 950803 - RNA, 20 nt, Human
aguguaauggcgcgaucucg

SEQ ID NO: 950804 - RNA, 24 nt, Human
aguguaauggcgcgaucucggcuc

SEQ ID NO: 950805 - RNA, 20 nt, Human
aguucccacacuccaaccuc

SEQ ID NO: 950806 - RNA, 23 nt, Human
auauuuuuuuucuuugagaugga

SEQ ID NO: 950807 - RNA, 19 nt, Human
auccacccgccuuggccuc

SEQ ID NO: 950808 - RNA, 24 nt, Human
auccugaccucgugauccacccgc

SEQ ID NO: 950809 - RNA, 24 nt, Human
augauccacccgccuuggccuccc

SEQ ID NO: 950810 - RNA, 19 nt, Human
augcuaagacugagcuucu

SEQ ID NO: 950811 - RNA, 20 nt, Human
augggguuucaccauguuag

SEQ ID NO: 950812 - RNA, 24 nt, Human
augggguuucaccauguuagccag

SEQ ID NO: 950813 - RNA, 25 nt, Human
augggguuucaccauguuagccagg

SEQ ID NO: 950814 - RNA, 18 nt, Human
augggguuucaccguguu

SEQ ID NO: 950815 - RNA, 20 nt, Human
augggguuucaccguguuag

SEQ ID NO: 950816 - RNA, 24 nt, Human
augggguuucaccguguuagccag

SEQ ID NO: 950817 - RNA, 24 nt, Human
augggguuucauuauguuggccag

SEQ ID NO: 950818 - RNA, 23 nt, Human
augguggagaaccuacagggacc

SEQ ID NO: 950819 - RNA, 19 nt, Human
auguuggccaggcuggucu

SEQ ID NO: 950820 - RNA, 18 nt, Human
auucuccugccucagccu

SEQ ID NO: 950821 - RNA, 22 nt, Human
caacacccugcaccuccuuccc

SEQ ID NO: 950822 - RNA, 21 nt, Human
caacagcagccauggccuguc

SEQ ID NO: 950823 - RNA, 21 nt, Human
caacaguucccacacuccaac

SEQ ID NO: 950824 - RNA, 21 nt, Human
caacucaggacagcacagcag

SEQ ID NO: 950825 - RNA, 22 nt, Human
caagugauucuccugccucagc

SEQ ID NO: 950826 - RNA, 19 nt, Human
caagugauucucuaaucuc

SEQ ID NO: 950827 - RNA, 22 nt, Human
caagugauucucuaaucucggc

SEQ ID NO: 950828 - RNA, 18 nt, Human
cacagacacugucuugca

SEQ ID NO: 950829 - RNA, 19 nt, Human
caccaacacccugcaccuc

SEQ ID NO: 950830 - RNA, 20 nt, Human
caccacccugcccucaugug

SEQ ID NO: 950831 - RNA, 24 nt, Human
caccaugcccggcuaauuuuugua

SEQ ID NO: 950832 - RNA, 18 nt, Human
caccauguuagccagguu

SEQ ID NO: 950833 - RNA, 22 nt, Human
caccauguuagccagguugauc

SEQ ID NO: 950834 - RNA, 24 nt, Human
caccauguuagccagguugaucuc

SEQ ID NO: 950835 - RNA, 20 nt, Human
cacccgccucggccucccag

SEQ ID NO: 950836 - RNA, 23 nt, Human
cacccugcaccuccuucccacac

SEQ ID NO: 950837 - RNA, 24 nt, Human
caccguguuagccaggauggucuc

SEQ ID NO: 950838 - RNA, 23 nt, Human
caccuccuucccacaccugagcc

SEQ ID NO: 950839 - RNA, 24 nt, Human
caccucggccucccaaauugcugg

SEQ ID NO: 950840 - RNA, 19 nt, Human
caccugguaugugccaggc

SEQ ID NO: 950841 - RNA, 18 nt, Human
caccuucucagcccuccu

SEQ ID NO: 950842 - RNA, 19 nt, Human
cacgccagcccaggccagc

SEQ ID NO: 950843 - RNA, 24 nt, Human
cacucuguagcccaggcuggagug

SEQ ID NO: 950844 - RNA, 23 nt, Human
cacugcaaacugugccuccuggg

SEQ ID NO: 950845 - RNA, 18 nt, Human
cacuggccccguccccuc

SEQ ID NO: 950846 - RNA, 21 nt, Human
cagaagcaugccaccaugccc

SEQ ID NO: 950847 - RNA, 23 nt, Human
cagagcccaggcuauuccgagcc

SEQ ID NO: 950848 - RNA, 22 nt, Human
cagagugcugggauuauaggug

SEQ ID NO: 950849 - RNA, 24 nt, Human
cagagugcugggauuauaggugug

SEQ ID NO: 950850 - RNA, 19 nt, Human
cagcaucucacacccacug

SEQ ID NO: 950851 - RNA, 18 nt, Human
cagccacaggaccagcag

SEQ ID NO: 950852 - RNA, 20 nt, Human
cagccauggccuguccccaa

SEQ ID NO: 950853 - RNA, 21 nt, Human
caggaaauguggggcaggagg

SEQ ID NO: 950854 - RNA, 26 nt, Human
caggaccagcagccacaggaccagca

SEQ ID NO: 950855 - RNA, 20 nt, Human
caggcugggaggucccugag

SEQ ID NO: 950856 - RNA, 20 nt, Human
cagggaugggguuucauuau

SEQ ID NO: 950857 - RNA, 20 nt, Human
cagguuaucaagcacuuucc

SEQ ID NO: 950858 - RNA, 21 nt, Human
cagguugaucucaaacuccug

SEQ ID NO: 950859 - RNA, 22 nt, Human
cagugcucaauaaauaccuucc

SEQ ID NO: 950860 - RNA, 22 nt, Human
cauaaagucuuugagggaaaga

SEQ ID NO: 950861 - RNA, 18 nt, Human
cauacccaaccccaagcu

SEQ ID NO: 950862 - RNA, 22 nt, Human
caugccauucuccugccucagc

SEQ ID NO: 950863 - RNA, 20 nt, Human
cauguugggcaaacugaguu

SEQ ID NO: 950864 - RNA, 19 nt, Human
cauuauguuggccaggcug

SEQ ID NO: 950865 - RNA, 24 nt, Human
cauuauguuggccaggcuggucuu

SEQ ID NO: 950866 - RNA, 23 nt, Human
ccaaauugcugggauuacaggca

SEQ ID NO: 950867 - RNA, 24 nt, Human
ccaaauugcugggauuacaggcau

SEQ ID NO: 950868 - RNA, 26 nt, Human
ccaacacccugcaccuccuucccaca

SEQ ID NO: 950869 - RNA, 20 nt, Human
ccaaccaaggcugccuuggg

SEQ ID NO: 950870 - RNA, 25 nt, Human
ccaaccccaagcucagugcuuggcc

SEQ ID NO: 950871 - RNA, 18 nt, Human
ccaaugugcugggauuac

SEQ ID NO: 950872 - RNA, 24 nt, Human
ccaaugugcugggauuacuggcgu

SEQ ID NO: 950873 - RNA, 20 nt, Human
ccaccgcgcccagcuaauuu

SEQ ID NO: 950874 - RNA, 21 nt, Human
ccacuagccuuccuuucucag

SEQ ID NO: 950875 - RNA, 21 nt, Human
ccacugcauuuccugcugggu

SEQ ID NO: 950876 - RNA, 24 nt, Human
ccagacuagcugggacuacaggca

SEQ ID NO: 950877 - RNA, 21 nt, Human
ccagagugcugggauuauagg

SEQ ID NO: 950878 - RNA, 24 nt, Human
ccagagugcugggauuauaggugu

SEQ ID NO: 950879 - RNA, 20 nt, Human
ccaggacccccagcucugcc

SEQ ID NO: 950880 - RNA, 24 nt, Human
cccaaauugcugggauuacaggca

SEQ ID NO: 950881 - RNA, 19 nt, Human
cccacaaaauggcagguac

SEQ ID NO: 950882 - RNA, 21 nt, Human
cccacacuccaaccuccaggc

SEQ ID NO: 950883 - RNA, 22 nt, Human
cccacacuccaaccuccaggcu

SEQ ID NO: 950884 - RNA, 21 nt, Human
cccacacucugagcuccucca

SEQ ID NO: 950885 - RNA, 21 nt, Human
cccacgaugccagggacagcu

SEQ ID NO: 950886 - RNA, 20 nt, Human
cccagacuguguccuggcca

SEQ ID NO: 950887 - RNA, 22 nt, Human
ccccugcaaaagagaaggaagc

SEQ ID NO: 950888 - RNA, 19 nt, Human
cccguccccuccccacucu

SEQ ID NO: 950889 - RNA, 19 nt, Human
cccucgguccaggcgcccu

SEQ ID NO: 950890 - RNA, 20 nt, Human
cccuguccugaacacccucc

SEQ ID NO: 950891 - RNA, 25 nt, Human
ccucacccccccugggaugagccag

SEQ ID NO: 950892 - RNA, 18 nt, Human
ccucauguguccuagggc

SEQ ID NO: 950893 - RNA, 24 nt, Human
ccuccuggguucaagugauucucc

SEQ ID NO: 950894 - RNA, 18 nt, Human
ccugaacacccuccccuu

SEQ ID NO: 950895 - RNA, 20 nt, Human
ccugaccucgugauccaccc

SEQ ID NO: 950896 - RNA, 22 nt, Human
ccugacuucaaaugauccaccc

SEQ ID NO: 950897 - RNA, 19 nt, Human
ccugaguagcugggauuac

SEQ ID NO: 950898 - RNA, 22 nt, Human
ccugccaggcucacuguuccug

SEQ ID NO: 950899 - RNA, 19 nt, Human
ccugccucacccccccugg

SEQ ID NO: 950900 - RNA, 24 nt, Human
ccugccucagccucccaaguagcu

SEQ ID NO: 950901 - RNA, 18 nt, Human
ccugcuagauccugccca

SEQ ID NO: 950902 - RNA, 23 nt, Human
ccuggguucaagugauucuccuc

SEQ ID NO: 950903 - RNA, 23 nt, Human
ccuggguucaagugauucuccug

SEQ ID NO: 950904 - RNA, 19 nt, Human
ccuuggcccuggagagcug

SEQ ID NO: 950905 - RNA, 20 nt, Human
cgaaaagacagagaaaggca

SEQ ID NO: 950906 - RNA, 24 nt, Human
cgccucggccucccagagugcugg

SEQ ID NO: 950907 - RNA, 20 nt, Human
cggccuccugaguagcuggg

SEQ ID NO: 950908 - RNA, 24 nt, Human
cgugagccaccgugcccggccugu

SEQ ID NO: 950909 - RNA, 24 nt, Human
cucacugcaaacugugccuccugg

SEQ ID NO: 950910 - RNA, 24 nt, Human
cucacuguaagcuccgccuccugg

SEQ ID NO: 950911 - RNA, 21 nt, Human
cucagcccuccugcccaugcc

SEQ ID NO: 950912 - RNA, 18 nt, Human
cucagugcuuggcccaua

SEQ ID NO: 950913 - RNA, 19 nt, Human
cucauguguccuagggcac

SEQ ID NO: 950914 - RNA, 24 nt, Human
cucauucugucucucaggcuggag

SEQ ID NO: 950915 - RNA, 21 nt, Human
cuccuccaggccucagggccu

SEQ ID NO: 950916 - RNA, 22 nt, Human
cuccugccucagccuccagacu

SEQ ID NO: 950917 - RNA, 20 nt, Human
cuccuggguucaagugauuc

SEQ ID NO: 950918 - RNA, 21 nt, Human
cuccuggguucaagugauucu

SEQ ID NO: 950919 - RNA, 21 nt, Human
cuccuggguucaugccauucu

SEQ ID NO: 950920 - RNA, 20 nt, Human
cuccuucccacaccugagcc

SEQ ID NO: 950921 - RNA, 19 nt, Human
cucgcugaagcccuuucca

SEQ ID NO: 950922 - RNA, 19 nt, Human
cucggccuccugaguagcu

SEQ ID NO: 950923 - RNA, 24 nt, Human
cucggccuccugaguagcugggau

SEQ ID NO: 950924 - RNA, 23 nt, Human
cucuccgccgggcugcgcucccc

SEQ ID NO: 950925 - RNA, 20 nt, Human
cugcagacuaagcaaggcuu

SEQ ID NO: 950926 - RNA, 26 nt, Human
cugcagccugcauuuacuugugucug

SEQ ID NO: 950927 - RNA, 23 nt, Human
cugccucagccuccagacuagcu

SEQ ID NO: 950928 - RNA, 22 nt, Human
cuggaacuguacacucccccau

SEQ ID NO: 950929 - RNA, 20 nt, Human
cuggccccguccccucccca

SEQ ID NO: 950930 - RNA, 21 nt, Human
cugggauuauaggugugagcc

SEQ ID NO: 950931 - RNA, 20 nt, Human
cuuugugcaggcugugcucc

SEQ ID NO: 950932 - RNA, 19 nt, Human
gaaaagacagagaaaggca

SEQ ID NO: 950933 - RNA, 22 nt, Human
gaaaggcaggguggggaagagg

SEQ ID NO: 950934 - RNA, 18 nt, Human
gacacuggccccgucccc

SEQ ID NO: 950935 - RNA, 23 nt, Human
gacagagaaaggcagggugggga

SEQ ID NO: 950936 - RNA, 22 nt, Human
gacccccagcucugccuuggug

SEQ ID NO: 950937 - RNA, 22 nt, Human
gaccucgugauccacccgccuc

SEQ ID NO: 950938 - RNA, 22 nt, Human
gaccucgugauccacccgccuc

SEQ ID NO: 950939 - RNA, 24 nt, Human
gaccucgugauccacccgccucgg

SEQ ID NO: 950940 - RNA, 24 nt, Human
gacuucaaaugauccacccgccuu

SEQ ID NO: 950941 - RNA, 18 nt, Human
gagaaaaaaggcaacaca

SEQ ID NO: 950942 - RNA, 20 nt, Human
gagaugggguuucaccaugu

SEQ ID NO: 950943 - RNA, 24 nt, Human
gagaugggguuucaccauguuagc

SEQ ID NO: 950944 - RNA, 24 nt, Human
gagaugggguuucaccguguuagc

SEQ ID NO: 950945 - RNA, 18 nt, Human
gagccaccaugccugacc

SEQ ID NO: 950946 - RNA, 25 nt, Human
gaggaacuggucuugugaucugggg

SEQ ID NO: 950947 - RNA, 22 nt, Human
gaugggguuucauuauguuggc

SEQ ID NO: 950948 - RNA, 18 nt, Human
gauuacagaagcaugcca

SEQ ID NO: 950949 - RNA, 18 nt, Human
gauuacaggcaugagcca

SEQ ID NO: 950950 - RNA, 21 nt, Human
gauuacaggcaugagccacca

SEQ ID NO: 950951 - RNA, 24 nt, Human
gauuacaggcaugagccaccaugc

SEQ ID NO: 950952 - RNA, 18 nt, Human
gauuacuggcgugagcca

SEQ ID NO: 950953 - RNA, 21 nt, Human
gauuacuggcgugagccaccg

SEQ ID NO: 950954 - RNA, 24 nt, Human
gauuacuggcgugagccaccgugc

SEQ ID NO: 950955 - RNA, 18 nt, Human
gauuauaggugugagcca

SEQ ID NO: 950956 - RNA, 22 nt, Human
gauuauaggugugagccaccgc

SEQ ID NO: 950957 - RNA, 22 nt, Human
gauuauaggugugagccaccgc

SEQ ID NO: 950958 - RNA, 21 nt, Human
gauucuccugccucagccucc

SEQ ID NO: 950959 - RNA, 22 nt, Human
gauugcagggaugggugaacag

SEQ ID NO: 950960 - RNA, 22 nt, Human
gcacaugugugugcucacaugg

SEQ ID NO: 950961 - RNA, 22 nt, Human
gcagggaugggguuucauuaug

SEQ ID NO: 950962 - RNA, 19 nt, Human
gcccaggcuggagugcagu

SEQ ID NO: 950963 - RNA, 23 nt, Human
gcccaggcuggagugcaguggca

SEQ ID NO: 950964 - RNA, 21 nt, Human
gcccauauuugcuguggcccc

SEQ ID NO: 950965 - RNA, 18 nt, Human
gcccauggcucccaggcc

SEQ ID NO: 950966 - RNA, 22 nt, Human
gcccggcuaauuuuuguauuuu

SEQ ID NO: 950967 - RNA, 21 nt, Human
gcccugcugggagcuuucaca

SEQ ID NO: 950968 - RNA, 18 nt, Human
gccgggcugcgcuccccg

SEQ ID NO: 950969 - RNA, 20 nt, Human
gccugcugcugccucgcugu

SEQ ID NO: 950970 - RNA, 23 nt, Human
gccuggcuaauuuuuuguauuuu

SEQ ID NO: 950971 - RNA, 18 nt, Human
gccuguccccacauccug

SEQ ID NO: 950972 - RNA, 22 nt, Human
gccuugguguugguuccuccca

SEQ ID NO: 950973 - RNA, 19 nt, Human
gcugcagggcccaguuggg

SEQ ID NO: 950974 - RNA, 19 nt, Human
gcuggagugcaguggcacg

SEQ ID NO: 950975 - RNA, 21 nt, Human
ggagagcaggauggguuacgg

SEQ ID NO: 950976 - RNA, 21 nt, Human
ggagcaccugguaugugccag

SEQ ID NO: 950977 - RNA, 24 nt, Human
ggaggagggaggccugcugcugcc

SEQ ID NO: 950978 - RNA, 24 nt, Human
ggauggucucgauauccugaccuc

SEQ ID NO: 950979 - RNA, 24 nt, Human
ggauuacaggcaugagccaccaug

SEQ ID NO: 950980 - RNA, 19 nt, Human
ggccaggggcucuggcugg

SEQ ID NO: 950981 - RNA, 18 nt, Human
ggcccaggggccugaacc

SEQ ID NO: 950982 - RNA, 19 nt, Human
ggcccugccucaccccccc

SEQ ID NO: 950983 - RNA, 18 nt, Human
ggccuuggcccuggagag

SEQ ID NO: 950984 - RNA, 22 nt, Human
ggcgugagccaccgugcccggc

SEQ ID NO: 950985 - RNA, 19 nt, Human
ggcucuggcugggacacca

SEQ ID NO: 950986 - RNA, 31 nt, Human
ggcugcagugcaauggugugaucucagcucc

SEQ ID NO: 950987 - RNA, 20 nt, Human
ggcugccccucccaagcaga

SEQ ID NO: 950988 - RNA, 19 nt, Human
ggcuggugagaaaaaaggc

SEQ ID NO: 950989 - RNA, 18 nt, Human
gggaccaggcugcccaga

SEQ ID NO: 950990 - RNA, 22 nt, Human
gggagagcaggauggguuacgg

SEQ ID NO: 950991 - RNA, 20 nt, Human
gggaggaguccccaacucag

SEQ ID NO: 950992 - RNA, 23 nt, Human
gggaugggguuucauuauguugg

SEQ ID NO: 950993 - RNA, 21 nt, Human
gggcaggaggcagaaggaagg

SEQ ID NO: 950994 - RNA, 22 nt, Human
gggguuucaccauguuagccag

SEQ ID NO: 950995 - RNA, 23 nt, Human
gggguuucaccauguuagccagg

SEQ ID NO: 950996 - RNA, 22 nt, Human
gggguuucaccguguuagccag

SEQ ID NO: 950997 - RNA, 22 nt, Human
gggguuucauuauguuggccag

SEQ ID NO: 950998 - RNA, 22 nt, Human
ggguuucaccguguuagccagg

SEQ ID NO: 950999 - RNA, 18 nt, Human
ggguuucauuauguuggc

SEQ ID NO: 951000 - RNA, 22 nt, Human
ggguuucauuauguuggccagg

SEQ ID NO: 951001 - RNA, 23 nt, Human
guagagaugggguuucaccaugu

SEQ ID NO: 951002 - RNA, 21 nt, Human
gucacccaggcugcagugcaa

SEQ ID NO: 951003 - RNA, 27 nt, Human
guccugaacacccuccccuuuuucucu

SEQ ID NO: 951004 - RNA, 23 nt, Human
gugaucacccaccucggccuccc

SEQ ID NO: 951005 - RNA, 24 nt, Human
gugauccacccgccucggccuccc

SEQ ID NO: 951006 - RNA, 26 nt, Human
gugauucucccugcuagauccugccc

SEQ ID NO: 951007 - RNA, 24 nt, Human
gugauucuccugccucagccuccc

SEQ ID NO: 951008 - RNA, 22 nt, Human
gugcacaagugucuuggcccuu

SEQ ID NO: 951009 - RNA, 21 nt, Human
gugcugggauuacuggcguga

SEQ ID NO: 951010 - RNA, 25 nt, Human
guuugugcaugugcacaugugugug

SEQ ID NO: 951011 - RNA, 18 nt, Human
uaacucuucaaccuuccg

SEQ ID NO: 951012 - RNA, 20 nt, Human
uaaucucggccuccugagua

SEQ ID NO: 951013 - RNA, 25 nt, Human
uaauuuuugaauuuuuuaguagaga

SEQ ID NO: 951014 - RNA, 24 nt, Human
uaauuuuuguauuuuuggcaggga

SEQ ID NO: 951015 - RNA, 24 nt, Human
uaauuuuuuguauuuuuaguagag

SEQ ID NO: 951016 - RNA, 23 nt, Human
uacaggcacaugccaccaugccc

SEQ ID NO: 951017 - RNA, 22 nt, Human
uacaggcacccgccaccacgcc

SEQ ID NO: 951018 - RNA, 22 nt, Human
uacaggcaugagccaccaugcc

SEQ ID NO: 951019 - RNA, 22 nt, Human
uacccaaccccaagcucagugc

SEQ ID NO: 951020 - RNA, 23 nt, Human
uaccugcaccaacacccugcacc

SEQ ID NO: 951021 - RNA, 24 nt, Human
uacuggcgugagccaccgugcccg

SEQ ID NO: 951022 - RNA, 22 nt, Human
uagagaugggguuucaccaugu

SEQ ID NO: 951023 - RNA, 26 nt, Human
uagagcccucccuaaccaugccccuc

SEQ ID NO: 951024 - RNA, 18 nt, Human
uagcccaggcuggagugc

SEQ ID NO: 951025 - RNA, 21 nt, Human
uaguagagaugggguuucacc

SEQ ID NO: 951026 - RNA, 24 nt, Human
uaguagagaugggguuucaccaug

SEQ ID NO: 951027 - RNA, 24 nt, Human
uaguagagaugggguuucaccgug

SEQ ID NO: 951028 - RNA, 20 nt, Human
uaucucuucugcagacgccc

SEQ ID NO: 951029 - RNA, 19 nt, Human
uauguuggccaggcugguc

SEQ ID NO: 951030 - RNA, 23 nt, Human
uauguuggccaggcuggucuuua

SEQ ID NO: 951031 - RNA, 26 nt, Human
uauuuuuuuucuuugagauggagucu

SEQ ID NO: 951032 - RNA, 19 nt, Human
ucaagugauucuccugccu

SEQ ID NO: 951033 - RNA, 25 nt, Human
ucacauacccaaccccaagcucagu

SEQ ID NO: 951034 - RNA, 23 nt, Human
ucacccaccucggccucccaaau

SEQ ID NO: 951035 - RNA, 24 nt, Human
ucaccguguuagccaggauggucu

SEQ ID NO: 951036 - RNA, 24 nt, Human
ucacugcaaacugugccuccuggg

SEQ ID NO: 951037 - RNA, 18 nt, Human
ucacuguaagcuccgccu

SEQ ID NO: 951038 - RNA, 22 nt, Human
ucacuguaagcuccgccuccug

SEQ ID NO: 951039 - RNA, 23 nt, Human
ucacuguaagcuccgccuccugg

SEQ ID NO: 951040 - RNA, 24 nt, Human
ucacuguaagcuccgccuccuggg

SEQ ID NO: 951041 - RNA, 20 nt, Human
ucagccucccaaguagcugg

SEQ ID NO: 951042 - RNA, 19 nt, Human
ucagcucacuguaagcucc

SEQ ID NO: 951043 - RNA, 19 nt, Human
ucauuacaaccuccgacuc

SEQ ID NO: 951044 - RNA, 22 nt, Human
ucauuauguuggccaggcuggu

SEQ ID NO: 951045 - RNA, 22 nt, Human
uccacccgccucggccucccag

SEQ ID NO: 951046 - RNA, 24 nt, Human
uccagacuagcugggacuacaggc

SEQ ID NO: 951047 - RNA, 24 nt, Human
ucccaaauugcugggauuacaggc

SEQ ID NO: 951048 - RNA, 24 nt, Human
ucccaagcagagucacugagccag

SEQ ID NO: 951049 - RNA, 24 nt, Human
ucccaaguagcuggaacuacaggc

SEQ ID NO: 951050 - RNA, 24 nt, Human
ucccaaugugcugggauuacuggc

SEQ ID NO: 951051 - RNA, 23 nt, Human
ucccagagugcugggauuauagg

SEQ ID NO: 951052 - RNA, 23 nt, Human
ucccagucucaauggcccagguc

SEQ ID NO: 951053 - RNA, 21 nt, Human
uccccauacucugccuucaca

SEQ ID NO: 951054 - RNA, 19 nt, Human
ucccugagggcaaggacgc

SEQ ID NO: 951055 - RNA, 22 nt, Human
ucccugccaacagcagccaugg

SEQ ID NO: 951056 - RNA, 18 nt, Human
ucccugcuagauccugcc

SEQ ID NO: 951057 - RNA, 22 nt, Human
ucccuguccugaacacccuccc

SEQ ID NO: 951058 - RNA, 20 nt, Human
ucccugugggcacagccugg

SEQ ID NO: 951059 - RNA, 23 nt, Human
ucccuuaauguacaagguggcag

SEQ ID NO: 951060 - RNA, 27 nt, Human
ucccuuguucccguugagggauggucc

SEQ ID NO: 951061 - RNA, 18 nt, Human
uccucccacacucugagc

SEQ ID NO: 951062 - RNA, 18 nt, Human
uccugacuucaaaugauc

SEQ ID NO: 951063 - RNA, 18 nt, Human
uccugaguagcugggauu

SEQ ID NO: 951064 - RNA, 21 nt, Human
uccuggguucaagugauucuc

SEQ ID NO: 951065 - RNA, 24 nt, Human
uccuggguucaagugauucuccug

SEQ ID NO: 951066 - RNA, 24 nt, Human
uccuggguucaugccauucuccug

SEQ ID NO: 951067 - RNA, 20 nt, Human
uccuucccacaccugagccu

SEQ ID NO: 951068 - RNA, 23 nt, Human
ucggccuccugaguagcugggau

SEQ ID NO: 951069 - RNA, 23 nt, Human
ucuauaacccccacaaaauggcc

SEQ ID NO: 951070 - RNA, 23 nt, Human
ucucacucuguagcccaggcugg

SEQ ID NO: 951071 - RNA, 24 nt, Human
ucucacucuguagcccaggcugga

SEQ ID NO: 951072 - RNA, 23 nt, Human
ucucacuuuccagaaagccucaa

SEQ ID NO: 951073 - RNA, 23 nt, Human
ucucaggcuggaguguaauggcg

SEQ ID NO: 951074 - RNA, 23 nt, Human
ucucauucugucucucaggcugg

SEQ ID NO: 951075 - RNA, 24 nt, Human
ucucauucugucucucaggcugga

SEQ ID NO: 951076 - RNA, 21 nt, Human
ucucccugcuagauccugccc

SEQ ID NO: 951077 - RNA, 22 nt, Human
ucucguuuggucacccaggcug

SEQ ID NO: 951078 - RNA, 23 nt, Human
ucucucaggcuggaguguaaugg

SEQ ID NO: 951079 - RNA, 20 nt, Human
ucuggaggagggaggccugc

SEQ ID NO: 951080 - RNA, 24 nt, Human
ucuguagcccaggcuggagugcag

SEQ ID NO: 951081 - RNA, 18 nt, Human
ucugucucucaggcugga

SEQ ID NO: 951082 - RNA, 24 nt, Human
ucugucucucaggcuggaguguaa

SEQ ID NO: 951083 - RNA, 18 nt, Human
ucugucucuuuugcugcu

SEQ ID NO: 951084 - RNA, 20 nt, Human
ugaaaagcgaaaagacagag

SEQ ID NO: 951085 - RNA, 23 nt, Human
ugaacacccuccccuuuuucucu

SEQ ID NO: 951086 - RNA, 21 nt, Human
ugaaggaccuguccaaggcug

SEQ ID NO: 951087 - RNA, 19 nt, Human
ugaauauauauauauauau

SEQ ID NO: 951088 - RNA, 21 nt, Human
ugacuucaaaugauccacccg

SEQ ID NO: 951089 - RNA, 22 nt, Human
ugacuucaaaugauccacccgc

SEQ ID NO: 951090 - RNA, 25 nt, Human
ugagaaaaaaggcaacacagcagga

SEQ ID NO: 951091 - RNA, 24 nt, Human
ugagccaccgugcccggccugugu

SEQ ID NO: 951092 - RNA, 23 nt, Human
ugagccagggagagcaggauggg

SEQ ID NO: 951093 - RNA, 20 nt, Human
ugaggcagggucugaacugg

SEQ ID NO: 951094 - RNA, 21 nt, Human
ugaggcagggucugaacuggu

SEQ ID NO: 951095 - RNA, 23 nt, Human
ugaggcccuggguggccccaccc

SEQ ID NO: 951096 - RNA, 21 nt, Human
ugagggaaagagagguaccag

SEQ ID NO: 951097 - RNA, 20 nt, Human
ugagggcaggaaacagauuu

SEQ ID NO: 951098 - RNA, 23 nt, Human
ugagugccauuucccccucucca

SEQ ID NO: 951099 - RNA, 18 nt, Human
ugaguucaugaggcaggg

SEQ ID NO: 951100 - RNA, 19 nt, Human
ugcacacccugccccuaac

SEQ ID NO: 951101 - RNA, 19 nt, Human
ugcaggcugugcuccuggu

SEQ ID NO: 951102 - RNA, 24 nt, Human
ugcagggcccaguugggcucuucc

SEQ ID NO: 951103 - RNA, 19 nt, Human
ugcagugcaauggugugau

SEQ ID NO: 951104 - RNA, 23 nt, Human
ugcagugcaauggugugaucuca

SEQ ID NO: 951105 - RNA, 26 nt, Human
ugccaggcccugccucacccccccug

SEQ ID NO: 951106 - RNA, 19 nt, Human
ugccagggacagcucuugc

SEQ ID NO: 951107 - RNA, 19 nt, Human
ugccauagagcacauggca

SEQ ID NO: 951108 - RNA, 19 nt, Human
ugccauuucccccucucca

SEQ ID NO: 951109 - RNA, 21 nt, Human
ugcccagacuguguccuggcc

SEQ ID NO: 951110 - RNA, 24 nt, Human
ugcccggcuaauuuuuguauuuuu

SEQ ID NO: 951111 - RNA, 24 nt, Human
ugccucagccuccagacuagcugg

SEQ ID NO: 951112 - RNA, 24 nt, Human
ugccucagccucccaaguagcugg

SEQ ID NO: 951113 - RNA, 22 nt, Human
ugccuccuggguucaagugauu

SEQ ID NO: 951114 - RNA, 22 nt, Human
ugcgcuccccgcgggccugcga

SEQ ID NO: 951115 - RNA, 19 nt, Human
ugcuacaaaggcagaucau

SEQ ID NO: 951116 - RNA, 23 nt, Human
ugcuacaaaggcagaucaucaac

SEQ ID NO: 951117 - RNA, 24 nt, Human
uggaacuacaggcacaugccacca

SEQ ID NO: 951118 - RNA, 23 nt, Human
uggaacucacagcccuccuugca

SEQ ID NO: 951119 - RNA, 19 nt, Human
uggaaugaaugaaagaaag

SEQ ID NO: 951120 - RNA, 21 nt, Human
uggaggaccagacuccaccac

SEQ ID NO: 951121 - RNA, 23 nt, Human
uggagugcaguggcacgaucuca

SEQ ID NO: 951122 - RNA, 24 nt, Human
uggagugcaguggcacgaucucag

SEQ ID NO: 951123 - RNA, 24 nt, Human
uggaguguaauggcgcgaucucgg

SEQ ID NO: 951124 - RNA, 18 nt, Human
uggcaaaugugugcacuu

SEQ ID NO: 951125 - RNA, 20 nt, Human
uggcacgaucucagcucacu

SEQ ID NO: 951126 - RNA, 24 nt, Human
uggcacgaucucagcucacuguaa

SEQ ID NO: 951127 - RNA, 24 nt, Human
uggcacuccuucuggugacaucug

SEQ ID NO: 951128 - RNA, 24 nt, Human
uggcagggaugggguuucauuaug

SEQ ID NO: 951129 - RNA, 21 nt, Human
uggccaggcuggucuuuaacu

SEQ ID NO: 951130 - RNA, 20 nt, Human
uggcccuggagagcugggca

SEQ ID NO: 951131 - RNA, 26 nt, Human
uggccuguccccacauccugcccccg

SEQ ID NO: 951132 - RNA, 18 nt, Human
ugggaccaggcugcccag

SEQ ID NO: 951133 - RNA, 21 nt, Human
ugggacuacaggcacccgcca

SEQ ID NO: 951134 - RNA, 22 nt, Human
ugggacuacaggcacccgccac

SEQ ID NO: 951135 - RNA, 24 nt, Human
ugggacuacaggcacccgccacca

SEQ ID NO: 951136 - RNA, 22 nt, Human
ugggauuacagaagcaugccac

SEQ ID NO: 951137 - RNA, 24 nt, Human
ugggauuacagaagcaugccacca

SEQ ID NO: 951138 - RNA, 18 nt, Human
ugggauuacaggcaugag

SEQ ID NO: 951139 - RNA, 22 nt, Human
ugggauuacaggcaugagccac

SEQ ID NO: 951140 - RNA, 23 nt, Human
ugggauuacaggcaugagccacc

SEQ ID NO: 951141 - RNA, 24 nt, Human
ugggauuacaggcaugagccacca

SEQ ID NO: 951142 - RNA, 25 nt, Human
ugggauuacaggcaugagccaccau

SEQ ID NO: 951143 - RNA, 18 nt, Human
ugggauuacuggcgugag

SEQ ID NO: 951144 - RNA, 22 nt, Human
ugggauuacuggcgugagccac

SEQ ID NO: 951145 - RNA, 23 nt, Human
ugggauuacuggcgugagccacc

SEQ ID NO: 951146 - RNA, 23 nt, Human
ugggauuacuggcgugagccacc

SEQ ID NO: 951147 - RNA, 24 nt, Human
ugggauuacuggcgugagccaccg

SEQ ID NO: 951148 - RNA, 19 nt, Human
ugggauuauaggugugagc

SEQ ID NO: 951149 - RNA, 22 nt, Human
ugggauuauaggugugagccac

SEQ ID NO: 951150 - RNA, 23 nt, Human
ugggauuauaggugugagccacc

SEQ ID NO: 951151 - RNA, 24 nt, Human
ugggauuauaggugugagccaccg

SEQ ID NO: 951152 - RNA, 21 nt, Human
ugggcuucuuagagcccuccc

SEQ ID NO: 951153 - RNA, 22 nt, Human
uggggaagaggaagacauuuga

SEQ ID NO: 951154 - RNA, 24 nt, Human
ugggguuucaccauguuagccagg

SEQ ID NO: 951155 - RNA, 24 nt, Human
ugggguuucaccguguuagccagg

SEQ ID NO: 951156 - RNA, 24 nt, Human
ugggguuucauuauguuggccagg

SEQ ID NO: 951157 - RNA, 23 nt, Human
uggguucaagugauucuccugcc

SEQ ID NO: 951158 - RNA, 24 nt, Human
uggguucaagugauucuccugccu

SEQ ID NO: 951159 - RNA, 18 nt, Human
uggucacccaggcugcag

SEQ ID NO: 951160 - RNA, 24 nt, Human
uggugugaucucagcucauuacaa

SEQ ID NO: 951161 - RNA, 21 nt, Human
uguauuuuuaguagagauggg

SEQ ID NO: 951162 - RNA, 21 nt, Human
uguccuggccaggguucaaga

SEQ ID NO: 951163 - RNA, 22 nt, Human
ugugcacaugugugugcucaca

SEQ ID NO: 951164 - RNA, 21 nt, Human
ugugcaugugcacaugugugu

SEQ ID NO: 951165 - RNA, 24 nt, Human
ugugccuccuggguucaagugauu

SEQ ID NO: 951166 - RNA, 22 nt, Human
uguggggcaggaggcagaagga

SEQ ID NO: 951167 - RNA, 18 nt, Human
uuaguagagaugggguuu

SEQ ID NO: 951168 - RNA, 18 nt, Human
uuaguagagaugggguuu

SEQ ID NO: 951169 - RNA, 22 nt, Human
uuaguagagaugggguuucacc

SEQ ID NO: 951170 - RNA, 22 nt, Human
uuaguagagaugggguuucacc

SEQ ID NO: 951171 - RNA, 24 nt, Human
uuaguagagaugggguuucaccau

SEQ ID NO: 951172 - RNA, 24 nt, Human
uuaguagagaugggguuucaccgu

SEQ ID NO: 951173 - RNA, 24 nt, Human
uucaaaugauccacccgccuuggc

SEQ ID NO: 951174 - RNA, 21 nt, Human
uucaagugauucuccugccuc

SEQ ID NO: 951175 - RNA, 23 nt, Human
uucaagugauucuccugccucag

SEQ ID NO: 951176 - RNA, 24 nt, Human
uucaagugauucuccugccucagc

SEQ ID NO: 951177 - RNA, 19 nt, Human
uucaagugauucucuaauc

SEQ ID NO: 951178 - RNA, 23 nt, Human
uucaagugauucucuaaucucgg

SEQ ID NO: 951179 - RNA, 19 nt, Human
uucaugccauucuccugcc

SEQ ID NO: 951180 - RNA, 25 nt, Human
uucccacacuccaaccuccaggcug

SEQ ID NO: 951181 - RNA, 21 nt, Human
uucugucucucaggcuggagu

SEQ ID NO: 951182 - RNA, 23 nt, Human
uugagggaugguccgcauuucag

SEQ ID NO: 951183 - RNA, 23 nt, Human
uugcggccuuggcccuggagagc

SEQ ID NO: 951184 - RNA, 20 nt, Human
uugcugcuuagccuuugugc

SEQ ID NO: 951185 - RNA, 18 nt, Human
uugcuguggcccccuggc

SEQ ID NO: 951186 - RNA, 24 nt, Human
uuggcagggaugggguuucauuau

SEQ ID NO: 951187 - RNA, 23 nt, Human
uuguauuuuuaguagagaugggg

SEQ ID NO: 951188 - RNA, 23 nt, Human
uuguauuuuuggcagggaugggg

SEQ ID NO: 951189 - RNA, 19 nt, Human
uuucaccauguuagccagg

SEQ ID NO: 951190 - RNA, 19 nt, Human
uuucaccguguuagccagg

SEQ ID NO: 951191 - RNA, 24 nt, Human
uuucauuauguuggccaggcuggu

SEQ ID NO: 951192 - RNA, 22 nt, Human
uuuuauuuuucagauggagucu

SEQ ID NO: 951193 - RNA, 24 nt, Human
uuuuuaguagagaugggguuucac

SEQ ID NO: 951194 - RNA, 24 nt, Human
uuuuuaguagagaugggguuucac

SEQ ID NO: 951195 - RNA, 22 nt, Human
uuuuucucugaguccuucacag

SEQ ID NO: 951196 - RNA, 21 nt, Human
uuuuugaauuuuuuaguagag

SEQ ID NO: 951197 - RNA, 24 nt, Human
uuuuugaauuuuuuaguagagaug

SEQ ID NO: 951198 - RNA, 24 nt, Human
uuuuuggcagggaugggguuucau

SEQ ID NO: 951199 - RNA, 21 nt, Human
uuuuuguauuuuuaguagaga

SEQ ID NO: 951200 - RNA, 18 nt, Human
uuuuuguauuuuuggcag

SEQ ID NO: 951201 - RNA, 23 nt, Human
uuuuuguauuuuuggcagggaug

SEQ ID NO: 951202 - RNA, 23 nt, Human
uuuuuuaguagagaugggguuuc

SEQ ID NO: 951203 - RNA, 24 nt, Human
uuuuuuguauuuuuaguagagaug

SEQ ID NO: 951204 - RNA, 18 nt, Human
acauagguuggucccugc

SEQ ID NO: 951205 - RNA, 21 nt, Human
agcagaccauucagccaagaa

SEQ ID NO: 951206 - RNA, 18 nt, Human
agcgggggcccuggaagu

SEQ ID NO: 951207 - RNA, 22 nt, Human
agcugcccuuugacagugacau

SEQ ID NO: 951208 - RNA, 19 nt, Human
aggagggaggacguacuuu

SEQ ID NO: 951209 - RNA, 24 nt, Human
aggcgucaggggcucucugaagcc

SEQ ID NO: 951210 - RNA, 21 nt, Human
agggcaggaaugcugagggcu

SEQ ID NO: 951211 - RNA, 22 nt, Human
agggcaggaaugcugagggcuc

SEQ ID NO: 951212 - RNA, 21 nt, Human
aggggaugggggugggaccaa

SEQ ID NO: 951213 - RNA, 23 nt, Human
aggggcuagcaugaagguccagg

SEQ ID NO: 951214 - RNA, 19 nt, Human
augaaaagaagcaccugga

SEQ ID NO: 951215 - RNA, 19 nt, Human
caccuggaaagggcagugc

SEQ ID NO: 951216 - RNA, 25 nt, Human
cacucucauucccaucaggugaggg

SEQ ID NO: 951217 - RNA, 18 nt, Human
cagcagaccauucagcca

SEQ ID NO: 951218 - RNA, 25 nt, Human
cagccaagaagcaagcuccccacac

SEQ ID NO: 951219 - RNA, 18 nt, Human
cagggcaggaaugcugag

SEQ ID NO: 951220 - RNA, 19 nt, Human
caguauguuggggugggag

SEQ ID NO: 951221 - RNA, 24 nt, Human
cagugucccuucucuaggcccaag

SEQ ID NO: 951222 - RNA, 23 nt, Human
cauucagccaagaagcaagcucc

SEQ ID NO: 951223 - RNA, 22 nt, Human
ccagcagaccauucagccaaga

SEQ ID NO: 951224 - RNA, 18 nt, Human
cccaaggccacagggccc

SEQ ID NO: 951225 - RNA, 23 nt, Human
ccccaggaacaguucuccucccu

SEQ ID NO: 951226 - RNA, 20 nt, Human
cccuugugauugaaaguaaa

SEQ ID NO: 951227 - RNA, 18 nt, Human
ccucuugucuguuuacca

SEQ ID NO: 951228 - RNA, 22 nt, Human
ccucuuuaggaguuauaggagu

SEQ ID NO: 951229 - RNA, 27 nt, Human
ccuggcugagagcuggaggagcucauu

SEQ ID NO: 951230 - RNA, 22 nt, Human
ccuucuucacagggccucauca

SEQ ID NO: 951231 - RNA, 24 nt, Human
ccuugggccccaggaacaguucuc

SEQ ID NO: 951232 - RNA, 18 nt, Human
cgucuguauauccugucc

SEQ ID NO: 951233 - RNA, 24 nt, Human
cuaggcccaaggccacagggcccc

SEQ ID NO: 951234 - RNA, 21 nt, Human
cuccccacacucucauuccca

SEQ ID NO: 951235 - RNA, 18 nt, Human
cuccuggcugagagcugg

SEQ ID NO: 951236 - RNA, 23 nt, Human
cugaagccugaacuggggaguag

SEQ ID NO: 951237 - RNA, 23 nt, Human
cugccauguuccugcaggcguca

SEQ ID NO: 951238 - RNA, 20 nt, Human
cugcccccgucuguauaucc

SEQ ID NO: 951239 - RNA, 20 nt, Human
cugcccccgucuguauaucc

SEQ ID NO: 951240 - RNA, 19 nt, Human
cugggcaucgaggagugcc

SEQ ID NO: 951241 - RNA, 23 nt, Human
gaaacaguauguuggggugggag

SEQ ID NO: 951242 - RNA, 21 nt, Human
gaacuggggaguaggaaaggu

SEQ ID NO: 951243 - RNA, 19 nt, Human
gaagcaccuggaaagggca

SEQ ID NO: 951244 - RNA, 20 nt, Human
gagacagcgggggcccugga

SEQ ID NO: 951245 - RNA, 19 nt, Human
gagcauggggcaugguggu

SEQ ID NO: 951246 - RNA, 23 nt, Human
gagcauggggcaugguggugggg

SEQ ID NO: 951247 - RNA, 21 nt, Human
gaggagugccaggcaucuacc

SEQ ID NO: 951248 - RNA, 19 nt, Human
gaucaggaaacaguauguu

SEQ ID NO: 951249 - RNA, 19 nt, Human
gaugaugaagacacucaga

SEQ ID NO: 951250 - RNA, 19 nt, Human
gcaccuggaaagggcagug

SEQ ID NO: 951251 - RNA, 24 nt, Human
gcagaccauucagccaagaagcaa

SEQ ID NO: 951252 - RNA, 18 nt, Human
gcaugguggugggggugg

SEQ ID NO: 951253 - RNA, 20 nt, Human
gccccaggaacaguucuccu

SEQ ID NO: 951254 - RNA, 18 nt, Human
gcucacagcucucuaccu

SEQ ID NO: 951255 - RNA, 24 nt, Human
gcuggagucagguggggcuggggc

SEQ ID NO: 951256 - RNA, 19 nt, Human
gcuggggcucacagcucuc

SEQ ID NO: 951257 - RNA, 26 nt, Human
ggaaugcagaaccagguucaggggag

SEQ ID NO: 951258 - RNA, 19 nt, Human
ggagucagguggggcuggg

SEQ ID NO: 951259 - RNA, 21 nt, Human
ggccacagggcccagguaacc

SEQ ID NO: 951260 - RNA, 18 nt, Human
ggcuggugggaagaggca

SEQ ID NO: 951261 - RNA, 20 nt, Human
gggaagaggcagcaaggagg

SEQ ID NO: 951262 - RNA, 22 nt, Human
gggcaugguggugggggugggg

SEQ ID NO: 951263 - RNA, 21 nt, Human
gggcuggggcucacagcucuc

SEQ ID NO: 951264 - RNA, 19 nt, Human
ggggcucucugaagccuga

SEQ ID NO: 951265 - RNA, 21 nt, Human
ggggugggaggagcucugagc

SEQ ID NO: 951266 - RNA, 24 nt, Human
ggggugggaggagcucugagcugg

SEQ ID NO: 951267 - RNA, 23 nt, Human
gggugggaggagcucugagcugg

SEQ ID NO: 951268 - RNA, 20 nt, Human
gguggggaagcacagucugg

SEQ ID NO: 951269 - RNA, 19 nt, Human
gugcuggagucaggugggg

SEQ ID NO: 951270 - RNA, 22 nt, Human
uagcagaugaugaagacacuca

SEQ ID NO: 951271 - RNA, 18 nt, Human
uagcaugaagguccaggc

SEQ ID NO: 951272 - RNA, 19 nt, Human
uagcaugaagguccagggc

SEQ ID NO: 951273 - RNA, 22 nt, Human
uauauggagcuccccaccgaag

SEQ ID NO: 951274 - RNA, 19 nt, Human
uauccagcucuaagcccuc

SEQ ID NO: 951275 - RNA, 18 nt, Human
uauccugucccuucuuca

SEQ ID NO: 951276 - RNA, 18 nt, Human
ucacugggcaucgaggag

SEQ ID NO: 951277 - RNA, 23 nt, Human
ucaucauaacugucuccagcugc

SEQ ID NO: 951278 - RNA, 22 nt, Human
uccagcucuaagcccucccaag

SEQ ID NO: 951279 - RNA, 20 nt, Human
uccagggcaggaaugcugag

SEQ ID NO: 951280 - RNA, 23 nt, Human
uccaguuucuuccuuccuugggg

SEQ ID NO: 951281 - RNA, 21 nt, Human
uccuggcugagagcuggaggc

SEQ ID NO: 951282 - RNA, 23 nt, Human
ucuaagcccucccaagaaaugag

SEQ ID NO: 951283 - RNA, 25 nt, Human
ucucacuuccuugccauccugggag

SEQ ID NO: 951284 - RNA, 25 nt, Human
ucuccuaacuuccuaccuuguuaaa

SEQ ID NO: 951285 - RNA, 22 nt, Human
ugaggaagcaguuccuaauuuc

SEQ ID NO: 951286 - RNA, 23 nt, Human
ugaggaagcaguuccuaauuucc

SEQ ID NO: 951287 - RNA, 21 nt, Human
ugagggcucuucagccugggc

SEQ ID NO: 951288 - RNA, 19 nt, Human
ugccaggcaucuacugcuc

SEQ ID NO: 951289 - RNA, 20 nt, Human
ugcuggagucagguggggcu

SEQ ID NO: 951290 - RNA, 25 nt, Human
uggcugagagcuggaggcuggccau

SEQ ID NO: 951291 - RNA, 18 nt, Human
ugggccccaggaacaguu

SEQ ID NO: 951292 - RNA, 21 nt, Human
uggggcucaggcccuucucag

SEQ ID NO: 951293 - RNA, 22 nt, Human
uggggugggaggagcucugagc

SEQ ID NO: 951294 - RNA, 18 nt, Human
ugguggggguggggaagc

SEQ ID NO: 951295 - RNA, 21 nt, Human
uggugguggggguggggaagc

SEQ ID NO: 951296 - RNA, 21 nt, Human
uggugguggggguggggaagc

SEQ ID NO: 951297 - RNA, 24 nt, Human
uggugguggggguggggaagcaca

SEQ ID NO: 951298 - RNA, 23 nt, Human
ugucuccagcugcccccgucugu

SEQ ID NO: 951299 - RNA, 22 nt, Human
uuccuugccauccugggaggug

SEQ ID NO: 951300 - RNA, 23 nt, Human
uuccuugggguuggggaccuccu

SEQ ID NO: 951301 - RNA, 26 nt, Human
uuccuugggguuggggaccuccuggc

SEQ ID NO: 951302 - RNA, 19 nt, Human
uuggggaccuccuggcuga

SEQ ID NO: 951303 - RNA, 21 nt, Human
uuuuuuuuuuuuuuuucccaa

SEQ ID NO: 951304 - RNA, 24 nt, Human
uuuuuuuuuuuuuuuuucccaagg

SEQ ID NO: 951305 - RNA, 21 nt, Human
auagagacgggguuucaccau

SEQ ID NO: 951306 - RNA, 22 nt, Human
auagagacgggguuucaccaug

SEQ ID NO: 951307 - RNA, 18 nt, Human
gagacgggguuucaccau

SEQ ID NO: 951308 - RNA, 21 nt, Human
uagagacgggguuucaccaug

SEQ ID NO: 951309 - RNA, 23 nt, Human
uauagagacgggguuucaccaug

SEQ ID NO: 951310 - RNA, 23 nt, Human
uuauagagacgggguuucaccau

SEQ ID NO: 951311 - RNA, 24 nt, Human
uuauagagacgggguuucaccaug

SEQ ID NO: 951312 - RNA, 24 nt, Human
uuuauagagacgggguuucaccau

SEQ ID NO: 951313 - RNA, 23 nt, Human
uuuuuauagagacgggguuucac

SEQ ID NO: 951314 - RNA, 30 nt, Human
uuuuuuuuuuuuauagagacgggguuucaa

SEQ ID NO: 951315 - RNA, 28 nt, Human
uuuuuuuuuuuuuuuauagagacggggg

SEQ ID NO: 951316 - RNA, 18 nt, Human
aaaacaacagaaacaaga

SEQ ID NO: 951317 - RNA, 19 nt, Human
aaaauacaaaucaagucug

SEQ ID NO: 951318 - RNA, 23 nt, Human
aaagugguuuugauauuuuggua

SEQ ID NO: 951319 - RNA, 20 nt, Human
ccggccggcaaggaaagggu

SEQ ID NO: 951320 - RNA, 22 nt, Human
cggccggcaaggaaagggugau

SEQ ID NO: 951321 - RNA, 19 nt, Human
cugccgcccguccaccucg

SEQ ID NO: 951322 - RNA, 25 nt, Human
gccgaagugccggccggcaaggaaa

SEQ ID NO: 951323 - RNA, 19 nt, Human
ggcgcuugacugccgcccg

SEQ ID NO: 951324 - RNA, 20 nt, Human
ucaaagugguuuugauauuu

SEQ ID NO: 951325 - RNA, 21 nt, Human
uccaaaacaacagaaacaaga

SEQ ID NO: 951326 - RNA, 23 nt, Human
ugagugggcaaauucugaaauuc

SEQ ID NO: 951327 - RNA, 18 nt, Human
uguccaaaacaacagaaa

SEQ ID NO: 951328 - RNA, 19 nt, Human
uguccaaauguucagaagc

SEQ ID NO: 951329 - RNA, 19 nt, Human
cccccagaucuucugagga

SEQ ID NO: 951330 - RNA, 21 nt, Human
uauuuugcuuuccaucccccc

SEQ ID NO: 951331 - RNA, 19 nt, Human
aagagcacucauuugccac

SEQ ID NO: 951332 - RNA, 25 nt, Human
aggguggaguuuaguuucugugaau

SEQ ID NO: 951333 - RNA, 19 nt, Human
cagcgcagcagggacacgg

SEQ ID NO: 951334 - RNA, 26 nt, Human
ccacuuccucuuggaucauuauaaga

SEQ ID NO: 951335 - RNA, 22 nt, Human
cggggaccaugcaagcuguaau

SEQ ID NO: 951336 - RNA, 23 nt, Human
cucauuugccacuuccucuugga

SEQ ID NO: 951337 - RNA, 24 nt, Human
guuucugugaauuuugcuucugau

SEQ ID NO: 951338 - RNA, 21 nt, Human
ucucucagcgcagcagggacu

SEQ ID NO: 951339 - RNA, 20 nt, Human
uggagucccaaggguggagu

SEQ ID NO: 951340 - RNA, 24 nt, Human
uguuguggagucccaaggguggag

SEQ ID NO: 951341 - RNA, 21 nt, Human
uuuuguuguuguuguuguugu

SEQ ID NO: 951342 - RNA, 20 nt, Human
aaagaguauucugucaaaag

SEQ ID NO: 951343 - RNA, 26 nt, Human
uaugaaaucagcaaaugccauuuuga

SEQ ID NO: 951344 - RNA, 19 nt, Human
ucagcaaaauccaauauca

SEQ ID NO: 951345 - RNA, 26 nt, Human
uccagacgugaaagguuuaugaaauu

SEQ ID NO: 951346 - RNA, 23 nt, Human
ugaaagguuuaugaaaucagcaa

SEQ ID NO: 951347 - RNA, 20 nt, Human
uuuuuuuuuuuuuuuugcca

SEQ ID NO: 951348 - RNA, 22 nt, Human
uuuuuuuuuuuuuuuuugccau

SEQ ID NO: 951349 - RNA, 27 nt, Human
uuuuuuuuuuuuuuuuuuuuuuugggg

SEQ ID NO: 951350 - RNA, 26 nt, Human
aaaagcucagcggaggugccacugcc

SEQ ID NO: 951351 - RNA, 19 nt, Human
aaacucggaccagccagug

SEQ ID NO: 951352 - RNA, 21 nt, Human
aaagauugaugaugagcccaa

SEQ ID NO: 951353 - RNA, 19 nt, Human
aaaugccuccgugcccacc

SEQ ID NO: 951354 - RNA, 22 nt, Human
aaccccauccccauugcuccau

SEQ ID NO: 951355 - RNA, 26 nt, Human
aaccccauccccauugcuccaucccc

SEQ ID NO: 951356 - RNA, 19 nt, Human
aacucggaccagccaguga

SEQ ID NO: 951357 - RNA, 19 nt, Human
aagagagacagagagacug

SEQ ID NO: 951358 - RNA, 26 nt, Human
aagagucaaugaaacagagucaaggg

SEQ ID NO: 951359 - RNA, 20 nt, Human
aaggagaaaggcuggaggcu

SEQ ID NO: 951360 - RNA, 21 nt, Human
aaggagaaaggcuggaggcuu

SEQ ID NO: 951361 - RNA, 19 nt, Human
aagggaagaaaggcaggga

SEQ ID NO: 951362 - RNA, 24 nt, Human
acauguguguguucaaggcuagga

SEQ ID NO: 951363 - RNA, 19 nt, Human
agaaagagagaaucuacua

SEQ ID NO: 951364 - RNA, 27 nt, Human
agaaaggagaaaggcuggaggcuuugg

SEQ ID NO: 951365 - RNA, 27 nt, Human
agacagagagacagacaaaggggaccc

SEQ ID NO: 951366 - RNA, 23 nt, Human
agagagagaaaggcaaagggaag

SEQ ID NO: 951367 - RNA, 23 nt, Human
agagaugugauuuggggaaagug

SEQ ID NO: 951368 - RNA, 19 nt, Human
agagggaggaggagaaaag

SEQ ID NO: 951369 - RNA, 23 nt, Human
agaggggagaggcugagaaagag

SEQ ID NO: 951370 - RNA, 18 nt, Human
agaggggcuguauucaga

SEQ ID NO: 951371 - RNA, 23 nt, Human
agcaggcugggggggacccggga

SEQ ID NO: 951372 - RNA, 18 nt, Human
agcaucaggcuugggcga

SEQ ID NO: 951373 - RNA, 22 nt, Human
agcggagaaaggagaaaggcug

SEQ ID NO: 951374 - RNA, 19 nt, Human
aggaaagauggcagccagg

SEQ ID NO: 951375 - RNA, 19 nt, Human
aggagaggggagaggcuga

SEQ ID NO: 951376 - RNA, 22 nt, Human
aggcagggagagaaaggagagg

SEQ ID NO: 951377 - RNA, 23 nt, Human
aggcagggagagaaaggagaggg

SEQ ID NO: 951378 - RNA, 18 nt, Human
aggcagggaggugguuac

SEQ ID NO: 951379 - RNA, 22 nt, Human
aggcauagagaagagagaucag

SEQ ID NO: 951380 - RNA, 22 nt, Human
aggcuggaggcuuuggcugagg

SEQ ID NO: 951381 - RNA, 20 nt, Human
aggcugggggggacccggga

SEQ ID NO: 951382 - RNA, 23 nt, Human
aggggcacugugagcuugcugca

SEQ ID NO: 951383 - RNA, 23 nt, Human
aggugguuacauuugucggggac

SEQ ID NO: 951384 - RNA, 20 nt, Human
caacuccucccuucccugcc

SEQ ID NO: 951385 - RNA, 18 nt, Human
caccggaggacgugugug

SEQ ID NO: 951386 - RNA, 23 nt, Human
caggcuggugagagcaagggggu

SEQ ID NO: 951387 - RNA, 23 nt, Human
cagggaggagggagucuuuggca

SEQ ID NO: 951388 - RNA, 23 nt, Human
cagucuguuuuccuggcaaucag

SEQ ID NO: 951389 - RNA, 23 nt, Human
caguggacaagggacaguggcuc

SEQ ID NO: 951390 - RNA, 22 nt, Human
caguggcucccucagacugucc

SEQ ID NO: 951391 - RNA, 26 nt, Human
caucagggaggagggagucuuuggca

SEQ ID NO: 951392 - RNA, 18 nt, Human
cccaaugcuucucucaca

SEQ ID NO: 951393 - RNA, 19 nt, Human
ccccaaccccauccccauu

SEQ ID NO: 951394 - RNA, 18 nt, Human
cccuucucccuuccuuuc

SEQ ID NO: 951395 - RNA, 18 nt, Human
ccuccacauggaugaagg

SEQ ID NO: 951396 - RNA, 19 nt, Human
cucccaugaauugugcagg

SEQ ID NO: 951397 - RNA, 18 nt, Human
cucucucucucucucucc

SEQ ID NO: 951398 - RNA, 18 nt, Human
cucucucucucucucucu

SEQ ID NO: 951399 - RNA, 18 nt, Human
cucucucucucucucucu

SEQ ID NO: 951400 - RNA, 18 nt, Human
cucucucucucucucucu

SEQ ID NO: 951401 - RNA, 18 nt, Human
cucucucucucucucucu

SEQ ID NO: 951402 - RNA, 18 nt, Human
cucucucucucucucucu

SEQ ID NO: 951403 - RNA, 18 nt, Human
cucucucucucucucucu

SEQ ID NO: 951404 - RNA, 18 nt, Human
cucucucucucucucucu

SEQ ID NO: 951405 - RNA, 18 nt, Human
cucucucucucucucucu

SEQ ID NO: 951406 - RNA, 18 nt, Human
cucucucucucucucucu

SEQ ID NO: 951407 - RNA, 18 nt, Human
cucucucucucucucucu

SEQ ID NO: 951408 - RNA, 18 nt, Human
cucucucucucucucucu

SEQ ID NO: 951409 - RNA, 18 nt, Human
cucucucucucucucucu

SEQ ID NO: 951410 - RNA, 18 nt, Human
cucucucucucucucucu

SEQ ID NO: 951411 - RNA, 18 nt, Human
cucucucucucucucucu

SEQ ID NO: 951412 - RNA, 18 nt, Human
cucucucucucucucucu

SEQ ID NO: 951413 - RNA, 18 nt, Human
cucucucucucucucucu

SEQ ID NO: 951414 - RNA, 18 nt, Human
cucucucucucucucucu

SEQ ID NO: 951415 - RNA, 18 nt, Human
cucucucucucucucucu

SEQ ID NO: 951416 - RNA, 18 nt, Human
cucucucucucucucucu

SEQ ID NO: 951417 - RNA, 18 nt, Human
cucucucucucucucucu

SEQ ID NO: 951418 - RNA, 18 nt, Human
cucucucucucucucucu

SEQ ID NO: 951419 - RNA, 23 nt, Human
cugauuccagcgccuacaccagc

SEQ ID NO: 951420 - RNA, 23 nt, Human
cuuuggcaucaggccugucucuu

SEQ ID NO: 951421 - RNA, 24 nt, Human
cuuuguaaacgucuccccaacccc

SEQ ID NO: 951422 - RNA, 19 nt, Human
gagaggcugagaaagagag

SEQ ID NO: 951423 - RNA, 21 nt, Human
gauugaugaugagcccaaagc

SEQ ID NO: 951424 - RNA, 18 nt, Human
gcagggagagaaaggaga

SEQ ID NO: 951425 - RNA, 19 nt, Human
gccccuggugaauucugug

SEQ ID NO: 951426 - RNA, 19 nt, Human
gcggagaaaacucggacca

SEQ ID NO: 951427 - RNA, 18 nt, Human
ggagaggggagaggcuga

SEQ ID NO: 951428 - RNA, 19 nt, Human
ggcauugaagauugccuga

SEQ ID NO: 951429 - RNA, 21 nt, Human
ggcauuggggaggaggguagc

SEQ ID NO: 951430 - RNA, 19 nt, Human
ggcucagggagaucagcag

SEQ ID NO: 951431 - RNA, 18 nt, Human
gggaaagugagaguuuga

SEQ ID NO: 951432 - RNA, 21 nt, Human
gggcacccagacuaggggcac

SEQ ID NO: 951433 - RNA, 23 nt, Human
ggguagaaagacgcuaaguccca

SEQ ID NO: 951434 - RNA, 24 nt, Human
gggugugugugugugugugugugg

SEQ ID NO: 951435 - RNA, 19 nt, Human
ggugcggugggcagcuaga

SEQ ID NO: 951436 - RNA, 21 nt, Human
ggugugugugugugugugugu

SEQ ID NO: 951437 - RNA, 20 nt, Human
gguuacauuugucggggaca

SEQ ID NO: 951438 - RNA, 21 nt, Human
guguguguguguguguacaug

SEQ ID NO: 951439 - RNA, 20 nt, Human
gugugugugugugugugugu

SEQ ID NO: 951440 - RNA, 19 nt, Human
guuuuccuggcaaucaggg

SEQ ID NO: 951441 - RNA, 23 nt, Human
uaaacgucuccccaaccccaucc

SEQ ID NO: 951442 - RNA, 23 nt, Human
uaaaugaugaagaaccuuuguaa

SEQ ID NO: 951443 - RNA, 22 nt, Human
uauacagagacacaacacaggg

SEQ ID NO: 951444 - RNA, 19 nt, Human
ucaagggcauuggggagga

SEQ ID NO: 951445 - RNA, 21 nt, Human
ucacaaagaaagaugcugggu

SEQ ID NO: 951446 - RNA, 18 nt, Human
ucagagcccacaucccag

SEQ ID NO: 951447 - RNA, 18 nt, Human
uccaucccagggaugaga

SEQ ID NO: 951448 - RNA, 23 nt, Human
ucccaugaauugugcagggagcu

SEQ ID NO: 951449 - RNA, 19 nt, Human
ucccucagacuguccucca

SEQ ID NO: 951450 - RNA, 19 nt, Human
uccucccuucccugccggg

SEQ ID NO: 951451 - RNA, 19 nt, Human
ucuccccaaccccaucccc

SEQ ID NO: 951452 - RNA, 19 nt, Human
ucucucucucccuucuccc

SEQ ID NO: 951453 - RNA, 23 nt, Human
ucuuuggcagcagugcccaacgu

SEQ ID NO: 951454 - RNA, 20 nt, Human
ugacugggagugauuuucau

SEQ ID NO: 951455 - RNA, 23 nt, Human
ugacuugguuuaaaagcucagcg

SEQ ID NO: 951456 - RNA, 25 nt, Human
ugacuugguuuaaaagcucagcggg

SEQ ID NO: 951457 - RNA, 18 nt, Human
ugagaaagagagaaucua

SEQ ID NO: 951458 - RNA, 19 nt, Human
ugagaaagagagaaucuac

SEQ ID NO: 951459 - RNA, 19 nt, Human
ugagaaagagagaaucuac

SEQ ID NO: 951460 - RNA, 19 nt, Human
ugagagcaagggggugagg

SEQ ID NO: 951461 - RNA, 20 nt, Human
ugagagcaagggggugaggc

SEQ ID NO: 951462 - RNA, 24 nt, Human
ugagagcaagggggugaggcuagg

SEQ ID NO: 951463 - RNA, 23 nt, Human
ugaggcuuccucagacccauggc

SEQ ID NO: 951464 - RNA, 24 nt, Human
ugccacugccagaagcggagaaaa

SEQ ID NO: 951465 - RNA, 20 nt, Human
ugccccaaugcuucucucac

SEQ ID NO: 951466 - RNA, 21 nt, Human
ugcuuuagagagagagaaagg

SEQ ID NO: 951467 - RNA, 23 nt, Human
uggaagggaaagaagagggagga

SEQ ID NO: 951468 - RNA, 20 nt, Human
uggaaucucagguuugggcc

SEQ ID NO: 951469 - RNA, 20 nt, Human
uggcagccaggaagcuguug

SEQ ID NO: 951470 - RNA, 18 nt, Human
uggccaccuuggggaagg

SEQ ID NO: 951471 - RNA, 22 nt, Human
ugggcagcuagagcaggcuggg

SEQ ID NO: 951472 - RNA, 20 nt, Human
uggugagggaggugggcuga

SEQ ID NO: 951473 - RNA, 23 nt, Human
uguccgggucugcugacaacugg

SEQ ID NO: 951474 - RNA, 20 nt, Human
ugucguuuguuuuuguuuug

SEQ ID NO: 951475 - RNA, 21 nt, Human
uguggugagggaggugggcug

SEQ ID NO: 951476 - RNA, 19 nt, Human
uguguguguacaugugugu

SEQ ID NO: 951477 - RNA, 20 nt, Human
uguguguguacaugugugug

SEQ ID NO: 951478 - RNA, 21 nt, Human
uguguguguacaugugugugu

SEQ ID NO: 951479 - RNA, 21 nt, Human
uguguguguguacaugugugu

SEQ ID NO: 951480 - RNA, 21 nt, Human
uguguguguguacaugugugu

SEQ ID NO: 951481 - RNA, 22 nt, Human
uguguguguguacaugugugug

SEQ ID NO: 951482 - RNA, 23 nt, Human
uguguguguguguacaugugugu

SEQ ID NO: 951483 - RNA, 19 nt, Human
uguguguguguguguacau

SEQ ID NO: 951484 - RNA, 19 nt, Human
uguguguguguguguacau

SEQ ID NO: 951485 - RNA, 18 nt, Human
ugugugugugugugugug

SEQ ID NO: 951486 - RNA, 18 nt, Human
ugugugugugugugugug

SEQ ID NO: 951487 - RNA, 18 nt, Human
ugugugugugugugugug

SEQ ID NO: 951488 - RNA, 18 nt, Human
ugugugugugugugugug

SEQ ID NO: 951489 - RNA, 18 nt, Human
ugugugugugugugugug

SEQ ID NO: 951490 - RNA, 18 nt, Human
ugugugugugugugugug

SEQ ID NO: 951491 - RNA, 23 nt, Human
uguguguguguguguguguacau

SEQ ID NO: 951492 - RNA, 21 nt, Human
ugugugugugugugugugugu

SEQ ID NO: 951493 - RNA, 21 nt, Human
ugugugugugugugugugugu

SEQ ID NO: 951494 - RNA, 21 nt, Human
ugugugugugugugugugugu

SEQ ID NO: 951495 - RNA, 21 nt, Human
ugugugugugugugugugugu

SEQ ID NO: 951496 - RNA, 21 nt, Human
ugugugugugugugugugugu

SEQ ID NO: 951497 - RNA, 21 nt, Human
ugugugugugugugugugugu

SEQ ID NO: 951498 - RNA, 21 nt, Human
ugugugugugugugugugugu

SEQ ID NO: 951499 - RNA, 21 nt, Human
ugugugugugugugugugugu

SEQ ID NO: 951500 - RNA, 21 nt, Human
ugugugugugugugugugugu

SEQ ID NO: 951501 - RNA, 22 nt, Human
ugugugugugugugugugugua

SEQ ID NO: 951502 - RNA, 22 nt, Human
ugugugugugugugugugugug

SEQ ID NO: 951503 - RNA, 22 nt, Human
ugugugugugugugugugugug

SEQ ID NO: 951504 - RNA, 22 nt, Human
ugugugugugugugugugugug

SEQ ID NO: 951505 - RNA, 22 nt, Human
ugugugugugugugugugugug

SEQ ID NO: 951506 - RNA, 19 nt, Human
uguucauuuaccuaagagc

SEQ ID NO: 951507 - RNA, 25 nt, Human
uuagaaaaugguuauucaaggcaag

SEQ ID NO: 951508 - RNA, 18 nt, Human
uuccauagccaugauauu

SEQ ID NO: 951509 - RNA, 21 nt, Human
uuccuggucaggcuggugaga

SEQ ID NO: 951510 - RNA, 18 nt, Human
uucuguagagaaugucag

SEQ ID NO: 951511 - RNA, 19 nt, Human
uugcuaggaagcacacagg

SEQ ID NO: 951512 - RNA, 20 nt, Human
uugucguuuguuuuuguuuu

SEQ ID NO: 951513 - RNA, 20 nt, Human
uugugcagggagcugagggu

SEQ ID NO: 951514 - RNA, 30 nt, Human
uugugcaugcaccggaggacguguguguag

SEQ ID NO: 951515 - RNA, 20 nt, Human
uuuugcuguuguuuuugcgg

SEQ ID NO: 951516 - RNA, 21 nt, Human
aaacucaauauucagaagcuu

SEQ ID NO: 951517 - RNA, 21 nt, Human
aaccugcaaacaauauaaaga

SEQ ID NO: 951518 - RNA, 21 nt, Human
aauaacaaaggaacagagaaa

SEQ ID NO: 951519 - RNA, 23 nt, Human
aauaacaaaggaacagagaaaaa

SEQ ID NO: 951520 - RNA, 22 nt, Human
accuuggcugugggcuggagac

SEQ ID NO: 951521 - RNA, 25 nt, Human
agaaaaauauuaauaacaaaaagaa

SEQ ID NO: 951522 - RNA, 25 nt, Human
agagaaaaauauuaauaacaaaaag

SEQ ID NO: 951523 - RNA, 27 nt, Human
agagaaaaauauuaauaacaaaaagaa

SEQ ID NO: 951524 - RNA, 24 nt, Human
agcagacucaagucaaagguuuua

SEQ ID NO: 951525 - RNA, 26 nt, Human
agcaggaauaugaagaaacccccaga

SEQ ID NO: 951526 - RNA, 25 nt, Human
aggaacagagaaaaauauuaauaac

SEQ ID NO: 951527 - RNA, 19 nt, Human
aggaauaugaagaaacccc

SEQ ID NO: 951528 - RNA, 21 nt, Human
aggaauaugaagaaaccccca

SEQ ID NO: 951529 - RNA, 19 nt, Human
aggcaucaggagaucacug

SEQ ID NO: 951530 - RNA, 20 nt, Human
auaacaaaggaacagagaaa

SEQ ID NO: 951531 - RNA, 22 nt, Human
auacaguuuaccucauuuuuuu

SEQ ID NO: 951532 - RNA, 21 nt, Human
auuucucagcaaacucaauau

SEQ ID NO: 951533 - RNA, 22 nt, Human
caaaccaugcaaguaauaacaa

SEQ ID NO: 951534 - RNA, 30 nt, Human
caacagcaggaauaugaagaaacccccagg

SEQ ID NO: 951535 - RNA, 18 nt, Human
cacgugggaacccgggag

SEQ ID NO: 951536 - RNA, 24 nt, Human
cagcaaacucaauauucagaagcu

SEQ ID NO: 951537 - RNA, 22 nt, Human
caggaauaugaagaaaccccca

SEQ ID NO: 951538 - RNA, 21 nt, Human
caggagaucacugcugguggg

SEQ ID NO: 951539 - RNA, 25 nt, Human
cauuccauaccauaccgcuccacug

SEQ ID NO: 951540 - RNA, 22 nt, Human
ccaaaccaugcaaguaauaaca

SEQ ID NO: 951541 - RNA, 21 nt, Human
ccacucuuccccccacccccc

SEQ ID NO: 951542 - RNA, 27 nt, Human
ccauaccgcuccacuccacaguuuuau

SEQ ID NO: 951543 - RNA, 19 nt, Human
cccaccccccaccacaagu

SEQ ID NO: 951544 - RNA, 24 nt, Human
cccaccccccaccacaaguugucc

SEQ ID NO: 951545 - RNA, 25 nt, Human
cccaccccccaccacaaguugucca

SEQ ID NO: 951546 - RNA, 24 nt, Human
ccccccaccacaaguuguccaggc

SEQ ID NO: 951547 - RNA, 20 nt, Human
ccccccaccccccaccacaa

SEQ ID NO: 951548 - RNA, 22 nt, Human
cccccucccacucuucccccca

SEQ ID NO: 951549 - RNA, 20 nt, Human
cccgggcagcggggccaaga

SEQ ID NO: 951550 - RNA, 19 nt, Human
cccucccgggcagcggggc

SEQ ID NO: 951551 - RNA, 21 nt, Human
ccgcuccacuccacaguuuua

SEQ ID NO: 951552 - RNA, 25 nt, Human
ccucccacucuuccccccacccccc

SEQ ID NO: 951553 - RNA, 19 nt, Human
ccucccgggcagcggggcc

SEQ ID NO: 951554 - RNA, 22 nt, Human
cgcgcccccggcccucccgggc

SEQ ID NO: 951555 - RNA, 24 nt, Human
cucacaauaaaaacuaacuaaaaa

SEQ ID NO: 951556 - RNA, 25 nt, Human
cuggauuuaacucccccucccacuc

SEQ ID NO: 951557 - RNA, 23 nt, Human
cuguucccuccuccgccggaggc

SEQ ID NO: 951558 - RNA, 23 nt, Human
cuuuaccagcagacucaagucaa

SEQ ID NO: 951559 - RNA, 19 nt, Human
gaagggcccggggcgcugc

SEQ ID NO: 951560 - RNA, 24 nt, Human
gagaaaaauauuaauaacaaaaag

SEQ ID NO: 951561 - RNA, 24 nt, Human
gaugcuguuggaguccccgcagcu

SEQ ID NO: 951562 - RNA, 18 nt, Human
ggaguccccgcagcuggu

SEQ ID NO: 951563 - RNA, 20 nt, Human
ggugcugaagggcccggggc

SEQ ID NO: 951564 - RNA, 24 nt, Human
gugcacgccccggcagccgcacgu

SEQ ID NO: 951565 - RNA, 21 nt, Human
uaaaaaaacaaaguacuucac

SEQ ID NO: 951566 - RNA, 21 nt, Human
uaaaccugcaaacaauauaaa

SEQ ID NO: 951567 - RNA, 21 nt, Human
uaacaaaaagaaaaucauuaa

SEQ ID NO: 951568 - RNA, 24 nt, Human
uaacaaaggaacagagaaaaauau

SEQ ID NO: 951569 - RNA, 26 nt, Human
uaacaacauuuucucccugacagcuu

SEQ ID NO: 951570 - RNA, 21 nt, Human
uaacaauacuucauaagacug

SEQ ID NO: 951571 - RNA, 26 nt, Human
uaacucccccucccacucuucccccc

SEQ ID NO: 951572 - RNA, 19 nt, Human
uagagggugcugaagggcc

SEQ ID NO: 951573 - RNA, 25 nt, Human
uauguuuauauuucucuuuuuaaaa

SEQ ID NO: 951574 - RNA, 19 nt, Human
ucacugcuggugggccccu

SEQ ID NO: 951575 - RNA, 18 nt, Human
ucaggagaucacugcugg

SEQ ID NO: 951576 - RNA, 22 nt, Human
uccaggcagagauacauuaagg

SEQ ID NO: 951577 - RNA, 21 nt, Human
ucccacucuuccccccacccc

SEQ ID NO: 951578 - RNA, 19 nt, Human
ucccagacugugcacgccc

SEQ ID NO: 951579 - RNA, 20 nt, Human
ucccagacugugcacgcccc

SEQ ID NO: 951580 - RNA, 22 nt, Human
ucccagcuguucccuccuccgc

SEQ ID NO: 951581 - RNA, 21 nt, Human
uccccccaccccccaccacaa

SEQ ID NO: 951582 - RNA, 23 nt, Human
ucccccucccacucuucccccca

SEQ ID NO: 951583 - RNA, 19 nt, Human
ucucccugacagcuuacau

SEQ ID NO: 951584 - RNA, 23 nt, Human
ucucccugacagcuuacauucca

SEQ ID NO: 951585 - RNA, 20 nt, Human
ugaagaaacccccagaucuu

SEQ ID NO: 951586 - RNA, 23 nt, Human
ugcugaagggcccggggcgcugc

SEQ ID NO: 951587 - RNA, 18 nt, Human
uggcaagcauuucugguc

SEQ ID NO: 951588 - RNA, 20 nt, Human
ugggccccucacuuuaccag

SEQ ID NO: 951589 - RNA, 20 nt, Human
uguuggaguccccgcagcug

SEQ ID NO: 951590 - RNA, 24 nt, Human
uuaacucccccucccacucuuccc

SEQ ID NO: 951591 - RNA, 19 nt, Human
uuccaagucauuccauacc

SEQ ID NO: 951592 - RNA, 19 nt, Human
uuccccccaccccccacca

SEQ ID NO: 951593 - RNA, 22 nt, Human
uucccuccuccgccggaggccg

SEQ ID NO: 951594 - RNA, 26 nt, Human
uuuaaaaagacauuuaauaacaauac

SEQ ID NO: 951595 - RNA, 21 nt, Human
uuucacagcagugcuuuggca

SEQ ID NO: 951596 - RNA, 22 nt, Human
uuuuuuuuuuuuuuuuuuuggc

SEQ ID NO: 951597 - RNA, 28 nt, Human
uuuuuuuuuuuuuuuuuuuuuuuggggg

SEQ ID NO: 951598 - RNA, 22 nt, Human
accagcauggcccaaggagaca

SEQ ID NO: 951599 - RNA, 20 nt, Human
cagaccagcauggcccaagg

SEQ ID NO: 951600 - RNA, 18 nt, Human
ucagaccagcauggccca

SEQ ID NO: 951601 - RNA, 19 nt, Human
uggcccaaggagacaguac

SEQ ID NO: 951602 - RNA, 22 nt, Human
uuauauacguugccccucgucc

SEQ ID NO: 951603 - RNA, 22 nt, Human
uuuuuuuuuuuuuugccaguaa

SEQ ID NO: 951604 - RNA, 18 nt, Human
uuuuuuuuuuuuuuuuug

SEQ ID NO: 951605 - RNA, 23 nt, Human
uuuuuuuuuuuuuuuuugccagu

SEQ ID NO: 951606 - RNA, 28 nt, Human
caaaugauccuuuauugaaauguuuucc

SEQ ID NO: 951607 - RNA, 19 nt, Human
gaaguugcaccuuggccuc

SEQ ID NO: 951608 - RNA, 25 nt, Human
aaagaaaaaacacaaguccacucug

SEQ ID NO: 951609 - RNA, 22 nt, Human
aaagcauuauccagggcuugga

SEQ ID NO: 951610 - RNA, 18 nt, Human
aaagugcugggauuacag

SEQ ID NO: 951611 - RNA, 24 nt, Human
aaagugcugggauuacagcuguga

SEQ ID NO: 951612 - RNA, 20 nt, Human
aacagugcuucaacacagaa

SEQ ID NO: 951613 - RNA, 20 nt, Human
aacagugcuucaacacagaa

SEQ ID NO: 951614 - RNA, 20 nt, Human
aagaagaaggggcccaucca

SEQ ID NO: 951615 - RNA, 24 nt, Human
acaccacguggagacccagcauga

SEQ ID NO: 951616 - RNA, 24 nt, Human
acaccacguggagacccagcauga

SEQ ID NO: 951617 - RNA, 19 nt, Human
agaaaaccguuuuacauca

SEQ ID NO: 951618 - RNA, 20 nt, Human
agccaaccucaaagugcugg

SEQ ID NO: 951619 - RNA, 19 nt, Human
aggggagcgagugagaggc

SEQ ID NO: 951620 - RNA, 24 nt, Human
agugcugggauuacagcugugagc

SEQ ID NO: 951621 - RNA, 19 nt, Human
auccagggcuuggacuguc

SEQ ID NO: 951622 - RNA, 24 nt, Human
auccuguucugcggcuuccuuggc

SEQ ID NO: 951623 - RNA, 23 nt, Human
auuauccagggcuuggacugucu

SEQ ID NO: 951624 - RNA, 23 nt, Human
auuauccagggcuuggacugucu

SEQ ID NO: 951625 - RNA, 19 nt, Human
caaagugcugggauuacag

SEQ ID NO: 951626 - RNA, 24 nt, Human
caaagugcugggauuacagcugug

SEQ ID NO: 951627 - RNA, 21 nt, Human
caacagugcuucaacacagaa

SEQ ID NO: 951628 - RNA, 19 nt, Human
cacccccccgggccuccgc

SEQ ID NO: 951629 - RNA, 19 nt, Human
cacuaaccaaacaaccaac

SEQ ID NO: 951630 - RNA, 19 nt, Human
cacuaaccaaacaaccaac

SEQ ID NO: 951631 - RNA, 24 nt, Human
cagccaaccucaaagugcugggau

SEQ ID NO: 951632 - RNA, 19 nt, Human
cagcugugagcaccagccc

SEQ ID NO: 951633 - RNA, 20 nt, Human
caucccaggcccaguuguuc

SEQ ID NO: 951634 - RNA, 20 nt, Human
caucccaggcccaguuguuc

SEQ ID NO: 951635 - RNA, 18 nt, Human
cauguuggccaggcuggu

SEQ ID NO: 951636 - RNA, 20 nt, Human
cauguuggccaggcuggucu

SEQ ID NO: 951637 - RNA, 24 nt, Human
cauguuggccaggcuggucuugaa

SEQ ID NO: 951638 - RNA, 19 nt, Human
ccagggcuuggacugucuu

SEQ ID NO: 951639 - RNA, 19 nt, Human
ccagggcuuggacugucuu

SEQ ID NO: 951640 - RNA, 19 nt, Human
cccaaauccccuggcagga

SEQ ID NO: 951641 - RNA, 19 nt, Human
cccaaauccccuggcagga

SEQ ID NO: 951642 - RNA, 18 nt, Human
cccccgggccuccgcccc

SEQ ID NO: 951643 - RNA, 21 nt, Human
cccccgggccuccgccccgaa

SEQ ID NO: 951644 - RNA, 23 nt, Human
ccccgggccuccgccccgaaccc

SEQ ID NO: 951645 - RNA, 24 nt, Human
ccccgggccuccgccccgaacccu

SEQ ID NO: 951646 - RNA, 25 nt, Human
ccgauggcgcuggaugaugcccaaa

SEQ ID NO: 951647 - RNA, 21 nt, Human
ccgccccgaacccuccagacu

SEQ ID NO: 951648 - RNA, 22 nt, Human
ccucaaagugcugggauuacag

SEQ ID NO: 951649 - RNA, 22 nt, Human
cgaacgcugucugcgaagaaga

SEQ ID NO: 951650 - RNA, 22 nt, Human
cgccccgaacccuccagacugg

SEQ ID NO: 951651 - RNA, 22 nt, Human
cgcgcacccccccgggccuccg

SEQ ID NO: 951652 - RNA, 24 nt, Human
cggaccccgggcgcgcgcaccccc

SEQ ID NO: 951653 - RNA, 19 nt, Human
cggucagcuggguggccag

SEQ ID NO: 951654 - RNA, 25 nt, Human
cguuuuacaucagucacuaaccaaa

SEQ ID NO: 951655 - RNA, 25 nt, Human
cguuuuacaucagucacuaaccaaa

SEQ ID NO: 951656 - RNA, 19 nt, Human
cugccgacugauuccaagu

SEQ ID NO: 951657 - RNA, 19 nt, Human
cugccgacugauuccaagu

SEQ ID NO: 951658 - RNA, 21 nt, Human
cugugagcaccagcccaaccu

SEQ ID NO: 951659 - RNA, 25 nt, Human
cuuggacugucuuucaagaaagccc

SEQ ID NO: 951660 - RNA, 25 nt, Human
cuuggacugucuuucaagaaagccc

SEQ ID NO: 951661 - RNA, 20 nt, Human
gaaacacaccacguggagac

SEQ ID NO: 951662 - RNA, 20 nt, Human
gaaacacaccacguggagac

SEQ ID NO: 951663 - RNA, 19 nt, Human
gaagagccgggcguuggca

SEQ ID NO: 951664 - RNA, 24 nt, Human
gacauguuggccaggcuggucuug

SEQ ID NO: 951665 - RNA, 18 nt, Human
gacgagaggggagcgagu

SEQ ID NO: 951666 - RNA, 21 nt, Human
gauuacagcugugagcaccag

SEQ ID NO: 951667 - RNA, 21 nt, Human
gcccaaccuugccucuuuaaa

SEQ ID NO: 951668 - RNA, 21 nt, Human
gcccaguuguucccacgaaac

SEQ ID NO: 951669 - RNA, 21 nt, Human
gcccaguuguucccacgaaac

SEQ ID NO: 951670 - RNA, 24 nt, Human
gccucuguaaccuccccacaagaa

SEQ ID NO: 951671 - RNA, 24 nt, Human
gccucuguaaccuccccacaagaa

SEQ ID NO: 951672 - RNA, 20 nt, Human
gcgccuagagcccgggcagc

SEQ ID NO: 951673 - RNA, 22 nt, Human
ggauuacagcugugagcaccag

SEQ ID NO: 951674 - RNA, 18 nt, Human
ggcccugcggcugcggac

SEQ ID NO: 951675 - RNA, 18 nt, Human
ggcuggucuugaacuccc

SEQ ID NO: 951676 - RNA, 19 nt, Human
gggccuccgccccgaaccc

SEQ ID NO: 951677 - RNA, 22 nt, Human
gggccuccgccccgaacccucc

SEQ ID NO: 951678 - RNA, 18 nt, Human
gggcgcgcgcaccccccc

SEQ ID NO: 951679 - RNA, 18 nt, Human
guaaagcauuauccaggg

SEQ ID NO: 951680 - RNA, 18 nt, Human
guaaagcauuauccaggg

SEQ ID NO: 951681 - RNA, 24 nt, Human
guaaagcauuauccagggcuugga

SEQ ID NO: 951682 - RNA, 23 nt, Human
gugagcaccagcccaaccuugcc

SEQ ID NO: 951683 - RNA, 19 nt, Human
guucccacgaaacacacca

SEQ ID NO: 951684 - RNA, 19 nt, Human
guucccacgaaacacacca

SEQ ID NO: 951685 - RNA, 18 nt, Human
uaaccaaacaaccaacag

SEQ ID NO: 951686 - RNA, 18 nt, Human
uaaccaaacaaccaacag

SEQ ID NO: 951687 - RNA, 22 nt, Human
uacagcugugagcaccagccca

SEQ ID NO: 951688 - RNA, 25 nt, Human
uacggcccugcggcuccugcgcagg

SEQ ID NO: 951689 - RNA, 25 nt, Human
uacggcccugcggcuccugcgcagg

SEQ ID NO: 951690 - RNA, 24 nt, Human
ucaaagugcugggauuacagcugu

SEQ ID NO: 951691 - RNA, 19 nt, Human
ucaacacagaaaguaaagc

SEQ ID NO: 951692 - RNA, 19 nt, Human
ucaacacagaaaguaaagc

SEQ ID NO: 951693 - RNA, 19 nt, Human
ucaagaaagccccaaaucc

SEQ ID NO: 951694 - RNA, 24 nt, Human
ucagugaugacucgagcuuucucc

SEQ ID NO: 951695 - RNA, 23 nt, Human
ucccgcguuggcugaagcgccag

SEQ ID NO: 951696 - RNA, 18 nt, Human
uccuguucugcggcuucc

SEQ ID NO: 951697 - RNA, 23 nt, Human
uccuuggcucuuuuugcccguau

SEQ ID NO: 951698 - RNA, 19 nt, Human
ucugcggcuuccuuggcuc

SEQ ID NO: 951699 - RNA, 24 nt, Human
ucugcggcuuccuuggcucuuuuu

SEQ ID NO: 951700 - RNA, 22 nt, Human
ucuuccucagugaugacucgag

SEQ ID NO: 951701 - RNA, 22 nt, Human
ucuugaacucccagccaaccuc

SEQ ID NO: 951702 - RNA, 24 nt, Human
ugacauguuggccaggcuggucuu

SEQ ID NO: 951703 - RNA, 19 nt, Human
ugaccgguccggucagcug

SEQ ID NO: 951704 - RNA, 19 nt, Human
ugacucgagcuuucuccuu

SEQ ID NO: 951705 - RNA, 22 nt, Human
ugagcaccagcccaaccuugcc

SEQ ID NO: 951706 - RNA, 18 nt, Human
ugauuccaaguccccagg

SEQ ID NO: 951707 - RNA, 24 nt, Human
uggacugucuuucaagaaagcccc

SEQ ID NO: 951708 - RNA, 24 nt, Human
uggacugucuuucaagaaagcccc

SEQ ID NO: 951709 - RNA, 23 nt, Human
uggccaggcuggucuugaacucc

SEQ ID NO: 951710 - RNA, 18 nt, Human
ugggauuacagcugugag

SEQ ID NO: 951711 - RNA, 21 nt, Human
ugggauuacagcugugagcac

SEQ ID NO: 951712 - RNA, 23 nt, Human
ugggauuacagcugugagcacca

SEQ ID NO: 951713 - RNA, 25 nt, Human
uuuaaaaagaaaaaacacaagucca

SEQ ID NO: 951714 - RNA, 22 nt, Human
uuucaagaaagccccaaauccc

SEQ ID NO: 951715 - RNA, 25 nt, Human
uuuuuuuuuuuuuuuuuuuucaugg

SEQ ID NO: 951716 - RNA, 20 nt, Human
aagacccuuuccuugcuccc

SEQ ID NO: 951717 - RNA, 25 nt, Human
acugguugcucuuccuauuggucau

SEQ ID NO: 951718 - RNA, 19 nt, Human
caaaauacaggugaggagc

SEQ ID NO: 951719 - RNA, 20 nt, Human
caaaauacaggugaggagca

SEQ ID NO: 951720 - RNA, 21 nt, Human
cacaauucuccgagugcuuuc

SEQ ID NO: 951721 - RNA, 21 nt, Human
ccccaagugcuugcacauucu

SEQ ID NO: 951722 - RNA, 25 nt, Human
cucauaguaacugguugcucuuccu

SEQ ID NO: 951723 - RNA, 18 nt, Human
cuggacugcugcugcccc

SEQ ID NO: 951724 - RNA, 19 nt, Human
cuggacugcugcugccccu

SEQ ID NO: 951725 - RNA, 23 nt, Human
gcaacaauggaggaagggcaggc

SEQ ID NO: 951726 - RNA, 22 nt, Human
ggagcaugggcgaugccuguaa

SEQ ID NO: 951727 - RNA, 24 nt, Human
ggcaacaauggaggaagggcaggc

SEQ ID NO: 951728 - RNA, 28 nt, Human
ggcaacaauggaggaagggccgguaccc

SEQ ID NO: 951729 - RNA, 21 nt, Human
ggugaggagcaugggcgaugc

SEQ ID NO: 951730 - RNA, 21 nt, Human
uaacugguugcucuuccuauu

SEQ ID NO: 951731 - RNA, 21 nt, Human
uacccuguguacaacagcaag

SEQ ID NO: 951732 - RNA, 21 nt, Human
uagaaauacccuguguacaac

SEQ ID NO: 951733 - RNA, 22 nt, Human
uagaaauacccuguguacaaca

SEQ ID NO: 951734 - RNA, 21 nt, Human
uagggcccuccaaucagucuu

SEQ ID NO: 951735 - RNA, 22 nt, Human
uagggcccuccaaucagucuuc

SEQ ID NO: 951736 - RNA, 19 nt, Human
ucaagcaacuucgggaggc

SEQ ID NO: 951737 - RNA, 19 nt, Human
uccagggcaacaauggagg

SEQ ID NO: 951738 - RNA, 19 nt, Human
ucccagggcugccuguggc

SEQ ID NO: 951739 - RNA, 22 nt, Human
ucccagggcugccuguggcacc

SEQ ID NO: 951740 - RNA, 18 nt, Human
uccuaugucccagggcug

SEQ ID NO: 951741 - RNA, 20 nt, Human
ucggcagccgcuuggaaaag

SEQ ID NO: 951742 - RNA, 18 nt, Human
uggcaccuggacugcugc

SEQ ID NO: 951743 - RNA, 22 nt, Human
uguguacaacagcaagcucaug

SEQ ID NO: 951744 - RNA, 25 nt, Human
uuuuuuuuucuuuaaaagcaauuua

SEQ ID NO: 951745 - RNA, 23 nt, Human
uuuuuuuuuuuuuucuuuaaaag

SEQ ID NO: 951746 - RNA, 25 nt, Human
uuuuuuuuuuuuuuuuuucuuuaaa

SEQ ID NO: 951747 - RNA, 19 nt, Human
aggcgagaaggaagaagac

SEQ ID NO: 951748 - RNA, 18 nt, Human
ccuaacucuagccucaac

SEQ ID NO: 951749 - RNA, 22 nt, Human
ccuaacucuagccucaacaggc

SEQ ID NO: 951750 - RNA, 19 nt, Human
cucuagccucaacaggcuu

SEQ ID NO: 951751 - RNA, 22 nt, Human
uaacucuagccucaacaggcuu

SEQ ID NO: 951752 - RNA, 18 nt, Human
ucaacaggcuuuaaaucc

SEQ ID NO: 951753 - RNA, 23 nt, Human
uuaaauacauuugucaacagguc

SEQ ID NO: 951754 - RNA, 28 nt, Human
uuaaauacauuugucaacaggucaaaaa

SEQ ID NO: 951755 - RNA, 18 nt, Human
uuuuuuuuuuuuuuuuug

SEQ ID NO: 951756 - RNA, 21 nt, Human
aaacaggaaaugaaauguucc

SEQ ID NO: 951757 - RNA, 23 nt, Human
aaacaggaaaugaaauguuccag

SEQ ID NO: 951758 - RNA, 24 nt, Human
aaacaggaaaugaaauguuccaga

SEQ ID NO: 951759 - RNA, 21 nt, Human
aaagaaacacacccuagccuc

SEQ ID NO: 951760 - RNA, 20 nt, Human
acccuagccucaaaaucucc

SEQ ID NO: 951761 - RNA, 24 nt, Human
cacacccuagccucaaaaucuccu

SEQ ID NO: 951762 - RNA, 24 nt, Human
cagaggcacagguaacaaaacagg

SEQ ID NO: 951763 - RNA, 22 nt, Human
cccuccggcuacuagcugccuc

SEQ ID NO: 951764 - RNA, 21 nt, Human
ccuccggcuacuagcugccuc

SEQ ID NO: 951765 - RNA, 18 nt, Human
gaggcacagguaacaaaa

SEQ ID NO: 951766 - RNA, 20 nt, Human
uaacaaaacaggaaaugaaa

SEQ ID NO: 951767 - RNA, 19 nt, Human
uccgaaaaguucgaaagaa

SEQ ID NO: 951768 - RNA, 19 nt, Human
ugaaauguuccagacauuc

SEQ ID NO: 951769 - RNA, 19 nt, Human
ugccucagacccugagugc

SEQ ID NO: 951770 - RNA, 18 nt, Human
accacccgggccuacagc

SEQ ID NO: 951771 - RNA, 20 nt, Human
cgggccuacagcaaaaagga

SEQ ID NO: 951772 - RNA, 19 nt, Human
uacagcaaaaaggaaagaa

SEQ ID NO: 951773 - RNA, 24 nt, Human
uuuuuuuuuuuuuuuuuuuucuuu

SEQ ID NO: 951774 - RNA, 26 nt, Human
uuuuuuuuuuuuuuuuuuuuuucuuu

SEQ ID NO: 951775 - RNA, 23 nt, Human
cagcguccaaguuggaaaggaag

SEQ ID NO: 951776 - RNA, 22 nt, Human
gcaauuuuauaacuuuauuuga

SEQ ID NO: 951777 - RNA, 20 nt, Human
aaacagaaaacgugcacaug

SEQ ID NO: 951778 - RNA, 21 nt, Human
aacagaaaacgugcacaugag

SEQ ID NO: 951779 - RNA, 18 nt, Human
aaggaagaugccagaugg

SEQ ID NO: 951780 - RNA, 23 nt, Human
ccaccuccguaggcagcgccgag

SEQ ID NO: 951781 - RNA, 20 nt, Human
cgagaaggagauggcugcca

SEQ ID NO: 951782 - RNA, 20 nt, Human
gaagaugccagauggcaguu

SEQ ID NO: 951783 - RNA, 23 nt, Human
uccguaggcagcgccgaggaaga

SEQ ID NO: 951784 - RNA, 18 nt, Human
aaacauguaccagauaua

SEQ ID NO: 951785 - RNA, 19 nt, Human
aagcagacgucacuggaug

SEQ ID NO: 951786 - RNA, 22 nt, Human
caacguccccggaagaggaaga

SEQ ID NO: 951787 - RNA, 24 nt, Human
caagcagacgucacuggaugcaaa

SEQ ID NO: 951788 - RNA, 19 nt, Human
cagacaacguccccggaag

SEQ ID NO: 951789 - RNA, 20 nt, Human
cagauauauaucagagcucc

SEQ ID NO: 951790 - RNA, 21 nt, Human
cagcucaaaggacugcuucug

SEQ ID NO: 951791 - RNA, 21 nt, Human
ccugcagacaacguccccgga

SEQ ID NO: 951792 - RNA, 23 nt, Human
cucaagcugaggugagguagcuc

SEQ ID NO: 951793 - RNA, 19 nt, Human
gaaaacaggauuuugcagc

SEQ ID NO: 951794 - RNA, 18 nt, Human
gaugcaaaacuggaaaga

SEQ ID NO: 951795 - RNA, 18 nt, Human
gugccugcagacaacguc

SEQ ID NO: 951796 - RNA, 18 nt, Human
ucaagaugccaagcagac

SEQ ID NO: 951797 - RNA, 20 nt, Human
uccccggaagaggaagaaaa

SEQ ID NO: 951798 - RNA, 21 nt, Human
ucucucaagcugaggugaggu

SEQ ID NO: 951799 - RNA, 23 nt, Human
ucucugggggaaaacaggauuuu

SEQ ID NO: 951800 - RNA, 20 nt, Human
ucugagugccccuacaccag

SEQ ID NO: 951801 - RNA, 21 nt, Human
ugagagcucuaggcuuccuca

SEQ ID NO: 951802 - RNA, 21 nt, Human
ugagugccccuacaccagcuc

SEQ ID NO: 951803 - RNA, 22 nt, Human
ugagugccccuacaccagcuca

SEQ ID NO: 951804 - RNA, 20 nt, Human
ugccugcagacaacgucccc

SEQ ID NO: 951805 - RNA, 21 nt, Human
uggacagcgucuuuucauuuu

SEQ ID NO: 951806 - RNA, 22 nt, Human
aagccgccaacgccgccgcccg

SEQ ID NO: 951807 - RNA, 19 nt, Human
ccagcugugcuuuauugac

SEQ ID NO: 951808 - RNA, 22 nt, Human
aagcuguucuuuauuucaggga

SEQ ID NO: 951809 - RNA, 18 nt, Human
agaggacccgggaguccg

SEQ ID NO: 951810 - RNA, 19 nt, Human
agcgacggggagaaggggc

SEQ ID NO: 951811 - RNA, 29 nt, Human
cacaaccaaccauccuccaaccugcacag

SEQ ID NO: 951812 - RNA, 20 nt, Human
cagggagagggcaggggagg

SEQ ID NO: 951813 - RNA, 21 nt, Human
ccacaaccaaccauccuccaa

SEQ ID NO: 951814 - RNA, 23 nt, Human
cccagagccccgcgucccggcuc

SEQ ID NO: 951815 - RNA, 21 nt, Human
ccuccaaccugcacagaggac

SEQ ID NO: 951816 - RNA, 24 nt, Human
ccuccaaccugcacagaggacccg

SEQ ID NO: 951817 - RNA, 25 nt, Human
cgaggcccagagccccgcgucccgg

SEQ ID NO: 951818 - RNA, 19 nt, Human
cggggagaaggggcggagg

SEQ ID NO: 951819 - RNA, 23 nt, Human
gccacaaccaaccauccuccaac

SEQ ID NO: 951820 - RNA, 18 nt, Human
gcccagagccccgcgucc

SEQ ID NO: 951821 - RNA, 21 nt, Human
gccucgcucgccacaaccaac

SEQ ID NO: 951822 - RNA, 22 nt, Human
ggacccgggaguccggauggcg

SEQ ID NO: 951823 - RNA, 18 nt, Human
ggagagggcaggggaggg

SEQ ID NO: 951824 - RNA, 18 nt, Human
gggagagggcaggggagg

SEQ ID NO: 951825 - RNA, 22 nt, Human
ucagccucgcucgccacaacca

SEQ ID NO: 951826 - RNA, 22 nt, Human
ugcacagaggacccgggagucc

SEQ ID NO: 951827 - RNA, 21 nt, Human
ugucaagcuguucuuuauuuc

SEQ ID NO: 951828 - RNA, 23 nt, Human
uuuuuuuuuuuuuuuuuuccugu

SEQ ID NO: 951829 - RNA, 27 nt, Human
uuuuuuuuuuuuuuuuuuuuccugggg

SEQ ID NO: 951830 - RNA, 24 nt, Human
uuuuuuuuuuuuuuuuuuuuuccu

SEQ ID NO: 951831 - RNA, 21 nt, Human
auaggccagugaugucucaaa

SEQ ID NO: 951832 - RNA, 19 nt, Human
ccuagguccgagcccagaa

SEQ ID NO: 951833 - RNA, 20 nt, Human
cgaccuagguccgagcccag

SEQ ID NO: 951834 - RNA, 18 nt, Human
uuuuuuuuuuuuuuuuug

SEQ ID NO: 951835 - RNA, 20 nt, Human
uuuuuuuuuuuuuuuuuguu

SEQ ID NO: 951836 - RNA, 19 nt, Human
aacacaccacgauggcgga

SEQ ID NO: 951837 - RNA, 19 nt, Human
aacacgucgaaaucuccag

SEQ ID NO: 951838 - RNA, 20 nt, Human
acugaauccagccaaccaac

SEQ ID NO: 951839 - RNA, 18 nt, Human
agaaaggaagaggaggga

SEQ ID NO: 951840 - RNA, 22 nt, Human
agacagcauaaauaugugugcc

SEQ ID NO: 951841 - RNA, 20 nt, Human
aggaagaggagggaagcugg

SEQ ID NO: 951842 - RNA, 21 nt, Human
ccagauaguggugacauuuuc

SEQ ID NO: 951843 - RNA, 19 nt, Human
cgauggcggagaaaggaag

SEQ ID NO: 951844 - RNA, 21 nt, Human
cugaauccagccaaccaacgu

SEQ ID NO: 951845 - RNA, 25 nt, Human
gcggagaaaggaagaggagggaagc

SEQ ID NO: 951846 - RNA, 19 nt, Human
ggagaaaggaagaggaggg

SEQ ID NO: 951847 - RNA, 24 nt, Human
ggcgagcagcggagucaagaacac

SEQ ID NO: 951848 - RNA, 20 nt, Human
ugugugccaucucaugugca

SEQ ID NO: 951849 - RNA, 20 nt, Human
aaacagaaaaaaauauuccc

SEQ ID NO: 951850 - RNA, 21 nt, Human
acagagcauacagaaaaacag

SEQ ID NO: 951851 - RNA, 19 nt, Human
acagagucaaccacacacc

SEQ ID NO: 951852 - RNA, 26 nt, Human
acccgcuccgucguccugacgccccc

SEQ ID NO: 951853 - RNA, 20 nt, Human
agcacagagcauacagaaaa

SEQ ID NO: 951854 - RNA, 23 nt, Human
auacagaaaaacagaaaaaaaua

SEQ ID NO: 951855 - RNA, 18 nt, Human
caaccacacaccacuuuu

SEQ ID NO: 951856 - RNA, 27 nt, Human
cagagcauacagaaaaacagaaaaaaa

SEQ ID NO: 951857 - RNA, 21 nt, Human
cauacagaaaaacagaaaaaa

SEQ ID NO: 951858 - RNA, 21 nt, Human
ccagguaguggugacauuuuc

SEQ ID NO: 951859 - RNA, 26 nt, Human
cccgcuccgucguccugacgcccccg

SEQ ID NO: 951860 - RNA, 19 nt, Human
cccggccuagcugcagcca

SEQ ID NO: 951861 - RNA, 19 nt, Human
ccucaggucugcgugucac

SEQ ID NO: 951862 - RNA, 21 nt, Human
cgagaaacagagucaaccaca

SEQ ID NO: 951863 - RNA, 23 nt, Human
cugaauccacccuacuagcacug

SEQ ID NO: 951864 - RNA, 22 nt, Human
gagcauacagaaaaacagaaaa

SEQ ID NO: 951865 - RNA, 24 nt, Human
gcccuggccucugcuuuuuuccca

SEQ ID NO: 951866 - RNA, 26 nt, Human
ggccuggggcgcgggcggaaaaggcc

SEQ ID NO: 951867 - RNA, 23 nt, Human
gggccuggggcgcgggcggaaaa

SEQ ID NO: 951868 - RNA, 18 nt, Human
uacagcauaaauaugugu

SEQ ID NO: 951869 - RNA, 23 nt, Human
ugaauccacccuacuagcacaga

SEQ ID NO: 951870 - RNA, 20 nt, Human
ugugcaacuguccagguagu

SEQ ID NO: 951871 - RNA, 20 nt, Human
ugugugccaucucaugugca

SEQ ID NO: 951872 - RNA, 24 nt, Human
uuacugaauccacccuacuagcac

SEQ ID NO: 951873 - RNA, 20 nt, Human
uugucgcaggggccuuggug

SEQ ID NO: 951874 - RNA, 28 nt, Human
uuuuuuuuuuuuuuuuuuuuuuuggggg

SEQ ID NO: 951875 - RNA, 22 nt, Human
aaacauaaaacuccggucuccc

SEQ ID NO: 951876 - RNA, 26 nt, Human
cagcgcucugagaccucgcaggaaga

SEQ ID NO: 951877 - RNA, 21 nt, Human
ccagcucugugugaauuacuc

SEQ ID NO: 951878 - RNA, 19 nt, Human
cccugaaggucaggaaggg

SEQ ID NO: 951879 - RNA, 22 nt, Human
uuuuuuuuuuuuuuuugcucaa

SEQ ID NO: 951880 - RNA, 18 nt, Human
uuuuuuuuuuuuuuuuug

SEQ ID NO: 951881 - RNA, 20 nt, Human
uuuuuuuuuuuuuuuuugcu

SEQ ID NO: 951882 - RNA, 19 nt, Human
aaacagcggaagaggugau

SEQ ID NO: 951883 - RNA, 20 nt, Human
aacuuguaccagcaucccca

SEQ ID NO: 951884 - RNA, 24 nt, Human
augagcaaggugggucucagaggu

SEQ ID NO: 951885 - RNA, 23 nt, Human
caaauaaacacagaaauagucca

SEQ ID NO: 951886 - RNA, 26 nt, Human
cagcgucuggcauuccauguuucugc

SEQ ID NO: 951887 - RNA, 22 nt, Human
cgcagagguuuccaaaaaaaug

SEQ ID NO: 951888 - RNA, 19 nt, Human
gacaguagcaugcaguccc

SEQ ID NO: 951889 - RNA, 21 nt, Human
gaggaccaacaugggcauuuu

SEQ ID NO: 951890 - RNA, 23 nt, Human
uaccagcauccccagcgucuggc

SEQ ID NO: 951891 - RNA, 21 nt, Human
uagcaugcagucccacaacuu

SEQ ID NO: 951892 - RNA, 20 nt, Human
ugagacaagcucuagacagu

SEQ ID NO: 951893 - RNA, 19 nt, Human
ugucacagguccagggcag

SEQ ID NO: 951894 - RNA, 19 nt, Human
uuccaaaaaaauggcgcua

SEQ ID NO: 951895 - RNA, 22 nt, Human
aaaaaacaaaggggcaggagga

SEQ ID NO: 951896 - RNA, 22 nt, Human
aaaaaacaaaggggcaggagga

SEQ ID NO: 951897 - RNA, 23 nt, Human
aaaaaacaucuuauaauugcaga

SEQ ID NO: 951898 - RNA, 20 nt, Human
aaaaagcaaaaaacaaaggg

SEQ ID NO: 951899 - RNA, 20 nt, Human
aaaaagcaaaaaacaaaggg

SEQ ID NO: 951900 - RNA, 22 nt, Human
aaaaagcaaaaaacaaaggggc

SEQ ID NO: 951901 - RNA, 22 nt, Human
aaaaagcaaaaaacaaaggggc

SEQ ID NO: 951902 - RNA, 24 nt, Human
aaaacaaaaacucaacagcaacca

SEQ ID NO: 951903 - RNA, 21 nt, Human
aaaagcuauuuuaauagacac

SEQ ID NO: 951904 - RNA, 24 nt, Human
aaaauguugggauuaguggcguga

SEQ ID NO: 951905 - RNA, 20 nt, Human
aaaauuacauuacagcuugc

SEQ ID NO: 951906 - RNA, 20 nt, Human
aaaauuacauuacagcuugc

SEQ ID NO: 951907 - RNA, 21 nt, Human
aaacaaaaacucaacagcaac

SEQ ID NO: 951908 - RNA, 21 nt, Human
aaacaaaaacucaacagcaac

SEQ ID NO: 951909 - RNA, 23 nt, Human
aaacaaaaacucaacagcaacca

SEQ ID NO: 951910 - RNA, 26 nt, Human
aaacaaaaacucaacagcaaccaaaa

SEQ ID NO: 951911 - RNA, 26 nt, Human
aaacaaaaacucaacagcaaccaaaa

SEQ ID NO: 951912 - RNA, 21 nt, Human
aaacaucuuauaauugcagaa

SEQ ID NO: 951913 - RNA, 19 nt, Human
aaacggcaauccaucguca

SEQ ID NO: 951914 - RNA, 22 nt, Human
aaagaucuguuguacaacaugg

SEQ ID NO: 951915 - RNA, 22 nt, Human
aaagaucuguuguacaacaugg

SEQ ID NO: 951916 - RNA, 22 nt, Human
aaagcugguaaaaaacacugua

SEQ ID NO: 951917 - RNA, 22 nt, Human
aaagcugguaaaaaacacugua

SEQ ID NO: 951918 - RNA, 21 nt, Human
aaaggaagccccaggacucug

SEQ ID NO: 951919 - RNA, 24 nt, Human
aaaguguugggauuauggguguga

SEQ ID NO: 951920 - RNA, 22 nt, Human
aacaaaaacucaacagcaacca

SEQ ID NO: 951921 - RNA, 22 nt, Human
aacaaaaacucaacagcaacca

SEQ ID NO: 951922 - RNA, 23 nt, Human
aacaaaaacucaacagcaaccaa

SEQ ID NO: 951923 - RNA, 23 nt, Human
aacaaaaacucaacagcaaccaa

SEQ ID NO: 951924 - RNA, 23 nt, Human
aacacaaaguccagaaucuugua

SEQ ID NO: 951925 - RNA, 24 nt, Human
aacauaaaagcagaaaaaagccaa

SEQ ID NO: 951926 - RNA, 21 nt, Human
aaccaaaaagcaaaaaacaaa

SEQ ID NO: 951927 - RNA, 26 nt, Human
aaccaaaaagcaaaaaacaaaggggc

SEQ ID NO: 951928 - RNA, 26 nt, Human
aaccaaaaagcaaaaaacaaaggggc

SEQ ID NO: 951929 - RNA, 18 nt, Human
aagaguuccuggugugug

SEQ ID NO: 951930 - RNA, 25 nt, Human
aagcaauccucccaccucagccucc

SEQ ID NO: 951931 - RNA, 25 nt, Human
aagcagaaaaaagccaaguaugggg

SEQ ID NO: 951932 - RNA, 21 nt, Human
aaggaacaauccuggguacag

SEQ ID NO: 951933 - RNA, 18 nt, Human
aaggagacuugucaccgu

SEQ ID NO: 951934 - RNA, 18 nt, Human
aaggagacuugucaccgu

SEQ ID NO: 951935 - RNA, 22 nt, Human
aaguagcugggacuacaggggu

SEQ ID NO: 951936 - RNA, 24 nt, Human
aaguagcugggacuacaggggugu

SEQ ID NO: 951937 - RNA, 26 nt, Human
aaguagcugggacuacaggggugugc

SEQ ID NO: 951938 - RNA, 19 nt, Human
aauauugcaugaucccacu

SEQ ID NO: 951939 - RNA, 19 nt, Human
aauauugcaugaucccacu

SEQ ID NO: 951940 - RNA, 20 nt, Human
acaaaacaaaaacucaacag

SEQ ID NO: 951941 - RNA, 19 nt, Human
acaagaaagaaaacauaag

SEQ ID NO: 951942 - RNA, 21 nt, Human
acagcaacgauggcauugguc

SEQ ID NO: 951943 - RNA, 19 nt, Human
acccaggcuggagugcagu

SEQ ID NO: 951944 - RNA, 21 nt, Human
acccggugugaggacuuccug

SEQ ID NO: 951945 - RNA, 23 nt, Human
accucagccuccugaguagcugg

SEQ ID NO: 951946 - RNA, 22 nt, Human
accucagccucucaaauagcag

SEQ ID NO: 951947 - RNA, 22 nt, Human
accucagccucucaaauagcag

SEQ ID NO: 951948 - RNA, 19 nt, Human
acggcaauccaucgucauc

SEQ ID NO: 951949 - RNA, 18 nt, Human
acugcagccucgaccucu

SEQ ID NO: 951950 - RNA, 21 nt, Human
acuguacacaagaaagaaaac

SEQ ID NO: 951951 - RNA, 21 nt, Human
acuguacacaagaaagaaaac

SEQ ID NO: 951952 - RNA, 23 nt, Human
acuugaauuccuggguucaagca

SEQ ID NO: 951953 - RNA, 25 nt, Human
agaaaaaaguuauaauggccaaaga

SEQ ID NO: 951954 - RNA, 26 nt, Human
agaaaaaaguuauaauggccaaagaa

SEQ ID NO: 951955 - RNA, 18 nt, Human
agaaagaaaacauaagug

SEQ ID NO: 951956 - RNA, 21 nt, Human
agaaagaaaacauaaguggca

SEQ ID NO: 951957 - RNA, 20 nt, Human
agaauggaacaacuuaaaua

SEQ ID NO: 951958 - RNA, 23 nt, Human
agcaaccaaaaagcaaaaaacaa

SEQ ID NO: 951959 - RNA, 23 nt, Human
agcaaccaaaaagcaaaaaacaa

SEQ ID NO: 951960 - RNA, 20 nt, Human
agcacuuucggaggccgagg

SEQ ID NO: 951961 - RNA, 24 nt, Human
agcacuuucggaggccgagguggg

SEQ ID NO: 951962 - RNA, 24 nt, Human
agcacuuucggaggccgagguggg

SEQ ID NO: 951963 - RNA, 21 nt, Human
agccacaacacaaaguccaga

SEQ ID NO: 951964 - RNA, 19 nt, Human
agccacugcgcccauccug

SEQ ID NO: 951965 - RNA, 23 nt, Human
agccagucacaggacaaauauug

SEQ ID NO: 951966 - RNA, 23 nt, Human
agccagucacaggacaaauauug

SEQ ID NO: 951967 - RNA, 21 nt, Human
agcuugucagccacaacacaa

SEQ ID NO: 951968 - RNA, 19 nt, Human
aggaagccccaggacucug

SEQ ID NO: 951969 - RNA, 25 nt, Human
aggaauucuuuucucucucaacacc

SEQ ID NO: 951970 - RNA, 24 nt, Human
aggcacaguggcucacaccuguaa

SEQ ID NO: 951971 - RNA, 24 nt, Human
aggcacaguggcucacaccuguaa

SEQ ID NO: 951972 - RNA, 21 nt, Human
aggccgagguggguggaucac

SEQ ID NO: 951973 - RNA, 21 nt, Human
aggccgagguggguggaucac

SEQ ID NO: 951974 - RNA, 25 nt, Human
aggcuggagugcaguggcacaaucu

SEQ ID NO: 951975 - RNA, 23 nt, Human
agguggguggaucacuugagguc

SEQ ID NO: 951976 - RNA, 23 nt, Human
agguggguggaucacuugagguc

SEQ ID NO: 951977 - RNA, 21 nt, Human
aggugguucaucaggccacag

SEQ ID NO: 951978 - RNA, 19 nt, Human
agguuugaugccaaacacc

SEQ ID NO: 951979 - RNA, 23 nt, Human
aguagcuggaacuacaggcaugu

SEQ ID NO: 951980 - RNA, 20 nt, Human
agugcaguggcacaaucuug

SEQ ID NO: 951981 - RNA, 24 nt, Human
agugcaguggcacaaucuuggcuc

SEQ ID NO: 951982 - RNA, 24 nt, Human
aguggcucacaccuguaauccuag

SEQ ID NO: 951983 - RNA, 24 nt, Human
aguggcucacaccuguaauccuag

SEQ ID NO: 951984 - RNA, 20 nt, Human
agugugguggcacaaucuug

SEQ ID NO: 951985 - RNA, 24 nt, Human
agugugguggcacaaucuuggcuc

SEQ ID NO: 951986 - RNA, 24 nt, Human
aguguugggauuaugggugugagc

SEQ ID NO: 951987 - RNA, 20 nt, Human
auaauggccaaagaauggaa

SEQ ID NO: 951988 - RNA, 20 nt, Human
auaauggccaaagaauggaa

SEQ ID NO: 951989 - RNA, 19 nt, Human
aucacuugaggucaggguc

SEQ ID NO: 951990 - RNA, 22 nt, Human
aucuuauuucacuaugcuaagu

SEQ ID NO: 951991 - RNA, 22 nt, Human
aucuuauuucacuaugcuaagu

SEQ ID NO: 951992 - RNA, 20 nt, Human
augcacucuccuuuggcuaa

SEQ ID NO: 951993 - RNA, 23 nt, Human
augggcaaagccucguucccaag

SEQ ID NO: 951994 - RNA, 23 nt, Human
augugccaccacaccaggcuaau

SEQ ID NO: 951995 - RNA, 25 nt, Human
caaaaagcaaaaaacaaaggggcag

SEQ ID NO: 951996 - RNA, 23 nt, Human
caaaacaaaaacucaacagcaac

SEQ ID NO: 951997 - RNA, 23 nt, Human
caaaacaaaaacucaacagcaac

SEQ ID NO: 951998 - RNA, 27 nt, Human
caaaacaaaaacucaacagcaaccaaa

SEQ ID NO: 951999 - RNA, 27 nt, Human
caaaacaaaaacucaacagcaaccaaa

SEQ ID NO: 952000 - RNA, 23 nt, Human
caaagaauggaacaacuuaaaua

SEQ ID NO: 952001 - RNA, 19 nt, Human
caaaguccagaaucuugua

SEQ ID NO: 952002 - RNA, 24 nt, Human
caaaguguugggauuaugggugug

SEQ ID NO: 952003 - RNA, 20 nt, Human
caaaugauccucccaccuca

SEQ ID NO: 952004 - RNA, 22 nt, Human
caacagcaaccaaaaagcaaaa

SEQ ID NO: 952005 - RNA, 22 nt, Human
caacagcaaccaaaaagcaaaa

SEQ ID NO: 952006 - RNA, 28 nt, Human
caacagcaaccaaaaagcaaaaaacaaa

SEQ ID NO: 952007 - RNA, 21 nt, Human
caacgauggcauuggucccaa

SEQ ID NO: 952008 - RNA, 27 nt, Human
caagcaauccucccaccucagccuccc

SEQ ID NO: 952009 - RNA, 19 nt, Human
cacaacacaaaguccagaa

SEQ ID NO: 952010 - RNA, 21 nt, Human
cacaagugauugcuccugccu

SEQ ID NO: 952011 - RNA, 23 nt, Human
cacaccuguaauccuagcacuuu

SEQ ID NO: 952012 - RNA, 23 nt, Human
cacaccuguaauccuagcacuuu

SEQ ID NO: 952013 - RNA, 22 nt, Human
caccaugccuggcuuccaaaau

SEQ ID NO: 952014 - RNA, 22 nt, Human
caccaugccuggcuuccaaaau

SEQ ID NO: 952015 - RNA, 24 nt, Human
caccaugccuggcuuccaaaaugg

SEQ ID NO: 952016 - RNA, 24 nt, Human
caccaugccuggcuuccaaaaugg

SEQ ID NO: 952017 - RNA, 22 nt, Human
caccggaggccaggcacagugg

SEQ ID NO: 952018 - RNA, 22 nt, Human
caccggaggccaggcacagugg

SEQ ID NO: 952019 - RNA, 24 nt, Human
caccucagccucccaaguagcugg

SEQ ID NO: 952020 - RNA, 18 nt, Human
caccuguaauccuagcac

SEQ ID NO: 952021 - RNA, 18 nt, Human
caccuguaauccuagcac

SEQ ID NO: 952022 - RNA, 23 nt, Human
caccuguaauccuagcacuuucg

SEQ ID NO: 952023 - RNA, 24 nt, Human
caccuguaauccuagcacuuucgg

SEQ ID NO: 952024 - RNA, 21 nt, Human
caccuuaaaaugacgaagaga

SEQ ID NO: 952025 - RNA, 24 nt, Human
cacucuacacacugcuaugaaagc

SEQ ID NO: 952026 - RNA, 24 nt, Human
cacucuacacacugcuaugaaagc

SEQ ID NO: 952027 - RNA, 18 nt, Human
cacugcagccucgaccuc

SEQ ID NO: 952028 - RNA, 22 nt, Human
cacugccugcugagagcagggu

SEQ ID NO: 952029 - RNA, 22 nt, Human
cacugccugcugagagcagggu

SEQ ID NO: 952030 - RNA, 18 nt, Human
cacugcuaugaaagcaga

SEQ ID NO: 952031 - RNA, 18 nt, Human
cacugcuaugaaagcaga

SEQ ID NO: 952032 - RNA, 20 nt, Human
cacuguaugaucggugggga

SEQ ID NO: 952033 - RNA, 21 nt, Human
cagcaggacaggguagcacuc

SEQ ID NO: 952034 - RNA, 19 nt, Human
cagccuccugaguagcugg

SEQ ID NO: 952035 - RNA, 23 nt, Human
cagccucgaccucuuggguucaa

SEQ ID NO: 952036 - RNA, 23 nt, Human
cagcuugucagccacaacacaaa

SEQ ID NO: 952037 - RNA, 23 nt, Human
caggcaugugccaccacaccagg

SEQ ID NO: 952038 - RNA, 24 nt, Human
cagggucucauucugucgcccagg

SEQ ID NO: 952039 - RNA, 24 nt, Human
cagggucuuccuauauuacccagg

SEQ ID NO: 952040 - RNA, 24 nt, Human
cagggucuuccuauauuacccagg

SEQ ID NO: 952041 - RNA, 22 nt, Human
cauagccaguguaagaaaucac

SEQ ID NO: 952042 - RNA, 24 nt, Human
caugugccaccacaccaggcuaau

SEQ ID NO: 952043 - RNA, 24 nt, Human
cauguugcccagauuggacuugaa

SEQ ID NO: 952044 - RNA, 24 nt, Human
cauucugucgcccaggcuggagug

SEQ ID NO: 952045 - RNA, 19 nt, Human
ccaaaaggucaacaucaag

SEQ ID NO: 952046 - RNA, 19 nt, Human
ccaaaaggucaacaucaag

SEQ ID NO: 952047 - RNA, 21 nt, Human
ccaaaguguugggauuauggg

SEQ ID NO: 952048 - RNA, 21 nt, Human
ccaaaguguugggauuauggg

SEQ ID NO: 952049 - RNA, 24 nt, Human
ccaaaguguugggauuaugggugu

SEQ ID NO: 952050 - RNA, 20 nt, Human
ccacaacacaaaguccagaa

SEQ ID NO: 952051 - RNA, 23 nt, Human
ccaccucagccuccugaguagcu

SEQ ID NO: 952052 - RNA, 19 nt, Human
ccaggcucaggagauucuc

SEQ ID NO: 952053 - RNA, 22 nt, Human
ccaggcucaggagauucuccca

SEQ ID NO: 952054 - RNA, 23 nt, Human
cccaaguagcugggacuacaggg

SEQ ID NO: 952055 - RNA, 23 nt, Human
cccaccucagccucccaaguagc

SEQ ID NO: 952056 - RNA, 23 nt, Human
cccaccucagccuccugaguagc

SEQ ID NO: 952057 - RNA, 18 nt, Human
ccccaggacucuggcagc

SEQ ID NO: 952058 - RNA, 18 nt, Human
ccccucugugcacgcagc

SEQ ID NO: 952059 - RNA, 19 nt, Human
ccuauauuacccaggcugu

SEQ ID NO: 952060 - RNA, 19 nt, Human
ccuauauuacccaggcugu

SEQ ID NO: 952061 - RNA, 23 nt, Human
ccucccaccucagccucccaagu

SEQ ID NO: 952062 - RNA, 26 nt, Human
ccucccaccucagccucucaaauagc

SEQ ID NO: 952063 - RNA, 26 nt, Human
ccucccaccucagccucucaaauagc

SEQ ID NO: 952064 - RNA, 18 nt, Human
ccucgaccucuuggguuc

SEQ ID NO: 952065 - RNA, 21 nt, Human
ccucuuggguucaagcaaucc

SEQ ID NO: 952066 - RNA, 20 nt, Human
ccuggguacagacuugguuu

SEQ ID NO: 952067 - RNA, 18 nt, Human
ccuggguucaagcaaucu

SEQ ID NO: 952068 - RNA, 24 nt, Human
ccuuccaggcucaggagauucucc

SEQ ID NO: 952069 - RNA, 25 nt, Human
cgaccucuuggguucaagcaauccu

SEQ ID NO: 952070 - RNA, 24 nt, Human
cgagguggguggaucacuugaggu

SEQ ID NO: 952071 - RNA, 24 nt, Human
cgagguggguggaucacuugaggu

SEQ ID NO: 952072 - RNA, 26 nt, Human
cgagguggguggaucacuugagguca

SEQ ID NO: 952073 - RNA, 24 nt, Human
cuaaaauguugggauuaguggcgu

SEQ ID NO: 952074 - RNA, 24 nt, Human
cucaaaugauccucccaccucagc

SEQ ID NO: 952075 - RNA, 24 nt, Human
cucaaaugauccucccaccucagc

SEQ ID NO: 952076 - RNA, 24 nt, Human
cucaacagcaaccaaaaagcaaaa

SEQ ID NO: 952077 - RNA, 24 nt, Human
cucacaccuguaauccuagcacuu

SEQ ID NO: 952078 - RNA, 24 nt, Human
cucacaccuguaauccuagcacuu

SEQ ID NO: 952079 - RNA, 20 nt, Human
cucacugcagccucgaccuc

SEQ ID NO: 952080 - RNA, 24 nt, Human
cucacugcagccucgaccucuugg

SEQ ID NO: 952081 - RNA, 24 nt, Human
cucagccucccaaguagcugggac

SEQ ID NO: 952082 - RNA, 24 nt, Human
cucauucugucgcccaggcuggag

SEQ ID NO: 952083 - RNA, 22 nt, Human
cuccguacugcaguuuugcucc

SEQ ID NO: 952084 - RNA, 24 nt, Human
cugcucugucacccaggcuggagu

SEQ ID NO: 952085 - RNA, 18 nt, Human
cuguaauagucaaacuca

SEQ ID NO: 952086 - RNA, 18 nt, Human
cuguaauagucaaacuca

SEQ ID NO: 952087 - RNA, 21 nt, Human
cuguggugguccucaucuugg

SEQ ID NO: 952088 - RNA, 23 nt, Human
cuguggugguccucaucuuggca

SEQ ID NO: 952089 - RNA, 18 nt, Human
cuuaaaaugacgaagaga

SEQ ID NO: 952090 - RNA, 22 nt, Human
cuuggcucacugcagccucgac

SEQ ID NO: 952091 - RNA, 26 nt, Human
gaccaucugaaccaaacucaggaagu

SEQ ID NO: 952092 - RNA, 26 nt, Human
gaccuuccaggcucagggguguccga

SEQ ID NO: 952093 - RNA, 21 nt, Human
gacuauagaugcacagcacca

SEQ ID NO: 952094 - RNA, 21 nt, Human
gacuauagaugcacagcacca

SEQ ID NO: 952095 - RNA, 20 nt, Human
gagcugggguuuccccaugu

SEQ ID NO: 952096 - RNA, 18 nt, Human
gaggaauucuuuucucuc

SEQ ID NO: 952097 - RNA, 23 nt, Human
gagguggguggaucacuugaggu

SEQ ID NO: 952098 - RNA, 23 nt, Human
gagguggguggaucacuugaggu

SEQ ID NO: 952099 - RNA, 25 nt, Human
gagguggguggaucacuugagguca

SEQ ID NO: 952100 - RNA, 20 nt, Human
gaguaaccugguaaugauau

SEQ ID NO: 952101 - RNA, 20 nt, Human
gaguaaccugguaaugauau

SEQ ID NO: 952102 - RNA, 25 nt, Human
gaguagcuggaacuacaggcaugug

SEQ ID NO: 952103 - RNA, 18 nt, Human
gaucacuugaggucaggg

SEQ ID NO: 952104 - RNA, 18 nt, Human
gaucacuugaggucaggg

SEQ ID NO: 952105 - RNA, 23 nt, Human
gaucacuugaggucagggucuuc

SEQ ID NO: 952106 - RNA, 23 nt, Human
gaucacuugaggucagggucuuu

SEQ ID NO: 952107 - RNA, 24 nt, Human
gaucacuugaggucagggucuuua

SEQ ID NO: 952108 - RNA, 18 nt, Human
gauuaguggcgugagcca

SEQ ID NO: 952109 - RNA, 22 nt, Human
gauuaguggcgugagccacugc

SEQ ID NO: 952110 - RNA, 18 nt, Human
gauuaugggugugagcca

SEQ ID NO: 952111 - RNA, 21 nt, Human
gauuaugggugugagccacca

SEQ ID NO: 952112 - RNA, 22 nt, Human
gauuaugggugugagccaccac

SEQ ID NO: 952113 - RNA, 18 nt, Human
gcaaccaaaaagcaaaaa

SEQ ID NO: 952114 - RNA, 22 nt, Human
gcagaaaaaagccaaguaugga

SEQ ID NO: 952115 - RNA, 22 nt, Human
gcagaaaaaagccaaguaugga

SEQ ID NO: 952116 - RNA, 21 nt, Human
gcagccugcguacuguggugg

SEQ ID NO: 952117 - RNA, 21 nt, Human
gcaggguguagggaaccuggg

SEQ ID NO: 952118 - RNA, 21 nt, Human
gcaggguguagggaaccuggg

SEQ ID NO: 952119 - RNA, 22 nt, Human
gccaaagaauggaacaacuuaa

SEQ ID NO: 952120 - RNA, 21 nt, Human
gccaaagauaagucaccagaa

SEQ ID NO: 952121 - RNA, 21 nt, Human
gccaaagauaagucaccagaa

SEQ ID NO: 952122 - RNA, 20 nt, Human
gcccaggcuggaguguggug

SEQ ID NO: 952123 - RNA, 27 nt, Human
gccuggagcaagauccuucuccuacgg

SEQ ID NO: 952124 - RNA, 21 nt, Human
gcgaugccuggagcaagaucc

SEQ ID NO: 952125 - RNA, 20 nt, Human
gcuaaagcaaagagcuuucg

SEQ ID NO: 952126 - RNA, 21 nt, Human
gcuagucuagaacucccaggc

SEQ ID NO: 952127 - RNA, 21 nt, Human
gcucacugcagccucgaccuc

SEQ ID NO: 952128 - RNA, 25 nt, Human
gcucugucacccaggcuggagugca

SEQ ID NO: 952129 - RNA, 19 nt, Human
gcuggagugcaguggcaca

SEQ ID NO: 952130 - RNA, 21 nt, Human
ggaaagaguuccuggugugug

SEQ ID NO: 952131 - RNA, 18 nt, Human
ggacuacaggggugugcc

SEQ ID NO: 952132 - RNA, 23 nt, Human
ggagacuugucaccguaugcucu

SEQ ID NO: 952133 - RNA, 23 nt, Human
ggagacuugucaccguaugcucu

SEQ ID NO: 952134 - RNA, 24 nt, Human
ggagauucucccaccucagccucc

SEQ ID NO: 952135 - RNA, 24 nt, Human
ggaggccaggcacaguggcucaca

SEQ ID NO: 952136 - RNA, 24 nt, Human
ggaggccaggcacaguggcucaca

SEQ ID NO: 952137 - RNA, 21 nt, Human
ggaggccgagguggguggauc

SEQ ID NO: 952138 - RNA, 21 nt, Human
ggaggccgagguggguggauc

SEQ ID NO: 952139 - RNA, 23 nt, Human
ggguguagggaaccugggguugg

SEQ ID NO: 952140 - RNA, 23 nt, Human
ggguguagggaaccugggguugg

SEQ ID NO: 952141 - RNA, 21 nt, Human
gguggaucacuugaggucagg

SEQ ID NO: 952142 - RNA, 21 nt, Human
gguggaucacuugaggucagg

SEQ ID NO: 952143 - RNA, 20 nt, Human
ggugugagccaccacaccca

SEQ ID NO: 952144 - RNA, 18 nt, Human
guagcugggacuacaggg

SEQ ID NO: 952145 - RNA, 20 nt, Human
gucagggucuucaagacagg

SEQ ID NO: 952146 - RNA, 23 nt, Human
guccagaaucuuguaggaggcca

SEQ ID NO: 952147 - RNA, 24 nt, Human
gugagccaccacacccagccuuuu

SEQ ID NO: 952148 - RNA, 22 nt, Human
guuccaauuagcucuucuuugc

SEQ ID NO: 952149 - RNA, 22 nt, Human
uaaaaaggaacaauccugggua

SEQ ID NO: 952150 - RNA, 20 nt, Human
uaaaagcagaaaaaagccaa

SEQ ID NO: 952151 - RNA, 21 nt, Human
uaaaauuacauuacagcuugc

SEQ ID NO: 952152 - RNA, 21 nt, Human
uaaaauuacauuacagcuugc

SEQ ID NO: 952153 - RNA, 20 nt, Human
uaacuccagcaaaaacuuca

SEQ ID NO: 952154 - RNA, 21 nt, Human
uaagaaaucacagcaacgaug

SEQ ID NO: 952155 - RNA, 21 nt, Human
uaagugagaaguggaaagccc

SEQ ID NO: 952156 - RNA, 21 nt, Human
uacaggggugugccacuaugc

SEQ ID NO: 952157 - RNA, 23 nt, Human
uacaggggugugccacuaugcuu

SEQ ID NO: 952158 - RNA, 20 nt, Human
uaccacagaagacaaaacaa

SEQ ID NO: 952159 - RNA, 20 nt, Human
uaccacagaagacaaaacaa

SEQ ID NO: 952160 - RNA, 21 nt, Human
uaccacagaagacaaaacaaa

SEQ ID NO: 952161 - RNA, 21 nt, Human
uaccacagaagacaaaacaaa

SEQ ID NO: 952162 - RNA, 18 nt, Human
uacccaucuggcauuggu

SEQ ID NO: 952163 - RNA, 19 nt, Human
uacccugauuguggugaug

SEQ ID NO: 952164 - RNA, 19 nt, Human
uacccugauuguggugaug

SEQ ID NO: 952165 - RNA, 19 nt, Human
uaccgaaaaacauaaggca

SEQ ID NO: 952166 - RNA, 20 nt, Human
uaccgaaaaacauaaggcac

SEQ ID NO: 952167 - RNA, 18 nt, Human
uacuugguuuucaggucu

SEQ ID NO: 952168 - RNA, 18 nt, Human
uacuugguuuucaggucu

SEQ ID NO: 952169 - RNA, 23 nt, Human
uagaacucccaggcacaagugau

SEQ ID NO: 952170 - RNA, 22 nt, Human
uagagacaggguccugcucugu

SEQ ID NO: 952171 - RNA, 24 nt, Human
uagcacuuucggaggccgaggugg

SEQ ID NO: 952172 - RNA, 24 nt, Human
uagcacuuucggaggccgaggugg

SEQ ID NO: 952173 - RNA, 25 nt, Human
uagcagggacuauagaugcacagca

SEQ ID NO: 952174 - RNA, 18 nt, Human
uaguuaaucuaccagaga

SEQ ID NO: 952175 - RNA, 18 nt, Human
uaguuaaucuaccagaga

SEQ ID NO: 952176 - RNA, 18 nt, Human
uauaauuagugacagacc

SEQ ID NO: 952177 - RNA, 22 nt, Human
uauacaagaugaucuauuauca

SEQ ID NO: 952178 - RNA, 23 nt, Human
uauauuacccaggcuguccuuga

SEQ ID NO: 952179 - RNA, 24 nt, Human
uauauuacccaggcuguccuugaa

SEQ ID NO: 952180 - RNA, 24 nt, Human
uauauuacccaggcuguccuugaa

SEQ ID NO: 952181 - RNA, 21 nt, Human
ucaacauaaaagcagaaaaaa

SEQ ID NO: 952182 - RNA, 22 nt, Human
ucacccaggcuggagugcagug

SEQ ID NO: 952183 - RNA, 23 nt, Human
ucacugcagccucgaccucuugg

SEQ ID NO: 952184 - RNA, 23 nt, Human
ucacugcagccucgaccucuugg

SEQ ID NO: 952185 - RNA, 24 nt, Human
ucacugcagccucgaccucuuggg

SEQ ID NO: 952186 - RNA, 19 nt, Human
ucacugccugcugagagca

SEQ ID NO: 952187 - RNA, 19 nt, Human
ucacugccugcugagagca

SEQ ID NO: 952188 - RNA, 19 nt, Human
ucagcaggcuguguggaaa

SEQ ID NO: 952189 - RNA, 20 nt, Human
ucagccucccaaguagcugg

SEQ ID NO: 952190 - RNA, 23 nt, Human
ucagccuccugaguagcuggaac

SEQ ID NO: 952191 - RNA, 24 nt, Human
ucauucugucgcccaggcuggagu

SEQ ID NO: 952192 - RNA, 25 nt, Human
ucccaaguagcugggacuacagggg

SEQ ID NO: 952193 - RNA, 20 nt, Human
uccuaaaauguugggauuag

SEQ ID NO: 952194 - RNA, 24 nt, Human
uccuaaaauguugggauuaguggc

SEQ ID NO: 952195 - RNA, 23 nt, Human
uccucaaagauagcgacauucau

SEQ ID NO: 952196 - RNA, 27 nt, Human
uccucccaccucagccucccaaguagc

SEQ ID NO: 952197 - RNA, 24 nt, Human
uccugaguagcuggaacuacaggc

SEQ ID NO: 952198 - RNA, 23 nt, Human
uccugcucugucacccaggcugg

SEQ ID NO: 952199 - RNA, 24 nt, Human
uccugcucugucacccaggcugga

SEQ ID NO: 952200 - RNA, 20 nt, Human
uccuggguacagacuugguu

SEQ ID NO: 952201 - RNA, 21 nt, Human
uccuggguacagacuugguuu

SEQ ID NO: 952202 - RNA, 18 nt, Human
uccuggguucaagcaauc

SEQ ID NO: 952203 - RNA, 19 nt, Human
uccuggguucaagcaaucu

SEQ ID NO: 952204 - RNA, 20 nt, Human
uccuggguucaagcaaucug

SEQ ID NO: 952205 - RNA, 24 nt, Human
ucgcccaggcuggagugugguggc

SEQ ID NO: 952206 - RNA, 20 nt, Human
ucgguacacgccggacgcca

SEQ ID NO: 952207 - RNA, 24 nt, Human
ucuaccagagagauucagaaaccu

SEQ ID NO: 952208 - RNA, 24 nt, Human
ucuaccagagagauucagaaaccu

SEQ ID NO: 952209 - RNA, 23 nt, Human
ucucauucugucgcccaggcugg

SEQ ID NO: 952210 - RNA, 24 nt, Human
ucucauucugucgcccaggcugga

SEQ ID NO: 952211 - RNA, 24 nt, Human
ucucccaccucagccuccugagua

SEQ ID NO: 952212 - RNA, 24 nt, Human
ucugucacccaggcuggagugcag

SEQ ID NO: 952213 - RNA, 22 nt, Human
ucugucgcccaggcuggagugu

SEQ ID NO: 952214 - RNA, 24 nt, Human
ucugucgcccaggcuggagugugg

SEQ ID NO: 952215 - RNA, 24 nt, Human
ucuuggguucaagcaauccuccca

SEQ ID NO: 952216 - RNA, 24 nt, Human
ugaaagcagaucaacauaaaagca

SEQ ID NO: 952217 - RNA, 24 nt, Human
ugaaagcagaucaauauaaaagca

SEQ ID NO: 952218 - RNA, 20 nt, Human
ugaaaugauagauuuuucug

SEQ ID NO: 952219 - RNA, 19 nt, Human
ugacacucacugccugcug

SEQ ID NO: 952220 - RNA, 19 nt, Human
ugacacucacugccugcug

SEQ ID NO: 952221 - RNA, 28 nt, Human
ugacagaccaucugaaccaaacucagga

SEQ ID NO: 952222 - RNA, 21 nt, Human
ugagaagacaugaacuuuuug

SEQ ID NO: 952223 - RNA, 21 nt, Human
ugagaagacaugaacuuuuug

SEQ ID NO: 952224 - RNA, 19 nt, Human
ugagccaccacacccagcc

SEQ ID NO: 952225 - RNA, 24 nt, Human
ugaguuaaguguucuuaccacaga

SEQ ID NO: 952226 - RNA, 22 nt, Human
ugcacgggacaaaggaagcccc

SEQ ID NO: 952227 - RNA, 22 nt, Human
ugcaguggcacaaucuuggcuc

SEQ ID NO: 952228 - RNA, 23 nt, Human
ugcccaaugcuaaguucugcaca

SEQ ID NO: 952229 - RNA, 25 nt, Human
ugccuggagcaagauccuuauccac

SEQ ID NO: 952230 - RNA, 26 nt, Human
ugcuaugaaagcagaucaacauaaaa

SEQ ID NO: 952231 - RNA, 24 nt, Human
ugcucugucacccaggcuggagug

SEQ ID NO: 952232 - RNA, 22 nt, Human
ugcuuacccaucuggcauuggu

SEQ ID NO: 952233 - RNA, 21 nt, Human
uggaaaggagacuugucaccg

SEQ ID NO: 952234 - RNA, 21 nt, Human
uggaaaggagacuugucaccg

SEQ ID NO: 952235 - RNA, 21 nt, Human
uggaacuacaggcaugugcca

SEQ ID NO: 952236 - RNA, 24 nt, Human
uggaacuacaggcaugugccacca

SEQ ID NO: 952237 - RNA, 23 nt, Human
uggagugcaguggcacaaucuug

SEQ ID NO: 952238 - RNA, 24 nt, Human
uggagugcaguggcacaaucuugg

SEQ ID NO: 952239 - RNA, 24 nt, Human
uggagugugguggcacaaucuugg

SEQ ID NO: 952240 - RNA, 22 nt, Human
uggaucacuugaggucaggguc

SEQ ID NO: 952241 - RNA, 22 nt, Human
uggaucacuugaggucaggguc

SEQ ID NO: 952242 - RNA, 20 nt, Human
uggcacaaucuuggcucacu

SEQ ID NO: 952243 - RNA, 23 nt, Human
uggcacaaucuuggcucacugca

SEQ ID NO: 952244 - RNA, 24 nt, Human
uggcagcagccugcguacuguggu

SEQ ID NO: 952245 - RNA, 23 nt, Human
uggcaucuuccauaucauagcca

SEQ ID NO: 952246 - RNA, 24 nt, Human
uggccaaagaauggaacaacuuaa

SEQ ID NO: 952247 - RNA, 22 nt, Human
uggccaaagauaagucaccaga

SEQ ID NO: 952248 - RNA, 22 nt, Human
uggccaaagauaagucaccaga

SEQ ID NO: 952249 - RNA, 19 nt, Human
uggcucacaccuguaaucc

SEQ ID NO: 952250 - RNA, 19 nt, Human
uggcucacaccuguaaucc

SEQ ID NO: 952251 - RNA, 19 nt, Human
uggcucacaccuguaaucc

SEQ ID NO: 952252 - RNA, 24 nt, Human
uggcucacaccuguaauccuagca

SEQ ID NO: 952253 - RNA, 24 nt, Human
uggcucacaccuguaauccuagca

SEQ ID NO: 952254 - RNA, 24 nt, Human
uggcucacugcagccucgaccucu

SEQ ID NO: 952255 - RNA, 24 nt, Human
uggcuuccaaaauggaugaaucuu

SEQ ID NO: 952256 - RNA, 24 nt, Human
uggcuuccaaaauggaugaaucuu

SEQ ID NO: 952257 - RNA, 22 nt, Human
ugggacuacaggggugugccac

SEQ ID NO: 952258 - RNA, 22 nt, Human
ugggacuacaggggugugccac

SEQ ID NO: 952259 - RNA, 24 nt, Human
ugggacuacaggggugugccacua

SEQ ID NO: 952260 - RNA, 22 nt, Human
ugggauuaguggcgugagccac

SEQ ID NO: 952261 - RNA, 22 nt, Human
ugggauuaguggcgugagccac

SEQ ID NO: 952262 - RNA, 24 nt, Human
ugggauuaguggcgugagccacug

SEQ ID NO: 952263 - RNA, 18 nt, Human
ugggauuaugggugugag

SEQ ID NO: 952264 - RNA, 19 nt, Human
ugggauuaugggugugagc

SEQ ID NO: 952265 - RNA, 22 nt, Human
ugggauuaugggugugagccac

SEQ ID NO: 952266 - RNA, 23 nt, Human
ugggauuaugggugugagccacc

SEQ ID NO: 952267 - RNA, 24 nt, Human
ugggauuaugggugugagccacca

SEQ ID NO: 952268 - RNA, 18 nt, Human
ugggguuuccccauguug

SEQ ID NO: 952269 - RNA, 21 nt, Human
uggguucaagcaauccuccca

SEQ ID NO: 952270 - RNA, 24 nt, Human
uguaauacggaucuccguacugca

SEQ ID NO: 952271 - RNA, 22 nt, Human
ugugguggcacaaucuuggcuc

SEQ ID NO: 952272 - RNA, 25 nt, Human
ugugguggcacaaucuuggcucaac

SEQ ID NO: 952273 - RNA, 20 nt, Human
uguggugguccucaucuugg

SEQ ID NO: 952274 - RNA, 22 nt, Human
uguggugguccucaucuuggca

SEQ ID NO: 952275 - RNA, 18 nt, Human
uguucaacagguauaaag

SEQ ID NO: 952276 - RNA, 19 nt, Human
uguuuguuuuuacuucaac

SEQ ID NO: 952277 - RNA, 19 nt, Human
uguuuguuuuuacuucaac

SEQ ID NO: 952278 - RNA, 21 nt, Human
uuaaacaacauccaguuucac

SEQ ID NO: 952279 - RNA, 22 nt, Human
uuaaauauguaacaacuguacu

SEQ ID NO: 952280 - RNA, 22 nt, Human
uuaaauauguaacaacuguacu

SEQ ID NO: 952281 - RNA, 21 nt, Human
uuauaauggccaaagauaagu

SEQ ID NO: 952282 - RNA, 21 nt, Human
uuauaauggccaaagauaagu

SEQ ID NO: 952283 - RNA, 21 nt, Human
uucaagcaauccucccaccuc

SEQ ID NO: 952284 - RNA, 24 nt, Human
uucaagcaauccucccaccucagc

SEQ ID NO: 952285 - RNA, 20 nt, Human
uucacuuugauguucauagc

SEQ ID NO: 952286 - RNA, 22 nt, Human
uucagcuacaaaauaccgaaaa

SEQ ID NO: 952287 - RNA, 18 nt, Human
uucauauuuugagaagac

SEQ ID NO: 952288 - RNA, 18 nt, Human
uucauauuuugagaagac

SEQ ID NO: 952289 - RNA, 21 nt, Human
uuccuggguucaagcaaucug

SEQ ID NO: 952290 - RNA, 18 nt, Human
uugcccagauuggacuug

SEQ ID NO: 952291 - RNA, 21 nt, Human
uugggauuaugggugugagcc

SEQ ID NO: 952292 - RNA, 19 nt, Human
uuguaaaaauccucaucaa

SEQ ID NO: 952293 - RNA, 24 nt, Human
uuuccccauguugcccagauugga

SEQ ID NO: 952294 - RNA, 22 nt, Human
uuuuuuguagagaugaagucuc

SEQ ID NO: 952295 - RNA, 24 nt, Human
uuuuuuuguagagaugaagucucg

SEQ ID NO: 952296 - RNA, 23 nt, Human
aaaaaacaaaaaacaaacaaaaa

SEQ ID NO: 952297 - RNA, 24 nt, Human
aaaaaacaaaaaacaaacaaaaaa

SEQ ID NO: 952298 - RNA, 21 nt, Human
aaaaaacccaggcagauaaug

SEQ ID NO: 952299 - RNA, 21 nt, Human
aaaacaaaaaacaaacaaaaa

SEQ ID NO: 952300 - RNA, 23 nt, Human
aaaacaaacaaaaaacccaggca

SEQ ID NO: 952301 - RNA, 19 nt, Human
aaaacaucuauuucaggau

SEQ ID NO: 952302 - RNA, 25 nt, Human
aaacaaaaaacaaacaaaaaaccca

SEQ ID NO: 952303 - RNA, 21 nt, Human
aaacaaacaaaaaacccaggc

SEQ ID NO: 952304 - RNA, 24 nt, Human
aaagugccaggauuacaggcauga

SEQ ID NO: 952305 - RNA, 24 nt, Human
aaagugggcauuugaacaacccuc

SEQ ID NO: 952306 - RNA, 20 nt, Human
aacaugcaggcaccaaaaaa

SEQ ID NO: 952307 - RNA, 26 nt, Human
aagugccaggauuacaggcaugagcc

SEQ ID NO: 952308 - RNA, 24 nt, Human
accauguuggccaggcuggucuug

SEQ ID NO: 952309 - RNA, 22 nt, Human
acuucugcagaagcuaaaacaa

SEQ ID NO: 952310 - RNA, 20 nt, Human
agaaauacacagccuggccc

SEQ ID NO: 952311 - RNA, 23 nt, Human
aggauuacaggcaugagccaccg

SEQ ID NO: 952312 - RNA, 25 nt, Human
aggauuacaggcaugagccaccggg

SEQ ID NO: 952313 - RNA, 20 nt, Human
aggcagauaaugaaauccug

SEQ ID NO: 952314 - RNA, 21 nt, Human
aggcaugagccaccgggccca

SEQ ID NO: 952315 - RNA, 18 nt, Human
aggcccuccuaaguucag

SEQ ID NO: 952316 - RNA, 24 nt, Human
auaaauaugagaguggaugaacgu

SEQ ID NO: 952317 - RNA, 18 nt, Human
augggguuucaccauguu

SEQ ID NO: 952318 - RNA, 22 nt, Human
augggguuucaccauguuggcc

SEQ ID NO: 952319 - RNA, 24 nt, Human
augggguuucaccauguuggccag

SEQ ID NO: 952320 - RNA, 19 nt, Human
caaaauggaagacuauuca

SEQ ID NO: 952321 - RNA, 24 nt, Human
caaacaaaaaacccaggcagauaa

SEQ ID NO: 952322 - RNA, 24 nt, Human
caaagugccaggauuacaggcaug

SEQ ID NO: 952323 - RNA, 21 nt, Human
caccauguuggccaggcuggu

SEQ ID NO: 952324 - RNA, 24 nt, Human
caccauguuggccaggcuggucuu

SEQ ID NO: 952325 - RNA, 31 nt, Human
caccauguuggccaggcuggucuuggacucc

SEQ ID NO: 952326 - RNA, 21 nt, Human
cagacagacuguccuccgaag

SEQ ID NO: 952327 - RNA, 24 nt, Human
cagacagacuguccuccgaagccc

SEQ ID NO: 952328 - RNA, 18 nt, Human
cagcagccacagcugggc

SEQ ID NO: 952329 - RNA, 21 nt, Human
caggauuacaggcaugagcca

SEQ ID NO: 952330 - RNA, 25 nt, Human
caucuuuaaaacaucuauuucagga

SEQ ID NO: 952331 - RNA, 27 nt, Human
caugacacugcaauaauagcaaugaac

SEQ ID NO: 952332 - RNA, 23 nt, Human
cauguuggccaggcuggucuugg

SEQ ID NO: 952333 - RNA, 24 nt, Human
cauguuggccaggcuggucuugga

SEQ ID NO: 952334 - RNA, 24 nt, Human
ccaaagugccaggauuacaggcau

SEQ ID NO: 952335 - RNA, 20 nt, Human
ccaccgggcccagccuacuu

SEQ ID NO: 952336 - RNA, 21 nt, Human
ccaggcagauaaugaaauccu

SEQ ID NO: 952337 - RNA, 23 nt, Human
ccccuaacuaagaugggcuucug

SEQ ID NO: 952338 - RNA, 21 nt, Human
ccgaagcccaccccaccaaag

SEQ ID NO: 952339 - RNA, 20 nt, Human
ccuccgaagcccaccccacc

SEQ ID NO: 952340 - RNA, 18 nt, Human
ccugaccucaagugaucc

SEQ ID NO: 952341 - RNA, 21 nt, Human
ccugaccucaagugauccgcc

SEQ ID NO: 952342 - RNA, 23 nt, Human
ccugaccucaagugauccgccug

SEQ ID NO: 952343 - RNA, 23 nt, Human
cgccugaccagacuccuauucgc

SEQ ID NO: 952344 - RNA, 21 nt, Human
cucaagugauccgccugccgc

SEQ ID NO: 952345 - RNA, 26 nt, Human
cuccugaccucaagugauccgccugc

SEQ ID NO: 952346 - RNA, 20 nt, Human
cucuuuaacaacagcauugg

SEQ ID NO: 952347 - RNA, 22 nt, Human
cuggaaccauaacuuuaaccca

SEQ ID NO: 952348 - RNA, 21 nt, Human
cuucugggccuaucaaccauu

SEQ ID NO: 952349 - RNA, 22 nt, Human
cuucuugaauuaaaaaacaaaa

SEQ ID NO: 952350 - RNA, 21 nt, Human
cuuuacguuuggcuucuccuc

SEQ ID NO: 952351 - RNA, 31 nt, Human
gaccagacuccuauucgccgcaaggacccgg

SEQ ID NO: 952352 - RNA, 22 nt, Human
gaccucaagugauccgccugcc

SEQ ID NO: 952353 - RNA, 21 nt, Human
gacgccugaccagacuccuau

SEQ ID NO: 952354 - RNA, 20 nt, Human
gagaugggguuucaccaugu

SEQ ID NO: 952355 - RNA, 24 nt, Human
gagaugggguuucaccauguuggc

SEQ ID NO: 952356 - RNA, 20 nt, Human
gagcagcaauuccccauagg

SEQ ID NO: 952357 - RNA, 18 nt, Human
gauuacaggcaugagcca

SEQ ID NO: 952358 - RNA, 20 nt, Human
gauuacaggcaugagccacc

SEQ ID NO: 952359 - RNA, 21 nt, Human
gauuacaggcaugagccaccg

SEQ ID NO: 952360 - RNA, 25 nt, Human
gcaaagucuucauucaaaugcaaag

SEQ ID NO: 952361 - RNA, 25 nt, Human
gcagcagccacagcugaccccuugg

SEQ ID NO: 952362 - RNA, 20 nt, Human
gcugcagggucagcacuggc

SEQ ID NO: 952363 - RNA, 23 nt, Human
gcuggucuuggacuccugaccuc

SEQ ID NO: 952364 - RNA, 20 nt, Human
ggaacaucuucagcacccuc

SEQ ID NO: 952365 - RNA, 22 nt, Human
ggauuacaggcaugagccaccg

SEQ ID NO: 952366 - RNA, 23 nt, Human
ggcauuuuaguuccuaggagagc

SEQ ID NO: 952367 - RNA, 24 nt, Human
ggcuggucuuggacuccugaccuc

SEQ ID NO: 952368 - RNA, 22 nt, Human
gggguuucaccauguuggccag

SEQ ID NO: 952369 - RNA, 18 nt, Human
ggguuucaccauguuggc

SEQ ID NO: 952370 - RNA, 22 nt, Human
gguagagaugggguuucaccau

SEQ ID NO: 952371 - RNA, 23 nt, Human
gguagagaugggguuucaccaug

SEQ ID NO: 952372 - RNA, 21 nt, Human
guagagaugggguuucaccau

SEQ ID NO: 952373 - RNA, 22 nt, Human
guagagaugggguuucaccaug

SEQ ID NO: 952374 - RNA, 23 nt, Human
guagagaugggguuucaccaugu

SEQ ID NO: 952375 - RNA, 19 nt, Human
gucugcaugaagcauaagg

SEQ ID NO: 952376 - RNA, 24 nt, Human
gugauccgccugccgcagccuccc

SEQ ID NO: 952377 - RNA, 23 nt, Human
gugauggcuggaaauuaguggga

SEQ ID NO: 952378 - RNA, 18 nt, Human
guucagcgcggucuccaa

SEQ ID NO: 952379 - RNA, 23 nt, Human
uaaaaaacaaaaaacaaacaaaa

SEQ ID NO: 952380 - RNA, 26 nt, Human
uaaaaaacaaaaaacaaacaaaaaac

SEQ ID NO: 952381 - RNA, 21 nt, Human
uaauagcaaugaaccgcuuca

SEQ ID NO: 952382 - RNA, 24 nt, Human
uacaggcaugagccaccgggccca

SEQ ID NO: 952383 - RNA, 22 nt, Human
uagagaugggguuucaccaugu

SEQ ID NO: 952384 - RNA, 25 nt, Human
ucaagagcuuuuagccugcuucagu

SEQ ID NO: 952385 - RNA, 21 nt, Human
ucaggauuuggaagcuucugg

SEQ ID NO: 952386 - RNA, 29 nt, Human
ucagucuucaaacaugcaggcaccaaaaa

SEQ ID NO: 952387 - RNA, 20 nt, Human
uccaacuuugaugugcauau

SEQ ID NO: 952388 - RNA, 21 nt, Human
uccauaacagucuuuuuacuu

SEQ ID NO: 952389 - RNA, 24 nt, Human
ucccaaagugccaggauuacaggc

SEQ ID NO: 952390 - RNA, 21 nt, Human
ucuuggacuccugaccucaag

SEQ ID NO: 952391 - RNA, 24 nt, Human
ugaacaacccucuuccugcucccu

SEQ ID NO: 952392 - RNA, 20 nt, Human
ugaccagacuccuauucgcc

SEQ ID NO: 952393 - RNA, 18 nt, Human
ugaccucaagugauccgc

SEQ ID NO: 952394 - RNA, 22 nt, Human
ugcauacacucaagucugcaug

SEQ ID NO: 952395 - RNA, 24 nt, Human
ugccgcagccucccaaagugccag

SEQ ID NO: 952396 - RNA, 24 nt, Human
uggccaggcuggucuuggacuccu

SEQ ID NO: 952397 - RNA, 24 nt, Human
ugggguuucaccauguuggccagg

SEQ ID NO: 952398 - RNA, 27 nt, Human
uguguuuugcaaagucuucauucaaau

SEQ ID NO: 952399 - RNA, 24 nt, Human
uuucaccauguuggccaggcuggu

SEQ ID NO: 952400 - RNA, 24 nt, Human
uuuccaaaauggaagacuauucau

SEQ ID NO: 952401 - RNA, 24 nt, Human
uuuccagugcugaucacacccacu

SEQ ID NO: 952402 - RNA, 18 nt, Human
uuuggaagcuucuggaac

SEQ ID NO: 952403 - RNA, 21 nt, Human
aaacuuuauugaaaaacugac

SEQ ID NO: 952404 - RNA, 22 nt, Human
aauuauggaauuuaugauaagg

SEQ ID NO: 952405 - RNA, 23 nt, Human
agacaacacaaaauuaaaauuca

SEQ ID NO: 952406 - RNA, 20 nt, Human
caaaaccaaauguaauuaca

SEQ ID NO: 952407 - RNA, 19 nt, Human
caagcugcaagcgaucugc

SEQ ID NO: 952408 - RNA, 21 nt, Human
ccuaccagaccucccagccca

SEQ ID NO: 952409 - RNA, 21 nt, Human
ccucccagcccacacagcuag

SEQ ID NO: 952410 - RNA, 24 nt, Human
cucagcccuaccagaccucccagc

SEQ ID NO: 952411 - RNA, 19 nt, Human
cuugcaagcucagcccuac

SEQ ID NO: 952412 - RNA, 18 nt, Human
uuugcccauaaucaaaac

SEQ ID NO: 952413 - RNA, 19 nt, Human
uuuuuuuuuuuuuugccca

SEQ ID NO: 952414 - RNA, 18 nt, Human
uuuuuuuuuuuuuuuuug

SEQ ID NO: 952415 - RNA, 21 nt, Human
uuuuuuuuuuuuuuuuugccc

SEQ ID NO: 952416 - RNA, 25 nt, Human
uuuuuuuuuuuuuuuuugcccauaa

SEQ ID NO: 952417 - RNA, 20 nt, Human
aaaccccacuccccagcagg

SEQ ID NO: 952418 - RNA, 21 nt, Human
acagacaguccauaaagugac

SEQ ID NO: 952419 - RNA, 21 nt, Human
acccccaaggccccaccccca

SEQ ID NO: 952420 - RNA, 24 nt, Human
accuaucuccuuccuuagccccaa

SEQ ID NO: 952421 - RNA, 22 nt, Human
acggggccucaggggagaacag

SEQ ID NO: 952422 - RNA, 21 nt, Human
agccccaacaggggagaagcc

SEQ ID NO: 952423 - RNA, 20 nt, Human
aggcagugaccauggaugcc

SEQ ID NO: 952424 - RNA, 23 nt, Human
aggcaguguccugggagagggcc

SEQ ID NO: 952425 - RNA, 24 nt, Human
agggaagggggucacagugguggg

SEQ ID NO: 952426 - RNA, 21 nt, Human
agggggucacaguggugggga

SEQ ID NO: 952427 - RNA, 24 nt, Human
caaggccccacccccagccaggag

SEQ ID NO: 952428 - RNA, 20 nt, Human
cacccccagccaggaguagc

SEQ ID NO: 952429 - RNA, 23 nt, Human
cagacccccaaggccccaccccc

SEQ ID NO: 952430 - RNA, 18 nt, Human
cagcaggcccccccuucc

SEQ ID NO: 952431 - RNA, 24 nt, Human
cagugaccauggaugcccagccca

SEQ ID NO: 952432 - RNA, 22 nt, Human
caguguccugggagagggcccc

SEQ ID NO: 952433 - RNA, 22 nt, Human
cccaaaccccacuccccagcag

SEQ ID NO: 952434 - RNA, 24 nt, Human
cccagacccccaaggccccacccc

SEQ ID NO: 952435 - RNA, 21 nt, Human
cccagcccagacccccaaggc

SEQ ID NO: 952436 - RNA, 21 nt, Human
ccccaaaccccacuccccagc

SEQ ID NO: 952437 - RNA, 19 nt, Human
ccccaaggccccaccccca

SEQ ID NO: 952438 - RNA, 24 nt, Human
ccccacccccagccaggaguagcu

SEQ ID NO: 952439 - RNA, 20 nt, Human
ccccacuccccagcaggccc

SEQ ID NO: 952440 - RNA, 18 nt, Human
ccccagcaggcccccccu

SEQ ID NO: 952441 - RNA, 19 nt, Human
ccccagcaggcccccccuu

SEQ ID NO: 952442 - RNA, 19 nt, Human
cccccaaaccccacucccc

SEQ ID NO: 952443 - RNA, 20 nt, Human
ccccccaaaccccacucccc

SEQ ID NO: 952444 - RNA, 23 nt, Human
ccccccaaaccccacuccccagc

SEQ ID NO: 952445 - RNA, 26 nt, Human
ccccccaaaccccacuccccagcagg

SEQ ID NO: 952446 - RNA, 19 nt, Human
ccccucccaggaacggggc

SEQ ID NO: 952447 - RNA, 21 nt, Human
ccccuggaggggccuucugcc

SEQ ID NO: 952448 - RNA, 23 nt, Human
ccuaucuccuuccuuagccccaa

SEQ ID NO: 952449 - RNA, 18 nt, Human
ccucaggggagaacaggg

SEQ ID NO: 952450 - RNA, 22 nt, Human
ccuucccugcaacucuaucugg

SEQ ID NO: 952451 - RNA, 21 nt, Human
cgcaggcagaggccuccggga

SEQ ID NO: 952452 - RNA, 21 nt, Human
cgcuggggcccgcgcggcucg

SEQ ID NO: 952453 - RNA, 23 nt, Human
cgggagugagccgggcucccagg

SEQ ID NO: 952454 - RNA, 21 nt, Human
cgggcucccaggucacagccc

SEQ ID NO: 952455 - RNA, 23 nt, Human
cgggcucccaggucacagccccu

SEQ ID NO: 952456 - RNA, 18 nt, Human
cugugccaaagaggaagg

SEQ ID NO: 952457 - RNA, 26 nt, Human
cuuagccccaacaggggagaagcaga

SEQ ID NO: 952458 - RNA, 23 nt, Human
gacuuuuauuuuaaagucaaagg

SEQ ID NO: 952459 - RNA, 25 nt, Human
gagcagucccccuggaggggccuuc

SEQ ID NO: 952460 - RNA, 20 nt, Human
gaggggcucuuuccuguugg

SEQ ID NO: 952461 - RNA, 18 nt, Human
gccccccaaaccccacuc

SEQ ID NO: 952462 - RNA, 21 nt, Human
ggccccccaaaccccacuccc

SEQ ID NO: 952463 - RNA, 19 nt, Human
gggaguggggugggguagg

SEQ ID NO: 952464 - RNA, 21 nt, Human
ggggccuucugcccagaagag

SEQ ID NO: 952465 - RNA, 21 nt, Human
uacuucugcucugucugggag

SEQ ID NO: 952466 - RNA, 27 nt, Human
uaggagccaccuaucuccuuccuuagc

SEQ ID NO: 952467 - RNA, 19 nt, Human
uaucugguaagacauaaaa

SEQ ID NO: 952468 - RNA, 23 nt, Human
ucagagggucccccagggccucu

SEQ ID NO: 952469 - RNA, 24 nt, Human
ucccccagggccucuccuucagua

SEQ ID NO: 952470 - RNA, 19 nt, Human
uccuucaguacccccaaca

SEQ ID NO: 952471 - RNA, 18 nt, Human
ucgcuggggcccgcgcgg

SEQ ID NO: 952472 - RNA, 20 nt, Human
ucugcucugucugggagugg

SEQ ID NO: 952473 - RNA, 21 nt, Human
ugagaagauggccuccucuuu

SEQ ID NO: 952474 - RNA, 20 nt, Human
ugagggaagggggucacagu

SEQ ID NO: 952475 - RNA, 22 nt, Human
ugagggaagggggucacagugg

SEQ ID NO: 952476 - RNA, 18 nt, Human
ugcaacucuaucugguaa

SEQ ID NO: 952477 - RNA, 23 nt, Human
ugccaaagaggaaggggugggug

SEQ ID NO: 952478 - RNA, 24 nt, Human
ugcucugucugggagugggguggg

SEQ ID NO: 952479 - RNA, 25 nt, Human
ugcucugucugggaguggggugggg

SEQ ID NO: 952480 - RNA, 21 nt, Human
uggcugggcugaggcagugac

SEQ ID NO: 952481 - RNA, 23 nt, Human
ugggagagggccccccaaacccc

SEQ ID NO: 952482 - RNA, 20 nt, Human
ugggaguggggugggguagg

SEQ ID NO: 952483 - RNA, 26 nt, Human
ugggggaggggcucuuuccuguugga

SEQ ID NO: 952484 - RNA, 23 nt, Human
ugguaagacauaaaaaauucucu

SEQ ID NO: 952485 - RNA, 21 nt, Human
uuggagcagucccccuggagg

SEQ ID NO: 952486 - RNA, 25 nt, Human
aaaccccagguccaccccaaucccu

SEQ ID NO: 952487 - RNA, 21 nt, Human
aaagaccugauuggcaguuuc

SEQ ID NO: 952488 - RNA, 26 nt, Human
aagcuugcaugcuaauuuguccuuag

SEQ ID NO: 952489 - RNA, 20 nt, Human
acugacuuacauccucuuca

SEQ ID NO: 952490 - RNA, 23 nt, Human
agaaacagaaguugucuggcuuu

SEQ ID NO: 952491 - RNA, 18 nt, Human
auuucuuuucagcagcuu

SEQ ID NO: 952492 - RNA, 23 nt, Human
caaacgagccacagcuguguuaa

SEQ ID NO: 952493 - RNA, 20 nt, Human
caacaugaaaauccuugaua

SEQ ID NO: 952494 - RNA, 24 nt, Human
cacaucucccucuccaccuuuuug

SEQ ID NO: 952495 - RNA, 24 nt, Human
caccaagagaagaaacagaaguug

SEQ ID NO: 952496 - RNA, 21 nt, Human
cagagcaacauccuacccuua

SEQ ID NO: 952497 - RNA, 22 nt, Human
cagcaugucauacauuaaugcu

SEQ ID NO: 952498 - RNA, 22 nt, Human
cagguccaccccaaucccucaa

SEQ ID NO: 952499 - RNA, 24 nt, Human
caucucccucuccaccuuuuugcc

SEQ ID NO: 952500 - RNA, 20 nt, Human
ccagaaagaccugauuggca

SEQ ID NO: 952501 - RNA, 25 nt, Human
ccucuucagauugcaacagagguug

SEQ ID NO: 952502 - RNA, 24 nt, Human
ccuucuucacacaucagacucaca

SEQ ID NO: 952503 - RNA, 20 nt, Human
cucacacaucucccucucca

SEQ ID NO: 952504 - RNA, 20 nt, Human
cuucccauuuugccugggaa

SEQ ID NO: 952505 - RNA, 20 nt, Human
cuuuuuaagcagaucucugg

SEQ ID NO: 952506 - RNA, 21 nt, Human
gagcaacauccuacccuuaau

SEQ ID NO: 952507 - RNA, 21 nt, Human
gagucaucaacaugaaaaucc

SEQ ID NO: 952508 - RNA, 20 nt, Human
ggaugcucacacaucucccu

SEQ ID NO: 952509 - RNA, 20 nt, Human
uaaaagggggcuccaccuuu

SEQ ID NO: 952510 - RNA, 18 nt, Human
uaaaccccagguccaccc

SEQ ID NO: 952511 - RNA, 19 nt, Human
uaaaccccagguccacccc

SEQ ID NO: 952512 - RNA, 19 nt, Human
uaaaccccagguccacccc

SEQ ID NO: 952513 - RNA, 25 nt, Human
ucagcagcuuuuuaagcagaucucu

SEQ ID NO: 952514 - RNA, 21 nt, Human
ucauuugcauuuuauuauuuc

SEQ ID NO: 952515 - RNA, 21 nt, Human
uccaccccaaucccucaaacg

SEQ ID NO: 952516 - RNA, 19 nt, Human
uccaccuuuuugccuuaaa

SEQ ID NO: 952517 - RNA, 24 nt, Human
uccaccuuuuugccuuaaauucau

SEQ ID NO: 952518 - RNA, 26 nt, Human
ucuccagcguccccaggaccagcuca

SEQ ID NO: 952519 - RNA, 19 nt, Human
ucuccccaguaaauggggg

SEQ ID NO: 952520 - RNA, 19 nt, Human
ugaaaauaaaccccagguc

SEQ ID NO: 952521 - RNA, 27 nt, Human
ugaaaauaaaccccagguccaccccaa

SEQ ID NO: 952522 - RNA, 20 nt, Human
ugaacuucuccagcgucccc

SEQ ID NO: 952523 - RNA, 18 nt, Human
ugaccaagcuugcaugcu

SEQ ID NO: 952524 - RNA, 22 nt, Human
ugagcugaaucaaaaaucuauu

SEQ ID NO: 952525 - RNA, 22 nt, Human
ugagguagggaggcaaauugag

SEQ ID NO: 952526 - RNA, 23 nt, Human
ugauugauuuuuuaaaauccacg

SEQ ID NO: 952527 - RNA, 24 nt, Human
ugauuggcaguuucacugagaguu

SEQ ID NO: 952528 - RNA, 22 nt, Human
ugcaggaugcucacacaucucc

SEQ ID NO: 952529 - RNA, 20 nt, Human
ugggaaaaguuugaccaagc

SEQ ID NO: 952530 - RNA, 22 nt, Human
uggguuacugaaaauaaacccc

SEQ ID NO: 952531 - RNA, 23 nt, Human
ugucauacauuaaugcucccaaa

SEQ ID NO: 952532 - RNA, 23 nt, Human
uucagcagcuuuuuaagcagauc

SEQ ID NO: 952533 - RNA, 23 nt, Human
uucauaaugagcugaaucaaaaa

SEQ ID NO: 952534 - RNA, 23 nt, Human
uucuugugugagguagggaggca

SEQ ID NO: 952535 - RNA, 19 nt, Human
acaccccacccccagacac

SEQ ID NO: 952536 - RNA, 19 nt, Human
acccccaggucucuggaac

SEQ ID NO: 952537 - RNA, 18 nt, Human
agacacacacuuucauac

SEQ ID NO: 952538 - RNA, 23 nt, Human
agacacacccccaggucucugga

SEQ ID NO: 952539 - RNA, 21 nt, Human
aggucucuggaacuggcccag

SEQ ID NO: 952540 - RNA, 21 nt, Human
auacgcacucacaccccaccc

SEQ ID NO: 952541 - RNA, 22 nt, Human
caccccacccccagacacaccc

SEQ ID NO: 952542 - RNA, 23 nt, Human
caccccacccccagacacacccc

SEQ ID NO: 952543 - RNA, 22 nt, Human
caguugagcgcgggguguggcc

SEQ ID NO: 952544 - RNA, 19 nt, Human
ccagacacacccccagguc

SEQ ID NO: 952545 - RNA, 20 nt, Human
cccacccccagacacacccc

SEQ ID NO: 952546 - RNA, 27 nt, Human
ccccacccccagacacacccccagguc

SEQ ID NO: 952547 - RNA, 23 nt, Human
cccccagacacacccccaggucu

SEQ ID NO: 952548 - RNA, 26 nt, Human
cccccagacacacccccaggucucug

SEQ ID NO: 952549 - RNA, 20 nt, Human
cccccaggucucuggaacug

SEQ ID NO: 952550 - RNA, 23 nt, Human
cccccaggucucuggaacuggcc

SEQ ID NO: 952551 - RNA, 22 nt, Human
ccgcagggacagggcucaaggg

SEQ ID NO: 952552 - RNA, 18 nt, Human
cgcacucacaccccaccc

SEQ ID NO: 952553 - RNA, 20 nt, Human
cgcacucacaccccaccccc

SEQ ID NO: 952554 - RNA, 24 nt, Human
cgggagcaguugagcgcggggugu

SEQ ID NO: 952555 - RNA, 22 nt, Human
cucaagggcuacccucaccccc

SEQ ID NO: 952556 - RNA, 20 nt, Human
cucacaccccacccccagac

SEQ ID NO: 952557 - RNA, 21 nt, Human
cucacaccccacccccagaca

SEQ ID NO: 952558 - RNA, 19 nt, Human
cugcugcucucacagccgc

SEQ ID NO: 952559 - RNA, 23 nt, Human
gagcgcgggguguggcgggcggc

SEQ ID NO: 952560 - RNA, 23 nt, Human
gcacucacaccccacccccagac

SEQ ID NO: 952561 - RNA, 20 nt, Human
ggcuacccucacccccaccc

SEQ ID NO: 952562 - RNA, 22 nt, Human
uacccucacccccacccggcuu

SEQ ID NO: 952563 - RNA, 29 nt, Human
uacgcacucacaccccacccccagacacc

SEQ ID NO: 952564 - RNA, 18 nt, Human
ucacaccccacccccaga

SEQ ID NO: 952565 - RNA, 18 nt, Human
uccugcugcucucacagc

SEQ ID NO: 952566 - RNA, 19 nt, Human
uggcccaggguccugcugc

SEQ ID NO: 952567 - RNA, 23 nt, Human
acagaauaugagggaacaagcag

SEQ ID NO: 952568 - RNA, 18 nt, Human
accacauucaacauacau

SEQ ID NO: 952569 - RNA, 21 nt, Human
acucccuucccuuuuuuguug

SEQ ID NO: 952570 - RNA, 19 nt, Human
agaucagaaugugugaaga

SEQ ID NO: 952571 - RNA, 18 nt, Human
aguacaaagcugacaaca

SEQ ID NO: 952572 - RNA, 23 nt, Human
cacuucuagcuuccuaucagagg

SEQ ID NO: 952573 - RNA, 24 nt, Human
ccacggcggcgccucagcugcaca

SEQ ID NO: 952574 - RNA, 19 nt, Human
ccgccgccacccgcccggg

SEQ ID NO: 952575 - RNA, 21 nt, Human
ccgccgccucugccgccgccg

SEQ ID NO: 952576 - RNA, 18 nt, Human
ccucccgccgccucugcc

SEQ ID NO: 952577 - RNA, 21 nt, Human
ccucugccgccgccgccaccc

SEQ ID NO: 952578 - RNA, 21 nt, Human
cgccucugccgccgccgccac

SEQ ID NO: 952579 - RNA, 22 nt, Human
gaacaagcagagggugcagaaa

SEQ ID NO: 952580 - RNA, 23 nt, Human
gcaguaucaacaaagaguacaaa

SEQ ID NO: 952581 - RNA, 19 nt, Human
gcgcgguccagguucccca

SEQ ID NO: 952582 - RNA, 20 nt, Human
ggaaauaagcacucccuucc

SEQ ID NO: 952583 - RNA, 19 nt, Human
ggaacucuuucaguuggcu

SEQ ID NO: 952584 - RNA, 20 nt, Human
ggaagaacagaauaugaggg

SEQ ID NO: 952585 - RNA, 22 nt, Human
gggggcgguggcuccaaggcgg

SEQ ID NO: 952586 - RNA, 22 nt, Human
gguggcuccaaggcggcuccac

SEQ ID NO: 952587 - RNA, 21 nt, Human
gugcuggagaugccugucaca

SEQ ID NO: 952588 - RNA, 21 nt, Human
uaacagccccuggcacaauua

SEQ ID NO: 952589 - RNA, 22 nt, Human
uaaguaacugugagucagaggu

SEQ ID NO: 952590 - RNA, 23 nt, Human
uaauuuaaucauauaaaccaaga

SEQ ID NO: 952591 - RNA, 23 nt, Human
uaauuuaaucauauaaaccaauc

SEQ ID NO: 952592 - RNA, 21 nt, Human
uacaacucaucugcaacacca

SEQ ID NO: 952593 - RNA, 19 nt, Human
uacagcaucaggguacagg

SEQ ID NO: 952594 - RNA, 19 nt, Human
ucaacaaagaguacaaagc

SEQ ID NO: 952595 - RNA, 22 nt, Human
uccccaacgcagcggcgaaggc

SEQ ID NO: 952596 - RNA, 21 nt, Human
ugacaacauggagugucuucu

SEQ ID NO: 952597 - RNA, 22 nt, Human
ugagggaacaagcagagggugc

SEQ ID NO: 952598 - RNA, 22 nt, Human
ugagucagaggugccucagugc

SEQ ID NO: 952599 - RNA, 19 nt, Human
ugccauguaaagguccuuc

SEQ ID NO: 952600 - RNA, 21 nt, Human
uggagugucuucuuacagaaa

SEQ ID NO: 952601 - RNA, 22 nt, Human
uggcuccaaggcggcuccacgg

SEQ ID NO: 952602 - RNA, 22 nt, Human
uguauauaacagccccuggcac

SEQ ID NO: 952603 - RNA, 18 nt, Human
uguguauauauguauaua

SEQ ID NO: 952604 - RNA, 27 nt, Human
uguucucuuuuagccauuuccccccca

SEQ ID NO: 952605 - RNA, 22 nt, Human
uuaaucauauaaaccaauccug

SEQ ID NO: 952606 - RNA, 20 nt, Human
uucaccauguuuauuugaua

SEQ ID NO: 952607 - RNA, 19 nt, Human
uucucgcuuuuaaguuuca

SEQ ID NO: 952608 - RNA, 21 nt, Human
uuguguauauauguauauaac

SEQ ID NO: 952609 - RNA, 23 nt, Human
uuuuuuuuuuuuuuuuaauguuu

SEQ ID NO: 952610 - RNA, 20 nt, Human
aaaaaaacccagucuucaga

SEQ ID NO: 952611 - RNA, 19 nt, Human
aaacaagcaaauccuucca

SEQ ID NO: 952612 - RNA, 21 nt, Human
aaacaagcaaauccuuccaaa

SEQ ID NO: 952613 - RNA, 19 nt, Human
aaacagcaacccguaaaac

SEQ ID NO: 952614 - RNA, 18 nt, Human
aacaaaaaaaacccaguc

SEQ ID NO: 952615 - RNA, 20 nt, Human
aacccauguuaaaacagcaa

SEQ ID NO: 952616 - RNA, 25 nt, Human
aagaaaaccacccauauccaaaacu

SEQ ID NO: 952617 - RNA, 21 nt, Human
aaguaaacaaaaaaguacaca

SEQ ID NO: 952618 - RNA, 21 nt, Human
aaguacacauguaagaaacaa

SEQ ID NO: 952619 - RNA, 22 nt, Human
aagugaugcagaucaaaacuga

SEQ ID NO: 952620 - RNA, 24 nt, Human
aaguuccagauuaaccaugucauu

SEQ ID NO: 952621 - RNA, 24 nt, Human
aauuacaucuaccuggaccuccau

SEQ ID NO: 952622 - RNA, 22 nt, Human
acaacaacaacaaaaaaaaccc

SEQ ID NO: 952623 - RNA, 22 nt, Human
accaaacccggaaaagaaaacc

SEQ ID NO: 952624 - RNA, 24 nt, Human
accuggaagugccacagccgaggc

SEQ ID NO: 952625 - RNA, 18 nt, Human
acucugugucccagacca

SEQ ID NO: 952626 - RNA, 23 nt, Human
agaaaaccacccauauccaaaac

SEQ ID NO: 952627 - RNA, 23 nt, Human
agaaggugaacaauguagccaaa

SEQ ID NO: 952628 - RNA, 18 nt, Human
aggcuuuagagaaggauu

SEQ ID NO: 952629 - RNA, 23 nt, Human
aggcuuuagagaaggauuccgac

SEQ ID NO: 952630 - RNA, 22 nt, Human
auggccaccaaggagcaguucu

SEQ ID NO: 952631 - RNA, 23 nt, Human
auggccaccaaggagcaguucua

SEQ ID NO: 952632 - RNA, 25 nt, Human
caaaacuuuaaagcaauaaaaauuu

SEQ ID NO: 952633 - RNA, 22 nt, Human
caaacccggaaaagaaaaccac

SEQ ID NO: 952634 - RNA, 24 nt, Human
caaaugucacaucucagucacaaa

SEQ ID NO: 952635 - RNA, 20 nt, Human
caacccacaaagaccccacu

SEQ ID NO: 952636 - RNA, 25 nt, Human
caacccguaaaacagucugcugccc

SEQ ID NO: 952637 - RNA, 19 nt, Human
cacaaguaaacaaaaaagu

SEQ ID NO: 952638 - RNA, 24 nt, Human
cauacaaagcccuggaaaagagga

SEQ ID NO: 952639 - RNA, 21 nt, Human
caugauagucuucauuuuguc

SEQ ID NO: 952640 - RNA, 24 nt, Human
ccaaacccggaaaagaaaaccacc

SEQ ID NO: 952641 - RNA, 23 nt, Human
ccaagccgaaugugcgaugcaca

SEQ ID NO: 952642 - RNA, 25 nt, Human
ccacagccgaggcaggccggggucc

SEQ ID NO: 952643 - RNA, 21 nt, Human
ccauggaucugacaaaaaccc

SEQ ID NO: 952644 - RNA, 24 nt, Human
cccacaaagaccccacuuacuacu

SEQ ID NO: 952645 - RNA, 27 nt, Human
cccauguuaaaacagcaacccguaaaa

SEQ ID NO: 952646 - RNA, 24 nt, Human
cgaaccuggaagugccacagccga

SEQ ID NO: 952647 - RNA, 24 nt, Human
cuccaacucugugucccagaccuu

SEQ ID NO: 952648 - RNA, 20 nt, Human
cugauucuguuucccuauau

SEQ ID NO: 952649 - RNA, 19 nt, Human
cuggagaucuucagugcca

SEQ ID NO: 952650 - RNA, 20 nt, Human
gaaggugaacaauguagccc

SEQ ID NO: 952651 - RNA, 28 nt, Human
gacaaaaacccauguuaaaacagcaacc

SEQ ID NO: 952652 - RNA, 23 nt, Human
gaccauggaucugacaaaaaccc

SEQ ID NO: 952653 - RNA, 24 nt, Human
gaccauggaucugacaaaaaccca

SEQ ID NO: 952654 - RNA, 18 nt, Human
gagcaguucuagaucuaa

SEQ ID NO: 952655 - RNA, 20 nt, Human
gagcaguucuagaucuaagg

SEQ ID NO: 952656 - RNA, 19 nt, Human
ggaaaagaaaaccacccau

SEQ ID NO: 952657 - RNA, 21 nt, Human
ggaaaagaaaaccacccauau

SEQ ID NO: 952658 - RNA, 24 nt, Human
ggccgcaguuuuuuuuuuuuuuuu

SEQ ID NO: 952659 - RNA, 19 nt, Human
ggggaacaacaacaacaaa

SEQ ID NO: 952660 - RNA, 22 nt, Human
gucaaaaagcuguuaacacaaa

SEQ ID NO: 952661 - RNA, 21 nt, Human
uaaaacagcaacccguaaaac

SEQ ID NO: 952662 - RNA, 22 nt, Human
uaaaacagcaacccguaaaaca

SEQ ID NO: 952663 - RNA, 27 nt, Human
uaaagggaauaagcuugguccgaaagg

SEQ ID NO: 952664 - RNA, 22 nt, Human
uaaaguucucaaauuacuuucc

SEQ ID NO: 952665 - RNA, 21 nt, Human
uaagaaacaaagugaaaaugc

SEQ ID NO: 952666 - RNA, 22 nt, Human
uaaggggaacaacaacaacaaa

SEQ ID NO: 952667 - RNA, 23 nt, Human
uacaaaaagaggcuuuagagaag

SEQ ID NO: 952668 - RNA, 21 nt, Human
uacacauguaagaaacaaagu

SEQ ID NO: 952669 - RNA, 18 nt, Human
uauccaaaacuuuaaagc

SEQ ID NO: 952670 - RNA, 19 nt, Human
uauccaaaacuuuaaagca

SEQ ID NO: 952671 - RNA, 25 nt, Human
uauuuuccaaaaaaguauuuacaga

SEQ ID NO: 952672 - RNA, 25 nt, Human
ucaaugcccaauggcacaagcuggg

SEQ ID NO: 952673 - RNA, 24 nt, Human
ucacaaguaaacaaaaaaguacac

SEQ ID NO: 952674 - RNA, 24 nt, Human
ucagaugcuugauucagucgaacc

SEQ ID NO: 952675 - RNA, 20 nt, Human
uccaacucugugucccagac

SEQ ID NO: 952676 - RNA, 23 nt, Human
uccaccaaacccggaaaagaaaa

SEQ ID NO: 952677 - RNA, 19 nt, Human
ucccaacccacaaagaccc

SEQ ID NO: 952678 - RNA, 20 nt, Human
ucccuaugggcuuuuauugg

SEQ ID NO: 952679 - RNA, 18 nt, Human
ucgaaccuggaagugcca

SEQ ID NO: 952680 - RNA, 18 nt, Human
ucucaaauuacuuuccac

SEQ ID NO: 952681 - RNA, 20 nt, Human
ucugucuucucuacacuccc

SEQ ID NO: 952682 - RNA, 22 nt, Human
ucuucccuaugggcuuuuauug

SEQ ID NO: 952683 - RNA, 21 nt, Human
ugacaaaaacccauguuaaaa

SEQ ID NO: 952684 - RNA, 20 nt, Human
ugacaagugauggggaaucc

SEQ ID NO: 952685 - RNA, 21 nt, Human
ugagggcaugacaagugaugg

SEQ ID NO: 952686 - RNA, 18 nt, Human
ugagguaccuuuuauugg

SEQ ID NO: 952687 - RNA, 22 nt, Human
ugcggccgcaguuuuuuuuuuu

SEQ ID NO: 952688 - RNA, 24 nt, Human
uggauuuuuuuucacaaacuccuu

SEQ ID NO: 952689 - RNA, 24 nt, Human
uguacauauuaaacaagcaaaucc

SEQ ID NO: 952690 - RNA, 24 nt, Human
ugucaaaaagcuguuaacacaaaa

SEQ ID NO: 952691 - RNA, 24 nt, Human
ugucgggccagcucucagcuuucc

SEQ ID NO: 952692 - RNA, 23 nt, Human
ugugagcaaaaccguacaccaaa

SEQ ID NO: 952693 - RNA, 19 nt, Human
ugugcgaugcacacagcca

SEQ ID NO: 952694 - RNA, 21 nt, Human
ugugucaaaaagcuguuaaca

SEQ ID NO: 952695 - RNA, 22 nt, Human
uuccaccaaacccggaaaagaa

SEQ ID NO: 952696 - RNA, 19 nt, Human
uucccaacccacaaagacc

SEQ ID NO: 952697 - RNA, 23 nt, Human
aaacagaccauuuggaggucagg

SEQ ID NO: 952698 - RNA, 26 nt, Human
aaauagcugggacuacaggugcacac

SEQ ID NO: 952699 - RNA, 20 nt, Human
aagcaggccugugggcugga

SEQ ID NO: 952700 - RNA, 25 nt, Human
aagugauucucccaccucagccucc

SEQ ID NO: 952701 - RNA, 19 nt, Human
aagugcugggauuauaggc

SEQ ID NO: 952702 - RNA, 19 nt, Human
aagugcugggauuauaggc

SEQ ID NO: 952703 - RNA, 23 nt, Human
aagugcugggauuauaggcguga

SEQ ID NO: 952704 - RNA, 26 nt, Human
aagugcugggauuauaggcgugagcc

SEQ ID NO: 952705 - RNA, 19 nt, Human
acaaggaacacgcaacaga

SEQ ID NO: 952706 - RNA, 24 nt, Human
accacacaucacagucuucacucc

SEQ ID NO: 952707 - RNA, 19 nt, Human
accauuuggaggucaggga

SEQ ID NO: 952708 - RNA, 25 nt, Human
accucagccucccaaauagcuggga

SEQ ID NO: 952709 - RNA, 24 nt, Human
accuuguuggccaggcuggucucg

SEQ ID NO: 952710 - RNA, 20 nt, Human
agaaagcaggccugugggcu

SEQ ID NO: 952711 - RNA, 22 nt, Human
aggccaaaacagaccauuugga

SEQ ID NO: 952712 - RNA, 23 nt, Human
aggcgugagccaccgugccuggc

SEQ ID NO: 952713 - RNA, 24 nt, Human
aggugaucugcccgccuuggccuc

SEQ ID NO: 952714 - RNA, 21 nt, Human
agguucaagugauucucccac

SEQ ID NO: 952715 - RNA, 20 nt, Human
aguagagaugggguuucacc

SEQ ID NO: 952716 - RNA, 24 nt, Human
agugauucucccaccucagccucc

SEQ ID NO: 952717 - RNA, 19 nt, Human
aucugccacccaggcuugg

SEQ ID NO: 952718 - RNA, 18 nt, Human
augggguuucaccuuguu

SEQ ID NO: 952719 - RNA, 24 nt, Human
augggguuucaccuuguuggccag

SEQ ID NO: 952720 - RNA, 23 nt, Human
caaaacagaccauuuggagguca

SEQ ID NO: 952721 - RNA, 22 nt, Human
caacagaaaaucagauuccaac

SEQ ID NO: 952722 - RNA, 20 nt, Human
caaggaacacgcaacagaaa

SEQ ID NO: 952723 - RNA, 23 nt, Human
caagucacucuccaagcaggaca

SEQ ID NO: 952724 - RNA, 22 nt, Human
caagugauucucccaccucagc

SEQ ID NO: 952725 - RNA, 27 nt, Human
caagugauucucccaccucagccuccc

SEQ ID NO: 952726 - RNA, 19 nt, Human
cacaccaccacaccuggcu

SEQ ID NO: 952727 - RNA, 21 nt, Human
caccuuguuggccaggcuggu

SEQ ID NO: 952728 - RNA, 24 nt, Human
caccuuguuggccaggcuggucuc

SEQ ID NO: 952729 - RNA, 22 nt, Human
cacgcaacagaaaaucagauuc

SEQ ID NO: 952730 - RNA, 21 nt, Human
cacugcaaccuccgccuccca

SEQ ID NO: 952731 - RNA, 21 nt, Human
cacugugcacuuugaaagagc

SEQ ID NO: 952732 - RNA, 19 nt, Human
cacuuugaaagagcugaag

SEQ ID NO: 952733 - RNA, 21 nt, Human
cagaacauucacuguauuauc

SEQ ID NO: 952734 - RNA, 21 nt, Human
caggugcacaccaccacaccu

SEQ ID NO: 952735 - RNA, 22 nt, Human
cccaaauagcugggacuacagg

SEQ ID NO: 952736 - RNA, 22 nt, Human
cccagguucaagugauucuccc

SEQ ID NO: 952737 - RNA, 24 nt, Human
ccgccucccagguucaagugauuc

SEQ ID NO: 952738 - RNA, 18 nt, Human
ccuaagugcugggauuau

SEQ ID NO: 952739 - RNA, 24 nt, Human
ccuaagugcugggauuauaggcgu

SEQ ID NO: 952740 - RNA, 24 nt, Human
ccucccagguucaagugauucucc

SEQ ID NO: 952741 - RNA, 20 nt, Human
cgcaacagaaaaucagauuc

SEQ ID NO: 952742 - RNA, 22 nt, Human
cgccucccagguucaagugauu

SEQ ID NO: 952743 - RNA, 24 nt, Human
cuaagugcugggauuauaggcgug

SEQ ID NO: 952744 - RNA, 23 nt, Human
cuaauuuuuuguauuuuuaguag

SEQ ID NO: 952745 - RNA, 24 nt, Human
cucacugcaaccuccgccucccag

SEQ ID NO: 952746 - RNA, 24 nt, Human
cucccaaauagcugggacuacagg

SEQ ID NO: 952747 - RNA, 18 nt, Human
cucccagguucaagugau

SEQ ID NO: 952748 - RNA, 24 nt, Human
cucgcucugucacccaggcuggag

SEQ ID NO: 952749 - RNA, 20 nt, Human
cucugucacccaggcuggag

SEQ ID NO: 952750 - RNA, 23 nt, Human
cugcaaccuccgccucccagguu

SEQ ID NO: 952751 - RNA, 21 nt, Human
cuggaggccgucacagggccg

SEQ ID NO: 952752 - RNA, 19 nt, Human
cugucacccaggcuggagu

SEQ ID NO: 952753 - RNA, 23 nt, Human
cuuauuuucuucauguuuaucug

SEQ ID NO: 952754 - RNA, 24 nt, Human
cuuuuaacucugaaucauccacaa

SEQ ID NO: 952755 - RNA, 20 nt, Human
gaccauuuggaggucaggga

SEQ ID NO: 952756 - RNA, 23 nt, Human
gaccucaggugaucugcccgccu

SEQ ID NO: 952757 - RNA, 24 nt, Human
gagaugggguuucaccuuguuggc

SEQ ID NO: 952758 - RNA, 18 nt, Human
gauuauaggcgugagcca

SEQ ID NO: 952759 - RNA, 21 nt, Human
gauuauaggcgugagccaccg

SEQ ID NO: 952760 - RNA, 24 nt, Human
gauuauaggcgugagccaccgugc

SEQ ID NO: 952761 - RNA, 22 nt, Human
gcaaccuccgccucccagguuc

SEQ ID NO: 952762 - RNA, 25 nt, Human
gcccgguguggacauaaucacaucu

SEQ ID NO: 952763 - RNA, 20 nt, Human
gcgauuucagcucacugcaa

SEQ ID NO: 952764 - RNA, 25 nt, Human
gcucugucacccaggcuggagugug

SEQ ID NO: 952765 - RNA, 18 nt, Human
gcuuguuuuuuuuuuucu

SEQ ID NO: 952766 - RNA, 22 nt, Human
gggcuggaggccgucacagggc

SEQ ID NO: 952767 - RNA, 18 nt, Human
gggguuucaccuuguugg

SEQ ID NO: 952768 - RNA, 22 nt, Human
gggguuucaccuuguuggccag

SEQ ID NO: 952769 - RNA, 19 nt, Human
ggucucgaacuauugaccu

SEQ ID NO: 952770 - RNA, 24 nt, Human
gugauucucccaccucagccuccc

SEQ ID NO: 952771 - RNA, 20 nt, Human
gugcacuuugaaagagcuga

SEQ ID NO: 952772 - RNA, 18 nt, Human
guggaagacaaaggauuc

SEQ ID NO: 952773 - RNA, 19 nt, Human
guggaagacaaaggauucu

SEQ ID NO: 952774 - RNA, 24 nt, Human
uaagugcugggauuauaggcguga

SEQ ID NO: 952775 - RNA, 24 nt, Human
uaauuuuuuguauuuuuaguagag

SEQ ID NO: 952776 - RNA, 22 nt, Human
uacaggugcacaccaccacacc

SEQ ID NO: 952777 - RNA, 19 nt, Human
uaguagagaugggguuuca

SEQ ID NO: 952778 - RNA, 24 nt, Human
uaguagagaugggguuucaccuug

SEQ ID NO: 952779 - RNA, 26 nt, Human
uaguagagaugggguuucaccuuguu

SEQ ID NO: 952780 - RNA, 23 nt, Human
uauaggcgugagccaccgugccu

SEQ ID NO: 952781 - RNA, 21 nt, Human
ucacccaggcuggaguguggu

SEQ ID NO: 952782 - RNA, 19 nt, Human
ucacugcaaccuccgccuc

SEQ ID NO: 952783 - RNA, 24 nt, Human
ucacugcaaccuccgccucccagg

SEQ ID NO: 952784 - RNA, 25 nt, Human
ucacugcaaccuccgccucccaggu

SEQ ID NO: 952785 - RNA, 27 nt, Human
ucacugcaaccuccgccucccagguuc

SEQ ID NO: 952786 - RNA, 18 nt, Human
ucagccucccaaauagcu

SEQ ID NO: 952787 - RNA, 20 nt, Human
ucagccucccaaauagcugg

SEQ ID NO: 952788 - RNA, 27 nt, Human
ucagcucacugcaaccuccgccuccca

SEQ ID NO: 952789 - RNA, 21 nt, Human
uccaagcaggacagauuaagg

SEQ ID NO: 952790 - RNA, 24 nt, Human
ucccaaauagcugggacuacaggu

SEQ ID NO: 952791 - RNA, 21 nt, Human
ucccagguucaagugauucuc

SEQ ID NO: 952792 - RNA, 23 nt, Human
ucccagguucaagugauucuccc

SEQ ID NO: 952793 - RNA, 20 nt, Human
ucccagucuccauuuuucuu

SEQ ID NO: 952794 - RNA, 24 nt, Human
ucccuaagugcugggauuauaggc

SEQ ID NO: 952795 - RNA, 24 nt, Human
ucuauggcuacaaggaaccggggc

SEQ ID NO: 952796 - RNA, 20 nt, Human
ucuccaagcaggacagauua

SEQ ID NO: 952797 - RNA, 23 nt, Human
ucucccaccucagccucccaaau

SEQ ID NO: 952798 - RNA, 26 nt, Human
ucucccaccucagccucccaaauagc

SEQ ID NO: 952799 - RNA, 19 nt, Human
ucucgcucugucacccagg

SEQ ID NO: 952800 - RNA, 23 nt, Human
ucucgcucugucacccaggcugg

SEQ ID NO: 952801 - RNA, 24 nt, Human
ucucgcucugucacccaggcugga

SEQ ID NO: 952802 - RNA, 18 nt, Human
ugaccucaggugaucugc

SEQ ID NO: 952803 - RNA, 20 nt, Human
ugaccucaggugaucugccc

SEQ ID NO: 952804 - RNA, 22 nt, Human
ugaccucaggugaucugcccgc

SEQ ID NO: 952805 - RNA, 24 nt, Human
ugaccucaggugaucugcccgccu

SEQ ID NO: 952806 - RNA, 20 nt, Human
ugaguggaagacaaaggauu

SEQ ID NO: 952807 - RNA, 21 nt, Human
ugaguggaagacaaaggauuc

SEQ ID NO: 952808 - RNA, 20 nt, Human
ugauucucccaccucagccu

SEQ ID NO: 952809 - RNA, 19 nt, Human
ugcugagccacauaugggg

SEQ ID NO: 952810 - RNA, 21 nt, Human
ugcugagccacauauggggac

SEQ ID NO: 952811 - RNA, 18 nt, Human
uggaggccgucacagggc

SEQ ID NO: 952812 - RNA, 24 nt, Human
uggccaggcuggucucgaacuauu

SEQ ID NO: 952813 - RNA, 19 nt, Human
uggccugcuugguuaacuu

SEQ ID NO: 952814 - RNA, 24 nt, Human
ugggacuacaggugcacaccacca

SEQ ID NO: 952815 - RNA, 18 nt, Human
ugggauuauaggcgugag

SEQ ID NO: 952816 - RNA, 21 nt, Human
ugggauuauaggcgugagcca

SEQ ID NO: 952817 - RNA, 22 nt, Human
ugggauuauaggcgugagccac

SEQ ID NO: 952818 - RNA, 23 nt, Human
ugggauuauaggcgugagccacc

SEQ ID NO: 952819 - RNA, 23 nt, Human
ugggauuauaggcgugagccacc

SEQ ID NO: 952820 - RNA, 24 nt, Human
ugggauuauaggcgugagccaccg

SEQ ID NO: 952821 - RNA, 24 nt, Human
ugggguuucaccuuguuggccagg

SEQ ID NO: 952822 - RNA, 21 nt, Human
uguauuuuuaguagagauggg

SEQ ID NO: 952823 - RNA, 19 nt, Human
ugucacccaggcuggagug

SEQ ID NO: 952824 - RNA, 24 nt, Human
ugugcacuuugaaagagcugaaac

SEQ ID NO: 952825 - RNA, 19 nt, Human
uguuuuuuuuuuucuuuga

SEQ ID NO: 952826 - RNA, 24 nt, Human
uuaguagagaugggguuucaccuu

SEQ ID NO: 952827 - RNA, 25 nt, Human
uuaguagagaugggguuucaccuug

SEQ ID NO: 952828 - RNA, 23 nt, Human
uucaagugauucucccaccucag

SEQ ID NO: 952829 - RNA, 24 nt, Human
uucaagugauucucccaccucagc

SEQ ID NO: 952830 - RNA, 19 nt, Human
uuccaggaugggagcccau

SEQ ID NO: 952831 - RNA, 20 nt, Human
uucuucagcgagaacucugg

SEQ ID NO: 952832 - RNA, 20 nt, Human
uuggaggucagggaugccau

SEQ ID NO: 952833 - RNA, 22 nt, Human
uuucaccuuguuggccaggcug

SEQ ID NO: 952834 - RNA, 23 nt, Human
uuucaccuuguuggccaggcugu

SEQ ID NO: 952835 - RNA, 24 nt, Human
uuuuuaguagagaugggguuucac

SEQ ID NO: 952836 - RNA, 21 nt, Human
uuuuuguauuuuuaguagaga

SEQ ID NO: 952837 - RNA, 24 nt, Human
uuuuuuguauuuuuaguagagaug

SEQ ID NO: 952838 - RNA, 25 nt, Human
uuuuuuuucuuugaaacacagucuc

SEQ ID NO: 952839 - RNA, 20 nt, Human
uuuuuuuuuuuuuuucucac

SEQ ID NO: 952840 - RNA, 23 nt, Human
augauuuugcaaugauuuucucu

SEQ ID NO: 952841 - RNA, 24 nt, Human
auuuugcaaugauuuucucuccca

SEQ ID NO: 952842 - RNA, 18 nt, Human
caaaagcgugggugaaaa

SEQ ID NO: 952843 - RNA, 22 nt, Human
caacugaccuguaaaaaagucc

SEQ ID NO: 952844 - RNA, 21 nt, Human
caccugaaaaaacccauaguu

SEQ ID NO: 952845 - RNA, 23 nt, Human
ccaguaacuuauaaaaauacuuu

SEQ ID NO: 952846 - RNA, 23 nt, Human
cccauaguuuuuugccucaacug

SEQ ID NO: 952847 - RNA, 19 nt, Human
gcgggcuccaccaaacacc

SEQ ID NO: 952848 - RNA, 25 nt, Human
guaaacuuuauuguaccgaacaaaa

SEQ ID NO: 952849 - RNA, 26 nt, Human
ucucccacaaaagcgugggugaaaac

SEQ ID NO: 952850 - RNA, 22 nt, Human
ugaccuguaaaaaaguccaccu

SEQ ID NO: 952851 - RNA, 22 nt, Human
ugcaaugauuuucucucccaca

SEQ ID NO: 952852 - RNA, 23 nt, Human
ugcaaugauuuucucucccacaa

SEQ ID NO: 952853 - RNA, 22 nt, Human
caaggccuccccacaggagccc

SEQ ID NO: 952854 - RNA, 18 nt, Human
cccccaggccugggggcu

SEQ ID NO: 952855 - RNA, 19 nt, Human
cugugcccccaggccuggg

SEQ ID NO: 952856 - RNA, 19 nt, Human
ggcaaggcugggcugcugg

SEQ ID NO: 952857 - RNA, 21 nt, Human
ggccugggggcugucacaggc

SEQ ID NO: 952858 - RNA, 19 nt, Human
gguuugcuucaggcuguag

SEQ ID NO: 952859 - RNA, 23 nt, Human
uagggggugaguggguggaggca

SEQ ID NO: 952860 - RNA, 18 nt, Human
ucagagaggcaaggcugg

SEQ ID NO: 952861 - RNA, 20 nt, Human
ucugugcccccaggccuggg

SEQ ID NO: 952862 - RNA, 22 nt, Human
ugaguggguggaggcaauggga

SEQ ID NO: 952863 - RNA, 19 nt, Human
ugcaggcucaaggagccca

SEQ ID NO: 952864 - RNA, 20 nt, Human
uguagggggugagugggugg

SEQ ID NO: 952865 - RNA, 19 nt, Human
uuuuuuuuuuuuuuuuuaa

SEQ ID NO: 952866 - RNA, 25 nt, Human
aaaagaaaaaaaaaggcuguuuaag

SEQ ID NO: 952867 - RNA, 24 nt, Human
agaaaaaaaaaggcuguuuaagaa

SEQ ID NO: 952868 - RNA, 27 nt, Human
caaauaaguucuuaaucuccaaagucu

SEQ ID NO: 952869 - RNA, 19 nt, Human
cagacggguccgacaguua

SEQ ID NO: 952870 - RNA, 23 nt, Human
cagcauaaccacgugccucgugc

SEQ ID NO: 952871 - RNA, 24 nt, Human
cagcauaaccacgugccucgugcc

SEQ ID NO: 952872 - RNA, 24 nt, Human
cagcugaaguuacuuuuccuacag

SEQ ID NO: 952873 - RNA, 21 nt, Human
cauaaccacgugccucgugcc

SEQ ID NO: 952874 - RNA, 23 nt, Human
ccaaauuauuucccuaauucuua

SEQ ID NO: 952875 - RNA, 23 nt, Human
cccccgcacucccgcucugauac

SEQ ID NO: 952876 - RNA, 18 nt, Human
ccguauaauugccuagaa

SEQ ID NO: 952877 - RNA, 19 nt, Human
cgcuuuggggcugcagcug

SEQ ID NO: 952878 - RNA, 18 nt, Human
cggcccaaacuccggcag

SEQ ID NO: 952879 - RNA, 22 nt, Human
cggcucggcucacucgcuuugg

SEQ ID NO: 952880 - RNA, 20 nt, Human
cuccaaagucucgguugugg

SEQ ID NO: 952881 - RNA, 19 nt, Human
uaagaauagaacucauucc

SEQ ID NO: 952882 - RNA, 24 nt, Human
uaagucucugaaauauggccaacu

SEQ ID NO: 952883 - RNA, 24 nt, Human
uaaguucuuaaucuccaaagucuc

SEQ ID NO: 952884 - RNA, 28 nt, Human
ucaaugaaggcagcggccagguccuucu

SEQ ID NO: 952885 - RNA, 19 nt, Human
uccaacauuaaaaagaaaa

SEQ ID NO: 952886 - RNA, 25 nt, Human
uccaacauuaaaaagaaaaaaaaag

SEQ ID NO: 952887 - RNA, 22 nt, Human
ucccuuuaaacucaaugaaggc

SEQ ID NO: 952888 - RNA, 19 nt, Human
uccggcagcauaaccacgu

SEQ ID NO: 952889 - RNA, 18 nt, Human
ucgcuuuggggcugcagc

SEQ ID NO: 952890 - RNA, 18 nt, Human
ucuccaaagucucgguug

SEQ ID NO: 952891 - RNA, 18 nt, Human
ugaaacuguuuguuuucu

SEQ ID NO: 952892 - RNA, 21 nt, Human
ugcaguccaacacuuacauac

SEQ ID NO: 952893 - RNA, 19 nt, Human
uguuuucuuucccuccccc

SEQ ID NO: 952894 - RNA, 19 nt, Human
uuaaaaagaaaaaaaaagg

SEQ ID NO: 952895 - RNA, 22 nt, Human
uuaaauccucaaauaaguucuu

SEQ ID NO: 952896 - RNA, 19 nt, Human
uuuaaaacagucacuugcc

SEQ ID NO: 952897 - RNA, 21 nt, Human
uuuuuuuuuuuuuaaaaguca

SEQ ID NO: 952898 - RNA, 23 nt, Human
uuuuuuuuuuuuuuuuuuaaaag

SEQ ID NO: 952899 - RNA, 23 nt, Human
aauauaauccaugcuaacuaccu

SEQ ID NO: 952900 - RNA, 24 nt, Human
acccguggagggcgcggggagcgg

SEQ ID NO: 952901 - RNA, 18 nt, Human
agggggccguuacccgug

SEQ ID NO: 952902 - RNA, 24 nt, Human
cacagaucucuaggagaaaggcuu

SEQ ID NO: 952903 - RNA, 18 nt, Human
caugcuaacuaccucuaa

SEQ ID NO: 952904 - RNA, 22 nt, Human
cccguggagggcgcggggagcg

SEQ ID NO: 952905 - RNA, 22 nt, Human
cccguggagggcgcggggagcg

SEQ ID NO: 952906 - RNA, 20 nt, Human
cgagagagggggccguuacc

SEQ ID NO: 952907 - RNA, 19 nt, Human
cgccaggaggcacagaucu

SEQ ID NO: 952908 - RNA, 20 nt, Human
gaaaggcuugcagacaagga

SEQ ID NO: 952909 - RNA, 20 nt, Human
gagaaaggcuugcagacaag

SEQ ID NO: 952910 - RNA, 18 nt, Human
gagagccaccugucgaca

SEQ ID NO: 952911 - RNA, 21 nt, Human
ucccugcccucuggggacagg

SEQ ID NO: 952912 - RNA, 23 nt, Human
ucgccaggaggcacagaucucua

SEQ ID NO: 952913 - RNA, 24 nt, Human
ugccuuccuuuucuaucccugccc

SEQ ID NO: 952914 - RNA, 19 nt, Human
uuuuuuuuuuuuuuuuuaa

SEQ ID NO: 952915 - RNA, 24 nt, Human
aaauacaacauaauuucuauaacc

SEQ ID NO: 952916 - RNA, 20 nt, Human
acuaaauacaacauaauuuc

SEQ ID NO: 952917 - RNA, 18 nt, Human
cacgugcuccugcucuuc

SEQ ID NO: 952918 - RNA, 22 nt, Human
cagccaggcucccagcucuguu

SEQ ID NO: 952919 - RNA, 19 nt, Human
ccccgcgauaacacgcccc

SEQ ID NO: 952920 - RNA, 25 nt, Human
ccccuggcagccaggcucccagcuc

SEQ ID NO: 952921 - RNA, 23 nt, Human
ccugcggggcaacgguggcuguc

SEQ ID NO: 952922 - RNA, 23 nt, Human
cucccaggcugcccccgcgauaa

SEQ ID NO: 952923 - RNA, 21 nt, Human
gcagccaggcucccagcucug

SEQ ID NO: 952924 - RNA, 20 nt, Human
gccaggcucccagcucuguu

SEQ ID NO: 952925 - RNA, 22 nt, Human
gccccuggcagccaggcuccca

SEQ ID NO: 952926 - RNA, 19 nt, Human
gcugcccccgcgauaacac

SEQ ID NO: 952927 - RNA, 20 nt, Human
guggcuguccuuggcccggc

SEQ ID NO: 952928 - RNA, 25 nt, Human
uaaauacaacauaauuucuauaacc

SEQ ID NO: 952929 - RNA, 19 nt, Human
uaacacgccccuggcagcc

SEQ ID NO: 952930 - RNA, 19 nt, Human
uccugccgcggcgcagcag

SEQ ID NO: 952931 - RNA, 23 nt, Human
ucuuccaggguguccucggcugu

SEQ ID NO: 952932 - RNA, 18 nt, Human
ugaggggacucgcacauc

SEQ ID NO: 952933 - RNA, 20 nt, Human
ugccgcggcgcagcagcgcu

SEQ ID NO: 952934 - RNA, 26 nt, Human
ugcuccugcucuuccaggguguccuc

SEQ ID NO: 952935 - RNA, 24 nt, Human
uuccaggguguccucggcuguuuc

SEQ ID NO: 952936 - RNA, 21 nt, Human
aaggggagagggaaaagugag

SEQ ID NO: 952937 - RNA, 27 nt, Human
acgccggagccagacaugaguuggaaa

SEQ ID NO: 952938 - RNA, 21 nt, Human
agaaggccgagaggacgaggg

SEQ ID NO: 952939 - RNA, 19 nt, Human
agagcaaguacugcagcag

SEQ ID NO: 952940 - RNA, 21 nt, Human
agauggcccgaucuccggagc

SEQ ID NO: 952941 - RNA, 20 nt, Human
agcugauuggucagugcagc

SEQ ID NO: 952942 - RNA, 20 nt, Human
aggacgaggggugggguucu

SEQ ID NO: 952943 - RNA, 22 nt, Human
aggagggacagacaucucaaaa

SEQ ID NO: 952944 - RNA, 20 nt, Human
caaggggagcugauugguca

SEQ ID NO: 952945 - RNA, 18 nt, Human
cagacugcaggaaggacc

SEQ ID NO: 952946 - RNA, 20 nt, Human
caggaaaaauggugaucaga

SEQ ID NO: 952947 - RNA, 24 nt, Human
caugaguuggaaaacuaauuugcu

SEQ ID NO: 952948 - RNA, 22 nt, Human
ccacauucucuccgccucucgg

SEQ ID NO: 952949 - RNA, 23 nt, Human
ccacauucucuccgccucucggg

SEQ ID NO: 952950 - RNA, 25 nt, Human
ccgagaggacgaggggugggguucu

SEQ ID NO: 952951 - RNA, 19 nt, Human
cgaggggugggguucuggg

SEQ ID NO: 952952 - RNA, 23 nt, Human
cggggguggguuaggagaguggg

SEQ ID NO: 952953 - RNA, 21 nt, Human
cuccggagccuaggccucucu

SEQ ID NO: 952954 - RNA, 23 nt, Human
cuggcgacuuuauucaaagggga

SEQ ID NO: 952955 - RNA, 26 nt, Human
gaagugcucccacauucucuccgccu

SEQ ID NO: 952956 - RNA, 21 nt, Human
gacgaggggugggguucuggg

SEQ ID NO: 952957 - RNA, 22 nt, Human
gacugcaggaaggaccuuccag

SEQ ID NO: 952958 - RNA, 20 nt, Human
gcggggcugggggaaggguc

SEQ ID NO: 952959 - RNA, 20 nt, Human
ggcugggggaagggucgcuc

SEQ ID NO: 952960 - RNA, 24 nt, Human
gggugggguucuggguguccugag

SEQ ID NO: 952961 - RNA, 23 nt, Human
ggguguccugaggggcggggcug

SEQ ID NO: 952962 - RNA, 22 nt, Human
ggugaucagacugcaggaagga

SEQ ID NO: 952963 - RNA, 23 nt, Human
ggugggguucuggguguccugag

SEQ ID NO: 952964 - RNA, 20 nt, Human
gguucuggguguccugaggg

SEQ ID NO: 952965 - RNA, 18 nt, Human
gugagagaguugggucau

SEQ ID NO: 952966 - RNA, 19 nt, Human
guugggucauuucugggau

SEQ ID NO: 952967 - RNA, 21 nt, Human
uaaccuggagagggguggguc

SEQ ID NO: 952968 - RNA, 18 nt, Human
ucccgagguugaaggccu

SEQ ID NO: 952969 - RNA, 24 nt, Human
ucucuggagcuccagggaggaggg

SEQ ID NO: 952970 - RNA, 23 nt, Human
ugcggcaaaguuagagcaaguac

SEQ ID NO: 952971 - RNA, 19 nt, Human
uggguguccugaggggcgg

SEQ ID NO: 952972 - RNA, 19 nt, Human
uucaaaggggagagggaaa

SEQ ID NO: 952973 - RNA, 22 nt, Human
uucaaaggggagagggaaaagu

SEQ ID NO: 952974 - RNA, 18 nt, Human
uuuuuuuuuuuuuuuuug

SEQ ID NO: 952975 - RNA, 20 nt, Human
uuuuuuuuuuuuuuuuugcu

SEQ ID NO: 952976 - RNA, 24 nt, Human
uuuuuuuuuuuuuuuuugcucuag

SEQ ID NO: 952977 - RNA, 18 nt, Human
aaagaagagacguuggcu

SEQ ID NO: 952978 - RNA, 23 nt, Human
aaccuagaacacuguacuucauc

SEQ ID NO: 952979 - RNA, 18 nt, Human
aagaagcggcgccucucg

SEQ ID NO: 952980 - RNA, 24 nt, Human
acaaagccuccgccagagcgggag

SEQ ID NO: 952981 - RNA, 23 nt, Human
caaagccuccgccagagcgggag

SEQ ID NO: 952982 - RNA, 23 nt, Human
cacccuggggcccagcccgcagc

SEQ ID NO: 952983 - RNA, 20 nt, Human
cagaaaccuugguucaugcc

SEQ ID NO: 952984 - RNA, 18 nt, Human
ccagagcgggagaaagaa

SEQ ID NO: 952985 - RNA, 18 nt, Human
cccuggggcccagcccgc

SEQ ID NO: 952986 - RNA, 24 nt, Human
gaacacuguacuucaucuucaaau

SEQ ID NO: 952987 - RNA, 20 nt, Human
gacaaagccuccgccagagc

SEQ ID NO: 952988 - RNA, 19 nt, Human
gagaaagcggaagaagcgg

SEQ ID NO: 952989 - RNA, 24 nt, Human
gcccgcagcgacaaagccuccgcc

SEQ ID NO: 952990 - RNA, 20 nt, Human
ggcccagcccgcagcgacaa

SEQ ID NO: 952991 - RNA, 25 nt, Human
uagugcaauauaucaaugagguauc

SEQ ID NO: 952992 - RNA, 23 nt, Human
uauccaccaacugauauuucauu

SEQ ID NO: 952993 - RNA, 23 nt, Human
ucucagcaaaccuagaacacugu

SEQ ID NO: 952994 - RNA, 23 nt, Human
ugaaaucagcuaucacacauauc

SEQ ID NO: 952995 - RNA, 23 nt, Human
ugagguaucauuuaagaggcaaa

SEQ ID NO: 952996 - RNA, 23 nt, Human
aaacugaaagaagaauacggaac

SEQ ID NO: 952997 - RNA, 18 nt, Human
agaaacugaaagaagaau

SEQ ID NO: 952998 - RNA, 26 nt, Human
caaauucugccaaaccacgggcuagg

SEQ ID NO: 952999 - RNA, 23 nt, Human
caccccugaauucagucaaauuc

SEQ ID NO: 953000 - RNA, 22 nt, Human
ccgcagugcaugcauuucuucu

SEQ ID NO: 953001 - RNA, 24 nt, Human
ccucacuuucacccccuccacuuc

SEQ ID NO: 953002 - RNA, 20 nt, Human
cgaaaaugaagcuaaucuaa

SEQ ID NO: 953003 - RNA, 20 nt, Human
cucacuuucacccccuccac

SEQ ID NO: 953004 - RNA, 18 nt, Human
guccauucuccucccuca

SEQ ID NO: 953005 - RNA, 24 nt, Human
uauucuguccauucuccucccuca

SEQ ID NO: 953006 - RNA, 19 nt, Human
ucaaauacacuuggacugg

SEQ ID NO: 953007 - RNA, 19 nt, Human
ucccucacuuucacccccu

SEQ ID NO: 953008 - RNA, 23 nt, Human
ucccucacuuucacccccuccac

SEQ ID NO: 953009 - RNA, 20 nt, Human
uuauuccgcucuucgcauau

SEQ ID NO: 953010 - RNA, 25 nt, Human
uucuucuaaguacacaagucuucag

SEQ ID NO: 953011 - RNA, 19 nt, Human
uuuuuuuuuucacuaaacu

SEQ ID NO: 953012 - RNA, 24 nt, Human
uuuuuuuuuuuuuuuuuucacuaa

SEQ ID NO: 953013 - RNA, 24 nt, Human
aaaacaaacaacaaacacacuugg

SEQ ID NO: 953014 - RNA, 19 nt, Human
aaacaaacaacaaacacac

SEQ ID NO: 953015 - RNA, 28 nt, Human
aaacaaacaacaaacacacuuggucccu

SEQ ID NO: 953016 - RNA, 22 nt, Human
aaacaagauacaaaacaaacaa

SEQ ID NO: 953017 - RNA, 18 nt, Human
aacacuauucccccaccu

SEQ ID NO: 953018 - RNA, 24 nt, Human
aaccaccuccacgaccuccgaccu

SEQ ID NO: 953019 - RNA, 21 nt, Human
aagauacaaaacaaacaacaa

SEQ ID NO: 953020 - RNA, 18 nt, Human
aagugaucccugacaccc

SEQ ID NO: 953021 - RNA, 21 nt, Human
aagugaucccugacacccacc

SEQ ID NO: 953022 - RNA, 25 nt, Human
aagugucaaagaucccaagugaucc

SEQ ID NO: 953023 - RNA, 23 nt, Human
acaagauacaaaacaaacaacaa

SEQ ID NO: 953024 - RNA, 23 nt, Human
agaaaaacaagauacaaaacaaa

SEQ ID NO: 953025 - RNA, 19 nt, Human
agucgucucugucuuggag

SEQ ID NO: 953026 - RNA, 18 nt, Human
augcuacacacacaucca

SEQ ID NO: 953027 - RNA, 28 nt, Human
caaaacaaacaacaaacacacuuggucc

SEQ ID NO: 953028 - RNA, 27 nt, Human
caacaaacacacuuggucccuucagac

SEQ ID NO: 953029 - RNA, 22 nt, Human
caaccaccgagagccgcccaga

SEQ ID NO: 953030 - RNA, 22 nt, Human
caagugaucccugacacccacc

SEQ ID NO: 953031 - RNA, 19 nt, Human
cacccugggccaggcuggg

SEQ ID NO: 953032 - RNA, 20 nt, Human
caccuccaccuuagguggcu

SEQ ID NO: 953033 - RNA, 21 nt, Human
caccuccaccuuagguggcug

SEQ ID NO: 953034 - RNA, 21 nt, Human
caccucccccuuggccugcug

SEQ ID NO: 953035 - RNA, 21 nt, Human
cagaaaaacaagauacaaaac

SEQ ID NO: 953036 - RNA, 22 nt, Human
cagccacccgcacacaacucag

SEQ ID NO: 953037 - RNA, 25 nt, Human
cagcccccacccucucagccccucc

SEQ ID NO: 953038 - RNA, 19 nt, Human
cagccccuccccugccagc

SEQ ID NO: 953039 - RNA, 19 nt, Human
cagucccucagcuccugcc

SEQ ID NO: 953040 - RNA, 23 nt, Human
cagucgucucugucuuggagggc

SEQ ID NO: 953041 - RNA, 22 nt, Human
ccaccuccacgaccuccgaccu

SEQ ID NO: 953042 - RNA, 26 nt, Human
ccacgcucgcaccucccccuuggccu

SEQ ID NO: 953043 - RNA, 18 nt, Human
cccaaaaguucagucguc

SEQ ID NO: 953044 - RNA, 23 nt, Human
cccaagugaucccugacacccac

SEQ ID NO: 953045 - RNA, 23 nt, Human
cccacccucucagccccuccccu

SEQ ID NO: 953046 - RNA, 22 nt, Human
cccagacccgucccagguccac

SEQ ID NO: 953047 - RNA, 18 nt, Human
cccagguccacgcucgca

SEQ ID NO: 953048 - RNA, 22 nt, Human
ccccaaaaguucagucgucucu

SEQ ID NO: 953049 - RNA, 18 nt, Human
ccccacccucucagcccc

SEQ ID NO: 953050 - RNA, 20 nt, Human
ccccacccucucagccccuc

SEQ ID NO: 953051 - RNA, 22 nt, Human
cccgcacacaacucaaugagcu

SEQ ID NO: 953052 - RNA, 23 nt, Human
cccucagcuccugccucuagucu

SEQ ID NO: 953053 - RNA, 21 nt, Human
cccugacacccaccccuuccu

SEQ ID NO: 953054 - RNA, 22 nt, Human
cccugccagcucaacucugcag

SEQ ID NO: 953055 - RNA, 23 nt, Human
ccucccggggagggguuccagcc

SEQ ID NO: 953056 - RNA, 22 nt, Human
ccugacacccaccccuuccuac

SEQ ID NO: 953057 - RNA, 22 nt, Human
ccuuagguggcugccucaguuu

SEQ ID NO: 953058 - RNA, 18 nt, Human
cgaccuccccccucccuc

SEQ ID NO: 953059 - RNA, 20 nt, Human
cgaccuccgaccuccccccu

SEQ ID NO: 953060 - RNA, 23 nt, Human
cgaugggggaaggcuuaaacgca

SEQ ID NO: 953061 - RNA, 22 nt, Human
cggggagggguuccagccccca

SEQ ID NO: 953062 - RNA, 21 nt, Human
cucaacucugcaguacacgau

SEQ ID NO: 953063 - RNA, 18 nt, Human
cucagccccuccccugcc

SEQ ID NO: 953064 - RNA, 20 nt, Human
cucgcaccucccccuuggcc

SEQ ID NO: 953065 - RNA, 24 nt, Human
cugccagcucaacucugcaguaca

SEQ ID NO: 953066 - RNA, 22 nt, Human
cuggaagccuuguuggccccua

SEQ ID NO: 953067 - RNA, 20 nt, Human
gauacaaaacaaacaacaag

SEQ ID NO: 953068 - RNA, 24 nt, Human
gccggagcguagaagccgcagcua

SEQ ID NO: 953069 - RNA, 23 nt, Human
gcugccucaguuuuccaaccacu

SEQ ID NO: 953070 - RNA, 23 nt, Human
gcuggaagccuuguuggccccua

SEQ ID NO: 953071 - RNA, 23 nt, Human
ggaaacacuauucccccaccucc

SEQ ID NO: 953072 - RNA, 18 nt, Human
ggagcagcccagcugcuc

SEQ ID NO: 953073 - RNA, 21 nt, Human
ggcacugucggcccccucagg

SEQ ID NO: 953074 - RNA, 26 nt, Human
ggcguuugcugaugaacucagagugc

SEQ ID NO: 953075 - RNA, 22 nt, Human
gguacaugcuacacacacaucc

SEQ ID NO: 953076 - RNA, 22 nt, Human
uaagauacacaaaccaccucca

SEQ ID NO: 953077 - RNA, 19 nt, Human
uaagauagcugccuacaac

SEQ ID NO: 953078 - RNA, 21 nt, Human
uacaaaacaaacaacaaacac

SEQ ID NO: 953079 - RNA, 25 nt, Human
uacacaaaccaccuccacgaccucc

SEQ ID NO: 953080 - RNA, 18 nt, Human
uagauggaagacccagau

SEQ ID NO: 953081 - RNA, 20 nt, Human
ucaguaacaaaaauaauaag

SEQ ID NO: 953082 - RNA, 21 nt, Human
ucagucgucucugucuuggag

SEQ ID NO: 953083 - RNA, 19 nt, Human
uccaccccaaaaguucagu

SEQ ID NO: 953084 - RNA, 22 nt, Human
uccaugcuacaguacugagggg

SEQ ID NO: 953085 - RNA, 21 nt, Human
ucccagguccacgcucgcacc

SEQ ID NO: 953086 - RNA, 24 nt, Human
ucccucagcuccugccuuccucgg

SEQ ID NO: 953087 - RNA, 19 nt, Human
ucccuccggcugcucugag

SEQ ID NO: 953088 - RNA, 21 nt, Human
ucccuccggcugcucugagga

SEQ ID NO: 953089 - RNA, 22 nt, Human
uccgaucagaaaaacaagauac

SEQ ID NO: 953090 - RNA, 24 nt, Human
ucugucuuggagggcacugucggc

SEQ ID NO: 953091 - RNA, 21 nt, Human
ucuuccuucacccugggccag

SEQ ID NO: 953092 - RNA, 18 nt, Human
ugaggacagacgccaggg

SEQ ID NO: 953093 - RNA, 21 nt, Human
ugaucccugacacccaccccu

SEQ ID NO: 953094 - RNA, 21 nt, Human
uggaagccuuguuggccccua

SEQ ID NO: 953095 - RNA, 24 nt, Human
uggaagccuuguuggccccuaagc

SEQ ID NO: 953096 - RNA, 21 nt, Human
uggccccuaagccuuuguucc

SEQ ID NO: 953097 - RNA, 21 nt, Human
ugggaaacacuauucccccac

SEQ ID NO: 953098 - RNA, 21 nt, Human
ugucaguaacaaaaauaauaa

SEQ ID NO: 953099 - RNA, 26 nt, Human
ugucaguaacaaaaauaauaagguac

SEQ ID NO: 953100 - RNA, 19 nt, Human
uucagucgucucugucuug

SEQ ID NO: 953101 - RNA, 23 nt, Human
uuccagcccccacccucucagcc

SEQ ID NO: 953102 - RNA, 19 nt, Human
uucccccaccuccaccuua

SEQ ID NO: 953103 - RNA, 25 nt, Human
uuuuuuguuuuaacaaacauguuua

SEQ ID NO: 953104 - RNA, 18 nt, Human
uuuuuuuuuuuuuuuuug

SEQ ID NO: 953105 - RNA, 22 nt, Human
uuuuuuuuuuuuuuuuuguuuu

SEQ ID NO: 953106 - RNA, 24 nt, Human
uuuuuuuuuuuuuuuuuguuuuaa

SEQ ID NO: 953107 - RNA, 23 nt, Human
aaauaacuguuaaauaggauuuu

SEQ ID NO: 953108 - RNA, 18 nt, Human
aauaaauggcauagaaaa

SEQ ID NO: 953109 - RNA, 19 nt, Human
agagagguagcacgucuuc

SEQ ID NO: 953110 - RNA, 21 nt, Human
aggcacagaaaguugucagcu

SEQ ID NO: 953111 - RNA, 23 nt, Human
caacagaaaggaaaaggcacaga

SEQ ID NO: 953112 - RNA, 19 nt, Human
ucaacagaaaggaaaaggc

SEQ ID NO: 953113 - RNA, 19 nt, Human
ucaugggaaagaaggggau

SEQ ID NO: 953114 - RNA, 23 nt, Human
ucucucaugggaaagaaggggau

SEQ ID NO: 953115 - RNA, 18 nt, Human
ugccacaacuggacggug

SEQ ID NO: 953116 - RNA, 24 nt, Human
ugggaaagaaggggaucaacacuu

SEQ ID NO: 953117 - RNA, 23 nt, Human
uuggaguaucaccaguucucucu

SEQ ID NO: 953118 - RNA, 21 nt, Human
ccugagugcucagcccacagc

SEQ ID NO: 953119 - RNA, 21 nt, Human
cuucagcuuugagaaaacaga

SEQ ID NO: 953120 - RNA, 22 nt, Human
uaaaaaaaagccauaugugaau

SEQ ID NO: 953121 - RNA, 23 nt, Human
uaaaaaaaagccauaugugaaug

SEQ ID NO: 953122 - RNA, 24 nt, Human
uauugguuaaaaaaaagccauaug

SEQ ID NO: 953123 - RNA, 22 nt, Human
caacugcugugcagugcuccug

SEQ ID NO: 953124 - RNA, 22 nt, Human
ccgagcugcucugguucugcug

SEQ ID NO: 953125 - RNA, 20 nt, Human
ccugcuuuucaacuuucucc

SEQ ID NO: 953126 - RNA, 18 nt, Human
cugcauuuaaaggcuuca

SEQ ID NO: 953127 - RNA, 18 nt, Human
cugcucugguucugcugu

SEQ ID NO: 953128 - RNA, 19 nt, Human
cugugcagugcuccugucc

SEQ ID NO: 953129 - RNA, 22 nt, Human
cuucuccuuuuuaggggguggu

SEQ ID NO: 953130 - RNA, 20 nt, Human
cuuucuccuucuucuccuuu

SEQ ID NO: 953131 - RNA, 24 nt, Human
gagcgagucuuuuccuuaaagucu

SEQ ID NO: 953132 - RNA, 21 nt, Human
gcucugguucugcuguucuga

SEQ ID NO: 953133 - RNA, 19 nt, Human
gggaggagcccuugucugu

SEQ ID NO: 953134 - RNA, 22 nt, Human
ggguggugggguggcauacugu

SEQ ID NO: 953135 - RNA, 21 nt, Human
uaaaaaguagauucaggagca

SEQ ID NO: 953136 - RNA, 18 nt, Human
ucccaaaacccuucgucu

SEQ ID NO: 953137 - RNA, 19 nt, Human
uccucacaucgcagaugcu

SEQ ID NO: 953138 - RNA, 23 nt, Human
ucucugaccccgagcugcucugg

SEQ ID NO: 953139 - RNA, 19 nt, Human
ucugcggcagguuucgcuu

SEQ ID NO: 953140 - RNA, 23 nt, Human
ugauuuguuucgcuggucuuugu

SEQ ID NO: 953141 - RNA, 24 nt, Human
ugcagacgcuacaaucccaaaacc

SEQ ID NO: 953142 - RNA, 23 nt, Human
ugcugugcagugcuccuguccac

SEQ ID NO: 953143 - RNA, 20 nt, Human
uguagcauuugcagacugua

SEQ ID NO: 953144 - RNA, 28 nt, Human
uuuucagccggggccuugaggagguccu

SEQ ID NO: 953145 - RNA, 20 nt, Human
ggauacauuuccauguggga

SEQ ID NO: 953146 - RNA, 23 nt, Human
ugaggauacauuuccauguggga

SEQ ID NO: 953147 - RNA, 22 nt, Human
uguguccacggcugcuugugug

SEQ ID NO: 953148 - RNA, 20 nt, Human
uguguggcagguccuauggc

SEQ ID NO: 953149 - RNA, 21 nt, Human
aaaaacagcaaaagccuccaa

SEQ ID NO: 953150 - RNA, 22 nt, Human
aaaaacagcaaaagccuccaac

SEQ ID NO: 953151 - RNA, 20 nt, Human
aaaaacgacaacaacucaag

SEQ ID NO: 953152 - RNA, 22 nt, Human
aaaaagauaagguuacaggcac

SEQ ID NO: 953153 - RNA, 20 nt, Human
aaaaucaguaaaauguaaaa

SEQ ID NO: 953154 - RNA, 24 nt, Human
aaacaaacaaaaaacgacaacaac

SEQ ID NO: 953155 - RNA, 19 nt, Human
aaagcccauucaacucugc

SEQ ID NO: 953156 - RNA, 21 nt, Human
aaagcccauucaacucugcuu

SEQ ID NO: 953157 - RNA, 21 nt, Human
aaagccuccaacugcuacaca

SEQ ID NO: 953158 - RNA, 18 nt, Human
aacauucacaaucuacaa

SEQ ID NO: 953159 - RNA, 19 nt, Human
aacugcucuuuccuuccca

SEQ ID NO: 953160 - RNA, 18 nt, Human
aacuugggccucuccucu

SEQ ID NO: 953161 - RNA, 21 nt, Human
aagauaagcacaaaauuuacc

SEQ ID NO: 953162 - RNA, 18 nt, Human
aagcaguuggcacuaaga

SEQ ID NO: 953163 - RNA, 22 nt, Human
accagguacuaugugagcuauu

SEQ ID NO: 953164 - RNA, 20 nt, Human
accuugaugaaguaaaaaaa

SEQ ID NO: 953165 - RNA, 27 nt, Human
aggcuucaagugagccccgacaggcac

SEQ ID NO: 953166 - RNA, 21 nt, Human
agggaccuuuuaaaaaacagu

SEQ ID NO: 953167 - RNA, 20 nt, Human
agguuacaggcaccacacca

SEQ ID NO: 953168 - RNA, 18 nt, Human
aguagugauaaaaaauaa

SEQ ID NO: 953169 - RNA, 18 nt, Human
aguucagauucuaaagca

SEQ ID NO: 953170 - RNA, 20 nt, Human
auggugugggauuggagagg

SEQ ID NO: 953171 - RNA, 27 nt, Human
caaaaagauaagguuacaggcaccaca

SEQ ID NO: 953172 - RNA, 25 nt, Human
caaaaucaguaaaauguaaaacuuc

SEQ ID NO: 953173 - RNA, 22 nt, Human
caagugagccccgacaggcacc

SEQ ID NO: 953174 - RNA, 23 nt, Human
caccacaccauccaccaaacuga

SEQ ID NO: 953175 - RNA, 21 nt, Human
caccuugaugaaguaaaaaaa

SEQ ID NO: 953176 - RNA, 22 nt, Human
cagagccagcuuauaauaccac

SEQ ID NO: 953177 - RNA, 20 nt, Human
cagaucugccccaaaccacu

SEQ ID NO: 953178 - RNA, 18 nt, Human
caggcaccacaccaucca

SEQ ID NO: 953179 - RNA, 26 nt, Human
caggcaccacaccauccaaccuucag

SEQ ID NO: 953180 - RNA, 18 nt, Human
cagguuaugaaugaaaau

SEQ ID NO: 953181 - RNA, 31 nt, Human
caguuuacauuuaaaaaacaaacaaaaaacc

SEQ ID NO: 953182 - RNA, 21 nt, Human
caucaugaaauaaaacacaaa

SEQ ID NO: 953183 - RNA, 19 nt, Human
ccaaaaaauuuacaaaaac

SEQ ID NO: 953184 - RNA, 23 nt, Human
ccaaauaucugugucuaaacaau

SEQ ID NO: 953185 - RNA, 21 nt, Human
ccacuccauguggaaaauaca

SEQ ID NO: 953186 - RNA, 21 nt, Human
cugaaacuugggccucuccuc

SEQ ID NO: 953187 - RNA, 18 nt, Human
cugcuacacauucucccu

SEQ ID NO: 953188 - RNA, 23 nt, Human
cuuaagccagccuugaagauaag

SEQ ID NO: 953189 - RNA, 19 nt, Human
cuuguggaaaaccagguac

SEQ ID NO: 953190 - RNA, 20 nt, Human
cuuuaaaggugagucacuua

SEQ ID NO: 953191 - RNA, 23 nt, Human
gaacaucaugaaauaaaacacaa

SEQ ID NO: 953192 - RNA, 22 nt, Human
gaagauaagcacaaaauuuacc

SEQ ID NO: 953193 - RNA, 19 nt, Human
uaaaaacagcaaaagccuc

SEQ ID NO: 953194 - RNA, 22 nt, Human
uaaaaagcaguuggcacuaaga

SEQ ID NO: 953195 - RNA, 24 nt, Human
uaaaaagcaguuggcacuaagaua

SEQ ID NO: 953196 - RNA, 22 nt, Human
uaaaaagcaguuggcacuaagg

SEQ ID NO: 953197 - RNA, 18 nt, Human
uaaaaauacauacauaaa

SEQ ID NO: 953198 - RNA, 23 nt, Human
uaaaagugcucacaaacacaaaa

SEQ ID NO: 953199 - RNA, 24 nt, Human
uaaaagugcucacaaacacaaaaa

SEQ ID NO: 953200 - RNA, 22 nt, Human
uaaaauagaucauguacauguu

SEQ ID NO: 953201 - RNA, 19 nt, Human
uaagaauguaccccuaguc

SEQ ID NO: 953202 - RNA, 20 nt, Human
uaagaauguaccccuagucc

SEQ ID NO: 953203 - RNA, 18 nt, Human
uacaauaaaacuacugga

SEQ ID NO: 953204 - RNA, 18 nt, Human
uacacagaaaaucaugcc

SEQ ID NO: 953205 - RNA, 23 nt, Human
uacauaaaauaaaagugcucaca

SEQ ID NO: 953206 - RNA, 21 nt, Human
uaccugcaggccuagcuauuu

SEQ ID NO: 953207 - RNA, 22 nt, Human
uagaaauaugaguucacuuucu

SEQ ID NO: 953208 - RNA, 26 nt, Human
uagaucauguacauguuaauaaacug

SEQ ID NO: 953209 - RNA, 21 nt, Human
uagcuaauuccaaauaucugu

SEQ ID NO: 953210 - RNA, 25 nt, Human
uagcucaccaagaaaaaucuacuac

SEQ ID NO: 953211 - RNA, 24 nt, Human
uauuuuucccgaugugcugcugau

SEQ ID NO: 953212 - RNA, 23 nt, Human
ucaaagacuuaccagacacaaua

SEQ ID NO: 953213 - RNA, 24 nt, Human
uccaaaguaaguauguuuuaaaaa

SEQ ID NO: 953214 - RNA, 22 nt, Human
uccaaauaucugugucuaaaca

SEQ ID NO: 953215 - RNA, 23 nt, Human
uccaaguagcucaccaagaaaaa

SEQ ID NO: 953216 - RNA, 24 nt, Human
uccaccaaacugaggacauuucuu

SEQ ID NO: 953217 - RNA, 24 nt, Human
uccaccaaacugaggacauuucuu

SEQ ID NO: 953218 - RNA, 20 nt, Human
ucccacagcgucacuccaaa

SEQ ID NO: 953219 - RNA, 28 nt, Human
ucccuuauauaccucugaagaugggagu

SEQ ID NO: 953220 - RNA, 23 nt, Human
ucuaaagcauuucuaaggcacgg

SEQ ID NO: 953221 - RNA, 21 nt, Human
ucuaaggcccagcaacaggcc

SEQ ID NO: 953222 - RNA, 24 nt, Human
ucuccuuuuccagagaguaaaaau

SEQ ID NO: 953223 - RNA, 19 nt, Human
ugaagaugggaguaguggc

SEQ ID NO: 953224 - RNA, 19 nt, Human
ugagucagggagaucuuau

SEQ ID NO: 953225 - RNA, 22 nt, Human
ugaguucccacagcgucacucc

SEQ ID NO: 953226 - RNA, 22 nt, Human
ugauggugugggauuggagagg

SEQ ID NO: 953227 - RNA, 20 nt, Human
uggaacaucaugaaauaaaa

SEQ ID NO: 953228 - RNA, 28 nt, Human
uggcugggcuauucgguaaccaucuucu

SEQ ID NO: 953229 - RNA, 23 nt, Human
uuaaaaaacaauuuuauacuuaa

SEQ ID NO: 953230 - RNA, 21 nt, Human
uuaaaaacagcaaaagccucc

SEQ ID NO: 953231 - RNA, 22 nt, Human
uuaaaaacagcaaaagccuccc

SEQ ID NO: 953232 - RNA, 21 nt, Human
uuacauuuaaaaaacaaacaa

SEQ ID NO: 953233 - RNA, 24 nt, Human
uuacuagaaccuggagucugagcc

SEQ ID NO: 953234 - RNA, 26 nt, Human
uucaauacugucauaauauaaaacaa

SEQ ID NO: 953235 - RNA, 18 nt, Human
uucauaaggcuuuuuuaa

SEQ ID NO: 953236 - RNA, 22 nt, Human
uucccagaguagugauaaaaaa

SEQ ID NO: 953237 - RNA, 23 nt, Human
uuccugauggugugggauuggag

SEQ ID NO: 953238 - RNA, 20 nt, Human
uuguauuaucuccuuuucca

SEQ ID NO: 953239 - RNA, 18 nt, Human
uuuagaaagcccauucaa

SEQ ID NO: 953240 - RNA, 20 nt, Human
uuuuuuuuuuaaaauagauc

SEQ ID NO: 953241 - RNA, 18 nt, Human
aaacccggggagaagaca

SEQ ID NO: 953242 - RNA, 21 nt, Human
aacugaccacuccagaagcag

SEQ ID NO: 953243 - RNA, 21 nt, Human
caccaaacccggggagaagac

SEQ ID NO: 953244 - RNA, 21 nt, Human
cagaagcaggccaccaaaccc

SEQ ID NO: 953245 - RNA, 22 nt, Human
cagcagaacugaccacuccaga

SEQ ID NO: 953246 - RNA, 18 nt, Human
cagcuagagcgagcaaga

SEQ ID NO: 953247 - RNA, 19 nt, Human
cguggagauuagcaagccg

SEQ ID NO: 953248 - RNA, 21 nt, Human
cuguauccuuugucuucaaag

SEQ ID NO: 953249 - RNA, 20 nt, Human
gagcgagcaagaggcccugc

SEQ ID NO: 953250 - RNA, 24 nt, Human
uagagcgagcaagaggcccugcug

SEQ ID NO: 953251 - RNA, 22 nt, Human
ucaaaauacaauuuaaggauau

SEQ ID NO: 953252 - RNA, 25 nt, Human
ugaaaguagcuaaauuuuuguaaug

SEQ ID NO: 953253 - RNA, 19 nt, Human
ugaaggguauaaaugaaca

SEQ ID NO: 953254 - RNA, 20 nt, Human
uggagagcugggugucuaca

SEQ ID NO: 953255 - RNA, 23 nt, Human
ugucugaauuucugggcguggag

SEQ ID NO: 953256 - RNA, 20 nt, Human
ugugcagaugagauaagggg

SEQ ID NO: 953257 - RNA, 23 nt, Human
uuauagcuauaaaugacauuacu

SEQ ID NO: 953258 - RNA, 23 nt, Human
uucaaagcauuuuucuggagagc

SEQ ID NO: 953259 - RNA, 22 nt, Human
uuuuuuuuuuuuuugccaguua

SEQ ID NO: 953260 - RNA, 23 nt, Human
uuuuuuuuuuuuuuuuugccagu

SEQ ID NO: 953261 - RNA, 27 nt, Human
uuuuuuuuuuuuuuuuuuuuuuugggg

SEQ ID NO: 953262 - RNA, 21 nt, Human
aaaggggguuuucacuuacac

SEQ ID NO: 953263 - RNA, 19 nt, Human
aacaaauuagaggaccaaa

SEQ ID NO: 953264 - RNA, 20 nt, Human
aagaaacaaaucagcagaac

SEQ ID NO: 953265 - RNA, 21 nt, Human
aagaaacaaaucagcagaaca

SEQ ID NO: 953266 - RNA, 21 nt, Human
aagaagaaaucugaaauggaa

SEQ ID NO: 953267 - RNA, 26 nt, Human
aaggggguuuucacuuacacuuuuug

SEQ ID NO: 953268 - RNA, 18 nt, Human
aauaagaaaaccccaucc

SEQ ID NO: 953269 - RNA, 23 nt, Human
aaucugcggaaaauguccuccuu

SEQ ID NO: 953270 - RNA, 24 nt, Human
aaugauuuaccuuuauccuuaaau

SEQ ID NO: 953271 - RNA, 21 nt, Human
acaaaaaaaaaaaauuacaga

SEQ ID NO: 953272 - RNA, 21 nt, Human
acaaagaaaaauucaaagucc

SEQ ID NO: 953273 - RNA, 21 nt, Human
acaacgaagaaagccccagga

SEQ ID NO: 953274 - RNA, 19 nt, Human
acaagacaaaaaugaaaac

SEQ ID NO: 953275 - RNA, 22 nt, Human
acagggcaacaacaaauuagag

SEQ ID NO: 953276 - RNA, 21 nt, Human
acauaauggaaccacaucagg

SEQ ID NO: 953277 - RNA, 24 nt, Human
agacaaaaaugaaaacaaagggac

SEQ ID NO: 953278 - RNA, 25 nt, Human
agacaaaaaugaaaacaaauaguua

SEQ ID NO: 953279 - RNA, 18 nt, Human
aggcuguguacaguagcu

SEQ ID NO: 953280 - RNA, 20 nt, Human
agggcaacaacaaauuagag

SEQ ID NO: 953281 - RNA, 23 nt, Human
agguguguuuaaaaaaaaaaaaa

SEQ ID NO: 953282 - RNA, 19 nt, Human
agugguaguaggaccacaa

SEQ ID NO: 953283 - RNA, 19 nt, Human
agugguugguaacugccuu

SEQ ID NO: 953284 - RNA, 22 nt, Human
auaaaccuucuacaagacaaaa

SEQ ID NO: 953285 - RNA, 21 nt, Human
auacauuuuuaauauuugaaa

SEQ ID NO: 953286 - RNA, 23 nt, Human
aucuacaacgaagaaagccccag

SEQ ID NO: 953287 - RNA, 21 nt, Human
augauccacauuccuuuaaaa

SEQ ID NO: 953288 - RNA, 19 nt, Human
auguuuguaaaacucucac

SEQ ID NO: 953289 - RNA, 19 nt, Human
auuuacauaauggaaccac

SEQ ID NO: 953290 - RNA, 27 nt, Human
caaaaaaaaaaaauuacagaucucacu

SEQ ID NO: 953291 - RNA, 28 nt, Human
caacaaaaacagugguaguaggaccaca

SEQ ID NO: 953292 - RNA, 22 nt, Human
caacaaauuagaggaccaaaaa

SEQ ID NO: 953293 - RNA, 21 nt, Human
caagaaacaaaucagcagaac

SEQ ID NO: 953294 - RNA, 25 nt, Human
caaugucuucaaagacaaagaaaaa

SEQ ID NO: 953295 - RNA, 23 nt, Human
caauucuauucuuuaguugggaa

SEQ ID NO: 953296 - RNA, 26 nt, Human
cacauugcucacgacacgagaacacc

SEQ ID NO: 953297 - RNA, 22 nt, Human
cacauuuagcuaagaguugucu

SEQ ID NO: 953298 - RNA, 25 nt, Human
caccaaagcaaauuagggaaaagaa

SEQ ID NO: 953299 - RNA, 24 nt, Human
caccuuguacucucuuccagcuca

SEQ ID NO: 953300 - RNA, 23 nt, Human
cagaacaagauuauaucagauag

SEQ ID NO: 953301 - RNA, 21 nt, Human
cagccgcgcugcgcggcgagc

SEQ ID NO: 953302 - RNA, 24 nt, Human
caggaauuucucuaagcacaucau

SEQ ID NO: 953303 - RNA, 23 nt, Human
caugccuucacaagggcuugcca

SEQ ID NO: 953304 - RNA, 20 nt, Human
cauguaaacuuacaaauugc

SEQ ID NO: 953305 - RNA, 18 nt, Human
ccaaagcucacauuaugc

SEQ ID NO: 953306 - RNA, 23 nt, Human
ccaaagcucacauuaugcuuuuu

SEQ ID NO: 953307 - RNA, 19 nt, Human
cccaaaugcuuuccaacca

SEQ ID NO: 953308 - RNA, 23 nt, Human
cccaccaaagcaaauuagggaaa

SEQ ID NO: 953309 - RNA, 20 nt, Human
cccgcucccguucuuucucc

SEQ ID NO: 953310 - RNA, 19 nt, Human
cccgucgcucgccagggag

SEQ ID NO: 953311 - RNA, 18 nt, Human
cccucucucuuucucucc

SEQ ID NO: 953312 - RNA, 19 nt, Human
cccucucucuuucucuccg

SEQ ID NO: 953313 - RNA, 20 nt, Human
cgagcagaauaccuaucaug

SEQ ID NO: 953314 - RNA, 20 nt, Human
cgccagggagacugagugcc

SEQ ID NO: 953315 - RNA, 24 nt, Human
cggaagcaccuuguacucucuucc

SEQ ID NO: 953316 - RNA, 23 nt, Human
cuacaagacaaaaaugaaaacaa

SEQ ID NO: 953317 - RNA, 23 nt, Human
cucacauuaugcuuuuucuaaca

SEQ ID NO: 953318 - RNA, 19 nt, Human
cucacuggaguauucacga

SEQ ID NO: 953319 - RNA, 20 nt, Human
cucccucucucuuucucucc

SEQ ID NO: 953320 - RNA, 23 nt, Human
cucccucucucuuucucuccguu

SEQ ID NO: 953321 - RNA, 19 nt, Human
cucggaguuuucuuucaag

SEQ ID NO: 953322 - RNA, 21 nt, Human
cucguucccuuucacgcuccc

SEQ ID NO: 953323 - RNA, 18 nt, Human
cugaucuacaacgaagaa

SEQ ID NO: 953324 - RNA, 24 nt, Human
cugccuucgcgaccuucugggauc

SEQ ID NO: 953325 - RNA, 21 nt, Human
cuucaucuucuucucgguccc

SEQ ID NO: 953326 - RNA, 24 nt, Human
cuucuuccauuucuauagcauuua

SEQ ID NO: 953327 - RNA, 20 nt, Human
cuucuucuuucuucuucucu

SEQ ID NO: 953328 - RNA, 24 nt, Human
cuuucagcuucuuucucauauucc

SEQ ID NO: 953329 - RNA, 18 nt, Human
cuuucccuuucucguucc

SEQ ID NO: 953330 - RNA, 20 nt, Human
gaaagccccaggaauuucuc

SEQ ID NO: 953331 - RNA, 19 nt, Human
gaaauccuggaaacugcgg

SEQ ID NO: 953332 - RNA, 19 nt, Human
gaagcuuucucggaaaugu

SEQ ID NO: 953333 - RNA, 18 nt, Human
gacacaguggguacuaag

SEQ ID NO: 953334 - RNA, 20 nt, Human
gacacgagaacaccaugcuc

SEQ ID NO: 953335 - RNA, 22 nt, Human
gaguagcuuuuucucuccaauu

SEQ ID NO: 953336 - RNA, 18 nt, Human
gaucucucucucgauccc

SEQ ID NO: 953337 - RNA, 18 nt, Human
gauuucugcccgucgcuc

SEQ ID NO: 953338 - RNA, 21 nt, Human
gcacaggccgcaaauacagcc

SEQ ID NO: 953339 - RNA, 20 nt, Human
gccuuucucguucccuuuca

SEQ ID NO: 953340 - RNA, 19 nt, Human
gcgcggcgagcugauggag

SEQ ID NO: 953341 - RNA, 19 nt, Human
ggaauuucucuaagcacau

SEQ ID NO: 953342 - RNA, 20 nt, Human
ggagugcugggauucccaug

SEQ ID NO: 953343 - RNA, 23 nt, Human
ggagugcugggauucccauggga

SEQ ID NO: 953344 - RNA, 24 nt, Human
gggcauuuagcucacuggaguauu

SEQ ID NO: 953345 - RNA, 24 nt, Human
gggccacuggaaaucugcggaaaa

SEQ ID NO: 953346 - RNA, 20 nt, Human
gggucccuggagguacaggu

SEQ ID NO: 953347 - RNA, 23 nt, Human
ggugagaaucagauuccugugag

SEQ ID NO: 953348 - RNA, 18 nt, Human
gguugguaacugccuuga

SEQ ID NO: 953349 - RNA, 20 nt, Human
guccuccuucuuuuccuucc

SEQ ID NO: 953350 - RNA, 18 nt, Human
gugguugguaacugccuu

SEQ ID NO: 953351 - RNA, 23 nt, Human
guucucuuucccuuucucguucc

SEQ ID NO: 953352 - RNA, 22 nt, Human
uaaaacaagauauaaaccuucu

SEQ ID NO: 953353 - RNA, 24 nt, Human
uaaacacuaaugagccaagguaaa

SEQ ID NO: 953354 - RNA, 23 nt, Human
uaaauaaguacucagacauggga

SEQ ID NO: 953355 - RNA, 23 nt, Human
uaagaaaaccccauccaguuagc

SEQ ID NO: 953356 - RNA, 23 nt, Human
uaagacaguuggagcaggagcca

SEQ ID NO: 953357 - RNA, 19 nt, Human
uaagcagcuucuuucucuc

SEQ ID NO: 953358 - RNA, 23 nt, Human
uaagcagcuucuuucucucggag

SEQ ID NO: 953359 - RNA, 26 nt, Human
uacaaaaaaaaaaaauuacagaucuc

SEQ ID NO: 953360 - RNA, 23 nt, Human
uacaaauugccgagcagaauacc

SEQ ID NO: 953361 - RNA, 19 nt, Human
uacaacgaagaaagcccca

SEQ ID NO: 953362 - RNA, 23 nt, Human
uacaagaaacaaaucagcagaac

SEQ ID NO: 953363 - RNA, 21 nt, Human
uacacauacauucacaaacac

SEQ ID NO: 953364 - RNA, 18 nt, Human
uaccuggugaguauaaag

SEQ ID NO: 953365 - RNA, 19 nt, Human
uacuaagacaguuggagca

SEQ ID NO: 953366 - RNA, 21 nt, Human
uacucccuggugaaauucuga

SEQ ID NO: 953367 - RNA, 20 nt, Human
uaucauguuuguaaaacucu

SEQ ID NO: 953368 - RNA, 22 nt, Human
ucaaaaccaaaccacauuuagc

SEQ ID NO: 953369 - RNA, 30 nt, Human
ucaauagccccuuuaaucaucugaucucuu

SEQ ID NO: 953370 - RNA, 22 nt, Human
ucacugucugucaauuugccua

SEQ ID NO: 953371 - RNA, 22 nt, Human
ucccgaucucggucucucucuu

SEQ ID NO: 953372 - RNA, 21 nt, Human
ucccgcucucguucccuuuca

SEQ ID NO: 953373 - RNA, 20 nt, Human
ucguaugcaucuucuucauc

SEQ ID NO: 953374 - RNA, 25 nt, Human
ucuacaaaaaaaaaaaauuacagau

SEQ ID NO: 953375 - RNA, 22 nt, Human
ucuacaagacaaaaaugaaaac

SEQ ID NO: 953376 - RNA, 22 nt, Human
ucucggaguuuucuuucaaguu

SEQ ID NO: 953377 - RNA, 22 nt, Human
ucucuucuucuuucuucuucuc

SEQ ID NO: 953378 - RNA, 18 nt, Human
ucucuuucucuccguucu

SEQ ID NO: 953379 - RNA, 21 nt, Human
ucugauuucccaauucuuaag

SEQ ID NO: 953380 - RNA, 22 nt, Human
ucuuucuucuucucuuucagcu

SEQ ID NO: 953381 - RNA, 25 nt, Human
ucuuucuucuucucuuucagcuucu

SEQ ID NO: 953382 - RNA, 24 nt, Human
ucuuucuuuuuccuuuuugccuuu

SEQ ID NO: 953383 - RNA, 21 nt, Human
ucuuuuguccggucacggucc

SEQ ID NO: 953384 - RNA, 24 nt, Human
ucuuuuguccggucacggucccua

SEQ ID NO: 953385 - RNA, 18 nt, Human
ugaucaaaagagaguggg

SEQ ID NO: 953386 - RNA, 23 nt, Human
ugcauuaaauacagcucuccagg

SEQ ID NO: 953387 - RNA, 22 nt, Human
ugcgcccaaaugcuuuccaacc

SEQ ID NO: 953388 - RNA, 22 nt, Human
ugcgggggugggaucccuggug

SEQ ID NO: 953389 - RNA, 25 nt, Human
uggaaaagacauucuuacugcagca

SEQ ID NO: 953390 - RNA, 21 nt, Human
uggagcaggagccauaaugcu

SEQ ID NO: 953391 - RNA, 21 nt, Human
uggaguauucacgaauuaaaa

SEQ ID NO: 953392 - RNA, 19 nt, Human
ugggaaacuaauaaccuaa

SEQ ID NO: 953393 - RNA, 21 nt, Human
ugggagugcugggauucccau

SEQ ID NO: 953394 - RNA, 20 nt, Human
ugggaucccuggugggagug

SEQ ID NO: 953395 - RNA, 21 nt, Human
ugggauucccaugggagggcg

SEQ ID NO: 953396 - RNA, 20 nt, Human
uggggucccuggagguacag

SEQ ID NO: 953397 - RNA, 18 nt, Human
uggugggagugcugggau

SEQ ID NO: 953398 - RNA, 19 nt, Human
ugucugaagcuuucucgga

SEQ ID NO: 953399 - RNA, 25 nt, Human
ugugccuuugucuuugcaucaacuu

SEQ ID NO: 953400 - RNA, 23 nt, Human
uguguuuaaaaaaaaaaaaaauc

SEQ ID NO: 953401 - RNA, 19 nt, Human
uuagggaaaagaaagacuu

SEQ ID NO: 953402 - RNA, 18 nt, Human
uuagugacaguuucuggc

SEQ ID NO: 953403 - RNA, 21 nt, Human
uucaaagacaaagaaaaauuc

SEQ ID NO: 953404 - RNA, 23 nt, Human
uucaauagccccuuuaaucaucu

SEQ ID NO: 953405 - RNA, 19 nt, Human
uucucguucccuuucacgc

SEQ ID NO: 953406 - RNA, 23 nt, Human
uuggggucccuggagguacaggu

SEQ ID NO: 953407 - RNA, 23 nt, Human
uuuaaaaaaaaaaaaaauccagu

SEQ ID NO: 953408 - RNA, 26 nt, Human
uuuaaacacuaaugagccaagguaaa

SEQ ID NO: 953409 - RNA, 23 nt, Human
uuucagguuggaacaguaccacu

SEQ ID NO: 953410 - RNA, 21 nt, Human
uuuccaagcugagaguuucau

SEQ ID NO: 953411 - RNA, 20 nt, Human
uuuccuuuuugccuuucucu

SEQ ID NO: 953412 - RNA, 22 nt, Human
uuucucguucccuuucacgcuc

SEQ ID NO: 953413 - RNA, 24 nt, Human
uuucucguucccuuucacgcuccc

SEQ ID NO: 953414 - RNA, 22 nt, Human
uuucuggccuugcauucccauu

SEQ ID NO: 953415 - RNA, 21 nt, Human
uuuucacuuacacuuuuuggu

SEQ ID NO: 953416 - RNA, 21 nt, Human
uuuugucuuuuucucuuucuc

SEQ ID NO: 953417 - RNA, 21 nt, Human
aaaacccuuuccaaugaacag

SEQ ID NO: 953418 - RNA, 23 nt, Human
aaaacccuuuccaaugaacagaa

SEQ ID NO: 953419 - RNA, 20 nt, Human
aaaacgcuaauccccuaagc

SEQ ID NO: 953420 - RNA, 26 nt, Human
aaaacgcuaauccccuaagcaucugc

SEQ ID NO: 953421 - RNA, 18 nt, Human
aaaagccauggaaggauu

SEQ ID NO: 953422 - RNA, 20 nt, Human
aaaccuaauaggugcuggua

SEQ ID NO: 953423 - RNA, 24 nt, Human
aaaguguugggauuauagguguga

SEQ ID NO: 953424 - RNA, 18 nt, Human
aacagaguaaagcucuaa

SEQ ID NO: 953425 - RNA, 23 nt, Human
aagaacacacaggaaugaacuga

SEQ ID NO: 953426 - RNA, 25 nt, Human
aagcucuaaagacaccagacgaacc

SEQ ID NO: 953427 - RNA, 21 nt, Human
aaguguugggauuauaggugu

SEQ ID NO: 953428 - RNA, 26 nt, Human
aaguguugggauuauaggugugagcc

SEQ ID NO: 953429 - RNA, 18 nt, Human
acagcucacugcagccuc

SEQ ID NO: 953430 - RNA, 23 nt, Human
agacaccagacgaaccaauacuu

SEQ ID NO: 953431 - RNA, 22 nt, Human
agcaaagugcucuguaguguau

SEQ ID NO: 953432 - RNA, 20 nt, Human
aggcaugcaccacuaugccc

SEQ ID NO: 953433 - RNA, 24 nt, Human
agggaggcggcggcccgcgggcgg

SEQ ID NO: 953434 - RNA, 18 nt, Human
aggugugagccacugcac

SEQ ID NO: 953435 - RNA, 19 nt, Human
augaaaaacgcuaaucccc

SEQ ID NO: 953436 - RNA, 24 nt, Human
caaaguguugggauuauaggugug

SEQ ID NO: 953437 - RNA, 20 nt, Human
caacagaguaaagcucuaaa

SEQ ID NO: 953438 - RNA, 20 nt, Human
cacaagauuuaacacguaaa

SEQ ID NO: 953439 - RNA, 23 nt, Human
cacaggaaugaacugacaaacag

SEQ ID NO: 953440 - RNA, 22 nt, Human
caccagacgaaccaauacuugu

SEQ ID NO: 953441 - RNA, 20 nt, Human
cacguaaaaaaaaagauagc

SEQ ID NO: 953442 - RNA, 24 nt, Human
cacuaugcccagcuaauuuuugua

SEQ ID NO: 953443 - RNA, 24 nt, Human
cagacuaaauuguuuuugagacac

SEQ ID NO: 953444 - RNA, 24 nt, Human
cagccucaaucucaugggcucaag

SEQ ID NO: 953445 - RNA, 21 nt, Human
caguacaauuaaaauacccca

SEQ ID NO: 953446 - RNA, 22 nt, Human
cauggaaggauucuuauggcua

SEQ ID NO: 953447 - RNA, 20 nt, Human
cauuguauaggcagcagagu

SEQ ID NO: 953448 - RNA, 21 nt, Human
ccaaaguguugggauuauagg

SEQ ID NO: 953449 - RNA, 24 nt, Human
ccaaaguguugggauuauaggugu

SEQ ID NO: 953450 - RNA, 18 nt, Human
ccaagaggugaaaauuuc

SEQ ID NO: 953451 - RNA, 19 nt, Human
cccaagaggugaaaauuuc

SEQ ID NO: 953452 - RNA, 18 nt, Human
ccccgcgcgcccagggag

SEQ ID NO: 953453 - RNA, 22 nt, Human
ccccgcgcgcccagggaggcgg

SEQ ID NO: 953454 - RNA, 24 nt, Human
cccgcgccucggggagcggccggg

SEQ ID NO: 953455 - RNA, 18 nt, Human
ccgcgccgagaagcagcg

SEQ ID NO: 953456 - RNA, 20 nt, Human
ccuccugcguagcuagaaac

SEQ ID NO: 953457 - RNA, 18 nt, Human
cgcccagggaggcggcgg

SEQ ID NO: 953458 - RNA, 23 nt, Human
cguagcuagaaacacaggcaugc

SEQ ID NO: 953459 - RNA, 23 nt, Human
cucaaaacuccuggccucccaaa

SEQ ID NO: 953460 - RNA, 22 nt, Human
cuccuggaauaaauuaaaaccu

SEQ ID NO: 953461 - RNA, 20 nt, Human
cucugucccccaggcuggag

SEQ ID NO: 953462 - RNA, 23 nt, Human
cugcagccucaaucucaugggcu

SEQ ID NO: 953463 - RNA, 19 nt, Human
cuggccccgcgcgcccagg

SEQ ID NO: 953464 - RNA, 19 nt, Human
cuguaaaauuuggaaaucu

SEQ ID NO: 953465 - RNA, 21 nt, Human
gaacaaauuaugaaaaacuac

SEQ ID NO: 953466 - RNA, 24 nt, Human
gaacaguuaagccaucaaaacuaa

SEQ ID NO: 953467 - RNA, 21 nt, Human
gaacgccccggggcacccgac

SEQ ID NO: 953468 - RNA, 23 nt, Human
gaggcggcggcccgcgggcggcg

SEQ ID NO: 953469 - RNA, 18 nt, Human
gauuauaggugugagcca

SEQ ID NO: 953470 - RNA, 22 nt, Human
gauuauaggugugagccacugc

SEQ ID NO: 953471 - RNA, 23 nt, Human
gauuauaggugugagccacugca

SEQ ID NO: 953472 - RNA, 22 nt, Human
gcccagcuaauuuuuguauuuu

SEQ ID NO: 953473 - RNA, 19 nt, Human
gccucggggagcggccggg

SEQ ID NO: 953474 - RNA, 24 nt, Human
gcuggucucaaaacuccuggccuc

SEQ ID NO: 953475 - RNA, 25 nt, Human
gggcagcccugguucuggcccggcg

SEQ ID NO: 953476 - RNA, 21 nt, Human
ggggauuacaggggcagcccu

SEQ ID NO: 953477 - RNA, 22 nt, Human
ggggauuacaggggcagcccug

SEQ ID NO: 953478 - RNA, 19 nt, Human
guaaagcucuaaagacacc

SEQ ID NO: 953479 - RNA, 19 nt, Human
guagaggcagauguuuccc

SEQ ID NO: 953480 - RNA, 19 nt, Human
gucuacccaccccacucca

SEQ ID NO: 953481 - RNA, 24 nt, Human
gucuugcucugucccccaggcugg

SEQ ID NO: 953482 - RNA, 22 nt, Human
uaaagacaccagacgaaccaau

SEQ ID NO: 953483 - RNA, 23 nt, Human
uaaagacaccagacgaaccaaua

SEQ ID NO: 953484 - RNA, 21 nt, Human
uaaagacaccagacgaaccag

SEQ ID NO: 953485 - RNA, 19 nt, Human
uaaauuaaaaccugacuga

SEQ ID NO: 953486 - RNA, 19 nt, Human
uaacacguaaaaaaaaaga

SEQ ID NO: 953487 - RNA, 24 nt, Human
uaagaacacacaggaaugaacuga

SEQ ID NO: 953488 - RNA, 24 nt, Human
uaauuuuuguauuuuuuuguagag

SEQ ID NO: 953489 - RNA, 21 nt, Human
uagaaacacaggcaugcacca

SEQ ID NO: 953490 - RNA, 24 nt, Human
uagaaacacaggcaugcaccacua

SEQ ID NO: 953491 - RNA, 26 nt, Human
uagaaacacaggcaugcaccacuaug

SEQ ID NO: 953492 - RNA, 20 nt, Human
uaggaucaaaugagaauucc

SEQ ID NO: 953493 - RNA, 22 nt, Human
uauaggugugagccacugcacu

SEQ ID NO: 953494 - RNA, 21 nt, Human
uaucaaaguaacgacauaaug

SEQ ID NO: 953495 - RNA, 24 nt, Human
ucacugcagccucaaucucauggg

SEQ ID NO: 953496 - RNA, 24 nt, Human
ucauauuuuuaaauaaaagccaug

SEQ ID NO: 953497 - RNA, 23 nt, Human
ucccaaaguguugggauuauagg

SEQ ID NO: 953498 - RNA, 21 nt, Human
ucccccaggcuggaggucagu

SEQ ID NO: 953499 - RNA, 18 nt, Human
uccugaaaacagcaaaau

SEQ ID NO: 953500 - RNA, 20 nt, Human
uccuggccucccaaaguguu

SEQ ID NO: 953501 - RNA, 19 nt, Human
ucuaaagacaccagacgaa

SEQ ID NO: 953502 - RNA, 23 nt, Human
ucugucccccaggcuggagguca

SEQ ID NO: 953503 - RNA, 19 nt, Human
ucuugcucugucccccagg

SEQ ID NO: 953504 - RNA, 23 nt, Human
ucuugcucugucccccaggcugg

SEQ ID NO: 953505 - RNA, 24 nt, Human
ucuugcucugucccccaggcugga

SEQ ID NO: 953506 - RNA, 22 nt, Human
ugaaaacagcaaaaugaaaccu

SEQ ID NO: 953507 - RNA, 18 nt, Human
ugaaaccuaauaggugcu

SEQ ID NO: 953508 - RNA, 23 nt, Human
ugaacugacaaacagaacaaauu

SEQ ID NO: 953509 - RNA, 26 nt, Human
ugacaaacagaacaaauuaugaaaaa

SEQ ID NO: 953510 - RNA, 18 nt, Human
ugaugcacuucuguaguc

SEQ ID NO: 953511 - RNA, 20 nt, Human
ugcguagcuagaaacacagg

SEQ ID NO: 953512 - RNA, 21 nt, Human
ugcucugucccccaggcugga

SEQ ID NO: 953513 - RNA, 23 nt, Human
uggcacgaucacagcucacugca

SEQ ID NO: 953514 - RNA, 18 nt, Human
ugggauuauaggugugag

SEQ ID NO: 953515 - RNA, 19 nt, Human
ugggauuauaggugugagc

SEQ ID NO: 953516 - RNA, 21 nt, Human
ugggauuauaggugugagcca

SEQ ID NO: 953517 - RNA, 22 nt, Human
ugggauuauaggugugagccac

SEQ ID NO: 953518 - RNA, 22 nt, Human
ugggauuauaggugugagccac

SEQ ID NO: 953519 - RNA, 24 nt, Human
ugggauuauaggugugagccacug

SEQ ID NO: 953520 - RNA, 18 nt, Human
uguggggauuacaggggc

SEQ ID NO: 953521 - RNA, 22 nt, Human
uucaaauaagcaaagugcucug

SEQ ID NO: 953522 - RNA, 21 nt, Human
uucaaguagaauacggggaaa

SEQ ID NO: 953523 - RNA, 18 nt, Human
uuccugaaaacagcaaaa

SEQ ID NO: 953524 - RNA, 21 nt, Human
uuggaaaucuacucagguucc

SEQ ID NO: 953525 - RNA, 21 nt, Human
uugggauuauaggugugagcc

SEQ ID NO: 953526 - RNA, 22 nt, Human
uuuggaaaucuacucagguucc

SEQ ID NO: 953527 - RNA, 21 nt, Human
uuuuuguauuuuuuuguagag

SEQ ID NO: 953528 - RNA, 24 nt, Human
uuuuuguauuuuuuuguagaggca

SEQ ID NO: 953529 - RNA, 19 nt, Human
aaaguacuugccacacacc

SEQ ID NO: 953530 - RNA, 21 nt, Human
aaaguacuugccacacaccag

SEQ ID NO: 953531 - RNA, 20 nt, Human
aacgggacaacagaagccgg

SEQ ID NO: 953532 - RNA, 21 nt, Human
acaggcauaagcauugaugug

SEQ ID NO: 953533 - RNA, 18 nt, Human
accauaggaaaauccucc

SEQ ID NO: 953534 - RNA, 22 nt, Human
accauaggaaaauccuccaccu

SEQ ID NO: 953535 - RNA, 19 nt, Human
agaaaaaaaugaucaaaga

SEQ ID NO: 953536 - RNA, 22 nt, Human
aggaaauggggggaaccauagg

SEQ ID NO: 953537 - RNA, 18 nt, Human
agugacaguguggggcca

SEQ ID NO: 953538 - RNA, 18 nt, Human
aucuagaaaaaaaugauc

SEQ ID NO: 953539 - RNA, 23 nt, Human
cagccacagcccuugggagcaaa

SEQ ID NO: 953540 - RNA, 22 nt, Human
ccagccuguguucagcuacagc

SEQ ID NO: 953541 - RNA, 20 nt, Human
cccgcacaaacgggacaaca

SEQ ID NO: 953542 - RNA, 22 nt, Human
ccggccggacaucuccacuacc

SEQ ID NO: 953543 - RNA, 21 nt, Human
cgcaccucccgcucaggcucc

SEQ ID NO: 953544 - RNA, 22 nt, Human
cgccucaggcucccgcucccga

SEQ ID NO: 953545 - RNA, 20 nt, Human
cgggcaguggcggcuccucc

SEQ ID NO: 953546 - RNA, 19 nt, Human
cucagaauccacucggcca

SEQ ID NO: 953547 - RNA, 18 nt, Human
cucccgcuuagaccggcc

SEQ ID NO: 953548 - RNA, 24 nt, Human
gaaaauccuccaccucuaacagag

SEQ ID NO: 953549 - RNA, 21 nt, Human
gaauguaggcgugagacuuca

SEQ ID NO: 953550 - RNA, 20 nt, Human
gacgcgaccggagcugcccc

SEQ ID NO: 953551 - RNA, 23 nt, Human
gccagccuguguucagcuacagc

SEQ ID NO: 953552 - RNA, 21 nt, Human
gccccgcgacucagacucucg

SEQ ID NO: 953553 - RNA, 23 nt, Human
gccucaggcucccgcucccgauc

SEQ ID NO: 953554 - RNA, 19 nt, Human
gccucgcgcgcgcucgccg

SEQ ID NO: 953555 - RNA, 21 nt, Human
ggaaaauccuccaccucuaac

SEQ ID NO: 953556 - RNA, 19 nt, Human
gggaaccauaggaaaaucc

SEQ ID NO: 953557 - RNA, 20 nt, Human
uaggcgugagacuucaaacc

SEQ ID NO: 953558 - RNA, 21 nt, Human
ucaaugcaugggagaaaggag

SEQ ID NO: 953559 - RNA, 23 nt, Human
ucaggaaauggggggaaccauag

SEQ ID NO: 953560 - RNA, 24 nt, Human
ucccaaggcuugauguuuggaagg

SEQ ID NO: 953561 - RNA, 24 nt, Human
ucccgcuucacgcgcacagggcug

SEQ ID NO: 953562 - RNA, 19 nt, Human
uccucagaauccacucggc

SEQ ID NO: 953563 - RNA, 26 nt, Human
ucucgcucccgcuugacgcgaccgga

SEQ ID NO: 953564 - RNA, 19 nt, Human
ucugcccugcugaagcuag

SEQ ID NO: 953565 - RNA, 22 nt, Human
ugaucaaagaacagcugaguga

SEQ ID NO: 953566 - RNA, 21 nt, Human
ugcccugcugaagcuagaugg

SEQ ID NO: 953567 - RNA, 18 nt, Human
ugggagaaaggagcauca

SEQ ID NO: 953568 - RNA, 19 nt, Human
ugggagcaaagcccuagac

SEQ ID NO: 953569 - RNA, 21 nt, Human
uguggggccaucccaggcaag

SEQ ID NO: 953570 - RNA, 20 nt, Human
uucugcuugcuccaagaauc

SEQ ID NO: 953571 - RNA, 22 nt, Human
uugaugugugagagggagauag

SEQ ID NO: 953572 - RNA, 18 nt, Human
aaaacaagcaaauccuaa

SEQ ID NO: 953573 - RNA, 22 nt, Human
aaacaaaggaccaacauagccc

SEQ ID NO: 953574 - RNA, 21 nt, Human
aaacaagcaaauccuaaagca

SEQ ID NO: 953575 - RNA, 24 nt, Human
aagaacagcacaccaggaugccac

SEQ ID NO: 953576 - RNA, 21 nt, Human
aagcaaauccuaaagcaagua

SEQ ID NO: 953577 - RNA, 20 nt, Human
aagcuccggucccgcucaag

SEQ ID NO: 953578 - RNA, 20 nt, Human
acagcacaccaggaugccac

SEQ ID NO: 953579 - RNA, 19 nt, Human
acagugcuggaacaaagac

SEQ ID NO: 953580 - RNA, 19 nt, Human
acauagcccugaaaugcaa

SEQ ID NO: 953581 - RNA, 20 nt, Human
accaaggaaaauucacaaca

SEQ ID NO: 953582 - RNA, 25 nt, Human
accaaggaaaauucacaacauaugu

SEQ ID NO: 953583 - RNA, 25 nt, Human
acuggugccucaugggccugggccu

SEQ ID NO: 953584 - RNA, 27 nt, Human
agaaaaacaagcaaauccuaaagcaag

SEQ ID NO: 953585 - RNA, 18 nt, Human
agaacagcacaccaggau

SEQ ID NO: 953586 - RNA, 21 nt, Human
agcccugaaaugcaacagccu

SEQ ID NO: 953587 - RNA, 20 nt, Human
aggaaaauucacaacauaug

SEQ ID NO: 953588 - RNA, 27 nt, Human
aggccgggacagcauaaggacagagaa

SEQ ID NO: 953589 - RNA, 23 nt, Human
agggcagaggggugcuuggaagu

SEQ ID NO: 953590 - RNA, 18 nt, Human
aggggacagggaauacag

SEQ ID NO: 953591 - RNA, 18 nt, Human
auaaggacagagaaaggg

SEQ ID NO: 953592 - RNA, 19 nt, Human
caacauaugugaaacacaa

SEQ ID NO: 953593 - RNA, 18 nt, Human
caagaggcucccgagcaa

SEQ ID NO: 953594 - RNA, 19 nt, Human
caagaggcucccgagcaac

SEQ ID NO: 953595 - RNA, 23 nt, Human
caagaggcucccgagcaacagag

SEQ ID NO: 953596 - RNA, 23 nt, Human
caagcaaauccuaaagcaaguaa

SEQ ID NO: 953597 - RNA, 21 nt, Human
cagcauaaggacagagaaagg

SEQ ID NO: 953598 - RNA, 25 nt, Human
caggcuccucccuccuagcccuucu

SEQ ID NO: 953599 - RNA, 21 nt, Human
cauagcccugaaaugcaacag

SEQ ID NO: 953600 - RNA, 21 nt, Human
caucucccacaauuccccaga

SEQ ID NO: 953601 - RNA, 24 nt, Human
cauuccuuuaaaaagaaccaagga

SEQ ID NO: 953602 - RNA, 19 nt, Human
ccaccuguuguuugucagg

SEQ ID NO: 953603 - RNA, 20 nt, Human
cccacaauuccccagagggc

SEQ ID NO: 953604 - RNA, 19 nt, Human
ccccagagggcugcgaggc

SEQ ID NO: 953605 - RNA, 23 nt, Human
cccuugucgagcagcugcuggug

SEQ ID NO: 953606 - RNA, 26 nt, Human
ccuagcccuugaagccccagggaacc

SEQ ID NO: 953607 - RNA, 22 nt, Human
ccucccuccuagcccuugaagc

SEQ ID NO: 953608 - RNA, 21 nt, Human
ccuccuagcccuugaagcccc

SEQ ID NO: 953609 - RNA, 23 nt, Human
ccuccuagcccuugaagccccag

SEQ ID NO: 953610 - RNA, 18 nt, Human
ccuggccuugaaagacaa

SEQ ID NO: 953611 - RNA, 22 nt, Human
cggcccuuaacauccaaagacu

SEQ ID NO: 953612 - RNA, 22 nt, Human
cugcaguuggcaucucuggggc

SEQ ID NO: 953613 - RNA, 22 nt, Human
cugucugaacuuggagcugugc

SEQ ID NO: 953614 - RNA, 20 nt, Human
gacagagaaagggcagaggg

SEQ ID NO: 953615 - RNA, 20 nt, Human
gacagccacccugcgccccu

SEQ ID NO: 953616 - RNA, 24 nt, Human
gagccucaggucugaaaaggcaac

SEQ ID NO: 953617 - RNA, 24 nt, Human
ggaaccuggccuugaaagacaagc

SEQ ID NO: 953618 - RNA, 18 nt, Human
gguuuuccucucuaaggg

SEQ ID NO: 953619 - RNA, 23 nt, Human
guagcaucuccuuucucccaaaa

SEQ ID NO: 953620 - RNA, 20 nt, Human
uacaggugggcaugcugcag

SEQ ID NO: 953621 - RNA, 24 nt, Human
uagcaucuccuuucucccaaaacc

SEQ ID NO: 953622 - RNA, 18 nt, Human
uaggaucaucccauuccc

SEQ ID NO: 953623 - RNA, 24 nt, Human
ucaacuaauccuaaacgaaaacuc

SEQ ID NO: 953624 - RNA, 22 nt, Human
ucacaacauaugugaaacacaa

SEQ ID NO: 953625 - RNA, 20 nt, Human
ucacucaggggagcuggcag

SEQ ID NO: 953626 - RNA, 22 nt, Human
ucacucaggggagcuggcaggc

SEQ ID NO: 953627 - RNA, 24 nt, Human
uccacuggugccucaugggccugg

SEQ ID NO: 953628 - RNA, 21 nt, Human
uccagaggaaaugcauuugcc

SEQ ID NO: 953629 - RNA, 18 nt, Human
ucccaaaacccagcugga

SEQ ID NO: 953630 - RNA, 22 nt, Human
ucccaaaacccagcuggaacuc

SEQ ID NO: 953631 - RNA, 21 nt, Human
ucccucucagaagcuucugaa

SEQ ID NO: 953632 - RNA, 20 nt, Human
ucucccacaauuccccagag

SEQ ID NO: 953633 - RNA, 19 nt, Human
ucucuggggcugccaaauc

SEQ ID NO: 953634 - RNA, 20 nt, Human
ugaaacacaaacagcugugg

SEQ ID NO: 953635 - RNA, 22 nt, Human
ugaacagugcuggaacaaagac

SEQ ID NO: 953636 - RNA, 24 nt, Human
ugaaguggaagaaaaacaagcaaa

SEQ ID NO: 953637 - RNA, 21 nt, Human
ugacaggcagccugaacagug

SEQ ID NO: 953638 - RNA, 18 nt, Human
ugacuugagccgcaugua

SEQ ID NO: 953639 - RNA, 23 nt, Human
ugccucaagcuccggucccgcuc

SEQ ID NO: 953640 - RNA, 20 nt, Human
ugccugucaugguuuuccuc

SEQ ID NO: 953641 - RNA, 24 nt, Human
uggaagaaaaacaagcaaauccua

SEQ ID NO: 953642 - RNA, 22 nt, Human
uggaagugcucaucacucaggg

SEQ ID NO: 953643 - RNA, 18 nt, Human
uggugaugggaagcagca

SEQ ID NO: 953644 - RNA, 18 nt, Human
ugugaaacacaaacagcu

SEQ ID NO: 953645 - RNA, 18 nt, Human
uuccucucuaagggcacc

SEQ ID NO: 953646 - RNA, 22 nt, Human
uuccuuuaaaaagaaccaagga

SEQ ID NO: 953647 - RNA, 19 nt, Human
uucugaaguggaagaaaaa

SEQ ID NO: 953648 - RNA, 23 nt, Human
uugccuggagaugccuucaugaa

SEQ ID NO: 953649 - RNA, 20 nt, Human
uuuaaaaagaaccaaggaaa

SEQ ID NO: 953650 - RNA, 21 nt, Human
aacuaaaaauuugaacagcuc

SEQ ID NO: 953651 - RNA, 19 nt, Human
caaaauagauguacugagc

SEQ ID NO: 953652 - RNA, 19 nt, Human
gauguucacaaaauagaug

SEQ ID NO: 953653 - RNA, 25 nt, Human
uaaauuccauacagugaacuaaaaa

SEQ ID NO: 953654 - RNA, 20 nt, Human
ucaaauagguugacucuaaa

SEQ ID NO: 953655 - RNA, 21 nt, Human
uugaacagcucugugcuggac

SEQ ID NO: 953656 - RNA, 24 nt, Human
uugcucgaccaguaagauguagaa

SEQ ID NO: 953657 - RNA, 20 nt, Human
aaaaaagaaaaaaaauagag

SEQ ID NO: 953658 - RNA, 18 nt, Human
aaacaaagucccaggucu

SEQ ID NO: 953659 - RNA, 24 nt, Human
aaagugcugggauuacaggcauga

SEQ ID NO: 953660 - RNA, 20 nt, Human
aacagagcaaaaccuugucu

SEQ ID NO: 953661 - RNA, 21 nt, Human
aacagagcaaaaccuugucuc

SEQ ID NO: 953662 - RNA, 23 nt, Human
aagaaaaaaaauagaguucagaa

SEQ ID NO: 953663 - RNA, 19 nt, Human
aagcacacaccaccacgcc

SEQ ID NO: 953664 - RNA, 20 nt, Human
aagcacacaccaccacgccc

SEQ ID NO: 953665 - RNA, 22 nt, Human
aagcugggugugguggcacaug

SEQ ID NO: 953666 - RNA, 19 nt, Human
aaguagcugggacuacagg

SEQ ID NO: 953667 - RNA, 20 nt, Human
aaguagcugggacuacaggc

SEQ ID NO: 953668 - RNA, 24 nt, Human
aaguagcugggacuacaggcacac

SEQ ID NO: 953669 - RNA, 24 nt, Human
aagugauccgcccaccuuggccuc

SEQ ID NO: 953670 - RNA, 19 nt, Human
aagugcugggauuacaggc

SEQ ID NO: 953671 - RNA, 21 nt, Human
aagugcugggauuacaggcau

SEQ ID NO: 953672 - RNA, 24 nt, Human
aaguuaccuagcggagccuggagc

SEQ ID NO: 953673 - RNA, 18 nt, Human
aauggaaacaguugcaaa

SEQ ID NO: 953674 - RNA, 23 nt, Human
acaaauccccuugauacagcacc

SEQ ID NO: 953675 - RNA, 22 nt, Human
acaaugucaauuucuaguucca

SEQ ID NO: 953676 - RNA, 21 nt, Human
accaccucgccuggccaagaa

SEQ ID NO: 953677 - RNA, 24 nt, Human
acccaggcuggagugcaauggcgu

SEQ ID NO: 953678 - RNA, 19 nt, Human
accuagcggagccuggagc

SEQ ID NO: 953679 - RNA, 22 nt, Human
accucaagugauccgcccaccu

SEQ ID NO: 953680 - RNA, 21 nt, Human
acuccacugcugggaaaacga

SEQ ID NO: 953681 - RNA, 18 nt, Human
acuccuggccaucaucuc

SEQ ID NO: 953682 - RNA, 18 nt, Human
acucugucacccaggcug

SEQ ID NO: 953683 - RNA, 26 nt, Human
acucugucacccaggcuggagugcaa

SEQ ID NO: 953684 - RNA, 21 nt, Human
acuggccuguaucuucagcac

SEQ ID NO: 953685 - RNA, 20 nt, Human
acuggguuucgccaugcuag

SEQ ID NO: 953686 - RNA, 22 nt, Human
agaaauaaaaugauuuuaacag

SEQ ID NO: 953687 - RNA, 19 nt, Human
agacuggguuucgccaugc

SEQ ID NO: 953688 - RNA, 21 nt, Human
agacuggguuucgccaugcua

SEQ ID NO: 953689 - RNA, 23 nt, Human
agacuggguuucgccaugcuagc

SEQ ID NO: 953690 - RNA, 18 nt, Human
agaggacuauccucaaac

SEQ ID NO: 953691 - RNA, 20 nt, Human
agcaauccuccugccucagc

SEQ ID NO: 953692 - RNA, 24 nt, Human
agcgauucuccugccucagccucc

SEQ ID NO: 953693 - RNA, 23 nt, Human
agcggagccuggagcccacuggg

SEQ ID NO: 953694 - RNA, 21 nt, Human
agcugggauuacaagcacaca

SEQ ID NO: 953695 - RNA, 22 nt, Human
aggcacuacccgggucuggagc

SEQ ID NO: 953696 - RNA, 23 nt, Human
aggcaggagggucgcuugagccc

SEQ ID NO: 953697 - RNA, 21 nt, Human
aggccacuccuggccaucauc

SEQ ID NO: 953698 - RNA, 25 nt, Human
aggcuggagugcaguggccugaucu

SEQ ID NO: 953699 - RNA, 23 nt, Human
aggcuuuaauaauauuaaaaaua

SEQ ID NO: 953700 - RNA, 20 nt, Human
agggaacucuucacgggggc

SEQ ID NO: 953701 - RNA, 23 nt, Human
agggaacucuucacgggggcagg

SEQ ID NO: 953702 - RNA, 21 nt, Human
agggaggcuuaguccggggag

SEQ ID NO: 953703 - RNA, 19 nt, Human
aggggguggggugaucaua

SEQ ID NO: 953704 - RNA, 22 nt, Human
aguagagacuggguuucgccau

SEQ ID NO: 953705 - RNA, 19 nt, Human
aguagcugggauuacaagc

SEQ ID NO: 953706 - RNA, 20 nt, Human
agucccagcuacuugggggg

SEQ ID NO: 953707 - RNA, 20 nt, Human
agugcaauggcgugaucuag

SEQ ID NO: 953708 - RNA, 24 nt, Human
agugcaauggcgugaucuaggcuc

SEQ ID NO: 953709 - RNA, 20 nt, Human
agugcaguggccugaucuug

SEQ ID NO: 953710 - RNA, 24 nt, Human
agugcaguggccugaucuuggcuc

SEQ ID NO: 953711 - RNA, 18 nt, Human
agugcugggauuacaggc

SEQ ID NO: 953712 - RNA, 21 nt, Human
auaaaguacagcugcguuaca

SEQ ID NO: 953713 - RNA, 21 nt, Human
auccuccugccucagccuccc

SEQ ID NO: 953714 - RNA, 18 nt, Human
aucuggcuacacgguggc

SEQ ID NO: 953715 - RNA, 18 nt, Human
auguuugucaaugacaau

SEQ ID NO: 953716 - RNA, 20 nt, Human
caaaaaacaaucaucuguca

SEQ ID NO: 953717 - RNA, 25 nt, Human
caaaaaacaaucaucugucauaaaa

SEQ ID NO: 953718 - RNA, 23 nt, Human
caaaaacaaagucccaggucuga

SEQ ID NO: 953719 - RNA, 23 nt, Human
caaaauuaaagcaugaguuguca

SEQ ID NO: 953720 - RNA, 24 nt, Human
caaagugcugggauuacaggcaug

SEQ ID NO: 953721 - RNA, 22 nt, Human
caacagagcaaaaccuugucuc

SEQ ID NO: 953722 - RNA, 21 nt, Human
caagcacacaccaccacgccc

SEQ ID NO: 953723 - RNA, 22 nt, Human
caagcgauucuccugccucagc

SEQ ID NO: 953724 - RNA, 21 nt, Human
caagguggugcccacuccacu

SEQ ID NO: 953725 - RNA, 23 nt, Human
cacacaccaccacgcccggcuaa

SEQ ID NO: 953726 - RNA, 24 nt, Human
cacaccaccacgcccggcuaauuu

SEQ ID NO: 953727 - RNA, 23 nt, Human
cacucugucacccaggcuggagu

SEQ ID NO: 953728 - RNA, 24 nt, Human
cacucugucacccaggcuggagug

SEQ ID NO: 953729 - RNA, 21 nt, Human
cacugcaaccuccgccuccca

SEQ ID NO: 953730 - RNA, 18 nt, Human
cacugcaaccucugccuc

SEQ ID NO: 953731 - RNA, 21 nt, Human
cacugcaaccucugccucccg

SEQ ID NO: 953732 - RNA, 21 nt, Human
cagaaucucagaguaaaccac

SEQ ID NO: 953733 - RNA, 21 nt, Human
cagacauuccaaguacucuuc

SEQ ID NO: 953734 - RNA, 21 nt, Human
cagagcaaaaccuugucucuu

SEQ ID NO: 953735 - RNA, 18 nt, Human
cagagcucucagaucuuc

SEQ ID NO: 953736 - RNA, 18 nt, Human
cagaguuucgcucuugac

SEQ ID NO: 953737 - RNA, 24 nt, Human
cagcaaaaacaaagucccaggucu

SEQ ID NO: 953738 - RNA, 20 nt, Human
cagcagucaagaaccucggc

SEQ ID NO: 953739 - RNA, 18 nt, Human
caggccucucaccagcgu

SEQ ID NO: 953740 - RNA, 21 nt, Human
cagggcacagccuaguuuggg

SEQ ID NO: 953741 - RNA, 20 nt, Human
caguguggacggaacagaau

SEQ ID NO: 953742 - RNA, 23 nt, Human
caugcuagccaggcuggucucaa

SEQ ID NO: 953743 - RNA, 23 nt, Human
ccaaagugcugggauuacaggca

SEQ ID NO: 953744 - RNA, 24 nt, Human
ccaaagugcugggauuacaggcau

SEQ ID NO: 953745 - RNA, 21 nt, Human
ccacggagccagggcacagcc

SEQ ID NO: 953746 - RNA, 23 nt, Human
ccacuccuggccaucaucuccaa

SEQ ID NO: 953747 - RNA, 24 nt, Human
ccagagcucucagaucuuccccaa

SEQ ID NO: 953748 - RNA, 20 nt, Human
ccagcaaaaacaaaguccca

SEQ ID NO: 953749 - RNA, 20 nt, Human
ccaggcugggcagugggaag

SEQ ID NO: 953750 - RNA, 24 nt, Human
cccaaagugcugggauuacaggca

SEQ ID NO: 953751 - RNA, 23 nt, Human
cccaaguagcugggacuacaggc

SEQ ID NO: 953752 - RNA, 24 nt, Human
cccaaguagcugggacuacaggca

SEQ ID NO: 953753 - RNA, 20 nt, Human
cccagguucgagcaauccuc

SEQ ID NO: 953754 - RNA, 23 nt, Human
cccagguucgagcaauccuccug

SEQ ID NO: 953755 - RNA, 22 nt, Human
cccauaugugaacaaauccccu

SEQ ID NO: 953756 - RNA, 19 nt, Human
ccccaccaagguggugccc

SEQ ID NO: 953757 - RNA, 22 nt, Human
ccccgaggcuggagugcagugg

SEQ ID NO: 953758 - RNA, 19 nt, Human
cccgaguagcugggauuac

SEQ ID NO: 953759 - RNA, 23 nt, Human
cccggauucaagcgauucuccug

SEQ ID NO: 953760 - RNA, 19 nt, Human
cccuccuuccuuccuuccu

SEQ ID NO: 953761 - RNA, 27 nt, Human
ccgccucccagguucgagcaauccuuu

SEQ ID NO: 953762 - RNA, 25 nt, Human
ccuaauaccaucuuauuucuuugau

SEQ ID NO: 953763 - RNA, 21 nt, Human
ccucccagguucgagcaaucc

SEQ ID NO: 953764 - RNA, 24 nt, Human
ccucccggauucaagcgauucucc

SEQ ID NO: 953765 - RNA, 22 nt, Human
ccucucaccagcguguuggagg

SEQ ID NO: 953766 - RNA, 21 nt, Human
ccugaccuuaggucugggcac

SEQ ID NO: 953767 - RNA, 23 nt, Human
ccugccucagccucccaaguagc

SEQ ID NO: 953768 - RNA, 20 nt, Human
ccuuccuucccuccuuccuc

SEQ ID NO: 953769 - RNA, 20 nt, Human
ccuuccuuccuuccuuucuc

SEQ ID NO: 953770 - RNA, 19 nt, Human
ccuuguagggggcuagaag

SEQ ID NO: 953771 - RNA, 21 nt, Human
ccuuucuuucuuuuuguuuga

SEQ ID NO: 953772 - RNA, 27 nt, Human
cgagcaauccuccugccucagccuccc

SEQ ID NO: 953773 - RNA, 27 nt, Human
cgagcaauccuccugccucagccuccc

SEQ ID NO: 953774 - RNA, 24 nt, Human
cgccaugcuagccaggcuggucuc

SEQ ID NO: 953775 - RNA, 27 nt, Human
cgccaugcuagccaggcuggucucaac

SEQ ID NO: 953776 - RNA, 24 nt, Human
cgccucccagguucgagcaauccu

SEQ ID NO: 953777 - RNA, 24 nt, Human
cucaagugauccgcccaccuuggc

SEQ ID NO: 953778 - RNA, 24 nt, Human
cucacucugucacccaggcuggag

SEQ ID NO: 953779 - RNA, 24 nt, Human
cucacugcaaccuccgccucccag

SEQ ID NO: 953780 - RNA, 24 nt, Human
cucacugcaaccucugccucccgg

SEQ ID NO: 953781 - RNA, 24 nt, Human
cucagccucccaaguagcugggac

SEQ ID NO: 953782 - RNA, 24 nt, Human
cucagccucccgaguagcugggau

SEQ ID NO: 953783 - RNA, 22 nt, Human
cuccaacucuuuaccccaaccu

SEQ ID NO: 953784 - RNA, 23 nt, Human
cuccugcgcaggcucacugacag

SEQ ID NO: 953785 - RNA, 19 nt, Human
cucggcgccggacccgcgc

SEQ ID NO: 953786 - RNA, 25 nt, Human
cucucagaucuuccccaaaaccuaa

SEQ ID NO: 953787 - RNA, 18 nt, Human
cugaccuuaggucugggc

SEQ ID NO: 953788 - RNA, 23 nt, Human
cugcaaccuccgccucccagguu

SEQ ID NO: 953789 - RNA, 24 nt, Human
cugcaaccuccgccucccagguuc

SEQ ID NO: 953790 - RNA, 19 nt, Human
cugcaaccucugccucccg

SEQ ID NO: 953791 - RNA, 23 nt, Human
cugcaaccucugccucccggauu

SEQ ID NO: 953792 - RNA, 24 nt, Human
cugcaaccucugccucccggauuc

SEQ ID NO: 953793 - RNA, 22 nt, Human
cugccccaccaagguggugccc

SEQ ID NO: 953794 - RNA, 23 nt, Human
cugccucagccucccaaguagcu

SEQ ID NO: 953795 - RNA, 23 nt, Human
cugccucagccucccgaguagcu

SEQ ID NO: 953796 - RNA, 24 nt, Human
cuggguuucgccaugcuagccagg

SEQ ID NO: 953797 - RNA, 20 nt, Human
cugucauaaaaguucagagu

SEQ ID NO: 953798 - RNA, 21 nt, Human
cuuccuuccuucccuccuucc

SEQ ID NO: 953799 - RNA, 24 nt, Human
cuuccuuccuucccuccuuccuuc

SEQ ID NO: 953800 - RNA, 20 nt, Human
cuuuagucccagcuacuugg

SEQ ID NO: 953801 - RNA, 21 nt, Human
cuuucuuucuuuucuuucucu

SEQ ID NO: 953802 - RNA, 20 nt, Human
gaacagaaucuggcuacacg

SEQ ID NO: 953803 - RNA, 20 nt, Human
gacagcacaaugauacaauu

SEQ ID NO: 953804 - RNA, 25 nt, Human
gagcaauccuccugccucagccucc

SEQ ID NO: 953805 - RNA, 21 nt, Human
gagcaucagagcagaagacau

SEQ ID NO: 953806 - RNA, 22 nt, Human
gaggcggcuuuauguuccacuc

SEQ ID NO: 953807 - RNA, 22 nt, Human
gaggugucuuucacuuaugcuu

SEQ ID NO: 953808 - RNA, 24 nt, Human
gaguagcugggauuacaagcacac

SEQ ID NO: 953809 - RNA, 19 nt, Human
gagugcaguggccugaucu

SEQ ID NO: 953810 - RNA, 24 nt, Human
gaguuucgcucuugaccccgaggc

SEQ ID NO: 953811 - RNA, 19 nt, Human
gauuacaggcaugaccacc

SEQ ID NO: 953812 - RNA, 20 nt, Human
gcacagccuaguuuggggga

SEQ ID NO: 953813 - RNA, 19 nt, Human
gcagugggaaggcccucug

SEQ ID NO: 953814 - RNA, 21 nt, Human
gcagugggaaggcccucugga

SEQ ID NO: 953815 - RNA, 18 nt, Human
gccaagaaaaauguaacc

SEQ ID NO: 953816 - RNA, 20 nt, Human
gccucagccucccgaguagc

SEQ ID NO: 953817 - RNA, 18 nt, Human
gccucuggccagcucucc

SEQ ID NO: 953818 - RNA, 24 nt, Human
gcgauucuccugccucagccuccc

SEQ ID NO: 953819 - RNA, 21 nt, Human
gcucacugcaaccucugccuc

SEQ ID NO: 953820 - RNA, 24 nt, Human
gcuggagugcaauggcgugaucua

SEQ ID NO: 953821 - RNA, 19 nt, Human
gcuggagugcaguggccug

SEQ ID NO: 953822 - RNA, 21 nt, Human
ggaacucuucacgggggcagg

SEQ ID NO: 953823 - RNA, 20 nt, Human
ggacggaacagaaucuggcu

SEQ ID NO: 953824 - RNA, 18 nt, Human
ggauuacaggcaugacca

SEQ ID NO: 953825 - RNA, 21 nt, Human
ggccucuggccagcucuccag

SEQ ID NO: 953826 - RNA, 20 nt, Human
ggcguccggcacagcaguca

SEQ ID NO: 953827 - RNA, 23 nt, Human
ggcugaggcaggagggucgcuug

SEQ ID NO: 953828 - RNA, 22 nt, Human
ggcuggagugcaauggcgugau

SEQ ID NO: 953829 - RNA, 24 nt, Human
gggaaugaggugugcccugggcac

SEQ ID NO: 953830 - RNA, 18 nt, Human
ggggcaggauuugauguu

SEQ ID NO: 953831 - RNA, 18 nt, Human
gggggcugaggcaggagg

SEQ ID NO: 953832 - RNA, 18 nt, Human
ggucucaacucuuuaccu

SEQ ID NO: 953833 - RNA, 22 nt, Human
guggacggaacagaaucuggcu

SEQ ID NO: 953834 - RNA, 19 nt, Human
uaaacaacugacuacagac

SEQ ID NO: 953835 - RNA, 22 nt, Human
uaagaaaauagacuacugaagg

SEQ ID NO: 953836 - RNA, 23 nt, Human
uaagauacacagaaauaaaauga

SEQ ID NO: 953837 - RNA, 24 nt, Human
uaauuuuuguauuuuuaguagaga

SEQ ID NO: 953838 - RNA, 24 nt, Human
uacagcaccaugguaggcaugagg

SEQ ID NO: 953839 - RNA, 22 nt, Human
uacaggcacacgccgccacgcc

SEQ ID NO: 953840 - RNA, 23 nt, Human
uacauguaacaaaagaugcaaac

SEQ ID NO: 953841 - RNA, 21 nt, Human
uaccucaagugauccgcccac

SEQ ID NO: 953842 - RNA, 18 nt, Human
uacugagagagcagguca

SEQ ID NO: 953843 - RNA, 22 nt, Human
uacugauggauggacagggggu

SEQ ID NO: 953844 - RNA, 23 nt, Human
uacuuggggggcugaggcaggag

SEQ ID NO: 953845 - RNA, 23 nt, Human
uagccaggcuggucucaacucuu

SEQ ID NO: 953846 - RNA, 20 nt, Human
uaggcaagguaaugcuuuuc

SEQ ID NO: 953847 - RNA, 24 nt, Human
uaguagagacuggguuucgccaug

SEQ ID NO: 953848 - RNA, 19 nt, Human
uauagaggcaccuuggcua

SEQ ID NO: 953849 - RNA, 23 nt, Human
uauaguaagauuugccuaauacc

SEQ ID NO: 953850 - RNA, 24 nt, Human
uaugacauuccugaccuuaggucu

SEQ ID NO: 953851 - RNA, 18 nt, Human
ucacccaggcuggagugc

SEQ ID NO: 953852 - RNA, 21 nt, Human
ucacccggcuaauuuuuguau

SEQ ID NO: 953853 - RNA, 24 nt, Human
ucacucugucacccaggcuggagu

SEQ ID NO: 953854 - RNA, 19 nt, Human
ucacugcaaccuccgccuc

SEQ ID NO: 953855 - RNA, 24 nt, Human
ucacugcaaccuccgccucccagg

SEQ ID NO: 953856 - RNA, 25 nt, Human
ucacugcaaccuccgccucccaggu

SEQ ID NO: 953857 - RNA, 27 nt, Human
ucacugcaaccuccgccucccagguuc

SEQ ID NO: 953858 - RNA, 18 nt, Human
ucacugcaaccucugccu

SEQ ID NO: 953859 - RNA, 19 nt, Human
ucacugcaaccucugccuc

SEQ ID NO: 953860 - RNA, 23 nt, Human
ucacugcaaccucugccucccgg

SEQ ID NO: 953861 - RNA, 24 nt, Human
ucacugcaaccucugccucccgga

SEQ ID NO: 953862 - RNA, 18 nt, Human
ucagcacccucuggccac

SEQ ID NO: 953863 - RNA, 20 nt, Human
ucagccucccaaguagcugg

SEQ ID NO: 953864 - RNA, 20 nt, Human
ucagccucccgaguagcugg

SEQ ID NO: 953865 - RNA, 18 nt, Human
uccaaggaguauuggcag

SEQ ID NO: 953866 - RNA, 24 nt, Human
ucccaaagugcugggauuacaggc

SEQ ID NO: 953867 - RNA, 26 nt, Human
ucccaagguaaccacguucaguaacu

SEQ ID NO: 953868 - RNA, 24 nt, Human
ucccaaguagcugggacuacaggc

SEQ ID NO: 953869 - RNA, 19 nt, Human
ucccaggucugaggagcuc

SEQ ID NO: 953870 - RNA, 18 nt, Human
ucccagguucgagcaauc

SEQ ID NO: 953871 - RNA, 24 nt, Human
ucccagguucgagcaauccuccug

SEQ ID NO: 953872 - RNA, 28 nt, Human
uccccaaaaccuaaucaggccucucacc

SEQ ID NO: 953873 - RNA, 18 nt, Human
ucccgaguagcugggauu

SEQ ID NO: 953874 - RNA, 21 nt, Human
ucccggauucaagcgauucuc

SEQ ID NO: 953875 - RNA, 24 nt, Human
ucccggauucaagcgauucuccug

SEQ ID NO: 953876 - RNA, 27 nt, Human
uccuccugccucagccucccaaguagc

SEQ ID NO: 953877 - RNA, 23 nt, Human
ucucacucugucacccaggcugg

SEQ ID NO: 953878 - RNA, 24 nt, Human
ucucacucugucacccaggcugga

SEQ ID NO: 953879 - RNA, 26 nt, Human
ucucacucugucacccaggcuggagu

SEQ ID NO: 953880 - RNA, 27 nt, Human
ucucacucugucacccaggcuggagug

SEQ ID NO: 953881 - RNA, 24 nt, Human
ucuccugccucagccucccgagua

SEQ ID NO: 953882 - RNA, 19 nt, Human
ucugaggaugaugccugug

SEQ ID NO: 953883 - RNA, 20 nt, Human
ucuggccaccaccagcuuug

SEQ ID NO: 953884 - RNA, 24 nt, Human
ucugucacccaggcuggagugcaa

SEQ ID NO: 953885 - RNA, 23 nt, Human
ucuuucucuuucuuucuuucuuu

SEQ ID NO: 953886 - RNA, 25 nt, Human
ucuuucuuucuuucuuucuuucuuu

SEQ ID NO: 953887 - RNA, 22 nt, Human
ucuuucuuucuuucuuucuuuu

SEQ ID NO: 953888 - RNA, 24 nt, Human
ucuuucuuucuuucuuuucuuucc

SEQ ID NO: 953889 - RNA, 20 nt, Human
ucuuuuuguuugagacagag

SEQ ID NO: 953890 - RNA, 23 nt, Human
ugacaaugucaauuucuaguucc

SEQ ID NO: 953891 - RNA, 24 nt, Human
ugacuuuagucccagcuacuuggg

SEQ ID NO: 953892 - RNA, 24 nt, Human
ugagcccuucgggcagggcagccu

SEQ ID NO: 953893 - RNA, 24 nt, Human
ugaggcaggagggucgcuugagcc

SEQ ID NO: 953894 - RNA, 25 nt, Human
ugaggcaggagggucgcuugagccc

SEQ ID NO: 953895 - RNA, 22 nt, Human
ugaggugacagggaacucuuca

SEQ ID NO: 953896 - RNA, 23 nt, Human
ugaggugugcccugggcacaggg

SEQ ID NO: 953897 - RNA, 22 nt, Human
ugauacagcaccaugguaggca

SEQ ID NO: 953898 - RNA, 24 nt, Human
ugauccgcccaccuuggccuccca

SEQ ID NO: 953899 - RNA, 18 nt, Human
ugauggccucuggccagc

SEQ ID NO: 953900 - RNA, 18 nt, Human
ugcaaacaaaauagauuc

SEQ ID NO: 953901 - RNA, 21 nt, Human
ugcacugaaccagcaaaaaca

SEQ ID NO: 953902 - RNA, 22 nt, Human
ugcaguggccugaucuuggcuc

SEQ ID NO: 953903 - RNA, 24 nt, Human
ugccucagccucccaaguagcugg

SEQ ID NO: 953904 - RNA, 24 nt, Human
ugccucagccucccgaguagcugg

SEQ ID NO: 953905 - RNA, 18 nt, Human
ugcuagccaggcuggucu

SEQ ID NO: 953906 - RNA, 22 nt, Human
ugcuauagaacugggaaugagg

SEQ ID NO: 953907 - RNA, 21 nt, Human
ugcuggccuguggucugaguu

SEQ ID NO: 953908 - RNA, 22 nt, Human
ugcugggauuacaggcaugacc

SEQ ID NO: 953909 - RNA, 20 nt, Human
uggacggaacagaaucuggc

SEQ ID NO: 953910 - RNA, 19 nt, Human
uggagugcaauggcgugau

SEQ ID NO: 953911 - RNA, 22 nt, Human
uggagugcaauggcgugaucua

SEQ ID NO: 953912 - RNA, 24 nt, Human
uggagugcaauggcgugaucuagg

SEQ ID NO: 953913 - RNA, 19 nt, Human
uggagugcaguggccugau

SEQ ID NO: 953914 - RNA, 24 nt, Human
uggagugcaguggccugaucuugg

SEQ ID NO: 953915 - RNA, 22 nt, Human
uggccaagaaaaauguaaccuu

SEQ ID NO: 953916 - RNA, 18 nt, Human
uggccagugauggacugc

SEQ ID NO: 953917 - RNA, 20 nt, Human
ugggacuacaggcacacgcc

SEQ ID NO: 953918 - RNA, 21 nt, Human
ugggacuacaggcacacgccg

SEQ ID NO: 953919 - RNA, 24 nt, Human
ugggacuacaggcacacgccgcca

SEQ ID NO: 953920 - RNA, 21 nt, Human
ugggauuacaagcacacacca

SEQ ID NO: 953921 - RNA, 24 nt, Human
ugggauuacaagcacacaccacca

SEQ ID NO: 953922 - RNA, 20 nt, Human
ugggauuacaggcaugacca

SEQ ID NO: 953923 - RNA, 22 nt, Human
ugggauuacaggcaugaccacc

SEQ ID NO: 953924 - RNA, 23 nt, Human
ugggauuacaggcaugaccaccu

SEQ ID NO: 953925 - RNA, 24 nt, Human
ugggauuacaggcaugaccaccuc

SEQ ID NO: 953926 - RNA, 20 nt, Human
ugggcacaugaugucugacc

SEQ ID NO: 953927 - RNA, 28 nt, Human
ugggcagugggaaggcccucuggaccgg

SEQ ID NO: 953928 - RNA, 23 nt, Human
uggggggcugaggcaggaggguc

SEQ ID NO: 953929 - RNA, 18 nt, Human
ugggugugguggcacaug

SEQ ID NO: 953930 - RNA, 23 nt, Human
uggguuucgccaugcuagccagg

SEQ ID NO: 953931 - RNA, 20 nt, Human
uguaaauagcacagcguucu

SEQ ID NO: 953932 - RNA, 22 nt, Human
uguagggggcuagaagggugag

SEQ ID NO: 953933 - RNA, 20 nt, Human
ugucacccaggcuggagugc

SEQ ID NO: 953934 - RNA, 21 nt, Human
ugucauaaaaguucagaguaa

SEQ ID NO: 953935 - RNA, 26 nt, Human
ugugcaggagagggaguuugggaacc

SEQ ID NO: 953936 - RNA, 21 nt, Human
uguuuuguuuuuagccauguu

SEQ ID NO: 953937 - RNA, 24 nt, Human
uguuuuguuuuuagccauguuugu

SEQ ID NO: 953938 - RNA, 23 nt, Human
uuaaaaaagaaaaaaaauagagu

SEQ ID NO: 953939 - RNA, 25 nt, Human
uuaaauacacaaaaugcacugaacc

SEQ ID NO: 953940 - RNA, 18 nt, Human
uuaccucaagugauccgc

SEQ ID NO: 953941 - RNA, 24 nt, Human
uuaguagagacuggguuucgccau

SEQ ID NO: 953942 - RNA, 21 nt, Human
uucaaaauacaaaauuaaagc

SEQ ID NO: 953943 - RNA, 21 nt, Human
uucaagcgauucuccugccuc

SEQ ID NO: 953944 - RNA, 23 nt, Human
uucaagcgauucuccugccucag

SEQ ID NO: 953945 - RNA, 24 nt, Human
uucaagcgauucuccugccucagc

SEQ ID NO: 953946 - RNA, 21 nt, Human
uucagcacaggcagugcagug

SEQ ID NO: 953947 - RNA, 19 nt, Human
uucaggggacaaaggcacu

SEQ ID NO: 953948 - RNA, 20 nt, Human
uucaggggacaaaggcacua

SEQ ID NO: 953949 - RNA, 20 nt, Human
uuccuuccuuucuuucuuuu

SEQ ID NO: 953950 - RNA, 21 nt, Human
uucgagcaauccuccugccuc

SEQ ID NO: 953951 - RNA, 21 nt, Human
uucuacauuaaaaacaaaaaa

SEQ ID NO: 953952 - RNA, 19 nt, Human
uucucauaauggaaacagu

SEQ ID NO: 953953 - RNA, 22 nt, Human
uuggggggcugaggcaggaggg

SEQ ID NO: 953954 - RNA, 25 nt, Human
uuggggggcugaggcaggagggucg

SEQ ID NO: 953955 - RNA, 24 nt, Human
uuucuuuucuuucucucuuucccu

SEQ ID NO: 953956 - RNA, 18 nt, Human
uuugcaguucuauuuaca

SEQ ID NO: 953957 - RNA, 20 nt, Human
uuuucuuucucucuuuccuu

SEQ ID NO: 953958 - RNA, 22 nt, Human
uuuuuaguagagacuggguuuc

SEQ ID NO: 953959 - RNA, 20 nt, Human
uuuuuguauuuuuaguagag

SEQ ID NO: 953960 - RNA, 21 nt, Human
aacccacgggccgugcucccc

SEQ ID NO: 953961 - RNA, 19 nt, Human
acagaguaauacaaucaaa

SEQ ID NO: 953962 - RNA, 19 nt, Human
accaauggagagaagcauc

SEQ ID NO: 953963 - RNA, 28 nt, Human
acucuaaagugcuaccaauggagagaag

SEQ ID NO: 953964 - RNA, 22 nt, Human
cagucccaggcccuguccuccc

SEQ ID NO: 953965 - RNA, 21 nt, Human
ccaggcccuguccucccuguu

SEQ ID NO: 953966 - RNA, 22 nt, Human
ccccagccaggccgugggcuuc

SEQ ID NO: 953967 - RNA, 22 nt, Human
cccugguccuggccucccaggg

SEQ ID NO: 953968 - RNA, 24 nt, Human
ccgcucagucaggccuggggaugc

SEQ ID NO: 953969 - RNA, 21 nt, Human
ccgcugaaugaaggaccucug

SEQ ID NO: 953970 - RNA, 18 nt, Human
ccugauugagaugugaga

SEQ ID NO: 953971 - RNA, 22 nt, Human
ccugguccuggccucccagggu

SEQ ID NO: 953972 - RNA, 21 nt, Human
cgcugaaugaaggaccucuga

SEQ ID NO: 953973 - RNA, 20 nt, Human
cggcguugacccugccccag

SEQ ID NO: 953974 - RNA, 21 nt, Human
cgggcuccugguggacagccu

SEQ ID NO: 953975 - RNA, 21 nt, Human
cucccggaaccgcugaaugaa

SEQ ID NO: 953976 - RNA, 22 nt, Human
cuggccauuuagugggggaagg

SEQ ID NO: 953977 - RNA, 19 nt, Human
gacauggggacauggggag

SEQ ID NO: 953978 - RNA, 20 nt, Human
gacuuuggcccugguccugg

SEQ ID NO: 953979 - RNA, 18 nt, Human
gaguguccucuguuccca

SEQ ID NO: 953980 - RNA, 19 nt, Human
gccgugggcuucccagacc

SEQ ID NO: 953981 - RNA, 19 nt, Human
ggcguugacccugccccag

SEQ ID NO: 953982 - RNA, 20 nt, Human
gggaguggcggaucuggaag

SEQ ID NO: 953983 - RNA, 21 nt, Human
gggccgugcuccccugccgcu

SEQ ID NO: 953984 - RNA, 18 nt, Human
guaauacaaucaaaccca

SEQ ID NO: 953985 - RNA, 18 nt, Human
uagcaccgggcuccuggu

SEQ ID NO: 953986 - RNA, 21 nt, Human
ucccaacgcccugcgucccuc

SEQ ID NO: 953987 - RNA, 21 nt, Human
ucccaggcccuguccucccug

SEQ ID NO: 953988 - RNA, 24 nt, Human
ucccagggucagcgccuggagugu

SEQ ID NO: 953989 - RNA, 21 nt, Human
uccccuagcaccgggcuccug

SEQ ID NO: 953990 - RNA, 22 nt, Human
uccccuagcaccgggcuccugg

SEQ ID NO: 953991 - RNA, 22 nt, Human
uccugauugagaugugagaagc

SEQ ID NO: 953992 - RNA, 23 nt, Human
uccugguggacagccuuagaagg

SEQ ID NO: 953993 - RNA, 20 nt, Human
ucuaaagugcuaccaaugga

SEQ ID NO: 953994 - RNA, 20 nt, Human
ucugaggacuccucuugccc

SEQ ID NO: 953995 - RNA, 28 nt, Human
ugauauauauauauuuuuuaccauaaua

SEQ ID NO: 953996 - RNA, 20 nt, Human
uuccccuagcaccgggcucc

SEQ ID NO: 953997 - RNA, 24 nt, Human
uugacccugccccagccaggccgu

SEQ ID NO: 953998 - RNA, 22 nt, Human
aaacaagaaaucaacgugucau

SEQ ID NO: 953999 - RNA, 23 nt, Human
aaagcauaugucacacauaccaa

SEQ ID NO: 954000 - RNA, 21 nt, Human
aagaagaguuaaaauggaaug

SEQ ID NO: 954001 - RNA, 18 nt, Human
aagcauaugucacacaua

SEQ ID NO: 954002 - RNA, 27 nt, Human
acauaccaaagucuuacauuuugccuu

SEQ ID NO: 954003 - RNA, 21 nt, Human
accaaagucuuacauuuugcc

SEQ ID NO: 954004 - RNA, 20 nt, Human
agaaaacaaaaugaagaaau

SEQ ID NO: 954005 - RNA, 20 nt, Human
agaagaguuaaaauggaaug

SEQ ID NO: 954006 - RNA, 23 nt, Human
auaaagcauaugucacacauacc

SEQ ID NO: 954007 - RNA, 21 nt, Human
augcaaauaguucuuuuuauu

SEQ ID NO: 954008 - RNA, 23 nt, Human
caaggaauggcgacaguggacac

SEQ ID NO: 954009 - RNA, 20 nt, Human
caucuucaucuucaauuugc

SEQ ID NO: 954010 - RNA, 19 nt, Human
cauuguuuucuauggccaa

SEQ ID NO: 954011 - RNA, 19 nt, Human
ccucgugcuaacacuauuc

SEQ ID NO: 954012 - RNA, 19 nt, Human
cgacaguggacacugcuga

SEQ ID NO: 954013 - RNA, 21 nt, Human
gaauguuagagauacaaaauu

SEQ ID NO: 954014 - RNA, 18 nt, Human
gacaguaauuuggaaugu

SEQ ID NO: 954015 - RNA, 24 nt, Human
gucaucuucaucuucaauuugcua

SEQ ID NO: 954016 - RNA, 24 nt, Human
uaaaucagaagugacuacacauua

SEQ ID NO: 954017 - RNA, 24 nt, Human
uaauuacuaaaacuccacugugga

SEQ ID NO: 954018 - RNA, 23 nt, Human
uauaccagaaaacaaaaugaaga

SEQ ID NO: 954019 - RNA, 27 nt, Human
uaucuuccucuccuauuugacguuuua

SEQ ID NO: 954020 - RNA, 26 nt, Human
uccaauauuaacucacacuuucccaa

SEQ ID NO: 954021 - RNA, 20 nt, Human
uccucgugcuaacacuauuc

SEQ ID NO: 954022 - RNA, 20 nt, Human
uggccaaggaauggcgacag

SEQ ID NO: 954023 - RNA, 20 nt, Human
uguaaaauaaagccaaauaa

SEQ ID NO: 954024 - RNA, 19 nt, Human
uucuauggccaaggaaugg

SEQ ID NO: 954025 - RNA, 21 nt, Human
uuuccacaauuauuacaauug

SEQ ID NO: 954026 - RNA, 23 nt, Human
aaaaaagagacuuuuaaaaagga

SEQ ID NO: 954027 - RNA, 21 nt, Human
aaaacugaaacauucaaaagc

SEQ ID NO: 954028 - RNA, 22 nt, Human
aaaaggagacgguuguuuuaaa

SEQ ID NO: 954029 - RNA, 22 nt, Human
aaacugaaacauucaaaagcga

SEQ ID NO: 954030 - RNA, 25 nt, Human
aaauucacauuuacaaaauaauaaa

SEQ ID NO: 954031 - RNA, 27 nt, Human
aagcgaacagggaaaccgagggcuuca

SEQ ID NO: 954032 - RNA, 19 nt, Human
acuugaacauuuggauggc

SEQ ID NO: 954033 - RNA, 20 nt, Human
agccuuuguuuuguuuuccu

SEQ ID NO: 954034 - RNA, 18 nt, Human
auggcacugggugcaagu

SEQ ID NO: 954035 - RNA, 21 nt, Human
cacacauauauuuaacaguac

SEQ ID NO: 954036 - RNA, 19 nt, Human
cacaguaccacugaguuag

SEQ ID NO: 954037 - RNA, 18 nt, Human
ccuuuguuuuguuuuccu

SEQ ID NO: 954038 - RNA, 22 nt, Human
cuaacuccuaaauagaugaugc

SEQ ID NO: 954039 - RNA, 21 nt, Human
cuucauauuuuacagaagggc

SEQ ID NO: 954040 - RNA, 24 nt, Human
gaaaaaagagacuuuuaaaaagga

SEQ ID NO: 954041 - RNA, 26 nt, Human
gaaaaaagagacuuuuaaaaaggaga

SEQ ID NO: 954042 - RNA, 19 nt, Human
gagccguuucagacagugg

SEQ ID NO: 954043 - RNA, 23 nt, Human
gcuuuuuuuuuuugucuuuuuuu

SEQ ID NO: 954044 - RNA, 20 nt, Human
ggauggcacugggugcaagu

SEQ ID NO: 954045 - RNA, 20 nt, Human
uaaaaaggagacgguuguuu

SEQ ID NO: 954046 - RNA, 20 nt, Human
uaacugacggaaaaauaaau

SEQ ID NO: 954047 - RNA, 23 nt, Human
uacaauagcacauccaaaucuaa

SEQ ID NO: 954048 - RNA, 24 nt, Human
ucagagccguuucagacaguggaa

SEQ ID NO: 954049 - RNA, 25 nt, Human
uccuacggccugcgagacgcucgcc

SEQ ID NO: 954050 - RNA, 19 nt, Human
uccugugcuguaaaggaag

SEQ ID NO: 954051 - RNA, 22 nt, Human
ucuguuuuugugcuguuacucg

SEQ ID NO: 954052 - RNA, 21 nt, Human
ugaaacauucaaaagcgaaca

SEQ ID NO: 954053 - RNA, 23 nt, Human
ugacggaaaaauaaauucaacaa

SEQ ID NO: 954054 - RNA, 20 nt, Human
uggcaauaaucaggggagga

SEQ ID NO: 954055 - RNA, 20 nt, Human
uguuuuguuuuccugagccc

SEQ ID NO: 954056 - RNA, 22 nt, Human
uguuuuguuuuccugagcccuc

SEQ ID NO: 954057 - RNA, 23 nt, Human
uguuuuguuuuccugagcccuca

SEQ ID NO: 954058 - RNA, 23 nt, Human
uuaaaguacuguaacucacgacu

SEQ ID NO: 954059 - RNA, 20 nt, Human
uuacaaaauaauaaagucag

SEQ ID NO: 954060 - RNA, 23 nt, Human
uucauauuuuacagaagggcuug

SEQ ID NO: 954061 - RNA, 23 nt, Human
uugaacauuuggauggcacuggg

SEQ ID NO: 954062 - RNA, 29 nt, Human
uuuaaggaggaagccuuuguuccguucgg

SEQ ID NO: 954063 - RNA, 22 nt, Human
uuuacauaacugacggaaaaau

SEQ ID NO: 954064 - RNA, 20 nt, Human
acagugcugagggccgggac

SEQ ID NO: 954065 - RNA, 22 nt, Human
acagugcugagggccgggacgc

SEQ ID NO: 954066 - RNA, 18 nt, Human
agaaaaaauacacaaaga

SEQ ID NO: 954067 - RNA, 22 nt, Human
agaaaaaauacacaaagaacau

SEQ ID NO: 954068 - RNA, 23 nt, Human
caaagaaaauaaaaucagagaaa

SEQ ID NO: 954069 - RNA, 23 nt, Human
caaguuagacagcggcacggcca

SEQ ID NO: 954070 - RNA, 23 nt, Human
cacggccaaacaccaacuguccc

SEQ ID NO: 954071 - RNA, 28 nt, Human
cacggccaaacaccaacugucccgggcc

SEQ ID NO: 954072 - RNA, 27 nt, Human
cagaaacaaagaaaauaaaaucagaga

SEQ ID NO: 954073 - RNA, 19 nt, Human
caguggacagugcugaggg

SEQ ID NO: 954074 - RNA, 24 nt, Human
ccggcgcugacagaaauccccucu

SEQ ID NO: 954075 - RNA, 20 nt, Human
ccuggccgcuccgccucucu

SEQ ID NO: 954076 - RNA, 18 nt, Human
cggcagcggcaauucacu

SEQ ID NO: 954077 - RNA, 26 nt, Human
cggccaaacaccaacugucccgggcc

SEQ ID NO: 954078 - RNA, 23 nt, Human
gaaacaaagaaaauaaaaucaga

SEQ ID NO: 954079 - RNA, 23 nt, Human
ggccggcgcugacagaaaucccc

SEQ ID NO: 954080 - RNA, 21 nt, Human
uauaugaguuuccaacuaauu

SEQ ID NO: 954081 - RNA, 21 nt, Human
ucccgggccugcuggucucug

SEQ ID NO: 954082 - RNA, 22 nt, Human
uccggcagcggcaauucacucu

SEQ ID NO: 954083 - RNA, 21 nt, Human
ucucugcuggcaccgaaacag

SEQ ID NO: 954084 - RNA, 19 nt, Human
ucuguagaaaaaauacaca

SEQ ID NO: 954085 - RNA, 22 nt, Human
ugcacaccaaguuagacagcgg

SEQ ID NO: 954086 - RNA, 23 nt, Human
uuuuuuuuuuuuuuuuuuaauag

SEQ ID NO: 954087 - RNA, 23 nt, Human
aaacaacucaaauuuaggagccu

SEQ ID NO: 954088 - RNA, 19 nt, Human
aaccuggguaaggaagggg

SEQ ID NO: 954089 - RNA, 24 nt, Human
aauaacuucuugaauaauuucuac

SEQ ID NO: 954090 - RNA, 21 nt, Human
acaacucaaauuuaggagccu

SEQ ID NO: 954091 - RNA, 20 nt, Human
cacauauucuccacuuccaa

SEQ ID NO: 954092 - RNA, 22 nt, Human
caccaaacaaaccaccucccaa

SEQ ID NO: 954093 - RNA, 23 nt, Human
ccauucaccaaacaaaccaccuc

SEQ ID NO: 954094 - RNA, 22 nt, Human
cccaucaaacgauuuccccauc

SEQ ID NO: 954095 - RNA, 19 nt, Human
ccuacugcucaucucuuag

SEQ ID NO: 954096 - RNA, 19 nt, Human
cucccaaucuauuauguuu

SEQ ID NO: 954097 - RNA, 24 nt, Human
cugcaaguuccgcugggaauccau

SEQ ID NO: 954098 - RNA, 22 nt, Human
gagacuuuuccccaucaaacga

SEQ ID NO: 954099 - RNA, 23 nt, Human
uacaauccauugagugaaacaga

SEQ ID NO: 954100 - RNA, 23 nt, Human
uauuauuagaaaaugguuuuaaa

SEQ ID NO: 954101 - RNA, 24 nt, Human
ucacaaaauaauuuguucaacuga

SEQ ID NO: 954102 - RNA, 23 nt, Human
ucaccaaacaaaccaccucccaa

SEQ ID NO: 954103 - RNA, 20 nt, Human
ucuauuauguuuugucaccu

SEQ ID NO: 954104 - RNA, 18 nt, Human
ugaagcacgaggagaggu

SEQ ID NO: 954105 - RNA, 21 nt, Human
ugagugaaacagauucacaaa

SEQ ID NO: 954106 - RNA, 19 nt, Human
ugagugucuguacaagcuu

SEQ ID NO: 954107 - RNA, 26 nt, Human
uguaauagaaaaucaguuuaaggaua

SEQ ID NO: 954108 - RNA, 21 nt, Human
uuaaagccccauucaccaaac

SEQ ID NO: 954109 - RNA, 20 nt, Human
uuugaagcacgaggagaggu

SEQ ID NO: 954110 - RNA, 20 nt, Human
aaaaaaucacccaggcaugg

SEQ ID NO: 954111 - RNA, 18 nt, Human
aaacugcacagccccaac

SEQ ID NO: 954112 - RNA, 23 nt, Human
aaaucagcuucagcaaacugaaa

SEQ ID NO: 954113 - RNA, 23 nt, Human
aaaugcagaguccuaggccccac

SEQ ID NO: 954114 - RNA, 26 nt, Human
aacugcacagccccaaccagguuccc

SEQ ID NO: 954115 - RNA, 23 nt, Human
aagagccagaaaucauccccugg

SEQ ID NO: 954116 - RNA, 24 nt, Human
aagagccuucagcagcccccacgg

SEQ ID NO: 954117 - RNA, 22 nt, Human
aagagugccaaucauuacaaau

SEQ ID NO: 954118 - RNA, 18 nt, Human
aaggaugaaugagugugg

SEQ ID NO: 954119 - RNA, 20 nt, Human
aaggcaccaccccauccaca

SEQ ID NO: 954120 - RNA, 21 nt, Human
aaggcaccaccccauccacag

SEQ ID NO: 954121 - RNA, 22 nt, Human
aauacagugcccaggcccgccu

SEQ ID NO: 954122 - RNA, 22 nt, Human
aaucauaacccacacaggccca

SEQ ID NO: 954123 - RNA, 20 nt, Human
aauggcagggccugggggag

SEQ ID NO: 954124 - RNA, 24 nt, Human
acaacaguggaggguauaccaaau

SEQ ID NO: 954125 - RNA, 18 nt, Human
acacccuggcccuacaga

SEQ ID NO: 954126 - RNA, 20 nt, Human
acaccuggcccuugcgggga

SEQ ID NO: 954127 - RNA, 25 nt, Human
acagagcaagacccugucucuuaaa

SEQ ID NO: 954128 - RNA, 23 nt, Human
acagugcccaggcccgccugggc

SEQ ID NO: 954129 - RNA, 18 nt, Human
accacccccaccccaacu

SEQ ID NO: 954130 - RNA, 25 nt, Human
accccagaucuccugauuuuaacaa

SEQ ID NO: 954131 - RNA, 20 nt, Human
accuuugacuuucugaugau

SEQ ID NO: 954132 - RNA, 18 nt, Human
acugaauccuugucacag

SEQ ID NO: 954133 - RNA, 24 nt, Human
acugcccuccagccuggacaacag

SEQ ID NO: 954134 - RNA, 24 nt, Human
acugcccuccagccuggacaacag

SEQ ID NO: 954135 - RNA, 18 nt, Human
acuggugaggaaggggag

SEQ ID NO: 954136 - RNA, 23 nt, Human
agaaguagggggaggaucuggga

SEQ ID NO: 954137 - RNA, 19 nt, Human
agacagaagaucgggcaga

SEQ ID NO: 954138 - RNA, 22 nt, Human
agacagacaacccaauggcagg

SEQ ID NO: 954139 - RNA, 23 nt, Human
agagagaccaaggcaccacccca

SEQ ID NO: 954140 - RNA, 20 nt, Human
agaguuggaauauggcccuu

SEQ ID NO: 954141 - RNA, 21 nt, Human
agcaaagugaacaccaagcaa

SEQ ID NO: 954142 - RNA, 20 nt, Human
agcaagugcagcaaagcugg

SEQ ID NO: 954143 - RNA, 22 nt, Human
agcagcccccacggccuggagc

SEQ ID NO: 954144 - RNA, 23 nt, Human
agccugggcaacauagcaagacc

SEQ ID NO: 954145 - RNA, 24 nt, Human
agccugggcaacauagcaagaccu

SEQ ID NO: 954146 - RNA, 18 nt, Human
agcugcagguucugucua

SEQ ID NO: 954147 - RNA, 20 nt, Human
agcuggaagcccagcccaca

SEQ ID NO: 954148 - RNA, 23 nt, Human
agcuguguuuguccuaguauggg

SEQ ID NO: 954149 - RNA, 21 nt, Human
agcuguuccagcuggggcugg

SEQ ID NO: 954150 - RNA, 23 nt, Human
aggaagcuguaggggaucuggga

SEQ ID NO: 954151 - RNA, 24 nt, Human
aggaccacuugagcccgggaauuc

SEQ ID NO: 954152 - RNA, 23 nt, Human
aggaggcugaggcaggaggauca

SEQ ID NO: 954153 - RNA, 24 nt, Human
aggaggcugaggcaggaggaucac

SEQ ID NO: 954154 - RNA, 20 nt, Human
aggagggagggagguaagag

SEQ ID NO: 954155 - RNA, 21 nt, Human
aggagggagggagguaagagg

SEQ ID NO: 954156 - RNA, 24 nt, Human
aggaucacuugagcccaggaguuc

SEQ ID NO: 954157 - RNA, 18 nt, Human
aggaugcuggaaaaggcu

SEQ ID NO: 954158 - RNA, 18 nt, Human
aggcaggaggaccacuug

SEQ ID NO: 954159 - RNA, 24 nt, Human
aggcaggaggaccacuugagcccg

SEQ ID NO: 954160 - RNA, 18 nt, Human
aggcaggaggaucacuug

SEQ ID NO: 954161 - RNA, 23 nt, Human
aggcaggaggaucacuugagccc

SEQ ID NO: 954162 - RNA, 24 nt, Human
aggcugaggcaggaggaccacuug

SEQ ID NO: 954163 - RNA, 24 nt, Human
aggcugaggcaggaggaucacuug

SEQ ID NO: 954164 - RNA, 19 nt, Human
aggcuuuggaggaaaggcc

SEQ ID NO: 954165 - RNA, 20 nt, Human
agggaaugcagaaccacccc

SEQ ID NO: 954166 - RNA, 19 nt, Human
agggagggagguaagaggg

SEQ ID NO: 954167 - RNA, 24 nt, Human
agggcaguggacaacaguggagaa

SEQ ID NO: 954168 - RNA, 21 nt, Human
agggcgagauggcgagcuagg

SEQ ID NO: 954169 - RNA, 20 nt, Human
agggggagggagagccauuu

SEQ ID NO: 954170 - RNA, 18 nt, Human
aguggaggagggggcaau

SEQ ID NO: 954171 - RNA, 19 nt, Human
aguggguagcccuggaugg

SEQ ID NO: 954172 - RNA, 20 nt, Human
aguguugccuuugcuguggu

SEQ ID NO: 954173 - RNA, 20 nt, Human
aguuccccuauuucccucca

SEQ ID NO: 954174 - RNA, 21 nt, Human
aguuguaagugcaggggccag

SEQ ID NO: 954175 - RNA, 18 nt, Human
auccaugcccuggcucug

SEQ ID NO: 954176 - RNA, 19 nt, Human
auggcagggccugggggag

SEQ ID NO: 954177 - RNA, 23 nt, Human
augggguagggugggcuuugagg

SEQ ID NO: 954178 - RNA, 24 nt, Human
auuaugucacugcccuccagccug

SEQ ID NO: 954179 - RNA, 23 nt, Human
caaaaccaaagcaucgaggcugg

SEQ ID NO: 954180 - RNA, 24 nt, Human
caaaagauaccacaccgaaggaag

SEQ ID NO: 954181 - RNA, 22 nt, Human
caaagugaacaccaagcaacug

SEQ ID NO: 954182 - RNA, 19 nt, Human
caacagaagcugcugggcu

SEQ ID NO: 954183 - RNA, 23 nt, Human
caacagaagcugcugggcugggc

SEQ ID NO: 954184 - RNA, 22 nt, Human
caacagagcaagacccugucuc

SEQ ID NO: 954185 - RNA, 20 nt, Human
caacuggaggucugcagcug

SEQ ID NO: 954186 - RNA, 18 nt, Human
caagagagaccaaggcac

SEQ ID NO: 954187 - RNA, 22 nt, Human
caagagagaccaaggcaccacc

SEQ ID NO: 954188 - RNA, 22 nt, Human
caagaggagcaaagugaacacc

SEQ ID NO: 954189 - RNA, 22 nt, Human
caagcaacucuugucuaagggc

SEQ ID NO: 954190 - RNA, 22 nt, Human
caagcagaacacccuggcccua

SEQ ID NO: 954191 - RNA, 20 nt, Human
cacacagcugugagguggug

SEQ ID NO: 954192 - RNA, 20 nt, Human
cacagccaagaguggggcug

SEQ ID NO: 954193 - RNA, 23 nt, Human
caccucgaguuccagcaguuucc

SEQ ID NO: 954194 - RNA, 18 nt, Human
cacugcccuccagccugg

SEQ ID NO: 954195 - RNA, 18 nt, Human
cacugcccuccagccugg

SEQ ID NO: 954196 - RNA, 19 nt, Human
cacugcccuccagccugga

SEQ ID NO: 954197 - RNA, 24 nt, Human
cacugcccuccagccuggacaaca

SEQ ID NO: 954198 - RNA, 24 nt, Human
cacugguagucccagcuacuaagg

SEQ ID NO: 954199 - RNA, 23 nt, Human
cagaaccacccccaccccaacuc

SEQ ID NO: 954200 - RNA, 21 nt, Human
cagaagcugcugggcugggca

SEQ ID NO: 954201 - RNA, 21 nt, Human
cagagcaagacccugucucuu

SEQ ID NO: 954202 - RNA, 20 nt, Human
cagaguccuaggccccaccc

SEQ ID NO: 954203 - RNA, 19 nt, Human
cagcaccaaggcauggggu

SEQ ID NO: 954204 - RNA, 21 nt, Human
cagcccaaacugcacagcccc

SEQ ID NO: 954205 - RNA, 23 nt, Human
cagcugcagcccagccaagcaga

SEQ ID NO: 954206 - RNA, 18 nt, Human
cagcuucagcaaacugaa

SEQ ID NO: 954207 - RNA, 18 nt, Human
caggaguucaaggguaca

SEQ ID NO: 954208 - RNA, 24 nt, Human
caggaguucaaggguacagugaga

SEQ ID NO: 954209 - RNA, 18 nt, Human
cagggcuucuacugacuc

SEQ ID NO: 954210 - RNA, 25 nt, Human
cauagcaagaccuugucuguauaaa

SEQ ID NO: 954211 - RNA, 24 nt, Human
ccaaccgagggguagcagcugcag

SEQ ID NO: 954212 - RNA, 22 nt, Human
ccaauggcagggccugggggag

SEQ ID NO: 954213 - RNA, 18 nt, Human
ccacagagcugcagguuc

SEQ ID NO: 954214 - RNA, 19 nt, Human
ccacaggcuagcuugaccc

SEQ ID NO: 954215 - RNA, 21 nt, Human
ccacaggcuagcuugacccgc

SEQ ID NO: 954216 - RNA, 21 nt, Human
ccacccccaccccaacuccag

SEQ ID NO: 954217 - RNA, 21 nt, Human
ccagagccaugucccuggaua

SEQ ID NO: 954218 - RNA, 22 nt, Human
ccagcccaaacugcacagcccc

SEQ ID NO: 954219 - RNA, 23 nt, Human
ccagcccacagcaggacaagcaa

SEQ ID NO: 954220 - RNA, 19 nt, Human
ccagcuggggcuggaugcu

SEQ ID NO: 954221 - RNA, 26 nt, Human
cccagacccaggcccaaacaggaggc

SEQ ID NO: 954222 - RNA, 18 nt, Human
cccagguugccccucucc

SEQ ID NO: 954223 - RNA, 19 nt, Human
cccaugacggagacagaca

SEQ ID NO: 954224 - RNA, 30 nt, Human
ccccagagccccugaucugccuggaccagg

SEQ ID NO: 954225 - RNA, 19 nt, Human
ccccaugcccagacccagg

SEQ ID NO: 954226 - RNA, 22 nt, Human
ccccaugcccagacccaggccc

SEQ ID NO: 954227 - RNA, 18 nt, Human
cccccaccccaacuccag

SEQ ID NO: 954228 - RNA, 18 nt, Human
ccccggugagcacuugug

SEQ ID NO: 954229 - RNA, 18 nt, Human
cccggcuguucugauugg

SEQ ID NO: 954230 - RNA, 20 nt, Human
cccucagagagacagaagau

SEQ ID NO: 954231 - RNA, 23 nt, Human
cccuccagccuggacaacagagc

SEQ ID NO: 954232 - RNA, 19 nt, Human
cccuccauucccauuuuau

SEQ ID NO: 954233 - RNA, 19 nt, Human
cccucuguuuuccugcucc

SEQ ID NO: 954234 - RNA, 19 nt, Human
cccuuggggagaaguaggg

SEQ ID NO: 954235 - RNA, 20 nt, Human
ccggugagcacuugugcugc

SEQ ID NO: 954236 - RNA, 20 nt, Human
ccuaggugcuugaccuggug

SEQ ID NO: 954237 - RNA, 24 nt, Human
ccucugggucagcuuuuuguugca

SEQ ID NO: 954238 - RNA, 21 nt, Human
ccugggcaacauagcaagacc

SEQ ID NO: 954239 - RNA, 22 nt, Human
ccuguaaucccgauccuguggg

SEQ ID NO: 954240 - RNA, 18 nt, Human
ccuucauccuccucaagc

SEQ ID NO: 954241 - RNA, 25 nt, Human
ccuuggcuauggccuacccacuccc

SEQ ID NO: 954242 - RNA, 19 nt, Human
ccuugggcuuuggggcccu

SEQ ID NO: 954243 - RNA, 24 nt, Human
cgagguagucaagagagaccaagg

SEQ ID NO: 954244 - RNA, 19 nt, Human
cgauccugugggaggcuga

SEQ ID NO: 954245 - RNA, 24 nt, Human
cgauccugugggaggcugaggcag

SEQ ID NO: 954246 - RNA, 18 nt, Human
cucacucuacccagccac

SEQ ID NO: 954247 - RNA, 18 nt, Human
cucccggucacacagcug

SEQ ID NO: 954248 - RNA, 23 nt, Human
cucucugaauacugcccuugggg

SEQ ID NO: 954249 - RNA, 18 nt, Human
cucucuucaugggccugg

SEQ ID NO: 954250 - RNA, 20 nt, Human
cucugugccagcuacugucc

SEQ ID NO: 954251 - RNA, 20 nt, Human
cucuugccuguaaucccgau

SEQ ID NO: 954252 - RNA, 19 nt, Human
cugcagcuggaagcccagc

SEQ ID NO: 954253 - RNA, 22 nt, Human
cuggauguggcaaaagauacca

SEQ ID NO: 954254 - RNA, 18 nt, Human
cugggugucuugucccag

SEQ ID NO: 954255 - RNA, 21 nt, Human
cugguagucccagcuacuaag

SEQ ID NO: 954256 - RNA, 18 nt, Human
cuguguuaaagggaaggc

SEQ ID NO: 954257 - RNA, 18 nt, Human
cuuauaaccccacaggcc

SEQ ID NO: 954258 - RNA, 18 nt, Human
cuuggcccuuggggagaa

SEQ ID NO: 954259 - RNA, 28 nt, Human
gaagcccagcccacagcaggacaagcaa

SEQ ID NO: 954260 - RNA, 24 nt, Human
gaccacuugagcccgggaauucaa

SEQ ID NO: 954261 - RNA, 21 nt, Human
gaccuuugacuuucugaugau

SEQ ID NO: 954262 - RNA, 18 nt, Human
gagcuauuugggacagga

SEQ ID NO: 954263 - RNA, 24 nt, Human
gaggggcuggggaagccagcuggg

SEQ ID NO: 954264 - RNA, 24 nt, Human
gaucacuugagcccaggaguucaa

SEQ ID NO: 954265 - RNA, 20 nt, Human
gccaagaacuaggagucacc

SEQ ID NO: 954266 - RNA, 24 nt, Human
gccaggccuaggugcuugaccugg

SEQ ID NO: 954267 - RNA, 21 nt, Human
gcccacagcaggacaagcaac

SEQ ID NO: 954268 - RNA, 22 nt, Human
gccccggugagcacuugugcug

SEQ ID NO: 954269 - RNA, 21 nt, Human
gcccucuguuuuccugcuccc

SEQ ID NO: 954270 - RNA, 22 nt, Human
gcccugagcugccugguggauu

SEQ ID NO: 954271 - RNA, 23 nt, Human
gcccuggauguggcaaaagauac

SEQ ID NO: 954272 - RNA, 19 nt, Human
gcugccuaauccuccagga

SEQ ID NO: 954273 - RNA, 20 nt, Human
gcuggcaucucuccuuccag

SEQ ID NO: 954274 - RNA, 22 nt, Human
gcuggccuccugcucaucccgg

SEQ ID NO: 954275 - RNA, 24 nt, Human
gcuggcuccugggcccaggcccuu

SEQ ID NO: 954276 - RNA, 24 nt, Human
gcugugcaaccuugagcaagcccc

SEQ ID NO: 954277 - RNA, 20 nt, Human
gcuguuccagcuggggcugg

SEQ ID NO: 954278 - RNA, 21 nt, Human
gcuucucagcuuggggaagga

SEQ ID NO: 954279 - RNA, 19 nt, Human
gcuugaccuggugaucuga

SEQ ID NO: 954280 - RNA, 18 nt, Human
gcuuuuuguugcaaaauc

SEQ ID NO: 954281 - RNA, 20 nt, Human
ggaaggagggagggagguaa

SEQ ID NO: 954282 - RNA, 26 nt, Human
ggagcccuuucucuuaaaaguuuccu

SEQ ID NO: 954283 - RNA, 18 nt, Human
ggaguguuugggaaaugg

SEQ ID NO: 954284 - RNA, 23 nt, Human
ggaucacuugagcccaggaguuc

SEQ ID NO: 954285 - RNA, 18 nt, Human
ggcaccgccagccgcucg

SEQ ID NO: 954286 - RNA, 23 nt, Human
ggccacuucugaguccucugucu

SEQ ID NO: 954287 - RNA, 23 nt, Human
ggcguggaggcucuugccuguaa

SEQ ID NO: 954288 - RNA, 18 nt, Human
ggcuagcuugacccgcug

SEQ ID NO: 954289 - RNA, 19 nt, Human
ggcuucgugcuuuagagau

SEQ ID NO: 954290 - RNA, 18 nt, Human
gggaaggaggagguucag

SEQ ID NO: 954291 - RNA, 18 nt, Human
gggcauugccuuaauucc

SEQ ID NO: 954292 - RNA, 23 nt, Human
gggcgcagccagcuuuaaggugu

SEQ ID NO: 954293 - RNA, 20 nt, Human
gggcuggggaagccagcugg

SEQ ID NO: 954294 - RNA, 22 nt, Human
ggggcuggggaagccagcuggg

SEQ ID NO: 954295 - RNA, 24 nt, Human
ggguacagugagcuaugauuaugu

SEQ ID NO: 954296 - RNA, 18 nt, Human
gucagcuaguuguggcug

SEQ ID NO: 954297 - RNA, 19 nt, Human
gucuaagggcagugcucuc

SEQ ID NO: 954298 - RNA, 24 nt, Human
gugaucucuggaggaagaguguug

SEQ ID NO: 954299 - RNA, 21 nt, Human
guugcucugaugacuggagac

SEQ ID NO: 954300 - RNA, 20 nt, Human
uaccacaccgaaggaagcug

SEQ ID NO: 954301 - RNA, 21 nt, Human
uaccagguagaguugcucuga

SEQ ID NO: 954302 - RNA, 25 nt, Human
uaccugguuagugccagccuuggga

SEQ ID NO: 954303 - RNA, 19 nt, Human
uacuggugaggaaggggag

SEQ ID NO: 954304 - RNA, 19 nt, Human
uacuguccacauaugaccu

SEQ ID NO: 954305 - RNA, 23 nt, Human
uagaggaggcuugugacuucagc

SEQ ID NO: 954306 - RNA, 23 nt, Human
uaggucuggaucuggggcugcca

SEQ ID NO: 954307 - RNA, 19 nt, Human
uauagauggaacuauggca

SEQ ID NO: 954308 - RNA, 22 nt, Human
uauccaugcccuggcucuggcc

SEQ ID NO: 954309 - RNA, 24 nt, Human
uauuguuauuggcgcuguccugug

SEQ ID NO: 954310 - RNA, 18 nt, Human
uauuucuucacaggugcu

SEQ ID NO: 954311 - RNA, 21 nt, Human
ucaaccuuucugagccucagu

SEQ ID NO: 954312 - RNA, 20 nt, Human
ucaacucacucuacccagcc

SEQ ID NO: 954313 - RNA, 24 nt, Human
ucaagagagaccaaggcaccaccc

SEQ ID NO: 954314 - RNA, 21 nt, Human
ucacugcccuccagccuggac

SEQ ID NO: 954315 - RNA, 23 nt, Human
ucacuugagcccaggaguucaag

SEQ ID NO: 954316 - RNA, 19 nt, Human
ucagcaaacugaaacaaac

SEQ ID NO: 954317 - RNA, 22 nt, Human
ucagcaaacugaaacaaaccuu

SEQ ID NO: 954318 - RNA, 24 nt, Human
ucaggagcuguuccuucagaaagg

SEQ ID NO: 954319 - RNA, 19 nt, Human
ucagguggggucaaaacca

SEQ ID NO: 954320 - RNA, 19 nt, Human
ucccaaccagaaauggcag

SEQ ID NO: 954321 - RNA, 18 nt, Human
ucccagguugccccucuc

SEQ ID NO: 954322 - RNA, 19 nt, Human
ucccugagcaguucuuggc

SEQ ID NO: 954323 - RNA, 18 nt, Human
ucccugaguaagcagugg

SEQ ID NO: 954324 - RNA, 25 nt, Human
ucccuucccucuccagauacugagg

SEQ ID NO: 954325 - RNA, 20 nt, Human
ucccuuucugcuauccauca

SEQ ID NO: 954326 - RNA, 18 nt, Human
uccuaggccccaccccag

SEQ ID NO: 954327 - RNA, 18 nt, Human
uccuaucccccgcugcua

SEQ ID NO: 954328 - RNA, 22 nt, Human
uccugggagcuggccuccugcu

SEQ ID NO: 954329 - RNA, 22 nt, Human
uccugggcccaggcccuugcuc

SEQ ID NO: 954330 - RNA, 25 nt, Human
ucucagcccagggagacugguuuca

SEQ ID NO: 954331 - RNA, 21 nt, Human
ucucugaauacugcccuuggg

SEQ ID NO: 954332 - RNA, 18 nt, Human
ucucuggucucucacagg

SEQ ID NO: 954333 - RNA, 22 nt, Human
ucucuggucucucacaggaugc

SEQ ID NO: 954334 - RNA, 22 nt, Human
ucugcagcuggaagcccagccc

SEQ ID NO: 954335 - RNA, 23 nt, Human
ucugggugucuugucccagguug

SEQ ID NO: 954336 - RNA, 19 nt, Human
ucuucaacucacucuaccc

SEQ ID NO: 954337 - RNA, 23 nt, Human
ugaauacugcccuuggggaccuc

SEQ ID NO: 954338 - RNA, 20 nt, Human
ugacggccuccggcaucuuc

SEQ ID NO: 954339 - RNA, 20 nt, Human
ugacucagccccaaccgagg

SEQ ID NO: 954340 - RNA, 21 nt, Human
ugagaugccucucuucauggg

SEQ ID NO: 954341 - RNA, 22 nt, Human
ugagcaggcuuuggaggaaagg

SEQ ID NO: 954342 - RNA, 20 nt, Human
ugaggaaaggaggaucaggu

SEQ ID NO: 954343 - RNA, 22 nt, Human
ugaggaaaguggguuggaggug

SEQ ID NO: 954344 - RNA, 19 nt, Human
ugaggaaggggagacauag

SEQ ID NO: 954345 - RNA, 20 nt, Human
ugaggcaggaggaccacuug

SEQ ID NO: 954346 - RNA, 24 nt, Human
ugaggcaggaggaccacuugagcc

SEQ ID NO: 954347 - RNA, 25 nt, Human
ugaggcaggaggaccacuugagccc

SEQ ID NO: 954348 - RNA, 20 nt, Human
ugaggcaggaggaucacuug

SEQ ID NO: 954349 - RNA, 24 nt, Human
ugaggcaggaggaucacuugagcc

SEQ ID NO: 954350 - RNA, 25 nt, Human
ugaggcaggaggaucacuugagccc

SEQ ID NO: 954351 - RNA, 24 nt, Human
ugaggggcuggggaagccagcugg

SEQ ID NO: 954352 - RNA, 21 nt, Human
ugaguaagcaguggguagccc

SEQ ID NO: 954353 - RNA, 28 nt, Human
ugcacagccccaaccagguucccaacac

SEQ ID NO: 954354 - RNA, 23 nt, Human
ugcagaguccuaggccccacccc

SEQ ID NO: 954355 - RNA, 20 nt, Human
ugcagcccagccaagcagaa

SEQ ID NO: 954356 - RNA, 20 nt, Human
ugccaguggacugggugcca

SEQ ID NO: 954357 - RNA, 19 nt, Human
ugcccuggcucuggccccg

SEQ ID NO: 954358 - RNA, 26 nt, Human
ugccugguggauugguaccaaguggg

SEQ ID NO: 954359 - RNA, 19 nt, Human
ugccuugggcuuuggggcc

SEQ ID NO: 954360 - RNA, 25 nt, Human
ugccuugggcuuuggggcccucugu

SEQ ID NO: 954361 - RNA, 25 nt, Human
ugcggggaaagagccuucagcagga

SEQ ID NO: 954362 - RNA, 18 nt, Human
ugcucugaugacuggaga

SEQ ID NO: 954363 - RNA, 21 nt, Human
ugcuuuagagauuugcuaccc

SEQ ID NO: 954364 - RNA, 20 nt, Human
uggaaaaggcugauccucac

SEQ ID NO: 954365 - RNA, 25 nt, Human
uggaaggaaggagccccaaaccugg

SEQ ID NO: 954366 - RNA, 20 nt, Human
uggacugggugccaggaggc

SEQ ID NO: 954367 - RNA, 24 nt, Human
uggaggcucuugccuguaaucccg

SEQ ID NO: 954368 - RNA, 19 nt, Human
uggauggacaaguuaggaa

SEQ ID NO: 954369 - RNA, 22 nt, Human
uggcaaaagauaccacaccgaa

SEQ ID NO: 954370 - RNA, 26 nt, Human
uggcaaggcuguguucucucucccag

SEQ ID NO: 954371 - RNA, 20 nt, Human
uggcagaggagcuauuuggg

SEQ ID NO: 954372 - RNA, 25 nt, Human
uggccaagaacuaggagucaccugg

SEQ ID NO: 954373 - RNA, 21 nt, Human
uggccaagacagacucuggcc

SEQ ID NO: 954374 - RNA, 18 nt, Human
uggcccaggcaccgccag

SEQ ID NO: 954375 - RNA, 23 nt, Human
uggcccaggcaccgccagccgcu

SEQ ID NO: 954376 - RNA, 26 nt, Human
uggcugcagugacaaggaagucagag

SEQ ID NO: 954377 - RNA, 18 nt, Human
ugggaaggagggagggag

SEQ ID NO: 954378 - RNA, 18 nt, Human
ugggacaggagucaguuc

SEQ ID NO: 954379 - RNA, 20 nt, Human
ugggaggcugaggcaggagg

SEQ ID NO: 954380 - RNA, 24 nt, Human
ugggaggcugaggcaggaggacca

SEQ ID NO: 954381 - RNA, 21 nt, Human
uggggaccucaggagggagug

SEQ ID NO: 954382 - RNA, 22 nt, Human
uggggcccucuguuuuccugcu

SEQ ID NO: 954383 - RNA, 21 nt, Human
ugggguagggugggcuuugag

SEQ ID NO: 954384 - RNA, 26 nt, Human
uggugaggaaggggagacauagguua

SEQ ID NO: 954385 - RNA, 18 nt, Human
ugguuagugccagccuug

SEQ ID NO: 954386 - RNA, 20 nt, Human
uguaagaaaugcagaguccu

SEQ ID NO: 954387 - RNA, 23 nt, Human
ugucacaguacaugauguagcag

SEQ ID NO: 954388 - RNA, 19 nt, Human
ugucagcuaguuguggcug

SEQ ID NO: 954389 - RNA, 25 nt, Human
ugugcaccagcaagugcagcaaagc

SEQ ID NO: 954390 - RNA, 18 nt, Human
uguuugggaaauggcaaa

SEQ ID NO: 954391 - RNA, 19 nt, Human
uuaaccaccagcaucagcu

SEQ ID NO: 954392 - RNA, 23 nt, Human
uuaugucacugcccuccagccug

SEQ ID NO: 954393 - RNA, 21 nt, Human
uuccuucauccuccucaagcu

SEQ ID NO: 954394 - RNA, 22 nt, Human
uuccuucauccuccucaagcug

SEQ ID NO: 954395 - RNA, 23 nt, Human
uucuaaccucccgugcccaagcc

SEQ ID NO: 954396 - RNA, 24 nt, Human
uugccucuuuccacagagcugcag

SEQ ID NO: 954397 - RNA, 24 nt, Human
uugcuacccuuaaccaccagcauc

SEQ ID NO: 954398 - RNA, 21 nt, Human
uuuaauguggauuuaauagca

SEQ ID NO: 954399 - RNA, 20 nt, Human
uuuauuggagggugcuuucu

SEQ ID NO: 954400 - RNA, 23 nt, Human
uuucaggacuuugccucuuucca

SEQ ID NO: 954401 - RNA, 18 nt, Human
uuuccacagagcugcagg

SEQ ID NO: 954402 - RNA, 26 nt, Human
uuucuuacccucugaacccaguggag

SEQ ID NO: 954403 - RNA, 21 nt, Human
aagcccggggaagaagacuga

SEQ ID NO: 954404 - RNA, 21 nt, Human
agacagaaaugaaagccuggc

SEQ ID NO: 954405 - RNA, 18 nt, Human
aggagacaggaacaucug

SEQ ID NO: 954406 - RNA, 23 nt, Human
cggggaagaagacugaggaagag

SEQ ID NO: 954407 - RNA, 19 nt, Human
gaagaagacugaggaagag

SEQ ID NO: 954408 - RNA, 23 nt, Human
gacagaaaugaaagccuggcaaa

SEQ ID NO: 954409 - RNA, 23 nt, Human
gcucugagaucucagcagacaga

SEQ ID NO: 954410 - RNA, 21 nt, Human
ggcacuguuccccucucagcu

SEQ ID NO: 954411 - RNA, 20 nt, Human
ggggaugaaugggugcuugg

SEQ ID NO: 954412 - RNA, 25 nt, Human
ggggcagggggaugaaugggugcuu

SEQ ID NO: 954413 - RNA, 18 nt, Human
uccccagagaugcuuuau

SEQ ID NO: 954414 - RNA, 23 nt, Human
uccccagagaugcuuuauuacau

SEQ ID NO: 954415 - RNA, 23 nt, Human
ucucagcagacagaaaugaaagc

SEQ ID NO: 954416 - RNA, 22 nt, Human
ugggcaggcucugagaucucag

SEQ ID NO: 954417 - RNA, 22 nt, Human
ugggggcagggggaugaauggg

SEQ ID NO: 954418 - RNA, 25 nt, Human
ugggggcagggggaugaaugggugc

SEQ ID NO: 954419 - RNA, 21 nt, Human
ugugguacauggcacuguucc

SEQ ID NO: 954420 - RNA, 24 nt, Human
uuuuuuuuuuuuuuuuucgggguu

SEQ ID NO: 954421 - RNA, 29 nt, Human
uuuuuuuuuuuuuuuuuuuuuuuucgggg

SEQ ID NO: 954422 - RNA, 19 nt, Human
aaaggcucuugacuuagaa

SEQ ID NO: 954423 - RNA, 21 nt, Human
aaauaauuccuauacaaaaca

SEQ ID NO: 954424 - RNA, 19 nt, Human
aacaugaaacaagggcuga

SEQ ID NO: 954425 - RNA, 18 nt, Human
aagaaaacaguccacagc

SEQ ID NO: 954426 - RNA, 19 nt, Human
aagguacacccacuucaaa

SEQ ID NO: 954427 - RNA, 18 nt, Human
acaaaacaaauguugcaa

SEQ ID NO: 954428 - RNA, 21 nt, Human
acacaucuauuagguaaagca

SEQ ID NO: 954429 - RNA, 19 nt, Human
accacauccugggcccagc

SEQ ID NO: 954430 - RNA, 21 nt, Human
agcaagaaguuuugaagagaa

SEQ ID NO: 954431 - RNA, 20 nt, Human
aggcaaagaaaacaguccac

SEQ ID NO: 954432 - RNA, 22 nt, Human
agguacacccacuucaaaacac

SEQ ID NO: 954433 - RNA, 19 nt, Human
caaaaccaaagggcugaaa

SEQ ID NO: 954434 - RNA, 19 nt, Human
caaaaccaaagggcugaaa

SEQ ID NO: 954435 - RNA, 22 nt, Human
caaauaauuccuauacaaaaca

SEQ ID NO: 954436 - RNA, 19 nt, Human
caaauguugcaaauauucu

SEQ ID NO: 954437 - RNA, 21 nt, Human
caagguacacccacuucaaaa

SEQ ID NO: 954438 - RNA, 19 nt, Human
cacagccccauugaacaaa

SEQ ID NO: 954439 - RNA, 21 nt, Human
cacuucaaaacacaucuguau

SEQ ID NO: 954440 - RNA, 19 nt, Human
cagcacaccaggccugucc

SEQ ID NO: 954441 - RNA, 19 nt, Human
cagccccauugaacaaaac

SEQ ID NO: 954442 - RNA, 21 nt, Human
caggguggaagagaaguguca

SEQ ID NO: 954443 - RNA, 19 nt, Human
cauccugggcccagccugc

SEQ ID NO: 954444 - RNA, 24 nt, Human
caucugccauuucaucuuuuaaaa

SEQ ID NO: 954445 - RNA, 19 nt, Human
cccucagacccacccccac

SEQ ID NO: 954446 - RNA, 21 nt, Human
cccucagacccacccccacaa

SEQ ID NO: 954447 - RNA, 21 nt, Human
cuagucacuaggcaaagaaaa

SEQ ID NO: 954448 - RNA, 22 nt, Human
cucaauaugagggagcacugaa

SEQ ID NO: 954449 - RNA, 24 nt, Human
cucagacccacccccacaagaggc

SEQ ID NO: 954450 - RNA, 24 nt, Human
cucuugacuuagaaccccuucccc

SEQ ID NO: 954451 - RNA, 21 nt, Human
cugucuaaagccgaggagcca

SEQ ID NO: 954452 - RNA, 21 nt, Human
gaaacaugaaacaagggcuga

SEQ ID NO: 954453 - RNA, 22 nt, Human
gaaaggcucuugacuuagaacc

SEQ ID NO: 954454 - RNA, 25 nt, Human
gaagugucauacaaaaaggggccgg

SEQ ID NO: 954455 - RNA, 21 nt, Human
gacuucccucagacccacccc

SEQ ID NO: 954456 - RNA, 19 nt, Human
gcaaagaaaacaguccaca

SEQ ID NO: 954457 - RNA, 23 nt, Human
gcacagccccauugaacaaaacu

SEQ ID NO: 954458 - RNA, 22 nt, Human
ggacaccacauccugggcccag

SEQ ID NO: 954459 - RNA, 20 nt, Human
gggccggagcuggccagaaa

SEQ ID NO: 954460 - RNA, 23 nt, Human
ggguggugggagguccgccgggc

SEQ ID NO: 954461 - RNA, 24 nt, Human
ggguggugggagguccgccgggcc

SEQ ID NO: 954462 - RNA, 23 nt, Human
gguggugggagguccgccgggcc

SEQ ID NO: 954463 - RNA, 18 nt, Human
guaaagcaagguacaccc

SEQ ID NO: 954464 - RNA, 19 nt, Human
gucaguuuaauaaagcuaa

SEQ ID NO: 954465 - RNA, 18 nt, Human
uagaaccccuuccccuuu

SEQ ID NO: 954466 - RNA, 20 nt, Human
uaugugaaugcacaucugag

SEQ ID NO: 954467 - RNA, 21 nt, Human
ucaaaacacaucuguauguga

SEQ ID NO: 954468 - RNA, 19 nt, Human
uccugggcccagccugcag

SEQ ID NO: 954469 - RNA, 22 nt, Human
ucugugguugcgagcacgcagc

SEQ ID NO: 954470 - RNA, 22 nt, Human
ugaacaaaacuccagcaaaugu

SEQ ID NO: 954471 - RNA, 21 nt, Human
ugaaguaaggcauuuccuguc

SEQ ID NO: 954472 - RNA, 19 nt, Human
ugaaugcacaucugaguac

SEQ ID NO: 954473 - RNA, 20 nt, Human
ugacuuagaaccccuucccc

SEQ ID NO: 954474 - RNA, 19 nt, Human
ugacuucccucagacccac

SEQ ID NO: 954475 - RNA, 23 nt, Human
ugacuucccucagacccaccccc

SEQ ID NO: 954476 - RNA, 23 nt, Human
ugaguaccauucagcaagaaguu

SEQ ID NO: 954477 - RNA, 25 nt, Human
ugaguaccauucagcaagaaguuuu

SEQ ID NO: 954478 - RNA, 28 nt, Human
uggccagaaacauuuggacaacuguguc

SEQ ID NO: 954479 - RNA, 24 nt, Human
uggguggugggagguccgccgggc

SEQ ID NO: 954480 - RNA, 19 nt, Human
uuagaaccccuuccccuuu

SEQ ID NO: 954481 - RNA, 20 nt, Human
uuccccuuucugucuaaagc

SEQ ID NO: 954482 - RNA, 21 nt, Human
uuuucugccacugcccucaau

SEQ ID NO: 954483 - RNA, 25 nt, Human
aaacagcagcgcgcuccccuaccac

SEQ ID NO: 954484 - RNA, 19 nt, Human
aaagaugcauucucuuuau

SEQ ID NO: 954485 - RNA, 20 nt, Human
aauauuggaaaacuucaaca

SEQ ID NO: 954486 - RNA, 22 nt, Human
acucguggcucuaaacagcagc

SEQ ID NO: 954487 - RNA, 20 nt, Human
acuucaacagaauauuggaa

SEQ ID NO: 954488 - RNA, 23 nt, Human
cagaauauuggaaaacuucaaca

SEQ ID NO: 954489 - RNA, 18 nt, Human
cccagacaaauuuccuug

SEQ ID NO: 954490 - RNA, 20 nt, Human
cggccaccacugacuucggc

SEQ ID NO: 954491 - RNA, 20 nt, Human
cugccaaaaaccuuaugcuu

SEQ ID NO: 954492 - RNA, 26 nt, Human
ggaaaacuucaacagaauauuggaaa

SEQ ID NO: 954493 - RNA, 19 nt, Human
ggacaagaauuuuuaaaau

SEQ ID NO: 954494 - RNA, 19 nt, Human
uaacacuccacaaugaacu

SEQ ID NO: 954495 - RNA, 20 nt, Human
uauugcucccauaguucuua

SEQ ID NO: 954496 - RNA, 20 nt, Human
ucaaagaugcauucucuuua

SEQ ID NO: 954497 - RNA, 24 nt, Human
uccuuguggacaagaauuuuuaaa

SEQ ID NO: 954498 - RNA, 21 nt, Human
ucggcuacuggaauuuccucu

SEQ ID NO: 954499 - RNA, 19 nt, Human
ugaacugugaaauuucccu

SEQ ID NO: 954500 - RNA, 23 nt, Human
ugaucggcuacuggaauuuccuc

SEQ ID NO: 954501 - RNA, 20 nt, Human
uugauccaaaacugccaaaa

SEQ ID NO: 954502 - RNA, 19 nt, Human
uuuaacacuccacaaugaa

SEQ ID NO: 954503 - RNA, 21 nt, Human
uuugcagacuccugaucggcu

SEQ ID NO: 954504 - RNA, 22 nt, Human
uuugcagacuccugaucggcua

SEQ ID NO: 954505 - RNA, 18 nt, Human
uuuuacagcgacuccgga

SEQ ID NO: 954506 - RNA, 25 nt, Human
aaaggagcagaacaugccgaccaca

SEQ ID NO: 954507 - RNA, 18 nt, Human
aaggggucacgggugagg

SEQ ID NO: 954508 - RNA, 23 nt, Human
agagagagucagacaugacccgg

SEQ ID NO: 954509 - RNA, 26 nt, Human
agcacgccaucggccagaggcagaac

SEQ ID NO: 954510 - RNA, 26 nt, Human
agccagaugaagggagcgaggccaga

SEQ ID NO: 954511 - RNA, 19 nt, Human
agcgugggugaagugcugg

SEQ ID NO: 954512 - RNA, 19 nt, Human
agcgugggugaagugcugg

SEQ ID NO: 954513 - RNA, 21 nt, Human
agcuggugaaggcgcuccugg

SEQ ID NO: 954514 - RNA, 23 nt, Human
aggaggagggggagcgcccgggg

SEQ ID NO: 954515 - RNA, 22 nt, Human
aggagggggagcgcccggggcu

SEQ ID NO: 954516 - RNA, 21 nt, Human
aguaacgaaggccaccuccaa

SEQ ID NO: 954517 - RNA, 19 nt, Human
auaauaagcaacuucuuca

SEQ ID NO: 954518 - RNA, 21 nt, Human
cacgcagcacggacgcacuuu

SEQ ID NO: 954519 - RNA, 19 nt, Human
cagaacaugccgaccacaa

SEQ ID NO: 954520 - RNA, 19 nt, Human
cagagcguucauaggcguc

SEQ ID NO: 954521 - RNA, 20 nt, Human
cagcagccucgcagggcgug

SEQ ID NO: 954522 - RNA, 19 nt, Human
cagcagcggcggaggcggc

SEQ ID NO: 954523 - RNA, 18 nt, Human
caggaggacgagacggug

SEQ ID NO: 954524 - RNA, 23 nt, Human
caugaccaugcagagguggcgcc

SEQ ID NO: 954525 - RNA, 22 nt, Human
caugacccggcggcggcgacau

SEQ ID NO: 954526 - RNA, 21 nt, Human
ccauagccagaugaagggagc

SEQ ID NO: 954527 - RNA, 18 nt, Human
ccgccggggaaggagggc

SEQ ID NO: 954528 - RNA, 18 nt, Human
ccuucggccgccuccagc

SEQ ID NO: 954529 - RNA, 19 nt, Human
cgcuccacaaaggccugcu

SEQ ID NO: 954530 - RNA, 25 nt, Human
cggcggcggcggcggcgcggggagg

SEQ ID NO: 954531 - RNA, 21 nt, Human
cggggcugaggcuccgugagc

SEQ ID NO: 954532 - RNA, 20 nt, Human
cguaggaggagggggagcgc

SEQ ID NO: 954533 - RNA, 21 nt, Human
cucaaaggagcagaacaugcc

SEQ ID NO: 954534 - RNA, 21 nt, Human
cuccucgggguugaauuccag

SEQ ID NO: 954535 - RNA, 19 nt, Human
cugcugccuaggugaccug

SEQ ID NO: 954536 - RNA, 27 nt, Human
cuguccuguuccuccagaugcaccaca

SEQ ID NO: 954537 - RNA, 21 nt, Human
cuugcugcugcggcccucaga

SEQ ID NO: 954538 - RNA, 20 nt, Human
gaccguggugaugaggccgu

SEQ ID NO: 954539 - RNA, 21 nt, Human
gagaagugggcggggguguug

SEQ ID NO: 954540 - RNA, 21 nt, Human
gagcaggaggacgagacggug

SEQ ID NO: 954541 - RNA, 20 nt, Human
gagcgaggccagagaccacc

SEQ ID NO: 954542 - RNA, 18 nt, Human
gcaccgucucagcaaagu

SEQ ID NO: 954543 - RNA, 25 nt, Human
gcacgccaucggccagaggcagaac

SEQ ID NO: 954544 - RNA, 20 nt, Human
gccaucggccagaggcagaa

SEQ ID NO: 954545 - RNA, 25 nt, Human
gccgaccacaaacggguucucggcg

SEQ ID NO: 954546 - RNA, 20 nt, Human
gcggaacauacugccgccgg

SEQ ID NO: 954547 - RNA, 23 nt, Human
gcggaggcggcggcggcggcggc

SEQ ID NO: 954548 - RNA, 21 nt, Human
gcuccaauauucuucagcagg

SEQ ID NO: 954549 - RNA, 23 nt, Human
ggaggacgagacgguggaacugg

SEQ ID NO: 954550 - RNA, 21 nt, Human
ggaggcuguaggcuugagguc

SEQ ID NO: 954551 - RNA, 22 nt, Human
ggaggcuguaggcuugaggucg

SEQ ID NO: 954552 - RNA, 20 nt, Human
ggccagcucgaugaucuggu

SEQ ID NO: 954553 - RNA, 23 nt, Human
ggcggaggcggcggcggcggcgg

SEQ ID NO: 954554 - RNA, 22 nt, Human
gggaggaggcaaacgagaagug

SEQ ID NO: 954555 - RNA, 21 nt, Human
ggggagaaguuucgggggcug

SEQ ID NO: 954556 - RNA, 28 nt, Human
gggggcuguccaggggacugcugccuag

SEQ ID NO: 954557 - RNA, 21 nt, Human
uaacgaaggccaccuccaagc

SEQ ID NO: 954558 - RNA, 18 nt, Human
uaagcaacuucuucacca

SEQ ID NO: 954559 - RNA, 22 nt, Human
uacggaggcuguacagcgcggg

SEQ ID NO: 954560 - RNA, 21 nt, Human
uagaaagcgcgguccagagag

SEQ ID NO: 954561 - RNA, 22 nt, Human
ucccccggcgguuucuuggccu

SEQ ID NO: 954562 - RNA, 21 nt, Human
ucgcgcagcuucuccuccauc

SEQ ID NO: 954563 - RNA, 21 nt, Human
ucuccugcaauucauagaagu

SEQ ID NO: 954564 - RNA, 18 nt, Human
ucucggcgaaggugagga

SEQ ID NO: 954565 - RNA, 22 nt, Human
ucucguugucguaggaggaggg

SEQ ID NO: 954566 - RNA, 25 nt, Human
ucucuacgggcagcgcuccaauauu

SEQ ID NO: 954567 - RNA, 25 nt, Human
ugaauuccaggcacuccagcagccu

SEQ ID NO: 954568 - RNA, 20 nt, Human
ugacccggcggcggcgacau

SEQ ID NO: 954569 - RNA, 23 nt, Human
ugccauagccagaugaagggagc

SEQ ID NO: 954570 - RNA, 21 nt, Human
ugccauaguugugcaaauacu

SEQ ID NO: 954571 - RNA, 23 nt, Human
ugccauaguugugcaaauacucc

SEQ ID NO: 954572 - RNA, 19 nt, Human
ugcggaggaucaaguucug

SEQ ID NO: 954573 - RNA, 19 nt, Human
uggaaaggggucacgggug

SEQ ID NO: 954574 - RNA, 21 nt, Human
uggaaaggggucacgggugag

SEQ ID NO: 954575 - RNA, 23 nt, Human
uggaacugggcguguuggugcca

SEQ ID NO: 954576 - RNA, 23 nt, Human
ugggaggagcaggaggacgagac

SEQ ID NO: 954577 - RNA, 27 nt, Human
ugggggagaaguuucgggggcugguca

SEQ ID NO: 954578 - RNA, 22 nt, Human
uggugaaggcgcuccugggagg

SEQ ID NO: 954579 - RNA, 18 nt, Human
uggugcggcagcucuugg

SEQ ID NO: 954580 - RNA, 24 nt, Human
uguccuguuccuccagaugcacca

SEQ ID NO: 954581 - RNA, 18 nt, Human
uguguacauauguauacg

SEQ ID NO: 954582 - RNA, 18 nt, Human
uucaccagcugaguaacg

SEQ ID NO: 954583 - RNA, 26 nt, Human
uuccaugaccaugcagagguggcgcc

SEQ ID NO: 954584 - RNA, 19 nt, Human
uuucauggcaaagcgcugc

SEQ ID NO: 954585 - RNA, 24 nt, Human
aaauagccagucaaucuugagagc

SEQ ID NO: 954586 - RNA, 20 nt, Human
aaauauaaagauugcauucc

SEQ ID NO: 954587 - RNA, 21 nt, Human
aacaagcaacacccaaccacc

SEQ ID NO: 954588 - RNA, 24 nt, Human
aacacccaaccacccgagagcgac

SEQ ID NO: 954589 - RNA, 27 nt, Human
acaagcaacacccaaccacccgagagc

SEQ ID NO: 954590 - RNA, 23 nt, Human
acaauaaucagaaaauauucucc

SEQ ID NO: 954591 - RNA, 20 nt, Human
accacccgagagcgacccca

SEQ ID NO: 954592 - RNA, 19 nt, Human
acuucaguacuuuauaaua

SEQ ID NO: 954593 - RNA, 19 nt, Human
agaaaauauucuccaaaag

SEQ ID NO: 954594 - RNA, 21 nt, Human
agcaugugugugaugcacaga

SEQ ID NO: 954595 - RNA, 20 nt, Human
auguaguuuacaguaauucc

SEQ ID NO: 954596 - RNA, 21 nt, Human
caagcaacacccaaccacccg

SEQ ID NO: 954597 - RNA, 22 nt, Human
cacgcuuuauuugaguuaaaga

SEQ ID NO: 954598 - RNA, 21 nt, Human
cagaaaagcaugugugugaug

SEQ ID NO: 954599 - RNA, 20 nt, Human
cagaaaauauaaagauugca

SEQ ID NO: 954600 - RNA, 19 nt, Human
caugugugugaugcacaga

SEQ ID NO: 954601 - RNA, 20 nt, Human
caugugugugaugcacagaa

SEQ ID NO: 954602 - RNA, 24 nt, Human
ccaaccacccgagagcgaccccag

SEQ ID NO: 954603 - RNA, 18 nt, Human
ccaaugauauauagcaca

SEQ ID NO: 954604 - RNA, 18 nt, Human
cccgagagcgaccccagc

SEQ ID NO: 954605 - RNA, 22 nt, Human
cgcgaaucccacggacccggau

SEQ ID NO: 954606 - RNA, 24 nt, Human
cguauuauucuuuuagacauuuua

SEQ ID NO: 954607 - RNA, 22 nt, Human
cgugcagaaaagcaugugugug

SEQ ID NO: 954608 - RNA, 27 nt, Human
gaugacuaaggcaaccacgugcagaaa

SEQ ID NO: 954609 - RNA, 23 nt, Human
gcaaugauaguuuguuaucugaa

SEQ ID NO: 954610 - RNA, 23 nt, Human
uaaacuguacuuuuaggcacugu

SEQ ID NO: 954611 - RNA, 24 nt, Human
uaaggcaaccacgugcagaaaagc

SEQ ID NO: 954612 - RNA, 21 nt, Human
uagccagucaaucuugagagc

SEQ ID NO: 954613 - RNA, 19 nt, Human
uaucacaaauggugccuga

SEQ ID NO: 954614 - RNA, 24 nt, Human
uauucaaaauauggaauguuuaac

SEQ ID NO: 954615 - RNA, 20 nt, Human
ucguauuauucuuuuagaca

SEQ ID NO: 954616 - RNA, 22 nt, Human
ugacuaaggcaaccacgugcag

SEQ ID NO: 954617 - RNA, 21 nt, Human
ugcacagaaaauauaaagauu

SEQ ID NO: 954618 - RNA, 22 nt, Human
ugcacagaaaauauaaagauug

SEQ ID NO: 954619 - RNA, 24 nt, Human
ugcacagaaaauauaaagauugca

SEQ ID NO: 954620 - RNA, 18 nt, Human
ugccugauguggacacuc

SEQ ID NO: 954621 - RNA, 22 nt, Human
uggaacagcgggaacaagcaac

SEQ ID NO: 954622 - RNA, 19 nt, Human
uggaauguuuaacauagag

SEQ ID NO: 954623 - RNA, 21 nt, Human
uggagugucuugucauuaaaa

SEQ ID NO: 954624 - RNA, 21 nt, Human
ugucuagauggugcuguagga

SEQ ID NO: 954625 - RNA, 19 nt, Human
uguggacacucuaccuuua

SEQ ID NO: 954626 - RNA, 22 nt, Human
ugugugaugcacagaaaauaua

SEQ ID NO: 954627 - RNA, 20 nt, Human
uguuuugucauauugcauag

SEQ ID NO: 954628 - RNA, 19 nt, Human
uuccugaaguggcuugcua

SEQ ID NO: 954629 - RNA, 18 nt, Human
caggggaugaaugugaug

SEQ ID NO: 954630 - RNA, 21 nt, Human
cgacugaguauuccuucccag

SEQ ID NO: 954631 - RNA, 18 nt, Human
cugaagagauucucccag

SEQ ID NO: 954632 - RNA, 24 nt, Human
ucccagugacaagcuccaucgccc

SEQ ID NO: 954633 - RNA, 26 nt, Human
ucccagugacaagcuccaucgcccag

SEQ ID NO: 954634 - RNA, 18 nt, Human
ucucaucacugaaaccca

SEQ ID NO: 954635 - RNA, 21 nt, Human
ugaaacccagguccuuccaag

SEQ ID NO: 954636 - RNA, 23 nt, Human
ugaagagauucucccaguaaccc

SEQ ID NO: 954637 - RNA, 19 nt, Human
uucccagugacaagcucca

SEQ ID NO: 954638 - RNA, 18 nt, Human
aaaacaccaaaccaaaac

SEQ ID NO: 954639 - RNA, 19 nt, Human
aaacagagacauaaauuaa

SEQ ID NO: 954640 - RNA, 18 nt, Human
aaauccauauaaaagaaa

SEQ ID NO: 954641 - RNA, 22 nt, Human
aaccacuggauaaaacagagac

SEQ ID NO: 954642 - RNA, 27 nt, Human
aagacaaggccgggcggcccccuuaga

SEQ ID NO: 954643 - RNA, 22 nt, Human
aagcacugguggcuauauuuua

SEQ ID NO: 954644 - RNA, 19 nt, Human
acagaccuaaccguauagc

SEQ ID NO: 954645 - RNA, 22 nt, Human
acauuuggcacuaaauaaaaua

SEQ ID NO: 954646 - RNA, 22 nt, Human
acgcccaugaaacccgccaaca

SEQ ID NO: 954647 - RNA, 20 nt, Human
agcuucuucccgagcagcaa

SEQ ID NO: 954648 - RNA, 18 nt, Human
aggcggcgguggcucggc

SEQ ID NO: 954649 - RNA, 21 nt, Human
augacgcccaugaaacccgcc

SEQ ID NO: 954650 - RNA, 21 nt, Human
augccuugacucacucuggcu

SEQ ID NO: 954651 - RNA, 19 nt, Human
cacugccgaaagacaaggc

SEQ ID NO: 954652 - RNA, 22 nt, Human
ccaaacuccuggaacaaagcac

SEQ ID NO: 954653 - RNA, 20 nt, Human
cccaugaaacccgccaacaa

SEQ ID NO: 954654 - RNA, 22 nt, Human
cccaugaaacccgccaacaauu

SEQ ID NO: 954655 - RNA, 23 nt, Human
ccccagaggcugccauccucccu

SEQ ID NO: 954656 - RNA, 20 nt, Human
cccccuuagaaacgcucagg

SEQ ID NO: 954657 - RNA, 23 nt, Human
cgaaagacaaggccgggcggccc

SEQ ID NO: 954658 - RNA, 21 nt, Human
cgcccaugaaacccgccaaca

SEQ ID NO: 954659 - RNA, 19 nt, Human
cuagagcuaagauacugcg

SEQ ID NO: 954660 - RNA, 23 nt, Human
cucaugauuacaaaacuuuuaga

SEQ ID NO: 954661 - RNA, 23 nt, Human
cucucugggcacacuggggauuc

SEQ ID NO: 954662 - RNA, 22 nt, Human
gaaaguguguauaugccuugac

SEQ ID NO: 954663 - RNA, 19 nt, Human
gcaggcggcgguggcucgg

SEQ ID NO: 954664 - RNA, 21 nt, Human
gcggcaggcggcgguggcucg

SEQ ID NO: 954665 - RNA, 18 nt, Human
gggccgggcgaggggucg

SEQ ID NO: 954666 - RNA, 22 nt, Human
ggggcucgccgggccgggcgag

SEQ ID NO: 954667 - RNA, 21 nt, Human
guuaaagaaguucaaagucaa

SEQ ID NO: 954668 - RNA, 19 nt, Human
uaaaacagagacauaaauu

SEQ ID NO: 954669 - RNA, 26 nt, Human
uaaaauaaauagacaagcaaacugug

SEQ ID NO: 954670 - RNA, 23 nt, Human
uaaggaaauccauauaaaagaaa

SEQ ID NO: 954671 - RNA, 19 nt, Human
uauagcacuucugugaugc

SEQ ID NO: 954672 - RNA, 24 nt, Human
uaucuaacucaugauuacaaaacu

SEQ ID NO: 954673 - RNA, 19 nt, Human
ucaccaaacuccuggaaca

SEQ ID NO: 954674 - RNA, 22 nt, Human
ucacucuggcuuacuuuuaaaa

SEQ ID NO: 954675 - RNA, 21 nt, Human
ucccgagcagcaaguuucuuc

SEQ ID NO: 954676 - RNA, 20 nt, Human
ucgaccaaacacggcgaucg

SEQ ID NO: 954677 - RNA, 19 nt, Human
ucgccgggccgggcgaggg

SEQ ID NO: 954678 - RNA, 21 nt, Human
ucuucucggucuucuucuugc

SEQ ID NO: 954679 - RNA, 24 nt, Human
ugaaaauagaaucuagagcuaaga

SEQ ID NO: 954680 - RNA, 21 nt, Human
ugaaacccgccaacaauuuag

SEQ ID NO: 954681 - RNA, 21 nt, Human
ugagcacaaacagaccuaacc

SEQ ID NO: 954682 - RNA, 18 nt, Human
ugccgaaagacaaggccg

SEQ ID NO: 954683 - RNA, 21 nt, Human
ugccuugacucacucuggcuu

SEQ ID NO: 954684 - RNA, 24 nt, Human
uucuucucggucuucuucuugcug

SEQ ID NO: 954685 - RNA, 21 nt, Human
uucuugguuuuguggccagcu

SEQ ID NO: 954686 - RNA, 23 nt, Human
uuuaggaaguuuugugagaaagu

SEQ ID NO: 954687 - RNA, 23 nt, Human
aaaaguuugcagcaggcuuaaaa

SEQ ID NO: 954688 - RNA, 21 nt, Human
aaacaaacaccaacaacuuca

SEQ ID NO: 954689 - RNA, 22 nt, Human
aaaguuugcagcaggcuuaaaa

SEQ ID NO: 954690 - RNA, 19 nt, Human
aacaaaauggccccuaaac

SEQ ID NO: 954691 - RNA, 18 nt, Human
aaggaugauguacagugg

SEQ ID NO: 954692 - RNA, 21 nt, Human
acaaacaccaacaacuucacu

SEQ ID NO: 954693 - RNA, 24 nt, Human
acaaacaccaacaacuucacuugg

SEQ ID NO: 954694 - RNA, 22 nt, Human
acaaagaaacagucuuuuuuuc

SEQ ID NO: 954695 - RNA, 20 nt, Human
acagaacuuacuaaaacgaa

SEQ ID NO: 954696 - RNA, 23 nt, Human
acauggcacccuucuaaagggcu

SEQ ID NO: 954697 - RNA, 20 nt, Human
acuugcuucugcuucuuuuc

SEQ ID NO: 954698 - RNA, 20 nt, Human
aguguuaaaaguuaugugcu

SEQ ID NO: 954699 - RNA, 25 nt, Human
caaaauggccccuaaacaaacacca

SEQ ID NO: 954700 - RNA, 22 nt, Human
caaggaucauccuaauagccca

SEQ ID NO: 954701 - RNA, 19 nt, Human
cacacccuugaguaaaccc

SEQ ID NO: 954702 - RNA, 28 nt, Human
cacauacagcacauacauauagguagua

SEQ ID NO: 954703 - RNA, 26 nt, Human
cacucuacuucuuaaacacuuggccu

SEQ ID NO: 954704 - RNA, 21 nt, Human
cauaaauaggcuagcuauuaa

SEQ ID NO: 954705 - RNA, 18 nt, Human
cccacauacagcacauac

SEQ ID NO: 954706 - RNA, 19 nt, Human
cccacauguaguacagaau

SEQ ID NO: 954707 - RNA, 21 nt, Human
ccccuaaacaaacaccaacaa

SEQ ID NO: 954708 - RNA, 24 nt, Human
ccuaaaaugaaugcacacccuuga

SEQ ID NO: 954709 - RNA, 21 nt, Human
ccuccuuuucauggguuucua

SEQ ID NO: 954710 - RNA, 22 nt, Human
cgcuucacuccuugucaguuca

SEQ ID NO: 954711 - RNA, 23 nt, Human
cugaguaugaugcaacuccacuc

SEQ ID NO: 954712 - RNA, 21 nt, Human
cuuaaacacuuggccuuagcc

SEQ ID NO: 954713 - RNA, 20 nt, Human
cuucaaacaaagaaacaguu

SEQ ID NO: 954714 - RNA, 20 nt, Human
cuuggccuuagccugaccac

SEQ ID NO: 954715 - RNA, 22 nt, Human
gaaaugcccacauacagcacag

SEQ ID NO: 954716 - RNA, 24 nt, Human
gaggaaaagcuacuuguugugaug

SEQ ID NO: 954717 - RNA, 19 nt, Human
gcagugugugucuguggcc

SEQ ID NO: 954718 - RNA, 25 nt, Human
gccagccggcugagggcgaguuggg

SEQ ID NO: 954719 - RNA, 18 nt, Human
gcuguccauccgcugggu

SEQ ID NO: 954720 - RNA, 23 nt, Human
gggcuuucaaggaucauccuaau

SEQ ID NO: 954721 - RNA, 18 nt, Human
gggugggcgcuucacucc

SEQ ID NO: 954722 - RNA, 19 nt, Human
guauauaugcuuuuauccu

SEQ ID NO: 954723 - RNA, 21 nt, Human
gucuuuuuuuccaacauagga

SEQ ID NO: 954724 - RNA, 24 nt, Human
guuaaauugguagguauugauuuc

SEQ ID NO: 954725 - RNA, 24 nt, Human
uaaaaacauuuuaaaaaaaucucc

SEQ ID NO: 954726 - RNA, 21 nt, Human
uaaaaugaaugcacacccuug

SEQ ID NO: 954727 - RNA, 25 nt, Human
uaaaaugaaugcacacccuugagua

SEQ ID NO: 954728 - RNA, 21 nt, Human
uaaaaugccaugaucuuaaaa

SEQ ID NO: 954729 - RNA, 29 nt, Human
uaaacaaacaccaacaacuucacuugguc

SEQ ID NO: 954730 - RNA, 23 nt, Human
uaaauaccuugcucccacagaac

SEQ ID NO: 954731 - RNA, 29 nt, Human
uaaccccugaguaugaugcaacuccuuuu

SEQ ID NO: 954732 - RNA, 31 nt, Human
uacagcacauacauauagguaguauauaugg

SEQ ID NO: 954733 - RNA, 22 nt, Human
uagauccuaaucaaaaaccaug

SEQ ID NO: 954734 - RNA, 21 nt, Human
uaucacuggcugagaaaaucu

SEQ ID NO: 954735 - RNA, 18 nt, Human
uaugauucaggauaugau

SEQ ID NO: 954736 - RNA, 20 nt, Human
uccaauacccaacuauuacu

SEQ ID NO: 954737 - RNA, 20 nt, Human
uccaucuucacauuuagcag

SEQ ID NO: 954738 - RNA, 21 nt, Human
ucuccuggugccagcauuuca

SEQ ID NO: 954739 - RNA, 24 nt, Human
ucuccuggugccagcauuucagaa

SEQ ID NO: 954740 - RNA, 23 nt, Human
ucuccuguggccuccuuuucaug

SEQ ID NO: 954741 - RNA, 23 nt, Human
ugaaauccuguggcgaucccacc

SEQ ID NO: 954742 - RNA, 23 nt, Human
ugaaaugcccacauacagcacau

SEQ ID NO: 954743 - RNA, 18 nt, Human
ugaagcagagaguggcuu

SEQ ID NO: 954744 - RNA, 22 nt, Human
ugaguaaacccaggugggugcu

SEQ ID NO: 954745 - RNA, 21 nt, Human
ugaguaugaugcaacuccacu

SEQ ID NO: 954746 - RNA, 18 nt, Human
ugcaacuccacucuaaug

SEQ ID NO: 954747 - RNA, 18 nt, Human
ugcacuuuaccacuagcu

SEQ ID NO: 954748 - RNA, 25 nt, Human
ugcccacauacagcacauacauaua

SEQ ID NO: 954749 - RNA, 20 nt, Human
ugcucccacagaacuuacua

SEQ ID NO: 954750 - RNA, 26 nt, Human
uggccccuaaacaaacaccaacaacu

SEQ ID NO: 954751 - RNA, 22 nt, Human
uggccuccuuuucauggguuuc

SEQ ID NO: 954752 - RNA, 19 nt, Human
uggcugagaaaaucucacg

SEQ ID NO: 954753 - RNA, 18 nt, Human
uggugcgacugaagcaga

SEQ ID NO: 954754 - RNA, 25 nt, Human
uguuuugcuacacccagugcuccca

SEQ ID NO: 954755 - RNA, 23 nt, Human
uuaaaaaaaucuccaauacccaa

SEQ ID NO: 954756 - RNA, 18 nt, Human
uuaaaaaugccauaauau

SEQ ID NO: 954757 - RNA, 19 nt, Human
uucacuccuugucaguuca

SEQ ID NO: 954758 - RNA, 18 nt, Human
uuuuuuuuuuuuuccuug

SEQ ID NO: 954759 - RNA, 21 nt, Human
agcagcggcaguggggagcag

SEQ ID NO: 954760 - RNA, 22 nt, Human
aggcagcagcggcaguggggag

SEQ ID NO: 954761 - RNA, 18 nt, Human
augcagugugcgcagccg

SEQ ID NO: 954762 - RNA, 22 nt, Human
cagcagauuuauugaggcagca

SEQ ID NO: 954763 - RNA, 19 nt, Human
cagcagcggcaguggggag

SEQ ID NO: 954764 - RNA, 19 nt, Human
cagcggcaguggggagcag

SEQ ID NO: 954765 - RNA, 20 nt, Human
cagcggcaguggggagcagg

SEQ ID NO: 954766 - RNA, 21 nt, Human
cagcggcaguggggagcaggg

SEQ ID NO: 954767 - RNA, 22 nt, Human
cgcaaaucagcagauuuauuga

SEQ ID NO: 954768 - RNA, 23 nt, Human
cggcuccugcccagccacggcgc

SEQ ID NO: 954769 - RNA, 20 nt, Human
gcagauuuauugaggcagca

SEQ ID NO: 954770 - RNA, 23 nt, Human
gcagcagcggcaguggggagcag

SEQ ID NO: 954771 - RNA, 19 nt, Human
gcggcaguggggagcaggg

SEQ ID NO: 954772 - RNA, 21 nt, Human
ggagcagggguguggggaggg

SEQ ID NO: 954773 - RNA, 20 nt, Human
ggggagcaggggugugggga

SEQ ID NO: 954774 - RNA, 23 nt, Human
gggguguggggagggggcggggc

SEQ ID NO: 954775 - RNA, 19 nt, Human
ggguguggggagggggcgg

SEQ ID NO: 954776 - RNA, 19 nt, Human
gugcuggccuuucccaggc

SEQ ID NO: 954777 - RNA, 21 nt, Human
gugggcgccgauggucagcca

SEQ ID NO: 954778 - RNA, 20 nt, Human
guggggagggggcggggccu

SEQ ID NO: 954779 - RNA, 20 nt, Human
guguggggagggggcggggc

SEQ ID NO: 954780 - RNA, 21 nt, Human
ugaggcagcagcggcaguggg

SEQ ID NO: 954781 - RNA, 22 nt, Human
uggggagggggcggggccuccc

SEQ ID NO: 954782 - RNA, 20 nt, Human
uguggggagggggcggggcc

SEQ ID NO: 954783 - RNA, 18 nt, Human
uuuuuuuuuuuuuuuucg

SEQ ID NO: 954784 - RNA, 22 nt, Human
uuuuuuuuuuuuuuuuucgcaa

SEQ ID NO: 954785 - RNA, 18 nt, Human
aaaauuagcugggcgugg

SEQ ID NO: 954786 - RNA, 19 nt, Human
aacaucgagaaaccccauc

SEQ ID NO: 954787 - RNA, 20 nt, Human
aacaucgagaaaccccaucu

SEQ ID NO: 954788 - RNA, 21 nt, Human
aacaucgagaaaccccaucuc

SEQ ID NO: 954789 - RNA, 22 nt, Human
aagaauugcuugaacugggagg

SEQ ID NO: 954790 - RNA, 25 nt, Human
aaggagacagaguguggcuuugucu

SEQ ID NO: 954791 - RNA, 23 nt, Human
aauugcuugaacugggaggcaga

SEQ ID NO: 954792 - RNA, 21 nt, Human
acaccuguaaucccagcacuu

SEQ ID NO: 954793 - RNA, 24 nt, Human
acagaguguggcuuugucucaaaa

SEQ ID NO: 954794 - RNA, 19 nt, Human
acagccuuauaauucugaa

SEQ ID NO: 954795 - RNA, 24 nt, Human
accacacuccagacaaggagacag

SEQ ID NO: 954796 - RNA, 25 nt, Human
acuaugaagaauuuucugaaaugac

SEQ ID NO: 954797 - RNA, 18 nt, Human
agagguugcagugagcug

SEQ ID NO: 954798 - RNA, 22 nt, Human
agagguugcagugagcugagac

SEQ ID NO: 954799 - RNA, 24 nt, Human
agagguugcagugagcugagacug

SEQ ID NO: 954800 - RNA, 20 nt, Human
agagguugcagugagcuggc

SEQ ID NO: 954801 - RNA, 24 nt, Human
agcacuuugggaggccaagguggg

SEQ ID NO: 954802 - RNA, 24 nt, Human
agccuggccaacaucgagaaaccc

SEQ ID NO: 954803 - RNA, 21 nt, Human
agcugagacugugccaccaca

SEQ ID NO: 954804 - RNA, 23 nt, Human
agcugggcgugguggcgggugcc

SEQ ID NO: 954805 - RNA, 21 nt, Human
aggcagaagaauugcuugaac

SEQ ID NO: 954806 - RNA, 23 nt, Human
aggcagaagaauugcuugaacug

SEQ ID NO: 954807 - RNA, 20 nt, Human
aggcagagguugcagugagc

SEQ ID NO: 954808 - RNA, 24 nt, Human
aggcagagguugcagugagcugag

SEQ ID NO: 954809 - RNA, 21 nt, Human
aggccaaggugggcagaucac

SEQ ID NO: 954810 - RNA, 22 nt, Human
aggccaauaccacuaugaagaa

SEQ ID NO: 954811 - RNA, 24 nt, Human
aggcugaggcagaagaauugcuug

SEQ ID NO: 954812 - RNA, 23 nt, Human
aggugggcagaucacuugagguc

SEQ ID NO: 954813 - RNA, 24 nt, Human
aguggcuuacaccuguaaucccag

SEQ ID NO: 954814 - RNA, 24 nt, Human
caaggugggcagaucacuugaggu

SEQ ID NO: 954815 - RNA, 26 nt, Human
caaggugggcagaucacuugagguca

SEQ ID NO: 954816 - RNA, 21 nt, Human
caccgacaccgaggacucgcc

SEQ ID NO: 954817 - RNA, 19 nt, Human
caccuguaaucccagcacu

SEQ ID NO: 954818 - RNA, 24 nt, Human
caccuguaaucccagcacuuuggg

SEQ ID NO: 954819 - RNA, 21 nt, Human
cacuugaggucagaaguuuga

SEQ ID NO: 954820 - RNA, 27 nt, Human
cagaucacuugaggucagaaguuugag

SEQ ID NO: 954821 - RNA, 24 nt, Human
cagcacuuugggaggccaaggugg

SEQ ID NO: 954822 - RNA, 24 nt, Human
cagcuacuugggaggcugaggcag

SEQ ID NO: 954823 - RNA, 19 nt, Human
ccacacuccagacaaggag

SEQ ID NO: 954824 - RNA, 22 nt, Human
ccagaagacaugcuuauuucug

SEQ ID NO: 954825 - RNA, 24 nt, Human
ccuggccaacaucgagaaacccca

SEQ ID NO: 954826 - RNA, 18 nt, Human
ccuguaaucccagcuacu

SEQ ID NO: 954827 - RNA, 21 nt, Human
ccuguaaucccagcuacuugg

SEQ ID NO: 954828 - RNA, 22 nt, Human
ccuguaaucccagcuacuuggg

SEQ ID NO: 954829 - RNA, 18 nt, Human
cugugccaccacacucca

SEQ ID NO: 954830 - RNA, 22 nt, Human
cuuacaccuguaaucccagcac

SEQ ID NO: 954831 - RNA, 24 nt, Human
gacagaguguggcuuugucucaaa

SEQ ID NO: 954832 - RNA, 20 nt, Human
gagaccagccuggccaacau

SEQ ID NO: 954833 - RNA, 24 nt, Human
gaucacuugaggucagaaguuuga

SEQ ID NO: 954834 - RNA, 20 nt, Human
gcacuuugggaggccaaggu

SEQ ID NO: 954835 - RNA, 20 nt, Human
gcgggugccuguaaucccag

SEQ ID NO: 954836 - RNA, 22 nt, Human
gcgggugccuguaaucccagcu

SEQ ID NO: 954837 - RNA, 18 nt, Human
ggcgcaguggcuuacacc

SEQ ID NO: 954838 - RNA, 23 nt, Human
ggcgcaguggcuuacaccuguaa

SEQ ID NO: 954839 - RNA, 23 nt, Human
ggcgugguggcgggugccuguaa

SEQ ID NO: 954840 - RNA, 24 nt, Human
ggugccuguaaucccagcuacuug

SEQ ID NO: 954841 - RNA, 24 nt, Human
gguggcgggugccuguaaucccag

SEQ ID NO: 954842 - RNA, 24 nt, Human
guugcagugagcugagacugugcc

SEQ ID NO: 954843 - RNA, 24 nt, Human
uacaccuguaaucccagcacuuug

SEQ ID NO: 954844 - RNA, 22 nt, Human
uauccaaaaccuucuuggaagc

SEQ ID NO: 954845 - RNA, 18 nt, Human
ucgagaaaccccaucucu

SEQ ID NO: 954846 - RNA, 22 nt, Human
ucugcagacagccuuauaauuc

SEQ ID NO: 954847 - RNA, 18 nt, Human
ugagaccagccuggccaa

SEQ ID NO: 954848 - RNA, 19 nt, Human
ugagcugagacugugccac

SEQ ID NO: 954849 - RNA, 23 nt, Human
ugaggcagaagaauugcuugaac

SEQ ID NO: 954850 - RNA, 24 nt, Human
ugccuguaaucccagcuacuuggg

SEQ ID NO: 954851 - RNA, 22 nt, Human
uggcgggugccuguaaucccag

SEQ ID NO: 954852 - RNA, 21 nt, Human
uggcuuacaccuguaauccca

SEQ ID NO: 954853 - RNA, 24 nt, Human
uggcuuacaccuguaaucccagca

SEQ ID NO: 954854 - RNA, 24 nt, Human
ugggaggcagagguugcagugagc

SEQ ID NO: 954855 - RNA, 20 nt, Human
ugggaggccaaggugggcag

SEQ ID NO: 954856 - RNA, 24 nt, Human
ugggaggccaaggugggcagauca

SEQ ID NO: 954857 - RNA, 22 nt, Human
ugggaggcugaggcagaagaau

SEQ ID NO: 954858 - RNA, 27 nt, Human
ugggaggcugaggcagaagaauugcuu

SEQ ID NO: 954859 - RNA, 18 nt, Human
ugggcagaucacuugagg

SEQ ID NO: 954860 - RNA, 24 nt, Human
ugggcagaucacuugaggucagaa

SEQ ID NO: 954861 - RNA, 24 nt, Human
ugguggcgggugccuguaauccca

SEQ ID NO: 954862 - RNA, 21 nt, Human
uuaaaaaggccgggcgcagug

SEQ ID NO: 954863 - RNA, 24 nt, Human
uuagcugggcgugguggcgggugc

SEQ ID NO: 954864 - RNA, 19 nt, Human
uuaguagccagaagacaug

SEQ ID NO: 954865 - RNA, 23 nt, Human
uugaacugggaggcagagguugc

SEQ ID NO: 954866 - RNA, 19 nt, Human
uugcagugagcugagacug

SEQ ID NO: 954867 - RNA, 22 nt, Human
uugcagugagcugagacugugc

SEQ ID NO: 954868 - RNA, 23 nt, Human
uugggaggcugaggcagaagaau

SEQ ID NO: 954869 - RNA, 22 nt, Human
uuuuaaaacuuccucaugaaaa

SEQ ID NO: 954870 - RNA, 24 nt, Human
aaaaugcugggauuacagguguga

SEQ ID NO: 954871 - RNA, 22 nt, Human
aaagauggagucucgcucuguc

SEQ ID NO: 954872 - RNA, 26 nt, Human
aaaugcugggauuacaggugugagcc

SEQ ID NO: 954873 - RNA, 23 nt, Human
aaccugcaaugccaccaccaucc

SEQ ID NO: 954874 - RNA, 24 nt, Human
aagugauccacccaccuuggccuc

SEQ ID NO: 954875 - RNA, 22 nt, Human
accauguuggccaggcaggucu

SEQ ID NO: 954876 - RNA, 19 nt, Human
accugcaaugccaccacca

SEQ ID NO: 954877 - RNA, 25 nt, Human
acucugucgcccaggcuggagugca

SEQ ID NO: 954878 - RNA, 18 nt, Human
acugcaagcuccgccucc

SEQ ID NO: 954879 - RNA, 22 nt, Human
agcagugaggagggcggacccc

SEQ ID NO: 954880 - RNA, 21 nt, Human
agccaccgcaccuggcccauc

SEQ ID NO: 954881 - RNA, 23 nt, Human
agccaccgugccggcccgucuug

SEQ ID NO: 954882 - RNA, 20 nt, Human
agcccacuugccaaccugca

SEQ ID NO: 954883 - RNA, 19 nt, Human
agcuacgauuacaggugug

SEQ ID NO: 954884 - RNA, 18 nt, Human
agcuccgccuccuggguu

SEQ ID NO: 954885 - RNA, 25 nt, Human
aggcuggagugcaguggcacgaucu

SEQ ID NO: 954886 - RNA, 22 nt, Human
aggucucaucauguuggccagg

SEQ ID NO: 954887 - RNA, 22 nt, Human
aguagagaugggguuucaccau

SEQ ID NO: 954888 - RNA, 18 nt, Human
aguagcugggauuucagg

SEQ ID NO: 954889 - RNA, 19 nt, Human
agugauccacccaccuugg

SEQ ID NO: 954890 - RNA, 20 nt, Human
agugcaguggcacgaucucg

SEQ ID NO: 954891 - RNA, 23 nt, Human
agugcaguggcacgaucucggcu

SEQ ID NO: 954892 - RNA, 24 nt, Human
agugcaguggcacgaucucggcuc

SEQ ID NO: 954893 - RNA, 21 nt, Human
agugcgguggcgcaaucucag

SEQ ID NO: 954894 - RNA, 18 nt, Human
agugcugggauuacaggc

SEQ ID NO: 954895 - RNA, 18 nt, Human
agugcugggauuacaggc

SEQ ID NO: 954896 - RNA, 18 nt, Human
augggguuucaccauguu

SEQ ID NO: 954897 - RNA, 22 nt, Human
augggguuucaccauguuggcc

SEQ ID NO: 954898 - RNA, 23 nt, Human
augggguuucaccauguuggcca

SEQ ID NO: 954899 - RNA, 24 nt, Human
augggguuucaccauguuggccag

SEQ ID NO: 954900 - RNA, 25 nt, Human
auuuuuguauuuuuuaguagagaug

SEQ ID NO: 954901 - RNA, 24 nt, Human
caaaaugcugggauuacaggugug

SEQ ID NO: 954902 - RNA, 25 nt, Human
caacaaacauuuauugagcaccuac

SEQ ID NO: 954903 - RNA, 24 nt, Human
caaccugcaaugccaccaccaucc

SEQ ID NO: 954904 - RNA, 20 nt, Human
caagcgauucuccugccuca

SEQ ID NO: 954905 - RNA, 22 nt, Human
caagcgauucuccugccucagc

SEQ ID NO: 954906 - RNA, 20 nt, Human
caaugccaccaccauccugu

SEQ ID NO: 954907 - RNA, 21 nt, Human
cacacccggcuaauuuaugua

SEQ ID NO: 954908 - RNA, 24 nt, Human
caccaugccuggcuaauuuuugua

SEQ ID NO: 954909 - RNA, 21 nt, Human
caccauguuggccaggcaggu

SEQ ID NO: 954910 - RNA, 23 nt, Human
caccauguuggccaggcaggucu

SEQ ID NO: 954911 - RNA, 24 nt, Human
caccauguuggccaggcaggucuu

SEQ ID NO: 954912 - RNA, 31 nt, Human
caccauguuggccaggcaggucuugaacucc

SEQ ID NO: 954913 - RNA, 23 nt, Human
cacccaccuuggccucccaaaau

SEQ ID NO: 954914 - RNA, 21 nt, Human
caccgcaaccuuugccuccca

SEQ ID NO: 954915 - RNA, 24 nt, Human
cacucugucgcccaggcuggagug

SEQ ID NO: 954916 - RNA, 19 nt, Human
cagcccacuugccaaccug

SEQ ID NO: 954917 - RNA, 22 nt, Human
caggcgauucuccugccucagc

SEQ ID NO: 954918 - RNA, 21 nt, Human
caggcgccugccaccacaccc

SEQ ID NO: 954919 - RNA, 23 nt, Human
caggcgccugccaccacacccgg

SEQ ID NO: 954920 - RNA, 25 nt, Human
caggugugugccaccaugccuggcu

SEQ ID NO: 954921 - RNA, 19 nt, Human
cagugcugggauuacaggc

SEQ ID NO: 954922 - RNA, 25 nt, Human
cagugcugggauuacaggcgugagc

SEQ ID NO: 954923 - RNA, 27 nt, Human
caucauguuggccaggcuggucuugaa

SEQ ID NO: 954924 - RNA, 23 nt, Human
cauguuggccaggcaggucuuga

SEQ ID NO: 954925 - RNA, 18 nt, Human
cauguuggccaggcuggu

SEQ ID NO: 954926 - RNA, 20 nt, Human
cauguuggccaggcuggucu

SEQ ID NO: 954927 - RNA, 20 nt, Human
cauguuggccaggcuggucu

SEQ ID NO: 954928 - RNA, 24 nt, Human
cauguuggccaggcuggucuugaa

SEQ ID NO: 954929 - RNA, 20 nt, Human
ccaaaaugcugggauuacag

SEQ ID NO: 954930 - RNA, 21 nt, Human
ccaaaaugcugggauuacagg

SEQ ID NO: 954931 - RNA, 21 nt, Human
ccaaaaugcugggauuacagg

SEQ ID NO: 954932 - RNA, 24 nt, Human
ccaaaaugcugggauuacaggugu

SEQ ID NO: 954933 - RNA, 22 nt, Human
cccaggcuggagugcgguggcg

SEQ ID NO: 954934 - RNA, 23 nt, Human
cccagguucaagcgauucuccug

SEQ ID NO: 954935 - RNA, 19 nt, Human
cccaugggugaggcaggau

SEQ ID NO: 954936 - RNA, 23 nt, Human
ccgcaaccuuugccucccagguu

SEQ ID NO: 954937 - RNA, 24 nt, Human
ccgcaaccuuugccucccagguuc

SEQ ID NO: 954938 - RNA, 24 nt, Human
ccgccuccuggguucaggcgauuc

SEQ ID NO: 954939 - RNA, 23 nt, Human
ccuacuggucagggcccuggaac

SEQ ID NO: 954940 - RNA, 24 nt, Human
ccucccagguucaagcgauucucc

SEQ ID NO: 954941 - RNA, 24 nt, Human
ccucucagugcugggauuacaggc

SEQ ID NO: 954942 - RNA, 18 nt, Human
ccugaccucaagugaucg

SEQ ID NO: 954943 - RNA, 24 nt, Human
ccugccucagccucuugaguagcu

SEQ ID NO: 954944 - RNA, 18 nt, Human
ccuggccucaagugaucc

SEQ ID NO: 954945 - RNA, 24 nt, Human
ccuggccucaagugauccacccac

SEQ ID NO: 954946 - RNA, 24 nt, Human
cgcucugucgcccaggcuggagug

SEQ ID NO: 954947 - RNA, 24 nt, Human
cggaggucucaucauguuggccag

SEQ ID NO: 954948 - RNA, 23 nt, Human
cgugagccaccgugccggcccgu

SEQ ID NO: 954949 - RNA, 21 nt, Human
cgugccggcccgucuuguuuu

SEQ ID NO: 954950 - RNA, 24 nt, Human
cucaagugauccacccaccuuggc

SEQ ID NO: 954951 - RNA, 24 nt, Human
cucacucugucgcccaggcuggag

SEQ ID NO: 954952 - RNA, 24 nt, Human
cucagccucuugaguagcugggau

SEQ ID NO: 954953 - RNA, 23 nt, Human
cuccuggccucaagugauccacc

SEQ ID NO: 954954 - RNA, 27 nt, Human
cuccuggccucaagugauccacccacc

SEQ ID NO: 954955 - RNA, 21 nt, Human
cuccuggguucaggcgauucu

SEQ ID NO: 954956 - RNA, 21 nt, Human
cuccuuguccaggagacuguc

SEQ ID NO: 954957 - RNA, 23 nt, Human
cuccuuguccaggagacugucca

SEQ ID NO: 954958 - RNA, 24 nt, Human
cucgcucugucgcccaggcuggag

SEQ ID NO: 954959 - RNA, 23 nt, Human
cucugucgcccaggcuggagugc

SEQ ID NO: 954960 - RNA, 21 nt, Human
cuugaguagcugggauuucag

SEQ ID NO: 954961 - RNA, 19 nt, Human
gaccucaagugaucggccu

SEQ ID NO: 954962 - RNA, 25 nt, Human
gagacuguccaggugaggagcucag

SEQ ID NO: 954963 - RNA, 18 nt, Human
gagaugggguuucaccau

SEQ ID NO: 954964 - RNA, 24 nt, Human
gagaugggguuucaccauguuggc

SEQ ID NO: 954965 - RNA, 18 nt, Human
gauuacaggcgugagcca

SEQ ID NO: 954966 - RNA, 21 nt, Human
gauuacaggcgugagccaccg

SEQ ID NO: 954967 - RNA, 24 nt, Human
gauuacaggcgugagccaccgugc

SEQ ID NO: 954968 - RNA, 18 nt, Human
gauuacaggugugagcca

SEQ ID NO: 954969 - RNA, 22 nt, Human
gauuacaggugugagccaccgc

SEQ ID NO: 954970 - RNA, 23 nt, Human
gauuacaggugugagccaccgca

SEQ ID NO: 954971 - RNA, 18 nt, Human
gauuacaggugugugcca

SEQ ID NO: 954972 - RNA, 22 nt, Human
gauuacaggugugugccaccau

SEQ ID NO: 954973 - RNA, 20 nt, Human
gauucuccugccucagccuc

SEQ ID NO: 954974 - RNA, 19 nt, Human
gcccaggcuggagugcagu

SEQ ID NO: 954975 - RNA, 23 nt, Human
gcccaggcuggagugcaguggca

SEQ ID NO: 954976 - RNA, 19 nt, Human
gcccaggcuggagugcggu

SEQ ID NO: 954977 - RNA, 20 nt, Human
gcccaggcuggagugcggug

SEQ ID NO: 954978 - RNA, 20 nt, Human
gcccuggaaccacuagacuc

SEQ ID NO: 954979 - RNA, 21 nt, Human
gccggcccgucuuguuuuuuu

SEQ ID NO: 954980 - RNA, 25 nt, Human
gccuccuggguucaggcgauucucc

SEQ ID NO: 954981 - RNA, 22 nt, Human
gcgauucuccugccucagccuc

SEQ ID NO: 954982 - RNA, 18 nt, Human
gcugcugcccaggcuggu

SEQ ID NO: 954983 - RNA, 19 nt, Human
gcuggagugcaguggcacg

SEQ ID NO: 954984 - RNA, 23 nt, Human
gcuggucuugaacuccuggccuc

SEQ ID NO: 954985 - RNA, 26 nt, Human
ggaaacuccuuguccaggagacuguc

SEQ ID NO: 954986 - RNA, 24 nt, Human
ggaggucucaucauguuggccagg

SEQ ID NO: 954987 - RNA, 24 nt, Human
ggcaggucuugaacuccugaccuc

SEQ ID NO: 954988 - RNA, 24 nt, Human
ggccucaagugauccacccaccuu

SEQ ID NO: 954989 - RNA, 24 nt, Human
ggcuggucuugaacuccuggccuc

SEQ ID NO: 954990 - RNA, 22 nt, Human
gggguuucaccauguuggccag

SEQ ID NO: 954991 - RNA, 23 nt, Human
gggguuucaccauguuggccagg

SEQ ID NO: 954992 - RNA, 19 nt, Human
gguccagucagcugugucc

SEQ ID NO: 954993 - RNA, 20 nt, Human
ggucuugaacuccugaccuc

SEQ ID NO: 954994 - RNA, 23 nt, Human
guagagaugggguuucaccaugu

SEQ ID NO: 954995 - RNA, 20 nt, Human
guauuuuuuaguagagaugg

SEQ ID NO: 954996 - RNA, 24 nt, Human
gugauccacccaccuuggccuccc

SEQ ID NO: 954997 - RNA, 23 nt, Human
uaaauaguucuugcugcugccca

SEQ ID NO: 954998 - RNA, 23 nt, Human
uaauuuauguauuuuaguagaga

SEQ ID NO: 954999 - RNA, 25 nt, Human
uaauuuauguauuuuaguagagacg

SEQ ID NO: 955000 - RNA, 25 nt, Human
uaauuuuuguauuuuuuaguagaga

SEQ ID NO: 955001 - RNA, 22 nt, Human
uacaggcgugagccaccgugcc

SEQ ID NO: 955002 - RNA, 22 nt, Human
uacaggugugagccaccgcacc

SEQ ID NO: 955003 - RNA, 22 nt, Human
uacaggugugagccaccgcacc

SEQ ID NO: 955004 - RNA, 23 nt, Human
uacaggugugagccaccgcaccu

SEQ ID NO: 955005 - RNA, 24 nt, Human
uacgauuacaggugugugccacca

SEQ ID NO: 955006 - RNA, 22 nt, Human
uagagaugggguuucaccaugu

SEQ ID NO: 955007 - RNA, 25 nt, Human
uaguagagacggaggucucaucaug

SEQ ID NO: 955008 - RNA, 24 nt, Human
uaguagagaugggguuucaccaug

SEQ ID NO: 955009 - RNA, 26 nt, Human
uaguagagaugggguuucaccauguu

SEQ ID NO: 955010 - RNA, 24 nt, Human
ucaccgcaaccuuugccucccagg

SEQ ID NO: 955011 - RNA, 25 nt, Human
ucaccgcaaccuuugccucccaggu

SEQ ID NO: 955012 - RNA, 24 nt, Human
ucacucugucgcccaggcuggagu

SEQ ID NO: 955013 - RNA, 18 nt, Human
ucacugcaagcuccgccu

SEQ ID NO: 955014 - RNA, 23 nt, Human
ucacugcaagcuccgccuccugg

SEQ ID NO: 955015 - RNA, 24 nt, Human
ucacugcaagcuccgccuccuggg

SEQ ID NO: 955016 - RNA, 26 nt, Human
ucacugcaagcuccgccuccuggguu

SEQ ID NO: 955017 - RNA, 20 nt, Human
ucagcagugaggagggcgga

SEQ ID NO: 955018 - RNA, 20 nt, Human
ucagccucuugaguagcugg

SEQ ID NO: 955019 - RNA, 19 nt, Human
ucaggcgauucuccugccu

SEQ ID NO: 955020 - RNA, 24 nt, Human
ucagugcugggauuacaggcguga

SEQ ID NO: 955021 - RNA, 25 nt, Human
ucaguucaccgcaaccuuugccucc

SEQ ID NO: 955022 - RNA, 23 nt, Human
ucccaaaaugcugggauuacagg

SEQ ID NO: 955023 - RNA, 21 nt, Human
ucccagguucaagcgauucuc

SEQ ID NO: 955024 - RNA, 24 nt, Human
ucccagguucaagcgauucuccug

SEQ ID NO: 955025 - RNA, 19 nt, Human
uccuggguucaggcgauuc

SEQ ID NO: 955026 - RNA, 21 nt, Human
uccuggguucaggcgauucuc

SEQ ID NO: 955027 - RNA, 24 nt, Human
uccuggguucaggcgauucuccug

SEQ ID NO: 955028 - RNA, 24 nt, Human
ucgcccaggcuggagugcaguggc

SEQ ID NO: 955029 - RNA, 24 nt, Human
ucgcccaggcuggagugcgguggc

SEQ ID NO: 955030 - RNA, 24 nt, Human
ucgcucugucgcccaggcuggagu

SEQ ID NO: 955031 - RNA, 22 nt, Human
ucucacucugucgcccaggcug

SEQ ID NO: 955032 - RNA, 23 nt, Human
ucucacucugucgcccaggcugg

SEQ ID NO: 955033 - RNA, 24 nt, Human
ucucacucugucgcccaggcugga

SEQ ID NO: 955034 - RNA, 26 nt, Human
ucucacucugucgcccaggcuggagu

SEQ ID NO: 955035 - RNA, 27 nt, Human
ucucacucugucgcccaggcuggagug

SEQ ID NO: 955036 - RNA, 22 nt, Human
ucucagugcugggauuacaggc

SEQ ID NO: 955037 - RNA, 24 nt, Human
ucucagugcugggauuacaggcgu

SEQ ID NO: 955038 - RNA, 24 nt, Human
ucucaucauguuggccaggcuggu

SEQ ID NO: 955039 - RNA, 24 nt, Human
ucuccugccucagccucuugagua

SEQ ID NO: 955040 - RNA, 19 nt, Human
ucucgcucugucgcccagg

SEQ ID NO: 955041 - RNA, 23 nt, Human
ucucgcucugucgcccaggcugg

SEQ ID NO: 955042 - RNA, 24 nt, Human
ucucgcucugucgcccaggcugga

SEQ ID NO: 955043 - RNA, 20 nt, Human
ucugcaauuuggccugagac

SEQ ID NO: 955044 - RNA, 24 nt, Human
ucugucgcccaggcuggagugcag

SEQ ID NO: 955045 - RNA, 24 nt, Human
ucugucgcccaggcuggagugcgg

SEQ ID NO: 955046 - RNA, 21 nt, Human
ucuugaacuccugaccucaag

SEQ ID NO: 955047 - RNA, 21 nt, Human
ucuugaacuccuggccucaag

SEQ ID NO: 955048 - RNA, 24 nt, Human
ucuugaguagcugggauuucaggc

SEQ ID NO: 955049 - RNA, 21 nt, Human
ucuugcugcugcccaggcugg

SEQ ID NO: 955050 - RNA, 22 nt, Human
ucuugcugcugcccaggcuggu

SEQ ID NO: 955051 - RNA, 23 nt, Human
ucuugcugcugcccaggcuggug

SEQ ID NO: 955052 - RNA, 19 nt, Human
ugaccucaagugaucggcc

SEQ ID NO: 955053 - RNA, 19 nt, Human
ugaccucaagugaucggcc

SEQ ID NO: 955054 - RNA, 21 nt, Human
ugaccucaagugaucggccuc

SEQ ID NO: 955055 - RNA, 22 nt, Human
ugagauggagucucacucuguc

SEQ ID NO: 955056 - RNA, 21 nt, Human
ugaggagggcggaccccauca

SEQ ID NO: 955057 - RNA, 24 nt, Human
ugauccacccaccuuggccuccca

SEQ ID NO: 955058 - RNA, 19 nt, Human
ugcaaugccaccaccaucc

SEQ ID NO: 955059 - RNA, 23 nt, Human
ugccaccaccauccuguggucca

SEQ ID NO: 955060 - RNA, 24 nt, Human
ugccaccaccauccugugguccag

SEQ ID NO: 955061 - RNA, 21 nt, Human
ugccggcccgucuuguuuuuu

SEQ ID NO: 955062 - RNA, 24 nt, Human
ugccucagccucuugaguagcugg

SEQ ID NO: 955063 - RNA, 22 nt, Human
ugcgguggcgcaaucucaguuc

SEQ ID NO: 955064 - RNA, 23 nt, Human
ugcgguggcgcaaucucaguuca

SEQ ID NO: 955065 - RNA, 24 nt, Human
ugcugggauuacaggcgugagcca

SEQ ID NO: 955066 - RNA, 24 nt, Human
ugcugggauuacaggugugagcca

SEQ ID NO: 955067 - RNA, 24 nt, Human
uggagucucacucugucgcccagg

SEQ ID NO: 955068 - RNA, 24 nt, Human
uggagucucgcucugucgcccagg

SEQ ID NO: 955069 - RNA, 23 nt, Human
uggagugcaguggcacgaucucg

SEQ ID NO: 955070 - RNA, 24 nt, Human
uggagugcaguggcacgaucucgg

SEQ ID NO: 955071 - RNA, 18 nt, Human
uggagugcgguggcgcaa

SEQ ID NO: 955072 - RNA, 23 nt, Human
uggagugcgguggcgcaaucuca

SEQ ID NO: 955073 - RNA, 24 nt, Human
uggagugcgguggcgcaaucucag

SEQ ID NO: 955074 - RNA, 24 nt, Human
uggccaggcaggucuugaacuccu

SEQ ID NO: 955075 - RNA, 24 nt, Human
uggccaggcuggucuugaacuccu

SEQ ID NO: 955076 - RNA, 22 nt, Human
uggccucaagugauccacccac

SEQ ID NO: 955077 - RNA, 24 nt, Human
uggcgcaaucucaguucaccgcaa

SEQ ID NO: 955078 - RNA, 18 nt, Human
ugggauuacaggcgugag

SEQ ID NO: 955079 - RNA, 21 nt, Human
ugggauuacaggcgugagcca

SEQ ID NO: 955080 - RNA, 22 nt, Human
ugggauuacaggcgugagccac

SEQ ID NO: 955081 - RNA, 23 nt, Human
ugggauuacaggcgugagccacc

SEQ ID NO: 955082 - RNA, 23 nt, Human
ugggauuacaggcgugagccacc

SEQ ID NO: 955083 - RNA, 24 nt, Human
ugggauuacaggcgugagccaccg

SEQ ID NO: 955084 - RNA, 18 nt, Human
ugggauuacaggugugag

SEQ ID NO: 955085 - RNA, 19 nt, Human
ugggauuacaggugugagc

SEQ ID NO: 955086 - RNA, 21 nt, Human
ugggauuacaggugugagcca

SEQ ID NO: 955087 - RNA, 22 nt, Human
ugggauuacaggugugagccac

SEQ ID NO: 955088 - RNA, 23 nt, Human
ugggauuacaggugugagccacc

SEQ ID NO: 955089 - RNA, 24 nt, Human
ugggauuacaggugugagccaccg

SEQ ID NO: 955090 - RNA, 24 nt, Human
ugggauuucaggcgccugccacca

SEQ ID NO: 955091 - RNA, 18 nt, Human
uggggugcagcacccaug

SEQ ID NO: 955092 - RNA, 24 nt, Human
ugggguuucaccauguuggccagg

SEQ ID NO: 955093 - RNA, 24 nt, Human
uggguucaggcgauucuccugccu

SEQ ID NO: 955094 - RNA, 22 nt, Human
uguccaggugaggagcucagca

SEQ ID NO: 955095 - RNA, 24 nt, Human
uguuuuuuuuuaaagauggagucu

SEQ ID NO: 955096 - RNA, 22 nt, Human
uuaguagagacggaggucucau

SEQ ID NO: 955097 - RNA, 25 nt, Human
uuaguagagacggaggucucaucau

SEQ ID NO: 955098 - RNA, 18 nt, Human
uuaguagagaugggguuu

SEQ ID NO: 955099 - RNA, 22 nt, Human
uuaguagagaugggguuucacc

SEQ ID NO: 955100 - RNA, 24 nt, Human
uuaguagagaugggguuucaccau

SEQ ID NO: 955101 - RNA, 21 nt, Human
uucaagcgauucuccugccuc

SEQ ID NO: 955102 - RNA, 23 nt, Human
uucaagcgauucuccugccucag

SEQ ID NO: 955103 - RNA, 24 nt, Human
uucaagcgauucuccugccucagc

SEQ ID NO: 955104 - RNA, 18 nt, Human
uucaggcgauucuccugc

SEQ ID NO: 955105 - RNA, 21 nt, Human
uucaggcgauucuccugccuc

SEQ ID NO: 955106 - RNA, 23 nt, Human
uucaggcgauucuccugccucag

SEQ ID NO: 955107 - RNA, 23 nt, Human
uucuccugccucagcuacgauua

SEQ ID NO: 955108 - RNA, 21 nt, Human
uucuugcugcugcccaggcug

SEQ ID NO: 955109 - RNA, 24 nt, Human
uuucaccauguuggccaggcaggu

SEQ ID NO: 955110 - RNA, 24 nt, Human
uuuuuaguagagaugggguuucac

SEQ ID NO: 955111 - RNA, 21 nt, Human
uuuuuguauuuuuuaguagag

SEQ ID NO: 955112 - RNA, 23 nt, Human
uuuuuuaguagagaugggguuuc

SEQ ID NO: 955113 - RNA, 23 nt, Human
uuuuuuuuuaaagauggagucuc

SEQ ID NO: 955114 - RNA, 26 nt, Human
uuuuuuuuuuuugagauggagucuca

SEQ ID NO: 955115 - RNA, 22 nt, Human
uuuuuuuuuuuuuugagaugga

SEQ ID NO: 955116 - RNA, 21 nt, Human
uuuuuuuuuuuuuuuuucauu

SEQ ID NO: 955117 - RNA, 18 nt, Human
uuuuuuuuuuuuuuuuug

SEQ ID NO: 955118 - RNA, 23 nt, Human
aaagcggagagcuggucccuguu

SEQ ID NO: 955119 - RNA, 23 nt, Human
acacagcagucucccuggggaau

SEQ ID NO: 955120 - RNA, 21 nt, Human
acacccagcuggaggccagaa

SEQ ID NO: 955121 - RNA, 18 nt, Human
agaaggcaaagagggcag

SEQ ID NO: 955122 - RNA, 22 nt, Human
agccagcugcuccucugcgugu

SEQ ID NO: 955123 - RNA, 22 nt, Human
agcuggucccugucgugacaca

SEQ ID NO: 955124 - RNA, 19 nt, Human
aggcaaagagggcagccag

SEQ ID NO: 955125 - RNA, 20 nt, Human
aggugggaggacuccgggca

SEQ ID NO: 955126 - RNA, 21 nt, Human
augccagggccagggccagga

SEQ ID NO: 955127 - RNA, 18 nt, Human
caaagcggagagcugguc

SEQ ID NO: 955128 - RNA, 19 nt, Human
cagcaagcuggggugcugg

SEQ ID NO: 955129 - RNA, 20 nt, Human
cagcacacagcagucucccu

SEQ ID NO: 955130 - RNA, 19 nt, Human
cagcaggcgggggcggccu

SEQ ID NO: 955131 - RNA, 19 nt, Human
cagcaggcgggggcggccu

SEQ ID NO: 955132 - RNA, 19 nt, Human
caggcgggcagcacacagc

SEQ ID NO: 955133 - RNA, 23 nt, Human
ccagcuggaggccagaaggcaaa

SEQ ID NO: 955134 - RNA, 20 nt, Human
ccagggggcuucgagggggg

SEQ ID NO: 955135 - RNA, 19 nt, Human
ccccccacacccagcugga

SEQ ID NO: 955136 - RNA, 21 nt, Human
ccccgccuugcuccgcccccc

SEQ ID NO: 955137 - RNA, 20 nt, Human
ccgcuccccaccccauccug

SEQ ID NO: 955138 - RNA, 22 nt, Human
ccucccacgagugccaccgcuc

SEQ ID NO: 955139 - RNA, 21 nt, Human
ccucuguauuuggggaguggg

SEQ ID NO: 955140 - RNA, 22 nt, Human
ccugcccggcugcugccugccc

SEQ ID NO: 955141 - RNA, 18 nt, Human
cgaaggcccuugugucca

SEQ ID NO: 955142 - RNA, 19 nt, Human
cgccuugcuccgccccccc

SEQ ID NO: 955143 - RNA, 21 nt, Human
cuaguggugccuggccccaca

SEQ ID NO: 955144 - RNA, 19 nt, Human
cugucccccgccuugcucc

SEQ ID NO: 955145 - RNA, 18 nt, Human
cuuggggucuggucucaa

SEQ ID NO: 955146 - RNA, 23 nt, Human
gagcucagguccuggggaaggag

SEQ ID NO: 955147 - RNA, 18 nt, Human
gauguggggcugggggag

SEQ ID NO: 955148 - RNA, 24 nt, Human
gccaccgcuccccaccccauccug

SEQ ID NO: 955149 - RNA, 19 nt, Human
gccagggccagggccagga

SEQ ID NO: 955150 - RNA, 21 nt, Human
gcugcgggggucgucugcaga

SEQ ID NO: 955151 - RNA, 25 nt, Human
ggaaaugaaagggcugugggaggaa

SEQ ID NO: 955152 - RNA, 21 nt, Human
ggagcaggauggggguggggg

SEQ ID NO: 955153 - RNA, 21 nt, Human
ggcaaagagggcagccagcaa

SEQ ID NO: 955154 - RNA, 19 nt, Human
ggccuuggggccagagcuc

SEQ ID NO: 955155 - RNA, 19 nt, Human
ggcugggcccgaggccgcc

SEQ ID NO: 955156 - RNA, 21 nt, Human
gggaagaggaggccuuggggc

SEQ ID NO: 955157 - RNA, 19 nt, Human
gggaaggaggaugugggcg

SEQ ID NO: 955158 - RNA, 21 nt, Human
gggaaggaggaugugggcggg

SEQ ID NO: 955159 - RNA, 20 nt, Human
gggaaucaguccagggggcu

SEQ ID NO: 955160 - RNA, 22 nt, Human
gggaaucaguccagggggcuuc

SEQ ID NO: 955161 - RNA, 19 nt, Human
gggcagcacacagcagucu

SEQ ID NO: 955162 - RNA, 20 nt, Human
gggcuucgagggggguccga

SEQ ID NO: 955163 - RNA, 25 nt, Human
ggggaaggaggaugugggcgggggu

SEQ ID NO: 955164 - RNA, 18 nt, Human
ggggaggaaaugaaaggg

SEQ ID NO: 955165 - RNA, 21 nt, Human
ggggcugggggagagccagca

SEQ ID NO: 955166 - RNA, 20 nt, Human
ucagguccuggggaaggagg

SEQ ID NO: 955167 - RNA, 18 nt, Human
uccagaggggaugugggg

SEQ ID NO: 955168 - RNA, 24 nt, Human
uccagggggcuucgagggggggaa

SEQ ID NO: 955169 - RNA, 22 nt, Human
ucccacgagugccaccgcuccc

SEQ ID NO: 955170 - RNA, 24 nt, Human
uccccaccccauccuggcuggcuc

SEQ ID NO: 955171 - RNA, 24 nt, Human
uccccggcgagcagguggcugggc

SEQ ID NO: 955172 - RNA, 22 nt, Human
ucccugcccggcugcugccugc

SEQ ID NO: 955173 - RNA, 19 nt, Human
ugagccaggcuaguggugc

SEQ ID NO: 955174 - RNA, 18 nt, Human
ugccuggccccacagugc

SEQ ID NO: 955175 - RNA, 19 nt, Human
ugccugugagucgugggug

SEQ ID NO: 955176 - RNA, 20 nt, Human
ugcuccgcccccccacaccc

SEQ ID NO: 955177 - RNA, 21 nt, Human
ugcugcgggggucgucugcag

SEQ ID NO: 955178 - RNA, 18 nt, Human
uggcuggcuccaaguugc

SEQ ID NO: 955179 - RNA, 20 nt, Human
ugggaggaaugccugugagu

SEQ ID NO: 955180 - RNA, 18 nt, Human
uggggaggaaaugaaagg

SEQ ID NO: 955181 - RNA, 21 nt, Human
uggggccagagcucuugccag

SEQ ID NO: 955182 - RNA, 20 nt, Human
ugggggugggggacuugggg

SEQ ID NO: 955183 - RNA, 19 nt, Human
uugcuccgcccccccacac

SEQ ID NO: 955184 - RNA, 20 nt, Human
uuggggagugggguggggag

SEQ ID NO: 955185 - RNA, 23 nt, Human
aaaagagaaaaaacaaaacaaaa

SEQ ID NO: 955186 - RNA, 18 nt, Human
aaaauuagcugggcgugg

SEQ ID NO: 955187 - RNA, 24 nt, Human
aaacaaaacaaaacaaaacacaaa

SEQ ID NO: 955188 - RNA, 27 nt, Human
aaacaaaacacaaaggccucuccugca

SEQ ID NO: 955189 - RNA, 19 nt, Human
aaaugucuugccugggaga

SEQ ID NO: 955190 - RNA, 23 nt, Human
aacaaaacacaaaggccucuccu

SEQ ID NO: 955191 - RNA, 19 nt, Human
aacauggugaaaccccauc

SEQ ID NO: 955192 - RNA, 20 nt, Human
aacauggugaaaccccaucu

SEQ ID NO: 955193 - RNA, 23 nt, Human
aacauggugaaaccccaucugua

SEQ ID NO: 955194 - RNA, 25 nt, Human
aagagaaaaaacaaaacaaaacaaa

SEQ ID NO: 955195 - RNA, 22 nt, Human
acaaaacaaaacaaaacacaaa

SEQ ID NO: 955196 - RNA, 23 nt, Human
acaaaacaaaacacaaaggccuc

SEQ ID NO: 955197 - RNA, 20 nt, Human
acaccacugcacuccagccu

SEQ ID NO: 955198 - RNA, 24 nt, Human
acaccacugcacuccagccugggc

SEQ ID NO: 955199 - RNA, 23 nt, Human
acaccuauuaucccagcacuuug

SEQ ID NO: 955200 - RNA, 18 nt, Human
acagagugaaacucuguc

SEQ ID NO: 955201 - RNA, 19 nt, Human
acagagugaaacucugucu

SEQ ID NO: 955202 - RNA, 20 nt, Human
acagagugaaacucugucuc

SEQ ID NO: 955203 - RNA, 24 nt, Human
acagagugaaacucugucucaaaa

SEQ ID NO: 955204 - RNA, 24 nt, Human
acauccuggggagggcuccagggc

SEQ ID NO: 955205 - RNA, 22 nt, Human
accacugcacuccagccugggc

SEQ ID NO: 955206 - RNA, 23 nt, Human
acccugaagcauggccgugagac

SEQ ID NO: 955207 - RNA, 20 nt, Human
accuauuaucccagcacuuu

SEQ ID NO: 955208 - RNA, 24 nt, Human
acuccagccugggcgacagaguga

SEQ ID NO: 955209 - RNA, 19 nt, Human
acuccaggcugggugcggu

SEQ ID NO: 955210 - RNA, 24 nt, Human
acugcacuccagccugggcgacag

SEQ ID NO: 955211 - RNA, 26 nt, Human
acugcacuccagccugggcgacagag

SEQ ID NO: 955212 - RNA, 24 nt, Human
acuugaggucaggaguucgagacc

SEQ ID NO: 955213 - RNA, 23 nt, Human
agaaaaaacaaaacaaaacaaaa

SEQ ID NO: 955214 - RNA, 21 nt, Human
agacaaggccguaccagccgu

SEQ ID NO: 955215 - RNA, 24 nt, Human
agacggagcuccccaucagacccg

SEQ ID NO: 955216 - RNA, 18 nt, Human
agagguugcagugagccg

SEQ ID NO: 955217 - RNA, 23 nt, Human
agagguugcagugagccgagauc

SEQ ID NO: 955218 - RNA, 24 nt, Human
agagguugcagugagccgagauca

SEQ ID NO: 955219 - RNA, 18 nt, Human
agagugaaacucugucuc

SEQ ID NO: 955220 - RNA, 22 nt, Human
agccuggccaacauggugaaac

SEQ ID NO: 955221 - RNA, 24 nt, Human
agccuggccaacauggugaaaccc

SEQ ID NO: 955222 - RNA, 22 nt, Human
agccugggcgacagagugaaac

SEQ ID NO: 955223 - RNA, 24 nt, Human
agccugggcgacagagugaaacuc

SEQ ID NO: 955224 - RNA, 24 nt, Human
agcuggggggauggggccccaggu

SEQ ID NO: 955225 - RNA, 21 nt, Human
aggcagagguugcagugagcc

SEQ ID NO: 955226 - RNA, 24 nt, Human
aggcagagguugcagugagccgag

SEQ ID NO: 955227 - RNA, 18 nt, Human
aggcaggagaacugcuug

SEQ ID NO: 955228 - RNA, 21 nt, Human
aggccaaggcggguggaucac

SEQ ID NO: 955229 - RNA, 22 nt, Human
aggcggguggaucacuugaggu

SEQ ID NO: 955230 - RNA, 23 nt, Human
aggcggguggaucacuugagguc

SEQ ID NO: 955231 - RNA, 26 nt, Human
aggcggguggaucacuugaggucagg

SEQ ID NO: 955232 - RNA, 24 nt, Human
aggcugaggcaggagaacugcuug

SEQ ID NO: 955233 - RNA, 25 nt, Human
aggggacuggcucacauccugggga

SEQ ID NO: 955234 - RNA, 22 nt, Human
agggggaguuggggggugaggg

SEQ ID NO: 955235 - RNA, 21 nt, Human
aggggugggguggggguuggg

SEQ ID NO: 955236 - RNA, 22 nt, Human
aggggugggguggggguugggc

SEQ ID NO: 955237 - RNA, 24 nt, Human
aucacaccacugcacuccagccug

SEQ ID NO: 955238 - RNA, 22 nt, Human
aucccagcacuuugggaggcca

SEQ ID NO: 955239 - RNA, 21 nt, Human
auccuggggagggcuccaggg

SEQ ID NO: 955240 - RNA, 21 nt, Human
augaacacggguucuguggcc

SEQ ID NO: 955241 - RNA, 23 nt, Human
caaaacaaaacacaaaggccucu

SEQ ID NO: 955242 - RNA, 21 nt, Human
caacauggugaaaccccaucu

SEQ ID NO: 955243 - RNA, 22 nt, Human
caacauggugaaaccccaucug

SEQ ID NO: 955244 - RNA, 23 nt, Human
caacuguaaucccagcuauuugg

SEQ ID NO: 955245 - RNA, 24 nt, Human
caacuguaaucccagcuauuuggg

SEQ ID NO: 955246 - RNA, 24 nt, Human
caaggcggguggaucacuugaggu

SEQ ID NO: 955247 - RNA, 26 nt, Human
caaggcggguggaucacuugagguca

SEQ ID NO: 955248 - RNA, 21 nt, Human
cacaccacugcacuccagccu

SEQ ID NO: 955249 - RNA, 23 nt, Human
caccaaccagcgcaggcugaagc

SEQ ID NO: 955250 - RNA, 26 nt, Human
caccacugcacuccagccugggcgac

SEQ ID NO: 955251 - RNA, 20 nt, Human
caccauggccgccuccgggc

SEQ ID NO: 955252 - RNA, 22 nt, Human
cacuccagccugggcgacagag

SEQ ID NO: 955253 - RNA, 22 nt, Human
cacuccagccugggcgacagag

SEQ ID NO: 955254 - RNA, 24 nt, Human
cacuccagccugggcgacagagug

SEQ ID NO: 955255 - RNA, 19 nt, Human
cacugcacuccagccuggg

SEQ ID NO: 955256 - RNA, 20 nt, Human
cacugcacuccagccugggc

SEQ ID NO: 955257 - RNA, 22 nt, Human
cacugcacuccagccugggcga

SEQ ID NO: 955258 - RNA, 23 nt, Human
cacugcacuccagccugggcgac

SEQ ID NO: 955259 - RNA, 24 nt, Human
cacugcacuccagccugggcgaca

SEQ ID NO: 955260 - RNA, 25 nt, Human
cacugcacuccagccugggcgacaa

SEQ ID NO: 955261 - RNA, 23 nt, Human
cacuugaggucaggaguucgaga

SEQ ID NO: 955262 - RNA, 23 nt, Human
cagcaacagcauccuggggguga

SEQ ID NO: 955263 - RNA, 22 nt, Human
cagcacuuugggaggccaaggc

SEQ ID NO: 955264 - RNA, 24 nt, Human
cagcacuuugggaggccaaggcgg

SEQ ID NO: 955265 - RNA, 23 nt, Human
cagcgaggggacuggcucacauc

SEQ ID NO: 955266 - RNA, 24 nt, Human
cagcuauuugggaggcugaggcag

SEQ ID NO: 955267 - RNA, 19 nt, Human
caggaaugaaggggaggag

SEQ ID NO: 955268 - RNA, 18 nt, Human
caggaccugaagacccug

SEQ ID NO: 955269 - RNA, 21 nt, Human
caggccucgagaccugaagag

SEQ ID NO: 955270 - RNA, 23 nt, Human
ccaccaccggcuuccaccauccc

SEQ ID NO: 955271 - RNA, 20 nt, Human
ccacugcacuccagccuggg

SEQ ID NO: 955272 - RNA, 21 nt, Human
ccacugcacuccagccugggc

SEQ ID NO: 955273 - RNA, 21 nt, Human
ccacugcacuccagccugggc

SEQ ID NO: 955274 - RNA, 21 nt, Human
ccacugcacuccagccugggc

SEQ ID NO: 955275 - RNA, 23 nt, Human
ccacugcacuccagccugggcga

SEQ ID NO: 955276 - RNA, 24 nt, Human
ccacugcacuccagccugggcgac

SEQ ID NO: 955277 - RNA, 23 nt, Human
ccaggcugggugcgguggcugac

SEQ ID NO: 955278 - RNA, 18 nt, Human
ccagggggaguugggggg

SEQ ID NO: 955279 - RNA, 22 nt, Human
ccauggccgccuccgggcaccc

SEQ ID NO: 955280 - RNA, 21 nt, Human
cccaaccguugugaauggugc

SEQ ID NO: 955281 - RNA, 24 nt, Human
cccgaccuggccuggguccccgac

SEQ ID NO: 955282 - RNA, 23 nt, Human
ccgggcacccagcggcauuccgu

SEQ ID NO: 955283 - RNA, 19 nt, Human
ccguccaucgagacaccau

SEQ ID NO: 955284 - RNA, 20 nt, Human
ccuccgggcacccagcggca

SEQ ID NO: 955285 - RNA, 20 nt, Human
ccucuuggcagacuggccgg

SEQ ID NO: 955286 - RNA, 22 nt, Human
ccucuuggcagacuggccgggg

SEQ ID NO: 955287 - RNA, 24 nt, Human
ccugcagggcuccggcugcuggga

SEQ ID NO: 955288 - RNA, 23 nt, Human
ccugcugccaccugucccccgga

SEQ ID NO: 955289 - RNA, 23 nt, Human
ccuggccaacauggugaaacccc

SEQ ID NO: 955290 - RNA, 24 nt, Human
ccuggccaacauggugaaacccca

SEQ ID NO: 955291 - RNA, 20 nt, Human
ccugggcgacagagugaaac

SEQ ID NO: 955292 - RNA, 21 nt, Human
ccugggggugaacgggugggg

SEQ ID NO: 955293 - RNA, 23 nt, Human
ccugggguguccaaaguuguggu

SEQ ID NO: 955294 - RNA, 21 nt, Human
cgaccugcugccaccuguccc

SEQ ID NO: 955295 - RNA, 24 nt, Human
cgagaccagccuggccaacauggu

SEQ ID NO: 955296 - RNA, 19 nt, Human
cgaggggccacacacggcg

SEQ ID NO: 955297 - RNA, 20 nt, Human
cgggaccagggguagcagca

SEQ ID NO: 955298 - RNA, 24 nt, Human
cgggaggcagagguugcagugagc

SEQ ID NO: 955299 - RNA, 24 nt, Human
cggguggaucacuugaggucagga

SEQ ID NO: 955300 - RNA, 24 nt, Human
cucaaaagagaaaaaacaaaacaa

SEQ ID NO: 955301 - RNA, 22 nt, Human
cuccugcagggcuccggcugcu

SEQ ID NO: 955302 - RNA, 23 nt, Human
cugaagcauggccgugagaccca

SEQ ID NO: 955303 - RNA, 19 nt, Human
cugccaccugucccccgga

SEQ ID NO: 955304 - RNA, 23 nt, Human
cuggccaacauggugaaacccca

SEQ ID NO: 955305 - RNA, 20 nt, Human
cuguaaucccagcuauuugg

SEQ ID NO: 955306 - RNA, 24 nt, Human
cugugaaaaugucuugccugggag

SEQ ID NO: 955307 - RNA, 23 nt, Human
cugugcucccgaccuggccuggg

SEQ ID NO: 955308 - RNA, 19 nt, Human
gaagcuggccccgacgccu

SEQ ID NO: 955309 - RNA, 21 nt, Human
gacagagugaaacucugucuc

SEQ ID NO: 955310 - RNA, 24 nt, Human
gacagagugaaacucugucucaaa

SEQ ID NO: 955311 - RNA, 25 nt, Human
gaccugcugccaccuguccccuuuc

SEQ ID NO: 955312 - RNA, 20 nt, Human
gaccuggccuggguccccga

SEQ ID NO: 955313 - RNA, 23 nt, Human
gagaucacaccacugcacuccag

SEQ ID NO: 955314 - RNA, 19 nt, Human
gaggacgggagggcggccc

SEQ ID NO: 955315 - RNA, 18 nt, Human
gaggcagggaggguggcc

SEQ ID NO: 955316 - RNA, 20 nt, Human
gagguggugggcgguggggg

SEQ ID NO: 955317 - RNA, 24 nt, Human
gaucacuugaggucaggaguucga

SEQ ID NO: 955318 - RNA, 20 nt, Human
gauggcggggacagcgagga

SEQ ID NO: 955319 - RNA, 23 nt, Human
gcacuccagccugggcgacagag

SEQ ID NO: 955320 - RNA, 20 nt, Human
gcaggcaacuguaaucccag

SEQ ID NO: 955321 - RNA, 22 nt, Human
gccaacauggugaaaccccauc

SEQ ID NO: 955322 - RNA, 21 nt, Human
gccaccaccggcuuccaccau

SEQ ID NO: 955323 - RNA, 20 nt, Human
gccgagaucacaccacugca

SEQ ID NO: 955324 - RNA, 25 nt, Human
gccugggguguccaaaguugugguc

SEQ ID NO: 955325 - RNA, 23 nt, Human
gcgacagagugaaacucugucuc

SEQ ID NO: 955326 - RNA, 22 nt, Human
gcucugaccucagcgccagcag

SEQ ID NO: 955327 - RNA, 18 nt, Human
gcugacaccuauuauccc

SEQ ID NO: 955328 - RNA, 22 nt, Human
ggagaacugcuugaacacggga

SEQ ID NO: 955329 - RNA, 20 nt, Human
ggagagguguuccaggggga

SEQ ID NO: 955330 - RNA, 21 nt, Human
ggagcaagagggcguccugug

SEQ ID NO: 955331 - RNA, 18 nt, Human
ggagcggcugugcucccg

SEQ ID NO: 955332 - RNA, 23 nt, Human
ggagcuccccaucagacccgcuc

SEQ ID NO: 955333 - RNA, 18 nt, Human
ggaggagguggugggcgg

SEQ ID NO: 955334 - RNA, 21 nt, Human
ggagggcuccagggcagcagg

SEQ ID NO: 955335 - RNA, 22 nt, Human
ggaucacuugaggucaggaguu

SEQ ID NO: 955336 - RNA, 22 nt, Human
ggccccagguacucccagcccu

SEQ ID NO: 955337 - RNA, 21 nt, Human
ggcccuggcaggaggggggcg

SEQ ID NO: 955338 - RNA, 19 nt, Human
ggcugaagccugcagccgc

SEQ ID NO: 955339 - RNA, 20 nt, Human
gggaguuggggggugagggg

SEQ ID NO: 955340 - RNA, 19 nt, Human
gggccacacacggcggggg

SEQ ID NO: 955341 - RNA, 22 nt, Human
ggggacagcgaggacucagccg

SEQ ID NO: 955342 - RNA, 21 nt, Human
ggggaggagguggugggcggu

SEQ ID NO: 955343 - RNA, 18 nt, Human
ggggagggggcgaggcug

SEQ ID NO: 955344 - RNA, 22 nt, Human
gggggagggguggggugggggu

SEQ ID NO: 955345 - RNA, 18 nt, Human
ggggugaacgggugggga

SEQ ID NO: 955346 - RNA, 24 nt, Human
ggguugggccugccaggugagauu

SEQ ID NO: 955347 - RNA, 19 nt, Human
ggugagauuuugucugcau

SEQ ID NO: 955348 - RNA, 21 nt, Human
gguggaucacuugaggucagg

SEQ ID NO: 955349 - RNA, 19 nt, Human
gugcaguggacggcgggug

SEQ ID NO: 955350 - RNA, 18 nt, Human
guggaaagacagccugcc

SEQ ID NO: 955351 - RNA, 19 nt, Human
guggggagggggcgaggcu

SEQ ID NO: 955352 - RNA, 19 nt, Human
guugcagugagccgagauc

SEQ ID NO: 955353 - RNA, 24 nt, Human
uaaggcacagauuugacggguccc

SEQ ID NO: 955354 - RNA, 22 nt, Human
ucaaaagagaaaaaacaaaaca

SEQ ID NO: 955355 - RNA, 23 nt, Human
ucacaccacugcacuccagccug

SEQ ID NO: 955356 - RNA, 20 nt, Human
ucacuugaggucaggaguuc

SEQ ID NO: 955357 - RNA, 24 nt, Human
ucagacccgcucugaccucagcgc

SEQ ID NO: 955358 - RNA, 20 nt, Human
ucagugcaggcgagaggcug

SEQ ID NO: 955359 - RNA, 23 nt, Human
uccaccaucccagcuggggggau

SEQ ID NO: 955360 - RNA, 22 nt, Human
uccagccugggcgacagaguga

SEQ ID NO: 955361 - RNA, 24 nt, Human
uccaggcugggugcgguggcugac

SEQ ID NO: 955362 - RNA, 18 nt, Human
uccagggggaguuggggg

SEQ ID NO: 955363 - RNA, 21 nt, Human
ucccagcuggggggauggggc

SEQ ID NO: 955364 - RNA, 20 nt, Human
ucucaaaagagaaaaaacaa

SEQ ID NO: 955365 - RNA, 19 nt, Human
ugaaaccccaucuguacua

SEQ ID NO: 955366 - RNA, 22 nt, Human
ugaacacggguucuguggcccu

SEQ ID NO: 955367 - RNA, 21 nt, Human
ugaaggggaggaggugguggg

SEQ ID NO: 955368 - RNA, 25 nt, Human
ugagggauccgggcgcgagcgcagc

SEQ ID NO: 955369 - RNA, 18 nt, Human
ugcaggcgagaggcuggg

SEQ ID NO: 955370 - RNA, 22 nt, Human
ugcaucagugcaggcgagaggc

SEQ ID NO: 955371 - RNA, 21 nt, Human
ugccagggaucccuguuuugg

SEQ ID NO: 955372 - RNA, 21 nt, Human
ugcuggggagugcuugugagg

SEQ ID NO: 955373 - RNA, 19 nt, Human
uggacggcagaggccaagg

SEQ ID NO: 955374 - RNA, 24 nt, Human
uggaucacuugaggucaggaguuc

SEQ ID NO: 955375 - RNA, 27 nt, Human
uggaucacuugaggucaggaguucgag

SEQ ID NO: 955376 - RNA, 20 nt, Human
uggcagacuggccgggggca

SEQ ID NO: 955377 - RNA, 21 nt, Human
uggcagacuggccgggggcag

SEQ ID NO: 955378 - RNA, 18 nt, Human
uggcaggaggggggcggu

SEQ ID NO: 955379 - RNA, 20 nt, Human
uggcaggaggggggcggucc

SEQ ID NO: 955380 - RNA, 20 nt, Human
uggcaggaggggggcggucc

SEQ ID NO: 955381 - RNA, 24 nt, Human
uggccaacauggugaaaccccauc

SEQ ID NO: 955382 - RNA, 21 nt, Human
uggcggggacagcgaggacuc

SEQ ID NO: 955383 - RNA, 23 nt, Human
uggcggggacagcgaggacuccu

SEQ ID NO: 955384 - RNA, 22 nt, Human
uggcugacaccuauuaucccag

SEQ ID NO: 955385 - RNA, 24 nt, Human
ugggaggccaaggcggguggauca

SEQ ID NO: 955386 - RNA, 18 nt, Human
ugggaggcugaggcagga

SEQ ID NO: 955387 - RNA, 19 nt, Human
ugggaggcugaggcaggag

SEQ ID NO: 955388 - RNA, 20 nt, Human
uggggagggggcgaggcugg

SEQ ID NO: 955389 - RNA, 24 nt, Human
uggggagggggcgaggcuggagcc

SEQ ID NO: 955390 - RNA, 19 nt, Human
ugggguggggguugggccu

SEQ ID NO: 955391 - RNA, 23 nt, Human
uggguccccgacucugaacucag

SEQ ID NO: 955392 - RNA, 18 nt, Human
uggugggcggugggggca

SEQ ID NO: 955393 - RNA, 19 nt, Human
uggugggcggugggggcag

SEQ ID NO: 955394 - RNA, 18 nt, Human
uuagcugggcgugguggc

SEQ ID NO: 955395 - RNA, 18 nt, Human
uugcagugagccgagauc

SEQ ID NO: 955396 - RNA, 19 nt, Human
uugcagugagccgagauca

SEQ ID NO: 955397 - RNA, 20 nt, Human
uugcagugagccgagaucac

SEQ ID NO: 955398 - RNA, 19 nt, Human
uuuuuuuuuuuuuuucuaa

SEQ ID NO: 955399 - RNA, 22 nt, Human
aaaacaaaacaaaacuaaagcc

SEQ ID NO: 955400 - RNA, 19 nt, Human
aaaagaugagccugccccu

SEQ ID NO: 955401 - RNA, 23 nt, Human
aaacaaaacaaaacuaaagccag

SEQ ID NO: 955402 - RNA, 19 nt, Human
aaacagggagcagcagcgg

SEQ ID NO: 955403 - RNA, 22 nt, Human
aaaguucugggguaggggagag

SEQ ID NO: 955404 - RNA, 22 nt, Human
aacagccccacgggccuaaaac

SEQ ID NO: 955405 - RNA, 24 nt, Human
aacagcucaggcaagcuucuggug

SEQ ID NO: 955406 - RNA, 23 nt, Human
aacccacuccccuucaggccccg

SEQ ID NO: 955407 - RNA, 21 nt, Human
aagagugcuaaguacuguuac

SEQ ID NO: 955408 - RNA, 18 nt, Human
acaaaacaaaacuaaagc

SEQ ID NO: 955409 - RNA, 18 nt, Human
acaaaacuaaagccagag

SEQ ID NO: 955410 - RNA, 21 nt, Human
acaaagaaaagccacauagga

SEQ ID NO: 955411 - RNA, 21 nt, Human
acacaucuagcaccacaagag

SEQ ID NO: 955412 - RNA, 25 nt, Human
acagaacagccccacgggccuaaaa

SEQ ID NO: 955413 - RNA, 21 nt, Human
acauauacauauauauauaua

SEQ ID NO: 955414 - RNA, 19 nt, Human
acaucagggaacagaugag

SEQ ID NO: 955415 - RNA, 21 nt, Human
acccacccucccacccaccac

SEQ ID NO: 955416 - RNA, 22 nt, Human
acccacccucccacccaccacc

SEQ ID NO: 955417 - RNA, 20 nt, Human
acccugccuaaccugaaauc

SEQ ID NO: 955418 - RNA, 23 nt, Human
accugggcccuccuucacccgac

SEQ ID NO: 955419 - RNA, 22 nt, Human
acucugguccuuuguacaaagu

SEQ ID NO: 955420 - RNA, 22 nt, Human
agaacagccccacgggccuaaa

SEQ ID NO: 955421 - RNA, 25 nt, Human
agacugaaaguagaaacaggggacc

SEQ ID NO: 955422 - RNA, 22 nt, Human
agagauagacagaccaugggca

SEQ ID NO: 955423 - RNA, 19 nt, Human
agagcagaaucugaaaggu

SEQ ID NO: 955424 - RNA, 21 nt, Human
agaggaagggaaagggaagaa

SEQ ID NO: 955425 - RNA, 25 nt, Human
agaggggcucaagggggcucugggg

SEQ ID NO: 955426 - RNA, 20 nt, Human
agaugccaccuggcacaugg

SEQ ID NO: 955427 - RNA, 23 nt, Human
aggaggcagagggacauaggcag

SEQ ID NO: 955428 - RNA, 28 nt, Human
aggaggcagagggacauaggcagagggg

SEQ ID NO: 955429 - RNA, 20 nt, Human
aggcagaggggcucaagggg

SEQ ID NO: 955430 - RNA, 22 nt, Human
aggcagaggggcucaagggggc

SEQ ID NO: 955431 - RNA, 23 nt, Human
agggaagaagggccuagaccuag

SEQ ID NO: 955432 - RNA, 21 nt, Human
agggaagggggaacccugcuu

SEQ ID NO: 955433 - RNA, 23 nt, Human
agggaagggggaacccugcuugg

SEQ ID NO: 955434 - RNA, 23 nt, Human
agggacauaggcagaggggcuca

SEQ ID NO: 955435 - RNA, 19 nt, Human
aggggcagguggagggugg

SEQ ID NO: 955436 - RNA, 20 nt, Human
aggggcucaagggggcucug

SEQ ID NO: 955437 - RNA, 19 nt, Human
agguaccagggacugugac

SEQ ID NO: 955438 - RNA, 18 nt, Human
agguauuggguuccaagc

SEQ ID NO: 955439 - RNA, 19 nt, Human
aguuaccaaagacagacac

SEQ ID NO: 955440 - RNA, 21 nt, Human
aguucugggguaggggagagg

SEQ ID NO: 955441 - RNA, 22 nt, Human
auauacauauauauauauauau

SEQ ID NO: 955442 - RNA, 23 nt, Human
caaaacaaaacuaaagccagaga

SEQ ID NO: 955443 - RNA, 20 nt, Human
caaaacuaaagccagagagc

SEQ ID NO: 955444 - RNA, 22 nt, Human
caaaacuaaagccagagagccu

SEQ ID NO: 955445 - RNA, 33 nt, Human
caaaacuaaagccagagagccuccccuccccuu

SEQ ID NO: 955446 - RNA, 19 nt, Human
caaagcaggucacugggac

SEQ ID NO: 955447 - RNA, 22 nt, Human
caagggaagauugcacagggaa

SEQ ID NO: 955448 - RNA, 21 nt, Human
cacagcuagagccucuaccag

SEQ ID NO: 955449 - RNA, 22 nt, Human
cacccucccacccaccaccaag

SEQ ID NO: 955450 - RNA, 20 nt, Human
caccugguaggcguggcugg

SEQ ID NO: 955451 - RNA, 18 nt, Human
cacugcuuggaacagaac

SEQ ID NO: 955452 - RNA, 25 nt, Human
cacugcuuggaacagaacagcccca

SEQ ID NO: 955453 - RNA, 22 nt, Human
cagaacagccccacgggccuaa

SEQ ID NO: 955454 - RNA, 23 nt, Human
cagagagccuccccucccacccu

SEQ ID NO: 955455 - RNA, 19 nt, Human
cagagggacauaggcagag

SEQ ID NO: 955456 - RNA, 19 nt, Human
cagaguagccaaguggggu

SEQ ID NO: 955457 - RNA, 23 nt, Human
cagaucaaacucucaggcccaag

SEQ ID NO: 955458 - RNA, 18 nt, Human
cagcaacugggggcaugg

SEQ ID NO: 955459 - RNA, 18 nt, Human
cagcagcggcaccaggag

SEQ ID NO: 955460 - RNA, 22 nt, Human
cagccagaccuuccccagggac

SEQ ID NO: 955461 - RNA, 22 nt, Human
cagccaggacugggccugugcu

SEQ ID NO: 955462 - RNA, 25 nt, Human
cagccuuggggaagacaaagaaaag

SEQ ID NO: 955463 - RNA, 18 nt, Human
cagcuagagccucuacca

SEQ ID NO: 955464 - RNA, 20 nt, Human
cagcucaggcaagcuucugg

SEQ ID NO: 955465 - RNA, 18 nt, Human
cagcugagugccaagagc

SEQ ID NO: 955466 - RNA, 21 nt, Human
caggaagagaauuuccagagg

SEQ ID NO: 955467 - RNA, 19 nt, Human
cagggaccaaucauuacug

SEQ ID NO: 955468 - RNA, 21 nt, Human
cagggguaaggcccagcuccc

SEQ ID NO: 955469 - RNA, 19 nt, Human
cagguggagggugggggug

SEQ ID NO: 955470 - RNA, 20 nt, Human
cauauacauauauauauaua

SEQ ID NO: 955471 - RNA, 24 nt, Human
cauauacauauauauauauauaua

SEQ ID NO: 955472 - RNA, 20 nt, Human
caucagggaacagaugaggg

SEQ ID NO: 955473 - RNA, 22 nt, Human
ccaaagacagacacauuggcuc

SEQ ID NO: 955474 - RNA, 21 nt, Human
ccacaagagaccuccacugca

SEQ ID NO: 955475 - RNA, 21 nt, Human
ccagagagccuccccucccac

SEQ ID NO: 955476 - RNA, 22 nt, Human
ccagagagccuccccucccacc

SEQ ID NO: 955477 - RNA, 23 nt, Human
ccaggccagaguagccaaguggg

SEQ ID NO: 955478 - RNA, 19 nt, Human
cccaagcagacucauccuu

SEQ ID NO: 955479 - RNA, 22 nt, Human
cccacagcugagugccaagagc

SEQ ID NO: 955480 - RNA, 24 nt, Human
cccaccaccaagagugcuaaguac

SEQ ID NO: 955481 - RNA, 21 nt, Human
cccacccucccacccaccacc

SEQ ID NO: 955482 - RNA, 21 nt, Human
cccacccugccuaaccugaaa

SEQ ID NO: 955483 - RNA, 21 nt, Human
cccagcugugugccccuccua

SEQ ID NO: 955484 - RNA, 18 nt, Human
ccccacgggccuaaaacc

SEQ ID NO: 955485 - RNA, 22 nt, Human
ccccagaacugaccugggcccu

SEQ ID NO: 955486 - RNA, 19 nt, Human
ccccagcugugugccccuc

SEQ ID NO: 955487 - RNA, 21 nt, Human
ccccaucagcuuccuugaacu

SEQ ID NO: 955488 - RNA, 23 nt, Human
ccccugggggucagguacccagg

SEQ ID NO: 955489 - RNA, 24 nt, Human
ccccugggggucagguacccaggu

SEQ ID NO: 955490 - RNA, 22 nt, Human
cccucccacccaccaccaagag

SEQ ID NO: 955491 - RNA, 19 nt, Human
cccugccugccuucuccuc

SEQ ID NO: 955492 - RNA, 22 nt, Human
cccuggccuguacccacccucc

SEQ ID NO: 955493 - RNA, 22 nt, Human
cccuucaggccccgcacacagc

SEQ ID NO: 955494 - RNA, 19 nt, Human
ccgcacgggacagcuccac

SEQ ID NO: 955495 - RNA, 25 nt, Human
ccuaaaaccacucuccugaaagugg

SEQ ID NO: 955496 - RNA, 19 nt, Human
ccucucacugggcccugcc

SEQ ID NO: 955497 - RNA, 19 nt, Human
ccugccuaaccugaaaucc

SEQ ID NO: 955498 - RNA, 19 nt, Human
ccugccuucuccucugacc

SEQ ID NO: 955499 - RNA, 24 nt, Human
ccugccuucuccucugaccuuccc

SEQ ID NO: 955500 - RNA, 22 nt, Human
ccuggccuguacccacccuccc

SEQ ID NO: 955501 - RNA, 22 nt, Human
ccugggccagggucagaggggc

SEQ ID NO: 955502 - RNA, 22 nt, Human
ccuguacccacccucccaccca

SEQ ID NO: 955503 - RNA, 18 nt, Human
ccuguaggcagaagggag

SEQ ID NO: 955504 - RNA, 21 nt, Human
ccugucccaauggccccagcc

SEQ ID NO: 955505 - RNA, 27 nt, Human
ccugugaccaagagcaagccggggucc

SEQ ID NO: 955506 - RNA, 23 nt, Human
ccuucacccgaccccaggccaga

SEQ ID NO: 955507 - RNA, 22 nt, Human
cgaccccaggccagaccuuccu

SEQ ID NO: 955508 - RNA, 19 nt, Human
cuaaagccagagagccucc

SEQ ID NO: 955509 - RNA, 18 nt, Human
cuagagccucuaccagcc

SEQ ID NO: 955510 - RNA, 24 nt, Human
cuccgugccuagcccucugagccc

SEQ ID NO: 955511 - RNA, 25 nt, Human
cucucacugggcccugccugccuuc

SEQ ID NO: 955512 - RNA, 19 nt, Human
cucugcacccccagcugug

SEQ ID NO: 955513 - RNA, 19 nt, Human
cugaaaggugggggcuggg

SEQ ID NO: 955514 - RNA, 18 nt, Human
cugaaaucccauucaggc

SEQ ID NO: 955515 - RNA, 23 nt, Human
cugaagccaggccagaguagcca

SEQ ID NO: 955516 - RNA, 20 nt, Human
cugagcccuguccuaccaga

SEQ ID NO: 955517 - RNA, 18 nt, Human
cugcccagcaugucccag

SEQ ID NO: 955518 - RNA, 24 nt, Human
cuggccccgugaggggucccuggg

SEQ ID NO: 955519 - RNA, 24 nt, Human
cugguccuuuguacaaaguaggac

SEQ ID NO: 955520 - RNA, 21 nt, Human
cugugugccccuccuacauca

SEQ ID NO: 955521 - RNA, 23 nt, Human
cugugugccccuccuacaucagg

SEQ ID NO: 955522 - RNA, 21 nt, Human
cuucccaggaagacugaaagu

SEQ ID NO: 955523 - RNA, 22 nt, Human
cuuccuacaaagaugaaugugu

SEQ ID NO: 955524 - RNA, 18 nt, Human
cuugggcccugaguucaa

SEQ ID NO: 955525 - RNA, 21 nt, Human
cuuucugcuaugccuccccug

SEQ ID NO: 955526 - RNA, 21 nt, Human
gaacagcuacugcuuccagga

SEQ ID NO: 955527 - RNA, 21 nt, Human
gaacauccagcuccagaaaca

SEQ ID NO: 955528 - RNA, 22 nt, Human
gaagacaaagaaaagccacaua

SEQ ID NO: 955529 - RNA, 20 nt, Human
gaaggagaaaagggaagggg

SEQ ID NO: 955530 - RNA, 18 nt, Human
gacacauuggcucaggca

SEQ ID NO: 955531 - RNA, 25 nt, Human
gagcaagggaauaucccuggccugu

SEQ ID NO: 955532 - RNA, 20 nt, Human
gagcagaaucugaaaggugg

SEQ ID NO: 955533 - RNA, 21 nt, Human
gagcagcagcggcaccaggag

SEQ ID NO: 955534 - RNA, 18 nt, Human
gaggaggcugaaggaggc

SEQ ID NO: 955535 - RNA, 21 nt, Human
gaggcagagggacauaggcag

SEQ ID NO: 955536 - RNA, 20 nt, Human
gaggggcagguggagggugg

SEQ ID NO: 955537 - RNA, 23 nt, Human
gaucaaacucucaggcccaagca

SEQ ID NO: 955538 - RNA, 23 nt, Human
gcaaagcaggucacugggacccc

SEQ ID NO: 955539 - RNA, 18 nt, Human
gccuagcccucugagccc

SEQ ID NO: 955540 - RNA, 19 nt, Human
gcuaggcagggagcuggau

SEQ ID NO: 955541 - RNA, 19 nt, Human
ggaaaugggcagaugcucu

SEQ ID NO: 955542 - RNA, 19 nt, Human
ggaaggagaaaagggaagg

SEQ ID NO: 955543 - RNA, 21 nt, Human
ggaaggagaaaagggaagggg

SEQ ID NO: 955544 - RNA, 26 nt, Human
ggagaugcagcaucccagggccugaa

SEQ ID NO: 955545 - RNA, 23 nt, Human
ggaggaggaggcugaaggaggcg

SEQ ID NO: 955546 - RNA, 20 nt, Human
ggagggugggggugggggcu

SEQ ID NO: 955547 - RNA, 26 nt, Human
ggcaggggagagaaaagaugagcccc

SEQ ID NO: 955548 - RNA, 19 nt, Human
ggcagguggaggguggggg

SEQ ID NO: 955549 - RNA, 21 nt, Human
ggcucuggggagagaaggagg

SEQ ID NO: 955550 - RNA, 23 nt, Human
gggaaggagaaaagggaaggggg

SEQ ID NO: 955551 - RNA, 18 nt, Human
gggcagguggaggguggg

SEQ ID NO: 955552 - RNA, 22 nt, Human
gggcugguuuagcucuaaacac

SEQ ID NO: 955553 - RNA, 23 nt, Human
gggguaaggcccagcuccccauc

SEQ ID NO: 955554 - RNA, 19 nt, Human
gggguaggggagaggaagg

SEQ ID NO: 955555 - RNA, 20 nt, Human
ggggugggggcugguuuagc

SEQ ID NO: 955556 - RNA, 24 nt, Human
gguacagacauauacauauauaua

SEQ ID NO: 955557 - RNA, 18 nt, Human
gguaggggagaggaaggg

SEQ ID NO: 955558 - RNA, 21 nt, Human
guggagggugggggugggggc

SEQ ID NO: 955559 - RNA, 23 nt, Human
uaaacacacaucuagcaccacaa

SEQ ID NO: 955560 - RNA, 19 nt, Human
uaccagccauguucucaca

SEQ ID NO: 955561 - RNA, 23 nt, Human
uacccacccucccacccaccacc

SEQ ID NO: 955562 - RNA, 18 nt, Human
uacccaggugggcucugc

SEQ ID NO: 955563 - RNA, 20 nt, Human
uaccuaaaugccucacugug

SEQ ID NO: 955564 - RNA, 24 nt, Human
uagauuuggggaucugggcucagu

SEQ ID NO: 955565 - RNA, 19 nt, Human
uauacauauauauauauau

SEQ ID NO: 955566 - RNA, 22 nt, Human
uauacauauauauauauauaua

SEQ ID NO: 955567 - RNA, 20 nt, Human
ucacccgaccccaggccaga

SEQ ID NO: 955568 - RNA, 22 nt, Human
ucaccgagagauaccuaaaugc

SEQ ID NO: 955569 - RNA, 24 nt, Human
ucacugggaccccagaacugaccu

SEQ ID NO: 955570 - RNA, 21 nt, Human
ucaggcuauugugcuugcagc

SEQ ID NO: 955571 - RNA, 21 nt, Human
ucagggaaggcaguaaggcag

SEQ ID NO: 955572 - RNA, 26 nt, Human
ucagguacccaggugggcucugcacc

SEQ ID NO: 955573 - RNA, 20 nt, Human
ucauaacccuaggaaggggc

SEQ ID NO: 955574 - RNA, 21 nt, Human
uccaagcugaagccaggccag

SEQ ID NO: 955575 - RNA, 18 nt, Human
ucccacccaccaccaaga

SEQ ID NO: 955576 - RNA, 21 nt, Human
ucccacccugccuaaccugaa

SEQ ID NO: 955577 - RNA, 20 nt, Human
ucccagggccugaacaagcu

SEQ ID NO: 955578 - RNA, 20 nt, Human
ucccugggccagggucagag

SEQ ID NO: 955579 - RNA, 18 nt, Human
ucucaggcccaagcagac

SEQ ID NO: 955580 - RNA, 20 nt, Human
ucugcuccagcugugccuuu

SEQ ID NO: 955581 - RNA, 21 nt, Human
ucuuugggcgagaacccacuc

SEQ ID NO: 955582 - RNA, 18 nt, Human
ugaccaagagcaagccag

SEQ ID NO: 955583 - RNA, 26 nt, Human
ugagcccccugucccaauggccccag

SEQ ID NO: 955584 - RNA, 24 nt, Human
ugagggaggaggaggcugaaggag

SEQ ID NO: 955585 - RNA, 22 nt, Human
ugcacccccagcugugugcccc

SEQ ID NO: 955586 - RNA, 26 nt, Human
ugccuaaccugaaaucccauucaggc

SEQ ID NO: 955587 - RNA, 23 nt, Human
ugccucacugugcuggagccagc

SEQ ID NO: 955588 - RNA, 24 nt, Human
ugcucccaagagagaaaaugggag

SEQ ID NO: 955589 - RNA, 19 nt, Human
uggaaaacaaaacaaaacu

SEQ ID NO: 955590 - RNA, 26 nt, Human
uggaaaacaaaacaaaacuaaagcca

SEQ ID NO: 955591 - RNA, 20 nt, Human
uggaacagaacagccccacg

SEQ ID NO: 955592 - RNA, 18 nt, Human
uggagggugggggugggg

SEQ ID NO: 955593 - RNA, 19 nt, Human
uggaggguggggguggggg

SEQ ID NO: 955594 - RNA, 21 nt, Human
uggagggugggggugggggcu

SEQ ID NO: 955595 - RNA, 19 nt, Human
uggauuuuuguccaaacag

SEQ ID NO: 955596 - RNA, 18 nt, Human
uggccccgugaggggucc

SEQ ID NO: 955597 - RNA, 23 nt, Human
ugggacacucagccuuggggaag

SEQ ID NO: 955598 - RNA, 21 nt, Human
ugggaccccagaacugaccug

SEQ ID NO: 955599 - RNA, 22 nt, Human
ugggcccugaguucaagugccc

SEQ ID NO: 955600 - RNA, 23 nt, Human
uggggaacauccagcuccagaaa

SEQ ID NO: 955601 - RNA, 21 nt, Human
ugggggucagguacccaggug

SEQ ID NO: 955602 - RNA, 19 nt, Human
ugggguaggggagaggaag

SEQ ID NO: 955603 - RNA, 18 nt, Human
ugugaccauugcucccaa

SEQ ID NO: 955604 - RNA, 19 nt, Human
ugugcccaaaccuaaagga

SEQ ID NO: 955605 - RNA, 22 nt, Human
ugugugccccuccuacaucagg

SEQ ID NO: 955606 - RNA, 22 nt, Human
uucugggguaggggagaggaag

SEQ ID NO: 955607 - RNA, 21 nt, Human
uugccuggagaugcagcaucc

SEQ ID NO: 955608 - RNA, 18 nt, Human
uuggggaucugggcucag

SEQ ID NO: 955609 - RNA, 23 nt, Human
uuucacagggccaaauguucccc

SEQ ID NO: 955610 - RNA, 22 nt, Human
uuuggaaaacaaaacaaaacua

SEQ ID NO: 955611 - RNA, 22 nt, Human
uuugggcgagaacccacucccc

SEQ ID NO: 955612 - RNA, 25 nt, Human
uuuuuuuuuuuuuuuuucacagggg

SEQ ID NO: 955613 - RNA, 22 nt, Human
aagcgccugcggcagccggaag

SEQ ID NO: 955614 - RNA, 20 nt, Human
accugcaccagcgaagcgcc

SEQ ID NO: 955615 - RNA, 20 nt, Human
aggcucaggcccccgggccc

SEQ ID NO: 955616 - RNA, 26 nt, Human
cacugcgucugcaccagcgaagcgcc

SEQ ID NO: 955617 - RNA, 18 nt, Human
cagcacugcgucugcacc

SEQ ID NO: 955618 - RNA, 21 nt, Human
caggcucaggcccccgggccc

SEQ ID NO: 955619 - RNA, 19 nt, Human
ccaguccgcacagagcgcc

SEQ ID NO: 955620 - RNA, 19 nt, Human
cccccgggcccgaucaugg

SEQ ID NO: 955621 - RNA, 21 nt, Human
ccccgggcccgaucauggccc

SEQ ID NO: 955622 - RNA, 22 nt, Human
cccggcccuggccgcccgcagc

SEQ ID NO: 955623 - RNA, 26 nt, Human
cgccugcggcagccggaagcgaaagu

SEQ ID NO: 955624 - RNA, 25 nt, Human
cgggguggggucccaggcucaggcc

SEQ ID NO: 955625 - RNA, 18 nt, Human
gagcucgcgucacccuug

SEQ ID NO: 955626 - RNA, 18 nt, Human
gccgcccgcagcuccacc

SEQ ID NO: 955627 - RNA, 21 nt, Human
gcgaagcgccugcggcagccg

SEQ ID NO: 955628 - RNA, 21 nt, Human
gcggggguggggugagcaggg

SEQ ID NO: 955629 - RNA, 19 nt, Human
gucccaggcucaggccccc

SEQ ID NO: 955630 - RNA, 20 nt, Human
gucccaggcucaggcccccg

SEQ ID NO: 955631 - RNA, 23 nt, Human
ucccaggcucaggcccccgggcc

SEQ ID NO: 955632 - RNA, 22 nt, Human
uccgcacagagcgcccggcccu

SEQ ID NO: 955633 - RNA, 22 nt, Human
uggggucccaggcucaggcccc

SEQ ID NO: 955634 - RNA, 24 nt, Human
uuuuuggcgcugccaaaacucauu

SEQ ID NO: 955635 - RNA, 18 nt, Human
uuuuuuuuuuuuuuuuug

SEQ ID NO: 955636 - RNA, 18 nt, Human
uuuuuuuuuuuuuuuuug

SEQ ID NO: 955637 - RNA, 23 nt, Human
uuuuuuuuuuuuuuuuuggcgcu

SEQ ID NO: 955638 - RNA, 24 nt, Human
uuuuuuuuuuuuuuuuuggcgcug

SEQ ID NO: 955639 - RNA, 22 nt, Human
uuuuuuuuuuuuuuuuuuuggc

SEQ ID NO: 955640 - RNA, 28 nt, Human
uuuuuuuuuuuuuuuuuuuuuuuggggg

SEQ ID NO: 955641 - RNA, 27 nt, Human
aaaaaaaaaaaaggcauucuuacccag

SEQ ID NO: 955642 - RNA, 20 nt, Human
aaaaaaaaaaaauuaaacuc

SEQ ID NO: 955643 - RNA, 22 nt, Human
aaaaaaaaaaauuaaacucuuc

SEQ ID NO: 955644 - RNA, 23 nt, Human
aaaaaaaaaagaaaaaaacaaag

SEQ ID NO: 955645 - RNA, 22 nt, Human
aaaaaaaagaaaaaaacaaaga

SEQ ID NO: 955646 - RNA, 24 nt, Human
aaaaaaacaaagacuacacauugg

SEQ ID NO: 955647 - RNA, 18 nt, Human
aaaagaaaaaaacaaaga

SEQ ID NO: 955648 - RNA, 20 nt, Human
aaaauccagcgugaccucau

SEQ ID NO: 955649 - RNA, 20 nt, Human
aaaauccagcgugaccucau

SEQ ID NO: 955650 - RNA, 20 nt, Human
aaaauccagcgugaccucau

SEQ ID NO: 955651 - RNA, 20 nt, Human
aaaauccagcgugaccucau

SEQ ID NO: 955652 - RNA, 19 nt, Human
aacagagccaggacaauaa

SEQ ID NO: 955653 - RNA, 19 nt, Human
aacauuucuuuuuuuuuuu

SEQ ID NO: 955654 - RNA, 21 nt, Human
aaccucuucaucaccucacug

SEQ ID NO: 955655 - RNA, 23 nt, Human
aacuugaaaaaggucuggaguag

SEQ ID NO: 955656 - RNA, 18 nt, Human
aagaagagagccuuccug

SEQ ID NO: 955657 - RNA, 21 nt, Human
aagaagcccgagcccaggucc

SEQ ID NO: 955658 - RNA, 22 nt, Human
aagaagcccgagcccagguccc

SEQ ID NO: 955659 - RNA, 26 nt, Human
aagaagcccgagcccaggucccaaac

SEQ ID NO: 955660 - RNA, 19 nt, Human
aagcugagagaauacggac

SEQ ID NO: 955661 - RNA, 24 nt, Human
aaggccuggggaccaagccuccag

SEQ ID NO: 955662 - RNA, 22 nt, Human
aaguagagaugaaauuaacuca

SEQ ID NO: 955663 - RNA, 22 nt, Human
aagucacagcagucagaaucuu

SEQ ID NO: 955664 - RNA, 18 nt, Human
aaguggucuuugugagcc

SEQ ID NO: 955665 - RNA, 24 nt, Human
aaucacuugaacccgggaggcaga

SEQ ID NO: 955666 - RNA, 23 nt, Human
aaugcaguggcaugaucacagcu

SEQ ID NO: 955667 - RNA, 23 nt, Human
acaauaucaaaaaaaagcagcaa

SEQ ID NO: 955668 - RNA, 22 nt, Human
acagaacagccuuuccuccccc

SEQ ID NO: 955669 - RNA, 24 nt, Human
acagcagucuaucaaauuuggguu

SEQ ID NO: 955670 - RNA, 18 nt, Human
acagcucacugcggccuc

SEQ ID NO: 955671 - RNA, 21 nt, Human
acauagggaaaaagaaaaaaa

SEQ ID NO: 955672 - RNA, 24 nt, Human
accacuccacuccagccuggguga

SEQ ID NO: 955673 - RNA, 18 nt, Human
accccaucuggcugggga

SEQ ID NO: 955674 - RNA, 20 nt, Human
accuccacuuaccuuggcau

SEQ ID NO: 955675 - RNA, 18 nt, Human
acuccacuccagccuggg

SEQ ID NO: 955676 - RNA, 24 nt, Human
acuccacuccagccugggugauag

SEQ ID NO: 955677 - RNA, 18 nt, Human
acuccagccugggugaua

SEQ ID NO: 955678 - RNA, 24 nt, Human
acuccugggcucaagugauucucc

SEQ ID NO: 955679 - RNA, 24 nt, Human
acucugucgcccaggcucaaaaaa

SEQ ID NO: 955680 - RNA, 25 nt, Human
acucugucgcccaggcuggaaugca

SEQ ID NO: 955681 - RNA, 25 nt, Human
acucugucgcccaggcuggagugca

SEQ ID NO: 955682 - RNA, 24 nt, Human
agaacuuuuccaugcaaccaaaca

SEQ ID NO: 955683 - RNA, 22 nt, Human
agaaucacuugaacccgggagg

SEQ ID NO: 955684 - RNA, 21 nt, Human
agagagccuuccugucccagc

SEQ ID NO: 955685 - RNA, 19 nt, Human
agaggagcuugaagcugag

SEQ ID NO: 955686 - RNA, 20 nt, Human
agaggagcuugaagcugaga

SEQ ID NO: 955687 - RNA, 24 nt, Human
agauauuuuacuuuagcucgugcu

SEQ ID NO: 955688 - RNA, 20 nt, Human
agauguugcagugagucaag

SEQ ID NO: 955689 - RNA, 22 nt, Human
agcaaacuaggcuuuaccuucu

SEQ ID NO: 955690 - RNA, 20 nt, Human
agcagagcaagagccucaaa

SEQ ID NO: 955691 - RNA, 24 nt, Human
agcccagcaggcuugaggugaaga

SEQ ID NO: 955692 - RNA, 21 nt, Human
agccgaaucaccaggugucac

SEQ ID NO: 955693 - RNA, 24 nt, Human
agccugggugauagaaugagacuc

SEQ ID NO: 955694 - RNA, 19 nt, Human
aggaauucccagagccaca

SEQ ID NO: 955695 - RNA, 19 nt, Human
aggaauucccagagccaca

SEQ ID NO: 955696 - RNA, 21 nt, Human
aggagucaagggcuagugacc

SEQ ID NO: 955697 - RNA, 24 nt, Human
aggcagauguugcagugagucaag

SEQ ID NO: 955698 - RNA, 23 nt, Human
aggcaggaagggagacuccuugg

SEQ ID NO: 955699 - RNA, 18 nt, Human
aggcaggagaaucacuug

SEQ ID NO: 955700 - RNA, 24 nt, Human
aggcaggagaaucacuugaacccg

SEQ ID NO: 955701 - RNA, 20 nt, Human
aggccucugagaauucccag

SEQ ID NO: 955702 - RNA, 24 nt, Human
aggcugaggcaggagaaucacuug

SEQ ID NO: 955703 - RNA, 25 nt, Human
aggcuggagugcaguggcacaaucu

SEQ ID NO: 955704 - RNA, 19 nt, Human
agggaggcauuagaguaca

SEQ ID NO: 955705 - RNA, 21 nt, Human
agguccauugugggggagagu

SEQ ID NO: 955706 - RNA, 21 nt, Human
aggucccaaacacggcuauuc

SEQ ID NO: 955707 - RNA, 18 nt, Human
agguguuagaaagugccc

SEQ ID NO: 955708 - RNA, 19 nt, Human
aguagcugggacuacaggc

SEQ ID NO: 955709 - RNA, 19 nt, Human
aguagcugggacuacaggc

SEQ ID NO: 955710 - RNA, 23 nt, Human
agugauucuccugccccagccuc

SEQ ID NO: 955711 - RNA, 21 nt, Human
agugcaguggcacaaucucag

SEQ ID NO: 955712 - RNA, 23 nt, Human
aguggucuuugugagccacccug

SEQ ID NO: 955713 - RNA, 22 nt, Human
auagaaugagacucagucucaa

SEQ ID NO: 955714 - RNA, 24 nt, Human
auagaaugagacucagucucaaaa

SEQ ID NO: 955715 - RNA, 24 nt, Human
aucauaccacuccacuccagccug

SEQ ID NO: 955716 - RNA, 18 nt, Human
aucuggcaaaauauaaga

SEQ ID NO: 955717 - RNA, 22 nt, Human
aucuuagaacuuccacuuagga

SEQ ID NO: 955718 - RNA, 24 nt, Human
augccuccuaggagauauacacag

SEQ ID NO: 955719 - RNA, 22 nt, Human
auuggguuucauuauugacaau

SEQ ID NO: 955720 - RNA, 18 nt, Human
caaagcucuucacuuuuc

SEQ ID NO: 955721 - RNA, 28 nt, Human
caacuccugggcucaagugauucuccuu

SEQ ID NO: 955722 - RNA, 20 nt, Human
caagugauucuccugcccca

SEQ ID NO: 955723 - RNA, 23 nt, Human
cacagaacagccuuuccuccccc

SEQ ID NO: 955724 - RNA, 23 nt, Human
cacagcagucagaaucuucuguu

SEQ ID NO: 955725 - RNA, 22 nt, Human
caccccugcucuucucugcagg

SEQ ID NO: 955726 - RNA, 22 nt, Human
caccccugcucuucucugcagg

SEQ ID NO: 955727 - RNA, 22 nt, Human
caccccugcucuucucugcagg

SEQ ID NO: 955728 - RNA, 20 nt, Human
caccugcacuggacguuuuc

SEQ ID NO: 955729 - RNA, 22 nt, Human
cacuccacuccagccuggguga

SEQ ID NO: 955730 - RNA, 18 nt, Human
cacuccagccugggugau

SEQ ID NO: 955731 - RNA, 22 nt, Human
cacuccagccugggugauagaa

SEQ ID NO: 955732 - RNA, 24 nt, Human
cacuccagccugggugauagaaug

SEQ ID NO: 955733 - RNA, 23 nt, Human
cacuccugccaccuucucauccu

SEQ ID NO: 955734 - RNA, 18 nt, Human
cacucuaaagcucaaacc

SEQ ID NO: 955735 - RNA, 18 nt, Human
cacucugucgcccaggcu

SEQ ID NO: 955736 - RNA, 19 nt, Human
cacucugucgcccaggcuc

SEQ ID NO: 955737 - RNA, 24 nt, Human
cacucugucgcccaggcuggaaug

SEQ ID NO: 955738 - RNA, 24 nt, Human
cacucugucgcccaggcuggagug

SEQ ID NO: 955739 - RNA, 23 nt, Human
cacugagcagucuuucacacucu

SEQ ID NO: 955740 - RNA, 23 nt, Human
cacugagcagucuuucacacucu

SEQ ID NO: 955741 - RNA, 23 nt, Human
cacugagcagucuuucacacucu

SEQ ID NO: 955742 - RNA, 23 nt, Human
cacugagcagucuuucacacucu

SEQ ID NO: 955743 - RNA, 22 nt, Human
cagaaaaacagcagucuaucaa

SEQ ID NO: 955744 - RNA, 21 nt, Human
cagaaaucaccacugaagaac

SEQ ID NO: 955745 - RNA, 21 nt, Human
cagaacagccuuuccuccccc

SEQ ID NO: 955746 - RNA, 21 nt, Human
cagagccaggacaauaaucac

SEQ ID NO: 955747 - RNA, 21 nt, Human
cagcaaucuuuaagaguucaa

SEQ ID NO: 955748 - RNA, 20 nt, Human
cagcauugugaccccaucug

SEQ ID NO: 955749 - RNA, 24 nt, Human
cagcgacucaggaggcugaggcag

SEQ ID NO: 955750 - RNA, 24 nt, Human
caggaggcugaggcaggagaauca

SEQ ID NO: 955751 - RNA, 22 nt, Human
cagggcugggggaagaaaaggg

SEQ ID NO: 955752 - RNA, 21 nt, Human
cagguucuggaucccuccaug

SEQ ID NO: 955753 - RNA, 21 nt, Human
cagguucuggaucccuccaug

SEQ ID NO: 955754 - RNA, 21 nt, Human
cagguucuggaucccuccaug

SEQ ID NO: 955755 - RNA, 21 nt, Human
cagguucuggaucccuccaug

SEQ ID NO: 955756 - RNA, 21 nt, Human
cagguucuggaucccuccaug

SEQ ID NO: 955757 - RNA, 23 nt, Human
caucuuagaacuuccacuuagga

SEQ ID NO: 955758 - RNA, 22 nt, Human
ccaaagaaggccuccuaccacc

SEQ ID NO: 955759 - RNA, 20 nt, Human
ccacuccacuccagccuggg

SEQ ID NO: 955760 - RNA, 21 nt, Human
ccacuccacuccagccugggu

SEQ ID NO: 955761 - RNA, 21 nt, Human
ccacuccacuccagccugggu

SEQ ID NO: 955762 - RNA, 23 nt, Human
ccacuccacuccagccuggguga

SEQ ID NO: 955763 - RNA, 24 nt, Human
ccacuccacuccagccugggugau

SEQ ID NO: 955764 - RNA, 18 nt, Human
ccagacccaaauuaguca

SEQ ID NO: 955765 - RNA, 18 nt, Human
ccagagccacaucaggca

SEQ ID NO: 955766 - RNA, 18 nt, Human
ccagagccacaucaggca

SEQ ID NO: 955767 - RNA, 18 nt, Human
ccagagccacaucaggca

SEQ ID NO: 955768 - RNA, 24 nt, Human
ccagagccacaucaggcagggcug

SEQ ID NO: 955769 - RNA, 23 nt, Human
cccaaagaaggccuccuaccacc

SEQ ID NO: 955770 - RNA, 24 nt, Human
cccacaggacugcgucgcucccac

SEQ ID NO: 955771 - RNA, 24 nt, Human
cccagcaggcuugaggugaagaag

SEQ ID NO: 955772 - RNA, 24 nt, Human
cccagcgacucaggaggcugaggc

SEQ ID NO: 955773 - RNA, 24 nt, Human
cccaggcucaaaaaaaaaaaaaaa

SEQ ID NO: 955774 - RNA, 25 nt, Human
cccaggcucaaaaaaaaaaaaaaaa

SEQ ID NO: 955775 - RNA, 23 nt, Human
cccaggcuggaaugcaguggcau

SEQ ID NO: 955776 - RNA, 25 nt, Human
ccccaaacacuacugaaauaaaagu

SEQ ID NO: 955777 - RNA, 24 nt, Human
cccgaguagcugggacuacaggcu

SEQ ID NO: 955778 - RNA, 24 nt, Human
ccuccacuauuucauuaccauccc

SEQ ID NO: 955779 - RNA, 20 nt, Human
ccuccaggauuccucuugag

SEQ ID NO: 955780 - RNA, 23 nt, Human
ccuccaggauuccucuugagacu

SEQ ID NO: 955781 - RNA, 18 nt, Human
ccuccagggccugccacu

SEQ ID NO: 955782 - RNA, 23 nt, Human
ccuccagggccugccacuccagc

SEQ ID NO: 955783 - RNA, 20 nt, Human
ccuccugggagcugcucacu

SEQ ID NO: 955784 - RNA, 20 nt, Human
ccuccugggagcugcucacu

SEQ ID NO: 955785 - RNA, 20 nt, Human
ccuccugggagcugcucacu

SEQ ID NO: 955786 - RNA, 18 nt, Human
ccucugagaauucccaga

SEQ ID NO: 955787 - RNA, 19 nt, Human
ccucuucaucaccucacug

SEQ ID NO: 955788 - RNA, 23 nt, Human
ccugccccagccucccgaguagc

SEQ ID NO: 955789 - RNA, 24 nt, Human
ccugccccagccucccgaguagcu

SEQ ID NO: 955790 - RNA, 20 nt, Human
ccuggccaccccugcucuuc

SEQ ID NO: 955791 - RNA, 20 nt, Human
ccuggccaccccugcucuuc

SEQ ID NO: 955792 - RNA, 23 nt, Human
ccugggcucaagugauucuccuc

SEQ ID NO: 955793 - RNA, 23 nt, Human
ccugggcucaagugauucuccug

SEQ ID NO: 955794 - RNA, 22 nt, Human
ccugggugauagaaugagacuc

SEQ ID NO: 955795 - RNA, 21 nt, Human
ccuguaagcaaucacagauuc

SEQ ID NO: 955796 - RNA, 23 nt, Human
ccuuccugucccagcccuguugc

SEQ ID NO: 955797 - RNA, 22 nt, Human
ccuugaugcucuucaacagaga

SEQ ID NO: 955798 - RNA, 21 nt, Human
cgacucaggaggcugaggcag

SEQ ID NO: 955799 - RNA, 18 nt, Human
cgcaagaagcccgagccc

SEQ ID NO: 955800 - RNA, 24 nt, Human
cgccacgaugcccggcuuauaggg

SEQ ID NO: 955801 - RNA, 21 nt, Human
cggaguuuuucguggauccag

SEQ ID NO: 955802 - RNA, 24 nt, Human
cgggaggcagauguugcagugagu

SEQ ID NO: 955803 - RNA, 18 nt, Human
cucaaaaaaaaaaaaaaa

SEQ ID NO: 955804 - RNA, 23 nt, Human
cucaaaaaaaaaaaaaaagaaaa

SEQ ID NO: 955805 - RNA, 24 nt, Human
cucaaaaaaaaaaaaaaagaaaaa

SEQ ID NO: 955806 - RNA, 24 nt, Human
cucaagugauucuccugccccagc

SEQ ID NO: 955807 - RNA, 22 nt, Human
cucacuaucuccuggccacccc

SEQ ID NO: 955808 - RNA, 22 nt, Human
cucacuaucuccuggccacccc

SEQ ID NO: 955809 - RNA, 24 nt, Human
cucacucugucgcccaggcuggag

SEQ ID NO: 955810 - RNA, 21 nt, Human
cucacugcggccuccaacucc

SEQ ID NO: 955811 - RNA, 24 nt, Human
cucacugcggccuccaacuccugg

SEQ ID NO: 955812 - RNA, 24 nt, Human
cucagucucaaaaaaaaaaaaaaa

SEQ ID NO: 955813 - RNA, 19 nt, Human
cuccagggccugccacucc

SEQ ID NO: 955814 - RNA, 19 nt, Human
cuccugggagcugcucacu

SEQ ID NO: 955815 - RNA, 19 nt, Human
cuccugggagcugcucacu

SEQ ID NO: 955816 - RNA, 19 nt, Human
cuccugggagcugcucacu

SEQ ID NO: 955817 - RNA, 20 nt, Human
cuccugggcucaagugauuc

SEQ ID NO: 955818 - RNA, 21 nt, Human
cuccugggcucaagugauucu

SEQ ID NO: 955819 - RNA, 23 nt, Human
cuccugggcucaagugauucucc

SEQ ID NO: 955820 - RNA, 19 nt, Human
cugaaggcaggaagggaga

SEQ ID NO: 955821 - RNA, 23 nt, Human
cugagcagucuuucacacucucu

SEQ ID NO: 955822 - RNA, 23 nt, Human
cugagcagucuuucacacucucu

SEQ ID NO: 955823 - RNA, 23 nt, Human
cugagcagucuuucacacucucu

SEQ ID NO: 955824 - RNA, 23 nt, Human
cugagcagucuuucacacucucu

SEQ ID NO: 955825 - RNA, 18 nt, Human
cugcugaguuauuucuag

SEQ ID NO: 955826 - RNA, 20 nt, Human
cugcugaguuauuucuaggu

SEQ ID NO: 955827 - RNA, 20 nt, Human
cugcugaguuauuucuaggu

SEQ ID NO: 955828 - RNA, 20 nt, Human
cugcugaguuauuucuaggu

SEQ ID NO: 955829 - RNA, 20 nt, Human
cugcugaguuauuucuaggu

SEQ ID NO: 955830 - RNA, 20 nt, Human
cugcugaguuauuucuaggu

SEQ ID NO: 955831 - RNA, 19 nt, Human
cuggccaccccugcucuuc

SEQ ID NO: 955832 - RNA, 19 nt, Human
cuggccaccccugcucuuc

SEQ ID NO: 955833 - RNA, 25 nt, Human
cuggugggguggcaguuccggaagu

SEQ ID NO: 955834 - RNA, 25 nt, Human
cuguggagucacuggugggguggca

SEQ ID NO: 955835 - RNA, 23 nt, Human
cuuccugucccagcccuguugca

SEQ ID NO: 955836 - RNA, 18 nt, Human
gaaaaaaaaaaaaaggca

SEQ ID NO: 955837 - RNA, 24 nt, Human
gaaacaaaugacuggaucuuuaac

SEQ ID NO: 955838 - RNA, 22 nt, Human
gaaauucuagagucagagacau

SEQ ID NO: 955839 - RNA, 18 nt, Human
gaacccgggaggcagaug

SEQ ID NO: 955840 - RNA, 22 nt, Human
gaagaaaagggaggcauuagag

SEQ ID NO: 955841 - RNA, 22 nt, Human
gaagguuggugaaaaaccaaaa

SEQ ID NO: 955842 - RNA, 20 nt, Human
gacuaugaaaaaaaaaaaaa

SEQ ID NO: 955843 - RNA, 24 nt, Human
gagcagucuuucacacucucuuuu

SEQ ID NO: 955844 - RNA, 24 nt, Human
gagcagucuuucacacucucuuuu

SEQ ID NO: 955845 - RNA, 24 nt, Human
gagcagucuuucacacucucuuuu

SEQ ID NO: 955846 - RNA, 24 nt, Human
gagcagucuuucacacucucuuuu

SEQ ID NO: 955847 - RNA, 24 nt, Human
gaguagcugggacuacaggcuugc

SEQ ID NO: 955848 - RNA, 23 nt, Human
gcaggagaaucacuugaacccgg

SEQ ID NO: 955849 - RNA, 23 nt, Human
gcccaggcuggaaugcaguggca

SEQ ID NO: 955850 - RNA, 19 nt, Human
gcccaggcuggagugcagu

SEQ ID NO: 955851 - RNA, 23 nt, Human
gcccaggcuggagugcaguggca

SEQ ID NO: 955852 - RNA, 24 nt, Human
gccccaagacucaacagggcaucc

SEQ ID NO: 955853 - RNA, 21 nt, Human
gccuccugggagcugcucacu

SEQ ID NO: 955854 - RNA, 23 nt, Human
gcucacuaucuccuggccacccc

SEQ ID NO: 955855 - RNA, 23 nt, Human
gcucacuaucuccuggccacccc

SEQ ID NO: 955856 - RNA, 19 nt, Human
gcuggaaugcaguggcaug

SEQ ID NO: 955857 - RNA, 19 nt, Human
gcuggagugcaguggcaca

SEQ ID NO: 955858 - RNA, 19 nt, Human
gcugggacuacaggcuugc

SEQ ID NO: 955859 - RNA, 19 nt, Human
gcugggggaagaaaaggga

SEQ ID NO: 955860 - RNA, 23 nt, Human
ggaagaaaagggaggcauuagag

SEQ ID NO: 955861 - RNA, 18 nt, Human
ggaauucccagagccaca

SEQ ID NO: 955862 - RNA, 18 nt, Human
ggaauucccagagccaca

SEQ ID NO: 955863 - RNA, 23 nt, Human
ggacgcaagaagcccgagcccag

SEQ ID NO: 955864 - RNA, 21 nt, Human
ggagaucuucauuccaaagcu

SEQ ID NO: 955865 - RNA, 21 nt, Human
ggagucacuggugggguggca

SEQ ID NO: 955866 - RNA, 21 nt, Human
ggaguuuuucguggauccagg

SEQ ID NO: 955867 - RNA, 19 nt, Human
ggaucccuccaugccuccu

SEQ ID NO: 955868 - RNA, 19 nt, Human
ggaucccuccaugccuccu

SEQ ID NO: 955869 - RNA, 19 nt, Human
ggaucccuccaugccuccu

SEQ ID NO: 955870 - RNA, 19 nt, Human
ggaucccuccaugccuccu

SEQ ID NO: 955871 - RNA, 19 nt, Human
ggaucccuccaugccuccu

SEQ ID NO: 955872 - RNA, 18 nt, Human
ggauuggaaaauccagcg

SEQ ID NO: 955873 - RNA, 18 nt, Human
ggauuggaaaauccagcg

SEQ ID NO: 955874 - RNA, 18 nt, Human
ggauuggaaaauccagcg

SEQ ID NO: 955875 - RNA, 18 nt, Human
ggauuggaaaauccagcg

SEQ ID NO: 955876 - RNA, 22 nt, Human
gggaaaaagaaaaaaaauucaa

SEQ ID NO: 955877 - RNA, 19 nt, Human
gggcacuuuagauggaaac

SEQ ID NO: 955878 - RNA, 22 nt, Human
gggcucaagugauucuccugcc

SEQ ID NO: 955879 - RNA, 18 nt, Human
gucacuggugggguggca

SEQ ID NO: 955880 - RNA, 21 nt, Human
gucucaaaaaaaaaaaaaaag

SEQ ID NO: 955881 - RNA, 22 nt, Human
gugaauacuacagaaacuccau

SEQ ID NO: 955882 - RNA, 24 nt, Human
gugauucuccugccccagccuccc

SEQ ID NO: 955883 - RNA, 20 nt, Human
guguaggugcuccuggcuuu

SEQ ID NO: 955884 - RNA, 22 nt, Human
guugaaaaguagaggagcuuga

SEQ ID NO: 955885 - RNA, 20 nt, Human
guugccacugggauuccacc

SEQ ID NO: 955886 - RNA, 22 nt, Human
uaaaaaagacuacccuugggug

SEQ ID NO: 955887 - RNA, 19 nt, Human
uaaagagcagagcaagagc

SEQ ID NO: 955888 - RNA, 20 nt, Human
uaacagaucuggcaaaauau

SEQ ID NO: 955889 - RNA, 21 nt, Human
uaagacgucuuuacugacuga

SEQ ID NO: 955890 - RNA, 18 nt, Human
uacaaaguuaacucuagu

SEQ ID NO: 955891 - RNA, 25 nt, Human
uagcccagcaggcuugaggugaaga

SEQ ID NO: 955892 - RNA, 19 nt, Human
uagggaaaaagaaaaaaaa

SEQ ID NO: 955893 - RNA, 20 nt, Human
uagggcacuuuagauggaaa

SEQ ID NO: 955894 - RNA, 21 nt, Human
uauaccuccacuuaccuuggc

SEQ ID NO: 955895 - RNA, 18 nt, Human
uaucaaaaaaaagcagca

SEQ ID NO: 955896 - RNA, 19 nt, Human
uaucaaaaaaaagcagcaa

SEQ ID NO: 955897 - RNA, 24 nt, Human
uaucaaaaaaaagcagcaaucuuu

SEQ ID NO: 955898 - RNA, 21 nt, Human
uaugaaaaaaaaaaaaaggca

SEQ ID NO: 955899 - RNA, 22 nt, Human
uauugaguucaauccucacacc

SEQ ID NO: 955900 - RNA, 19 nt, Human
ucaaaaaaaaaaaaaaaga

SEQ ID NO: 955901 - RNA, 18 nt, Human
ucaacagggcauccaucu

SEQ ID NO: 955902 - RNA, 19 nt, Human
ucaagcaauauuugaggac

SEQ ID NO: 955903 - RNA, 23 nt, Human
ucaaggcguauguaaucuucccu

SEQ ID NO: 955904 - RNA, 23 nt, Human
ucacacucucuuuuucuccagaa

SEQ ID NO: 955905 - RNA, 23 nt, Human
ucacacucucuuuuucuccagaa

SEQ ID NO: 955906 - RNA, 23 nt, Human
ucacacucucuuuuucuccagaa

SEQ ID NO: 955907 - RNA, 23 nt, Human
ucacacucucuuuuucuccagaa

SEQ ID NO: 955908 - RNA, 24 nt, Human
ucacucugucgcccaggcuggagu

SEQ ID NO: 955909 - RNA, 24 nt, Human
ucacugcggccuccaacuccuggg

SEQ ID NO: 955910 - RNA, 19 nt, Human
ucagaaaucaccacugaag

SEQ ID NO: 955911 - RNA, 23 nt, Human
ucagaccagaaaaacagcagucu

SEQ ID NO: 955912 - RNA, 18 nt, Human
ucagagacauacauuaca

SEQ ID NO: 955913 - RNA, 19 nt, Human
ucagcugagucugggucuc

SEQ ID NO: 955914 - RNA, 26 nt, Human
ucagucucaaaaaaaaaaaaaaagaa

SEQ ID NO: 955915 - RNA, 20 nt, Human
ucaguuguaauuaaagugcu

SEQ ID NO: 955916 - RNA, 23 nt, Human
ucauaccacuccacuccagccug

SEQ ID NO: 955917 - RNA, 24 nt, Human
uccagccugggugauagaaugaga

SEQ ID NO: 955918 - RNA, 21 nt, Human
uccaucucaucauagaagaca

SEQ ID NO: 955919 - RNA, 19 nt, Human
ucccagaaaaaucuugguu

SEQ ID NO: 955920 - RNA, 25 nt, Human
ucccagaaaaaucuugguuucuuug

SEQ ID NO: 955921 - RNA, 18 nt, Human
ucccagagccacaucagc

SEQ ID NO: 955922 - RNA, 18 nt, Human
ucccagagccacaucagc

SEQ ID NO: 955923 - RNA, 18 nt, Human
ucccagagccacaucagc

SEQ ID NO: 955924 - RNA, 24 nt, Human
ucccagcgacucaggaggcugagg

SEQ ID NO: 955925 - RNA, 19 nt, Human
uccccagugcacuccugcc

SEQ ID NO: 955926 - RNA, 23 nt, Human
uccccagugcacuccugccaccu

SEQ ID NO: 955927 - RNA, 24 nt, Human
ucccgaguagcugggacuacaggc

SEQ ID NO: 955928 - RNA, 21 nt, Human
uccugggcucaagugauucuc

SEQ ID NO: 955929 - RNA, 22 nt, Human
uccugggcucaagugauucucc

SEQ ID NO: 955930 - RNA, 24 nt, Human
uccugggcucaagugauucuccug

SEQ ID NO: 955931 - RNA, 24 nt, Human
ucgcccaggcuggaaugcaguggc

SEQ ID NO: 955932 - RNA, 24 nt, Human
ucgcccaggcuggagugcaguggc

SEQ ID NO: 955933 - RNA, 20 nt, Human
ucuaggugguucuucagucc

SEQ ID NO: 955934 - RNA, 20 nt, Human
ucuaggugguucuucagucc

SEQ ID NO: 955935 - RNA, 20 nt, Human
ucuaggugguucuucagucc

SEQ ID NO: 955936 - RNA, 20 nt, Human
ucuaggugguucuucagucc

SEQ ID NO: 955937 - RNA, 20 nt, Human
ucuaggugguucuucagucc

SEQ ID NO: 955938 - RNA, 24 nt, Human
ucucaaaaaaaaaaaaaaagaaaa

SEQ ID NO: 955939 - RNA, 19 nt, Human
ucucacucugucgcccagg

SEQ ID NO: 955940 - RNA, 24 nt, Human
ucucacucugucgcccaggcucaa

SEQ ID NO: 955941 - RNA, 24 nt, Human
ucucacucugucgcccaggcucaa

SEQ ID NO: 955942 - RNA, 23 nt, Human
ucucacucugucgcccaggcugg

SEQ ID NO: 955943 - RNA, 23 nt, Human
ucucacucugucgcccaggcugg

SEQ ID NO: 955944 - RNA, 24 nt, Human
ucucacucugucgcccaggcugga

SEQ ID NO: 955945 - RNA, 24 nt, Human
ucucacucugucgcccaggcugga

SEQ ID NO: 955946 - RNA, 26 nt, Human
ucucacucugucgcccaggcuggaau

SEQ ID NO: 955947 - RNA, 26 nt, Human
ucucacucugucgcccaggcuggagu

SEQ ID NO: 955948 - RNA, 27 nt, Human
ucucacucugucgcccaggcuggagug

SEQ ID NO: 955949 - RNA, 18 nt, Human
ucuccugauucugagccu

SEQ ID NO: 955950 - RNA, 24 nt, Human
ucuccugccccagccucccgagua

SEQ ID NO: 955951 - RNA, 26 nt, Human
ucuggcaaaauauaagaaugaaaaaa

SEQ ID NO: 955952 - RNA, 24 nt, Human
ucugucgcccaggcuggaaugcag

SEQ ID NO: 955953 - RNA, 24 nt, Human
ucugucgcccaggcuggagugcag

SEQ ID NO: 955954 - RNA, 18 nt, Human
ucuuuuuuuuuuuuuuuu

SEQ ID NO: 955955 - RNA, 19 nt, Human
ugaaaaaaaaaaaaaggca

SEQ ID NO: 955956 - RNA, 20 nt, Human
ugaaaaaaauucuacacagg

SEQ ID NO: 955957 - RNA, 21 nt, Human
ugaaaaaggucuggaguagug

SEQ ID NO: 955958 - RNA, 23 nt, Human
ugaaauucuagagucagagacau

SEQ ID NO: 955959 - RNA, 26 nt, Human
ugacaauaucaaaaaaaagcagcaau

SEQ ID NO: 955960 - RNA, 21 nt, Human
ugacauguucuuagcggggac

SEQ ID NO: 955961 - RNA, 19 nt, Human
ugaccugguugaaaaguag

SEQ ID NO: 955962 - RNA, 22 nt, Human
ugagacggagucucacucuguc

SEQ ID NO: 955963 - RNA, 24 nt, Human
ugaggcaggagaaucacuugaacc

SEQ ID NO: 955964 - RNA, 25 nt, Human
ugaggcaggagaaucacuugaaccc

SEQ ID NO: 955965 - RNA, 20 nt, Human
ugauucuccugccccagccu

SEQ ID NO: 955966 - RNA, 23 nt, Human
ugcaaccaaacacuacuuguucc

SEQ ID NO: 955967 - RNA, 25 nt, Human
ugcacuggacguuuucugaaucucc

SEQ ID NO: 955968 - RNA, 18 nt, Human
ugccccaagacucaacag

SEQ ID NO: 955969 - RNA, 21 nt, Human
ugccccaagacucaacagggc

SEQ ID NO: 955970 - RNA, 24 nt, Human
ugccccagccucccgaguagcugg

SEQ ID NO: 955971 - RNA, 19 nt, Human
uggaaugcaguggcaugau

SEQ ID NO: 955972 - RNA, 19 nt, Human
uggaaugcaguggcaugau

SEQ ID NO: 955973 - RNA, 20 nt, Human
uggaaugcuagcucccauuc

SEQ ID NO: 955974 - RNA, 20 nt, Human
uggagucacugguggggugg

SEQ ID NO: 955975 - RNA, 18 nt, Human
uggagugcaguggcacaa

SEQ ID NO: 955976 - RNA, 23 nt, Human
uggagugcaguggcacaaucuca

SEQ ID NO: 955977 - RNA, 24 nt, Human
uggagugcaguggcacaaucucag

SEQ ID NO: 955978 - RNA, 21 nt, Human
uggcaaaauauaagaaugaaa

SEQ ID NO: 955979 - RNA, 22 nt, Human
uggcacaaucucaguaauccca

SEQ ID NO: 955980 - RNA, 24 nt, Human
uggcaugaucacagcucacugcgg

SEQ ID NO: 955981 - RNA, 20 nt, Human
uggcuaaagagcagagcaag

SEQ ID NO: 955982 - RNA, 21 nt, Human
ugggacuacaggcuugcgcca

SEQ ID NO: 955983 - RNA, 18 nt, Human
ugggcucaagugauucuc

SEQ ID NO: 955984 - RNA, 23 nt, Human
ugggggaagaaaagggaggcauu

SEQ ID NO: 955985 - RNA, 23 nt, Human
ugggucucacucugucgcccagg

SEQ ID NO: 955986 - RNA, 21 nt, Human
uggguucaaugucagcaaacu

SEQ ID NO: 955987 - RNA, 21 nt, Human
ugguaguaaauggugacuguu

SEQ ID NO: 955988 - RNA, 18 nt, Human
uggugaaaaaccaaaaug

SEQ ID NO: 955989 - RNA, 21 nt, Human
uggugccuguggagucacugg

SEQ ID NO: 955990 - RNA, 25 nt, Human
uggugggguggcaguuccggaaguu

SEQ ID NO: 955991 - RNA, 19 nt, Human
uguauccccagugcacucc

SEQ ID NO: 955992 - RNA, 24 nt, Human
ugucgcccaggcucaaaaaaaaaa

SEQ ID NO: 955993 - RNA, 25 nt, Human
uguuagaaagugccccaagacucaa

SEQ ID NO: 955994 - RNA, 26 nt, Human
uuacaaaguuaacucuaguaaaaauc

SEQ ID NO: 955995 - RNA, 22 nt, Human
uuagcccagcaggcuugaggug

SEQ ID NO: 955996 - RNA, 27 nt, Human
uucaaacuugacauauauuaaaaaagu

SEQ ID NO: 955997 - RNA, 22 nt, Human
uucacaaauuaacaaauagcgu

SEQ ID NO: 955998 - RNA, 20 nt, Human
uuccacuuaggagucacuaa

SEQ ID NO: 955999 - RNA, 24 nt, Human
uucccagaaaaaucuugguuucuu

SEQ ID NO: 956000 - RNA, 22 nt, Human
uucuacacagggcacuuauuuc

SEQ ID NO: 956001 - RNA, 21 nt, Human
uucuagagucagagacauaca

SEQ ID NO: 956002 - RNA, 18 nt, Human
uucucauccuccagggcc

SEQ ID NO: 956003 - RNA, 23 nt, Human
uucuccagauuagcaccuggcca

SEQ ID NO: 956004 - RNA, 19 nt, Human
uugacuaugaaaaaaaaaa

SEQ ID NO: 956005 - RNA, 20 nt, Human
uugcagugagucaagaucau

SEQ ID NO: 956006 - RNA, 19 nt, Human
uuggggacuagcccaacug

SEQ ID NO: 956007 - RNA, 24 nt, Human
uuucagaauucugcugaguuauuu

SEQ ID NO: 956008 - RNA, 24 nt, Human
uuucagaauucugcugaguuauuu

SEQ ID NO: 956009 - RNA, 24 nt, Human
uuucagaauucugcugaguuauuu

SEQ ID NO: 956010 - RNA, 24 nt, Human
uuucagaauucugcugaguuauuu

SEQ ID NO: 956011 - RNA, 24 nt, Human
uuucagaauucugcugaguuauuu

SEQ ID NO: 956012 - RNA, 26 nt, Human
uuuuuuuuuuuugagacggagucuca

SEQ ID NO: 956013 - RNA, 22 nt, Human
uuuuuuuuuuuuuugagacgga

SEQ ID NO: 956014 - RNA, 22 nt, Human
uuuuuuuuuuuuuuuuucacau

SEQ ID NO: 956015 - RNA, 18 nt, Human
uuuuuuuuuuuuuuuuug

SEQ ID NO: 956016 - RNA, 24 nt, Human
aagcugcggcggcggcggcggcgg

SEQ ID NO: 956017 - RNA, 21 nt, Human
aauauuauuacagucaggagg

SEQ ID NO: 956018 - RNA, 18 nt, Human
accccagccuccugccug

SEQ ID NO: 956019 - RNA, 25 nt, Human
aggcagcggcuggaagauacucggc

SEQ ID NO: 956020 - RNA, 21 nt, Human
agucaggaggcagcggcugga

SEQ ID NO: 956021 - RNA, 18 nt, Human
caaagaacaacaugugca

SEQ ID NO: 956022 - RNA, 29 nt, Human
caagcugcggcggcggcggcggcggcgac

SEQ ID NO: 956023 - RNA, 22 nt, Human
cacccuggcacacacuugacag

SEQ ID NO: 956024 - RNA, 24 nt, Human
caggggcggagcgcggcgugcgcg

SEQ ID NO: 956025 - RNA, 19 nt, Human
cccagccuccugccugggc

SEQ ID NO: 956026 - RNA, 20 nt, Human
ccccagccuccugccugggc

SEQ ID NO: 956027 - RNA, 22 nt, Human
cccccacacagcaccccagccu

SEQ ID NO: 956028 - RNA, 18 nt, Human
cccggaaagugaccaugg

SEQ ID NO: 956029 - RNA, 21 nt, Human
ccggugcguggcgcccucccu

SEQ ID NO: 956030 - RNA, 21 nt, Human
ccugugguggcagcaccuccc

SEQ ID NO: 956031 - RNA, 21 nt, Human
cgcgcucucggcccgcagucc

SEQ ID NO: 956032 - RNA, 24 nt, Human
cggcgacgggggcggcagcagggg

SEQ ID NO: 956033 - RNA, 19 nt, Human
cggcggcggcggcggcgac

SEQ ID NO: 956034 - RNA, 20 nt, Human
cggcucuuucccccaagucc

SEQ ID NO: 956035 - RNA, 26 nt, Human
cggcucuuucccccaaguccagguuc

SEQ ID NO: 956036 - RNA, 18 nt, Human
cgggggcggcagcagggg

SEQ ID NO: 956037 - RNA, 25 nt, Human
cugacagaugaugauaugguuuuuu

SEQ ID NO: 956038 - RNA, 21 nt, Human
cugcggcggcggcggcggcuu

SEQ ID NO: 956039 - RNA, 23 nt, Human
cuggaagauacucggcucuuucc

SEQ ID NO: 956040 - RNA, 21 nt, Human
gcccccacacagcaccccagc

SEQ ID NO: 956041 - RNA, 19 nt, Human
gcggcagcaggggcggagc

SEQ ID NO: 956042 - RNA, 31 nt, Human
gcggcggcggcggcgacgggggcggcagcaa

SEQ ID NO: 956043 - RNA, 20 nt, Human
gcggcggcggcggcggcgac

SEQ ID NO: 956044 - RNA, 20 nt, Human
ggcagcaggggcggagcgcg

SEQ ID NO: 956045 - RNA, 20 nt, Human
ggcgcccucccucucucucc

SEQ ID NO: 956046 - RNA, 19 nt, Human
gggcggcagcaggggcgga

SEQ ID NO: 956047 - RNA, 22 nt, Human
gggcggcagcaggggcggagcg

SEQ ID NO: 956048 - RNA, 22 nt, Human
uauuacagucaggaggcagcgg

SEQ ID NO: 956049 - RNA, 25 nt, Human
ucccggaaagugaccauggaucacc

SEQ ID NO: 956050 - RNA, 22 nt, Human
ugacaaagaacaacaugugcag

SEQ ID NO: 956051 - RNA, 26 nt, Human
ugacaaagaacaacaugugcagguac

SEQ ID NO: 956052 - RNA, 19 nt, Human
ugacagcacugacaaagaa

SEQ ID NO: 956053 - RNA, 21 nt, Human
ugcggcggcggcggcggcggc

SEQ ID NO: 956054 - RNA, 20 nt, Human
uggaagauacucggcucuuu

SEQ ID NO: 956055 - RNA, 22 nt, Human
uggcacacacuugacagcacug

SEQ ID NO: 956056 - RNA, 24 nt, Human
uggcagcaccucccaagcugcggc

SEQ ID NO: 956057 - RNA, 20 nt, Human
uggcccccacacagcacccc

SEQ ID NO: 956058 - RNA, 23 nt, Human
aaaaagacgggaacacaaaagca

SEQ ID NO: 956059 - RNA, 25 nt, Human
aaaaagacgggaacacaaaagcaag

SEQ ID NO: 956060 - RNA, 21 nt, Human
aaaacagacacaaaggaggcu

SEQ ID NO: 956061 - RNA, 19 nt, Human
aaacagacacaaaggaggc

SEQ ID NO: 956062 - RNA, 20 nt, Human
aaacaggaaaucagaacagu

SEQ ID NO: 956063 - RNA, 21 nt, Human
aaacaggaaaucagaacagug

SEQ ID NO: 956064 - RNA, 22 nt, Human
aaacuuccugcaugcugaacuu

SEQ ID NO: 956065 - RNA, 21 nt, Human
aaagauaacagguaaccaagg

SEQ ID NO: 956066 - RNA, 20 nt, Human
aaagcaagcuccauagauua

SEQ ID NO: 956067 - RNA, 18 nt, Human
aaaguguuuugcccuaua

SEQ ID NO: 956068 - RNA, 20 nt, Human
aaauaccauuaaccaaugua

SEQ ID NO: 956069 - RNA, 25 nt, Human
aagaaaaagccggguucugcucccg

SEQ ID NO: 956070 - RNA, 19 nt, Human
aagaggcauauuacauucg

SEQ ID NO: 956071 - RNA, 21 nt, Human
aagugcagauagggcuuuaac

SEQ ID NO: 956072 - RNA, 21 nt, Human
aaugcccaugccauucuugaa

SEQ ID NO: 956073 - RNA, 24 nt, Human
aauuuaaaaauaaauuuaucuccu

SEQ ID NO: 956074 - RNA, 20 nt, Human
acaaaggaggcagagagaaa

SEQ ID NO: 956075 - RNA, 27 nt, Human
acaccaucuggaaagguucauacagaa

SEQ ID NO: 956076 - RNA, 18 nt, Human
accuaauuuccaguuacg

SEQ ID NO: 956077 - RNA, 20 nt, Human
acuuuaccagcccugucacc

SEQ ID NO: 956078 - RNA, 24 nt, Human
agaaugcccaugccauucuugaaa

SEQ ID NO: 956079 - RNA, 18 nt, Human
agacacaaaggaggcaga

SEQ ID NO: 956080 - RNA, 19 nt, Human
agagcaccauacuuagaaa

SEQ ID NO: 956081 - RNA, 23 nt, Human
agcaaaaugcauaaaaaacacaa

SEQ ID NO: 956082 - RNA, 20 nt, Human
agcccugucacccaaacugg

SEQ ID NO: 956083 - RNA, 24 nt, Human
agcccugucacccaaacugguugu

SEQ ID NO: 956084 - RNA, 18 nt, Human
aggaaaggcaaagaaaag

SEQ ID NO: 956085 - RNA, 19 nt, Human
agguauuggccuuuucucu

SEQ ID NO: 956086 - RNA, 24 nt, Human
auaagaaaaaauguaguucucugu

SEQ ID NO: 956087 - RNA, 21 nt, Human
aucuggaaagguucauacaga

SEQ ID NO: 956088 - RNA, 25 nt, Human
auuggccuuuucucuggaaaccaua

SEQ ID NO: 956089 - RNA, 23 nt, Human
caaaagauaacagguaaccaagg

SEQ ID NO: 956090 - RNA, 23 nt, Human
caaaaugcauaaaaaacacaaug

SEQ ID NO: 956091 - RNA, 20 nt, Human
caaagcaaggcugagacuca

SEQ ID NO: 956092 - RNA, 22 nt, Human
caaagcaguuaugaagaggaag

SEQ ID NO: 956093 - RNA, 26 nt, Human
caagaaaaagccggguucugcucccg

SEQ ID NO: 956094 - RNA, 19 nt, Human
caaggcaauaagaaaaaau

SEQ ID NO: 956095 - RNA, 18 nt, Human
cagacacaaaggaggcag

SEQ ID NO: 956096 - RNA, 25 nt, Human
cagacacaaaggaggcagagagaaa

SEQ ID NO: 956097 - RNA, 24 nt, Human
cagcaaaaugcauaaaaaacacaa

SEQ ID NO: 956098 - RNA, 20 nt, Human
cagcgucgcuccaagaaaaa

SEQ ID NO: 956099 - RNA, 22 nt, Human
caguaggacagcagggccaaac

SEQ ID NO: 956100 - RNA, 21 nt, Human
cauacagaaugcccaugccau

SEQ ID NO: 956101 - RNA, 22 nt, Human
caucuggaaagguucauacaga

SEQ ID NO: 956102 - RNA, 22 nt, Human
cauugcauugcaggcuaguagu

SEQ ID NO: 956103 - RNA, 21 nt, Human
ccaccuaauuuccaguuacgu

SEQ ID NO: 956104 - RNA, 23 nt, Human
ccaucuggaaagguucauacaga

SEQ ID NO: 956105 - RNA, 26 nt, Human
ccccaaacuuccugcaugcugaacuu

SEQ ID NO: 956106 - RNA, 19 nt, Human
cccugcgcucucgccgccu

SEQ ID NO: 956107 - RNA, 23 nt, Human
cccugucacccaaacugguugua

SEQ ID NO: 956108 - RNA, 20 nt, Human
ccuaaauuuucuaaagacau

SEQ ID NO: 956109 - RNA, 26 nt, Human
cgccgcccugcgcucucgccgccugc

SEQ ID NO: 956110 - RNA, 23 nt, Human
cgccgccugcgcucgcccugcgc

SEQ ID NO: 956111 - RNA, 19 nt, Human
cgccugcgcucgcccugcg

SEQ ID NO: 956112 - RNA, 22 nt, Human
cgcucgcccugcgcuggcccgg

SEQ ID NO: 956113 - RNA, 23 nt, Human
cuauuaaacaguaggacagcagg

SEQ ID NO: 956114 - RNA, 25 nt, Human
cucccgggaccgacgccgcgccgcc

SEQ ID NO: 956115 - RNA, 20 nt, Human
cuugcuuuggaggaugauga

SEQ ID NO: 956116 - RNA, 23 nt, Human
gacacaaaggaggcagagagaaa

SEQ ID NO: 956117 - RNA, 19 nt, Human
gauaacagguaaccaaggg

SEQ ID NO: 956118 - RNA, 18 nt, Human
gcaaaagauaacagguaa

SEQ ID NO: 956119 - RNA, 20 nt, Human
gcauauauaaccucaaacac

SEQ ID NO: 956120 - RNA, 24 nt, Human
gccgagcucuccccaaacuuccug

SEQ ID NO: 956121 - RNA, 22 nt, Human
gccgccugcgcucgcccugcgc

SEQ ID NO: 956122 - RNA, 21 nt, Human
gcucgcccugcgcuggcccgg

SEQ ID NO: 956123 - RNA, 21 nt, Human
ggaagguuuauugaaaacugg

SEQ ID NO: 956124 - RNA, 19 nt, Human
guaggacagcagggccaaa

SEQ ID NO: 956125 - RNA, 22 nt, Human
guaguaaguuugguugcuggua

SEQ ID NO: 956126 - RNA, 21 nt, Human
gucgcuccaagaaaaagccgg

SEQ ID NO: 956127 - RNA, 23 nt, Human
uaaauccaugucuauauuucaaa

SEQ ID NO: 956128 - RNA, 24 nt, Human
uaacguucauuuugacuuugguac

SEQ ID NO: 956129 - RNA, 24 nt, Human
uaacugggaagaauugcacugcuu

SEQ ID NO: 956130 - RNA, 23 nt, Human
uaagaaaaaauguaguucucugu

SEQ ID NO: 956131 - RNA, 19 nt, Human
uaagaaccauagccucuag

SEQ ID NO: 956132 - RNA, 20 nt, Human
uaaguucucaacuacccaca

SEQ ID NO: 956133 - RNA, 22 nt, Human
uauacacauagacaugaauaua

SEQ ID NO: 956134 - RNA, 19 nt, Human
uaucaaauaucccaccuaa

SEQ ID NO: 956135 - RNA, 24 nt, Human
uaucucacccuccuuaaacuaaag

SEQ ID NO: 956136 - RNA, 24 nt, Human
uaugacaaaaaacauaaaaaacuc

SEQ ID NO: 956137 - RNA, 18 nt, Human
uaugagaggaaaaagcug

SEQ ID NO: 956138 - RNA, 21 nt, Human
uauuuaggucacucaucuaac

SEQ ID NO: 956139 - RNA, 18 nt, Human
ucaaaaagacgggaacac

SEQ ID NO: 956140 - RNA, 25 nt, Human
ucaaaaagacgggaacacaaaagca

SEQ ID NO: 956141 - RNA, 21 nt, Human
ucgccgagcucuccccaaacu

SEQ ID NO: 956142 - RNA, 18 nt, Human
ucgcuauagaaaaugcua

SEQ ID NO: 956143 - RNA, 21 nt, Human
ucucacccuccuuaaacuaaa

SEQ ID NO: 956144 - RNA, 21 nt, Human
ucucuguuagcagucccugag

SEQ ID NO: 956145 - RNA, 24 nt, Human
ucugccugagcuauuucugauugu

SEQ ID NO: 956146 - RNA, 26 nt, Human
ugaauaagcaugccucagcaaaaugc

SEQ ID NO: 956147 - RNA, 22 nt, Human
ugagagcaccauacuuagaaau

SEQ ID NO: 956148 - RNA, 22 nt, Human
ugcaaagaaaaacaauucaaaa

SEQ ID NO: 956149 - RNA, 22 nt, Human
ugcagccuggaagguuuauuga

SEQ ID NO: 956150 - RNA, 24 nt, Human
ugcagccuggaagguuuauugaaa

SEQ ID NO: 956151 - RNA, 18 nt, Human
ugccugcuuacauuucag

SEQ ID NO: 956152 - RNA, 24 nt, Human
ugcgcuggcccgggucgcugugcu

SEQ ID NO: 956153 - RNA, 26 nt, Human
ugcuaugagaggaaaaagcugcaugu

SEQ ID NO: 956154 - RNA, 18 nt, Human
uggaaaaaaugcuuaggu

SEQ ID NO: 956155 - RNA, 18 nt, Human
ugggacuuuaccagcccu

SEQ ID NO: 956156 - RNA, 21 nt, Human
uggguagaacacucucauuuu

SEQ ID NO: 956157 - RNA, 20 nt, Human
uguaagcucugguguaccug

SEQ ID NO: 956158 - RNA, 20 nt, Human
uguguguguuugugcauaua

SEQ ID NO: 956159 - RNA, 22 nt, Human
uguguguguuugugcauauaua

SEQ ID NO: 956160 - RNA, 22 nt, Human
uguuacagcuuauacauugucu

SEQ ID NO: 956161 - RNA, 18 nt, Human
uuaggucacucaucuaac

SEQ ID NO: 956162 - RNA, 19 nt, Human
uuaguaggaccacaaaguc

SEQ ID NO: 956163 - RNA, 24 nt, Human
uucaaaauuuaaaaauaaauuuau

SEQ ID NO: 956164 - RNA, 20 nt, Human
uugcacugcuuaagaauagu

SEQ ID NO: 956165 - RNA, 25 nt, Human
uugcagccuggaagguuuauugaaa

SEQ ID NO: 956166 - RNA, 20 nt, Human
uuuauugaaaacuggguaga

SEQ ID NO: 956167 - RNA, 18 nt, Human
uuucuguguguguuugug

SEQ ID NO: 956168 - RNA, 18 nt, Human
uuugauggcuaucaaaua

SEQ ID NO: 956169 - RNA, 20 nt, Human
uuuuuuuuuuuuuuuuuugg

SEQ ID NO: 956170 - RNA, 22 nt, Human
agaucaggguaucauugaaaga

SEQ ID NO: 956171 - RNA, 23 nt, Human
agaucagggugucauugaaagac

SEQ ID NO: 956172 - RNA, 21 nt, Human
gaaagacaguggaaaccagga

SEQ ID NO: 956173 - RNA, 22 nt, Human
uaaagcaagacguugaaaccuu

SEQ ID NO: 956174 - RNA, 24 nt, Human
ucagggugucauugaaagacagug

SEQ ID NO: 956175 - RNA, 22 nt, Human
ucauugaaagacaguggaaacc

SEQ ID NO: 956176 - RNA, 22 nt, Human
ugaaagacaguggaaaccagga

SEQ ID NO: 956177 - RNA, 21 nt, Human
uuaaagcaagacguugaaacc

SEQ ID NO: 956178 - RNA, 21 nt, Human
aagagcccucccagaagcgcc

SEQ ID NO: 956179 - RNA, 20 nt, Human
agagcccucccagaagcgcc

SEQ ID NO: 956180 - RNA, 24 nt, Human
agagcccucccagaagcgcccuuc

SEQ ID NO: 956181 - RNA, 19 nt, Human
agcuggacucuuggcaccc

SEQ ID NO: 956182 - RNA, 19 nt, Human
agggaaaggccggguggug

SEQ ID NO: 956183 - RNA, 19 nt, Human
agugccccugcccugugug

SEQ ID NO: 956184 - RNA, 18 nt, Human
caagagcccucccagaag

SEQ ID NO: 956185 - RNA, 21 nt, Human
caagagcccucccagaagcgc

SEQ ID NO: 956186 - RNA, 21 nt, Human
caccgcaagagcccucccaga

SEQ ID NO: 956187 - RNA, 18 nt, Human
ccagaagcgcccagacug

SEQ ID NO: 956188 - RNA, 22 nt, Human
ccaggaagggaagggcgauucc

SEQ ID NO: 956189 - RNA, 19 nt, Human
cccagaagcgcccagacug

SEQ ID NO: 956190 - RNA, 18 nt, Human
cccagguucccgauucuc

SEQ ID NO: 956191 - RNA, 19 nt, Human
ccccagguucccgauucuc

SEQ ID NO: 956192 - RNA, 23 nt, Human
cccccagguucccgauucuccca

SEQ ID NO: 956193 - RNA, 22 nt, Human
ccucugggaacugccgagugcc

SEQ ID NO: 956194 - RNA, 21 nt, Human
cgcaagagcccucccagaagc

SEQ ID NO: 956195 - RNA, 24 nt, Human
cgcccagacugggggucggggagg

SEQ ID NO: 956196 - RNA, 22 nt, Human
cgccccuucaaggaaagacacu

SEQ ID NO: 956197 - RNA, 20 nt, Human
cggcaccgcaagagcccucc

SEQ ID NO: 956198 - RNA, 22 nt, Human
cggggaggacgcugccauucgu

SEQ ID NO: 956199 - RNA, 21 nt, Human
cguggccaggaagggaagggc

SEQ ID NO: 956200 - RNA, 20 nt, Human
cuucaaggaaagacacuaac

SEQ ID NO: 956201 - RNA, 21 nt, Human
cuuccuguuccucuccucguc

SEQ ID NO: 956202 - RNA, 18 nt, Human
gcaccggaccuagccugg

SEQ ID NO: 956203 - RNA, 20 nt, Human
gcccagacugggggucgggg

SEQ ID NO: 956204 - RNA, 24 nt, Human
gcgauuccggaggagggugggcac

SEQ ID NO: 956205 - RNA, 23 nt, Human
ggaacugccgagugccccugccc

SEQ ID NO: 956206 - RNA, 19 nt, Human
ggcgauuccggaggagggu

SEQ ID NO: 956207 - RNA, 21 nt, Human
ggucacuagcccccagguucc

SEQ ID NO: 956208 - RNA, 19 nt, Human
uaacaaggaggagugccgg

SEQ ID NO: 956209 - RNA, 25 nt, Human
uagcccccagguucccgauucuccc

SEQ ID NO: 956210 - RNA, 19 nt, Human
uagccuggugcccgccccu

SEQ ID NO: 956211 - RNA, 21 nt, Human
ucagauuccacaaggauuuau

SEQ ID NO: 956212 - RNA, 21 nt, Human
ucucccagcuucucucuuccu

SEQ ID NO: 956213 - RNA, 22 nt, Human
ucucccagcuucucucuuccug

SEQ ID NO: 956214 - RNA, 24 nt, Human
ucuuccuguuccucuccucgucuc

SEQ ID NO: 956215 - RNA, 23 nt, Human
uggacucuuggcacccaaaguuc

SEQ ID NO: 956216 - RNA, 24 nt, Human
uggacucuuggcacccaaaguucc

SEQ ID NO: 956217 - RNA, 21 nt, Human
uggcacccaaaguuccagaug

SEQ ID NO: 956218 - RNA, 21 nt, Human
uggccaggaagggaagggcga

SEQ ID NO: 956219 - RNA, 25 nt, Human
uggccaggaagggaagggcgauucc

SEQ ID NO: 956220 - RNA, 19 nt, Human
ugggagggguggccucugg

SEQ ID NO: 956221 - RNA, 20 nt, Human
ugggagggguggccucugga

SEQ ID NO: 956222 - RNA, 18 nt, Human
ugggaugggcaaggaggc

SEQ ID NO: 956223 - RNA, 19 nt, Human
ugggaugggcaaggaggcg

SEQ ID NO: 956224 - RNA, 22 nt, Human
ugggggucggggaggacgcugg

SEQ ID NO: 956225 - RNA, 18 nt, Human
uggggugggagggguggc

SEQ ID NO: 956226 - RNA, 23 nt, Human
uggggugggagggguggccucug

SEQ ID NO: 956227 - RNA, 24 nt, Human
uggggugggagggguggccucugg

SEQ ID NO: 956228 - RNA, 22 nt, Human
ugucuggaugucugggguggga

SEQ ID NO: 956229 - RNA, 24 nt, Human
aagaaaagcacaaaaugaaugcac

SEQ ID NO: 956230 - RNA, 20 nt, Human
aagcagaaagcccauaagaa

SEQ ID NO: 956231 - RNA, 23 nt, Human
acaggggcuuucagugagacagg

SEQ ID NO: 956232 - RNA, 19 nt, Human
agaaagcccauaagaaaag

SEQ ID NO: 956233 - RNA, 24 nt, Human
agaccaggcaccggcgcggaagga

SEQ ID NO: 956234 - RNA, 23 nt, Human
aggcagagccaucuaacagggga

SEQ ID NO: 956235 - RNA, 21 nt, Human
aggggcuuucagugagacagg

SEQ ID NO: 956236 - RNA, 24 nt, Human
caacacagacacuacacaggggcu

SEQ ID NO: 956237 - RNA, 23 nt, Human
cacacacacaaaaaaaaucuaug

SEQ ID NO: 956238 - RNA, 23 nt, Human
cagacuaagcagaaagcccauaa

SEQ ID NO: 956239 - RNA, 23 nt, Human
cagagccaucuaacaggggagcu

SEQ ID NO: 956240 - RNA, 20 nt, Human
cagcugccccuguccccccc

SEQ ID NO: 956241 - RNA, 24 nt, Human
cagcugccccugucccccccaccc

SEQ ID NO: 956242 - RNA, 22 nt, Human
cauaguaagagcaaaaggcaaa

SEQ ID NO: 956243 - RNA, 20 nt, Human
ccagcaagaucacagaaaca

SEQ ID NO: 956244 - RNA, 26 nt, Human
ccagggucaagggaaaacaacacaga

SEQ ID NO: 956245 - RNA, 25 nt, Human
cccaacaucaaugcacagauacaau

SEQ ID NO: 956246 - RNA, 19 nt, Human
cccaagaauagcacaccau

SEQ ID NO: 956247 - RNA, 18 nt, Human
ccccugucccccccaccc

SEQ ID NO: 956248 - RNA, 20 nt, Human
cucagcugccccuguccccc

SEQ ID NO: 956249 - RNA, 22 nt, Human
gaccuagacaacuuugggaagg

SEQ ID NO: 956250 - RNA, 23 nt, Human
gacuaagcagaaagcccauaaga

SEQ ID NO: 956251 - RNA, 18 nt, Human
gacuugcucuccugcuuc

SEQ ID NO: 956252 - RNA, 20 nt, Human
gcuggggaggacgcgagcgc

SEQ ID NO: 956253 - RNA, 19 nt, Human
ggaaaacaacacagacacu

SEQ ID NO: 956254 - RNA, 20 nt, Human
ggaaaacaacacagacacua

SEQ ID NO: 956255 - RNA, 28 nt, Human
ggaaggacaggcagagccaucuaacagg

SEQ ID NO: 956256 - RNA, 22 nt, Human
ggaaggaccuagacaacuuugg

SEQ ID NO: 956257 - RNA, 18 nt, Human
ggcagagccaucuaacag

SEQ ID NO: 956258 - RNA, 19 nt, Human
gggagcugagucuuuggga

SEQ ID NO: 956259 - RNA, 21 nt, Human
ggggagcugagucuuugggag

SEQ ID NO: 956260 - RNA, 20 nt, Human
guggaaggaaggcccuagcg

SEQ ID NO: 956261 - RNA, 20 nt, Human
guguucccaacaucaaugca

SEQ ID NO: 956262 - RNA, 27 nt, Human
uaagaaaagcacaaaaugaaugcacuc

SEQ ID NO: 956263 - RNA, 24 nt, Human
uaagaaaagcacaaaaugaaugcu

SEQ ID NO: 956264 - RNA, 25 nt, Human
uaagaaaagcacaaaaugaauggug

SEQ ID NO: 956265 - RNA, 18 nt, Human
uagcgucccucuucuugc

SEQ ID NO: 956266 - RNA, 19 nt, Human
uaguaagagcaaaaggcaa

SEQ ID NO: 956267 - RNA, 23 nt, Human
ucagacuaagcagaaagcccaua

SEQ ID NO: 956268 - RNA, 18 nt, Human
ucagcugccccugucccc

SEQ ID NO: 956269 - RNA, 18 nt, Human
ucagugagacagggauag

SEQ ID NO: 956270 - RNA, 21 nt, Human
ugaaugccacacaccuuucag

SEQ ID NO: 956271 - RNA, 20 nt, Human
ugacgacgaagaccaggcac

SEQ ID NO: 956272 - RNA, 18 nt, Human
uucagacuaagcagaaag

SEQ ID NO: 956273 - RNA, 21 nt, Human
uucccaacaucaaugcacaga

SEQ ID NO: 956274 - RNA, 18 nt, Human
uugaaguuacaggauugc

SEQ ID NO: 956275 - RNA, 19 nt, Human
uugcuggggaggacgcgag

SEQ ID NO: 956276 - RNA, 21 nt, Human
uuugcccacuguguucccaac

SEQ ID NO: 956277 - RNA, 19 nt, Human
uuuuuuuuuuuuuguuucc

SEQ ID NO: 956278 - RNA, 24 nt, Human
uuuuuuuuuuuuuuuuguuuccaa

SEQ ID NO: 956279 - RNA, 22 nt, Human
uuuuuuuuuuuuuuuuuuguuu

SEQ ID NO: 956280 - RNA, 23 nt, Human
uuuuuuuuuuuuuuuuuuuuggg

SEQ ID NO: 956281 - RNA, 22 nt, Human
aaacuuucaaggaacccucuga

SEQ ID NO: 956282 - RNA, 22 nt, Human
aacagcauuuuuacaaccacag

SEQ ID NO: 956283 - RNA, 18 nt, Human
aacuuaaaaucucuaaac

SEQ ID NO: 956284 - RNA, 19 nt, Human
aaugccugauauuaagugg

SEQ ID NO: 956285 - RNA, 25 nt, Human
acaaccacagaagcaaaauaaauuc

SEQ ID NO: 956286 - RNA, 23 nt, Human
acucucuuuuauuaaccaugauu

SEQ ID NO: 956287 - RNA, 18 nt, Human
acucuugcccauuugaga

SEQ ID NO: 956288 - RNA, 25 nt, Human
agaagcaaaauaaauucuagcuugu

SEQ ID NO: 956289 - RNA, 21 nt, Human
caaggaacccucugaauccag

SEQ ID NO: 956290 - RNA, 23 nt, Human
cagaagcaaaauaaauucuagcu

SEQ ID NO: 956291 - RNA, 20 nt, Human
caguacuguacauuuuuugu

SEQ ID NO: 956292 - RNA, 24 nt, Human
ccacagaagcaaaauaaauucuag

SEQ ID NO: 956293 - RNA, 24 nt, Human
cuugcccauuugagagggaagagu

SEQ ID NO: 956294 - RNA, 18 nt, Human
gcaggcauguauuuuuug

SEQ ID NO: 956295 - RNA, 26 nt, Human
uaaaauaaauuaagaagcaaaggcca

SEQ ID NO: 956296 - RNA, 19 nt, Human
uaaaauauacauauuacgg

SEQ ID NO: 956297 - RNA, 20 nt, Human
uaagaagcaaaggccaauca

SEQ ID NO: 956298 - RNA, 19 nt, Human
uacaaccacagaagcaaaa

SEQ ID NO: 956299 - RNA, 22 nt, Human
uacaacuucacuacgaggcagg

SEQ ID NO: 956300 - RNA, 24 nt, Human
ucaacauucacaaaauguugaaaa

SEQ ID NO: 956301 - RNA, 21 nt, Human
ucacaaaauguugaaaacuga

SEQ ID NO: 956302 - RNA, 20 nt, Human
ugaagaaugaaaaguaguca

SEQ ID NO: 956303 - RNA, 27 nt, Human
ugagagggaagaguuguuuauucaaau

SEQ ID NO: 956304 - RNA, 23 nt, Human
uggcacaaguaaaaaauuaaaau

SEQ ID NO: 956305 - RNA, 23 nt, Human
uuaaaauaaauuaagaagcaaag

SEQ ID NO: 956306 - RNA, 26 nt, Human
uuaaaauaaauuaagaagcaaaggcc

SEQ ID NO: 956307 - RNA, 22 nt, Human
uuaauagcacaucuaaaaagga

SEQ ID NO: 956308 - RNA, 24 nt, Human
aaaaagauauaaaucaguuuccau

SEQ ID NO: 956309 - RNA, 21 nt, Human
aaaagacaaauaagcaaaaag

SEQ ID NO: 956310 - RNA, 24 nt, Human
aaagugcugggauuacagguguga

SEQ ID NO: 956311 - RNA, 23 nt, Human
aaaucaguuuccauaagagcuaa

SEQ ID NO: 956312 - RNA, 23 nt, Human
aaccacaccacugauaaauuucc

SEQ ID NO: 956313 - RNA, 23 nt, Human
aagaagaauuucaagccaaaacu

SEQ ID NO: 956314 - RNA, 21 nt, Human
aagaaggaaaauagcaaccaa

SEQ ID NO: 956315 - RNA, 24 nt, Human
aagccaaaacuaagcauuaaaaaa

SEQ ID NO: 956316 - RNA, 26 nt, Human
aagcucuggcuuuuccccuaagaccu

SEQ ID NO: 956317 - RNA, 18 nt, Human
aagugcugggauuacagg

SEQ ID NO: 956318 - RNA, 19 nt, Human
aagugcugggauuacaggu

SEQ ID NO: 956319 - RNA, 26 nt, Human
aagugcugggauuacaggugugagcc

SEQ ID NO: 956320 - RNA, 19 nt, Human
acagcaaugagauaacugc

SEQ ID NO: 956321 - RNA, 21 nt, Human
acagcaaugagauaacugccu

SEQ ID NO: 956322 - RNA, 23 nt, Human
accacaccacugauaaauuucca

SEQ ID NO: 956323 - RNA, 22 nt, Human
accuccaucuggaagcucuggc

SEQ ID NO: 956324 - RNA, 18 nt, Human
acuccaggugaagaagaa

SEQ ID NO: 956325 - RNA, 24 nt, Human
acuuuugaaaggucauaaaaaaga

SEQ ID NO: 956326 - RNA, 18 nt, Human
agaaggaaaauagcaacc

SEQ ID NO: 956327 - RNA, 24 nt, Human
agagucucuguugcccaggcugga

SEQ ID NO: 956328 - RNA, 23 nt, Human
agccuccuggguucaagcaauuu

SEQ ID NO: 956329 - RNA, 22 nt, Human
aguagaggcgagguuucgccau

SEQ ID NO: 956330 - RNA, 24 nt, Human
agucucuguugcccaggcuggagu

SEQ ID NO: 956331 - RNA, 20 nt, Human
agugugguggcgcaauccug

SEQ ID NO: 956332 - RNA, 24 nt, Human
aucaguuuccauaagagcuaauau

SEQ ID NO: 956333 - RNA, 20 nt, Human
caaagugcugggauuacagg

SEQ ID NO: 956334 - RNA, 24 nt, Human
caaagugcugggauuacaggugug

SEQ ID NO: 956335 - RNA, 25 nt, Human
caaauaagcaaaaagcuuuucccgu

SEQ ID NO: 956336 - RNA, 23 nt, Human
caaccucagccuccuggguucaa

SEQ ID NO: 956337 - RNA, 22 nt, Human
caagcaauuuuccugucucagc

SEQ ID NO: 956338 - RNA, 23 nt, Human
caaucuauagaaaagagaauaac

SEQ ID NO: 956339 - RNA, 19 nt, Human
cacugcaaccucagccucc

SEQ ID NO: 956340 - RNA, 21 nt, Human
cacugcaaccucagccuccug

SEQ ID NO: 956341 - RNA, 23 nt, Human
cacugcaaccucagccuccuggg

SEQ ID NO: 956342 - RNA, 19 nt, Human
cagagucucuguugcccag

SEQ ID NO: 956343 - RNA, 22 nt, Human
cagccuccuggguucaagcaau

SEQ ID NO: 956344 - RNA, 23 nt, Human
cagccuccuggguucaagcaauu

SEQ ID NO: 956345 - RNA, 24 nt, Human
cauguuggccaggcuggucucgaa

SEQ ID NO: 956346 - RNA, 22 nt, Human
ccaccgcgcccagccuuaauuu

SEQ ID NO: 956347 - RNA, 21 nt, Human
ccaggcuggucucgaaauccu

SEQ ID NO: 956348 - RNA, 26 nt, Human
ccagugauccgccuaccucauccucu

SEQ ID NO: 956349 - RNA, 19 nt, Human
ccauguuggccaggcuggu

SEQ ID NO: 956350 - RNA, 22 nt, Human
ccauguuggccaggcuggucuc

SEQ ID NO: 956351 - RNA, 23 nt, Human
ccauguuggccaggcuggucucg

SEQ ID NO: 956352 - RNA, 19 nt, Human
ccccuaagaccuuuauaag

SEQ ID NO: 956353 - RNA, 18 nt, Human
ccgcgcccagccuuaauu

SEQ ID NO: 956354 - RNA, 19 nt, Human
ccucagccuccuggguuca

SEQ ID NO: 956355 - RNA, 23 nt, Human
ccugaccccagugauccgccuac

SEQ ID NO: 956356 - RNA, 22 nt, Human
ccuggcucacugcaaccucagc

SEQ ID NO: 956357 - RNA, 23 nt, Human
ccuggguucaagcaauuuuccug

SEQ ID NO: 956358 - RNA, 19 nt, Human
cgagguuucgccauguugg

SEQ ID NO: 956359 - RNA, 23 nt, Human
cgagguuucgccauguuggccag

SEQ ID NO: 956360 - RNA, 24 nt, Human
cgagguuucgccauguuggccagg

SEQ ID NO: 956361 - RNA, 24 nt, Human
cgccauguuggccaggcuggucuc

SEQ ID NO: 956362 - RNA, 24 nt, Human
cucacugcaaccucagccuccugg

SEQ ID NO: 956363 - RNA, 23 nt, Human
cuccaggugaagaagaauuucaa

SEQ ID NO: 956364 - RNA, 22 nt, Human
cucccaaaacagcaaugagaua

SEQ ID NO: 956365 - RNA, 24 nt, Human
cucuggcauguuaaaaaacaacuc

SEQ ID NO: 956366 - RNA, 19 nt, Human
cucuguugcccaggcugga

SEQ ID NO: 956367 - RNA, 20 nt, Human
cucuguugcccaggcuggag

SEQ ID NO: 956368 - RNA, 23 nt, Human
cucuguugcccaggcuggagugu

SEQ ID NO: 956369 - RNA, 19 nt, Human
gaaaguuuccuucagguua

SEQ ID NO: 956370 - RNA, 23 nt, Human
gaccccagugauccgccuaccuc

SEQ ID NO: 956371 - RNA, 18 nt, Human
gaccuuccuuuccuuuca

SEQ ID NO: 956372 - RNA, 25 nt, Human
gaccuuccuuuccuuucauuguacc

SEQ ID NO: 956373 - RNA, 23 nt, Human
gagguuucgccauguuggccagg

SEQ ID NO: 956374 - RNA, 18 nt, Human
gauuacaggugugagcca

SEQ ID NO: 956375 - RNA, 22 nt, Human
gauuacaggugugagccaccgc

SEQ ID NO: 956376 - RNA, 22 nt, Human
gauuacaggugugagccaccgc

SEQ ID NO: 956377 - RNA, 22 nt, Human
gcaaccucagccuccuggguuc

SEQ ID NO: 956378 - RNA, 22 nt, Human
gcagcuaauuuuuuuguauuuu

SEQ ID NO: 956379 - RNA, 23 nt, Human
gggacuacaggcgugcaccacca

SEQ ID NO: 956380 - RNA, 21 nt, Human
gucucuguugcccaggcugga

SEQ ID NO: 956381 - RNA, 22 nt, Human
guugcacgaggaaccacaccac

SEQ ID NO: 956382 - RNA, 24 nt, Human
uaacuuccaaggcauuacaacuuu

SEQ ID NO: 956383 - RNA, 26 nt, Human
uaauuuuuuuguauuuuuaguagagg

SEQ ID NO: 956384 - RNA, 24 nt, Human
uacaggugugagccaccgcgccca

SEQ ID NO: 956385 - RNA, 22 nt, Human
uagaggcgagguuucgccaugu

SEQ ID NO: 956386 - RNA, 18 nt, Human
uagcagggacuacaggcg

SEQ ID NO: 956387 - RNA, 24 nt, Human
uaguagaggcgagguuucgccaug

SEQ ID NO: 956388 - RNA, 24 nt, Human
uauagaaaagagaauaacuuccaa

SEQ ID NO: 956389 - RNA, 20 nt, Human
ucaaagugcugggauuacag

SEQ ID NO: 956390 - RNA, 21 nt, Human
ucaaagugcugggauuacagg

SEQ ID NO: 956391 - RNA, 24 nt, Human
ucaaagugcugggauuacaggugu

SEQ ID NO: 956392 - RNA, 18 nt, Human
ucacugcaaccucagccu

SEQ ID NO: 956393 - RNA, 23 nt, Human
ucacugcaaccucagccuccugg

SEQ ID NO: 956394 - RNA, 24 nt, Human
ucacugcaaccucagccuccuggg

SEQ ID NO: 956395 - RNA, 27 nt, Human
ucacugcaaccucagccuccuggguuc

SEQ ID NO: 956396 - RNA, 23 nt, Human
uccaaguagcagggacuacaggc

SEQ ID NO: 956397 - RNA, 21 nt, Human
uccuggguucaagcaauuuuc

SEQ ID NO: 956398 - RNA, 24 nt, Human
uccuggguucaagcaauuuuccug

SEQ ID NO: 956399 - RNA, 22 nt, Human
ucgccauguuggccaggcuggu

SEQ ID NO: 956400 - RNA, 24 nt, Human
ucgccauguuggccaggcuggucu

SEQ ID NO: 956401 - RNA, 23 nt, Human
ucucaaagugcugggauuacagg

SEQ ID NO: 956402 - RNA, 24 nt, Human
ucucaaagugcugggauuacaggu

SEQ ID NO: 956403 - RNA, 23 nt, Human
ucucuguugcccaggcuggagug

SEQ ID NO: 956404 - RNA, 18 nt, Human
ucuguugcccaggcugga

SEQ ID NO: 956405 - RNA, 24 nt, Human
ucuguugcccaggcuggagugugg

SEQ ID NO: 956406 - RNA, 22 nt, Human
ugaacacaaucuauagaaaaga

SEQ ID NO: 956407 - RNA, 22 nt, Human
ugagacagagucucuguugccc

SEQ ID NO: 956408 - RNA, 24 nt, Human
ugauccgccuaccucauccucuca

SEQ ID NO: 956409 - RNA, 21 nt, Human
ugcccaggcuggaguguggug

SEQ ID NO: 956410 - RNA, 24 nt, Human
ugcccaggcuggagugugguggcg

SEQ ID NO: 956411 - RNA, 24 nt, Human
ugcugggauuacaggugugagcca

SEQ ID NO: 956412 - RNA, 20 nt, Human
uggaagcucuggcuuuuccc

SEQ ID NO: 956413 - RNA, 24 nt, Human
uggagugugguggcgcaauccugg

SEQ ID NO: 956414 - RNA, 24 nt, Human
uggccaggcuggucucgaaauccu

SEQ ID NO: 956415 - RNA, 23 nt, Human
uggcccauaacgaaaguuuccuu

SEQ ID NO: 956416 - RNA, 20 nt, Human
uggcucacugcaaccucagc

SEQ ID NO: 956417 - RNA, 18 nt, Human
ugggauuacaggugugag

SEQ ID NO: 956418 - RNA, 19 nt, Human
ugggauuacaggugugagc

SEQ ID NO: 956419 - RNA, 21 nt, Human
ugggauuacaggugugagcca

SEQ ID NO: 956420 - RNA, 22 nt, Human
ugggauuacaggugugagccac

SEQ ID NO: 956421 - RNA, 23 nt, Human
ugggauuacaggugugagccacc

SEQ ID NO: 956422 - RNA, 24 nt, Human
ugggauuacaggugugagccaccg

SEQ ID NO: 956423 - RNA, 24 nt, Human
uggguucaagcaauuuuccugucu

SEQ ID NO: 956424 - RNA, 23 nt, Human
ugucaucaucaucaccuccaucu

SEQ ID NO: 956425 - RNA, 19 nt, Human
ugucucagccuuccaagua

SEQ ID NO: 956426 - RNA, 23 nt, Human
ugugguggcgcaauccuggcuca

SEQ ID NO: 956427 - RNA, 25 nt, Human
ugugguggcgcaauccuggcucaac

SEQ ID NO: 956428 - RNA, 21 nt, Human
uuaaaaaacaacucugacuaa

SEQ ID NO: 956429 - RNA, 24 nt, Human
uuaguagaggcgagguuucgccau

SEQ ID NO: 956430 - RNA, 22 nt, Human
uuaguucagaccuuccuuuccu

SEQ ID NO: 956431 - RNA, 18 nt, Human
uucaaaagacaaauaagc

SEQ ID NO: 956432 - RNA, 24 nt, Human
uucacuuccuucuuccacgacaau

SEQ ID NO: 956433 - RNA, 24 nt, Human
uuccaaguagcagggacuacaggc

SEQ ID NO: 956434 - RNA, 24 nt, Human
uucuagauuaugcauaguauuuua

SEQ ID NO: 956435 - RNA, 23 nt, Human
uucuuccacgacaauuaguucag

SEQ ID NO: 956436 - RNA, 18 nt, Human
uugagacagagucucugu

SEQ ID NO: 956437 - RNA, 24 nt, Human
uugcccaggcuggagugugguggc

SEQ ID NO: 956438 - RNA, 21 nt, Human
uuuauaaguucugaggguuca

SEQ ID NO: 956439 - RNA, 24 nt, Human
uuucgccauguuggccaggcuggu

SEQ ID NO: 956440 - RNA, 23 nt, Human
uuugagacagagucucuguugcc

SEQ ID NO: 956441 - RNA, 22 nt, Human
uuuuuaguagaggcgagguuuc

SEQ ID NO: 956442 - RNA, 20 nt, Human
uuuuuguauuuuuaguagag

SEQ ID NO: 956443 - RNA, 21 nt, Human
uuuuuuguauuuuuaguagag

SEQ ID NO: 956444 - RNA, 24 nt, Human
uuuuuuguauuuuuaguagaggcg

SEQ ID NO: 956445 - RNA, 18 nt, Human
uuuuuuuuuuuuuuuuug

SEQ ID NO: 956446 - RNA, 23 nt, Human
aaagggacaagacaggaaggccu

SEQ ID NO: 956447 - RNA, 22 nt, Human
aacucagcgagguuggagcuga

SEQ ID NO: 956448 - RNA, 22 nt, Human
acuccaggacaaaaugcagagg

SEQ ID NO: 956449 - RNA, 18 nt, Human
agacaggaaggccugggg

SEQ ID NO: 956450 - RNA, 20 nt, Human
agcaggguggugggggcagc

SEQ ID NO: 956451 - RNA, 18 nt, Human
agcauuuggcugacaaug

SEQ ID NO: 956452 - RNA, 18 nt, Human
aggaaggccuggggaccg

SEQ ID NO: 956453 - RNA, 20 nt, Human
aggagggguggugggcggug

SEQ ID NO: 956454 - RNA, 20 nt, Human
aggccagaggagcagggugg

SEQ ID NO: 956455 - RNA, 19 nt, Human
agggacaagacaggaaggc

SEQ ID NO: 956456 - RNA, 23 nt, Human
agggacaagacaggaaggccugg

SEQ ID NO: 956457 - RNA, 19 nt, Human
caaauaucgacaugugaug

SEQ ID NO: 956458 - RNA, 23 nt, Human
cacuccaggacaaaaugcagagg

SEQ ID NO: 956459 - RNA, 21 nt, Human
cacucuggaaaggugcaugua

SEQ ID NO: 956460 - RNA, 23 nt, Human
cagcccucaggagggaacuggag

SEQ ID NO: 956461 - RNA, 23 nt, Human
cagcgagguuggagcugaaaccc

SEQ ID NO: 956462 - RNA, 21 nt, Human
caggagggguggugggcggug

SEQ ID NO: 956463 - RNA, 20 nt, Human
cagucauccuggcacagccc

SEQ ID NO: 956464 - RNA, 19 nt, Human
caguucccaguggggaggg

SEQ ID NO: 956465 - RNA, 21 nt, Human
cauguagaggccaugaucaaa

SEQ ID NO: 956466 - RNA, 23 nt, Human
caugugggcggucccaugugggc

SEQ ID NO: 956467 - RNA, 23 nt, Human
caugugggcggucccaugugggc

SEQ ID NO: 956468 - RNA, 20 nt, Human
caugugggcgguccuaugug

SEQ ID NO: 956469 - RNA, 20 nt, Human
caugugggcguucccaugug

SEQ ID NO: 956470 - RNA, 20 nt, Human
caugugggcguucccaugug

SEQ ID NO: 956471 - RNA, 24 nt, Human
ccaugugggcgguccuaugugggc

SEQ ID NO: 956472 - RNA, 21 nt, Human
ccccgccccacugcugccucg

SEQ ID NO: 956473 - RNA, 22 nt, Human
cccgagaagagaccacucugga

SEQ ID NO: 956474 - RNA, 23 nt, Human
cccugccacgggcuucccagaag

SEQ ID NO: 956475 - RNA, 23 nt, Human
ccugccacgggcuucccagaagc

SEQ ID NO: 956476 - RNA, 25 nt, Human
ccuggccgaggcugggggccacugu

SEQ ID NO: 956477 - RNA, 22 nt, Human
cgagaagagaccacucuggaaa

SEQ ID NO: 956478 - RNA, 24 nt, Human
cuaugugggcgguccuaugugggc

SEQ ID NO: 956479 - RNA, 19 nt, Human
gaaaagaauccucugcaaa

SEQ ID NO: 956480 - RNA, 24 nt, Human
gaacuggagggacaacccugugcc

SEQ ID NO: 956481 - RNA, 19 nt, Human
gagcaggguggugggggca

SEQ ID NO: 956482 - RNA, 28 nt, Human
gcacagcccucaggagggagggaacgcc

SEQ ID NO: 956483 - RNA, 18 nt, Human
gccgaggcugggggccac

SEQ ID NO: 956484 - RNA, 18 nt, Human
gcuucccagaagcggggu

SEQ ID NO: 956485 - RNA, 20 nt, Human
ggagggguggugggcggugg

SEQ ID NO: 956486 - RNA, 19 nt, Human
ggcggugggcgcugagcag

SEQ ID NO: 956487 - RNA, 18 nt, Human
gggaccguggacagggaa

SEQ ID NO: 956488 - RNA, 18 nt, Human
gggcuucccagaagcggg

SEQ ID NO: 956489 - RNA, 22 nt, Human
ggggaagcaggagggguggugg

SEQ ID NO: 956490 - RNA, 21 nt, Human
gguggugggggcagcuuugga

SEQ ID NO: 956491 - RNA, 27 nt, Human
gguggugggggcagcuuuggaaaggga

SEQ ID NO: 956492 - RNA, 21 nt, Human
gucccaugugggcgguccuau

SEQ ID NO: 956493 - RNA, 22 nt, Human
gugggcggaacagggucaggcu

SEQ ID NO: 956494 - RNA, 22 nt, Human
guucccaugugggcgguccuau

SEQ ID NO: 956495 - RNA, 22 nt, Human
guucccaugugggcgguccuau

SEQ ID NO: 956496 - RNA, 22 nt, Human
uaaaaauguuauuccacugaaa

SEQ ID NO: 956497 - RNA, 18 nt, Human
uaaaauuaagguauaagc

SEQ ID NO: 956498 - RNA, 21 nt, Human
uagcauuuggcugacaaugag

SEQ ID NO: 956499 - RNA, 23 nt, Human
uaugugggcggucccaugugggc

SEQ ID NO: 956500 - RNA, 23 nt, Human
uaugugggcggucccaugugggc

SEQ ID NO: 956501 - RNA, 23 nt, Human
uaugugggcggucccaugugggc

SEQ ID NO: 956502 - RNA, 20 nt, Human
ucacaacaggcgugcccagu

SEQ ID NO: 956503 - RNA, 20 nt, Human
ucagcgagguuggagcugaa

SEQ ID NO: 956504 - RNA, 19 nt, Human
uccaggacaaaaugcagag

SEQ ID NO: 956505 - RNA, 20 nt, Human
ucccaugugggcggucccau

SEQ ID NO: 956506 - RNA, 20 nt, Human
ucccaugugggcggucccau

SEQ ID NO: 956507 - RNA, 26 nt, Human
uccucugcaaauaaaauuaagguauu

SEQ ID NO: 956508 - RNA, 19 nt, Human
uccugggcccugugagcuc

SEQ ID NO: 956509 - RNA, 25 nt, Human
ucgcuggcacuccaggacaaaaugc

SEQ ID NO: 956510 - RNA, 22 nt, Human
ugaaccguaaaaccacacauua

SEQ ID NO: 956511 - RNA, 20 nt, Human
ugacaaugaguuauaaauac

SEQ ID NO: 956512 - RNA, 19 nt, Human
ugacccggagcugcaccaa

SEQ ID NO: 956513 - RNA, 21 nt, Human
ugccacgggcuucccagaagc

SEQ ID NO: 956514 - RNA, 24 nt, Human
ugccagagcauuuugagaaaagaa

SEQ ID NO: 956515 - RNA, 20 nt, Human
ugccagugggcggaacaggg

SEQ ID NO: 956516 - RNA, 19 nt, Human
ugggcgcugagcagagcag

SEQ ID NO: 956517 - RNA, 22 nt, Human
ugggcggaacagggucaggcuc

SEQ ID NO: 956518 - RNA, 19 nt, Human
ugggcgguccuaugcggcg

SEQ ID NO: 956519 - RNA, 22 nt, Human
ugggcggugggcgcugagcagg

SEQ ID NO: 956520 - RNA, 21 nt, Human
uggugggggcagcuuuggaaa

SEQ ID NO: 956521 - RNA, 24 nt, Human
uguccugggcccugugagcucugc

SEQ ID NO: 956522 - RNA, 21 nt, Human
uuccagauaaaaacaccuucc

SEQ ID NO: 956523 - RNA, 22 nt, Human
uuggaaagggacuaaaaagggc

SEQ ID NO: 956524 - RNA, 22 nt, Human
uuuuuuuuuuuuuuuuuucggg

SEQ ID NO: 956525 - RNA, 22 nt, Human
aaccugcccucccaucccccuu

SEQ ID NO: 956526 - RNA, 23 nt, Human
accaauaccuugcucugacuucu

SEQ ID NO: 956527 - RNA, 26 nt, Human
acccagugucuagugugggaggagua

SEQ ID NO: 956528 - RNA, 25 nt, Human
acccuagauccaggaugucagcagc

SEQ ID NO: 956529 - RNA, 18 nt, Human
acuccagucuaucacauu

SEQ ID NO: 956530 - RNA, 19 nt, Human
acuucaaagaaugucagaa

SEQ ID NO: 956531 - RNA, 25 nt, Human
acuucaaagaaugucagaagauuug

SEQ ID NO: 956532 - RNA, 26 nt, Human
agaaauaaauagagggaccuuagagc

SEQ ID NO: 956533 - RNA, 19 nt, Human
agagccccggcagagcuga

SEQ ID NO: 956534 - RNA, 19 nt, Human
agguggcccggaaccccac

SEQ ID NO: 956535 - RNA, 24 nt, Human
aucuucuuuacaacccuagaucca

SEQ ID NO: 956536 - RNA, 24 nt, Human
auuugagaguuuuuaagauguuuu

SEQ ID NO: 956537 - RNA, 23 nt, Human
caagaccaggacagaguuggcug

SEQ ID NO: 956538 - RNA, 21 nt, Human
cacucucccuccucaguccuu

SEQ ID NO: 956539 - RNA, 23 nt, Human
cagcccuggacccccacucuccc

SEQ ID NO: 956540 - RNA, 19 nt, Human
cagggacucccuucccaca

SEQ ID NO: 956541 - RNA, 30 nt, Human
cagggacucccuucccacagaugaggccuu

SEQ ID NO: 956542 - RNA, 19 nt, Human
cagggauccuucuccuccc

SEQ ID NO: 956543 - RNA, 25 nt, Human
caucccccuuagcgccuucuuggcc

SEQ ID NO: 956544 - RNA, 20 nt, Human
ccaagugccagaaacaauaa

SEQ ID NO: 956545 - RNA, 24 nt, Human
cccaccugcugccacuugguuguc

SEQ ID NO: 956546 - RNA, 20 nt, Human
cccacugaggugccuggggu

SEQ ID NO: 956547 - RNA, 23 nt, Human
cccccacucucccuccucagucc

SEQ ID NO: 956548 - RNA, 20 nt, Human
ccuagauccaggaugucagc

SEQ ID NO: 956549 - RNA, 21 nt, Human
ccuagggcugcaaaagggccc

SEQ ID NO: 956550 - RNA, 21 nt, Human
ccucccaucccccuuagcgcc

SEQ ID NO: 956551 - RNA, 22 nt, Human
ccucccaucccccuuagcgccu

SEQ ID NO: 956552 - RNA, 22 nt, Human
ccuggaaaaccugcccucccau

SEQ ID NO: 956553 - RNA, 24 nt, Human
ccuggaaaaccugcccucccaucc

SEQ ID NO: 956554 - RNA, 22 nt, Human
ccuggacccccacucucccucc

SEQ ID NO: 956555 - RNA, 22 nt, Human
ccuggugagaggccagccaggg

SEQ ID NO: 956556 - RNA, 18 nt, Human
ccuuagagccccggcaga

SEQ ID NO: 956557 - RNA, 24 nt, Human
cggcgggggcgcggggcggcucac

SEQ ID NO: 956558 - RNA, 20 nt, Human
cuccacacagccucuuggag

SEQ ID NO: 956559 - RNA, 20 nt, Human
cugcugccacuugguugucu

SEQ ID NO: 956560 - RNA, 22 nt, Human
cuucccgccgccauguuuccgc

SEQ ID NO: 956561 - RNA, 22 nt, Human
gaagccuguggacaggcgagug

SEQ ID NO: 956562 - RNA, 19 nt, Human
gaccaggacagaguuggcc

SEQ ID NO: 956563 - RNA, 20 nt, Human
gacuucugacaagucaguuu

SEQ ID NO: 956564 - RNA, 23 nt, Human
gagggcgcggcgggggcgcgggg

SEQ ID NO: 956565 - RNA, 21 nt, Human
gauuuucuucgacagcaguuc

SEQ ID NO: 956566 - RNA, 19 nt, Human
gcccuggacccccacucuc

SEQ ID NO: 956567 - RNA, 24 nt, Human
gccugauuuucuucgacagcaguu

SEQ ID NO: 956568 - RNA, 20 nt, Human
gccuggaaaaccugcccucc

SEQ ID NO: 956569 - RNA, 21 nt, Human
gcugcaaaagggccccgugaa

SEQ ID NO: 956570 - RNA, 21 nt, Human
ggccagggcaaggagcugugg

SEQ ID NO: 956571 - RNA, 21 nt, Human
ggcgcggcgggggcgcggggc

SEQ ID NO: 956572 - RNA, 20 nt, Human
ggugggggcaguaugagcca

SEQ ID NO: 956573 - RNA, 18 nt, Human
guacgagcuguggggcga

SEQ ID NO: 956574 - RNA, 23 nt, Human
guuuggauucaggggaaucuggu

SEQ ID NO: 956575 - RNA, 21 nt, Human
uaaacagauugacauaaaaua

SEQ ID NO: 956576 - RNA, 18 nt, Human
uaaauuaacaauaagauc

SEQ ID NO: 956577 - RNA, 22 nt, Human
uagggguuaagaaguuugggau

SEQ ID NO: 956578 - RNA, 21 nt, Human
ucaguuucuuuguaugcuaau

SEQ ID NO: 956579 - RNA, 21 nt, Human
ucauggaaggacuuaucaugg

SEQ ID NO: 956580 - RNA, 20 nt, Human
uccacacagccucuuggagu

SEQ ID NO: 956581 - RNA, 23 nt, Human
ucccaucccccuuagcgccuucu

SEQ ID NO: 956582 - RNA, 19 nt, Human
ucucccuccuccugaaacc

SEQ ID NO: 956583 - RNA, 25 nt, Human
ucucugggaccaaagcagggcaguc

SEQ ID NO: 956584 - RNA, 22 nt, Human
ucuggccagggcaaggagcugu

SEQ ID NO: 956585 - RNA, 21 nt, Human
ugaagaggggccacgccuauc

SEQ ID NO: 956586 - RNA, 22 nt, Human
ugacagggauccuucuccuccc

SEQ ID NO: 956587 - RNA, 20 nt, Human
ugagaaauaaauagagggaa

SEQ ID NO: 956588 - RNA, 21 nt, Human
ugagggaagagcagcaccagc

SEQ ID NO: 956589 - RNA, 20 nt, Human
uggaaggacuuaucauggca

SEQ ID NO: 956590 - RNA, 23 nt, Human
uggcagcgugaguagcugugcug

SEQ ID NO: 956591 - RNA, 24 nt, Human
uggcuaggagugguggcuccacag

SEQ ID NO: 956592 - RNA, 20 nt, Human
uggugagaggccagccaggg

SEQ ID NO: 956593 - RNA, 18 nt, Human
uguggacaggcgaguggg

SEQ ID NO: 956594 - RNA, 27 nt, Human
uguggugggggcaguaugagccagggg

SEQ ID NO: 956595 - RNA, 21 nt, Human
uuagcgccuucuuggccuucc

SEQ ID NO: 956596 - RNA, 20 nt, Human
uucuucgacagcaguucugg

SEQ ID NO: 956597 - RNA, 22 nt, Human
uuuguaugcuaauuucuccauc

SEQ ID NO: 956598 - RNA, 19 nt, Human
aaaagagcuacaugugaua

SEQ ID NO: 956599 - RNA, 26 nt, Human
aaaagagcuacaugugauaaaccaca

SEQ ID NO: 956600 - RNA, 19 nt, Human
aaacaaaaaugauguaucu

SEQ ID NO: 956601 - RNA, 22 nt, Human
aaacagccugcccuaggauucc

SEQ ID NO: 956602 - RNA, 22 nt, Human
aaacccaaaauaauuaauguug

SEQ ID NO: 956603 - RNA, 19 nt, Human
aaagugcugggauuccagg

SEQ ID NO: 956604 - RNA, 24 nt, Human
aaagugcugggauuccaggcauga

SEQ ID NO: 956605 - RNA, 20 nt, Human
aagcgauucuccugccucag

SEQ ID NO: 956606 - RNA, 21 nt, Human
aagcgauucuccugccucagc

SEQ ID NO: 956607 - RNA, 23 nt, Human
aagcugcugaccccuggagcuca

SEQ ID NO: 956608 - RNA, 19 nt, Human
aaguagcugggacuacagg

SEQ ID NO: 956609 - RNA, 20 nt, Human
aaguagcugggacuacaggc

SEQ ID NO: 956610 - RNA, 26 nt, Human
aaguagcugggacuacaggcgcacgc

SEQ ID NO: 956611 - RNA, 19 nt, Human
aagugcugggauuccaggc

SEQ ID NO: 956612 - RNA, 21 nt, Human
aauguccuuuuacaguccuuc

SEQ ID NO: 956613 - RNA, 19 nt, Human
acaguccuuccuggugucu

SEQ ID NO: 956614 - RNA, 23 nt, Human
accaugcccagcuaauuuuugua

SEQ ID NO: 956615 - RNA, 24 nt, Human
accucgugauccaccugccuuggc

SEQ ID NO: 956616 - RNA, 18 nt, Human
acggaguuucaucauggu

SEQ ID NO: 956617 - RNA, 20 nt, Human
acggaguuucaucaugguug

SEQ ID NO: 956618 - RNA, 21 nt, Human
acggaguuucaucaugguugg

SEQ ID NO: 956619 - RNA, 25 nt, Human
acggaguuucaucaugguuggccag

SEQ ID NO: 956620 - RNA, 24 nt, Human
acucugucaccaggcuggagugca

SEQ ID NO: 956621 - RNA, 18 nt, Human
agagaugaccaccacugu

SEQ ID NO: 956622 - RNA, 21 nt, Human
aggcgggaauaaaacagccug

SEQ ID NO: 956623 - RNA, 25 nt, Human
aggcuggagugcagugacacgaucu

SEQ ID NO: 956624 - RNA, 20 nt, Human
aggucaggggccuugggagc

SEQ ID NO: 956625 - RNA, 24 nt, Human
agugcagugacacgaucuuggcuc

SEQ ID NO: 956626 - RNA, 19 nt, Human
auccaccugccuuggccuc

SEQ ID NO: 956627 - RNA, 23 nt, Human
auggaacacaaacagaaagcuuu

SEQ ID NO: 956628 - RNA, 23 nt, Human
caaacccaaaauaauuaauguug

SEQ ID NO: 956629 - RNA, 23 nt, Human
caaagugcugggauuccaggcau

SEQ ID NO: 956630 - RNA, 24 nt, Human
caaagugcugggauuccaggcaug

SEQ ID NO: 956631 - RNA, 20 nt, Human
cacagauccucagaaaggcc

SEQ ID NO: 956632 - RNA, 22 nt, Human
cacagauccucagaaaggccuc

SEQ ID NO: 956633 - RNA, 23 nt, Human
caccugccuuggccucucaaagu

SEQ ID NO: 956634 - RNA, 24 nt, Human
caccugccuuggccucucaaagug

SEQ ID NO: 956635 - RNA, 23 nt, Human
cacucugucaccaggcuggagug

SEQ ID NO: 956636 - RNA, 21 nt, Human
caggcaugagccacugcgccc

SEQ ID NO: 956637 - RNA, 19 nt, Human
cagugacacgaucuuggcu

SEQ ID NO: 956638 - RNA, 22 nt, Human
caugguuggccaggauggucuc

SEQ ID NO: 956639 - RNA, 22 nt, Human
ccacagauccucagaaaggccu

SEQ ID NO: 956640 - RNA, 21 nt, Human
ccaggcaugagccacugcgcc

SEQ ID NO: 956641 - RNA, 23 nt, Human
cccaaguagcugggacuacaggc

SEQ ID NO: 956642 - RNA, 24 nt, Human
cccaaguagcugggacuacaggcg

SEQ ID NO: 956643 - RNA, 23 nt, Human
cccagguuuaagcgauucuccug

SEQ ID NO: 956644 - RNA, 24 nt, Human
ccugccucagccucccaaguagcu

SEQ ID NO: 956645 - RNA, 25 nt, Human
ccuugggagcugauuggcugugaag

SEQ ID NO: 956646 - RNA, 25 nt, Human
cggaguuucaucaugguuggccagg

SEQ ID NO: 956647 - RNA, 23 nt, Human
cucacucugucaccaggcuggag

SEQ ID NO: 956648 - RNA, 24 nt, Human
cucacugcaaccuccgucucccag

SEQ ID NO: 956649 - RNA, 24 nt, Human
cucagccucccaaguagcugggac

SEQ ID NO: 956650 - RNA, 24 nt, Human
cucuugaccucgugauccaccugc

SEQ ID NO: 956651 - RNA, 23 nt, Human
cugcaaccuccgucucccagguu

SEQ ID NO: 956652 - RNA, 24 nt, Human
cugcaaccuccgucucccagguuu

SEQ ID NO: 956653 - RNA, 24 nt, Human
cuuaaaauuuuaauguguuuuuug

SEQ ID NO: 956654 - RNA, 21 nt, Human
cuugaccucgugauccaccug

SEQ ID NO: 956655 - RNA, 24 nt, Human
cuuggccucucaaagugcugggau

SEQ ID NO: 956656 - RNA, 30 nt, Human
cuuuauugaauuuauauauauauauauauu

SEQ ID NO: 956657 - RNA, 21 nt, Human
gaccucgugauccaccugccu

SEQ ID NO: 956658 - RNA, 24 nt, Human
gaccucgugauccaccugccuugg

SEQ ID NO: 956659 - RNA, 18 nt, Human
gagcuacaugugauaaac

SEQ ID NO: 956660 - RNA, 19 nt, Human
gauuccaggcaugagccac

SEQ ID NO: 956661 - RNA, 22 nt, Human
gauuccaggcaugagccacugc

SEQ ID NO: 956662 - RNA, 21 nt, Human
gauucuccugccucagccucc

SEQ ID NO: 956663 - RNA, 22 nt, Human
gcaaccuccgucucccagguuu

SEQ ID NO: 956664 - RNA, 22 nt, Human
gcccagcuaauuuuuguauuuu

SEQ ID NO: 956665 - RNA, 20 nt, Human
gccucagccucccaaguagc

SEQ ID NO: 956666 - RNA, 22 nt, Human
gccuuggccucucaaagugcug

SEQ ID NO: 956667 - RNA, 24 nt, Human
gcgauucuccugccucagccuccc

SEQ ID NO: 956668 - RNA, 19 nt, Human
gcuggagugcagugacacg

SEQ ID NO: 956669 - RNA, 19 nt, Human
gggccuugggagcugauug

SEQ ID NO: 956670 - RNA, 22 nt, Human
gugauccaccugccuuggccuc

SEQ ID NO: 956671 - RNA, 26 nt, Human
uaaaaaaugucugcaauaagcuauuc

SEQ ID NO: 956672 - RNA, 18 nt, Human
uaaaacagccugcccuag

SEQ ID NO: 956673 - RNA, 27 nt, Human
uaagcgauucuccugccucagccuccc

SEQ ID NO: 956674 - RNA, 19 nt, Human
uaauuuggugaauccacuc

SEQ ID NO: 956675 - RNA, 23 nt, Human
uaauuuuuguauuuuaguagaga

SEQ ID NO: 956676 - RNA, 24 nt, Human
uacaaaagcugagcugaggucagg

SEQ ID NO: 956677 - RNA, 24 nt, Human
uaguagagacggaguuucaucaug

SEQ ID NO: 956678 - RNA, 24 nt, Human
uaucauuuaaaaugaaauugaaau

SEQ ID NO: 956679 - RNA, 20 nt, Human
uauggaacacaaacagaaag

SEQ ID NO: 956680 - RNA, 18 nt, Human
ucaaagugcugggauucc

SEQ ID NO: 956681 - RNA, 24 nt, Human
ucaaagugcugggauuccaggcau

SEQ ID NO: 956682 - RNA, 19 nt, Human
ucacugcaaccuccgucuc

SEQ ID NO: 956683 - RNA, 24 nt, Human
ucacugcaaccuccgucucccagg

SEQ ID NO: 956684 - RNA, 25 nt, Human
ucacugcaaccuccgucucccaggu

SEQ ID NO: 956685 - RNA, 20 nt, Human
ucagccucccaaguagcugg

SEQ ID NO: 956686 - RNA, 21 nt, Human
ucaggacagagacaagccaca

SEQ ID NO: 956687 - RNA, 24 nt, Human
ucccaaguagcugggacuacaggc

SEQ ID NO: 956688 - RNA, 21 nt, Human
ucccagguuuaagcgauucuc

SEQ ID NO: 956689 - RNA, 24 nt, Human
ucccagguuuaagcgauucuccug

SEQ ID NO: 956690 - RNA, 21 nt, Human
uccuuccuggugucuucuucc

SEQ ID NO: 956691 - RNA, 24 nt, Human
ucucaaagugcugggauuccaggc

SEQ ID NO: 956692 - RNA, 21 nt, Human
ucucacucugucaccaggcug

SEQ ID NO: 956693 - RNA, 23 nt, Human
ucucacucugucaccaggcugga

SEQ ID NO: 956694 - RNA, 24 nt, Human
ucucccagguuuaagcgauucucc

SEQ ID NO: 956695 - RNA, 26 nt, Human
ucuccugccucagccucccaaguagc

SEQ ID NO: 956696 - RNA, 23 nt, Human
ucugucaccaggcuggagugcag

SEQ ID NO: 956697 - RNA, 18 nt, Human
ugaaacagagucucacuc

SEQ ID NO: 956698 - RNA, 22 nt, Human
ugaaacagagucucacucuguc

SEQ ID NO: 956699 - RNA, 19 nt, Human
ugaccucgugauccaccug

SEQ ID NO: 956700 - RNA, 23 nt, Human
ugaccucgugauccaccugccuu

SEQ ID NO: 956701 - RNA, 22 nt, Human
ugcagugacacgaucuuggcuc

SEQ ID NO: 956702 - RNA, 22 nt, Human
ugcaucaggaaaauaucaaaca

SEQ ID NO: 956703 - RNA, 24 nt, Human
ugccucagccucccaaguagcugg

SEQ ID NO: 956704 - RNA, 19 nt, Human
uggaacacaaacagaaagc

SEQ ID NO: 956705 - RNA, 21 nt, Human
uggaacacaaacagaaagcuu

SEQ ID NO: 956706 - RNA, 23 nt, Human
uggagugcagugacacgaucuug

SEQ ID NO: 956707 - RNA, 24 nt, Human
uggagugcagugacacgaucuugg

SEQ ID NO: 956708 - RNA, 22 nt, Human
uggccaggauggucucgaucuc

SEQ ID NO: 956709 - RNA, 24 nt, Human
ugggacuacaggcgcacgcaacca

SEQ ID NO: 956710 - RNA, 25 nt, Human
ugggacuacaggcgcacgcaaccau

SEQ ID NO: 956711 - RNA, 18 nt, Human
ugggagcugauuggcugu

SEQ ID NO: 956712 - RNA, 18 nt, Human
ugggauuccaggcaugag

SEQ ID NO: 956713 - RNA, 22 nt, Human
ugggauuccaggcaugagccac

SEQ ID NO: 956714 - RNA, 24 nt, Human
ugggauuccaggcaugagccacug

SEQ ID NO: 956715 - RNA, 26 nt, Human
ugggauuccaggcaugagccacugcg

SEQ ID NO: 956716 - RNA, 20 nt, Human
ugguagcuugugaaagggua

SEQ ID NO: 956717 - RNA, 18 nt, Human
ugugaagcuaugagguag

SEQ ID NO: 956718 - RNA, 18 nt, Human
uguguuuuuuguuucuua

SEQ ID NO: 956719 - RNA, 18 nt, Human
uuaguagagacggaguuu

SEQ ID NO: 956720 - RNA, 21 nt, Human
uuaguagagacggaguuucau

SEQ ID NO: 956721 - RNA, 24 nt, Human
uuaguagagacggaguuucaucau

SEQ ID NO: 956722 - RNA, 18 nt, Human
uuggccucucaaagugcu

SEQ ID NO: 956723 - RNA, 24 nt, Human
uuuaagcgauucuccugccucagc

SEQ ID NO: 956724 - RNA, 25 nt, Human
uuuacaguccuuccuggugucuucu

SEQ ID NO: 956725 - RNA, 31 nt, Human
uuuacaguccuuccuggugucuucuuccuuu

SEQ ID NO: 956726 - RNA, 19 nt, Human
uuuauauauauauauauau

SEQ ID NO: 956727 - RNA, 20 nt, Human
uuuauauauauauauauauu

SEQ ID NO: 956728 - RNA, 22 nt, Human
uuuuaguagagacggaguuuca

SEQ ID NO: 956729 - RNA, 20 nt, Human
uuuuguauuuuaguagagac

SEQ ID NO: 956730 - RNA, 19 nt, Human
uuuuuguauuuuaguagag

SEQ ID NO: 956731 - RNA, 23 nt, Human
uuuuuuuuuuuuuuuuuuuaugg

SEQ ID NO: 956732 - RNA, 24 nt, Human
acacaaauaaaucacuuucacagg

SEQ ID NO: 956733 - RNA, 26 nt, Human
acagaguucucuuacgauucuuaaag

SEQ ID NO: 956734 - RNA, 18 nt, Human
acaggcuguaaacaauau

SEQ ID NO: 956735 - RNA, 26 nt, Human
caaaaauaaccaucugcuaaugcugc

SEQ ID NO: 956736 - RNA, 25 nt, Human
cagaguucucuuacgauucuuaaag

SEQ ID NO: 956737 - RNA, 23 nt, Human
caucagugcaaaaauaaccaucu

SEQ ID NO: 956738 - RNA, 18 nt, Human
cccaccuuucuuaggaaa

SEQ ID NO: 956739 - RNA, 21 nt, Human
cccaccuuucuuaggaaauca

SEQ ID NO: 956740 - RNA, 21 nt, Human
cugcacugccuucgagaauau

SEQ ID NO: 956741 - RNA, 24 nt, Human
cuguaaacaauauaucaaaaauga

SEQ ID NO: 956742 - RNA, 23 nt, Human
guuagugacugcacugccuucga

SEQ ID NO: 956743 - RNA, 26 nt, Human
uaaaaaccaaaaaacugaaucaauca

SEQ ID NO: 956744 - RNA, 22 nt, Human
uaacacaaauaaaucacuuuca

SEQ ID NO: 956745 - RNA, 22 nt, Human
uaauuccuacagaguucucuua

SEQ ID NO: 956746 - RNA, 21 nt, Human
uauaaucaauaauuccuacag

SEQ ID NO: 956747 - RNA, 25 nt, Human
uauuuuaauuccucuucagcuccuc

SEQ ID NO: 956748 - RNA, 23 nt, Human
uccucaaaagaguuuuauuaaca

SEQ ID NO: 956749 - RNA, 23 nt, Human
ugcaaaaauaaccaucugcuaau

SEQ ID NO: 956750 - RNA, 22 nt, Human
ugggaaacaagacuaauuacaa

SEQ ID NO: 956751 - RNA, 24 nt, Human
ugggaaacaagacuaauuacaauc

SEQ ID NO: 956752 - RNA, 23 nt, Human
uuaaaaaccaaaaaacugaauca

SEQ ID NO: 956753 - RNA, 21 nt, Human
uuaauuccucuucagcuccuc

SEQ ID NO: 956754 - RNA, 20 nt, Human
uuccucuucagcuccucaca

SEQ ID NO: 956755 - RNA, 18 nt, Human
uuuuuuuuuuuuuuucug

SEQ ID NO: 956756 - RNA, 19 nt, Human
uuuuuuuuuuuuuuucugu

SEQ ID NO: 956757 - RNA, 25 nt, Human
aaaaaauaacccaaagaaagagaac

SEQ ID NO: 956758 - RNA, 23 nt, Human
aaaaacaaaacaaaacaaaacaa

SEQ ID NO: 956759 - RNA, 22 nt, Human
aaaaagccauuuuaaaaaauau

SEQ ID NO: 956760 - RNA, 23 nt, Human
aaaacaaaacaaaacaaaacaaa

SEQ ID NO: 956761 - RNA, 18 nt, Human
aaacaaaacaaaacaaaa

SEQ ID NO: 956762 - RNA, 22 nt, Human
aaacaaaacaaaacaaaacaaa

SEQ ID NO: 956763 - RNA, 22 nt, Human
aaacaaaacaaaacaaaacaaa

SEQ ID NO: 956764 - RNA, 22 nt, Human
aaacaaaacaaaacaaaacaaa

SEQ ID NO: 956765 - RNA, 25 nt, Human
aaacaaaagccuuuuccccccaaag

SEQ ID NO: 956766 - RNA, 22 nt, Human
aaacaacaaaaagccauuuuaa

SEQ ID NO: 956767 - RNA, 23 nt, Human
aaagaaagagaaccuacagauua

SEQ ID NO: 956768 - RNA, 23 nt, Human
aacaaaagccuuuuccccccaaa

SEQ ID NO: 956769 - RNA, 23 nt, Human
aagacaaaaacaaaacaaaacaa

SEQ ID NO: 956770 - RNA, 21 nt, Human
acaaaacaaaacaaaacaaaa

SEQ ID NO: 956771 - RNA, 21 nt, Human
acaaaacaaaacaaaacaaaa

SEQ ID NO: 956772 - RNA, 21 nt, Human
acaaaacaaaacaaaacaaaa

SEQ ID NO: 956773 - RNA, 26 nt, Human
acaaaacaaaacaaaacaaaagccuu

SEQ ID NO: 956774 - RNA, 22 nt, Human
acaaaacaaaagccuuuucccc

SEQ ID NO: 956775 - RNA, 22 nt, Human
acccaaagaaagagaaccuaca

SEQ ID NO: 956776 - RNA, 24 nt, Human
acgaggagccgccgccgcugcugu

SEQ ID NO: 956777 - RNA, 21 nt, Human
acuacaaaacaucguaagccu

SEQ ID NO: 956778 - RNA, 21 nt, Human
acucuggguauguaaauggcc

SEQ ID NO: 956779 - RNA, 26 nt, Human
agaaacacugcagcugcucagccucc

SEQ ID NO: 956780 - RNA, 20 nt, Human
aggagccgccgccgcugcug

SEQ ID NO: 956781 - RNA, 20 nt, Human
aggauguggaguaaaacccc

SEQ ID NO: 956782 - RNA, 20 nt, Human
aggggaggaaaauggguuca

SEQ ID NO: 956783 - RNA, 18 nt, Human
aggggcugcgcggggugg

SEQ ID NO: 956784 - RNA, 19 nt, Human
agguucuuguccaguggcc

SEQ ID NO: 956785 - RNA, 25 nt, Human
caaaaacaaaacaaaacaaaacaaa

SEQ ID NO: 956786 - RNA, 21 nt, Human
caaaacaaaacaaaacaaaac

SEQ ID NO: 956787 - RNA, 24 nt, Human
caaaacaaaacaaaacaaaacaaa

SEQ ID NO: 956788 - RNA, 25 nt, Human
caaaacaaaacaaaacaaaacaaaa

SEQ ID NO: 956789 - RNA, 22 nt, Human
caaaacaaaacaaaacaaaagc

SEQ ID NO: 956790 - RNA, 25 nt, Human
caaaacaaaacaaaagccuuuuccc

SEQ ID NO: 956791 - RNA, 22 nt, Human
caaaacaaaagccuuuuccccc

SEQ ID NO: 956792 - RNA, 22 nt, Human
caaacaaacaacaaaaagccau

SEQ ID NO: 956793 - RNA, 18 nt, Human
cacagcuccccaaauccc

SEQ ID NO: 956794 - RNA, 18 nt, Human
cacuauacaacacugagc

SEQ ID NO: 956795 - RNA, 22 nt, Human
cagagaaaauuagugaauccca

SEQ ID NO: 956796 - RNA, 21 nt, Human
cagcugcucagccuccucauu

SEQ ID NO: 956797 - RNA, 23 nt, Human
caggcuccucagaggggaggggg

SEQ ID NO: 956798 - RNA, 23 nt, Human
caguggccuaagauccauuuccu

SEQ ID NO: 956799 - RNA, 24 nt, Human
cccaaagaaagagaaccuacagau

SEQ ID NO: 956800 - RNA, 20 nt, Human
cccccaaagaaauacagaaa

SEQ ID NO: 956801 - RNA, 22 nt, Human
ccccgcuccucccggggguaga

SEQ ID NO: 956802 - RNA, 21 nt, Human
ccuccaagcgccggguggucu

SEQ ID NO: 956803 - RNA, 24 nt, Human
ccugcacccuccacagcuccccaa

SEQ ID NO: 956804 - RNA, 18 nt, Human
cgccaagacuacaaaaca

SEQ ID NO: 956805 - RNA, 21 nt, Human
cgccaagacuacaaaacaucg

SEQ ID NO: 956806 - RNA, 21 nt, Human
cggcagccugcccugccuucc

SEQ ID NO: 956807 - RNA, 21 nt, Human
cgggaggggcugcgcggggug

SEQ ID NO: 956808 - RNA, 23 nt, Human
cgggguggccgggacggcggggc

SEQ ID NO: 956809 - RNA, 22 nt, Human
cuagaagaaaguggugauuacu

SEQ ID NO: 956810 - RNA, 18 nt, Human
cuauuauuuucaagacaa

SEQ ID NO: 956811 - RNA, 24 nt, Human
cucacuauacaacacugagcuauu

SEQ ID NO: 956812 - RNA, 24 nt, Human
cucagaggggagggggaggggaaa

SEQ ID NO: 956813 - RNA, 22 nt, Human
cuccgcggucaccccgcuccuc

SEQ ID NO: 956814 - RNA, 24 nt, Human
cuccucauucagugaagugagggu

SEQ ID NO: 956815 - RNA, 19 nt, Human
cucgcggacggccccgccc

SEQ ID NO: 956816 - RNA, 23 nt, Human
cucggggcuuucugcuccuaagg

SEQ ID NO: 956817 - RNA, 19 nt, Human
cugcaauggcuucuccucc

SEQ ID NO: 956818 - RNA, 24 nt, Human
cugccuuccaaacaaacaacaaaa

SEQ ID NO: 956819 - RNA, 21 nt, Human
cugcggcugaggcgaggaagc

SEQ ID NO: 956820 - RNA, 21 nt, Human
cugggacucagacugaagcuc

SEQ ID NO: 956821 - RNA, 19 nt, Human
cugggagacucuugcaacu

SEQ ID NO: 956822 - RNA, 21 nt, Human
gacggccccgcccgggcuguc

SEQ ID NO: 956823 - RNA, 18 nt, Human
gacggcggggcuggcccg

SEQ ID NO: 956824 - RNA, 21 nt, Human
gaucugcaauggcuucuccuc

SEQ ID NO: 956825 - RNA, 20 nt, Human
gcaacggcagccugcccugc

SEQ ID NO: 956826 - RNA, 19 nt, Human
gccacggcugccgcugccu

SEQ ID NO: 956827 - RNA, 22 nt, Human
gccuuccuccugcacccuccac

SEQ ID NO: 956828 - RNA, 19 nt, Human
gcugcucagccuccucauu

SEQ ID NO: 956829 - RNA, 21 nt, Human
ggaaggcugggacaggggagg

SEQ ID NO: 956830 - RNA, 20 nt, Human
ggacaggggaggaaaauggg

SEQ ID NO: 956831 - RNA, 19 nt, Human
ggaggaaaauggguucagg

SEQ ID NO: 956832 - RNA, 18 nt, Human
ggagggggaggggaaacg

SEQ ID NO: 956833 - RNA, 20 nt, Human
ggcgaggaagccgucugggg

SEQ ID NO: 956834 - RNA, 20 nt, Human
gggaggggcugcgcggggug

SEQ ID NO: 956835 - RNA, 22 nt, Human
ggggcugcgcgggguggccggg

SEQ ID NO: 956836 - RNA, 20 nt, Human
ggugggcggcgggggcggcg

SEQ ID NO: 956837 - RNA, 21 nt, Human
ggugggcggcgggggcggcgg

SEQ ID NO: 956838 - RNA, 20 nt, Human
uaaagcaucacuagaagaaa

SEQ ID NO: 956839 - RNA, 19 nt, Human
uaacaaauguaaaucauau

SEQ ID NO: 956840 - RNA, 21 nt, Human
uaacccaaagaaagagaaccu

SEQ ID NO: 956841 - RNA, 22 nt, Human
uacaaaugucuauuauuuucaa

SEQ ID NO: 956842 - RNA, 18 nt, Human
uacagggugggcggcggg

SEQ ID NO: 956843 - RNA, 21 nt, Human
uaugacauguccauuugugca

SEQ ID NO: 956844 - RNA, 21 nt, Human
ucaaagugggaaggcugggac

SEQ ID NO: 956845 - RNA, 23 nt, Human
ucaaagugggaaggcugggacag

SEQ ID NO: 956846 - RNA, 24 nt, Human
ucaagacaaaaacaaaacaaaaca

SEQ ID NO: 956847 - RNA, 26 nt, Human
ucaagacaaaaacaaaacaaaacaaa

SEQ ID NO: 956848 - RNA, 22 nt, Human
ucaauggcccucggggcuuucu

SEQ ID NO: 956849 - RNA, 26 nt, Human
uccaaacaaacaacaaaaaggaguuc

SEQ ID NO: 956850 - RNA, 23 nt, Human
ucggggcuuucugcugcggcuga

SEQ ID NO: 956851 - RNA, 20 nt, Human
ugagccugggagacucuugc

SEQ ID NO: 956852 - RNA, 22 nt, Human
uggaagagguagucauuuugga

SEQ ID NO: 956853 - RNA, 25 nt, Human
uggcagcaguaaggaacacaguuaa

SEQ ID NO: 956854 - RNA, 20 nt, Human
uggcccgggacccccgucgg

SEQ ID NO: 956855 - RNA, 23 nt, Human
ugggggaaggauguggaguaaaa

SEQ ID NO: 956856 - RNA, 18 nt, Human
ugucugggggaaggaugu

SEQ ID NO: 956857 - RNA, 20 nt, Human
ugucugggggaaggaugugg

SEQ ID NO: 956858 - RNA, 18 nt, Human
uguguccuuacgccaaga

SEQ ID NO: 956859 - RNA, 18 nt, Human
uguuaaacagcucggcug

SEQ ID NO: 956860 - RNA, 25 nt, Human
uuauuuucaagacaaaaacaaaaca

SEQ ID NO: 956861 - RNA, 21 nt, Human
uucaagacaaaaacaaaacaa

SEQ ID NO: 956862 - RNA, 19 nt, Human
uucagugaagugaggguga

SEQ ID NO: 956863 - RNA, 22 nt, Human
uuccaaacaaacaacaaaaagc

SEQ ID NO: 956864 - RNA, 23 nt, Human
uuggaucugcaauggcuucuccu

SEQ ID NO: 956865 - RNA, 19 nt, Human
uuucugcugcggcugaggc

SEQ ID NO: 956866 - RNA, 22 nt, Human
aacuagucuauacaagaaccuc

SEQ ID NO: 956867 - RNA, 18 nt, Human
aggugcuggaaggagcuu

SEQ ID NO: 956868 - RNA, 18 nt, Human
aguuugugggaaaucagg

SEQ ID NO: 956869 - RNA, 18 nt, Human
caaaaggagaagagagga

SEQ ID NO: 956870 - RNA, 20 nt, Human
cagaggaugcuucuuaaaug

SEQ ID NO: 956871 - RNA, 19 nt, Human
ccacagagaaaaauuagau

SEQ ID NO: 956872 - RNA, 22 nt, Human
ccaggacuguggggaggagggg

SEQ ID NO: 956873 - RNA, 20 nt, Human
ccugagggauuuuaaaagaa

SEQ ID NO: 956874 - RNA, 20 nt, Human
cugccuccuuuggaaguguu

SEQ ID NO: 956875 - RNA, 22 nt, Human
cugccuugucucuggccuggga

SEQ ID NO: 956876 - RNA, 21 nt, Human
cugcuccagccaggacugugg

SEQ ID NO: 956877 - RNA, 22 nt, Human
cuuuuucuucuuuccuuuuggu

SEQ ID NO: 956878 - RNA, 23 nt, Human
gagaggaggugcuggaaggagcu

SEQ ID NO: 956879 - RNA, 19 nt, Human
gcccuuuuucuucuuuccc

SEQ ID NO: 956880 - RNA, 25 nt, Human
gcuucuuuacaaaugaaccuuuguc

SEQ ID NO: 956881 - RNA, 19 nt, Human
ggagaagagaggaggugcu

SEQ ID NO: 956882 - RNA, 24 nt, Human
ggagaagagaggaggugcuggaag

SEQ ID NO: 956883 - RNA, 19 nt, Human
guagugcaguuugugggaa

SEQ ID NO: 956884 - RNA, 24 nt, Human
uccagccaggacuguggggaggag

SEQ ID NO: 956885 - RNA, 23 nt, Human
ucugccuugucucuggccuggga

SEQ ID NO: 956886 - RNA, 20 nt, Human
ugaguuugggcaaaaggaga

SEQ ID NO: 956887 - RNA, 18 nt, Human
uggaaggagacaaggcug

SEQ ID NO: 956888 - RNA, 22 nt, Human
ugggcaaaaggagaagagagga

SEQ ID NO: 956889 - RNA, 24 nt, Human
ugggcaaaaggagaagagaggagg

SEQ ID NO: 956890 - RNA, 24 nt, Human
uggggaggaggggaguggaaggag

SEQ ID NO: 956891 - RNA, 24 nt, Human
uuggcagaggaugcuucuuaaaug

SEQ ID NO: 956892 - RNA, 20 nt, Human
uuuggaaguguucaguuugu

SEQ ID NO: 956893 - RNA, 20 nt, Human
uuugggcaaaaggagaagag

SEQ ID NO: 956894 - RNA, 19 nt, Human
agaaggaaugguguagggc

SEQ ID NO: 956895 - RNA, 22 nt, Human
agcagcuuugaugagccuggug

SEQ ID NO: 956896 - RNA, 22 nt, Human
agcccacaauggaaagaaaucu

SEQ ID NO: 956897 - RNA, 27 nt, Human
agggcagaaggaaugguguagggcugg

SEQ ID NO: 956898 - RNA, 22 nt, Human
cccacaauggaaagaaaucugc

SEQ ID NO: 956899 - RNA, 18 nt, Human
cuggcuugggccuuccug

SEQ ID NO: 956900 - RNA, 18 nt, Human
cuggucuggcuugggccu

SEQ ID NO: 956901 - RNA, 26 nt, Human
cuucuggucuggcuugggaggaaaac

SEQ ID NO: 956902 - RNA, 18 nt, Human
gcuugggccuuccuggag

SEQ ID NO: 956903 - RNA, 19 nt, Human
ggugaagcuaagagcucac

SEQ ID NO: 956904 - RNA, 20 nt, Human
uagcuuaucaagaccaagca

SEQ ID NO: 956905 - RNA, 22 nt, Human
uccucugugaccuagcaaaagc

SEQ ID NO: 956906 - RNA, 23 nt, Human
uuccagagcccacaauggaaaga

SEQ ID NO: 956907 - RNA, 22 nt, Human
uuucggggacaggugaagccau

SEQ ID NO: 956908 - RNA, 18 nt, Human
aagagaggagagggggaa

SEQ ID NO: 956909 - RNA, 18 nt, Human
agggaggaagagaggaga

SEQ ID NO: 956910 - RNA, 22 nt, Human
auacugaucaucuuugccagga

SEQ ID NO: 956911 - RNA, 19 nt, Human
auauauauauauauauaua

SEQ ID NO: 956912 - RNA, 19 nt, Human
cccacacgugacaggggau

SEQ ID NO: 956913 - RNA, 19 nt, Human
cuuuggguucacaagaaca

SEQ ID NO: 956914 - RNA, 19 nt, Human
gaggaagagaggagagggg

SEQ ID NO: 956915 - RNA, 24 nt, Human
ggggaucgaauuggggcucccagg

SEQ ID NO: 956916 - RNA, 19 nt, Human
uaugcacauacuuuaugua

SEQ ID NO: 956917 - RNA, 23 nt, Human
uccagggaggaagagaggagagg

SEQ ID NO: 956918 - RNA, 21 nt, Human
ucccaggggguaaagaaucug

SEQ ID NO: 956919 - RNA, 22 nt, Human
ugagguuaccucagaaugcauu

SEQ ID NO: 956920 - RNA, 19 nt, Human
uggaggauaaguuuuaaag

SEQ ID NO: 956921 - RNA, 24 nt, Human
uguaagaagggaaaacaaauuagg

SEQ ID NO: 956922 - RNA, 27 nt, Human
uuuaaaaaaaaauauauauauauauau

SEQ ID NO: 956923 - RNA, 23 nt, Human
aaagaucagcaauacucaaauaa

SEQ ID NO: 956924 - RNA, 28 nt, Human
aaagaucagcaauacucaaauaaacucc

SEQ ID NO: 956925 - RNA, 19 nt, Human
aaagucauuucacguacuc

SEQ ID NO: 956926 - RNA, 24 nt, Human
agcaucccuucauguccaugacuc

SEQ ID NO: 956927 - RNA, 20 nt, Human
auucacaaagagcucuccuu

SEQ ID NO: 956928 - RNA, 24 nt, Human
cagcaauacucaaauaaacuccaa

SEQ ID NO: 956929 - RNA, 18 nt, Human
caggcaugcucucaaccc

SEQ ID NO: 956930 - RNA, 23 nt, Human
cucaaauaaacuccaaaccagca

SEQ ID NO: 956931 - RNA, 23 nt, Human
cuccuuccuacauugcagcaucc

SEQ ID NO: 956932 - RNA, 21 nt, Human
cucucugcuccucuggcuguu

SEQ ID NO: 956933 - RNA, 20 nt, Human
gcaacaccucacauucacaa

SEQ ID NO: 956934 - RNA, 23 nt, Human
gcaucccuucauguccaugacuc

SEQ ID NO: 956935 - RNA, 20 nt, Human
guacuccagcuugauuucag

SEQ ID NO: 956936 - RNA, 23 nt, Human
uaauagccaauauuacuuaacac

SEQ ID NO: 956937 - RNA, 26 nt, Human
uacaaacccacugccagcagcucaua

SEQ ID NO: 956938 - RNA, 21 nt, Human
uauugcauucaucuuuccaca

SEQ ID NO: 956939 - RNA, 19 nt, Human
ucacguacuccagcuugau

SEQ ID NO: 956940 - RNA, 19 nt, Human
ucauuucacguacuccagc

SEQ ID NO: 956941 - RNA, 18 nt, Human
uccaaaccagcaacaagu

SEQ ID NO: 956942 - RNA, 20 nt, Human
uccaaagcauagaagaggag

SEQ ID NO: 956943 - RNA, 18 nt, Human
ucugcaaaaugucagcag

SEQ ID NO: 956944 - RNA, 25 nt, Human
ugaaucacaaaaccgaaugcauccu

SEQ ID NO: 956945 - RNA, 25 nt, Human
uuccaaagcauagaagaggaggcca

SEQ ID NO: 956946 - RNA, 18 nt, Human
uugaaucacaaaaccgaa

SEQ ID NO: 956947 - RNA, 21 nt, Human
aaaaagagaacaaggcugaga

SEQ ID NO: 956948 - RNA, 21 nt, Human
aagaagaggaggauccaggaa

SEQ ID NO: 956949 - RNA, 23 nt, Human
aagcuguucagaacuacuggauu

SEQ ID NO: 956950 - RNA, 19 nt, Human
aagcuguugugggaggaga

SEQ ID NO: 956951 - RNA, 23 nt, Human
aagcuuugacaucauuaacucug

SEQ ID NO: 956952 - RNA, 21 nt, Human
acuggauuuuccaguggaagc

SEQ ID NO: 956953 - RNA, 20 nt, Human
agcgguggguggaggagggg

SEQ ID NO: 956954 - RNA, 22 nt, Human
aggcaggagagggcagccacgg

SEQ ID NO: 956955 - RNA, 19 nt, Human
aggcagggcuggccgagga

SEQ ID NO: 956956 - RNA, 21 nt, Human
agguguuggagguggguggcu

SEQ ID NO: 956957 - RNA, 22 nt, Human
caaggaagagucuucccuccag

SEQ ID NO: 956958 - RNA, 22 nt, Human
caaggacagcaacaagcaugag

SEQ ID NO: 956959 - RNA, 24 nt, Human
caaggacagcaacaagcaugaggc

SEQ ID NO: 956960 - RNA, 20 nt, Human
cacggagaccuucauccucc

SEQ ID NO: 956961 - RNA, 20 nt, Human
cagaggucagaaugcucuuc

SEQ ID NO: 956962 - RNA, 19 nt, Human
cagcagcaaagugaaagcu

SEQ ID NO: 956963 - RNA, 18 nt, Human
cagcagucagcagcaaag

SEQ ID NO: 956964 - RNA, 26 nt, Human
caugcaauccugaacucccggaccac

SEQ ID NO: 956965 - RNA, 18 nt, Human
ccacggagaccuucaucc

SEQ ID NO: 956966 - RNA, 24 nt, Human
ccaguggaagcuuugacaucauua

SEQ ID NO: 956967 - RNA, 21 nt, Human
ccccgggauaccagcucugcc

SEQ ID NO: 956968 - RNA, 18 nt, Human
ccuccuggugggcaggca

SEQ ID NO: 956969 - RNA, 22 nt, Human
ccuccuggugggcaggcagggc

SEQ ID NO: 956970 - RNA, 22 nt, Human
ccucuaagccugagauaggagu

SEQ ID NO: 956971 - RNA, 25 nt, Human
ccucuaagccugagauaggaguggg

SEQ ID NO: 956972 - RNA, 20 nt, Human
cuccugggcucacugcuucc

SEQ ID NO: 956973 - RNA, 20 nt, Human
cuccugggcucacugcuucc

SEQ ID NO: 956974 - RNA, 24 nt, Human
cuccuggugggcaggcagggcugg

SEQ ID NO: 956975 - RNA, 18 nt, Human
gcagcagucagcagcaaa

SEQ ID NO: 956976 - RNA, 19 nt, Human
gccacggagaccuucaucc

SEQ ID NO: 956977 - RNA, 20 nt, Human
gccuuuuuucccuuuccagu

SEQ ID NO: 956978 - RNA, 18 nt, Human
gcuggccucuuuugucuc

SEQ ID NO: 956979 - RNA, 24 nt, Human
gcuggccucuuuugucucuuuauu

SEQ ID NO: 956980 - RNA, 23 nt, Human
ggaagcuguugugggaggagagc

SEQ ID NO: 956981 - RNA, 24 nt, Human
ggaagucccagggcagaggucaga

SEQ ID NO: 956982 - RNA, 24 nt, Human
ggacuccugggcucacugcuuccu

SEQ ID NO: 956983 - RNA, 21 nt, Human
ggagagcuggccuggugggag

SEQ ID NO: 956984 - RNA, 22 nt, Human
ggagguguuagcaguggugaau

SEQ ID NO: 956985 - RNA, 19 nt, Human
ggccuggugggagcuucag

SEQ ID NO: 956986 - RNA, 19 nt, Human
gguggaggagggggccuug

SEQ ID NO: 956987 - RNA, 21 nt, Human
ggugggcaggcagggcuggcc

SEQ ID NO: 956988 - RNA, 21 nt, Human
guggaggagggggccuuggca

SEQ ID NO: 956989 - RNA, 24 nt, Human
gugggaagcuguugugggaggaga

SEQ ID NO: 956990 - RNA, 20 nt, Human
gugggaggagagcuggccug

SEQ ID NO: 956991 - RNA, 21 nt, Human
uacuggauuuuccaguggaag

SEQ ID NO: 956992 - RNA, 24 nt, Human
uacuggauuuuccaguggaagcuu

SEQ ID NO: 956993 - RNA, 22 nt, Human
ucacugcuuccuggcuccccgg

SEQ ID NO: 956994 - RNA, 23 nt, Human
uccaaggacagcaacaagcauga

SEQ ID NO: 956995 - RNA, 24 nt, Human
uccaaggacagcaacaagcaugag

SEQ ID NO: 956996 - RNA, 19 nt, Human
uccaggagauuaaucuaau

SEQ ID NO: 956997 - RNA, 19 nt, Human
uccugggcucacugcuucc

SEQ ID NO: 956998 - RNA, 21 nt, Human
uccugggcucacugcuuccug

SEQ ID NO: 956999 - RNA, 24 nt, Human
uccugggcucacugcuuccuggcu

SEQ ID NO: 957000 - RNA, 22 nt, Human
uccuggugggcaggcagggcug

SEQ ID NO: 957001 - RNA, 21 nt, Human
ucuaagccugagauaggagug

SEQ ID NO: 957002 - RNA, 18 nt, Human
ugaaagcuguucagaacu

SEQ ID NO: 957003 - RNA, 22 nt, Human
ugagaguuagcgguggguggag

SEQ ID NO: 957004 - RNA, 24 nt, Human
ugagcugugccuucgccaccccuu

SEQ ID NO: 957005 - RNA, 21 nt, Human
ugaggcaggagagggcagcca

SEQ ID NO: 957006 - RNA, 19 nt, Human
ugcuuugugagauguagga

SEQ ID NO: 957007 - RNA, 19 nt, Human
uggagguggguggcuggcc

SEQ ID NO: 957008 - RNA, 18 nt, Human
uggauucaggauugggau

SEQ ID NO: 957009 - RNA, 19 nt, Human
uggcacagacuugccgccc

SEQ ID NO: 957010 - RNA, 21 nt, Human
uggccucuuuugucucuuuau

SEQ ID NO: 957011 - RNA, 20 nt, Human
uggcuggccucuuuugucuc

SEQ ID NO: 957012 - RNA, 18 nt, Human
ugggaggagagcuggccu

SEQ ID NO: 957013 - RNA, 19 nt, Human
ugggauguggugaaugcug

SEQ ID NO: 957014 - RNA, 27 nt, Human
ugggcaggcagggcuggccgaggacuc

SEQ ID NO: 957015 - RNA, 20 nt, Human
ugggcucacugcuuccuggc

SEQ ID NO: 957016 - RNA, 23 nt, Human
uggguggaggagggggccuuggc

SEQ ID NO: 957017 - RNA, 23 nt, Human
uucaaagcagggaagcuccaaga

SEQ ID NO: 957018 - RNA, 24 nt, Human
uucuuuagcuauauaauaguuacc

SEQ ID NO: 957019 - RNA, 27 nt, Human
uuggcaucuucucuuuaugucucugag

SEQ ID NO: 957020 - RNA, 23 nt, Human
uugugagauguaggaggugcagc

SEQ ID NO: 957021 - RNA, 25 nt, Human
uuucaaggaagagucuucccuccag

SEQ ID NO: 957022 - RNA, 21 nt, Human
uuugacaucauuaacucuguc

SEQ ID NO: 957023 - RNA, 21 nt, Human
aaaaagagaacaaggcugaga

SEQ ID NO: 957024 - RNA, 21 nt, Human
aagaagaggaggauccaggaa

SEQ ID NO: 957025 - RNA, 19 nt, Human
aggcagggcuggccgagga

SEQ ID NO: 957026 - RNA, 21 nt, Human
agguguuggagguggguggcu

SEQ ID NO: 957027 - RNA, 20 nt, Human
cagaggucagaaugcucuuc

SEQ ID NO: 957028 - RNA, 21 nt, Human
ccccgggauaccagcucugcc

SEQ ID NO: 957029 - RNA, 18 nt, Human
ccuccuggugggcaggca

SEQ ID NO: 957030 - RNA, 22 nt, Human
ccuccuggugggcaggcagggc

SEQ ID NO: 957031 - RNA, 22 nt, Human
ccucuaagccugagauaggagu

SEQ ID NO: 957032 - RNA, 25 nt, Human
ccucuaagccugagauaggaguggg

SEQ ID NO: 957033 - RNA, 20 nt, Human
cuccugggcucacugcuucc

SEQ ID NO: 957034 - RNA, 24 nt, Human
cuccuggugggcaggcagggcugg

SEQ ID NO: 957035 - RNA, 20 nt, Human
gccuuuuuucccuuuccagu

SEQ ID NO: 957036 - RNA, 24 nt, Human
gcugcccucuuuugucucuuuauu

SEQ ID NO: 957037 - RNA, 24 nt, Human
ggaagucccagggcagaggucaga

SEQ ID NO: 957038 - RNA, 24 nt, Human
ggacuccugggcucacugcuuccu

SEQ ID NO: 957039 - RNA, 22 nt, Human
ggagguguuagcaguggugaau

SEQ ID NO: 957040 - RNA, 21 nt, Human
ggugggcaggcagggcuggcc

SEQ ID NO: 957041 - RNA, 23 nt, Human
uauuagaugcauuacuuucauua

SEQ ID NO: 957042 - RNA, 22 nt, Human
ucacugcuuccuggcuccccgg

SEQ ID NO: 957043 - RNA, 18 nt, Human
ucagaccaagaaacucac

SEQ ID NO: 957044 - RNA, 19 nt, Human
uccaggagauuaaucuaau

SEQ ID NO: 957045 - RNA, 19 nt, Human
uccugggcucacugcuucc

SEQ ID NO: 957046 - RNA, 21 nt, Human
uccugggcucacugcuuccug

SEQ ID NO: 957047 - RNA, 24 nt, Human
uccugggcucacugcuuccuggcu

SEQ ID NO: 957048 - RNA, 22 nt, Human
uccuggugggcaggcagggcug

SEQ ID NO: 957049 - RNA, 21 nt, Human
ucuaagccugagauaggagug

SEQ ID NO: 957050 - RNA, 18 nt, Human
ugcauuacuuucauuacc

SEQ ID NO: 957051 - RNA, 18 nt, Human
uggauucaggauugggau

SEQ ID NO: 957052 - RNA, 19 nt, Human
ugggauguggugaaugcug

SEQ ID NO: 957053 - RNA, 27 nt, Human
ugggcaggcagggcuggccgaggacuc

SEQ ID NO: 957054 - RNA, 20 nt, Human
ugggcucacugcuuccuggc

SEQ ID NO: 957055 - RNA, 23 nt, Human
uucagaccaagaaacucacagga

SEQ ID NO: 957056 - RNA, 24 nt, Human
uucuuuagcuauauaauaguuacc

SEQ ID NO: 957057 - RNA, 25 nt, Human
uuucaaggaagagucuucccuccag

SEQ ID NO: 957058 - RNA, 20 nt, Human
aaaaauaaaaauauaaauau

SEQ ID NO: 957059 - RNA, 21 nt, Human
aaaauauucgaaauacuucuc

SEQ ID NO: 957060 - RNA, 19 nt, Human
aaagagcguaccucugccc

SEQ ID NO: 957061 - RNA, 21 nt, Human
aacaugguagaaucccgucuc

SEQ ID NO: 957062 - RNA, 22 nt, Human
aagaucaagugagccaagauca

SEQ ID NO: 957063 - RNA, 21 nt, Human
aaucccgucucuaccaaaaau

SEQ ID NO: 957064 - RNA, 23 nt, Human
aaugaaagaauaauugaagaaaa

SEQ ID NO: 957065 - RNA, 18 nt, Human
acaccacugcacuccagc

SEQ ID NO: 957066 - RNA, 20 nt, Human
acaccacugcacuccagccu

SEQ ID NO: 957067 - RNA, 24 nt, Human
acagaguaagacccuaucucaaaa

SEQ ID NO: 957068 - RNA, 19 nt, Human
accacugcacuccagccug

SEQ ID NO: 957069 - RNA, 24 nt, Human
acugcacuccagccugggugacag

SEQ ID NO: 957070 - RNA, 26 nt, Human
acugcacuccagccugggugacagag

SEQ ID NO: 957071 - RNA, 22 nt, Human
agacaaaauaugagaggaucua

SEQ ID NO: 957072 - RNA, 23 nt, Human
agauccagaaaaauccauaaaga

SEQ ID NO: 957073 - RNA, 21 nt, Human
agccaggugugguggcgcaag

SEQ ID NO: 957074 - RNA, 23 nt, Human
agccaggugugguggcgcaagcc

SEQ ID NO: 957075 - RNA, 20 nt, Human
agccugggcaacaugguaga

SEQ ID NO: 957076 - RNA, 24 nt, Human
agccugggcaacaugguagaaucc

SEQ ID NO: 957077 - RNA, 22 nt, Human
agccugggugacagaguaagac

SEQ ID NO: 957078 - RNA, 24 nt, Human
agccuguagucccagcuacucagg

SEQ ID NO: 957079 - RNA, 24 nt, Human
agcuacucaggaggcugggguggg

SEQ ID NO: 957080 - RNA, 21 nt, Human
aggcugaggcagguggauugc

SEQ ID NO: 957081 - RNA, 24 nt, Human
aggcugaggcagguggauugcuug

SEQ ID NO: 957082 - RNA, 24 nt, Human
aggcuggggugggaggaucacuug

SEQ ID NO: 957083 - RNA, 19 nt, Human
agguggagguuacagugag

SEQ ID NO: 957084 - RNA, 24 nt, Human
agguggagguuacagugagccaag

SEQ ID NO: 957085 - RNA, 18 nt, Human
agucucugcaaaaaugau

SEQ ID NO: 957086 - RNA, 24 nt, Human
aucacaccacugcacuccagccug

SEQ ID NO: 957087 - RNA, 23 nt, Human
aucacuugagccugggaggugga

SEQ ID NO: 957088 - RNA, 19 nt, Human
aucaggcacucucuguacc

SEQ ID NO: 957089 - RNA, 21 nt, Human
caaaaauacaaaaauuagcca

SEQ ID NO: 957090 - RNA, 24 nt, Human
caacaugguagaaucccgucucua

SEQ ID NO: 957091 - RNA, 21 nt, Human
caagggcuuccacuaaagccu

SEQ ID NO: 957092 - RNA, 21 nt, Human
cacaccacugcacuccagccu

SEQ ID NO: 957093 - RNA, 25 nt, Human
cacgccuguaaucccagcacuuuug

SEQ ID NO: 957094 - RNA, 22 nt, Human
cacuccagccugggugacagag

SEQ ID NO: 957095 - RNA, 22 nt, Human
cacuccagccugggugacagag

SEQ ID NO: 957096 - RNA, 18 nt, Human
cacucucuguaccccugc

SEQ ID NO: 957097 - RNA, 19 nt, Human
cacugcacuccagccuggg

SEQ ID NO: 957098 - RNA, 19 nt, Human
cacugcacuccagccuggg

SEQ ID NO: 957099 - RNA, 21 nt, Human
cacugcacuccagccugggug

SEQ ID NO: 957100 - RNA, 22 nt, Human
cacugcacuccagccuggguga

SEQ ID NO: 957101 - RNA, 24 nt, Human
cacugcacuccagccugggugaca

SEQ ID NO: 957102 - RNA, 24 nt, Human
cacugcacuccagccugggugaca

SEQ ID NO: 957103 - RNA, 25 nt, Human
cagcacuuuuggaaggcugaggcag

SEQ ID NO: 957104 - RNA, 20 nt, Human
cagcuacucaggaggcuggg

SEQ ID NO: 957105 - RNA, 24 nt, Human
cagcuacucaggaggcuggggugg

SEQ ID NO: 957106 - RNA, 22 nt, Human
cagggagagccgaaugaagaug

SEQ ID NO: 957107 - RNA, 23 nt, Human
ccaagaucaagugagccaagauc

SEQ ID NO: 957108 - RNA, 20 nt, Human
ccacugcacuccagccuggg

SEQ ID NO: 957109 - RNA, 20 nt, Human
ccacugcacuccagccuggg

SEQ ID NO: 957110 - RNA, 20 nt, Human
ccacugcacuccagccuggg

SEQ ID NO: 957111 - RNA, 21 nt, Human
ccacugcacuccagccugggu

SEQ ID NO: 957112 - RNA, 21 nt, Human
ccacugcacuccagccugggu

SEQ ID NO: 957113 - RNA, 23 nt, Human
ccacugcacuccagccuggguga

SEQ ID NO: 957114 - RNA, 23 nt, Human
ccacugcacuccagccuggguga

SEQ ID NO: 957115 - RNA, 24 nt, Human
ccacugcacuccagccugggugac

SEQ ID NO: 957116 - RNA, 25 nt, Human
ccacugcacuccagccugggugaca

SEQ ID NO: 957117 - RNA, 22 nt, Human
cccgucucuaccaaaaauacaa

SEQ ID NO: 957118 - RNA, 22 nt, Human
cccuaucucaaaaaaauaaaaa

SEQ ID NO: 957119 - RNA, 23 nt, Human
cccugccacccugaggaagacaa

SEQ ID NO: 957120 - RNA, 18 nt, Human
cccuuucuuucccugucc

SEQ ID NO: 957121 - RNA, 19 nt, Human
ccuaucucaaaaaaauaaa

SEQ ID NO: 957122 - RNA, 23 nt, Human
ccugggcaacaugguagaauccc

SEQ ID NO: 957123 - RNA, 24 nt, Human
ccugggcaacaugguagaaucccg

SEQ ID NO: 957124 - RNA, 20 nt, Human
ccugggugacagaguaagac

SEQ ID NO: 957125 - RNA, 21 nt, Human
ccuguagucccagcuacucag

SEQ ID NO: 957126 - RNA, 18 nt, Human
cgccuguaaucccagcac

SEQ ID NO: 957127 - RNA, 22 nt, Human
cucacgccuguaaucccagcac

SEQ ID NO: 957128 - RNA, 24 nt, Human
cucacgccuguaaucccagcacuu

SEQ ID NO: 957129 - RNA, 23 nt, Human
cuucuucucucucucucucuuuu

SEQ ID NO: 957130 - RNA, 19 nt, Human
cuucuucuucuucucucuc

SEQ ID NO: 957131 - RNA, 20 nt, Human
gaaagaauaauugaagaaaa

SEQ ID NO: 957132 - RNA, 18 nt, Human
gagguuacagugagccaa

SEQ ID NO: 957133 - RNA, 19 nt, Human
gagguuacagugagccaag

SEQ ID NO: 957134 - RNA, 24 nt, Human
gaucacuugagccugggaggugga

SEQ ID NO: 957135 - RNA, 23 nt, Human
gcacuccagccugggugacagag

SEQ ID NO: 957136 - RNA, 20 nt, Human
gccaagaucacaccacugca

SEQ ID NO: 957137 - RNA, 21 nt, Human
ggagguggagguuacagugag

SEQ ID NO: 957138 - RNA, 20 nt, Human
ggagguuacagugagccaag

SEQ ID NO: 957139 - RNA, 24 nt, Human
ggagguuacagugagccaagauca

SEQ ID NO: 957140 - RNA, 20 nt, Human
ggaucacuugagccugggag

SEQ ID NO: 957141 - RNA, 24 nt, Human
ggaugugguggcucacgccuguaa

SEQ ID NO: 957142 - RNA, 21 nt, Human
ggccggaugugguggcucacg

SEQ ID NO: 957143 - RNA, 24 nt, Human
gguggcucacgccuguaaucccag

SEQ ID NO: 957144 - RNA, 21 nt, Human
ggugggaggaucacuugagcc

SEQ ID NO: 957145 - RNA, 23 nt, Human
ggugggaggaucacuugagccug

SEQ ID NO: 957146 - RNA, 20 nt, Human
ggugugguggcgcaagccug

SEQ ID NO: 957147 - RNA, 26 nt, Human
guacagcuucagggagaggggaacgc

SEQ ID NO: 957148 - RNA, 23 nt, Human
guagaaucccgucucuaccaaaa

SEQ ID NO: 957149 - RNA, 21 nt, Human
gugugguggcgcaagccugua

SEQ ID NO: 957150 - RNA, 22 nt, Human
uaaagauggacaggaaaaauca

SEQ ID NO: 957151 - RNA, 21 nt, Human
uaccaaaaauacaaaaauuag

SEQ ID NO: 957152 - RNA, 24 nt, Human
uaccaaaaauacaaaaauuagcca

SEQ ID NO: 957153 - RNA, 20 nt, Human
uacccuuucuuucccugucc

SEQ ID NO: 957154 - RNA, 21 nt, Human
uagauccagaaaaauccauaa

SEQ ID NO: 957155 - RNA, 23 nt, Human
ucacaccacugcacuccagccug

SEQ ID NO: 957156 - RNA, 24 nt, Human
ucacuugagccugggagguggagg

SEQ ID NO: 957157 - RNA, 25 nt, Human
ucacuugagccugggagguggaggu

SEQ ID NO: 957158 - RNA, 23 nt, Human
uccaaucaggcacucucuguacc

SEQ ID NO: 957159 - RNA, 24 nt, Human
uccagccugggugacagaguaaga

SEQ ID NO: 957160 - RNA, 20 nt, Human
ucucuguaccccugccaccc

SEQ ID NO: 957161 - RNA, 22 nt, Human
ucucuucuguaaacaagggcug

SEQ ID NO: 957162 - RNA, 24 nt, Human
ucuucuguaaacaagggcuuccac

SEQ ID NO: 957163 - RNA, 25 nt, Human
ugaaagagagcaggagaaggaugug

SEQ ID NO: 957164 - RNA, 18 nt, Human
ugagccugggagguggag

SEQ ID NO: 957165 - RNA, 20 nt, Human
ugagccugggagguggaggu

SEQ ID NO: 957166 - RNA, 21 nt, Human
ugaggaagacaaaauaugaga

SEQ ID NO: 957167 - RNA, 21 nt, Human
ugaggaauugaaagagagcag

SEQ ID NO: 957168 - RNA, 20 nt, Human
ugaggcagguggauugcuuc

SEQ ID NO: 957169 - RNA, 18 nt, Human
uggaaggcugaggcaggu

SEQ ID NO: 957170 - RNA, 22 nt, Human
uggaaggcugaggcagguggau

SEQ ID NO: 957171 - RNA, 24 nt, Human
uggaaggcugaggcagguggauug

SEQ ID NO: 957172 - RNA, 23 nt, Human
uggacaggaaaaaucaagaguuc

SEQ ID NO: 957173 - RNA, 24 nt, Human
uggccggaugugguggcucacgcc

SEQ ID NO: 957174 - RNA, 22 nt, Human
uggcucacgccuguaaucccag

SEQ ID NO: 957175 - RNA, 24 nt, Human
uggcucacgccuguaaucccagca

SEQ ID NO: 957176 - RNA, 29 nt, Human
ugggagguggagguuacagugacaacggu

SEQ ID NO: 957177 - RNA, 24 nt, Human
ugggagguggagguuacagugagc

SEQ ID NO: 957178 - RNA, 18 nt, Human
uggggugggaggaucacu

SEQ ID NO: 957179 - RNA, 23 nt, Human
uggggugggaggaucacuugagc

SEQ ID NO: 957180 - RNA, 24 nt, Human
uggggugggaggaucacuugagcc

SEQ ID NO: 957181 - RNA, 20 nt, Human
ugggucaagacccagagggc

SEQ ID NO: 957182 - RNA, 24 nt, Human
ugguggcgcaagccuguaguccca

SEQ ID NO: 957183 - RNA, 24 nt, Human
ugguggcucacgccuguaauccca

SEQ ID NO: 957184 - RNA, 18 nt, Human
ugucucuucuucuucuuc

SEQ ID NO: 957185 - RNA, 20 nt, Human
uguucugcuucucucaaugu

SEQ ID NO: 957186 - RNA, 21 nt, Human
uugagccugggagguggaggu

SEQ ID NO: 957187 - RNA, 20 nt, Human
uuggaaggcugaggcaggug

SEQ ID NO: 957188 - RNA, 23 nt, Human
uuucuuucccuguccugcaaagc

SEQ ID NO: 957189 - RNA, 23 nt, Human
uuuuauuuauugcaugcuugggu

SEQ ID NO: 957190 - RNA, 18 nt, Human
uuuuuuuccaaucaggca

SEQ ID NO: 957191 - RNA, 19 nt, Human
aggccuccccuggacccag

SEQ ID NO: 957192 - RNA, 19 nt, Human
aggcgcucagggugggggc

SEQ ID NO: 957193 - RNA, 19 nt, Human
augggaucucccucacugu

SEQ ID NO: 957194 - RNA, 18 nt, Human
caggagcccaggagggaa

SEQ ID NO: 957195 - RNA, 18 nt, Human
cccuggacccaggcgcuc

SEQ ID NO: 957196 - RNA, 23 nt, Human
ccuggaaggccuccccuggaccc

SEQ ID NO: 957197 - RNA, 20 nt, Human
cucagggugggggcggugaa

SEQ ID NO: 957198 - RNA, 20 nt, Human
cuccccuggacccaggcgcu

SEQ ID NO: 957199 - RNA, 22 nt, Human
cuggaaggccuccccuggaccc

SEQ ID NO: 957200 - RNA, 18 nt, Human
gagucuggggugaggagg

SEQ ID NO: 957201 - RNA, 22 nt, Human
ggagacagucaggagucugggg

SEQ ID NO: 957202 - RNA, 22 nt, Human
ggugccaggagcccaggaggga

SEQ ID NO: 957203 - RNA, 23 nt, Human
uccccuggacccaggcgcucagg

SEQ ID NO: 957204 - RNA, 19 nt, Human
ucucugugugcaggucccu

SEQ ID NO: 957205 - RNA, 24 nt, Human
aaaucaauuucaaaaugaaauaug

SEQ ID NO: 957206 - RNA, 27 nt, Human
aagcuaaucacacugauugauccaugc

SEQ ID NO: 957207 - RNA, 25 nt, Human
agaaguggucagagugagcuggggc

SEQ ID NO: 957208 - RNA, 18 nt, Human
agagugagcuggggcuug

SEQ ID NO: 957209 - RNA, 18 nt, Human
aggcagagaaguggucag

SEQ ID NO: 957210 - RNA, 24 nt, Human
aucacacugauugauccaugcauu

SEQ ID NO: 957211 - RNA, 25 nt, Human
cagcucaacaauagaaaucaauuuc

SEQ ID NO: 957212 - RNA, 25 nt, Human
cccuccugggcccaccaaguucacu

SEQ ID NO: 957213 - RNA, 22 nt, Human
ccuccugggcccaccaaguuca

SEQ ID NO: 957214 - RNA, 23 nt, Human
cuccugggcccaccaaguucacu

SEQ ID NO: 957215 - RNA, 22 nt, Human
cuccuguucccuccugggccca

SEQ ID NO: 957216 - RNA, 22 nt, Human
cugcugagaaagcuaaucacac

SEQ ID NO: 957217 - RNA, 22 nt, Human
cugggcccaccaaguucacugg

SEQ ID NO: 957218 - RNA, 19 nt, Human
gcuccuguucccuccuggg

SEQ ID NO: 957219 - RNA, 22 nt, Human
gcugagcaaaaccauucaauaa

SEQ ID NO: 957220 - RNA, 24 nt, Human
uaaugcagcucaacaauagaaauc

SEQ ID NO: 957221 - RNA, 20 nt, Human
uaauguggcugggcauagca

SEQ ID NO: 957222 - RNA, 22 nt, Human
uauauaauaaguacugccaaua

SEQ ID NO: 957223 - RNA, 23 nt, Human
ucacugggcccucgcagcuucca

SEQ ID NO: 957224 - RNA, 18 nt, Human
uccaggguggcagggcca

SEQ ID NO: 957225 - RNA, 30 nt, Human
uccugggcccaccaaguucacugggcccuu

SEQ ID NO: 957226 - RNA, 23 nt, Human
ucuuagaagagguggccuccagg

SEQ ID NO: 957227 - RNA, 20 nt, Human
ugcccuggcucaggcuccug

SEQ ID NO: 957228 - RNA, 19 nt, Human
uggaaacucacaacuccuc

SEQ ID NO: 957229 - RNA, 18 nt, Human
uggucagagugagcuggg

SEQ ID NO: 957230 - RNA, 23 nt, Human
uucacugggcccucgcagcuucc

SEQ ID NO: 957231 - RNA, 24 nt, Human
uucacugggcccucgcagcuucca

SEQ ID NO: 957232 - RNA, 22 nt, Human
uuggaaacucacaacuccucuc

SEQ ID NO: 957233 - RNA, 22 nt, Human
uuuuuuuuuuuuuuuuucacag

SEQ ID NO: 957234 - RNA, 23 nt, Human
uuuuuuuuuuuuuuuuucacagu

SEQ ID NO: 957235 - RNA, 19 nt, Human
aacagaggcaggccaacgg

SEQ ID NO: 957236 - RNA, 22 nt, Human
accacacucacccucucgcuca

SEQ ID NO: 957237 - RNA, 18 nt, Human
agcuuuacucugaccaca

SEQ ID NO: 957238 - RNA, 18 nt, Human
aggcugcagggcgacugg

SEQ ID NO: 957239 - RNA, 21 nt, Human
cacacaccccaggcccugucc

SEQ ID NO: 957240 - RNA, 20 nt, Human
cacucacacacaccccaggc

SEQ ID NO: 957241 - RNA, 19 nt, Human
cacucacccucucgcucac

SEQ ID NO: 957242 - RNA, 23 nt, Human
ccacacucacccucucgcucaca

SEQ ID NO: 957243 - RNA, 19 nt, Human
cccucucgcucacacucac

SEQ ID NO: 957244 - RNA, 19 nt, Human
cuggaagccugguccuucc

SEQ ID NO: 957245 - RNA, 26 nt, Human
gcucacacucacacucacacacaccc

SEQ ID NO: 957246 - RNA, 19 nt, Human
ggcgacugggaugcagggg

SEQ ID NO: 957247 - RNA, 19 nt, Human
ucugugugaggcugcaggg

SEQ ID NO: 957248 - RNA, 19 nt, Human
ugaccacacucacccucuc

SEQ ID NO: 957249 - RNA, 22 nt, Human
ugaccacacucacccucucgcu

SEQ ID NO: 957250 - RNA, 18 nt, Human
ugggaugcaggggugaaa

SEQ ID NO: 957251 - RNA, 19 nt, Human
uguccuggcuggucagguc

SEQ ID NO: 957252 - RNA, 25 nt, Human
uguccuggcuggucaggucuggugc

SEQ ID NO: 957253 - RNA, 26 nt, Human
aaacaaaauucauuauaauaaaauaa

SEQ ID NO: 957254 - RNA, 21 nt, Human
acuaguaccaugaaagauaaa

SEQ ID NO: 957255 - RNA, 19 nt, Human
agggugucuggggaaagcu

SEQ ID NO: 957256 - RNA, 21 nt, Human
cccagggguagaacugugguu

SEQ ID NO: 957257 - RNA, 24 nt, Human
cccucaaaacaucccagggguaga

SEQ ID NO: 957258 - RNA, 19 nt, Human
cugcagauucuuggguugu

SEQ ID NO: 957259 - RNA, 25 nt, Human
cuugcaaagacccucaaaacauccc

SEQ ID NO: 957260 - RNA, 24 nt, Human
uaaaacagggugucuggggaaagc

SEQ ID NO: 957261 - RNA, 21 nt, Human
uaaaacaucaauaacuuaaau

SEQ ID NO: 957262 - RNA, 23 nt, Human
uaccaugaaagauaaacuuaaaa

SEQ ID NO: 957263 - RNA, 18 nt, Human
uaucuaaaaaacacuagu

SEQ ID NO: 957264 - RNA, 23 nt, Human
ucuaaaaaacacuaguaccauga

SEQ ID NO: 957265 - RNA, 19 nt, Human
uggaauguuaaaaaaaauu

SEQ ID NO: 957266 - RNA, 21 nt, Human
uggggaaagcuaggggaaaau

SEQ ID NO: 957267 - RNA, 22 nt, Human
uuaaaacaucaauaacuuaaau

SEQ ID NO: 957268 - RNA, 21 nt, Human
uucuuuguauuaaugauucuu

SEQ ID NO: 957269 - RNA, 24 nt, Human
uuuuuuuuuuuuguacaaaaauau

SEQ ID NO: 957270 - RNA, 23 nt, Human
aaacacagaaaaccuacagcuau

SEQ ID NO: 957271 - RNA, 23 nt, Human
aaccuccaaccccagcaagguuc

SEQ ID NO: 957272 - RNA, 20 nt, Human
agaaaaccuacagcuauaaa

SEQ ID NO: 957273 - RNA, 20 nt, Human
agauaagcacuaaacccucc

SEQ ID NO: 957274 - RNA, 21 nt, Human
agauaagcacuaaacccucca

SEQ ID NO: 957275 - RNA, 19 nt, Human
agcuaaacacagaaaaccu

SEQ ID NO: 957276 - RNA, 21 nt, Human
caagguucuuucuguucuugg

SEQ ID NO: 957277 - RNA, 18 nt, Human
caauuccauuccagaaaa

SEQ ID NO: 957278 - RNA, 20 nt, Human
cagcaagguucuuucuguuc

SEQ ID NO: 957279 - RNA, 19 nt, Human
ccuccaaccccagcaaggu

SEQ ID NO: 957280 - RNA, 22 nt, Human
gagacaaaacaauauaaacaaa

SEQ ID NO: 957281 - RNA, 23 nt, Human
ggagacaaaacaauauaaacaaa

SEQ ID NO: 957282 - RNA, 22 nt, Human
gugaaaccuccaaccccagcaa

SEQ ID NO: 957283 - RNA, 24 nt, Human
uaaaauacaguuuaacuuuaaugu

SEQ ID NO: 957284 - RNA, 18 nt, Human
uaaugcaauuacaacaau

SEQ ID NO: 957285 - RNA, 22 nt, Human
ugaugcaauaugaaucaacuuc

SEQ ID NO: 957286 - RNA, 19 nt, Human
uuacaacaauuuaggagac

SEQ ID NO: 957287 - RNA, 20 nt, Human
uuacaacaauuuaggagaca

SEQ ID NO: 957288 - RNA, 21 nt, Human
aagaggccagagcugagggug

SEQ ID NO: 957289 - RNA, 19 nt, Human
aagcaggagaaagagugug

SEQ ID NO: 957290 - RNA, 23 nt, Human
aagcaggagaaagaguguggcaa

SEQ ID NO: 957291 - RNA, 25 nt, Human
aagcaggagaaagaguguggcaagg

SEQ ID NO: 957292 - RNA, 19 nt, Human
aagcguuggugaggcuggu

SEQ ID NO: 957293 - RNA, 20 nt, Human
aagcguuggugaggcuggug

SEQ ID NO: 957294 - RNA, 24 nt, Human
agacagaacagcuuuuuauucagu

SEQ ID NO: 957295 - RNA, 20 nt, Human
aggguccugaugauucuccu

SEQ ID NO: 957296 - RNA, 18 nt, Human
caggagaaagaguguggc

SEQ ID NO: 957297 - RNA, 19 nt, Human
caggagaaagaguguggca

SEQ ID NO: 957298 - RNA, 21 nt, Human
ccagggccccugagcauagcc

SEQ ID NO: 957299 - RNA, 23 nt, Human
ccaggguccugaugauucuccuu

SEQ ID NO: 957300 - RNA, 19 nt, Human
cugcugccuccucucaugc

SEQ ID NO: 957301 - RNA, 21 nt, Human
gaagacagaacagcuuuuuau

SEQ ID NO: 957302 - RNA, 20 nt, Human
gggagacucucccuccucgg

SEQ ID NO: 957303 - RNA, 22 nt, Human
gggccccugagcauagccuccu

SEQ ID NO: 957304 - RNA, 24 nt, Human
ggggugguuaaagcaggagaaaga

SEQ ID NO: 957305 - RNA, 21 nt, Human
ggguagagcugggaaugcaga

SEQ ID NO: 957306 - RNA, 19 nt, Human
ggguggcugcuccagggcc

SEQ ID NO: 957307 - RNA, 18 nt, Human
guccugcugccuccucuc

SEQ ID NO: 957308 - RNA, 24 nt, Human
gucucucuggaccuggccugcugu

SEQ ID NO: 957309 - RNA, 20 nt, Human
gugggguguacuggggagcc

SEQ ID NO: 957310 - RNA, 19 nt, Human
uaaagcaggagaaagagug

SEQ ID NO: 957311 - RNA, 19 nt, Human
uaucagguccaggguccug

SEQ ID NO: 957312 - RNA, 20 nt, Human
uaucagguccaggguccuga

SEQ ID NO: 957313 - RNA, 21 nt, Human
ucaagcguuggugaggcuggu

SEQ ID NO: 957314 - RNA, 19 nt, Human
ucccugggagacucucccu

SEQ ID NO: 957315 - RNA, 20 nt, Human
uccucggucucucuggaccu

SEQ ID NO: 957316 - RNA, 18 nt, Human
ucucccuccucggucucu

SEQ ID NO: 957317 - RNA, 18 nt, Human
ucucuggaccuggccugc

SEQ ID NO: 957318 - RNA, 24 nt, Human
ucugugguagagggugaguaagag

SEQ ID NO: 957319 - RNA, 18 nt, Human
ugaguaagaggccagagc

SEQ ID NO: 957320 - RNA, 18 nt, Human
ugaguaagaggccagagc

SEQ ID NO: 957321 - RNA, 23 nt, Human
ugcagauggggugguuaaagcag

SEQ ID NO: 957322 - RNA, 23 nt, Human
ugcugugggcagcucagccaugc

SEQ ID NO: 957323 - RNA, 22 nt, Human
uggcugcuccagggccccugag

SEQ ID NO: 957324 - RNA, 22 nt, Human
ugggaagacagaacagcuuuuu

SEQ ID NO: 957325 - RNA, 19 nt, Human
ugggguggcugcuccaggg

SEQ ID NO: 957326 - RNA, 19 nt, Human
ugggguguacuggggagcc

SEQ ID NO: 957327 - RNA, 21 nt, Human
uggguucaggcuucaagcguu

SEQ ID NO: 957328 - RNA, 22 nt, Human
uggguucaggcuucaagcguug

SEQ ID NO: 957329 - RNA, 18 nt, Human
aaaauuagcugggcgugg

SEQ ID NO: 957330 - RNA, 18 nt, Human
aaaauucuuccauucauc

SEQ ID NO: 957331 - RNA, 20 nt, Human
aacauggcaaaaccccgucu

SEQ ID NO: 957332 - RNA, 21 nt, Human
aacauggcaaaaccccgucuc

SEQ ID NO: 957333 - RNA, 21 nt, Human
aagaggccaggcacuguggcu

SEQ ID NO: 957334 - RNA, 18 nt, Human
aagaggccaggccugggu

SEQ ID NO: 957335 - RNA, 26 nt, Human
aagcagacacgacacauagguaaaac

SEQ ID NO: 957336 - RNA, 20 nt, Human
aagcaggggaaucgcugaug

SEQ ID NO: 957337 - RNA, 23 nt, Human
aagccaggcgcagugacucacgc

SEQ ID NO: 957338 - RNA, 18 nt, Human
aaggacaggacaggaggg

SEQ ID NO: 957339 - RNA, 24 nt, Human
aaucacuugaacccaggaggcaga

SEQ ID NO: 957340 - RNA, 24 nt, Human
aaucgcuugaacccaggaggucga

SEQ ID NO: 957341 - RNA, 19 nt, Human
aaucugggcaaauuugggg

SEQ ID NO: 957342 - RNA, 19 nt, Human
acaagagcgaaacuccauc

SEQ ID NO: 957343 - RNA, 20 nt, Human
acaagagcgaaacuccaucu

SEQ ID NO: 957344 - RNA, 21 nt, Human
acaagagcgaaacuccaucuc

SEQ ID NO: 957345 - RNA, 18 nt, Human
acaaggaagguggaucac

SEQ ID NO: 957346 - RNA, 24 nt, Human
acagagugagacccugccauaaaa

SEQ ID NO: 957347 - RNA, 23 nt, Human
acagggauggagaucagggaaug

SEQ ID NO: 957348 - RNA, 21 nt, Human
acauauauaacuccagcuuau

SEQ ID NO: 957349 - RNA, 23 nt, Human
accacccaaaaaaagccugaggg

SEQ ID NO: 957350 - RNA, 22 nt, Human
accauugcacuccagcgugggu

SEQ ID NO: 957351 - RNA, 25 nt, Human
accauugcacuccagcgugggugac

SEQ ID NO: 957352 - RNA, 22 nt, Human
acccaaaucccagucuuuagcc

SEQ ID NO: 957353 - RNA, 20 nt, Human
accuguaaucccagcuacuc

SEQ ID NO: 957354 - RNA, 23 nt, Human
accuguaaucccagcuacucagg

SEQ ID NO: 957355 - RNA, 22 nt, Human
acgccacugcacuccagccugg

SEQ ID NO: 957356 - RNA, 24 nt, Human
acgccacugcacuccagccugggc

SEQ ID NO: 957357 - RNA, 24 nt, Human
acuccagccugggcgacagaguga

SEQ ID NO: 957358 - RNA, 24 nt, Human
acugcacuccagccugggcgacag

SEQ ID NO: 957359 - RNA, 26 nt, Human
acugcacuccagccugggcgacagag

SEQ ID NO: 957360 - RNA, 24 nt, Human
acuugaggucaggaguucaagacc

SEQ ID NO: 957361 - RNA, 22 nt, Human
agaaucacuugaacccaggagg

SEQ ID NO: 957362 - RNA, 24 nt, Human
agacagagauggaacccagaucca

SEQ ID NO: 957363 - RNA, 19 nt, Human
agcacuuugggaggcugag

SEQ ID NO: 957364 - RNA, 24 nt, Human
agcacuuugggaggcugagguggg

SEQ ID NO: 957365 - RNA, 21 nt, Human
agcaggaaccuguaaucccag

SEQ ID NO: 957366 - RNA, 18 nt, Human
agccagaaaggcauagau

SEQ ID NO: 957367 - RNA, 23 nt, Human
agccaggaggaucgcuugagccc

SEQ ID NO: 957368 - RNA, 18 nt, Human
agccagggccugucugca

SEQ ID NO: 957369 - RNA, 19 nt, Human
agccguaguggcacacacc

SEQ ID NO: 957370 - RNA, 24 nt, Human
agccguaguggcacacaccuguaa

SEQ ID NO: 957371 - RNA, 23 nt, Human
agccuggccaacauggugaagcc

SEQ ID NO: 957372 - RNA, 22 nt, Human
agccuggccaauauggugaaac

SEQ ID NO: 957373 - RNA, 23 nt, Human
agccuggccaauauggugaaacc

SEQ ID NO: 957374 - RNA, 24 nt, Human
agccuggccaauauggugaaaccu

SEQ ID NO: 957375 - RNA, 22 nt, Human
agccugggcgacagagugagac

SEQ ID NO: 957376 - RNA, 24 nt, Human
agccuggguaacauggcaaaaccc

SEQ ID NO: 957377 - RNA, 24 nt, Human
agcuacuugggaggcugggguggg

SEQ ID NO: 957378 - RNA, 21 nt, Human
agcugcuugggcgagcaaugc

SEQ ID NO: 957379 - RNA, 21 nt, Human
agcuggaugccuaggcagugu

SEQ ID NO: 957380 - RNA, 19 nt, Human
aggaaaaaaagggggaggc

SEQ ID NO: 957381 - RNA, 22 nt, Human
aggaaaaaaagggggaggcugg

SEQ ID NO: 957382 - RNA, 23 nt, Human
aggaaggaggcagggaaagugga

SEQ ID NO: 957383 - RNA, 22 nt, Human
aggaagguggaucacuugaggu

SEQ ID NO: 957384 - RNA, 26 nt, Human
aggaagguggaucacuugaggucagg

SEQ ID NO: 957385 - RNA, 21 nt, Human
aggaccacccaaaaaaagccu

SEQ ID NO: 957386 - RNA, 23 nt, Human
aggaggcagggaaaguggaaugg

SEQ ID NO: 957387 - RNA, 19 nt, Human
aggaggcugaggcaagaga

SEQ ID NO: 957388 - RNA, 20 nt, Human
aggaguuugagaccagccug

SEQ ID NO: 957389 - RNA, 24 nt, Human
aggaucgcuugagcccaggaguuu

SEQ ID NO: 957390 - RNA, 24 nt, Human
aggauuccuucacucaauuacacc

SEQ ID NO: 957391 - RNA, 18 nt, Human
aggcaagagaaucacuug

SEQ ID NO: 957392 - RNA, 24 nt, Human
aggcaagagaaucacuugaaccca

SEQ ID NO: 957393 - RNA, 24 nt, Human
aggcacuguggcucacgccuguaa

SEQ ID NO: 957394 - RNA, 24 nt, Human
aggcagaggauggguuagaggggu

SEQ ID NO: 957395 - RNA, 25 nt, Human
aggcagaggcuucaauaagccaaga

SEQ ID NO: 957396 - RNA, 20 nt, Human
aggcagggaaaguggaaugg

SEQ ID NO: 957397 - RNA, 21 nt, Human
aggcagggaaaguggaauggg

SEQ ID NO: 957398 - RNA, 22 nt, Human
aggcccuggaugacacugagcu

SEQ ID NO: 957399 - RNA, 24 nt, Human
aggcgcagugacucacgccuguaa

SEQ ID NO: 957400 - RNA, 24 nt, Human
aggcugagccaggaggaucgcuug

SEQ ID NO: 957401 - RNA, 24 nt, Human
aggcugaggcaagagaaucacuug

SEQ ID NO: 957402 - RNA, 24 nt, Human
aggcugaggugggcggauuaccug

SEQ ID NO: 957403 - RNA, 24 nt, Human
aggcuggggugggagaaucgcuug

SEQ ID NO: 957404 - RNA, 22 nt, Human
aggcuuggagacuagaguaacu

SEQ ID NO: 957405 - RNA, 20 nt, Human
agggagaggggagggacauu

SEQ ID NO: 957406 - RNA, 23 nt, Human
agggagaggggagggacauuagu

SEQ ID NO: 957407 - RNA, 20 nt, Human
agggagugggggaagaaagg

SEQ ID NO: 957408 - RNA, 24 nt, Human
agggcaguggggagucauggaagg

SEQ ID NO: 957409 - RNA, 21 nt, Human
agggccaggaaagcuccaccu

SEQ ID NO: 957410 - RNA, 19 nt, Human
aggggcaaggacaggacag

SEQ ID NO: 957411 - RNA, 19 nt, Human
agguagggcuccugagccu

SEQ ID NO: 957412 - RNA, 24 nt, Human
aggucgagguuguagugagccgag

SEQ ID NO: 957413 - RNA, 22 nt, Human
agguggaucacuugaggucagg

SEQ ID NO: 957414 - RNA, 21 nt, Human
aggugggcggauuaccugagg

SEQ ID NO: 957415 - RNA, 21 nt, Human
agguggugggacuuucugggu

SEQ ID NO: 957416 - RNA, 24 nt, Human
agugacucacgccuguaaucccag

SEQ ID NO: 957417 - RNA, 19 nt, Human
agugcucuaugcuagaggc

SEQ ID NO: 957418 - RNA, 24 nt, Human
aguggcacacaccuguaaucccag

SEQ ID NO: 957419 - RNA, 18 nt, Human
auaaaaaaaaaaaaaagu

SEQ ID NO: 957420 - RNA, 23 nt, Human
auagcucacgccuguaaucucag

SEQ ID NO: 957421 - RNA, 24 nt, Human
aucacgccacugcacuccagccug

SEQ ID NO: 957422 - RNA, 23 nt, Human
aucacuugaggucaggaguucaa

SEQ ID NO: 957423 - RNA, 23 nt, Human
augcagagaguuggcacaggcuu

SEQ ID NO: 957424 - RNA, 19 nt, Human
auggugaaaccugucucua

SEQ ID NO: 957425 - RNA, 19 nt, Human
auuacacccuacucuuugc

SEQ ID NO: 957426 - RNA, 21 nt, Human
auugcacuccagcguggguga

SEQ ID NO: 957427 - RNA, 22 nt, Human
caaaaaaaaaaaaaaaaaggga

SEQ ID NO: 957428 - RNA, 22 nt, Human
caaauacauauauaacuccagc

SEQ ID NO: 957429 - RNA, 23 nt, Human
caaaucccaagaaucugcggaga

SEQ ID NO: 957430 - RNA, 21 nt, Human
caacaucccaggcaaagaccc

SEQ ID NO: 957431 - RNA, 24 nt, Human
caacaucccaggcaaagacccaga

SEQ ID NO: 957432 - RNA, 24 nt, Human
caacauggugaagccucgucucua

SEQ ID NO: 957433 - RNA, 23 nt, Human
caagaccacaccauugcacucca

SEQ ID NO: 957434 - RNA, 24 nt, Human
caagaccagccuggccaauauggu

SEQ ID NO: 957435 - RNA, 24 nt, Human
caaggaagguggaucacuugaggu

SEQ ID NO: 957436 - RNA, 26 nt, Human
caaggaagguggaucacuugagguca

SEQ ID NO: 957437 - RNA, 23 nt, Human
caauauggugaaaccugucucua

SEQ ID NO: 957438 - RNA, 24 nt, Human
cacaccuguaaucccagcuacuug

SEQ ID NO: 957439 - RNA, 20 nt, Human
cacacuuucaaccugagccc

SEQ ID NO: 957440 - RNA, 24 nt, Human
cacacuuucaaccugagccccaca

SEQ ID NO: 957441 - RNA, 22 nt, Human
cacccuacucuuugccuccugc

SEQ ID NO: 957442 - RNA, 23 nt, Human
caccuguaaucccagcuacuugg

SEQ ID NO: 957443 - RNA, 24 nt, Human
caccuguaaucccagcuacuuggg

SEQ ID NO: 957444 - RNA, 19 nt, Human
caccuugucccccucucac

SEQ ID NO: 957445 - RNA, 20 nt, Human
caccuugucccccucucaca

SEQ ID NO: 957446 - RNA, 24 nt, Human
cacgccuguaaucccagcacuuug

SEQ ID NO: 957447 - RNA, 24 nt, Human
cacgccuguaaucccagcacuuug

SEQ ID NO: 957448 - RNA, 24 nt, Human
cacgccuguaaucucagcacuuug

SEQ ID NO: 957449 - RNA, 22 nt, Human
cacuccagccugggcgacagag

SEQ ID NO: 957450 - RNA, 22 nt, Human
cacuccagccugggcgacagag

SEQ ID NO: 957451 - RNA, 24 nt, Human
cacuccagccugggcgacagagug

SEQ ID NO: 957452 - RNA, 24 nt, Human
cacuccagcgugggugacaagagc

SEQ ID NO: 957453 - RNA, 19 nt, Human
cacugcacuccagccuggg

SEQ ID NO: 957454 - RNA, 20 nt, Human
cacugcacuccagccugggc

SEQ ID NO: 957455 - RNA, 22 nt, Human
cacugcacuccagccugggcga

SEQ ID NO: 957456 - RNA, 23 nt, Human
cacugcacuccagccugggcgac

SEQ ID NO: 957457 - RNA, 24 nt, Human
cacugcacuccagccugggcgaca

SEQ ID NO: 957458 - RNA, 23 nt, Human
cacuugaggucaggaguucaaga

SEQ ID NO: 957459 - RNA, 21 nt, Human
cagcacggaggugaccaaggg

SEQ ID NO: 957460 - RNA, 20 nt, Human
cagcacuuugggagcacaag

SEQ ID NO: 957461 - RNA, 27 nt, Human
cagcacuuugggagcacaaggaaggug

SEQ ID NO: 957462 - RNA, 18 nt, Human
cagcacuuugggaggcug

SEQ ID NO: 957463 - RNA, 24 nt, Human
cagcacuuugggaggcugagccag

SEQ ID NO: 957464 - RNA, 21 nt, Human
cagcacuuugggaggcugagg

SEQ ID NO: 957465 - RNA, 24 nt, Human
cagcacuuugggaggcugaggugg

SEQ ID NO: 957466 - RNA, 24 nt, Human
cagcuacuugggaggcuggggugg

SEQ ID NO: 957467 - RNA, 18 nt, Human
caggacaggagggagaag

SEQ ID NO: 957468 - RNA, 24 nt, Human
caggaggcugaggcaagagaauca

SEQ ID NO: 957469 - RNA, 24 nt, Human
cagugcucuaugcuagaggcuugg

SEQ ID NO: 957470 - RNA, 21 nt, Human
cauagauagacccaaauccca

SEQ ID NO: 957471 - RNA, 22 nt, Human
cauagauagacccaaaucccuc

SEQ ID NO: 957472 - RNA, 19 nt, Human
cauugcacuccagcguggg

SEQ ID NO: 957473 - RNA, 19 nt, Human
cauugcacuccagcguggg

SEQ ID NO: 957474 - RNA, 21 nt, Human
cauugcacuccagcgugggug

SEQ ID NO: 957475 - RNA, 24 nt, Human
cauugcacuccagcgugggugaca

SEQ ID NO: 957476 - RNA, 25 nt, Human
cauugcacuccagcgugggugacaa

SEQ ID NO: 957477 - RNA, 18 nt, Human
ccaagaccacaccauugc

SEQ ID NO: 957478 - RNA, 22 nt, Human
ccacagacagagagagagagcg

SEQ ID NO: 957479 - RNA, 21 nt, Human
ccacagccagcuuccucccag

SEQ ID NO: 957480 - RNA, 22 nt, Human
ccacaugccaggcuugggagac

SEQ ID NO: 957481 - RNA, 20 nt, Human
ccacugcacuccagccuggg

SEQ ID NO: 957482 - RNA, 20 nt, Human
ccacugcacuccagccuggg

SEQ ID NO: 957483 - RNA, 21 nt, Human
ccacugcacuccagccugggc

SEQ ID NO: 957484 - RNA, 21 nt, Human
ccacugcacuccagccugggc

SEQ ID NO: 957485 - RNA, 24 nt, Human
ccacugcacuccagccugggcgac

SEQ ID NO: 957486 - RNA, 21 nt, Human
ccacuuucugggcucugauuc

SEQ ID NO: 957487 - RNA, 22 nt, Human
ccaggaggucgagguuguagug

SEQ ID NO: 957488 - RNA, 18 nt, Human
ccaggcacuguggcucac

SEQ ID NO: 957489 - RNA, 24 nt, Human
ccagucuuuagccuggcccaacca

SEQ ID NO: 957490 - RNA, 24 nt, Human
ccaucucaaaaaaaaaaaaaaaaa

SEQ ID NO: 957491 - RNA, 20 nt, Human
ccauugcacuccagcguggg

SEQ ID NO: 957492 - RNA, 20 nt, Human
ccauugcacuccagcguggg

SEQ ID NO: 957493 - RNA, 21 nt, Human
ccauugcacuccagcgugggu

SEQ ID NO: 957494 - RNA, 23 nt, Human
ccauugcacuccagcguggguga

SEQ ID NO: 957495 - RNA, 24 nt, Human
ccauugcacuccagcgugggugac

SEQ ID NO: 957496 - RNA, 25 nt, Human
ccauugcacuccagcgugggugaca

SEQ ID NO: 957497 - RNA, 24 nt, Human
cccacacuuucaaccugagcccca

SEQ ID NO: 957498 - RNA, 19 nt, Human
cccaggauuccuucacuca

SEQ ID NO: 957499 - RNA, 22 nt, Human
cccccucucacaguuccuaaaa

SEQ ID NO: 957500 - RNA, 22 nt, Human
ccuaaaauucuuccauucaucu

SEQ ID NO: 957501 - RNA, 20 nt, Human
ccucccucagaaaggaccag

SEQ ID NO: 957502 - RNA, 23 nt, Human
ccucgucucuacuaaaaauacaa

SEQ ID NO: 957503 - RNA, 21 nt, Human
ccugagccuuccuggaggagc

SEQ ID NO: 957504 - RNA, 21 nt, Human
ccuggccaacauggugaagcc

SEQ ID NO: 957505 - RNA, 24 nt, Human
ccuggccaacauggugaagccucg

SEQ ID NO: 957506 - RNA, 21 nt, Human
ccuggccaauauggugaaacc

SEQ ID NO: 957507 - RNA, 23 nt, Human
ccuggccaauauggugaaaccug

SEQ ID NO: 957508 - RNA, 21 nt, Human
ccuggcccaaccaccugagaa

SEQ ID NO: 957509 - RNA, 23 nt, Human
ccuggguaacauggcaaaacccc

SEQ ID NO: 957510 - RNA, 24 nt, Human
ccuggguaacauggcaaaaccccg

SEQ ID NO: 957511 - RNA, 22 nt, Human
ccuguaaucccagcacuuuggg

SEQ ID NO: 957512 - RNA, 21 nt, Human
ccuguaaucccagcuacucag

SEQ ID NO: 957513 - RNA, 21 nt, Human
ccuguaaucccagcuacuugg

SEQ ID NO: 957514 - RNA, 22 nt, Human
ccugucucuacuaaaaauacaa

SEQ ID NO: 957515 - RNA, 23 nt, Human
cgaaacuccaucucaaaaaaaaa

SEQ ID NO: 957516 - RNA, 24 nt, Human
cgagaccagccuggccaacauggu

SEQ ID NO: 957517 - RNA, 26 nt, Human
cgccacugcacuccagccugggcgac

SEQ ID NO: 957518 - RNA, 23 nt, Human
cgccuguaaucccagcacuuugg

SEQ ID NO: 957519 - RNA, 24 nt, Human
cgccuguaaucccagcacuuuggg

SEQ ID NO: 957520 - RNA, 23 nt, Human
cgccuguaaucucagcacuuugg

SEQ ID NO: 957521 - RNA, 24 nt, Human
cgccuguaaucucagcacuuuggg

SEQ ID NO: 957522 - RNA, 24 nt, Human
cggauuaccugaggacaggaguuc

SEQ ID NO: 957523 - RNA, 20 nt, Human
cuagaacccaacauucauga

SEQ ID NO: 957524 - RNA, 22 nt, Human
cucacgccuguaaucccagcac

SEQ ID NO: 957525 - RNA, 22 nt, Human
cucacgccuguaaucccagcac

SEQ ID NO: 957526 - RNA, 24 nt, Human
cucacgccuguaaucccagcacuu

SEQ ID NO: 957527 - RNA, 24 nt, Human
cucacgccuguaaucccagcacuu

SEQ ID NO: 957528 - RNA, 22 nt, Human
cucacgccuguaaucucagcac

SEQ ID NO: 957529 - RNA, 24 nt, Human
cucacgccuguaaucucagcacuu

SEQ ID NO: 957530 - RNA, 19 nt, Human
cuccaucucaaaaaaaaaa

SEQ ID NO: 957531 - RNA, 21 nt, Human
cucccagggccaggaaagcuc

SEQ ID NO: 957532 - RNA, 18 nt, Human
cuccugccacagacagag

SEQ ID NO: 957533 - RNA, 21 nt, Human
cugccauaaaaaaaaaaaaaa

SEQ ID NO: 957534 - RNA, 22 nt, Human
cugggugucagcaacaucccag

SEQ ID NO: 957535 - RNA, 22 nt, Human
cugggugucagcaacaucccag

SEQ ID NO: 957536 - RNA, 21 nt, Human
cuguaaucccagcuacucagg

SEQ ID NO: 957537 - RNA, 21 nt, Human
cuguaaucccagcuacuuggg

SEQ ID NO: 957538 - RNA, 18 nt, Human
cugugguaggcagguuga

SEQ ID NO: 957539 - RNA, 20 nt, Human
cuugucccccucucacaguu

SEQ ID NO: 957540 - RNA, 18 nt, Human
gaaaaaaagggggaggcu

SEQ ID NO: 957541 - RNA, 18 nt, Human
gaagaggaagccaggcgc

SEQ ID NO: 957542 - RNA, 20 nt, Human
gaagaggaagccaggcgcag

SEQ ID NO: 957543 - RNA, 19 nt, Human
gaagaggccaggccugggg

SEQ ID NO: 957544 - RNA, 21 nt, Human
gaccacccaaaaaaagccuga

SEQ ID NO: 957545 - RNA, 25 nt, Human
gacgcuugagggccccguuccagag

SEQ ID NO: 957546 - RNA, 21 nt, Human
gacugcagggagggaggcagg

SEQ ID NO: 957547 - RNA, 19 nt, Human
gagaggggagggacauuag

SEQ ID NO: 957548 - RNA, 23 nt, Human
gagaucacgccacugcacuccag

SEQ ID NO: 957549 - RNA, 21 nt, Human
gagauggcagugacagcacgg

SEQ ID NO: 957550 - RNA, 18 nt, Human
gaggcuggggugggagaa

SEQ ID NO: 957551 - RNA, 20 nt, Human
gaggcugggugugauagcuc

SEQ ID NO: 957552 - RNA, 22 nt, Human
gagguuguagugagccgagauc

SEQ ID NO: 957553 - RNA, 23 nt, Human
gagguuguagugagccgagauca

SEQ ID NO: 957554 - RNA, 23 nt, Human
gaucacuugaggucaggaguuca

SEQ ID NO: 957555 - RNA, 24 nt, Human
gaucacuugaggucaggaguucaa

SEQ ID NO: 957556 - RNA, 24 nt, Human
gaucgcuugagcccaggaguuuga

SEQ ID NO: 957557 - RNA, 18 nt, Human
gauuaccugaggacagga

SEQ ID NO: 957558 - RNA, 24 nt, Human
gauuaccugaggacaggaguucga

SEQ ID NO: 957559 - RNA, 22 nt, Human
gcaagagaaucacuugaaccca

SEQ ID NO: 957560 - RNA, 24 nt, Human
gcacuccagccugggcgacagagu

SEQ ID NO: 957561 - RNA, 21 nt, Human
gcagguugacccuggguucgg

SEQ ID NO: 957562 - RNA, 24 nt, Human
gccaacauggugaagccucgucuc

SEQ ID NO: 957563 - RNA, 23 nt, Human
gccaauauggugaaaccugucuc

SEQ ID NO: 957564 - RNA, 22 nt, Human
gccacugcacuccagccugggc

SEQ ID NO: 957565 - RNA, 24 nt, Human
gccacugcacuccagccugggcga

SEQ ID NO: 957566 - RNA, 22 nt, Human
gcccaggaguuugagaccagcc

SEQ ID NO: 957567 - RNA, 20 nt, Human
gccgagaucacgccacugca

SEQ ID NO: 957568 - RNA, 20 nt, Human
gccuuggagggcuggugggg

SEQ ID NO: 957569 - RNA, 20 nt, Human
gcgcuacgcuaccacagcca

SEQ ID NO: 957570 - RNA, 22 nt, Human
gcuccaccuugucccccucuca

SEQ ID NO: 957571 - RNA, 19 nt, Human
gcugggugugauagcucac

SEQ ID NO: 957572 - RNA, 20 nt, Human
gcuucuggcggggagcagcu

SEQ ID NO: 957573 - RNA, 19 nt, Human
gcuuggagacuagaguaac

SEQ ID NO: 957574 - RNA, 18 nt, Human
ggaaagcuccaccuuguc

SEQ ID NO: 957575 - RNA, 24 nt, Human
ggaagccaggcgcagugacucacg

SEQ ID NO: 957576 - RNA, 21 nt, Human
ggacaucuaauacaugaaaug

SEQ ID NO: 957577 - RNA, 22 nt, Human
ggagacagagauggaacccaga

SEQ ID NO: 957578 - RNA, 24 nt, Human
ggagaucccaggacgcuugagggc

SEQ ID NO: 957579 - RNA, 22 nt, Human
ggaggucgagguuguagugagc

SEQ ID NO: 957580 - RNA, 22 nt, Human
ggaucacuugaggucaggaguu

SEQ ID NO: 957581 - RNA, 22 nt, Human
ggaucgcuugagcccaggaguu

SEQ ID NO: 957582 - RNA, 23 nt, Human
ggauuaccugaggacaggaguuc

SEQ ID NO: 957583 - RNA, 23 nt, Human
ggcgugguagcaggaaccuguaa

SEQ ID NO: 957584 - RNA, 21 nt, Human
ggcucacgccuguaaucccag

SEQ ID NO: 957585 - RNA, 22 nt, Human
ggcuccugagccuuccuggagg

SEQ ID NO: 957586 - RNA, 19 nt, Human
gggagauggcagugacagc

SEQ ID NO: 957587 - RNA, 26 nt, Human
gggaggcagaggauggguuagagggg

SEQ ID NO: 957588 - RNA, 20 nt, Human
gggaggcugaggugggcgga

SEQ ID NO: 957589 - RNA, 24 nt, Human
gggauggagaucagggaaugcaga

SEQ ID NO: 957590 - RNA, 18 nt, Human
gggcuccugagccuuccu

SEQ ID NO: 957591 - RNA, 18 nt, Human
ggggagagggaagaggcc

SEQ ID NO: 957592 - RNA, 24 nt, Human
ggggaggcugggugugauagcuca

SEQ ID NO: 957593 - RNA, 19 nt, Human
gggggagaaaacccccaaa

SEQ ID NO: 957594 - RNA, 21 nt, Human
gggggagauggcagugacagc

SEQ ID NO: 957595 - RNA, 23 nt, Human
gggggguggggagagggaagagg

SEQ ID NO: 957596 - RNA, 19 nt, Human
ggguauuggagguuggagg

SEQ ID NO: 957597 - RNA, 23 nt, Human
gggugggagaaucgcuugaaccc

SEQ ID NO: 957598 - RNA, 22 nt, Human
ggugggagaaucgcuugaaccc

SEQ ID NO: 957599 - RNA, 23 nt, Human
ggugugauagcucacgccuguaa

SEQ ID NO: 957600 - RNA, 21 nt, Human
gugaagccucgucucuacuaa

SEQ ID NO: 957601 - RNA, 21 nt, Human
guggaaugggggguacucuga

SEQ ID NO: 957602 - RNA, 22 nt, Human
guggcucacgccuguaauccca

SEQ ID NO: 957603 - RNA, 23 nt, Human
guggcucacgccuguaaucccag

SEQ ID NO: 957604 - RNA, 21 nt, Human
uaaaaauacaaaaauuagcca

SEQ ID NO: 957605 - RNA, 24 nt, Human
uaacauggcaaaaccccgucucua

SEQ ID NO: 957606 - RNA, 23 nt, Human
uaaggaaggaggcagggaaagug

SEQ ID NO: 957607 - RNA, 18 nt, Human
uacccaggauuccuucac

SEQ ID NO: 957608 - RNA, 22 nt, Human
uacccaggauuccuucacucaa

SEQ ID NO: 957609 - RNA, 23 nt, Human
uacccaggauuccuucacucaau

SEQ ID NO: 957610 - RNA, 22 nt, Human
uagcaggaaccuguaaucccag

SEQ ID NO: 957611 - RNA, 23 nt, Human
uagcuagaaaccuugguccaacu

SEQ ID NO: 957612 - RNA, 24 nt, Human
uagcucacgccuguaaucucagca

SEQ ID NO: 957613 - RNA, 25 nt, Human
uagggcuccugagccuuccuggagg

SEQ ID NO: 957614 - RNA, 23 nt, Human
uaguggcacacaccuguaauccc

SEQ ID NO: 957615 - RNA, 24 nt, Human
uaguggcacacaccuguaauccca

SEQ ID NO: 957616 - RNA, 22 nt, Human
uaugaaaagaauauuucucaag

SEQ ID NO: 957617 - RNA, 25 nt, Human
ucaaaaaaaaaaaaaaaaagggagu

SEQ ID NO: 957618 - RNA, 25 nt, Human
ucaaagguagucuuucacaccauag

SEQ ID NO: 957619 - RNA, 20 nt, Human
ucaagaggaagaggaagcca

SEQ ID NO: 957620 - RNA, 18 nt, Human
ucaauaagccaagaccac

SEQ ID NO: 957621 - RNA, 23 nt, Human
ucacgccacugcacuccagccug

SEQ ID NO: 957622 - RNA, 23 nt, Human
ucacuugaggucaggaguucaag

SEQ ID NO: 957623 - RNA, 20 nt, Human
ucagcuauuuaaggaaggag

SEQ ID NO: 957624 - RNA, 18 nt, Human
ucaggggggagauggcag

SEQ ID NO: 957625 - RNA, 23 nt, Human
uccagccugggcgacagagugag

SEQ ID NO: 957626 - RNA, 24 nt, Human
uccagccugggcgacagagugaga

SEQ ID NO: 957627 - RNA, 23 nt, Human
uccaucucaaaaaaaaaaaaaaa

SEQ ID NO: 957628 - RNA, 19 nt, Human
ucccagggccaggaaagcu

SEQ ID NO: 957629 - RNA, 24 nt, Human
ucccucagaaaggaccagacacuu

SEQ ID NO: 957630 - RNA, 22 nt, Human
uccugagccuuccuggaggagc

SEQ ID NO: 957631 - RNA, 19 nt, Human
ucgcuugagcccaggaguu

SEQ ID NO: 957632 - RNA, 21 nt, Human
ucgcuugagcccaggaguuug

SEQ ID NO: 957633 - RNA, 20 nt, Human
ucuaugcuagaggcuuggag

SEQ ID NO: 957634 - RNA, 21 nt, Human
ucucuacuaaaaauacaaaaa

SEQ ID NO: 957635 - RNA, 21 nt, Human
ucucuacuaaaaauacaaaaa

SEQ ID NO: 957636 - RNA, 23 nt, Human
ucugcggagacugugacuagggu

SEQ ID NO: 957637 - RNA, 23 nt, Human
ucuuaaguauuuacucuguuuuc

SEQ ID NO: 957638 - RNA, 22 nt, Human
ugaaauggaauuaccagcugcu

SEQ ID NO: 957639 - RNA, 21 nt, Human
ugaagggaagugggcaggcug

SEQ ID NO: 957640 - RNA, 21 nt, Human
ugacucacgccuguaauccca

SEQ ID NO: 957641 - RNA, 22 nt, Human
ugacucacgccuguaaucccag

SEQ ID NO: 957642 - RNA, 24 nt, Human
ugacucacgccuguaaucccagca

SEQ ID NO: 957643 - RNA, 23 nt, Human
ugacugcagggagggaggcagag

SEQ ID NO: 957644 - RNA, 18 nt, Human
ugagaauggucucuaccc

SEQ ID NO: 957645 - RNA, 23 nt, Human
ugagcccaggaguuugagaccag

SEQ ID NO: 957646 - RNA, 22 nt, Human
ugagccgagaucacgccacugc

SEQ ID NO: 957647 - RNA, 18 nt, Human
ugaggcaagagaaucacu

SEQ ID NO: 957648 - RNA, 20 nt, Human
ugaggcaagagaaucacuug

SEQ ID NO: 957649 - RNA, 24 nt, Human
ugaggcaagagaaucacuugaacc

SEQ ID NO: 957650 - RNA, 25 nt, Human
ugaggcaagagaaucacuugaaccc

SEQ ID NO: 957651 - RNA, 19 nt, Human
ugaggggagaaggaaaugu

SEQ ID NO: 957652 - RNA, 19 nt, Human
ugaggugggcggauuaccu

SEQ ID NO: 957653 - RNA, 23 nt, Human
ugaggugggcggauuaccugagg

SEQ ID NO: 957654 - RNA, 18 nt, Human
ugauauguaacugccuuu

SEQ ID NO: 957655 - RNA, 19 nt, Human
ugauucugagccagggccu

SEQ ID NO: 957656 - RNA, 26 nt, Human
ugccuuggagggcugguggggcuuga

SEQ ID NO: 957657 - RNA, 20 nt, Human
uggaacccagauccagaggg

SEQ ID NO: 957658 - RNA, 25 nt, Human
uggaaugggggguacucugaagagg

SEQ ID NO: 957659 - RNA, 30 nt, Human
uggaggaccacccaaaaaaagccugagggg

SEQ ID NO: 957660 - RNA, 24 nt, Human
uggaucacuugaggucaggaguuc

SEQ ID NO: 957661 - RNA, 27 nt, Human
uggaucacuugaggucaggaguucaag

SEQ ID NO: 957662 - RNA, 22 nt, Human
uggcacacaccuguaaucccag

SEQ ID NO: 957663 - RNA, 19 nt, Human
uggcacaggcuucuggcgg

SEQ ID NO: 957664 - RNA, 23 nt, Human
uggcagggagaggggagggacau

SEQ ID NO: 957665 - RNA, 18 nt, Human
uggcagggagguagggcu

SEQ ID NO: 957666 - RNA, 24 nt, Human
uggccaacauggugaagccucguc

SEQ ID NO: 957667 - RNA, 23 nt, Human
uggccaauauggugaaaccuguc

SEQ ID NO: 957668 - RNA, 24 nt, Human
uggccucuuaaguauuuacucuuu

SEQ ID NO: 957669 - RNA, 22 nt, Human
uggcucacgccuguaaucccag

SEQ ID NO: 957670 - RNA, 24 nt, Human
uggcucacgccuguaaucccagca

SEQ ID NO: 957671 - RNA, 19 nt, Human
ugggaggcugagccaggag

SEQ ID NO: 957672 - RNA, 23 nt, Human
ugggaggcugagccaggaggauc

SEQ ID NO: 957673 - RNA, 18 nt, Human
ugggaggcugaggugggc

SEQ ID NO: 957674 - RNA, 19 nt, Human
ugggaggcugaggugggcg

SEQ ID NO: 957675 - RNA, 22 nt, Human
ugggaggcugaggugggcggau

SEQ ID NO: 957676 - RNA, 23 nt, Human
ugggaggcuggggugggagaauc

SEQ ID NO: 957677 - RNA, 24 nt, Human
ugggaggcuggggugggagaaucg

SEQ ID NO: 957678 - RNA, 21 nt, Human
ugggcgacagagugagacccu

SEQ ID NO: 957679 - RNA, 21 nt, Human
ugggggaagaaaggugaaucu

SEQ ID NO: 957680 - RNA, 22 nt, Human
ugggggaagaaaggugaaucug

SEQ ID NO: 957681 - RNA, 23 nt, Human
ugggggaagaaaggugaaucugg

SEQ ID NO: 957682 - RNA, 18 nt, Human
ugggggggggguggggag

SEQ ID NO: 957683 - RNA, 22 nt, Human
ugggggggggguggggagaggg

SEQ ID NO: 957684 - RNA, 24 nt, Human
ugguagcaggaaccuguaauccca

SEQ ID NO: 957685 - RNA, 21 nt, Human
ugguggggcuacacaugugca

SEQ ID NO: 957686 - RNA, 19 nt, Human
uuaagaggggacagagggc

SEQ ID NO: 957687 - RNA, 22 nt, Human
uuaggaaaaaaagggggaggcu

SEQ ID NO: 957688 - RNA, 22 nt, Human
uucacauugacccagcuggccc

SEQ ID NO: 957689 - RNA, 22 nt, Human
uugagcccaggaguuugagacc

SEQ ID NO: 957690 - RNA, 24 nt, Human
uugggaggcugagccaggaggauc

SEQ ID NO: 957691 - RNA, 18 nt, Human
uuguagugagccgagauc

SEQ ID NO: 957692 - RNA, 20 nt, Human
uuguagugagccgagaucac

SEQ ID NO: 957693 - RNA, 21 nt, Human
uuguagugagccgagaucacg

SEQ ID NO: 957694 - RNA, 20 nt, Human
uuucugggcucugauucuga

SEQ ID NO: 957695 - RNA, 19 nt, Human
aggcagggcuggccgagga

SEQ ID NO: 957696 - RNA, 18 nt, Human
ccuccuggugggcaggca

SEQ ID NO: 957697 - RNA, 22 nt, Human
ccuccuggugggcaggcagggc

SEQ ID NO: 957698 - RNA, 20 nt, Human
cuccugggcucacugcuucc

SEQ ID NO: 957699 - RNA, 24 nt, Human
cuccuggugggcaggcagggcugg

SEQ ID NO: 957700 - RNA, 24 nt, Human
ggacuccugggcucacugcuuccu

SEQ ID NO: 957701 - RNA, 22 nt, Human
uccagaacacaagaauaaaugc

SEQ ID NO: 957702 - RNA, 19 nt, Human
uccugggcucacugcuucc

SEQ ID NO: 957703 - RNA, 21 nt, Human
uccugggcucacugcuuccug

SEQ ID NO: 957704 - RNA, 24 nt, Human
uccugggcucacugcuuccuggcu

SEQ ID NO: 957705 - RNA, 22 nt, Human
uccuggugggcaggcagggcug

SEQ ID NO: 957706 - RNA, 21 nt, Human
uggcuggcaacuugugucccu

SEQ ID NO: 957707 - RNA, 27 nt, Human
ugggcaggcagggcuggccgaggacuc

SEQ ID NO: 957708 - RNA, 20 nt, Human
ugggcucacugcuuccuggc

SEQ ID NO: 957709 - RNA, 27 nt, Human
uugguggcuggcaacuugugucccuuc

SEQ ID NO: 957710 - RNA, 23 nt, Human
aaacagaaagugagagaggggac

SEQ ID NO: 957711 - RNA, 19 nt, Human
auggagcccagaaaugagc

SEQ ID NO: 957712 - RNA, 20 nt, Human
cacuggcugcccaggauugu

SEQ ID NO: 957713 - RNA, 26 nt, Human
caguugccagacgggcaggagguggg

SEQ ID NO: 957714 - RNA, 24 nt, Human
cauucaccccccaagguuuauuua

SEQ ID NO: 957715 - RNA, 23 nt, Human
ccugugccgauggagcccagaaa

SEQ ID NO: 957716 - RNA, 22 nt, Human
cggcaagaaacagaaagugaga

SEQ ID NO: 957717 - RNA, 22 nt, Human
cuacaagagccacuggcugccc

SEQ ID NO: 957718 - RNA, 22 nt, Human
cuggcugcccaggauugugcug

SEQ ID NO: 957719 - RNA, 21 nt, Human
cugggucuguagggcgacggu

SEQ ID NO: 957720 - RNA, 22 nt, Human
gagguggugggggugcagaggg

SEQ ID NO: 957721 - RNA, 21 nt, Human
gcaagaaacagaaagugagag

SEQ ID NO: 957722 - RNA, 22 nt, Human
ggacccagaggacacacuggca

SEQ ID NO: 957723 - RNA, 18 nt, Human
ggcaagaaacagaaagug

SEQ ID NO: 957724 - RNA, 22 nt, Human
ggcaagaaacagaaagugagag

SEQ ID NO: 957725 - RNA, 23 nt, Human
ggcccgggguggacggcaagaaa

SEQ ID NO: 957726 - RNA, 22 nt, Human
gggcaggagguggugggggugc

SEQ ID NO: 957727 - RNA, 21 nt, Human
ggggacagcugggucuguagg

SEQ ID NO: 957728 - RNA, 21 nt, Human
uagaaaagcauagccuuggga

SEQ ID NO: 957729 - RNA, 25 nt, Human
ucucuacaagagccacuggcugccc

SEQ ID NO: 957730 - RNA, 22 nt, Human
ugcagagggaggaccaacucag

SEQ ID NO: 957731 - RNA, 20 nt, Human
uggcccgggguggacggcaa

SEQ ID NO: 957732 - RNA, 21 nt, Human
ugggaggggauccuugaaugg

SEQ ID NO: 957733 - RNA, 21 nt, Human
uuaagacuugacccaaaagac

SEQ ID NO: 957734 - RNA, 21 nt, Human
caagagcgggguccaagcguc

SEQ ID NO: 957735 - RNA, 19 nt, Human
ccccagagggcugcagagc

SEQ ID NO: 957736 - RNA, 21 nt, Human
ccccagcggguccauguagcc

SEQ ID NO: 957737 - RNA, 25 nt, Human
cuucagaaaagauuccgcaggcucc

SEQ ID NO: 957738 - RNA, 22 nt, Human
uaaaguaacucugggaggaaac

SEQ ID NO: 957739 - RNA, 20 nt, Human
uccucggaugacaauucagc

SEQ ID NO: 957740 - RNA, 28 nt, Human
cccaaugcugcuuuauuauuuggcuauu

SEQ ID NO: 957741 - RNA, 22 nt, Human
uuauuauuuggcuauugggggc

SEQ ID NO: 957742 - RNA, 23 nt, Human
aaaaaauaccaaaaccagccagg

SEQ ID NO: 957743 - RNA, 26 nt, Human
aaaaauaccaaaaccagccaggcgca

SEQ ID NO: 957744 - RNA, 23 nt, Human
aaaauaccaaaaccagccaggcg

SEQ ID NO: 957745 - RNA, 19 nt, Human
aacacggugaaaccccguc

SEQ ID NO: 957746 - RNA, 20 nt, Human
aacacggugaaaccccgucu

SEQ ID NO: 957747 - RNA, 21 nt, Human
aagcaauagccaaacaacuau

SEQ ID NO: 957748 - RNA, 21 nt, Human
aaucauggccaaguccacuug

SEQ ID NO: 957749 - RNA, 21 nt, Human
aaucauuaggauauggaaauu

SEQ ID NO: 957750 - RNA, 23 nt, Human
aaucauuaggauauggaaauugc

SEQ ID NO: 957751 - RNA, 24 nt, Human
aaucccuugaacccgugaggcaaa

SEQ ID NO: 957752 - RNA, 20 nt, Human
acaccugcaaucccagccac

SEQ ID NO: 957753 - RNA, 19 nt, Human
acauggugcugagucagga

SEQ ID NO: 957754 - RNA, 23 nt, Human
accugaaagaaugucucgaaggg

SEQ ID NO: 957755 - RNA, 23 nt, Human
acugauuggucaggguaagggag

SEQ ID NO: 957756 - RNA, 24 nt, Human
acugcccuccagccugugugacag

SEQ ID NO: 957757 - RNA, 26 nt, Human
acugcccuccagccugugugacagag

SEQ ID NO: 957758 - RNA, 24 nt, Human
aggcacgagaaucccuugaacccg

SEQ ID NO: 957759 - RNA, 26 nt, Human
aggcagauggaucacuugagaucaga

SEQ ID NO: 957760 - RNA, 22 nt, Human
aggccaggugcaguggcucaug

SEQ ID NO: 957761 - RNA, 24 nt, Human
aggcugaggcacgagaaucccuug

SEQ ID NO: 957762 - RNA, 24 nt, Human
aggugcaguggcucaugccuguaa

SEQ ID NO: 957763 - RNA, 18 nt, Human
aguaugcaggaccugaaa

SEQ ID NO: 957764 - RNA, 23 nt, Human
aguggcucaugccuguaauccca

SEQ ID NO: 957765 - RNA, 24 nt, Human
aguggcucaugccuguaaucccag

SEQ ID NO: 957766 - RNA, 23 nt, Human
auaauucugaagcaauagccaaa

SEQ ID NO: 957767 - RNA, 22 nt, Human
aucccagcacccugggaggcca

SEQ ID NO: 957768 - RNA, 24 nt, Human
aucccgccacugcccuccagccug

SEQ ID NO: 957769 - RNA, 19 nt, Human
augccuguaaucccagcac

SEQ ID NO: 957770 - RNA, 20 nt, Human
auggugcugagucaggaggu

SEQ ID NO: 957771 - RNA, 27 nt, Human
caagcaaagugaccuagugauuaaugc

SEQ ID NO: 957772 - RNA, 21 nt, Human
cacaccugcaaucccagccac

SEQ ID NO: 957773 - RNA, 24 nt, Human
cacaccugcaaucccagccacuug

SEQ ID NO: 957774 - RNA, 20 nt, Human
caccugcaaucccagccacu

SEQ ID NO: 957775 - RNA, 24 nt, Human
cacugcccuccagccugugugaca

SEQ ID NO: 957776 - RNA, 21 nt, Human
cacuggcgcacaccugcaauc

SEQ ID NO: 957777 - RNA, 24 nt, Human
cagauggaucacuugagaucagaa

SEQ ID NO: 957778 - RNA, 20 nt, Human
caugccuguaaucccagcac

SEQ ID NO: 957779 - RNA, 27 nt, Human
ccaaggcagauggaucacuugagauca

SEQ ID NO: 957780 - RNA, 18 nt, Human
ccacugcccuccagccug

SEQ ID NO: 957781 - RNA, 18 nt, Human
ccacugcccuccagccug

SEQ ID NO: 957782 - RNA, 19 nt, Human
ccacugcccuccagccugu

SEQ ID NO: 957783 - RNA, 24 nt, Human
ccacugcccuccagccugugugac

SEQ ID NO: 957784 - RNA, 22 nt, Human
cccagcacccugggaggccaag

SEQ ID NO: 957785 - RNA, 23 nt, Human
cccuccagccugugugacagagu

SEQ ID NO: 957786 - RNA, 22 nt, Human
ccgucuguaacaaaaaauacca

SEQ ID NO: 957787 - RNA, 18 nt, Human
ccuguaaucccagcaccc

SEQ ID NO: 957788 - RNA, 20 nt, Human
ccuguaaucccagcacccug

SEQ ID NO: 957789 - RNA, 22 nt, Human
cgagaucccgccacugcccucc

SEQ ID NO: 957790 - RNA, 23 nt, Human
cucaugccuguaaucccagcacc

SEQ ID NO: 957791 - RNA, 21 nt, Human
cuggcgcacaccugcaauccc

SEQ ID NO: 957792 - RNA, 21 nt, Human
cugggaggcaaggggcuggaa

SEQ ID NO: 957793 - RNA, 19 nt, Human
cuuggaaggcugaggcacg

SEQ ID NO: 957794 - RNA, 19 nt, Human
gagucaggagguaggagga

SEQ ID NO: 957795 - RNA, 24 nt, Human
gaucacuugagaucagaaguucga

SEQ ID NO: 957796 - RNA, 22 nt, Human
gcacgagaaucccuugaacccg

SEQ ID NO: 957797 - RNA, 20 nt, Human
gcagcagagaguuuaaugau

SEQ ID NO: 957798 - RNA, 22 nt, Human
gccaacacggugaaaccccguc

SEQ ID NO: 957799 - RNA, 24 nt, Human
gcccuccagccugugugacagagu

SEQ ID NO: 957800 - RNA, 19 nt, Human
ggaaauugcauucuuugau

SEQ ID NO: 957801 - RNA, 19 nt, Human
ggguucugggaggcaaggg

SEQ ID NO: 957802 - RNA, 22 nt, Human
guaggccaggugcaguggcuca

SEQ ID NO: 957803 - RNA, 23 nt, Human
uaaagccuaauacguaggccagg

SEQ ID NO: 957804 - RNA, 18 nt, Human
uacguaggccaggugcag

SEQ ID NO: 957805 - RNA, 22 nt, Human
uacuauguacaucuuacauaaa

SEQ ID NO: 957806 - RNA, 19 nt, Human
uaggaggaaaaggaaagga

SEQ ID NO: 957807 - RNA, 23 nt, Human
uccagccugugugacagagugag

SEQ ID NO: 957808 - RNA, 24 nt, Human
uccagccugugugacagagugaga

SEQ ID NO: 957809 - RNA, 21 nt, Human
ucugggcugggguucugggag

SEQ ID NO: 957810 - RNA, 22 nt, Human
ugaagcaauagccaaacaacua

SEQ ID NO: 957811 - RNA, 24 nt, Human
ugaaucauuaggauauggaaauug

SEQ ID NO: 957812 - RNA, 19 nt, Human
ugacagcaacacaagugag

SEQ ID NO: 957813 - RNA, 24 nt, Human
ugaggcacgagaaucccuugaacc

SEQ ID NO: 957814 - RNA, 18 nt, Human
ugagucaggagguaggag

SEQ ID NO: 957815 - RNA, 21 nt, Human
ugauuaaugcugaauguggug

SEQ ID NO: 957816 - RNA, 21 nt, Human
ugccuguaaucccagcacccu

SEQ ID NO: 957817 - RNA, 23 nt, Human
ugccuguaaucccagcacccugg

SEQ ID NO: 957818 - RNA, 24 nt, Human
ugccuguaaucccagcacccuggg

SEQ ID NO: 957819 - RNA, 24 nt, Human
uggaaggcugaggcacgagaaucc

SEQ ID NO: 957820 - RNA, 24 nt, Human
uggaucacuugagaucagaaguuc

SEQ ID NO: 957821 - RNA, 27 nt, Human
uggaucacuugagaucagaaguucgag

SEQ ID NO: 957822 - RNA, 27 nt, Human
uggcacugacagcaacacaagugaggc

SEQ ID NO: 957823 - RNA, 22 nt, Human
uggcucaugccuguaaucccag

SEQ ID NO: 957824 - RNA, 24 nt, Human
uggcucaugccuguaaucccagca

SEQ ID NO: 957825 - RNA, 18 nt, Human
ugggaggcaaggggcugg

SEQ ID NO: 957826 - RNA, 18 nt, Human
ugggaggcaaggggcugg

SEQ ID NO: 957827 - RNA, 18 nt, Human
ugggaggccaaggcagau

SEQ ID NO: 957828 - RNA, 24 nt, Human
ugggaggccaaggcagauggauca

SEQ ID NO: 957829 - RNA, 18 nt, Human
ugggcugggguucuggga

SEQ ID NO: 957830 - RNA, 21 nt, Human
ugggcugggguucugggaggc

SEQ ID NO: 957831 - RNA, 22 nt, Human
ugggguucugggaggcaagggg

SEQ ID NO: 957832 - RNA, 22 nt, Human
ugguaggguccuucagaccagc

SEQ ID NO: 957833 - RNA, 23 nt, Human
uuacauggugcugagucaggagg

SEQ ID NO: 957834 - RNA, 20 nt, Human
uucaucaguaugcaggaccu

SEQ ID NO: 957835 - RNA, 21 nt, Human
uucaucaguaugcaggaccug

SEQ ID NO: 957836 - RNA, 21 nt, Human
uucgagaccagcccagccaac

SEQ ID NO: 957837 - RNA, 18 nt, Human
uucugggaggcaaggggc

SEQ ID NO: 957838 - RNA, 19 nt, Human
uucugggcugggguucugg

SEQ ID NO: 957839 - RNA, 19 nt, Human
uuuuuuuuuuuuuuugcag

SEQ ID NO: 957840 - RNA, 22 nt, Human
aaacaaucacaaacacacugug

SEQ ID NO: 957841 - RNA, 23 nt, Human
acaaaaacuaaauaguauaaaua

SEQ ID NO: 957842 - RNA, 25 nt, Human
acacauuugucagucugguggcuuu

SEQ ID NO: 957843 - RNA, 23 nt, Human
agcaaacaaucacaaacacacug

SEQ ID NO: 957844 - RNA, 21 nt, Human
agggaagggggaggggacagg

SEQ ID NO: 957845 - RNA, 23 nt, Human
agggggaggggacaggggaacuc

SEQ ID NO: 957846 - RNA, 18 nt, Human
caaggcucaggcuccugc

SEQ ID NO: 957847 - RNA, 23 nt, Human
cacagcccugaacaaaagcaucc

SEQ ID NO: 957848 - RNA, 24 nt, Human
cagagcaaacaaucacaaacacac

SEQ ID NO: 957849 - RNA, 21 nt, Human
caggcuccugcuccucccccu

SEQ ID NO: 957850 - RNA, 21 nt, Human
ccaggccgaucacagcccuga

SEQ ID NO: 957851 - RNA, 21 nt, Human
cggugugagggaagggggagg

SEQ ID NO: 957852 - RNA, 18 nt, Human
cucaggcuccugcuccuc

SEQ ID NO: 957853 - RNA, 23 nt, Human
cuccccacugggcccaccgaggu

SEQ ID NO: 957854 - RNA, 22 nt, Human
cugggcccaccgaggucgcugg

SEQ ID NO: 957855 - RNA, 18 nt, Human
ggugugagggaaggggga

SEQ ID NO: 957856 - RNA, 23 nt, Human
ucaccagacgcggugugagggaa

SEQ ID NO: 957857 - RNA, 24 nt, Human
ucagcagagccaagaaaggacuga

SEQ ID NO: 957858 - RNA, 21 nt, Human
ucaggcuccugcuccucccca

SEQ ID NO: 957859 - RNA, 22 nt, Human
ucagucugguggcuuuggugcc

SEQ ID NO: 957860 - RNA, 18 nt, Human
ucccaaggcucaggcucc

SEQ ID NO: 957861 - RNA, 23 nt, Human
uccccaggccgaucacagcccug

SEQ ID NO: 957862 - RNA, 23 nt, Human
ucgagugucagcagagccaagaa

SEQ ID NO: 957863 - RNA, 22 nt, Human
ucgcugggccucgaagcuucug

SEQ ID NO: 957864 - RNA, 22 nt, Human
ugagcaggugacggaauguggg

SEQ ID NO: 957865 - RNA, 28 nt, Human
ugagcaggugacggaauguuguaaugac

SEQ ID NO: 957866 - RNA, 20 nt, Human
ugagggaagggggaggggac

SEQ ID NO: 957867 - RNA, 20 nt, Human
uguggaggucacacgcaugu

SEQ ID NO: 957868 - RNA, 21 nt, Human
uucccaaggcucaggcuccug

SEQ ID NO: 957869 - RNA, 25 nt, Human
uuggcaacaaccaguccauagaaga

SEQ ID NO: 957870 - RNA, 27 nt, Human
aacacacagaaucaaauguguuaucca

SEQ ID NO: 957871 - RNA, 20 nt, Human
aagacuuccugucucugagc

SEQ ID NO: 957872 - RNA, 22 nt, Human
acagugacaguggaccaucccc

SEQ ID NO: 957873 - RNA, 21 nt, Human
agaagggacaggaacugcgga

SEQ ID NO: 957874 - RNA, 21 nt, Human
auaaauaauggaaaugacacc

SEQ ID NO: 957875 - RNA, 18 nt, Human
cagcuguguccugugcuc

SEQ ID NO: 957876 - RNA, 21 nt, Human
caguggaccauccccauagga

SEQ ID NO: 957877 - RNA, 23 nt, Human
cauccgggcucaggugaccuucc

SEQ ID NO: 957878 - RNA, 20 nt, Human
ccugaagacuuccugucucu

SEQ ID NO: 957879 - RNA, 18 nt, Human
cugaagacuuccugucuc

SEQ ID NO: 957880 - RNA, 21 nt, Human
ggagaagcauccgggcucagg

SEQ ID NO: 957881 - RNA, 20 nt, Human
gggcgggggggggggggggg

SEQ ID NO: 957882 - RNA, 19 nt, Human
guccugaguauggaggaga

SEQ ID NO: 957883 - RNA, 20 nt, Human
guguccugugcucgggcggg

SEQ ID NO: 957884 - RNA, 21 nt, Human
uaacacggcacauaaaaaaga

SEQ ID NO: 957885 - RNA, 22 nt, Human
uacaauaacacggcacauaaaa

SEQ ID NO: 957886 - RNA, 21 nt, Human
uauuauggaaaacacacagaa

SEQ ID NO: 957887 - RNA, 22 nt, Human
ucagaacccagcuguguccugu

SEQ ID NO: 957888 - RNA, 20 nt, Human
ucccugaagacuuccugucc

SEQ ID NO: 957889 - RNA, 21 nt, Human
ucccugaagacuuccugucuc

SEQ ID NO: 957890 - RNA, 23 nt, Human
ucccugaagacuuccugucucug

SEQ ID NO: 957891 - RNA, 19 nt, Human
ugacaguggaccaucccca

SEQ ID NO: 957892 - RNA, 25 nt, Human
uggaaaacacacagaaucaaaugug

SEQ ID NO: 957893 - RNA, 19 nt, Human
aaagugcugggauuacaag

SEQ ID NO: 957894 - RNA, 20 nt, Human
aaagugcugggauuacaagg

SEQ ID NO: 957895 - RNA, 20 nt, Human
aagagcaagcagaaacaggc

SEQ ID NO: 957896 - RNA, 19 nt, Human
aagccaaggcaaagccaga

SEQ ID NO: 957897 - RNA, 24 nt, Human
aagccagagcucagaaccuagaga

SEQ ID NO: 957898 - RNA, 22 nt, Human
aaggcaaagccagagcucagaa

SEQ ID NO: 957899 - RNA, 24 nt, Human
aagugauccacccaccuuggccuc

SEQ ID NO: 957900 - RNA, 20 nt, Human
aagugcugggauuacaaggc

SEQ ID NO: 957901 - RNA, 25 nt, Human
aagugcugggauuacaaggcugagc

SEQ ID NO: 957902 - RNA, 26 nt, Human
aagugcugggauuacaaggcugagcc

SEQ ID NO: 957903 - RNA, 20 nt, Human
acagagcccuugcaaagcca

SEQ ID NO: 957904 - RNA, 18 nt, Human
acugcagccuccaccucc

SEQ ID NO: 957905 - RNA, 18 nt, Human
acuuugucacccaggcug

SEQ ID NO: 957906 - RNA, 27 nt, Human
acuuugucacccaggcuggagugaagu

SEQ ID NO: 957907 - RNA, 22 nt, Human
agaaacaggcaaauuuguguaa

SEQ ID NO: 957908 - RNA, 21 nt, Human
agagcccuugcaaagccaagg

SEQ ID NO: 957909 - RNA, 18 nt, Human
agccucccgaguagcugg

SEQ ID NO: 957910 - RNA, 22 nt, Human
agcugggauuacaggcgugggc

SEQ ID NO: 957911 - RNA, 20 nt, Human
aggacaagagcaagcagaaa

SEQ ID NO: 957912 - RNA, 25 nt, Human
aggauagugaggggaagccgguacc

SEQ ID NO: 957913 - RNA, 20 nt, Human
aggcgcccgcuaccacgccc

SEQ ID NO: 957914 - RNA, 25 nt, Human
aggcuggagugcaguggcgcgaucu

SEQ ID NO: 957915 - RNA, 24 nt, Human
aggcugucucgaacuccugaccuc

SEQ ID NO: 957916 - RNA, 18 nt, Human
aguagcugggacuacagg

SEQ ID NO: 957917 - RNA, 19 nt, Human
aguagcugggacuacaggc

SEQ ID NO: 957918 - RNA, 19 nt, Human
aguagcugggauuacaggc

SEQ ID NO: 957919 - RNA, 22 nt, Human
aguagcugggauuacaggcgug

SEQ ID NO: 957920 - RNA, 19 nt, Human
agugauccacccaccuugg

SEQ ID NO: 957921 - RNA, 20 nt, Human
agugcaguggcgcgaucucg

SEQ ID NO: 957922 - RNA, 23 nt, Human
agugcaguggcgcgaucucggcu

SEQ ID NO: 957923 - RNA, 24 nt, Human
agugcaguggcgcgaucucggcuc

SEQ ID NO: 957924 - RNA, 24 nt, Human
agugcugggauuacaaggcugagc

SEQ ID NO: 957925 - RNA, 23 nt, Human
aucauguuggccaggcugucucg

SEQ ID NO: 957926 - RNA, 18 nt, Human
augggguuucaucauguu

SEQ ID NO: 957927 - RNA, 22 nt, Human
caaacaauuuuccugccuuagc

SEQ ID NO: 957928 - RNA, 20 nt, Human
caaagcagcgccucagaagc

SEQ ID NO: 957929 - RNA, 21 nt, Human
caaagccaaggcaaagccaga

SEQ ID NO: 957930 - RNA, 24 nt, Human
caaagugcugggauuacaaggcug

SEQ ID NO: 957931 - RNA, 21 nt, Human
caaggagcgggugggguagga

SEQ ID NO: 957932 - RNA, 23 nt, Human
caagugauccacccaccuuggcc

SEQ ID NO: 957933 - RNA, 22 nt, Human
caccacgcggcuaauuuuugua

SEQ ID NO: 957934 - RNA, 22 nt, Human
cacccaccuuggccucccaaag

SEQ ID NO: 957935 - RNA, 23 nt, Human
cacccaccuuggccucccaaagu

SEQ ID NO: 957936 - RNA, 22 nt, Human
cacgccauucuccugccucagc

SEQ ID NO: 957937 - RNA, 23 nt, Human
cacugcagccuccaccuccuggg

SEQ ID NO: 957938 - RNA, 24 nt, Human
cacuuugucacccaggcuggagug

SEQ ID NO: 957939 - RNA, 23 nt, Human
cagccuccaccuccuggguucaa

SEQ ID NO: 957940 - RNA, 26 nt, Human
caucauguuggccaggcugucucgaa

SEQ ID NO: 957941 - RNA, 20 nt, Human
cauguuggccaggcugucuc

SEQ ID NO: 957942 - RNA, 23 nt, Human
cauguuggccaggcugucucgaa

SEQ ID NO: 957943 - RNA, 19 nt, Human
ccaaagugcugggauuaca

SEQ ID NO: 957944 - RNA, 24 nt, Human
ccaaggcaaagccagagcucagaa

SEQ ID NO: 957945 - RNA, 18 nt, Human
ccaccacgcggcuaauuu

SEQ ID NO: 957946 - RNA, 26 nt, Human
ccaccuccuggguucaaacaauuuuu

SEQ ID NO: 957947 - RNA, 22 nt, Human
cccaggcuggagugcaguggcg

SEQ ID NO: 957948 - RNA, 23 nt, Human
cccgaguagcugggacuacaggc

SEQ ID NO: 957949 - RNA, 24 nt, Human
cccgaguagcugggacuacaggcg

SEQ ID NO: 957950 - RNA, 23 nt, Human
cccgaguagcugggauuacaggc

SEQ ID NO: 957951 - RNA, 24 nt, Human
cccgaguagcugggauuacaggcg

SEQ ID NO: 957952 - RNA, 22 nt, Human
ccgaguagcugggauuacaggc

SEQ ID NO: 957953 - RNA, 24 nt, Human
ccgaguagcugggauuacaggcgu

SEQ ID NO: 957954 - RNA, 19 nt, Human
ccgcucccggguucacgcc

SEQ ID NO: 957955 - RNA, 19 nt, Human
ccuccaccuccuggguuca

SEQ ID NO: 957956 - RNA, 22 nt, Human
ccucccaagcuaggacaagagc

SEQ ID NO: 957957 - RNA, 25 nt, Human
ccucccaagcuaggacaagagcaag

SEQ ID NO: 957958 - RNA, 21 nt, Human
ccucuagaggcaugcugacuu

SEQ ID NO: 957959 - RNA, 24 nt, Human
ccugaccucaagugauccacccac

SEQ ID NO: 957960 - RNA, 24 nt, Human
ccugccucagccucccgaguagcu

SEQ ID NO: 957961 - RNA, 23 nt, Human
ccugccuuagccucccgaguagc

SEQ ID NO: 957962 - RNA, 24 nt, Human
ccugccuuagccucccgaguagcu

SEQ ID NO: 957963 - RNA, 23 nt, Human
ccuggguucaaacaauuuuccug

SEQ ID NO: 957964 - RNA, 25 nt, Human
cgcucccggguucacgccauucucc

SEQ ID NO: 957965 - RNA, 24 nt, Human
cgcucugucgcccaggcuggagug

SEQ ID NO: 957966 - RNA, 24 nt, Human
cucaagugauccacccaccuuggc

SEQ ID NO: 957967 - RNA, 24 nt, Human
cucacugcagccuccaccuccugg

SEQ ID NO: 957968 - RNA, 24 nt, Human
cucacuuugucacccaggcuggag

SEQ ID NO: 957969 - RNA, 24 nt, Human
cucagccucccgaguagcugggac

SEQ ID NO: 957970 - RNA, 21 nt, Human
cucccaagcuaggacaagagc

SEQ ID NO: 957971 - RNA, 21 nt, Human
cucccggguucacgccauucu

SEQ ID NO: 957972 - RNA, 21 nt, Human
cucgcucugucgcccaggcug

SEQ ID NO: 957973 - RNA, 24 nt, Human
cucgcucugucgcccaggcuggag

SEQ ID NO: 957974 - RNA, 23 nt, Human
cucugucgcccaggcuggagugc

SEQ ID NO: 957975 - RNA, 23 nt, Human
cugcagccuccaccuccuggguu

SEQ ID NO: 957976 - RNA, 23 nt, Human
cuuagccucccgaguagcuggga

SEQ ID NO: 957977 - RNA, 24 nt, Human
gaccucaagugauccacccaccuu

SEQ ID NO: 957978 - RNA, 25 nt, Human
gaguagcugggacuacaggcgcccg

SEQ ID NO: 957979 - RNA, 27 nt, Human
gaguagcugggauuacaggcgugggcc

SEQ ID NO: 957980 - RNA, 18 nt, Human
gauuacaaggcugagcca

SEQ ID NO: 957981 - RNA, 18 nt, Human
gauuacaggcgugggcca

SEQ ID NO: 957982 - RNA, 21 nt, Human
gauuacaggcgugggccacca

SEQ ID NO: 957983 - RNA, 22 nt, Human
gauuacaggcgugggccaccac

SEQ ID NO: 957984 - RNA, 22 nt, Human
gcagccuccaccuccuggguuc

SEQ ID NO: 957985 - RNA, 19 nt, Human
gcccaggcuggagugcagu

SEQ ID NO: 957986 - RNA, 20 nt, Human
gcccaggcuggagugcagug

SEQ ID NO: 957987 - RNA, 23 nt, Human
gcccggcuaauuuuuuguauuuu

SEQ ID NO: 957988 - RNA, 20 nt, Human
gccucagccucccgaguagc

SEQ ID NO: 957989 - RNA, 19 nt, Human
gcuggagugcaguggcgcg

SEQ ID NO: 957990 - RNA, 24 nt, Human
gcuuuuuguuguuguuguugugac

SEQ ID NO: 957991 - RNA, 21 nt, Human
ggaagccucccaagcuaggac

SEQ ID NO: 957992 - RNA, 26 nt, Human
ggcaaagccagagcucagaaccuaga

SEQ ID NO: 957993 - RNA, 22 nt, Human
ggcugagccaccacguccagcc

SEQ ID NO: 957994 - RNA, 22 nt, Human
gggguuucaucauguuggccag

SEQ ID NO: 957995 - RNA, 18 nt, Human
ggguuucaucauguuggc

SEQ ID NO: 957996 - RNA, 18 nt, Human
guagcugggauuacaggc

SEQ ID NO: 957997 - RNA, 24 nt, Human
gugauccacccaccuuggccuccc

SEQ ID NO: 957998 - RNA, 19 nt, Human
uaauuuuuuguauuuuuag

SEQ ID NO: 957999 - RNA, 20 nt, Human
uaauuuuuuguauuuuuaga

SEQ ID NO: 958000 - RNA, 24 nt, Human
uacaaggcugagccaccacgucca

SEQ ID NO: 958001 - RNA, 19 nt, Human
uacaggcgugggccaccac

SEQ ID NO: 958002 - RNA, 23 nt, Human
uaggauagugaggggaagccucc

SEQ ID NO: 958003 - RNA, 24 nt, Human
uaguacacaugggguuucaucaug

SEQ ID NO: 958004 - RNA, 21 nt, Human
ucacccaggcuggagugaagu

SEQ ID NO: 958005 - RNA, 22 nt, Human
ucacugcaagcuccgcucccgg

SEQ ID NO: 958006 - RNA, 23 nt, Human
ucacugcaagcuccgcucccggg

SEQ ID NO: 958007 - RNA, 23 nt, Human
ucacugcagccuccaccuccugg

SEQ ID NO: 958008 - RNA, 24 nt, Human
ucacugcagccuccaccuccuggg

SEQ ID NO: 958009 - RNA, 25 nt, Human
ucacugcagccuccaccuccugggu

SEQ ID NO: 958010 - RNA, 27 nt, Human
ucacugcagccuccaccuccuggguuc

SEQ ID NO: 958011 - RNA, 24 nt, Human
ucacuuugucacccaggcuggagu

SEQ ID NO: 958012 - RNA, 23 nt, Human
ucagccucccgaguagcugggac

SEQ ID NO: 958013 - RNA, 25 nt, Human
ucccaaagugcugggauuacaaggc

SEQ ID NO: 958014 - RNA, 24 nt, Human
ucccgaguagcugggacuacaggc

SEQ ID NO: 958015 - RNA, 24 nt, Human
ucccgaguagcugggauuacaggc

SEQ ID NO: 958016 - RNA, 21 nt, Human
ucccggguucacgccauucuc

SEQ ID NO: 958017 - RNA, 24 nt, Human
ucccggguucacgccauucuccug

SEQ ID NO: 958018 - RNA, 21 nt, Human
uccuggguucaaacaauuuuc

SEQ ID NO: 958019 - RNA, 24 nt, Human
uccuggguucaaacaauuuuccug

SEQ ID NO: 958020 - RNA, 24 nt, Human
ucgcccaggcuggagugcaguggc

SEQ ID NO: 958021 - RNA, 24 nt, Human
ucgcucugucgcccaggcuggagu

SEQ ID NO: 958022 - RNA, 23 nt, Human
ucucacuuugucacccaggcugg

SEQ ID NO: 958023 - RNA, 24 nt, Human
ucucacuuugucacccaggcugga

SEQ ID NO: 958024 - RNA, 24 nt, Human
ucuccugccucagccucccgagua

SEQ ID NO: 958025 - RNA, 21 nt, Human
ucucgaacuccugaccucaag

SEQ ID NO: 958026 - RNA, 19 nt, Human
ucucgcucugucgcccagg

SEQ ID NO: 958027 - RNA, 23 nt, Human
ucucgcucugucgcccaggcugg

SEQ ID NO: 958028 - RNA, 24 nt, Human
ucucgcucugucgcccaggcugga

SEQ ID NO: 958029 - RNA, 26 nt, Human
ucucgcucugucgcccaggcuggagu

SEQ ID NO: 958030 - RNA, 27 nt, Human
ucucgcucugucgcccaggcuggagug

SEQ ID NO: 958031 - RNA, 24 nt, Human
ucugucgcccaggcuggagugcag

SEQ ID NO: 958032 - RNA, 23 nt, Human
ugaaguggcacaaucucagcuca

SEQ ID NO: 958033 - RNA, 21 nt, Human
ugacaaagcagcgccucagaa

SEQ ID NO: 958034 - RNA, 22 nt, Human
ugagacggagucucgcucuguc

SEQ ID NO: 958035 - RNA, 24 nt, Human
ugauccacccaccuuggccuccca

SEQ ID NO: 958036 - RNA, 24 nt, Human
ugccucagccucccgaguagcugg

SEQ ID NO: 958037 - RNA, 24 nt, Human
ugccuuagccucccgaguagcugg

SEQ ID NO: 958038 - RNA, 23 nt, Human
ugcugggauuacaaggcugagcc

SEQ ID NO: 958039 - RNA, 24 nt, Human
uggagugaaguggcacaaucucag

SEQ ID NO: 958040 - RNA, 23 nt, Human
uggagugcaguggcgcgaucucg

SEQ ID NO: 958041 - RNA, 24 nt, Human
uggagugcaguggcgcgaucucgg

SEQ ID NO: 958042 - RNA, 23 nt, Human
uggcacaaucucagcucacugca

SEQ ID NO: 958043 - RNA, 23 nt, Human
uggccaggcugucucgaacuccu

SEQ ID NO: 958044 - RNA, 21 nt, Human
ugggacuacaggcgcccgcua

SEQ ID NO: 958045 - RNA, 22 nt, Human
ugggacuacaggcgcccgcuac

SEQ ID NO: 958046 - RNA, 24 nt, Human
ugggacuacaggcgcccgcuacca

SEQ ID NO: 958047 - RNA, 22 nt, Human
ugggauuacaaggcugagccac

SEQ ID NO: 958048 - RNA, 24 nt, Human
ugggauuacaaggcugagccacca

SEQ ID NO: 958049 - RNA, 18 nt, Human
ugggauuacaggcguggg

SEQ ID NO: 958050 - RNA, 19 nt, Human
ugggauuacaggcgugggc

SEQ ID NO: 958051 - RNA, 21 nt, Human
ugggauuacaggcgugggcca

SEQ ID NO: 958052 - RNA, 22 nt, Human
ugggauuacaggcgugggccac

SEQ ID NO: 958053 - RNA, 23 nt, Human
ugggauuacaggcgugggccacc

SEQ ID NO: 958054 - RNA, 24 nt, Human
ugggauuacaggcgugggccacca

SEQ ID NO: 958055 - RNA, 24 nt, Human
ugggguuucaucauguuggccagg

SEQ ID NO: 958056 - RNA, 23 nt, Human
uggguucaaacaauuuuccugcc

SEQ ID NO: 958057 - RNA, 21 nt, Human
uguauuuuuaguacacauggg

SEQ ID NO: 958058 - RNA, 21 nt, Human
ugucacagagcccuugcaaag

SEQ ID NO: 958059 - RNA, 19 nt, Human
ugucacccaggcuggagug

SEQ ID NO: 958060 - RNA, 21 nt, Human
ugucacccaggcuggagugaa

SEQ ID NO: 958061 - RNA, 19 nt, Human
ugugagggguugagacggc

SEQ ID NO: 958062 - RNA, 24 nt, Human
uuaguacacaugggguuucaucau

SEQ ID NO: 958063 - RNA, 24 nt, Human
uucaaacaauuuuccugccuuagc

SEQ ID NO: 958064 - RNA, 18 nt, Human
uuggccucccaaagugcu

SEQ ID NO: 958065 - RNA, 23 nt, Human
uuguauuuuuaguacacaugggg

SEQ ID NO: 958066 - RNA, 21 nt, Human
uuucaucauguuggccaggcu

SEQ ID NO: 958067 - RNA, 23 nt, Human
uuuuuaguacacaugggguuuca

SEQ ID NO: 958068 - RNA, 18 nt, Human
uuuuuuguauuuuuagua

SEQ ID NO: 958069 - RNA, 25 nt, Human
uuuuuuuuuuuugagacggagucuc

SEQ ID NO: 958070 - RNA, 22 nt, Human
uuuuuuuuuuuuuugagacgga

SEQ ID NO: 958071 - RNA, 18 nt, Human
uuuuuuuuuuuuuuuuug

SEQ ID NO: 958072 - RNA, 22 nt, Human
aaaaaucuauuuuaugugaaaa

SEQ ID NO: 958073 - RNA, 18 nt, Human
agucauggcuuguuuuua

SEQ ID NO: 958074 - RNA, 18 nt, Human
auacauaugcaaauaugu

SEQ ID NO: 958075 - RNA, 18 nt, Human
caaaacccaccaaaaucc

SEQ ID NO: 958076 - RNA, 19 nt, Human
cacucugagaaaggacagg

SEQ ID NO: 958077 - RNA, 22 nt, Human
cauacauaugcaaauauguaau

SEQ ID NO: 958078 - RNA, 23 nt, Human
cauaugcaaauauguaauuauau

SEQ ID NO: 958079 - RNA, 18 nt, Human
cugguuuggucucagccc

SEQ ID NO: 958080 - RNA, 19 nt, Human
cuuccauagggacaucaua

SEQ ID NO: 958081 - RNA, 18 nt, Human
gagggugagggcaugggc

SEQ ID NO: 958082 - RNA, 18 nt, Human
ggagucauacauaugcaa

SEQ ID NO: 958083 - RNA, 23 nt, Human
uaaaaucuacuaagaaaaaccau

SEQ ID NO: 958084 - RNA, 22 nt, Human
uaagaaaaaccaugauucacau

SEQ ID NO: 958085 - RNA, 22 nt, Human
uacaauacccccaugagguaga

SEQ ID NO: 958086 - RNA, 23 nt, Human
uacauccaaggcuuuauguucaa

SEQ ID NO: 958087 - RNA, 20 nt, Human
uccacaugagaauuggaggu

SEQ ID NO: 958088 - RNA, 18 nt, Human
uggcuuguuuuuaguuca

SEQ ID NO: 958089 - RNA, 19 nt, Human
uggucucagccccucugcu

SEQ ID NO: 958090 - RNA, 20 nt, Human
ugguuuggucucagccccuc

SEQ ID NO: 958091 - RNA, 21 nt, Human
uucugguuuggucucagcccc

SEQ ID NO: 958092 - RNA, 20 nt, Human
aaagauuccuuaguacccuu

SEQ ID NO: 958093 - RNA, 19 nt, Human
aaccuuuugaucuuucaac

SEQ ID NO: 958094 - RNA, 23 nt, Human
acacugaaaacaauauaggaaau

SEQ ID NO: 958095 - RNA, 20 nt, Human
agaacauccacuaagaacau

SEQ ID NO: 958096 - RNA, 19 nt, Human
agacuggagguuccucugc

SEQ ID NO: 958097 - RNA, 22 nt, Human
agagcuuacauuauagugccag

SEQ ID NO: 958098 - RNA, 18 nt, Human
agauucugagaauucuga

SEQ ID NO: 958099 - RNA, 19 nt, Human
agcagaaagauuccuuagu

SEQ ID NO: 958100 - RNA, 18 nt, Human
aggcagccucuguguggu

SEQ ID NO: 958101 - RNA, 19 nt, Human
agggaaauauuugaagcag

SEQ ID NO: 958102 - RNA, 19 nt, Human
aguagagcuuacauuauag

SEQ ID NO: 958103 - RNA, 18 nt, Human
cauagcaccucaguagag

SEQ ID NO: 958104 - RNA, 19 nt, Human
caucgauuuugcuccccuc

SEQ ID NO: 958105 - RNA, 21 nt, Human
caucgauuuugcuccccucug

SEQ ID NO: 958106 - RNA, 19 nt, Human
ccaaagcagaaagauuccu

SEQ ID NO: 958107 - RNA, 23 nt, Human
cccuuggaagaugggaaagguga

SEQ ID NO: 958108 - RNA, 24 nt, Human
cccuuggaagaugggaaaggugag

SEQ ID NO: 958109 - RNA, 18 nt, Human
ccucugcuguaggcucag

SEQ ID NO: 958110 - RNA, 22 nt, Human
cucagaauaugucuaagcaauu

SEQ ID NO: 958111 - RNA, 19 nt, Human
cuguaggcucagaauaugu

SEQ ID NO: 958112 - RNA, 24 nt, Human
cuuuauuaaccuuuugaucuuuca

SEQ ID NO: 958113 - RNA, 22 nt, Human
gauggcaguggaaguccaugaa

SEQ ID NO: 958114 - RNA, 24 nt, Human
gcagggucagaacauccacuaaga

SEQ ID NO: 958115 - RNA, 18 nt, Human
gggucagaacauccacua

SEQ ID NO: 958116 - RNA, 24 nt, Human
uaacaugcagagcauauaucuauc

SEQ ID NO: 958117 - RNA, 19 nt, Human
uacugaauagcuuaggaug

SEQ ID NO: 958118 - RNA, 22 nt, Human
uauguaacaugcagagcauaua

SEQ ID NO: 958119 - RNA, 24 nt, Human
ucuguauuuuuaaaauuuuccugu

SEQ ID NO: 958120 - RNA, 24 nt, Human
ugaagcagggucagaacauccacu

SEQ ID NO: 958121 - RNA, 21 nt, Human
uggaaguccaugaaguaaaga

SEQ ID NO: 958122 - RNA, 24 nt, Human
uugaagcagggucagaacauccac

SEQ ID NO: 958123 - RNA, 20 nt, Human
aaaaaagaaagguuguggua

SEQ ID NO: 958124 - RNA, 22 nt, Human
aaaaguugaaagucacaaaacc

SEQ ID NO: 958125 - RNA, 22 nt, Human
aaacaucaaauuaagacuggug

SEQ ID NO: 958126 - RNA, 22 nt, Human
aagugauugcuagguauacauu

SEQ ID NO: 958127 - RNA, 24 nt, Human
aaugaauugguuauaaaacaaacc

SEQ ID NO: 958128 - RNA, 18 nt, Human
accaaaugaugcauaaga

SEQ ID NO: 958129 - RNA, 27 nt, Human
accguaaccacagauaguaauauagca

SEQ ID NO: 958130 - RNA, 18 nt, Human
auagcauaaagaucaaua

SEQ ID NO: 958131 - RNA, 18 nt, Human
auucugauugucauucau

SEQ ID NO: 958132 - RNA, 20 nt, Human
caggaagacuguauuucugu

SEQ ID NO: 958133 - RNA, 23 nt, Human
cauaaagaucaauacagacagau

SEQ ID NO: 958134 - RNA, 25 nt, Human
caucucaaugaauaaaaguugaaaa

SEQ ID NO: 958135 - RNA, 23 nt, Human
cauuuuguauuucagaugugucc

SEQ ID NO: 958136 - RNA, 22 nt, Human
cggaucaaaacaaaaaguacag

SEQ ID NO: 958137 - RNA, 20 nt, Human
cuucagcuuugcugcucuuc

SEQ ID NO: 958138 - RNA, 20 nt, Human
cuucuuggaaggaguagaaa

SEQ ID NO: 958139 - RNA, 18 nt, Human
gcugcuggugcugcugcu

SEQ ID NO: 958140 - RNA, 23 nt, Human
gcuggugcugcugcugcuacuuc

SEQ ID NO: 958141 - RNA, 22 nt, Human
guuuuuugcuguugcugcuggu

SEQ ID NO: 958142 - RNA, 26 nt, Human
uaaacacacauauccuaauugcuuca

SEQ ID NO: 958143 - RNA, 23 nt, Human
uaaccagccuuucuuaagguagc

SEQ ID NO: 958144 - RNA, 23 nt, Human
uacaguauauaggcaugaacaaa

SEQ ID NO: 958145 - RNA, 24 nt, Human
uacaugauguuuggggaaagaagu

SEQ ID NO: 958146 - RNA, 27 nt, Human
uaccuaaauuuuacaguauauaggcau

SEQ ID NO: 958147 - RNA, 22 nt, Human
uacgacacauagaugcuuuuga

SEQ ID NO: 958148 - RNA, 21 nt, Human
uagacaaaaacauuuuguauu

SEQ ID NO: 958149 - RNA, 24 nt, Human
uaguuuauuagagaaaaaaaugac

SEQ ID NO: 958150 - RNA, 21 nt, Human
uauuagagaaaaaaaugacuu

SEQ ID NO: 958151 - RNA, 19 nt, Human
uauugaugugcuacaugau

SEQ ID NO: 958152 - RNA, 22 nt, Human
uauuucagauguguccaagaua

SEQ ID NO: 958153 - RNA, 19 nt, Human
uccaccguaaccacagaua

SEQ ID NO: 958154 - RNA, 23 nt, Human
uccuuugggcaguggaauucuga

SEQ ID NO: 958155 - RNA, 22 nt, Human
ucuucuuggaaggaguagaaau

SEQ ID NO: 958156 - RNA, 26 nt, Human
ugcaacaaguaagaacgugaaagcac

SEQ ID NO: 958157 - RNA, 24 nt, Human
ugccaguaucccauagcguauaau

SEQ ID NO: 958158 - RNA, 23 nt, Human
uggaaggaguagaaaugcugaac

SEQ ID NO: 958159 - RNA, 24 nt, Human
uguagaauucuugucauuucagua

SEQ ID NO: 958160 - RNA, 22 nt, Human
uguguauuugcaugaaaaaaug

SEQ ID NO: 958161 - RNA, 23 nt, Human
uguugcugcuggugcugcugcug

SEQ ID NO: 958162 - RNA, 23 nt, Human
uuaaugaauugguuauaaaacaa

SEQ ID NO: 958163 - RNA, 20 nt, Human
uucuagagacagaaauguuc

SEQ ID NO: 958164 - RNA, 26 nt, Human
uucucauagucacaacagaauaguug

SEQ ID NO: 958165 - RNA, 24 nt, Human
uucuuggaaggaguagaaaugcug

SEQ ID NO: 958166 - RNA, 18 nt, Human
uugcugcuggugcugcug

SEQ ID NO: 958167 - RNA, 22 nt, Human
uugcugcuggugcugcugcugc

SEQ ID NO: 958168 - RNA, 30 nt, Human
uugcuguugcugcuggugcugcugcugccg

SEQ ID NO: 958169 - RNA, 23 nt, Human
uuucacccaccuuucauccuuca

SEQ ID NO: 958170 - RNA, 24 nt, Human
uuugcuuauuuuucaacauuuuuc

SEQ ID NO: 958171 - RNA, 21 nt, Human
uuuugcuguugcugcuggugc

SEQ ID NO: 958172 - RNA, 21 nt, Human
uuuuugguccuuucacccacc

SEQ ID NO: 958173 - RNA, 21 nt, Human
cacaagucucccaacugguuu

SEQ ID NO: 958174 - RNA, 23 nt, Human
ccaacugguuuggaguuuucccu

SEQ ID NO: 958175 - RNA, 19 nt, Human
cggcccggagacgccaccc

SEQ ID NO: 958176 - RNA, 19 nt, Human
cgguggaugcccagggcug

SEQ ID NO: 958177 - RNA, 21 nt, Human
cgucggagcggcggcccggag

SEQ ID NO: 958178 - RNA, 19 nt, Human
cucccaacugguuuggagu

SEQ ID NO: 958179 - RNA, 19 nt, Human
cucugcccggggcgcgccu

SEQ ID NO: 958180 - RNA, 20 nt, Human
cuggcccgucggagcggcgg

SEQ ID NO: 958181 - RNA, 21 nt, Human
gcggcccggagacgccaccca

SEQ ID NO: 958182 - RNA, 18 nt, Human
gggcgcgccuuccggcuc

SEQ ID NO: 958183 - RNA, 23 nt, Human
uaaucugcaaaguccuuugcaca

SEQ ID NO: 958184 - RNA, 23 nt, Human
uggaguuuucccuucugagguuu

SEQ ID NO: 958185 - RNA, 24 nt, Human
uggaugcccagggcugucuguggc

SEQ ID NO: 958186 - RNA, 24 nt, Human
uuuuuuuuuuuuuuuuuuaaucug

SEQ ID NO: 958187 - RNA, 22 nt, Human
aaaauauauauuuagcuaccag

SEQ ID NO: 958188 - RNA, 19 nt, Human
aaacaaauaaacaaacaac

SEQ ID NO: 958189 - RNA, 22 nt, Human
aaacaaauaaacaaacaacaac

SEQ ID NO: 958190 - RNA, 20 nt, Human
aaacaacaacaaaaucuuuc

SEQ ID NO: 958191 - RNA, 20 nt, Human
aacaacaaaaucuuuccuuc

SEQ ID NO: 958192 - RNA, 21 nt, Human
aacagcaaauagcagagguac

SEQ ID NO: 958193 - RNA, 25 nt, Human
aacuacuggaaaaacaaauaaacaa

SEQ ID NO: 958194 - RNA, 21 nt, Human
aacuuaaacuuuuagaaauuc

SEQ ID NO: 958195 - RNA, 22 nt, Human
acagaauucuuaugaaacauca

SEQ ID NO: 958196 - RNA, 18 nt, Human
acuagcagucaggaauuu

SEQ ID NO: 958197 - RNA, 21 nt, Human
acuucauuagcugagcugaaa

SEQ ID NO: 958198 - RNA, 24 nt, Human
agccagugauuccuggcucacacu

SEQ ID NO: 958199 - RNA, 24 nt, Human
agcgaagauuggaggauccggagc

SEQ ID NO: 958200 - RNA, 23 nt, Human
auagguuuuccucacacucuuca

SEQ ID NO: 958201 - RNA, 24 nt, Human
auagguuuuccucacacucuucaa

SEQ ID NO: 958202 - RNA, 23 nt, Human
aucuaaaauauauauuuagcuac

SEQ ID NO: 958203 - RNA, 19 nt, Human
auuucuuggaaauauaaua

SEQ ID NO: 958204 - RNA, 24 nt, Human
caaaacuuucagaguacaagucau

SEQ ID NO: 958205 - RNA, 28 nt, Human
caacaacaaaaucuuuccuucuugucuu

SEQ ID NO: 958206 - RNA, 22 nt, Human
caauugccaaaacuucaauagc

SEQ ID NO: 958207 - RNA, 22 nt, Human
cagcuuucuaaagugaaauaau

SEQ ID NO: 958208 - RNA, 25 nt, Human
ccauacuaaaaagauaaagaauguc

SEQ ID NO: 958209 - RNA, 20 nt, Human
cccuggguucagagaccucc

SEQ ID NO: 958210 - RNA, 22 nt, Human
cuaacauauuccccaagaaaca

SEQ ID NO: 958211 - RNA, 26 nt, Human
cuaacuacuggaaaaacaaauaaaca

SEQ ID NO: 958212 - RNA, 20 nt, Human
cuauagucaauugccaaaac

SEQ ID NO: 958213 - RNA, 21 nt, Human
gaaauucucuaacauauuccc

SEQ ID NO: 958214 - RNA, 21 nt, Human
gaagauaagauauuagcccuc

SEQ ID NO: 958215 - RNA, 18 nt, Human
gaagauuggaggauccgg

SEQ ID NO: 958216 - RNA, 20 nt, Human
gccuguuuucuagcuucuuc

SEQ ID NO: 958217 - RNA, 23 nt, Human
gcggguuccugaacuggguggag

SEQ ID NO: 958218 - RNA, 22 nt, Human
gguggaggagcggagauuggag

SEQ ID NO: 958219 - RNA, 19 nt, Human
guuaaguuugccuuuacuu

SEQ ID NO: 958220 - RNA, 24 nt, Human
uaaacaaacaacaacaaaaucuuu

SEQ ID NO: 958221 - RNA, 19 nt, Human
uacaagucauuguuaaguu

SEQ ID NO: 958222 - RNA, 18 nt, Human
uagcagagguacuaugcu

SEQ ID NO: 958223 - RNA, 19 nt, Human
uaguaucccacaaucaaga

SEQ ID NO: 958224 - RNA, 22 nt, Human
uccaucaacagaauucuuauga

SEQ ID NO: 958225 - RNA, 22 nt, Human
ucccuggguucagagaccucca

SEQ ID NO: 958226 - RNA, 23 nt, Human
ucuaaaauauauauuuagcuacc

SEQ ID NO: 958227 - RNA, 18 nt, Human
ucucugcugaagacuggg

SEQ ID NO: 958228 - RNA, 19 nt, Human
ucuuuccuucuugucuucc

SEQ ID NO: 958229 - RNA, 18 nt, Human
ugaggaauccaggaagaa

SEQ ID NO: 958230 - RNA, 19 nt, Human
ugccuuuacuuuaaaaacu

SEQ ID NO: 958231 - RNA, 20 nt, Human
ugcuagggccucgaggaugu

SEQ ID NO: 958232 - RNA, 20 nt, Human
ugcugaagacugggaaacuu

SEQ ID NO: 958233 - RNA, 20 nt, Human
uggaaaaacaaauaaacaaa

SEQ ID NO: 958234 - RNA, 22 nt, Human
uuaaauaguaucccacaaucaa

SEQ ID NO: 958235 - RNA, 24 nt, Human
uucaaagugaggaauccaggaaga

SEQ ID NO: 958236 - RNA, 22 nt, Human
uugaaagauuaacagccaguga

SEQ ID NO: 958237 - RNA, 22 nt, Human
uuggaggagcgaagauuggagg

SEQ ID NO: 958238 - RNA, 25 nt, Human
uuguuugaauacguuuccaaaacuu

SEQ ID NO: 958239 - RNA, 19 nt, Human
uuuccacauuaaauccaca

SEQ ID NO: 958240 - RNA, 23 nt, Human
uuuuccaugcgugcucauuucuc

SEQ ID NO: 958241 - RNA, 18 nt, Human
uuuuuuuuuuuuuuuuug

SEQ ID NO: 958242 - RNA, 26 nt, Human
aaaaaagggaaccccugacuuuaugc

SEQ ID NO: 958243 - RNA, 24 nt, Human
aaagucuuuccaaagucuuccuac

SEQ ID NO: 958244 - RNA, 25 nt, Human
aacucacucccuugcaggcccucug

SEQ ID NO: 958245 - RNA, 19 nt, Human
aacugcagcaggaccaaga

SEQ ID NO: 958246 - RNA, 24 nt, Human
acaaaguccauggaagggggaccu

SEQ ID NO: 958247 - RNA, 21 nt, Human
acagggcagcaugggucagaa

SEQ ID NO: 958248 - RNA, 20 nt, Human
acccuuaucuccccuuccca

SEQ ID NO: 958249 - RNA, 21 nt, Human
acccuuaucuccccuucccac

SEQ ID NO: 958250 - RNA, 22 nt, Human
accucccucuuuccuuucacag

SEQ ID NO: 958251 - RNA, 20 nt, Human
accuggguagaacccagccc

SEQ ID NO: 958252 - RNA, 19 nt, Human
acuggccccagcggcuucc

SEQ ID NO: 958253 - RNA, 23 nt, Human
agaaacuaacaaaguccauggaa

SEQ ID NO: 958254 - RNA, 21 nt, Human
agcagcagaggagaguuuugg

SEQ ID NO: 958255 - RNA, 22 nt, Human
agccaaaaaagggaaccccuga

SEQ ID NO: 958256 - RNA, 22 nt, Human
aggaaacaccacacuagccuca

SEQ ID NO: 958257 - RNA, 21 nt, Human
aggaauguggcugcuccugga

SEQ ID NO: 958258 - RNA, 21 nt, Human
aggaccaagagacacaaucag

SEQ ID NO: 958259 - RNA, 18 nt, Human
aggagaaggucuuggagg

SEQ ID NO: 958260 - RNA, 21 nt, Human
aggcaggcggcuagagccagg

SEQ ID NO: 958261 - RNA, 24 nt, Human
aggcagggccccaucacagggugu

SEQ ID NO: 958262 - RNA, 21 nt, Human
aggcccuuggguggggguggg

SEQ ID NO: 958263 - RNA, 18 nt, Human
agggaaccucuaaccagc

SEQ ID NO: 958264 - RNA, 20 nt, Human
agggagugggcagagggccu

SEQ ID NO: 958265 - RNA, 21 nt, Human
agggauggucucugcucugcc

SEQ ID NO: 958266 - RNA, 23 nt, Human
aggggacucauggaaaacaucau

SEQ ID NO: 958267 - RNA, 24 nt, Human
agguagacggcaagggucggggac

SEQ ID NO: 958268 - RNA, 21 nt, Human
agugagagaggugggaaggga

SEQ ID NO: 958269 - RNA, 20 nt, Human
auccaggggcuggagagaag

SEQ ID NO: 958270 - RNA, 20 nt, Human
caaaaaagggaaccccugac

SEQ ID NO: 958271 - RNA, 22 nt, Human
caaaauggcacagacguuggug

SEQ ID NO: 958272 - RNA, 18 nt, Human
caaagugcauugggccca

SEQ ID NO: 958273 - RNA, 21 nt, Human
caaguuaguccauuggcaggg

SEQ ID NO: 958274 - RNA, 21 nt, Human
caccacacuagccucaugcaa

SEQ ID NO: 958275 - RNA, 19 nt, Human
caccagauacccuuaucuc

SEQ ID NO: 958276 - RNA, 23 nt, Human
caccagauacccuuaucuccccu

SEQ ID NO: 958277 - RNA, 28 nt, Human
caccagggacccugaggggccaggccag

SEQ ID NO: 958278 - RNA, 21 nt, Human
cacccccucugucccuggcag

SEQ ID NO: 958279 - RNA, 23 nt, Human
caccuccccccuccaaucauccc

SEQ ID NO: 958280 - RNA, 23 nt, Human
caccugagccaggcccugagcuu

SEQ ID NO: 958281 - RNA, 19 nt, Human
cacuagccucaugcaagaa

SEQ ID NO: 958282 - RNA, 28 nt, Human
cagcagcagaggagaguuuuggggcugg

SEQ ID NO: 958283 - RNA, 21 nt, Human
cagcaggaccaagagacacaa

SEQ ID NO: 958284 - RNA, 24 nt, Human
cagcaugggucagaaggggcuggg

SEQ ID NO: 958285 - RNA, 21 nt, Human
cagccagcagcagaggagagu

SEQ ID NO: 958286 - RNA, 22 nt, Human
caggaaacaccacacuagccuc

SEQ ID NO: 958287 - RNA, 23 nt, Human
caggagucucugaagaagcauca

SEQ ID NO: 958288 - RNA, 22 nt, Human
cagggccccaucacaggguguc

SEQ ID NO: 958289 - RNA, 23 nt, Human
caugcaagaaaagacaugucacc

SEQ ID NO: 958290 - RNA, 22 nt, Human
ccaaagucuuccuacucuuucc

SEQ ID NO: 958291 - RNA, 25 nt, Human
ccaacuggccccagcggcuuccuca

SEQ ID NO: 958292 - RNA, 18 nt, Human
ccagugggggcgugggcu

SEQ ID NO: 958293 - RNA, 18 nt, Human
ccccauccaggcaugcuc

SEQ ID NO: 958294 - RNA, 23 nt, Human
ccccuggaaggcucucccagccu

SEQ ID NO: 958295 - RNA, 21 nt, Human
cccuuaucuccccuucccaca

SEQ ID NO: 958296 - RNA, 22 nt, Human
ccuccaagcacccaucugugaa

SEQ ID NO: 958297 - RNA, 19 nt, Human
ccuggguagaacccagccc

SEQ ID NO: 958298 - RNA, 23 nt, Human
ccugucugcgguggggacaaagg

SEQ ID NO: 958299 - RNA, 18 nt, Human
ccuuaccucccucuuucc

SEQ ID NO: 958300 - RNA, 18 nt, Human
cucagcacaguguagacc

SEQ ID NO: 958301 - RNA, 18 nt, Human
cucauggaaaacaucaug

SEQ ID NO: 958302 - RNA, 20 nt, Human
cucccacccucucugagcug

SEQ ID NO: 958303 - RNA, 18 nt, Human
cucugcccauuuccauuu

SEQ ID NO: 958304 - RNA, 20 nt, Human
cugcgguggggacaaaggug

SEQ ID NO: 958305 - RNA, 21 nt, Human
cugcucugcccauuuccauuu

SEQ ID NO: 958306 - RNA, 19 nt, Human
cuggaaggcucucccagcc

SEQ ID NO: 958307 - RNA, 18 nt, Human
cuggccccagcggcuucc

SEQ ID NO: 958308 - RNA, 20 nt, Human
cuggcgugugugggguggga

SEQ ID NO: 958309 - RNA, 21 nt, Human
cugugaggcugcauccagggg

SEQ ID NO: 958310 - RNA, 19 nt, Human
cuucccacaaugccuaacc

SEQ ID NO: 958311 - RNA, 21 nt, Human
cuuccuacucuuuccaaaguc

SEQ ID NO: 958312 - RNA, 20 nt, Human
cuucuuggacaugugucugg

SEQ ID NO: 958313 - RNA, 21 nt, Human
cuuuaugccuacaacuucccc

SEQ ID NO: 958314 - RNA, 23 nt, Human
gacaaguuaguccauuggcaggg

SEQ ID NO: 958315 - RNA, 21 nt, Human
gagcugccagagugaccccac

SEQ ID NO: 958316 - RNA, 18 nt, Human
gaggcagagcccgggcug

SEQ ID NO: 958317 - RNA, 18 nt, Human
gagggccuggccugaugc

SEQ ID NO: 958318 - RNA, 24 nt, Human
gaucccaccuccccccuccaauca

SEQ ID NO: 958319 - RNA, 22 nt, Human
gcagugccaggaaacaccacac

SEQ ID NO: 958320 - RNA, 18 nt, Human
gccaggcccugagcuucc

SEQ ID NO: 958321 - RNA, 28 nt, Human
gcccagccucaggaaagaagggaacgcc

SEQ ID NO: 958322 - RNA, 19 nt, Human
gcccauaagaggccccuca

SEQ ID NO: 958323 - RNA, 27 nt, Human
gcuccuggagccuuuccugggcuucuu

SEQ ID NO: 958324 - RNA, 22 nt, Human
gcugcuccuggagccuuuccug

SEQ ID NO: 958325 - RNA, 21 nt, Human
ggaggcagagcccgggcuguc

SEQ ID NO: 958326 - RNA, 19 nt, Human
ggagugggcagagggccug

SEQ ID NO: 958327 - RNA, 21 nt, Human
ggcagguggagaauggucaag

SEQ ID NO: 958328 - RNA, 21 nt, Human
ggccucaggguccaaagacaa

SEQ ID NO: 958329 - RNA, 24 nt, Human
ggcuggagagaagggccucagguc

SEQ ID NO: 958330 - RNA, 22 nt, Human
ggcuggggugaguugggaggcc

SEQ ID NO: 958331 - RNA, 21 nt, Human
gggaaccccugacuuuaugcc

SEQ ID NO: 958332 - RNA, 19 nt, Human
gggaaugccugggagcuug

SEQ ID NO: 958333 - RNA, 19 nt, Human
gggacagguauuccuuacc

SEQ ID NO: 958334 - RNA, 19 nt, Human
gggagugcagaggccaggu

SEQ ID NO: 958335 - RNA, 21 nt, Human
gggcagcacagcgucuugcuc

SEQ ID NO: 958336 - RNA, 21 nt, Human
gggcugggauggcgucaaagg

SEQ ID NO: 958337 - RNA, 21 nt, Human
ggggaaugccugggagcuugg

SEQ ID NO: 958338 - RNA, 20 nt, Human
ggggacagguauuccuuacc

SEQ ID NO: 958339 - RNA, 20 nt, Human
ggggcccacagggcaggguc

SEQ ID NO: 958340 - RNA, 23 nt, Human
ggggcugggauggcgucaaaggg

SEQ ID NO: 958341 - RNA, 18 nt, Human
ggggugggaccacaaggg

SEQ ID NO: 958342 - RNA, 20 nt, Human
ggguggguaugaggaugagg

SEQ ID NO: 958343 - RNA, 21 nt, Human
gguggagaauggucaaggcug

SEQ ID NO: 958344 - RNA, 18 nt, Human
gugagaugggaggacugu

SEQ ID NO: 958345 - RNA, 20 nt, Human
guggagaauggucaaggcug

SEQ ID NO: 958346 - RNA, 19 nt, Human
gugggggcgugggcucugu

SEQ ID NO: 958347 - RNA, 20 nt, Human
gugggggcgugggcucugua

SEQ ID NO: 958348 - RNA, 19 nt, Human
guugggaggccacccccuc

SEQ ID NO: 958349 - RNA, 20 nt, Human
uaaccaagggcagagccuca

SEQ ID NO: 958350 - RNA, 19 nt, Human
uagaacccagcccauaaga

SEQ ID NO: 958351 - RNA, 19 nt, Human
uagcaccuggguagaaccc

SEQ ID NO: 958352 - RNA, 21 nt, Human
uaguaaaauacaaaauggcac

SEQ ID NO: 958353 - RNA, 23 nt, Human
uaguaaaauacaaaauggcacag

SEQ ID NO: 958354 - RNA, 23 nt, Human
ucaacucacucccuugcaggccc

SEQ ID NO: 958355 - RNA, 20 nt, Human
ucacagggugucccaccccu

SEQ ID NO: 958356 - RNA, 22 nt, Human
ucaggccaggcccuuggguggg

SEQ ID NO: 958357 - RNA, 24 nt, Human
ucccacccucucugagcugccaga

SEQ ID NO: 958358 - RNA, 18 nt, Human
ucccaccuccccccucca

SEQ ID NO: 958359 - RNA, 19 nt, Human
ucccaccuccccccuccaa

SEQ ID NO: 958360 - RNA, 26 nt, Human
ucccaccuccccccuccaaucauccc

SEQ ID NO: 958361 - RNA, 25 nt, Human
ucccaggcagcugucugaaucaaac

SEQ ID NO: 958362 - RNA, 20 nt, Human
ucccucuuuccuuucacaga

SEQ ID NO: 958363 - RNA, 18 nt, Human
uccuggagccuuuccugg

SEQ ID NO: 958364 - RNA, 18 nt, Human
uccuggggaaugccuggg

SEQ ID NO: 958365 - RNA, 19 nt, Human
uccuuaccucccucuuucc

SEQ ID NO: 958366 - RNA, 21 nt, Human
ucuauggaccagagcuggguu

SEQ ID NO: 958367 - RNA, 20 nt, Human
ucucugagcugccagagucg

SEQ ID NO: 958368 - RNA, 24 nt, Human
ucucugagcugccagagucgacuu

SEQ ID NO: 958369 - RNA, 22 nt, Human
ucugagcugccagagugacccc

SEQ ID NO: 958370 - RNA, 20 nt, Human
ugagaugggaggacuguagu

SEQ ID NO: 958371 - RNA, 22 nt, Human
ugagaugggaggacuguaguac

SEQ ID NO: 958372 - RNA, 22 nt, Human
ugaggcugcauccaggggcugg

SEQ ID NO: 958373 - RNA, 21 nt, Human
ugaugggaggcagagcccggg

SEQ ID NO: 958374 - RNA, 21 nt, Human
ugcagggagugggcagagggc

SEQ ID NO: 958375 - RNA, 25 nt, Human
ugcagggagugggcagagggccugg

SEQ ID NO: 958376 - RNA, 19 nt, Human
ugccuaaccaagggcagag

SEQ ID NO: 958377 - RNA, 19 nt, Human
ugccugggagcuuggagcu

SEQ ID NO: 958378 - RNA, 19 nt, Human
ugcucgagccuucagcagc

SEQ ID NO: 958379 - RNA, 23 nt, Human
ugcuuggagaaacuaacaaaguc

SEQ ID NO: 958380 - RNA, 19 nt, Human
uggaggaucccaccucccc

SEQ ID NO: 958381 - RNA, 20 nt, Human
uggcagguggagaaugguca

SEQ ID NO: 958382 - RNA, 25 nt, Human
uggccuccuggggaaugccugggag

SEQ ID NO: 958383 - RNA, 25 nt, Human
ugggaggccacccccucugucccug

SEQ ID NO: 958384 - RNA, 19 nt, Human
ugggauggcgucaaaggga

SEQ ID NO: 958385 - RNA, 18 nt, Human
uggggaaugccugggagc

SEQ ID NO: 958386 - RNA, 19 nt, Human
ugggggcccacagggcagg

SEQ ID NO: 958387 - RNA, 20 nt, Human
uggggugaguugggaggcca

SEQ ID NO: 958388 - RNA, 21 nt, Human
uggggugggaccacaaggguc

SEQ ID NO: 958389 - RNA, 19 nt, Human
ugucccagcccccuucccg

SEQ ID NO: 958390 - RNA, 19 nt, Human
ugucccagcccccuucccg

SEQ ID NO: 958391 - RNA, 20 nt, Human
ugucucagugacuaagccug

SEQ ID NO: 958392 - RNA, 21 nt, Human
uguggggugggaccacaaggg

SEQ ID NO: 958393 - RNA, 24 nt, Human
ugugucuggagcccucccucccuc

SEQ ID NO: 958394 - RNA, 22 nt, Human
uguguggggugggaccacaagg

SEQ ID NO: 958395 - RNA, 23 nt, Human
uucagacucagcacaguguagac

SEQ ID NO: 958396 - RNA, 18 nt, Human
uucccaugucccagcccc

SEQ ID NO: 958397 - RNA, 24 nt, Human
uuggggcugggauggcgucaaagg

SEQ ID NO: 958398 - RNA, 23 nt, Human
agguggaggguggcagaggcugg

SEQ ID NO: 958399 - RNA, 18 nt, Human
gagaaagaggagacagag

SEQ ID NO: 958400 - RNA, 19 nt, Human
gaggagguggaggguggca

SEQ ID NO: 958401 - RNA, 22 nt, Human
ggagguggaggguggcagaggc

SEQ ID NO: 958402 - RNA, 23 nt, Human
ggggcuggggcugaccgaggagg

SEQ ID NO: 958403 - RNA, 23 nt, Human
uggggcugaccgaggagguggag

SEQ ID NO: 958404 - RNA, 22 nt, Human
uggggcuggggcugaccgagga

SEQ ID NO: 958405 - RNA, 20 nt, Human
aaaaaaaaaaaaaacaaaaa

SEQ ID NO: 958406 - RNA, 30 nt, Human
aaaaaaaaaacaaaaacaaaaacaaaaccu

SEQ ID NO: 958407 - RNA, 30 nt, Human
aaaaaaacaaaaacaaaaacaaaaccaggg

SEQ ID NO: 958408 - RNA, 24 nt, Human
aaaacaaaaacaaaaacaaaacca

SEQ ID NO: 958409 - RNA, 19 nt, Human
aaaagaucugugaccccac

SEQ ID NO: 958410 - RNA, 22 nt, Human
aaaagaucugugaccccacauu

SEQ ID NO: 958411 - RNA, 27 nt, Human
aaacaaaaaaaaaaaaaacaaaaacaa

SEQ ID NO: 958412 - RNA, 22 nt, Human
aaacaaaaacaaaaacaaaacc

SEQ ID NO: 958413 - RNA, 19 nt, Human
aaacaaaaacaaaaccagu

SEQ ID NO: 958414 - RNA, 22 nt, Human
aaagccccucagaacacuccau

SEQ ID NO: 958415 - RNA, 21 nt, Human
aaaggacuuggcuaaggaggg

SEQ ID NO: 958416 - RNA, 18 nt, Human
aaaggcaccccuaccaca

SEQ ID NO: 958417 - RNA, 18 nt, Human
aaagguggucaguugcug

SEQ ID NO: 958418 - RNA, 24 nt, Human
aaccacaugcccccucccugcccu

SEQ ID NO: 958419 - RNA, 20 nt, Human
aacccccucucuuuacccaa

SEQ ID NO: 958420 - RNA, 19 nt, Human
aaccugccuuccugacuug

SEQ ID NO: 958421 - RNA, 19 nt, Human
aagaaauccagagaacaca

SEQ ID NO: 958422 - RNA, 21 nt, Human
aagaccccccaacaaccuggg

SEQ ID NO: 958423 - RNA, 20 nt, Human
aagaggccuggggaggcaag

SEQ ID NO: 958424 - RNA, 18 nt, Human
aagcacacccuccccaaa

SEQ ID NO: 958425 - RNA, 21 nt, Human
aagcaggaaggggacacaggg

SEQ ID NO: 958426 - RNA, 22 nt, Human
aagccaggcccaccugcaugca

SEQ ID NO: 958427 - RNA, 20 nt, Human
aagccccccgugggcuucuc

SEQ ID NO: 958428 - RNA, 18 nt, Human
aagccgggacagugaagg

SEQ ID NO: 958429 - RNA, 22 nt, Human
aaggacacagagaagagaagcc

SEQ ID NO: 958430 - RNA, 25 nt, Human
aaggacucacaggagggagggacaa

SEQ ID NO: 958431 - RNA, 22 nt, Human
aaggcuggguccaccuggcuuc

SEQ ID NO: 958432 - RNA, 24 nt, Human
aaggucugcagagaaagccacaua

SEQ ID NO: 958433 - RNA, 18 nt, Human
aagguuuuggccaugaac

SEQ ID NO: 958434 - RNA, 26 nt, Human
aaguguuaaaaaacaaacaaacaaac

SEQ ID NO: 958435 - RNA, 24 nt, Human
aaugcccuaaaagggcuguggccc

SEQ ID NO: 958436 - RNA, 18 nt, Human
acacagagaagagaagcc

SEQ ID NO: 958437 - RNA, 19 nt, Human
acaccgcuaccccucaucc

SEQ ID NO: 958438 - RNA, 18 nt, Human
acagagaagagaagccag

SEQ ID NO: 958439 - RNA, 18 nt, Human
acaugagguccugaagcc

SEQ ID NO: 958440 - RNA, 25 nt, Human
accccagagagaccaggacaaaaca

SEQ ID NO: 958441 - RNA, 19 nt, Human
accccagcuuccuauccca

SEQ ID NO: 958442 - RNA, 21 nt, Human
accccaugaggcagagggucu

SEQ ID NO: 958443 - RNA, 21 nt, Human
acccccucucuuuacccaauu

SEQ ID NO: 958444 - RNA, 21 nt, Human
accccgaguagaggucaucca

SEQ ID NO: 958445 - RNA, 20 nt, Human
accccucccccacuaucacc

SEQ ID NO: 958446 - RNA, 24 nt, Human
accccucccccacuaucaccuggu

SEQ ID NO: 958447 - RNA, 18 nt, Human
acccuaagcccugcccag

SEQ ID NO: 958448 - RNA, 18 nt, Human
acccuaagcccugcccag

SEQ ID NO: 958449 - RNA, 19 nt, Human
acccuaagcccugcccagc

SEQ ID NO: 958450 - RNA, 22 nt, Human
accgcuaccccucauccugcag

SEQ ID NO: 958451 - RNA, 21 nt, Human
accuggggccaaauuuccuuc

SEQ ID NO: 958452 - RNA, 18 nt, Human
accugggggaugcugggg

SEQ ID NO: 958453 - RNA, 24 nt, Human
acuugcuggggcuugcaggggaac

SEQ ID NO: 958454 - RNA, 18 nt, Human
agaagagaagccagugcc

SEQ ID NO: 958455 - RNA, 18 nt, Human
agacagcagcaccccagg

SEQ ID NO: 958456 - RNA, 23 nt, Human
agacagcagcaccccagggagca

SEQ ID NO: 958457 - RNA, 25 nt, Human
agaccagaggcgagggcugugggga

SEQ ID NO: 958458 - RNA, 26 nt, Human
agagaagccagugccuggagcccaag

SEQ ID NO: 958459 - RNA, 19 nt, Human
agagucagcccccuagcuc

SEQ ID NO: 958460 - RNA, 20 nt, Human
agaugccagcccgugcccuc

SEQ ID NO: 958461 - RNA, 25 nt, Human
agcaagaagaacuugccugacccag

SEQ ID NO: 958462 - RNA, 21 nt, Human
agccacagccagcuccugggc

SEQ ID NO: 958463 - RNA, 18 nt, Human
agccagaauuguuuggcc

SEQ ID NO: 958464 - RNA, 25 nt, Human
agccagcuccugggcucggaaccag

SEQ ID NO: 958465 - RNA, 25 nt, Human
agccauggccccugaagcugcagcc

SEQ ID NO: 958466 - RNA, 21 nt, Human
agcccaagccccaaaucagaa

SEQ ID NO: 958467 - RNA, 19 nt, Human
agcccuacuugcuagguaa

SEQ ID NO: 958468 - RNA, 18 nt, Human
agcccugguugccaccca

SEQ ID NO: 958469 - RNA, 20 nt, Human
agccuggacaucugccuugg

SEQ ID NO: 958470 - RNA, 21 nt, Human
agcuaaagguggucaguugcu

SEQ ID NO: 958471 - RNA, 19 nt, Human
agcuccugggcucggaacc

SEQ ID NO: 958472 - RNA, 22 nt, Human
aggcaagaggccuggggaggca

SEQ ID NO: 958473 - RNA, 18 nt, Human
aggcaaggcccccaucug

SEQ ID NO: 958474 - RNA, 24 nt, Human
aggcaccacuugaagcaccugccc

SEQ ID NO: 958475 - RNA, 19 nt, Human
aggcagagggcagagggug

SEQ ID NO: 958476 - RNA, 26 nt, Human
aggcagagggcagagggugcggaggg

SEQ ID NO: 958477 - RNA, 19 nt, Human
aggcagagggucugcuccc

SEQ ID NO: 958478 - RNA, 22 nt, Human
aggcagagguagggaggggggu

SEQ ID NO: 958479 - RNA, 22 nt, Human
aggcaggagggaggggagccag

SEQ ID NO: 958480 - RNA, 24 nt, Human
aggcaggagggaggggagccaggg

SEQ ID NO: 958481 - RNA, 25 nt, Human
aggcagggguagggggacaugaggg

SEQ ID NO: 958482 - RNA, 26 nt, Human
aggcagggguagggggacaugagggc

SEQ ID NO: 958483 - RNA, 23 nt, Human
aggcaggggugguacacuaaggg

SEQ ID NO: 958484 - RNA, 19 nt, Human
aggcagguucuguacagga

SEQ ID NO: 958485 - RNA, 21 nt, Human
aggcugcagggaggcacugug

SEQ ID NO: 958486 - RNA, 21 nt, Human
agggccucugggcaggugggc

SEQ ID NO: 958487 - RNA, 26 nt, Human
aggggaacacaggaguggcauucugg

SEQ ID NO: 958488 - RNA, 20 nt, Human
aggugaaaauacagggauuc

SEQ ID NO: 958489 - RNA, 21 nt, Human
agugaaggaacuugggaggaa

SEQ ID NO: 958490 - RNA, 19 nt, Human
auccucccugguuucucag

SEQ ID NO: 958491 - RNA, 27 nt, Human
caaaaaaaaaaaaaacaaaaacaaaaa

SEQ ID NO: 958492 - RNA, 31 nt, Human
caaaaaaaaaaaaaacaaaaacaaaaacaaa

SEQ ID NO: 958493 - RNA, 22 nt, Human
caaaaaggagaucucagugagc

SEQ ID NO: 958494 - RNA, 24 nt, Human
caaaacaggcuggugacaagggac

SEQ ID NO: 958495 - RNA, 30 nt, Human
caaacaaacaaacaaaaaaaaaaaaaacaa

SEQ ID NO: 958496 - RNA, 21 nt, Human
caaaccucccccucugccagc

SEQ ID NO: 958497 - RNA, 21 nt, Human
caaaucagaagccaaccccug

SEQ ID NO: 958498 - RNA, 19 nt, Human
caaccccagagagaccagg

SEQ ID NO: 958499 - RNA, 22 nt, Human
caagaggagagauucaacaacc

SEQ ID NO: 958500 - RNA, 18 nt, Human
caagcacacccuccccaa

SEQ ID NO: 958501 - RNA, 22 nt, Human
caagccccaaaucagaagccaa

SEQ ID NO: 958502 - RNA, 26 nt, Human
caagccccaaaucagaagccaacccc

SEQ ID NO: 958503 - RNA, 21 nt, Human
cacacacccuaagcccugccc

SEQ ID NO: 958504 - RNA, 20 nt, Human
cacacccuccccaaaagauc

SEQ ID NO: 958505 - RNA, 20 nt, Human
cacaccgcuaccccucaucc

SEQ ID NO: 958506 - RNA, 22 nt, Human
caccacaucccuuuggcuccaa

SEQ ID NO: 958507 - RNA, 18 nt, Human
caccccagggagcagggu

SEQ ID NO: 958508 - RNA, 26 nt, Human
cacccccaccauuggcuccagcccca

SEQ ID NO: 958509 - RNA, 19 nt, Human
caccccuaccacaagcuca

SEQ ID NO: 958510 - RNA, 19 nt, Human
cacccucucacccagcuag

SEQ ID NO: 958511 - RNA, 21 nt, Human
cacccuuucuuccaccaccag

SEQ ID NO: 958512 - RNA, 23 nt, Human
cacccuuucuuccaccaccagcc

SEQ ID NO: 958513 - RNA, 19 nt, Human
caccggaaccaagcaaggu

SEQ ID NO: 958514 - RNA, 18 nt, Human
caccugggggaugcuggg

SEQ ID NO: 958515 - RNA, 19 nt, Human
cacugcgccagcgcugggc

SEQ ID NO: 958516 - RNA, 22 nt, Human
cacuggcugggguugguggcug

SEQ ID NO: 958517 - RNA, 19 nt, Human
cacugugggugccaaguca

SEQ ID NO: 958518 - RNA, 20 nt, Human
cagaccccaaaggcaccccu

SEQ ID NO: 958519 - RNA, 23 nt, Human
cagagagaccaggacaaaacagg

SEQ ID NO: 958520 - RNA, 20 nt, Human
cagagcaagaagaacuugcc

SEQ ID NO: 958521 - RNA, 19 nt, Human
cagaggcagaggcggaggg

SEQ ID NO: 958522 - RNA, 20 nt, Human
cagaggcggaggguaaaagg

SEQ ID NO: 958523 - RNA, 18 nt, Human
cagagguagggagggggg

SEQ ID NO: 958524 - RNA, 24 nt, Human
cagauaucaggggccccccaugcc

SEQ ID NO: 958525 - RNA, 22 nt, Human
cagauggcaacucccagggccc

SEQ ID NO: 958526 - RNA, 19 nt, Human
cagcaaaugccaaagcccc

SEQ ID NO: 958527 - RNA, 22 nt, Human
cagcagcaccccagggagcagg

SEQ ID NO: 958528 - RNA, 26 nt, Human
cagccaaucgcaacucacaccacauc

SEQ ID NO: 958529 - RNA, 24 nt, Human
cagccagcuccugggcucggaacc

SEQ ID NO: 958530 - RNA, 20 nt, Human
cagccccuggaaccuccccc

SEQ ID NO: 958531 - RNA, 19 nt, Human
caggcaccacuugaagcac

SEQ ID NO: 958532 - RNA, 19 nt, Human
caggcagagggcagagggu

SEQ ID NO: 958533 - RNA, 19 nt, Human
caggggaacugcuugagca

SEQ ID NO: 958534 - RNA, 23 nt, Human
cagggucugggcucuccaggucc

SEQ ID NO: 958535 - RNA, 25 nt, Human
caucuggccuccuggccuccuggag

SEQ ID NO: 958536 - RNA, 21 nt, Human
caucuugaaaagggcccugaa

SEQ ID NO: 958537 - RNA, 23 nt, Human
cauucugggcccugagguccucc

SEQ ID NO: 958538 - RNA, 21 nt, Human
cauuggcuccagccccacuga

SEQ ID NO: 958539 - RNA, 21 nt, Human
cauuggcuccagccccacuga

SEQ ID NO: 958540 - RNA, 21 nt, Human
ccaaaccucccccucugccag

SEQ ID NO: 958541 - RNA, 24 nt, Human
ccaacccccucucuuuacccaauu

SEQ ID NO: 958542 - RNA, 20 nt, Human
ccaagacagcagcaccccag

SEQ ID NO: 958543 - RNA, 20 nt, Human
ccaagaccccccaacaaccu

SEQ ID NO: 958544 - RNA, 19 nt, Human
ccacagccagcuccugggc

SEQ ID NO: 958545 - RNA, 22 nt, Human
ccacccccaccauuggcuccag

SEQ ID NO: 958546 - RNA, 19 nt, Human
ccaggcaggagggagggga

SEQ ID NO: 958547 - RNA, 18 nt, Human
ccaggcccaccugcaugc

SEQ ID NO: 958548 - RNA, 21 nt, Human
cccaaaggcaccccuaccaca

SEQ ID NO: 958549 - RNA, 23 nt, Human
cccaagccccaaaucagaagcca

SEQ ID NO: 958550 - RNA, 21 nt, Human
cccacaugccuccagcgauca

SEQ ID NO: 958551 - RNA, 18 nt, Human
cccagaaggauguucugc

SEQ ID NO: 958552 - RNA, 23 nt, Human
cccagcuagagagaggcccuggg

SEQ ID NO: 958553 - RNA, 21 nt, Human
cccagucucagcugccuucuu

SEQ ID NO: 958554 - RNA, 19 nt, Human
ccccagaaggauguucugc

SEQ ID NO: 958555 - RNA, 18 nt, Human
ccccagaggcucucaagc

SEQ ID NO: 958556 - RNA, 24 nt, Human
ccccagcuuccuaucccaaaccuu

SEQ ID NO: 958557 - RNA, 23 nt, Human
cccccaacaaccuggggccaaau

SEQ ID NO: 958558 - RNA, 19 nt, Human
ccccccaacaaccuggggc

SEQ ID NO: 958559 - RNA, 22 nt, Human
ccccccaugcccacucuuccaa

SEQ ID NO: 958560 - RNA, 22 nt, Human
cccccugccaagcacacccucc

SEQ ID NO: 958561 - RNA, 22 nt, Human
ccccggucaggccggccagggc

SEQ ID NO: 958562 - RNA, 23 nt, Human
ccccuaccacaagcucaaggcag

SEQ ID NO: 958563 - RNA, 23 nt, Human
ccccuccucaccaguggcugccc

SEQ ID NO: 958564 - RNA, 20 nt, Human
ccccuggaaccucccccuca

SEQ ID NO: 958565 - RNA, 22 nt, Human
ccccuggaaccucccccucacu

SEQ ID NO: 958566 - RNA, 19 nt, Human
ccccuggccucuucucuca

SEQ ID NO: 958567 - RNA, 21 nt, Human
ccccuggccucuucucucaaa

SEQ ID NO: 958568 - RNA, 21 nt, Human
cccgagauucugcuagacccu

SEQ ID NO: 958569 - RNA, 24 nt, Human
cccgcaguggggcaggccgggguc

SEQ ID NO: 958570 - RNA, 24 nt, Human
cccguaccaucuccucagaugcca

SEQ ID NO: 958571 - RNA, 20 nt, Human
cccuaagcccugcccagccc

SEQ ID NO: 958572 - RNA, 21 nt, Human
cccuaagcccugcccagcccu

SEQ ID NO: 958573 - RNA, 18 nt, Human
cccucaaacccugaccuc

SEQ ID NO: 958574 - RNA, 19 nt, Human
cccucagaacacuccauca

SEQ ID NO: 958575 - RNA, 21 nt, Human
cccuggaaccucccccucacu

SEQ ID NO: 958576 - RNA, 24 nt, Human
cccugguuucucagccucggccug

SEQ ID NO: 958577 - RNA, 18 nt, Human
cccuguguccaggggccc

SEQ ID NO: 958578 - RNA, 18 nt, Human
cccuuuucuccucuaucc

SEQ ID NO: 958579 - RNA, 18 nt, Human
ccuaaccccaccauuggc

SEQ ID NO: 958580 - RNA, 25 nt, Human
ccuaccacaagcucaaggcaggggu

SEQ ID NO: 958581 - RNA, 19 nt, Human
ccucacugggcccagucuc

SEQ ID NO: 958582 - RNA, 18 nt, Human
ccucaggaggauaaagcc

SEQ ID NO: 958583 - RNA, 22 nt, Human
ccuccagguccacgggucucuc

SEQ ID NO: 958584 - RNA, 18 nt, Human
ccucuuauaaaugggcac

SEQ ID NO: 958585 - RNA, 24 nt, Human
ccugaaauaaaaccugccuuccug

SEQ ID NO: 958586 - RNA, 25 nt, Human
ccugaagccccagacugguggcagg

SEQ ID NO: 958587 - RNA, 19 nt, Human
ccugaccucggggccugag

SEQ ID NO: 958588 - RNA, 21 nt, Human
ccugagggaucugcaggggcu

SEQ ID NO: 958589 - RNA, 20 nt, Human
ccugcacccacauugcaccu

SEQ ID NO: 958590 - RNA, 19 nt, Human
ccugcaugcaaugcccuaa

SEQ ID NO: 958591 - RNA, 22 nt, Human
ccugcaugcaaugcccuaaaag

SEQ ID NO: 958592 - RNA, 22 nt, Human
ccugccaagcacacccucccca

SEQ ID NO: 958593 - RNA, 19 nt, Human
ccugccggggccaccccca

SEQ ID NO: 958594 - RNA, 21 nt, Human
ccuggcuuccucacaagccuc

SEQ ID NO: 958595 - RNA, 21 nt, Human
ccugggagacccaagaccccc

SEQ ID NO: 958596 - RNA, 22 nt, Human
ccugggccuuccguccugggag

SEQ ID NO: 958597 - RNA, 21 nt, Human
ccugguuucucagccucggcc

SEQ ID NO: 958598 - RNA, 25 nt, Human
ccugugaaggaggguuuugggacug

SEQ ID NO: 958599 - RNA, 24 nt, Human
ccuucuuguucuggggauccagag

SEQ ID NO: 958600 - RNA, 18 nt, Human
ccuugggagagagggcag

SEQ ID NO: 958601 - RNA, 19 nt, Human
ccuuguggucuguggcccc

SEQ ID NO: 958602 - RNA, 23 nt, Human
cgaguagaggucauccaguucau

SEQ ID NO: 958603 - RNA, 21 nt, Human
cgcggugcccuucucucccga

SEQ ID NO: 958604 - RNA, 18 nt, Human
cuacacaccgcuaccccu

SEQ ID NO: 958605 - RNA, 27 nt, Human
cucacugggcccagucucagcugccuu

SEQ ID NO: 958606 - RNA, 22 nt, Human
cucagccucggccugcccaggc

SEQ ID NO: 958607 - RNA, 23 nt, Human
cucagugagcacugugggugcca

SEQ ID NO: 958608 - RNA, 21 nt, Human
cucaucccucaaacccugacc

SEQ ID NO: 958609 - RNA, 22 nt, Human
cucccaacccccucucuuuacc

SEQ ID NO: 958610 - RNA, 26 nt, Human
cucccaacccccucucuuuacccaau

SEQ ID NO: 958611 - RNA, 23 nt, Human
cuccccaaaagaucugugacccc

SEQ ID NO: 958612 - RNA, 24 nt, Human
cucccgagauucugcuagacccag

SEQ ID NO: 958613 - RNA, 19 nt, Human
cuccucugugccagacccc

SEQ ID NO: 958614 - RNA, 25 nt, Human
cucucugccaagucaaaaauucugg

SEQ ID NO: 958615 - RNA, 22 nt, Human
cucugugccagaccccagcuuc

SEQ ID NO: 958616 - RNA, 19 nt, Human
cucuuuuuuccacugucuu

SEQ ID NO: 958617 - RNA, 19 nt, Human
cugaagccccagacuggug

SEQ ID NO: 958618 - RNA, 22 nt, Human
cugacaugagguccugaagccc

SEQ ID NO: 958619 - RNA, 23 nt, Human
cugacccaggcagugaaugcccc

SEQ ID NO: 958620 - RNA, 18 nt, Human
cugacgcaaagccgggac

SEQ ID NO: 958621 - RNA, 24 nt, Human
cugagaagaagucguauuucucac

SEQ ID NO: 958622 - RNA, 21 nt, Human
cugccggggccacccccacca

SEQ ID NO: 958623 - RNA, 19 nt, Human
cugcuagacccagcugacc

SEQ ID NO: 958624 - RNA, 20 nt, Human
cugcucccuguguccagggg

SEQ ID NO: 958625 - RNA, 19 nt, Human
cugggcccugagguccucc

SEQ ID NO: 958626 - RNA, 22 nt, Human
cugggcccugagguccucccag

SEQ ID NO: 958627 - RNA, 24 nt, Human
cugggcccugugaaggaggguuuu

SEQ ID NO: 958628 - RNA, 19 nt, Human
cugggggccgccucucccg

SEQ ID NO: 958629 - RNA, 21 nt, Human
cuguaaaucuguacaguuugc

SEQ ID NO: 958630 - RNA, 19 nt, Human
cugugaaggaggguuuugg

SEQ ID NO: 958631 - RNA, 22 nt, Human
cuuccagcaaaugccaaagccc

SEQ ID NO: 958632 - RNA, 24 nt, Human
cuuccuaucccaaacccuccuaga

SEQ ID NO: 958633 - RNA, 26 nt, Human
cuuccuaucccaaacccuccuagagg

SEQ ID NO: 958634 - RNA, 22 nt, Human
cuugcaggggaacacaggagug

SEQ ID NO: 958635 - RNA, 21 nt, Human
cuugcuggggcuugcagggga

SEQ ID NO: 958636 - RNA, 20 nt, Human
gaaaagaagcccuugaggca

SEQ ID NO: 958637 - RNA, 20 nt, Human
gaaaagacaggcugugggag

SEQ ID NO: 958638 - RNA, 22 nt, Human
gaagcagguaggggugaagcca

SEQ ID NO: 958639 - RNA, 24 nt, Human
gaagcagguaggggugaagccagg

SEQ ID NO: 958640 - RNA, 24 nt, Human
gaagcucccucucauuuggaacuc

SEQ ID NO: 958641 - RNA, 24 nt, Human
gacagcagcaccccagggagcagg

SEQ ID NO: 958642 - RNA, 25 nt, Human
gaccaggacaaaacaggcuggugac

SEQ ID NO: 958643 - RNA, 19 nt, Human
gaccaugacuagugacuug

SEQ ID NO: 958644 - RNA, 25 nt, Human
gaccccaaaggcaccccuaccacaa

SEQ ID NO: 958645 - RNA, 21 nt, Human
gaccuggcuccccuuccccaa

SEQ ID NO: 958646 - RNA, 19 nt, Human
gacgcaaagccgggacagu

SEQ ID NO: 958647 - RNA, 21 nt, Human
gacugguggcagggaugaggg

SEQ ID NO: 958648 - RNA, 18 nt, Human
gagaacacaggaggcagc

SEQ ID NO: 958649 - RNA, 18 nt, Human
gagagagggcagagaaga

SEQ ID NO: 958650 - RNA, 24 nt, Human
gagcccaagccccaaaucccgagg

SEQ ID NO: 958651 - RNA, 18 nt, Human
gagcccccaggcucccag

SEQ ID NO: 958652 - RNA, 19 nt, Human
gaggaggccacacugucac

SEQ ID NO: 958653 - RNA, 19 nt, Human
gaggcaggggaacugcuug

SEQ ID NO: 958654 - RNA, 22 nt, Human
gaggccugacaggcggcuuugc

SEQ ID NO: 958655 - RNA, 20 nt, Human
gagggagaagccacagccag

SEQ ID NO: 958656 - RNA, 20 nt, Human
gauccaugaacaaggccccu

SEQ ID NO: 958657 - RNA, 18 nt, Human
gaugagagaaaggaggaa

SEQ ID NO: 958658 - RNA, 20 nt, Human
gccacagcuuauugcaccug

SEQ ID NO: 958659 - RNA, 21 nt, Human
gcccacacacccuaagcccug

SEQ ID NO: 958660 - RNA, 19 nt, Human
gcccugggauacgagcaag

SEQ ID NO: 958661 - RNA, 21 nt, Human
gccuacacaccgcuaccccuc

SEQ ID NO: 958662 - RNA, 22 nt, Human
gccugagggaucugcaggggcu

SEQ ID NO: 958663 - RNA, 18 nt, Human
gccugccucgugcucugg

SEQ ID NO: 958664 - RNA, 19 nt, Human
gccugccuguuucccucca

SEQ ID NO: 958665 - RNA, 21 nt, Human
gccuuguggucuguggcccca

SEQ ID NO: 958666 - RNA, 19 nt, Human
gcggaggguaaaagggaaa

SEQ ID NO: 958667 - RNA, 18 nt, Human
gcggcuuugccaacccca

SEQ ID NO: 958668 - RNA, 21 nt, Human
gcggugcccuucucucccgag

SEQ ID NO: 958669 - RNA, 20 nt, Human
gcucaggcucaucucaagcc

SEQ ID NO: 958670 - RNA, 21 nt, Human
gcucccucucauuuggaacuc

SEQ ID NO: 958671 - RNA, 23 nt, Human
gcugcaaaacuugcuggggcuug

SEQ ID NO: 958672 - RNA, 22 nt, Human
gcugggguugguggcugcaugg

SEQ ID NO: 958673 - RNA, 23 nt, Human
ggaagaugcagaaagaaaugaag

SEQ ID NO: 958674 - RNA, 20 nt, Human
ggaagcagguaggggugaag

SEQ ID NO: 958675 - RNA, 24 nt, Human
ggacacccucucacccagcuagag

SEQ ID NO: 958676 - RNA, 24 nt, Human
ggacagugaaggaacuugggagga

SEQ ID NO: 958677 - RNA, 24 nt, Human
ggacaucagagcagccccuccuca

SEQ ID NO: 958678 - RNA, 18 nt, Human
ggagacuuguguccuggg

SEQ ID NO: 958679 - RNA, 25 nt, Human
ggagcccagccuggaaaagacaggc

SEQ ID NO: 958680 - RNA, 26 nt, Human
ggaggaaaugagacggggaguagggg

SEQ ID NO: 958681 - RNA, 21 nt, Human
ggaguaggggaugggggaggg

SEQ ID NO: 958682 - RNA, 22 nt, Human
ggaguaggggaugggggaggga

SEQ ID NO: 958683 - RNA, 18 nt, Human
ggaugggggagggagaag

SEQ ID NO: 958684 - RNA, 20 nt, Human
ggaugugaggagccaggccu

SEQ ID NO: 958685 - RNA, 23 nt, Human
ggcaccacuugaagcaccugccc

SEQ ID NO: 958686 - RNA, 24 nt, Human
ggcagagaagaacuggggccaggu

SEQ ID NO: 958687 - RNA, 21 nt, Human
ggcagugaaugcccccugccu

SEQ ID NO: 958688 - RNA, 19 nt, Human
ggccuggggaggcaagucc

SEQ ID NO: 958689 - RNA, 18 nt, Human
ggcugcagggaggcacug

SEQ ID NO: 958690 - RNA, 24 nt, Human
ggcuguggggagccagcucugugg

SEQ ID NO: 958691 - RNA, 18 nt, Human
gggaacacaggaguggcc

SEQ ID NO: 958692 - RNA, 21 nt, Human
gggacagugaaggaacuuggg

SEQ ID NO: 958693 - RNA, 23 nt, Human
gggagauaaaggagcccaaccac

SEQ ID NO: 958694 - RNA, 19 nt, Human
gggaugggggagggagaag

SEQ ID NO: 958695 - RNA, 21 nt, Human
gggccaaauuuccuuccucag

SEQ ID NO: 958696 - RNA, 18 nt, Human
gggcccugagguccuccc

SEQ ID NO: 958697 - RNA, 27 nt, Human
gggcucggaaccaggcaggagggaggg

SEQ ID NO: 958698 - RNA, 22 nt, Human
gggcugggggcccaagcccuuu

SEQ ID NO: 958699 - RNA, 18 nt, Human
ggggaggaagcagguagg

SEQ ID NO: 958700 - RNA, 20 nt, Human
ggggcagggaaggccugggg

SEQ ID NO: 958701 - RNA, 21 nt, Human
ggggcccagcaucuucugggg

SEQ ID NO: 958702 - RNA, 22 nt, Human
ggggcccagcaucuucuggggc

SEQ ID NO: 958703 - RNA, 22 nt, Human
gggugccaagucagggcucagg

SEQ ID NO: 958704 - RNA, 20 nt, Human
gguagggaggcugagccuug

SEQ ID NO: 958705 - RNA, 20 nt, Human
gguagggggacaugagggcc

SEQ ID NO: 958706 - RNA, 18 nt, Human
gguuccaggcccaguccc

SEQ ID NO: 958707 - RNA, 18 nt, Human
gucagacuccucauccuc

SEQ ID NO: 958708 - RNA, 24 nt, Human
gucuggccccaaaccucccccucu

SEQ ID NO: 958709 - RNA, 18 nt, Human
gugaggcuggcagccugg

SEQ ID NO: 958710 - RNA, 20 nt, Human
gugggcaccauggcauggga

SEQ ID NO: 958711 - RNA, 18 nt, Human
gugggguucgcggugccc

SEQ ID NO: 958712 - RNA, 22 nt, Human
guugggagaagaaauccagaga

SEQ ID NO: 958713 - RNA, 24 nt, Human
uaaaaaacaaacaaacaaacaaaa

SEQ ID NO: 958714 - RNA, 18 nt, Human
uaaacggguuuuacaaag

SEQ ID NO: 958715 - RNA, 22 nt, Human
uaaccccucccccacuaucacc

SEQ ID NO: 958716 - RNA, 22 nt, Human
uaaggacacagagaagagaagc

SEQ ID NO: 958717 - RNA, 24 nt, Human
uaaggacacagagaagagaagcca

SEQ ID NO: 958718 - RNA, 25 nt, Human
uacacuaagggcuucccccagaggc

SEQ ID NO: 958719 - RNA, 20 nt, Human
uacagcccgagcccgacccc

SEQ ID NO: 958720 - RNA, 18 nt, Human
uacaggcaagaggccugg

SEQ ID NO: 958721 - RNA, 20 nt, Human
uacaggggagagaaggggca

SEQ ID NO: 958722 - RNA, 27 nt, Human
uacaggggagagaaggggcagggaagg

SEQ ID NO: 958723 - RNA, 24 nt, Human
uacaugcauuugccacgcugaggc

SEQ ID NO: 958724 - RNA, 19 nt, Human
uagaggcacugagaagaag

SEQ ID NO: 958725 - RNA, 24 nt, Human
uagcucaaagcaggaaggggacac

SEQ ID NO: 958726 - RNA, 22 nt, Human
uaucccaaacccuccuagaggc

SEQ ID NO: 958727 - RNA, 24 nt, Human
uaugguuuugucauugcaugcuuu

SEQ ID NO: 958728 - RNA, 19 nt, Human
ucagaugccagcccgugcc

SEQ ID NO: 958729 - RNA, 24 nt, Human
ucagauggcaacucccagggccca

SEQ ID NO: 958730 - RNA, 21 nt, Human
ucaggacagguaugguuaaua

SEQ ID NO: 958731 - RNA, 24 nt, Human
uccaagaggcccccugccaagcac

SEQ ID NO: 958732 - RNA, 27 nt, Human
uccaaggcuggguccaccuggcuuccc

SEQ ID NO: 958733 - RNA, 18 nt, Human
uccacaggugaaaauaca

SEQ ID NO: 958734 - RNA, 23 nt, Human
uccacaggugaaaauacagggau

SEQ ID NO: 958735 - RNA, 23 nt, Human
uccacgggucucucgaaguucuc

SEQ ID NO: 958736 - RNA, 18 nt, Human
uccagcaaaugccaaagc

SEQ ID NO: 958737 - RNA, 21 nt, Human
uccaggcagcagcaacugagg

SEQ ID NO: 958738 - RNA, 18 nt, Human
ucccaacccccucucuuu

SEQ ID NO: 958739 - RNA, 19 nt, Human
ucccaggcaccacuugaag

SEQ ID NO: 958740 - RNA, 23 nt, Human
uccccagagcccuccagguccac

SEQ ID NO: 958741 - RNA, 18 nt, Human
ucccccagaggcagaggc

SEQ ID NO: 958742 - RNA, 25 nt, Human
ucccccagaggcagaggcggagggu

SEQ ID NO: 958743 - RNA, 24 nt, Human
ucccccucacugccuacacaccgc

SEQ ID NO: 958744 - RNA, 19 nt, Human
ucccugguuucucagccuc

SEQ ID NO: 958745 - RNA, 18 nt, Human
ucccuguguccaggggcc

SEQ ID NO: 958746 - RNA, 22 nt, Human
uccugcagaaaucugcugccag

SEQ ID NO: 958747 - RNA, 18 nt, Human
uccuggagacagggucug

SEQ ID NO: 958748 - RNA, 21 nt, Human
ucggggccugagggaucugca

SEQ ID NO: 958749 - RNA, 20 nt, Human
ucguauuucucaccauccac

SEQ ID NO: 958750 - RNA, 25 nt, Human
ucguauuucucaccauccacaggug

SEQ ID NO: 958751 - RNA, 20 nt, Human
ucgugcucuggcagccaagg

SEQ ID NO: 958752 - RNA, 23 nt, Human
ucucaccauccacaggugaaaau

SEQ ID NO: 958753 - RNA, 21 nt, Human
ucuccaagacagcagcacccc

SEQ ID NO: 958754 - RNA, 24 nt, Human
ucucccaacccccucucuuuaccc

SEQ ID NO: 958755 - RNA, 19 nt, Human
ucucccgggaagccuuccu

SEQ ID NO: 958756 - RNA, 19 nt, Human
ucugcccuucuuguucugg

SEQ ID NO: 958757 - RNA, 18 nt, Human
ucuggggcugggggccca

SEQ ID NO: 958758 - RNA, 18 nt, Human
ucugugccagaccccagc

SEQ ID NO: 958759 - RNA, 18 nt, Human
ucuuccucccauccaucu

SEQ ID NO: 958760 - RNA, 20 nt, Human
ucuuguucuauccccagaag

SEQ ID NO: 958761 - RNA, 22 nt, Human
ugaaugcccccugccucacuga

SEQ ID NO: 958762 - RNA, 19 nt, Human
ugacaagggacacccucuc

SEQ ID NO: 958763 - RNA, 19 nt, Human
ugacgcaaagccgggacag

SEQ ID NO: 958764 - RNA, 20 nt, Human
ugacuagugacuugcauugc

SEQ ID NO: 958765 - RNA, 19 nt, Human
ugacuugaaucugggaugu

SEQ ID NO: 958766 - RNA, 22 nt, Human
ugagaagaagucguauuucuca

SEQ ID NO: 958767 - RNA, 20 nt, Human
ugaggcagagggucugcucc

SEQ ID NO: 958768 - RNA, 20 nt, Human
ugaggcagagggucugcucc

SEQ ID NO: 958769 - RNA, 23 nt, Human
ugaggcagagggucugcucccug

SEQ ID NO: 958770 - RNA, 20 nt, Human
ugaggccaacccgcccccuc

SEQ ID NO: 958771 - RNA, 23 nt, Human
ugaggccaacccgcccccuccag

SEQ ID NO: 958772 - RNA, 19 nt, Human
ugaggggguguccacaggg

SEQ ID NO: 958773 - RNA, 24 nt, Human
ugagguugaauccaggcagcagca

SEQ ID NO: 958774 - RNA, 18 nt, Human
ugagugccucucugcccc

SEQ ID NO: 958775 - RNA, 18 nt, Human
ugcaaaacuugcuggggc

SEQ ID NO: 958776 - RNA, 22 nt, Human
ugcagaccccguaccaucuccu

SEQ ID NO: 958777 - RNA, 19 nt, Human
ugcaguacgugucuggggg

SEQ ID NO: 958778 - RNA, 24 nt, Human
ugccaaagccccucagaacacucc

SEQ ID NO: 958779 - RNA, 22 nt, Human
ugccaagcacacccuccccaaa

SEQ ID NO: 958780 - RNA, 23 nt, Human
ugccaagcacacccuccccaaaa

SEQ ID NO: 958781 - RNA, 24 nt, Human
ugccagcccgugcccucacugggc

SEQ ID NO: 958782 - RNA, 18 nt, Human
ugccaggcaggcaccugg

SEQ ID NO: 958783 - RNA, 18 nt, Human
ugccagggcaucuugaaa

SEQ ID NO: 958784 - RNA, 27 nt, Human
ugcccuaaccccaccauuggccacagc

SEQ ID NO: 958785 - RNA, 19 nt, Human
ugcccugggccuuccgucc

SEQ ID NO: 958786 - RNA, 22 nt, Human
ugcccugugucaucacugcccu

SEQ ID NO: 958787 - RNA, 19 nt, Human
ugccugacccaggcaguga

SEQ ID NO: 958788 - RNA, 20 nt, Human
ugccuugccccggucaggcc

SEQ ID NO: 958789 - RNA, 24 nt, Human
ugccuugccccggucaggccggcc

SEQ ID NO: 958790 - RNA, 26 nt, Human
ugcuacauggcagagugggguucgcg

SEQ ID NO: 958791 - RNA, 19 nt, Human
ugcuggggcuugcagggga

SEQ ID NO: 958792 - RNA, 19 nt, Human
uggaaaagacaggcugugg

SEQ ID NO: 958793 - RNA, 21 nt, Human
uggaaaagacaggcuguggga

SEQ ID NO: 958794 - RNA, 18 nt, Human
uggaaaccagccugagug

SEQ ID NO: 958795 - RNA, 23 nt, Human
uggacagcagggugguguugagg

SEQ ID NO: 958796 - RNA, 19 nt, Human
uggcagacccccacccacc

SEQ ID NO: 958797 - RNA, 19 nt, Human
uggcagcagccccucuucc

SEQ ID NO: 958798 - RNA, 21 nt, Human
uggcaggcaagaggagagauu

SEQ ID NO: 958799 - RNA, 19 nt, Human
uggcauucugggaagaguc

SEQ ID NO: 958800 - RNA, 18 nt, Human
uggccccaaaccuccccc

SEQ ID NO: 958801 - RNA, 20 nt, Human
uggccccugaagcugcagcc

SEQ ID NO: 958802 - RNA, 20 nt, Human
uggcucgauuccacccuccc

SEQ ID NO: 958803 - RNA, 23 nt, Human
uggcucgauuccacccuccccag

SEQ ID NO: 958804 - RNA, 21 nt, Human
uggcugggguugguggcugca

SEQ ID NO: 958805 - RNA, 23 nt, Human
ugggaagagucagaccccaaagg

SEQ ID NO: 958806 - RNA, 18 nt, Human
ugggaggaaaugagacgg

SEQ ID NO: 958807 - RNA, 21 nt, Human
ugggaugugggugaggggugg

SEQ ID NO: 958808 - RNA, 19 nt, Human
ugggcccugagguccuccc

SEQ ID NO: 958809 - RNA, 21 nt, Human
uggggacuggacagcagggug

SEQ ID NO: 958810 - RNA, 22 nt, Human
uggggccaggcuggggacugga

SEQ ID NO: 958811 - RNA, 21 nt, Human
ugggggagggagaagccacag

SEQ ID NO: 958812 - RNA, 21 nt, Human
ugggggaugcuggggccaucg

SEQ ID NO: 958813 - RNA, 24 nt, Human
ugggggcccaagcccuuuucuccu

SEQ ID NO: 958814 - RNA, 22 nt, Human
uguccuggaaaccagccugagu

SEQ ID NO: 958815 - RNA, 19 nt, Human
ugugaaggaggguuuuggg

SEQ ID NO: 958816 - RNA, 22 nt, Human
ugugcucuccaagacagcagca

SEQ ID NO: 958817 - RNA, 19 nt, Human
uguguccugggaggcagag

SEQ ID NO: 958818 - RNA, 25 nt, Human
uguguguggugccagagugugggug

SEQ ID NO: 958819 - RNA, 30 nt, Human
uuaaaaaacaaacaaacaaacaaaaaaaaa

SEQ ID NO: 958820 - RNA, 18 nt, Human
uucacaaggcuggaacag

SEQ ID NO: 958821 - RNA, 23 nt, Human
uucagggagggggagcaccgagg

SEQ ID NO: 958822 - RNA, 27 nt, Human
uuccaggcccagucccaggcuugggcu

SEQ ID NO: 958823 - RNA, 23 nt, Human
uucuugggggaagaugcagaaag

SEQ ID NO: 958824 - RNA, 23 nt, Human
uugcaugcuuuugucuugugugu

SEQ ID NO: 958825 - RNA, 18 nt, Human
uuggcaggcaagaggaga

SEQ ID NO: 958826 - RNA, 23 nt, Human
uuggcccacacacccuaagcccu

SEQ ID NO: 958827 - RNA, 19 nt, Human
uugguggcugcaugguugg

SEQ ID NO: 958828 - RNA, 20 nt, Human
uuuaccaaauguuuguccug

SEQ ID NO: 958829 - RNA, 20 nt, Human
uuuauuuccucuuauaaaug

SEQ ID NO: 958830 - RNA, 18 nt, Human
uuuccgagaaaggcaagg

SEQ ID NO: 958831 - RNA, 23 nt, Human
uuugaaagaggcucaaaggacuu

SEQ ID NO: 958832 - RNA, 23 nt, Human
uuuugagagcuccuccucugugc

SEQ ID NO: 958833 - RNA, 20 nt, Human
aaaaaaaaaaaucaaaggca

SEQ ID NO: 958834 - RNA, 21 nt, Human
aaaaggaacaaguuaucagaa

SEQ ID NO: 958835 - RNA, 22 nt, Human
aaagaaaaaaaucaggauaaag

SEQ ID NO: 958836 - RNA, 22 nt, Human
aaccgcucgccgccgccgcucc

SEQ ID NO: 958837 - RNA, 18 nt, Human
acacacacacacacagaa

SEQ ID NO: 958838 - RNA, 18 nt, Human
accgcucgccgccgccgc

SEQ ID NO: 958839 - RNA, 19 nt, Human
accgcucgccgccgccgcu

SEQ ID NO: 958840 - RNA, 25 nt, Human
acuaaaaaaucucaaaaacaacuaa

SEQ ID NO: 958841 - RNA, 24 nt, Human
agaauagacauaaaccaaaaaaaa

SEQ ID NO: 958842 - RNA, 26 nt, Human
auaaucuuaagagucaaaugccaaaa

SEQ ID NO: 958843 - RNA, 24 nt, Human
auggaaugaaaccaguguucuuaa

SEQ ID NO: 958844 - RNA, 21 nt, Human
caaaugccaaaauuaaguauu

SEQ ID NO: 958845 - RNA, 22 nt, Human
cacacacacacacagaauuuaa

SEQ ID NO: 958846 - RNA, 26 nt, Human
cacacacacacagaauuuaaaaaaaa

SEQ ID NO: 958847 - RNA, 23 nt, Human
cacagaauuuaaaaaaaaaaauc

SEQ ID NO: 958848 - RNA, 19 nt, Human
caccgcccccgccucgugc

SEQ ID NO: 958849 - RNA, 23 nt, Human
caguaaguaccauuaaacuguuc

SEQ ID NO: 958850 - RNA, 18 nt, Human
ccaaagaaggaaacugga

SEQ ID NO: 958851 - RNA, 25 nt, Human
ccgcucgccgccgccgcuccgguca

SEQ ID NO: 958852 - RNA, 23 nt, Human
cuaaaaaaucucaaaaacaacua

SEQ ID NO: 958853 - RNA, 24 nt, Human
cuaaaaaaucucaaaaacaacuaa

SEQ ID NO: 958854 - RNA, 20 nt, Human
cuaagcagcuaugcuauagc

SEQ ID NO: 958855 - RNA, 23 nt, Human
cuagaugcuuaacauaguuaagg

SEQ ID NO: 958856 - RNA, 23 nt, Human
cuaucauuuuguuugcaaggagg

SEQ ID NO: 958857 - RNA, 23 nt, Human
cugggcuaguguacauuucaggu

SEQ ID NO: 958858 - RNA, 23 nt, Human
gcuuacauggaaugaaaccagug

SEQ ID NO: 958859 - RNA, 18 nt, Human
ggaaagucaguaaaucuc

SEQ ID NO: 958860 - RNA, 19 nt, Human
ggagucaaaaguuuauccu

SEQ ID NO: 958861 - RNA, 20 nt, Human
gggcuaguguacauuucagg

SEQ ID NO: 958862 - RNA, 23 nt, Human
uaaaaaaaaaaaucaaaggcaau

SEQ ID NO: 958863 - RNA, 22 nt, Human
uaaaccaaaaaaaagaaaaaaa

SEQ ID NO: 958864 - RNA, 18 nt, Human
uaagauccccagccauaa

SEQ ID NO: 958865 - RNA, 24 nt, Human
uacagaaguugccaaagaaggaaa

SEQ ID NO: 958866 - RNA, 21 nt, Human
uagaaagguccucaugcagca

SEQ ID NO: 958867 - RNA, 24 nt, Human
uauucuaggaaagucaguaaaucu

SEQ ID NO: 958868 - RNA, 19 nt, Human
ucacacaaagcuaagccug

SEQ ID NO: 958869 - RNA, 22 nt, Human
ucacgugcauaauacagaaguu

SEQ ID NO: 958870 - RNA, 18 nt, Human
ucacuggcacggacuucu

SEQ ID NO: 958871 - RNA, 20 nt, Human
uccacaaaugaacaaaaggg

SEQ ID NO: 958872 - RNA, 18 nt, Human
ugaaaccuacauacacug

SEQ ID NO: 958873 - RNA, 19 nt, Human
ugaaagaguaagaucccca

SEQ ID NO: 958874 - RNA, 24 nt, Human
ugaagguaguuaaaauuuaagaau

SEQ ID NO: 958875 - RNA, 21 nt, Human
ugacuaaaaaaucucaaaaac

SEQ ID NO: 958876 - RNA, 23 nt, Human
ugacuaaaaaaucucaaaaacaa

SEQ ID NO: 958877 - RNA, 23 nt, Human
ugcaaggaggagucaggaaaagg

SEQ ID NO: 958878 - RNA, 20 nt, Human
ugcaccgcccccgccucgug

SEQ ID NO: 958879 - RNA, 20 nt, Human
ugccaaagaaggaaacugga

SEQ ID NO: 958880 - RNA, 19 nt, Human
ugcuauagcucaguaagua

SEQ ID NO: 958881 - RNA, 22 nt, Human
uggaaugaaaccaguguucuua

SEQ ID NO: 958882 - RNA, 19 nt, Human
ugucaacuaucauuuuguu

SEQ ID NO: 958883 - RNA, 18 nt, Human
uguguugacuaaaaaauc

SEQ ID NO: 958884 - RNA, 22 nt, Human
uugaaaguucacaucuguaaaa

SEQ ID NO: 958885 - RNA, 20 nt, Human
uuuuguuugcaaggaggagu

SEQ ID NO: 958886 - RNA, 24 nt, Human
uuuuguuugcaaggaggagucagg

SEQ ID NO: 958887 - RNA, 18 nt, Human
uuuuuuuuuuuuuuuuug

SEQ ID NO: 958888 - RNA, 22 nt, Human
uuuuuuuuuuuuuuuuugacag

SEQ ID NO: 958889 - RNA, 23 nt, Human
caggagggcgggaagcccccccu

SEQ ID NO: 958890 - RNA, 19 nt, Human
cccccccugccugcccugc

SEQ ID NO: 958891 - RNA, 18 nt, Human
ccugcccugcccugcagu

SEQ ID NO: 958892 - RNA, 23 nt, Human
cugccugcccugcccugcagugg

SEQ ID NO: 958893 - RNA, 25 nt, Human
gaagcccccccugccugcccugccc

SEQ ID NO: 958894 - RNA, 23 nt, Human
gcccccccugccugcccugcccu

SEQ ID NO: 958895 - RNA, 19 nt, Human
aaagcagaagaaaauccac

SEQ ID NO: 958896 - RNA, 23 nt, Human
aagcagaagaaaauccacuccaa

SEQ ID NO: 958897 - RNA, 23 nt, Human
accucccaaauuucaagaaaaug

SEQ ID NO: 958898 - RNA, 23 nt, Human
accucucaaauuucaagaaaaug

SEQ ID NO: 958899 - RNA, 21 nt, Human
agaagaaaauccacuccaaua

SEQ ID NO: 958900 - RNA, 19 nt, Human
agcagaagaaaauccacuc

SEQ ID NO: 958901 - RNA, 25 nt, Human
aguccuuuuggugaauauagcaagg

SEQ ID NO: 958902 - RNA, 25 nt, Human
aguccuuuuggugaauauagcaagg

SEQ ID NO: 958903 - RNA, 22 nt, Human
auaguguuuccucuauauaaaa

SEQ ID NO: 958904 - RNA, 23 nt, Human
aucaagccacuucacuguucagu

SEQ ID NO: 958905 - RNA, 23 nt, Human
aucaagccacuucacuguucagu

SEQ ID NO: 958906 - RNA, 20 nt, Human
aucaaugaaagcagaagaaa

SEQ ID NO: 958907 - RNA, 22 nt, Human
cacaaauacuuuaggaaauccu

SEQ ID NO: 958908 - RNA, 25 nt, Human
cacuguucaguuucuuuacaucaug

SEQ ID NO: 958909 - RNA, 25 nt, Human
cacuguucaguuucuuuacaucaug

SEQ ID NO: 958910 - RNA, 25 nt, Human
ccaaccaagccaggugauuuccuaa

SEQ ID NO: 958911 - RNA, 25 nt, Human
cucuauauaaaacugggaaaaaaac

SEQ ID NO: 958912 - RNA, 25 nt, Human
cucuauauaaaacugggaaaaaaac

SEQ ID NO: 958913 - RNA, 18 nt, Human
ggaaauccugauacaugg

SEQ ID NO: 958914 - RNA, 20 nt, Human
uauaaaacugggaaaaaaac

SEQ ID NO: 958915 - RNA, 20 nt, Human
uauaaaacugggaaaaaaac

SEQ ID NO: 958916 - RNA, 24 nt, Human
uauaaaacugggaaaaaaacaaga

SEQ ID NO: 958917 - RNA, 24 nt, Human
uauaaaacugggaaaaaaacaaga

SEQ ID NO: 958918 - RNA, 20 nt, Human
uauauuagauguuauauaca

SEQ ID NO: 958919 - RNA, 20 nt, Human
uauauuagauguuauauaca

SEQ ID NO: 958920 - RNA, 19 nt, Human
ucaauaguuuaagcaauca

SEQ ID NO: 958921 - RNA, 19 nt, Human
ucaauaguuuaagcaauca

SEQ ID NO: 958922 - RNA, 23 nt, Human
ucauguuauucuuuauccucauc

SEQ ID NO: 958923 - RNA, 23 nt, Human
uccacaggaguuucauguuauuc

SEQ ID NO: 958924 - RNA, 22 nt, Human
ucccauauuucuccaaaaaauc

SEQ ID NO: 958925 - RNA, 24 nt, Human
ugcuuucaucuuugaacuuccaaa

SEQ ID NO: 958926 - RNA, 24 nt, Human
aaaaauacuucuuuucacaccccu

SEQ ID NO: 958927 - RNA, 23 nt, Human
acaagauaauuguuuuucaaaac

SEQ ID NO: 958928 - RNA, 18 nt, Human
auacuucuuuucacaccc

SEQ ID NO: 958929 - RNA, 25 nt, Human
caaaaccagacaacagguucaaaaa

SEQ ID NO: 958930 - RNA, 19 nt, Human
caacagguucaaaaauacu

SEQ ID NO: 958931 - RNA, 24 nt, Human
caauauaaaaggucagcuaggaaa

SEQ ID NO: 958932 - RNA, 21 nt, Human
ccaaaagcauuugcuuacauc

SEQ ID NO: 958933 - RNA, 24 nt, Human
uaaccaaaagcauuugcuuacauc

SEQ ID NO: 958934 - RNA, 19 nt, Human
ucagcuaggaaaaaacaca

SEQ ID NO: 958935 - RNA, 19 nt, Human
uguaccaguaaccaaaagc

SEQ ID NO: 958936 - RNA, 19 nt, Human
uuuucaaaaccagacaaca

SEQ ID NO: 958937 - RNA, 22 nt, Human
cugagccaguuuuggaauccac

SEQ ID NO: 958938 - RNA, 21 nt, Human
gggcuccuggcugucacuccu

SEQ ID NO: 958939 - RNA, 20 nt, Human
ucagaguaaaacuggaccaa

SEQ ID NO: 958940 - RNA, 23 nt, Human
uggaccaaaggaagugaagucag

SEQ ID NO: 958941 - RNA, 22 nt, Human
uuaaaaaaugccuuuauuuuua

SEQ ID NO: 958942 - RNA, 24 nt, Human
caaggaaggcuccagcccaaaggc

SEQ ID NO: 958943 - RNA, 20 nt, Human
caaucuaagccuguauccaa

SEQ ID NO: 958944 - RNA, 20 nt, Human
cagcagggucuuccuccauc

SEQ ID NO: 958945 - RNA, 21 nt, Human
cagggacuccccuagguucuc

SEQ ID NO: 958946 - RNA, 20 nt, Human
ccaagguggggguaggagaa

SEQ ID NO: 958947 - RNA, 23 nt, Human
ccccugucccucuuugggcccuc

SEQ ID NO: 958948 - RNA, 21 nt, Human
ccugggguacaaggaaggcuc

SEQ ID NO: 958949 - RNA, 18 nt, Human
cgucccugaagcggugcg

SEQ ID NO: 958950 - RNA, 23 nt, Human
cuugcucacagccugcugagacc

SEQ ID NO: 958951 - RNA, 23 nt, Human
gaccuggcaagccccugucccuc

SEQ ID NO: 958952 - RNA, 20 nt, Human
ggagaagaauugggaacagg

SEQ ID NO: 958953 - RNA, 20 nt, Human
ucaggccaagguggggguag

SEQ ID NO: 958954 - RNA, 22 nt, Human
uccccuagguucucaggguaca

SEQ ID NO: 958955 - RNA, 21 nt, Human
uccuccaucaggccaaggugg

SEQ ID NO: 958956 - RNA, 20 nt, Human
uggcaagccccugucccucu

SEQ ID NO: 958957 - RNA, 22 nt, Human
ugggaacagggacuccccuagg

SEQ ID NO: 958958 - RNA, 22 nt, Human
ugggcccucagguuugcaauuu

SEQ ID NO: 958959 - RNA, 18 nt, Human
aaaaugccacuugaaacg

SEQ ID NO: 958960 - RNA, 26 nt, Human
accagaacccccagccaaagaggcac

SEQ ID NO: 958961 - RNA, 19 nt, Human
acccacuggggccacaaga

SEQ ID NO: 958962 - RNA, 18 nt, Human
acccccagccaaagaggc

SEQ ID NO: 958963 - RNA, 22 nt, Human
acccgggagccagagggagccc

SEQ ID NO: 958964 - RNA, 25 nt, Human
acgcgguggccccugcgcacucagg

SEQ ID NO: 958965 - RNA, 20 nt, Human
agaaaggcaacugggaccug

SEQ ID NO: 958966 - RNA, 21 nt, Human
agaaccacucuuuuucuuaaa

SEQ ID NO: 958967 - RNA, 23 nt, Human
agcugggggagacaagaccggcg

SEQ ID NO: 958968 - RNA, 21 nt, Human
aggaaaaaaaaguuuuaaaaa

SEQ ID NO: 958969 - RNA, 24 nt, Human
aggaaaaaaaaguuuuaaaaaaaa

SEQ ID NO: 958970 - RNA, 23 nt, Human
aggucccugccaugggggcgcuc

SEQ ID NO: 958971 - RNA, 18 nt, Human
aucacuggcuuuuaugac

SEQ ID NO: 958972 - RNA, 18 nt, Human
auggccccggcuccgccc

SEQ ID NO: 958973 - RNA, 20 nt, Human
cacagagacaacucggccag

SEQ ID NO: 958974 - RNA, 19 nt, Human
cacauacuugaaauuccug

SEQ ID NO: 958975 - RNA, 20 nt, Human
cacgcgguggccccugcgca

SEQ ID NO: 958976 - RNA, 18 nt, Human
cagaacccccagccaaag

SEQ ID NO: 958977 - RNA, 19 nt, Human
cagcgggguggcgcccggg

SEQ ID NO: 958978 - RNA, 23 nt, Human
cauagaaaccacagagacaacuc

SEQ ID NO: 958979 - RNA, 18 nt, Human
cauugugguggccaagaa

SEQ ID NO: 958980 - RNA, 18 nt, Human
ccaccagaacccccagcc

SEQ ID NO: 958981 - RNA, 24 nt, Human
cccccagccaaagaggcacaucug

SEQ ID NO: 958982 - RNA, 18 nt, Human
ccccgugggucccggagg

SEQ ID NO: 958983 - RNA, 19 nt, Human
ccccugcgcacucaggcca

SEQ ID NO: 958984 - RNA, 21 nt, Human
ccccugcgcacucaggccaug

SEQ ID NO: 958985 - RNA, 18 nt, Human
cccgggcacauacuugaa

SEQ ID NO: 958986 - RNA, 18 nt, Human
ccgggguggccaucucag

SEQ ID NO: 958987 - RNA, 20 nt, Human
ccucugaggggggccgucag

SEQ ID NO: 958988 - RNA, 23 nt, Human
cggcagccacgcgguggccccug

SEQ ID NO: 958989 - RNA, 22 nt, Human
cggcagcggcggcuccauggcc

SEQ ID NO: 958990 - RNA, 18 nt, Human
cuccauggccccggcucc

SEQ ID NO: 958991 - RNA, 21 nt, Human
cuccauggccccggcuccgcc

SEQ ID NO: 958992 - RNA, 23 nt, Human
cugguagcccgacaucgccgccg

SEQ ID NO: 958993 - RNA, 25 nt, Human
cuugaaacguccaccagaaccccca

SEQ ID NO: 958994 - RNA, 20 nt, Human
gaaaauagucaaaaaagcau

SEQ ID NO: 958995 - RNA, 18 nt, Human
gaagaagggggaguccag

SEQ ID NO: 958996 - RNA, 25 nt, Human
gaggaaaaaaaaguuuuaaaaaaaa

SEQ ID NO: 958997 - RNA, 18 nt, Human
gaugggacuggaaaacac

SEQ ID NO: 958998 - RNA, 19 nt, Human
gccacgcgguggccccugc

SEQ ID NO: 958999 - RNA, 18 nt, Human
gcgaucaacacuuuacuc

SEQ ID NO: 959000 - RNA, 21 nt, Human
ggacagcggcagccacgcggu

SEQ ID NO: 959001 - RNA, 23 nt, Human
ggaggaggacagcggcagccacg

SEQ ID NO: 959002 - RNA, 18 nt, Human
ggguggcgcugguagccc

SEQ ID NO: 959003 - RNA, 24 nt, Human
uauacacggagcuucaugcugaga

SEQ ID NO: 959004 - RNA, 24 nt, Human
uaugacaaugucuuccaagagcuc

SEQ ID NO: 959005 - RNA, 24 nt, Human
ucacuggcuuuuaugacaaugucu

SEQ ID NO: 959006 - RNA, 24 nt, Human
ucacuggcuuuuaugacaaugucu

SEQ ID NO: 959007 - RNA, 18 nt, Human
ucagaaaggcaacuggga

SEQ ID NO: 959008 - RNA, 21 nt, Human
ugaaacguccaccagaacccc

SEQ ID NO: 959009 - RNA, 22 nt, Human
ugaaacguccaccagaaccccc

SEQ ID NO: 959010 - RNA, 24 nt, Human
ugacugcagggaccacccacuggg

SEQ ID NO: 959011 - RNA, 18 nt, Human
ugagaacacccagggguc

SEQ ID NO: 959012 - RNA, 25 nt, Human
ugcccgggguggccaucucagaggc

SEQ ID NO: 959013 - RNA, 18 nt, Human
ugccuagcccggcagcgg

SEQ ID NO: 959014 - RNA, 26 nt, Human
ugugguggccaagaacuggcugaggg

SEQ ID NO: 959015 - RNA, 23 nt, Human
uucaugcugagaacacccagggg

SEQ ID NO: 959016 - RNA, 18 nt, Human
uuggaacaggaggaaaaa

SEQ ID NO: 959017 - RNA, 19 nt, Human
uuuguucuacuuaugaaau

SEQ ID NO: 959018 - RNA, 21 nt, Human
uuuuaugacaaugucuuccaa

SEQ ID NO: 959019 - RNA, 23 nt, Human
uuuuuuuggugaacuacagaauu

SEQ ID NO: 959020 - RNA, 24 nt, Human
uuuuuuuuggugaacuacagaauu

SEQ ID NO: 959021 - RNA, 19 nt, Human
uuuuuuuuuuuuuuuuugg

SEQ ID NO: 959022 - RNA, 20 nt, Human
uuuuuuuuuuuuuuuuuggu

SEQ ID NO: 959023 - RNA, 19 nt, Human
aaaagauagcuuaacacca

SEQ ID NO: 959024 - RNA, 24 nt, Human
aaaauauguguaagaaaaccaagg

SEQ ID NO: 959025 - RNA, 22 nt, Human
aaagaaaaauaacaugcacaga

SEQ ID NO: 959026 - RNA, 21 nt, Human
acuuugacucacggaaaaaga

SEQ ID NO: 959027 - RNA, 18 nt, Human
agaggcucaggccaggcc

SEQ ID NO: 959028 - RNA, 22 nt, Human
aguacaugcacuucagcaccuu

SEQ ID NO: 959029 - RNA, 23 nt, Human
caaaagauagcuuaacaccaaaa

SEQ ID NO: 959030 - RNA, 24 nt, Human
caaaagauagcuuaacaccaaaaa

SEQ ID NO: 959031 - RNA, 21 nt, Human
cacuauuuccuacaaaagaua

SEQ ID NO: 959032 - RNA, 24 nt, Human
cacuggcuccuucagaggcacuuu

SEQ ID NO: 959033 - RNA, 23 nt, Human
cagcucgacgacguuuagugcaa

SEQ ID NO: 959034 - RNA, 20 nt, Human
cagggagcgcuuccugggcu

SEQ ID NO: 959035 - RNA, 18 nt, Human
cauggcaacuucaccauu

SEQ ID NO: 959036 - RNA, 19 nt, Human
cauggcaacuucaccauuu

SEQ ID NO: 959037 - RNA, 20 nt, Human
ccaagguccagagaggcggg

SEQ ID NO: 959038 - RNA, 21 nt, Human
ccacaguacaugcacuucagc

SEQ ID NO: 959039 - RNA, 22 nt, Human
ccagcaacaaaggaaagacuga

SEQ ID NO: 959040 - RNA, 18 nt, Human
ccaggccuagugcagcuc

SEQ ID NO: 959041 - RNA, 19 nt, Human
ccuccuuccccuccaucuc

SEQ ID NO: 959042 - RNA, 21 nt, Human
cgggccagcaacaaaggaaag

SEQ ID NO: 959043 - RNA, 23 nt, Human
cuuuuuaucauuguuauuugugu

SEQ ID NO: 959044 - RNA, 18 nt, Human
gggagcaggggggcgcca

SEQ ID NO: 959045 - RNA, 23 nt, Human
gucucugaguagugugccccacu

SEQ ID NO: 959046 - RNA, 24 nt, Human
guggaggggaccaguuuggugaug

SEQ ID NO: 959047 - RNA, 22 nt, Human
uaagaaaaccaagguccagaga

SEQ ID NO: 959048 - RNA, 25 nt, Human
uacaaaauauguguaagaaaaccaa

SEQ ID NO: 959049 - RNA, 19 nt, Human
uagcuuaacaccaaaaaca

SEQ ID NO: 959050 - RNA, 19 nt, Human
ucaggccaggccuagugca

SEQ ID NO: 959051 - RNA, 19 nt, Human
ucaggccaggccuagugca

SEQ ID NO: 959052 - RNA, 21 nt, Human
ucauguggacgcugagguccu

SEQ ID NO: 959053 - RNA, 22 nt, Human
ucauguggacgcugagguccug

SEQ ID NO: 959054 - RNA, 20 nt, Human
uccugggcuuggaccaccuc

SEQ ID NO: 959055 - RNA, 22 nt, Human
ucuuuuuaucauuguuauuugu

SEQ ID NO: 959056 - RNA, 18 nt, Human
ugaaaggcacagaaaugc

SEQ ID NO: 959057 - RNA, 23 nt, Human
ugcacagaucggacagagagcau

SEQ ID NO: 959058 - RNA, 23 nt, Human
ugcuggcucaggggagcaggggg

SEQ ID NO: 959059 - RNA, 19 nt, Human
uguaagaaaaccaaggucc

SEQ ID NO: 959060 - RNA, 24 nt, Human
ugucauggcaacuucaccauuuua

SEQ ID NO: 959061 - RNA, 30 nt, Human
uugagaauaaaggucagacuuugacucacu

SEQ ID NO: 959062 - RNA, 27 nt, Human
uuggugauggcuggcacuggcuccuuc

SEQ ID NO: 959063 - RNA, 23 nt, Human
aaccuuuuccgauaauuuuuuuu

SEQ ID NO: 959064 - RNA, 18 nt, Human
aacugaauugauggaaua

SEQ ID NO: 959065 - RNA, 18 nt, Human
aagaaugaccccgcccuc

SEQ ID NO: 959066 - RNA, 21 nt, Human
aagcagcuccgccagugugcc

SEQ ID NO: 959067 - RNA, 20 nt, Human
aagggcuguguugugcccac

SEQ ID NO: 959068 - RNA, 24 nt, Human
aagugggcaggagagagggcagcc

SEQ ID NO: 959069 - RNA, 23 nt, Human
aaguggguguggagacggcgcgu

SEQ ID NO: 959070 - RNA, 19 nt, Human
aaucauggagaagggaggg

SEQ ID NO: 959071 - RNA, 23 nt, Human
accuagcaauggaagcucuucaa

SEQ ID NO: 959072 - RNA, 22 nt, Human
acggccagcagggggauagugg

SEQ ID NO: 959073 - RNA, 20 nt, Human
agaaacuauacaauucacag

SEQ ID NO: 959074 - RNA, 22 nt, Human
agaagggagggaagugggcagg

SEQ ID NO: 959075 - RNA, 19 nt, Human
agccccuggaugagcccag

SEQ ID NO: 959076 - RNA, 20 nt, Human
aggcaagggggacaggugag

SEQ ID NO: 959077 - RNA, 22 nt, Human
agggaagugggcaggagagagg

SEQ ID NO: 959078 - RNA, 19 nt, Human
agggggacaggugagggca

SEQ ID NO: 959079 - RNA, 19 nt, Human
agguggaggaggcuggggc

SEQ ID NO: 959080 - RNA, 21 nt, Human
caaggcacuguacuucugcag

SEQ ID NO: 959081 - RNA, 18 nt, Human
cacagguuggccugggag

SEQ ID NO: 959082 - RNA, 20 nt, Human
cacucuacugaggacaaagc

SEQ ID NO: 959083 - RNA, 19 nt, Human
cacuguacuucugcagggu

SEQ ID NO: 959084 - RNA, 21 nt, Human
cagaagauucugcauaaucac

SEQ ID NO: 959085 - RNA, 24 nt, Human
cagaaugaauggacagggcagcca

SEQ ID NO: 959086 - RNA, 21 nt, Human
cagggcaagggggcccaguac

SEQ ID NO: 959087 - RNA, 26 nt, Human
cagggcagccacgcccgaccccuugg

SEQ ID NO: 959088 - RNA, 21 nt, Human
caggggugagcagagccacag

SEQ ID NO: 959089 - RNA, 21 nt, Human
cauaaucaccuagaaaauuca

SEQ ID NO: 959090 - RNA, 23 nt, Human
ccaacacacaccuuauccucacu

SEQ ID NO: 959091 - RNA, 25 nt, Human
ccagcgcaacaacugacauucccua

SEQ ID NO: 959092 - RNA, 18 nt, Human
ccagugggagguggagga

SEQ ID NO: 959093 - RNA, 20 nt, Human
ccuagaaaauucaauucuaa

SEQ ID NO: 959094 - RNA, 18 nt, Human
ccuccgcagagcaggcuu

SEQ ID NO: 959095 - RNA, 18 nt, Human
ccuggaugagcccaggga

SEQ ID NO: 959096 - RNA, 20 nt, Human
ccuggaugagcccagggaac

SEQ ID NO: 959097 - RNA, 24 nt, Human
cgacagcaucgugcccuggcagaa

SEQ ID NO: 959098 - RNA, 24 nt, Human
cggcacucuacugaggacaaagca

SEQ ID NO: 959099 - RNA, 23 nt, Human
cuccacagggugggcgggcagcc

SEQ ID NO: 959100 - RNA, 24 nt, Human
cugcuuuccagugggagguggagg

SEQ ID NO: 959101 - RNA, 24 nt, Human
gcuucagauuuguaaaccauucac

SEQ ID NO: 959102 - RNA, 18 nt, Human
ggaaccggcacucuacug

SEQ ID NO: 959103 - RNA, 22 nt, Human
ggaaggccgcuggguacacagg

SEQ ID NO: 959104 - RNA, 22 nt, Human
ggagacggcgcguggaccacag

SEQ ID NO: 959105 - RNA, 25 nt, Human
ggagagcggucugcaugccaggggu

SEQ ID NO: 959106 - RNA, 24 nt, Human
ggagggaagugggcaggagagagg

SEQ ID NO: 959107 - RNA, 25 nt, Human
gggaaggccgcuggguacacagguu

SEQ ID NO: 959108 - RNA, 18 nt, Human
gggagggaagugggcagg

SEQ ID NO: 959109 - RNA, 20 nt, Human
gggagguggaggaggcuggg

SEQ ID NO: 959110 - RNA, 18 nt, Human
gggcaggagagagggcag

SEQ ID NO: 959111 - RNA, 20 nt, Human
gguuggccugggagcugggc

SEQ ID NO: 959112 - RNA, 23 nt, Human
uaauaaguacagaaacuauacaa

SEQ ID NO: 959113 - RNA, 21 nt, Human
uacaaggaagggauucacagg

SEQ ID NO: 959114 - RNA, 22 nt, Human
uagaaaauucaauucuaacuga

SEQ ID NO: 959115 - RNA, 19 nt, Human
uauaggaagugggugugga

SEQ ID NO: 959116 - RNA, 25 nt, Human
ucaaugcacaagccaauugcaaagg

SEQ ID NO: 959117 - RNA, 19 nt, Human
ucaccuaacguuuucuggc

SEQ ID NO: 959118 - RNA, 21 nt, Human
ucugcucaccuaacguuuucu

SEQ ID NO: 959119 - RNA, 20 nt, Human
ucuuacgacagcaucgugcc

SEQ ID NO: 959120 - RNA, 23 nt, Human
ugagcaagcagcuccgccagugu

SEQ ID NO: 959121 - RNA, 26 nt, Human
ugagcagagccacaggucuccaugga

SEQ ID NO: 959122 - RNA, 19 nt, Human
ugcauuuggcacaaugguc

SEQ ID NO: 959123 - RNA, 22 nt, Human
ugccacugaccaccauguacaa

SEQ ID NO: 959124 - RNA, 19 nt, Human
uggcccagcgcaacaacug

SEQ ID NO: 959125 - RNA, 25 nt, Human
uggcccagcgcaacaacugacauuc

SEQ ID NO: 959126 - RNA, 19 nt, Human
uggcggauuucucauggcc

SEQ ID NO: 959127 - RNA, 18 nt, Human
ugggaaggccgcugggua

SEQ ID NO: 959128 - RNA, 18 nt, Human
uguuuauuuuucuccuuc

SEQ ID NO: 959129 - RNA, 18 nt, Human
uuggccugggagcugggc

SEQ ID NO: 959130 - RNA, 19 nt, Human
cauacaccaggagcucugc

SEQ ID NO: 959131 - RNA, 21 nt, Human
cugcuuccugccgcggcuguc

SEQ ID NO: 959132 - RNA, 20 nt, Human
cuuccugccgcggcugucac

SEQ ID NO: 959133 - RNA, 22 nt, Human
gacuccagcuccagcccgacug

SEQ ID NO: 959134 - RNA, 20 nt, Human
gggaaauguccagcuuucuc

SEQ ID NO: 959135 - RNA, 19 nt, Human
gucacaggggagccuagaa

SEQ ID NO: 959136 - RNA, 20 nt, Human
ucacccugggaaggucgugg

SEQ ID NO: 959137 - RNA, 23 nt, Human
uccugccgcggcugucacagggg

SEQ ID NO: 959138 - RNA, 21 nt, Human
ugaauguaaauaucucuuugu

SEQ ID NO: 959139 - RNA, 22 nt, Human
ugaggcggugucacccugggaa

SEQ ID NO: 959140 - RNA, 21 nt, Human
uuccugccgcggcugucacag

SEQ ID NO: 959141 - RNA, 18 nt, Human
aaaaaccaaaaacaaguu

SEQ ID NO: 959142 - RNA, 20 nt, Human
aaacaaaaacccacaagugc

SEQ ID NO: 959143 - RNA, 18 nt, Human
aaagcccuuggcaaugcc

SEQ ID NO: 959144 - RNA, 18 nt, Human
aagcacaggugacacgca

SEQ ID NO: 959145 - RNA, 22 nt, Human
aauacagcucuaucgacugccc

SEQ ID NO: 959146 - RNA, 23 nt, Human
acaagcagagugcccucuggagc

SEQ ID NO: 959147 - RNA, 30 nt, Human
acaccacagcacaaacacguggcacagacc

SEQ ID NO: 959148 - RNA, 27 nt, Human
acaccgaauucccuugggcucugccca

SEQ ID NO: 959149 - RNA, 19 nt, Human
acacuccaaaugucaggca

SEQ ID NO: 959150 - RNA, 18 nt, Human
acauccaaguucuacgug

SEQ ID NO: 959151 - RNA, 19 nt, Human
accaagaauucaauggucu

SEQ ID NO: 959152 - RNA, 20 nt, Human
accuggauaaugacugcccc

SEQ ID NO: 959153 - RNA, 18 nt, Human
acugaauaaucaaacuaa

SEQ ID NO: 959154 - RNA, 23 nt, Human
agaagccuucacuaggcuuugcc

SEQ ID NO: 959155 - RNA, 22 nt, Human
agacagagaaugaugagcagaa

SEQ ID NO: 959156 - RNA, 18 nt, Human
agacauuggucacagagg

SEQ ID NO: 959157 - RNA, 23 nt, Human
agagguuaauuucaaaagguuuu

SEQ ID NO: 959158 - RNA, 25 nt, Human
agaguccagcgagguugcaaaauaa

SEQ ID NO: 959159 - RNA, 24 nt, Human
aggaggacgcuggcuuuccuuaaa

SEQ ID NO: 959160 - RNA, 25 nt, Human
aggaggacgcuggcuuugaacaaaa

SEQ ID NO: 959161 - RNA, 27 nt, Human
aggcucccucagcccagucuccccacc

SEQ ID NO: 959162 - RNA, 23 nt, Human
aucaaauggugaaaauauggcaa

SEQ ID NO: 959163 - RNA, 19 nt, Human
auccucuggggucaacccu

SEQ ID NO: 959164 - RNA, 18 nt, Human
aucuaagguugggggagg

SEQ ID NO: 959165 - RNA, 25 nt, Human
augaaaaacaaaacaaaaacccaca

SEQ ID NO: 959166 - RNA, 18 nt, Human
augcaaauaauuuucccu

SEQ ID NO: 959167 - RNA, 20 nt, Human
caaaaacccacaagugcuuu

SEQ ID NO: 959168 - RNA, 18 nt, Human
caaaacaaagcccuuggc

SEQ ID NO: 959169 - RNA, 24 nt, Human
caaauggaagacuguauuuaaaug

SEQ ID NO: 959170 - RNA, 22 nt, Human
caacacacagccagucaacgag

SEQ ID NO: 959171 - RNA, 18 nt, Human
caagacacagaugugcac

SEQ ID NO: 959172 - RNA, 23 nt, Human
caauggaaagacuuagaacaucu

SEQ ID NO: 959173 - RNA, 19 nt, Human
caauggucuugguucaugg

SEQ ID NO: 959174 - RNA, 24 nt, Human
cacaccacagcacaaacacguggc

SEQ ID NO: 959175 - RNA, 22 nt, Human
cacagcucagagaauacaaaac

SEQ ID NO: 959176 - RNA, 24 nt, Human
cacccuagggcugaccauggggcc

SEQ ID NO: 959177 - RNA, 20 nt, Human
caccugggaaaggcgaucaa

SEQ ID NO: 959178 - RNA, 22 nt, Human
cacucuaauaaggcaaguacaa

SEQ ID NO: 959179 - RNA, 24 nt, Human
cagaagaggcagacccggcuccca

SEQ ID NO: 959180 - RNA, 19 nt, Human
cagcucguggacgcacuug

SEQ ID NO: 959181 - RNA, 23 nt, Human
caggcgucccucuugguggcucu

SEQ ID NO: 959182 - RNA, 23 nt, Human
caggcucccucagcccagucucc

SEQ ID NO: 959183 - RNA, 23 nt, Human
caguggaaggggaacacuccaaa

SEQ ID NO: 959184 - RNA, 21 nt, Human
cauguuuguuuccucaaccaa

SEQ ID NO: 959185 - RNA, 24 nt, Human
ccaaacaagacacagaugugcaca

SEQ ID NO: 959186 - RNA, 21 nt, Human
cccaacacacagccagucaac

SEQ ID NO: 959187 - RNA, 18 nt, Human
cccaaggagcaucuccuc

SEQ ID NO: 959188 - RNA, 20 nt, Human
cccuccaccaucccauccca

SEQ ID NO: 959189 - RNA, 20 nt, Human
cccucugcuccaagcggaac

SEQ ID NO: 959190 - RNA, 19 nt, Human
cccugcugcccucccagaa

SEQ ID NO: 959191 - RNA, 22 nt, Human
ccucaguggaaggggaacacuc

SEQ ID NO: 959192 - RNA, 23 nt, Human
ccucgcucagcggcugcacaggg

SEQ ID NO: 959193 - RNA, 25 nt, Human
ccucuugguggcucuccacccuagg

SEQ ID NO: 959194 - RNA, 25 nt, Human
ccuggacagagggggacacaccaca

SEQ ID NO: 959195 - RNA, 21 nt, Human
ccuggcacccccaggcguccc

SEQ ID NO: 959196 - RNA, 25 nt, Human
ccuggccucacacugcugccucagc

SEQ ID NO: 959197 - RNA, 22 nt, Human
cgaauucccuugggcucugccc

SEQ ID NO: 959198 - RNA, 21 nt, Human
cgagcgcgggucgggggccgg

SEQ ID NO: 959199 - RNA, 21 nt, Human
cgccagugacacugaauaauc

SEQ ID NO: 959200 - RNA, 21 nt, Human
cgggcgggcgggcgggcggac

SEQ ID NO: 959201 - RNA, 21 nt, Human
cgggcgggcgggcgggcgggc

SEQ ID NO: 959202 - RNA, 19 nt, Human
cucaaucccaacacacagc

SEQ ID NO: 959203 - RNA, 19 nt, Human
cuccccaccugcacagcuc

SEQ ID NO: 959204 - RNA, 26 nt, Human
cucugcccuggccucacaccgguucc

SEQ ID NO: 959205 - RNA, 18 nt, Human
cugcacagcucagagaau

SEQ ID NO: 959206 - RNA, 22 nt, Human
cuggaccauuuucacauuaucu

SEQ ID NO: 959207 - RNA, 18 nt, Human
cuggcaggggaggcugug

SEQ ID NO: 959208 - RNA, 18 nt, Human
cuucacuaggcuuugccc

SEQ ID NO: 959209 - RNA, 18 nt, Human
gacccggcucccaugugg

SEQ ID NO: 959210 - RNA, 18 nt, Human
gacugccccacugaaaac

SEQ ID NO: 959211 - RNA, 22 nt, Human
gacuuuucccuugcaaauggaa

SEQ ID NO: 959212 - RNA, 18 nt, Human
gagacagagaaugaugag

SEQ ID NO: 959213 - RNA, 20 nt, Human
gagcagaacguggaggaugu

SEQ ID NO: 959214 - RNA, 19 nt, Human
gagcaucuccucgcucagc

SEQ ID NO: 959215 - RNA, 19 nt, Human
gcccaggaggaaggcagga

SEQ ID NO: 959216 - RNA, 23 nt, Human
gcccaggaggaaggcaggagaug

SEQ ID NO: 959217 - RNA, 18 nt, Human
gccccuuccucugggucc

SEQ ID NO: 959218 - RNA, 18 nt, Human
gcgggcgggcgggcggac

SEQ ID NO: 959219 - RNA, 21 nt, Human
gcgggcgggcgggcgggcggg

SEQ ID NO: 959220 - RNA, 22 nt, Human
ggaagggcccgaagcacaggug

SEQ ID NO: 959221 - RNA, 22 nt, Human
ggacagaugagggaucccuagu

SEQ ID NO: 959222 - RNA, 22 nt, Human
ggauaaugacugccccacugaa

SEQ ID NO: 959223 - RNA, 24 nt, Human
ggccggacgccgagcgggcaaugc

SEQ ID NO: 959224 - RNA, 19 nt, Human
ggcgcgggcgggcgggcgg

SEQ ID NO: 959225 - RNA, 19 nt, Human
gggcccaggaggaaggcag

SEQ ID NO: 959226 - RNA, 22 nt, Human
gggccggacgccgagcgggcaa

SEQ ID NO: 959227 - RNA, 20 nt, Human
gggcgggcgggcgggcgggc

SEQ ID NO: 959228 - RNA, 21 nt, Human
guaaagaucccucaggcucua

SEQ ID NO: 959229 - RNA, 21 nt, Human
gucacagaggaggacgcuggc

SEQ ID NO: 959230 - RNA, 18 nt, Human
guccugugggaagggccc

SEQ ID NO: 959231 - RNA, 21 nt, Human
gugagccucccauguggcccu

SEQ ID NO: 959232 - RNA, 24 nt, Human
guggauggagaagggggugagccu

SEQ ID NO: 959233 - RNA, 23 nt, Human
guggcuccguggaaagacacucu

SEQ ID NO: 959234 - RNA, 21 nt, Human
uaagacugaaugaaaaacaaa

SEQ ID NO: 959235 - RNA, 21 nt, Human
uacaugaaagcuuugguccug

SEQ ID NO: 959236 - RNA, 18 nt, Human
uagaugugaauugggaaa

SEQ ID NO: 959237 - RNA, 25 nt, Human
uagcugggcagucuccaggaaggag

SEQ ID NO: 959238 - RNA, 23 nt, Human
uauuuuuucaauauaacauagcu

SEQ ID NO: 959239 - RNA, 20 nt, Human
ucaagacauuggucacagag

SEQ ID NO: 959240 - RNA, 19 nt, Human
ucacauagcacauuguucu

SEQ ID NO: 959241 - RNA, 20 nt, Human
ucagagaauacaaaacccag

SEQ ID NO: 959242 - RNA, 21 nt, Human
ucagagcugggcuccuacugu

SEQ ID NO: 959243 - RNA, 19 nt, Human
ucagcccagucuccccacc

SEQ ID NO: 959244 - RNA, 21 nt, Human
ucagccccucugcuccaagcg

SEQ ID NO: 959245 - RNA, 19 nt, Human
ucagugccuggacagaggg

SEQ ID NO: 959246 - RNA, 20 nt, Human
ucagugccuggacagagggg

SEQ ID NO: 959247 - RNA, 23 nt, Human
ucccagaagaggcagacccggcu

SEQ ID NO: 959248 - RNA, 24 nt, Human
ucccauguggcccuccaccauccc

SEQ ID NO: 959249 - RNA, 18 nt, Human
ucccucagcccagucucc

SEQ ID NO: 959250 - RNA, 23 nt, Human
ucccucagcccagucuccccacc

SEQ ID NO: 959251 - RNA, 20 nt, Human
uccucuggggucaacccugg

SEQ ID NO: 959252 - RNA, 23 nt, Human
ucgcucagcggcugcacaggggg

SEQ ID NO: 959253 - RNA, 23 nt, Human
ucuaauaacaagcagagugcccu

SEQ ID NO: 959254 - RNA, 19 nt, Human
ucuggagccuccucgcugg

SEQ ID NO: 959255 - RNA, 18 nt, Human
ucuuaucuauuuucuccc

SEQ ID NO: 959256 - RNA, 25 nt, Human
ugaaaaacaaaacaaaaacccacaa

SEQ ID NO: 959257 - RNA, 26 nt, Human
ugaaaaacaaaacaaaaacccacaag

SEQ ID NO: 959258 - RNA, 20 nt, Human
ugaaagcuuugguccugaga

SEQ ID NO: 959259 - RNA, 25 nt, Human
ugaaugaaaaacaaaacaaaaaccc

SEQ ID NO: 959260 - RNA, 23 nt, Human
ugagauccaauggaaagacuuag

SEQ ID NO: 959261 - RNA, 21 nt, Human
ugauacagagcuggcagcgag

SEQ ID NO: 959262 - RNA, 21 nt, Human
ugcaaauaauuuucccugcag

SEQ ID NO: 959263 - RNA, 18 nt, Human
ugcccucuggagccuccu

SEQ ID NO: 959264 - RNA, 19 nt, Human
ugcuacgugucgccaguga

SEQ ID NO: 959265 - RNA, 25 nt, Human
ugcucgggaugagggcugggguggc

SEQ ID NO: 959266 - RNA, 19 nt, Human
uggaaaaggguguagcacc

SEQ ID NO: 959267 - RNA, 25 nt, Human
uggaaaaggguguagcaccugggaa

SEQ ID NO: 959268 - RNA, 19 nt, Human
uggaaguuucuagggaaua

SEQ ID NO: 959269 - RNA, 23 nt, Human
uggacaauauuccaaacaagaca

SEQ ID NO: 959270 - RNA, 23 nt, Human
uggaggagaaauagaaaugauuc

SEQ ID NO: 959271 - RNA, 18 nt, Human
ugggaagggcccgaagca

SEQ ID NO: 959272 - RNA, 20 nt, Human
uggggcagcaauccucuggg

SEQ ID NO: 959273 - RNA, 20 nt, Human
ugggucucacucugcccugg

SEQ ID NO: 959274 - RNA, 22 nt, Human
uguggaggugcucgggaugagg

SEQ ID NO: 959275 - RNA, 18 nt, Human
uguuuccucaaccaagaa

SEQ ID NO: 959276 - RNA, 23 nt, Human
uugacuagcaguucgaaagcaaa

SEQ ID NO: 959277 - RNA, 24 nt, Human
uugacugguccuggcacccccagg

SEQ ID NO: 959278 - RNA, 20 nt, Human
uugcagggccauggagacag

SEQ ID NO: 959279 - RNA, 21 nt, Human
uuggauuaccuggauaaugac

SEQ ID NO: 959280 - RNA, 25 nt, Human
uuggccuucuccuggaccauuuucc

SEQ ID NO: 959281 - RNA, 24 nt, Human
uugguccugagaguccuuuugcag

SEQ ID NO: 959282 - RNA, 19 nt, Human
uuucccaggaauggggcuc

SEQ ID NO: 959283 - RNA, 19 nt, Human
uuuccugacuguagucaag

SEQ ID NO: 959284 - RNA, 20 nt, Human
uuucucaaagaguuguuucu

SEQ ID NO: 959285 - RNA, 20 nt, Human
aguggcccugcagacgcccc

SEQ ID NO: 959286 - RNA, 21 nt, Human
caaacccaaagucucugccaa

SEQ ID NO: 959287 - RNA, 24 nt, Human
caaacccaaagucucugccaagag

SEQ ID NO: 959288 - RNA, 20 nt, Human
cacccuccauccacccaucc

SEQ ID NO: 959289 - RNA, 21 nt, Human
cagacgccccaccugccaccc

SEQ ID NO: 959290 - RNA, 23 nt, Human
ccccuacaaacccaaagucucug

SEQ ID NO: 959291 - RNA, 26 nt, Human
cccugcagacgccccaccugccaccc

SEQ ID NO: 959292 - RNA, 26 nt, Human
ccuccauccacccauccauccacaca

SEQ ID NO: 959293 - RNA, 21 nt, Human
cugccacccuccauccaccca

SEQ ID NO: 959294 - RNA, 21 nt, Human
gccccaccugccacccuccau

SEQ ID NO: 959295 - RNA, 18 nt, Human
ggaccccuacaaacccaa

SEQ ID NO: 959296 - RNA, 19 nt, Human
ugaggaccccuacaaaccc

SEQ ID NO: 959297 - RNA, 22 nt, Human
ugcagacgccccaccugccacc

SEQ ID NO: 959298 - RNA, 18 nt, Human
ugccaagaguggcccugc

SEQ ID NO: 959299 - RNA, 18 nt, Human
uggcccugcagacgcccc

SEQ ID NO: 959300 - RNA, 20 nt, Human
aaaggggagagaaccaaaga

SEQ ID NO: 959301 - RNA, 20 nt, Human
aacaaaggaaaaaaaaaagc

SEQ ID NO: 959302 - RNA, 24 nt, Human
aacauuucaaggucauuggaaaca

SEQ ID NO: 959303 - RNA, 23 nt, Human
aagaauaagguucaacacaucag

SEQ ID NO: 959304 - RNA, 21 nt, Human
aaggggagagaaccaaagagg

SEQ ID NO: 959305 - RNA, 23 nt, Human
acaaaggaaaaaaaaaagcaaca

SEQ ID NO: 959306 - RNA, 23 nt, Human
acagcgaaugggccggggccaga

SEQ ID NO: 959307 - RNA, 22 nt, Human
acugcaauucauuauacccauu

SEQ ID NO: 959308 - RNA, 21 nt, Human
aggcaugcuuuagacagucau

SEQ ID NO: 959309 - RNA, 21 nt, Human
agggaggggagggagggaggg

SEQ ID NO: 959310 - RNA, 24 nt, Human
agggaggggagggagggagggggc

SEQ ID NO: 959311 - RNA, 19 nt, Human
auauaaauauauauauaua

SEQ ID NO: 959312 - RNA, 24 nt, Human
auauaaauauauauauauauauau

SEQ ID NO: 959313 - RNA, 18 nt, Human
auaugcuguauauaccug

SEQ ID NO: 959314 - RNA, 21 nt, Human
augaauaucagcagcuuaaaa

SEQ ID NO: 959315 - RNA, 21 nt, Human
caaaacacacaaguacaugca

SEQ ID NO: 959316 - RNA, 19 nt, Human
cagaagaaaagauaaucac

SEQ ID NO: 959317 - RNA, 19 nt, Human
cagcagcuuaaaaaugaaa

SEQ ID NO: 959318 - RNA, 22 nt, Human
cagcagugcauuuuagagcuuu

SEQ ID NO: 959319 - RNA, 21 nt, Human
caggagaggcuaaauaaggca

SEQ ID NO: 959320 - RNA, 20 nt, Human
caugacuuaacagaagaaaa

SEQ ID NO: 959321 - RNA, 22 nt, Human
caugcaucuacaauuacgcacc

SEQ ID NO: 959322 - RNA, 19 nt, Human
cauguugccaccaguuuca

SEQ ID NO: 959323 - RNA, 20 nt, Human
cauguugccaccaguuucag

SEQ ID NO: 959324 - RNA, 21 nt, Human
cauugcacuucaauaguuaca

SEQ ID NO: 959325 - RNA, 22 nt, Human
cauugcacuucaauaguuacac

SEQ ID NO: 959326 - RNA, 23 nt, Human
cccggggaagggaggggagggag

SEQ ID NO: 959327 - RNA, 22 nt, Human
cgaaugggccggggccagaccc

SEQ ID NO: 959328 - RNA, 25 nt, Human
cuuaacagaagaaaagauaaucacu

SEQ ID NO: 959329 - RNA, 25 nt, Human
gaaccaaagagguccaagcagaaaa

SEQ ID NO: 959330 - RNA, 26 nt, Human
gaaccaaagagguccaagcagaaaaa

SEQ ID NO: 959331 - RNA, 21 nt, Human
gaagggaggggagggagggag

SEQ ID NO: 959332 - RNA, 19 nt, Human
gaauaucagcagcuuaaaa

SEQ ID NO: 959333 - RNA, 21 nt, Human
gcuagaucacccuuacaggag

SEQ ID NO: 959334 - RNA, 20 nt, Human
ggagggagggggcgggcgag

SEQ ID NO: 959335 - RNA, 18 nt, Human
ggagggggcgggcgagug

SEQ ID NO: 959336 - RNA, 19 nt, Human
ggccggggccagacccggg

SEQ ID NO: 959337 - RNA, 18 nt, Human
gggaagggaggggaggga

SEQ ID NO: 959338 - RNA, 21 nt, Human
gggagggagggagggggcggg

SEQ ID NO: 959339 - RNA, 30 nt, Human
gggccggggccagacccgggcccggggaaa

SEQ ID NO: 959340 - RNA, 19 nt, Human
ggggaagggaggggaggga

SEQ ID NO: 959341 - RNA, 22 nt, Human
uaaaaguuugccuugauugaau

SEQ ID NO: 959342 - RNA, 22 nt, Human
uacguauauacugcaauucauu

SEQ ID NO: 959343 - RNA, 22 nt, Human
uaucagcagcuuaaaaaugaaa

SEQ ID NO: 959344 - RNA, 21 nt, Human
ugaaaggggagagaaccaaag

SEQ ID NO: 959345 - RNA, 18 nt, Human
ugacuuaacagaagaaaa

SEQ ID NO: 959346 - RNA, 20 nt, Human
ugacuuaacagaagaaaaga

SEQ ID NO: 959347 - RNA, 24 nt, Human
ugacuuaacagaagaaaagauaau

SEQ ID NO: 959348 - RNA, 21 nt, Human
ugagcgagggaggcagccgcg

SEQ ID NO: 959349 - RNA, 20 nt, Human
ugaucugauccucagaggac

SEQ ID NO: 959350 - RNA, 19 nt, Human
ugcacaauuuccucaucug

SEQ ID NO: 959351 - RNA, 21 nt, Human
uggcagcagugcauuuuagag

SEQ ID NO: 959352 - RNA, 19 nt, Human
uuaaaaacaggugaaucca

SEQ ID NO: 959353 - RNA, 20 nt, Human
uuauaugcuguauauaccug

SEQ ID NO: 959354 - RNA, 26 nt, Human
uucacuucuauuuaaauaaccccuag

SEQ ID NO: 959355 - RNA, 25 nt, Human
uucacuucuauuuaaauaaccccug

SEQ ID NO: 959356 - RNA, 21 nt, Human
uugccaauuuaacagcugcau

SEQ ID NO: 959357 - RNA, 20 nt, Human
uuugcuguacuuuacaaaag

SEQ ID NO: 959358 - RNA, 18 nt, Human
uuuggauuucucccaccc

SEQ ID NO: 959359 - RNA, 21 nt, Human
aagcagacgcgaagcccucca

SEQ ID NO: 959360 - RNA, 22 nt, Human
aagcagacgcgaagcccuccaa

SEQ ID NO: 959361 - RNA, 19 nt, Human
auuucucuuaucucuucuc

SEQ ID NO: 959362 - RNA, 21 nt, Human
cuccaacgccucgggccucac

SEQ ID NO: 959363 - RNA, 24 nt, Human
gaagcccuccaacgccucgggccu

SEQ ID NO: 959364 - RNA, 19 nt, Human
ggaaaugaguuauuuugca

SEQ ID NO: 959365 - RNA, 23 nt, Human
uaacgaaucgcuacagguuuuua

SEQ ID NO: 959366 - RNA, 19 nt, Human
uaccaaaaugcugcagcag

SEQ ID NO: 959367 - RNA, 20 nt, Human
uacuaaaguguucaaucaca

SEQ ID NO: 959368 - RNA, 18 nt, Human
uccgaagcagacgcgaag

SEQ ID NO: 959369 - RNA, 22 nt, Human
ucucuucucuuucauuucucuu

SEQ ID NO: 959370 - RNA, 18 nt, Human
ucuucucuuucauuucuc

SEQ ID NO: 959371 - RNA, 20 nt, Human
ucuuucauuucucuuaucuc

SEQ ID NO: 959372 - RNA, 23 nt, Human
ugucccauuucucuucucuuuca

SEQ ID NO: 959373 - RNA, 21 nt, Human
uuagggacuauuagauguccc

SEQ ID NO: 959374 - RNA, 20 nt, Human
uuuguauauaaccaggagau

SEQ ID NO: 959375 - RNA, 23 nt, Human
uuuuuuguuguuuuuccuugucc

SEQ ID NO: 959376 - RNA, 24 nt, Human
uuuuuuuuuuuuuuuucuucccag

SEQ ID NO: 959377 - RNA, 19 nt, Human
aaacagcagaaccuggaac

SEQ ID NO: 959378 - RNA, 22 nt, Human
aaacagcagaaccuggaacuca

SEQ ID NO: 959379 - RNA, 22 nt, Human
agcagaaccuggaacucaugga

SEQ ID NO: 959380 - RNA, 20 nt, Human
aggaucagagcaaacagcag

SEQ ID NO: 959381 - RNA, 20 nt, Human
caaacagcagaaccuggaac

SEQ ID NO: 959382 - RNA, 23 nt, Human
caaacagcagaaccuggaacuca

SEQ ID NO: 959383 - RNA, 18 nt, Human
cacauauaucaacaggau

SEQ ID NO: 959384 - RNA, 23 nt, Human
caggaucagagcaaacagcagaa

SEQ ID NO: 959385 - RNA, 24 nt, Human
caguaagucuacuccucgugacuu

SEQ ID NO: 959386 - RNA, 18 nt, Human
ccaggagaaaaugagaaa

SEQ ID NO: 959387 - RNA, 18 nt, Human
cucauggagauaagaaaa

SEQ ID NO: 959388 - RNA, 25 nt, Human
cuccucugccuaggaaaaccagaga

SEQ ID NO: 959389 - RNA, 22 nt, Human
gaagaugagggaccaggagaaa

SEQ ID NO: 959390 - RNA, 24 nt, Human
gaccaggagaaaaugagaaaaaag

SEQ ID NO: 959391 - RNA, 19 nt, Human
gcaaacagcagaaccugga

SEQ ID NO: 959392 - RNA, 19 nt, Human
ggaucagagcaaacagcag

SEQ ID NO: 959393 - RNA, 21 nt, Human
uaagucuacuccucgugacuu

SEQ ID NO: 959394 - RNA, 23 nt, Human
ucagagcaaacagcagaaccugg

SEQ ID NO: 959395 - RNA, 25 nt, Human
ucucuagcccugucaagggcucacc

SEQ ID NO: 959396 - RNA, 21 nt, Human
ugagggaccaggagaaaauga

SEQ ID NO: 959397 - RNA, 18 nt, Human
ugucaggugcucucuagc

SEQ ID NO: 959398 - RNA, 21 nt, Human
ugucaggugcucucuagcccu

SEQ ID NO: 959399 - RNA, 18 nt, Human
ugugggugcccaccugca

SEQ ID NO: 959400 - RNA, 20 nt, Human
aagcgggguacacacaaaca

SEQ ID NO: 959401 - RNA, 19 nt, Human
aaggcauccuccacccaca

SEQ ID NO: 959402 - RNA, 25 nt, Human
aaggcauccuccacccacacauccc

SEQ ID NO: 959403 - RNA, 19 nt, Human
acaagagcauccugaggcu

SEQ ID NO: 959404 - RNA, 18 nt, Human
acaguggagaugaugaca

SEQ ID NO: 959405 - RNA, 22 nt, Human
accacccugcucugccugagag

SEQ ID NO: 959406 - RNA, 21 nt, Human
agcuacuuugaaaccucaccc

SEQ ID NO: 959407 - RNA, 22 nt, Human
aggcauccuccacccacacauc

SEQ ID NO: 959408 - RNA, 24 nt, Human
aggcauccuccacccacacauccc

SEQ ID NO: 959409 - RNA, 19 nt, Human
auagcugggcccccgaggc

SEQ ID NO: 959410 - RNA, 25 nt, Human
caacaacccaaauuaacaguauuuu

SEQ ID NO: 959411 - RNA, 18 nt, Human
caagagcauccugaggcu

SEQ ID NO: 959412 - RNA, 20 nt, Human
cacaaacacucuagaagcca

SEQ ID NO: 959413 - RNA, 25 nt, Human
cacacguggugaaagagaaaaucua

SEQ ID NO: 959414 - RNA, 22 nt, Human
caggaaugagcugaccgagaca

SEQ ID NO: 959415 - RNA, 18 nt, Human
caggaugcccacucgccc

SEQ ID NO: 959416 - RNA, 24 nt, Human
caucccaucuucugagugguccca

SEQ ID NO: 959417 - RNA, 18 nt, Human
ccagaauaaacaagagca

SEQ ID NO: 959418 - RNA, 22 nt, Human
ccagagcugugcgccaccccug

SEQ ID NO: 959419 - RNA, 18 nt, Human
cccacacaucccaucuuc

SEQ ID NO: 959420 - RNA, 23 nt, Human
cccaggcccugaacuggcucagg

SEQ ID NO: 959421 - RNA, 22 nt, Human
cccagucuuccggcccagggga

SEQ ID NO: 959422 - RNA, 27 nt, Human
ccccaagcuggcucucccccaggcccu

SEQ ID NO: 959423 - RNA, 21 nt, Human
ccccaggcccugaacuggcuc

SEQ ID NO: 959424 - RNA, 24 nt, Human
ccccaggcccugaacuggcucagg

SEQ ID NO: 959425 - RNA, 20 nt, Human
ccccugugggacaaucaggc

SEQ ID NO: 959426 - RNA, 19 nt, Human
ccucacccacaguucacac

SEQ ID NO: 959427 - RNA, 18 nt, Human
ccuccacccacacauccc

SEQ ID NO: 959428 - RNA, 19 nt, Human
cgggguacacacaaacacu

SEQ ID NO: 959429 - RNA, 20 nt, Human
cuccugggucucuaccagcu

SEQ ID NO: 959430 - RNA, 21 nt, Human
cugggcccccgaggcccugac

SEQ ID NO: 959431 - RNA, 19 nt, Human
ggaccacccugcucugccu

SEQ ID NO: 959432 - RNA, 19 nt, Human
gggacaguggagaugauga

SEQ ID NO: 959433 - RNA, 19 nt, Human
ggucccagagcugugcgcc

SEQ ID NO: 959434 - RNA, 23 nt, Human
guaaauccaacaacaacccaaau

SEQ ID NO: 959435 - RNA, 22 nt, Human
gugaagcuacuuugaaaccuca

SEQ ID NO: 959436 - RNA, 23 nt, Human
gugaagcuacuuugaaaccucac

SEQ ID NO: 959437 - RNA, 19 nt, Human
ucaggaaggaggcaggaau

SEQ ID NO: 959438 - RNA, 18 nt, Human
ucccagagcugugcgccc

SEQ ID NO: 959439 - RNA, 21 nt, Human
ucccccaggcccugaacuggc

SEQ ID NO: 959440 - RNA, 22 nt, Human
ucuagcaaaguaaauccaacaa

SEQ ID NO: 959441 - RNA, 18 nt, Human
ugagcccagaauaaacaa

SEQ ID NO: 959442 - RNA, 19 nt, Human
ugaggcuggagaggcaggc

SEQ ID NO: 959443 - RNA, 20 nt, Human
ugcccggaccacccugcucu

SEQ ID NO: 959444 - RNA, 22 nt, Human
uggcccggccgccaccuaguga

SEQ ID NO: 959445 - RNA, 19 nt, Human
uggcucaggaaggaggcag

SEQ ID NO: 959446 - RNA, 19 nt, Human
ugggcuggguuccagcugg

SEQ ID NO: 959447 - RNA, 19 nt, Human
uggugaaagagaaaaucua

SEQ ID NO: 959448 - RNA, 25 nt, Human
ugucuucuccuucgacagcuucguu

SEQ ID NO: 959449 - RNA, 18 nt, Human
uuuuuuuuuuuuuuuuug

SEQ ID NO: 959450 - RNA, 19 nt, Human
uuuuuuuuuuuuuuuuugc

SEQ ID NO: 959451 - RNA, 21 nt, Human
uuuuuuuuuuuuuuuuugcag

SEQ ID NO: 959452 - RNA, 21 nt, Human
aacgggaggcagagcaucugg

SEQ ID NO: 959453 - RNA, 20 nt, Human
aguggguuuuggaacgggag

SEQ ID NO: 959454 - RNA, 22 nt, Human
cccccaaacuccguggcuccuc

SEQ ID NO: 959455 - RNA, 19 nt, Human
ccgcggagccgggcagggg

SEQ ID NO: 959456 - RNA, 23 nt, Human
cgccgcggagccgggcagggggc

SEQ ID NO: 959457 - RNA, 19 nt, Human
gagcaucuggggacagacc

SEQ ID NO: 959458 - RNA, 24 nt, Human
gcuguccugcucacccagcagaag

SEQ ID NO: 959459 - RNA, 22 nt, Human
ggaaauggucuaugcacacugc

SEQ ID NO: 959460 - RNA, 23 nt, Human
ggaaauguucaaaagugucaagg

SEQ ID NO: 959461 - RNA, 19 nt, Human
gggacaggagcuguccugc

SEQ ID NO: 959462 - RNA, 24 nt, Human
ggugugugcccaggugcuguggcc

SEQ ID NO: 959463 - RNA, 20 nt, Human
gugcccaggugcuguggccc

SEQ ID NO: 959464 - RNA, 25 nt, Human
uccgcgccgcggagccgggcagggg

SEQ ID NO: 959465 - RNA, 21 nt, Human
uccucaagcaugucuucaucc

SEQ ID NO: 959466 - RNA, 21 nt, Human
ucgcuggggacaggagcuguc

SEQ ID NO: 959467 - RNA, 22 nt, Human
ucuaugcacacugcugaggcug

SEQ ID NO: 959468 - RNA, 24 nt, Human
ucuggcuguuuuccugccucccug

SEQ ID NO: 959469 - RNA, 21 nt, Human
ucuucgcuggggacaggagcu

SEQ ID NO: 959470 - RNA, 21 nt, Human
ugacaauaaacucuacagaac

SEQ ID NO: 959471 - RNA, 19 nt, Human
ugaguggguuuuggaacgg

SEQ ID NO: 959472 - RNA, 20 nt, Human
ugcccaggugcuguggcccc

SEQ ID NO: 959473 - RNA, 21 nt, Human
uggacaggugcucgggugugu

SEQ ID NO: 959474 - RNA, 18 nt, Human
uggcccaggggcagccgg

SEQ ID NO: 959475 - RNA, 24 nt, Human
uggcccccaaacuccguggcuccu

SEQ ID NO: 959476 - RNA, 19 nt, Human
ugucaagguggcuucuggc

SEQ ID NO: 959477 - RNA, 22 nt, Human
ugucaagguggcuucuggcugu

SEQ ID NO: 959478 - RNA, 23 nt, Human
uguccugcucacccagcagaagc

SEQ ID NO: 959479 - RNA, 24 nt, Human
uguccugcucacccagcagaagca

SEQ ID NO: 959480 - RNA, 19 nt, Human
ugugcaaagguccugggac

SEQ ID NO: 959481 - RNA, 21 nt, Human
uucuggcuguuuuccugccuc

SEQ ID NO: 959482 - RNA, 22 nt, Human
uuuuucauuccugccguucaac

SEQ ID NO: 959483 - RNA, 20 nt, Human
aaaaaaaaaagaggaaaaaa

SEQ ID NO: 959484 - RNA, 20 nt, Human
aaaaccccaacacucaucac

SEQ ID NO: 959485 - RNA, 28 nt, Human
aaaacgaaacaaaacaaaaauaaaaccc

SEQ ID NO: 959486 - RNA, 25 nt, Human
aaaagaggaaaaaacggauuguaag

SEQ ID NO: 959487 - RNA, 21 nt, Human
aaaaggaaaguaaaucaaacc

SEQ ID NO: 959488 - RNA, 23 nt, Human
aaaauaaaacccacuccagaaaa

SEQ ID NO: 959489 - RNA, 25 nt, Human
aaacaaaaauaaaacccacuccaga

SEQ ID NO: 959490 - RNA, 26 nt, Human
aaacaaaaauaaaacccacuccagaa

SEQ ID NO: 959491 - RNA, 22 nt, Human
aaacaaaacaaaaauaaaaccc

SEQ ID NO: 959492 - RNA, 23 nt, Human
aaacaaaacaaaaauaaaaccca

SEQ ID NO: 959493 - RNA, 23 nt, Human
aaacgaaacaaaacaaaaauaaa

SEQ ID NO: 959494 - RNA, 19 nt, Human
aaagacugacaaaguugga

SEQ ID NO: 959495 - RNA, 21 nt, Human
aaauacuaguauccgcaugaa

SEQ ID NO: 959496 - RNA, 21 nt, Human
aacacacccgcagcaaacacu

SEQ ID NO: 959497 - RNA, 19 nt, Human
aacaguugcucuaacccca

SEQ ID NO: 959498 - RNA, 21 nt, Human
aaccccagugguuaucaauac

SEQ ID NO: 959499 - RNA, 18 nt, Human
aaccccauucuaaacccc

SEQ ID NO: 959500 - RNA, 18 nt, Human
aaccugggccaaaugaag

SEQ ID NO: 959501 - RNA, 18 nt, Human
aaccugggccaaaugaag

SEQ ID NO: 959502 - RNA, 21 nt, Human
aacuuggaaauucaucuggug

SEQ ID NO: 959503 - RNA, 20 nt, Human
aagcagagguaaaaugaagg

SEQ ID NO: 959504 - RNA, 20 nt, Human
aaggaaaguaaaucaaaccc

SEQ ID NO: 959505 - RNA, 21 nt, Human
aaggagaaaacgaaacaaaac

SEQ ID NO: 959506 - RNA, 21 nt, Human
aagucagagaggagagaaggc

SEQ ID NO: 959507 - RNA, 26 nt, Human
aaucaccugcauuaaauaacauuuaa

SEQ ID NO: 959508 - RNA, 22 nt, Human
acaaacaagaacaggugaagcc

SEQ ID NO: 959509 - RNA, 21 nt, Human
acaaaguucuccacagguuug

SEQ ID NO: 959510 - RNA, 26 nt, Human
acacucaucacccaaugaaucauuuc

SEQ ID NO: 959511 - RNA, 20 nt, Human
acagucaaggcuaacaaaca

SEQ ID NO: 959512 - RNA, 21 nt, Human
accugggccaaaugaagcugg

SEQ ID NO: 959513 - RNA, 21 nt, Human
agaaaaaaaaaaaaaaaagag

SEQ ID NO: 959514 - RNA, 23 nt, Human
agaaaaaaaaaaaaaaaagagga

SEQ ID NO: 959515 - RNA, 24 nt, Human
agaaaaccccaacacucaucaccc

SEQ ID NO: 959516 - RNA, 27 nt, Human
agaaucacuugagaccaaaagaauuac

SEQ ID NO: 959517 - RNA, 22 nt, Human
agaauucacugcagugcucucc

SEQ ID NO: 959518 - RNA, 23 nt, Human
agagacaacaugaagagaaucac

SEQ ID NO: 959519 - RNA, 19 nt, Human
agccacaagagugaaacuu

SEQ ID NO: 959520 - RNA, 20 nt, Human
agccagaacuucagagaagg

SEQ ID NO: 959521 - RNA, 19 nt, Human
agcuugauuugcagaucag

SEQ ID NO: 959522 - RNA, 21 nt, Human
aggaccucugccccaagcuuc

SEQ ID NO: 959523 - RNA, 20 nt, Human
aggagaaggcaauggcggag

SEQ ID NO: 959524 - RNA, 21 nt, Human
aggcagaaaagacugacaaag

SEQ ID NO: 959525 - RNA, 21 nt, Human
agggaaaaggggguaggcagg

SEQ ID NO: 959526 - RNA, 18 nt, Human
aggggguaggcagggcau

SEQ ID NO: 959527 - RNA, 22 nt, Human
aggggguaggcagggcaugggg

SEQ ID NO: 959528 - RNA, 18 nt, Human
aguaaaaauucaaagcua

SEQ ID NO: 959529 - RNA, 24 nt, Human
auagcagucggggauuggagggca

SEQ ID NO: 959530 - RNA, 23 nt, Human
aucaaaccccccaauacgccuga

SEQ ID NO: 959531 - RNA, 20 nt, Human
aucauugaaaaacuccaccu

SEQ ID NO: 959532 - RNA, 19 nt, Human
auccgcaugaaugaaaaca

SEQ ID NO: 959533 - RNA, 18 nt, Human
augaaauguccccucccc

SEQ ID NO: 959534 - RNA, 22 nt, Human
auuccagcuuaagcuagaacaa

SEQ ID NO: 959535 - RNA, 27 nt, Human
caaaaacaaaaauuaaguuagguaguc

SEQ ID NO: 959536 - RNA, 25 nt, Human
caaaaacaaguauaagcaaaaaaua

SEQ ID NO: 959537 - RNA, 21 nt, Human
caaaacccccaagcagaggua

SEQ ID NO: 959538 - RNA, 22 nt, Human
caaaacccccaagcagagguaa

SEQ ID NO: 959539 - RNA, 18 nt, Human
caacaccagaaaaaaaaa

SEQ ID NO: 959540 - RNA, 22 nt, Human
caacaugaguauagaaaacccc

SEQ ID NO: 959541 - RNA, 23 nt, Human
caacuauaaaaacaaacuuuggu

SEQ ID NO: 959542 - RNA, 18 nt, Human
caacucgaggaccggcag

SEQ ID NO: 959543 - RNA, 21 nt, Human
caagaacaggugaagccugug

SEQ ID NO: 959544 - RNA, 19 nt, Human
caaggcuaacaaacaagaa

SEQ ID NO: 959545 - RNA, 22 nt, Human
caauacccucaaaagucagaga

SEQ ID NO: 959546 - RNA, 23 nt, Human
caaucucaccucccacccguaaa

SEQ ID NO: 959547 - RNA, 20 nt, Human
cacacaaaacccccaagcag

SEQ ID NO: 959548 - RNA, 21 nt, Human
cacacaaaacccccaagcaga

SEQ ID NO: 959549 - RNA, 19 nt, Human
cacacccgcagcaaacacu

SEQ ID NO: 959550 - RNA, 21 nt, Human
cacagucaaggcuaacaaaca

SEQ ID NO: 959551 - RNA, 18 nt, Human
cacauuauaaauaugaaa

SEQ ID NO: 959552 - RNA, 20 nt, Human
caccacagaaguacccccau

SEQ ID NO: 959553 - RNA, 24 nt, Human
caccacagaaguacccccaucuac

SEQ ID NO: 959554 - RNA, 25 nt, Human
cacuacaugaaaaccaacagcugca

SEQ ID NO: 959555 - RNA, 20 nt, Human
cacuguacauagacuugagg

SEQ ID NO: 959556 - RNA, 19 nt, Human
cagaggcagccacagcaga

SEQ ID NO: 959557 - RNA, 21 nt, Human
cagaugccucuaacacaacac

SEQ ID NO: 959558 - RNA, 19 nt, Human
cagccucugggaucgaccu

SEQ ID NO: 959559 - RNA, 18 nt, Human
caggaggaaauuuauuua

SEQ ID NO: 959560 - RNA, 22 nt, Human
cagggccugacaacaaaguucu

SEQ ID NO: 959561 - RNA, 21 nt, Human
cagugcacauagucuuccagg

SEQ ID NO: 959562 - RNA, 21 nt, Human
caguguccgcggcagccccca

SEQ ID NO: 959563 - RNA, 22 nt, Human
cauauacagguucuugaucaaa

SEQ ID NO: 959564 - RNA, 22 nt, Human
caucaccugcuugaaauggcug

SEQ ID NO: 959565 - RNA, 19 nt, Human
caugaaaaccaacagcugc

SEQ ID NO: 959566 - RNA, 24 nt, Human
caugaaaaccaacagcugcacaau

SEQ ID NO: 959567 - RNA, 20 nt, Human
ccaaacccaaaaaacuguaa

SEQ ID NO: 959568 - RNA, 21 nt, Human
ccaacacucaucacccaauga

SEQ ID NO: 959569 - RNA, 19 nt, Human
ccacccguaaaagauuacc

SEQ ID NO: 959570 - RNA, 19 nt, Human
ccacggacaccgcggccac

SEQ ID NO: 959571 - RNA, 22 nt, Human
ccagaaaaaaaaaaaaaaaaaa

SEQ ID NO: 959572 - RNA, 24 nt, Human
cccaacacucaucacccaaugaau

SEQ ID NO: 959573 - RNA, 24 nt, Human
cccauacccuggucuucaaauaaa

SEQ ID NO: 959574 - RNA, 21 nt, Human
cccucaauacccucaaaaguc

SEQ ID NO: 959575 - RNA, 22 nt, Human
ccucugccccaagcuucugggc

SEQ ID NO: 959576 - RNA, 21 nt, Human
ccugcuaggaccucugcccca

SEQ ID NO: 959577 - RNA, 18 nt, Human
ccugucaggcuucaacug

SEQ ID NO: 959578 - RNA, 18 nt, Human
ccuugucuucaaccuggg

SEQ ID NO: 959579 - RNA, 20 nt, Human
cgcucagggccugacaacaa

SEQ ID NO: 959580 - RNA, 22 nt, Human
cguggcccacggacaccgcggc

SEQ ID NO: 959581 - RNA, 24 nt, Human
cuaaagaaaugugagaaggaagcc

SEQ ID NO: 959582 - RNA, 21 nt, Human
cuaaauaagacuccaacaccc

SEQ ID NO: 959583 - RNA, 25 nt, Human
cucaaaauggacuucucaccugccc

SEQ ID NO: 959584 - RNA, 19 nt, Human
cuccaccuucaauggaaaa

SEQ ID NO: 959585 - RNA, 24 nt, Human
cuccaccuucaauggaaaaauaca

SEQ ID NO: 959586 - RNA, 18 nt, Human
cucccccaaccccauuua

SEQ ID NO: 959587 - RNA, 23 nt, Human
cucugccccaagcuucugggcaa

SEQ ID NO: 959588 - RNA, 18 nt, Human
cugaccgcagcugagcgu

SEQ ID NO: 959589 - RNA, 24 nt, Human
cugcacaauaugugaugugacaca

SEQ ID NO: 959590 - RNA, 19 nt, Human
cugcuuauuccagcuuaag

SEQ ID NO: 959591 - RNA, 18 nt, Human
cuguuccuggucaccacu

SEQ ID NO: 959592 - RNA, 23 nt, Human
cuucagugcacauagucuuccag

SEQ ID NO: 959593 - RNA, 21 nt, Human
cuugauuugcagaucagccuc

SEQ ID NO: 959594 - RNA, 21 nt, Human
cuuggaaauucaucuggugcc

SEQ ID NO: 959595 - RNA, 23 nt, Human
cuuuaaaaaaaaaaaaaaaccua

SEQ ID NO: 959596 - RNA, 21 nt, Human
gaaaacuucugaaaugaccac

SEQ ID NO: 959597 - RNA, 22 nt, Human
gaaacaaaacaaaaauaaaacc

SEQ ID NO: 959598 - RNA, 20 nt, Human
gaagccaaacccaaaaaacu

SEQ ID NO: 959599 - RNA, 18 nt, Human
gaaggcaauggcggaguc

SEQ ID NO: 959600 - RNA, 21 nt, Human
gagaaaacgaaacaaaacaaa

SEQ ID NO: 959601 - RNA, 19 nt, Human
gagaagaaauacagaaccc

SEQ ID NO: 959602 - RNA, 19 nt, Human
gagcggaauggauggugug

SEQ ID NO: 959603 - RNA, 19 nt, Human
gcacauacuuacuacuacc

SEQ ID NO: 959604 - RNA, 20 nt, Human
gcccacggacaccgcggcca

SEQ ID NO: 959605 - RNA, 23 nt, Human
gcgcucgguacucgccgucugcc

SEQ ID NO: 959606 - RNA, 21 nt, Human
gcucagcgagcggaauggaug

SEQ ID NO: 959607 - RNA, 23 nt, Human
ggaauggauggugugcacagaug

SEQ ID NO: 959608 - RNA, 26 nt, Human
ggagaguguaucccuuccugcucuuc

SEQ ID NO: 959609 - RNA, 22 nt, Human
ggagggcagagaagaaauacag

SEQ ID NO: 959610 - RNA, 18 nt, Human
gggauuagaaauguaauu

SEQ ID NO: 959611 - RNA, 25 nt, Human
ggucaagagaagagcacuguagaaa

SEQ ID NO: 959612 - RNA, 22 nt, Human
uaaaaaauacagucaaccccau

SEQ ID NO: 959613 - RNA, 23 nt, Human
uaaaacagucucauggugacuga

SEQ ID NO: 959614 - RNA, 23 nt, Human
uaaauaagacuccaacaccagaa

SEQ ID NO: 959615 - RNA, 23 nt, Human
uacauucaccucucagaauauuu

SEQ ID NO: 959616 - RNA, 25 nt, Human
uagaaaaccccaacacucaucaccc

SEQ ID NO: 959617 - RNA, 23 nt, Human
uaggaggacaaaacacaugauca

SEQ ID NO: 959618 - RNA, 21 nt, Human
uaggauguguaaguucuacug

SEQ ID NO: 959619 - RNA, 19 nt, Human
uaguauccgcaugaaugaa

SEQ ID NO: 959620 - RNA, 27 nt, Human
uauaaaaaaagaccaucaccugcuuga

SEQ ID NO: 959621 - RNA, 20 nt, Human
uauaaauaugaaaugucccc

SEQ ID NO: 959622 - RNA, 21 nt, Human
uauagaaaaccccaacacuca

SEQ ID NO: 959623 - RNA, 22 nt, Human
ucagaggagguuuucaaaaaca

SEQ ID NO: 959624 - RNA, 19 nt, Human
ucaggcuucaacugcugau

SEQ ID NO: 959625 - RNA, 23 nt, Human
uccaacaccagaaaaaaaaaaaa

SEQ ID NO: 959626 - RNA, 23 nt, Human
ucccacagagaaggccagaaaaa

SEQ ID NO: 959627 - RNA, 18 nt, Human
uccugcuaggaccucugc

SEQ ID NO: 959628 - RNA, 20 nt, Human
ucuuuaaaaaaaaaaaaaaa

SEQ ID NO: 959629 - RNA, 21 nt, Human
ugaaaacacccuggcuuuggu

SEQ ID NO: 959630 - RNA, 24 nt, Human
ugaaauguccccucccccaacccc

SEQ ID NO: 959631 - RNA, 27 nt, Human
ugaauaaaucaccugcauuaaauaaca

SEQ ID NO: 959632 - RNA, 19 nt, Human
ugagaccaaaagaauuacu

SEQ ID NO: 959633 - RNA, 21 nt, Human
ugagcguggcccacggacacc

SEQ ID NO: 959634 - RNA, 20 nt, Human
ugaggcagaugccucuaacc

SEQ ID NO: 959635 - RNA, 19 nt, Human
ugauuugcagaucagccuc

SEQ ID NO: 959636 - RNA, 18 nt, Human
ugccccaagcuucugggc

SEQ ID NO: 959637 - RNA, 18 nt, Human
ugcggaaccccagugguu

SEQ ID NO: 959638 - RNA, 24 nt, Human
ugcugauuuuucaccucuggggug

SEQ ID NO: 959639 - RNA, 19 nt, Human
ugcuuauuccagcuuaagc

SEQ ID NO: 959640 - RNA, 22 nt, Human
ugcuucacaaaagcagaggucc

SEQ ID NO: 959641 - RNA, 23 nt, Human
uggaagaaguugaggcagaaaag

SEQ ID NO: 959642 - RNA, 25 nt, Human
uggcccacggacaccgcggccaccc

SEQ ID NO: 959643 - RNA, 18 nt, Human
uggcuacagaaauccauc

SEQ ID NO: 959644 - RNA, 26 nt, Human
uggcuacagaaauccaucuggaaauu

SEQ ID NO: 959645 - RNA, 19 nt, Human
ugggauuagaaauguaauu

SEQ ID NO: 959646 - RNA, 18 nt, Human
uggucaccacugaggccu

SEQ ID NO: 959647 - RNA, 19 nt, Human
uggucaccacugaggccug

SEQ ID NO: 959648 - RNA, 18 nt, Human
ugugagaaggaagccaaa

SEQ ID NO: 959649 - RNA, 19 nt, Human
uuacacaaagcauuuauuu

SEQ ID NO: 959650 - RNA, 22 nt, Human
uuacuacuaccuacuugggaac

SEQ ID NO: 959651 - RNA, 22 nt, Human
uuacuaugcugauucucaaaau

SEQ ID NO: 959652 - RNA, 22 nt, Human
uucacaaaagcagaggucccac

SEQ ID NO: 959653 - RNA, 19 nt, Human
uucaccucucagaauauuu

SEQ ID NO: 959654 - RNA, 23 nt, Human
uuccuggucaccacugaggccug

SEQ ID NO: 959655 - RNA, 18 nt, Human
uugaauaaaucaccugca

SEQ ID NO: 959656 - RNA, 24 nt, Human
uuugaaaguuuauuguuuucuuua

SEQ ID NO: 959657 - RNA, 18 nt, Human
uuugaacaucucaagaug

SEQ ID NO: 959658 - RNA, 21 nt, Human
aaauaagcccauuccaaaauc

SEQ ID NO: 959659 - RNA, 21 nt, Human
aagaagaaaauuagucacaaa

SEQ ID NO: 959660 - RNA, 20 nt, Human
aaggcagaggaaaccaugug

SEQ ID NO: 959661 - RNA, 20 nt, Human
aaucacaaacuccaccuaca

SEQ ID NO: 959662 - RNA, 18 nt, Human
accacuauaaaaaaguca

SEQ ID NO: 959663 - RNA, 21 nt, Human
accacuauaaaaaagucagaa

SEQ ID NO: 959664 - RNA, 24 nt, Human
acuacacugcaaauacuuaaagca

SEQ ID NO: 959665 - RNA, 24 nt, Human
agaauugacaaucuuaaaacaauc

SEQ ID NO: 959666 - RNA, 21 nt, Human
agacaacacugauauuucaca

SEQ ID NO: 959667 - RNA, 19 nt, Human
agauagauaguuaggucag

SEQ ID NO: 959668 - RNA, 25 nt, Human
agaucucuuucacugucauaauuuc

SEQ ID NO: 959669 - RNA, 20 nt, Human
agcaauaaaaauguuuccaa

SEQ ID NO: 959670 - RNA, 19 nt, Human
agcagucauuauuccuuug

SEQ ID NO: 959671 - RNA, 18 nt, Human
agcaucaauuuucuuuau

SEQ ID NO: 959672 - RNA, 21 nt, Human
aggauuacaguacuuggauaa

SEQ ID NO: 959673 - RNA, 18 nt, Human
aggcaggagaaucguuua

SEQ ID NO: 959674 - RNA, 24 nt, Human
aggcaggagaaucguuuaguuuug

SEQ ID NO: 959675 - RNA, 20 nt, Human
aggcugaggcaggagaaucg

SEQ ID NO: 959676 - RNA, 20 nt, Human
aggcugaggcaggagaaucg

SEQ ID NO: 959677 - RNA, 18 nt, Human
agucacaaaggcagagga

SEQ ID NO: 959678 - RNA, 19 nt, Human
aguuccauuuaaauaaugg

SEQ ID NO: 959679 - RNA, 24 nt, Human
auaaauauaccuucaaaauaagcu

SEQ ID NO: 959680 - RNA, 18 nt, Human
auacaugcccuucauaca

SEQ ID NO: 959681 - RNA, 24 nt, Human
auagugaaaucaaaauaaaaacca

SEQ ID NO: 959682 - RNA, 21 nt, Human
aucaacucauuucagcaaaau

SEQ ID NO: 959683 - RNA, 21 nt, Human
aucuuuccaauucauaaauuc

SEQ ID NO: 959684 - RNA, 19 nt, Human
auuauucccccuuguaauc

SEQ ID NO: 959685 - RNA, 21 nt, Human
caaacuccaccuacaaagaag

SEQ ID NO: 959686 - RNA, 24 nt, Human
caaaguuagcuuggcccacacuca

SEQ ID NO: 959687 - RNA, 21 nt, Human
caaauacuuaaagcaggacuc

SEQ ID NO: 959688 - RNA, 23 nt, Human
caagacgaaguaaaauuaauaga

SEQ ID NO: 959689 - RNA, 21 nt, Human
caccaugugagcaaguagaau

SEQ ID NO: 959690 - RNA, 21 nt, Human
cacuagagaggaagaucaaag

SEQ ID NO: 959691 - RNA, 22 nt, Human
cagcauuauuuuucuauccccc

SEQ ID NO: 959692 - RNA, 24 nt, Human
cagcuacucgggaggcugaggcag

SEQ ID NO: 959693 - RNA, 21 nt, Human
caguagaaaaaaaaaucugaa

SEQ ID NO: 959694 - RNA, 24 nt, Human
cauaaaacucacacacaguuacac

SEQ ID NO: 959695 - RNA, 20 nt, Human
ccaaaaguuaacuuucaaau

SEQ ID NO: 959696 - RNA, 26 nt, Human
cccacacucaggaacgaccaagggca

SEQ ID NO: 959697 - RNA, 18 nt, Human
cccugggcgaucggaccu

SEQ ID NO: 959698 - RNA, 24 nt, Human
ccucuagaaaccaauuuuuaaucc

SEQ ID NO: 959699 - RNA, 25 nt, Human
ccuucuauuuauacucuuaaaaacc

SEQ ID NO: 959700 - RNA, 22 nt, Human
cggugcugcuccuccccugggc

SEQ ID NO: 959701 - RNA, 25 nt, Human
cucccuucuauuuauacucuuaaaa

SEQ ID NO: 959702 - RNA, 22 nt, Human
cugcuccuccccugggcgaucg

SEQ ID NO: 959703 - RNA, 24 nt, Human
cuucaaaauaagcaagcaauaaaa

SEQ ID NO: 959704 - RNA, 18 nt, Human
cuuuucuuuuccugacuu

SEQ ID NO: 959705 - RNA, 21 nt, Human
gacuggcuucccuuguggggc

SEQ ID NO: 959706 - RNA, 28 nt, Human
gacuggcuucccuuguggggcgccccgg

SEQ ID NO: 959707 - RNA, 21 nt, Human
gagaugaacuuaugucacugu

SEQ ID NO: 959708 - RNA, 20 nt, Human
gagcuaaaacgccaaccuug

SEQ ID NO: 959709 - RNA, 24 nt, Human
gaggcaagauagauaguuagguca

SEQ ID NO: 959710 - RNA, 20 nt, Human
gcaaguagaaugaauaucaa

SEQ ID NO: 959711 - RNA, 20 nt, Human
gcccacacucaggaacgacc

SEQ ID NO: 959712 - RNA, 18 nt, Human
gcccagccgacgcggggu

SEQ ID NO: 959713 - RNA, 18 nt, Human
gcgcccagccgacgcggg

SEQ ID NO: 959714 - RNA, 18 nt, Human
ggcauauggguuggggaa

SEQ ID NO: 959715 - RNA, 20 nt, Human
gggcaguuucgaggcaagau

SEQ ID NO: 959716 - RNA, 19 nt, Human
ggggaagauaaaauaaauu

SEQ ID NO: 959717 - RNA, 21 nt, Human
gguauuauaaagacagcuacu

SEQ ID NO: 959718 - RNA, 19 nt, Human
guaaaacaggaauaaucug

SEQ ID NO: 959719 - RNA, 18 nt, Human
guaguccagcuggugaaa

SEQ ID NO: 959720 - RNA, 21 nt, Human
gugaaagaucaacucauuuca

SEQ ID NO: 959721 - RNA, 23 nt, Human
guuucuuuucuuuuccugacuuc

SEQ ID NO: 959722 - RNA, 24 nt, Human
uaaaaaccacuauaaaaaagucag

SEQ ID NO: 959723 - RNA, 19 nt, Human
uaaaacaggaauaaucugc

SEQ ID NO: 959724 - RNA, 24 nt, Human
uaaaacucacacacaguuacacaa

SEQ ID NO: 959725 - RNA, 23 nt, Human
uaaaggaaauucauccuuuaggg

SEQ ID NO: 959726 - RNA, 19 nt, Human
uaaagucauaaauaauaaa

SEQ ID NO: 959727 - RNA, 24 nt, Human
uaagacucacgcagucuuucuaaa

SEQ ID NO: 959728 - RNA, 25 nt, Human
uaauauauacauuuucauggaagua

SEQ ID NO: 959729 - RNA, 21 nt, Human
uagcaucaauuuucuuuaugg

SEQ ID NO: 959730 - RNA, 21 nt, Human
uaggaaacaauccauacauga

SEQ ID NO: 959731 - RNA, 23 nt, Human
uaguccagcuggugaaagaucaa

SEQ ID NO: 959732 - RNA, 21 nt, Human
uaugcccuaaauguuaacaga

SEQ ID NO: 959733 - RNA, 21 nt, Human
uauucacugcaaucacaaacu

SEQ ID NO: 959734 - RNA, 25 nt, Human
ucacuguacgaucuuuccuaucauc

SEQ ID NO: 959735 - RNA, 22 nt, Human
ucaguuaaauaagcccauucca

SEQ ID NO: 959736 - RNA, 21 nt, Human
ucaugagaaggcaccugguuu

SEQ ID NO: 959737 - RNA, 21 nt, Human
ucauguaugaauuucagaccc

SEQ ID NO: 959738 - RNA, 24 nt, Human
ucauucauacacauauacacucuc

SEQ ID NO: 959739 - RNA, 26 nt, Human
uccacaaaauaacacaggcagucauu

SEQ ID NO: 959740 - RNA, 19 nt, Human
uccaccuacaaagaaggca

SEQ ID NO: 959741 - RNA, 20 nt, Human
uccagcaugaugaaugaggu

SEQ ID NO: 959742 - RNA, 19 nt, Human
ucccaaaguuagcuuggcc

SEQ ID NO: 959743 - RNA, 19 nt, Human
ucccagaacuaagaagaac

SEQ ID NO: 959744 - RNA, 19 nt, Human
ucccaguagaaaaaaaaau

SEQ ID NO: 959745 - RNA, 24 nt, Human
ucccggugcugcuccuccccuggg

SEQ ID NO: 959746 - RNA, 24 nt, Human
ucgggaggcugaggcaggagaauc

SEQ ID NO: 959747 - RNA, 22 nt, Human
ucugaaaugucaucuucuugca

SEQ ID NO: 959748 - RNA, 22 nt, Human
ucugcucuuucuccugcccccc

SEQ ID NO: 959749 - RNA, 18 nt, Human
ucuggccaagacgaagua

SEQ ID NO: 959750 - RNA, 20 nt, Human
ucuuuccaauucauaaauuc

SEQ ID NO: 959751 - RNA, 20 nt, Human
ugaaaucaaaauaaaaacca

SEQ ID NO: 959752 - RNA, 22 nt, Human
ugaaaucaaaauaaaaaccaac

SEQ ID NO: 959753 - RNA, 19 nt, Human
ugaggcaggagaaucguuu

SEQ ID NO: 959754 - RNA, 19 nt, Human
ugaguauagugaaaucaaa

SEQ ID NO: 959755 - RNA, 22 nt, Human
ugcucauucauacauauacaug

SEQ ID NO: 959756 - RNA, 19 nt, Human
uggcaaaaauagagagaag

SEQ ID NO: 959757 - RNA, 27 nt, Human
uguaaaacaggaauaaucugcuucuga

SEQ ID NO: 959758 - RNA, 23 nt, Human
ugucaucuucuugcaaagccauu

SEQ ID NO: 959759 - RNA, 21 nt, Human
ugugcguuuguguguacaggu

SEQ ID NO: 959760 - RNA, 24 nt, Human
uguucuuuccugacuguaugucug

SEQ ID NO: 959761 - RNA, 21 nt, Human
uguugcugguauaagguaacu

SEQ ID NO: 959762 - RNA, 21 nt, Human
uuagcagggaaguuugucuga

SEQ ID NO: 959763 - RNA, 23 nt, Human
uuauuuggaauaaaacugaacua

SEQ ID NO: 959764 - RNA, 23 nt, Human
uucacugagaaguguuuuuuuuu

SEQ ID NO: 959765 - RNA, 18 nt, Human
uuccauguucaaaaauga

SEQ ID NO: 959766 - RNA, 19 nt, Human
uuccauguucaaaaaugag

SEQ ID NO: 959767 - RNA, 23 nt, Human
uugcugguauaagguaacuaugc

SEQ ID NO: 959768 - RNA, 24 nt, Human
uugggcuguguuucagagaauaaa

SEQ ID NO: 959769 - RNA, 19 nt, Human
uuuucuauccccccaauau

SEQ ID NO: 959770 - RNA, 19 nt, Human
uuuuuagcagggaaguuug

SEQ ID NO: 959771 - RNA, 22 nt, Human
aaauucauuccuuauuuggaau

SEQ ID NO: 959772 - RNA, 25 nt, Human
aacauugucuuggcuuuuuuuuuuu

SEQ ID NO: 959773 - RNA, 18 nt, Human
aaggacacaugucuccuc

SEQ ID NO: 959774 - RNA, 21 nt, Human
aaguauguaauaaaaacauug

SEQ ID NO: 959775 - RNA, 20 nt, Human
aauacauaacuuggagacuu

SEQ ID NO: 959776 - RNA, 27 nt, Human
aauuauuuucuaauggaucuguucuau

SEQ ID NO: 959777 - RNA, 21 nt, Human
acaaaaggcuaauacauagua

SEQ ID NO: 959778 - RNA, 22 nt, Human
caaaauacaagaucagaaggua

SEQ ID NO: 959779 - RNA, 20 nt, Human
caaagaacccaaagaauucu

SEQ ID NO: 959780 - RNA, 21 nt, Human
caugucuccucucauacaaaa

SEQ ID NO: 959781 - RNA, 21 nt, Human
cuacuggaucacuuccaugau

SEQ ID NO: 959782 - RNA, 24 nt, Human
cucucauacaaaaacccuuuucau

SEQ ID NO: 959783 - RNA, 23 nt, Human
cuuuuuuuuuuuuaaagagacca

SEQ ID NO: 959784 - RNA, 20 nt, Human
gaguucuagcauaugcagau

SEQ ID NO: 959785 - RNA, 18 nt, Human
ggggaguccaggaggagg

SEQ ID NO: 959786 - RNA, 22 nt, Human
gguggggggaguccaggaggag

SEQ ID NO: 959787 - RNA, 18 nt, Human
gguguaagaauuggugga

SEQ ID NO: 959788 - RNA, 22 nt, Human
gucuccucucauacaaaaaccc

SEQ ID NO: 959789 - RNA, 22 nt, Human
uaaaacaaaguccucuaaguua

SEQ ID NO: 959790 - RNA, 22 nt, Human
uaacaggugggagacugggugg

SEQ ID NO: 959791 - RNA, 20 nt, Human
uaaguuuucagaccuauuca

SEQ ID NO: 959792 - RNA, 21 nt, Human
uacaaagaacccaaagaauuc

SEQ ID NO: 959793 - RNA, 21 nt, Human
uacaccauuaucauuaaaacc

SEQ ID NO: 959794 - RNA, 22 nt, Human
uacaccauuaucauuaaaaccc

SEQ ID NO: 959795 - RNA, 21 nt, Human
uacugggggccugagauucac

SEQ ID NO: 959796 - RNA, 22 nt, Human
uacuguaauagugcugcucaaa

SEQ ID NO: 959797 - RNA, 23 nt, Human
uagauaauacuaaugaaacacag

SEQ ID NO: 959798 - RNA, 23 nt, Human
uauguaauauuauaauacauaac

SEQ ID NO: 959799 - RNA, 24 nt, Human
uauucaguuuugaaaacauucauu

SEQ ID NO: 959800 - RNA, 22 nt, Human
ucaaaauacaagaucagaaggu

SEQ ID NO: 959801 - RNA, 25 nt, Human
ucaaaguagguacaggguaguggcc

SEQ ID NO: 959802 - RNA, 25 nt, Human
ucacaucuucuacaacuacuggauc

SEQ ID NO: 959803 - RNA, 19 nt, Human
ucaguuuugaaaacauuca

SEQ ID NO: 959804 - RNA, 23 nt, Human
uccaugaucaaaaggaccggggc

SEQ ID NO: 959805 - RNA, 29 nt, Human
uccucucauacaaaaacccuuuucaucag

SEQ ID NO: 959806 - RNA, 18 nt, Human
ugaaacacagguagaguu

SEQ ID NO: 959807 - RNA, 20 nt, Human
ugaaguaaaaugcaaacauc

SEQ ID NO: 959808 - RNA, 19 nt, Human
ugaguaggagcaauuacug

SEQ ID NO: 959809 - RNA, 21 nt, Human
ugcauaaggacucauguaaag

SEQ ID NO: 959810 - RNA, 25 nt, Human
ugcugggaaaggcagcauaccagga

SEQ ID NO: 959811 - RNA, 18 nt, Human
uggagguggggggagucc

SEQ ID NO: 959812 - RNA, 19 nt, Human
uggagguggggggagucca

SEQ ID NO: 959813 - RNA, 19 nt, Human
uggcauggguggucuuacg

SEQ ID NO: 959814 - RNA, 22 nt, Human
uggcggugguacugggggccug

SEQ ID NO: 959815 - RNA, 22 nt, Human
uggcuuuuuuuuuuuuuuuuuu

SEQ ID NO: 959816 - RNA, 25 nt, Human
ugggggccugagauucacagguggg

SEQ ID NO: 959817 - RNA, 22 nt, Human
uggggggaguccaggaggaggu

SEQ ID NO: 959818 - RNA, 24 nt, Human
uggggguguaagaauugguggagg

SEQ ID NO: 959819 - RNA, 27 nt, Human
uguaauagugcugcucaaaguagguac

SEQ ID NO: 959820 - RNA, 24 nt, Human
uucgguaguguuguuuccaugaug

SEQ ID NO: 959821 - RNA, 25 nt, Human
uuuggaauaaaacaaaguccucuaa

SEQ ID NO: 959822 - RNA, 22 nt, Human
uuugucauugcuuuucucuuuu

SEQ ID NO: 959823 - RNA, 21 nt, Human
uuuuugucauugcuuuucucu

SEQ ID NO: 959824 - RNA, 21 nt, Human
uuuuuugucauugcuuuucuc

SEQ ID NO: 959825 - RNA, 23 nt, Human
uuuuuuuuugucauugcuuuucu

SEQ ID NO: 959826 - RNA, 18 nt, Human
uuuuuuuuuuuuuuuuug

SEQ ID NO: 959827 - RNA, 21 nt, Human
uuuuuuuuuuuuuuuuuuguc

SEQ ID NO: 959828 - RNA, 21 nt, Human
aagccgcaaacgcuccggaau

SEQ ID NO: 959829 - RNA, 21 nt, Human
cagaucccaggaggggcggga

SEQ ID NO: 959830 - RNA, 22 nt, Human
cagcuccggcuccgggccgcug

SEQ ID NO: 959831 - RNA, 20 nt, Human
ccacagaucccaggaggggc

SEQ ID NO: 959832 - RNA, 22 nt, Human
cccacagaucccaggaggggcg

SEQ ID NO: 959833 - RNA, 22 nt, Human
ccccccacuggaugccgucucc

SEQ ID NO: 959834 - RNA, 21 nt, Human
ccgcugcgggcuccccagcuc

SEQ ID NO: 959835 - RNA, 25 nt, Human
cuccccagcuccccacagaucccag

SEQ ID NO: 959836 - RNA, 20 nt, Human
gcgaagccgcaaacgcuccu

SEQ ID NO: 959837 - RNA, 25 nt, Human
ggccaugaagcgaagccgcaaacgc

SEQ ID NO: 959838 - RNA, 19 nt, Human
ggcugagaggcucgccccc

SEQ ID NO: 959839 - RNA, 22 nt, Human
ucccaggaggggcgggagagcg

SEQ ID NO: 959840 - RNA, 22 nt, Human
uccccagcuccccacagauccc

SEQ ID NO: 959841 - RNA, 21 nt, Human
uccgcucggcucgccagcucc

SEQ ID NO: 959842 - RNA, 21 nt, Human
ugaagcgaagccgcaaacgcu

SEQ ID NO: 959843 - RNA, 19 nt, Human
aaaaagaacagaucuucag

SEQ ID NO: 959844 - RNA, 20 nt, Human
aaacacaaaugugguccaaa

SEQ ID NO: 959845 - RNA, 21 nt, Human
aaacacguguugcauguccuu

SEQ ID NO: 959846 - RNA, 27 nt, Human
aaacaguucuauaaacaucucugggca

SEQ ID NO: 959847 - RNA, 20 nt, Human
aaagaagcaggacuccuaca

SEQ ID NO: 959848 - RNA, 20 nt, Human
aaauaacaaauuuaggaagg

SEQ ID NO: 959849 - RNA, 22 nt, Human
aacacgaugcaaacugcauacu

SEQ ID NO: 959850 - RNA, 19 nt, Human
aaccucugaauccucagag

SEQ ID NO: 959851 - RNA, 23 nt, Human
aagaacccccccacccaaggcac

SEQ ID NO: 959852 - RNA, 23 nt, Human
aagaacccccccacccaaguuca

SEQ ID NO: 959853 - RNA, 18 nt, Human
aagauuccuucauuacuc

SEQ ID NO: 959854 - RNA, 21 nt, Human
aagcagcacagacgcgcuacu

SEQ ID NO: 959855 - RNA, 19 nt, Human
aagcgagcuggcagcuucc

SEQ ID NO: 959856 - RNA, 22 nt, Human
aagggccuguaccagauagagc

SEQ ID NO: 959857 - RNA, 24 nt, Human
aaugcaacagcaacccucucacac

SEQ ID NO: 959858 - RNA, 21 nt, Human
aauucauucacuaauggacaa

SEQ ID NO: 959859 - RNA, 18 nt, Human
aauugguacagaaacuac

SEQ ID NO: 959860 - RNA, 22 nt, Human
acaaagaagcaggacuccuaca

SEQ ID NO: 959861 - RNA, 21 nt, Human
acacacacgcaugaguccaca

SEQ ID NO: 959862 - RNA, 31 nt, Human
acacagcacaugcacacacacacacgcaugg

SEQ ID NO: 959863 - RNA, 30 nt, Human
acacaugcacacacacagcacaugcacaca

SEQ ID NO: 959864 - RNA, 21 nt, Human
acagaaaaauccugcucuaaa

SEQ ID NO: 959865 - RNA, 23 nt, Human
accccguccccccagcaccccca

SEQ ID NO: 959866 - RNA, 23 nt, Human
acccucucacaccugucuuguug

SEQ ID NO: 959867 - RNA, 19 nt, Human
acugcauacucaaaccaua

SEQ ID NO: 959868 - RNA, 24 nt, Human
agacauaauagagggagaaucaaa

SEQ ID NO: 959869 - RNA, 21 nt, Human
agagaaagagaaagagaaagc

SEQ ID NO: 959870 - RNA, 18 nt, Human
agagccccuccugagccc

SEQ ID NO: 959871 - RNA, 18 nt, Human
agagccccuccugagccc

SEQ ID NO: 959872 - RNA, 20 nt, Human
agcaaacacaaauguggucc

SEQ ID NO: 959873 - RNA, 21 nt, Human
agcacagacgcgcuacuaacc

SEQ ID NO: 959874 - RNA, 25 nt, Human
agcauuuucuuggcagcugucagca

SEQ ID NO: 959875 - RNA, 18 nt, Human
agccccuccugagccccc

SEQ ID NO: 959876 - RNA, 20 nt, Human
agcccuaccuacuaacccua

SEQ ID NO: 959877 - RNA, 20 nt, Human
agcccuaccuacuaacccua

SEQ ID NO: 959878 - RNA, 20 nt, Human
agcccuaccuacuaacccua

SEQ ID NO: 959879 - RNA, 20 nt, Human
agcccuaccuacuaacccua

SEQ ID NO: 959880 - RNA, 20 nt, Human
agcccuaccuacuaacccua

SEQ ID NO: 959881 - RNA, 20 nt, Human
agcccuaccuacuaacccua

SEQ ID NO: 959882 - RNA, 20 nt, Human
agcccuaccuacuaacccua

SEQ ID NO: 959883 - RNA, 20 nt, Human
agcccuaccuacuaacccua

SEQ ID NO: 959884 - RNA, 26 nt, Human
agcuacuaauaaaaccccauggacag

SEQ ID NO: 959885 - RNA, 19 nt, Human
agcuauuugcuaucuagag

SEQ ID NO: 959886 - RNA, 21 nt, Human
agcuauuugcuaucuagaggu

SEQ ID NO: 959887 - RNA, 18 nt, Human
aggaggggcggccguccc

SEQ ID NO: 959888 - RNA, 23 nt, Human
aggcagcuugggggaagcgagcu

SEQ ID NO: 959889 - RNA, 22 nt, Human
aggcaggugaucacagcacagg

SEQ ID NO: 959890 - RNA, 23 nt, Human
agggggaaggggcgcggcgacgg

SEQ ID NO: 959891 - RNA, 18 nt, Human
agggggcaggggauggcu

SEQ ID NO: 959892 - RNA, 20 nt, Human
agguaguuuugggaucaaac

SEQ ID NO: 959893 - RNA, 21 nt, Human
augcacacaugcacacacaca

SEQ ID NO: 959894 - RNA, 20 nt, Human
augccacacgccacccugaa

SEQ ID NO: 959895 - RNA, 21 nt, Human
auggcagcauuuuccuggagu

SEQ ID NO: 959896 - RNA, 20 nt, Human
augucacaggaauucauuca

SEQ ID NO: 959897 - RNA, 21 nt, Human
caaaaucgccaucugagacac

SEQ ID NO: 959898 - RNA, 22 nt, Human
caaacauacaaaacugaauauc

SEQ ID NO: 959899 - RNA, 23 nt, Human
caaccucugaauccucagaggau

SEQ ID NO: 959900 - RNA, 24 nt, Human
caaugcaacagcaacccucucaca

SEQ ID NO: 959901 - RNA, 25 nt, Human
cacacacagcacaugcacacacaca

SEQ ID NO: 959902 - RNA, 19 nt, Human
cacagaccaucuugacugg

SEQ ID NO: 959903 - RNA, 23 nt, Human
cacccacacagugccuucagagc

SEQ ID NO: 959904 - RNA, 22 nt, Human
caccccguccccccagcacccc

SEQ ID NO: 959905 - RNA, 27 nt, Human
cacucaccccguccccccagcaccccc

SEQ ID NO: 959906 - RNA, 19 nt, Human
cagaguuaaaacuaccugc

SEQ ID NO: 959907 - RNA, 22 nt, Human
cagcaacccucucacaccuguc

SEQ ID NO: 959908 - RNA, 21 nt, Human
cagcagcguuuuaaaagagug

SEQ ID NO: 959909 - RNA, 22 nt, Human
cagccacuagggcugacccgac

SEQ ID NO: 959910 - RNA, 18 nt, Human
caggcuuuaaaaucagga

SEQ ID NO: 959911 - RNA, 23 nt, Human
caugaaaaacacggccucugcug

SEQ ID NO: 959912 - RNA, 21 nt, Human
caugcacacacacagcacaug

SEQ ID NO: 959913 - RNA, 22 nt, Human
ccacacagcucuccagucacgc

SEQ ID NO: 959914 - RNA, 21 nt, Human
cccacacagugccuucagagc

SEQ ID NO: 959915 - RNA, 27 nt, Human
ccccaccgucaugcacacaugcacaca

SEQ ID NO: 959916 - RNA, 18 nt, Human
ccccagcacccccaccgu

SEQ ID NO: 959917 - RNA, 23 nt, Human
ccccagcacccccaccgucaugc

SEQ ID NO: 959918 - RNA, 19 nt, Human
cccccacccaaguucacau

SEQ ID NO: 959919 - RNA, 22 nt, Human
cccccagcacccccaccgucau

SEQ ID NO: 959920 - RNA, 22 nt, Human
ccccguccccccagcaccccca

SEQ ID NO: 959921 - RNA, 20 nt, Human
cccuaccuacgaacccuacc

SEQ ID NO: 959922 - RNA, 20 nt, Human
cccuaccuacgaacccuacc

SEQ ID NO: 959923 - RNA, 20 nt, Human
cccuaccuacgaacccuacc

SEQ ID NO: 959924 - RNA, 20 nt, Human
cccuaccuacgaacccuacc

SEQ ID NO: 959925 - RNA, 20 nt, Human
cccuaccuacgaacccuacc

SEQ ID NO: 959926 - RNA, 20 nt, Human
cccuaccuacgaacccuacc

SEQ ID NO: 959927 - RNA, 20 nt, Human
cccuaccuacgaacccuacc

SEQ ID NO: 959928 - RNA, 20 nt, Human
cccuaccuacgaacccuacc

SEQ ID NO: 959929 - RNA, 20 nt, Human
cccuaccuacgaacccuacc

SEQ ID NO: 959930 - RNA, 20 nt, Human
cccuaccuacgaacccuacc

SEQ ID NO: 959931 - RNA, 22 nt, Human
cccuaccuacuaacccuaccua

SEQ ID NO: 959932 - RNA, 22 nt, Human
cccuaccuacuaacccuaccua

SEQ ID NO: 959933 - RNA, 22 nt, Human
cccuaccuacuaacccuaccua

SEQ ID NO: 959934 - RNA, 22 nt, Human
cccuaccuacuaacccuaccua

SEQ ID NO: 959935 - RNA, 22 nt, Human
cccuaccuacuaacccuaccua

SEQ ID NO: 959936 - RNA, 22 nt, Human
cccuaccuacuaacccuaccua

SEQ ID NO: 959937 - RNA, 22 nt, Human
cccuaccuacuaacccuaccua

SEQ ID NO: 959938 - RNA, 22 nt, Human
cccuaccuacuaacccuaccua

SEQ ID NO: 959939 - RNA, 22 nt, Human
cccuaccuacuaacccuaccua

SEQ ID NO: 959940 - RNA, 22 nt, Human
cccuaccuacuaacccuaccua

SEQ ID NO: 959941 - RNA, 24 nt, Human
cccuccugagcccccggccccacu

SEQ ID NO: 959942 - RNA, 18 nt, Human
ccguccccucugcacacu

SEQ ID NO: 959943 - RNA, 19 nt, Human
ccuaccgcgcuuuccggaa

SEQ ID NO: 959944 - RNA, 19 nt, Human
ccuaccuacgaacccuacc

SEQ ID NO: 959945 - RNA, 19 nt, Human
ccuaccuacgaacccuacc

SEQ ID NO: 959946 - RNA, 19 nt, Human
ccuaccuacgaacccuacc

SEQ ID NO: 959947 - RNA, 19 nt, Human
ccuaccuacgaacccuacc

SEQ ID NO: 959948 - RNA, 19 nt, Human
ccuaccuacgaacccuacc

SEQ ID NO: 959949 - RNA, 19 nt, Human
ccuaccuacgaacccuacc

SEQ ID NO: 959950 - RNA, 19 nt, Human
ccuaccuacgaacccuacc

SEQ ID NO: 959951 - RNA, 19 nt, Human
ccuaccuacgaacccuacc

SEQ ID NO: 959952 - RNA, 19 nt, Human
ccuaccuacgaacccuacc

SEQ ID NO: 959953 - RNA, 19 nt, Human
ccuaccuacgaacccuacc

SEQ ID NO: 959954 - RNA, 27 nt, Human
ccuacgaacccuaccgcgcuuuccgga

SEQ ID NO: 959955 - RNA, 21 nt, Human
ccuacgaacccuaccuacgaa

SEQ ID NO: 959956 - RNA, 21 nt, Human
ccuacgaacccuaccuacgaa

SEQ ID NO: 959957 - RNA, 25 nt, Human
ccuacgaacccuaccuacgaacccu

SEQ ID NO: 959958 - RNA, 25 nt, Human
ccuacgaacccuaccuacgaacccu

SEQ ID NO: 959959 - RNA, 25 nt, Human
ccucaagggcuggcccuaaguccac

SEQ ID NO: 959960 - RNA, 18 nt, Human
cgggaagaacccccccac

SEQ ID NO: 959961 - RNA, 21 nt, Human
cgggaagaacccccccaccca

SEQ ID NO: 959962 - RNA, 21 nt, Human
cgggccugggacacggggugg

SEQ ID NO: 959963 - RNA, 19 nt, Human
cggucccucccccgcccuc

SEQ ID NO: 959964 - RNA, 26 nt, Human
cgucaugcacacaugcacacacacag

SEQ ID NO: 959965 - RNA, 23 nt, Human
cuaacccuaccuaccagcccuac

SEQ ID NO: 959966 - RNA, 23 nt, Human
cuaacccuaccuaccagcccuac

SEQ ID NO: 959967 - RNA, 23 nt, Human
cuaacccuaccuaccagcccuac

SEQ ID NO: 959968 - RNA, 23 nt, Human
cuaacccuaccuaccagcccuac

SEQ ID NO: 959969 - RNA, 18 nt, Human
cuaccuacuaacccuacc

SEQ ID NO: 959970 - RNA, 18 nt, Human
cuaccuacuaacccuacc

SEQ ID NO: 959971 - RNA, 19 nt, Human
cucaaaccauagcugcccc

SEQ ID NO: 959972 - RNA, 20 nt, Human
cucccccgcccuccugaucc

SEQ ID NO: 959973 - RNA, 18 nt, Human
cuggaacugucugggcuc

SEQ ID NO: 959974 - RNA, 24 nt, Human
cuggagucaccaggagucccugag

SEQ ID NO: 959975 - RNA, 22 nt, Human
gaaaaacacggccucugcugca

SEQ ID NO: 959976 - RNA, 19 nt, Human
gaacccuaccgcgcuuucc

SEQ ID NO: 959977 - RNA, 21 nt, Human
gaacccuaccuacuaacccua

SEQ ID NO: 959978 - RNA, 21 nt, Human
gaacccuaccuacuaacccua

SEQ ID NO: 959979 - RNA, 21 nt, Human
gaacccuaccuacuaacccua

SEQ ID NO: 959980 - RNA, 21 nt, Human
gaacccuaccuacuaacccua

SEQ ID NO: 959981 - RNA, 20 nt, Human
gagaaagagaaagagaaagg

SEQ ID NO: 959982 - RNA, 23 nt, Human
gagccuccagagggcacagagga

SEQ ID NO: 959983 - RNA, 21 nt, Human
gagcggagcugagacggcaca

SEQ ID NO: 959984 - RNA, 22 nt, Human
gaggcagcuugggggaagcgag

SEQ ID NO: 959985 - RNA, 20 nt, Human
gaggggccaucucuggagga

SEQ ID NO: 959986 - RNA, 21 nt, Human
gcaacagcaacccucucacac

SEQ ID NO: 959987 - RNA, 22 nt, Human
gcaacccucucacaccugucuu

SEQ ID NO: 959988 - RNA, 19 nt, Human
gcacacacacagcacaugc

SEQ ID NO: 959989 - RNA, 22 nt, Human
gcacaugcacacacacacacgg

SEQ ID NO: 959990 - RNA, 18 nt, Human
gcagcacccacacagugc

SEQ ID NO: 959991 - RNA, 18 nt, Human
gcagcugcuguccgagga

SEQ ID NO: 959992 - RNA, 19 nt, Human
gcagcuugggggaagcgag

SEQ ID NO: 959993 - RNA, 18 nt, Human
gccaugaggcagcuuggg

SEQ ID NO: 959994 - RNA, 22 nt, Human
gccccacugcagacagugggug

SEQ ID NO: 959995 - RNA, 23 nt, Human
gcuacuaauaaaaccccauggac

SEQ ID NO: 959996 - RNA, 23 nt, Human
gcucggucccucccccgcccucc

SEQ ID NO: 959997 - RNA, 24 nt, Human
ggaggaugucacaggaauucauuc

SEQ ID NO: 959998 - RNA, 24 nt, Human
ggagggggccggggaggcgggagg

SEQ ID NO: 959999 - RNA, 20 nt, Human
ggcaaacaaaucccauauuc

SEQ ID NO: 960000 - RNA, 23 nt, Human
gggaaaugacagcagcguuuuaa

SEQ ID NO: 960001 - RNA, 19 nt, Human
gggacacgggguggcgagg

SEQ ID NO: 960002 - RNA, 20 nt, Human
gggccggggaggcgggaggg

SEQ ID NO: 960003 - RNA, 18 nt, Human
ggggagggggccggggag

SEQ ID NO: 960004 - RNA, 18 nt, Human
gggggccgugaggcggcg

SEQ ID NO: 960005 - RNA, 20 nt, Human
gggugggcgggugcagcugc

SEQ ID NO: 960006 - RNA, 24 nt, Human
gguagaaacacgaugcaaacugca

SEQ ID NO: 960007 - RNA, 18 nt, Human
gguuccggggagggggcc

SEQ ID NO: 960008 - RNA, 21 nt, Human
gucaugugcuuugagcucuuc

SEQ ID NO: 960009 - RNA, 19 nt, Human
gugggugugucuggcccug

SEQ ID NO: 960010 - RNA, 23 nt, Human
gugguccaaaggcaggugaucac

SEQ ID NO: 960011 - RNA, 22 nt, Human
uaaaaccccauggacaguguca

SEQ ID NO: 960012 - RNA, 21 nt, Human
uaaaaggcaaacaaaucccau

SEQ ID NO: 960013 - RNA, 18 nt, Human
uaagagcaaacacaaaug

SEQ ID NO: 960014 - RNA, 21 nt, Human
uaagagcaaacacaaaugugg

SEQ ID NO: 960015 - RNA, 25 nt, Human
uacaugccacacgccacccugaagu

SEQ ID NO: 960016 - RNA, 20 nt, Human
uacuaagaaaugggaaauga

SEQ ID NO: 960017 - RNA, 18 nt, Human
ucaaacaguucuauaaac

SEQ ID NO: 960018 - RNA, 20 nt, Human
ucaaacuaaguuuccacuca

SEQ ID NO: 960019 - RNA, 22 nt, Human
ucagccugggagggggcagggg

SEQ ID NO: 960020 - RNA, 21 nt, Human
uccacagaccaucuugacugg

SEQ ID NO: 960021 - RNA, 19 nt, Human
uccacucguccgcgaccgu

SEQ ID NO: 960022 - RNA, 23 nt, Human
uccccuaugcaacuucuggacag

SEQ ID NO: 960023 - RNA, 22 nt, Human
uccgcaggcaaccucugaaucc

SEQ ID NO: 960024 - RNA, 21 nt, Human
uccggggagggggccggggag

SEQ ID NO: 960025 - RNA, 21 nt, Human
ucuaaaaaguaucaaaaagau

SEQ ID NO: 960026 - RNA, 22 nt, Human
ucuauaaacaucucugggcaca

SEQ ID NO: 960027 - RNA, 19 nt, Human
ucucuggaggaugucacag

SEQ ID NO: 960028 - RNA, 22 nt, Human
ugaaguggaugcgagagcugcu

SEQ ID NO: 960029 - RNA, 22 nt, Human
ugacagccgcgugggguuuggc

SEQ ID NO: 960030 - RNA, 18 nt, Human
ugacugcaggugagaggg

SEQ ID NO: 960031 - RNA, 24 nt, Human
ugagaccacgucaauccuuuaauu

SEQ ID NO: 960032 - RNA, 23 nt, Human
ugagagcuauuugcuaucuagag

SEQ ID NO: 960033 - RNA, 18 nt, Human
ugagaggggcgacgcacg

SEQ ID NO: 960034 - RNA, 22 nt, Human
ugagcccccggccccacugcag

SEQ ID NO: 960035 - RNA, 20 nt, Human
ugaggaggggccaucucugg

SEQ ID NO: 960036 - RNA, 23 nt, Human
ugaggaggggccaucucuggagg

SEQ ID NO: 960037 - RNA, 23 nt, Human
ugaggcggcgugcgggccaugag

SEQ ID NO: 960038 - RNA, 19 nt, Human
ugagguaauauguuuacaa

SEQ ID NO: 960039 - RNA, 21 nt, Human
ugauaacaauaaaaaaaucuu

SEQ ID NO: 960040 - RNA, 20 nt, Human
ugauuugcuucugugaagau

SEQ ID NO: 960041 - RNA, 23 nt, Human
ugauuugcuucugugaagauucc

SEQ ID NO: 960042 - RNA, 22 nt, Human
ugcaacagcaacccucucacac

SEQ ID NO: 960043 - RNA, 26 nt, Human
ugcacacacacacacgcaugagucca

SEQ ID NO: 960044 - RNA, 26 nt, Human
ugcacacacacagcacaugcacacac

SEQ ID NO: 960045 - RNA, 19 nt, Human
ugccacacgccacccugaa

SEQ ID NO: 960046 - RNA, 19 nt, Human
ugccccagaauucccuuac

SEQ ID NO: 960047 - RNA, 23 nt, Human
ugccccagaauucccuuacaagg

SEQ ID NO: 960048 - RNA, 21 nt, Human
ugcugcacacagaaacacgug

SEQ ID NO: 960049 - RNA, 19 nt, Human
uggcaagguacuaaaggua

SEQ ID NO: 960050 - RNA, 20 nt, Human
uggcccuaaguccacagacc

SEQ ID NO: 960051 - RNA, 26 nt, Human
uggcgggaagcaugggggccgugagg

SEQ ID NO: 960052 - RNA, 19 nt, Human
ugggagggggcaggggaug

SEQ ID NO: 960053 - RNA, 24 nt, Human
ugggagggggcaggggauggcugc

SEQ ID NO: 960054 - RNA, 20 nt, Human
ugggugggcgggugcagcug

SEQ ID NO: 960055 - RNA, 23 nt, Human
uggguggugugggugugucuggc

SEQ ID NO: 960056 - RNA, 18 nt, Human
uggugagaggauauucaa

SEQ ID NO: 960057 - RNA, 21 nt, Human
uguaaaaggcaaacaaauccc

SEQ ID NO: 960058 - RNA, 19 nt, Human
uguacaaagaagcaggacu

SEQ ID NO: 960059 - RNA, 20 nt, Human
ugucagaaaggccgggccug

SEQ ID NO: 960060 - RNA, 20 nt, Human
uguccgaggaggggcggccg

SEQ ID NO: 960061 - RNA, 19 nt, Human
uguugagugaagcauuuuc

SEQ ID NO: 960062 - RNA, 21 nt, Human
uguugagugaagcauuuucuu

SEQ ID NO: 960063 - RNA, 23 nt, Human
uuacucaaacuaaguuuccacuc

SEQ ID NO: 960064 - RNA, 20 nt, Human
uuaguacuaagaaaugggaa

SEQ ID NO: 960065 - RNA, 18 nt, Human
uucacauuuauuauugau

SEQ ID NO: 960066 - RNA, 19 nt, Human
uucauucacuaauggacaa

SEQ ID NO: 960067 - RNA, 22 nt, Human
uuccacucaccccgucccccca

SEQ ID NO: 960068 - RNA, 23 nt, Human
aaaagccaaaagcuaccccagcc

SEQ ID NO: 960069 - RNA, 21 nt, Human
aaaggaucccgagaggcggag

SEQ ID NO: 960070 - RNA, 26 nt, Human
aacucuagcaaccagcuacccugcua

SEQ ID NO: 960071 - RNA, 22 nt, Human
aagggcacuggacgaucugcuu

SEQ ID NO: 960072 - RNA, 21 nt, Human
acccgaagucccaggaagcuc

SEQ ID NO: 960073 - RNA, 23 nt, Human
acccggaguaaagucccagccuu

SEQ ID NO: 960074 - RNA, 22 nt, Human
accugaacucccugcacgcguu

SEQ ID NO: 960075 - RNA, 18 nt, Human
acucccacccccaaccuc

SEQ ID NO: 960076 - RNA, 21 nt, Human
acucccacccccaaccucccu

SEQ ID NO: 960077 - RNA, 20 nt, Human
acugagggggccaggccugc

SEQ ID NO: 960078 - RNA, 23 nt, Human
agcguuguaaacccaggccggga

SEQ ID NO: 960079 - RNA, 19 nt, Human
aggaagcucugagucacug

SEQ ID NO: 960080 - RNA, 18 nt, Human
auggagaacagcgggugg

SEQ ID NO: 960081 - RNA, 20 nt, Human
cacccccaaccucccuggcc

SEQ ID NO: 960082 - RNA, 21 nt, Human
cacccccaaccucccuggccc

SEQ ID NO: 960083 - RNA, 26 nt, Human
cacccggaguaaagucccagccuuuu

SEQ ID NO: 960084 - RNA, 19 nt, Human
caccgcgggacacucagac

SEQ ID NO: 960085 - RNA, 24 nt, Human
cacugcagucgcucuuccucugcc

SEQ ID NO: 960086 - RNA, 22 nt, Human
cagccucggccccuuccggucc

SEQ ID NO: 960087 - RNA, 18 nt, Human
cagcuccuggggacuccu

SEQ ID NO: 960088 - RNA, 21 nt, Human
caggacagacagauccuauca

SEQ ID NO: 960089 - RNA, 24 nt, Human
ccagccccuagucugcgagacgcc

SEQ ID NO: 960090 - RNA, 25 nt, Human
cccaaucuuucacccuuuucuaauu

SEQ ID NO: 960091 - RNA, 21 nt, Human
cccacccccaaccucccuggc

SEQ ID NO: 960092 - RNA, 21 nt, Human
cccaccguaacucuagcaacc

SEQ ID NO: 960093 - RNA, 23 nt, Human
ccccaaccucccuggcccucccu

SEQ ID NO: 960094 - RNA, 19 nt, Human
ccccaccguaacucuagca

SEQ ID NO: 960095 - RNA, 18 nt, Human
ccccagccucagugcuaa

SEQ ID NO: 960096 - RNA, 24 nt, Human
ccccagccucagugcuaaaauguu

SEQ ID NO: 960097 - RNA, 26 nt, Human
cccccaaccucccuggcccucccugc

SEQ ID NO: 960098 - RNA, 18 nt, Human
cccccagccccuagucug

SEQ ID NO: 960099 - RNA, 21 nt, Human
ccccccgccacccccagcuuc

SEQ ID NO: 960100 - RNA, 23 nt, Human
ccccgccacccccagcuucgcug

SEQ ID NO: 960101 - RNA, 22 nt, Human
cccugagcucccucagcuucgc

SEQ ID NO: 960102 - RNA, 20 nt, Human
cccugugguacaugcccccc

SEQ ID NO: 960103 - RNA, 18 nt, Human
ccgccacccccagcuucg

SEQ ID NO: 960104 - RNA, 23 nt, Human
ccuccagcccaguuucuuugggc

SEQ ID NO: 960105 - RNA, 18 nt, Human
ccucccacagagauggga

SEQ ID NO: 960106 - RNA, 25 nt, Human
ccucgccgccacccggaguaaaguc

SEQ ID NO: 960107 - RNA, 19 nt, Human
ccucugccuaacugaaaug

SEQ ID NO: 960108 - RNA, 20 nt, Human
ccugcagcugcgaucccugu

SEQ ID NO: 960109 - RNA, 28 nt, Human
ccuggccuuugcccugagcucccucagc

SEQ ID NO: 960110 - RNA, 23 nt, Human
cgaaaaugacugcuacaaggggu

SEQ ID NO: 960111 - RNA, 20 nt, Human
cgcccccagccccuagucug

SEQ ID NO: 960112 - RNA, 24 nt, Human
cgcggagcuggcagccaagccccg

SEQ ID NO: 960113 - RNA, 25 nt, Human
cggaguaaagucccagccuuuugcc

SEQ ID NO: 960114 - RNA, 25 nt, Human
cgggacacucagacuggcaaacacc

SEQ ID NO: 960115 - RNA, 23 nt, Human
cuccagcccaguuucuuugggcu

SEQ ID NO: 960116 - RNA, 25 nt, Human
cucccacccccaaccucccuggccc

SEQ ID NO: 960117 - RNA, 24 nt, Human
cuccccggcagcugacuucccuga

SEQ ID NO: 960118 - RNA, 20 nt, Human
cuccuggggacuccuuaggu

SEQ ID NO: 960119 - RNA, 18 nt, Human
cugaaaugaaagcuccug

SEQ ID NO: 960120 - RNA, 18 nt, Human
cuggacaggugaaguugg

SEQ ID NO: 960121 - RNA, 23 nt, Human
cuguggccgcccccagccccuag

SEQ ID NO: 960122 - RNA, 19 nt, Human
cuuugcccugagcucccuc

SEQ ID NO: 960123 - RNA, 23 nt, Human
gaaaagccaaaagcuaccccaga

SEQ ID NO: 960124 - RNA, 22 nt, Human
gacugcuacaagggguagaaau

SEQ ID NO: 960125 - RNA, 27 nt, Human
gagaacagcggguggguaccgguaccc

SEQ ID NO: 960126 - RNA, 20 nt, Human
gcacugaaaagggcacugga

SEQ ID NO: 960127 - RNA, 18 nt, Human
gcacuggacgaucugcuu

SEQ ID NO: 960128 - RNA, 24 nt, Human
gccuuuugcccgggccgcggagcc

SEQ ID NO: 960129 - RNA, 23 nt, Human
gcugcucucuugaucccacuuag

SEQ ID NO: 960130 - RNA, 19 nt, Human
ggacacucagacuggcaaa

SEQ ID NO: 960131 - RNA, 24 nt, Human
ggagaggccagccugucuaccgag

SEQ ID NO: 960132 - RNA, 18 nt, Human
ggccgcggagcuggcagc

SEQ ID NO: 960133 - RNA, 18 nt, Human
gggaggcggcgggugcgg

SEQ ID NO: 960134 - RNA, 24 nt, Human
gggccggggccuggcucugaggga

SEQ ID NO: 960135 - RNA, 27 nt, Human
gggcggccuccugccuggggggccucc

SEQ ID NO: 960136 - RNA, 18 nt, Human
ggggaugggguuuggggg

SEQ ID NO: 960137 - RNA, 19 nt, Human
ggggaugggguuugggggc

SEQ ID NO: 960138 - RNA, 19 nt, Human
gggucauuucccuggcgcu

SEQ ID NO: 960139 - RNA, 24 nt, Human
gugguacaugccccccgccacccc

SEQ ID NO: 960140 - RNA, 20 nt, Human
guuugggggcgggaggcggc

SEQ ID NO: 960141 - RNA, 19 nt, Human
uaccccagccucagugcua

SEQ ID NO: 960142 - RNA, 23 nt, Human
uaccccagccucagugcuaaaau

SEQ ID NO: 960143 - RNA, 20 nt, Human
uagcauucacucccaccccc

SEQ ID NO: 960144 - RNA, 19 nt, Human
ucacucccacccccaaccu

SEQ ID NO: 960145 - RNA, 18 nt, Human
ucauuuaggagcaaguuu

SEQ ID NO: 960146 - RNA, 19 nt, Human
ucccacccccaaccucccu

SEQ ID NO: 960147 - RNA, 19 nt, Human
ucccaggaagcucugaguc

SEQ ID NO: 960148 - RNA, 20 nt, Human
ucccugcagcugcgaucccu

SEQ ID NO: 960149 - RNA, 21 nt, Human
ucccugcagcugcgaucccug

SEQ ID NO: 960150 - RNA, 21 nt, Human
ucgcugucccuggacagguga

SEQ ID NO: 960151 - RNA, 22 nt, Human
ucggccccuuccgguccgcgcu

SEQ ID NO: 960152 - RNA, 18 nt, Human
ugagaccugggaaaagcc

SEQ ID NO: 960153 - RNA, 22 nt, Human
ugagcguucuggcagaggcccg

SEQ ID NO: 960154 - RNA, 18 nt, Human
ugauggagcacagacucg

SEQ ID NO: 960155 - RNA, 23 nt, Human
ugcccugagcucccucagcuucg

SEQ ID NO: 960156 - RNA, 19 nt, Human
ugccuaacugaaaugaaag

SEQ ID NO: 960157 - RNA, 21 nt, Human
uggcagccaagccccgccucu

SEQ ID NO: 960158 - RNA, 18 nt, Human
uggccagccagcuccugg

SEQ ID NO: 960159 - RNA, 24 nt, Human
ugggaaaagccaaaagcuacccca

SEQ ID NO: 960160 - RNA, 21 nt, Human
ugggacugcuuaguaagaccu

SEQ ID NO: 960161 - RNA, 20 nt, Human
ugggauugggguaagggcug

SEQ ID NO: 960162 - RNA, 23 nt, Human
ugggauugggguaagggcugugg

SEQ ID NO: 960163 - RNA, 20 nt, Human
ugucccuggacaggugaagu

SEQ ID NO: 960164 - RNA, 21 nt, Human
uucccauguucucuaaagccc

SEQ ID NO: 960165 - RNA, 24 nt, Human
uugucucgggguugcucacaugga

SEQ ID NO: 960166 - RNA, 22 nt, Human
uuugcccgggccgcggagcugg

SEQ ID NO: 960167 - RNA, 18 nt, Human
uuugggcggccuccugcc

SEQ ID NO: 960168 - RNA, 21 nt, Human
aaaacacugggaauugacuug

SEQ ID NO: 960169 - RNA, 20 nt, Human
aaaauuacuuucuuaaaaca

SEQ ID NO: 960170 - RNA, 26 nt, Human
aaacaaaguacacuacaacugcaacc

SEQ ID NO: 960171 - RNA, 23 nt, Human
aaacauguagaaaaaacauauua

SEQ ID NO: 960172 - RNA, 21 nt, Human
aaaccacaacccaccugccca

SEQ ID NO: 960173 - RNA, 19 nt, Human
aaacugcagagaggacaaa

SEQ ID NO: 960174 - RNA, 20 nt, Human
aacauucagaucacauagga

SEQ ID NO: 960175 - RNA, 21 nt, Human
aagaaaacagagaaaacauag

SEQ ID NO: 960176 - RNA, 20 nt, Human
aagaaauaacgaauauauuu

SEQ ID NO: 960177 - RNA, 18 nt, Human
aagacaugcauggcucau

SEQ ID NO: 960178 - RNA, 20 nt, Human
aagcagacauaauaccagga

SEQ ID NO: 960179 - RNA, 25 nt, Human
aagcagacauaauaccaggaaccau

SEQ ID NO: 960180 - RNA, 23 nt, Human
aagggcaacagacugagaaucuu

SEQ ID NO: 960181 - RNA, 19 nt, Human
aaggucaaugaaaaaauga

SEQ ID NO: 960182 - RNA, 27 nt, Human
aaguagccucuacauaucauuaaaggu

SEQ ID NO: 960183 - RNA, 25 nt, Human
acaaaguacacuacaacugcaaccc

SEQ ID NO: 960184 - RNA, 26 nt, Human
acaaaguacacuacaacugcaacccc

SEQ ID NO: 960185 - RNA, 26 nt, Human
acagacaggaccauaucacugaaaac

SEQ ID NO: 960186 - RNA, 18 nt, Human
acagagaaaacauagaca

SEQ ID NO: 960187 - RNA, 18 nt, Human
accauuuucagaugaaaa

SEQ ID NO: 960188 - RNA, 23 nt, Human
acccaauuccuguugucaaugag

SEQ ID NO: 960189 - RNA, 21 nt, Human
accuuuucccugccccacaau

SEQ ID NO: 960190 - RNA, 19 nt, Human
acuacaacugcaacccaau

SEQ ID NO: 960191 - RNA, 19 nt, Human
acugaauucuaaagcuaaa

SEQ ID NO: 960192 - RNA, 22 nt, Human
agaaaaaacauauuaaaaggca

SEQ ID NO: 960193 - RNA, 22 nt, Human
agaacugugagaaacaaauuuc

SEQ ID NO: 960194 - RNA, 21 nt, Human
agacugguagcuuauaaacaa

SEQ ID NO: 960195 - RNA, 20 nt, Human
aggaacaacuaggagaggaa

SEQ ID NO: 960196 - RNA, 20 nt, Human
aggcuccacagccgccccag

SEQ ID NO: 960197 - RNA, 23 nt, Human
aggcuccacagccgccccagccu

SEQ ID NO: 960198 - RNA, 19 nt, Human
auaauugugagauuaacuc

SEQ ID NO: 960199 - RNA, 20 nt, Human
auacuggguacugcuaaguc

SEQ ID NO: 960200 - RNA, 22 nt, Human
auaguccucuuuggugcuaaaa

SEQ ID NO: 960201 - RNA, 23 nt, Human
augaauaucacauuauaugaaua

SEQ ID NO: 960202 - RNA, 22 nt, Human
augcuuaagaaaacagagaaaa

SEQ ID NO: 960203 - RNA, 19 nt, Human
caacagacuagagugccac

SEQ ID NO: 960204 - RNA, 25 nt, Human
caacagacugagaaucuuaaaacca

SEQ ID NO: 960205 - RNA, 21 nt, Human
caaccgaaaaauauuagaaac

SEQ ID NO: 960206 - RNA, 20 nt, Human
caagaaacuguaucucccuc

SEQ ID NO: 960207 - RNA, 20 nt, Human
cacauuuuaagggguuucug

SEQ ID NO: 960208 - RNA, 24 nt, Human
cacuaaauuucaaauagauguucu

SEQ ID NO: 960209 - RNA, 22 nt, Human
cagaauaauguaacaaaauccc

SEQ ID NO: 960210 - RNA, 19 nt, Human
cagaucacauaggagcuga

SEQ ID NO: 960211 - RNA, 25 nt, Human
cagaugaaaaaaaugcaaaggucaa

SEQ ID NO: 960212 - RNA, 23 nt, Human
cagcgcguccccuccgucggcuc

SEQ ID NO: 960213 - RNA, 23 nt, Human
caggaccauaucacugaaaacca

SEQ ID NO: 960214 - RNA, 25 nt, Human
caucaaagaauuucaguuuauauaa

SEQ ID NO: 960215 - RNA, 27 nt, Human
caucaggugcugugaagcaaugaagac

SEQ ID NO: 960216 - RNA, 22 nt, Human
caucauaaucuaucaccuccca

SEQ ID NO: 960217 - RNA, 18 nt, Human
cauggccacaaggaacaa

SEQ ID NO: 960218 - RNA, 22 nt, Human
ccacaguuagagguuugaggac

SEQ ID NO: 960219 - RNA, 22 nt, Human
ccauagacugguagcuuauaaa

SEQ ID NO: 960220 - RNA, 23 nt, Human
ccauccuugcauuucuggaauaa

SEQ ID NO: 960221 - RNA, 19 nt, Human
cccaccacaggcuccacag

SEQ ID NO: 960222 - RNA, 22 nt, Human
cccaccacaggcuccacagccg

SEQ ID NO: 960223 - RNA, 21 nt, Human
ccccgcagcgcguccccuccg

SEQ ID NO: 960224 - RNA, 20 nt, Human
ccccguauccucacauggcc

SEQ ID NO: 960225 - RNA, 21 nt, Human
ccuacuccucgcuauacaaaa

SEQ ID NO: 960226 - RNA, 18 nt, Human
ccuggauguaauaaaaug

SEQ ID NO: 960227 - RNA, 24 nt, Human
cgccccagccucuggcuacccgcu

SEQ ID NO: 960228 - RNA, 21 nt, Human
cggcucaccuuuucccugccc

SEQ ID NO: 960229 - RNA, 19 nt, Human
cuaccaacaagggcaaaca

SEQ ID NO: 960230 - RNA, 29 nt, Human
cuaggagaggaaguaaaacauguagaaaa

SEQ ID NO: 960231 - RNA, 21 nt, Human
cucaagacauuuaccagauuc

SEQ ID NO: 960232 - RNA, 23 nt, Human
cucacuaguagaagaaugccuaa

SEQ ID NO: 960233 - RNA, 24 nt, Human
cugaaaaccaagagaaaaaaaauc

SEQ ID NO: 960234 - RNA, 22 nt, Human
cugaggaaaauaaggguuuaag

SEQ ID NO: 960235 - RNA, 19 nt, Human
cugcuaagucuccuucuca

SEQ ID NO: 960236 - RNA, 24 nt, Human
cuuauaaacaaggaguguuaccau

SEQ ID NO: 960237 - RNA, 20 nt, Human
gaaaaacugacuccaaaaag

SEQ ID NO: 960238 - RNA, 19 nt, Human
gaaaaagacucacuaguag

SEQ ID NO: 960239 - RNA, 19 nt, Human
gaacagacaagguuucugu

SEQ ID NO: 960240 - RNA, 19 nt, Human
gacaaauuagauaaaaaag

SEQ ID NO: 960241 - RNA, 24 nt, Human
gagaagcaucuucacccaauuccu

SEQ ID NO: 960242 - RNA, 22 nt, Human
gaggcuuggaaguccaacauca

SEQ ID NO: 960243 - RNA, 20 nt, Human
gagggcacaaaaauuucaga

SEQ ID NO: 960244 - RNA, 20 nt, Human
gaguuuguccuuuuugccuc

SEQ ID NO: 960245 - RNA, 20 nt, Human
gauacagaggugccauuuau

SEQ ID NO: 960246 - RNA, 23 nt, Human
gccacaguuagagguuucggacc

SEQ ID NO: 960247 - RNA, 20 nt, Human
gcuuuuauauugucuuugua

SEQ ID NO: 960248 - RNA, 29 nt, Human
ggcugaggaaaauaaggguuuaagcccca

SEQ ID NO: 960249 - RNA, 22 nt, Human
guuucugugaagagcaggaauu

SEQ ID NO: 960250 - RNA, 24 nt, Human
uaaaaagacaaugacauaucaggc

SEQ ID NO: 960251 - RNA, 19 nt, Human
uaaaaccaggcagagacua

SEQ ID NO: 960252 - RNA, 24 nt, Human
uaaaauauacauaucugaaauucu

SEQ ID NO: 960253 - RNA, 19 nt, Human
uaaaaugucuuucuagaau

SEQ ID NO: 960254 - RNA, 23 nt, Human
uaaagaauauucuaaaacuaaaa

SEQ ID NO: 960255 - RNA, 21 nt, Human
uaaagggaauaaaacugcaga

SEQ ID NO: 960256 - RNA, 21 nt, Human
uaaaguaacacugacaauccc

SEQ ID NO: 960257 - RNA, 22 nt, Human
uaacaaaaucccauagacuggu

SEQ ID NO: 960258 - RNA, 20 nt, Human
uaagaaaacagagaaaacau

SEQ ID NO: 960259 - RNA, 21 nt, Human
uaagcagacauaauaccagga

SEQ ID NO: 960260 - RNA, 20 nt, Human
uaaggauacagaggugccag

SEQ ID NO: 960261 - RNA, 22 nt, Human
uaagugaaucaucuaaccuaaa

SEQ ID NO: 960262 - RNA, 19 nt, Human
uacaggaggcugaacagac

SEQ ID NO: 960263 - RNA, 22 nt, Human
uaccauuuucuuauuucugagu

SEQ ID NO: 960264 - RNA, 18 nt, Human
uagaacuucuaaaguguu

SEQ ID NO: 960265 - RNA, 19 nt, Human
uaguuacagcagaaacuaa

SEQ ID NO: 960266 - RNA, 24 nt, Human
uaucacacaagcuuaauuuguaug

SEQ ID NO: 960267 - RNA, 22 nt, Human
uauccuaccaacaagggcaaac

SEQ ID NO: 960268 - RNA, 23 nt, Human
uaugcuuaagaaaacagagaaaa

SEQ ID NO: 960269 - RNA, 24 nt, Human
uauuggacuuugcagccuccagaa

SEQ ID NO: 960270 - RNA, 22 nt, Human
ucaacauaugauuuuuuggggu

SEQ ID NO: 960271 - RNA, 24 nt, Human
ucagaauaauguaacaaaauccca

SEQ ID NO: 960272 - RNA, 22 nt, Human
ucauaaucuaucaccucccaag

SEQ ID NO: 960273 - RNA, 26 nt, Human
uccaaaaagacuacaauaacuagacc

SEQ ID NO: 960274 - RNA, 23 nt, Human
uccacagccgccccagccucugg

SEQ ID NO: 960275 - RNA, 19 nt, Human
uccucacauggccacaagg

SEQ ID NO: 960276 - RNA, 27 nt, Human
ucuaagugaaucaucuaaccuaaacuc

SEQ ID NO: 960277 - RNA, 25 nt, Human
ucuacauauuuuauacaaugucuaa

SEQ ID NO: 960278 - RNA, 23 nt, Human
ucugcagagccauauccuaccaa

SEQ ID NO: 960279 - RNA, 20 nt, Human
ucuuuuuuuaauucuaccaa

SEQ ID NO: 960280 - RNA, 20 nt, Human
ugaaaaaacuuucuacagaa

SEQ ID NO: 960281 - RNA, 22 nt, Human
ugaaaagcaaggagauuucuca

SEQ ID NO: 960282 - RNA, 19 nt, Human
ugaaggccuauuuccuagu

SEQ ID NO: 960283 - RNA, 22 nt, Human
ugacaggagcuaucuuagucca

SEQ ID NO: 960284 - RNA, 25 nt, Human
ugacuccaaaaagacuacaauaacu

SEQ ID NO: 960285 - RNA, 18 nt, Human
ugacuugcuaaguagcug

SEQ ID NO: 960286 - RNA, 21 nt, Human
ugccccacaaugccgcuccca

SEQ ID NO: 960287 - RNA, 18 nt, Human
uguacuaauuaccuugaa

SEQ ID NO: 960288 - RNA, 23 nt, Human
uguaucucccucaccuaguaaua

SEQ ID NO: 960289 - RNA, 22 nt, Human
uguaugucuuauuaauagaguu

SEQ ID NO: 960290 - RNA, 22 nt, Human
uguccauuuuugcuuacaaaug

SEQ ID NO: 960291 - RNA, 24 nt, Human
uuaauuuauaccuacuccucgcua

SEQ ID NO: 960292 - RNA, 20 nt, Human
uucagaucacauaggagcug

SEQ ID NO: 960293 - RNA, 25 nt, Human
uugauacucacugcaauuagauuaa

SEQ ID NO: 960294 - RNA, 20 nt, Human
uuuaucagacacugaaucug

SEQ ID NO: 960295 - RNA, 25 nt, Human
uuuaucagacacugaaucugcugac

SEQ ID NO: 960296 - RNA, 20 nt, Human
uuucagagaaaaagacucac

SEQ ID NO: 960297 - RNA, 25 nt, Human
uuugccuucucugccacguaaggau

SEQ ID NO: 960298 - RNA, 20 nt, Human
uuuuauacaaugucuaacau

SEQ ID NO: 960299 - RNA, 24 nt, Human
aaaaccuuuuguucauauucagaa

SEQ ID NO: 960300 - RNA, 23 nt, Human
aaaauaaaagcuaaaagucagaa

SEQ ID NO: 960301 - RNA, 24 nt, Human
aaaccaaaccaaacaaauccagaa

SEQ ID NO: 960302 - RNA, 18 nt, Human
aaccaaacaaauccagaa

SEQ ID NO: 960303 - RNA, 22 nt, Human
aacccugaugaacagaaacaac

SEQ ID NO: 960304 - RNA, 21 nt, Human
aacuggaaccaaaccaaacca

SEQ ID NO: 960305 - RNA, 20 nt, Human
aagcccucauguaucuucuc

SEQ ID NO: 960306 - RNA, 23 nt, Human
acaaugaggauaaaguacugaaa

SEQ ID NO: 960307 - RNA, 19 nt, Human
accacccaaguagaacaaa

SEQ ID NO: 960308 - RNA, 18 nt, Human
acccugaugaacagaaac

SEQ ID NO: 960309 - RNA, 29 nt, Human
agaacgauuaaauuaaaccacccaaguag

SEQ ID NO: 960310 - RNA, 23 nt, Human
agacuggauuuauauugccauuu

SEQ ID NO: 960311 - RNA, 21 nt, Human
aucaacauugaaucauggauu

SEQ ID NO: 960312 - RNA, 21 nt, Human
augaacagaaacaacacugca

SEQ ID NO: 960313 - RNA, 23 nt, Human
auggauuuggugucacugaguca

SEQ ID NO: 960314 - RNA, 22 nt, Human
caaauccagaauggggucaccu

SEQ ID NO: 960315 - RNA, 26 nt, Human
caagcaauauaguuagaaauauuaac

SEQ ID NO: 960316 - RNA, 19 nt, Human
cacaaaauccagagaugua

SEQ ID NO: 960317 - RNA, 22 nt, Human
cacuuuugcauuuuccccuaaa

SEQ ID NO: 960318 - RNA, 26 nt, Human
caucuacccucgcacaagcugcaccc

SEQ ID NO: 960319 - RNA, 20 nt, Human
ccaaagccauauacugauca

SEQ ID NO: 960320 - RNA, 20 nt, Human
ccagaguucauuugguuugg

SEQ ID NO: 960321 - RNA, 19 nt, Human
ccaucuacccucgcacaag

SEQ ID NO: 960322 - RNA, 24 nt, Human
cccucauguaucuucucuauugua

SEQ ID NO: 960323 - RNA, 18 nt, Human
ccucgcacaagcugcacc

SEQ ID NO: 960324 - RNA, 19 nt, Human
ccugaagugguuagcccca

SEQ ID NO: 960325 - RNA, 23 nt, Human
ccuucagaauuagcagaauuaga

SEQ ID NO: 960326 - RNA, 18 nt, Human
cugaaaaggcaaagggaa

SEQ ID NO: 960327 - RNA, 21 nt, Human
cuuaaaucacauugaggugaa

SEQ ID NO: 960328 - RNA, 21 nt, Human
gaacaaauaauucacauucuu

SEQ ID NO: 960329 - RNA, 25 nt, Human
gaccacggaaacauacacaaaggaa

SEQ ID NO: 960330 - RNA, 24 nt, Human
gaggauaaaguacugaaaucugcu

SEQ ID NO: 960331 - RNA, 18 nt, Human
gauuugucuauuuccccu

SEQ ID NO: 960332 - RNA, 21 nt, Human
gcauaaauacaacaaagggag

SEQ ID NO: 960333 - RNA, 21 nt, Human
gugaaauacuaccauaucaga

SEQ ID NO: 960334 - RNA, 18 nt, Human
uaaaagcuaaaagucaga

SEQ ID NO: 960335 - RNA, 22 nt, Human
uaaaccacccaaguagaacaaa

SEQ ID NO: 960336 - RNA, 22 nt, Human
uaacccugaugaacagaaacaa

SEQ ID NO: 960337 - RNA, 24 nt, Human
uaacuggaaccaaaccaaaccaaa

SEQ ID NO: 960338 - RNA, 23 nt, Human
uacaacaaagggagaauaaagac

SEQ ID NO: 960339 - RNA, 24 nt, Human
uagaaaauccaaaaccuuuuguuc

SEQ ID NO: 960340 - RNA, 21 nt, Human
uagaaauuuuggucugcuuaa

SEQ ID NO: 960341 - RNA, 18 nt, Human
uagaacaaauaauucaca

SEQ ID NO: 960342 - RNA, 27 nt, Human
ucaccuacaagcaauauaguuagaaau

SEQ ID NO: 960343 - RNA, 22 nt, Human
ugaacagaaacaacacugcauc

SEQ ID NO: 960344 - RNA, 19 nt, Human
ugcucaagaucaacauuga

SEQ ID NO: 960345 - RNA, 18 nt, Human
uggaaccaaaccaaacca

SEQ ID NO: 960346 - RNA, 21 nt, Human
uggaaccaaaccaaaccaaac

SEQ ID NO: 960347 - RNA, 22 nt, Human
uguacauauaauucuuuacacu

SEQ ID NO: 960348 - RNA, 21 nt, Human
uuagaaauuuuggucugcuua

SEQ ID NO: 960349 - RNA, 19 nt, Human
uuccacaaugaggauaaag

SEQ ID NO: 960350 - RNA, 28 nt, Human
uuuaauauuucaucacaaaauccagaga

SEQ ID NO: 960351 - RNA, 21 nt, Human
uuuagguuuuccagaguucau

SEQ ID NO: 960352 - RNA, 20 nt, Human
uuuguucauauucagaacga

SEQ ID NO: 960353 - RNA, 21 nt, Human
uuuuguucauauucagaacga

SEQ ID NO: 960354 - RNA, 18 nt, Human
uuuuuggauucuguaaac

SEQ ID NO: 960355 - RNA, 24 nt, Human
aagaaacaauaaauguggauuaga

SEQ ID NO: 960356 - RNA, 19 nt, Human
aagaaccaauuucacacca

SEQ ID NO: 960357 - RNA, 26 nt, Human
aagcaaaaauauaaaaguaaaaagaa

SEQ ID NO: 960358 - RNA, 21 nt, Human
aagcagagcuucuccucugug

SEQ ID NO: 960359 - RNA, 19 nt, Human
aaggaaaguuggagagaaa

SEQ ID NO: 960360 - RNA, 26 nt, Human
aauauaaaaguaaaaagaaccaauuu

SEQ ID NO: 960361 - RNA, 22 nt, Human
acuuccaauggcauaugacugu

SEQ ID NO: 960362 - RNA, 21 nt, Human
agacugaaguuugggaaacaa

SEQ ID NO: 960363 - RNA, 24 nt, Human
agacuuccaauggcauaugacugu

SEQ ID NO: 960364 - RNA, 18 nt, Human
agagaaagaaagcagagc

SEQ ID NO: 960365 - RNA, 20 nt, Human
agagcaauaccacaucuauu

SEQ ID NO: 960366 - RNA, 22 nt, Human
agaguuccuccugccugguccu

SEQ ID NO: 960367 - RNA, 25 nt, Human
agcaaaaauauaaaaguaaaaagaa

SEQ ID NO: 960368 - RNA, 23 nt, Human
agcuucuccucuguggggaacag

SEQ ID NO: 960369 - RNA, 25 nt, Human
agcuucuccucuguggggaacagcu

SEQ ID NO: 960370 - RNA, 24 nt, Human
aggacugcuggccaagacuuccaa

SEQ ID NO: 960371 - RNA, 19 nt, Human
aguuccuccugccuggucc

SEQ ID NO: 960372 - RNA, 20 nt, Human
aucacagucuucuucuacau

SEQ ID NO: 960373 - RNA, 24 nt, Human
caacagagaagaccugucgagacg

SEQ ID NO: 960374 - RNA, 19 nt, Human
cauaaaugugcaaauaauc

SEQ ID NO: 960375 - RNA, 22 nt, Human
ccccugaagccaaggcaauaga

SEQ ID NO: 960376 - RNA, 19 nt, Human
ccugccugguccucagagc

SEQ ID NO: 960377 - RNA, 20 nt, Human
cucacaaaggcaaacucagg

SEQ ID NO: 960378 - RNA, 21 nt, Human
cucacaggcacaucaugcuga

SEQ ID NO: 960379 - RNA, 21 nt, Human
cuccuuaucccccugaagcca

SEQ ID NO: 960380 - RNA, 21 nt, Human
gagagaaauccccuccuccuc

SEQ ID NO: 960381 - RNA, 22 nt, Human
gaggacucuuccaugcucacag

SEQ ID NO: 960382 - RNA, 21 nt, Human
ggaaggauucaggacugcugg

SEQ ID NO: 960383 - RNA, 21 nt, Human
ggacccgccgcuccccaauuc

SEQ ID NO: 960384 - RNA, 24 nt, Human
guggggaacagcuucuucaucaca

SEQ ID NO: 960385 - RNA, 23 nt, Human
uaaaaguaaaaagaaccaauuuc

SEQ ID NO: 960386 - RNA, 23 nt, Human
uaccacaucuauuuucugaacuc

SEQ ID NO: 960387 - RNA, 22 nt, Human
uagacgugauuucaaaagaaac

SEQ ID NO: 960388 - RNA, 25 nt, Human
uauaaaaguaaaaagaaccaauuuc

SEQ ID NO: 960389 - RNA, 20 nt, Human
ucuuccacuguuauggccuu

SEQ ID NO: 960390 - RNA, 22 nt, Human
ugauauguucccuccuuauccc

SEQ ID NO: 960391 - RNA, 18 nt, Human
ugauuuuaaaaaaggaaa

SEQ ID NO: 960392 - RNA, 19 nt, Human
ugccucacaaaggcaaacu

SEQ ID NO: 960393 - RNA, 23 nt, Human
ugccucacaaaggcaaacucagg

SEQ ID NO: 960394 - RNA, 22 nt, Human
uggauuagaaaggaaacaucca

SEQ ID NO: 960395 - RNA, 19 nt, Human
uguagaguuccuccugccu

SEQ ID NO: 960396 - RNA, 19 nt, Human
uguagaguuccuccugccu

SEQ ID NO: 960397 - RNA, 25 nt, Human
uuaugauauguucccuccuuauccc

SEQ ID NO: 960398 - RNA, 24 nt, Human
uucaagcaaaaauauaaaaguaaa

SEQ ID NO: 960399 - RNA, 21 nt, Human
uuccaauuucugcagcuuuuu

SEQ ID NO: 960400 - RNA, 18 nt, Human
aaaguagagaagcagaaa

SEQ ID NO: 960401 - RNA, 21 nt, Human
aaaugguuuugcccugacuaa

SEQ ID NO: 960402 - RNA, 24 nt, Human
aagcaaccccagaaucauauaaau

SEQ ID NO: 960403 - RNA, 18 nt, Human
aagcagaaagagaaacau

SEQ ID NO: 960404 - RNA, 21 nt, Human
aagcagaaagagaaacauaga

SEQ ID NO: 960405 - RNA, 25 nt, Human
aagcagaaagagaaacauagauuga

SEQ ID NO: 960406 - RNA, 21 nt, Human
aagcucuuucuggaugagccc

SEQ ID NO: 960407 - RNA, 19 nt, Human
acuguuuaacauccccaau

SEQ ID NO: 960408 - RNA, 21 nt, Human
agaaaagcccauuaaacaaaa

SEQ ID NO: 960409 - RNA, 21 nt, Human
agaaagagaaacauagauuga

SEQ ID NO: 960410 - RNA, 20 nt, Human
agcagaaagagaaacauaga

SEQ ID NO: 960411 - RNA, 24 nt, Human
caaaagaaaaucaaagaauccauu

SEQ ID NO: 960412 - RNA, 22 nt, Human
caaaauagaauccugggggauc

SEQ ID NO: 960413 - RNA, 22 nt, Human
caagagaagucaugaggacacc

SEQ ID NO: 960414 - RNA, 27 nt, Human
cacugcaacuguuuaacauccccaauu

SEQ ID NO: 960415 - RNA, 18 nt, Human
cagcuacccgccgccucc

SEQ ID NO: 960416 - RNA, 26 nt, Human
ccacaggcucccugcugaugagauuu

SEQ ID NO: 960417 - RNA, 22 nt, Human
cccccagauccagcuguccuag

SEQ ID NO: 960418 - RNA, 23 nt, Human
ccgccuccucagcaaucuuagcc

SEQ ID NO: 960419 - RNA, 21 nt, Human
ccugccagcuacccgccgccu

SEQ ID NO: 960420 - RNA, 18 nt, Human
ccuucggaagucggcgcc

SEQ ID NO: 960421 - RNA, 20 nt, Human
ccuuucucucuuccaauaaa

SEQ ID NO: 960422 - RNA, 22 nt, Human
cgccgccuccucagcaaucuua

SEQ ID NO: 960423 - RNA, 18 nt, Human
cuaagcaugggucagagg

SEQ ID NO: 960424 - RNA, 25 nt, Human
cucaaaauauuuauuguuacaagaa

SEQ ID NO: 960425 - RNA, 18 nt, Human
cugcaguaaugcuuggca

SEQ ID NO: 960426 - RNA, 21 nt, Human
cuuagccgaccgggagggcuc

SEQ ID NO: 960427 - RNA, 21 nt, Human
gaacagcaaguauugaaaacg

SEQ ID NO: 960428 - RNA, 26 nt, Human
gaguuuguuaaaauguacccauuauu

SEQ ID NO: 960429 - RNA, 22 nt, Human
gcccauuaaacaaaauagaauc

SEQ ID NO: 960430 - RNA, 22 nt, Human
gcccggacggcggccuucggaa

SEQ ID NO: 960431 - RNA, 18 nt, Human
ggcacagaaccaaggcug

SEQ ID NO: 960432 - RNA, 23 nt, Human
ggccuucggaagucggcgccugc

SEQ ID NO: 960433 - RNA, 18 nt, Human
guaucauucaacuuaaaa

SEQ ID NO: 960434 - RNA, 20 nt, Human
uaaaggucauauguacuaag

SEQ ID NO: 960435 - RNA, 24 nt, Human
uacccgccgccuccucagcaaucu

SEQ ID NO: 960436 - RNA, 19 nt, Human
uauuuccuuucucucuucc

SEQ ID NO: 960437 - RNA, 26 nt, Human
uauuuuaugcuuuuaguagaaaagcc

SEQ ID NO: 960438 - RNA, 23 nt, Human
ucagaggaauagaauggauuugu

SEQ ID NO: 960439 - RNA, 18 nt, Human
uccacaggcucccugcug

SEQ ID NO: 960440 - RNA, 23 nt, Human
uccagccauucccagauuucacu

SEQ ID NO: 960441 - RNA, 23 nt, Human
uccccaauuccugguuuuucagu

SEQ ID NO: 960442 - RNA, 21 nt, Human
uccucaaaagaaaaucaaaga

SEQ ID NO: 960443 - RNA, 21 nt, Human
ucggcgccugccagcuacccg

SEQ ID NO: 960444 - RNA, 19 nt, Human
ucuccucauuugggucagg

SEQ ID NO: 960445 - RNA, 19 nt, Human
ugaaaaggauggaaacugg

SEQ ID NO: 960446 - RNA, 24 nt, Human
ugagcccccagauccagcuguccu

SEQ ID NO: 960447 - RNA, 18 nt, Human
uggaugagcccccagauc

SEQ ID NO: 960448 - RNA, 23 nt, Human
uggaugagcccccagauccagcu

SEQ ID NO: 960449 - RNA, 21 nt, Human
uggcacagaaccaaggcuggg

SEQ ID NO: 960450 - RNA, 23 nt, Human
uggcacagaaccaaggcugggua

SEQ ID NO: 960451 - RNA, 24 nt, Human
uggcacagaaccaaggcuggguau

SEQ ID NO: 960452 - RNA, 23 nt, Human
ugggagaaucagagcucuccuca

SEQ ID NO: 960453 - RNA, 24 nt, Human
uguaaggguuaaaggucauaugua

SEQ ID NO: 960454 - RNA, 23 nt, Human
uguuacaagaaaaccguaagaag

SEQ ID NO: 960455 - RNA, 20 nt, Human
uuccaauaaagcucuuucug

SEQ ID NO: 960456 - RNA, 22 nt, Human
uuggcacagaaccaaggcuggg

SEQ ID NO: 960457 - RNA, 21 nt, Human
uuuacacacuuuuauacaagu

SEQ ID NO: 960458 - RNA, 20 nt, Human
uuuguuaaaauguacccauu

SEQ ID NO: 960459 - RNA, 18 nt, Human
uuuuuuuuuuuuuuuuug

SEQ ID NO: 960460 - RNA, 24 nt, Human
uuuuuuuuuuuuuuuuuuguuauu

SEQ ID NO: 960461 - RNA, 18 nt, Human
aacacugugguaagcaaa

SEQ ID NO: 960462 - RNA, 22 nt, Human
agcuauaacacugugguaagca

SEQ ID NO: 960463 - RNA, 18 nt, Human
aggacccgucgcagccuc

SEQ ID NO: 960464 - RNA, 19 nt, Human
auaauuccagcuuaaucuu

SEQ ID NO: 960465 - RNA, 18 nt, Human
cacugugguaagcaaaau

SEQ ID NO: 960466 - RNA, 23 nt, Human
ccauauguugucucaaaccauac

SEQ ID NO: 960467 - RNA, 18 nt, Human
ccucacugucccccugca

SEQ ID NO: 960468 - RNA, 21 nt, Human
ccucuccgcccagcaggagcu

SEQ ID NO: 960469 - RNA, 22 nt, Human
cuagaaccagcuauaacacugu

SEQ ID NO: 960470 - RNA, 19 nt, Human
cugucccccugcaggaccc

SEQ ID NO: 960471 - RNA, 22 nt, Human
cuuaaucuacaaaugugaacau

SEQ ID NO: 960472 - RNA, 20 nt, Human
uaaucuacaaaugugaacau

SEQ ID NO: 960473 - RNA, 18 nt, Human
uacaaaaaauauagagca

SEQ ID NO: 960474 - RNA, 26 nt, Human
uauuucaucuucuuaaggugucuuua

SEQ ID NO: 960475 - RNA, 21 nt, Human
ucccccaggagcggagacgag

SEQ ID NO: 960476 - RNA, 22 nt, Human
ucccccugcaggacccgucgca

SEQ ID NO: 960477 - RNA, 22 nt, Human
ucgcagccuccgcuuugcaaaa

SEQ ID NO: 960478 - RNA, 23 nt, Human
ucgcagccuccgcuuugcaaaau

SEQ ID NO: 960479 - RNA, 18 nt, Human
ugcucucauuauaauucc

SEQ ID NO: 960480 - RNA, 24 nt, Human
ugguaagcaaaauaaauuuguucu

SEQ ID NO: 960481 - RNA, 21 nt, Human
ugucucaaaccauacuaauac

SEQ ID NO: 960482 - RNA, 24 nt, Human
uuccacagauaaauggaaaaagga

SEQ ID NO: 960483 - RNA, 22 nt, Human
uuccauauguugucucaaacca

SEQ ID NO: 960484 - RNA, 23 nt, Human
aaaaagcacauaaacaucuacaa

SEQ ID NO: 960485 - RNA, 22 nt, Human
aaaaaggacaaagacaggaaua

SEQ ID NO: 960486 - RNA, 25 nt, Human
aaaaggacaaagacaggaauacaaa

SEQ ID NO: 960487 - RNA, 20 nt, Human
aaacaagcugccaaaauaca

SEQ ID NO: 960488 - RNA, 24 nt, Human
acaaaaagcacauaaacaucuaca

SEQ ID NO: 960489 - RNA, 22 nt, Human
accgccaaguccagcucagcuc

SEQ ID NO: 960490 - RNA, 18 nt, Human
agaaaaaggacaaagaca

SEQ ID NO: 960491 - RNA, 27 nt, Human
agacaggaauacaaauaaauuauaauc

SEQ ID NO: 960492 - RNA, 20 nt, Human
agggaacguugccuaagcgc

SEQ ID NO: 960493 - RNA, 24 nt, Human
caaaaagcacauaaacaucuacaa

SEQ ID NO: 960494 - RNA, 18 nt, Human
caacaagcaggcuccggc

SEQ ID NO: 960495 - RNA, 18 nt, Human
caacaagcaggcuccggc

SEQ ID NO: 960496 - RNA, 21 nt, Human
cacccacagcugcaacaagca

SEQ ID NO: 960497 - RNA, 19 nt, Human
caccuaaacaagcugccaa

SEQ ID NO: 960498 - RNA, 22 nt, Human
cagccagcgcuccucagagguu

SEQ ID NO: 960499 - RNA, 18 nt, Human
cagcucagcucucaaccg

SEQ ID NO: 960500 - RNA, 24 nt, Human
caucuacaaguaccaaaacauuua

SEQ ID NO: 960501 - RNA, 19 nt, Human
ccacagcugcaacaagcag

SEQ ID NO: 960502 - RNA, 19 nt, Human
ccacagcugcaacaagcag

SEQ ID NO: 960503 - RNA, 22 nt, Human
ccaccgccaaguccagcucagc

SEQ ID NO: 960504 - RNA, 22 nt, Human
cccacagcugcaacaagcaggc

SEQ ID NO: 960505 - RNA, 22 nt, Human
cccacagcugcaacaagcaggc

SEQ ID NO: 960506 - RNA, 21 nt, Human
ccgccaaguccagcucagcuc

SEQ ID NO: 960507 - RNA, 22 nt, Human
gaacacaaucugacaccguugc

SEQ ID NO: 960508 - RNA, 22 nt, Human
gcuagagccguccucacccaca

SEQ ID NO: 960509 - RNA, 22 nt, Human
gcuagagccguccucacccaca

SEQ ID NO: 960510 - RNA, 26 nt, Human
gcugccaaaauacauuaccucugauu

SEQ ID NO: 960511 - RNA, 18 nt, Human
guuacauauaaaaugucc

SEQ ID NO: 960512 - RNA, 23 nt, Human
uaaaagggaacuagcuagagccg

SEQ ID NO: 960513 - RNA, 27 nt, Human
uaaaagggaacuggccggagccgcuca

SEQ ID NO: 960514 - RNA, 24 nt, Human
uaaacaucuacaaguaccaaaaca

SEQ ID NO: 960515 - RNA, 23 nt, Human
uaccucugauuuuauuuagauuc

SEQ ID NO: 960516 - RNA, 21 nt, Human
uaggauacaaaaagcacauaa

SEQ ID NO: 960517 - RNA, 22 nt, Human
uaggauacaaaaagcacauaaa

SEQ ID NO: 960518 - RNA, 23 nt, Human
ucacccacagcugcaacaagcag

SEQ ID NO: 960519 - RNA, 23 nt, Human
ucacccacagcugcaacaagcag

SEQ ID NO: 960520 - RNA, 19 nt, Human
ucccaccgccaaguccagc

SEQ ID NO: 960521 - RNA, 19 nt, Human
ugacaccguugcauuuccu

SEQ ID NO: 960522 - RNA, 20 nt, Human
ugcauuuccugguuguaucc

SEQ ID NO: 960523 - RNA, 22 nt, Human
ugccaaaauacauuaccucuga

SEQ ID NO: 960524 - RNA, 23 nt, Human
ugccaaaauacauuaccucugau

SEQ ID NO: 960525 - RNA, 24 nt, Human
uguuaaaaucugcuagaaaaguaa

SEQ ID NO: 960526 - RNA, 25 nt, Human
uuagcaauauuuuagccaguacuuu

SEQ ID NO: 960527 - RNA, 21 nt, Human
uucugcaucuagauuuauuuc

SEQ ID NO: 960528 - RNA, 23 nt, Human
uuuauuuagauucuaaaaguuag

SEQ ID NO: 960529 - RNA, 20 nt, Human
uuuucaggaaaucacauuug

SEQ ID NO: 960530 - RNA, 20 nt, Human
uuuuuuuuuuuuuuuucagg

SEQ ID NO: 960531 - RNA, 22 nt, Human
aaaaaaaagacacgugugggga

SEQ ID NO: 960532 - RNA, 20 nt, Human
aaaacaucacuaccaaucaa

SEQ ID NO: 960533 - RNA, 18 nt, Human
aaaagcacaaauguuucc

SEQ ID NO: 960534 - RNA, 20 nt, Human
aaacaaaaaacccaaaaaua

SEQ ID NO: 960535 - RNA, 21 nt, Human
aaacaaaacaaaaaacccaaa

SEQ ID NO: 960536 - RNA, 19 nt, Human
aaaccuuucauuucuucac

SEQ ID NO: 960537 - RNA, 18 nt, Human
aaauccuagaaauuagaa

SEQ ID NO: 960538 - RNA, 18 nt, Human
aacacugcuuaagggaga

SEQ ID NO: 960539 - RNA, 18 nt, Human
aagagucauacccacuua

SEQ ID NO: 960540 - RNA, 26 nt, Human
aauacugacagauuuuaacuccgaga

SEQ ID NO: 960541 - RNA, 22 nt, Human
aauauccaccaaaucaaacagc

SEQ ID NO: 960542 - RNA, 23 nt, Human
aauugcuucuuaauagaugaagc

SEQ ID NO: 960543 - RNA, 21 nt, Human
acaaaacaaaaaacccaaaaa

SEQ ID NO: 960544 - RNA, 18 nt, Human
acaaagaaaaaaaaaaga

SEQ ID NO: 960545 - RNA, 24 nt, Human
acacacugcaaaccaaccuuaaca

SEQ ID NO: 960546 - RNA, 22 nt, Human
acauucaacauugcaaaaaaua

SEQ ID NO: 960547 - RNA, 22 nt, Human
acucauuucaccaaaaaccccc

SEQ ID NO: 960548 - RNA, 21 nt, Human
acugaagacugggagaagagg

SEQ ID NO: 960549 - RNA, 18 nt, Human
agaaaaccaccuaaugau

SEQ ID NO: 960550 - RNA, 22 nt, Human
agaaaugcaccaaauaaaaucc

SEQ ID NO: 960551 - RNA, 24 nt, Human
agacaaaaugaaucugugaaaacu

SEQ ID NO: 960552 - RNA, 26 nt, Human
agacaaaaugaaucugugaaaacuga

SEQ ID NO: 960553 - RNA, 18 nt, Human
agagcugaaagaccacug

SEQ ID NO: 960554 - RNA, 18 nt, Human
agcauaaagaauacugac

SEQ ID NO: 960555 - RNA, 18 nt, Human
agccugggagcugaggcu

SEQ ID NO: 960556 - RNA, 19 nt, Human
aguauccaaucauacguag

SEQ ID NO: 960557 - RNA, 24 nt, Human
auauuauacacuacuuuacaaaau

SEQ ID NO: 960558 - RNA, 19 nt, Human
aucccaaacaacucaguua

SEQ ID NO: 960559 - RNA, 21 nt, Human
aucccaaacaacucaguuaaa

SEQ ID NO: 960560 - RNA, 18 nt, Human
augcaucuuugauuagaa

SEQ ID NO: 960561 - RNA, 21 nt, Human
auuucuuaugaaugacuucca

SEQ ID NO: 960562 - RNA, 21 nt, Human
caaaacaaaaaacccaaaaau

SEQ ID NO: 960563 - RNA, 23 nt, Human
caaaaugaaucugugaaaacuga

SEQ ID NO: 960564 - RNA, 23 nt, Human
caaacuguaaaaaggaagacaaa

SEQ ID NO: 960565 - RNA, 21 nt, Human
caaaucaaacagcagcauuua

SEQ ID NO: 960566 - RNA, 24 nt, Human
caaccuuaacacugcuuaagggag

SEQ ID NO: 960567 - RNA, 23 nt, Human
caagaagagagcugaaagaccac

SEQ ID NO: 960568 - RNA, 26 nt, Human
cacaaacauaauagaaaaagaaggua

SEQ ID NO: 960569 - RNA, 21 nt, Human
cacaaauguuucccucuagaa

SEQ ID NO: 960570 - RNA, 22 nt, Human
cacagccuagccugggagcuga

SEQ ID NO: 960571 - RNA, 18 nt, Human
caccaaaucaaacagcag

SEQ ID NO: 960572 - RNA, 27 nt, Human
cagaaaaccaccuaaugauaguucuca

SEQ ID NO: 960573 - RNA, 21 nt, Human
cagcagcauuuaugcuuucau

SEQ ID NO: 960574 - RNA, 22 nt, Human
cauuucaccaaaaacccccacu

SEQ ID NO: 960575 - RNA, 20 nt, Human
cccacuuuuauuauauaccc

SEQ ID NO: 960576 - RNA, 19 nt, Human
ccccaggccaccggcggcc

SEQ ID NO: 960577 - RNA, 24 nt, Human
ccuaucccaaacaacucaguuaaa

SEQ ID NO: 960578 - RNA, 22 nt, Human
cgacaacagcgcacaagaagag

SEQ ID NO: 960579 - RNA, 24 nt, Human
cgcgaacgcccggcuagaaggcgg

SEQ ID NO: 960580 - RNA, 25 nt, Human
cuaaaaaacacauucaacauugcaa

SEQ ID NO: 960581 - RNA, 23 nt, Human
cuccaaaggcucauucauucucu

SEQ ID NO: 960582 - RNA, 21 nt, Human
cuccccaggccaccggcggcc

SEQ ID NO: 960583 - RNA, 22 nt, Human
cugaaagcggagggaggaggcu

SEQ ID NO: 960584 - RNA, 25 nt, Human
cuuuacaucaaaaaguaauacaaga

SEQ ID NO: 960585 - RNA, 20 nt, Human
gacaacagcgcacaagaaga

SEQ ID NO: 960586 - RNA, 22 nt, Human
gaucauauaagaccaagauugu

SEQ ID NO: 960587 - RNA, 22 nt, Human
gcucauauugauauaaaccugg

SEQ ID NO: 960588 - RNA, 19 nt, Human
ggccaccggcggccacagc

SEQ ID NO: 960589 - RNA, 20 nt, Human
ggggaaaaaaaaagaaucaa

SEQ ID NO: 960590 - RNA, 24 nt, Human
guauacuguagagggacugcuucu

SEQ ID NO: 960591 - RNA, 25 nt, Human
gucaaguuucuuucauaacuuuaau

SEQ ID NO: 960592 - RNA, 28 nt, Human
uaaaacaaaacaaaaaacccaaaaauau

SEQ ID NO: 960593 - RNA, 25 nt, Human
uaaaauaaaugguacugcuugagug

SEQ ID NO: 960594 - RNA, 24 nt, Human
uaacccauuaaaacaaaacaaaaa

SEQ ID NO: 960595 - RNA, 21 nt, Human
uaagaaaggaccuacaaauaa

SEQ ID NO: 960596 - RNA, 21 nt, Human
uacaaauaacuccauuuaaaa

SEQ ID NO: 960597 - RNA, 23 nt, Human
uaccaagauugcccuugucuguu

SEQ ID NO: 960598 - RNA, 23 nt, Human
uacccagagcagaaaugcaccaa

SEQ ID NO: 960599 - RNA, 23 nt, Human
uaccuauuuguaaacaaaauuca

SEQ ID NO: 960600 - RNA, 23 nt, Human
uacuaagaaaggaccuacaaaua

SEQ ID NO: 960601 - RNA, 28 nt, Human
uaguuaacaaaauuuugaaaucacauuu

SEQ ID NO: 960602 - RNA, 21 nt, Human
uauacuaaaaaagcauguggu

SEQ ID NO: 960603 - RNA, 18 nt, Human
uaucccaaacaacucagu

SEQ ID NO: 960604 - RNA, 20 nt, Human
uaucccuaaaagcacaaaug

SEQ ID NO: 960605 - RNA, 19 nt, Human
uauggcagguagugcccua

SEQ ID NO: 960606 - RNA, 23 nt, Human
ucaaacuaaaaaacacauucaac

SEQ ID NO: 960607 - RNA, 22 nt, Human
ucagaaaaccaccuaaugauag

SEQ ID NO: 960608 - RNA, 23 nt, Human
ucagcucauauugauauaaaccu

SEQ ID NO: 960609 - RNA, 19 nt, Human
ucauaacuuuaauauguug

SEQ ID NO: 960610 - RNA, 21 nt, Human
uccagguauucugcacuaucg

SEQ ID NO: 960611 - RNA, 23 nt, Human
ucccuuaacaaagaaaaaaaaaa

SEQ ID NO: 960612 - RNA, 23 nt, Human
ucuucaagcauaaagaauacuga

SEQ ID NO: 960613 - RNA, 19 nt, Human
ugaaaauuacaaacuguaa

SEQ ID NO: 960614 - RNA, 24 nt, Human
ugaagacugggagaagaggggggg

SEQ ID NO: 960615 - RNA, 22 nt, Human
ugacuggguuggaaggggcugg

SEQ ID NO: 960616 - RNA, 20 nt, Human
ugcacuaucgugacauuccu

SEQ ID NO: 960617 - RNA, 22 nt, Human
ugcccuugucuguuacauuagu

SEQ ID NO: 960618 - RNA, 23 nt, Human
ugccuuauaucaguaucuccaaa

SEQ ID NO: 960619 - RNA, 20 nt, Human
uggaaggggcuggucggggu

SEQ ID NO: 960620 - RNA, 21 nt, Human
uggcagguagugcccuauugg

SEQ ID NO: 960621 - RNA, 20 nt, Human
ugggagaagaggggggggcg

SEQ ID NO: 960622 - RNA, 27 nt, Human
ugggagaagaggggggggcgcauuaag

SEQ ID NO: 960623 - RNA, 20 nt, Human
uguggggaaugaauucuagu

SEQ ID NO: 960624 - RNA, 19 nt, Human
uuaaaacaaaacaaaaaac

SEQ ID NO: 960625 - RNA, 19 nt, Human
uuauuuugauccagcuggc

SEQ ID NO: 960626 - RNA, 18 nt, Human
uucaagcauaaagaauac

SEQ ID NO: 960627 - RNA, 22 nt, Human
uucgcuacaauuugaaaauugc

SEQ ID NO: 960628 - RNA, 22 nt, Human
uugaaaaauacaguauuucaga

SEQ ID NO: 960629 - RNA, 18 nt, Human
uugauuagaagaaauaaa

SEQ ID NO: 960630 - RNA, 19 nt, Human
uuuaagaaauucuuaagac

SEQ ID NO: 960631 - RNA, 19 nt, Human
uuugugagguuuuaaaugu

SEQ ID NO: 960632 - RNA, 24 nt, Human
uuuuaaaaacaucacuaccaauca

SEQ ID NO: 960633 - RNA, 21 nt, Human
aaaugccuucauuucaaauuu

SEQ ID NO: 960634 - RNA, 21 nt, Human
aagaggaaggaacgcgccugg

SEQ ID NO: 960635 - RNA, 22 nt, Human
aagaguugucauccaacaaugc

SEQ ID NO: 960636 - RNA, 20 nt, Human
aagaguuuuguguuccuuug

SEQ ID NO: 960637 - RNA, 24 nt, Human
accucauucucuaacugugacaaa

SEQ ID NO: 960638 - RNA, 21 nt, Human
acucaauucauaauaugcauu

SEQ ID NO: 960639 - RNA, 23 nt, Human
agaguugucauccaacaaugcag

SEQ ID NO: 960640 - RNA, 24 nt, Human
agaguugucauccaacaaugcagc

SEQ ID NO: 960641 - RNA, 23 nt, Human
agaguuuuguguuccuuugugga

SEQ ID NO: 960642 - RNA, 20 nt, Human
agggaagggaaggcggggcc

SEQ ID NO: 960643 - RNA, 18 nt, Human
agggaggugggcggaggg

SEQ ID NO: 960644 - RNA, 18 nt, Human
aguucauguacugaaacu

SEQ ID NO: 960645 - RNA, 23 nt, Human
caaaugccuucauuucaaauuuc

SEQ ID NO: 960646 - RNA, 21 nt, Human
caaauuucucacgcgcuucuc

SEQ ID NO: 960647 - RNA, 20 nt, Human
cagaguucaaguccagaaau

SEQ ID NO: 960648 - RNA, 24 nt, Human
cagaguucaaguccagaaauguua

SEQ ID NO: 960649 - RNA, 20 nt, Human
caucaucguuaccauuaauu

SEQ ID NO: 960650 - RNA, 23 nt, Human
ccacauagcuacauaaauuugcc

SEQ ID NO: 960651 - RNA, 18 nt, Human
cccgggaccgcggcucag

SEQ ID NO: 960652 - RNA, 18 nt, Human
cuccgcuucagggaggug

SEQ ID NO: 960653 - RNA, 20 nt, Human
cuccgcuucagggagguggg

SEQ ID NO: 960654 - RNA, 24 nt, Human
cugguggcgacggcggcuccgcuu

SEQ ID NO: 960655 - RNA, 22 nt, Human
gacaaaaagaguugucauccaa

SEQ ID NO: 960656 - RNA, 22 nt, Human
gagaggagagaggaagaggaag

SEQ ID NO: 960657 - RNA, 21 nt, Human
gccuuuuggcaucucuugcca

SEQ ID NO: 960658 - RNA, 20 nt, Human
gcguugcaucuuguauuaac

SEQ ID NO: 960659 - RNA, 19 nt, Human
ggaaggaacgcgccuggcg

SEQ ID NO: 960660 - RNA, 21 nt, Human
ggagaggagagaggaagagga

SEQ ID NO: 960661 - RNA, 20 nt, Human
uaacugugacaaaaagaguu

SEQ ID NO: 960662 - RNA, 20 nt, Human
uaagaaaaaagaauuuaucu

SEQ ID NO: 960663 - RNA, 18 nt, Human
uacaaagaguuuuguguu

SEQ ID NO: 960664 - RNA, 18 nt, Human
uaccauuaauuugaguug

SEQ ID NO: 960665 - RNA, 22 nt, Human
uacuacuggaaauguguagaag

SEQ ID NO: 960666 - RNA, 24 nt, Human
uauauagauuuuuuucuauaguuc

SEQ ID NO: 960667 - RNA, 22 nt, Human
ucuauaguucauguacugaaac

SEQ ID NO: 960668 - RNA, 20 nt, Human
ugaaacagcaucaucguuac

SEQ ID NO: 960669 - RNA, 23 nt, Human
ugacauaucauuccacauagcua

SEQ ID NO: 960670 - RNA, 18 nt, Human
ugagggugucacccggga

SEQ ID NO: 960671 - RNA, 21 nt, Human
ugaguugaaaaagaucuguca

SEQ ID NO: 960672 - RNA, 22 nt, Human
uggaaauguguagaaaccaauu

SEQ ID NO: 960673 - RNA, 19 nt, Human
uggcgucacugaggguguc

SEQ ID NO: 960674 - RNA, 19 nt, Human
ugggcggagggaagggaag

SEQ ID NO: 960675 - RNA, 22 nt, Human
ugggcggagggaagggaaggcg

SEQ ID NO: 960676 - RNA, 23 nt, Human
uggugaaacagcaucaucguuac

SEQ ID NO: 960677 - RNA, 18 nt, Human
ugugacaaaaagaguugu

SEQ ID NO: 960678 - RNA, 24 nt, Human
uucuauaguucauguacugaaacu

SEQ ID NO: 960679 - RNA, 19 nt, Human
uugccagaguucaagucca

SEQ ID NO: 960680 - RNA, 19 nt, Human
uuggcaucucuugccagag

SEQ ID NO: 960681 - RNA, 21 nt, Human
uuuuuuuuuuuuuuugucaag

SEQ ID NO: 960682 - RNA, 22 nt, Human
aaaaauaaaccaaugaagagaa

SEQ ID NO: 960683 - RNA, 18 nt, Human
aagagaaaugagaggucc

SEQ ID NO: 960684 - RNA, 22 nt, Human
aagaugcauugaaaaauaaacc

SEQ ID NO: 960685 - RNA, 25 nt, Human
aagcugguaccucuaccagaucuua

SEQ ID NO: 960686 - RNA, 20 nt, Human
acagaaccauccaguguugg

SEQ ID NO: 960687 - RNA, 22 nt, Human
agaaacuugacugcuaaccucc

SEQ ID NO: 960688 - RNA, 18 nt, Human
agagaaaugagaggucca

SEQ ID NO: 960689 - RNA, 22 nt, Human
agaggguagaaugagggaacag

SEQ ID NO: 960690 - RNA, 20 nt, Human
agccuggccaccaucaagcc

SEQ ID NO: 960691 - RNA, 18 nt, Human
aggaaaaagaggguagaa

SEQ ID NO: 960692 - RNA, 21 nt, Human
aggaaaaagaggguagaauga

SEQ ID NO: 960693 - RNA, 21 nt, Human
agguauugcaaguugaugacc

SEQ ID NO: 960694 - RNA, 22 nt, Human
augacaggauuagcaggaaaaa

SEQ ID NO: 960695 - RNA, 18 nt, Human
caagccuagcccuugucc

SEQ ID NO: 960696 - RNA, 22 nt, Human
caauuugaucucaccuuaucag

SEQ ID NO: 960697 - RNA, 23 nt, Human
caccaccuaugggcuauacccca

SEQ ID NO: 960698 - RNA, 21 nt, Human
cagaaagaaggugucuccuua

SEQ ID NO: 960699 - RNA, 18 nt, Human
cagagcaggggcauccca

SEQ ID NO: 960700 - RNA, 20 nt, Human
cagcugccucugccucucuc

SEQ ID NO: 960701 - RNA, 23 nt, Human
caggagagagcgagcgagcagug

SEQ ID NO: 960702 - RNA, 23 nt, Human
caggauuagcaggaaaaagaggg

SEQ ID NO: 960703 - RNA, 22 nt, Human
ccaauaccgaaucauauacagu

SEQ ID NO: 960704 - RNA, 19 nt, Human
ccaggcccaagaaggacug

SEQ ID NO: 960705 - RNA, 18 nt, Human
cccagaaagaaggugucu

SEQ ID NO: 960706 - RNA, 21 nt, Human
ccuccaggcccaagaaggacu

SEQ ID NO: 960707 - RNA, 19 nt, Human
ccugcccccaagccaguug

SEQ ID NO: 960708 - RNA, 22 nt, Human
ccugccccucuccucuugggag

SEQ ID NO: 960709 - RNA, 22 nt, Human
ccuguaguaaccuuaggauccc

SEQ ID NO: 960710 - RNA, 22 nt, Human
cucagucaauaccaaagcccaa

SEQ ID NO: 960711 - RNA, 23 nt, Human
cuccaccaccuaugggcuauacc

SEQ ID NO: 960712 - RNA, 23 nt, Human
cuccuuauaucucccccuccccc

SEQ ID NO: 960713 - RNA, 20 nt, Human
cucuuuccugccugccccuc

SEQ ID NO: 960714 - RNA, 21 nt, Human
cugaccacuuuucucuccacc

SEQ ID NO: 960715 - RNA, 20 nt, Human
cugccucucuccccaacaac

SEQ ID NO: 960716 - RNA, 23 nt, Human
cugccucugccucucuccccaac

SEQ ID NO: 960717 - RNA, 24 nt, Human
cuuauaucucccccuccccccaga

SEQ ID NO: 960718 - RNA, 18 nt, Human
gaacaggggcaccuucca

SEQ ID NO: 960719 - RNA, 20 nt, Human
gcaggauacuugagcccaga

SEQ ID NO: 960720 - RNA, 18 nt, Human
gccagggucugggugccu

SEQ ID NO: 960721 - RNA, 19 nt, Human
ggggcaucccaggugggga

SEQ ID NO: 960722 - RNA, 20 nt, Human
gguccaaagggacacauaau

SEQ ID NO: 960723 - RNA, 21 nt, Human
ggugucccagcaggagagaac

SEQ ID NO: 960724 - RNA, 19 nt, Human
uaccagaucuuaauauauu

SEQ ID NO: 960725 - RNA, 26 nt, Human
uaccgaaucauauacagugaacugag

SEQ ID NO: 960726 - RNA, 18 nt, Human
uaucagacagugaucagu

SEQ ID NO: 960727 - RNA, 19 nt, Human
ucaccuuaucagacaguga

SEQ ID NO: 960728 - RNA, 24 nt, Human
ucauauacagugaacugagaagcu

SEQ ID NO: 960729 - RNA, 20 nt, Human
uccagcuggaaaggaagcuc

SEQ ID NO: 960730 - RNA, 24 nt, Human
uccaguguuggggccucuccagcc

SEQ ID NO: 960731 - RNA, 18 nt, Human
uccaucagcaggacauga

SEQ ID NO: 960732 - RNA, 18 nt, Human
uccccaacaaccccgggc

SEQ ID NO: 960733 - RNA, 21 nt, Human
ucccccuccccccagagagac

SEQ ID NO: 960734 - RNA, 18 nt, Human
uccuuauaucucccccuc

SEQ ID NO: 960735 - RNA, 19 nt, Human
ucgugggagcucagagugg

SEQ ID NO: 960736 - RNA, 27 nt, Human
ucuccuuauaucucccccuccccccag

SEQ ID NO: 960737 - RNA, 21 nt, Human
ucucgugggagcucagagugg

SEQ ID NO: 960738 - RNA, 19 nt, Human
ugaaaaauaaaccaaugaa

SEQ ID NO: 960739 - RNA, 20 nt, Human
ugagaagcuacauucauuau

SEQ ID NO: 960740 - RNA, 19 nt, Human
ugagcccagaaagaaggug

SEQ ID NO: 960741 - RNA, 21 nt, Human
ugccagggucugggugccucc

SEQ ID NO: 960742 - RNA, 19 nt, Human
ugccuccaaacccccaaua

SEQ ID NO: 960743 - RNA, 20 nt, Human
ugccugccccucuccucuug

SEQ ID NO: 960744 - RNA, 22 nt, Human
ugggaugugaacuggcucugug

SEQ ID NO: 960745 - RNA, 19 nt, Human
ugggugccuccaaaccccc

SEQ ID NO: 960746 - RNA, 19 nt, Human
uguccugcccccaagccag

SEQ ID NO: 960747 - RNA, 24 nt, Human
uuaguaauuuucugccccagccag

SEQ ID NO: 960748 - RNA, 18 nt, Human
uugagcccagaaagaagg

SEQ ID NO: 960749 - RNA, 24 nt, Human
uugaucucaccuuaucagacagug

SEQ ID NO: 960750 - RNA, 19 nt, Human
uugggguuggaagauaacu

SEQ ID NO: 960751 - RNA, 21 nt, Human
aaacaacuggaaaauaguuuu

SEQ ID NO: 960752 - RNA, 22 nt, Human
aaggagauuaucuccuuggaaa

SEQ ID NO: 960753 - RNA, 29 nt, Human
aagugauuuauugauacugguuaacaucc

SEQ ID NO: 960754 - RNA, 19 nt, Human
accccgcgggcuuccgagc

SEQ ID NO: 960755 - RNA, 24 nt, Human
agaaacuuucaaaauuguacaaag

SEQ ID NO: 960756 - RNA, 19 nt, Human
agaauguuuaugguucugu

SEQ ID NO: 960757 - RNA, 20 nt, Human
agcauaaagaaaauugagaa

SEQ ID NO: 960758 - RNA, 18 nt, Human
aggcaccaagaaggagau

SEQ ID NO: 960759 - RNA, 24 nt, Human
cacaucaguuuuaaaaauuagaaa

SEQ ID NO: 960760 - RNA, 21 nt, Human
caccaagaaggagauuaucuc

SEQ ID NO: 960761 - RNA, 20 nt, Human
caccccgcgggcuuccgagc

SEQ ID NO: 960762 - RNA, 22 nt, Human
caucuagaaaauuaggcaccaa

SEQ ID NO: 960763 - RNA, 22 nt, Human
cccaagguuauuaaaagucugc

SEQ ID NO: 960764 - RNA, 22 nt, Human
cccgcugcggucgcuucucccg

SEQ ID NO: 960765 - RNA, 21 nt, Human
cccucgguggccgggcucccg

SEQ ID NO: 960766 - RNA, 19 nt, Human
ccuagugccggcagcccuc

SEQ ID NO: 960767 - RNA, 24 nt, Human
cuaccagauaaaucccaagguuau

SEQ ID NO: 960768 - RNA, 23 nt, Human
cucccgcaccccgcgggcuuccg

SEQ ID NO: 960769 - RNA, 22 nt, Human
cugaaaaugagcaagaaaucaa

SEQ ID NO: 960770 - RNA, 22 nt, Human
cuggacucacgcucggaguugc

SEQ ID NO: 960771 - RNA, 20 nt, Human
gagcaagaaaucaaaacuag

SEQ ID NO: 960772 - RNA, 21 nt, Human
gcaacaucaaugacagagaag

SEQ ID NO: 960773 - RNA, 22 nt, Human
gcuuuuuuuucucauugcaauu

SEQ ID NO: 960774 - RNA, 23 nt, Human
gucuguucccgcucccgcacccc

SEQ ID NO: 960775 - RNA, 18 nt, Human
uagaaacuuucaaaauug

SEQ ID NO: 960776 - RNA, 22 nt, Human
uagcauaaagaaaauugagaau

SEQ ID NO: 960777 - RNA, 21 nt, Human
uaggcaccaagaaggagauua

SEQ ID NO: 960778 - RNA, 25 nt, Human
uauaauuaugaaaaaaauguagaac

SEQ ID NO: 960779 - RNA, 22 nt, Human
uauauaauuaugaaaaaaaugu

SEQ ID NO: 960780 - RNA, 27 nt, Human
uaugaaaugcaaaccacaucaguuuua

SEQ ID NO: 960781 - RNA, 22 nt, Human
uccauuauauacagguagaaac

SEQ ID NO: 960782 - RNA, 22 nt, Human
uggccgggcucccgcugcgguc

SEQ ID NO: 960783 - RNA, 20 nt, Human
uguucccgcucccgcacccc

SEQ ID NO: 960784 - RNA, 22 nt, Human
uuaaaagucugcuaugcagacc

SEQ ID NO: 960785 - RNA, 22 nt, Human
uucuaaaugccaucucuuccug

SEQ ID NO: 960786 - RNA, 22 nt, Human
aaaugcuaaaggcauuuuaugg

SEQ ID NO: 960787 - RNA, 21 nt, Human
aacauuuaauaauacauaaaa

SEQ ID NO: 960788 - RNA, 22 nt, Human
aaguagugaaagcugaagaacu

SEQ ID NO: 960789 - RNA, 22 nt, Human
agcaagcaacagagaaguagug

SEQ ID NO: 960790 - RNA, 21 nt, Human
auaggacaaccacucaaacac

SEQ ID NO: 960791 - RNA, 18 nt, Human
caaccuauagggcaaaua

SEQ ID NO: 960792 - RNA, 18 nt, Human
cagcuaggcaauaaagga

SEQ ID NO: 960793 - RNA, 22 nt, Human
ggggccacuaggauacgccccu

SEQ ID NO: 960794 - RNA, 19 nt, Human
uaaguuaguaugcaaccua

SEQ ID NO: 960795 - RNA, 22 nt, Human
uaucuuuucuucuuucacaagg

SEQ ID NO: 960796 - RNA, 20 nt, Human
uauuuuaguaguuacaugau

SEQ ID NO: 960797 - RNA, 19 nt, Human
uggcugugccgaggcgggu

SEQ ID NO: 960798 - RNA, 18 nt, Human
uggguucucaaaacaguu

SEQ ID NO: 960799 - RNA, 24 nt, Human
uuacaugauuagcaagcaacagag

SEQ ID NO: 960800 - RNA, 18 nt, Human
uucacaaaugaucaucac

SEQ ID NO: 960801 - RNA, 23 nt, Human
uucuccauauacacauuuguuag

SEQ ID NO: 960802 - RNA, 20 nt, Human
uugguauuuugguauagugu

SEQ ID NO: 960803 - RNA, 20 nt, Human
uuucucagcgcaaggccgga

SEQ ID NO: 960804 - RNA, 19 nt, Human
uuugcauuuaaauauuugu

SEQ ID NO: 960805 - RNA, 21 nt, Human
uuuuauggugacaugaaugcu

SEQ ID NO: 960806 - RNA, 26 nt, Human
aaaaagaaacagaaucuguugcagaa

SEQ ID NO: 960807 - RNA, 23 nt, Human
aaaaagcaggcacucagcugguu

SEQ ID NO: 960808 - RNA, 22 nt, Human
aacaauccuguucacccucuca

SEQ ID NO: 960809 - RNA, 24 nt, Human
aagauauccugccccagguccuua

SEQ ID NO: 960810 - RNA, 20 nt, Human
accacagaagggagaaacaa

SEQ ID NO: 960811 - RNA, 21 nt, Human
accccagacccugggcuacag

SEQ ID NO: 960812 - RNA, 20 nt, Human
agaaaacugacauggcccuc

SEQ ID NO: 960813 - RNA, 19 nt, Human
agaaggccagacauaaagg

SEQ ID NO: 960814 - RNA, 21 nt, Human
agagugaagaacugauucuau

SEQ ID NO: 960815 - RNA, 20 nt, Human
agcaaaaggcaguucauccc

SEQ ID NO: 960816 - RNA, 24 nt, Human
agcaaggaaaagagucgggaaaaa

SEQ ID NO: 960817 - RNA, 18 nt, Human
agccaagccuacagcauc

SEQ ID NO: 960818 - RNA, 22 nt, Human
agcuuccagcaaaaggcaguuc

SEQ ID NO: 960819 - RNA, 24 nt, Human
aggacccccaacccuugaggagcc

SEQ ID NO: 960820 - RNA, 27 nt, Human
aggcagggaaaagguaagggcaggguc

SEQ ID NO: 960821 - RNA, 22 nt, Human
auaaaccacagaagggagaaac

SEQ ID NO: 960822 - RNA, 23 nt, Human
auaaaggaguaaaaagcaggcac

SEQ ID NO: 960823 - RNA, 20 nt, Human
aucccuuucaccuuccaucc

SEQ ID NO: 960824 - RNA, 19 nt, Human
auggcuccaauuccagaac

SEQ ID NO: 960825 - RNA, 18 nt, Human
caaaucgaagcagcuuua

SEQ ID NO: 960826 - RNA, 26 nt, Human
cacagccuaagacagcuuccagcaaa

SEQ ID NO: 960827 - RNA, 22 nt, Human
cacccucucagaagccacuuaa

SEQ ID NO: 960828 - RNA, 21 nt, Human
cagaggcagggaaaagguaag

SEQ ID NO: 960829 - RNA, 23 nt, Human
cagcaaaaggcaguucaucccuu

SEQ ID NO: 960830 - RNA, 18 nt, Human
cagccuaagacagcuucc

SEQ ID NO: 960831 - RNA, 22 nt, Human
ccaacauagguggagucaaggg

SEQ ID NO: 960832 - RNA, 20 nt, Human
ccaaccuagcccacccuuaa

SEQ ID NO: 960833 - RNA, 18 nt, Human
ccacagaagggagaaaca

SEQ ID NO: 960834 - RNA, 20 nt, Human
ccauccaaccuagcccaccc

SEQ ID NO: 960835 - RNA, 22 nt, Human
cccagacccugggcuacagaga

SEQ ID NO: 960836 - RNA, 21 nt, Human
ccccagacccugggcuacaga

SEQ ID NO: 960837 - RNA, 21 nt, Human
cccucucagaagccacuuaaa

SEQ ID NO: 960838 - RNA, 21 nt, Human
ccuccaggccugagagugucu

SEQ ID NO: 960839 - RNA, 24 nt, Human
cgggaaaaagaaacagaaucuguu

SEQ ID NO: 960840 - RNA, 25 nt, Human
cucuugguucugcucagcacccauc

SEQ ID NO: 960841 - RNA, 18 nt, Human
cuugguucugcucagcac

SEQ ID NO: 960842 - RNA, 20 nt, Human
gaaacagaaucuguugcaga

SEQ ID NO: 960843 - RNA, 24 nt, Human
gaaauacggaccuggaaauaccaa

SEQ ID NO: 960844 - RNA, 21 nt, Human
gacagcuuccagcaaaaggca

SEQ ID NO: 960845 - RNA, 24 nt, Human
gcuacagagaaauacggaccugga

SEQ ID NO: 960846 - RNA, 21 nt, Human
gcugugguuccccugcuccug

SEQ ID NO: 960847 - RNA, 19 nt, Human
gggcaggcucauaaaccac

SEQ ID NO: 960848 - RNA, 24 nt, Human
ggggagaagauauccugccccagg

SEQ ID NO: 960849 - RNA, 19 nt, Human
guucaaagggugaacagca

SEQ ID NO: 960850 - RNA, 18 nt, Human
uaaaggaguaaaaagcag

SEQ ID NO: 960851 - RNA, 18 nt, Human
uaagacagcuuccagcaa

SEQ ID NO: 960852 - RNA, 23 nt, Human
uacagcaucacauaccuggcagc

SEQ ID NO: 960853 - RNA, 19 nt, Human
uaccccagacccugggcua

SEQ ID NO: 960854 - RNA, 18 nt, Human
uagaagaucccuggggga

SEQ ID NO: 960855 - RNA, 21 nt, Human
uagaagaucccugggggagaa

SEQ ID NO: 960856 - RNA, 19 nt, Human
uagaaggccagacauaaag

SEQ ID NO: 960857 - RNA, 19 nt, Human
uagcccacccuuaauaaug

SEQ ID NO: 960858 - RNA, 18 nt, Human
uagguggcagaaaacuga

SEQ ID NO: 960859 - RNA, 18 nt, Human
ucacagaaggaauggccu

SEQ ID NO: 960860 - RNA, 19 nt, Human
uccaaccuagcccacccuu

SEQ ID NO: 960861 - RNA, 22 nt, Human
uccaaccuagcccacccuuaau

SEQ ID NO: 960862 - RNA, 24 nt, Human
ucccugggggagaagauauccugc

SEQ ID NO: 960863 - RNA, 21 nt, Human
uccugccccagguccuuacag

SEQ ID NO: 960864 - RNA, 24 nt, Human
ugcccugccuccaggccugagagu

SEQ ID NO: 960865 - RNA, 23 nt, Human
ugccuccaggccugagagugucu

SEQ ID NO: 960866 - RNA, 21 nt, Human
ugcgagggagaaggaccccca

SEQ ID NO: 960867 - RNA, 22 nt, Human
ugcucagcacccaucccucacg

SEQ ID NO: 960868 - RNA, 20 nt, Human
uggaaauaccaagucagagg

SEQ ID NO: 960869 - RNA, 25 nt, Human
uggcagaaaacugacauggcccuca

SEQ ID NO: 960870 - RNA, 22 nt, Human
uggcugcgagggagaaggaccc

SEQ ID NO: 960871 - RNA, 19 nt, Human
ugguucugcucagcaccca

SEQ ID NO: 960872 - RNA, 21 nt, Human
uguaguauuagggagagugaa

SEQ ID NO: 960873 - RNA, 24 nt, Human
uguaguauuagggagagugaagaa

SEQ ID NO: 960874 - RNA, 24 nt, Human
uguucacccucucagaagccacuu

SEQ ID NO: 960875 - RNA, 22 nt, Human
uuggacagauccuagaaggcca

SEQ ID NO: 960876 - RNA, 21 nt, Human
uuguucaaagggugaacagca

SEQ ID NO: 960877 - RNA, 22 nt, Human
uuuuuuuuuuuuuuuuuaccaa

SEQ ID NO: 960878 - RNA, 23 nt, Human
aaccacugcaacaaacaagcacc

SEQ ID NO: 960879 - RNA, 20 nt, Human
acacuggcaccuaaagacag

SEQ ID NO: 960880 - RNA, 22 nt, Human
accacugcaacaaacaagcacc

SEQ ID NO: 960881 - RNA, 23 nt, Human
aggccuuugacagcacagugagg

SEQ ID NO: 960882 - RNA, 19 nt, Human
caacaaacaagcacccaag

SEQ ID NO: 960883 - RNA, 29 nt, Human
caacaaacaagcacccaagagaggcugug

SEQ ID NO: 960884 - RNA, 23 nt, Human
cacccacaggccuuugacagcac

SEQ ID NO: 960885 - RNA, 20 nt, Human
cacugcaacaaacaagcacc

SEQ ID NO: 960886 - RNA, 20 nt, Human
cagggaccgaggcuguggag

SEQ ID NO: 960887 - RNA, 20 nt, Human
cagggaccgaggcuguggag

SEQ ID NO: 960888 - RNA, 18 nt, Human
ccacaggccuuugacagc

SEQ ID NO: 960889 - RNA, 20 nt, Human
cggcugcggcgagcuggcuu

SEQ ID NO: 960890 - RNA, 19 nt, Human
cuaaaggcagggaccgagg

SEQ ID NO: 960891 - RNA, 23 nt, Human
gacaggccgugcagcuaaaagga

SEQ ID NO: 960892 - RNA, 21 nt, Human
gagcccugcacccacaggccu

SEQ ID NO: 960893 - RNA, 22 nt, Human
gcggcagagcccugcacccaca

SEQ ID NO: 960894 - RNA, 23 nt, Human
ggcuguggaggggcgagcagggc

SEQ ID NO: 960895 - RNA, 20 nt, Human
ggugacgggguuccgagcac

SEQ ID NO: 960896 - RNA, 21 nt, Human
ggugcggugaaggcccaggga

SEQ ID NO: 960897 - RNA, 18 nt, Human
gucucccucacaaucuca

SEQ ID NO: 960898 - RNA, 19 nt, Human
ucacacuggcaccuaaaga

SEQ ID NO: 960899 - RNA, 21 nt, Human
ucccgcguuucuaaaggcagg

SEQ ID NO: 960900 - RNA, 24 nt, Human
ucccgcguuucuaaaggcagggac

SEQ ID NO: 960901 - RNA, 21 nt, Human
uuagguccugggucucccuca

SEQ ID NO: 960902 - RNA, 24 nt, Human
uugacagcacagugaggggccucc

SEQ ID NO: 960903 - RNA, 22 nt, Human
aaacaggcagacucuaagccca

SEQ ID NO: 960904 - RNA, 23 nt, Human
aaacuggcuuuauuugucacuua

SEQ ID NO: 960905 - RNA, 21 nt, Human
aacaggcagacucuaagccca

SEQ ID NO: 960906 - RNA, 23 nt, Human
aacauccuuggucccaccaaugu

SEQ ID NO: 960907 - RNA, 24 nt, Human
aaccugacuucacuaccaaccuug

SEQ ID NO: 960908 - RNA, 18 nt, Human
aacugaucaacaccacca

SEQ ID NO: 960909 - RNA, 21 nt, Human
aacugaucaacaccaccacag

SEQ ID NO: 960910 - RNA, 20 nt, Human
aagaaaauucugaacacagc

SEQ ID NO: 960911 - RNA, 28 nt, Human
aaugaaagaauacgaaauucaaaaacau

SEQ ID NO: 960912 - RNA, 22 nt, Human
acacccuacugccaaaaugaaa

SEQ ID NO: 960913 - RNA, 24 nt, Human
agaaacaggcagacucuaagccca

SEQ ID NO: 960914 - RNA, 21 nt, Human
agagugagaaauucccuuugu

SEQ ID NO: 960915 - RNA, 31 nt, Human
agcaacugaucaacaccaccacagcccaugg

SEQ ID NO: 960916 - RNA, 22 nt, Human
agcaaggucuccagagugugcc

SEQ ID NO: 960917 - RNA, 22 nt, Human
agcagcagagcagacagggcag

SEQ ID NO: 960918 - RNA, 19 nt, Human
agcagcuuccucaaccugu

SEQ ID NO: 960919 - RNA, 26 nt, Human
agccagcucgaaaccucgagcuccuc

SEQ ID NO: 960920 - RNA, 23 nt, Human
agcccccacccacccaccgugac

SEQ ID NO: 960921 - RNA, 19 nt, Human
agcugccugccugccagag

SEQ ID NO: 960922 - RNA, 18 nt, Human
agcuuggcagagcugaug

SEQ ID NO: 960923 - RNA, 20 nt, Human
auaugccgcagcagcacgcg

SEQ ID NO: 960924 - RNA, 24 nt, Human
augacccaaguggacuaaacacgg

SEQ ID NO: 960925 - RNA, 19 nt, Human
caacugaucaacaccacca

SEQ ID NO: 960926 - RNA, 24 nt, Human
cacacccuacugccaaaaugaaac

SEQ ID NO: 960927 - RNA, 22 nt, Human
cacaguaagaaaauucugaaca

SEQ ID NO: 960928 - RNA, 22 nt, Human
cacaguggaaugaaagaauacg

SEQ ID NO: 960929 - RNA, 18 nt, Human
caccaaugucuaaagcca

SEQ ID NO: 960930 - RNA, 20 nt, Human
caccugucagcacaaacaga

SEQ ID NO: 960931 - RNA, 19 nt, Human
cacugcacagcagcuccgc

SEQ ID NO: 960932 - RNA, 18 nt, Human
cagacucuaagcccaacc

SEQ ID NO: 960933 - RNA, 23 nt, Human
cagcacaaacagaacuuauucca

SEQ ID NO: 960934 - RNA, 25 nt, Human
cagcacaaacagaacuuauuccaga

SEQ ID NO: 960935 - RNA, 19 nt, Human
cagcacugagaaggugcaa

SEQ ID NO: 960936 - RNA, 19 nt, Human
cagcccccugcccaccagc

SEQ ID NO: 960937 - RNA, 22 nt, Human
cagcuagaagagccaauaggug

SEQ ID NO: 960938 - RNA, 24 nt, Human
cagcuucacacccuacugccaaaa

SEQ ID NO: 960939 - RNA, 19 nt, Human
cagcuuccucaaccugucc

SEQ ID NO: 960940 - RNA, 24 nt, Human
caggcccccuucuuaggaucaggg

SEQ ID NO: 960941 - RNA, 22 nt, Human
cagugccaggauaaaaagcaaa

SEQ ID NO: 960942 - RNA, 24 nt, Human
caugcaccccgaaccugacuucac

SEQ ID NO: 960943 - RNA, 21 nt, Human
ccacagcccaugcaccccgaa

SEQ ID NO: 960944 - RNA, 24 nt, Human
ccaccacagcccaugcaccccgaa

SEQ ID NO: 960945 - RNA, 24 nt, Human
ccagccgaugguuacaggcugcag

SEQ ID NO: 960946 - RNA, 18 nt, Human
cccaaguggacuaaacac

SEQ ID NO: 960947 - RNA, 18 nt, Human
cccaccaaugucuaaagc

SEQ ID NO: 960948 - RNA, 19 nt, Human
cccacugucagaguggggu

SEQ ID NO: 960949 - RNA, 20 nt, Human
cccacugucagagugggguc

SEQ ID NO: 960950 - RNA, 20 nt, Human
cccgaaccugacuucacuac

SEQ ID NO: 960951 - RNA, 25 nt, Human
cccuaaaggccagagagagggugcu

SEQ ID NO: 960952 - RNA, 20 nt, Human
cccuacugccaaaaugaaac

SEQ ID NO: 960953 - RNA, 24 nt, Human
ccucaggaucuuagcacccaacuc

SEQ ID NO: 960954 - RNA, 22 nt, Human
ccucuguagcagcagagcagac

SEQ ID NO: 960955 - RNA, 24 nt, Human
ccuuggucacucuguuuccuggcu

SEQ ID NO: 960956 - RNA, 23 nt, Human
cgcguuccacugcacagcagcuc

SEQ ID NO: 960957 - RNA, 21 nt, Human
cggcgcggcgcggcgcggggc

SEQ ID NO: 960958 - RNA, 18 nt, Human
cgggcuccgggucccgcu

SEQ ID NO: 960959 - RNA, 21 nt, Human
cggggccgggccucggaucgc

SEQ ID NO: 960960 - RNA, 22 nt, Human
cgugaccaucacccacagggcu

SEQ ID NO: 960961 - RNA, 19 nt, Human
cgugugcccacugucagag

SEQ ID NO: 960962 - RNA, 25 nt, Human
cuaagcacaguaagaaaauucugaa

SEQ ID NO: 960963 - RNA, 25 nt, Human
cuccccgacaggcugcacgcacccc

SEQ ID NO: 960964 - RNA, 20 nt, Human
cuccccugcucaggacuggg

SEQ ID NO: 960965 - RNA, 21 nt, Human
cuccgggucccgcuucagcuc

SEQ ID NO: 960966 - RNA, 19 nt, Human
cuccugaggccuggugccu

SEQ ID NO: 960967 - RNA, 23 nt, Human
cucgaaaccucgagcuccucagg

SEQ ID NO: 960968 - RNA, 21 nt, Human
cugacuucacuaccaaccuug

SEQ ID NO: 960969 - RNA, 22 nt, Human
cugaggccuggugccuuccagc

SEQ ID NO: 960970 - RNA, 20 nt, Human
cugcagccgcauacagcacu

SEQ ID NO: 960971 - RNA, 24 nt, Human
cugcccuugcugcugggcagugcc

SEQ ID NO: 960972 - RNA, 18 nt, Human
cugcuccgcgugaggcga

SEQ ID NO: 960973 - RNA, 21 nt, Human
cugcuccgcgugaggcgacgc

SEQ ID NO: 960974 - RNA, 19 nt, Human
cugcugcccuugcugcugg

SEQ ID NO: 960975 - RNA, 23 nt, Human
cugcugcccuugcugcugggcag

SEQ ID NO: 960976 - RNA, 23 nt, Human
cugcugcugaguugcuggguggc

SEQ ID NO: 960977 - RNA, 22 nt, Human
cuggagcagcuuccucaaccug

SEQ ID NO: 960978 - RNA, 18 nt, Human
cuggugacgcagaaagga

SEQ ID NO: 960979 - RNA, 20 nt, Human
cuguccuuaaaaaaaucacu

SEQ ID NO: 960980 - RNA, 18 nt, Human
cugugcuuugcaggcugc

SEQ ID NO: 960981 - RNA, 21 nt, Human
cuugcgugcaguccuaagcac

SEQ ID NO: 960982 - RNA, 18 nt, Human
gaaagccaucccucucuu

SEQ ID NO: 960983 - RNA, 18 nt, Human
gaaccauguggguaggag

SEQ ID NO: 960984 - RNA, 24 nt, Human
gagagacacgucagugcuagcccg

SEQ ID NO: 960985 - RNA, 18 nt, Human
gagcagacagggcagugg

SEQ ID NO: 960986 - RNA, 20 nt, Human
gagggugcucaucuccagga

SEQ ID NO: 960987 - RNA, 22 nt, Human
gaguugcuggguggcuuuaggc

SEQ ID NO: 960988 - RNA, 22 nt, Human
gcaguccuaagcacaguaagaa

SEQ ID NO: 960989 - RNA, 20 nt, Human
gccaggauaaaaagcaaaau

SEQ ID NO: 960990 - RNA, 19 nt, Human
gcccugugcuuugcaggcu

SEQ ID NO: 960991 - RNA, 24 nt, Human
gcccugugcuuugcaggcugccgu

SEQ ID NO: 960992 - RNA, 25 nt, Human
gcgacgcugcccgcggcccagcgcg

SEQ ID NO: 960993 - RNA, 18 nt, Human
gcgcggcgcggggcgggg

SEQ ID NO: 960994 - RNA, 18 nt, Human
gcgcggggcggggccggg

SEQ ID NO: 960995 - RNA, 26 nt, Human
gcugcagccgcauacagcacugagaa

SEQ ID NO: 960996 - RNA, 18 nt, Human
gcuucagcucagcucugc

SEQ ID NO: 960997 - RNA, 23 nt, Human
ggacaaacggacaucacugcaag

SEQ ID NO: 960998 - RNA, 25 nt, Human
ggccggggccgggccucggaucgcu

SEQ ID NO: 960999 - RNA, 21 nt, Human
ggccuggugccuuccagcccc

SEQ ID NO: 961000 - RNA, 18 nt, Human
ggcgcggcgcggcgcggg

SEQ ID NO: 961001 - RNA, 20 nt, Human
ggcgcggcgcggcgcggggc

SEQ ID NO: 961002 - RNA, 21 nt, Human
ggcuguggcgguggcccugug

SEQ ID NO: 961003 - RNA, 26 nt, Human
gggcggggccggggccgggccucgga

SEQ ID NO: 961004 - RNA, 24 nt, Human
gggcuugugagcacuaagucaguu

SEQ ID NO: 961005 - RNA, 22 nt, Human
ggggccggggccgggccucgga

SEQ ID NO: 961006 - RNA, 22 nt, Human
ggucacucuguuuccuggcuag

SEQ ID NO: 961007 - RNA, 20 nt, Human
gugaccaucacccacagggc

SEQ ID NO: 961008 - RNA, 18 nt, Human
gugugcccacugucagag

SEQ ID NO: 961009 - RNA, 20 nt, Human
guuugugcuuccaaccagag

SEQ ID NO: 961010 - RNA, 21 nt, Human
uaagccagauauucccacgcc

SEQ ID NO: 961011 - RNA, 18 nt, Human
uacauggacacuugggga

SEQ ID NO: 961012 - RNA, 26 nt, Human
uaccacaaugucuccccuugcuaggg

SEQ ID NO: 961013 - RNA, 20 nt, Human
uagaagagccaauaggugca

SEQ ID NO: 961014 - RNA, 24 nt, Human
uagacauuucaguguuugugcuuc

SEQ ID NO: 961015 - RNA, 21 nt, Human
uagcacugccagcaaggucuc

SEQ ID NO: 961016 - RNA, 23 nt, Human
uagcagaaacaggcagacucuaa

SEQ ID NO: 961017 - RNA, 23 nt, Human
uagcccggcggcaagcggcgcgg

SEQ ID NO: 961018 - RNA, 18 nt, Human
uagggcagcugcgaggag

SEQ ID NO: 961019 - RNA, 21 nt, Human
ucaacaccaccacagcccaug

SEQ ID NO: 961020 - RNA, 19 nt, Human
ucacaguucuuuuugccag

SEQ ID NO: 961021 - RNA, 18 nt, Human
ucagcucagcucugcucc

SEQ ID NO: 961022 - RNA, 22 nt, Human
ucagcucugcuccgcgugaggc

SEQ ID NO: 961023 - RNA, 24 nt, Human
ucaguguuugugcuuccaaccaga

SEQ ID NO: 961024 - RNA, 23 nt, Human
uccacagauggccaggagugucu

SEQ ID NO: 961025 - RNA, 19 nt, Human
ucccuuggucacucuguuu

SEQ ID NO: 961026 - RNA, 20 nt, Human
uccuaagcacaguaagaaaa

SEQ ID NO: 961027 - RNA, 19 nt, Human
ucgaaaccucgagcuccuc

SEQ ID NO: 961028 - RNA, 23 nt, Human
ucuccagagugugccccucugcc

SEQ ID NO: 961029 - RNA, 22 nt, Human
ucugcucccagcuucacacccu

SEQ ID NO: 961030 - RNA, 22 nt, Human
ugacgacacuggugacgcagaa

SEQ ID NO: 961031 - RNA, 27 nt, Human
ugaucaacaccaccacagcccaugcac

SEQ ID NO: 961032 - RNA, 20 nt, Human
ugcacgcacccccaggcccc

SEQ ID NO: 961033 - RNA, 23 nt, Human
ugcugcugaguugcuggguggcu

SEQ ID NO: 961034 - RNA, 18 nt, Human
uggccaggcucagcuugg

SEQ ID NO: 961035 - RNA, 23 nt, Human
uggugccuuccagcccccugccc

SEQ ID NO: 961036 - RNA, 18 nt, Human
uguccagugaugacuggc

SEQ ID NO: 961037 - RNA, 19 nt, Human
uuacacaguggaaugaaag

SEQ ID NO: 961038 - RNA, 19 nt, Human
uuagcacccaacucugcug

SEQ ID NO: 961039 - RNA, 21 nt, Human
uucaccuuaucucaguuaugc

SEQ ID NO: 961040 - RNA, 22 nt, Human
uuggaaaaugucuagcacuuua

SEQ ID NO: 961041 - RNA, 18 nt, Human
uuuccuggcuagcacugc

SEQ ID NO: 961042 - RNA, 18 nt, Human
acggagcccccgaaagac

SEQ ID NO: 961043 - RNA, 23 nt, Human
agaaaaaaacugauuccucaaaa

SEQ ID NO: 961044 - RNA, 21 nt, Human
ccccuguaaaacagcaagcuu

SEQ ID NO: 961045 - RNA, 18 nt, Human
cgaaagaccggcagcugg

SEQ ID NO: 961046 - RNA, 22 nt, Human
cucaugaacagauagucacuau

SEQ ID NO: 961047 - RNA, 24 nt, Human
gaacagauagucacuauacuuuug

SEQ ID NO: 961048 - RNA, 22 nt, Human
guaaaacagcaagcuuacagaa

SEQ ID NO: 961049 - RNA, 23 nt, Human
uaaaacagcaagcuuacagaaaa

SEQ ID NO: 961050 - RNA, 19 nt, Human
uagaaaaaaacugauuccu

SEQ ID NO: 961051 - RNA, 21 nt, Human
uagaaaaaaacugauuccuca

SEQ ID NO: 961052 - RNA, 19 nt, Human
uagccauagaaaaaaacug

SEQ ID NO: 961053 - RNA, 21 nt, Human
uagucacuauacuuuuggucc

SEQ ID NO: 961054 - RNA, 19 nt, Human
uccccuguaaaacagcaag

SEQ ID NO: 961055 - RNA, 18 nt, Human
ucucucaugaacagauag

SEQ ID NO: 961056 - RNA, 19 nt, Human
ucucucaugaacagauagu

SEQ ID NO: 961057 - RNA, 22 nt, Human
uucaguauaagugaauuaaaaa

SEQ ID NO: 961058 - RNA, 19 nt, Human
uuggguuuuuuccuccuuc

SEQ ID NO: 961059 - RNA, 24 nt, Human
uuuuuuuuuuuuuuuuuuuuucag

SEQ ID NO: 961060 - RNA, 26 nt, Human
aaacaucuugaaaggaaaaaaaaaaa

SEQ ID NO: 961061 - RNA, 23 nt, Human
aaauagaaaacaucuugaaagga

SEQ ID NO: 961062 - RNA, 19 nt, Human
agaaaacaucuugaaagga

SEQ ID NO: 961063 - RNA, 23 nt, Human
aggaaaaaaaaaaacccacaaaa

SEQ ID NO: 961064 - RNA, 24 nt, Human
cacccucacacuuguucaccaauc

SEQ ID NO: 961065 - RNA, 22 nt, Human
ccaaccgacaccuaaaaugcca

SEQ ID NO: 961066 - RNA, 18 nt, Human
cccacaaaacauacaggc

SEQ ID NO: 961067 - RNA, 22 nt, Human
cccacaaaacauacaggcaaau

SEQ ID NO: 961068 - RNA, 24 nt, Human
cucacacuuguucaccaaucucua

SEQ ID NO: 961069 - RNA, 20 nt, Human
cugugaguuucucacacccu

SEQ ID NO: 961070 - RNA, 21 nt, Human
gaaaaaaaaaaacccacaaaa

SEQ ID NO: 961071 - RNA, 22 nt, Human
gaaaaaaaaaaacccacaaaac

SEQ ID NO: 961072 - RNA, 19 nt, Human
gaaaggaaaaaaaaaaacc

SEQ ID NO: 961073 - RNA, 20 nt, Human
gcugauggagcccaccggaa

SEQ ID NO: 961074 - RNA, 21 nt, Human
uaaaaugccagggacacguag

SEQ ID NO: 961075 - RNA, 22 nt, Human
ugccuacccaaccgacaccuaa

SEQ ID NO: 961076 - RNA, 20 nt, Human
ugcugauggagcccaccgga

SEQ ID NO: 961077 - RNA, 21 nt, Human
ugcugauggagcccaccggaa

SEQ ID NO: 961078 - RNA, 19 nt, Human
uucucacacccucacacuu

SEQ ID NO: 961079 - RNA, 20 nt, Human
uuucucacacccucacacuu

SEQ ID NO: 961080 - RNA, 27 nt, Human
uuuuuuuuuuuuuuuuuuuuacuuuga

SEQ ID NO: 961081 - RNA, 23 nt, Human
aaaaguuuaaaucuaugagugga

SEQ ID NO: 961082 - RNA, 21 nt, Human
aaaauaaaaguuuaaaucuau

SEQ ID NO: 961083 - RNA, 19 nt, Human
aaaauuccaaaacguagcc

SEQ ID NO: 961084 - RNA, 18 nt, Human
aaagcugaacaaagaaaa

SEQ ID NO: 961085 - RNA, 22 nt, Human
aacaacagagcuuaucaagaga

SEQ ID NO: 961086 - RNA, 21 nt, Human
aagaaaaggaaaauuccaaaa

SEQ ID NO: 961087 - RNA, 24 nt, Human
aagaaaaggaaaauuccaaaacgu

SEQ ID NO: 961088 - RNA, 18 nt, Human
aagauagagguuuagaaa

SEQ ID NO: 961089 - RNA, 23 nt, Human
aagcuuccuuugcauguuauacu

SEQ ID NO: 961090 - RNA, 24 nt, Human
accauccccuacuugaaagguuuc

SEQ ID NO: 961091 - RNA, 30 nt, Human
agccaccaguaucagaaaacauacaguccu

SEQ ID NO: 961092 - RNA, 22 nt, Human
agguuuagaaaugguuuaagcc

SEQ ID NO: 961093 - RNA, 25 nt, Human
agugaaccuuuuuuaaaaaagguuu

SEQ ID NO: 961094 - RNA, 23 nt, Human
auaauaacaaaggauuuauuauc

SEQ ID NO: 961095 - RNA, 18 nt, Human
auacacuuucaaaacagc

SEQ ID NO: 961096 - RNA, 21 nt, Human
auuugugguguuugcuaaaac

SEQ ID NO: 961097 - RNA, 26 nt, Human
caaaaaauugcaaauaugugcaaaca

SEQ ID NO: 961098 - RNA, 24 nt, Human
caaaaugaauacaaaaaaagcuuc

SEQ ID NO: 961099 - RNA, 21 nt, Human
caagagauuaucaacuugagc

SEQ ID NO: 961100 - RNA, 25 nt, Human
caccaguaucagaaaacauacaguc

SEQ ID NO: 961101 - RNA, 24 nt, Human
cacccccuccuccgccaccacugg

SEQ ID NO: 961102 - RNA, 18 nt, Human
cacccccuccuccgccuc

SEQ ID NO: 961103 - RNA, 22 nt, Human
cacucccgcucccaacgcccca

SEQ ID NO: 961104 - RNA, 26 nt, Human
cagaugaaauaaauguaccauccccu

SEQ ID NO: 961105 - RNA, 18 nt, Human
cauguggaaugugagaga

SEQ ID NO: 961106 - RNA, 21 nt, Human
ccauuucuagaguaaaaaaac

SEQ ID NO: 961107 - RNA, 18 nt, Human
ccgccgccgccacgacca

SEQ ID NO: 961108 - RNA, 20 nt, Human
ccgccgccgccacgaccacg

SEQ ID NO: 961109 - RNA, 20 nt, Human
ccgccgccucuccuccccgc

SEQ ID NO: 961110 - RNA, 22 nt, Human
ccgccgccucuccuccccgccc

SEQ ID NO: 961111 - RNA, 19 nt, Human
ccuccgccucgcucuucuc

SEQ ID NO: 961112 - RNA, 19 nt, Human
ccucuccuccccgccccca

SEQ ID NO: 961113 - RNA, 24 nt, Human
cuaagauagagguuuagaaauggu

SEQ ID NO: 961114 - RNA, 23 nt, Human
cuucucaccgccgccgccacgac

SEQ ID NO: 961115 - RNA, 18 nt, Human
gaccacgcucugcacucc

SEQ ID NO: 961116 - RNA, 23 nt, Human
gauguuacuuaaaacauauuugu

SEQ ID NO: 961117 - RNA, 22 nt, Human
ggaaaauuccaaaacguagccc

SEQ ID NO: 961118 - RNA, 23 nt, Human
gucaaguagacugaaaacuaagg

SEQ ID NO: 961119 - RNA, 21 nt, Human
uaagaaaaggaaaauuccaaa

SEQ ID NO: 961120 - RNA, 19 nt, Human
uaagccaccaguaucagaa

SEQ ID NO: 961121 - RNA, 21 nt, Human
uacgagucaacaaacuucuau

SEQ ID NO: 961122 - RNA, 22 nt, Human
uaucacugcaaaaugucaacaa

SEQ ID NO: 961123 - RNA, 19 nt, Human
uaucauguggaaugugaga

SEQ ID NO: 961124 - RNA, 21 nt, Human
ucaaaacagcaaaaaauugca

SEQ ID NO: 961125 - RNA, 21 nt, Human
ucaaaagaauuagauccugca

SEQ ID NO: 961126 - RNA, 20 nt, Human
ucaacaaacuucuauuuuuu

SEQ ID NO: 961127 - RNA, 21 nt, Human
ucaccgccgccgccacgacca

SEQ ID NO: 961128 - RNA, 21 nt, Human
uccaaaaugaauacaaaaaaa

SEQ ID NO: 961129 - RNA, 24 nt, Human
uccugcaucuuuacuuuuacuggg

SEQ ID NO: 961130 - RNA, 25 nt, Human
ucucaccgccgccgccacgaccacg

SEQ ID NO: 961131 - RNA, 20 nt, Human
ugagagaaugccaacuuaug

SEQ ID NO: 961132 - RNA, 22 nt, Human
ugcaaauaugugcaaacacugu

SEQ ID NO: 961133 - RNA, 21 nt, Human
ugcuaaaacuaaagcugaaca

SEQ ID NO: 961134 - RNA, 22 nt, Human
uggacacugccgccgccgccuc

SEQ ID NO: 961135 - RNA, 18 nt, Human
uggcguagcuuggacacu

SEQ ID NO: 961136 - RNA, 19 nt, Human
uguucugguuuaugauaca

SEQ ID NO: 961137 - RNA, 22 nt, Human
uuauugacaggaguccaaaaug

SEQ ID NO: 961138 - RNA, 24 nt, Human
uuauugacaggaguccaaaaugaa

SEQ ID NO: 961139 - RNA, 23 nt, Human
uucaaaacagcaaaaaauugcaa

SEQ ID NO: 961140 - RNA, 25 nt, Human
uuucagguuguaccaaggcaccgcc

SEQ ID NO: 961141 - RNA, 19 nt, Human
uuuuuuuuuuuuacgaguc

SEQ ID NO: 961142 - RNA, 21 nt, Human
aaagccaaaaccagagagaaa

SEQ ID NO: 961143 - RNA, 20 nt, Human
aacacucuguacugucgccu

SEQ ID NO: 961144 - RNA, 23 nt, Human
aacggauaaggucaggagaggaa

SEQ ID NO: 961145 - RNA, 22 nt, Human
aagccaaaaccagagagaaaga

SEQ ID NO: 961146 - RNA, 22 nt, Human
aauauacucaauaacauaccaa

SEQ ID NO: 961147 - RNA, 21 nt, Human
aauugccuuucauuccuccau

SEQ ID NO: 961148 - RNA, 22 nt, Human
accgggggacauggugaggucc

SEQ ID NO: 961149 - RNA, 19 nt, Human
acucugucccaucuucccu

SEQ ID NO: 961150 - RNA, 18 nt, Human
agaaaugucacucugucc

SEQ ID NO: 961151 - RNA, 20 nt, Human
agaauauacucaauaacaua

SEQ ID NO: 961152 - RNA, 24 nt, Human
agaauauacucaauaacauaccaa

SEQ ID NO: 961153 - RNA, 18 nt, Human
agagaaaacuaagcucag

SEQ ID NO: 961154 - RNA, 20 nt, Human
agagaaaacuaagcucagaa

SEQ ID NO: 961155 - RNA, 21 nt, Human
aggacuggugaccgggggaca

SEQ ID NO: 961156 - RNA, 18 nt, Human
aggagaaaugucacucug

SEQ ID NO: 961157 - RNA, 19 nt, Human
aggcaucacuguguguggg

SEQ ID NO: 961158 - RNA, 23 nt, Human
agggacuaaaaguuagguagcag

SEQ ID NO: 961159 - RNA, 24 nt, Human
aucaagaccaaaguuguacaaaca

SEQ ID NO: 961160 - RNA, 22 nt, Human
caaaaccagagagaaagaaucc

SEQ ID NO: 961161 - RNA, 23 nt, Human
caaacagguacaaaaucccccac

SEQ ID NO: 961162 - RNA, 22 nt, Human
caagauacagcauacaaaacug

SEQ ID NO: 961163 - RNA, 24 nt, Human
caagugagcaccuaagaaucauuu

SEQ ID NO: 961164 - RNA, 19 nt, Human
cacuguguguggucaaagu

SEQ ID NO: 961165 - RNA, 21 nt, Human
cagcauacaaaacugucccac

SEQ ID NO: 961166 - RNA, 22 nt, Human
cagcauacaaaacugucccacg

SEQ ID NO: 961167 - RNA, 18 nt, Human
caggcucagcuggaggcc

SEQ ID NO: 961168 - RNA, 21 nt, Human
caugguaagugcccacauugc

SEQ ID NO: 961169 - RNA, 21 nt, Human
cauggugagguccagugugcc

SEQ ID NO: 961170 - RNA, 24 nt, Human
cauuuauaugaaaagccaaaacca

SEQ ID NO: 961171 - RNA, 18 nt, Human
ccaaaacacucuguacug

SEQ ID NO: 961172 - RNA, 19 nt, Human
ccaaaaccagagagaaaga

SEQ ID NO: 961173 - RNA, 23 nt, Human
ccaaaaccagagagaaagaaucc

SEQ ID NO: 961174 - RNA, 18 nt, Human
ccaacaauuugauaccac

SEQ ID NO: 961175 - RNA, 23 nt, Human
cccaucuccuccccuuucccuuu

SEQ ID NO: 961176 - RNA, 26 nt, Human
ccuccccuuucccuuuccacgaguuu

SEQ ID NO: 961177 - RNA, 19 nt, Human
ccuccucuccacuaaagua

SEQ ID NO: 961178 - RNA, 24 nt, Human
ccuuucauuccuccauaguugucu

SEQ ID NO: 961179 - RNA, 21 nt, Human
cucuccacuaaaguaucacug

SEQ ID NO: 961180 - RNA, 25 nt, Human
cucugucccaucuucccugcauuca

SEQ ID NO: 961181 - RNA, 25 nt, Human
cuguacugucgccuuccuuuagcag

SEQ ID NO: 961182 - RNA, 28 nt, Human
gaacaauucagagacaggcucagcugga

SEQ ID NO: 961183 - RNA, 23 nt, Human
gagggaacaauucagagacaggc

SEQ ID NO: 961184 - RNA, 25 nt, Human
gauaccaccuuccucccuaucccac

SEQ ID NO: 961185 - RNA, 23 nt, Human
gccaaaaccagagagaaagaauc

SEQ ID NO: 961186 - RNA, 18 nt, Human
ggagggaacaauucagag

SEQ ID NO: 961187 - RNA, 22 nt, Human
ggagggaacaauucagagacag

SEQ ID NO: 961188 - RNA, 21 nt, Human
ggcaauagagacagacagcaa

SEQ ID NO: 961189 - RNA, 22 nt, Human
gucccaucuccuccccuuuccc

SEQ ID NO: 961190 - RNA, 23 nt, Human
uaaaccaaccuacaaccugugua

SEQ ID NO: 961191 - RNA, 23 nt, Human
uaaaguaguuguucaaccaaaac

SEQ ID NO: 961192 - RNA, 21 nt, Human
uaaaguaucacuguagagaaa

SEQ ID NO: 961193 - RNA, 23 nt, Human
uaaaugguuuuggaagggacuaa

SEQ ID NO: 961194 - RNA, 18 nt, Human
uacaaaaucccccaccuu

SEQ ID NO: 961195 - RNA, 22 nt, Human
uacaaacagguacaaaaucccc

SEQ ID NO: 961196 - RNA, 19 nt, Human
uacaagauacagcauacaa

SEQ ID NO: 961197 - RNA, 19 nt, Human
uacuaaaugguuuuggaag

SEQ ID NO: 961198 - RNA, 22 nt, Human
uagauuugacugcauuaaagua

SEQ ID NO: 961199 - RNA, 21 nt, Human
uauguaauagaacccuacuaa

SEQ ID NO: 961200 - RNA, 23 nt, Human
ucaaauauuaguaauccauccac

SEQ ID NO: 961201 - RNA, 25 nt, Human
ucaaccaaaacacucuguacugucg

SEQ ID NO: 961202 - RNA, 18 nt, Human
ucaagugagaugcaaugu

SEQ ID NO: 961203 - RNA, 18 nt, Human
ucagaaauuagggguggc

SEQ ID NO: 961204 - RNA, 20 nt, Human
ucagaccaagugagcaccua

SEQ ID NO: 961205 - RNA, 24 nt, Human
uccacuaaaguaucacuguagaga

SEQ ID NO: 961206 - RNA, 18 nt, Human
uccccuuucccuuuccac

SEQ ID NO: 961207 - RNA, 19 nt, Human
uccucccuaucccacccua

SEQ ID NO: 961208 - RNA, 20 nt, Human
ucuguacugucgccuuccuu

SEQ ID NO: 961209 - RNA, 21 nt, Human
ugaaaagccaaaaccagagag

SEQ ID NO: 961210 - RNA, 18 nt, Human
ugaccgggggacauggug

SEQ ID NO: 961211 - RNA, 23 nt, Human
ugaccgggggacauggugagguc

SEQ ID NO: 961212 - RNA, 23 nt, Human
ugcccacauugcgggggagggaa

SEQ ID NO: 961213 - RNA, 26 nt, Human
uggaagggacuaaaaguuagguagca

SEQ ID NO: 961214 - RNA, 18 nt, Human
uguagagaaaacuaagcu

SEQ ID NO: 961215 - RNA, 20 nt, Human
uugcugccuucuaugaccua

SEQ ID NO: 961216 - RNA, 21 nt, Human
uuuauaagcuucucaaaacac

SEQ ID NO: 961217 - RNA, 24 nt, Human
uuuuuuuuuuuuauaagcuucuca

SEQ ID NO: 961218 - RNA, 19 nt, Human
aaccuggcuuguccuuugg

SEQ ID NO: 961219 - RNA, 18 nt, Human
aucauauuuccaaaaagg

SEQ ID NO: 961220 - RNA, 25 nt, Human
caucucccucacaucaugcaacccu

SEQ ID NO: 961221 - RNA, 25 nt, Human
ccaaaaacagucauuauuaaaaucu

SEQ ID NO: 961222 - RNA, 20 nt, Human
cgcgcaccgggguggggcuu

SEQ ID NO: 961223 - RNA, 23 nt, Human
ugcaaccuggcuuguccuuuggc

SEQ ID NO: 961224 - RNA, 22 nt, Human
uucacaauuuuuaaaaaggagu

SEQ ID NO: 961225 - RNA, 20 nt, Human
uuuuuuuuuuuuuuuuuugg

SEQ ID NO: 961226 - RNA, 19 nt, Human
aaccaauucuucccaggcu

SEQ ID NO: 961227 - RNA, 24 nt, Human
agacuggauggaggacugccuggc

SEQ ID NO: 961228 - RNA, 19 nt, Human
aggcaagaagucagggccc

SEQ ID NO: 961229 - RNA, 21 nt, Human
agucagggcccauggacugua

SEQ ID NO: 961230 - RNA, 21 nt, Human
caagugccaaagucaagacug

SEQ ID NO: 961231 - RNA, 20 nt, Human
cccacuggcauggagcccac

SEQ ID NO: 961232 - RNA, 18 nt, Human
ccgggggugaugguuucu

SEQ ID NO: 961233 - RNA, 22 nt, Human
ccucucugggagucaugagucu

SEQ ID NO: 961234 - RNA, 25 nt, Human
ccuggcugcaaaccaauucuuccca

SEQ ID NO: 961235 - RNA, 20 nt, Human
cuacuucuagaugccauccu

SEQ ID NO: 961236 - RNA, 28 nt, Human
cugcaaaccaauucuucccaggcugugc

SEQ ID NO: 961237 - RNA, 20 nt, Human
cugugcuuugcccacuggca

SEQ ID NO: 961238 - RNA, 22 nt, Human
ggcagggaacaaccugggagga

SEQ ID NO: 961239 - RNA, 22 nt, Human
gggcgcugcauagauggcuggc

SEQ ID NO: 961240 - RNA, 21 nt, Human
uacuucugaaaggcuaacaga

SEQ ID NO: 961241 - RNA, 19 nt, Human
ucaaauuuuauuuuggaca

SEQ ID NO: 961242 - RNA, 21 nt, Human
ucaaauuuuauuuuggacaug

SEQ ID NO: 961243 - RNA, 23 nt, Human
uccaggcagaaagguccuugagg

SEQ ID NO: 961244 - RNA, 18 nt, Human
ucccaggcugugcuuugc

SEQ ID NO: 961245 - RNA, 20 nt, Human
ucccaggcugugcuuugccc

SEQ ID NO: 961246 - RNA, 19 nt, Human
ucucugggagucaugaguc

SEQ ID NO: 961247 - RNA, 21 nt, Human
ugagacgaaggcaagaaguca

SEQ ID NO: 961248 - RNA, 19 nt, Human
uggcauggagcccacgguc

SEQ ID NO: 961249 - RNA, 24 nt, Human
uggcugcagagucuauuugagacg

SEQ ID NO: 961250 - RNA, 23 nt, Human
uggggcgcugcauagauggcugg

SEQ ID NO: 961251 - RNA, 21 nt, Human
aaaaagcugccagcugccuuu

SEQ ID NO: 961252 - RNA, 28 nt, Human
aaaaauaaaugagaacauuaucugcaaa

SEQ ID NO: 961253 - RNA, 22 nt, Human
aaaguccugccccaucccaccu

SEQ ID NO: 961254 - RNA, 26 nt, Human
aaauucuacaucaaaaauaaaugaga

SEQ ID NO: 961255 - RNA, 23 nt, Human
aacagcaggcagaucuggccccc

SEQ ID NO: 961256 - RNA, 26 nt, Human
aagaaacuugaugccagagaacagac

SEQ ID NO: 961257 - RNA, 20 nt, Human
aagccccccuuuccccaccu

SEQ ID NO: 961258 - RNA, 26 nt, Human
aaguaucaaaacccuaaauccaaacu

SEQ ID NO: 961259 - RNA, 21 nt, Human
acacaccugcucuaaggcaca

SEQ ID NO: 961260 - RNA, 23 nt, Human
acacagcuuuagaccagaaggcc

SEQ ID NO: 961261 - RNA, 23 nt, Human
acagcaggcagaucuggcccccc

SEQ ID NO: 961262 - RNA, 18 nt, Human
acaggggagaccaagaca

SEQ ID NO: 961263 - RNA, 18 nt, Human
acccaguaacacagagac

SEQ ID NO: 961264 - RNA, 22 nt, Human
acucagaccaagaggaggcugu

SEQ ID NO: 961265 - RNA, 18 nt, Human
agaaugccuaggaugaaa

SEQ ID NO: 961266 - RNA, 21 nt, Human
agcaaacaggcaaaguuugca

SEQ ID NO: 961267 - RNA, 23 nt, Human
agcacccaugagaaagguaguga

SEQ ID NO: 961268 - RNA, 18 nt, Human
agcugcaagaaacuugau

SEQ ID NO: 961269 - RNA, 19 nt, Human
aggaacaacauaaaaugac

SEQ ID NO: 961270 - RNA, 21 nt, Human
aggagcucugcacucauucca

SEQ ID NO: 961271 - RNA, 19 nt, Human
aggcagucuugcagcucac

SEQ ID NO: 961272 - RNA, 21 nt, Human
auagcaagcucucugcccaca

SEQ ID NO: 961273 - RNA, 24 nt, Human
aucccaccucccaccuugccucag

SEQ ID NO: 961274 - RNA, 18 nt, Human
caaaaccaguucagcaga

SEQ ID NO: 961275 - RNA, 22 nt, Human
caaaaucuaacagcacccauga

SEQ ID NO: 961276 - RNA, 21 nt, Human
caacauaaaaugacucuucuc

SEQ ID NO: 961277 - RNA, 18 nt, Human
caaccaaagcacgaacug

SEQ ID NO: 961278 - RNA, 21 nt, Human
caagaaacuugaugccagaga

SEQ ID NO: 961279 - RNA, 18 nt, Human
caagaggaggcugugugu

SEQ ID NO: 961280 - RNA, 19 nt, Human
caagugggccaugcaacca

SEQ ID NO: 961281 - RNA, 19 nt, Human
cagaaggccaaccaaagca

SEQ ID NO: 961282 - RNA, 21 nt, Human
cagcacaguaaauguaaccca

SEQ ID NO: 961283 - RNA, 18 nt, Human
cagcacccaugagaaagg

SEQ ID NO: 961284 - RNA, 23 nt, Human
cagcaggggugcaagccccccuu

SEQ ID NO: 961285 - RNA, 19 nt, Human
cagcucacugucucucccu

SEQ ID NO: 961286 - RNA, 22 nt, Human
cagcucacugucucucccucag

SEQ ID NO: 961287 - RNA, 21 nt, Human
caucuuaaaaagagguuuguc

SEQ ID NO: 961288 - RNA, 24 nt, Human
caugaacaaagcugaauacccuaa

SEQ ID NO: 961289 - RNA, 22 nt, Human
ccaaccaaagcacgaacugcaa

SEQ ID NO: 961290 - RNA, 24 nt, Human
ccaguccuccauucucucccuggg

SEQ ID NO: 961291 - RNA, 22 nt, Human
cccaaaaagcugccagcugccu

SEQ ID NO: 961292 - RNA, 30 nt, Human
cccaaaaagcugccagcugccuuuacagaa

SEQ ID NO: 961293 - RNA, 18 nt, Human
cccaucccaccucccacc

SEQ ID NO: 961294 - RNA, 22 nt, Human
cccauggaaacagcaggcagau

SEQ ID NO: 961295 - RNA, 18 nt, Human
ccccccuuuccccaccug

SEQ ID NO: 961296 - RNA, 20 nt, Human
cccuaccucccacaacaggc

SEQ ID NO: 961297 - RNA, 23 nt, Human
ccugccaugcaugugcuuggaag

SEQ ID NO: 961298 - RNA, 21 nt, Human
ccugggcugaaugcugagaaa

SEQ ID NO: 961299 - RNA, 20 nt, Human
cggucaagacggucagccug

SEQ ID NO: 961300 - RNA, 25 nt, Human
cuacaucaaaaauaaaugagaacau

SEQ ID NO: 961301 - RNA, 26 nt, Human
cuaccucccacaacaggcucugaucc

SEQ ID NO: 961302 - RNA, 25 nt, Human
cuacucagaccaagaggaggcugug

SEQ ID NO: 961303 - RNA, 19 nt, Human
cuccauucuaccaucuuaa

SEQ ID NO: 961304 - RNA, 25 nt, Human
cugaaugcugagaaaacgggugcca

SEQ ID NO: 961305 - RNA, 24 nt, Human
cuggggccuucugcacgaugacca

SEQ ID NO: 961306 - RNA, 20 nt, Human
gaacagacgagcacguucuu

SEQ ID NO: 961307 - RNA, 19 nt, Human
gaagggaaaguccugcccc

SEQ ID NO: 961308 - RNA, 20 nt, Human
gagcucaguuaaugcuucuc

SEQ ID NO: 961309 - RNA, 28 nt, Human
gcaggggugcaagccccccuuuccccaa

SEQ ID NO: 961310 - RNA, 23 nt, Human
gcagguaucuuccuguuuuucuu

SEQ ID NO: 961311 - RNA, 20 nt, Human
gccagcugccuuuacagagc

SEQ ID NO: 961312 - RNA, 19 nt, Human
gcucacugucucucccuca

SEQ ID NO: 961313 - RNA, 21 nt, Human
ggagaccaagacagcauucau

SEQ ID NO: 961314 - RNA, 20 nt, Human
ggccccgugagcuucaccuc

SEQ ID NO: 961315 - RNA, 19 nt, Human
ggcugugugugcugagguc

SEQ ID NO: 961316 - RNA, 20 nt, Human
guaacccauggaaacagcag

SEQ ID NO: 961317 - RNA, 19 nt, Human
gugcugagguccuggggcc

SEQ ID NO: 961318 - RNA, 23 nt, Human
uaacagcacccaugagaaaggua

SEQ ID NO: 961319 - RNA, 23 nt, Human
uaacccauggaaacagcaggcag

SEQ ID NO: 961320 - RNA, 21 nt, Human
uacacaccugcucuaaggcac

SEQ ID NO: 961321 - RNA, 19 nt, Human
uacucagaccaagaggagg

SEQ ID NO: 961322 - RNA, 26 nt, Human
uacucgguauauuaagaguuugauuu

SEQ ID NO: 961323 - RNA, 20 nt, Human
uagaaagucauucauaaaaa

SEQ ID NO: 961324 - RNA, 24 nt, Human
uagaccagaaggccaaccaaagca

SEQ ID NO: 961325 - RNA, 30 nt, Human
uagcaaacaggcaaaguuugcagagcucag

SEQ ID NO: 961326 - RNA, 19 nt, Human
uagcacucucuuuuucucu

SEQ ID NO: 961327 - RNA, 19 nt, Human
uagccaauagcaaacaggc

SEQ ID NO: 961328 - RNA, 20 nt, Human
uagccaauagcaaacaggca

SEQ ID NO: 961329 - RNA, 19 nt, Human
uaucaaaacccuaaaucca

SEQ ID NO: 961330 - RNA, 22 nt, Human
uaucugacgaagaagugaaaac

SEQ ID NO: 961331 - RNA, 19 nt, Human
uauucaggacacagcuuua

SEQ ID NO: 961332 - RNA, 22 nt, Human
uauucaggacacagcuuuagac

SEQ ID NO: 961333 - RNA, 19 nt, Human
ucagagcuccauaucauuu

SEQ ID NO: 961334 - RNA, 19 nt, Human
uccacacacugcuguauuu

SEQ ID NO: 961335 - RNA, 24 nt, Human
uccagauagacuggcacuugauuu

SEQ ID NO: 961336 - RNA, 22 nt, Human
ucccaaaaagcugccagcugcc

SEQ ID NO: 961337 - RNA, 18 nt, Human
ucccuggggccacuuucu

SEQ ID NO: 961338 - RNA, 21 nt, Human
ucuccucccaguccuccauuc

SEQ ID NO: 961339 - RNA, 18 nt, Human
ucucucccuggggccacu

SEQ ID NO: 961340 - RNA, 25 nt, Human
ucugcaauacaacauggauuccaga

SEQ ID NO: 961341 - RNA, 24 nt, Human
ugaaaaccacauucccugggcuga

SEQ ID NO: 961342 - RNA, 24 nt, Human
ugagguccuggggccuucugcacg

SEQ ID NO: 961343 - RNA, 24 nt, Human
ugcagagcucaaugaagucugaau

SEQ ID NO: 961344 - RNA, 19 nt, Human
ugcaucagaaauauacaca

SEQ ID NO: 961345 - RNA, 21 nt, Human
ugccacccaguaacacagaga

SEQ ID NO: 961346 - RNA, 27 nt, Human
ugccccaucccaccucccaccuugccu

SEQ ID NO: 961347 - RNA, 18 nt, Human
ugccuaggaugaaauggc

SEQ ID NO: 961348 - RNA, 23 nt, Human
ugccuaggaugaaauggcggggc

SEQ ID NO: 961349 - RNA, 21 nt, Human
ugcuguauuucagugaauugu

SEQ ID NO: 961350 - RNA, 24 nt, Human
uggccagcauuucacuccaaauau

SEQ ID NO: 961351 - RNA, 23 nt, Human
ugggaugugaacaauuguuuuuu

SEQ ID NO: 961352 - RNA, 22 nt, Human
uguaaauucuacaucaaaaaua

SEQ ID NO: 961353 - RNA, 20 nt, Human
ugucagaccuuauggacaug

SEQ ID NO: 961354 - RNA, 25 nt, Human
uuccagaaggguuuacaagcuagau

SEQ ID NO: 961355 - RNA, 19 nt, Human
uuccgaggcuuccagaagg

SEQ ID NO: 961356 - RNA, 26 nt, Human
uuccuguuuuucuuuacauauuuccu

SEQ ID NO: 961357 - RNA, 23 nt, Human
uucuacaucaaaaauaaaugaga

SEQ ID NO: 961358 - RNA, 24 nt, Human
uugaucagaaacauuaguauuuca

SEQ ID NO: 961359 - RNA, 24 nt, Human
uugaugccagagaacagacgagca

SEQ ID NO: 961360 - RNA, 20 nt, Human
uuggccucaauaagaaaucu

SEQ ID NO: 961361 - RNA, 20 nt, Human
agggaagccagcugugucuu

SEQ ID NO: 961362 - RNA, 21 nt, Human
cacccacaaccaaucaggaaa

SEQ ID NO: 961363 - RNA, 20 nt, Human
cacuagcggccaaucagaac

SEQ ID NO: 961364 - RNA, 26 nt, Human
cauuccaucacuaggggguaauucca

SEQ ID NO: 961365 - RNA, 23 nt, Human
ccaagcccuguucucuguacuag

SEQ ID NO: 961366 - RNA, 23 nt, Human
ccacccacaaccaaucaggaaac

SEQ ID NO: 961367 - RNA, 24 nt, Human
ccacccacaaccaaucaggaaacg

SEQ ID NO: 961368 - RNA, 20 nt, Human
cggcagcaucgcuuguuggc

SEQ ID NO: 961369 - RNA, 22 nt, Human
cucuucccguaucagagaagga

SEQ ID NO: 961370 - RNA, 19 nt, Human
gaagagguagccacccaca

SEQ ID NO: 961371 - RNA, 19 nt, Human
gcccaagcccuguucucug

SEQ ID NO: 961372 - RNA, 19 nt, Human
gcccaagcuaugaccccag

SEQ ID NO: 961373 - RNA, 21 nt, Human
gcccugagacaggaggacgga

SEQ ID NO: 961374 - RNA, 21 nt, Human
uaccagacaaccauuccagca

SEQ ID NO: 961375 - RNA, 26 nt, Human
ucagaacgaagagguagccacccaca

SEQ ID NO: 961376 - RNA, 20 nt, Human
ucagagaaggaacagcccaa

SEQ ID NO: 961377 - RNA, 22 nt, Human
ucagauaccagacaaccauucc

SEQ ID NO: 961378 - RNA, 21 nt, Human
ucccguaucagagaaggaaca

SEQ ID NO: 961379 - RNA, 22 nt, Human
ucgaggacaguugguccagcca

SEQ ID NO: 961380 - RNA, 22 nt, Human
ucuccaaaguggcccaagcccu

SEQ ID NO: 961381 - RNA, 19 nt, Human
ugcccaggacuagauucug

SEQ ID NO: 961382 - RNA, 23 nt, Human
uguacuagggaagccagcugugu

SEQ ID NO: 961383 - RNA, 21 nt, Human
uuuuuuuuuuuuuuuucccag

SEQ ID NO: 961384 - RNA, 25 nt, Human
uuuuuuuuuuuuuuuuuuucccagg

SEQ ID NO: 961385 - RNA, 20 nt, Human
aagcuugggggugggggcug

SEQ ID NO: 961386 - RNA, 19 nt, Human
aaggaggcccugggggagg

SEQ ID NO: 961387 - RNA, 20 nt, Human
aggaggcccugggggagguc

SEQ ID NO: 961388 - RNA, 22 nt, Human
caacccaucccccucagcuccu

SEQ ID NO: 961389 - RNA, 18 nt, Human
cagcaacccaucccccuc

SEQ ID NO: 961390 - RNA, 19 nt, Human
cagcaccaagcuugggggu

SEQ ID NO: 961391 - RNA, 18 nt, Human
cagcagccuggacugggc

SEQ ID NO: 961392 - RNA, 20 nt, Human
cagcagccuggacugggcug

SEQ ID NO: 961393 - RNA, 22 nt, Human
ccaucccccucagcuccucacc

SEQ ID NO: 961394 - RNA, 19 nt, Human
ccccagcaacccauccccc

SEQ ID NO: 961395 - RNA, 22 nt, Human
ccccagcaacccaucccccuca

SEQ ID NO: 961396 - RNA, 18 nt, Human
ccccucagcuccucacca

SEQ ID NO: 961397 - RNA, 19 nt, Human
cccuuuccuaguugggcug

SEQ ID NO: 961398 - RNA, 20 nt, Human
ccuccuggccccagcaaccc

SEQ ID NO: 961399 - RNA, 27 nt, Human
ccucugcccauggcccuuuccuaguug

SEQ ID NO: 961400 - RNA, 18 nt, Human
ccuggccccagcaaccca

SEQ ID NO: 961401 - RNA, 18 nt, Human
ccuggccccagcaaccca

SEQ ID NO: 961402 - RNA, 22 nt, Human
cuccuggccccagcaacccauc

SEQ ID NO: 961403 - RNA, 23 nt, Human
gaagauacuggcuaccagcccuc

SEQ ID NO: 961404 - RNA, 22 nt, Human
gccccagcaacccaucccccuc

SEQ ID NO: 961405 - RNA, 20 nt, Human
gcccugggggaggucaccgg

SEQ ID NO: 961406 - RNA, 20 nt, Human
gcucagcaccaagcuugggg

SEQ ID NO: 961407 - RNA, 20 nt, Human
ggacugggcugggcaaggag

SEQ ID NO: 961408 - RNA, 21 nt, Human
ggcaaggaggcccugggggag

SEQ ID NO: 961409 - RNA, 25 nt, Human
ggccacgggacauuuauuuguagcc

SEQ ID NO: 961410 - RNA, 24 nt, Human
ggcucagcaccaagcuugggggug

SEQ ID NO: 961411 - RNA, 22 nt, Human
gggcaaggaggcccugggggag

SEQ ID NO: 961412 - RNA, 19 nt, Human
ggggcugcugcugcaggac

SEQ ID NO: 961413 - RNA, 18 nt, Human
ggggugggggcugcugcu

SEQ ID NO: 961414 - RNA, 21 nt, Human
gggugggagugugcaggggcu

SEQ ID NO: 961415 - RNA, 18 nt, Human
gugcaggggcuggaggag

SEQ ID NO: 961416 - RNA, 18 nt, Human
uccuggccccagcaaccc

SEQ ID NO: 961417 - RNA, 18 nt, Human
uccugggugggagugugc

SEQ ID NO: 961418 - RNA, 23 nt, Human
ugcaggggcuggaggagagaccc

SEQ ID NO: 961419 - RNA, 23 nt, Human
uggaagauacuggcuaccagccc

SEQ ID NO: 961420 - RNA, 19 nt, Human
uggaggagagacccuccug

SEQ ID NO: 961421 - RNA, 19 nt, Human
uggcuaccagcccucugcc

SEQ ID NO: 961422 - RNA, 19 nt, Human
ugggagaggcugaggcgug

SEQ ID NO: 961423 - RNA, 20 nt, Human
ugggauuuggcacagcagcc

SEQ ID NO: 961424 - RNA, 23 nt, Human
ugggcaaggaggcccugggggag

SEQ ID NO: 961425 - RNA, 26 nt, Human
ugggcaaggaggcccugggggagguu

SEQ ID NO: 961426 - RNA, 21 nt, Human
ugggggaggguugagacuggc

SEQ ID NO: 961427 - RNA, 19 nt, Human
ugggggcugcugcugcagg

SEQ ID NO: 961428 - RNA, 19 nt, Human
ugggggcugcugcugcagg

SEQ ID NO: 961429 - RNA, 22 nt, Human
uguccugggugggagugugcag

SEQ ID NO: 961430 - RNA, 24 nt, Human
uugggggugggggcugcugcugca

SEQ ID NO: 961431 - RNA, 20 nt, Human
aaccuccccaaccccauccc

SEQ ID NO: 961432 - RNA, 23 nt, Human
aagcuggaggcgaaccuccgagu

SEQ ID NO: 961433 - RNA, 21 nt, Human
aagugggguugggagaaccuc

SEQ ID NO: 961434 - RNA, 19 nt, Human
aggaagaaagugggguugg

SEQ ID NO: 961435 - RNA, 24 nt, Human
aggcaggagggaauuuaguggagc

SEQ ID NO: 961436 - RNA, 20 nt, Human
aguggagcuggggaaggaag

SEQ ID NO: 961437 - RNA, 18 nt, Human
caucccugcuggcccggg

SEQ ID NO: 961438 - RNA, 21 nt, Human
cccaaccccaucccugcuggc

SEQ ID NO: 961439 - RNA, 23 nt, Human
cccagcuccgccgcgcccccgga

SEQ ID NO: 961440 - RNA, 23 nt, Human
ccccaaccccaucccugcuggcc

SEQ ID NO: 961441 - RNA, 18 nt, Human
gagaaccuccccaacccc

SEQ ID NO: 961442 - RNA, 21 nt, Human
gagcuggggaaggaagaaagu

SEQ ID NO: 961443 - RNA, 22 nt, Human
gcgcaagcuggaggcgaaccuc

SEQ ID NO: 961444 - RNA, 21 nt, Human
ggcaucggcucucagcaagag

SEQ ID NO: 961445 - RNA, 19 nt, Human
gggaauuuaguggagcugg

SEQ ID NO: 961446 - RNA, 21 nt, Human
ucccugcuggcccggggacgg

SEQ ID NO: 961447 - RNA, 22 nt, Human
ucccugcuggcccggggacggg

SEQ ID NO: 961448 - RNA, 20 nt, Human
ugaugcgcaagcuggaggcc

SEQ ID NO: 961449 - RNA, 21 nt, Human
uggcccggggacgggcaucgg

SEQ ID NO: 961450 - RNA, 19 nt, Human
ugggagaaccuccccaacc

SEQ ID NO: 961451 - RNA, 22 nt, Human
ugggagaaccuccccaacccca

SEQ ID NO: 961452 - RNA, 23 nt, Human
ugggagaaccuccccaaccccau

SEQ ID NO: 961453 - RNA, 25 nt, Human
uggggaaggaagaaagugggguugg

SEQ ID NO: 961454 - RNA, 19 nt, Human
ugggguugggagaaccucc

SEQ ID NO: 961455 - RNA, 20 nt, Human
aaaagccuauuaggaaaguu

SEQ ID NO: 961456 - RNA, 23 nt, Human
aggaaaaaaaagccuauuaggaa

SEQ ID NO: 961457 - RNA, 20 nt, Human
uaaacauccacauaaugcca

SEQ ID NO: 961458 - RNA, 18 nt, Human
uauuaggaaaaaaaagcc

SEQ ID NO: 961459 - RNA, 18 nt, Human
uugcauuuguuuuuccag

SEQ ID NO: 961460 - RNA, 23 nt, Human
acugcucacuacccaaggaggug

SEQ ID NO: 961461 - RNA, 19 nt, Human
agcugcccuggacucugcc

SEQ ID NO: 961462 - RNA, 19 nt, Human
agguggggucugucuccca

SEQ ID NO: 961463 - RNA, 23 nt, Human
cacagcuuucugcucacugcuca

SEQ ID NO: 961464 - RNA, 18 nt, Human
caggguucagcgggugug

SEQ ID NO: 961465 - RNA, 20 nt, Human
ccacuuccgaacccuccccu

SEQ ID NO: 961466 - RNA, 22 nt, Human
ccagggccugucgguugguguc

SEQ ID NO: 961467 - RNA, 20 nt, Human
cccaacccguccuucuuuuc

SEQ ID NO: 961468 - RNA, 20 nt, Human
cccaaugugcccggccccaa

SEQ ID NO: 961469 - RNA, 27 nt, Human
cccccaaugugcccggccccaacccgu

SEQ ID NO: 961470 - RNA, 22 nt, Human
cccgcgcagcugcccucagcca

SEQ ID NO: 961471 - RNA, 20 nt, Human
ccgaccugugccgcccuccc

SEQ ID NO: 961472 - RNA, 24 nt, Human
ccuccucggcccuggucguugcuc

SEQ ID NO: 961473 - RNA, 20 nt, Human
ccucgccccaccuccagcag

SEQ ID NO: 961474 - RNA, 21 nt, Human
ccugugccgcccucccggggc

SEQ ID NO: 961475 - RNA, 23 nt, Human
cgaccugugccgcccucccgggg

SEQ ID NO: 961476 - RNA, 27 nt, Human
cgagggcgggaggcuagggggggaguc

SEQ ID NO: 961477 - RNA, 20 nt, Human
cgccccaccuccagcagcca

SEQ ID NO: 961478 - RNA, 23 nt, Human
cgccccaccuccagcagcccagc

SEQ ID NO: 961479 - RNA, 19 nt, Human
cugccccaggaucuggaag

SEQ ID NO: 961480 - RNA, 23 nt, Human
cugugccgcccucccggggcugc

SEQ ID NO: 961481 - RNA, 24 nt, Human
gcagcccagccuguucacagcuuu

SEQ ID NO: 961482 - RNA, 22 nt, Human
gccccaccuccagcagcccagc

SEQ ID NO: 961483 - RNA, 18 nt, Human
gcccucagccagggccug

SEQ ID NO: 961484 - RNA, 19 nt, Human
gccgcccucccggggcugc

SEQ ID NO: 961485 - RNA, 22 nt, Human
gccucgccccaccuccagcagc

SEQ ID NO: 961486 - RNA, 20 nt, Human
ggaggcuagggggggagucc

SEQ ID NO: 961487 - RNA, 21 nt, Human
ggggaaagaggcugggggguc

SEQ ID NO: 961488 - RNA, 22 nt, Human
guggaggagccuugagcugccc

SEQ ID NO: 961489 - RNA, 23 nt, Human
guggaggagccuugagcugcccu

SEQ ID NO: 961490 - RNA, 22 nt, Human
uaauaaauaagcccgcgcagcu

SEQ ID NO: 961491 - RNA, 21 nt, Human
ucagauuacagccccuagggg

SEQ ID NO: 961492 - RNA, 23 nt, Human
ucagggucugucuggcuccucuc

SEQ ID NO: 961493 - RNA, 22 nt, Human
uccaggcaccuccucggcccug

SEQ ID NO: 961494 - RNA, 18 nt, Human
ucccagggugggcacucc

SEQ ID NO: 961495 - RNA, 23 nt, Human
ucccagggugggcacuccaggca

SEQ ID NO: 961496 - RNA, 20 nt, Human
uccugcgcccgaccugugcc

SEQ ID NO: 961497 - RNA, 21 nt, Human
ucugcucacugcucacuaccc

SEQ ID NO: 961498 - RNA, 18 nt, Human
ugagcugcccuggacucu

SEQ ID NO: 961499 - RNA, 21 nt, Human
ugccccgccuggccacaauca

SEQ ID NO: 961500 - RNA, 21 nt, Human
ugcccggccccaacccguccu

SEQ ID NO: 961501 - RNA, 25 nt, Human
ugcccuggacucugccccaggaucu

SEQ ID NO: 961502 - RNA, 19 nt, Human
ugccucgccccaccuccag

SEQ ID NO: 961503 - RNA, 21 nt, Human
ugccucgccccaccuccagca

SEQ ID NO: 961504 - RNA, 26 nt, Human
uggcuccucucucgccugucgucucc

SEQ ID NO: 961505 - RNA, 23 nt, Human
ugugccgcccucccggggcugcu

SEQ ID NO: 961506 - RNA, 20 nt, Human
uguggaggagccuugagcug

SEQ ID NO: 961507 - RNA, 24 nt, Human
uugguucccggcguggggacaguc

SEQ ID NO: 961508 - RNA, 21 nt, Human
aaaaagcaaaaguaguguuuu

SEQ ID NO: 961509 - RNA, 21 nt, Human
aaaaguaaugaaaguguacac

SEQ ID NO: 961510 - RNA, 22 nt, Human
aaagaaguuuaauuauaccuuu

SEQ ID NO: 961511 - RNA, 20 nt, Human
aaagccccaaagcaggaaag

SEQ ID NO: 961512 - RNA, 21 nt, Human
aacccugcuccuuucgcaguc

SEQ ID NO: 961513 - RNA, 19 nt, Human
aacugauuauuuuuacaau

SEQ ID NO: 961514 - RNA, 26 nt, Human
aacugcuucacugauauaacucccac

SEQ ID NO: 961515 - RNA, 19 nt, Human
aacugugacucugaaacaa

SEQ ID NO: 961516 - RNA, 23 nt, Human
aagaaaaggugaauaaaggggac

SEQ ID NO: 961517 - RNA, 19 nt, Human
aagaaucauugaauuugag

SEQ ID NO: 961518 - RNA, 21 nt, Human
aagagaaaagaaguuuaauua

SEQ ID NO: 961519 - RNA, 22 nt, Human
aagcaggaaaggaauaccacag

SEQ ID NO: 961520 - RNA, 24 nt, Human
aagcaggaaaggaauaccacaggg

SEQ ID NO: 961521 - RNA, 21 nt, Human
acacagauugaacauucacca

SEQ ID NO: 961522 - RNA, 18 nt, Human
acagaagaugguuuuggc

SEQ ID NO: 961523 - RNA, 23 nt, Human
accccgagcgcgcccgcgagagc

SEQ ID NO: 961524 - RNA, 23 nt, Human
agaaaucagcacggaaaagucau

SEQ ID NO: 961525 - RNA, 24 nt, Human
agagccuggcagggagccgcgggg

SEQ ID NO: 961526 - RNA, 19 nt, Human
agcacgucgcaaaggugaa

SEQ ID NO: 961527 - RNA, 18 nt, Human
agccccggccgcaucucc

SEQ ID NO: 961528 - RNA, 21 nt, Human
aggagauaauuauuuuauuca

SEQ ID NO: 961529 - RNA, 20 nt, Human
aguuuguuuucuuacacaga

SEQ ID NO: 961530 - RNA, 22 nt, Human
cacacugaaaagaucauaaaau

SEQ ID NO: 961531 - RNA, 19 nt, Human
caccaccgcgcagccccgg

SEQ ID NO: 961532 - RNA, 19 nt, Human
caccccuuauuuagaaguc

SEQ ID NO: 961533 - RNA, 20 nt, Human
cauaacaagcaccuugccau

SEQ ID NO: 961534 - RNA, 24 nt, Human
cauaacaagcaccuugccaucaca

SEQ ID NO: 961535 - RNA, 22 nt, Human
caugcucauuucaguucgugua

SEQ ID NO: 961536 - RNA, 22 nt, Human
ccaaaaaaaguaagugcuuuug

SEQ ID NO: 961537 - RNA, 24 nt, Human
ccaaagcaggaaaggaauaccaca

SEQ ID NO: 961538 - RNA, 21 nt, Human
ccacacagacuagggaauaag

SEQ ID NO: 961539 - RNA, 24 nt, Human
ccagccgcgaggccccaccccgag

SEQ ID NO: 961540 - RNA, 21 nt, Human
ccaucuaauuuuuauuuggag

SEQ ID NO: 961541 - RNA, 22 nt, Human
cccaccaaauaucuucaugggg

SEQ ID NO: 961542 - RNA, 18 nt, Human
cccagcaggcucgcauca

SEQ ID NO: 961543 - RNA, 19 nt, Human
ccccaccccgagcgcgccc

SEQ ID NO: 961544 - RNA, 19 nt, Human
ccccaccccgagcgcgccc

SEQ ID NO: 961545 - RNA, 19 nt, Human
cccggcgcgccgcccagca

SEQ ID NO: 961546 - RNA, 23 nt, Human
ccgcggcacccggagcucuucuc

SEQ ID NO: 961547 - RNA, 20 nt, Human
ccucugaguuucuuuguaaa

SEQ ID NO: 961548 - RNA, 21 nt, Human
cgcaucaccaccgcgcagccc

SEQ ID NO: 961549 - RNA, 19 nt, Human
cgccgcggcgcgcggcucc

SEQ ID NO: 961550 - RNA, 21 nt, Human
cgccgcggcgcgcggcuccgg

SEQ ID NO: 961551 - RNA, 18 nt, Human
cggccgcaggcuggagcc

SEQ ID NO: 961552 - RNA, 24 nt, Human
cggggccgacccuuagagcucgcg

SEQ ID NO: 961553 - RNA, 23 nt, Human
cugguuuuaauaaaaggaagaau

SEQ ID NO: 961554 - RNA, 20 nt, Human
cugugugucaauguagaaga

SEQ ID NO: 961555 - RNA, 22 nt, Human
cuuacuuucuagacauaacaag

SEQ ID NO: 961556 - RNA, 19 nt, Human
cuuccaaaaaaaguaagug

SEQ ID NO: 961557 - RNA, 23 nt, Human
cuuuaaaugccgucuuccuuuuc

SEQ ID NO: 961558 - RNA, 23 nt, Human
gaaaguggccggaggccgggggc

SEQ ID NO: 961559 - RNA, 21 nt, Human
gcgcugcagugccgcggcacc

SEQ ID NO: 961560 - RNA, 22 nt, Human
gcgcugcagugccgcggcaccc

SEQ ID NO: 961561 - RNA, 22 nt, Human
ggaaaggaauaccacagggaua

SEQ ID NO: 961562 - RNA, 22 nt, Human
ggagccgcgggggcggaccggg

SEQ ID NO: 961563 - RNA, 19 nt, Human
gggggcggaccgggcgggg

SEQ ID NO: 961564 - RNA, 26 nt, Human
gggguuggaugcgcuugugucuccag

SEQ ID NO: 961565 - RNA, 23 nt, Human
gucacugaauugucaagcuacau

SEQ ID NO: 961566 - RNA, 21 nt, Human
uaaaaaucaguaugauaucug

SEQ ID NO: 961567 - RNA, 18 nt, Human
uaaaaccaaucaaccacc

SEQ ID NO: 961568 - RNA, 19 nt, Human
uaaaaccaaucaaccacca

SEQ ID NO: 961569 - RNA, 23 nt, Human
uaaaauaaauuaaauaacuucca

SEQ ID NO: 961570 - RNA, 28 nt, Human
uaagcaggcaaaccauuauuguaaugac

SEQ ID NO: 961571 - RNA, 18 nt, Human
uaccacagggauauggcc

SEQ ID NO: 961572 - RNA, 21 nt, Human
uagcacgucgcaaaggugaaa

SEQ ID NO: 961573 - RNA, 23 nt, Human
uaggagauaauuauuuuauucau

SEQ ID NO: 961574 - RNA, 21 nt, Human
uaguuuguuuucuuacacaga

SEQ ID NO: 961575 - RNA, 23 nt, Human
uauaugagagcaugaauaauuuu

SEQ ID NO: 961576 - RNA, 21 nt, Human
uauguacaauacaaauggaau

SEQ ID NO: 961577 - RNA, 24 nt, Human
uauuaagucacugaauugucaagc

SEQ ID NO: 961578 - RNA, 24 nt, Human
uauucaucacaaaauuuacuacuu

SEQ ID NO: 961579 - RNA, 21 nt, Human
uccaucuaauuuuuauuugga

SEQ ID NO: 961580 - RNA, 22 nt, Human
uccgcaacccugcuccuuucgc

SEQ ID NO: 961581 - RNA, 18 nt, Human
ucgauuuugaagaaaagg

SEQ ID NO: 961582 - RNA, 18 nt, Human
ucgauuuugaagaaaagg

SEQ ID NO: 961583 - RNA, 20 nt, Human
ucgauuuugaagaaaaggug

SEQ ID NO: 961584 - RNA, 22 nt, Human
ucgcaucaccaccgcgcagccc

SEQ ID NO: 961585 - RNA, 25 nt, Human
ucgcaucaccaccgcgcagccccgg

SEQ ID NO: 961586 - RNA, 21 nt, Human
ucugaaacaauuuuacuuuua

SEQ ID NO: 961587 - RNA, 21 nt, Human
ucugugugucaauguagaaga

SEQ ID NO: 961588 - RNA, 20 nt, Human
ugaaauaaagggaacuguga

SEQ ID NO: 961589 - RNA, 19 nt, Human
ugaauggaaaguggccgga

SEQ ID NO: 961590 - RNA, 19 nt, Human
ugaauugucaagcuacaua

SEQ ID NO: 961591 - RNA, 21 nt, Human
uggaaggugauaacauaagaa

SEQ ID NO: 961592 - RNA, 23 nt, Human
uggaaggugauaacauaagaaua

SEQ ID NO: 961593 - RNA, 23 nt, Human
uguaaaggaaucucagcgcugca

SEQ ID NO: 961594 - RNA, 22 nt, Human
uguccgauuacagcgccgcggc

SEQ ID NO: 961595 - RNA, 22 nt, Human
ugugaaaauagaaagaauuaaa

SEQ ID NO: 961596 - RNA, 23 nt, Human
ugugucuccaguccuuuucccag

SEQ ID NO: 961597 - RNA, 24 nt, Human
uguuuggaaggugauaacauaaga

SEQ ID NO: 961598 - RNA, 19 nt, Human
uuaaauaacuuccaaaaaa

SEQ ID NO: 961599 - RNA, 18 nt, Human
uuaguuuuugaaguuuua

SEQ ID NO: 961600 - RNA, 22 nt, Human
uucaaauuuuuccuucuuauau

SEQ ID NO: 961601 - RNA, 23 nt, Human
uucccagacgaccuuauuuucua

SEQ ID NO: 961602 - RNA, 18 nt, Human
uuggaaccauaaaaacuc

SEQ ID NO: 961603 - RNA, 30 nt, Human
uuggaaccauaaaaacucaucauuuucucc

SEQ ID NO: 961604 - RNA, 23 nt, Human
uuuaaaauauauaugagagcaug

SEQ ID NO: 961605 - RNA, 25 nt, Human
uuuuccaucuaauuuuuauuuggag

SEQ ID NO: 961606 - RNA, 21 nt, Human
uuuuucacauuuuuccaucua

SEQ ID NO: 961607 - RNA, 19 nt, Human
aaaaaaaaaaaaagagaga

SEQ ID NO: 961608 - RNA, 19 nt, Human
aaaaaaaaaaaaagagaga

SEQ ID NO: 961609 - RNA, 19 nt, Human
aaaaaaaaaaaaagagaga

SEQ ID NO: 961610 - RNA, 22 nt, Human
aaaaaaaaaaaaagagagaaaa

SEQ ID NO: 961611 - RNA, 18 nt, Human
aaaaaaaaaaaagagaga

SEQ ID NO: 961612 - RNA, 21 nt, Human
aaaacccuaaaaccuauagca

SEQ ID NO: 961613 - RNA, 24 nt, Human
aaaacuaagucuauccacaggucc

SEQ ID NO: 961614 - RNA, 23 nt, Human
aaacaacacuaauaaaauaaucc

SEQ ID NO: 961615 - RNA, 23 nt, Human
aaacaggcagacuuucuguuccc

SEQ ID NO: 961616 - RNA, 25 nt, Human
aaacugagaaaauggugggacauga

SEQ ID NO: 961617 - RNA, 20 nt, Human
aaacuuaaaauuuggagcuu

SEQ ID NO: 961618 - RNA, 19 nt, Human
aaagcuauuuuccucugcc

SEQ ID NO: 961619 - RNA, 24 nt, Human
aaagugcugggauuacaggcguga

SEQ ID NO: 961620 - RNA, 21 nt, Human
aaauuguggacuugggcccuc

SEQ ID NO: 961621 - RNA, 21 nt, Human
aacaccuucauagucauuccu

SEQ ID NO: 961622 - RNA, 22 nt, Human
aacgcucuucaguauauggacu

SEQ ID NO: 961623 - RNA, 23 nt, Human
aagaaaaaauuagcaauauagaa

SEQ ID NO: 961624 - RNA, 26 nt, Human
aagauuauauacauauauauguacau

SEQ ID NO: 961625 - RNA, 21 nt, Human
aagcaagauuauauacauaua

SEQ ID NO: 961626 - RNA, 26 nt, Human
aagcagccaaguacugaaaauaacag

SEQ ID NO: 961627 - RNA, 19 nt, Human
aaguagcugggacuacagg

SEQ ID NO: 961628 - RNA, 20 nt, Human
aaguagcugggacuacaggc

SEQ ID NO: 961629 - RNA, 18 nt, Human
aagucagccucuugcacu

SEQ ID NO: 961630 - RNA, 20 nt, Human
aagucagccucuugcacuga

SEQ ID NO: 961631 - RNA, 19 nt, Human
aagugcugggauuacaggc

SEQ ID NO: 961632 - RNA, 19 nt, Human
aagugcugggauuacaggc

SEQ ID NO: 961633 - RNA, 22 nt, Human
acaaaacccuaaaaccuauagc

SEQ ID NO: 961634 - RNA, 19 nt, Human
acagguccucuccuguaac

SEQ ID NO: 961635 - RNA, 23 nt, Human
acagguccucuccuguaacaaag

SEQ ID NO: 961636 - RNA, 18 nt, Human
acgggguuucaccuuguu

SEQ ID NO: 961637 - RNA, 20 nt, Human
acgggguuucaccuuguuag

SEQ ID NO: 961638 - RNA, 20 nt, Human
acugcaguggcgcaaucucg

SEQ ID NO: 961639 - RNA, 24 nt, Human
acugcaguggcgcaaucucggcuc

SEQ ID NO: 961640 - RNA, 19 nt, Human
acuuuaaggagggucugag

SEQ ID NO: 961641 - RNA, 21 nt, Human
agaaaaaaaaaaaaaaaagag

SEQ ID NO: 961642 - RNA, 24 nt, Human
agaaaaaaaaaaaaaaaagagaga

SEQ ID NO: 961643 - RNA, 22 nt, Human
agaaaauuugauauuugagagc

SEQ ID NO: 961644 - RNA, 24 nt, Human
agaaggacagaacagcauagagga

SEQ ID NO: 961645 - RNA, 18 nt, Human
agacuuucuguucccuuu

SEQ ID NO: 961646 - RNA, 22 nt, Human
agagaaaaaagaaaugugugag

SEQ ID NO: 961647 - RNA, 24 nt, Human
agagaaaaaagaaaugugugagaa

SEQ ID NO: 961648 - RNA, 21 nt, Human
agcaagaggacauuccaaaga

SEQ ID NO: 961649 - RNA, 18 nt, Human
agcuguauuuuucaguca

SEQ ID NO: 961650 - RNA, 23 nt, Human
aguagcugggacuacaggcgccc

SEQ ID NO: 961651 - RNA, 18 nt, Human
agugcugggauuacaggc

SEQ ID NO: 961652 - RNA, 18 nt, Human
aguucacaugagaaugcc

SEQ ID NO: 961653 - RNA, 24 nt, Human
aguuggaugauuuauuuuuuuacu

SEQ ID NO: 961654 - RNA, 21 nt, Human
auccuuggaaacugcuuucuc

SEQ ID NO: 961655 - RNA, 22 nt, Human
aucucaguaguuaagugaacuc

SEQ ID NO: 961656 - RNA, 24 nt, Human
augauccacccgccucggccuccc

SEQ ID NO: 961657 - RNA, 22 nt, Human
auguguguguauaauuauaugu

SEQ ID NO: 961658 - RNA, 19 nt, Human
auugcaauuaaaaugauaa

SEQ ID NO: 961659 - RNA, 21 nt, Human
auuuuaaaauucagauacagg

SEQ ID NO: 961660 - RNA, 22 nt, Human
caaaagacaguagauagucuca

SEQ ID NO: 961661 - RNA, 24 nt, Human
caaagugcugggauuacaggcgug

SEQ ID NO: 961662 - RNA, 21 nt, Human
caacacaccugcuacuuaaca

SEQ ID NO: 961663 - RNA, 24 nt, Human
caacagcugcuguuuguuucaugc

SEQ ID NO: 961664 - RNA, 18 nt, Human
cacaagagggaagcaaaa

SEQ ID NO: 961665 - RNA, 20 nt, Human
caccaacacucaaaaugacu

SEQ ID NO: 961666 - RNA, 23 nt, Human
cacccgccucggccucccaaagu

SEQ ID NO: 961667 - RNA, 19 nt, Human
caccugcuacuuaacacuc

SEQ ID NO: 961668 - RNA, 21 nt, Human
caccugcuacuuaacacucau

SEQ ID NO: 961669 - RNA, 24 nt, Human
caccuuguuagccaggauggucuc

SEQ ID NO: 961670 - RNA, 22 nt, Human
cacgccauucuccugccucagc

SEQ ID NO: 961671 - RNA, 21 nt, Human
cagaacaaaagacuggggaug

SEQ ID NO: 961672 - RNA, 22 nt, Human
caggauggucuccaucuccuga

SEQ ID NO: 961673 - RNA, 21 nt, Human
caggcgcccgccaccgcgccc

SEQ ID NO: 961674 - RNA, 22 nt, Human
cagguccucuccuguaacaaag

SEQ ID NO: 961675 - RNA, 19 nt, Human
caguaguuagaauccuaac

SEQ ID NO: 961676 - RNA, 20 nt, Human
ccaaagugcugggauuacag

SEQ ID NO: 961677 - RNA, 22 nt, Human
ccaaagugcugggauuacaggc

SEQ ID NO: 961678 - RNA, 22 nt, Human
ccaaagugcugggauuacaggc

SEQ ID NO: 961679 - RNA, 24 nt, Human
ccaaagugcugggauuacaggcgu

SEQ ID NO: 961680 - RNA, 23 nt, Human
cccaaguagcugggacuacaggc

SEQ ID NO: 961681 - RNA, 24 nt, Human
cccaaguagcugggacuacaggcg

SEQ ID NO: 961682 - RNA, 20 nt, Human
cccucccucuucuuucccaa

SEQ ID NO: 961683 - RNA, 19 nt, Human
cccuucgucuuucucucuc

SEQ ID NO: 961684 - RNA, 23 nt, Human
ccuacugauaaucugcuuucaaa

SEQ ID NO: 961685 - RNA, 20 nt, Human
ccugaccucaugauccaccc

SEQ ID NO: 961686 - RNA, 24 nt, Human
ccugccucagccucccaaguagcu

SEQ ID NO: 961687 - RNA, 22 nt, Human
ccuggaagccucucagaaguca

SEQ ID NO: 961688 - RNA, 19 nt, Human
cgcucugucgcccaggccg

SEQ ID NO: 961689 - RNA, 24 nt, Human
cucagccucccaaguagcugggac

SEQ ID NO: 961690 - RNA, 24 nt, Human
cuccugaccucaugauccacccgc

SEQ ID NO: 961691 - RNA, 25 nt, Human
cuccugccucagccucccaaguagc

SEQ ID NO: 961692 - RNA, 23 nt, Human
cucugucgcccaggccggacugc

SEQ ID NO: 961693 - RNA, 20 nt, Human
cucuucagcaacuacgccgg

SEQ ID NO: 961694 - RNA, 18 nt, Human
cugaauaucucaguaguu

SEQ ID NO: 961695 - RNA, 22 nt, Human
gaagauuuauuuuauaguaugu

SEQ ID NO: 961696 - RNA, 21 nt, Human
gacaguagauagucucacccc

SEQ ID NO: 961697 - RNA, 22 nt, Human
gaccucaugauccacccgccuc

SEQ ID NO: 961698 - RNA, 18 nt, Human
gacguugugcugaaggag

SEQ ID NO: 961699 - RNA, 20 nt, Human
gagacgggguuucaccuugu

SEQ ID NO: 961700 - RNA, 23 nt, Human
gagcacacgcacucccuucuccc

SEQ ID NO: 961701 - RNA, 18 nt, Human
gauuacaggcgugagcca

SEQ ID NO: 961702 - RNA, 20 nt, Human
gauuacaggcgugagccacc

SEQ ID NO: 961703 - RNA, 22 nt, Human
gauuacaggcgugagccaccgc

SEQ ID NO: 961704 - RNA, 23 nt, Human
gcccggcuaauuuuuuguauuuu

SEQ ID NO: 961705 - RNA, 21 nt, Human
gccggacugcggacugcagug

SEQ ID NO: 961706 - RNA, 21 nt, Human
gccgggagcaagaggacauuc

SEQ ID NO: 961707 - RNA, 20 nt, Human
gccucagccucccaaguagc

SEQ ID NO: 961708 - RNA, 23 nt, Human
gccucggccucccaaagugcugg

SEQ ID NO: 961709 - RNA, 20 nt, Human
gcuauuuuccucugccuauu

SEQ ID NO: 961710 - RNA, 25 nt, Human
gcuucccggguucacgccauucucc

SEQ ID NO: 961711 - RNA, 18 nt, Human
ggacaugaaacauauccu

SEQ ID NO: 961712 - RNA, 18 nt, Human
ggagagagagggagaaac

SEQ ID NO: 961713 - RNA, 20 nt, Human
ggagagagagggagaaacug

SEQ ID NO: 961714 - RNA, 18 nt, Human
ggaggaggugaaugggca

SEQ ID NO: 961715 - RNA, 21 nt, Human
ggaggugaaugggcauuguuu

SEQ ID NO: 961716 - RNA, 24 nt, Human
gggaaaauuuggugagaugaaggg

SEQ ID NO: 961717 - RNA, 19 nt, Human
gggugugugugugugugug

SEQ ID NO: 961718 - RNA, 19 nt, Human
gggugugugugugugugug

SEQ ID NO: 961719 - RNA, 22 nt, Human
ggguuucaccuuguuagccagg

SEQ ID NO: 961720 - RNA, 20 nt, Human
ggucuccaucuccugaccuc

SEQ ID NO: 961721 - RNA, 19 nt, Human
guaauccacuugcuuucaa

SEQ ID NO: 961722 - RNA, 18 nt, Human
gugugugugugugugugu

SEQ ID NO: 961723 - RNA, 18 nt, Human
guguguguguguugggag

SEQ ID NO: 961724 - RNA, 18 nt, Human
guuagaauccuaacuaua

SEQ ID NO: 961725 - RNA, 20 nt, Human
uaaaauuuaguggucucacc

SEQ ID NO: 961726 - RNA, 21 nt, Human
uaaauguucauaaugguucuc

SEQ ID NO: 961727 - RNA, 20 nt, Human
uaaauuaucuauaaacaaua

SEQ ID NO: 961728 - RNA, 18 nt, Human
uaacaaagauagaagagg

SEQ ID NO: 961729 - RNA, 24 nt, Human
uaacaaagauagaagaggucuaaa

SEQ ID NO: 961730 - RNA, 21 nt, Human
uaagcuaacuuugaaaacuga

SEQ ID NO: 961731 - RNA, 24 nt, Human
uaauuuuuuguauuuuuaguagag

SEQ ID NO: 961732 - RNA, 25 nt, Human
uaauuuuuuguauuuuuaguagaga

SEQ ID NO: 961733 - RNA, 19 nt, Human
uacaaaauuucauauuuua

SEQ ID NO: 961734 - RNA, 18 nt, Human
uacaaggauuaacauguu

SEQ ID NO: 961735 - RNA, 19 nt, Human
uacaccauuguuaucauca

SEQ ID NO: 961736 - RNA, 19 nt, Human
uacagcacucacaacacac

SEQ ID NO: 961737 - RNA, 23 nt, Human
uacaggcgugagccaccgcgccc

SEQ ID NO: 961738 - RNA, 19 nt, Human
uacauauauauguacauau

SEQ ID NO: 961739 - RNA, 18 nt, Human
uaccacaagagggaagca

SEQ ID NO: 961740 - RNA, 23 nt, Human
uaccuacugauaaucugcuuuca

SEQ ID NO: 961741 - RNA, 21 nt, Human
uacuaaacaggcagacuuucu

SEQ ID NO: 961742 - RNA, 22 nt, Human
uagaagaaggaaagacuuugau

SEQ ID NO: 961743 - RNA, 20 nt, Human
uagcauugaauaaacuuucu

SEQ ID NO: 961744 - RNA, 24 nt, Human
uagccaggauggucuccaucuccu

SEQ ID NO: 961745 - RNA, 24 nt, Human
uaguagagacgggguuucaccuug

SEQ ID NO: 961746 - RNA, 27 nt, Human
uaguaugugaggggugugugugugugu

SEQ ID NO: 961747 - RNA, 18 nt, Human
uauacauauauauguaca

SEQ ID NO: 961748 - RNA, 20 nt, Human
uauauacauauauauguaca

SEQ ID NO: 961749 - RNA, 19 nt, Human
uauauguacauaugugugu

SEQ ID NO: 961750 - RNA, 24 nt, Human
uauauguacauauguguguguaua

SEQ ID NO: 961751 - RNA, 22 nt, Human
uauguacauauguguguguaua

SEQ ID NO: 961752 - RNA, 26 nt, Human
uaugugaggggugugugugugugugu

SEQ ID NO: 961753 - RNA, 20 nt, Human
ucaaaacuaagucuauccac

SEQ ID NO: 961754 - RNA, 23 nt, Human
ucaaaucuuuccuaaacagauau

SEQ ID NO: 961755 - RNA, 18 nt, Human
ucaauuuuuauuuaggug

SEQ ID NO: 961756 - RNA, 26 nt, Human
ucacaacacaccugcuacuguccgga

SEQ ID NO: 961757 - RNA, 24 nt, Human
ucacaacacaccugcuacuuaaca

SEQ ID NO: 961758 - RNA, 24 nt, Human
ucaccuuguuagccaggauggucu

SEQ ID NO: 961759 - RNA, 23 nt, Human
ucacugcaagcuccgcuucccgg

SEQ ID NO: 961760 - RNA, 24 nt, Human
ucacugcaagcuccgcuucccggg

SEQ ID NO: 961761 - RNA, 22 nt, Human
ucacuuuaauauuuuuuucaca

SEQ ID NO: 961762 - RNA, 20 nt, Human
ucagaaaaaaaaaaaaaaaa

SEQ ID NO: 961763 - RNA, 18 nt, Human
ucagccucccaaguagcu

SEQ ID NO: 961764 - RNA, 20 nt, Human
ucagccucccaaguagcugg

SEQ ID NO: 961765 - RNA, 27 nt, Human
uccaaagagugagucuucagagccaug

SEQ ID NO: 961766 - RNA, 24 nt, Human
uccacagguccucuccuguaacaa

SEQ ID NO: 961767 - RNA, 19 nt, Human
uccauguaccuacugauaa

SEQ ID NO: 961768 - RNA, 24 nt, Human
ucccaaagugcugggauuacaggc

SEQ ID NO: 961769 - RNA, 24 nt, Human
ucccaaguagcugggacuacaggc

SEQ ID NO: 961770 - RNA, 20 nt, Human
ucccggguucacgccauucu

SEQ ID NO: 961771 - RNA, 21 nt, Human
ucccggguucacgccauucuc

SEQ ID NO: 961772 - RNA, 24 nt, Human
ucccggguucacgccauucuccug

SEQ ID NO: 961773 - RNA, 23 nt, Human
ucgaacacucauuacaaacauuc

SEQ ID NO: 961774 - RNA, 21 nt, Human
ucuccaucuccugaccucaug

SEQ ID NO: 961775 - RNA, 22 nt, Human
ucuccuucuacaagaaagagaa

SEQ ID NO: 961776 - RNA, 18 nt, Human
ucucgcucugucgcccag

SEQ ID NO: 961777 - RNA, 18 nt, Human
ucucgcucugucgcccag

SEQ ID NO: 961778 - RNA, 19 nt, Human
ucucgcucugucgcccagg

SEQ ID NO: 961779 - RNA, 24 nt, Human
ucucgcucugucgcccaggccgga

SEQ ID NO: 961780 - RNA, 21 nt, Human
ucucuucgggcuccuggaagc

SEQ ID NO: 961781 - RNA, 18 nt, Human
ucuuaucaauuuucuuuc

SEQ ID NO: 961782 - RNA, 23 nt, Human
ugaauaaacuuaaauuuuucuua

SEQ ID NO: 961783 - RNA, 22 nt, Human
ugagagcaaaucacuuuaauau

SEQ ID NO: 961784 - RNA, 22 nt, Human
ugcaguggcgcaaucucggcuc

SEQ ID NO: 961785 - RNA, 23 nt, Human
ugcaguggcgcaaucucggcuca

SEQ ID NO: 961786 - RNA, 24 nt, Human
ugccucagccucccaaguagcugg

SEQ ID NO: 961787 - RNA, 24 nt, Human
ugcugggauuacaggcgugagcca

SEQ ID NO: 961788 - RNA, 25 nt, Human
uggaagccucucagaagucagccuc

SEQ ID NO: 961789 - RNA, 19 nt, Human
uggaauuuucagaggaugu

SEQ ID NO: 961790 - RNA, 21 nt, Human
uggagguccucucuucgggcu

SEQ ID NO: 961791 - RNA, 21 nt, Human
ugggacuacaggcgcccgcca

SEQ ID NO: 961792 - RNA, 22 nt, Human
ugggacuacaggcgcccgccac

SEQ ID NO: 961793 - RNA, 23 nt, Human
ugggacuacaggcgcccgccacc

SEQ ID NO: 961794 - RNA, 24 nt, Human
ugggacuacaggcgcccgccaccg

SEQ ID NO: 961795 - RNA, 19 nt, Human
ugggauuacaggcgugagc

SEQ ID NO: 961796 - RNA, 21 nt, Human
ugggauuacaggcgugagcca

SEQ ID NO: 961797 - RNA, 22 nt, Human
ugggauuacaggcgugagccac

SEQ ID NO: 961798 - RNA, 23 nt, Human
ugggauuacaggcgugagccacc

SEQ ID NO: 961799 - RNA, 24 nt, Human
ugggauuacaggcgugagccaccg

SEQ ID NO: 961800 - RNA, 19 nt, Human
uggggauguauuuuugugg

SEQ ID NO: 961801 - RNA, 21 nt, Human
uggggauguauuuuuguggga

SEQ ID NO: 961802 - RNA, 21 nt, Human
uguauuuuuaguagagacggg

SEQ ID NO: 961803 - RNA, 20 nt, Human
uguuaucaucauuaacuacu

SEQ ID NO: 961804 - RNA, 21 nt, Human
uuagcaauauagaauuauaga

SEQ ID NO: 961805 - RNA, 24 nt, Human
uuaguagagacgggguuucaccuu

SEQ ID NO: 961806 - RNA, 25 nt, Human
uuaguagagacgggguuucaccuug

SEQ ID NO: 961807 - RNA, 22 nt, Human
uuauauacauauauauguacau

SEQ ID NO: 961808 - RNA, 21 nt, Human
uucaccguccaagcccucgcu

SEQ ID NO: 961809 - RNA, 29 nt, Human
uucagaaaaaaaaaaaaaaaagagagaaa

SEQ ID NO: 961810 - RNA, 19 nt, Human
uuccuccaagucuuguagg

SEQ ID NO: 961811 - RNA, 20 nt, Human
uucucaagaaggacagaaca

SEQ ID NO: 961812 - RNA, 23 nt, Human
uuguauuuuuaguagagacgggg

SEQ ID NO: 961813 - RNA, 19 nt, Human
uugugcugaaggaggaggu

SEQ ID NO: 961814 - RNA, 21 nt, Human
uuuacuuaggacuucccucca

SEQ ID NO: 961815 - RNA, 20 nt, Human
uuuauaauuacuaugaagau

SEQ ID NO: 961816 - RNA, 21 nt, Human
uuugaagcauggugacuuauc

SEQ ID NO: 961817 - RNA, 20 nt, Human
uuuguaaggccccugugauc

SEQ ID NO: 961818 - RNA, 22 nt, Human
uuuuacuuuuuuacuuuccaaa

SEQ ID NO: 961819 - RNA, 21 nt, Human
uuuucaguauauuugcauuuc

SEQ ID NO: 961820 - RNA, 24 nt, Human
uuuuuaguagagacgggguuucac

SEQ ID NO: 961821 - RNA, 21 nt, Human
uuuuuguauuuuuaguagaga

SEQ ID NO: 961822 - RNA, 24 nt, Human
uuuuuuguauuuuuaguagagacg

SEQ ID NO: 961823 - RNA, 20 nt, Human
aaacagggucaagugggccc

SEQ ID NO: 961824 - RNA, 19 nt, Human
aaagauggagcgagggugg

SEQ ID NO: 961825 - RNA, 20 nt, Human
acgcagcccaagcugguccu

SEQ ID NO: 961826 - RNA, 21 nt, Human
agcaacaacuacauccucggc

SEQ ID NO: 961827 - RNA, 20 nt, Human
agcccaagcugguccugaau

SEQ ID NO: 961828 - RNA, 25 nt, Human
agcuggccccaaggcucccaagggc

SEQ ID NO: 961829 - RNA, 20 nt, Human
aggcccccauauuuggccag

SEQ ID NO: 961830 - RNA, 21 nt, Human
aggguuuccaacucugucuca

SEQ ID NO: 961831 - RNA, 24 nt, Human
auccccagcaccccugggaggcca

SEQ ID NO: 961832 - RNA, 25 nt, Human
auccccagcaccccugggaggccau

SEQ ID NO: 961833 - RNA, 19 nt, Human
auguauaaaaaccacauaa

SEQ ID NO: 961834 - RNA, 24 nt, Human
cacacggguucucacgcaacaacg

SEQ ID NO: 961835 - RNA, 20 nt, Human
cacagccccugaagccaggg

SEQ ID NO: 961836 - RNA, 18 nt, Human
cacauuuggaauuguuuu

SEQ ID NO: 961837 - RNA, 21 nt, Human
caccaaccuaggcaggccccc

SEQ ID NO: 961838 - RNA, 24 nt, Human
cacgcagcccaagcugguccugaa

SEQ ID NO: 961839 - RNA, 22 nt, Human
cagcaccccugggaggccauga

SEQ ID NO: 961840 - RNA, 19 nt, Human
cagcaggccagcuggcccc

SEQ ID NO: 961841 - RNA, 26 nt, Human
cagcaggccagcuggccccaaggcuc

SEQ ID NO: 961842 - RNA, 21 nt, Human
cagggcagcguccucuggaag

SEQ ID NO: 961843 - RNA, 22 nt, Human
caguugacccucuccgagcauu

SEQ ID NO: 961844 - RNA, 18 nt, Human
ccacagccugauacaggc

SEQ ID NO: 961845 - RNA, 21 nt, Human
ccacauaaauucagggccccu

SEQ ID NO: 961846 - RNA, 22 nt, Human
ccagcuggccccaaggcuccca

SEQ ID NO: 961847 - RNA, 21 nt, Human
ccccagcaccccugggaggcc

SEQ ID NO: 961848 - RNA, 21 nt, Human
cccccgagucgccccgggggc

SEQ ID NO: 961849 - RNA, 22 nt, Human
ccccgagucgccccgggggccc

SEQ ID NO: 961850 - RNA, 18 nt, Human
ccccgggggcccccgccu

SEQ ID NO: 961851 - RNA, 23 nt, Human
cccucuccgagcauucacagccc

SEQ ID NO: 961852 - RNA, 22 nt, Human
ccgcaguccucccgccggcgcc

SEQ ID NO: 961853 - RNA, 21 nt, Human
ccgcagugccaaccuagcccu

SEQ ID NO: 961854 - RNA, 19 nt, Human
ccgccccgcgguccgcccc

SEQ ID NO: 961855 - RNA, 22 nt, Human
ccggccccgcagccucggcuug

SEQ ID NO: 961856 - RNA, 23 nt, Human
ccuagcccucuggucccugaggu

SEQ ID NO: 961857 - RNA, 21 nt, Human
ccuccggaccuggggggcggg

SEQ ID NO: 961858 - RNA, 21 nt, Human
cgcaguccucccgccggcgcc

SEQ ID NO: 961859 - RNA, 21 nt, Human
cgccggccccgcagccucggc

SEQ ID NO: 961860 - RNA, 23 nt, Human
cgccggcgccggccccgcagccu

SEQ ID NO: 961861 - RNA, 23 nt, Human
cgcgcuguccucucguguggcca

SEQ ID NO: 961862 - RNA, 18 nt, Human
cggacucacgggcggcag

SEQ ID NO: 961863 - RNA, 19 nt, Human
cuuuggaugcauccccagc

SEQ ID NO: 961864 - RNA, 20 nt, Human
gaaaucucuccugagcucgc

SEQ ID NO: 961865 - RNA, 18 nt, Human
gagaggaccagggugcag

SEQ ID NO: 961866 - RNA, 23 nt, Human
gagguggugggacgacggcagca

SEQ ID NO: 961867 - RNA, 24 nt, Human
gcaacaacggaggaaggcaggcga

SEQ ID NO: 961868 - RNA, 26 nt, Human
gcaaggcagaacgcacgcagcccaag

SEQ ID NO: 961869 - RNA, 20 nt, Human
gccccaaggcucccaagggc

SEQ ID NO: 961870 - RNA, 24 nt, Human
gccccgggggcccccgccuccgga

SEQ ID NO: 961871 - RNA, 21 nt, Human
ggacuggggagaggaccaggg

SEQ ID NO: 961872 - RNA, 22 nt, Human
ggacuggggagaggaccagggu

SEQ ID NO: 961873 - RNA, 23 nt, Human
ggaggaaggugagggauggaggg

SEQ ID NO: 961874 - RNA, 20 nt, Human
ggccccaaggcucccaaggg

SEQ ID NO: 961875 - RNA, 21 nt, Human
ggccgcagugccaaccuagcc

SEQ ID NO: 961876 - RNA, 22 nt, Human
ggcgccggccccgcagccucgg

SEQ ID NO: 961877 - RNA, 21 nt, Human
ggcgggaggugggaaacaggg

SEQ ID NO: 961878 - RNA, 22 nt, Human
gggacgacggcagcaacaacua

SEQ ID NO: 961879 - RNA, 22 nt, Human
ggggccacggcuguuugggugu

SEQ ID NO: 961880 - RNA, 23 nt, Human
ggugaagaggccaguuggugagg

SEQ ID NO: 961881 - RNA, 20 nt, Human
gucucuucccugaauucuga

SEQ ID NO: 961882 - RNA, 19 nt, Human
guggcagcgggauaaugug

SEQ ID NO: 961883 - RNA, 21 nt, Human
guguuccacgaagagcagagc

SEQ ID NO: 961884 - RNA, 21 nt, Human
uaaaaaauguauaaaaaccac

SEQ ID NO: 961885 - RNA, 22 nt, Human
uaucucuucccucucauucuag

SEQ ID NO: 961886 - RNA, 21 nt, Human
uccaacucugucucagacaac

SEQ ID NO: 961887 - RNA, 20 nt, Human
uccgagcccaggaccuggug

SEQ ID NO: 961888 - RNA, 23 nt, Human
uccggaccuggggggcgggaggu

SEQ ID NO: 961889 - RNA, 21 nt, Human
ucggccggacucacgggcggc

SEQ ID NO: 961890 - RNA, 23 nt, Human
ucuccgagcauucacagccccug

SEQ ID NO: 961891 - RNA, 24 nt, Human
ucugggugguaggagcuucgcuac

SEQ ID NO: 961892 - RNA, 18 nt, Human
ugaagaggccaguuggug

SEQ ID NO: 961893 - RNA, 22 nt, Human
ugaagaggccaguuggugaggg

SEQ ID NO: 961894 - RNA, 21 nt, Human
ugaagccagggcagcguccuc

SEQ ID NO: 961895 - RNA, 19 nt, Human
ugacuggagagcagcaggc

SEQ ID NO: 961896 - RNA, 21 nt, Human
ugagggaaaggcguacauugu

SEQ ID NO: 961897 - RNA, 24 nt, Human
ugccaugcuaucucuucccucuca

SEQ ID NO: 961898 - RNA, 21 nt, Human
uggaaagguccaggaguuggg

SEQ ID NO: 961899 - RNA, 22 nt, Human
uggaggaaggugagggauggag

SEQ ID NO: 961900 - RNA, 23 nt, Human
uggaggaaggugagggauggagg

SEQ ID NO: 961901 - RNA, 21 nt, Human
uggcaaggcagaacgcacgca

SEQ ID NO: 961902 - RNA, 23 nt, Human
uggcagcgggauaauguggaagg

SEQ ID NO: 961903 - RNA, 20 nt, Human
uggccaggaccucuggggcc

SEQ ID NO: 961904 - RNA, 22 nt, Human
ugggaaggggcacacggguucu

SEQ ID NO: 961905 - RNA, 22 nt, Human
ugggcccuggcaaacucagccc

SEQ ID NO: 961906 - RNA, 21 nt, Human
ugucacgaaaucucuccugag

SEQ ID NO: 961907 - RNA, 18 nt, Human
ugugcugggcaguguuga

SEQ ID NO: 961908 - RNA, 23 nt, Human
uuaaaaaauguauaaaaaccaca

SEQ ID NO: 961909 - RNA, 24 nt, Human
aaacacaugugcaaauacagacaa

SEQ ID NO: 961910 - RNA, 21 nt, Human
aaacaggaaggcuaugccaca

SEQ ID NO: 961911 - RNA, 22 nt, Human
aaguauaaaauaccacugaacc

SEQ ID NO: 961912 - RNA, 24 nt, Human
acacaaacacaugugcaaauacag

SEQ ID NO: 961913 - RNA, 23 nt, Human
acacacacauacacacacacaca

SEQ ID NO: 961914 - RNA, 33 nt, Human
acacacacauacacacacacacaaacacauggu

SEQ ID NO: 961915 - RNA, 19 nt, Human
acacagccuuucccagccc

SEQ ID NO: 961916 - RNA, 18 nt, Human
acacaggaggcuccaucu

SEQ ID NO: 961917 - RNA, 24 nt, Human
accccuuccccuucauagcuccaa

SEQ ID NO: 961918 - RNA, 20 nt, Human
acccuguccaccccaccucc

SEQ ID NO: 961919 - RNA, 20 nt, Human
accucccacgcuucccgccg

SEQ ID NO: 961920 - RNA, 21 nt, Human
acugugcuugaaaaaccccaa

SEQ ID NO: 961921 - RNA, 23 nt, Human
agaaggcaaguauaaaauaccac

SEQ ID NO: 961922 - RNA, 25 nt, Human
agcgcgcacgcgcgugcacacacac

SEQ ID NO: 961923 - RNA, 21 nt, Human
aggaagaaggcaaguauaaaa

SEQ ID NO: 961924 - RNA, 26 nt, Human
aggugguguugugccaggaggugucc

SEQ ID NO: 961925 - RNA, 29 nt, Human
auacacacacacacaaacacaugugcagu

SEQ ID NO: 961926 - RNA, 23 nt, Human
caaaaguaggagcuacaccuccc

SEQ ID NO: 961927 - RNA, 22 nt, Human
cacacaggaggcuccaucuccc

SEQ ID NO: 961928 - RNA, 20 nt, Human
cacagcaggcccacccucuc

SEQ ID NO: 961929 - RNA, 21 nt, Human
cacaggaggcuccaucucccu

SEQ ID NO: 961930 - RNA, 20 nt, Human
cacccucucccuucucuccc

SEQ ID NO: 961931 - RNA, 19 nt, Human
cacccuguccaccccaccu

SEQ ID NO: 961932 - RNA, 24 nt, Human
cacccuuccccccaaacacacagg

SEQ ID NO: 961933 - RNA, 19 nt, Human
cacucggggcagugggggu

SEQ ID NO: 961934 - RNA, 24 nt, Human
cagaaacaggaaggcuaugccaca

SEQ ID NO: 961935 - RNA, 22 nt, Human
cagacaaacacacaucuugaaa

SEQ ID NO: 961936 - RNA, 20 nt, Human
cagagaggaggaagaugccu

SEQ ID NO: 961937 - RNA, 18 nt, Human
caggaggacccaggccaa

SEQ ID NO: 961938 - RNA, 20 nt, Human
caggaggcuccaucucccuc

SEQ ID NO: 961939 - RNA, 22 nt, Human
caugugcaaauacagacaaaca

SEQ ID NO: 961940 - RNA, 23 nt, Human
caugugcaaauacagacaaacac

SEQ ID NO: 961941 - RNA, 20 nt, Human
ccacagcaggcccacccucu

SEQ ID NO: 961942 - RNA, 22 nt, Human
ccacccacccuuccccccaaac

SEQ ID NO: 961943 - RNA, 23 nt, Human
ccacccacccuuccccccaaaca

SEQ ID NO: 961944 - RNA, 24 nt, Human
ccacccacccuuccccccaaacac

SEQ ID NO: 961945 - RNA, 24 nt, Human
ccacccuuccccccaaacacacag

SEQ ID NO: 961946 - RNA, 22 nt, Human
cccacccacccuuccccccaaa

SEQ ID NO: 961947 - RNA, 23 nt, Human
cccacccacccuuccccccaaac

SEQ ID NO: 961948 - RNA, 24 nt, Human
cccacccacccuuccccccaaaca

SEQ ID NO: 961949 - RNA, 23 nt, Human
ccccaagcccugcacucccucug

SEQ ID NO: 961950 - RNA, 21 nt, Human
ccccacccacccuucccccca

SEQ ID NO: 961951 - RNA, 23 nt, Human
ccccacccacccuuccccccaaa

SEQ ID NO: 961952 - RNA, 24 nt, Human
cccccaaacacacaggaggcucca

SEQ ID NO: 961953 - RNA, 18 nt, Human
ccccccacccugaaaaca

SEQ ID NO: 961954 - RNA, 20 nt, Human
cccucugaaggggcacagca

SEQ ID NO: 961955 - RNA, 20 nt, Human
cccuguccaccccaccucca

SEQ ID NO: 961956 - RNA, 23 nt, Human
ccuccauauguacaucgcugccc

SEQ ID NO: 961957 - RNA, 18 nt, Human
ccuccccccacccugaaa

SEQ ID NO: 961958 - RNA, 31 nt, Human
cgcacgcgcgugcacacacacauacacacag

SEQ ID NO: 961959 - RNA, 26 nt, Human
cgcgugcacacacacauacacacaca

SEQ ID NO: 961960 - RNA, 19 nt, Human
cgugccaugucccugaggu

SEQ ID NO: 961961 - RNA, 22 nt, Human
cuaugccacaagcgcgcacgcg

SEQ ID NO: 961962 - RNA, 20 nt, Human
cucauggccgggugggugcu

SEQ ID NO: 961963 - RNA, 22 nt, Human
gaccccuuccccuucauagcuc

SEQ ID NO: 961964 - RNA, 24 nt, Human
gagcuacaccucccacgcuucccg

SEQ ID NO: 961965 - RNA, 24 nt, Human
gccccacccacccuuccccccaaa

SEQ ID NO: 961966 - RNA, 20 nt, Human
gcuugaaaaaccccaaagaa

SEQ ID NO: 961967 - RNA, 19 nt, Human
ggcaguggggguaggagag

SEQ ID NO: 961968 - RNA, 22 nt, Human
ggcuccaucucccuccccccac

SEQ ID NO: 961969 - RNA, 20 nt, Human
ggggguaggagagacaaagu

SEQ ID NO: 961970 - RNA, 24 nt, Human
uacaacaaauaaauacgcggggac

SEQ ID NO: 961971 - RNA, 18 nt, Human
uacagacaaacacacauc

SEQ ID NO: 961972 - RNA, 28 nt, Human
uacgaccccuuccccuucauagcuccaa

SEQ ID NO: 961973 - RNA, 22 nt, Human
uaggagcccuccuccuagggcu

SEQ ID NO: 961974 - RNA, 30 nt, Human
uaugccacaagcgcgcacgcgcgugcacag

SEQ ID NO: 961975 - RNA, 19 nt, Human
uccaccccaccuccauaug

SEQ ID NO: 961976 - RNA, 27 nt, Human
uccaccccaccuccauauguacaucgc

SEQ ID NO: 961977 - RNA, 20 nt, Human
uccaucucccuccccccacc

SEQ ID NO: 961978 - RNA, 26 nt, Human
uccccccacccugaaaacauucacag

SEQ ID NO: 961979 - RNA, 21 nt, Human
ucccugagguagcuggugccu

SEQ ID NO: 961980 - RNA, 19 nt, Human
ucccuucucuccccucaca

SEQ ID NO: 961981 - RNA, 18 nt, Human
ucgcugcccgacacucgg

SEQ ID NO: 961982 - RNA, 21 nt, Human
ucgcugcccgacacucggggc

SEQ ID NO: 961983 - RNA, 18 nt, Human
ucggggcaguggggguag

SEQ ID NO: 961984 - RNA, 22 nt, Human
ucucccuccccccacccugaaa

SEQ ID NO: 961985 - RNA, 24 nt, Human
ucucccuccccccacccugaaaac

SEQ ID NO: 961986 - RNA, 20 nt, Human
ugacagaaacaggaaggcua

SEQ ID NO: 961987 - RNA, 21 nt, Human
ugagguagcuggugccugugc

SEQ ID NO: 961988 - RNA, 18 nt, Human
ugauacgaccccuucccc

SEQ ID NO: 961989 - RNA, 24 nt, Human
ugcacacacacauacacacacaca

SEQ ID NO: 961990 - RNA, 25 nt, Human
ugcacacacacauacacacacacac

SEQ ID NO: 961991 - RNA, 21 nt, Human
ugccaggagguguccugcagg

SEQ ID NO: 961992 - RNA, 18 nt, Human
ugcccgugccaugucccu

SEQ ID NO: 961993 - RNA, 22 nt, Human
ugcccgugcugagcagagcagg

SEQ ID NO: 961994 - RNA, 21 nt, Human
ugccugugcaaaaguaggagc

SEQ ID NO: 961995 - RNA, 24 nt, Human
ugccuucugcgaggcuggugcccu

SEQ ID NO: 961996 - RNA, 19 nt, Human
uggccgggugggugcuggg

SEQ ID NO: 961997 - RNA, 21 nt, Human
ugugccaggagguguccugca

SEQ ID NO: 961998 - RNA, 23 nt, Human
uguuaggagcccuccuccuaggg

SEQ ID NO: 961999 - RNA, 23 nt, Human
uuuuuuuuuuuuuuuuucauuuu

SEQ ID NO: 962000 - RNA, 20 nt, Human
aaaauccaaguaaucacuca

SEQ ID NO: 962001 - RNA, 20 nt, Human
aaagccauaaaaccucccca

SEQ ID NO: 962002 - RNA, 23 nt, Human
aaccagaaagcaaagucauagcu

SEQ ID NO: 962003 - RNA, 20 nt, Human
aagaauaagcagaaccaccc

SEQ ID NO: 962004 - RNA, 19 nt, Human
aagcaaagucauagcuaug

SEQ ID NO: 962005 - RNA, 19 nt, Human
aagcaaagucauagcuaug

SEQ ID NO: 962006 - RNA, 18 nt, Human
aagcagaaccaccccaag

SEQ ID NO: 962007 - RNA, 19 nt, Human
aagcaggaagaggucuuga

SEQ ID NO: 962008 - RNA, 18 nt, Human
aagcaguucugauuucuc

SEQ ID NO: 962009 - RNA, 21 nt, Human
aaugggcccaagauagggggc

SEQ ID NO: 962010 - RNA, 23 nt, Human
acaaaagccauaaaaccucccca

SEQ ID NO: 962011 - RNA, 21 nt, Human
acagacacacauguacaaaca

SEQ ID NO: 962012 - RNA, 22 nt, Human
acagacacacauguacaaacaa

SEQ ID NO: 962013 - RNA, 18 nt, Human
acauacagacacacaugu

SEQ ID NO: 962014 - RNA, 22 nt, Human
acauacagacacacauguacaa

SEQ ID NO: 962015 - RNA, 21 nt, Human
agaaacaagaaggccuccagc

SEQ ID NO: 962016 - RNA, 26 nt, Human
agaaggccuccagcagcuaccagucc

SEQ ID NO: 962017 - RNA, 20 nt, Human
agacacacauguacaaacaa

SEQ ID NO: 962018 - RNA, 21 nt, Human
agacuccauauugcaacaugg

SEQ ID NO: 962019 - RNA, 18 nt, Human
agagccaugugcgagugg

SEQ ID NO: 962020 - RNA, 21 nt, Human
agagcucagcuuccagggacu

SEQ ID NO: 962021 - RNA, 18 nt, Human
agaggcugggauggucuu

SEQ ID NO: 962022 - RNA, 23 nt, Human
agccauaaaaccuccccacagag

SEQ ID NO: 962023 - RNA, 22 nt, Human
aggaagaggucuugacguuugg

SEQ ID NO: 962024 - RNA, 27 nt, Human
aggccaagaccaggacucagcaggaga

SEQ ID NO: 962025 - RNA, 25 nt, Human
aggccuugaaaaucugacaaaagcc

SEQ ID NO: 962026 - RNA, 23 nt, Human
agggacuggccacagucagucag

SEQ ID NO: 962027 - RNA, 24 nt, Human
agggcaaguccagggagagcugcc

SEQ ID NO: 962028 - RNA, 23 nt, Human
auacagacacacauguacaaaca

SEQ ID NO: 962029 - RNA, 23 nt, Human
auauugcaacauggggaucaugc

SEQ ID NO: 962030 - RNA, 21 nt, Human
augaacgaggcacauucacag

SEQ ID NO: 962031 - RNA, 23 nt, Human
auguacaaacaacauuuugcaua

SEQ ID NO: 962032 - RNA, 20 nt, Human
caaguccagggagagcugcc

SEQ ID NO: 962033 - RNA, 22 nt, Human
cacauuugcccccaaccaccuc

SEQ ID NO: 962034 - RNA, 20 nt, Human
cacccuguuccaggcagggc

SEQ ID NO: 962035 - RNA, 28 nt, Human
caggcaacgcccccauuccccugaaagg

SEQ ID NO: 962036 - RNA, 18 nt, Human
cagggcagagacuccauu

SEQ ID NO: 962037 - RNA, 23 nt, Human
caggggguaaaaacaaagaaaag

SEQ ID NO: 962038 - RNA, 21 nt, Human
cauagagcucagcuuccaggg

SEQ ID NO: 962039 - RNA, 24 nt, Human
cauccccaaaacuaaugggcccaa

SEQ ID NO: 962040 - RNA, 24 nt, Human
cauguacaaacaacauuuugcaua

SEQ ID NO: 962041 - RNA, 20 nt, Human
ccaaccagaaagcaaaguca

SEQ ID NO: 962042 - RNA, 27 nt, Human
ccacccggaaggucacuuuaggagcuu

SEQ ID NO: 962043 - RNA, 22 nt, Human
ccagacccagcaaccuuuggca

SEQ ID NO: 962044 - RNA, 27 nt, Human
ccauggaccccagguaggggggacucc

SEQ ID NO: 962045 - RNA, 18 nt, Human
ccccaagcccauccaggc

SEQ ID NO: 962046 - RNA, 20 nt, Human
ccccaagcccauccaggcuc

SEQ ID NO: 962047 - RNA, 23 nt, Human
ccccaagcccauccaggcucaga

SEQ ID NO: 962048 - RNA, 21 nt, Human
ccccauuccaauugucucccu

SEQ ID NO: 962049 - RNA, 20 nt, Human
cccccaaccaccuccagggc

SEQ ID NO: 962050 - RNA, 19 nt, Human
cccccagcaucucaguggu

SEQ ID NO: 962051 - RNA, 20 nt, Human
cccccagcaucucagugguc

SEQ ID NO: 962052 - RNA, 22 nt, Human
cccucauaaauauuccuaagca

SEQ ID NO: 962053 - RNA, 18 nt, Human
ccuacacuccagccagag

SEQ ID NO: 962054 - RNA, 24 nt, Human
ccuccagggcucuuccuuccggcc

SEQ ID NO: 962055 - RNA, 20 nt, Human
cuacacuccagccagagaaa

SEQ ID NO: 962056 - RNA, 19 nt, Human
cuccagcagcuaccagucc

SEQ ID NO: 962057 - RNA, 20 nt, Human
cuccccacagagacauacag

SEQ ID NO: 962058 - RNA, 24 nt, Human
cuccccaucccucauaaauauucc

SEQ ID NO: 962059 - RNA, 18 nt, Human
cucucggcucgguccggc

SEQ ID NO: 962060 - RNA, 23 nt, Human
cuggagaaacaagaaggccucca

SEQ ID NO: 962061 - RNA, 19 nt, Human
cuggccccaagcccaucca

SEQ ID NO: 962062 - RNA, 19 nt, Human
cuucaaaggggaaggacug

SEQ ID NO: 962063 - RNA, 20 nt, Human
gaaagcagcugugacauggc

SEQ ID NO: 962064 - RNA, 19 nt, Human
gaagaucacacauuuacua

SEQ ID NO: 962065 - RNA, 23 nt, Human
gacauggcagugguggcagcccc

SEQ ID NO: 962066 - RNA, 22 nt, Human
gacuccugcuuuagggcaaggg

SEQ ID NO: 962067 - RNA, 21 nt, Human
gagaggccacaacagucuucc

SEQ ID NO: 962068 - RNA, 22 nt, Human
gagcugccacagagugaugcca

SEQ ID NO: 962069 - RNA, 24 nt, Human
gaggggcaguguuucaguuccuuu

SEQ ID NO: 962070 - RNA, 20 nt, Human
gcagaaagcaguucugauuu

SEQ ID NO: 962071 - RNA, 30 nt, Human
gcccccauuccaauugucucccuccccauu

SEQ ID NO: 962072 - RNA, 24 nt, Human
gcccugugccccauccccaaaacu

SEQ ID NO: 962073 - RNA, 21 nt, Human
gcugcccuucccacccggaag

SEQ ID NO: 962074 - RNA, 23 nt, Human
ggaaggacuggaucauugacugg

SEQ ID NO: 962075 - RNA, 19 nt, Human
ggccccggggcuacuggcc

SEQ ID NO: 962076 - RNA, 19 nt, Human
ggccucggccccacucggg

SEQ ID NO: 962077 - RNA, 19 nt, Human
gggaagaucucagggcaga

SEQ ID NO: 962078 - RNA, 22 nt, Human
ggggagaggggcaguguuucag

SEQ ID NO: 962079 - RNA, 18 nt, Human
gggugcggcgcaagcuac

SEQ ID NO: 962080 - RNA, 21 nt, Human
gggugcggcgcaagcuacggc

SEQ ID NO: 962081 - RNA, 18 nt, Human
gguaaaaacaaagaaaag

SEQ ID NO: 962082 - RNA, 24 nt, Human
gguuguggggcaauggggagaggg

SEQ ID NO: 962083 - RNA, 21 nt, Human
guagagcagaaaacuucaaag

SEQ ID NO: 962084 - RNA, 18 nt, Human
uaacuuggccucagugca

SEQ ID NO: 962085 - RNA, 21 nt, Human
uaagcagaaccaccccaagga

SEQ ID NO: 962086 - RNA, 25 nt, Human
uacagccuacacuccagccagagaa

SEQ ID NO: 962087 - RNA, 20 nt, Human
uacuaaaauccaaguaauca

SEQ ID NO: 962088 - RNA, 24 nt, Human
uagcuaugcccugugccccauccc

SEQ ID NO: 962089 - RNA, 22 nt, Human
uauuuucucauuuaauccuuga

SEQ ID NO: 962090 - RNA, 19 nt, Human
ucaguggucacuccguucc

SEQ ID NO: 962091 - RNA, 23 nt, Human
ucauggaaggaaaacugagaugg

SEQ ID NO: 962092 - RNA, 20 nt, Human
uccaaguaaucacucauacc

SEQ ID NO: 962093 - RNA, 19 nt, Human
uccaggcccagugaccccc

SEQ ID NO: 962094 - RNA, 19 nt, Human
uccauauugcaacaugggg

SEQ ID NO: 962095 - RNA, 22 nt, Human
uccauggaccccagguaggggg

SEQ ID NO: 962096 - RNA, 23 nt, Human
ucccuagguuagguuacuugccg

SEQ ID NO: 962097 - RNA, 22 nt, Human
uccuuuaacuuuguuaaggccu

SEQ ID NO: 962098 - RNA, 18 nt, Human
ugacaaaagccauaaaac

SEQ ID NO: 962099 - RNA, 18 nt, Human
ugacguuugguaagagcu

SEQ ID NO: 962100 - RNA, 19 nt, Human
ugaguaaacugaugucccu

SEQ ID NO: 962101 - RNA, 18 nt, Human
ugccccauccccaaaacu

SEQ ID NO: 962102 - RNA, 19 nt, Human
ugccccauccccaaaacua

SEQ ID NO: 962103 - RNA, 18 nt, Human
ugcugcagaaagcaguuc

SEQ ID NO: 962104 - RNA, 20 nt, Human
ugcuuuagggcaaggguguc

SEQ ID NO: 962105 - RNA, 18 nt, Human
uggaaggaaaacugagau

SEQ ID NO: 962106 - RNA, 22 nt, Human
uggaaggaaaacugagaugggg

SEQ ID NO: 962107 - RNA, 22 nt, Human
uggcagugguggcagccagggg

SEQ ID NO: 962108 - RNA, 23 nt, Human
uggcagugguggcagccaggggg

SEQ ID NO: 962109 - RNA, 19 nt, Human
ugggagccaaggaaauggg

SEQ ID NO: 962110 - RNA, 19 nt, Human
uggggaagaucucagggca

SEQ ID NO: 962111 - RNA, 21 nt, Human
ugucaucaaauacacauagag

SEQ ID NO: 962112 - RNA, 25 nt, Human
uuccaggcagggcaaguccagggag

SEQ ID NO: 962113 - RNA, 18 nt, Human
uuccaggcccagugaccc

SEQ ID NO: 962114 - RNA, 22 nt, Human
uugcccccaaccaccuccaggg

SEQ ID NO: 962115 - RNA, 21 nt, Human
uugguacagacaggucuuuau

SEQ ID NO: 962116 - RNA, 19 nt, Human
uuuaacuuuguuaaggccu

SEQ ID NO: 962117 - RNA, 21 nt, Human
uuuaacuuuguuaaggccuug

SEQ ID NO: 962118 - RNA, 19 nt, Human
uuugcccccaaccaccucc

SEQ ID NO: 962119 - RNA, 24 nt, Human
uuuugcauacaauuucagggaguc

SEQ ID NO: 962120 - RNA, 21 nt, Human
uuuuuuuuuuuuucauuggua

SEQ ID NO: 962121 - RNA, 19 nt, Human
aaaagagaggcuggcucau

SEQ ID NO: 962122 - RNA, 23 nt, Human
aaacccaacagacagguccaaga

SEQ ID NO: 962123 - RNA, 24 nt, Human
aaaggguuugggcagaugaaugga

SEQ ID NO: 962124 - RNA, 21 nt, Human
aagacccccaaagggagccag

SEQ ID NO: 962125 - RNA, 24 nt, Human
aagagaaaggguuugggcagauga

SEQ ID NO: 962126 - RNA, 24 nt, Human
aagagaaaggguuugggcagauga

SEQ ID NO: 962127 - RNA, 18 nt, Human
aagcguccaaacucccag

SEQ ID NO: 962128 - RNA, 19 nt, Human
aaugugcaucccagagccc

SEQ ID NO: 962129 - RNA, 23 nt, Human
acagcugcccuccaggcccccag

SEQ ID NO: 962130 - RNA, 20 nt, Human
acaggccacauagaggaggg

SEQ ID NO: 962131 - RNA, 18 nt, Human
accacaugugcaugggga

SEQ ID NO: 962132 - RNA, 30 nt, Human
accauccugguauuccauauaggguccugg

SEQ ID NO: 962133 - RNA, 24 nt, Human
accccacccucauagcgaccccag

SEQ ID NO: 962134 - RNA, 25 nt, Human
accccacccucauagcgaccccagc

SEQ ID NO: 962135 - RNA, 23 nt, Human
acccugaaagugccccggugagg

SEQ ID NO: 962136 - RNA, 24 nt, Human
accgcagauccuccugcccggcug

SEQ ID NO: 962137 - RNA, 18 nt, Human
accucgggcucccaccag

SEQ ID NO: 962138 - RNA, 18 nt, Human
accuguuggcuauggugg

SEQ ID NO: 962139 - RNA, 18 nt, Human
accuugucaucaucaccc

SEQ ID NO: 962140 - RNA, 23 nt, Human
acugugugcucagcgugaaggcu

SEQ ID NO: 962141 - RNA, 20 nt, Human
agacacgagccacacgggcc

SEQ ID NO: 962142 - RNA, 19 nt, Human
agacagccuggaucucugc

SEQ ID NO: 962143 - RNA, 22 nt, Human
agacaggccacauagaggaggg

SEQ ID NO: 962144 - RNA, 23 nt, Human
agacagguccaagacagcaaggg

SEQ ID NO: 962145 - RNA, 24 nt, Human
agacagguccaagacagcaaggga

SEQ ID NO: 962146 - RNA, 22 nt, Human
agacuaacaagacccccaaagg

SEQ ID NO: 962147 - RNA, 21 nt, Human
agagccucccccacaucuucc

SEQ ID NO: 962148 - RNA, 22 nt, Human
agaggagggaggaggccaggau

SEQ ID NO: 962149 - RNA, 18 nt, Human
agagguggguagaauuga

SEQ ID NO: 962150 - RNA, 25 nt, Human
agcagcaguguugaguaguucuggg

SEQ ID NO: 962151 - RNA, 19 nt, Human
agcagccauaguugccacu

SEQ ID NO: 962152 - RNA, 18 nt, Human
agcagcuggagaguggua

SEQ ID NO: 962153 - RNA, 23 nt, Human
agcauccaggcugcagaccccac

SEQ ID NO: 962154 - RNA, 19 nt, Human
agccaucagcugugcccag

SEQ ID NO: 962155 - RNA, 23 nt, Human
agcccaggacuacggccuugugg

SEQ ID NO: 962156 - RNA, 20 nt, Human
agccgguggcggugggggcg

SEQ ID NO: 962157 - RNA, 21 nt, Human
agcguccaaacucccagccuc

SEQ ID NO: 962158 - RNA, 25 nt, Human
agcugcccuccaggcccccagcccc

SEQ ID NO: 962159 - RNA, 19 nt, Human
aggccaccaagcgcggcaa

SEQ ID NO: 962160 - RNA, 19 nt, Human
aguaggggucucgggccaa

SEQ ID NO: 962161 - RNA, 25 nt, Human
agucagaauugauugucccauugug

SEQ ID NO: 962162 - RNA, 20 nt, Human
aguugagacaucagauuucu

SEQ ID NO: 962163 - RNA, 20 nt, Human
auagaggagggaggaggcca

SEQ ID NO: 962164 - RNA, 20 nt, Human
aucacccacugcacuggccu

SEQ ID NO: 962165 - RNA, 19 nt, Human
aucaggugccagcugugcc

SEQ ID NO: 962166 - RNA, 18 nt, Human
auggaacaggaggaugga

SEQ ID NO: 962167 - RNA, 21 nt, Human
auggaccugcagagcccugcc

SEQ ID NO: 962168 - RNA, 21 nt, Human
auggaccugcagagcccugcc

SEQ ID NO: 962169 - RNA, 18 nt, Human
auuuccgucggcgcccuc

SEQ ID NO: 962170 - RNA, 21 nt, Human
caaaguccaggaccagggaug

SEQ ID NO: 962171 - RNA, 21 nt, Human
caagacccccaaagggagcca

SEQ ID NO: 962172 - RNA, 21 nt, Human
caagggaggcucagaggugca

SEQ ID NO: 962173 - RNA, 22 nt, Human
cacaucaggugccagcugugcc

SEQ ID NO: 962174 - RNA, 21 nt, Human
caccagcagccuugcugaggc

SEQ ID NO: 962175 - RNA, 23 nt, Human
caccucgggcucccaccagcagc

SEQ ID NO: 962176 - RNA, 19 nt, Human
caccuugucaucaucaccc

SEQ ID NO: 962177 - RNA, 23 nt, Human
cacgagccaggccggggcucagg

SEQ ID NO: 962178 - RNA, 22 nt, Human
cacggacuaaacccaacagaca

SEQ ID NO: 962179 - RNA, 18 nt, Human
cacggugacugcugcggc

SEQ ID NO: 962180 - RNA, 19 nt, Human
cacugagagagaacagggc

SEQ ID NO: 962181 - RNA, 22 nt, Human
cacugcacuggccuugcucucc

SEQ ID NO: 962182 - RNA, 20 nt, Human
cacuucuccuuccccuccuc

SEQ ID NO: 962183 - RNA, 18 nt, Human
cagagcccaggacuacgg

SEQ ID NO: 962184 - RNA, 19 nt, Human
cagcagcccguccacgccc

SEQ ID NO: 962185 - RNA, 22 nt, Human
cagcauccaggcugcagacccc

SEQ ID NO: 962186 - RNA, 22 nt, Human
cagcugcccuccaggcccccag

SEQ ID NO: 962187 - RNA, 21 nt, Human
cagcugugcccagaaagagca

SEQ ID NO: 962188 - RNA, 22 nt, Human
caggaucuucuucccucccagg

SEQ ID NO: 962189 - RNA, 23 nt, Human
caggggcuuuuggagcuggggca

SEQ ID NO: 962190 - RNA, 22 nt, Human
cagggucuuccacugugugcuc

SEQ ID NO: 962191 - RNA, 19 nt, Human
cagguccaagacagcaagg

SEQ ID NO: 962192 - RNA, 27 nt, Human
cagguccaagacagcaagggaggcuga

SEQ ID NO: 962193 - RNA, 20 nt, Human
cagguugugggggcggggaa

SEQ ID NO: 962194 - RNA, 19 nt, Human
caugccuguuccacccacc

SEQ ID NO: 962195 - RNA, 20 nt, Human
caugccuguuccacccaccu

SEQ ID NO: 962196 - RNA, 21 nt, Human
ccaaaagagaggcuggcucau

SEQ ID NO: 962197 - RNA, 21 nt, Human
ccacccucauagcgaccccag

SEQ ID NO: 962198 - RNA, 19 nt, Human
ccaccugguuguaaguggg

SEQ ID NO: 962199 - RNA, 18 nt, Human
ccacgagcugcgugugcc

SEQ ID NO: 962200 - RNA, 23 nt, Human
ccagagccucccccacaucuucc

SEQ ID NO: 962201 - RNA, 21 nt, Human
ccagcagcccguccacgccca

SEQ ID NO: 962202 - RNA, 24 nt, Human
ccagcagccuugcugaggccuccu

SEQ ID NO: 962203 - RNA, 19 nt, Human
ccaggccggggcucaggca

SEQ ID NO: 962204 - RNA, 23 nt, Human
ccauuggucagcucagccggugg

SEQ ID NO: 962205 - RNA, 21 nt, Human
cccaacagacagguccaagac

SEQ ID NO: 962206 - RNA, 21 nt, Human
cccacccucauagcgacccca

SEQ ID NO: 962207 - RNA, 19 nt, Human
cccagacuaacaagacccc

SEQ ID NO: 962208 - RNA, 24 nt, Human
cccagacuaacaagacccccaaag

SEQ ID NO: 962209 - RNA, 19 nt, Human
cccagagagcucuucauag

SEQ ID NO: 962210 - RNA, 24 nt, Human
ccccacccucauagcgaccccagc

SEQ ID NO: 962211 - RNA, 21 nt, Human
ccccacucugucacaugccug

SEQ ID NO: 962212 - RNA, 24 nt, Human
cccccacauagaggcugugcugca

SEQ ID NO: 962213 - RNA, 23 nt, Human
ccccugaaagugccccggugagg

SEQ ID NO: 962214 - RNA, 22 nt, Human
ccccuggacccugaaagugccc

SEQ ID NO: 962215 - RNA, 20 nt, Human
cccuccaggcccccagcccc

SEQ ID NO: 962216 - RNA, 21 nt, Human
cccuggacccugaaagugccc

SEQ ID NO: 962217 - RNA, 19 nt, Human
cccugggaccuguuggcua

SEQ ID NO: 962218 - RNA, 21 nt, Human
ccgcagccggcugggcagugc

SEQ ID NO: 962219 - RNA, 24 nt, Human
ccucgggcucccaccagcagccuu

SEQ ID NO: 962220 - RNA, 19 nt, Human
ccucugaaauguccacgga

SEQ ID NO: 962221 - RNA, 23 nt, Human
ccucugcccuuugcauaguucca

SEQ ID NO: 962222 - RNA, 18 nt, Human
ccugaaagugccccggug

SEQ ID NO: 962223 - RNA, 18 nt, Human
ccugggacagauaggcug

SEQ ID NO: 962224 - RNA, 21 nt, Human
ccugugaagccacgggcuggg

SEQ ID NO: 962225 - RNA, 22 nt, Human
ccuugaagugccgggucccaga

SEQ ID NO: 962226 - RNA, 21 nt, Human
cgcagccggcugggcagugcc

SEQ ID NO: 962227 - RNA, 22 nt, Human
cgcuaggagcccccacauagag

SEQ ID NO: 962228 - RNA, 19 nt, Human
cgggagcagcuggagagug

SEQ ID NO: 962229 - RNA, 24 nt, Human
cguccaaacucccagccucugccc

SEQ ID NO: 962230 - RNA, 19 nt, Human
cgugaaggcugcauagaag

SEQ ID NO: 962231 - RNA, 27 nt, Human
cucauagcgaccccagcgccgggaacc

SEQ ID NO: 962232 - RNA, 25 nt, Human
cuccucccuuucccugcuguagucu

SEQ ID NO: 962233 - RNA, 19 nt, Human
cugagcccaggcuccccac

SEQ ID NO: 962234 - RNA, 21 nt, Human
cugagcccaggcuccccacuc

SEQ ID NO: 962235 - RNA, 18 nt, Human
cugagcccaggcuccccc

SEQ ID NO: 962236 - RNA, 22 nt, Human
cugcgugugcuuccuuuuuucc

SEQ ID NO: 962237 - RNA, 26 nt, Human
cugcugcucucacagccucggugaca

SEQ ID NO: 962238 - RNA, 19 nt, Human
cuggacccugaaagugccc

SEQ ID NO: 962239 - RNA, 21 nt, Human
cuggcuuggaagagcauuugu

SEQ ID NO: 962240 - RNA, 22 nt, Human
cugggaccuguuggcuauggug

SEQ ID NO: 962241 - RNA, 21 nt, Human
cuggggaggcuucccagugga

SEQ ID NO: 962242 - RNA, 18 nt, Human
cugugcugcaauagagag

SEQ ID NO: 962243 - RNA, 20 nt, Human
cuucagaggccccuggaccc

SEQ ID NO: 962244 - RNA, 21 nt, Human
cuucagaggccccuggccccu

SEQ ID NO: 962245 - RNA, 19 nt, Human
cuucccgcagacaggccac

SEQ ID NO: 962246 - RNA, 22 nt, Human
cuugcugaggccuccuccagca

SEQ ID NO: 962247 - RNA, 22 nt, Human
cuuuggcugggccugacuggcc

SEQ ID NO: 962248 - RNA, 21 nt, Human
gaacuggcucugggucugcag

SEQ ID NO: 962249 - RNA, 20 nt, Human
gacagggguaggagcuaagc

SEQ ID NO: 962250 - RNA, 19 nt, Human
gacgggcuuucaggaagga

SEQ ID NO: 962251 - RNA, 24 nt, Human
gagcauuuguucugggaggcuggg

SEQ ID NO: 962252 - RNA, 26 nt, Human
gagcuggggcaggaguggcuggccgg

SEQ ID NO: 962253 - RNA, 20 nt, Human
gaggggccagagccuccccc

SEQ ID NO: 962254 - RNA, 18 nt, Human
gagggggcuuuggcuggg

SEQ ID NO: 962255 - RNA, 24 nt, Human
gagguggguagaauugagccgcug

SEQ ID NO: 962256 - RNA, 20 nt, Human
gaguuccucggcgaaggagc

SEQ ID NO: 962257 - RNA, 19 nt, Human
gauaggaacuggcucuggg

SEQ ID NO: 962258 - RNA, 20 nt, Human
gcaauagagagaugacuaga

SEQ ID NO: 962259 - RNA, 25 nt, Human
gcaaugaaucugugauacacgagcc

SEQ ID NO: 962260 - RNA, 19 nt, Human
gcagauggcugaggccucc

SEQ ID NO: 962261 - RNA, 21 nt, Human
gcaggggcuuuuggagcuggg

SEQ ID NO: 962262 - RNA, 18 nt, Human
gccacugugcucaggcug

SEQ ID NO: 962263 - RNA, 24 nt, Human
gccagggucccagccacaguaggg

SEQ ID NO: 962264 - RNA, 21 nt, Human
gccuugcugaggccuccucca

SEQ ID NO: 962265 - RNA, 18 nt, Human
gcuggggcucccucccca

SEQ ID NO: 962266 - RNA, 18 nt, Human
ggacccugaaagugcccc

SEQ ID NO: 962267 - RNA, 18 nt, Human
ggagaacacaaacuccgc

SEQ ID NO: 962268 - RNA, 18 nt, Human
ggaggcuucccaguggau

SEQ ID NO: 962269 - RNA, 25 nt, Human
ggauccagccaucagcugugcccag

SEQ ID NO: 962270 - RNA, 21 nt, Human
ggcaggaggacaucaucaccc

SEQ ID NO: 962271 - RNA, 20 nt, Human
ggccugggcugcucacaugu

SEQ ID NO: 962272 - RNA, 20 nt, Human
ggcggugggggcgguggggg

SEQ ID NO: 962273 - RNA, 18 nt, Human
gggcacaacgggccgagc

SEQ ID NO: 962274 - RNA, 23 nt, Human
gggcugggucauaaggacacuuc

SEQ ID NO: 962275 - RNA, 21 nt, Human
gggcuucaugugccaguugag

SEQ ID NO: 962276 - RNA, 20 nt, Human
gggggcgguggggguggugg

SEQ ID NO: 962277 - RNA, 18 nt, Human
ggguggcuguguuaggga

SEQ ID NO: 962278 - RNA, 21 nt, Human
gguagcgggagcagcuggaga

SEQ ID NO: 962279 - RNA, 24 nt, Human
gguauggaguggggguaaugaagg

SEQ ID NO: 962280 - RNA, 21 nt, Human
gguccagcaggcguggugacc

SEQ ID NO: 962281 - RNA, 23 nt, Human
ggugccagcugugccccaggugu

SEQ ID NO: 962282 - RNA, 22 nt, Human
ggugggggcgguggggguggug

SEQ ID NO: 962283 - RNA, 23 nt, Human
ggugggggugguggggcuggggc

SEQ ID NO: 962284 - RNA, 19 nt, Human
gugcaucccagagcccagg

SEQ ID NO: 962285 - RNA, 18 nt, Human
guggaacaggaggaugga

SEQ ID NO: 962286 - RNA, 18 nt, Human
guguguguagcguauguu

SEQ ID NO: 962287 - RNA, 23 nt, Human
guguguguuaccacaugugcaug

SEQ ID NO: 962288 - RNA, 21 nt, Human
uaaacccaacagacaggucca

SEQ ID NO: 962289 - RNA, 24 nt, Human
uaaacccaacagacagguccaaga

SEQ ID NO: 962290 - RNA, 21 nt, Human
uaagcacaugugugauacagg

SEQ ID NO: 962291 - RNA, 21 nt, Human
uaagguguguguagcguaugu

SEQ ID NO: 962292 - RNA, 19 nt, Human
uagaggaagcaaaugcuug

SEQ ID NO: 962293 - RNA, 22 nt, Human
uagaggagggaggaggccagga

SEQ ID NO: 962294 - RNA, 19 nt, Human
uaguucugggcuuggcccu

SEQ ID NO: 962295 - RNA, 21 nt, Human
ucagaggccccuggacccuga

SEQ ID NO: 962296 - RNA, 18 nt, Human
ucagcauccaggcugcag

SEQ ID NO: 962297 - RNA, 18 nt, Human
ucagggaguguggguggc

SEQ ID NO: 962298 - RNA, 25 nt, Human
uccacgcccacacgguagccacccu

SEQ ID NO: 962299 - RNA, 23 nt, Human
uccacggacuaaacccaacagac

SEQ ID NO: 962300 - RNA, 22 nt, Human
uccacguucucagcuacaaaaa

SEQ ID NO: 962301 - RNA, 23 nt, Human
uccaggcccccagcccccucauc

SEQ ID NO: 962302 - RNA, 23 nt, Human
ucccagagcccaggacuacggcc

SEQ ID NO: 962303 - RNA, 19 nt, Human
ucccagccacaguaggggu

SEQ ID NO: 962304 - RNA, 24 nt, Human
ucccagccucugcccuuugcauag

SEQ ID NO: 962305 - RNA, 19 nt, Human
ucccaguggaucucuuugu

SEQ ID NO: 962306 - RNA, 23 nt, Human
ucccugcuguagucuagaggaag

SEQ ID NO: 962307 - RNA, 25 nt, Human
ucccugcuguagucuagaggaagca

SEQ ID NO: 962308 - RNA, 22 nt, Human
uccgcagugaggguccugggac

SEQ ID NO: 962309 - RNA, 23 nt, Human
uccuaggcaagggccugugagga

SEQ ID NO: 962310 - RNA, 24 nt, Human
uccucgaagcugguuggcaaggug

SEQ ID NO: 962311 - RNA, 20 nt, Human
ucgggcucccaccagcagcc

SEQ ID NO: 962312 - RNA, 21 nt, Human
ucgguagcgggagcagcugga

SEQ ID NO: 962313 - RNA, 20 nt, Human
ucuccucccuuucccugcug

SEQ ID NO: 962314 - RNA, 22 nt, Human
ucuccucccuuucccugcugua

SEQ ID NO: 962315 - RNA, 21 nt, Human
ucucuauguccuguaucagug

SEQ ID NO: 962316 - RNA, 25 nt, Human
ucugaaauguccacggacuaaaccc

SEQ ID NO: 962317 - RNA, 22 nt, Human
ucugcaggaucuucuucccucc

SEQ ID NO: 962318 - RNA, 19 nt, Human
ucuggagacagcugcccuc

SEQ ID NO: 962319 - RNA, 25 nt, Human
ugaagggcaguaaaaacccguggga

SEQ ID NO: 962320 - RNA, 23 nt, Human
ugagacaucagauuucuccuccc

SEQ ID NO: 962321 - RNA, 19 nt, Human
ugagcccaggcuccccacu

SEQ ID NO: 962322 - RNA, 22 nt, Human
ugaggagcaccgaugggccugg

SEQ ID NO: 962323 - RNA, 21 nt, Human
ugaggagggggcuuuggcugg

SEQ ID NO: 962324 - RNA, 24 nt, Human
ugaggagggggcuuuggcugggcc

SEQ ID NO: 962325 - RNA, 18 nt, Human
ugaguggaaauguaagca

SEQ ID NO: 962326 - RNA, 20 nt, Human
ugaguggaaauguaagcaca

SEQ ID NO: 962327 - RNA, 24 nt, Human
ugcacuggccuugcucucccgcac

SEQ ID NO: 962328 - RNA, 20 nt, Human
ugcauuggugucuccucagu

SEQ ID NO: 962329 - RNA, 23 nt, Human
ugcccuccaggcccccagccccc

SEQ ID NO: 962330 - RNA, 19 nt, Human
ugccucagaagcacauagc

SEQ ID NO: 962331 - RNA, 21 nt, Human
ugccugggagaaagagaaagg

SEQ ID NO: 962332 - RNA, 21 nt, Human
ugccugggagaaagagaaagg

SEQ ID NO: 962333 - RNA, 20 nt, Human
ugcugugaggaugcugagga

SEQ ID NO: 962334 - RNA, 23 nt, Human
ugcugugaggaugcugaggagga

SEQ ID NO: 962335 - RNA, 23 nt, Human
uggaauguggcagaugagacggg

SEQ ID NO: 962336 - RNA, 22 nt, Human
uggaugacuccgcuaggagccc

SEQ ID NO: 962337 - RNA, 23 nt, Human
uggcacugagagagaacagggca

SEQ ID NO: 962338 - RNA, 23 nt, Human
uggcaucuaguucucuagacggu

SEQ ID NO: 962339 - RNA, 19 nt, Human
uggccccugaaagugcccc

SEQ ID NO: 962340 - RNA, 23 nt, Human
ugggagaaggguauggagugggg

SEQ ID NO: 962341 - RNA, 18 nt, Human
ugggagggggaucucccu

SEQ ID NO: 962342 - RNA, 21 nt, Human
ugggcugcucacauguggguc

SEQ ID NO: 962343 - RNA, 22 nt, Human
ugggggcggugggggugguggg

SEQ ID NO: 962344 - RNA, 21 nt, Human
uggggguaaugaagggagggu

SEQ ID NO: 962345 - RNA, 23 nt, Human
uggggguaaugaagggagggugg

SEQ ID NO: 962346 - RNA, 19 nt, Human
ugggggugguggggcuggg

SEQ ID NO: 962347 - RNA, 21 nt, Human
ugggggugguggggcuggggc

SEQ ID NO: 962348 - RNA, 20 nt, Human
ugggguggaggugggagagg

SEQ ID NO: 962349 - RNA, 20 nt, Human
ugggguggaggugggagagg

SEQ ID NO: 962350 - RNA, 21 nt, Human
ugggguggaggugggagaggu

SEQ ID NO: 962351 - RNA, 24 nt, Human
ugguagcuggaugacuccgcuagg

SEQ ID NO: 962352 - RNA, 23 nt, Human
uggucagcucagccgguggcggu

SEQ ID NO: 962353 - RNA, 21 nt, Human
uguggagacugaggagggggc

SEQ ID NO: 962354 - RNA, 22 nt, Human
uguggagacugaggagggggcu

SEQ ID NO: 962355 - RNA, 25 nt, Human
uguggagacugaggagggggcuuug

SEQ ID NO: 962356 - RNA, 19 nt, Human
ugugggggcggggaauggg

SEQ ID NO: 962357 - RNA, 20 nt, Human
ugugggguggaggugggaga

SEQ ID NO: 962358 - RNA, 19 nt, Human
ugugugauacaggugugug

SEQ ID NO: 962359 - RNA, 22 nt, Human
uguguguuaccacaugugcaug

SEQ ID NO: 962360 - RNA, 19 nt, Human
uguuccacccaccugguug

SEQ ID NO: 962361 - RNA, 20 nt, Human
uguuccacccaccugguugu

SEQ ID NO: 962362 - RNA, 21 nt, Human
uguuccacccaccugguugua

SEQ ID NO: 962363 - RNA, 20 nt, Human
uucccaguggaucucuuugu

SEQ ID NO: 962364 - RNA, 18 nt, Human
uucccugggaccuguugg

SEQ ID NO: 962365 - RNA, 22 nt, Human
uucucagcuacaaaaauaacag

SEQ ID NO: 962366 - RNA, 18 nt, Human
uucucagggagugugggu

SEQ ID NO: 962367 - RNA, 20 nt, Human
uugagccgcugcaggaaccg

SEQ ID NO: 962368 - RNA, 19 nt, Human
uugcaccgcagauccuccu

SEQ ID NO: 962369 - RNA, 19 nt, Human
uugcauaguuccaagaaug

SEQ ID NO: 962370 - RNA, 21 nt, Human
uugcauaguuccaagaauggg

SEQ ID NO: 962371 - RNA, 22 nt, Human
uugcucugccucagaagcacau

SEQ ID NO: 962372 - RNA, 20 nt, Human
uuggcacugagagagaacag

SEQ ID NO: 962373 - RNA, 18 nt, Human
uugggcagaugaguggaa

SEQ ID NO: 962374 - RNA, 19 nt, Human
uugugggggcggggaaugg

SEQ ID NO: 962375 - RNA, 18 nt, Human
uuuccucucucuaugucc

SEQ ID NO: 962376 - RNA, 19 nt, Human
uuugggcagaugaauggaa

SEQ ID NO: 962377 - RNA, 18 nt, Human
uuuuuuuuuuuugugggg

SEQ ID NO: 962378 - RNA, 32 nt, Human
uuuuuuuuuuuuuguggggaaaaaggguguuc

SEQ ID NO: 962379 - RNA, 19 nt, Human
uuuuuuuuuuuuuuuuugu

SEQ ID NO: 962380 - RNA, 24 nt, Human
uuuuuuuuuuuuuuuuuguggggg

SEQ ID NO: 962381 - RNA, 22 nt, Human
aaaaaacaaaccaauggacuug

SEQ ID NO: 962382 - RNA, 24 nt, Human
aaacaaaccaauggacuugucaga

SEQ ID NO: 962383 - RNA, 18 nt, Human
aaaccccaguuucaccaa

SEQ ID NO: 962384 - RNA, 22 nt, Human
aaagacguguauuuuuggcacc

SEQ ID NO: 962385 - RNA, 24 nt, Human
aaagugcugggauuauaggcauga

SEQ ID NO: 962386 - RNA, 20 nt, Human
aacaggcuuagggaaccauc

SEQ ID NO: 962387 - RNA, 23 nt, Human
aacuauguguugguuuuuguucc

SEQ ID NO: 962388 - RNA, 24 nt, Human
aagaaacugggaccacaggcacgc

SEQ ID NO: 962389 - RNA, 21 nt, Human
aagaagacucaaaaauaacua

SEQ ID NO: 962390 - RNA, 21 nt, Human
aagaaucccacagcuuuaucc

SEQ ID NO: 962391 - RNA, 19 nt, Human
aagacaggaaggacucuug

SEQ ID NO: 962392 - RNA, 18 nt, Human
aagaucauuaaagaccag

SEQ ID NO: 962393 - RNA, 22 nt, Human
aagcaaauggaggagggacccc

SEQ ID NO: 962394 - RNA, 21 nt, Human
aagcccacccgcggcgggaaa

SEQ ID NO: 962395 - RNA, 23 nt, Human
aaggacucuugacauaugaggga

SEQ ID NO: 962396 - RNA, 19 nt, Human
aaggagcaggucuuucaga

SEQ ID NO: 962397 - RNA, 21 nt, Human
aaggggccucugacucugggc

SEQ ID NO: 962398 - RNA, 19 nt, Human
aagugcugggauuauaggc

SEQ ID NO: 962399 - RNA, 21 nt, Human
aagugcugggauuauaggcau

SEQ ID NO: 962400 - RNA, 22 nt, Human
aagugguugguuauuuuacaga

SEQ ID NO: 962401 - RNA, 18 nt, Human
aaugguguuagcacacuc

SEQ ID NO: 962402 - RNA, 20 nt, Human
acaaacacaacuuauuccac

SEQ ID NO: 962403 - RNA, 19 nt, Human
acagaagcucuucuucucc

SEQ ID NO: 962404 - RNA, 18 nt, Human
acauugaguccccccugc

SEQ ID NO: 962405 - RNA, 18 nt, Human
accaucccuacaaacaug

SEQ ID NO: 962406 - RNA, 21 nt, Human
accccaguuucaccaaagcua

SEQ ID NO: 962407 - RNA, 22 nt, Human
accucagccccacacauacauu

SEQ ID NO: 962408 - RNA, 19 nt, Human
acgagcacgguccccgagc

SEQ ID NO: 962409 - RNA, 24 nt, Human
acuccagcccaagucucacacacc

SEQ ID NO: 962410 - RNA, 25 nt, Human
acucccgccucagccucccaagaaa

SEQ ID NO: 962411 - RNA, 21 nt, Human
acucgcugaguuccagaaugg

SEQ ID NO: 962412 - RNA, 26 nt, Human
acugaaauaaaagaaaaggcaccagu

SEQ ID NO: 962413 - RNA, 19 nt, Human
agaaagacuccuuccaaug

SEQ ID NO: 962414 - RNA, 18 nt, Human
agacagguggacuuccag

SEQ ID NO: 962415 - RNA, 20 nt, Human
agaccccugguucaucccaa

SEQ ID NO: 962416 - RNA, 18 nt, Human
agcagcugcagccgcccc

SEQ ID NO: 962417 - RNA, 24 nt, Human
agccaagcgagcuuccucaugaaa

SEQ ID NO: 962418 - RNA, 19 nt, Human
agccuaucugcaacuguau

SEQ ID NO: 962419 - RNA, 23 nt, Human
agcgagcuuccucaugaaaacca

SEQ ID NO: 962420 - RNA, 21 nt, Human
aggaaggacucuugacauaug

SEQ ID NO: 962421 - RNA, 19 nt, Human
aggcagcaaguaacagcag

SEQ ID NO: 962422 - RNA, 21 nt, Human
aggcagcaaguaacagcagaa

SEQ ID NO: 962423 - RNA, 21 nt, Human
aggcaugagccacugcaccca

SEQ ID NO: 962424 - RNA, 23 nt, Human
aggccuugaggaacuggggauuu

SEQ ID NO: 962425 - RNA, 20 nt, Human
agggugaauggacugggugg

SEQ ID NO: 962426 - RNA, 24 nt, Human
aggugauccgcccaccuuggccuc

SEQ ID NO: 962427 - RNA, 19 nt, Human
agugaagagaccacaggga

SEQ ID NO: 962428 - RNA, 24 nt, Human
agugaugugaucucagcucacugc

SEQ ID NO: 962429 - RNA, 19 nt, Human
agugcagugaugugaucuc

SEQ ID NO: 962430 - RNA, 21 nt, Human
agugcagugaugugaucucag

SEQ ID NO: 962431 - RNA, 24 nt, Human
agugcagugaugugaucucagcuc

SEQ ID NO: 962432 - RNA, 21 nt, Human
auauuuuguagagauggaguu

SEQ ID NO: 962433 - RNA, 24 nt, Human
augaacaccaauuaaaaacuucac

SEQ ID NO: 962434 - RNA, 22 nt, Human
augaguuggaaauuucugauga

SEQ ID NO: 962435 - RNA, 24 nt, Human
augauacucccgccucagccuccc

SEQ ID NO: 962436 - RNA, 21 nt, Human
auggaccuuggagcaugugca

SEQ ID NO: 962437 - RNA, 24 nt, Human
auggagugcagugaugugaucuca

SEQ ID NO: 962438 - RNA, 25 nt, Human
auuaauccccaaauaacuuacagag

SEQ ID NO: 962439 - RNA, 20 nt, Human
caaaaccccaguuucaccaa

SEQ ID NO: 962440 - RNA, 22 nt, Human
caaauaacuuacagagcccacc

SEQ ID NO: 962441 - RNA, 18 nt, Human
caacacaggugcgaggag

SEQ ID NO: 962442 - RNA, 18 nt, Human
caacagcauggcaaggag

SEQ ID NO: 962443 - RNA, 23 nt, Human
caaccucaaccuccuggcucaaa

SEQ ID NO: 962444 - RNA, 22 nt, Human
caagaaacugggaccacaggca

SEQ ID NO: 962445 - RNA, 18 nt, Human
caagaaaggacccugaau

SEQ ID NO: 962446 - RNA, 26 nt, Human
caagacccuggauuucauuaaucccc

SEQ ID NO: 962447 - RNA, 24 nt, Human
caagcgagcuuccucaugaaaacc

SEQ ID NO: 962448 - RNA, 19 nt, Human
caagggccgcggcuggccu

SEQ ID NO: 962449 - RNA, 21 nt, Human
cacagaaacugcaucaggagc

SEQ ID NO: 962450 - RNA, 19 nt, Human
caccaggacuuccaaacag

SEQ ID NO: 962451 - RNA, 24 nt, Human
cacccaggauggagugcagugaug

SEQ ID NO: 962452 - RNA, 19 nt, Human
cacccgcggcgggaaagca

SEQ ID NO: 962453 - RNA, 23 nt, Human
cacgcaccacgauggcuggcuaa

SEQ ID NO: 962454 - RNA, 22 nt, Human
cacucugggcaguugauccuga

SEQ ID NO: 962455 - RNA, 19 nt, Human
cacugcaaccucaaccucc

SEQ ID NO: 962456 - RNA, 21 nt, Human
cacugcaaccucaaccuccug

SEQ ID NO: 962457 - RNA, 22 nt, Human
cacugcacccagccuuugucca

SEQ ID NO: 962458 - RNA, 25 nt, Human
cacuuccccagagccgcccccuacu

SEQ ID NO: 962459 - RNA, 19 nt, Human
cagaagcucuucuucuccu

SEQ ID NO: 962460 - RNA, 20 nt, Human
cagcagcugcagccgccccc

SEQ ID NO: 962461 - RNA, 19 nt, Human
caggccuugaggaacuggg

SEQ ID NO: 962462 - RNA, 21 nt, Human
caucaugaagauuuacacucc

SEQ ID NO: 962463 - RNA, 21 nt, Human
caucccuacaaacaugaagaa

SEQ ID NO: 962464 - RNA, 24 nt, Human
cauccggcuagauuucccccuacu

SEQ ID NO: 962465 - RNA, 21 nt, Human
caugaaaaccagccuaucugc

SEQ ID NO: 962466 - RNA, 23 nt, Human
cauguugcccaggcuggucuuaa

SEQ ID NO: 962467 - RNA, 24 nt, Human
cauguugcccaggcuggucuuaaa

SEQ ID NO: 962468 - RNA, 25 nt, Human
cauguuguguagugugcagaaauuc

SEQ ID NO: 962469 - RNA, 24 nt, Human
ccaaagugcugggauuauaggcau

SEQ ID NO: 962470 - RNA, 22 nt, Human
ccaaauaacuuacagagcccac

SEQ ID NO: 962471 - RNA, 21 nt, Human
ccaagggucagacccauggac

SEQ ID NO: 962472 - RNA, 20 nt, Human
ccaccagcaccagcaauggc

SEQ ID NO: 962473 - RNA, 20 nt, Human
ccacugcacccagccuuugu

SEQ ID NO: 962474 - RNA, 24 nt, Human
ccagacagguggacuuccaggcca

SEQ ID NO: 962475 - RNA, 21 nt, Human
ccauguugcccaggcuggucu

SEQ ID NO: 962476 - RNA, 19 nt, Human
cccaaaaacccuuacuucc

SEQ ID NO: 962477 - RNA, 23 nt, Human
cccacaguuuccauccuuuugga

SEQ ID NO: 962478 - RNA, 23 nt, Human
cccagcagagacgacccucgagg

SEQ ID NO: 962479 - RNA, 22 nt, Human
ccccaaaaacccuuacuuccag

SEQ ID NO: 962480 - RNA, 27 nt, Human
ccccauguugcccaggcuggucuuaaa

SEQ ID NO: 962481 - RNA, 21 nt, Human
ccccccugccaagacccugga

SEQ ID NO: 962482 - RNA, 23 nt, Human
cccccugccacuuccccagagcc

SEQ ID NO: 962483 - RNA, 21 nt, Human
ccccugcacggggaaggugga

SEQ ID NO: 962484 - RNA, 20 nt, Human
cccgagcgcgcggccaaccg

SEQ ID NO: 962485 - RNA, 20 nt, Human
ccgcugccuccaccagcacc

SEQ ID NO: 962486 - RNA, 21 nt, Human
ccgcugccuccaccagcacca

SEQ ID NO: 962487 - RNA, 19 nt, Human
ccucauguaagucacaaga

SEQ ID NO: 962488 - RNA, 18 nt, Human
ccugagcucaggugaucc

SEQ ID NO: 962489 - RNA, 24 nt, Human
ccugagcucaggugauccgcccac

SEQ ID NO: 962490 - RNA, 21 nt, Human
ccuggcucaaaugauacuccc

SEQ ID NO: 962491 - RNA, 23 nt, Human
ccuugaggaacuggggauuuaca

SEQ ID NO: 962492 - RNA, 21 nt, Human
cgaggaacaauuggggaacca

SEQ ID NO: 962493 - RNA, 24 nt, Human
cgccucagccucccaagaaacugg

SEQ ID NO: 962494 - RNA, 21 nt, Human
cgcgcccagcagagacgaccc

SEQ ID NO: 962495 - RNA, 19 nt, Human
cggcgggaaagcagcgcuc

SEQ ID NO: 962496 - RNA, 19 nt, Human
cgguggagccugaccacgu

SEQ ID NO: 962497 - RNA, 23 nt, Human
cucacagucuacuguaacuucug

SEQ ID NO: 962498 - RNA, 24 nt, Human
cucacugcaaccucaaccuccugg

SEQ ID NO: 962499 - RNA, 24 nt, Human
cucaggugauccgcccaccuuggc

SEQ ID NO: 962500 - RNA, 21 nt, Human
cuccacagccacgugggcacu

SEQ ID NO: 962501 - RNA, 25 nt, Human
cuggcucaaaugauacucccgccuc

SEQ ID NO: 962502 - RNA, 24 nt, Human
cuuccaauguggguggcacauuua

SEQ ID NO: 962503 - RNA, 24 nt, Human
cuucguguggaccuggcagacucc

SEQ ID NO: 962504 - RNA, 21 nt, Human
cuuggaaaugcuguugccucc

SEQ ID NO: 962505 - RNA, 20 nt, Human
gagauggaguuuccccaugu

SEQ ID NO: 962506 - RNA, 24 nt, Human
gagcucaggugauccgcccaccuu

SEQ ID NO: 962507 - RNA, 23 nt, Human
gauaaagaaagagagaaugaaaa

SEQ ID NO: 962508 - RNA, 22 nt, Human
gaucauuaaagaccagcuucga

SEQ ID NO: 962509 - RNA, 23 nt, Human
gaugaguuggaaauuucugauga

SEQ ID NO: 962510 - RNA, 22 nt, Human
gauuauaggcaugagccacugc

SEQ ID NO: 962511 - RNA, 23 nt, Human
gauuauaggcaugagccacugca

SEQ ID NO: 962512 - RNA, 21 nt, Human
gcagaacacauccacgcuuca

SEQ ID NO: 962513 - RNA, 19 nt, Human
gccacuuccccagagccgc

SEQ ID NO: 962514 - RNA, 21 nt, Human
gccagaacaugugaacgguag

SEQ ID NO: 962515 - RNA, 20 nt, Human
gccucaagaaaggacccuga

SEQ ID NO: 962516 - RNA, 22 nt, Human
gccucagaaacaugggcaguca

SEQ ID NO: 962517 - RNA, 24 nt, Human
gcggcuccgaggauccucuucagc

SEQ ID NO: 962518 - RNA, 19 nt, Human
gcgguggagccugaccacg

SEQ ID NO: 962519 - RNA, 20 nt, Human
gcugcagcgggccaagggcc

SEQ ID NO: 962520 - RNA, 20 nt, Human
ggaaagcagcgcucgggagg

SEQ ID NO: 962521 - RNA, 18 nt, Human
ggaagaagacucaaaaau

SEQ ID NO: 962522 - RNA, 21 nt, Human
ggaauggggaguucuggaggg

SEQ ID NO: 962523 - RNA, 19 nt, Human
ggacagagguuucucccca

SEQ ID NO: 962524 - RNA, 22 nt, Human
ggaguuuccccauguugcccag

SEQ ID NO: 962525 - RNA, 21 nt, Human
ggcaaggagcuuccuggaaug

SEQ ID NO: 962526 - RNA, 24 nt, Human
ggcacagaaacugcaucaggagca

SEQ ID NO: 962527 - RNA, 18 nt, Human
ggcagucauggggcacag

SEQ ID NO: 962528 - RNA, 25 nt, Human
ggccucugacucugggcacgugucu

SEQ ID NO: 962529 - RNA, 21 nt, Human
ggccuugaggaacuggggauu

SEQ ID NO: 962530 - RNA, 23 nt, Human
gggaauggggaguucuggaggga

SEQ ID NO: 962531 - RNA, 21 nt, Human
gggccagagcggcuccgagga

SEQ ID NO: 962532 - RNA, 19 nt, Human
ggggcaccggcuugggggc

SEQ ID NO: 962533 - RNA, 20 nt, Human
ggguguccaagccagcuccg

SEQ ID NO: 962534 - RNA, 24 nt, Human
gucaccuacuuauccgacuauuuc

SEQ ID NO: 962535 - RNA, 23 nt, Human
gugcgguggagccugaccacgug

SEQ ID NO: 962536 - RNA, 21 nt, Human
uaacagcagaaacugggggua

SEQ ID NO: 962537 - RNA, 19 nt, Human
uaacuuacagagcccaccu

SEQ ID NO: 962538 - RNA, 20 nt, Human
uaagacaggaaggacucuug

SEQ ID NO: 962539 - RNA, 22 nt, Human
uaagcguggaguacagagccag

SEQ ID NO: 962540 - RNA, 19 nt, Human
uaagucacaagaagcagca

SEQ ID NO: 962541 - RNA, 20 nt, Human
uaagucacaagaagcagcag

SEQ ID NO: 962542 - RNA, 21 nt, Human
uacaaaaccccaguuucacca

SEQ ID NO: 962543 - RNA, 18 nt, Human
uacacagugauggacaaa

SEQ ID NO: 962544 - RNA, 21 nt, Human
uacacagugauggacaaacac

SEQ ID NO: 962545 - RNA, 18 nt, Human
uacagaggauccaguggg

SEQ ID NO: 962546 - RNA, 21 nt, Human
uagaaccucagccccacacau

SEQ ID NO: 962547 - RNA, 23 nt, Human
uaggggacagagguuucucccca

SEQ ID NO: 962548 - RNA, 23 nt, Human
uauaagacaggaaggacucuuga

SEQ ID NO: 962549 - RNA, 20 nt, Human
uaucugcaacuguauucaga

SEQ ID NO: 962550 - RNA, 24 nt, Human
uauuuuguauauuuuguagagaug

SEQ ID NO: 962551 - RNA, 19 nt, Human
ucacugcaaccucaaccuc

SEQ ID NO: 962552 - RNA, 23 nt, Human
ucacugcaaccucaaccuccugg

SEQ ID NO: 962553 - RNA, 24 nt, Human
ucacugcaaccucaaccuccuggc

SEQ ID NO: 962554 - RNA, 26 nt, Human
ucacugcaaccucaaccuccuggcuc

SEQ ID NO: 962555 - RNA, 19 nt, Human
ucagaaacaugggcaguca

SEQ ID NO: 962556 - RNA, 19 nt, Human
ucagaggggaauggggagu

SEQ ID NO: 962557 - RNA, 18 nt, Human
ucagcaccuggcuaggga

SEQ ID NO: 962558 - RNA, 21 nt, Human
ucagccccacacauacauuuu

SEQ ID NO: 962559 - RNA, 21 nt, Human
ucagcucacugcaaccucaac

SEQ ID NO: 962560 - RNA, 22 nt, Human
uccaaacagcccaggccuaagg

SEQ ID NO: 962561 - RNA, 26 nt, Human
uccagaaugggggcaccggcuugggg

SEQ ID NO: 962562 - RNA, 24 nt, Human
ucccaaagugcugggauuauaggc

SEQ ID NO: 962563 - RNA, 18 nt, Human
ucccaggcaagaugaaaa

SEQ ID NO: 962564 - RNA, 25 nt, Human
uccccaaauaacuuacagagcccac

SEQ ID NO: 962565 - RNA, 22 nt, Human
uccccccugccaagacccugga

SEQ ID NO: 962566 - RNA, 18 nt, Human
uccccgagcgcgcggcca

SEQ ID NO: 962567 - RNA, 21 nt, Human
ucccgccucagccucccaaga

SEQ ID NO: 962568 - RNA, 19 nt, Human
ucgcgcccagcagagacgg

SEQ ID NO: 962569 - RNA, 20 nt, Human
ucucucucugucacccagga

SEQ ID NO: 962570 - RNA, 24 nt, Human
ucucucucugucacccaggaugga

SEQ ID NO: 962571 - RNA, 24 nt, Human
ucucucugucacccaggauggagu

SEQ ID NO: 962572 - RNA, 19 nt, Human
ucucugucacccaggaugg

SEQ ID NO: 962573 - RNA, 24 nt, Human
ucugucacccaggauggagugcag

SEQ ID NO: 962574 - RNA, 23 nt, Human
ucuuaaacuccugagcucaggug

SEQ ID NO: 962575 - RNA, 21 nt, Human
ucuucuccuuccuguaaacug

SEQ ID NO: 962576 - RNA, 20 nt, Human
ugaaaacacucaagcugcuu

SEQ ID NO: 962577 - RNA, 21 nt, Human
ugaaaauccagccgaggaaca

SEQ ID NO: 962578 - RNA, 22 nt, Human
ugaaaggcaggaaggaagaaca

SEQ ID NO: 962579 - RNA, 22 nt, Human
ugaaaugcacuugaaauguauc

SEQ ID NO: 962580 - RNA, 21 nt, Human
ugaaggacaaaaacaaagaua

SEQ ID NO: 962581 - RNA, 18 nt, Human
ugaagugggcaaccguuu

SEQ ID NO: 962582 - RNA, 19 nt, Human
ugaagugggcaaccguuuc

SEQ ID NO: 962583 - RNA, 20 nt, Human
ugaauggacugggugggugg

SEQ ID NO: 962584 - RNA, 21 nt, Human
ugaaugguguuagcacacucu

SEQ ID NO: 962585 - RNA, 20 nt, Human
ugacagcaugaccugcuaau

SEQ ID NO: 962586 - RNA, 22 nt, Human
ugaccacgugcccccugaguuc

SEQ ID NO: 962587 - RNA, 22 nt, Human
ugacucccacaguuuccauccu

SEQ ID NO: 962588 - RNA, 20 nt, Human
ugagaauauuuugaacucaa

SEQ ID NO: 962589 - RNA, 22 nt, Human
ugagcaucuccugcuccccugg

SEQ ID NO: 962590 - RNA, 18 nt, Human
ugagcucaggugauccgc

SEQ ID NO: 962591 - RNA, 23 nt, Human
ugagggaugagugagagggccac

SEQ ID NO: 962592 - RNA, 23 nt, Human
ugagugagagggccacauugagu

SEQ ID NO: 962593 - RNA, 21 nt, Human
ugaguuccagaaugggggcac

SEQ ID NO: 962594 - RNA, 21 nt, Human
ugcaaaagaucauuaaagacc

SEQ ID NO: 962595 - RNA, 22 nt, Human
ugcaaaagaucauuaaagacca

SEQ ID NO: 962596 - RNA, 18 nt, Human
ugcaacuguauucagaaa

SEQ ID NO: 962597 - RNA, 19 nt, Human
ugccaugaaauccaaaagu

SEQ ID NO: 962598 - RNA, 24 nt, Human
ugcccaggcuggucuuaaacuccu

SEQ ID NO: 962599 - RNA, 28 nt, Human
ugcccaggcuggucuuaaacuccugagc

SEQ ID NO: 962600 - RNA, 20 nt, Human
ugcucaaaaaacaaaccaau

SEQ ID NO: 962601 - RNA, 18 nt, Human
uggaaagugccaaggaga

SEQ ID NO: 962602 - RNA, 24 nt, Human
uggaaaguugggcaauccauggug

SEQ ID NO: 962603 - RNA, 23 nt, Human
uggaccuggcagacuccagaaag

SEQ ID NO: 962604 - RNA, 21 nt, Human
uggacugggugggugggaagg

SEQ ID NO: 962605 - RNA, 24 nt, Human
uggaggcagcaaguaacagcagaa

SEQ ID NO: 962606 - RNA, 19 nt, Human
uggagugcagugaugugau

SEQ ID NO: 962607 - RNA, 19 nt, Human
uggagugcagugaugugau

SEQ ID NO: 962608 - RNA, 28 nt, Human
uggagugcagugaugugauggcucuagc

SEQ ID NO: 962609 - RNA, 24 nt, Human
uggaguuuccccauguugcccagg

SEQ ID NO: 962610 - RNA, 23 nt, Human
uggcaaauagaaaagaagcaaau

SEQ ID NO: 962611 - RNA, 18 nt, Human
uggcacauuuauaaaaua

SEQ ID NO: 962612 - RNA, 18 nt, Human
uggcagacuccagaaagc

SEQ ID NO: 962613 - RNA, 21 nt, Human
uggcagacuccagaaagccag

SEQ ID NO: 962614 - RNA, 19 nt, Human
uggcagaguccaaggguca

SEQ ID NO: 962615 - RNA, 21 nt, Human
uggcaucaccugugacccgau

SEQ ID NO: 962616 - RNA, 19 nt, Human
uggccucaagaaaggaccc

SEQ ID NO: 962617 - RNA, 24 nt, Human
uggcuugaaaugcacuugaaaugu

SEQ ID NO: 962618 - RNA, 23 nt, Human
ugggacacucugguggcuugaaa

SEQ ID NO: 962619 - RNA, 21 nt, Human
ugggaccacaggcacgcacca

SEQ ID NO: 962620 - RNA, 23 nt, Human
ugggaccacaggcacgcaccacg

SEQ ID NO: 962621 - RNA, 19 nt, Human
ugggauuauaggcaugagc

SEQ ID NO: 962622 - RNA, 21 nt, Human
ugggauuauaggcaugagcca

SEQ ID NO: 962623 - RNA, 22 nt, Human
ugggauuauaggcaugagccac

SEQ ID NO: 962624 - RNA, 22 nt, Human
ugggauuauaggcaugagccac

SEQ ID NO: 962625 - RNA, 24 nt, Human
ugggauuauaggcaugagccacug

SEQ ID NO: 962626 - RNA, 24 nt, Human
ugggauuauaggcaugagccacug

SEQ ID NO: 962627 - RNA, 18 nt, Human
ugggcaguugauccuggc

SEQ ID NO: 962628 - RNA, 27 nt, Human
uguaaaaucaauaguagauggugauga

SEQ ID NO: 962629 - RNA, 24 nt, Human
uguagagauggaguuuccccaugu

SEQ ID NO: 962630 - RNA, 21 nt, Human
ugucacccaggauggagugca

SEQ ID NO: 962631 - RNA, 23 nt, Human
ugugaaaguccaacaugugaggg

SEQ ID NO: 962632 - RNA, 22 nt, Human
ugugaacgguagcuacacagug

SEQ ID NO: 962633 - RNA, 18 nt, Human
ugugaagugggcaaccgu

SEQ ID NO: 962634 - RNA, 19 nt, Human
ugugccugagccucugcuc

SEQ ID NO: 962635 - RNA, 21 nt, Human
uuagaaguuaaauaguggauu

SEQ ID NO: 962636 - RNA, 24 nt, Human
uuagaaguuaaauaguggauuaau

SEQ ID NO: 962637 - RNA, 25 nt, Human
uucaccaggacuuccaaacagccca

SEQ ID NO: 962638 - RNA, 19 nt, Human
uucacuaauugacaucaua

SEQ ID NO: 962639 - RNA, 20 nt, Human
uuccucaugaaaaccagccu

SEQ ID NO: 962640 - RNA, 18 nt, Human
uucguguggaccuggcag

SEQ ID NO: 962641 - RNA, 22 nt, Human
uugagacagggucucucucugu

SEQ ID NO: 962642 - RNA, 19 nt, Human
uugcaaugcuaauuucaaa

SEQ ID NO: 962643 - RNA, 18 nt, Human
uugcagcaaccugcagaa

SEQ ID NO: 962644 - RNA, 22 nt, Human
uuggaaaugcuguugccuccau

SEQ ID NO: 962645 - RNA, 18 nt, Human
uuggccucccaaagugcu

SEQ ID NO: 962646 - RNA, 21 nt, Human
uuggguguccaagccagcucc

SEQ ID NO: 962647 - RNA, 22 nt, Human
uuucccaucaauuccaguggaa

SEQ ID NO: 962648 - RNA, 23 nt, Human
uuuccccauguugcccaggcugg

SEQ ID NO: 962649 - RNA, 22 nt, Human
uuuuuuuuugagacagggucuc

SEQ ID NO: 962650 - RNA, 26 nt, Human
aaacuggcuccacugucccaucucca

SEQ ID NO: 962651 - RNA, 19 nt, Human
aacuggcuccacuguccca

SEQ ID NO: 962652 - RNA, 21 nt, Human
agaaaauccagagcuacugga

SEQ ID NO: 962653 - RNA, 22 nt, Human
aggcaagaagcccaagucccca

SEQ ID NO: 962654 - RNA, 18 nt, Human
aggcacagaggccagacu

SEQ ID NO: 962655 - RNA, 23 nt, Human
augaagggccagcagagacuccc

SEQ ID NO: 962656 - RNA, 22 nt, Human
caaacuuaaaagccugcccucu

SEQ ID NO: 962657 - RNA, 23 nt, Human
caagaagcccaaguccccaggac

SEQ ID NO: 962658 - RNA, 20 nt, Human
cacaggucagccuccaguuc

SEQ ID NO: 962659 - RNA, 20 nt, Human
caccagcuggaaccacucac

SEQ ID NO: 962660 - RNA, 23 nt, Human
cagacucagcuugugggggccac

SEQ ID NO: 962661 - RNA, 19 nt, Human
cagcccuuucccccauggu

SEQ ID NO: 962662 - RNA, 19 nt, Human
cagcgugacaguggguugg

SEQ ID NO: 962663 - RNA, 22 nt, Human
caguggguuggaagauaaccau

SEQ ID NO: 962664 - RNA, 22 nt, Human
ccagcagagacucccaagcagg

SEQ ID NO: 962665 - RNA, 19 nt, Human
ccagcccuggcagaaaauc

SEQ ID NO: 962666 - RNA, 21 nt, Human
ccauaugucagccugaaacca

SEQ ID NO: 962667 - RNA, 22 nt, Human
cccaguacucacugccucugac

SEQ ID NO: 962668 - RNA, 18 nt, Human
cccauggucaaugccagc

SEQ ID NO: 962669 - RNA, 24 nt, Human
cccauggucaaugccagccagagc

SEQ ID NO: 962670 - RNA, 21 nt, Human
ccccacaggcaaggcagcaag

SEQ ID NO: 962671 - RNA, 19 nt, Human
cccccacaggcaaggcagc

SEQ ID NO: 962672 - RNA, 21 nt, Human
cccccauggucaaugccagcc

SEQ ID NO: 962673 - RNA, 24 nt, Human
ccccccacaggcaaggcagcaagu

SEQ ID NO: 962674 - RNA, 26 nt, Human
cccucuugccaucuccauucuccaau

SEQ ID NO: 962675 - RNA, 24 nt, Human
ccgacucccgggcggcgcggagcg

SEQ ID NO: 962676 - RNA, 26 nt, Human
ccugcggccauaugucagccugaaac

SEQ ID NO: 962677 - RNA, 18 nt, Human
cgcuggccuuggucccau

SEQ ID NO: 962678 - RNA, 22 nt, Human
cuccaacccaaacuuaaaagcc

SEQ ID NO: 962679 - RNA, 19 nt, Human
cuccaauuccucaaaugcc

SEQ ID NO: 962680 - RNA, 22 nt, Human
cugaaaccagcccuuuccccca

SEQ ID NO: 962681 - RNA, 22 nt, Human
gaagauaaccaugagagaccug

SEQ ID NO: 962682 - RNA, 24 nt, Human
gaagauaaccaugagagaccuggg

SEQ ID NO: 962683 - RNA, 20 nt, Human
gagcagcaacuggaagauag

SEQ ID NO: 962684 - RNA, 20 nt, Human
gauccucucuccugggccac

SEQ ID NO: 962685 - RNA, 21 nt, Human
gcaaguucuuggccuagugca

SEQ ID NO: 962686 - RNA, 18 nt, Human
gcaccacaauggcccagc

SEQ ID NO: 962687 - RNA, 21 nt, Human
gcugaggccuguaccagccca

SEQ ID NO: 962688 - RNA, 18 nt, Human
ggcauugauccucucucc

SEQ ID NO: 962689 - RNA, 24 nt, Human
ggccacaggaaguugucuccaacc

SEQ ID NO: 962690 - RNA, 21 nt, Human
gggcagcaccacaauggccca

SEQ ID NO: 962691 - RNA, 22 nt, Human
gggcagcaccacaauggcccag

SEQ ID NO: 962692 - RNA, 23 nt, Human
gggcggcgcggagcggcgggagc

SEQ ID NO: 962693 - RNA, 21 nt, Human
guauagacuuccaggcagagg

SEQ ID NO: 962694 - RNA, 22 nt, Human
gugcaggugcccgguuccccgc

SEQ ID NO: 962695 - RNA, 18 nt, Human
gugugugugugugugugu

SEQ ID NO: 962696 - RNA, 19 nt, Human
guguuccugaacagaugaa

SEQ ID NO: 962697 - RNA, 22 nt, Human
uaaccagaugggcuggcggccg

SEQ ID NO: 962698 - RNA, 24 nt, Human
uaaccaugagagaccugggcugaa

SEQ ID NO: 962699 - RNA, 21 nt, Human
uagugcagagggagaaaacca

SEQ ID NO: 962700 - RNA, 21 nt, Human
uccaauuccucaaaugcccag

SEQ ID NO: 962701 - RNA, 27 nt, Human
uccacagcccaggcauggccggggucc

SEQ ID NO: 962702 - RNA, 22 nt, Human
uccccgcggcucccgacucccg

SEQ ID NO: 962703 - RNA, 22 nt, Human
uccucaaaugcccaguaggucc

SEQ ID NO: 962704 - RNA, 26 nt, Human
ucuccaacccaaacuuaaaagccugc

SEQ ID NO: 962705 - RNA, 21 nt, Human
ucuccauagaggcacagaggc

SEQ ID NO: 962706 - RNA, 21 nt, Human
ucugaccagagggaugcccug

SEQ ID NO: 962707 - RNA, 18 nt, Human
ugaaaccagcccuuuccc

SEQ ID NO: 962708 - RNA, 24 nt, Human
ugacaguggguuggaagauaacca

SEQ ID NO: 962709 - RNA, 20 nt, Human
ugagugugugugugugugug

SEQ ID NO: 962710 - RNA, 21 nt, Human
ugcgugugugagugugugugu

SEQ ID NO: 962711 - RNA, 21 nt, Human
ugcgugugugagugugugugu

SEQ ID NO: 962712 - RNA, 21 nt, Human
ugcgugugugagugugugugu

SEQ ID NO: 962713 - RNA, 25 nt, Human
ugcgugugugagugugugugugugu

SEQ ID NO: 962714 - RNA, 18 nt, Human
uggaaccacucacuccca

SEQ ID NO: 962715 - RNA, 20 nt, Human
uggaagauaaccaugagaga

SEQ ID NO: 962716 - RNA, 21 nt, Human
uggaagauagucuccauagag

SEQ ID NO: 962717 - RNA, 23 nt, Human
uggcggccggucugggaaugggg

SEQ ID NO: 962718 - RNA, 18 nt, Human
ugggcuggcggccggucu

SEQ ID NO: 962719 - RNA, 21 nt, Human
ugugagugugugugugugugu

SEQ ID NO: 962720 - RNA, 21 nt, Human
ugugcgugugugagugugugu

SEQ ID NO: 962721 - RNA, 21 nt, Human
ugugggggccacaggaaguug

SEQ ID NO: 962722 - RNA, 21 nt, Human
ugugugagugugugugugugu

SEQ ID NO: 962723 - RNA, 22 nt, Human
ugugugagugugugugugugug

SEQ ID NO: 962724 - RNA, 22 nt, Human
ugugugcgugugugagugugug

SEQ ID NO: 962725 - RNA, 24 nt, Human
ugugugcgugugugagugugugug

SEQ ID NO: 962726 - RNA, 21 nt, Human
uguguguguguguguguuccu

SEQ ID NO: 962727 - RNA, 22 nt, Human
uguguguguguguguguuccug

SEQ ID NO: 962728 - RNA, 24 nt, Human
uucccaguacucacugccucugac

SEQ ID NO: 962729 - RNA, 23 nt, Human
uugugggggccacaggaaguuga

SEQ ID NO: 962730 - RNA, 18 nt, Human
uuguugcuguagcaaauu

SEQ ID NO: 962731 - RNA, 27 nt, Human
uuuuuuguugcuguagcaaauugugau

SEQ ID NO: 962732 - RNA, 23 nt, Human
aaaaaaagaagaaaaagaaaaag

SEQ ID NO: 962733 - RNA, 20 nt, Human
aaaaagaaaaccaacaagga

SEQ ID NO: 962734 - RNA, 23 nt, Human
aaaaagaaaaccaacaaggaaga

SEQ ID NO: 962735 - RNA, 19 nt, Human
aaaagaaaaagaaaaccaa

SEQ ID NO: 962736 - RNA, 24 nt, Human
aaaagaaaaagaaaaccaacaagg

SEQ ID NO: 962737 - RNA, 21 nt, Human
aaaagaagaaaaagaaaaaga

SEQ ID NO: 962738 - RNA, 24 nt, Human
aacaaggaagaggguaaauguuca

SEQ ID NO: 962739 - RNA, 18 nt, Human
aagaagaaaaagaaaaag

SEQ ID NO: 962740 - RNA, 22 nt, Human
aagaagaaaaagaaaaagaaaa

SEQ ID NO: 962741 - RNA, 23 nt, Human
aagaagaaaaagaaaaagaaaac

SEQ ID NO: 962742 - RNA, 19 nt, Human
aaggggagaggaaaaaaga

SEQ ID NO: 962743 - RNA, 21 nt, Human
agaagaaaaagaaaaagaaaa

SEQ ID NO: 962744 - RNA, 24 nt, Human
agccaaaaaaaaaaagaagaaaaa

SEQ ID NO: 962745 - RNA, 18 nt, Human
agcgccugggcagccgag

SEQ ID NO: 962746 - RNA, 18 nt, Human
agcgggcaccucgccuug

SEQ ID NO: 962747 - RNA, 22 nt, Human
aggaaaaaagaagccaaaaaaa

SEQ ID NO: 962748 - RNA, 19 nt, Human
aggcggccggggcucggag

SEQ ID NO: 962749 - RNA, 18 nt, Human
caaggcucuggcccggcu

SEQ ID NO: 962750 - RNA, 21 nt, Human
ccaaaaaaaaaaagaagaaaa

SEQ ID NO: 962751 - RNA, 25 nt, Human
ccaaaaaaaaaaagaagaaaaagaa

SEQ ID NO: 962752 - RNA, 18 nt, Human
ccaaauccaaauuccacu

SEQ ID NO: 962753 - RNA, 20 nt, Human
ccgagcgccugggcagccga

SEQ ID NO: 962754 - RNA, 23 nt, Human
ccugcugguucgacaccugaccc

SEQ ID NO: 962755 - RNA, 19 nt, Human
ccugggcagccgagugcgc

SEQ ID NO: 962756 - RNA, 24 nt, Human
cucgaggcaguugagaaccuugcu

SEQ ID NO: 962757 - RNA, 21 nt, Human
cuggccgcugcuacacgcugc

SEQ ID NO: 962758 - RNA, 19 nt, Human
cugggaugcaaacgcgaug

SEQ ID NO: 962759 - RNA, 24 nt, Human
gaaaaagaaaaagaaaaccaacaa

SEQ ID NO: 962760 - RNA, 24 nt, Human
gaagaaaaagaaaaagaaaaccaa

SEQ ID NO: 962761 - RNA, 22 nt, Human
gacgagcggagaaggggagagg

SEQ ID NO: 962762 - RNA, 21 nt, Human
gccuuugucauuccuacaugu

SEQ ID NO: 962763 - RNA, 21 nt, Human
gcugguucgacaccugacccc

SEQ ID NO: 962764 - RNA, 18 nt, Human
ggcugggggaggggggca

SEQ ID NO: 962765 - RNA, 19 nt, Human
gggcggggggcgggguggg

SEQ ID NO: 962766 - RNA, 24 nt, Human
gggcggggggcggggugggggccg

SEQ ID NO: 962767 - RNA, 18 nt, Human
ggggaucucuccgggccg

SEQ ID NO: 962768 - RNA, 22 nt, Human
ggggcggggugggggcuggggg

SEQ ID NO: 962769 - RNA, 18 nt, Human
gggggaggggggcaaggc

SEQ ID NO: 962770 - RNA, 21 nt, Human
ggggugggggcugggggaggg

SEQ ID NO: 962771 - RNA, 22 nt, Human
ggggugggggcugggggagggg

SEQ ID NO: 962772 - RNA, 23 nt, Human
ggggugggggcugggggaggggg

SEQ ID NO: 962773 - RNA, 22 nt, Human
uacucgaggcaguugagaaccu

SEQ ID NO: 962774 - RNA, 22 nt, Human
uccccuugguggugucugcgcc

SEQ ID NO: 962775 - RNA, 19 nt, Human
uccgggccgcggcugcggc

SEQ ID NO: 962776 - RNA, 19 nt, Human
ucgacaccugacccccucc

SEQ ID NO: 962777 - RNA, 23 nt, Human
ucuccgggccgcggcugcggcuc

SEQ ID NO: 962778 - RNA, 23 nt, Human
ucuuggucugguggguacucgag

SEQ ID NO: 962779 - RNA, 18 nt, Human
ugacgagcggagaagggg

SEQ ID NO: 962780 - RNA, 19 nt, Human
ugacgagcggagaagggga

SEQ ID NO: 962781 - RNA, 23 nt, Human
ugagaaccuugcugagcugagcg

SEQ ID NO: 962782 - RNA, 21 nt, Human
ugcggccggcagcgcggugcc

SEQ ID NO: 962783 - RNA, 18 nt, Human
ugcuacacgcugcuaagc

SEQ ID NO: 962784 - RNA, 18 nt, Human
ugcuggguuccgagcgcc

SEQ ID NO: 962785 - RNA, 22 nt, Human
uggccgcugcuacacgcugcua

SEQ ID NO: 962786 - RNA, 18 nt, Human
uggcugcagccucgugcc

SEQ ID NO: 962787 - RNA, 22 nt, Human
uuccgagcgccugggcagccga

SEQ ID NO: 962788 - RNA, 22 nt, Human
uucgcaagccuuugucauuccu

SEQ ID NO: 962789 - RNA, 19 nt, Human
uucuuggucugguggguac

SEQ ID NO: 962790 - RNA, 26 nt, Human
aaaccgcaaaagaaaccaaaacugca

SEQ ID NO: 962791 - RNA, 21 nt, Human
aaacugcaaaaaaaaccaaaa

SEQ ID NO: 962792 - RNA, 27 nt, Human
aaagaaaccaaaacugcaaaaaaaacc

SEQ ID NO: 962793 - RNA, 20 nt, Human
aaaguccucccgcccaccca

SEQ ID NO: 962794 - RNA, 23 nt, Human
aaaguccucccgcccacccaccc

SEQ ID NO: 962795 - RNA, 21 nt, Human
acacggcacgcacacgcacgc

SEQ ID NO: 962796 - RNA, 25 nt, Human
accgcaaaagaaaccaaaacugcaa

SEQ ID NO: 962797 - RNA, 19 nt, Human
acuccagagagggcagagg

SEQ ID NO: 962798 - RNA, 23 nt, Human
aggcgacaggaggaggugacgcc

SEQ ID NO: 962799 - RNA, 20 nt, Human
agggcuuaggucugcagcug

SEQ ID NO: 962800 - RNA, 20 nt, Human
aggggacggguggcauggga

SEQ ID NO: 962801 - RNA, 20 nt, Human
aggggacggguggcauggga

SEQ ID NO: 962802 - RNA, 19 nt, Human
auagcaaaguccucccgcc

SEQ ID NO: 962803 - RNA, 21 nt, Human
caaaacugcaaaaaaaaccaa

SEQ ID NO: 962804 - RNA, 22 nt, Human
caaacuccagagagggcagagg

SEQ ID NO: 962805 - RNA, 22 nt, Human
caaacuccagagagggcagagg

SEQ ID NO: 962806 - RNA, 21 nt, Human
cacacacacgcccaccucccc

SEQ ID NO: 962807 - RNA, 23 nt, Human
cacacacccugcacgcguggccc

SEQ ID NO: 962808 - RNA, 18 nt, Human
cacacacgcccacagcag

SEQ ID NO: 962809 - RNA, 24 nt, Human
cacccacccccaaaccgucucagc

SEQ ID NO: 962810 - RNA, 20 nt, Human
cacgcacacccacacacgcc

SEQ ID NO: 962811 - RNA, 18 nt, Human
cagcguccugcggccccg

SEQ ID NO: 962812 - RNA, 22 nt, Human
cagcuggaggucagagggggga

SEQ ID NO: 962813 - RNA, 22 nt, Human
cagcuggaggucagagggggga

SEQ ID NO: 962814 - RNA, 23 nt, Human
cagcuguggccccccauucccca

SEQ ID NO: 962815 - RNA, 23 nt, Human
caggcgacaggaggaggugacgc

SEQ ID NO: 962816 - RNA, 24 nt, Human
ccaaaacugcaaaaaaaaccaaaa

SEQ ID NO: 962817 - RNA, 25 nt, Human
ccacccaccuucgccgccccccagg

SEQ ID NO: 962818 - RNA, 25 nt, Human
ccacccaccuucgccgccccccagg

SEQ ID NO: 962819 - RNA, 26 nt, Human
ccacccaccuucgccgccccccaggc

SEQ ID NO: 962820 - RNA, 27 nt, Human
cccacccaccuucgccgccccccaggc

SEQ ID NO: 962821 - RNA, 24 nt, Human
ccccaccggcguccaagccucccc

SEQ ID NO: 962822 - RNA, 26 nt, Human
ccccaccggcguccaagccuccccug

SEQ ID NO: 962823 - RNA, 18 nt, Human
ccccaggcccccaagccc

SEQ ID NO: 962824 - RNA, 18 nt, Human
ccccaggcccccaagccc

SEQ ID NO: 962825 - RNA, 18 nt, Human
ccccaggcccccaagccc

SEQ ID NO: 962826 - RNA, 18 nt, Human
ccccaggcccccaagccc

SEQ ID NO: 962827 - RNA, 18 nt, Human
cccccaggcccccaagcc

SEQ ID NO: 962828 - RNA, 18 nt, Human
cccccaggcccccaagcc

SEQ ID NO: 962829 - RNA, 19 nt, Human
cccccaggcccccaagccc

SEQ ID NO: 962830 - RNA, 19 nt, Human
cccccaggcccccaagccc

SEQ ID NO: 962831 - RNA, 19 nt, Human
cccccgggccuucuggaag

SEQ ID NO: 962832 - RNA, 21 nt, Human
ccccgggccuucuggaagccc

SEQ ID NO: 962833 - RNA, 19 nt, Human
ccccugccugccgccaccc

SEQ ID NO: 962834 - RNA, 20 nt, Human
cccgcccacccacccccaaa

SEQ ID NO: 962835 - RNA, 23 nt, Human
cccguggcuggcacugccaaggc

SEQ ID NO: 962836 - RNA, 21 nt, Human
ccgcaaaagaaaccaaaacug

SEQ ID NO: 962837 - RNA, 21 nt, Human
ccgccccccaggcccccaagc

SEQ ID NO: 962838 - RNA, 21 nt, Human
ccgccccccaggcccccaagc

SEQ ID NO: 962839 - RNA, 23 nt, Human
ccucccgcccacccacccccaaa

SEQ ID NO: 962840 - RNA, 24 nt, Human
ccucccgcccacccacccccaaac

SEQ ID NO: 962841 - RNA, 23 nt, Human
ccugccugccgccaccccgagaa

SEQ ID NO: 962842 - RNA, 24 nt, Human
ccugccugccgccaccccgagaac

SEQ ID NO: 962843 - RNA, 22 nt, Human
cgcacacacacgcccaccuccc

SEQ ID NO: 962844 - RNA, 18 nt, Human
cgcacacccacacacgcc

SEQ ID NO: 962845 - RNA, 20 nt, Human
cgccccccaggcccccaagc

SEQ ID NO: 962846 - RNA, 23 nt, Human
cgccccccaggcccccaagcccu

SEQ ID NO: 962847 - RNA, 23 nt, Human
cgccccccaggcccccaagcccu

SEQ ID NO: 962848 - RNA, 20 nt, Human
cgcuggcacgcacacacacg

SEQ ID NO: 962849 - RNA, 22 nt, Human
cgggugggucgcgggggggacu

SEQ ID NO: 962850 - RNA, 22 nt, Human
cguccaagccuccccugccugc

SEQ ID NO: 962851 - RNA, 25 nt, Human
cguggacacacacccugcacgcgug

SEQ ID NO: 962852 - RNA, 24 nt, Human
cucccgcccacccacccccaaacc

SEQ ID NO: 962853 - RNA, 18 nt, Human
cuccugguucccguggcu

SEQ ID NO: 962854 - RNA, 23 nt, Human
cugaaaccccggcauuguccccg

SEQ ID NO: 962855 - RNA, 23 nt, Human
cugaaaccccggcauuguccccg

SEQ ID NO: 962856 - RNA, 26 nt, Human
cugcagcuguggccccccauucccca

SEQ ID NO: 962857 - RNA, 19 nt, Human
gaaaccaaaacugcaaaaa

SEQ ID NO: 962858 - RNA, 24 nt, Human
gagcugguugugcuuccuuguggc

SEQ ID NO: 962859 - RNA, 18 nt, Human
gaggacccagccagccac

SEQ ID NO: 962860 - RNA, 18 nt, Human
gaggacccagccagccac

SEQ ID NO: 962861 - RNA, 22 nt, Human
gcaaacuccagagagggcagag

SEQ ID NO: 962862 - RNA, 22 nt, Human
gcaaacuccagagagggcagag

SEQ ID NO: 962863 - RNA, 21 nt, Human
gcacgcacacgcacgcacacc

SEQ ID NO: 962864 - RNA, 18 nt, Human
gcagagugggggggguuc

SEQ ID NO: 962865 - RNA, 21 nt, Human
gcaugcauggucagcuggagg

SEQ ID NO: 962866 - RNA, 21 nt, Human
gcaugcauggucagcuggagg

SEQ ID NO: 962867 - RNA, 22 nt, Human
gcccacuugacacacacgccca

SEQ ID NO: 962868 - RNA, 26 nt, Human
gccccacccaccuucgccgcccccca

SEQ ID NO: 962869 - RNA, 26 nt, Human
gccccacccaccuucgccgcccccca

SEQ ID NO: 962870 - RNA, 20 nt, Human
gccgccaccccgagaacgga

SEQ ID NO: 962871 - RNA, 22 nt, Human
gccugaaaccccggcauugucc

SEQ ID NO: 962872 - RNA, 22 nt, Human
gccugaaaccccggcauugucc

SEQ ID NO: 962873 - RNA, 18 nt, Human
gccuggguuggggaggga

SEQ ID NO: 962874 - RNA, 24 nt, Human
gccuucuggaagccccagcgucgg

SEQ ID NO: 962875 - RNA, 21 nt, Human
gcgacaggaggaggugacgcc

SEQ ID NO: 962876 - RNA, 19 nt, Human
gcuccugguucccguggcu

SEQ ID NO: 962877 - RNA, 21 nt, Human
gcuccugguucccguggcugg

SEQ ID NO: 962878 - RNA, 20 nt, Human
ggagggggcugggggaggca

SEQ ID NO: 962879 - RNA, 22 nt, Human
ggcacugccaaggcaucggggg

SEQ ID NO: 962880 - RNA, 24 nt, Human
ggcccuccucgugucuccugccug

SEQ ID NO: 962881 - RNA, 24 nt, Human
ggcccuccucgugucuccugccug

SEQ ID NO: 962882 - RNA, 21 nt, Human
ggcgacaggaggaggugacgc

SEQ ID NO: 962883 - RNA, 19 nt, Human
ggcugggggaggcaaacuc

SEQ ID NO: 962884 - RNA, 18 nt, Human
ggcuuaggucugcagcug

SEQ ID NO: 962885 - RNA, 18 nt, Human
gggacucucucaccaccc

SEQ ID NO: 962886 - RNA, 18 nt, Human
gggacucucucaccaccc

SEQ ID NO: 962887 - RNA, 24 nt, Human
gggagggggcugggggaggcaaac

SEQ ID NO: 962888 - RNA, 20 nt, Human
gggcagaggacccagccagc

SEQ ID NO: 962889 - RNA, 20 nt, Human
gggcagaggacccagccagc

SEQ ID NO: 962890 - RNA, 20 nt, Human
gggcugggggaggcaaacuc

SEQ ID NO: 962891 - RNA, 20 nt, Human
gggcugggggaggcaaacuc

SEQ ID NO: 962892 - RNA, 18 nt, Human
ggggagggggcuggggga

SEQ ID NO: 962893 - RNA, 18 nt, Human
ggggagggggcuggggga

SEQ ID NO: 962894 - RNA, 18 nt, Human
ggggaggucacaagggga

SEQ ID NO: 962895 - RNA, 20 nt, Human
gggggcugggggaggcaaac

SEQ ID NO: 962896 - RNA, 20 nt, Human
gggggcugggggaggcaaac

SEQ ID NO: 962897 - RNA, 19 nt, Human
ggguagggggagggcgagc

SEQ ID NO: 962898 - RNA, 22 nt, Human
ggguagggggagggcgagcugg

SEQ ID NO: 962899 - RNA, 23 nt, Human
ggguuggggagggaccuuuccag

SEQ ID NO: 962900 - RNA, 19 nt, Human
gucacaaggggacgggugg

SEQ ID NO: 962901 - RNA, 19 nt, Human
gucacaaggggacgggugg

SEQ ID NO: 962902 - RNA, 21 nt, Human
guccucccgcccacccacccc

SEQ ID NO: 962903 - RNA, 21 nt, Human
gucuccugccugaaaccccgg

SEQ ID NO: 962904 - RNA, 22 nt, Human
uagaaaaccgcaaaagaaacca

SEQ ID NO: 962905 - RNA, 19 nt, Human
ucagcguccugcggccccg

SEQ ID NO: 962906 - RNA, 20 nt, Human
ucagcuggaggucagagggg

SEQ ID NO: 962907 - RNA, 20 nt, Human
ucagcuggaggucagagggg

SEQ ID NO: 962908 - RNA, 30 nt, Human
ucagcuggaggucagaggggggaggucacc

SEQ ID NO: 962909 - RNA, 30 nt, Human; identical to SEQ ID NO: 962908

SEQ ID NO: 962910 - RNA, 21 nt, Human
uccaggggugggggagggcuu

SEQ ID NO: 962911 - RNA, 24 nt, Human
uccaggggugggggagggcuuagg

SEQ ID NO: 962912 - RNA, 18 nt, Human
ucccgcccacccaccccc

SEQ ID NO: 962913 - RNA, 19 nt, Human
ucccguggcuggcacugcc

SEQ ID NO: 962914 - RNA, 19 nt, Human
uccucccgcccacccaccc

SEQ ID NO: 962915 - RNA, 21 nt, Human
ucgcgggggggacuugagcac

SEQ ID NO: 962916 - RNA, 28 nt, Human
ucucaccacccuggggccguauuuacag

SEQ ID NO: 962917 - RNA, 28 nt, Human
ucucaccacccuggggccguauuuacag

SEQ ID NO: 962918 - RNA, 20 nt, Human
ucuccugccugaaaccccgg

SEQ ID NO: 962919 - RNA, 20 nt, Human
ucuccugccugaaaccccgg

SEQ ID NO: 962920 - RNA, 21 nt, Human
ugaaaccccggcauugucccc

SEQ ID NO: 962921 - RNA, 21 nt, Human
ugaaaccccggcauugucccc

SEQ ID NO: 962922 - RNA, 19 nt, Human
ugacacacacgcccacagc

SEQ ID NO: 962923 - RNA, 22 nt, Human
ugacuuccgggcaggcccuccu

SEQ ID NO: 962924 - RNA, 22 nt, Human
ugacuuccgggcaggcccuccu

SEQ ID NO: 962925 - RNA, 19 nt, Human
ugcaaaaaaaaccaaaacc

SEQ ID NO: 962926 - RNA, 24 nt, Human
ugccaaggcaucggggggcccccc

SEQ ID NO: 962927 - RNA, 18 nt, Human
ugccgccaccccgagaac

SEQ ID NO: 962928 - RNA, 25 nt, Human
ugccugaaaccccggcauugucccc

SEQ ID NO: 962929 - RNA, 25 nt, Human
ugccugaaaccccggcauugucccc

SEQ ID NO: 962930 - RNA, 22 nt, Human
uggaggucagaggggggagguc

SEQ ID NO: 962931 - RNA, 20 nt, Human
uggcacgcacacacacgccc

SEQ ID NO: 962932 - RNA, 24 nt, Human
uggcaugcauggucagcuggaggu

SEQ ID NO: 962933 - RNA, 20 nt, Human
uggcuggcacugccaaggca

SEQ ID NO: 962934 - RNA, 20 nt, Human
uggcuggcacugccaaggca

SEQ ID NO: 962935 - RNA, 20 nt, Human
uggggagggggcugggggag

SEQ ID NO: 962936 - RNA, 20 nt, Human
uggggagggggcugggggag

SEQ ID NO: 962937 - RNA, 23 nt, Human
uggggagggggcugggggaggca

SEQ ID NO: 962938 - RNA, 19 nt, Human
uuuuuuuuuuuuuugccgg

SEQ ID NO: 962939 - RNA, 19 nt, Human
uuuuuuuuuuuuuugccgg

SEQ ID NO: 962940 - RNA, 21 nt, Human
uuuuuuuuuuuuuugccggug

SEQ ID NO: 962941 - RNA, 18 nt, Human
uuuuuuuuuuuuuuuuug

SEQ ID NO: 962942 - RNA, 18 nt, Human
uuuuuuuuuuuuuuuuug

SEQ ID NO: 962943 - RNA, 22 nt, Human
uuuuuuuuuuuuuuuuugccgg

SEQ ID NO: 962944 - RNA, 22 nt, Human
uuuuuuuuuuuuuuuuugccgg

SEQ ID NO: 962945 - RNA, 23 nt, Human
uuuuuuuuuuuuuuuuugccggu

SEQ ID NO: 962946 - RNA, 23 nt, Human
uuuuuuuuuuuuuuuuugccggu

SEQ ID NO: 962947 - RNA, 20 nt, Human
aaccucugacuccaggauuc

SEQ ID NO: 962948 - RNA, 22 nt, Human
aaggggccucgggagacucugc

SEQ ID NO: 962949 - RNA, 22 nt, Human
acucugcgagucgggaaggcug

SEQ ID NO: 962950 - RNA, 27 nt, Human
agacccaggaggcccgaggacucugga

SEQ ID NO: 962951 - RNA, 19 nt, Human
aggaggcccgaggacucug

SEQ ID NO: 962952 - RNA, 18 nt, Human
agggagcggggaguggga

SEQ ID NO: 962953 - RNA, 23 nt, Human
aggugcggggcgagggggcggug

SEQ ID NO: 962954 - RNA, 24 nt, Human
caccucccacucuucugucgagga

SEQ ID NO: 962955 - RNA, 20 nt, Human
cacgcuggaggccguggacc

SEQ ID NO: 962956 - RNA, 19 nt, Human
cagcgcgcgcggcccgccc

SEQ ID NO: 962957 - RNA, 20 nt, Human
cagucaauaaauaaacccga

SEQ ID NO: 962958 - RNA, 18 nt, Human
ccccagggggugcccccu

SEQ ID NO: 962959 - RNA, 22 nt, Human
ccccagggggugcccccucacc

SEQ ID NO: 962960 - RNA, 25 nt, Human
ccccucacccauaagccggcccugg

SEQ ID NO: 962961 - RNA, 27 nt, Human
ccggcccuggguuggugacuccugugg

SEQ ID NO: 962962 - RNA, 19 nt, Human
cgcuggaggccguggaccg

SEQ ID NO: 962963 - RNA, 22 nt, Human
cgcuggaggccguggaccgcuc

SEQ ID NO: 962964 - RNA, 22 nt, Human
cggcccuggguuggugacuccu

SEQ ID NO: 962965 - RNA, 20 nt, Human
cuucucaccucccacucuuc

SEQ ID NO: 962966 - RNA, 21 nt, Human
gaagggagcggggagugggag

SEQ ID NO: 962967 - RNA, 20 nt, Human
gaggacagggggaaagacag

SEQ ID NO: 962968 - RNA, 22 nt, Human
gagucgggaaggcuggaggugc

SEQ ID NO: 962969 - RNA, 22 nt, Human
gcagacacggcuguauugggaa

SEQ ID NO: 962970 - RNA, 24 nt, Human
gcgagucgggaaggcuggaggugc

SEQ ID NO: 962971 - RNA, 18 nt, Human
gcggggcgagggggcggu

SEQ ID NO: 962972 - RNA, 18 nt, Human
gcuggaagggagcgggga

SEQ ID NO: 962973 - RNA, 22 nt, Human
gcuuggcuggaagggagcgggg

SEQ ID NO: 962974 - RNA, 21 nt, Human
ggaaaccucugacuccaggau

SEQ ID NO: 962975 - RNA, 20 nt, Human
ggacacagcgcgcgcggccc

SEQ ID NO: 962976 - RNA, 18 nt, Human
ggcagcucaggccccagg

SEQ ID NO: 962977 - RNA, 18 nt, Human
ggcagcucaggccccagg

SEQ ID NO: 962978 - RNA, 22 nt, Human
ggggcagcucaggccccagggg

SEQ ID NO: 962979 - RNA, 21 nt, Human
gucgggaaggcuggaggugcg

SEQ ID NO: 962980 - RNA, 21 nt, Human
uaaacccgaggcgaaaagggg

SEQ ID NO: 962981 - RNA, 24 nt, Human
uccaggauucgggucagcgggauc

SEQ ID NO: 962982 - RNA, 19 nt, Human
ucccagacccaggaggccc

SEQ ID NO: 962983 - RNA, 23 nt, Human
ucccagacccaggaggcccgagg

SEQ ID NO: 962984 - RNA, 22 nt, Human
ucgaggacagggggaaagacaa

SEQ ID NO: 962985 - RNA, 18 nt, Human
ucgugaccgagaggacuc

SEQ ID NO: 962986 - RNA, 22 nt, Human
ucucaccucccacucuucuguc

SEQ ID NO: 962987 - RNA, 18 nt, Human
ugaaacguccugaagagc

SEQ ID NO: 962988 - RNA, 19 nt, Human
ugcccccucacccauaagc

SEQ ID NO: 962989 - RNA, 24 nt, Human
ugucgaggacagggggaaagacag

SEQ ID NO: 962990 - RNA, 21 nt, Human
aagaaguggcaggcaaggagc

SEQ ID NO: 962991 - RNA, 20 nt, Human
aagaguccagaaggacucag

SEQ ID NO: 962992 - RNA, 23 nt, Human
aagcaaacauccuucaauaaaca

SEQ ID NO: 962993 - RNA, 25 nt, Human
agaggacagggcuggacagagggua

SEQ ID NO: 962994 - RNA, 20 nt, Human
agagggaggggaaggaggca

SEQ ID NO: 962995 - RNA, 20 nt, Human
aggaacaccagccacccagc

SEQ ID NO: 962996 - RNA, 22 nt, Human
aggacagggcuggacagagggu

SEQ ID NO: 962997 - RNA, 23 nt, Human
aggccucagccccagggucgaga

SEQ ID NO: 962998 - RNA, 27 nt, Human
cagccgccugcggcuggaaggggccgc

SEQ ID NO: 962999 - RNA, 20 nt, Human
cagcucuccuauccaaaccc

SEQ ID NO: 963000 - RNA, 22 nt, Human
cauaaaaauagagcuuuuuccg

SEQ ID NO: 963001 - RNA, 27 nt, Human
cauccuucaauaaacaugcaaggcggc

SEQ ID NO: 963002 - RNA, 18 nt, Human
caugcaaggcggcugucc

SEQ ID NO: 963003 - RNA, 26 nt, Human
ccaaacccacuccccgacccaugggc

SEQ ID NO: 963004 - RNA, 20 nt, Human
ccagaaggacucaggccuca

SEQ ID NO: 963005 - RNA, 27 nt, Human
cccgacccaugggcucuugggcuggga

SEQ ID NO: 963006 - RNA, 23 nt, Human
cccucaccauccgugcgcaccug

SEQ ID NO: 963007 - RNA, 19 nt, Human
cccugggcugcagaagccu

SEQ ID NO: 963008 - RNA, 19 nt, Human
ccuaacauaaaaauagagc

SEQ ID NO: 963009 - RNA, 23 nt, Human
ccuauccaaacccacuccccgac

SEQ ID NO: 963010 - RNA, 23 nt, Human
ccugggcugcagaagccugaggc

SEQ ID NO: 963011 - RNA, 21 nt, Human
ccugugggacccaggaccaga

SEQ ID NO: 963012 - RNA, 20 nt, Human
cgcaccuggggcccagcagc

SEQ ID NO: 963013 - RNA, 22 nt, Human
cgggccagccggcucugagugu

SEQ ID NO: 963014 - RNA, 18 nt, Human
cuccuauccaaacccacu

SEQ ID NO: 963015 - RNA, 22 nt, Human
cuccuauccaaacccacucccc

SEQ ID NO: 963016 - RNA, 24 nt, Human
cuucaggaacaccagccacccagc

SEQ ID NO: 963017 - RNA, 25 nt, Human
gagauggagucccagcucuccuauc

SEQ ID NO: 963018 - RNA, 22 nt, Human
gaggggaaggaggcaauguggg

SEQ ID NO: 963019 - RNA, 19 nt, Human
gcccugggcugcagaagcc

SEQ ID NO: 963020 - RNA, 19 nt, Human
ggaggggaaggaggcaaug

SEQ ID NO: 963021 - RNA, 19 nt, Human
ggccuggcauccuccacug

SEQ ID NO: 963022 - RNA, 19 nt, Human
gggaaggaggcaauguggg

SEQ ID NO: 963023 - RNA, 21 nt, Human
gguaccaagaguccagaagga

SEQ ID NO: 963024 - RNA, 23 nt, Human
guggcaggcaaggagcucccggg

SEQ ID NO: 963025 - RNA, 27 nt, Human
uaaaaauagagcuuuuuccguccuucc

SEQ ID NO: 963026 - RNA, 20 nt, Human
uagagcuuuuuccguccuuc

SEQ ID NO: 963027 - RNA, 23 nt, Human
uagcccugggucuucaggaacac

SEQ ID NO: 963028 - RNA, 22 nt, Human
ucaggaacaccagccacccagc

SEQ ID NO: 963029 - RNA, 18 nt, Human
uccccgacccaugggcuc

SEQ ID NO: 963030 - RNA, 23 nt, Human
uccccuggaagaaguggcaggca

SEQ ID NO: 963031 - RNA, 21 nt, Human
ucccgggccagccggcucuga

SEQ ID NO: 963032 - RNA, 19 nt, Human
uccgugcgcaccuggggcc

SEQ ID NO: 963033 - RNA, 22 nt, Human
ucugaaaaauauuuuccagaag

SEQ ID NO: 963034 - RNA, 23 nt, Human
ucuguccccuggaagaaguggca

SEQ ID NO: 963035 - RNA, 24 nt, Human
ugaaauaagccuaacauaaaaaua

SEQ ID NO: 963036 - RNA, 19 nt, Human
ugccccagcuucacagucg

SEQ ID NO: 963037 - RNA, 26 nt, Human
ugcccugggcugcagaagccugaggc

SEQ ID NO: 963038 - RNA, 18 nt, Human
uggaagaaguggcaggca

SEQ ID NO: 963039 - RNA, 22 nt, Human
uggagucccagcucuccuaucc

SEQ ID NO: 963040 - RNA, 18 nt, Human
uggcaggcaaggagcucc

SEQ ID NO: 963041 - RNA, 20 nt, Human
ugggacccaggaccagagag

SEQ ID NO: 963042 - RNA, 26 nt, Human
ugggacccaggaccagagagggagcu

SEQ ID NO: 963043 - RNA, 20 nt, Human
uggggcccagcagccgccug

SEQ ID NO: 963044 - RNA, 19 nt, Human
uggguuauucuguccccug

SEQ ID NO: 963045 - RNA, 19 nt, Human
uuagucaaguuugagggag

SEQ ID NO: 963046 - RNA, 20 nt, Human
uuuccagaagauaaagucuu

SEQ ID NO: 963047 - RNA, 23 nt, Human
aaacaaacaauucacagaauaaa

SEQ ID NO: 963048 - RNA, 22 nt, Human
aaacaggauugcaagcagcccu

SEQ ID NO: 963049 - RNA, 23 nt, Human
aaagagcagcaguaaaugaccac

SEQ ID NO: 963050 - RNA, 21 nt, Human
aacaaacacacagaaacaaac

SEQ ID NO: 963051 - RNA, 22 nt, Human
aacaaacacacagaaacaaaca

SEQ ID NO: 963052 - RNA, 20 nt, Human
aagucaggacuagaguacag

SEQ ID NO: 963053 - RNA, 19 nt, Human
agaaacaaacaauucacag

SEQ ID NO: 963054 - RNA, 22 nt, Human
agaagugaugcagggacuuuuu

SEQ ID NO: 963055 - RNA, 20 nt, Human
agaguucccuccugcucuuc

SEQ ID NO: 963056 - RNA, 21 nt, Human
agcagcccucugcaccccaag

SEQ ID NO: 963057 - RNA, 22 nt, Human
agcaggcacagccuuacaaaca

SEQ ID NO: 963058 - RNA, 21 nt, Human
augcagggacuuuuuaaccca

SEQ ID NO: 963059 - RNA, 21 nt, Human
caaacacacagaaacaaacaa

SEQ ID NO: 963060 - RNA, 24 nt, Human
cacuuccuuccgcccccagugaga

SEQ ID NO: 963061 - RNA, 18 nt, Human
cagcagcuagagggacca

SEQ ID NO: 963062 - RNA, 24 nt, Human
ccccaagucaggacuagaguacag

SEQ ID NO: 963063 - RNA, 23 nt, Human
ccuuccgcccccagugagaguuc

SEQ ID NO: 963064 - RNA, 18 nt, Human
cgagugagugaaugaaua

SEQ ID NO: 963065 - RNA, 19 nt, Human
gagggaccaggcaaaguuu

SEQ ID NO: 963066 - RNA, 21 nt, Human
gcaaacgagugagugaaugaa

SEQ ID NO: 963067 - RNA, 21 nt, Human
gccuucaugcacuuuugacag

SEQ ID NO: 963068 - RNA, 20 nt, Human
ggaaaagaaucucuuaaaaa

SEQ ID NO: 963069 - RNA, 19 nt, Human
guuacugcuccagcuccac

SEQ ID NO: 963070 - RNA, 24 nt, Human
uaaaugaccacugcccauuauguu

SEQ ID NO: 963071 - RNA, 20 nt, Human
ucaguaccugugagaacaga

SEQ ID NO: 963072 - RNA, 19 nt, Human
uccacuuccuuccgccccc

SEQ ID NO: 963073 - RNA, 23 nt, Human
ugaaagaaccaccagcagcuaga

SEQ ID NO: 963074 - RNA, 18 nt, Human
ugaacaaacacacagaaa

SEQ ID NO: 963075 - RNA, 19 nt, Human
ugaacaaacacacagaaac

SEQ ID NO: 963076 - RNA, 21 nt, Human
ugcuccagcuccacuuccuuc

SEQ ID NO: 963077 - RNA, 23 nt, Human
ugcuccagcuccacuuccuuccg

SEQ ID NO: 963078 - RNA, 24 nt, Human
uguggguugaacaguccaaagcuc

SEQ ID NO: 963079 - RNA, 20 nt, Human
uucaaacaaguaauuuagag

SEQ ID NO: 963080 - RNA, 23 nt, Human
uucaugcacuuuugacagcucag

SEQ ID NO: 963081 - RNA, 23 nt, Human
uugcaaacgagugagugaaugaa

SEQ ID NO: 963082 - RNA, 22 nt, Human
aaaggauccuuuauugaccaga

SEQ ID NO: 963083 - RNA, 23 nt, Human
aggcaagagaggaaaggaacugg

SEQ ID NO: 963084 - RNA, 19 nt, Human
auauauauauauauauaua

SEQ ID NO: 963085 - RNA, 19 nt, Human
auauauauauauauauaua

SEQ ID NO: 963086 - RNA, 19 nt, Human
auauauauauauauauaua

SEQ ID NO: 963087 - RNA, 19 nt, Human
auauauauauauauauaua

SEQ ID NO: 963088 - RNA, 19 nt, Human
auauauauauauauauaua

SEQ ID NO: 963089 - RNA, 19 nt, Human
auauauauauauauauaua

SEQ ID NO: 963090 - RNA, 19 nt, Human
auauauauauauauauaua

SEQ ID NO: 963091 - RNA, 19 nt, Human
auauauauauauauauaua

SEQ ID NO: 963092 - RNA, 19 nt, Human
auauauauauauauauaua

SEQ ID NO: 963093 - RNA, 19 nt, Human
auauauauauauauauaua

SEQ ID NO: 963094 - RNA, 19 nt, Human
auauauauauauauauaua

SEQ ID NO: 963095 - RNA, 19 nt, Human
auauauauauauauauaua

SEQ ID NO: 963096 - RNA, 21 nt, Human
caaagaaaaaaaaauacagaa

SEQ ID NO: 963097 - RNA, 20 nt, Human
cacccaggccacagggccac

SEQ ID NO: 963098 - RNA, 20 nt, Human
caguacccgggagcggggaa

SEQ ID NO: 963099 - RNA, 20 nt, Human
caugucucccuucccauuua

SEQ ID NO: 963100 - RNA, 21 nt, Human
ccacacuccccugcaaacaga

SEQ ID NO: 963101 - RNA, 21 nt, Human
ccaggccacagggccacacuc

SEQ ID NO: 963102 - RNA, 19 nt, Human
ccccugcaaacagaggaag

SEQ ID NO: 963103 - RNA, 23 nt, Human
ccgcccaccacccccagcacuga

SEQ ID NO: 963104 - RNA, 21 nt, Human
ccugcaaacagaggaagaaag

SEQ ID NO: 963105 - RNA, 24 nt, Human
cucaaagaaaaaaaaauacagaaa

SEQ ID NO: 963106 - RNA, 27 nt, Human
cuccacccaggccacagggccacacuc

SEQ ID NO: 963107 - RNA, 20 nt, Human
cucccaugucucccuuccca

SEQ ID NO: 963108 - RNA, 19 nt, Human
cuguagccacccccugcac

SEQ ID NO: 963109 - RNA, 21 nt, Human
cuuccaguacccgggagcggg

SEQ ID NO: 963110 - RNA, 19 nt, Human
gcaaacagaggaagaaagg

SEQ ID NO: 963111 - RNA, 22 nt, Human
gcaagagaggaaaggaacugga

SEQ ID NO: 963112 - RNA, 24 nt, Human
gcacugauuuccugcucccugcac

SEQ ID NO: 963113 - RNA, 22 nt, Human
ggaaaggaacuggaguuucuug

SEQ ID NO: 963114 - RNA, 18 nt, Human
ggaguuucuugggaaggg

SEQ ID NO: 963115 - RNA, 19 nt, Human
ggcauuuauauauuuuuau

SEQ ID NO: 963116 - RNA, 22 nt, Human
uacccgggagcggggaagccgg

SEQ ID NO: 963117 - RNA, 21 nt, Human
uagccacccccugcacaucag

SEQ ID NO: 963118 - RNA, 19 nt, Human
uauauauauauauauauau

SEQ ID NO: 963119 - RNA, 19 nt, Human
uauauauauauauauauau

SEQ ID NO: 963120 - RNA, 19 nt, Human
uauauauauauauauauau

SEQ ID NO: 963121 - RNA, 19 nt, Human
uauauauauauauauauau

SEQ ID NO: 963122 - RNA, 19 nt, Human
uauauauauauauauauau

SEQ ID NO: 963123 - RNA, 19 nt, Human
uauauauauauauauauau

SEQ ID NO: 963124 - RNA, 19 nt, Human
uauauauauauauauauau

SEQ ID NO: 963125 - RNA, 29 nt, Human
uccccugcaaacagaggaagaaaggggcu

SEQ ID NO: 963126 - RNA, 19 nt, Human
ucucucaaagaaaaaaaaa

SEQ ID NO: 963127 - RNA, 21 nt, Human
ugggaagaggcaagagaggaa

SEQ ID NO: 963128 - RNA, 19 nt, Human
uuuauauauauauauauau

SEQ ID NO: 963129 - RNA, 19 nt, Human
uuuauauauauauauauau

SEQ ID NO: 963130 - RNA, 21 nt, Human
uuuuauauauauauauauauu

SEQ ID NO: 963131 - RNA, 19 nt, Human
aaaaguaccccccaacaca

SEQ ID NO: 963132 - RNA, 20 nt, Human
aaaauuagauguacaaaaca

SEQ ID NO: 963133 - RNA, 19 nt, Human
aagcacuggggcuggcacc

SEQ ID NO: 963134 - RNA, 19 nt, Human
aaguuauuuucuucucugu

SEQ ID NO: 963135 - RNA, 21 nt, Human
acaagcacuggggcuggcacc

SEQ ID NO: 963136 - RNA, 22 nt, Human
acaagcacuggggcuggcacca

SEQ ID NO: 963137 - RNA, 18 nt, Human
acuccccucagcacccag

SEQ ID NO: 963138 - RNA, 19 nt, Human
agggagggggaggggaaag

SEQ ID NO: 963139 - RNA, 20 nt, Human
aguaaucuuagagaacaucu

SEQ ID NO: 963140 - RNA, 23 nt, Human
auacugcaugcuugagcugcaaa

SEQ ID NO: 963141 - RNA, 19 nt, Human
aucacccccauucccauuc

SEQ ID NO: 963142 - RNA, 18 nt, Human
aucauauauaaugccacc

SEQ ID NO: 963143 - RNA, 24 nt, Human
augaggaucauaggucucuaaaag

SEQ ID NO: 963144 - RNA, 19 nt, Human
auuaugaaugucuuuuugu

SEQ ID NO: 963145 - RNA, 20 nt, Human
caccucaggaccccuccggc

SEQ ID NO: 963146 - RNA, 23 nt, Human
cacuuuaaaagagcgaauuuuua

SEQ ID NO: 963147 - RNA, 23 nt, Human
cagaagggaugccguaaauggca

SEQ ID NO: 963148 - RNA, 21 nt, Human
cugcaaguuauuuucuucucu

SEQ ID NO: 963149 - RNA, 19 nt, Human
cuggcuaacacaaaugcug

SEQ ID NO: 963150 - RNA, 25 nt, Human
cuucucugugagcuggcuaacacaa

SEQ ID NO: 963151 - RNA, 18 nt, Human
gaaaaaaaaaaagcagag

SEQ ID NO: 963152 - RNA, 18 nt, Human
gagagcaaucuggcuuug

SEQ ID NO: 963153 - RNA, 19 nt, Human
gagcuggcuaacacaaaug

SEQ ID NO: 963154 - RNA, 25 nt, Human
ggaggcuuuaacuccccucagcacc

SEQ ID NO: 963155 - RNA, 20 nt, Human
gggaaaggaaaaaaaaaaaa

SEQ ID NO: 963156 - RNA, 23 nt, Human
guuauuuucuucucugugagcug

SEQ ID NO: 963157 - RNA, 23 nt, Human
uaaaaaauuaaguuccaugagga

SEQ ID NO: 963158 - RNA, 22 nt, Human
uaaaacaccgauauccucaaaa

SEQ ID NO: 963159 - RNA, 22 nt, Human
uaagaauacugaggcuuaacug

SEQ ID NO: 963160 - RNA, 18 nt, Human
uaagauacucacauauga

SEQ ID NO: 963161 - RNA, 22 nt, Human
uaagauacucacauaugacauc

SEQ ID NO: 963162 - RNA, 23 nt, Human
uaagauacucacauaugacauca

SEQ ID NO: 963163 - RNA, 19 nt, Human
uacaaacaaaaacauuaag

SEQ ID NO: 963164 - RNA, 18 nt, Human
uacacaguauucauacug

SEQ ID NO: 963165 - RNA, 21 nt, Human
uacccauuaauaaauaggacu

SEQ ID NO: 963166 - RNA, 18 nt, Human
uaccccccaacacacaca

SEQ ID NO: 963167 - RNA, 25 nt, Human
uagaauuacaauaugaugugaccug

SEQ ID NO: 963168 - RNA, 22 nt, Human
uagcaguaccucaaguugagcu

SEQ ID NO: 963169 - RNA, 22 nt, Human
uaucuauaucacccccauuccc

SEQ ID NO: 963170 - RNA, 22 nt, Human
uaugaaauauccaaacaacaaa

SEQ ID NO: 963171 - RNA, 19 nt, Human
uaugaggacaccaauuuua

SEQ ID NO: 963172 - RNA, 24 nt, Human
uauuuuaaauaauguuccaaugac

SEQ ID NO: 963173 - RNA, 21 nt, Human
uauuuugcacagguaaaauuu

SEQ ID NO: 963174 - RNA, 23 nt, Human
uccaugaggaucauaggucucua

SEQ ID NO: 963175 - RNA, 24 nt, Human
ucccaaaauuagauguacaaaaca

SEQ ID NO: 963176 - RNA, 26 nt, Human
ugaaaaacauacaaacaaaaacauua

SEQ ID NO: 963177 - RNA, 21 nt, Human
ugaaauaaaauguucagacuu

SEQ ID NO: 963178 - RNA, 24 nt, Human
ugacaucaaaagaaaugaaaaaaa

SEQ ID NO: 963179 - RNA, 26 nt, Human
ugacaucaaaagaaaugaaaaaaaaa

SEQ ID NO: 963180 - RNA, 23 nt, Human
ugagcuggcuaacacaaaugcug

SEQ ID NO: 963181 - RNA, 21 nt, Human
ugcaaagaauagaauuacaau

SEQ ID NO: 963182 - RNA, 19 nt, Human
ugccaaaaucaacaaaagc

SEQ ID NO: 963183 - RNA, 25 nt, Human
uggagagggagggggaggggaaagg

SEQ ID NO: 963184 - RNA, 18 nt, Human
ugguaaggggcuuuccag

SEQ ID NO: 963185 - RNA, 20 nt, Human
ugucuuauagacuugguuuc

SEQ ID NO: 963186 - RNA, 21 nt, Human
uuaaaaaauacacaguauuca

SEQ ID NO: 963187 - RNA, 19 nt, Human
uuagaaaguucugaagugu

SEQ ID NO: 963188 - RNA, 21 nt, Human
uuagcaauugagaauaauaag

SEQ ID NO: 963189 - RNA, 25 nt, Human
uucccauauuacauaugcuguugca

SEQ ID NO: 963190 - RNA, 18 nt, Human
uuuccaguaaucuuagag

SEQ ID NO: 963191 - RNA, 21 nt, Human
uuugacaagcacuggggcugg

SEQ ID NO: 963192 - RNA, 22 nt, Human
uuuuuuuuuuuuuugaauugga

SEQ ID NO: 963193 - RNA, 23 nt, Human
uuuuuuuuuuuuuuuugaauugg

SEQ ID NO: 963194 - RNA, 18 nt, Human
uuuuuuuuuuuuuuuuug

SEQ ID NO: 963195 - RNA, 25 nt, Human
aaauuccagaagcugaacaagagcu

SEQ ID NO: 963196 - RNA, 18 nt, Human
aagggagaccaaaggaaa

SEQ ID NO: 963197 - RNA, 18 nt, Human
acagaacauauugcuccc

SEQ ID NO: 963198 - RNA, 20 nt, Human
accuccccaaccacccucag

SEQ ID NO: 963199 - RNA, 22 nt, Human
accucuguguuggccggaaagc

SEQ ID NO: 963200 - RNA, 20 nt, Human
agaagcugaacaagagcugc

SEQ ID NO: 963201 - RNA, 21 nt, Human
aguacagggagaaucuaaagc

SEQ ID NO: 963202 - RNA, 21 nt, Human
caccucuguguuggccggaaa

SEQ ID NO: 963203 - RNA, 20 nt, Human
cacugagauugcagccaucc

SEQ ID NO: 963204 - RNA, 19 nt, Human
cagaggaugauauucuuuc

SEQ ID NO: 963205 - RNA, 23 nt, Human
ccagaauaagccaauguggauaa

SEQ ID NO: 963206 - RNA, 20 nt, Human
ccauggggauaaugcagagg

SEQ ID NO: 963207 - RNA, 24 nt, Human
ccccaaccacccucaggcaccucu

SEQ ID NO: 963208 - RNA, 22 nt, Human
cggucgcaaacucagagguuuc

SEQ ID NO: 963209 - RNA, 21 nt, Human
cuccagaauaagccaaugugg

SEQ ID NO: 963210 - RNA, 24 nt, Human
cuccccaaccacccucaggcaccu

SEQ ID NO: 963211 - RNA, 24 nt, Human
gacgagggcugcucagaaauucca

SEQ ID NO: 963212 - RNA, 19 nt, Human
gaggaugauauucuuucag

SEQ ID NO: 963213 - RNA, 21 nt, Human
uacguaaacccuguguguaau

SEQ ID NO: 963214 - RNA, 18 nt, Human
uaggcaucuucccucagg

SEQ ID NO: 963215 - RNA, 22 nt, Human
uaggcaucuucccucaggcacu

SEQ ID NO: 963216 - RNA, 23 nt, Human
uauaccaauaagaaaagucuuac

SEQ ID NO: 963217 - RNA, 22 nt, Human
ucaccuccccaaccacccucag

SEQ ID NO: 963218 - RNA, 27 nt, Human
uccccaaccacccucaggcaccucugu

SEQ ID NO: 963219 - RNA, 23 nt, Human
uccccaaccuugcgacaucccuu

SEQ ID NO: 963220 - RNA, 22 nt, Human
ucccuuuccaguacagggagaa

SEQ ID NO: 963221 - RNA, 23 nt, Human
ucuacuaggcaucuucccucagg

SEQ ID NO: 963222 - RNA, 24 nt, Human
ugaacaagagcugcucgggccuca

SEQ ID NO: 963223 - RNA, 20 nt, Human
ugcucagaaauuccagaagc

SEQ ID NO: 963224 - RNA, 22 nt, Human
uuccaguacagggagaaucuaa

SEQ ID NO: 963225 - RNA, 19 nt, Human
uuggccggaaagcgacagc

SEQ ID NO: 963226 - RNA, 23 nt, Human
uuucacagaacauauugcucccc

SEQ ID NO: 963227 - RNA, 21 nt, Human
aaaacuaaauuauuuucuagg

SEQ ID NO: 963228 - RNA, 24 nt, Human
aaaagaaagcuggguaauacaaaa

SEQ ID NO: 963229 - RNA, 23 nt, Human
aaacaugaaagaacaaaccagaa

SEQ ID NO: 963230 - RNA, 22 nt, Human
aaacuggaccaauuaucacaaa

SEQ ID NO: 963231 - RNA, 21 nt, Human
aaagcacuauuaccaacaaua

SEQ ID NO: 963232 - RNA, 18 nt, Human
aagcuugccaacuccuua

SEQ ID NO: 963233 - RNA, 19 nt, Human
aauacaaaaauaggagaga

SEQ ID NO: 963234 - RNA, 22 nt, Human
accaauuaucacaaacuaucau

SEQ ID NO: 963235 - RNA, 20 nt, Human
acuuuuuauuuauauuuugg

SEQ ID NO: 963236 - RNA, 19 nt, Human
agacugaucaauggaagca

SEQ ID NO: 963237 - RNA, 22 nt, Human
agccauuuuuacauuuuggcua

SEQ ID NO: 963238 - RNA, 25 nt, Human
auaagguaacaaaaggauaggacaa

SEQ ID NO: 963239 - RNA, 20 nt, Human
aucaauggaagcaagcaaaa

SEQ ID NO: 963240 - RNA, 18 nt, Human
auguaucugauccacaca

SEQ ID NO: 963241 - RNA, 26 nt, Human
gaaaaaaaugcauugaaaaacaucau

SEQ ID NO: 963242 - RNA, 18 nt, Human
gaaagaacaaaccagaag

SEQ ID NO: 963243 - RNA, 20 nt, Human
gaaagaacaaaccagaagaa

SEQ ID NO: 963244 - RNA, 24 nt, Human
gacaaaauuuaagcaagaggacau

SEQ ID NO: 963245 - RNA, 24 nt, Human
gaucaauggaagcaagcaaaacua

SEQ ID NO: 963246 - RNA, 21 nt, Human
gaucacuuuuaaauggacuuu

SEQ ID NO: 963247 - RNA, 19 nt, Human
gguaauacaaaaauaggag

SEQ ID NO: 963248 - RNA, 22 nt, Human
gguaauacaaaaauaggagaga

SEQ ID NO: 963249 - RNA, 19 nt, Human
uaaaaagaaagcuggguaa

SEQ ID NO: 963250 - RNA, 19 nt, Human
uacaaaguuuuuaugcagu

SEQ ID NO: 963251 - RNA, 24 nt, Human
uacuguaggaucuugaauauguuu

SEQ ID NO: 963252 - RNA, 24 nt, Human
uaucuuauuugcuuuguagucugc

SEQ ID NO: 963253 - RNA, 19 nt, Human
ucaauggaagcaagcaaaa

SEQ ID NO: 963254 - RNA, 18 nt, Human
ucacaaacuaucauuugc

SEQ ID NO: 963255 - RNA, 22 nt, Human
ucaguauaucuuauuugcuuug

SEQ ID NO: 963256 - RNA, 20 nt, Human
ucaucugucuuguuaaccuc

SEQ ID NO: 963257 - RNA, 23 nt, Human
ucauuuuuaaacaugaaagaaca

SEQ ID NO: 963258 - RNA, 24 nt, Human
uccaaauucagauagauuuuugaa

SEQ ID NO: 963259 - RNA, 18 nt, Human
ucccuagaaagguuuucu

SEQ ID NO: 963260 - RNA, 18 nt, Human
ucugauccacacaaaucc

SEQ ID NO: 963261 - RNA, 25 nt, Human
ugaaaaauaaaaucagacaaauaua

SEQ ID NO: 963262 - RNA, 22 nt, Human
uggaagcaagcaaaacuaaauu

SEQ ID NO: 963263 - RNA, 18 nt, Human
ugucuuguuaaccucucu

SEQ ID NO: 963264 - RNA, 19 nt, Human
uguuagugguaucaacaaa

SEQ ID NO: 963265 - RNA, 21 nt, Human
uuagauaucauggacuauacu

SEQ ID NO: 963266 - RNA, 23 nt, Human
uucacucuuacuguaggaucuug

SEQ ID NO: 963267 - RNA, 25 nt, Human
uucauaaaugaaaaaacuuugaaaa

SEQ ID NO: 963268 - RNA, 22 nt, Human
uuccaaauucagauagauuuuu

SEQ ID NO: 963269 - RNA, 22 nt, Human
uuuacaauaaugaagcuacaaa

SEQ ID NO: 963270 - RNA, 24 nt, Human
uuuucuguguagucuucauuaacg

SEQ ID NO: 963271 - RNA, 21 nt, Human
agaagaagggggacuccggaa

SEQ ID NO: 963272 - RNA, 23 nt, Human
agaagaagggggacuccggaaga

SEQ ID NO: 963273 - RNA, 21 nt, Human
agagucugggagaagaagggg

SEQ ID NO: 963274 - RNA, 18 nt, Human
agcccgcgcgagggcggg

SEQ ID NO: 963275 - RNA, 23 nt, Human
cagagucugggagaagaaggggg

SEQ ID NO: 963276 - RNA, 18 nt, Human
cccgcggaggucccgggg

SEQ ID NO: 963277 - RNA, 22 nt, Human
cccgcggaggucccggggggcg

SEQ ID NO: 963278 - RNA, 18 nt, Human
ccgcggaggucccggggg

SEQ ID NO: 963279 - RNA, 21 nt, Human
cugggagaaccucccccuaau

SEQ ID NO: 963280 - RNA, 18 nt, Human
ggcggugucugggugggc

SEQ ID NO: 963281 - RNA, 18 nt, Human
ucugggagaagaaggggg

SEQ ID NO: 963282 - RNA, 20 nt, Human
ucugggugggcgggaccagc

SEQ ID NO: 963283 - RNA, 23 nt, Human
ugggagaagaagggggacuccgg

SEQ ID NO: 963284 - RNA, 21 nt, Human
uuuuuuuuuuuuuugccgcgg

SEQ ID NO: 963285 - RNA, 18 nt, Human
uuuuuuuuuuuuuuuuug

SEQ ID NO: 963286 - RNA, 25 nt, Human
uuuuuuuuuuuuuuuuugccgcggg

SEQ ID NO: 963287 - RNA, 19 nt, Human
aaagaggcagcuggccccu

SEQ ID NO: 963288 - RNA, 27 nt, Human
aaccaggagaugggacagaagggaccc

SEQ ID NO: 963289 - RNA, 19 nt, Human
aaccucccccagaucuccu

SEQ ID NO: 963290 - RNA, 27 nt, Human
aacuggccuaaagaggcagcuggcccc

SEQ ID NO: 963291 - RNA, 23 nt, Human
aagaacccagcucuggccuacuu

SEQ ID NO: 963292 - RNA, 19 nt, Human
aagcaaauggagcaacaga

SEQ ID NO: 963293 - RNA, 18 nt, Human
aaggacagugcccaggag

SEQ ID NO: 963294 - RNA, 22 nt, Human
aagugcugggauucauagagga

SEQ ID NO: 963295 - RNA, 23 nt, Human
acacacacacacacacacacaca

SEQ ID NO: 963296 - RNA, 23 nt, Human
acacacacacacacacacacaca

SEQ ID NO: 963297 - RNA, 23 nt, Human
acacacacacacacacacacaca

SEQ ID NO: 963298 - RNA, 23 nt, Human
acacacacacacacacacacaca

SEQ ID NO: 963299 - RNA, 23 nt, Human
acacacacacacacacacacaca

SEQ ID NO: 963300 - RNA, 22 nt, Human
acacacagacaagaugcuccac

SEQ ID NO: 963301 - RNA, 22 nt, Human
acagaguugagaggaagaaggu

SEQ ID NO: 963302 - RNA, 18 nt, Human
acaguagccaaggauccc

SEQ ID NO: 963303 - RNA, 21 nt, Human
acgcccaccucccaugcccau

SEQ ID NO: 963304 - RNA, 22 nt, Human
agaaagacagacauaaauauga

SEQ ID NO: 963305 - RNA, 23 nt, Human
agaaagucaacuccagcaauguc

SEQ ID NO: 963306 - RNA, 19 nt, Human
agaagaaagucaacuccag

SEQ ID NO: 963307 - RNA, 21 nt, Human
agaggaagaaggugguuggug

SEQ ID NO: 963308 - RNA, 23 nt, Human
agagggugggcaaaggggaauuc

SEQ ID NO: 963309 - RNA, 26 nt, Human
agccuuacccccagaccacccccaac

SEQ ID NO: 963310 - RNA, 21 nt, Human
agcuccacugccaucuguccu

SEQ ID NO: 963311 - RNA, 20 nt, Human
aggaagagggugggcaaagg

SEQ ID NO: 963312 - RNA, 18 nt, Human
aggagccaaacuuacaag

SEQ ID NO: 963313 - RNA, 22 nt, Human
aggaggccuucucccugcaggg

SEQ ID NO: 963314 - RNA, 22 nt, Human
aggagggaaagggagaaagaag

SEQ ID NO: 963315 - RNA, 21 nt, Human
aggcaguggccuggcagcaga

SEQ ID NO: 963316 - RNA, 22 nt, Human
agggaaaggcaagaaaagccua

SEQ ID NO: 963317 - RNA, 21 nt, Human
agggagaugcuccgggcgcgg

SEQ ID NO: 963318 - RNA, 20 nt, Human
agggaggaugagggcugggu

SEQ ID NO: 963319 - RNA, 21 nt, Human
agguggggaggauguacaacc

SEQ ID NO: 963320 - RNA, 18 nt, Human
agguuguaugagguuauu

SEQ ID NO: 963321 - RNA, 20 nt, Human
aguggagagcagcaguaggc

SEQ ID NO: 963322 - RNA, 20 nt, Human
auagccccaguuugugugca

SEQ ID NO: 963323 - RNA, 19 nt, Human
auggagcaacagagaagga

SEQ ID NO: 963324 - RNA, 20 nt, Human
caaggaaaggagacagauaa

SEQ ID NO: 963325 - RNA, 18 nt, Human
caaguagcugggaugggc

SEQ ID NO: 963326 - RNA, 20 nt, Human
cacacacacacacacacaca

SEQ ID NO: 963327 - RNA, 20 nt, Human
cacacacacacacacacaca

SEQ ID NO: 963328 - RNA, 20 nt, Human
cacacacacacacacacaca

SEQ ID NO: 963329 - RNA, 20 nt, Human
cacacacacacacacacaca

SEQ ID NO: 963330 - RNA, 20 nt, Human
cacacacacacacacacaca

SEQ ID NO: 963331 - RNA, 20 nt, Human
cacacacacacacacacaca

SEQ ID NO: 963332 - RNA, 20 nt, Human
cacacacacacacacacaca

SEQ ID NO: 963333 - RNA, 20 nt, Human
cacacacacacacacacaca

SEQ ID NO: 963334 - RNA, 20 nt, Human
cacacacacacacacacaca

SEQ ID NO: 963335 - RNA, 20 nt, Human
cacacacacacacacacaca

SEQ ID NO: 963336 - RNA, 22 nt, Human
cacacacacacacacacacaca

SEQ ID NO: 963337 - RNA, 22 nt, Human
cacacacacacacacacacaca

SEQ ID NO: 963338 - RNA, 22 nt, Human
cacacacacacacacacacaca

SEQ ID NO: 963339 - RNA, 22 nt, Human
cacacacacacacacacacaca

SEQ ID NO: 963340 - RNA, 21 nt, Human
cacacacacacacagacaaga

SEQ ID NO: 963341 - RNA, 24 nt, Human
cacacacacacagacaagaugcuc

SEQ ID NO: 963342 - RNA, 24 nt, Human
cacacacagacaagaugcuccaca

SEQ ID NO: 963343 - RNA, 19 nt, Human
cacacagacaagaugcucc

SEQ ID NO: 963344 - RNA, 22 nt, Human
cacacaggcucucucgcucucu

SEQ ID NO: 963345 - RNA, 20 nt, Human
cacccugcagaugggcuagg

SEQ ID NO: 963346 - RNA, 23 nt, Human
cacccuugucccacuuuggggcu

SEQ ID NO: 963347 - RNA, 24 nt, Human
caccgccccccuuucuccuggucc

SEQ ID NO: 963348 - RNA, 18 nt, Human
caccugagugauaaaaga

SEQ ID NO: 963349 - RNA, 19 nt, Human
cagcaauaacagcugagag

SEQ ID NO: 963350 - RNA, 19 nt, Human
cagccuccaggaaagaccg

SEQ ID NO: 963351 - RNA, 19 nt, Human
caggaggccuucucccugc

SEQ ID NO: 963352 - RNA, 20 nt, Human
caggggugccaggcaccauu

SEQ ID NO: 963353 - RNA, 21 nt, Human
caggugccuacccuguaacuu

SEQ ID NO: 963354 - RNA, 19 nt, Human
cagugaccaccugugguca

SEQ ID NO: 963355 - RNA, 19 nt, Human
caugcaucugauggggggc

SEQ ID NO: 963356 - RNA, 25 nt, Human
ccaaacuuacaagggacucuccagg

SEQ ID NO: 963357 - RNA, 23 nt, Human
ccaacgcccaccucccaugccca

SEQ ID NO: 963358 - RNA, 21 nt, Human
ccaagaguagcucaugcagau

SEQ ID NO: 963359 - RNA, 23 nt, Human
ccacaaauaccagacaggccugu

SEQ ID NO: 963360 - RNA, 21 nt, Human
ccacugccaucuguccuugga

SEQ ID NO: 963361 - RNA, 22 nt, Human
ccagacaggccugugggacaga

SEQ ID NO: 963362 - RNA, 19 nt, Human
ccaggaaagaccgagagca

SEQ ID NO: 963363 - RNA, 20 nt, Human
ccagguggagacaggaagag

SEQ ID NO: 963364 - RNA, 19 nt, Human
ccaugcccauagaucuucc

SEQ ID NO: 963365 - RNA, 19 nt, Human
ccaugcccauagaucuucc

SEQ ID NO: 963366 - RNA, 26 nt, Human
cccagaccacccccaacuuacaggag

SEQ ID NO: 963367 - RNA, 30 nt, Human
cccagccuuacccccagaccacccccaacc

SEQ ID NO: 963368 - RNA, 25 nt, Human
cccaggaagccccagccuuaccccc

SEQ ID NO: 963369 - RNA, 22 nt, Human
ccccagaccacccccaacuuac

SEQ ID NO: 963370 - RNA, 22 nt, Human
cccccaacuuacaggaggguug

SEQ ID NO: 963371 - RNA, 21 nt, Human
cccccagaccacccccaacuu

SEQ ID NO: 963372 - RNA, 18 nt, Human
ccccccuuucuccugguc

SEQ ID NO: 963373 - RNA, 19 nt, Human
ccccccuuucuccuggucc

SEQ ID NO: 963374 - RNA, 19 nt, Human
ccccuaggcgugggccucu

SEQ ID NO: 963375 - RNA, 24 nt, Human
ccccuuucuccugguccauugaau

SEQ ID NO: 963376 - RNA, 19 nt, Human
ccggcugacgcagaugaug

SEQ ID NO: 963377 - RNA, 27 nt, Human
ccuaaagaggcagcuggccccucccac

SEQ ID NO: 963378 - RNA, 21 nt, Human
ccuccaggaaagaccgagagc

SEQ ID NO: 963379 - RNA, 23 nt, Human
ccugcucccagcacuuuuaaaug

SEQ ID NO: 963380 - RNA, 19 nt, Human
ccuggucucugggagcccu

SEQ ID NO: 963381 - RNA, 22 nt, Human
ccuguggucaggcuaauucauu

SEQ ID NO: 963382 - RNA, 23 nt, Human
ccuguucaggugcuugacuacag

SEQ ID NO: 963383 - RNA, 24 nt, Human
cggggcugcaaggcugagcggggc

SEQ ID NO: 963384 - RNA, 22 nt, Human
cugcagcaauaacagcugagag

SEQ ID NO: 963385 - RNA, 25 nt, Human
cuucuuaggaaaaccacucuuccuc

SEQ ID NO: 963386 - RNA, 18 nt, Human
cuuuacauuggcugccug

SEQ ID NO: 963387 - RNA, 19 nt, Human
cuuuccuauuccuuucuuu

SEQ ID NO: 963388 - RNA, 23 nt, Human
gaaacaccuaggcugaaccagga

SEQ ID NO: 963389 - RNA, 20 nt, Human
gaacucccugcccccuacuc

SEQ ID NO: 963390 - RNA, 19 nt, Human
gaagcagagacaggcagug

SEQ ID NO: 963391 - RNA, 18 nt, Human
gaauccuccuuugucucc

SEQ ID NO: 963392 - RNA, 23 nt, Human
gacacaguguguggggcaguggc

SEQ ID NO: 963393 - RNA, 18 nt, Human
gaccaccuguggucaggc

SEQ ID NO: 963394 - RNA, 20 nt, Human
gacccuuuaaggaagccaag

SEQ ID NO: 963395 - RNA, 23 nt, Human
gagaaagaagacaaagucggaag

SEQ ID NO: 963396 - RNA, 20 nt, Human
gagaaucucuauagccccag

SEQ ID NO: 963397 - RNA, 22 nt, Human
gagacagauaauggacaggcau

SEQ ID NO: 963398 - RNA, 19 nt, Human
gagcagcaguaggcucugg

SEQ ID NO: 963399 - RNA, 22 nt, Human
gcaacagagaagccugcuuaga

SEQ ID NO: 963400 - RNA, 19 nt, Human
gcagaaggagcucuugaug

SEQ ID NO: 963401 - RNA, 21 nt, Human
gcagaaggagcucuugaugag

SEQ ID NO: 963402 - RNA, 23 nt, Human
gccaaauuacuaagaaagacaaa

SEQ ID NO: 963403 - RNA, 22 nt, Human
gccccagccuuacccccagacc

SEQ ID NO: 963404 - RNA, 19 nt, Human
gccuacuucucugccuucu

SEQ ID NO: 963405 - RNA, 21 nt, Human
gcugagaggggcugugguggu

SEQ ID NO: 963406 - RNA, 23 nt, Human
ggaaaaccacucuuccucagugg

SEQ ID NO: 963407 - RNA, 22 nt, Human
ggaaaggcaagaaaagccuaaa

SEQ ID NO: 963408 - RNA, 18 nt, Human
ggaaggacagugcccagg

SEQ ID NO: 963409 - RNA, 18 nt, Human
ggagaggagugguuugga

SEQ ID NO: 963410 - RNA, 19 nt, Human
ggcacagguggaaggacag

SEQ ID NO: 963411 - RNA, 20 nt, Human
ggccuggcagcagaggccag

SEQ ID NO: 963412 - RNA, 21 nt, Human
ggccuuccuuuucccaggaag

SEQ ID NO: 963413 - RNA, 20 nt, Human
ggcuguagcgcugcugcugu

SEQ ID NO: 963414 - RNA, 24 nt, Human
gggaaggggguuggggguaggagu

SEQ ID NO: 963415 - RNA, 19 nt, Human
gggacagaguugagaggaa

SEQ ID NO: 963416 - RNA, 19 nt, Human
gggaugggcuuacaagggc

SEQ ID NO: 963417 - RNA, 18 nt, Human
ggggaaggggguuggggg

SEQ ID NO: 963418 - RNA, 20 nt, Human
ggggggcuuugcccucccuu

SEQ ID NO: 963419 - RNA, 20 nt, Human
gguggagacaggaagagggu

SEQ ID NO: 963420 - RNA, 21 nt, Human
gguguggucaaaaauuugucu

SEQ ID NO: 963421 - RNA, 22 nt, Human
gguucaggggugccaggcacca

SEQ ID NO: 963422 - RNA, 21 nt, Human
gucuccauacaggacugcuuc

SEQ ID NO: 963423 - RNA, 21 nt, Human
gugaaaggcagucuaaaguca

SEQ ID NO: 963424 - RNA, 20 nt, Human
uaacucacuguguuucccuc

SEQ ID NO: 963425 - RNA, 18 nt, Human
uaacuggacacugggaac

SEQ ID NO: 963426 - RNA, 19 nt, Human
uaacuggacacugggaacu

SEQ ID NO: 963427 - RNA, 22 nt, Human
uaagcagaaaaauugcuuucuu

SEQ ID NO: 963428 - RNA, 18 nt, Human
uaaguaaugaaggagaca

SEQ ID NO: 963429 - RNA, 21 nt, Human
uacaaguagcugggaugggcu

SEQ ID NO: 963430 - RNA, 24 nt, Human
uacagggcuucagggaaaggcaag

SEQ ID NO: 963431 - RNA, 23 nt, Human
uaccagacaggccugugggacag

SEQ ID NO: 963432 - RNA, 18 nt, Human
uagcaugugugcuuccuu

SEQ ID NO: 963433 - RNA, 18 nt, Human
uagccuacagugaccacc

SEQ ID NO: 963434 - RNA, 21 nt, Human
uaggaaaaccacucuuccuca

SEQ ID NO: 963435 - RNA, 23 nt, Human
uaggaccggcugacgcagaugau

SEQ ID NO: 963436 - RNA, 24 nt, Human
uaguaagcagaaaaauugcuuucu

SEQ ID NO: 963437 - RNA, 24 nt, Human
uauaaagacacaguguguggggca

SEQ ID NO: 963438 - RNA, 23 nt, Human
uaugagguuauuguaaacaguuu

SEQ ID NO: 963439 - RNA, 19 nt, Human
uauuguggguuucuggggg

SEQ ID NO: 963440 - RNA, 24 nt, Human
ucaacauucgcaaacauucaugca

SEQ ID NO: 963441 - RNA, 21 nt, Human
ucacacacacacacacacaca

SEQ ID NO: 963442 - RNA, 18 nt, Human
ucacuguguuucccucuu

SEQ ID NO: 963443 - RNA, 19 nt, Human
ucagcaguggggcaggggg

SEQ ID NO: 963444 - RNA, 22 nt, Human
ucaugcagaugaauggguaggg

SEQ ID NO: 963445 - RNA, 22 nt, Human
uccacaaauaccagacaggccu

SEQ ID NO: 963446 - RNA, 18 nt, Human
uccacugggaggagagga

SEQ ID NO: 963447 - RNA, 27 nt, Human
ucccaggaagccccagccuuaccccca

SEQ ID NO: 963448 - RNA, 20 nt, Human
uccccugcugguccaagguc

SEQ ID NO: 963449 - RNA, 21 nt, Human
ucuagaaccugaugucccaau

SEQ ID NO: 963450 - RNA, 24 nt, Human
ucuauagccccaguuugugugcag

SEQ ID NO: 963451 - RNA, 21 nt, Human
ucuguccuuggagaaucucuu

SEQ ID NO: 963452 - RNA, 25 nt, Human
ucuuccucaguggcugcguuaugag

SEQ ID NO: 963453 - RNA, 20 nt, Human
ugaaaauaccucaccccugc

SEQ ID NO: 963454 - RNA, 21 nt, Human
ugaaaccucccccagaucucc

SEQ ID NO: 963455 - RNA, 20 nt, Human
ugaagcaaauggagcaacaa

SEQ ID NO: 963456 - RNA, 22 nt, Human
ugaagcaaauggagcaacagag

SEQ ID NO: 963457 - RNA, 21 nt, Human
ugaauggguagggagcaaugc

SEQ ID NO: 963458 - RNA, 19 nt, Human
ugacggagaaaacggaggu

SEQ ID NO: 963459 - RNA, 19 nt, Human
ugagaagcagcgcuugaaa

SEQ ID NO: 963460 - RNA, 22 nt, Human
ugagaggaagaaggugguuggu

SEQ ID NO: 963461 - RNA, 19 nt, Human
ugagaggggcugugguggu

SEQ ID NO: 963462 - RNA, 25 nt, Human
ugagcucagggccuguucaggugcu

SEQ ID NO: 963463 - RNA, 20 nt, Human
ugagggaaggagggaaaggg

SEQ ID NO: 963464 - RNA, 18 nt, Human
ugagggcugagaggggcu

SEQ ID NO: 963465 - RNA, 18 nt, Human
ugaguggacagaagggug

SEQ ID NO: 963466 - RNA, 19 nt, Human
ugaucaccgccccccuuuc

SEQ ID NO: 963467 - RNA, 21 nt, Human
ugaucaccgccccccuuucuc

SEQ ID NO: 963468 - RNA, 19 nt, Human
ugcuccgggcgcggggcug

SEQ ID NO: 963469 - RNA, 20 nt, Human
ugcuucuacaguagccaagg

SEQ ID NO: 963470 - RNA, 21 nt, Human
ugcuugacuacagaaacuuuc

SEQ ID NO: 963471 - RNA, 21 nt, Human
uggaaggacagugcccaggag

SEQ ID NO: 963472 - RNA, 22 nt, Human
uggaaguagacugggcauaaau

SEQ ID NO: 963473 - RNA, 21 nt, Human
uggacgagcacagcacuaaaa

SEQ ID NO: 963474 - RNA, 20 nt, Human
uggagacaggaagagggugg

SEQ ID NO: 963475 - RNA, 23 nt, Human
uggagcuccauuuguaggcacug

SEQ ID NO: 963476 - RNA, 21 nt, Human
uggccuggcagcagaggccag

SEQ ID NO: 963477 - RNA, 21 nt, Human
uggccuggcagcagaggccag

SEQ ID NO: 963478 - RNA, 19 nt, Human
uggcucaccugcucccagc

SEQ ID NO: 963479 - RNA, 22 nt, Human
uggcugccugugagcucagggc

SEQ ID NO: 963480 - RNA, 18 nt, Human
ugggaugggcuuacaagg

SEQ ID NO: 963481 - RNA, 22 nt, Human
ugggaugugugugugugaagug

SEQ ID NO: 963482 - RNA, 20 nt, Human
ugggauucauagaggaccag

SEQ ID NO: 963483 - RNA, 23 nt, Human
ugguauuugggaugugugugugu

SEQ ID NO: 963484 - RNA, 18 nt, Human
uguggagaccagcagcug

SEQ ID NO: 963485 - RNA, 22 nt, Human
ugugugugugaaguggguaugu

SEQ ID NO: 963486 - RNA, 19 nt, Human
uuacccccagaccaccccc

SEQ ID NO: 963487 - RNA, 20 nt, Human
uucccuggccccgaauuuca

SEQ ID NO: 963488 - RNA, 23 nt, Human
uuuccauuagccuacagugacca

SEQ ID NO: 963489 - RNA, 19 nt, Human
uuucccaggaagccccagc

SEQ ID NO: 963490 - RNA, 18 nt, Human
aacgcgccgcuucccccu

SEQ ID NO: 963491 - RNA, 22 nt, Human
aagaagaagugagcuugaagua

SEQ ID NO: 963492 - RNA, 21 nt, Human
agaccugacaggccuaacuca

SEQ ID NO: 963493 - RNA, 18 nt, Human
agagcaccaaaccuacac

SEQ ID NO: 963494 - RNA, 20 nt, Human
agagcuucucaagccuuaac

SEQ ID NO: 963495 - RNA, 24 nt, Human
agcagauuuuuuuuuuuuuuuuuu

SEQ ID NO: 963496 - RNA, 25 nt, Human
agcuucucaagccuuaacuaguuaa

SEQ ID NO: 963497 - RNA, 18 nt, Human
aggaaccucggcuuaaaa

SEQ ID NO: 963498 - RNA, 22 nt, Human
aggcggcgguguggggaagugg

SEQ ID NO: 963499 - RNA, 21 nt, Human
aguaagugaucaaaaaaagaa

SEQ ID NO: 963500 - RNA, 23 nt, Human
agucaggaggcaugaaaauuagu

SEQ ID NO: 963501 - RNA, 19 nt, Human
auaggaaccucggcuuaaa

SEQ ID NO: 963502 - RNA, 24 nt, Human
cacagcaaaccuacauucuugcuu

SEQ ID NO: 963503 - RNA, 21 nt, Human
cacuucgggcgcgaccaaguc

SEQ ID NO: 963504 - RNA, 20 nt, Human
caggaggcaugaaaauuagu

SEQ ID NO: 963505 - RNA, 21 nt, Human
ccaaaccuacacagcaaaccu

SEQ ID NO: 963506 - RNA, 20 nt, Human
ccaccccuugaaaguagggu

SEQ ID NO: 963507 - RNA, 24 nt, Human
ccagggcugccacgggugccgccg

SEQ ID NO: 963508 - RNA, 18 nt, Human
ccaguggggcugggaggc

SEQ ID NO: 963509 - RNA, 21 nt, Human
cccaagaaacuggcuugugcu

SEQ ID NO: 963510 - RNA, 28 nt, Human
ccccaaccuccccucuaccgcccacccc

SEQ ID NO: 963511 - RNA, 20 nt, Human
cccccuauggccagcaccag

SEQ ID NO: 963512 - RNA, 24 nt, Human
cccccucgccgcugcuccaacccc

SEQ ID NO: 963513 - RNA, 21 nt, Human
ccccuauggccagcaccaguu

SEQ ID NO: 963514 - RNA, 23 nt, Human
cccucuaccgcccaccccuugaa

SEQ ID NO: 963515 - RNA, 26 nt, Human
ccucggucaagucccuucccuucucc

SEQ ID NO: 963516 - RNA, 24 nt, Human
cuccaaccccaaccuccccucuac

SEQ ID NO: 963517 - RNA, 18 nt, Human
cuccccucuaccgcccac

SEQ ID NO: 963518 - RNA, 24 nt, Human
cucuaaaaaaaaaauagaaguagg

SEQ ID NO: 963519 - RNA, 22 nt, Human
cucucugagcuacuggcugagu

SEQ ID NO: 963520 - RNA, 18 nt, Human
cuggucacucaccaauca

SEQ ID NO: 963521 - RNA, 18 nt, Human
gaauuuucccaagaaacu

SEQ ID NO: 963522 - RNA, 20 nt, Human
gagcagauuuuuuuuuuuuu

SEQ ID NO: 963523 - RNA, 20 nt, Human
gccgcugcuccaaccccaac

SEQ ID NO: 963524 - RNA, 22 nt, Human
gcgcgaccaaguccgguggggg

SEQ ID NO: 963525 - RNA, 20 nt, Human
gcgguguggggaaguggugg

SEQ ID NO: 963526 - RNA, 20 nt, Human
ggagaccugacaggccuaac

SEQ ID NO: 963527 - RNA, 22 nt, Human
ggagcaaguugcggaacucaaa

SEQ ID NO: 963528 - RNA, 21 nt, Human
gguggggggaggugcaaggga

SEQ ID NO: 963529 - RNA, 18 nt, Human
gucaagucccuucccuuc

SEQ ID NO: 963530 - RNA, 18 nt, Human
ucaaaaaggccuggaaau

SEQ ID NO: 963531 - RNA, 20 nt, Human
ucauuuuuuucuuuuugcuu

SEQ ID NO: 963532 - RNA, 22 nt, Human
uccaagcauauggucuucaaaa

SEQ ID NO: 963533 - RNA, 24 nt, Human
uccccucuaccgcccaccccuuga

SEQ ID NO: 963534 - RNA, 19 nt, Human
uccgacaaagagaaagugu

SEQ ID NO: 963535 - RNA, 20 nt, Human
ucuaaaaaaaaaauagaagu

SEQ ID NO: 963536 - RNA, 19 nt, Human
ugaaggucucuccaaggcu

SEQ ID NO: 963537 - RNA, 22 nt, Human
ugaauuucugggaaagcagcuc

SEQ ID NO: 963538 - RNA, 20 nt, Human
ugacaggccuaacucagcau

SEQ ID NO: 963539 - RNA, 23 nt, Human
ugcaaauaugaagccuuucccaa

SEQ ID NO: 963540 - RNA, 18 nt, Human
ugcauauguuugcuuuuc

SEQ ID NO: 963541 - RNA, 24 nt, Human
ugcggaacucaaaaagaagaagug

SEQ ID NO: 963542 - RNA, 19 nt, Human
ugcguccgccagggcugcc

SEQ ID NO: 963543 - RNA, 20 nt, Human
ugcuccaaccccaaccuccg

SEQ ID NO: 963544 - RNA, 22 nt, Human
ugcuuuggcagcaucaccuuca

SEQ ID NO: 963545 - RNA, 21 nt, Human
uggcaggauaggggugggggg

SEQ ID NO: 963546 - RNA, 20 nt, Human
ugggaaagcagcucugaagc

SEQ ID NO: 963547 - RNA, 20 nt, Human
ugggaggcaggagcaaguug

SEQ ID NO: 963548 - RNA, 20 nt, Human
uggggggaggugcaagggag

SEQ ID NO: 963549 - RNA, 23 nt, Human
ugucaacaagaaaagugcgugca

SEQ ID NO: 963550 - RNA, 28 nt, Human
uguggggaaguggugguuaaccgugagg

SEQ ID NO: 963551 - RNA, 19 nt, Human
uuaccaggcggcggugugg

SEQ ID NO: 963552 - RNA, 22 nt, Human
uuguuucuaccuccaagcauau

SEQ ID NO: 963553 - RNA, 18 nt, Human
uuuuuggucguugguuug

SEQ ID NO: 963554 - RNA, 18 nt, Human
uuuuuuuuuuuuuuuuug

SEQ ID NO: 963555 - RNA, 20 nt, Human
uuuuuuuuuuuuuuuuuggu

SEQ ID NO: 963556 - RNA, 20 nt, Human
aaggaugccugaggcgggau

SEQ ID NO: 963557 - RNA, 23 nt, Human
aaucucugcccccaacagcagcc

SEQ ID NO: 963558 - RNA, 22 nt, Human
agacacauacacacagacucuc

SEQ ID NO: 963559 - RNA, 23 nt, Human
agacacauacacacagacucucc

SEQ ID NO: 963560 - RNA, 24 nt, Human
agccacgagaacaucagggaaaga

SEQ ID NO: 963561 - RNA, 18 nt, Human
caaacguugccacaauca

SEQ ID NO: 963562 - RNA, 23 nt, Human
caaacuccaggggacaacugggg

SEQ ID NO: 963563 - RNA, 31 nt, Human
cacaaucagaaacccacccauccugaugccc

SEQ ID NO: 963564 - RNA, 21 nt, Human
caggaggagggugggguggug

SEQ ID NO: 963565 - RNA, 18 nt, Human
caucagggaaagaccagg

SEQ ID NO: 963566 - RNA, 19 nt, Human
caucagggaaagaccaggu

SEQ ID NO: 963567 - RNA, 23 nt, Human
ccccaacagcagccacgagaaca

SEQ ID NO: 963568 - RNA, 22 nt, Human
cccccaacagcagccacgagaa

SEQ ID NO: 963569 - RNA, 23 nt, Human
cccccaacagcagccacgagaac

SEQ ID NO: 963570 - RNA, 22 nt, Human
ccccccaaacuccaggggacaa

SEQ ID NO: 963571 - RNA, 28 nt, Human
ccccccaaacuccaggggacaacugggg

SEQ ID NO: 963572 - RNA, 20 nt, Human
cgagaacaucagggaaagac

SEQ ID NO: 963573 - RNA, 22 nt, Human
cgagaacaucagggaaagacca

SEQ ID NO: 963574 - RNA, 23 nt, Human
cgagaacaucagggaaagaccag

SEQ ID NO: 963575 - RNA, 18 nt, Human
cgcucagaggcaaagacc

SEQ ID NO: 963576 - RNA, 24 nt, Human
cguugccacaaucagaaacccacc

SEQ ID NO: 963577 - RNA, 22 nt, Human
cucucccgcucagaggcaaaga

SEQ ID NO: 963578 - RNA, 24 nt, Human
cugaugccucucuuggcuuccccu

SEQ ID NO: 963579 - RNA, 23 nt, Human
cugggucaaggucccuggacucu

SEQ ID NO: 963580 - RNA, 27 nt, Human
gagaacaucagggaaagaccgguaccc

SEQ ID NO: 963581 - RNA, 20 nt, Human
gagaggggcugggucaaggu

SEQ ID NO: 963582 - RNA, 23 nt, Human
gaggcaaagaccgggggcgucaa

SEQ ID NO: 963583 - RNA, 20 nt, Human
ggaaagaccagguguccaca

SEQ ID NO: 963584 - RNA, 22 nt, Human
ggaaagaccagguguccacaag

SEQ ID NO: 963585 - RNA, 22 nt, Human
gggacaacuggggaagacaugg

SEQ ID NO: 963586 - RNA, 21 nt, Human
ggggaagacacauacacacag

SEQ ID NO: 963587 - RNA, 22 nt, Human
guguggauuccggggaagacac

SEQ ID NO: 963588 - RNA, 22 nt, Human
uaucaugaagcgucugcugaga

SEQ ID NO: 963589 - RNA, 20 nt, Human
ugagaaggaugccugaggcg

SEQ ID NO: 963590 - RNA, 21 nt, Human
uggggugguguggauuccggg

SEQ ID NO: 963591 - RNA, 21 nt, Human
uuuuuuuuuuuuuuuuuccgg

SEQ ID NO: 963592 - RNA, 23 nt, Human
uuuuuuuuuuuuuuuuuccgguu

SEQ ID NO: 963593 - RNA, 23 nt, Human
uuuuuuuuuuuuuuuuuuuccgg

SEQ ID NO: 963594 - RNA, 24 nt, Human
aaaaauaaauaaauuaccugggug

SEQ ID NO: 963595 - RNA, 24 nt, Human
aaagugcucagauuacaggcauga

SEQ ID NO: 963596 - RNA, 18 nt, Human
aacaguagaaacuguaac

SEQ ID NO: 963597 - RNA, 24 nt, Human
aacagugcgagacucugucucaaa

SEQ ID NO: 963598 - RNA, 19 nt, Human
aacauggugaaaccccauc

SEQ ID NO: 963599 - RNA, 20 nt, Human
aacauggugaaaccccaucu

SEQ ID NO: 963600 - RNA, 21 nt, Human
aacauggugaaaccccaucuc

SEQ ID NO: 963601 - RNA, 21 nt, Human
aacauggugaaaccccaucuc

SEQ ID NO: 963602 - RNA, 24 nt, Human
aacugcuugaacccaggaggcaga

SEQ ID NO: 963603 - RNA, 24 nt, Human
aagaagagcaacucggaaaagcaa

SEQ ID NO: 963604 - RNA, 24 nt, Human
aaucgcuugaacccgggaggcgga

SEQ ID NO: 963605 - RNA, 24 nt, Human
acagagugagacuccaucucaaaa

SEQ ID NO: 963606 - RNA, 24 nt, Human
acagugcgagacucugucucaaaa

SEQ ID NO: 963607 - RNA, 24 nt, Human
accccaucucuacuaagaauacaa

SEQ ID NO: 963608 - RNA, 23 nt, Human
acccgccuuggucucccaaagug

SEQ ID NO: 963609 - RNA, 25 nt, Human
acccgccuuggucucccaaagugcu

SEQ ID NO: 963610 - RNA, 21 nt, Human
accuggguguggcagcgcgga

SEQ ID NO: 963611 - RNA, 24 nt, Human
acgccacugcaguccagccugggc

SEQ ID NO: 963612 - RNA, 23 nt, Human
acuccagucuggugacagaguga

SEQ ID NO: 963613 - RNA, 22 nt, Human
acucggccuauccccucgcccc

SEQ ID NO: 963614 - RNA, 23 nt, Human
acugcacuccagucuggugacag

SEQ ID NO: 963615 - RNA, 25 nt, Human
acugcacuccagucuggugacagag

SEQ ID NO: 963616 - RNA, 24 nt, Human
acugcaguccagccugggcaacag

SEQ ID NO: 963617 - RNA, 24 nt, Human
agagaucacgccacugcaguccag

SEQ ID NO: 963618 - RNA, 21 nt, Human
agaggccaacugucacaggca

SEQ ID NO: 963619 - RNA, 23 nt, Human
agagguugcauggagcugagaug

SEQ ID NO: 963620 - RNA, 24 nt, Human
agagguugcauggagcugagaugg

SEQ ID NO: 963621 - RNA, 19 nt, Human
agauuacaggcaugagcca

SEQ ID NO: 963622 - RNA, 22 nt, Human
agauuacaggcaugagccacca

SEQ ID NO: 963623 - RNA, 24 nt, Human
agcacuuugggaggccgaggcggg

SEQ ID NO: 963624 - RNA, 22 nt, Human
agccuggccaacauggugaaac

SEQ ID NO: 963625 - RNA, 24 nt, Human
agccuggccaacauggugaaaccc

SEQ ID NO: 963626 - RNA, 24 nt, Human
agccugggcaacagugcgagacuc

SEQ ID NO: 963627 - RNA, 21 nt, Human
agcgcgugccuguaaucccag

SEQ ID NO: 963628 - RNA, 23 nt, Human
agcugggcgugguggcaggcgcc

SEQ ID NO: 963629 - RNA, 19 nt, Human
aggaagcugaggcuggaga

SEQ ID NO: 963630 - RNA, 19 nt, Human
aggaggcugaggcaagaga

SEQ ID NO: 963631 - RNA, 19 nt, Human
aggcaagagaacugcuuga

SEQ ID NO: 963632 - RNA, 24 nt, Human
aggcaagagaacugcuugaaccca

SEQ ID NO: 963633 - RNA, 24 nt, Human
aggcagagguugcauggagcugag

SEQ ID NO: 963634 - RNA, 21 nt, Human
aggccgaggcgggugaaucac

SEQ ID NO: 963635 - RNA, 19 nt, Human
aggcggagguugcagugag

SEQ ID NO: 963636 - RNA, 20 nt, Human
aggcggagguugcagugagc

SEQ ID NO: 963637 - RNA, 24 nt, Human
aggcggagguugcagugagcagag

SEQ ID NO: 963638 - RNA, 24 nt, Human
aggcgggugaaucacgaggucagg

SEQ ID NO: 963639 - RNA, 24 nt, Human
aggcugaggcaagagaacugcuug

SEQ ID NO: 963640 - RNA, 24 nt, Human
aggcuggagaaucgcuugaacccg

SEQ ID NO: 963641 - RNA, 23 nt, Human
agggaucuacccgccuuggucuc

SEQ ID NO: 963642 - RNA, 22 nt, Human
aguagaaaugggguuucgccau

SEQ ID NO: 963643 - RNA, 23 nt, Human
agucuggugacagagugagacuc

SEQ ID NO: 963644 - RNA, 24 nt, Human
aucacgccacugcaguccagccug

SEQ ID NO: 963645 - RNA, 18 nt, Human
auccggaagaucagcugc

SEQ ID NO: 963646 - RNA, 21 nt, Human
augagccaccacgccuggccc

SEQ ID NO: 963647 - RNA, 18 nt, Human
augggguuucgccauguu

SEQ ID NO: 963648 - RNA, 19 nt, Human
augggguuucgccauguug

SEQ ID NO: 963649 - RNA, 24 nt, Human
augggguuucgccauguugcccag

SEQ ID NO: 963650 - RNA, 24 nt, Human
caaagugcucagauuacaggcaug

SEQ ID NO: 963651 - RNA, 24 nt, Human
caacauggugaaaccccaucucua

SEQ ID NO: 963652 - RNA, 18 nt, Human
caccacgccuggcccaac

SEQ ID NO: 963653 - RNA, 22 nt, Human
caccacgccuggcccaacaugg

SEQ ID NO: 963654 - RNA, 23 nt, Human
cacccggaacucggccuaucccc

SEQ ID NO: 963655 - RNA, 24 nt, Human
cacgccuguaaucccagcacuuug

SEQ ID NO: 963656 - RNA, 21 nt, Human
cacuccagucuggugacagag

SEQ ID NO: 963657 - RNA, 21 nt, Human
cacuccagucuggugacagag

SEQ ID NO: 963658 - RNA, 23 nt, Human
cacuccagucuggugacagagug

SEQ ID NO: 963659 - RNA, 18 nt, Human
cacugcacuccagucugg

SEQ ID NO: 963660 - RNA, 20 nt, Human
cacugcacuccagucuggug

SEQ ID NO: 963661 - RNA, 22 nt, Human
cacugcacuccagucuggugac

SEQ ID NO: 963662 - RNA, 23 nt, Human
cacugcacuccagucuggugaca

SEQ ID NO: 963663 - RNA, 24 nt, Human
cacugcacuccagucuggugacag

SEQ ID NO: 963664 - RNA, 21 nt, Human
cacugcaguccagccugggca

SEQ ID NO: 963665 - RNA, 24 nt, Human
cacugcaguccagccugggcaaca

SEQ ID NO: 963666 - RNA, 23 nt, Human
cagauuacaggcaugagccacca

SEQ ID NO: 963667 - RNA, 24 nt, Human
cagcacuuugggaggccgaggcgg

SEQ ID NO: 963668 - RNA, 21 nt, Human
cagcuuccgggcaaggccccc

SEQ ID NO: 963669 - RNA, 21 nt, Human
cauaucaugcauucacaugug

SEQ ID NO: 963670 - RNA, 19 nt, Human
cauguugcccaggcugguc

SEQ ID NO: 963671 - RNA, 20 nt, Human
cauguugcccaggcuggucu

SEQ ID NO: 963672 - RNA, 23 nt, Human
cauguugcccaggcuggucuuga

SEQ ID NO: 963673 - RNA, 24 nt, Human
cauguugcccaggcuggucuugaa

SEQ ID NO: 963674 - RNA, 24 nt, Human
ccaaagugcucagauuacaggcau

SEQ ID NO: 963675 - RNA, 22 nt, Human
ccaauccggaagaucagcugcc

SEQ ID NO: 963676 - RNA, 19 nt, Human
ccacugcacuccagucugg

SEQ ID NO: 963677 - RNA, 20 nt, Human
ccacugcacuccagucuggu

SEQ ID NO: 963678 - RNA, 23 nt, Human
ccacugcacuccagucuggugac

SEQ ID NO: 963679 - RNA, 20 nt, Human
ccacugcaguccagccuggg

SEQ ID NO: 963680 - RNA, 20 nt, Human
ccacugcaguccagccuggg

SEQ ID NO: 963681 - RNA, 21 nt, Human
ccacugcaguccagccugggc

SEQ ID NO: 963682 - RNA, 24 nt, Human
ccacugcaguccagccugggcaac

SEQ ID NO: 963683 - RNA, 19 nt, Human
ccaggcucuucauaucaug

SEQ ID NO: 963684 - RNA, 24 nt, Human
ccaggcuggucuugaacuccuggg

SEQ ID NO: 963685 - RNA, 24 nt, Human
ccaucucaaaaaaaaaaaaaaaaa

SEQ ID NO: 963686 - RNA, 21 nt, Human
ccauguugcccaggcuggucu

SEQ ID NO: 963687 - RNA, 23 nt, Human
ccucgccccagcuaauuuuugua

SEQ ID NO: 963688 - RNA, 23 nt, Human
ccuggccaacauggugaaacccc

SEQ ID NO: 963689 - RNA, 24 nt, Human
ccuggccaacauggugaaacccca

SEQ ID NO: 963690 - RNA, 21 nt, Human
ccuggguguggcagcgcgugc

SEQ ID NO: 963691 - RNA, 21 nt, Human
ccuguaaucccagcuacccag

SEQ ID NO: 963692 - RNA, 24 nt, Human
ccuguaaucccagcuacccaggag

SEQ ID NO: 963693 - RNA, 19 nt, Human
ccuguaaucccaucuacuc

SEQ ID NO: 963694 - RNA, 24 nt, Human
cgaggcgggugaaucacgagguca

SEQ ID NO: 963695 - RNA, 20 nt, Human
cgccacugcacuccagucug

SEQ ID NO: 963696 - RNA, 25 nt, Human
cgccacugcacuccagucuggugac

SEQ ID NO: 963697 - RNA, 24 nt, Human
cgccacugcaguccagccugggca

SEQ ID NO: 963698 - RNA, 24 nt, Human
cgccauguugcccaggcuggucuu

SEQ ID NO: 963699 - RNA, 27 nt, Human
cgccauguugcccaggcuggucuugaa

SEQ ID NO: 963700 - RNA, 23 nt, Human
cgccuguaaucccagcacuuugg

SEQ ID NO: 963701 - RNA, 24 nt, Human
cgccuguaaucccagcacuuuggg

SEQ ID NO: 963702 - RNA, 24 nt, Human
cgccuguaaucccaucuacucagg

SEQ ID NO: 963703 - RNA, 19 nt, Human
cgcucugcuccgccaacgg

SEQ ID NO: 963704 - RNA, 28 nt, Human
cgcucugcucucccuaauggcccccuua

SEQ ID NO: 963705 - RNA, 24 nt, Human
cgggaggcggagguugcagugagc

SEQ ID NO: 963706 - RNA, 19 nt, Human
cuaagaauacaaaaaauua

SEQ ID NO: 963707 - RNA, 25 nt, Human
cuaauggcccccuuacacccggaac

SEQ ID NO: 963708 - RNA, 18 nt, Human
cucaaaaaaaaaaaaaaa

SEQ ID NO: 963709 - RNA, 22 nt, Human
cucacgccuguaaucccagcac

SEQ ID NO: 963710 - RNA, 24 nt, Human
cucacgccuguaaucccagcacuu

SEQ ID NO: 963711 - RNA, 20 nt, Human
cucagauuacaggcaugagc

SEQ ID NO: 963712 - RNA, 24 nt, Human
cuccagucuggugacagagugaga

SEQ ID NO: 963713 - RNA, 19 nt, Human
cuccaucucaaaaaaaaaa

SEQ ID NO: 963714 - RNA, 19 nt, Human
cucccuaauggcccccuua

SEQ ID NO: 963715 - RNA, 20 nt, Human
cuccgcccggcugcgccucc

SEQ ID NO: 963716 - RNA, 21 nt, Human
cucuacuaagaauacaaaaaa

SEQ ID NO: 963717 - RNA, 19 nt, Human
cucugucucaaaaaaaaaa

SEQ ID NO: 963718 - RNA, 18 nt, Human
cuggaggcccgacaacag

SEQ ID NO: 963719 - RNA, 23 nt, Human
cuggccaacauggugaaacccca

SEQ ID NO: 963720 - RNA, 19 nt, Human
cuggucuugaacuccuggg

SEQ ID NO: 963721 - RNA, 23 nt, Human
cuggucuugaacuccugggcaca

SEQ ID NO: 963722 - RNA, 20 nt, Human
cuggugacagagugagacuc

SEQ ID NO: 963723 - RNA, 22 nt, Human
cuugcuagaaaauggaguuuga

SEQ ID NO: 963724 - RNA, 24 nt, Human
gaaaugggguuucgccauguugcc

SEQ ID NO: 963725 - RNA, 22 nt, Human
gaacaguagaaacuguaaccag

SEQ ID NO: 963726 - RNA, 24 nt, Human
gacagagugagacuccaucucaaa

SEQ ID NO: 963727 - RNA, 23 nt, Human
gagauggcgccacugcacuccag

SEQ ID NO: 963728 - RNA, 19 nt, Human
gagcccucgugggcccucc

SEQ ID NO: 963729 - RNA, 23 nt, Human
gagcccucgugggcccuccgccc

SEQ ID NO: 963730 - RNA, 21 nt, Human
gagucucuuauaccuuucugg

SEQ ID NO: 963731 - RNA, 18 nt, Human
gauuacaggcaugagcca

SEQ ID NO: 963732 - RNA, 22 nt, Human
gauuacaggcaugagccaccac

SEQ ID NO: 963733 - RNA, 22 nt, Human
gcaagagaacugcuugaaccca

SEQ ID NO: 963734 - RNA, 24 nt, Human
gcacaccagggccaggagaccuca

SEQ ID NO: 963735 - RNA, 23 nt, Human
gcacuccagucuggugacagagu

SEQ ID NO: 963736 - RNA, 20 nt, Human
gcagagaucacgccacugca

SEQ ID NO: 963737 - RNA, 23 nt, Human
gcagcgcgugccuguaaucccag

SEQ ID NO: 963738 - RNA, 24 nt, Human
gccaacauggugaaaccccaucuc

SEQ ID NO: 963739 - RNA, 22 nt, Human
gccacugcaguccagccugggc

SEQ ID NO: 963740 - RNA, 24 nt, Human
gccacugcaguccagccugggcaa

SEQ ID NO: 963741 - RNA, 24 nt, Human
gccauguugcccaggcuggucuug

SEQ ID NO: 963742 - RNA, 23 nt, Human
gccccagcuaauuuuuguauuuu

SEQ ID NO: 963743 - RNA, 19 nt, Human
ggaaaacaguuuuuguaga

SEQ ID NO: 963744 - RNA, 24 nt, Human
ggagaccagccuggccaacauggu

SEQ ID NO: 963745 - RNA, 25 nt, Human
ggagaucauauccucgugcaucuuc

SEQ ID NO: 963746 - RNA, 22 nt, Human
ggagccuggaagaagagcaacu

SEQ ID NO: 963747 - RNA, 22 nt, Human
ggagguugcagugagcagagau

SEQ ID NO: 963748 - RNA, 23 nt, Human
ggagguugcagugagcagagauc

SEQ ID NO: 963749 - RNA, 24 nt, Human
ggagguugcagugagcagagauca

SEQ ID NO: 963750 - RNA, 20 nt, Human
ggagguugcagugagcaggc

SEQ ID NO: 963751 - RNA, 21 nt, Human
ggccuauuuacuugcagagaa

SEQ ID NO: 963752 - RNA, 23 nt, Human
ggcgugguggcaggcgccuguaa

SEQ ID NO: 963753 - RNA, 18 nt, Human
ggcuggucuugaacuccu

SEQ ID NO: 963754 - RNA, 24 nt, Human
gggaucuacccgccuuggucuccc

SEQ ID NO: 963755 - RNA, 24 nt, Human
gggggcugugacucacgccuguaa

SEQ ID NO: 963756 - RNA, 22 nt, Human
gggguuucgccauguugcccag

SEQ ID NO: 963757 - RNA, 23 nt, Human
gggguuucgccauguugcccagg

SEQ ID NO: 963758 - RNA, 19 nt, Human
gggugaaucacgaggucag

SEQ ID NO: 963759 - RNA, 20 nt, Human
gugcgagacucugucucaaa

SEQ ID NO: 963760 - RNA, 20 nt, Human
uaaauaaauuaccugggugu

SEQ ID NO: 963761 - RNA, 22 nt, Human
uaagaauacaaaaaauuagcug

SEQ ID NO: 963762 - RNA, 18 nt, Human
uaagauaaauggagugac

SEQ ID NO: 963763 - RNA, 21 nt, Human
uaagauaaauggagugacucg

SEQ ID NO: 963764 - RNA, 22 nt, Human
uaauuuuuguauuuuuaguaga

SEQ ID NO: 963765 - RNA, 22 nt, Human
uacaggcaugagccaccacgcc

SEQ ID NO: 963766 - RNA, 21 nt, Human
uacaucuaaguuuccuauuuu

SEQ ID NO: 963767 - RNA, 22 nt, Human
uaccaauauucacagaggccaa

SEQ ID NO: 963768 - RNA, 20 nt, Human
uaccagagcucaacuuguuc

SEQ ID NO: 963769 - RNA, 23 nt, Human
uacccgccuuggucucccaaagu

SEQ ID NO: 963770 - RNA, 22 nt, Human
uaccgucaccaccgcugaccgg

SEQ ID NO: 963771 - RNA, 22 nt, Human
uagaaaugggguuucgccaugu

SEQ ID NO: 963772 - RNA, 20 nt, Human
uagcuauuaagaucaguuac

SEQ ID NO: 963773 - RNA, 24 nt, Human
uaguagaaaugggguuucgccaug

SEQ ID NO: 963774 - RNA, 26 nt, Human
uauuuacaauuauaccaauauucaca

SEQ ID NO: 963775 - RNA, 24 nt, Human
ucacgaggucaggagauggagacc

SEQ ID NO: 963776 - RNA, 23 nt, Human
ucacgccacugcaguccagccug

SEQ ID NO: 963777 - RNA, 23 nt, Human
ucagcugccucgcucugcucucc

SEQ ID NO: 963778 - RNA, 23 nt, Human
uccaucucaaaaaaaaaaaaaaa

SEQ ID NO: 963779 - RNA, 24 nt, Human
ucccaaagugcucagauuacaggc

SEQ ID NO: 963780 - RNA, 18 nt, Human
uccgccaacggccccgcc

SEQ ID NO: 963781 - RNA, 21 nt, Human
uccgggcaaggcccccaaucc

SEQ ID NO: 963782 - RNA, 21 nt, Human
ucgccauguugcccaggcugg

SEQ ID NO: 963783 - RNA, 22 nt, Human
ucgccauguugcccaggcuggu

SEQ ID NO: 963784 - RNA, 24 nt, Human
ucgcuugaacccgggaggcggagg

SEQ ID NO: 963785 - RNA, 24 nt, Human
ucucuacuaagaauacaaaaaauu

SEQ ID NO: 963786 - RNA, 21 nt, Human
ucuugaacuccugggcacaag

SEQ ID NO: 963787 - RNA, 19 nt, Human
ugaaaccccaucucuacua

SEQ ID NO: 963788 - RNA, 24 nt, Human
ugaacuccugggcacaagggaucu

SEQ ID NO: 963789 - RNA, 18 nt, Human
ugacauuauuuacaauua

SEQ ID NO: 963790 - RNA, 21 nt, Human
ugaccgggaaggcugagcccu

SEQ ID NO: 963791 - RNA, 21 nt, Human
ugacucacgccuguaauccca

SEQ ID NO: 963792 - RNA, 22 nt, Human
ugacucacgccuguaaucccag

SEQ ID NO: 963793 - RNA, 24 nt, Human
ugacucacgccuguaaucccagca

SEQ ID NO: 963794 - RNA, 24 nt, Human
ugaggcaagagaacugcuugaacc

SEQ ID NO: 963795 - RNA, 25 nt, Human
ugaggcaagagaacugcuugaaccc

SEQ ID NO: 963796 - RNA, 24 nt, Human
ugaggcuggagaaucgcuugaacc

SEQ ID NO: 963797 - RNA, 24 nt, Human
ugcccaggcuggucuugaacuccu

SEQ ID NO: 963798 - RNA, 28 nt, Human
ugcccaggcuggucuugaacuccugggc

SEQ ID NO: 963799 - RNA, 20 nt, Human
ugccucgcucugcucucccu

SEQ ID NO: 963800 - RNA, 24 nt, Human
ugccuguaaucccagcuacccagg

SEQ ID NO: 963801 - RNA, 19 nt, Human
uggaagaagagcaacucgg

SEQ ID NO: 963802 - RNA, 24 nt, Human
uggcagcgcgugccuguaauccca

SEQ ID NO: 963803 - RNA, 24 nt, Human
uggccaacauggugaaaccccauc

SEQ ID NO: 963804 - RNA, 23 nt, Human
uggccgggggcugugacucacgg

SEQ ID NO: 963805 - RNA, 19 nt, Human
ugggaggccgaggcgggug

SEQ ID NO: 963806 - RNA, 24 nt, Human
ugggaggccgaggcgggugaauca

SEQ ID NO: 963807 - RNA, 24 nt, Human
ugggguuucgccauguugcccagg

SEQ ID NO: 963808 - RNA, 24 nt, Human
ugguggcaggcgccuguaauccca

SEQ ID NO: 963809 - RNA, 19 nt, Human
ugucacaggcauuaagggc

SEQ ID NO: 963810 - RNA, 24 nt, Human
ugugacucacgccuguaaucccag

SEQ ID NO: 963811 - RNA, 22 nt, Human
uuaccuggguguggcagcgcgu

SEQ ID NO: 963812 - RNA, 18 nt, Human
uuagcugggcgugguggc

SEQ ID NO: 963813 - RNA, 22 nt, Human
uuagcugggcgugguggcaggc

SEQ ID NO: 963814 - RNA, 24 nt, Human
uuagcugggcgugguggcaggcgc

SEQ ID NO: 963815 - RNA, 18 nt, Human
uuaguagaaaugggguuu

SEQ ID NO: 963816 - RNA, 22 nt, Human
uuaguagaaaugggguuucgcc

SEQ ID NO: 963817 - RNA, 24 nt, Human
uuaguagaaaugggguuucgccau

SEQ ID NO: 963818 - RNA, 18 nt, Human
uucauaugcuguccaauu

SEQ ID NO: 963819 - RNA, 24 nt, Human
uugaacccgggaggcggagguugc

SEQ ID NO: 963820 - RNA, 20 nt, Human
uugcagugagcagagaucac

SEQ ID NO: 963821 - RNA, 21 nt, Human
uugcagugagcagagaucacg

SEQ ID NO: 963822 - RNA, 25 nt, Human
uugggaggccgaggcgggugaauca

SEQ ID NO: 963823 - RNA, 23 nt, Human
uuguauuuuuaguagaaaugggg

SEQ ID NO: 963824 - RNA, 22 nt, Human
uuuaagauaaauggagugacuc

SEQ ID NO: 963825 - RNA, 22 nt, Human
uuucgccauguugcccaggcug

SEQ ID NO: 963826 - RNA, 24 nt, Human
uuucgccauguugcccaggcuggu

SEQ ID NO: 963827 - RNA, 22 nt, Human
uuuuuaguagaaaugggguuuc

SEQ ID NO: 963828 - RNA, 18 nt, Human
uuuuuguauuuuuaguag

SEQ ID NO: 963829 - RNA, 21 nt, Human
aaaaaacacugggaaggggua

SEQ ID NO: 963830 - RNA, 25 nt, Human
aaaagcccaggcgcugucucgggug

SEQ ID NO: 963831 - RNA, 21 nt, Human
aaccgcugagcccgccuacca

SEQ ID NO: 963832 - RNA, 21 nt, Human
aaggcaggacuggggacucug

SEQ ID NO: 963833 - RNA, 18 nt, Human
acaagaaaaagcacgugg

SEQ ID NO: 963834 - RNA, 19 nt, Human
acagagcaagacuaugucu

SEQ ID NO: 963835 - RNA, 21 nt, Human
acagagcaagacuaugucucu

SEQ ID NO: 963836 - RNA, 24 nt, Human
accguacuccagcauggguaacag

SEQ ID NO: 963837 - RNA, 23 nt, Human
acguggauccacgggucgugcuu

SEQ ID NO: 963838 - RNA, 21 nt, Human
acuccaaauucagggucgcug

SEQ ID NO: 963839 - RNA, 24 nt, Human
acuccagcauggguaacagagcaa

SEQ ID NO: 963840 - RNA, 21 nt, Human
agcgcucagcguggggcgggg

SEQ ID NO: 963841 - RNA, 21 nt, Human
aggcaggacuggggacucuga

SEQ ID NO: 963842 - RNA, 24 nt, Human
aggcaggacuggggacucugaguu

SEQ ID NO: 963843 - RNA, 24 nt, Human
aggcugagaugggaggauugcuug

SEQ ID NO: 963844 - RNA, 24 nt, Human
caaccaggcccuuucucccgcccc

SEQ ID NO: 963845 - RNA, 21 nt, Human
cagagcaagacuaugucucuc

SEQ ID NO: 963846 - RNA, 18 nt, Human
caggguggggguggaggg

SEQ ID NO: 963847 - RNA, 24 nt, Human
ccacaggaauaaaaaacacuggga

SEQ ID NO: 963848 - RNA, 20 nt, Human
ccaccguacuccagcauggg

SEQ ID NO: 963849 - RNA, 20 nt, Human
ccaccguacuccagcauggg

SEQ ID NO: 963850 - RNA, 21 nt, Human
ccaccguacuccagcaugggu

SEQ ID NO: 963851 - RNA, 23 nt, Human
ccaggcccuuucucccgccccuc

SEQ ID NO: 963852 - RNA, 23 nt, Human
cccacaggaauaaaaaacacugg

SEQ ID NO: 963853 - RNA, 19 nt, Human
ccccgccccuucgcgcccg

SEQ ID NO: 963854 - RNA, 21 nt, Human
cccgccccuucgcgcccggga

SEQ ID NO: 963855 - RNA, 18 nt, Human
cccucaagggguugcagg

SEQ ID NO: 963856 - RNA, 20 nt, Human
ccgcgggcgggaaaaagccc

SEQ ID NO: 963857 - RNA, 20 nt, Human
ccuuuccuccccgccccuuc

SEQ ID NO: 963858 - RNA, 23 nt, Human
cgggaaaaagcccaggcgcuguc

SEQ ID NO: 963859 - RNA, 23 nt, Human
cuaaggcaggacuggggacucug

SEQ ID NO: 963860 - RNA, 19 nt, Human
cucugcggcugaaacccuc

SEQ ID NO: 963861 - RNA, 24 nt, Human
gagaugggaggauugcuugaaucc

SEQ ID NO: 963862 - RNA, 21 nt, Human
gcaggguggggguggaggggu

SEQ ID NO: 963863 - RNA, 24 nt, Human
gccaccguacuccagcauggguaa

SEQ ID NO: 963864 - RNA, 20 nt, Human
gcucagcguggggcggggcu

SEQ ID NO: 963865 - RNA, 22 nt, Human
ggaggauugcuugaauccagga

SEQ ID NO: 963866 - RNA, 22 nt, Human
ggcgacggcagcggcuccaacc

SEQ ID NO: 963867 - RNA, 25 nt, Human
gggaaaaagcccaggcgcugucucg

SEQ ID NO: 963868 - RNA, 20 nt, Human
gggcaggguggggguggagg

SEQ ID NO: 963869 - RNA, 22 nt, Human
gggcaggguggggguggagggg

SEQ ID NO: 963870 - RNA, 18 nt, Human
ggguggggguggaggggu

SEQ ID NO: 963871 - RNA, 24 nt, Human
guacuccagcauggguaacagagc

SEQ ID NO: 963872 - RNA, 18 nt, Human
gugcggcuggcgaugugg

SEQ ID NO: 963873 - RNA, 20 nt, Human
guggggguggaggggugcgg

SEQ ID NO: 963874 - RNA, 23 nt, Human
uacuccagcauggguaacagagc

SEQ ID NO: 963875 - RNA, 22 nt, Human
uagcccaaagcgauucaugcgg

SEQ ID NO: 963876 - RNA, 19 nt, Human
ucagccauccucuggucuc

SEQ ID NO: 963877 - RNA, 20 nt, Human
uccaaccugccuccguuacg

SEQ ID NO: 963878 - RNA, 20 nt, Human
uccagcauggguaacagagc

SEQ ID NO: 963879 - RNA, 21 nt, Human
ucccgccccucugcggcugaa

SEQ ID NO: 963880 - RNA, 22 nt, Human
uccgggcgguuggcccgccucg

SEQ ID NO: 963881 - RNA, 21 nt, Human
ucgcccuguaguccuuagcua

SEQ ID NO: 963882 - RNA, 19 nt, Human
ucgcucugcuuuuucauau

SEQ ID NO: 963883 - RNA, 22 nt, Human
ucucccgccccucugcggcuga

SEQ ID NO: 963884 - RNA, 22 nt, Human
ucugagugagaggucagacgcu

SEQ ID NO: 963885 - RNA, 18 nt, Human
ugagaugggaggauugcu

SEQ ID NO: 963886 - RNA, 21 nt, Human
ugcuuuuucauauucuucugg

SEQ ID NO: 963887 - RNA, 18 nt, Human
uggcaacguagcacaguc

SEQ ID NO: 963888 - RNA, 23 nt, Human
uggcgacggcagcggcuccaacc

SEQ ID NO: 963889 - RNA, 21 nt, Human
ugggcaggguggggguggagg

SEQ ID NO: 963890 - RNA, 22 nt, Human
ugggcaggguggggguggaggg

SEQ ID NO: 963891 - RNA, 19 nt, Human
ugggcgcgaaccgcugagc

SEQ ID NO: 963892 - RNA, 20 nt, Human
ugggcgcgaaccgcugagcc

SEQ ID NO: 963893 - RNA, 23 nt, Human
uggggaaacuaaggcaggacugg

SEQ ID NO: 963894 - RNA, 25 nt, Human
uggggaaacuaaggcaggacugggg

SEQ ID NO: 963895 - RNA, 21 nt, Human
uguaguccuuagcuacucagg

SEQ ID NO: 963896 - RNA, 24 nt, Human
uugcagguucagcuuucacuuaga

SEQ ID NO: 963897 - RNA, 24 nt, Human
uuuuuuuuuuuuuuuuuuacaaag

SEQ ID NO: 963898 - RNA, 20 nt, Human
acccagacucugucuccccc

SEQ ID NO: 963899 - RNA, 21 nt, Human
acuaccauccuaggcugggcc

SEQ ID NO: 963900 - RNA, 20 nt, Human
acuuccacaaacuggaaccg

SEQ ID NO: 963901 - RNA, 21 nt, Human
agacagcagcccuggaaccca

SEQ ID NO: 963902 - RNA, 23 nt, Human
agacagcagcccuggaacccaga

SEQ ID NO: 963903 - RNA, 21 nt, Human
aggccaggguugcugugauug

SEQ ID NO: 963904 - RNA, 23 nt, Human
auacaagaaccuuuuauuuucca

SEQ ID NO: 963905 - RNA, 19 nt, Human
auaguuccaggcccagagc

SEQ ID NO: 963906 - RNA, 25 nt, Human
auaguuccaggcccagagcuacagc

SEQ ID NO: 963907 - RNA, 24 nt, Human
auccaguugggcagcagggaaagg

SEQ ID NO: 963908 - RNA, 18 nt, Human
aucucgcuccuuccccug

SEQ ID NO: 963909 - RNA, 25 nt, Human
caucccuggccuuguuguggggcuc

SEQ ID NO: 963910 - RNA, 22 nt, Human
ccacgugcugggguucgcucau

SEQ ID NO: 963911 - RNA, 21 nt, Human
ccagagcuacagcugggcugg

SEQ ID NO: 963912 - RNA, 24 nt, Human
ccagagcuacagcugggcugggag

SEQ ID NO: 963913 - RNA, 18 nt, Human
cccgcccuuccuuccucc

SEQ ID NO: 963914 - RNA, 20 nt, Human
cccgcccuuccuuccuccag

SEQ ID NO: 963915 - RNA, 20 nt, Human
cccuggaacccagacucugu

SEQ ID NO: 963916 - RNA, 21 nt, Human
cuagugaggccuguccccacc

SEQ ID NO: 963917 - RNA, 19 nt, Human
cuggaacccagacucuguc

SEQ ID NO: 963918 - RNA, 22 nt, Human
gagacagcagcccuggaaccca

SEQ ID NO: 963919 - RNA, 21 nt, Human
gaggggaguguauccugcagu

SEQ ID NO: 963920 - RNA, 18 nt, Human
gauugccugggacuucca

SEQ ID NO: 963921 - RNA, 22 nt, Human
gcagcagggaaaggcuaggugg

SEQ ID NO: 963922 - RNA, 20 nt, Human
gcugaguugugaaguugcau

SEQ ID NO: 963923 - RNA, 21 nt, Human
ggcccagagcuacagcugggc

SEQ ID NO: 963924 - RNA, 18 nt, Human
gggaaaggcuaggugggc

SEQ ID NO: 963925 - RNA, 20 nt, Human
gggcagggccgaggccaggg

SEQ ID NO: 963926 - RNA, 22 nt, Human
gggcagggccgaggccaggguu

SEQ ID NO: 963927 - RNA, 19 nt, Human
gggccgaggccaggguugc

SEQ ID NO: 963928 - RNA, 21 nt, Human
guauccgaaguaguccucuuu

SEQ ID NO: 963929 - RNA, 22 nt, Human
gugcacuguaagaaggagcuga

SEQ ID NO: 963930 - RNA, 22 nt, Human
uaagaaggagcugaugauacug

SEQ ID NO: 963931 - RNA, 26 nt, Human
uacagcugggcugggagcgugugugu

SEQ ID NO: 963932 - RNA, 18 nt, Human
uacuggccacgugcuggg

SEQ ID NO: 963933 - RNA, 18 nt, Human
uagguagcaggaggggag

SEQ ID NO: 963934 - RNA, 23 nt, Human
uaggugggcccagcccgcccuuc

SEQ ID NO: 963935 - RNA, 25 nt, Human
uccacaaacuggaaccgcuuaggga

SEQ ID NO: 963936 - RNA, 19 nt, Human
uccccaccaucccuggccu

SEQ ID NO: 963937 - RNA, 22 nt, Human
uccccaccaucccuggccuugu

SEQ ID NO: 963938 - RNA, 21 nt, Human
ugcauggcagggacagggcag

SEQ ID NO: 963939 - RNA, 19 nt, Human
ugcugggguucgcucaugu

SEQ ID NO: 963940 - RNA, 21 nt, Human
uggaacccagacucugucucc

SEQ ID NO: 963941 - RNA, 20 nt, Human
uggcagggacagggcagggc

SEQ ID NO: 963942 - RNA, 20 nt, Human
ugggagcgugugugugcacu

SEQ ID NO: 963943 - RNA, 21 nt, Human
ugggcagcagggaaaggcuag

SEQ ID NO: 963944 - RNA, 23 nt, Human
uugccugggacuuccacaaacug

SEQ ID NO: 963945 - RNA, 23 nt, Human
uuggaggccucccaggggucuag

SEQ ID NO: 963946 - RNA, 24 nt, Human
uugggcagcagggaaaggcuaggu

SEQ ID NO: 963947 - RNA, 19 nt, Human
aaaacccaaaaccugcccu

SEQ ID NO: 963948 - RNA, 21 nt, Human
aaacaaguacagagacugauu

SEQ ID NO: 963949 - RNA, 23 nt, Human
aaacacaaacaacaacuuaaagc

SEQ ID NO: 963950 - RNA, 19 nt, Human
aaacuuggaaugacucaug

SEQ ID NO: 963951 - RNA, 18 nt, Human
aacaaagggaagacuaaa

SEQ ID NO: 963952 - RNA, 23 nt, Human
aaggcaccugcuaugaauuuagc

SEQ ID NO: 963953 - RNA, 19 nt, Human
aagggagugugcuuucagu

SEQ ID NO: 963954 - RNA, 18 nt, Human
acaaacaacaacuuaaag

SEQ ID NO: 963955 - RNA, 23 nt, Human
acucgccugccuccucuggagcc

SEQ ID NO: 963956 - RNA, 21 nt, Human
acuguucuccauguuugaggg

SEQ ID NO: 963957 - RNA, 24 nt, Human
agacauuuagaagcuuuuaaaacu

SEQ ID NO: 963958 - RNA, 25 nt, Human
agaugcuaaagguuguggcaaaacu

SEQ ID NO: 963959 - RNA, 23 nt, Human
agccaaauaucuauaguaaacca

SEQ ID NO: 963960 - RNA, 24 nt, Human
agccaauacuugcaguuuucaaca

SEQ ID NO: 963961 - RNA, 19 nt, Human
agcgcggagugaaagagga

SEQ ID NO: 963962 - RNA, 24 nt, Human
aggaggaagagaacuggccgccgg

SEQ ID NO: 963963 - RNA, 23 nt, Human
auaaacaaaccuucccugacuga

SEQ ID NO: 963964 - RNA, 19 nt, Human
augcuaaaaugucuuaugg

SEQ ID NO: 963965 - RNA, 21 nt, Human
augcuaaaaugucuuauggca

SEQ ID NO: 963966 - RNA, 18 nt, Human
caaaaucuagacccuguc

SEQ ID NO: 963967 - RNA, 19 nt, Human
caaagcaaacacaagcagc

SEQ ID NO: 963968 - RNA, 19 nt, Human
caagccgggcgccggccgc

SEQ ID NO: 963969 - RNA, 24 nt, Human
cacaguaacuaauuaagucagaaa

SEQ ID NO: 963970 - RNA, 20 nt, Human
caccaccugccccggccacc

SEQ ID NO: 963971 - RNA, 18 nt, Human
caguacuagaaaacccaa

SEQ ID NO: 963972 - RNA, 20 nt, Human
cccgcgccgccggagcgccg

SEQ ID NO: 963973 - RNA, 26 nt, Human
ccgccgggucguucucgcgccgccgu

SEQ ID NO: 963974 - RNA, 21 nt, Human
ccgccgucgccgccgcuuugg

SEQ ID NO: 963975 - RNA, 31 nt, Human
ccgccgucgccgccgcuuuggccgccgccgg

SEQ ID NO: 963976 - RNA, 24 nt, Human
ccgcugcgaggcucggcucguggu

SEQ ID NO: 963977 - RNA, 21 nt, Human
cgaggcucggcucguggugcc

SEQ ID NO: 963978 - RNA, 18 nt, Human
cgccgccgucgccgccgc

SEQ ID NO: 963979 - RNA, 20 nt, Human
cgcgccgccgucgccgccgc

SEQ ID NO: 963980 - RNA, 20 nt, Human
cgcgccgccgucgccgccgc

SEQ ID NO: 963981 - RNA, 19 nt, Human
cgggcgccggccgccgacu

SEQ ID NO: 963982 - RNA, 19 nt, Human
cucacccuuaccauuagua

SEQ ID NO: 963983 - RNA, 18 nt, Human
cucccuuacuguucucca

SEQ ID NO: 963984 - RNA, 18 nt, Human
cugacuucacuccaccac

SEQ ID NO: 963985 - RNA, 18 nt, Human
gaaacaaguacagagacu

SEQ ID NO: 963986 - RNA, 22 nt, Human
gaggguaucagaagcccccugu

SEQ ID NO: 963987 - RNA, 21 nt, Human
gcacaaccauaaaacagaauu

SEQ ID NO: 963988 - RNA, 22 nt, Human
gcaguuuucaacaguacuagaa

SEQ ID NO: 963989 - RNA, 18 nt, Human
gcgccaccaccugccccg

SEQ ID NO: 963990 - RNA, 19 nt, Human
ggaaacaaguacagagacu

SEQ ID NO: 963991 - RNA, 24 nt, Human
ggaaugacucaugaagaaaccuug

SEQ ID NO: 963992 - RNA, 20 nt, Human
ggcaggugcgcaggaggaag

SEQ ID NO: 963993 - RNA, 21 nt, Human
gggaaacaaguacagagacug

SEQ ID NO: 963994 - RNA, 18 nt, Human
gggaaugcaauuuuuuac

SEQ ID NO: 963995 - RNA, 20 nt, Human
uaaaaaacacaaacaacaac

SEQ ID NO: 963996 - RNA, 23 nt, Human
uaaaaaacacaaacaacaacuua

SEQ ID NO: 963997 - RNA, 26 nt, Human
uaaaacagaauuaguuaaccaagaca

SEQ ID NO: 963998 - RNA, 19 nt, Human
uaaagguuguggcaaaacu

SEQ ID NO: 963999 - RNA, 21 nt, Human
uacauagacacugcucagguu

SEQ ID NO: 964000 - RNA, 22 nt, Human
uacauuaaaaaacacaaacaac

SEQ ID NO: 964001 - RNA, 18 nt, Human
uacggccgcugggccugg

SEQ ID NO: 964002 - RNA, 19 nt, Human
uagaaaacccaaaaccugc

SEQ ID NO: 964003 - RNA, 25 nt, Human
uagaaaacccaaaaccugcccuaug

SEQ ID NO: 964004 - RNA, 23 nt, Human
uauaaaaaccacaagacuucaaa

SEQ ID NO: 964005 - RNA, 21 nt, Human
uaucagaagcccccugugagg

SEQ ID NO: 964006 - RNA, 20 nt, Human
uaugacccucacccuuacca

SEQ ID NO: 964007 - RNA, 23 nt, Human
ucaacaguacuagaaaacccaaa

SEQ ID NO: 964008 - RNA, 20 nt, Human
ucagaagcccccugugaggu

SEQ ID NO: 964009 - RNA, 18 nt, Human
ucaggccagacgcuagcu

SEQ ID NO: 964010 - RNA, 23 nt, Human
uccagaauaguuaaguuccugaa

SEQ ID NO: 964011 - RNA, 26 nt, Human
uccucuuaaaacagcuuauuuuaaaa

SEQ ID NO: 964012 - RNA, 24 nt, Human
uccugaaaguccuuaaccacucug

SEQ ID NO: 964013 - RNA, 22 nt, Human
ucuagaaaaagcauuugcaaac

SEQ ID NO: 964014 - RNA, 18 nt, Human
ucucgcgccgccgucgcc

SEQ ID NO: 964015 - RNA, 22 nt, Human
ucucgcgccgccgucgccgccg

SEQ ID NO: 964016 - RNA, 19 nt, Human
ucugcucccuuacuguucu

SEQ ID NO: 964017 - RNA, 21 nt, Human
ucuuuccaacgcauuaauaca

SEQ ID NO: 964018 - RNA, 22 nt, Human
ugaaaaaucauuaaucuagaaa

SEQ ID NO: 964019 - RNA, 25 nt, Human
ugacuaaaagcaaagaauaaggcac

SEQ ID NO: 964020 - RNA, 24 nt, Human
ugacuucacuccaccacgguagcu

SEQ ID NO: 964021 - RNA, 24 nt, Human
ugaggcaggaugcuuuacugaauu

SEQ ID NO: 964022 - RNA, 19 nt, Human
ugccccggccaccccucgg

SEQ ID NO: 964023 - RNA, 25 nt, Human
ugcucccuuacuguucuccauguuu

SEQ ID NO: 964024 - RNA, 24 nt, Human
ugcuuuacugaauuguuuucaacc

SEQ ID NO: 964025 - RNA, 21 nt, Human
ugcuuucaguucaaaagagua

SEQ ID NO: 964026 - RNA, 19 nt, Human
ugguauggacuagaaaacu

SEQ ID NO: 964027 - RNA, 23 nt, Human
ugguauggacuagaaaacuugga

SEQ ID NO: 964028 - RNA, 23 nt, Human
uuaaaagaaauauccugaggcaa

SEQ ID NO: 964029 - RNA, 18 nt, Human
uucacgcuguguauagac

SEQ ID NO: 964030 - RNA, 21 nt, Human
uucccugacugacuucacucc

SEQ ID NO: 964031 - RNA, 24 nt, Human
uuguacauuaaaaaacacaaacaa

SEQ ID NO: 964032 - RNA, 18 nt, Human
aggggagggguugaggag

SEQ ID NO: 964033 - RNA, 24 nt, Human
ccagggagggggccagggauggag

SEQ ID NO: 964034 - RNA, 22 nt, Human
ccugaagcugaggagacagggc

SEQ ID NO: 964035 - RNA, 19 nt, Human
cggaggagcaaacaggggc

SEQ ID NO: 964036 - RNA, 22 nt, Human
cggaggagcaaacaggggcuaa

SEQ ID NO: 964037 - RNA, 18 nt, Human
cgggggaggcugcuggug

SEQ ID NO: 964038 - RNA, 25 nt, Human
cucguccguauuuaagcaguggauc

SEQ ID NO: 964039 - RNA, 21 nt, Human
gagucgcccgccuacgcugcc

SEQ ID NO: 964040 - RNA, 24 nt, Human
ggccagggauggaggggagggguu

SEQ ID NO: 964041 - RNA, 23 nt, Human
gggagggguugaggagcgagagg

SEQ ID NO: 964042 - RNA, 20 nt, Human
gggccagggauggaggggag

SEQ ID NO: 964043 - RNA, 19 nt, Human
gggggccagggauggaggg

SEQ ID NO: 964044 - RNA, 24 nt, Human
guggauccagaggggcaacggggg

SEQ ID NO: 964045 - RNA, 20 nt, Human
ucagugguggugccugaagc

SEQ ID NO: 964046 - RNA, 26 nt, Human
uccagaggggcaacgggggagggaag

SEQ ID NO: 964047 - RNA, 21 nt, Human
ugaggagacagggcccugucc

SEQ ID NO: 964048 - RNA, 18 nt, Human
ugcccggacgcuuugccu

SEQ ID NO: 964049 - RNA, 24 nt, Human
ugccugaagcugaggagacagggc

SEQ ID NO: 964050 - RNA, 22 nt, Human
ugccugggcaguguacagcuuu

SEQ ID NO: 964051 - RNA, 21 nt, Human
ugguggugccugaagcugagg

SEQ ID NO: 964052 - RNA, 23 nt, Human
uuuuuuuuuuuuuuuuuuuccag

SEQ ID NO: 964053 - RNA, 25 nt, Human
aaaagucuuaagcagcaugccauuc

SEQ ID NO: 964054 - RNA, 24 nt, Human
aacaaaaggaacacucuccccugc

SEQ ID NO: 964055 - RNA, 18 nt, Human
aaccugggcaguaaggaa

SEQ ID NO: 964056 - RNA, 19 nt, Human
aagccuuucaagccucuuu

SEQ ID NO: 964057 - RNA, 20 nt, Human
accaugguccaaaaacauua

SEQ ID NO: 964058 - RNA, 22 nt, Human
acgcaccuuccuagacagaacc

SEQ ID NO: 964059 - RNA, 20 nt, Human
agcauggugaggacgcaccu

SEQ ID NO: 964060 - RNA, 23 nt, Human
agcauggugaggacgcaccuucc

SEQ ID NO: 964061 - RNA, 21 nt, Human
aucccugccuccccucagccc

SEQ ID NO: 964062 - RNA, 22 nt, Human
caagccucuuucccuuggccuc

SEQ ID NO: 964063 - RNA, 23 nt, Human
caagccucuuucccuuggccucc

SEQ ID NO: 964064 - RNA, 21 nt, Human
cagcacacaucccugccuccc

SEQ ID NO: 964065 - RNA, 23 nt, Human
cagcacacaucccugccuccccu

SEQ ID NO: 964066 - RNA, 18 nt, Human
cagcccugggaaggggag

SEQ ID NO: 964067 - RNA, 20 nt, Human
cagcucaccugccacuucuc

SEQ ID NO: 964068 - RNA, 23 nt, Human
cccaaugucuccacacugucuau

SEQ ID NO: 964069 - RNA, 20 nt, Human
ccggcagugagugguggugg

SEQ ID NO: 964070 - RNA, 23 nt, Human
ccuggacuaggacaccauccagc

SEQ ID NO: 964071 - RNA, 23 nt, Human
cgcgaagugcuuaugcguguccu

SEQ ID NO: 964072 - RNA, 22 nt, Human
cucaucuacccaacccuuugga

SEQ ID NO: 964073 - RNA, 22 nt, Human
cuccacacugucuaugcuccuc

SEQ ID NO: 964074 - RNA, 20 nt, Human
cuccccucagcccugggaag

SEQ ID NO: 964075 - RNA, 21 nt, Human
cuccuggacuaggacaccauc

SEQ ID NO: 964076 - RNA, 23 nt, Human
gaacacccuaaacuaguuaagaa

SEQ ID NO: 964077 - RNA, 21 nt, Human
gcucaccugccacuucucagc

SEQ ID NO: 964078 - RNA, 26 nt, Human
guagcccaguaauuccugggugcucc

SEQ ID NO: 964079 - RNA, 24 nt, Human
uaaacuaguuaagaacaaaaggaa

SEQ ID NO: 964080 - RNA, 22 nt, Human
uaaggaaucaccagcucaccug

SEQ ID NO: 964081 - RNA, 19 nt, Human
uagacagaaccugggcagu

SEQ ID NO: 964082 - RNA, 18 nt, Human
uagcccaguaauuccugg

SEQ ID NO: 964083 - RNA, 25 nt, Human
uaguagccuucucuauaaucaguuu

SEQ ID NO: 964084 - RNA, 27 nt, Human
uccaaaaacauuaaaugaaaaauucca

SEQ ID NO: 964085 - RNA, 23 nt, Human
uccaugguuuugcuuucugcagu

SEQ ID NO: 964086 - RNA, 21 nt, Human
ucccccucagauaagugggga

SEQ ID NO: 964087 - RNA, 20 nt, Human
ucccugccuccccucagccc

SEQ ID NO: 964088 - RNA, 19 nt, Human
ucucagcccugggacagca

SEQ ID NO: 964089 - RNA, 22 nt, Human
ucugcagucucaguuaaccaug

SEQ ID NO: 964090 - RNA, 24 nt, Human
ugccuaauuuauaaauuaaacuuu

SEQ ID NO: 964091 - RNA, 21 nt, Human
uggagucuaggccaggagcuc

SEQ ID NO: 964092 - RNA, 22 nt, Human
ugggugcuccuggacauauauc

SEQ ID NO: 964093 - RNA, 20 nt, Human
uuaguagccuucucuauaau

SEQ ID NO: 964094 - RNA, 18 nt, Human
uucaagccucuuucccuu

SEQ ID NO: 964095 - RNA, 23 nt, Human
uuccugcagaggagccccuugug

SEQ ID NO: 964096 - RNA, 23 nt, Human
uugcauuguccugcucuguccca

SEQ ID NO: 964097 - RNA, 19 nt, Human
acagugcugaggcucuggg

SEQ ID NO: 964098 - RNA, 24 nt, Human
agaugccuaaaguuagacacaacu

SEQ ID NO: 964099 - RNA, 23 nt, Human
cagacagugcugaggcucugggu

SEQ ID NO: 964100 - RNA, 21 nt, Human
ccaaagucagacagugcugag

SEQ ID NO: 964101 - RNA, 18 nt, Human
cucccgcucuccaaaaca

SEQ ID NO: 964102 - RNA, 21 nt, Human
ggaaaccucccgcucuccaaa

SEQ ID NO: 964103 - RNA, 22 nt, Human
uaaaagaugccuaaaguuagac

SEQ ID NO: 964104 - RNA, 25 nt, Human
uaaaagaugccuaaaguuagacaca

SEQ ID NO: 964105 - RNA, 23 nt, Human
uccaaaacauuucugugggaucc

SEQ ID NO: 964106 - RNA, 19 nt, Human
ucccaaagucagacagugc

SEQ ID NO: 964107 - RNA, 19 nt, Human
ucccaaagucagacagugc

SEQ ID NO: 964108 - RNA, 22 nt, Human
ucugugggaucccugguuccca

SEQ ID NO: 964109 - RNA, 19 nt, Human
ugaggcuguuucugcuggc

SEQ ID NO: 964110 - RNA, 18 nt, Human
ugcugaggcucugggugg

SEQ ID NO: 964111 - RNA, 21 nt, Human
uggaggagauugggggaaacc

SEQ ID NO: 964112 - RNA, 22 nt, Human
uggaggagauugggggaaaccu

SEQ ID NO: 964113 - RNA, 19 nt, Human
uggagggagaagaacuugg

SEQ ID NO: 964114 - RNA, 22 nt, Human
uggagggagaagaacuuggagg

SEQ ID NO: 964115 - RNA, 24 nt, Human
aaacacucccugagccagagacac

SEQ ID NO: 964116 - RNA, 25 nt, Human
aacccagucaaauuuauuagagcaa

SEQ ID NO: 964117 - RNA, 30 nt, Human
agagaaauauacaaacauagagccuuccuu

SEQ ID NO: 964118 - RNA, 18 nt, Human
agcagggguuucucuccc

SEQ ID NO: 964119 - RNA, 22 nt, Human
caaacauagagccuuccuaugc

SEQ ID NO: 964120 - RNA, 21 nt, Human
cagccaacaaaguucagccag

SEQ ID NO: 964121 - RNA, 18 nt, Human
cagggguuucucucccuu

SEQ ID NO: 964122 - RNA, 18 nt, Human
caucaggggcugagcagg

SEQ ID NO: 964123 - RNA, 22 nt, Human
caucaggggcugagcagggguu

SEQ ID NO: 964124 - RNA, 20 nt, Human
cauucugaaugcucugccau

SEQ ID NO: 964125 - RNA, 21 nt, Human
ccaagcucacaucaaucacac

SEQ ID NO: 964126 - RNA, 19 nt, Human
cuuccacagccaacaaagu

SEQ ID NO: 964127 - RNA, 23 nt, Human
gaugcaucuaauauggacaggga

SEQ ID NO: 964128 - RNA, 23 nt, Human
gcaauuagccaauggccuuuuuc

SEQ ID NO: 964129 - RNA, 23 nt, Human
gccagagacacauaauaaccacc

SEQ ID NO: 964130 - RNA, 24 nt, Human
uaagagaugaagugagacaaccac

SEQ ID NO: 964131 - RNA, 19 nt, Human
ucccuugaaaacaggagau

SEQ ID NO: 964132 - RNA, 21 nt, Human
ucccuugaaaacaggagaugc

SEQ ID NO: 964133 - RNA, 23 nt, Human
ucugacaaagagaaauauacaaa

SEQ ID NO: 964134 - RNA, 21 nt, Human
ugaagugagacaaccacugag

SEQ ID NO: 964135 - RNA, 22 nt, Human
ugaaugcucugccauaggauug

SEQ ID NO: 964136 - RNA, 21 nt, Human
ugagacaaccacugagggagc

SEQ ID NO: 964137 - RNA, 24 nt, Human
uggaaggaaguuaaucuauaagag

SEQ ID NO: 964138 - RNA, 24 nt, Human
uucagccaggguucaaucuucauc

SEQ ID NO: 964139 - RNA, 19 nt, Human
agguaauaaagcacuaagc

SEQ ID NO: 964140 - RNA, 24 nt, Human
uaaagcacuaagcuugauuuuugu

SEQ ID NO: 964141 - RNA, 25 nt, Human
uggcucuauuaaaaacucagguaau

SEQ ID NO: 964142 - RNA, 18 nt, Human
uuuuuuuuuuuuuuucug

SEQ ID NO: 964143 - RNA, 22 nt, Human
uuuuuuuuuuuuuuuuuuuucu

SEQ ID NO: 964144 - RNA, 19 nt, Human
acauauugucuuaucaaag

SEQ ID NO: 964145 - RNA, 23 nt, Human
cacuaccuaaugaaccaaaguca

SEQ ID NO: 964146 - RNA, 18 nt, Human
cagcauuucuagacaaaa

SEQ ID NO: 964147 - RNA, 23 nt, Human
cagugucaucugcugaccaaugu

SEQ ID NO: 964148 - RNA, 18 nt, Human
cucuaaaaucuucauagg

SEQ ID NO: 964149 - RNA, 21 nt, Human
gaagaaagacaaugaaauuag

SEQ ID NO: 964150 - RNA, 20 nt, Human
gacuguugagcccuagguau

SEQ ID NO: 964151 - RNA, 24 nt, Human
gcagcgcuagcaucugauacccag

SEQ ID NO: 964152 - RNA, 26 nt, Human
gcagugaugggaaucugguuuccuuu

SEQ ID NO: 964153 - RNA, 22 nt, Human
gccuguuuuaccacuaccuaau

SEQ ID NO: 964154 - RNA, 20 nt, Human
ggagaaugauagaaaugagc

SEQ ID NO: 964155 - RNA, 18 nt, Human
gggacugcuauaacagaa

SEQ ID NO: 964156 - RNA, 21 nt, Human
ggugagacacauggugguaga

SEQ ID NO: 964157 - RNA, 26 nt, Human
ggugaugaaggagagcuucgaaggga

SEQ ID NO: 964158 - RNA, 18 nt, Human
guuuccacacuucucaag

SEQ ID NO: 964159 - RNA, 19 nt, Human
uaaacuacacagcauauga

SEQ ID NO: 964160 - RNA, 22 nt, Human
uaaacucaaaggaaacaccaca

SEQ ID NO: 964161 - RNA, 20 nt, Human
uacaaugaagcuagaauauc

SEQ ID NO: 964162 - RNA, 20 nt, Human
uagaaugcuaagagcaggga

SEQ ID NO: 964163 - RNA, 23 nt, Human
uaggaagggucaagucaccagug

SEQ ID NO: 964164 - RNA, 27 nt, Human
uaucaaagaaaggccaaaauuugucaa

SEQ ID NO: 964165 - RNA, 23 nt, Human
ucacucacaaagaaaauguuucc

SEQ ID NO: 964166 - RNA, 18 nt, Human
uccagacgggucaugggg

SEQ ID NO: 964167 - RNA, 19 nt, Human
ucucaagacuguugagccc

SEQ ID NO: 964168 - RNA, 22 nt, Human
ugagcccuagguauuuuccccc

SEQ ID NO: 964169 - RNA, 24 nt, Human
ugggggagaaugauagaaaugagc

SEQ ID NO: 964170 - RNA, 18 nt, Human
ugggugagacacauggug

SEQ ID NO: 964171 - RNA, 20 nt, Human
uuacagguauguuguauuuc

SEQ ID NO: 964172 - RNA, 24 nt, Human
aaacuucuggucaccaggcagcuc

SEQ ID NO: 964173 - RNA, 20 nt, Human
acaccugaggcaggaggugg

SEQ ID NO: 964174 - RNA, 27 nt, Human
agggcugcaacugagagcugaggcugg

SEQ ID NO: 964175 - RNA, 18 nt, Human
aggggcaaguccaggcag

SEQ ID NO: 964176 - RNA, 24 nt, Human
aggggcaaguccaggcaggcagca

SEQ ID NO: 964177 - RNA, 21 nt, Human
cauggcagggccauggagaag

SEQ ID NO: 964178 - RNA, 21 nt, Human
ccaaacuucuggucaccaggc

SEQ ID NO: 964179 - RNA, 23 nt, Human
cugaggcaggagguggcaggggc

SEQ ID NO: 964180 - RNA, 23 nt, Human
gagcauggcagggccauggagaa

SEQ ID NO: 964181 - RNA, 19 nt, Human
gcugcaacugagagcugag

SEQ ID NO: 964182 - RNA, 21 nt, Human
ggagaagggcuaauagaagca

SEQ ID NO: 964183 - RNA, 22 nt, Human
ugagagcugaggcuggagaggu

SEQ ID NO: 964184 - RNA, 18 nt, Human
ugaggcaggagguggcag

SEQ ID NO: 964185 - RNA, 20 nt, Human
ugaggcaggagguggcaggg

SEQ ID NO: 964186 - RNA, 19 nt, Human
ugcccagacccucaggagc

SEQ ID NO: 964187 - RNA, 18 nt, Human
uggcagggccauggagaa

SEQ ID NO: 964188 - RNA, 20 nt, Human
uuggagagcauggcagggcc

SEQ ID NO: 964189 - RNA, 26 nt, Human
uuggagagcauggcagggccauggag

SEQ ID NO: 964190 - RNA, 23 nt, Human
aaaaaaacguacaaacaaguccc

SEQ ID NO: 964191 - RNA, 26 nt, Human
aaaaaaggaagaaacaaaacaaaaag

SEQ ID NO: 964192 - RNA, 20 nt, Human
aacaaaaaguucauccccac

SEQ ID NO: 964193 - RNA, 21 nt, Human
aacuaaaaaaggaagaaacaa

SEQ ID NO: 964194 - RNA, 19 nt, Human
aagccccuccugggagcuc

SEQ ID NO: 964195 - RNA, 22 nt, Human
acaaaacaaaaaguucaucccc

SEQ ID NO: 964196 - RNA, 20 nt, Human
accagggucuucccagaagc

SEQ ID NO: 964197 - RNA, 22 nt, Human
accucaccucccccccaacccc

SEQ ID NO: 964198 - RNA, 24 nt, Human
accucaccucccccccaaccccaa

SEQ ID NO: 964199 - RNA, 24 nt, Human
accucccccccaaccccaauagca

SEQ ID NO: 964200 - RNA, 18 nt, Human
acuuucagggcaggcaga

SEQ ID NO: 964201 - RNA, 24 nt, Human
agagcuggggaggcagcugaggug

SEQ ID NO: 964202 - RNA, 18 nt, Human
aggaagaaacaaaacaaa

SEQ ID NO: 964203 - RNA, 21 nt, Human
aggcagaaugacuauggccca

SEQ ID NO: 964204 - RNA, 19 nt, Human
aggcaggcuugaucuggga

SEQ ID NO: 964205 - RNA, 22 nt, Human
agugagaaaaaaaaacguacaa

SEQ ID NO: 964206 - RNA, 22 nt, Human
augguaucuggggcccaugucc

SEQ ID NO: 964207 - RNA, 22 nt, Human
caacaaaggcucauugcccccc

SEQ ID NO: 964208 - RNA, 23 nt, Human
caaggcugguaccucaccucccc

SEQ ID NO: 964209 - RNA, 20 nt, Human
caaucgccucacugcggcca

SEQ ID NO: 964210 - RNA, 21 nt, Human
caaucgccucacugcggccag

SEQ ID NO: 964211 - RNA, 23 nt, Human
cagaagccccuccugggagcucc

SEQ ID NO: 964212 - RNA, 22 nt, Human
cauugccccccuggccccccau

SEQ ID NO: 964213 - RNA, 25 nt, Human
ccagggucuucccagaagccccucc

SEQ ID NO: 964214 - RNA, 22 nt, Human
cccaggcugcagcaccuaguuu

SEQ ID NO: 964215 - RNA, 18 nt, Human
cccccaaccccaauagca

SEQ ID NO: 964216 - RNA, 19 nt, Human
cccccaaccccaauagcac

SEQ ID NO: 964217 - RNA, 21 nt, Human
cccccaaccccaauagcaccc

SEQ ID NO: 964218 - RNA, 23 nt, Human
ccccccaaccccaauagcaccca

SEQ ID NO: 964219 - RNA, 22 nt, Human
cccccccaaccccaauagcacc

SEQ ID NO: 964220 - RNA, 23 nt, Human
cccccccaaccccaauagcaccc

SEQ ID NO: 964221 - RNA, 22 nt, Human
ccucccccccaaccccaauagc

SEQ ID NO: 964222 - RNA, 21 nt, Human
ccuugaagaacuaaaaaagga

SEQ ID NO: 964223 - RNA, 21 nt, Human
cgagcucaauuuggucucaca

SEQ ID NO: 964224 - RNA, 22 nt, Human
cucaggagccuuuggaugccuc

SEQ ID NO: 964225 - RNA, 22 nt, Human
cugguaccucaccuccccccca

SEQ ID NO: 964226 - RNA, 24 nt, Human
cuucccagaagccccuccugggag

SEQ ID NO: 964227 - RNA, 19 nt, Human
gaagccccuccugggagcu

SEQ ID NO: 964228 - RNA, 19 nt, Human
gagcucaauuuggucucac

SEQ ID NO: 964229 - RNA, 18 nt, Human
gcagaaugacuauggccc

SEQ ID NO: 964230 - RNA, 18 nt, Human
gccuggucccaggcugca

SEQ ID NO: 964231 - RNA, 19 nt, Human
ggagagguugggauagagc

SEQ ID NO: 964232 - RNA, 21 nt, Human
ggagcuccuucucaaucgccu

SEQ ID NO: 964233 - RNA, 21 nt, Human
ggaggcagcugagguguuuua

SEQ ID NO: 964234 - RNA, 21 nt, Human
ggggcccauguccaaguggag

SEQ ID NO: 964235 - RNA, 24 nt, Human
ggucccacaggauguggaguuucc

SEQ ID NO: 964236 - RNA, 18 nt, Human
gguugggauagagcuggg

SEQ ID NO: 964237 - RNA, 23 nt, Human
gucucaggagccuuuggaugccu

SEQ ID NO: 964238 - RNA, 24 nt, Human
uaaaaaaggaagaaacaaaacaaa

SEQ ID NO: 964239 - RNA, 19 nt, Human
uaccucaccucccccccaa

SEQ ID NO: 964240 - RNA, 22 nt, Human
uaccucaccucccccccaaccc

SEQ ID NO: 964241 - RNA, 23 nt, Human
uagagcuggggaggcagcugagg

SEQ ID NO: 964242 - RNA, 23 nt, Human
ucaaucgccucacugcggccagg

SEQ ID NO: 964243 - RNA, 23 nt, Human
ucaggagccuuuggaugccuccu

SEQ ID NO: 964244 - RNA, 23 nt, Human
ucccacaggauguggaguuuccg

SEQ ID NO: 964245 - RNA, 23 nt, Human
ugaccagggucuucccagaagcc

SEQ ID NO: 964246 - RNA, 21 nt, Human
ugagaaaaaaaaacguacaaa

SEQ ID NO: 964247 - RNA, 25 nt, Human
ugagaaaaaaaaacguacaaacaag

SEQ ID NO: 964248 - RNA, 22 nt, Human
ugaggcaggcuugaucugggac

SEQ ID NO: 964249 - RNA, 19 nt, Human
ugccauccugugugcaccc

SEQ ID NO: 964250 - RNA, 26 nt, Human
ugcggccaggucauucugggggugcc

SEQ ID NO: 964251 - RNA, 18 nt, Human
ugggagagguugggauag

SEQ ID NO: 964252 - RNA, 21 nt, Human
ugggauagagcuggggaggca

SEQ ID NO: 964253 - RNA, 22 nt, Human
ugggauagagcuggggaggcag

SEQ ID NO: 964254 - RNA, 25 nt, Human
ugggauagagcuggggaggcagcug

SEQ ID NO: 964255 - RNA, 18 nt, Human
uucagugagaaaaaaaaa

SEQ ID NO: 964256 - RNA, 24 nt, Human
uucccagaagccccuccugggagc

SEQ ID NO: 964257 - RNA, 24 nt, Human
ucucccaaacugacuucugauuau

SEQ ID NO: 964258 - RNA, 22 nt, Human
uuuuuuuuuuuuuuuuauuuuu

SEQ ID NO: 964259 - RNA, 19 nt, Human
aaagaggauuuauaaucua

SEQ ID NO: 964260 - RNA, 21 nt, Human
aaaggaccaaaauaaagagga

SEQ ID NO: 964261 - RNA, 22 nt, Human
aaccucagcgaacguuuauuuc

SEQ ID NO: 964262 - RNA, 21 nt, Human
aagagaagucguaauucacag

SEQ ID NO: 964263 - RNA, 26 nt, Human
aagccgggacugggcgccgccgggga

SEQ ID NO: 964264 - RNA, 21 nt, Human
aagcugccuggagugucaguc

SEQ ID NO: 964265 - RNA, 20 nt, Human
aagggcaaaggaagucaaaa

SEQ ID NO: 964266 - RNA, 22 nt, Human
aagggucuggggcugucuccag

SEQ ID NO: 964267 - RNA, 18 nt, Human
acacaagcccacugcagc

SEQ ID NO: 964268 - RNA, 28 nt, Human
acacuggauaccacucccuacccaccca

SEQ ID NO: 964269 - RNA, 27 nt, Human
accaaaauaaagaggauuuauaaucua

SEQ ID NO: 964270 - RNA, 20 nt, Human
acccuggugccucccgcccc

SEQ ID NO: 964271 - RNA, 21 nt, Human
accuaagccaucuagaaaggc

SEQ ID NO: 964272 - RNA, 23 nt, Human
accuaagccaucuagaaaggcuc

SEQ ID NO: 964273 - RNA, 21 nt, Human
accuggccauggcccaggggc

SEQ ID NO: 964274 - RNA, 21 nt, Human
acucccuccucuucagaaggc

SEQ ID NO: 964275 - RNA, 20 nt, Human
acugcagcguggggagggug

SEQ ID NO: 964276 - RNA, 18 nt, Human
acugggcgccgccgggga

SEQ ID NO: 964277 - RNA, 19 nt, Human
agaacccagauccccaugc

SEQ ID NO: 964278 - RNA, 20 nt, Human
agacacuggcugcagaaaug

SEQ ID NO: 964279 - RNA, 21 nt, Human
agacacuggcugcagaaaugg

SEQ ID NO: 964280 - RNA, 21 nt, Human
agcauggagaaaagggaaaaa

SEQ ID NO: 964281 - RNA, 22 nt, Human
aggaaaagggaggguguggcuu

SEQ ID NO: 964282 - RNA, 20 nt, Human
aggagaguggggugcuggcc

SEQ ID NO: 964283 - RNA, 22 nt, Human
aggagcagggcugagaucccag

SEQ ID NO: 964284 - RNA, 25 nt, Human
aggaggaaggguguggucccuuagg

SEQ ID NO: 964285 - RNA, 20 nt, Human
aggcaggugcagcucuggga

SEQ ID NO: 964286 - RNA, 19 nt, Human
aggccggaagggggugccg

SEQ ID NO: 964287 - RNA, 24 nt, Human
aggcuccucuccugccccgcccag

SEQ ID NO: 964288 - RNA, 22 nt, Human
agggccacuggaggcaggagag

SEQ ID NO: 964289 - RNA, 20 nt, Human
agucauuugcuacagaaagu

SEQ ID NO: 964290 - RNA, 23 nt, Human
auaaaggaccaaaauaaagagga

SEQ ID NO: 964291 - RNA, 20 nt, Human
augacaggggagagaaggca

SEQ ID NO: 964292 - RNA, 21 nt, Human
augggggugggaguccucaga

SEQ ID NO: 964293 - RNA, 24 nt, Human
auuccagugaggaaaagggagggu

SEQ ID NO: 964294 - RNA, 22 nt, Human
caaagauuucugcacuugaaca

SEQ ID NO: 964295 - RNA, 23 nt, Human
caacagaacaggcuuuuagggaa

SEQ ID NO: 964296 - RNA, 23 nt, Human
caagcauaaaggaccaaaauaaa

SEQ ID NO: 964297 - RNA, 23 nt, Human
cacacaagcccacugcagcgugg

SEQ ID NO: 964298 - RNA, 23 nt, Human
cacagaccagcugugacccugac

SEQ ID NO: 964299 - RNA, 21 nt, Human
caccauuaagcauggagaaaa

SEQ ID NO: 964300 - RNA, 24 nt, Human
caccauuaagcauggagaaaaggg

SEQ ID NO: 964301 - RNA, 21 nt, Human
caccuggccauggcccagggg

SEQ ID NO: 964302 - RNA, 21 nt, Human
cacugcagcguggggagggug

SEQ ID NO: 964303 - RNA, 21 nt, Human
caggcuccucuccugcccccu

SEQ ID NO: 964304 - RNA, 22 nt, Human
caggggcagcuucagacauugu

SEQ ID NO: 964305 - RNA, 27 nt, Human
caggggcaggguccaaacaagaaccuu

SEQ ID NO: 964306 - RNA, 19 nt, Human
cagugcccuccaaacuggu

SEQ ID NO: 964307 - RNA, 22 nt, Human
caucacaugcccucuagaaccc

SEQ ID NO: 964308 - RNA, 19 nt, Human
caugccggggccucuucuc

SEQ ID NO: 964309 - RNA, 19 nt, Human
cauuccagugaggaaaagg

SEQ ID NO: 964310 - RNA, 20 nt, Human
ccaagugcucuuccagcucc

SEQ ID NO: 964311 - RNA, 25 nt, Human
ccccaugccggggccucuucucucc

SEQ ID NO: 964312 - RNA, 21 nt, Human
cccccgggggccagccaggga

SEQ ID NO: 964313 - RNA, 19 nt, Human
ccccgcccagcagcagcag

SEQ ID NO: 964314 - RNA, 18 nt, Human
ccccgggggccagccagg

SEQ ID NO: 964315 - RNA, 27 nt, Human
cccuacccacccagugaacauuuacag

SEQ ID NO: 964316 - RNA, 23 nt, Human
cccuccaaacuggucagagagga

SEQ ID NO: 964317 - RNA, 22 nt, Human
cccucuagaacccagaucccca

SEQ ID NO: 964318 - RNA, 23 nt, Human
cccucuccuccuccucucacaca

SEQ ID NO: 964319 - RNA, 19 nt, Human
cccuggugccucccgcccc

SEQ ID NO: 964320 - RNA, 24 nt, Human
cccuggugccucccgccccuccug

SEQ ID NO: 964321 - RNA, 19 nt, Human
ccucccgccccuccugcug

SEQ ID NO: 964322 - RNA, 23 nt, Human
ccuccugcugagccauggugccc

SEQ ID NO: 964323 - RNA, 20 nt, Human
ccugccccgcccagcagcag

SEQ ID NO: 964324 - RNA, 23 nt, Human
ccugccccgcccagcagcagcac

SEQ ID NO: 964325 - RNA, 20 nt, Human
ccuggugccucccgccccuc

SEQ ID NO: 964326 - RNA, 18 nt, Human
cuagaacccagaucccca

SEQ ID NO: 964327 - RNA, 21 nt, Human
cuagaacccagauccccaugc

SEQ ID NO: 964328 - RNA, 23 nt, Human
cucaaacucucuagagauaaucu

SEQ ID NO: 964329 - RNA, 18 nt, Human
cucagcgaacguuuauuu

SEQ ID NO: 964330 - RNA, 22 nt, Human
cuccaagugcucuuccagcucc

SEQ ID NO: 964331 - RNA, 20 nt, Human
cuccugccccgcccagcagc

SEQ ID NO: 964332 - RNA, 20 nt, Human
cucucggggcuccagaacgc

SEQ ID NO: 964333 - RNA, 22 nt, Human
cucucggggcuccagaacgcuc

SEQ ID NO: 964334 - RNA, 24 nt, Human
gagacacuggcugcagaaaugggg

SEQ ID NO: 964335 - RNA, 19 nt, Human
gagagaaggcaaagcugcc

SEQ ID NO: 964336 - RNA, 21 nt, Human
gcagguuggccugagaauccc

SEQ ID NO: 964337 - RNA, 22 nt, Human
gcccacugcagcguggggaggg

SEQ ID NO: 964338 - RNA, 22 nt, Human
gcucgccgacgacccgugcacc

SEQ ID NO: 964339 - RNA, 23 nt, Human
ggaaaugacaggggagagaaggc

SEQ ID NO: 964340 - RNA, 25 nt, Human
ggaagcaacccacuuaagccccagc

SEQ ID NO: 964341 - RNA, 22 nt, Human
ggaaggaggaaggguguggucc

SEQ ID NO: 964342 - RNA, 30 nt, Human
ggagaacagaauucucccucuccuccuccc

SEQ ID NO: 964343 - RNA, 22 nt, Human
ggaggcaggagaguggggugcu

SEQ ID NO: 964344 - RNA, 22 nt, Human
ggcaaaggaagucaaaaaacug

SEQ ID NO: 964345 - RNA, 19 nt, Human
ggcaggggaaggaggaagg

SEQ ID NO: 964346 - RNA, 20 nt, Human
gggccacuggaggcaggaga

SEQ ID NO: 964347 - RNA, 28 nt, Human
ggggacagaugagauacugggauggggg

SEQ ID NO: 964348 - RNA, 20 nt, Human
gggggugggaguccucagaa

SEQ ID NO: 964349 - RNA, 20 nt, Human
gggugcuggccucugcgagg

SEQ ID NO: 964350 - RNA, 21 nt, Human
gugaccagcaaaggcucaaac

SEQ ID NO: 964351 - RNA, 18 nt, Human
uacagucaucacaugccc

SEQ ID NO: 964352 - RNA, 21 nt, Human
uaggaucuccaagugcucuuc

SEQ ID NO: 964353 - RNA, 19 nt, Human
ucacacacaagcccacugc

SEQ ID NO: 964354 - RNA, 23 nt, Human
ucacaugcccucuagaacccaga

SEQ ID NO: 964355 - RNA, 19 nt, Human
uccagguuggaaccucaag

SEQ ID NO: 964356 - RNA, 20 nt, Human
ucccugaucuugcaagaaaa

SEQ ID NO: 964357 - RNA, 19 nt, Human
uccgagcuuggcccggcuu

SEQ ID NO: 964358 - RNA, 22 nt, Human
ucgcggcucgccgacgacccgu

SEQ ID NO: 964359 - RNA, 26 nt, Human
ucuagaaccccggggcgucucucggg

SEQ ID NO: 964360 - RNA, 20 nt, Human
ucucagucugcagcuguggc

SEQ ID NO: 964361 - RNA, 23 nt, Human
ucuccaagugcucuuccagcucu

SEQ ID NO: 964362 - RNA, 23 nt, Human
ucugcggcagggccacuggaggc

SEQ ID NO: 964363 - RNA, 24 nt, Human
ucuggaaaugacaggggagagaag

SEQ ID NO: 964364 - RNA, 19 nt, Human
ugaaacaaaaccucagcga

SEQ ID NO: 964365 - RNA, 21 nt, Human
ugaaacaaaaccucagcgaac

SEQ ID NO: 964366 - RNA, 19 nt, Human
ugcacaucacacacaagcc

SEQ ID NO: 964367 - RNA, 24 nt, Human
ugccuggaaucgguccuuggcugc

SEQ ID NO: 964368 - RNA, 25 nt, Human
ugccuggagugucagucccggaggc

SEQ ID NO: 964369 - RNA, 24 nt, Human
uggaaccucaagcauaaaggacca

SEQ ID NO: 964370 - RNA, 23 nt, Human
uggaagcaacccacuuaagcccc

SEQ ID NO: 964371 - RNA, 23 nt, Human
uggagaaaagggaaaaagggcaa

SEQ ID NO: 964372 - RNA, 19 nt, Human
uggcaaguaggagguaaug

SEQ ID NO: 964373 - RNA, 21 nt, Human
uggccaggcuccucuccugcc

SEQ ID NO: 964374 - RNA, 21 nt, Human
uggccugagaaucccaggggc

SEQ ID NO: 964375 - RNA, 18 nt, Human
ugggagacaucugcggca

SEQ ID NO: 964376 - RNA, 20 nt, Human
ugggaugggggugggagucc

SEQ ID NO: 964377 - RNA, 20 nt, Human
ugggcaugggacacaaaagg

SEQ ID NO: 964378 - RNA, 18 nt, Human
ugggcgccgccggggagc

SEQ ID NO: 964379 - RNA, 24 nt, Human
ugggcgccgccggggagcuucuag

SEQ ID NO: 964380 - RNA, 19 nt, Human
uggucccuuaggaucucca

SEQ ID NO: 964381 - RNA, 22 nt, Human
uguggcagucagagguuuggca

SEQ ID NO: 964382 - RNA, 19 nt, Human
uguggggagcugaaccggg

SEQ ID NO: 964383 - RNA, 22 nt, Human
uuaggaucuccaagugcucuuc

SEQ ID NO: 964384 - RNA, 23 nt, Human
uucacagucauuugcuacagaaa

SEQ ID NO: 964385 - RNA, 20 nt, Human
uugaacacuggauaccacuc

SEQ ID NO: 964386 - RNA, 18 nt, Human
uugcuguuggcagguugg

SEQ ID NO: 964387 - RNA, 23 nt, Human
uuggcccggcuucuuuccugugc

SEQ ID NO: 964388 - RNA, 21 nt, Human
uuguggggagcugaaccgggc

SEQ ID NO: 964389 - RNA, 21 nt, Human
aaaaacaucugaaguaauccg

SEQ ID NO: 964390 - RNA, 21 nt, Human
aaguguguaaaaaaaaauuca

SEQ ID NO: 964391 - RNA, 21 nt, Human
aggaaggcgcaggcggcgcgu

SEQ ID NO: 964392 - RNA, 20 nt, Human
aggcagggcccggcacccgc

SEQ ID NO: 964393 - RNA, 21 nt, Human
agggaaaguggggcggggagg

SEQ ID NO: 964394 - RNA, 19 nt, Human
agggaggaaggcgcaggcg

SEQ ID NO: 964395 - RNA, 21 nt, Human
agggaggaaggcgcaggcggc

SEQ ID NO: 964396 - RNA, 19 nt, Human
aguacaaaaacaacuagaa

SEQ ID NO: 964397 - RNA, 19 nt, Human
caaggcagggcccggcacc

SEQ ID NO: 964398 - RNA, 19 nt, Human
caccgcggcagccccgggc

SEQ ID NO: 964399 - RNA, 19 nt, Human
cagggaggaaggcgcaggc

SEQ ID NO: 964400 - RNA, 19 nt, Human
ccagcccgcccgcuccacc

SEQ ID NO: 964401 - RNA, 22 nt, Human
ccgcccggggcgaggcacgcag

SEQ ID NO: 964402 - RNA, 22 nt, Human
ccgcgcaccgcggcagccccgg

SEQ ID NO: 964403 - RNA, 18 nt, Human
ccuuugaagaagggaaag

SEQ ID NO: 964404 - RNA, 22 nt, Human
ccuuugaagaagggaaaguggg

SEQ ID NO: 964405 - RNA, 18 nt, Human
cggggagggcgcggggcc

SEQ ID NO: 964406 - RNA, 23 nt, Human
gaagaagggaaaguggggcgggg

SEQ ID NO: 964407 - RNA, 23 nt, Human
gaagggaaaguggggcggggagg

SEQ ID NO: 964408 - RNA, 20 nt, Human
ggcggggagggcgcggggcc

SEQ ID NO: 964409 - RNA, 18 nt, Human
gggcgcggggcccaccgg

SEQ ID NO: 964410 - RNA, 20 nt, Human
gggcggggagggcgcggggc

SEQ ID NO: 964411 - RNA, 22 nt, Human
ggggcggggagggcgcggggcc

SEQ ID NO: 964412 - RNA, 22 nt, Human
uaaguguguaaaaaaaaauuca

SEQ ID NO: 964413 - RNA, 24 nt, Human
ucccuuugagggcacuuuguccuu

SEQ ID NO: 964414 - RNA, 24 nt, Human
uguaacagauauuuaaauacuaca

SEQ ID NO: 964415 - RNA, 18 nt, Human
aaccauuuuauucugccu

SEQ ID NO: 964416 - RNA, 22 nt, Human
aaggugucucccugcuuugcuu

SEQ ID NO: 964417 - RNA, 20 nt, Human
aauuugcagcuuuucucccc

SEQ ID NO: 964418 - RNA, 26 nt, Human
acaaugcuaaaaaucaguguaugugc

SEQ ID NO: 964419 - RNA, 23 nt, Human
auaggaauagacaaugcuaaaaa

SEQ ID NO: 964420 - RNA, 19 nt, Human
auggcucagccccgucguc

SEQ ID NO: 964421 - RNA, 22 nt, Human
caagaaaaaaaaaaggcagcaa

SEQ ID NO: 964422 - RNA, 20 nt, Human
caaugcuaaaaaucagugua

SEQ ID NO: 964423 - RNA, 18 nt, Human
caccuuggcagcgugagg

SEQ ID NO: 964424 - RNA, 22 nt, Human
caggugcagacgcccagacccg

SEQ ID NO: 964425 - RNA, 21 nt, Human
ccaccagccugcuccuccugg

SEQ ID NO: 964426 - RNA, 22 nt, Human
ccaccuucugaucacacaauuc

SEQ ID NO: 964427 - RNA, 21 nt, Human
cccaagagcuccugauggcuc

SEQ ID NO: 964428 - RNA, 18 nt, Human
cccacgugucaguucccu

SEQ ID NO: 964429 - RNA, 21 nt, Human
ccccgucgucuggccggauuc

SEQ ID NO: 964430 - RNA, 20 nt, Human
ccccuuggaauguuuccuaa

SEQ ID NO: 964431 - RNA, 25 nt, Human
cccuaggccccaggugcagacgccc

SEQ ID NO: 964432 - RNA, 28 nt, Human
cugaucacacaauuccaucgagaaacug

SEQ ID NO: 964433 - RNA, 20 nt, Human
cugcggaggauccagccgua

SEQ ID NO: 964434 - RNA, 20 nt, Human
cuucugaucacacaauucca

SEQ ID NO: 964435 - RNA, 27 nt, Human
gcaauagaagaggcacacagaacauga

SEQ ID NO: 964436 - RNA, 18 nt, Human
gcugugggguauuuaaac

SEQ ID NO: 964437 - RNA, 22 nt, Human
ggccagcaaaugaaaucgggag

SEQ ID NO: 964438 - RNA, 18 nt, Human
guguaccaagaaaaaaaa

SEQ ID NO: 964439 - RNA, 19 nt, Human
gugucucccugcuuugcuu

SEQ ID NO: 964440 - RNA, 21 nt, Human
uaaaaagguuuuaucaauacu

SEQ ID NO: 964441 - RNA, 20 nt, Human
uaccaagaaaaaaaaaaggc

SEQ ID NO: 964442 - RNA, 21 nt, Human
uaccaagaaaaaaaaaaggca

SEQ ID NO: 964443 - RNA, 23 nt, Human
uaccaagaaaaaaaaaaggcagc

SEQ ID NO: 964444 - RNA, 18 nt, Human
uaccccaaagcuuagcag

SEQ ID NO: 964445 - RNA, 21 nt, Human
uaccccaaagcuuagcagagc

SEQ ID NO: 964446 - RNA, 24 nt, Human
uagcagagcuugaaaaucaaaaga

SEQ ID NO: 964447 - RNA, 24 nt, Human
uaggccccaggugcagacgcccag

SEQ ID NO: 964448 - RNA, 24 nt, Human
ucaguucccuaggccccaggugcc

SEQ ID NO: 964449 - RNA, 20 nt, Human
ugaaaagauauauggaagua

SEQ ID NO: 964450 - RNA, 18 nt, Human
ugaacuuuacagcacagg

SEQ ID NO: 964451 - RNA, 23 nt, Human
ugacaucugggucaacauauccu

SEQ ID NO: 964452 - RNA, 23 nt, Human
ugccaccagccugcuccuccugg

SEQ ID NO: 964453 - RNA, 26 nt, Human
uggccggauucugccugcccggcuuu

SEQ ID NO: 964454 - RNA, 23 nt, Human
ugggggccuuccgcucgccugcg

SEQ ID NO: 964455 - RNA, 25 nt, Human
ugggggccuuccgcucggggacacc

SEQ ID NO: 964456 - RNA, 25 nt, Human
uuaaugaaaagauauauggaaguac

SEQ ID NO: 964457 - RNA, 22 nt, Human
uucuucugaaggugucucccug

SEQ ID NO: 964458 - RNA, 23 nt, Human
aaacuuacaauaacagugacuua

SEQ ID NO: 964459 - RNA, 22 nt, Human
aaauggagaauucuauuacaga

SEQ ID NO: 964460 - RNA, 21 nt, Human
aagaggaggugaagggcagga

SEQ ID NO: 964461 - RNA, 19 nt, Human
aagcaggguuuagguaugc

SEQ ID NO: 964462 - RNA, 19 nt, Human
agacagaaaucaaaaaguc

SEQ ID NO: 964463 - RNA, 21 nt, Human
agacagaaaucaaaaagucag

SEQ ID NO: 964464 - RNA, 22 nt, Human
agacagaaaucaaaaagucagc

SEQ ID NO: 964465 - RNA, 21 nt, Human
agaggaggugaagggcaggau

SEQ ID NO: 964466 - RNA, 26 nt, Human
agaggaggugaagggcaggggcgugu

SEQ ID NO: 964467 - RNA, 23 nt, Human
aggaagaaagaggaggugaaggg

SEQ ID NO: 964468 - RNA, 18 nt, Human
agggucauccuggggucu

SEQ ID NO: 964469 - RNA, 18 nt, Human
auuuuucuaugcaauggc

SEQ ID NO: 964470 - RNA, 23 nt, Human
caacgcccacuacccugacaguc

SEQ ID NO: 964471 - RNA, 26 nt, Human
caauggcuuccuuucccagggucauc

SEQ ID NO: 964472 - RNA, 24 nt, Human
cccacuacccugacaguccugggc

SEQ ID NO: 964473 - RNA, 25 nt, Human
ccuagacuccuuuuaaccuuguuga

SEQ ID NO: 964474 - RNA, 22 nt, Human
ccucacgcaacgcccacuaccc

SEQ ID NO: 964475 - RNA, 23 nt, Human
ccuggggucuaggaugacugcuc

SEQ ID NO: 964476 - RNA, 21 nt, Human
cuacccugacaguccugggcc

SEQ ID NO: 964477 - RNA, 19 nt, Human
gaaaguacaaaggugucag

SEQ ID NO: 964478 - RNA, 20 nt, Human
gauacugauggacaacuugc

SEQ ID NO: 964479 - RNA, 21 nt, Human
ggguuuagguaugcagccaca

SEQ ID NO: 964480 - RNA, 20 nt, Human
uaccagacaccuagacuccu

SEQ ID NO: 964481 - RNA, 18 nt, Human
uagaacagucacuaagac

SEQ ID NO: 964482 - RNA, 20 nt, Human
uagaacagucacuaagacaa

SEQ ID NO: 964483 - RNA, 18 nt, Human
uaugcagccacaaggguu

SEQ ID NO: 964484 - RNA, 21 nt, Human
ucccagggucauccugggguc

SEQ ID NO: 964485 - RNA, 18 nt, Human
ugcaauggcuuccuuucc

SEQ ID NO: 964486 - RNA, 22 nt, Human
uguauacauuccagccagcagg

SEQ ID NO: 964487 - RNA, 19 nt, Human
uuccugaguuaaacuuaug

SEQ ID NO: 964488 - RNA, 19 nt, Human
uucuacaguaccagacacc

SEQ ID NO: 964489 - RNA, 20 nt, Human
aacacaguggucaagaggag

SEQ ID NO: 964490 - RNA, 19 nt, Human
aauaaggaaacaacagaaa

SEQ ID NO: 964491 - RNA, 20 nt, Human
acaguggucaagaggagagc

SEQ ID NO: 964492 - RNA, 19 nt, Human
accaagaaaauaggccaug

SEQ ID NO: 964493 - RNA, 22 nt, Human
agccuugcugcuggacuguggu

SEQ ID NO: 964494 - RNA, 23 nt, Human
aggaguuuuggccauuggugaug

SEQ ID NO: 964495 - RNA, 23 nt, Human
aggcggggaagggcacaacuucu

SEQ ID NO: 964496 - RNA, 20 nt, Human
augcccacccccuccccuua

SEQ ID NO: 964497 - RNA, 21 nt, Human
cagaauaugcccacccccucc

SEQ ID NO: 964498 - RNA, 24 nt, Human
cagcaggaagcaaggagccuugcu

SEQ ID NO: 964499 - RNA, 19 nt, Human
cagcuccugggcgucuccc

SEQ ID NO: 964500 - RNA, 20 nt, Human
caggagguggagggacagca

SEQ ID NO: 964501 - RNA, 22 nt, Human
cauauaauacauuacauguaca

SEQ ID NO: 964502 - RNA, 23 nt, Human
ccagaauaugcccacccccuccc

SEQ ID NO: 964503 - RNA, 24 nt, Human
ccauggugggcaucgcaggcgggg

SEQ ID NO: 964504 - RNA, 22 nt, Human
ccauuggugauggcgcugugag

SEQ ID NO: 964505 - RNA, 19 nt, Human
cccaagaggcugauguugg

SEQ ID NO: 964506 - RNA, 25 nt, Human
cccaagaggcugauguuggcaugcc

SEQ ID NO: 964507 - RNA, 25 nt, Human
cccaagugggcaaugacaccaagau

SEQ ID NO: 964508 - RNA, 22 nt, Human
ccccaagugggcaaugacacca

SEQ ID NO: 964509 - RNA, 21 nt, Human
cccccuccccuuaucccauaa

SEQ ID NO: 964510 - RNA, 21 nt, Human
ccuccccuuaucccauaacac

SEQ ID NO: 964511 - RNA, 23 nt, Human
cuagagaccucccaagaggcuga

SEQ ID NO: 964512 - RNA, 23 nt, Human
cugcuccucuccagaauaugccc

SEQ ID NO: 964513 - RNA, 25 nt, Human
cuggagcccagaccccauauaauac

SEQ ID NO: 964514 - RNA, 20 nt, Human
gaaacaacagaaauaaaaga

SEQ ID NO: 964515 - RNA, 20 nt, Human
gaggagggacuauuagggug

SEQ ID NO: 964516 - RNA, 22 nt, Human
gcaggaggcagaacuguccaga

SEQ ID NO: 964517 - RNA, 18 nt, Human
gccaaauuccuggguccu

SEQ ID NO: 964518 - RNA, 25 nt, Human
gccauggugggcaucgcaggcgggg

SEQ ID NO: 964519 - RNA, 19 nt, Human
gcccagggaagcccaaccu

SEQ ID NO: 964520 - RNA, 19 nt, Human
gcuugguggcaucuccucc

SEQ ID NO: 964521 - RNA, 22 nt, Human
ggcggggaagggcacaacuucu

SEQ ID NO: 964522 - RNA, 22 nt, Human
ggcuuucagccagcuccugggc

SEQ ID NO: 964523 - RNA, 21 nt, Human
gggacagcaggaagcaaggag

SEQ ID NO: 964524 - RNA, 25 nt, Human
gggcaggaggcagaacuguccagaa

SEQ ID NO: 964525 - RNA, 19 nt, Human
ggguccuuggaccucugcu

SEQ ID NO: 964526 - RNA, 23 nt, Human
gguccuuggaccucugcuccucu

SEQ ID NO: 964527 - RNA, 21 nt, Human
guuccaggcugguccagggca

SEQ ID NO: 964528 - RNA, 18 nt, Human
uacccuggugcaguuccc

SEQ ID NO: 964529 - RNA, 24 nt, Human
uccagggcaugaggaggcucagga

SEQ ID NO: 964530 - RNA, 18 nt, Human
uccaugccaaauuccugg

SEQ ID NO: 964531 - RNA, 19 nt, Human
ucccauaacacagugguca

SEQ ID NO: 964532 - RNA, 23 nt, Human
ucccuggggcucuccuaccaccu

SEQ ID NO: 964533 - RNA, 18 nt, Human
uccuggguccuuggaccu

SEQ ID NO: 964534 - RNA, 19 nt, Human
uccuggguccuuggaccuc

SEQ ID NO: 964535 - RNA, 21 nt, Human
uccuuggaccucugcuccucu

SEQ ID NO: 964536 - RNA, 22 nt, Human
ucuccuagaauuacugccucca

SEQ ID NO: 964537 - RNA, 19 nt, Human
ucucuggcuggagcccaga

SEQ ID NO: 964538 - RNA, 23 nt, Human
ucucuggcuggagcccagacccc

SEQ ID NO: 964539 - RNA, 23 nt, Human
ugaaccccuuaggaucuccuaga

SEQ ID NO: 964540 - RNA, 23 nt, Human
ugagguggggguagggucccccu

SEQ ID NO: 964541 - RNA, 24 nt, Human
ugagugcccagggaagcccaaccu

SEQ ID NO: 964542 - RNA, 21 nt, Human
ugcaguucccaccauggucaa

SEQ ID NO: 964543 - RNA, 21 nt, Human
uggaccucugcuccucuccag

SEQ ID NO: 964544 - RNA, 21 nt, Human
uggaggagggacuauuagggu

SEQ ID NO: 964545 - RNA, 21 nt, Human
uggaggagggacuauuagggu

SEQ ID NO: 964546 - RNA, 25 nt, Human
uggcuggaauuggaggagggacuau

SEQ ID NO: 964547 - RNA, 20 nt, Human
uguccagaacuuuagagaac

SEQ ID NO: 964548 - RNA, 21 nt, Human
uguuccaggcugguccagggc

SEQ ID NO: 964549 - RNA, 20 nt, Human
uucccacagguagaugcccc

SEQ ID NO: 964550 - RNA, 19 nt, Human
uuccuggguccuuggaccu

SEQ ID NO: 964551 - RNA, 20 nt, Human
uuccuggguccuuggaccuc

SEQ ID NO: 964552 - RNA, 21 nt, Human
uugcugcuggacuguggugca

SEQ ID NO: 964553 - RNA, 22 nt, Human
aaaacacaaugacaaugaagca

SEQ ID NO: 964554 - RNA, 18 nt, Human
aaacacaaugacaaugaa

SEQ ID NO: 964555 - RNA, 24 nt, Human
aaaucagugcugacuuaaagcuaa

SEQ ID NO: 964556 - RNA, 18 nt, Human
aagaaaaagaaagcagag

SEQ ID NO: 964557 - RNA, 19 nt, Human
aagaaaaagaaagcagaga

SEQ ID NO: 964558 - RNA, 22 nt, Human
aagaaaaagaaagcagagaaca

SEQ ID NO: 964559 - RNA, 21 nt, Human
aagcugauacccgcaggcccc

SEQ ID NO: 964560 - RNA, 21 nt, Human
agaacaaaguucaaucuacaa

SEQ ID NO: 964561 - RNA, 23 nt, Human
agaaugaaaacaaccaaaagggu

SEQ ID NO: 964562 - RNA, 19 nt, Human
aggcaggcuauauccuccc

SEQ ID NO: 964563 - RNA, 20 nt, Human
aggccacaccacuggaaaug

SEQ ID NO: 964564 - RNA, 24 nt, Human
augacaaugaagcacugauaugcc

SEQ ID NO: 964565 - RNA, 21 nt, Human
caaaacaaaggaaaggccuau

SEQ ID NO: 964566 - RNA, 22 nt, Human
caaaucagugcugacuuaaagc

SEQ ID NO: 964567 - RNA, 22 nt, Human
caagagauguccacauuuccac

SEQ ID NO: 964568 - RNA, 19 nt, Human
cacugauaugccuuaggaa

SEQ ID NO: 964569 - RNA, 26 nt, Human
cagagccccaggacuauuccagcucc

SEQ ID NO: 964570 - RNA, 18 nt, Human
cagcaggugauccacuuc

SEQ ID NO: 964571 - RNA, 20 nt, Human
cagcaggugauccacuucug

SEQ ID NO: 964572 - RNA, 22 nt, Human
ccacuggaaaugcuuuucuucu

SEQ ID NO: 964573 - RNA, 21 nt, Human
cccagagccccaggacuauuc

SEQ ID NO: 964574 - RNA, 22 nt, Human
cccagagccccaggacuauucc

SEQ ID NO: 964575 - RNA, 21 nt, Human
ccccgaaagugcaaagagagc

SEQ ID NO: 964576 - RNA, 26 nt, Human
cccgcaggccccagagccccaggacu

SEQ ID NO: 964577 - RNA, 18 nt, Human
cccgcucgcgcccuccuu

SEQ ID NO: 964578 - RNA, 24 nt, Human
cccucucgcgcucguuuucuuucu

SEQ ID NO: 964579 - RNA, 21 nt, Human
ccucccaaaacaaaggaaagg

SEQ ID NO: 964580 - RNA, 23 nt, Human
cucacaaccuuuauuuuuuaaaa

SEQ ID NO: 964581 - RNA, 24 nt, Human
cucgcccgcucgcgcccuccuucc

SEQ ID NO: 964582 - RNA, 23 nt, Human
cucgcuuuucccccucucgcgcu

SEQ ID NO: 964583 - RNA, 19 nt, Human
cugcauuugugcuucaaag

SEQ ID NO: 964584 - RNA, 27 nt, Human
cugcuggguucggcggagcggggcggc

SEQ ID NO: 964585 - RNA, 19 nt, Human
cugugaguccuccuucccc

SEQ ID NO: 964586 - RNA, 20 nt, Human
cuuuccgucuuuucgcuccc

SEQ ID NO: 964587 - RNA, 28 nt, Human
gaaaacaaccaaaagggugccgguaccc

SEQ ID NO: 964588 - RNA, 23 nt, Human
gaacagucccaaaucagugcuga

SEQ ID NO: 964589 - RNA, 21 nt, Human
gcagguuucaagcaucuguuc

SEQ ID NO: 964590 - RNA, 18 nt, Human
gcggccggcagcucuccc

SEQ ID NO: 964591 - RNA, 19 nt, Human
guuuucuuucuuucuuucc

SEQ ID NO: 964592 - RNA, 23 nt, Human
uccaagaaaaagaaagcagagaa

SEQ ID NO: 964593 - RNA, 24 nt, Human
uccaccagcaggugauccacuucu

SEQ ID NO: 964594 - RNA, 19 nt, Human
uccacuuauaaagcagggu

SEQ ID NO: 964595 - RNA, 19 nt, Human
uccgucuuuucgcuccccc

SEQ ID NO: 964596 - RNA, 21 nt, Human
uccuuccccgaaagugcaaaa

SEQ ID NO: 964597 - RNA, 25 nt, Human
ucgcgcgcgcgcucgcucgaucgcu

SEQ ID NO: 964598 - RNA, 18 nt, Human
ucugcuaggaucugaaga

SEQ ID NO: 964599 - RNA, 26 nt, Human
ugcugcccgcgcucgcccgcucgcgc

SEQ ID NO: 964600 - RNA, 22 nt, Human
uguccacauuuccaccagcagg

SEQ ID NO: 964601 - RNA, 22 nt, Human
uuaaaaacacaaugacaaugaa

SEQ ID NO: 964602 - RNA, 21 nt, Human
uuccugcuggguucggcggag

SEQ ID NO: 964603 - RNA, 22 nt, Human
uuugcuuccucacugugagucc

SEQ ID NO: 964604 - RNA, 22 nt, Human
uuuucgcgcgcgcgcucgcucg

SEQ ID NO: 964605 - RNA, 22 nt, Human
uuuucgcucccccgcgcggaag

SEQ ID NO: 964606 - RNA, 25 nt, Human
uuuucuuucuuucuuuccgucuuuu

SEQ ID NO: 964607 - RNA, 26 nt, Human
aaacaagagacaauaaaaaagggacc

SEQ ID NO: 964608 - RNA, 24 nt, Human
aaacauacuuuucugaaaacacuu

SEQ ID NO: 964609 - RNA, 23 nt, Human
aagaaaaguaaaaaucaaacugu

SEQ ID NO: 964610 - RNA, 19 nt, Human
acaaacaauaucccagcuc

SEQ ID NO: 964611 - RNA, 21 nt, Human
acaaagcaccaaacuacacaa

SEQ ID NO: 964612 - RNA, 23 nt, Human
accugaaaauaauauuuaaaaaa

SEQ ID NO: 964613 - RNA, 24 nt, Human
accugaaaauaauauuuaaaaaau

SEQ ID NO: 964614 - RNA, 24 nt, Human
accuuccuuaaggaggcuccgccg

SEQ ID NO: 964615 - RNA, 19 nt, Human
agaauacccuggauucagu

SEQ ID NO: 964616 - RNA, 19 nt, Human
agauuacauaaaagccgac

SEQ ID NO: 964617 - RNA, 20 nt, Human
aggaggcuccgccgcagccc

SEQ ID NO: 964618 - RNA, 21 nt, Human
agguguaaaagucaccuaacu

SEQ ID NO: 964619 - RNA, 19 nt, Human
auccccuuguaacaccuuu

SEQ ID NO: 964620 - RNA, 25 nt, Human
caaagcaccaaacuacacaaaugca

SEQ ID NO: 964621 - RNA, 22 nt, Human
cacaaaugcagaaugaaaacag

SEQ ID NO: 964622 - RNA, 19 nt, Human
cagauuacauaaaagccga

SEQ ID NO: 964623 - RNA, 22 nt, Human
cauauagucuaaaagcuagaag

SEQ ID NO: 964624 - RNA, 23 nt, Human
ccacaaacaauaucccagcucua

SEQ ID NO: 964625 - RNA, 23 nt, Human
ccccuuguaacaccuuuaagaaa

SEQ ID NO: 964626 - RNA, 22 nt, Human
ccggucgcccucgugccgaauu

SEQ ID NO: 964627 - RNA, 19 nt, Human
cgaagcugccaaccucuug

SEQ ID NO: 964628 - RNA, 25 nt, Human
cuccuggcugcugucgccggucgau

SEQ ID NO: 964629 - RNA, 20 nt, Human
cuugcaccuuccuuaaggaa

SEQ ID NO: 964630 - RNA, 27 nt, Human
gaaaacagcauuucaacuccaccaaaa

SEQ ID NO: 964631 - RNA, 23 nt, Human
uaaaagguguaaaagucaccuaa

SEQ ID NO: 964632 - RNA, 21 nt, Human
uaacuuggaacaaagcaccaa

SEQ ID NO: 964633 - RNA, 19 nt, Human
uaagaaacagccuuuuaag

SEQ ID NO: 964634 - RNA, 25 nt, Human
uaagcaaaggaccugaaaauaauau

SEQ ID NO: 964635 - RNA, 21 nt, Human
uacauaaaagccgacaaaucc

SEQ ID NO: 964636 - RNA, 24 nt, Human
uauaguguucccuuaucauguacu

SEQ ID NO: 964637 - RNA, 20 nt, Human
ucugaauaguucugcuaagc

SEQ ID NO: 964638 - RNA, 19 nt, Human
ucuucaguucauccaugac

SEQ ID NO: 964639 - RNA, 19 nt, Human
ucuuuaaauuuacuacuga

SEQ ID NO: 964640 - RNA, 18 nt, Human
ugacagguauaguguucc

SEQ ID NO: 964641 - RNA, 24 nt, Human
ugcagaaugaaaacagcauuucaa

SEQ ID NO: 964642 - RNA, 19 nt, Human
ugguaagcaaaggaccuga

SEQ ID NO: 964643 - RNA, 21 nt, Human
uuccugcuauacauauuacag

SEQ ID NO: 964644 - RNA, 22 nt, Human
uuuaaaaaaugaacaggcaaag

SEQ ID NO: 964645 - RNA, 26 nt, Human
uuuuuuuuuucuuuucauuugcguuu

SEQ ID NO: 964646 - RNA, 22 nt, Human
uuuuuuuuuuuucuuuucauuu

SEQ ID NO: 964647 - RNA, 23 nt, Human
uuuuuuuuuuuuuuuuuucuuuu

SEQ ID NO: 964648 - RNA, 22 nt, Human
aaaguuaaacaaaagccacaaa

SEQ ID NO: 964649 - RNA, 24 nt, Human
aaaguuaaacaaaagccacaaaaa

SEQ ID NO: 964650 - RNA, 22 nt, Human
aacaaauacagcauuaagaaau

SEQ ID NO: 964651 - RNA, 21 nt, Human
aacauggcacagacuguagcc

SEQ ID NO: 964652 - RNA, 19 nt, Human
aaguaauuccaggacgcua

SEQ ID NO: 964653 - RNA, 23 nt, Human
acaaaagccacaaaaauuuugcc

SEQ ID NO: 964654 - RNA, 22 nt, Human
acaacucuacuucaaaauaugc

SEQ ID NO: 964655 - RNA, 22 nt, Human
acacaaaggaaugacacugaug

SEQ ID NO: 964656 - RNA, 22 nt, Human
agaugcaugcagcuuuucauuu

SEQ ID NO: 964657 - RNA, 21 nt, Human
agccaccaaaaaagguuagug

SEQ ID NO: 964658 - RNA, 22 nt, Human
agcuguauacaucuagguuuga

SEQ ID NO: 964659 - RNA, 25 nt, Human
aggccggcaccggcaacggaaaagg

SEQ ID NO: 964660 - RNA, 23 nt, Human
augccugcuguagaugcaugcag

SEQ ID NO: 964661 - RNA, 23 nt, Human
caacauggcacagacuguagccu

SEQ ID NO: 964662 - RNA, 25 nt, Human
caccaaaaaagguuagugcauaaua

SEQ ID NO: 964663 - RNA, 19 nt, Human
caccggcaacggaaaaggc

SEQ ID NO: 964664 - RNA, 20 nt, Human
caggaaaaaaauucccaaac

SEQ ID NO: 964665 - RNA, 25 nt, Human
ccaccaaaaaagguuagugcauaau

SEQ ID NO: 964666 - RNA, 19 nt, Human
ccggcaacggaaaaggcuu

SEQ ID NO: 964667 - RNA, 31 nt, Human
ccggcaccggcaacggaaaaggcuucucucu

SEQ ID NO: 964668 - RNA, 24 nt, Human
ccuuuaagauagacucaggauagg

SEQ ID NO: 964669 - RNA, 20 nt, Human
cgacauaaacaauccaugcc

SEQ ID NO: 964670 - RNA, 20 nt, Human
cggcaccggcaacggaaaag

SEQ ID NO: 964671 - RNA, 24 nt, Human
cuacuuuuguuucuacugcacaaa

SEQ ID NO: 964672 - RNA, 21 nt, Human
cucacugcccaaagacaguuu

SEQ ID NO: 964673 - RNA, 23 nt, Human
cucacugcccaaagacaguuuua

SEQ ID NO: 964674 - RNA, 19 nt, Human
cugcaguaacacaaauuua

SEQ ID NO: 964675 - RNA, 23 nt, Human
guuuuuuucuuuuuuuccuuuaa

SEQ ID NO: 964676 - RNA, 24 nt, Human
uaaaacaauuucagaaacuguaca

SEQ ID NO: 964677 - RNA, 19 nt, Human
uaaaaugcacuaccccuuu

SEQ ID NO: 964678 - RNA, 27 nt, Human
uaaacaaaagccacaaaaauuuugcca

SEQ ID NO: 964679 - RNA, 25 nt, Human
uaaacccuaauuagccaccaaaaaa

SEQ ID NO: 964680 - RNA, 24 nt, Human
uaagaaaacaguugccuacuuugc

SEQ ID NO: 964681 - RNA, 23 nt, Human
uaagauuacuacugcaguaacac

SEQ ID NO: 964682 - RNA, 28 nt, Human
uaagguuuuuuucuuuuuuuccuuuaag

SEQ ID NO: 964683 - RNA, 18 nt, Human
uaaguagauccaucaugu

SEQ ID NO: 964684 - RNA, 22 nt, Human
uaaguagauccaucauguugga

SEQ ID NO: 964685 - RNA, 23 nt, Human
uacaacuugagaucaaauaaagg

SEQ ID NO: 964686 - RNA, 19 nt, Human
uacucacugcccaaagaca

SEQ ID NO: 964687 - RNA, 20 nt, Human
uaggccggcaccggcaacgg

SEQ ID NO: 964688 - RNA, 24 nt, Human
uaggccggcaccggcaacggaaaa

SEQ ID NO: 964689 - RNA, 24 nt, Human
uaugcuauuuacucacugcccaaa

SEQ ID NO: 964690 - RNA, 20 nt, Human
ucagagcuguauacaucuag

SEQ ID NO: 964691 - RNA, 25 nt, Human
ucagagcuguauacaucuagguuug

SEQ ID NO: 964692 - RNA, 23 nt, Human
ucuguaacuaagaaaacaguugc

SEQ ID NO: 964693 - RNA, 24 nt, Human
ucuguaacuaagaaaacaguugcc

SEQ ID NO: 964694 - RNA, 19 nt, Human
ugagaugaacaaauacagc

SEQ ID NO: 964695 - RNA, 20 nt, Human
ugagaugaacaaauacagca

SEQ ID NO: 964696 - RNA, 19 nt, Human
ugcacuaccccuuuuuuuc

SEQ ID NO: 964697 - RNA, 26 nt, Human
uggaaaauucaaaauaagggcaagag

SEQ ID NO: 964698 - RNA, 21 nt, Human
uggcacagacuguagccuacu

SEQ ID NO: 964699 - RNA, 23 nt, Human
uguacaucaacauggcacagacu

SEQ ID NO: 964700 - RNA, 22 nt, Human
uguagccuacuuuuguuucuac

SEQ ID NO: 964701 - RNA, 21 nt, Human
uucaaaguuaaacaaaagcca

SEQ ID NO: 964702 - RNA, 23 nt, Human
uucacugauguagaugugggaau

SEQ ID NO: 964703 - RNA, 22 nt, Human
uuguuaugaagcagcaccagaa

SEQ ID NO: 964704 - RNA, 19 nt, Human
uuuaaacccuaauuagcca

SEQ ID NO: 964705 - RNA, 24 nt, Human
aaaaaaaacaguaauucugaacac

SEQ ID NO: 964706 - RNA, 25 nt, Human
aaaaaggaaaaacaaacaaaaaaaa

SEQ ID NO: 964707 - RNA, 18 nt, Human
aaaacaguaauucugaac

SEQ ID NO: 964708 - RNA, 23 nt, Human
aaaagaaaacacaauagugagaa

SEQ ID NO: 964709 - RNA, 24 nt, Human
aaacaaaaaaaacaguaauucuga

SEQ ID NO: 964710 - RNA, 23 nt, Human
aaaggaaaaacaaacaaaaaaaa

SEQ ID NO: 964711 - RNA, 19 nt, Human
aacaagauggccacaaagu

SEQ ID NO: 964712 - RNA, 21 nt, Human
aacaagggcaacucuuuccau

SEQ ID NO: 964713 - RNA, 21 nt, Human
aacaauacaaaauucaguaac

SEQ ID NO: 964714 - RNA, 20 nt, Human
aacagugagcaaaagaaaac

SEQ ID NO: 964715 - RNA, 25 nt, Human
aagcagcuucauaaucaaaucaggc

SEQ ID NO: 964716 - RNA, 20 nt, Human
aauaagcuuggaaaugucaa

SEQ ID NO: 964717 - RNA, 21 nt, Human
accaaguaacuaacaugcuau

SEQ ID NO: 964718 - RNA, 21 nt, Human
agcaggagccaauaaagagag

SEQ ID NO: 964719 - RNA, 21 nt, Human
aggagccaauaaagagagggc

SEQ ID NO: 964720 - RNA, 19 nt, Human
agggcuuuggauuccucug

SEQ ID NO: 964721 - RNA, 20 nt, Human
aguccugugaaguaaauguu

SEQ ID NO: 964722 - RNA, 25 nt, Human
aguuuggguaacaucuguuauuuuc

SEQ ID NO: 964723 - RNA, 21 nt, Human
auagcccauuuugaaaagcca

SEQ ID NO: 964724 - RNA, 23 nt, Human
auggccacaaagucaucuaacaa

SEQ ID NO: 964725 - RNA, 21 nt, Human
caaaaaaaacaguaauucuga

SEQ ID NO: 964726 - RNA, 24 nt, Human
caaaagaaaacacaauagugagaa

SEQ ID NO: 964727 - RNA, 20 nt, Human
caaacuguauauauugaaau

SEQ ID NO: 964728 - RNA, 24 nt, Human
caagacacacugcaauauuauuca

SEQ ID NO: 964729 - RNA, 19 nt, Human
caauaaagagagggcuuug

SEQ ID NO: 964730 - RNA, 26 nt, Human
cacaauagugagaauuuaacacaauc

SEQ ID NO: 964731 - RNA, 24 nt, Human
cacuuauuuaagcaauuuuaaucu

SEQ ID NO: 964732 - RNA, 23 nt, Human
cagaauaagcuguuuaccagcca

SEQ ID NO: 964733 - RNA, 22 nt, Human
cagcuguugaugcaagacacac

SEQ ID NO: 964734 - RNA, 23 nt, Human
ccaaaauuuuaauguacacagug

SEQ ID NO: 964735 - RNA, 19 nt, Human
ccaccuacagcugacaaga

SEQ ID NO: 964736 - RNA, 24 nt, Human
ccuacagcugacaagaccgggguc

SEQ ID NO: 964737 - RNA, 21 nt, Human
cguauccuuaaacauaaaacc

SEQ ID NO: 964738 - RNA, 22 nt, Human
cuaaagcuucagcuugugcucc

SEQ ID NO: 964739 - RNA, 22 nt, Human
cuaaaguuucaaucuuauuaac

SEQ ID NO: 964740 - RNA, 21 nt, Human
cucuauggguaugcaugaaau

SEQ ID NO: 964741 - RNA, 19 nt, Human
cugaacacaugaagaguga

SEQ ID NO: 964742 - RNA, 19 nt, Human
cuugaaaacaggacuuccu

SEQ ID NO: 964743 - RNA, 20 nt, Human
gaaaaacaaacaaaaaaaac

SEQ ID NO: 964744 - RNA, 21 nt, Human
gagcaggagccaauaaagaga

SEQ ID NO: 964745 - RNA, 23 nt, Human
gcaacucuuuccauuccccacua

SEQ ID NO: 964746 - RNA, 20 nt, Human
gcaugaaauauccaucuaga

SEQ ID NO: 964747 - RNA, 21 nt, Human
guaaggcaacugaguaaucuc

SEQ ID NO: 964748 - RNA, 18 nt, Human
uaaaaaaguaacucuucc

SEQ ID NO: 964749 - RNA, 19 nt, Human
uaaaacaauacaaaauuca

SEQ ID NO: 964750 - RNA, 19 nt, Human
uaaaaccaauaaccuccca

SEQ ID NO: 964751 - RNA, 25 nt, Human
uaaagcuucagcuugugcucccaua

SEQ ID NO: 964752 - RNA, 23 nt, Human
uaaauaagacagcuguugaugca

SEQ ID NO: 964753 - RNA, 23 nt, Human
uaacuaacaugcuauucagcuuu

SEQ ID NO: 964754 - RNA, 24 nt, Human
uaagaacauguuucauuuucaauu

SEQ ID NO: 964755 - RNA, 23 nt, Human
uaagacagcuguugaugcaagac

SEQ ID NO: 964756 - RNA, 23 nt, Human
uacaacaauaaugaguucagaaa

SEQ ID NO: 964757 - RNA, 28 nt, Human
uacuuuacauaguaaagcaucuuccaaa

SEQ ID NO: 964758 - RNA, 19 nt, Human
uagaaaacaguauaccaca

SEQ ID NO: 964759 - RNA, 18 nt, Human
uagaaggcacuaaagcuu

SEQ ID NO: 964760 - RNA, 18 nt, Human
uaguacaaacuuggaucu

SEQ ID NO: 964761 - RNA, 24 nt, Human
ucaucuaacaacuggaaaagcugu

SEQ ID NO: 964762 - RNA, 23 nt, Human
uccaaaauuuuaauguacacagu

SEQ ID NO: 964763 - RNA, 20 nt, Human
uccuuauccccuuaggcaaa

SEQ ID NO: 964764 - RNA, 20 nt, Human
uccuuauccccuuaggcaaa

SEQ ID NO: 964765 - RNA, 23 nt, Human
ucuaaaaaaguaacucuucccau

SEQ ID NO: 964766 - RNA, 18 nt, Human
ucuagaaaacaguauacc

SEQ ID NO: 964767 - RNA, 19 nt, Human
ugaaaacaggacuuccuuc

SEQ ID NO: 964768 - RNA, 21 nt, Human
ugaaagagaacaguagcaugc

SEQ ID NO: 964769 - RNA, 22 nt, Human
ugaaagagaacaguagcaugca

SEQ ID NO: 964770 - RNA, 22 nt, Human
ugaaaucaguaagaagcucuuc

SEQ ID NO: 964771 - RNA, 18 nt, Human
ugaacacaugaagaguga

SEQ ID NO: 964772 - RNA, 22 nt, Human
ugaacacaugaagagugauuaa

SEQ ID NO: 964773 - RNA, 19 nt, Human
ugaagagugauuaagcagc

SEQ ID NO: 964774 - RNA, 22 nt, Human
ugaaugauuaaaaugaccaucu

SEQ ID NO: 964775 - RNA, 21 nt, Human
ugacaaaaaggaaaaacaaac

SEQ ID NO: 964776 - RNA, 24 nt, Human
ugacaaaaaggaaaaacaaacaaa

SEQ ID NO: 964777 - RNA, 26 nt, Human
ugacuagcacauauaaaauucuagaa

SEQ ID NO: 964778 - RNA, 18 nt, Human
ugcuuuauuuucuuacuc

SEQ ID NO: 964779 - RNA, 22 nt, Human
uggaaaugucaagaaaauuuaa

SEQ ID NO: 964780 - RNA, 22 nt, Human
uggcaaacacuaacagaccaca

SEQ ID NO: 964781 - RNA, 20 nt, Human
ugggauuuuaccuguacugg

SEQ ID NO: 964782 - RNA, 18 nt, Human
uggggaaaaacauuagca

SEQ ID NO: 964783 - RNA, 19 nt, Human
uggggaaaaacauuagcag

SEQ ID NO: 964784 - RNA, 23 nt, Human
uuaacuuuuaauacacuaauuaa

SEQ ID NO: 964785 - RNA, 20 nt, Human
uuaggugaaaucaguaagaa

SEQ ID NO: 964786 - RNA, 27 nt, Human
uucacauuauuuuuccuuauccccuua

SEQ ID NO: 964787 - RNA, 27 nt, Human
uucacauuauuuuuccuuauccccuua

SEQ ID NO: 964788 - RNA, 20 nt, Human
uuccuuauccccuuaggcaa

SEQ ID NO: 964789 - RNA, 20 nt, Human
uuccuuauccccuuaggcaa

SEQ ID NO: 964790 - RNA, 19 nt, Human
uuggauuccucugggauuu

SEQ ID NO: 964791 - RNA, 20 nt, Human
uuggauuugauuccagcauu

SEQ ID NO: 964792 - RNA, 22 nt, Human
uuguccuaaacagugagcaaaa

SEQ ID NO: 964793 - RNA, 23 nt, Human
uuguugagagaauuaaaagcuuu

SEQ ID NO: 964794 - RNA, 21 nt, Human
uuuggauuccucugggauuuu

SEQ ID NO: 964795 - RNA, 21 nt, Human
uuuuaggugaaaucaguaaga

SEQ ID NO: 964796 - RNA, 18 nt, Human
aagcgagagcacggcggc

SEQ ID NO: 964797 - RNA, 25 nt, Human
acaucgaagggcaucaauucaagag

SEQ ID NO: 964798 - RNA, 24 nt, Human
aggaaggccuggugccaggaggcu

SEQ ID NO: 964799 - RNA, 26 nt, Human
aggaaggccuggugccaggaggcuuu

SEQ ID NO: 964800 - RNA, 20 nt, Human
aggccuggugccaggaggcu

SEQ ID NO: 964801 - RNA, 21 nt, Human
cacaauaccagaauauggaac

SEQ ID NO: 964802 - RNA, 19 nt, Human
cagcagugacauguucuac

SEQ ID NO: 964803 - RNA, 20 nt, Human
ccccggccccagccccccuu

SEQ ID NO: 964804 - RNA, 23 nt, Human
cccggccccagccccccuuaggc

SEQ ID NO: 964805 - RNA, 25 nt, Human
cgagagcacggcggcagcuggagac

SEQ ID NO: 964806 - RNA, 24 nt, Human
cggcagugauggcuggccccggcc

SEQ ID NO: 964807 - RNA, 22 nt, Human
cggcagugauggcuggccccuu

SEQ ID NO: 964808 - RNA, 23 nt, Human
cggcggcagcggcggcggcggca

SEQ ID NO: 964809 - RNA, 22 nt, Human
cuggccccggccccagcccccc

SEQ ID NO: 964810 - RNA, 29 nt, Human
cuggccccggccccagccccccuuaggcc

SEQ ID NO: 964811 - RNA, 26 nt, Human
gagcaaaaaugguugaacucaccaua

SEQ ID NO: 964812 - RNA, 25 nt, Human
gcagcggcggcggcggcaacggccu

SEQ ID NO: 964813 - RNA, 21 nt, Human
gcggcagcggcggcggcggca

SEQ ID NO: 964814 - RNA, 21 nt, Human
gcuggccccggccccagcccc

SEQ ID NO: 964815 - RNA, 24 nt, Human
gcuggccccggccccagccccccu

SEQ ID NO: 964816 - RNA, 19 nt, Human
ggaaaggccaggccugaag

SEQ ID NO: 964817 - RNA, 20 nt, Human
ggcaaagcgagagcacggcg

SEQ ID NO: 964818 - RNA, 25 nt, Human
ggcagcggcggcggcggcaacggcc

SEQ ID NO: 964819 - RNA, 19 nt, Human
ggcggcagcggcggcggcg

SEQ ID NO: 964820 - RNA, 22 nt, Human
ggcggcggcaacggccucgugc

SEQ ID NO: 964821 - RNA, 24 nt, Human
gugauggcuggccccggccccagc

SEQ ID NO: 964822 - RNA, 21 nt, Human
uagcacuuucacuaaauggca

SEQ ID NO: 964823 - RNA, 21 nt, Human
uaggaaaggccaggccugaaa

SEQ ID NO: 964824 - RNA, 26 nt, Human
ucaagagcaaaaaugguugaacucac

SEQ ID NO: 964825 - RNA, 19 nt, Human
uccuauggguuacugcagg

SEQ ID NO: 964826 - RNA, 19 nt, Human
ucgacugugcuauucacaa

SEQ ID NO: 964827 - RNA, 24 nt, Human
ugagcucccuguaggaaaggccag

SEQ ID NO: 964828 - RNA, 18 nt, Human
uguaggaaaggccaggcc

SEQ ID NO: 964829 - RNA, 24 nt, Human
uuaggggaguuaaaaauguacagc

SEQ ID NO: 964830 - RNA, 27 nt, Human
aaagauauccagcccaacccaaccccc

SEQ ID NO: 964831 - RNA, 22 nt, Human
aaccaagaacuaaaauguucaa

SEQ ID NO: 964832 - RNA, 26 nt, Human
aacccaaccccccuuccaaaucccac

SEQ ID NO: 964833 - RNA, 22 nt, Human
aacgggacuugcuccggcuccg

SEQ ID NO: 964834 - RNA, 21 nt, Human
aagaggcaaacucaaccaccc

SEQ ID NO: 964835 - RNA, 20 nt, Human
aagauuugcgacuacgggaa

SEQ ID NO: 964836 - RNA, 18 nt, Human
aaucuuugagauccugcc

SEQ ID NO: 964837 - RNA, 22 nt, Human
acaauggaagaaaugcaaugac

SEQ ID NO: 964838 - RNA, 21 nt, Human
accauaagaggcaaacucaac

SEQ ID NO: 964839 - RNA, 26 nt, Human
acccuaacaaggaaaacaaauuaagc

SEQ ID NO: 964840 - RNA, 23 nt, Human
acuuguguucaacugugggcaag

SEQ ID NO: 964841 - RNA, 20 nt, Human
agaaaagcacauacuuacca

SEQ ID NO: 964842 - RNA, 21 nt, Human
agaagaacagauuauacggca

SEQ ID NO: 964843 - RNA, 23 nt, Human
agaccugcuucuugaccugugcc

SEQ ID NO: 964844 - RNA, 18 nt, Human
agcccaacccaacccccc

SEQ ID NO: 964845 - RNA, 22 nt, Human
auaagaggcaaacucaaccacc

SEQ ID NO: 964846 - RNA, 21 nt, Human
auccgcaaacguuacuucccc

SEQ ID NO: 964847 - RNA, 18 nt, Human
caaacucaaccaccccuu

SEQ ID NO: 964848 - RNA, 23 nt, Human
caacaaccccuuggugguccaca

SEQ ID NO: 964849 - RNA, 18 nt, Human
caacccaaccccccuucc

SEQ ID NO: 964850 - RNA, 21 nt, Human
caacccaaccccccuuccaaa

SEQ ID NO: 964851 - RNA, 27 nt, Human
caaccccccuuccaaaucccacccccu

SEQ ID NO: 964852 - RNA, 21 nt, Human
caagccaucagauaucacaag

SEQ ID NO: 964853 - RNA, 22 nt, Human
caauagauuuguguucuaugac

SEQ ID NO: 964854 - RNA, 19 nt, Human
caauggaagaaaugcaaug

SEQ ID NO: 964855 - RNA, 21 nt, Human
cagaaaagcacauacuuacca

SEQ ID NO: 964856 - RNA, 19 nt, Human
cagcagcuguuaaagagug

SEQ ID NO: 964857 - RNA, 18 nt, Human
cagcccaacccaaccccc

SEQ ID NO: 964858 - RNA, 24 nt, Human
cagcccaacccaaccccccuucca

SEQ ID NO: 964859 - RNA, 22 nt, Human
cagccccggccgcucacgaucu

SEQ ID NO: 964860 - RNA, 23 nt, Human
caucacugcuaaugacuccugaa

SEQ ID NO: 964861 - RNA, 25 nt, Human
ccaaccccccuuccaaaucccaccc

SEQ ID NO: 964862 - RNA, 22 nt, Human
ccagcugacucuugaggauaaa

SEQ ID NO: 964863 - RNA, 20 nt, Human
cccaacccaaccccccuucc

SEQ ID NO: 964864 - RNA, 23 nt, Human
cccaacccaaccccccuuccaaa

SEQ ID NO: 964865 - RNA, 22 nt, Human
cccacccccacagaaaagcaca

SEQ ID NO: 964866 - RNA, 22 nt, Human
ccccccuuccaaaucccacccc

SEQ ID NO: 964867 - RNA, 20 nt, Human
cccccuuccaaaucccaccc

SEQ ID NO: 964868 - RNA, 19 nt, Human
cuccugcuucuugaccggc

SEQ ID NO: 964869 - RNA, 20 nt, Human
cuggcucuucucaggcacgg

SEQ ID NO: 964870 - RNA, 20 nt, Human
cuguuaaagaguggaggaca

SEQ ID NO: 964871 - RNA, 20 nt, Human
cuugacccuaacaaggaaaa

SEQ ID NO: 964872 - RNA, 19 nt, Human
gacacccuugacccuaaca

SEQ ID NO: 964873 - RNA, 24 nt, Human
gaccggcuguaagauuugcgacua

SEQ ID NO: 964874 - RNA, 18 nt, Human
gagcggccaugaagaagc

SEQ ID NO: 964875 - RNA, 19 nt, Human
gagcggccaugaagaagcc

SEQ ID NO: 964876 - RNA, 19 nt, Human
gcuccggcuccugcuccug

SEQ ID NO: 964877 - RNA, 24 nt, Human
ggacacccuugacccuaacaagga

SEQ ID NO: 964878 - RNA, 19 nt, Human
gggaauuuuugugguuuuu

SEQ ID NO: 964879 - RNA, 19 nt, Human
gggagaccuacuaacagaa

SEQ ID NO: 964880 - RNA, 18 nt, Human
gggcaaguucaagccauc

SEQ ID NO: 964881 - RNA, 23 nt, Human
guggaggacacccuugacccuaa

SEQ ID NO: 964882 - RNA, 23 nt, Human
guuucuggcucuucucaggcacg

SEQ ID NO: 964883 - RNA, 22 nt, Human
uaacaaacagcugcucuaaugu

SEQ ID NO: 964884 - RNA, 22 nt, Human
uaacagaacgggacuugcuccg

SEQ ID NO: 964885 - RNA, 21 nt, Human
uaaccaagaacuaaaauguuc

SEQ ID NO: 964886 - RNA, 20 nt, Human
uaagaggcaaacucaaccac

SEQ ID NO: 964887 - RNA, 20 nt, Human
uaagucaccauaagaggcaa

SEQ ID NO: 964888 - RNA, 20 nt, Human
uagcaaguaugguuugggaa

SEQ ID NO: 964889 - RNA, 22 nt, Human
ucacugcuaaugacuccugaau

SEQ ID NO: 964890 - RNA, 19 nt, Human
uccagcccaacccaacccc

SEQ ID NO: 964891 - RNA, 21 nt, Human
uccagcccaacccaacccccc

SEQ ID NO: 964892 - RNA, 23 nt, Human
uccgagaaggcuugcccucaaag

SEQ ID NO: 964893 - RNA, 21 nt, Human
uccgcaaacguuacuucccca

SEQ ID NO: 964894 - RNA, 19 nt, Human
uccgcaaagagagcagccc

SEQ ID NO: 964895 - RNA, 19 nt, Human
ucugaggaagaaaauucgu

SEQ ID NO: 964896 - RNA, 23 nt, Human
ucuuaaaugcuaccccuacaaua

SEQ ID NO: 964897 - RNA, 23 nt, Human
ugcuccggcuccggcuccugcuc

SEQ ID NO: 964898 - RNA, 24 nt, Human
ugucaauauacacaaacuauauac

SEQ ID NO: 964899 - RNA, 23 nt, Human
uguccagcagcuguuaaagagug

SEQ ID NO: 964900 - RNA, 22 nt, Human
uucacaaaaaugugagcagaag

SEQ ID NO: 964901 - RNA, 19 nt, Human
uuccucgaaucaacugcgc

SEQ ID NO: 964902 - RNA, 21 nt, Human
uucugguccgggaucgagacc

SEQ ID NO: 964903 - RNA, 21 nt, Human
uugccacugucaacugaucug

SEQ ID NO: 964904 - RNA, 22 nt, Human
uugcugccuucaauuaauuuua

SEQ ID NO: 964905 - RNA, 23 nt, Human
uuuaagucaccauaagaggcaaa

SEQ ID NO: 964906 - RNA, 24 nt, Human
aaaaaaaaaaaaaacaacacuaaa

SEQ ID NO: 964907 - RNA, 23 nt, Human
aaaaaaaaaacaacacuaaauga

SEQ ID NO: 964908 - RNA, 23 nt, Human
aaaaaaacccugccagcagaucc

SEQ ID NO: 964909 - RNA, 22 nt, Human
aaaaaacccugccagcagaucc

SEQ ID NO: 964910 - RNA, 27 nt, Human
aaaaauaagcaaacaaauaaaacaaaa

SEQ ID NO: 964911 - RNA, 23 nt, Human
aaacaaauaaaacaaaaaaaccc

SEQ ID NO: 964912 - RNA, 23 nt, Human
aaauaaaacaaaaaaacccugcc

SEQ ID NO: 964913 - RNA, 23 nt, Human
aacccugccagcagauccugcug

SEQ ID NO: 964914 - RNA, 19 nt, Human
aaguauucaaagcucaaaa

SEQ ID NO: 964915 - RNA, 21 nt, Human
aaucaaaguuaucuuaauucu

SEQ ID NO: 964916 - RNA, 21 nt, Human
accgcaagccaguaaccgcgg

SEQ ID NO: 964917 - RNA, 24 nt, Human
acggcaagagcccgaacacgcgcc

SEQ ID NO: 964918 - RNA, 25 nt, Human
acugccuaaguaggaaaguguucca

SEQ ID NO: 964919 - RNA, 21 nt, Human
auaaaacaaaaaaacccugcc

SEQ ID NO: 964920 - RNA, 23 nt, Human
auaaaacaaaaaaacccugccag

SEQ ID NO: 964921 - RNA, 22 nt, Human
auccugcugaaauacuaaaaaa

SEQ ID NO: 964922 - RNA, 22 nt, Human
auucaaagcucaaaacaguuaa

SEQ ID NO: 964923 - RNA, 20 nt, Human
caaaagcuauaaaaucaaag

SEQ ID NO: 964924 - RNA, 23 nt, Human
caaauaaaacaaaaaaacccugc

SEQ ID NO: 964925 - RNA, 22 nt, Human
caagagcccgaacacgcgccuc

SEQ ID NO: 964926 - RNA, 22 nt, Human
cagaagaggccaaguauaaaca

SEQ ID NO: 964927 - RNA, 18 nt, Human
ccgcaagccaguaaccgc

SEQ ID NO: 964928 - RNA, 22 nt, Human
ccucacaccacaggggcggccg

SEQ ID NO: 964929 - RNA, 19 nt, Human
ccucaucuuuuucauccaa

SEQ ID NO: 964930 - RNA, 21 nt, Human
ccucuugcagaagaggccaag

SEQ ID NO: 964931 - RNA, 18 nt, Human
cucaucuuuuucauccaa

SEQ ID NO: 964932 - RNA, 25 nt, Human
cugaaauacuaaaaaaaaaaaaaaa

SEQ ID NO: 964933 - RNA, 18 nt, Human
gaagggagagggucuuca

SEQ ID NO: 964934 - RNA, 26 nt, Human
gagccucaucuuuuucauccaauuug

SEQ ID NO: 964935 - RNA, 25 nt, Human
gcaaacaaauaaaacaaaaaaaccc

SEQ ID NO: 964936 - RNA, 20 nt, Human
ggcaagagcccgaacacgcg

SEQ ID NO: 964937 - RNA, 19 nt, Human
ggccaaguauaaacaugga

SEQ ID NO: 964938 - RNA, 20 nt, Human
uaaaacaaaaaaacccugcc

SEQ ID NO: 964939 - RNA, 22 nt, Human
uaaaacaaaaaaacccugccag

SEQ ID NO: 964940 - RNA, 26 nt, Human
uaaaacaaaaaaacccugccagcaga

SEQ ID NO: 964941 - RNA, 22 nt, Human
uaaguaggaaaguguuccauaa

SEQ ID NO: 964942 - RNA, 18 nt, Human
ucugugugccccuguuuu

SEQ ID NO: 964943 - RNA, 31 nt, Human
ugcugaaauacuaaaaaaaaaaaaaaaaaaa

SEQ ID NO: 964944 - RNA, 21 nt, Human
uggguucucccucuaaagccu

SEQ ID NO: 964945 - RNA, 22 nt, Human
uggguucucccucuaaagccuu

SEQ ID NO: 964946 - RNA, 19 nt, Human
uguuccauaauaaugugca

SEQ ID NO: 964947 - RNA, 19 nt, Human
uucaagagauuccucuugc

SEQ ID NO: 964948 - RNA, 20 nt, Human
uuuuugguagcaaacuuuua

SEQ ID NO: 964949 - RNA, 20 nt, Human
uuuuuuuuuuuuuuuuuggu

SEQ ID NO: 964950 - RNA, 22 nt, Human
uuuuuuuuuuuuuuuuugguag

SEQ ID NO: 964951 - RNA, 28 nt, Human
uuuuuuuuuuuuuuuuuuuuuuuggggg

SEQ ID NO: 964952 - RNA, 19 nt, Human
aaagccaccaaggguccau

SEQ ID NO: 964953 - RNA, 21 nt, Human
aagaccccgcaucccggaccc

SEQ ID NO: 964954 - RNA, 24 nt, Human
aagguguuuccucccauuuuauuu

SEQ ID NO: 964955 - RNA, 18 nt, Human
acccaaccucaacaccgc

SEQ ID NO: 964956 - RNA, 26 nt, Human
caaagaccccgcaucccggacccaac

SEQ ID NO: 964957 - RNA, 19 nt, Human
cagaagcccacgcagccuc

SEQ ID NO: 964958 - RNA, 19 nt, Human
cagccucccggcucugccu

SEQ ID NO: 964959 - RNA, 24 nt, Human
cagucaaagaccccgcaucccgga

SEQ ID NO: 964960 - RNA, 25 nt, Human
cauggaggcggccagguggauggug

SEQ ID NO: 964961 - RNA, 20 nt, Human
ccccgcaucccggacccaac

SEQ ID NO: 964962 - RNA, 19 nt, Human
gaaaagguguuuccuccca

SEQ ID NO: 964963 - RNA, 21 nt, Human
gaccccgcaucccggacccaa

SEQ ID NO: 964964 - RNA, 20 nt, Human
gaccccgcaucccggacccc

SEQ ID NO: 964965 - RNA, 22 nt, Human
gacgucccugauaccuccacuu

SEQ ID NO: 964966 - RNA, 20 nt, Human
gccaccaaggguccauggag

SEQ ID NO: 964967 - RNA, 19 nt, Human
uacaaaagccaccaagggu

SEQ ID NO: 964968 - RNA, 21 nt, Human
uagaaaagguguuuccuccca

SEQ ID NO: 964969 - RNA, 26 nt, Human
ucaaagaccccgcaucccggacccaa

SEQ ID NO: 964970 - RNA, 23 nt, Human
ucccugauaccuccacuuggccu

SEQ ID NO: 964971 - RNA, 22 nt, Human
ucugcgugagccugcccagaag

SEQ ID NO: 964972 - RNA, 27 nt, Human
ucuucugugccgcgcgacgucccugau

SEQ ID NO: 964973 - RNA, 20 nt, Human
ugcccagaagcccacgcagc

SEQ ID NO: 964974 - RNA, 21 nt, Human
ugcgugagccugcccagaagc

SEQ ID NO: 964975 - RNA, 23 nt, Human
ugcgugagccugcccagaagccc

SEQ ID NO: 964976 - RNA, 23 nt, Human
uguggccggcgucugcgugagcc

SEQ ID NO: 964977 - RNA, 20 nt, Human
aaagcagcucaguuaaccua

SEQ ID NO: 964978 - RNA, 21 nt, Human
aagaaaaaauucccaucaccu

SEQ ID NO: 964979 - RNA, 21 nt, Human
acaaagcagcucaguuaaccu

SEQ ID NO: 964980 - RNA, 19 nt, Human
accccacaaagacagaacg

SEQ ID NO: 964981 - RNA, 21 nt, Human
acucagucacaguaacuguug

SEQ ID NO: 964982 - RNA, 19 nt, Human
aguaacuguugaucuccau

SEQ ID NO: 964983 - RNA, 24 nt, Human
cacaaagcagcucaguuaaccuaa

SEQ ID NO: 964984 - RNA, 18 nt, Human
cagaaugggccgacucag

SEQ ID NO: 964985 - RNA, 27 nt, Human
ccgccgcagcccacgucgccgccgccg

SEQ ID NO: 964986 - RNA, 27 nt, Human
ccuaaaaaauaaagaaaaaauucccau

SEQ ID NO: 964987 - RNA, 21 nt, Human
cugcaguuuaaaauguuucac

SEQ ID NO: 964988 - RNA, 20 nt, Human
gaaccccacaaagacagaac

SEQ ID NO: 964989 - RNA, 21 nt, Human
gcgaaccccacaaagacagaa

SEQ ID NO: 964990 - RNA, 20 nt, Human
uaaauccucaaucuggaaug

SEQ ID NO: 964991 - RNA, 24 nt, Human
uagauucugagcacaaagcagcuc

SEQ ID NO: 964992 - RNA, 18 nt, Human
uaguagagcgaaccccac

SEQ ID NO: 964993 - RNA, 24 nt, Human
uaguuuuuuuucuucuuuaaaaaa

SEQ ID NO: 964994 - RNA, 22 nt, Human
ucugcaguuuaaaauguuucac

SEQ ID NO: 964995 - RNA, 24 nt, Human
aaagagguauagaagcuuccuuuu

SEQ ID NO: 964996 - RNA, 22 nt, Human
aaccauguaacucugcugccuu

SEQ ID NO: 964997 - RNA, 24 nt, Human
aaccuaaugggcugaggaagggag

SEQ ID NO: 964998 - RNA, 19 nt, Human
aagaaagagguauagaagc

SEQ ID NO: 964999 - RNA, 19 nt, Human
aagaagaaagagguauaga

SEQ ID NO: 965000 - RNA, 20 nt, Human
aagcugccugaccagggggc

SEQ ID NO: 965001 - RNA, 24 nt, Human
aaucgcuugaauccaggaggcaga

SEQ ID NO: 965002 - RNA, 24 nt, Human
acagagcaagacuccaucuugaaa

SEQ ID NO: 965003 - RNA, 18 nt, Human
acagucccccaaggagcu

SEQ ID NO: 965004 - RNA, 18 nt, Human
acauuggccuuugcuacc

SEQ ID NO: 965005 - RNA, 23 nt, Human
accccgucuccacuaaaauacaa

SEQ ID NO: 965006 - RNA, 24 nt, Human
accugaggucaggaguucgagacc

SEQ ID NO: 965007 - RNA, 24 nt, Human
acuaaaauacaaaaauuagccagu

SEQ ID NO: 965008 - RNA, 24 nt, Human
acugcauuccagccugggcgacag

SEQ ID NO: 965009 - RNA, 26 nt, Human
acugcauuccagccugggcgacagag

SEQ ID NO: 965010 - RNA, 18 nt, Human
agaagaaagagguauaga

SEQ ID NO: 965011 - RNA, 19 nt, Human
agaagacauuggccuuugc

SEQ ID NO: 965012 - RNA, 18 nt, Human
agaagcuguccgggcugg

SEQ ID NO: 965013 - RNA, 22 nt, Human
agaaucgcuugaauccaggagg

SEQ ID NO: 965014 - RNA, 24 nt, Human
agaguuugcagugagccgagaucg

SEQ ID NO: 965015 - RNA, 20 nt, Human
agcauggugaaaccccgucu

SEQ ID NO: 965016 - RNA, 23 nt, Human
agccaggcgugguggcaggugcc

SEQ ID NO: 965017 - RNA, 24 nt, Human
agccugggcgacagagcaagacuc

SEQ ID NO: 965018 - RNA, 23 nt, Human
aggaggaagcgaagaagagggac

SEQ ID NO: 965019 - RNA, 23 nt, Human
aggaguucgagaccagucuggcc

SEQ ID NO: 965020 - RNA, 21 nt, Human
aggcagaguuugcagugagcc

SEQ ID NO: 965021 - RNA, 24 nt, Human
aggcagaguuugcagugagccgag

SEQ ID NO: 965022 - RNA, 23 nt, Human
aggcaggagaaucgcuugaaucc

SEQ ID NO: 965023 - RNA, 24 nt, Human
aggcaggagaaucgcuugaaucca

SEQ ID NO: 965024 - RNA, 22 nt, Human
aggcgggcggaucaccugaggu

SEQ ID NO: 965025 - RNA, 26 nt, Human
aggcgggcggaucaccugaggucagg

SEQ ID NO: 965026 - RNA, 20 nt, Human
aggcugaggcaggagaaucg

SEQ ID NO: 965027 - RNA, 24 nt, Human
aggcugaggcaggagaaucgcuug

SEQ ID NO: 965028 - RNA, 21 nt, Human
aggcugaggcgggcggaucac

SEQ ID NO: 965029 - RNA, 24 nt, Human
aggcugaggcgggcggaucaccug

SEQ ID NO: 965030 - RNA, 20 nt, Human
aguccuuucccccuucuuuu

SEQ ID NO: 965031 - RNA, 22 nt, Human
agucuggccagcauggugaaac

SEQ ID NO: 965032 - RNA, 24 nt, Human
agucuggccagcauggugaaaccc

SEQ ID NO: 965033 - RNA, 25 nt, Human
auagagaagauuccaagaauagguu

SEQ ID NO: 965034 - RNA, 24 nt, Human
aucgcgccacugcauuccagccug

SEQ ID NO: 965035 - RNA, 21 nt, Human
auuggccuuugcuacccuuuu

SEQ ID NO: 965036 - RNA, 21 nt, Human
caaaugauuugcuuggauguc

SEQ ID NO: 965037 - RNA, 20 nt, Human
caaggucuuuuccucaaccc

SEQ ID NO: 965038 - RNA, 21 nt, Human
cacaagugugcacguagcuaa

SEQ ID NO: 965039 - RNA, 23 nt, Human
caccugaggucaggaguucgaga

SEQ ID NO: 965040 - RNA, 19 nt, Human
cacugcauuccagccuggg

SEQ ID NO: 965041 - RNA, 22 nt, Human
cacugcauuccagccugggcga

SEQ ID NO: 965042 - RNA, 23 nt, Human
cacugcauuccagccugggcgac

SEQ ID NO: 965043 - RNA, 24 nt, Human
cacugcauuccagccugggcgaca

SEQ ID NO: 965044 - RNA, 18 nt, Human
cagaguccuuucccccuu

SEQ ID NO: 965045 - RNA, 24 nt, Human
cagcuacuugagaggcugaggcag

SEQ ID NO: 965046 - RNA, 18 nt, Human
cagcuucuggucuccagg

SEQ ID NO: 965047 - RNA, 25 nt, Human
caugccuguaaucccagcaauuuca

SEQ ID NO: 965048 - RNA, 18 nt, Human
cauggugaaaccccgucu

SEQ ID NO: 965049 - RNA, 19 nt, Human
cauggugaaaccccgucuc

SEQ ID NO: 965050 - RNA, 21 nt, Human
cauggugaaaccccgucucca

SEQ ID NO: 965051 - RNA, 23 nt, Human
cauuccagccugggcgacagagc

SEQ ID NO: 965052 - RNA, 22 nt, Human
ccaaggagcuugagaaaucacc

SEQ ID NO: 965053 - RNA, 20 nt, Human
ccacgcccgccccacgcccc

SEQ ID NO: 965054 - RNA, 25 nt, Human
ccacgcccgccccacgccccuccuu

SEQ ID NO: 965055 - RNA, 20 nt, Human
ccacugcauuccagccuggg

SEQ ID NO: 965056 - RNA, 21 nt, Human
ccacugcauuccagccugggc

SEQ ID NO: 965057 - RNA, 21 nt, Human
ccacugcauuccagccugggc

SEQ ID NO: 965058 - RNA, 24 nt, Human
ccacugcauuccagccugggcgac

SEQ ID NO: 965059 - RNA, 25 nt, Human
ccaucuugaaaaaaaaaaaaaagaa

SEQ ID NO: 965060 - RNA, 21 nt, Human
ccauuaaagugugugguuaau

SEQ ID NO: 965061 - RNA, 23 nt, Human
cccaaggagcuugagaaaucacc

SEQ ID NO: 965062 - RNA, 18 nt, Human
cccaaggggacagagucc

SEQ ID NO: 965063 - RNA, 21 nt, Human
cccaaucuacccuggccuuca

SEQ ID NO: 965064 - RNA, 23 nt, Human
cccacgccccuccuuuucgacca

SEQ ID NO: 965065 - RNA, 24 nt, Human
ccccacgcccgccccacgccccuc

SEQ ID NO: 965066 - RNA, 22 nt, Human
cccccaaucuacccuggccuuc

SEQ ID NO: 965067 - RNA, 19 nt, Human
cccgucuccacuaaaauac

SEQ ID NO: 965068 - RNA, 21 nt, Human
cccugagguccaaucaaccag

SEQ ID NO: 965069 - RNA, 21 nt, Human
cccuguaaucccagcuacuug

SEQ ID NO: 965070 - RNA, 22 nt, Human
cccuguaaucccagcuacuuga

SEQ ID NO: 965071 - RNA, 24 nt, Human
ccgggcugggugugguggcucaug

SEQ ID NO: 965072 - RNA, 23 nt, Human
ccgggugagaggaggaccugggc

SEQ ID NO: 965073 - RNA, 19 nt, Human
ccuaccagacaaaacucau

SEQ ID NO: 965074 - RNA, 22 nt, Human
ccugaggucaggaguucgagac

SEQ ID NO: 965075 - RNA, 22 nt, Human
ccugggcgacagagcaagacuc

SEQ ID NO: 965076 - RNA, 22 nt, Human
ccuguaaucccagcuacuugag

SEQ ID NO: 965077 - RNA, 20 nt, Human
ccuuucccccuucuuuuucc

SEQ ID NO: 965078 - RNA, 24 nt, Human
cgagaccagucuggccagcauggu

SEQ ID NO: 965079 - RNA, 24 nt, Human
cgagaucgcgccacugcauuccag

SEQ ID NO: 965080 - RNA, 22 nt, Human
cgaggaggaggauguggaaggg

SEQ ID NO: 965081 - RNA, 21 nt, Human
cgccuugaaaacuggcccggg

SEQ ID NO: 965082 - RNA, 19 nt, Human
cgcuugaauccaggaggca

SEQ ID NO: 965083 - RNA, 24 nt, Human
cggaucaccugaggucaggaguuc

SEQ ID NO: 965084 - RNA, 27 nt, Human
cggaucaccugaggucaggaguucgag

SEQ ID NO: 965085 - RNA, 24 nt, Human
cgggcggaucaccugaggucagga

SEQ ID NO: 965086 - RNA, 24 nt, Human
cguagcuaaggaggagcuggugaa

SEQ ID NO: 965087 - RNA, 24 nt, Human
cuaaagguuuccuaacuuuuccaa

SEQ ID NO: 965088 - RNA, 20 nt, Human
cuagggcagccaagcugggg

SEQ ID NO: 965089 - RNA, 25 nt, Human
cucaugccuguaaucccagcaauuu

SEQ ID NO: 965090 - RNA, 23 nt, Human
cucuuugguccugguugauuucc

SEQ ID NO: 965091 - RNA, 22 nt, Human
cuggccagcauggugaaacccc

SEQ ID NO: 965092 - RNA, 23 nt, Human
cuggccuucaggccuuguuggca

SEQ ID NO: 965093 - RNA, 19 nt, Human
cugguccuugcugaagugg

SEQ ID NO: 965094 - RNA, 26 nt, Human
cuugcucacacauaaaacuguggacc

SEQ ID NO: 965095 - RNA, 19 nt, Human
cuuucccccuucuuuuucc

SEQ ID NO: 965096 - RNA, 24 nt, Human
cuuuuuagcacuaauaacuccuaa

SEQ ID NO: 965097 - RNA, 24 nt, Human
gaaaucaccuagggcagccaagcu

SEQ ID NO: 965098 - RNA, 19 nt, Human
gaagggaaguggcugugca

SEQ ID NO: 965099 - RNA, 19 nt, Human
gagaggaggaccugggcug

SEQ ID NO: 965100 - RNA, 24 nt, Human
gaucaccugaggucaggaguucga

SEQ ID NO: 965101 - RNA, 24 nt, Human
gcauuccagccugggcgacagagc

SEQ ID NO: 965102 - RNA, 22 nt, Human
gccacugcauuccagccugggc

SEQ ID NO: 965103 - RNA, 24 nt, Human
gccacugcauuccagccugggcga

SEQ ID NO: 965104 - RNA, 24 nt, Human
gccagcauggugaaaccccgucuc

SEQ ID NO: 965105 - RNA, 20 nt, Human
gccgagaucgcgccacugca

SEQ ID NO: 965106 - RNA, 18 nt, Human
gcuggaaccagaauccua

SEQ ID NO: 965107 - RNA, 18 nt, Human
ggaggaggauguggaagg

SEQ ID NO: 965108 - RNA, 27 nt, Human
ggaggaggauguggaagggugaugagc

SEQ ID NO: 965109 - RNA, 22 nt, Human
ggaucaccugaggucaggaguu

SEQ ID NO: 965110 - RNA, 23 nt, Human
ggaucaccugaggucaggaguuc

SEQ ID NO: 965111 - RNA, 24 nt, Human
ggcaacgaggaggaggauguggaa

SEQ ID NO: 965112 - RNA, 18 nt, Human
ggcagccaagcuggggaa

SEQ ID NO: 965113 - RNA, 22 nt, Human
ggcaggugcccuguaaucccag

SEQ ID NO: 965114 - RNA, 21 nt, Human
ggcggaucaccugaggucagg

SEQ ID NO: 965115 - RNA, 19 nt, Human
ggcugggugugguggcuca

SEQ ID NO: 965116 - RNA, 23 nt, Human
ggcugggugugguggcucaugcc

SEQ ID NO: 965117 - RNA, 24 nt, Human
gggcagccaagcuggggaagggaa

SEQ ID NO: 965118 - RNA, 20 nt, Human
gggcugggugugguggcuca

SEQ ID NO: 965119 - RNA, 29 nt, Human
ggggacagaguccuuucccccuucuuuuu

SEQ ID NO: 965120 - RNA, 24 nt, Human
gguggcaggugcccuguaauccca

SEQ ID NO: 965121 - RNA, 24 nt, Human
gguggcucaugccuguaaucccag

SEQ ID NO: 965122 - RNA, 23 nt, Human
ggugugguggcucaugccuguaa

SEQ ID NO: 965123 - RNA, 25 nt, Human
guggacuuaucuuuuaaaacagagg

SEQ ID NO: 965124 - RNA, 24 nt, Human
guggcaggugcccuguaaucccag

SEQ ID NO: 965125 - RNA, 18 nt, Human
guggcagugggguaagag

SEQ ID NO: 965126 - RNA, 20 nt, Human
uaaaacagagguauguggca

SEQ ID NO: 965127 - RNA, 20 nt, Human
uaaggcucuuugguccuggu

SEQ ID NO: 965128 - RNA, 18 nt, Human
uacccuggccuucaggcc

SEQ ID NO: 965129 - RNA, 21 nt, Human
uagcuaaggaggagcugguga

SEQ ID NO: 965130 - RNA, 20 nt, Human
ucaccugaggucaggaguuc

SEQ ID NO: 965131 - RNA, 19 nt, Human
ucagcuucuggucuccagg

SEQ ID NO: 965132 - RNA, 23 nt, Human
ucaggccuuguuggcaaagggga

SEQ ID NO: 965133 - RNA, 20 nt, Human
ucaugccuguaaucccagca

SEQ ID NO: 965134 - RNA, 24 nt, Human
uccagccugggcgacagagcaaga

SEQ ID NO: 965135 - RNA, 20 nt, Human
ucccaccccccaaucuaccc

SEQ ID NO: 965136 - RNA, 21 nt, Human
ucccaggccgggaggcucccg

SEQ ID NO: 965137 - RNA, 19 nt, Human
ucccugagagggccucagc

SEQ ID NO: 965138 - RNA, 21 nt, Human
ucccugagagggccucagcuu

SEQ ID NO: 965139 - RNA, 22 nt, Human
ucccuuuccuauucaguacaca

SEQ ID NO: 965140 - RNA, 23 nt, Human
ucgcgccacugcauuccagccug

SEQ ID NO: 965141 - RNA, 18 nt, Human
ucuccaggggacaggggu

SEQ ID NO: 965142 - RNA, 24 nt, Human
ucuggccagcauggugaaaccccg

SEQ ID NO: 965143 - RNA, 23 nt, Human
ucuuugguguuuaaccuaauggg

SEQ ID NO: 965144 - RNA, 23 nt, Human
ucuuuuccucaacccuggcugga

SEQ ID NO: 965145 - RNA, 21 nt, Human
ugaaaaaaaaaaaaaagaagc

SEQ ID NO: 965146 - RNA, 22 nt, Human
ugaaaccccgucuccacuaaaa

SEQ ID NO: 965147 - RNA, 21 nt, Human
ugaccagggggcaacgaggag

SEQ ID NO: 965148 - RNA, 22 nt, Human
ugagaaacaacagucccccaag

SEQ ID NO: 965149 - RNA, 22 nt, Human
ugagaggaggaccugggcuggg

SEQ ID NO: 965150 - RNA, 22 nt, Human
ugagccgagaucgcgccacugc

SEQ ID NO: 965151 - RNA, 20 nt, Human
ugaggcaggagaaucgcuug

SEQ ID NO: 965152 - RNA, 22 nt, Human
ugaggcaggagaaucgcuugaa

SEQ ID NO: 965153 - RNA, 25 nt, Human
ugaggcaggagaaucgcuugaaucc

SEQ ID NO: 965154 - RNA, 20 nt, Human
ugaggcgggcggaucaccug

SEQ ID NO: 965155 - RNA, 24 nt, Human
ugaggcgggcggaucaccugaggu

SEQ ID NO: 965156 - RNA, 26 nt, Human
ugaggcgggcggaucaccugagguca

SEQ ID NO: 965157 - RNA, 20 nt, Human
ugauccaaggucuuuuccuc

SEQ ID NO: 965158 - RNA, 21 nt, Human
ugauuugaagaaccauguaac

SEQ ID NO: 965159 - RNA, 19 nt, Human
ugauuugcuuggaugucuc

SEQ ID NO: 965160 - RNA, 23 nt, Human
ugcccuguaaucccagcuacuug

SEQ ID NO: 965161 - RNA, 22 nt, Human
ugcugccuugcacgguccccuu

SEQ ID NO: 965162 - RNA, 20 nt, Human
uggaagggugaugagcccca

SEQ ID NO: 965163 - RNA, 24 nt, Human
uggccagcauggugaaaccccguc

SEQ ID NO: 965164 - RNA, 22 nt, Human
uggcucaugccuguaaucccag

SEQ ID NO: 965165 - RNA, 24 nt, Human
uggcucaugccuguaaucccagca

SEQ ID NO: 965166 - RNA, 21 nt, Human
uggcugugcauugcuguguga

SEQ ID NO: 965167 - RNA, 19 nt, Human
uggggaagggaaguggcug

SEQ ID NO: 965168 - RNA, 18 nt, Human
ugggugugguggcucaug

SEQ ID NO: 965169 - RNA, 24 nt, Human
ugguggcucaugccuguaauccca

SEQ ID NO: 965170 - RNA, 22 nt, Human
uuaaagugugugguuaaugccu

SEQ ID NO: 965171 - RNA, 25 nt, Human
uugagaggcugaggcaggagaaucg

SEQ ID NO: 965172 - RNA, 22 nt, Human
uugcacgguccccuuuuuagca

SEQ ID NO: 965173 - RNA, 19 nt, Human
uugcagugagccgagaucg

SEQ ID NO: 965174 - RNA, 22 nt, Human
uugcagugagccgagaucgcgc

SEQ ID NO: 965175 - RNA, 25 nt, Human
uuuccugaguucagcuagaauuaca

SEQ ID NO: 965176 - RNA, 22 nt, Human
uuugauccaaggucuuuuccuc

SEQ ID NO: 965177 - RNA, 19 nt, Human
uuugcagugagccgagauc

SEQ ID NO: 965178 - RNA, 21 nt, Human
uuugcagugagccgagaucgc

SEQ ID NO: 965179 - RNA, 25 nt, Human
aaaaaggaaccaaaguauaaaagga

SEQ ID NO: 965180 - RNA, 18 nt, Human
aaaagacgacccagacau

SEQ ID NO: 965181 - RNA, 27 nt, Human
aaaauaaaaauaaaaaaggaaccaaag

SEQ ID NO: 965182 - RNA, 19 nt, Human
aaagaagucggcucauaac

SEQ ID NO: 965183 - RNA, 19 nt, Human
aaaggccccugggaguggc

SEQ ID NO: 965184 - RNA, 24 nt, Human
aagaggccaagugcagguccaugg

SEQ ID NO: 965185 - RNA, 19 nt, Human
aagcaaaugaguuaugaga

SEQ ID NO: 965186 - RNA, 23 nt, Human
aaucugccccucaggccucccuu

SEQ ID NO: 965187 - RNA, 20 nt, Human
acacuggggacaugcccagg

SEQ ID NO: 965188 - RNA, 27 nt, Human
acccugcagcggccucuuccccccagg

SEQ ID NO: 965189 - RNA, 25 nt, Human
agaagggcauccccaagccugaggg

SEQ ID NO: 965190 - RNA, 25 nt, Human
agacaugccagcaccuaguucaggc

SEQ ID NO: 965191 - RNA, 23 nt, Human
agcacagcgcagcagucacuggc

SEQ ID NO: 965192 - RNA, 20 nt, Human
agccagcccagucuagcccc

SEQ ID NO: 965193 - RNA, 20 nt, Human
agcgggaggcgcaaggcguu

SEQ ID NO: 965194 - RNA, 21 nt, Human
agcuccccggcugcacagugc

SEQ ID NO: 965195 - RNA, 19 nt, Human
agcuggggucacuucaggg

SEQ ID NO: 965196 - RNA, 18 nt, Human
agcuggugggcaccagcg

SEQ ID NO: 965197 - RNA, 26 nt, Human
aggccagaggccagaacaccaaagaa

SEQ ID NO: 965198 - RNA, 18 nt, Human
aggcugggccagggcacc

SEQ ID NO: 965199 - RNA, 21 nt, Human
agggaggccuggggcugcagg

SEQ ID NO: 965200 - RNA, 20 nt, Human
aucuauguuaccuccuccuc

SEQ ID NO: 965201 - RNA, 22 nt, Human
aucuauguuaccuccuccucca

SEQ ID NO: 965202 - RNA, 21 nt, Human
augcccaggaugaccagcauc

SEQ ID NO: 965203 - RNA, 23 nt, Human
augugcugcagagccagcuggug

SEQ ID NO: 965204 - RNA, 26 nt, Human
caaaagacgacccagacaugccagca

SEQ ID NO: 965205 - RNA, 24 nt, Human
caaaucacauagauugagaaauuu

SEQ ID NO: 965206 - RNA, 26 nt, Human
caaaucacauagauugagaaauuuuc

SEQ ID NO: 965207 - RNA, 21 nt, Human
caacaccauggcacccccaca

SEQ ID NO: 965208 - RNA, 22 nt, Human
caacaccauggcacccccacac

SEQ ID NO: 965209 - RNA, 24 nt, Human
cacacucccgcuguuuuguccucc

SEQ ID NO: 965210 - RNA, 18 nt, Human
caccauggcacccccaca

SEQ ID NO: 965211 - RNA, 22 nt, Human
caccauggcacccccacacucc

SEQ ID NO: 965212 - RNA, 20 nt, Human
caccccaggcucugcuuccc

SEQ ID NO: 965213 - RNA, 23 nt, Human
cacccugggucuguccaccagcc

SEQ ID NO: 965214 - RNA, 23 nt, Human
caccugaagcugcauuugggagc

SEQ ID NO: 965215 - RNA, 18 nt, Human
cacugcaccgccacagga

SEQ ID NO: 965216 - RNA, 19 nt, Human
cacugcaccgccacaggag

SEQ ID NO: 965217 - RNA, 21 nt, Human
cacugcaccgccacaggagca

SEQ ID NO: 965218 - RNA, 22 nt, Human
cacugccauuuagugacagagc

SEQ ID NO: 965219 - RNA, 20 nt, Human
cagaacaccaaagaagucgg

SEQ ID NO: 965220 - RNA, 21 nt, Human
cagaacaccaaagaagucggc

SEQ ID NO: 965221 - RNA, 20 nt, Human
cagaggccuccagugcuccc

SEQ ID NO: 965222 - RNA, 18 nt, Human
cagcagaguggggcaugg

SEQ ID NO: 965223 - RNA, 23 nt, Human
cagcauccagccuggggccugga

SEQ ID NO: 965224 - RNA, 25 nt, Human
cagccuggccaccaaaccagcccaa

SEQ ID NO: 965225 - RNA, 24 nt, Human
cagccuuuuuccuccucuaggcuc

SEQ ID NO: 965226 - RNA, 19 nt, Human
cagcuggugggcaccagcg

SEQ ID NO: 965227 - RNA, 18 nt, Human
cagggucacuggacuuca

SEQ ID NO: 965228 - RNA, 19 nt, Human
cagucuagccccacucuca

SEQ ID NO: 965229 - RNA, 18 nt, Human
cauagcccacugucccuc

SEQ ID NO: 965230 - RNA, 19 nt, Human
caugccagcccagggagcc

SEQ ID NO: 965231 - RNA, 24 nt, Human
ccaaagaagucggcucauaaccag

SEQ ID NO: 965232 - RNA, 18 nt, Human
ccacagaaucuugcagag

SEQ ID NO: 965233 - RNA, 21 nt, Human
ccacaggcugggccagggcac

SEQ ID NO: 965234 - RNA, 22 nt, Human
ccaccucagcacacuuccccua

SEQ ID NO: 965235 - RNA, 22 nt, Human
ccaccuguccuccugccacuuc

SEQ ID NO: 965236 - RNA, 19 nt, Human
ccaggcaugaaccaaucug

SEQ ID NO: 965237 - RNA, 19 nt, Human
ccagucuucugguuucaga

SEQ ID NO: 965238 - RNA, 19 nt, Human
cccaccaucaggcccaggc

SEQ ID NO: 965239 - RNA, 21 nt, Human
ccccaccaucaggcccaggca

SEQ ID NO: 965240 - RNA, 19 nt, Human
ccccacucucagccccaga

SEQ ID NO: 965241 - RNA, 19 nt, Human
ccccagaacccagcaucca

SEQ ID NO: 965242 - RNA, 22 nt, Human
ccccaggcaugaaccaaucugc

SEQ ID NO: 965243 - RNA, 18 nt, Human
cccccgccacagcugccu

SEQ ID NO: 965244 - RNA, 23 nt, Human
ccccgccacagcugccucucccg

SEQ ID NO: 965245 - RNA, 23 nt, Human
ccccugagguggagaccccgggg

SEQ ID NO: 965246 - RNA, 23 nt, Human
cccgcaaucuccggcccuuuuaa

SEQ ID NO: 965247 - RNA, 21 nt, Human
cccguauuuauugcccaaagc

SEQ ID NO: 965248 - RNA, 21 nt, Human
cccuccaacaccauggcaccc

SEQ ID NO: 965249 - RNA, 20 nt, Human
cccugaaucaguuagagcuc

SEQ ID NO: 965250 - RNA, 24 nt, Human
cccugggccacugccugaggaccc

SEQ ID NO: 965251 - RNA, 25 nt, Human
cccugggccacugccugaggacccu

SEQ ID NO: 965252 - RNA, 23 nt, Human
ccuacccuaagaugccacccugc

SEQ ID NO: 965253 - RNA, 19 nt, Human
ccuccagugcucccugauu

SEQ ID NO: 965254 - RNA, 18 nt, Human
ccucuggccuaagucucc

SEQ ID NO: 965255 - RNA, 22 nt, Human
ccuuuguacagcuugcucuucc

SEQ ID NO: 965256 - RNA, 24 nt, Human
cuaacccuucucccccuccucacg

SEQ ID NO: 965257 - RNA, 20 nt, Human
cuagguggggucaggagggg

SEQ ID NO: 965258 - RNA, 18 nt, Human
cucaaaaaggccugcccc

SEQ ID NO: 965259 - RNA, 18 nt, Human
cuccacuguagguugagc

SEQ ID NO: 965260 - RNA, 22 nt, Human
cuccaggccuaaucuggcucgc

SEQ ID NO: 965261 - RNA, 21 nt, Human
cuccccuccccaugccagccc

SEQ ID NO: 965262 - RNA, 21 nt, Human
cuccccugagguggagacccc

SEQ ID NO: 965263 - RNA, 21 nt, Human
cuccugcccuuuucccaggcc

SEQ ID NO: 965264 - RNA, 23 nt, Human
cucgggguuuccugccccuaagg

SEQ ID NO: 965265 - RNA, 22 nt, Human
cucucagccccagaacccagcc

SEQ ID NO: 965266 - RNA, 22 nt, Human
cugaggcuggugcuucccccug

SEQ ID NO: 965267 - RNA, 20 nt, Human
cugagggcauguuugaagug

SEQ ID NO: 965268 - RNA, 18 nt, Human
cugcucccugcaggugca

SEQ ID NO: 965269 - RNA, 19 nt, Human
cuggccucagcagaguggg

SEQ ID NO: 965270 - RNA, 25 nt, Human
cuuagccuccaccccaggcaugaac

SEQ ID NO: 965271 - RNA, 22 nt, Human
cuucugcugaggccaacugcag

SEQ ID NO: 965272 - RNA, 19 nt, Human
cuuuguacagcuugcucuu

SEQ ID NO: 965273 - RNA, 20 nt, Human
cuuuguacagcuugcucuuc

SEQ ID NO: 965274 - RNA, 24 nt, Human
cuuuguacagcuugcucuuccuuc

SEQ ID NO: 965275 - RNA, 22 nt, Human
gacuccacggccagcuugacau

SEQ ID NO: 965276 - RNA, 20 nt, Human
gagcuggggucacuucaggg

SEQ ID NO: 965277 - RNA, 22 nt, Human
gagcuggggucacuucaggggc

SEQ ID NO: 965278 - RNA, 18 nt, Human
gagguggagaccccgggg

SEQ ID NO: 965279 - RNA, 23 nt, Human
gagucuacggcccugccccucag

SEQ ID NO: 965280 - RNA, 21 nt, Human
gcaccaggccucuggcagggg

SEQ ID NO: 965281 - RNA, 21 nt, Human
gcaugaaccaaucugccccuc

SEQ ID NO: 965282 - RNA, 19 nt, Human
gcccacugucccucuguca

SEQ ID NO: 965283 - RNA, 22 nt, Human
gcccauggaaggcccaccucag

SEQ ID NO: 965284 - RNA, 27 nt, Human
gccugccccuccaacaccauggcaccc

SEQ ID NO: 965285 - RNA, 25 nt, Human
gccuggggcugcagguggaggcuuc

SEQ ID NO: 965286 - RNA, 21 nt, Human
gcuccgcagaaggcagccagc

SEQ ID NO: 965287 - RNA, 21 nt, Human
gcuccugcccuuuucccaggc

SEQ ID NO: 965288 - RNA, 23 nt, Human
ggacccuagcuccagggucacug

SEQ ID NO: 965289 - RNA, 24 nt, Human
ggagaugggagccagcagcaaggg

SEQ ID NO: 965290 - RNA, 18 nt, Human
ggagccagcagcaagggg

SEQ ID NO: 965291 - RNA, 23 nt, Human
ggagcuggggucacuucaggggc

SEQ ID NO: 965292 - RNA, 21 nt, Human
ggaguggaggcugagagaagg

SEQ ID NO: 965293 - RNA, 20 nt, Human
ggccaccaaaccagcccaac

SEQ ID NO: 965294 - RNA, 21 nt, Human
ggccaggcagggacaccaggg

SEQ ID NO: 965295 - RNA, 20 nt, Human
ggccagggcaccaggccucu

SEQ ID NO: 965296 - RNA, 18 nt, Human
ggcugcacugaggcuggu

SEQ ID NO: 965297 - RNA, 28 nt, Human
ggcuggugcuucccccugguuugggccu

SEQ ID NO: 965298 - RNA, 23 nt, Human
gggaaccccuugauccagucuuc

SEQ ID NO: 965299 - RNA, 19 nt, Human
gggaauggaagaagggcau

SEQ ID NO: 965300 - RNA, 21 nt, Human
gggaggccuggggcugcaggu

SEQ ID NO: 965301 - RNA, 21 nt, Human
gggcagcaggugggcugcucc

SEQ ID NO: 965302 - RNA, 20 nt, Human
gggcaggcagccuugguggc

SEQ ID NO: 965303 - RNA, 19 nt, Human
gggcaugggugcuggguga

SEQ ID NO: 965304 - RNA, 23 nt, Human
gggccaggcagggacaccagggg

SEQ ID NO: 965305 - RNA, 23 nt, Human
gggcccaggacugcugggguugg

SEQ ID NO: 965306 - RNA, 20 nt, Human
gggggagggaggccuggggc

SEQ ID NO: 965307 - RNA, 24 nt, Human
ggugcagaccaccuucucuccccu

SEQ ID NO: 965308 - RNA, 21 nt, Human
ggugcugggugaagguuuccc

SEQ ID NO: 965309 - RNA, 21 nt, Human
gguggguaggcaguuuugguc

SEQ ID NO: 965310 - RNA, 19 nt, Human
gucuacggcccugccccuc

SEQ ID NO: 965311 - RNA, 24 nt, Human
gugcugcagagccagcuggugggc

SEQ ID NO: 965312 - RNA, 23 nt, Human
uaaaaugucccuccucggccccc

SEQ ID NO: 965313 - RNA, 18 nt, Human
uaacccuucucccccucc

SEQ ID NO: 965314 - RNA, 20 nt, Human
uagauugagaaauuuucuga

SEQ ID NO: 965315 - RNA, 19 nt, Human
uagguggggucaggagggg

SEQ ID NO: 965316 - RNA, 23 nt, Human
ucacacccaccccaggcucugcu

SEQ ID NO: 965317 - RNA, 22 nt, Human
ucacccugcucacacccacccc

SEQ ID NO: 965318 - RNA, 20 nt, Human
uccaacaccauggcaccccc

SEQ ID NO: 965319 - RNA, 21 nt, Human
uccaugguuccugccaagcac

SEQ ID NO: 965320 - RNA, 18 nt, Human
ucccccugguuugggccu

SEQ ID NO: 965321 - RNA, 20 nt, Human
ucccugauucccugggccac

SEQ ID NO: 965322 - RNA, 19 nt, Human
ucccugcaggugcagccgu

SEQ ID NO: 965323 - RNA, 21 nt, Human
ucccugggccacugccugagg

SEQ ID NO: 965324 - RNA, 23 nt, Human
ucccugggccacugccugaggac

SEQ ID NO: 965325 - RNA, 23 nt, Human
uccugcccuuuucccaggccaga

SEQ ID NO: 965326 - RNA, 18 nt, Human
ucugacaucucacugcca

SEQ ID NO: 965327 - RNA, 19 nt, Human
ucugauaggugucuaagga

SEQ ID NO: 965328 - RNA, 21 nt, Human
ucuugcagaggccuccagugc

SEQ ID NO: 965329 - RNA, 25 nt, Human
ucuugcagaggccuccagugcuccc

SEQ ID NO: 965330 - RNA, 22 nt, Human
ugaagugaccagaggagggcca

SEQ ID NO: 965331 - RNA, 20 nt, Human
ugaccagaggagggccaggc

SEQ ID NO: 965332 - RNA, 19 nt, Human
ugagaugcugaggccacag

SEQ ID NO: 965333 - RNA, 18 nt, Human
ugaggcugccagagugag

SEQ ID NO: 965334 - RNA, 22 nt, Human
ugaggcuggugcuucccccugg

SEQ ID NO: 965335 - RNA, 21 nt, Human
ugagguuaaaaagacgcugca

SEQ ID NO: 965336 - RNA, 23 nt, Human
ugagguuaaaaagacgcugcaaa

SEQ ID NO: 965337 - RNA, 24 nt, Human
ugaguuaugagaugcugaggccac

SEQ ID NO: 965338 - RNA, 22 nt, Human
ugcagagccagcuggugggcac

SEQ ID NO: 965339 - RNA, 19 nt, Human
ugccauuuagugacagagc

SEQ ID NO: 965340 - RNA, 25 nt, Human
ugcccaggaugaccagcaucugagc

SEQ ID NO: 965341 - RNA, 28 nt, Human
ugccuggagcuggggucacuucaggggc

SEQ ID NO: 965342 - RNA, 22 nt, Human
uggaaggaggaucuucccgaag

SEQ ID NO: 965343 - RNA, 18 nt, Human
uggagaccccgggggagg

SEQ ID NO: 965344 - RNA, 21 nt, Human
uggaguuuugacaaccccaca

SEQ ID NO: 965345 - RNA, 21 nt, Human
uggcagggggagggcgggaag

SEQ ID NO: 965346 - RNA, 24 nt, Human
uggccaccaaaccagcccaacucc

SEQ ID NO: 965347 - RNA, 22 nt, Human
uggccuaggcauucucaggcau

SEQ ID NO: 965348 - RNA, 18 nt, Human
ugggaguggcugaggcug

SEQ ID NO: 965349 - RNA, 20 nt, Human
ugggauggggcaggcagccu

SEQ ID NO: 965350 - RNA, 23 nt, Human
ugggauggggcaggcagccuugg

SEQ ID NO: 965351 - RNA, 24 nt, Human
uggggacaugcccaggaugaccag

SEQ ID NO: 965352 - RNA, 20 nt, Human
uggggcugcagguggaggcu

SEQ ID NO: 965353 - RNA, 19 nt, Human
uggguaggcaguuuugguc

SEQ ID NO: 965354 - RNA, 24 nt, Human
ugucuaaggagcuggccuaggcau

SEQ ID NO: 965355 - RNA, 20 nt, Human
ugugcugcagagccagcugg

SEQ ID NO: 965356 - RNA, 21 nt, Human
uucacauuauggugggauugg

SEQ ID NO: 965357 - RNA, 22 nt, Human
uuccuggucugcaaaugggagg

SEQ ID NO: 965358 - RNA, 24 nt, Human
uucuagguggggucaggagggggc

SEQ ID NO: 965359 - RNA, 27 nt, Human
uuggucccaagauaaagugcacaagaa

SEQ ID NO: 965360 - RNA, 21 nt, Human
uuuggcaaaggucaacugcuc

SEQ ID NO: 965361 - RNA, 18 nt, Human
uuuucagcuucacacaua

SEQ ID NO: 965362 - RNA, 22 nt, Human
uuuuuuuuuuuuuuuuuuuggc

SEQ ID NO: 965363 - RNA, 21 nt, Human
aaaccuaacauuggaagccau

SEQ ID NO: 965364 - RNA, 21 nt, Human
aacacaaaauaggcagcuaga

SEQ ID NO: 965365 - RNA, 20 nt, Human
aagaccccugugagccaggg

SEQ ID NO: 965366 - RNA, 19 nt, Human
acacccagggcaacaagac

SEQ ID NO: 965367 - RNA, 24 nt, Human
acccaacauucuccccuaaugucu

SEQ ID NO: 965368 - RNA, 22 nt, Human
agaaaugauauccccuggaccc

SEQ ID NO: 965369 - RNA, 19 nt, Human
agggauagucacguaccca

SEQ ID NO: 965370 - RNA, 21 nt, Human
agggggauggucagggugugg

SEQ ID NO: 965371 - RNA, 24 nt, Human
agucauuggggggagcuuuuggga

SEQ ID NO: 965372 - RNA, 21 nt, Human
augugcuggaaaaaauaaacc

SEQ ID NO: 965373 - RNA, 18 nt, Human
caaaauaggcagcuagag

SEQ ID NO: 965374 - RNA, 22 nt, Human
caaaauaggcagcuagagcucc

SEQ ID NO: 965375 - RNA, 19 nt, Human
caacaagaccccugugagc

SEQ ID NO: 965376 - RNA, 22 nt, Human
caacaagaccccugugagccag

SEQ ID NO: 965377 - RNA, 21 nt, Human
cagaagggauaaagggggaug

SEQ ID NO: 965378 - RNA, 21 nt, Human
cagcaaauaagccacauuucc

SEQ ID NO: 965379 - RNA, 24 nt, Human
cagccucugaguaucugaugaccu

SEQ ID NO: 965380 - RNA, 21 nt, Human
cagcuggccucaguaguuuca

SEQ ID NO: 965381 - RNA, 21 nt, Human
cagggcagagauacagccucu

SEQ ID NO: 965382 - RNA, 20 nt, Human
cauuucccagccuccauucc

SEQ ID NO: 965383 - RNA, 22 nt, Human
ccagcuggccucaguaguuuca

SEQ ID NO: 965384 - RNA, 20 nt, Human
ccccugugagccaggguagc

SEQ ID NO: 965385 - RNA, 18 nt, Human
ccccuuuccuccauuuuc

SEQ ID NO: 965386 - RNA, 20 nt, Human
ccccuuuccuccauuuuccc

SEQ ID NO: 965387 - RNA, 24 nt, Human
cccuuugcucuucuccccuuuccu

SEQ ID NO: 965388 - RNA, 24 nt, Human
ccugugagccaggguagcuccaga

SEQ ID NO: 965389 - RNA, 23 nt, Human
ccuuacuaauaccagcuggccuc

SEQ ID NO: 965390 - RNA, 18 nt, Human
cuaaacacaaaauaggca

SEQ ID NO: 965391 - RNA, 19 nt, Human
cuagagcuccaguaaccau

SEQ ID NO: 965392 - RNA, 24 nt, Human
cucuucuccccuuuccuccauuuu

SEQ ID NO: 965393 - RNA, 19 nt, Human
cugccuacccaacauucuc

SEQ ID NO: 965394 - RNA, 21 nt, Human
cuuugcucuucuccccuuucc

SEQ ID NO: 965395 - RNA, 22 nt, Human
gagaucaaaauccaaacaccag

SEQ ID NO: 965396 - RNA, 23 nt, Human
gaggcccuaugguaaaagagggc

SEQ ID NO: 965397 - RNA, 22 nt, Human
gauucuuuucaagaacugggga

SEQ ID NO: 965398 - RNA, 20 nt, Human
gccacauuucccagccucca

SEQ ID NO: 965399 - RNA, 22 nt, Human
gccuacccaacauucuccccua

SEQ ID NO: 965400 - RNA, 20 nt, Human
gcucuucuccccuuuccucc

SEQ ID NO: 965401 - RNA, 19 nt, Human
ggagcuuuugggaaagcuc

SEQ ID NO: 965402 - RNA, 24 nt, Human
ggggggagcuuuugggaaagcucu

SEQ ID NO: 965403 - RNA, 23 nt, Human
ggucaggguguggccccucccag

SEQ ID NO: 965404 - RNA, 19 nt, Human
gucauuggggggagcuuuu

SEQ ID NO: 965405 - RNA, 22 nt, Human
uaagccacauuucccagccucc

SEQ ID NO: 965406 - RNA, 23 nt, Human
uagcaaaccuaacauuggaagcc

SEQ ID NO: 965407 - RNA, 21 nt, Human
uagcuccagaaguccaagaug

SEQ ID NO: 965408 - RNA, 23 nt, Human
uauccccuggacccagacuuccu

SEQ ID NO: 965409 - RNA, 25 nt, Human
uauuagggauagucacguacccagc

SEQ ID NO: 965410 - RNA, 22 nt, Human
ucaaaauccaaacaccaggagg

SEQ ID NO: 965411 - RNA, 18 nt, Human
ucaguaguuucacagguc

SEQ ID NO: 965412 - RNA, 24 nt, Human
ucaguaguuucacagguccuucuc

SEQ ID NO: 965413 - RNA, 19 nt, Human
uccccuuuccuccauuuuc

SEQ ID NO: 965414 - RNA, 21 nt, Human
ucuucuccccuuuccuccauu

SEQ ID NO: 965415 - RNA, 21 nt, Human
ugagaucaaaauccaaacacc

SEQ ID NO: 965416 - RNA, 19 nt, Human
ugagauggaagcaaaaguc

SEQ ID NO: 965417 - RNA, 21 nt, Human
ugcucuucuccccuuuccucc

SEQ ID NO: 965418 - RNA, 21 nt, Human
uggaagcaaaagucauugggg

SEQ ID NO: 965419 - RNA, 22 nt, Human
uggaagccauuugucaagguug

SEQ ID NO: 965420 - RNA, 23 nt, Human
uggccccucccaggcugauucuu

SEQ ID NO: 965421 - RNA, 21 nt, Human
uguccugccaguccuggacuc

SEQ ID NO: 965422 - RNA, 22 nt, Human
uuaguuugagucgcucuuccua

SEQ ID NO: 965423 - RNA, 19 nt, Human
uucaagaacuggggacacc

SEQ ID NO: 965424 - RNA, 21 nt, Human
uuugcucuucuccccuuuccu

SEQ ID NO: 965425 - RNA, 26 nt, Human
aaagugcuggaauuuuauaggcauga

SEQ ID NO: 965426 - RNA, 24 nt, Human
aaagugcugggauuacaggcguga

SEQ ID NO: 965427 - RNA, 21 nt, Human
aaauaauccacaaaguugaac

SEQ ID NO: 965428 - RNA, 21 nt, Human
aacaaaagccauagcaaagag

SEQ ID NO: 965429 - RNA, 20 nt, Human
aagagcacaccaaaaaaugc

SEQ ID NO: 965430 - RNA, 24 nt, Human
aagagcuuugaaauaccuauuugc

SEQ ID NO: 965431 - RNA, 23 nt, Human
aagcaaauacaaagauucagaau

SEQ ID NO: 965432 - RNA, 25 nt, Human
aagcgauucuccugccuuagccucc

SEQ ID NO: 965433 - RNA, 23 nt, Human
aaggucuguuuccugugcuuuuu

SEQ ID NO: 965434 - RNA, 24 nt, Human
aaguagcugggauuauaggcaugu

SEQ ID NO: 965435 - RNA, 24 nt, Human
aagugauccuccugccuuggccuc

SEQ ID NO: 965436 - RNA, 19 nt, Human
aagugcugggauuacaggc

SEQ ID NO: 965437 - RNA, 19 nt, Human
aagugcugggauuacaggc

SEQ ID NO: 965438 - RNA, 20 nt, Human
aaguuauuccaauuguuaac

SEQ ID NO: 965439 - RNA, 23 nt, Human
aaugaguacaaaaaaucauacaa

SEQ ID NO: 965440 - RNA, 21 nt, Human
acaccaaaaaaugcauccgaa

SEQ ID NO: 965441 - RNA, 24 nt, Human
acaccaaaaaaugcauccgaagaa

SEQ ID NO: 965442 - RNA, 19 nt, Human
acauugccuaggcuggucu

SEQ ID NO: 965443 - RNA, 23 nt, Human
accucuacucuaagccaagaauc

SEQ ID NO: 965444 - RNA, 20 nt, Human
acgggguuuguccauguugg

SEQ ID NO: 965445 - RNA, 24 nt, Human
acgggguuuguccauguuggucag

SEQ ID NO: 965446 - RNA, 24 nt, Human
acuuauuuugcucaaugguuucug

SEQ ID NO: 965447 - RNA, 21 nt, Human
acuucagccuccugaguagcu

SEQ ID NO: 965448 - RNA, 21 nt, Human
agaaaugcuucugugauuucu

SEQ ID NO: 965449 - RNA, 21 nt, Human
agaggaaaaauaauccacaaa

SEQ ID NO: 965450 - RNA, 26 nt, Human
agcaaaaagguuucuuucuccccugg

SEQ ID NO: 965451 - RNA, 25 nt, Human
aggcaggagugcaauggugcgaucu

SEQ ID NO: 965452 - RNA, 19 nt, Human
aggcaugagccaccaugcc

SEQ ID NO: 965453 - RNA, 20 nt, Human
aggcaugagccaccgugccc

SEQ ID NO: 965454 - RNA, 21 nt, Human
aggcaugagccaccgugcccg

SEQ ID NO: 965455 - RNA, 23 nt, Human
aggcaugagccaccgugcccggc

SEQ ID NO: 965456 - RNA, 21 nt, Human
aggcucaagugauccuccugc

SEQ ID NO: 965457 - RNA, 22 nt, Human
aggcucaagugauccuccugcc

SEQ ID NO: 965458 - RNA, 23 nt, Human
agggucucgcuguggcacccagg

SEQ ID NO: 965459 - RNA, 24 nt, Human
aggugaucugcccgccucagccuc

SEQ ID NO: 965460 - RNA, 23 nt, Human
aguagcugggacuaaaggcaugu

SEQ ID NO: 965461 - RNA, 20 nt, Human
agugcaauggugcgaucucg

SEQ ID NO: 965462 - RNA, 24 nt, Human
agugcaauggugcgaucucggcuc

SEQ ID NO: 965463 - RNA, 21 nt, Human
agugcaguggcacaauuucag

SEQ ID NO: 965464 - RNA, 18 nt, Human
agugcugggauuacaggc

SEQ ID NO: 965465 - RNA, 18 nt, Human
auaggguuucgccauguu

SEQ ID NO: 965466 - RNA, 19 nt, Human
auaggguuucgccauguug

SEQ ID NO: 965467 - RNA, 24 nt, Human
auaggguuucgccauguugcccag

SEQ ID NO: 965468 - RNA, 21 nt, Human
caaaaaaugcauccgaagaaa

SEQ ID NO: 965469 - RNA, 23 nt, Human
caaaaaaugcauccgaagaaaca

SEQ ID NO: 965470 - RNA, 26 nt, Human
caaagugcuggaauuuuauaggcaug

SEQ ID NO: 965471 - RNA, 24 nt, Human
caaagugcugggauuacaggcgug

SEQ ID NO: 965472 - RNA, 18 nt, Human
caacuucagccuccugag

SEQ ID NO: 965473 - RNA, 22 nt, Human
caagcgauucuccugccuuagc

SEQ ID NO: 965474 - RNA, 22 nt, Human
caagugauccuccugccuuggc

SEQ ID NO: 965475 - RNA, 27 nt, Human
caagugauccuccugccuuggccuccc

SEQ ID NO: 965476 - RNA, 27 nt, Human
caagugauccuccugccuuggccuccc

SEQ ID NO: 965477 - RNA, 18 nt, Human
caccaugccuggccuauu

SEQ ID NO: 965478 - RNA, 24 nt, Human
caccaugucuggcuaauuuuugua

SEQ ID NO: 965479 - RNA, 21 nt, Human
cacugcaaccuccgccucccg

SEQ ID NO: 965480 - RNA, 23 nt, Human
cacugcaaccuccgccucccggg

SEQ ID NO: 965481 - RNA, 20 nt, Human
cagccuccugaguagcuggg

SEQ ID NO: 965482 - RNA, 23 nt, Human
caucucgugggcucaagccaucc

SEQ ID NO: 965483 - RNA, 24 nt, Human
caugagccaccaugccuggccuau

SEQ ID NO: 965484 - RNA, 24 nt, Human
cauguugcccaggauggucucaaa

SEQ ID NO: 965485 - RNA, 22 nt, Human
cauugccuaggcuggucuugaa

SEQ ID NO: 965486 - RNA, 26 nt, Human
ccaaagugcuggaauuuuauaggcau

SEQ ID NO: 965487 - RNA, 22 nt, Human
ccaaagugcugggauuacaggc

SEQ ID NO: 965488 - RNA, 22 nt, Human
ccaaagugcugggauuacaggc

SEQ ID NO: 965489 - RNA, 24 nt, Human
ccaaagugcugggauuacaggcgu

SEQ ID NO: 965490 - RNA, 22 nt, Human
ccaaauaaaccaaauauuuaca

SEQ ID NO: 965491 - RNA, 24 nt, Human
ccaaguagcugggauuauaggcau

SEQ ID NO: 965492 - RNA, 18 nt, Human
ccacugcccaauucugcu

SEQ ID NO: 965493 - RNA, 21 nt, Human
ccauagcaaagaguuacaaag

SEQ ID NO: 965494 - RNA, 22 nt, Human
ccauguugcccaggauggucuc

SEQ ID NO: 965495 - RNA, 19 nt, Human
ccauguuggucaggcuggu

SEQ ID NO: 965496 - RNA, 22 nt, Human
ccauguuggucaggcuggucuc

SEQ ID NO: 965497 - RNA, 23 nt, Human
cccaaguagcugggauuauaggc

SEQ ID NO: 965498 - RNA, 24 nt, Human
cccaaguagcugggauuauaggca

SEQ ID NO: 965499 - RNA, 20 nt, Human
cccggguucaagcgauucuc

SEQ ID NO: 965500 - RNA, 23 nt, Human
cccggguucaagcgauucuccug

SEQ ID NO: 965501 - RNA, 24 nt, Human
ccgccucagccucccaaagugcug

SEQ ID NO: 965502 - RNA, 24 nt, Human
ccgccucccggguucaagcgauuc

SEQ ID NO: 965503 - RNA, 20 nt, Human
ccgcgcccggccuguuacuu

SEQ ID NO: 965504 - RNA, 24 nt, Human
ccucccggguucaagcgauucucc

SEQ ID NO: 965505 - RNA, 26 nt, Human
ccuccugccuuggccucccaaagugc

SEQ ID NO: 965506 - RNA, 22 nt, Human
ccugaccucaggugaucugccc

SEQ ID NO: 965507 - RNA, 19 nt, Human
ccugaguagcugggacuaa

SEQ ID NO: 965508 - RNA, 23 nt, Human
ccugccuuagccucccaaguagc

SEQ ID NO: 965509 - RNA, 24 nt, Human
ccugccuuggccucccaaagugcu

SEQ ID NO: 965510 - RNA, 25 nt, Human
ccuuagccucccaaguagcugggau

SEQ ID NO: 965511 - RNA, 24 nt, Human
cgccauguugcccaggauggucuc

SEQ ID NO: 965512 - RNA, 27 nt, Human
cgccauguugcccaggauggucucaaa

SEQ ID NO: 965513 - RNA, 21 nt, Human
cucaaauaaucugccugccuc

SEQ ID NO: 965514 - RNA, 20 nt, Human
cucaagugauccuccugccu

SEQ ID NO: 965515 - RNA, 24 nt, Human
cucaagugauccuccugccuuggc

SEQ ID NO: 965516 - RNA, 24 nt, Human
cucacugcaaccuccgccucccgg

SEQ ID NO: 965517 - RNA, 26 nt, Human
cuccugaccucaggugaucugcccgc

SEQ ID NO: 965518 - RNA, 24 nt, Human
cucuacucuaagccaagaauccaa

SEQ ID NO: 965519 - RNA, 18 nt, Human
cucucucuuuuuuuuaaa

SEQ ID NO: 965520 - RNA, 23 nt, Human
cugcaaccuccgccucccggguu

SEQ ID NO: 965521 - RNA, 24 nt, Human
cugcaaccuccgccucccggguuc

SEQ ID NO: 965522 - RNA, 29 nt, Human
cugccaauuuuguauuuuuaguagagacg

SEQ ID NO: 965523 - RNA, 21 nt, Human
cugccugccucggccucccag

SEQ ID NO: 965524 - RNA, 23 nt, Human
cugccuuagccucccaaguagcu

SEQ ID NO: 965525 - RNA, 21 nt, Human
cuuauaggcaugagccaccau

SEQ ID NO: 965526 - RNA, 21 nt, Human
cuuuuguuacuuuuuccuuuu

SEQ ID NO: 965527 - RNA, 21 nt, Human
gaaaaaacagucaauagcaaa

SEQ ID NO: 965528 - RNA, 24 nt, Human
gaaaaaacagucaauagcaaaaag

SEQ ID NO: 965529 - RNA, 24 nt, Human
gaccucaggugaucugcccgccuc

SEQ ID NO: 965530 - RNA, 23 nt, Human
gagacgggguuuguccauguugg

SEQ ID NO: 965531 - RNA, 24 nt, Human
gagacgggguuuguccauguuggu

SEQ ID NO: 965532 - RNA, 24 nt, Human
gagcucaaauaaucugccugccuc

SEQ ID NO: 965533 - RNA, 20 nt, Human
gaguagcugggacuaaaggc

SEQ ID NO: 965534 - RNA, 23 nt, Human
gccucagccucccaaagugcugg

SEQ ID NO: 965535 - RNA, 22 nt, Human
gccuuggccucccaaagugcug

SEQ ID NO: 965536 - RNA, 24 nt, Human
gcgauucuccugccuuagccuccc

SEQ ID NO: 965537 - RNA, 23 nt, Human
gcuggucuccaacuccugaccuc

SEQ ID NO: 965538 - RNA, 24 nt, Human
gcuuauaggcaugagccaccaugc

SEQ ID NO: 965539 - RNA, 23 nt, Human
ggagugcaauggugcgaucucgg

SEQ ID NO: 965540 - RNA, 24 nt, Human
ggcuggucuccaacuccugaccuc

SEQ ID NO: 965541 - RNA, 23 nt, Human
gggguuuguccauguuggucagg

SEQ ID NO: 965542 - RNA, 21 nt, Human
ggguuucgccauguugcccag

SEQ ID NO: 965543 - RNA, 22 nt, Human
ggguuucgccauguugcccagg

SEQ ID NO: 965544 - RNA, 22 nt, Human
ggguuuguccauguuggucagg

SEQ ID NO: 965545 - RNA, 23 nt, Human
guagagacgggguuuguccaugu

SEQ ID NO: 965546 - RNA, 21 nt, Human
guagagauaggguuucgccau

SEQ ID NO: 965547 - RNA, 22 nt, Human
guagagauaggguuucgccaug

SEQ ID NO: 965548 - RNA, 18 nt, Human
guagcugggauuauaggc

SEQ ID NO: 965549 - RNA, 24 nt, Human
gugaucugcccgccucagccuccc

SEQ ID NO: 965550 - RNA, 22 nt, Human
uaaaauaaauagaaaugaggug

SEQ ID NO: 965551 - RNA, 22 nt, Human
uaaauuccgggcccgauuuuca

SEQ ID NO: 965552 - RNA, 24 nt, Human
uaacaggaaugaaugaguacaaaa

SEQ ID NO: 965553 - RNA, 23 nt, Human
uaagccaagaauccaagguaagc

SEQ ID NO: 965554 - RNA, 24 nt, Human
uaauuuuuguauuuuuuguagaga

SEQ ID NO: 965555 - RNA, 25 nt, Human
uacaaaaaaucauacaagaaacuag

SEQ ID NO: 965556 - RNA, 22 nt, Human
uacaggcgugacaacccgcgcc

SEQ ID NO: 965557 - RNA, 19 nt, Human
uacaguagugccaaauaaa

SEQ ID NO: 965558 - RNA, 24 nt, Human
uacauugccuaggcuggucuugaa

SEQ ID NO: 965559 - RNA, 22 nt, Human
uacgguuucuucuuaaacaacc

SEQ ID NO: 965560 - RNA, 19 nt, Human
uacuuuuuccuuuuuuuuu

SEQ ID NO: 965561 - RNA, 22 nt, Human
uagagauaggguuucgccaugu

SEQ ID NO: 965562 - RNA, 24 nt, Human
uagggucucgcuguggcacccagg

SEQ ID NO: 965563 - RNA, 24 nt, Human
uaggguuucgccauguugcccagg

SEQ ID NO: 965564 - RNA, 24 nt, Human
uaguagagacgggguuuguccaug

SEQ ID NO: 965565 - RNA, 26 nt, Human
uaugacagacauucauuuuugguacc

SEQ ID NO: 965566 - RNA, 21 nt, Human
uaugcuuuuacauuucgauca

SEQ ID NO: 965567 - RNA, 21 nt, Human
uauucacacaaauagaaguuu

SEQ ID NO: 965568 - RNA, 18 nt, Human
uauuuugcucaaugguuu

SEQ ID NO: 965569 - RNA, 20 nt, Human
ucacccccacugcccaauuc

SEQ ID NO: 965570 - RNA, 21 nt, Human
ucacccccacugcccaauucu

SEQ ID NO: 965571 - RNA, 23 nt, Human
ucacugcaaccuccgccucccgg

SEQ ID NO: 965572 - RNA, 24 nt, Human
ucacugcaaccuccgccucccggg

SEQ ID NO: 965573 - RNA, 25 nt, Human
ucacugcaaccuccgccucccgggu

SEQ ID NO: 965574 - RNA, 27 nt, Human
ucacugcaaccuccgccucccggguuc

SEQ ID NO: 965575 - RNA, 23 nt, Human
ucacugcaacuuccaucucgugg

SEQ ID NO: 965576 - RNA, 24 nt, Human
ucacugcaacuuccaucucguggg

SEQ ID NO: 965577 - RNA, 23 nt, Human
ucagccuccugaguagcugggac

SEQ ID NO: 965578 - RNA, 20 nt, Human
ucaggcuggucuccaacucc

SEQ ID NO: 965579 - RNA, 24 nt, Human
ucagucccaucuauagacuuauuu

SEQ ID NO: 965580 - RNA, 18 nt, Human
uccauguuggucaggcug

SEQ ID NO: 965581 - RNA, 26 nt, Human
ucccaaagugcuggaauuuuauaggc

SEQ ID NO: 965582 - RNA, 24 nt, Human
ucccaaagugcugggauuacaggc

SEQ ID NO: 965583 - RNA, 24 nt, Human
ucccaaguagcugggauuauaggc

SEQ ID NO: 965584 - RNA, 21 nt, Human
ucccggguucaagcgauucuc

SEQ ID NO: 965585 - RNA, 24 nt, Human
ucccggguucaagcgauucuccug

SEQ ID NO: 965586 - RNA, 23 nt, Human
uccuccauaacuuaaaaaaaacc

SEQ ID NO: 965587 - RNA, 24 nt, Human
uccugaguagcugggacuaaaggc

SEQ ID NO: 965588 - RNA, 24 nt, Human
ucgccauguugcccaggauggucu

SEQ ID NO: 965589 - RNA, 19 nt, Human
ucucaaacuccugagcuca

SEQ ID NO: 965590 - RNA, 20 nt, Human
ucucaagacauacauggaag

SEQ ID NO: 965591 - RNA, 26 nt, Human
ucuccugccuuagccucccaaguagc

SEQ ID NO: 965592 - RNA, 24 nt, Human
ucucgcuguggcacccaggcugaa

SEQ ID NO: 965593 - RNA, 21 nt, Human
ucugcccgccucagccuccca

SEQ ID NO: 965594 - RNA, 22 nt, Human
ucugccugccucggccucccag

SEQ ID NO: 965595 - RNA, 20 nt, Human
ucuuugggaauacuuaaaaa

SEQ ID NO: 965596 - RNA, 22 nt, Human
ucuuugggaauacuuaaaaauc

SEQ ID NO: 965597 - RNA, 22 nt, Human
ugaauauauucacacaaauaga

SEQ ID NO: 965598 - RNA, 18 nt, Human
ugaccucaggugaucugc

SEQ ID NO: 965599 - RNA, 20 nt, Human
ugaccucaggugaucugccc

SEQ ID NO: 965600 - RNA, 24 nt, Human
ugaccucaggugaucugcccgccu

SEQ ID NO: 965601 - RNA, 21 nt, Human
ugcagaauaaaguuauuccaa

SEQ ID NO: 965602 - RNA, 22 nt, Human
ugcaguggcacaauuucaguuc

SEQ ID NO: 965603 - RNA, 28 nt, Human
ugcccaggauggucucaaacuccugagc

SEQ ID NO: 965604 - RNA, 19 nt, Human
ugcccaggcaggagugcaa

SEQ ID NO: 965605 - RNA, 20 nt, Human
ugcccggccaguuauucucc

SEQ ID NO: 965606 - RNA, 21 nt, Human
ugccuaggcuggucuugaacu

SEQ ID NO: 965607 - RNA, 21 nt, Human
ugccucggccucccagggugc

SEQ ID NO: 965608 - RNA, 24 nt, Human
ugccuuagccucccaaguagcugg

SEQ ID NO: 965609 - RNA, 22 nt, Human
ugcugggauuacaggcgugaca

SEQ ID NO: 965610 - RNA, 20 nt, Human
uggcacaauuucaguucacu

SEQ ID NO: 965611 - RNA, 24 nt, Human
uggcacaauuucaguucacugcaa

SEQ ID NO: 965612 - RNA, 24 nt, Human
ugggacuaaaggcaugugccacca

SEQ ID NO: 965613 - RNA, 18 nt, Human
ugggauuacaggcgugac

SEQ ID NO: 965614 - RNA, 19 nt, Human
ugggauuacaggcgugaca

SEQ ID NO: 965615 - RNA, 22 nt, Human
ugggauuacaggcgugacaacc

SEQ ID NO: 965616 - RNA, 23 nt, Human
ugggauuacaggcgugacaaccc

SEQ ID NO: 965617 - RNA, 24 nt, Human
ugggauuacaggcgugacaacccg

SEQ ID NO: 965618 - RNA, 18 nt, Human
ugggauuauaggcaugug

SEQ ID NO: 965619 - RNA, 23 nt, Human
ugggauuauaggcaugugcacca

SEQ ID NO: 965620 - RNA, 24 nt, Human
ugguaccaccuuaaaaaauccuuu

SEQ ID NO: 965621 - RNA, 24 nt, Human
uggucaggcuggucuccaacuccu

SEQ ID NO: 965622 - RNA, 24 nt, Human
uguagagauaggguuucgccaugu

SEQ ID NO: 965623 - RNA, 21 nt, Human
uguauuuuuaguagagacggg

SEQ ID NO: 965624 - RNA, 26 nt, Human
uguggcacccaggcugaaaagugcag

SEQ ID NO: 965625 - RNA, 22 nt, Human
uguugcccaggcaggagugcaa

SEQ ID NO: 965626 - RNA, 18 nt, Human
uuaguagagacgggguuu

SEQ ID NO: 965627 - RNA, 24 nt, Human
uuaguagagacgggguuuguccau

SEQ ID NO: 965628 - RNA, 24 nt, Human
uuauuaaacaagaauauaaauuuu

SEQ ID NO: 965629 - RNA, 19 nt, Human
uucaaaagaugaauagaac

SEQ ID NO: 965630 - RNA, 24 nt, Human
uucaaaagaugaauagaacauaaa

SEQ ID NO: 965631 - RNA, 20 nt, Human
uucaagcgauucuccugccu

SEQ ID NO: 965632 - RNA, 24 nt, Human
uucaagcgauucuccugccuuagc

SEQ ID NO: 965633 - RNA, 24 nt, Human
uucagaggaaaaauaauccacaaa

SEQ ID NO: 965634 - RNA, 24 nt, Human
uucagccuccugaguagcugggac

SEQ ID NO: 965635 - RNA, 22 nt, Human
uucuagaaagcucaauuuuuua

SEQ ID NO: 965636 - RNA, 18 nt, Human
uugcccaggcaggagugc

SEQ ID NO: 965637 - RNA, 18 nt, Human
uuggccucccaaagugcu

SEQ ID NO: 965638 - RNA, 24 nt, Human
uuguagagauaggguuucgccaug

SEQ ID NO: 965639 - RNA, 23 nt, Human
uuguauuuuuaguagagacgggg

SEQ ID NO: 965640 - RNA, 21 nt, Human
uuuaaaauaaauagaaaugag

SEQ ID NO: 965641 - RNA, 25 nt, Human
uuuacaguauagauauuaaagucuu

SEQ ID NO: 965642 - RNA, 26 nt, Human
uuuacaguauagauauuaaagucuuc

SEQ ID NO: 965643 - RNA, 19 nt, Human
uuucgccauguugcccagg

SEQ ID NO: 965644 - RNA, 25 nt, Human
uuugaaauaccuauuugcaaaagca

SEQ ID NO: 965645 - RNA, 18 nt, Human
uuuguagagauaggguuu

SEQ ID NO: 965646 - RNA, 24 nt, Human
uuuguagagauaggguuucgccau

SEQ ID NO: 965647 - RNA, 19 nt, Human
uuuuguauuuuuaguagag

SEQ ID NO: 965648 - RNA, 20 nt, Human
uuuuguauuuuuaguagaga

SEQ ID NO: 965649 - RNA, 20 nt, Human
uuuuguauuuuuuguagaga

SEQ ID NO: 965650 - RNA, 23 nt, Human
uuuuuaguagagacgggguuugu

SEQ ID NO: 965651 - RNA, 20 nt, Human
uuuuuguauuuuuuguagag

SEQ ID NO: 965652 - RNA, 22 nt, Human
uuuuuuguagagauaggguuuc

SEQ ID NO: 965653 - RNA, 23 nt, Human
uuuuuuguagagauaggguuucg

SEQ ID NO: 965654 - RNA, 22 nt, Human
aaaaagcagauccagaagaaaa

SEQ ID NO: 965655 - RNA, 25 nt, Human
aaaaagcagauccagaagaaaaaca

SEQ ID NO: 965656 - RNA, 20 nt, Human
aaaagcagauccagaagaaa

SEQ ID NO: 965657 - RNA, 20 nt, Human
aaaggcaacuacagccaagg

SEQ ID NO: 965658 - RNA, 24 nt, Human
aagaagcacauugcauuuggcuca

SEQ ID NO: 965659 - RNA, 25 nt, Human
aagaagggugaaugagugaaaagaa

SEQ ID NO: 965660 - RNA, 24 nt, Human
aagagaagagagguuuaaaaauga

SEQ ID NO: 965661 - RNA, 18 nt, Human
aagaugcuuagccuuaga

SEQ ID NO: 965662 - RNA, 23 nt, Human
aauaaaaagcagauccagaagaa

SEQ ID NO: 965663 - RNA, 26 nt, Human
agaaaucaacacuacuguuaaaaaua

SEQ ID NO: 965664 - RNA, 20 nt, Human
agaauguccuucaacuugag

SEQ ID NO: 965665 - RNA, 23 nt, Human
aguacagagaauuccuagauagc

SEQ ID NO: 965666 - RNA, 24 nt, Human
cacuacuguuaaaaauacuccaga

SEQ ID NO: 965667 - RNA, 23 nt, Human
cacuuucaauccaggguuuuagu

SEQ ID NO: 965668 - RNA, 24 nt, Human
cauuuggcucacaugucuccuuag

SEQ ID NO: 965669 - RNA, 25 nt, Human
ggaauacucuaaaauaccccaggga

SEQ ID NO: 965670 - RNA, 19 nt, Human
guagaauguccuucaacuu

SEQ ID NO: 965671 - RNA, 22 nt, Human
guagaauguccuucaacuugag

SEQ ID NO: 965672 - RNA, 20 nt, Human
guggagcuaggaaaggcaac

SEQ ID NO: 965673 - RNA, 19 nt, Human
uaaaaagcagauccagaag

SEQ ID NO: 965674 - RNA, 24 nt, Human
uaaaaagcagauccagaagaaaaa

SEQ ID NO: 965675 - RNA, 24 nt, Human
uaaguagauaaucugacuccucuc

SEQ ID NO: 965676 - RNA, 24 nt, Human
uagauagcccucacccaguuucag

SEQ ID NO: 965677 - RNA, 21 nt, Human
uagcccuacucgguguguaau

SEQ ID NO: 965678 - RNA, 19 nt, Human
uaucuagaacaaaucugaa

SEQ ID NO: 965679 - RNA, 24 nt, Human
uauuuuuguaaaauaaaaagcaga

SEQ ID NO: 965680 - RNA, 19 nt, Human
ucacccaguuucaguuucu

SEQ ID NO: 965681 - RNA, 21 nt, Human
uccagaagaaaaacauuugaa

SEQ ID NO: 965682 - RNA, 18 nt, Human
uccuagauagcccucacc

SEQ ID NO: 965683 - RNA, 24 nt, Human
uccuagauagcccucacccaguuu

SEQ ID NO: 965684 - RNA, 19 nt, Human
ucuaccuccuugaguggag

SEQ ID NO: 965685 - RNA, 24 nt, Human
ucuauucagacuucaucaguuuuu

SEQ ID NO: 965686 - RNA, 19 nt, Human
uguaucaaacaugccuaca

SEQ ID NO: 965687 - RNA, 21 nt, Human
uuacugaucuuuuucuguucc

SEQ ID NO: 965688 - RNA, 23 nt, Human
uuauauuguucuuuuuguacauu

SEQ ID NO: 965689 - RNA, 24 nt, Human
uucaaaauuuucacccuaauuaaa

SEQ ID NO: 965690 - RNA, 18 nt, Human
uucuauucagacuucauc

SEQ ID NO: 965691 - RNA, 22 nt, Human
uuuaaaucacaaaguuuauaua

SEQ ID NO: 965692 - RNA, 22 nt, Human
uuucucaggauucccuuauuuu

SEQ ID NO: 965693 - RNA, 25 nt, Human
uuucuuagacuuaccgaaaauuugg

SEQ ID NO: 965694 - RNA, 24 nt, Human
uuuuuuuuuuuuuuuuuuuucaag

SEQ ID NO: 965695 - RNA, 21 nt, Human
aagauuucuccauccccacaa

SEQ ID NO: 965696 - RNA, 21 nt, Human
agaaguauaaucuuucaaaaa

SEQ ID NO: 965697 - RNA, 23 nt, Human
agaaugaaucuaucuaggagcaa

SEQ ID NO: 965698 - RNA, 23 nt, Human
agcaaacacaauguaacacugaa

SEQ ID NO: 965699 - RNA, 19 nt, Human
cacaauacgaugagagcaa

SEQ ID NO: 965700 - RNA, 20 nt, Human
cauuaaagauuucuccaucc

SEQ ID NO: 965701 - RNA, 19 nt, Human
cugaaaucuuuaaggacag

SEQ ID NO: 965702 - RNA, 18 nt, Human
uaaaauguuaucuucauu

SEQ ID NO: 965703 - RNA, 19 nt, Human
uacuaucacgguuaccacc

SEQ ID NO: 965704 - RNA, 21 nt, Human
uaucaaaaauaaggcaauaac

SEQ ID NO: 965705 - RNA, 25 nt, Human
ucaaaaauaaggcaauaaccgaaaa

SEQ ID NO: 965706 - RNA, 22 nt, Human
ucaaaagcaguuuuuaaaagca

SEQ ID NO: 965707 - RNA, 18 nt, Human
ucaaaauucaagaaugca

SEQ ID NO: 965708 - RNA, 27 nt, Human
uccauccccacaacuagauagaaugaa

SEQ ID NO: 965709 - RNA, 24 nt, Human
ugaaaaaucuaagcucacccaaag

SEQ ID NO: 965710 - RNA, 23 nt, Human
ugaaggaaaauaauuucuaaagc

SEQ ID NO: 965711 - RNA, 28 nt, Human
uuaaagauuucuccauccccacaacuag

SEQ ID NO: 965712 - RNA, 22 nt, Human
uucaaaaagauauucaguguuc

SEQ ID NO: 965713 - RNA, 19 nt, Human
acaggcccccucacacggu

SEQ ID NO: 965714 - RNA, 24 nt, Human
acaugucuugccccagaguuccag

SEQ ID NO: 965715 - RNA, 21 nt, Human
accauagacaucucuugcccc

SEQ ID NO: 965716 - RNA, 24 nt, Human
accauagacaucucuugccccaga

SEQ ID NO: 965717 - RNA, 22 nt, Human
acgcuggggccacaggcccccu

SEQ ID NO: 965718 - RNA, 20 nt, Human
acuccaaucacaccaacccg

SEQ ID NO: 965719 - RNA, 23 nt, Human
aggcccccucacacggucugccu

SEQ ID NO: 965720 - RNA, 19 nt, Human
caccuuuaguuucuuggcu

SEQ ID NO: 965721 - RNA, 27 nt, Human
ccacagcacgcuggggccacaggcccc

SEQ ID NO: 965722 - RNA, 23 nt, Human
ccacaggcccccucacacggucu

SEQ ID NO: 965723 - RNA, 23 nt, Human
ccauagacaugucuugccccaga

SEQ ID NO: 965724 - RNA, 22 nt, Human
ccucuccgccucuacaccagcc

SEQ ID NO: 965725 - RNA, 18 nt, Human
cucauggucauaguauca

SEQ ID NO: 965726 - RNA, 20 nt, Human
cucauggucauaguaucacc

SEQ ID NO: 965727 - RNA, 23 nt, Human
cucuacaccagccucauauccac

SEQ ID NO: 965728 - RNA, 24 nt, Human
gagucacuccaaucacaccaaccc

SEQ ID NO: 965729 - RNA, 19 nt, Human
gccuccacuucccacuccc

SEQ ID NO: 965730 - RNA, 18 nt, Human
gugaaccuuaaaacggaa

SEQ ID NO: 965731 - RNA, 18 nt, Human
uaccauagacaugucuug

SEQ ID NO: 965732 - RNA, 22 nt, Human
uacucauggucauaguaucacc

SEQ ID NO: 965733 - RNA, 22 nt, Human
ucauauccacacgggaugcucu

SEQ ID NO: 965734 - RNA, 19 nt, Human
ucuaaauuuugaaaccacu

SEQ ID NO: 965735 - RNA, 20 nt, Human
ucucuugccccagaguucca

SEQ ID NO: 965736 - RNA, 19 nt, Human
ugaaaaaugcuaccauagc

SEQ ID NO: 965737 - RNA, 23 nt, Human
ugccuccacuucccacuccccga

SEQ ID NO: 965738 - RNA, 19 nt, Human
uggcucagcuaccauagac

SEQ ID NO: 965739 - RNA, 21 nt, Human
ugucuugccccagaguuccag

SEQ ID NO: 965740 - RNA, 22 nt, Human
uucaccuuuaguuucuuggcuc

SEQ ID NO: 965741 - RNA, 22 nt, Human
uucccacuccccgaggccacag

SEQ ID NO: 965742 - RNA, 20 nt, Human
uucucccucucauguucugg

SEQ ID NO: 965743 - RNA, 24 nt, Human
aaagugcugagauuacaggccuga

SEQ ID NO: 965744 - RNA, 19 nt, Human
aacugcuagaaaucacggc

SEQ ID NO: 965745 - RNA, 26 nt, Human
aagugcugagauuacaggccugagcu

SEQ ID NO: 965746 - RNA, 24 nt, Human
accauguugcccuggcuggucuug

SEQ ID NO: 965747 - RNA, 22 nt, Human
agauuacaggccugagcugcug

SEQ ID NO: 965748 - RNA, 21 nt, Human
agggugccagggcugagcucu

SEQ ID NO: 965749 - RNA, 24 nt, Human
agugcugagauuacaggccugagc

SEQ ID NO: 965750 - RNA, 24 nt, Human
caaagugcugagauuacaggccug

SEQ ID NO: 965751 - RNA, 24 nt, Human
caccauguugcccuggcuggucuu

SEQ ID NO: 965752 - RNA, 27 nt, Human
caccauguugcccuggcuggucuugaa

SEQ ID NO: 965753 - RNA, 23 nt, Human
cagagggugccagggcugagcuc

SEQ ID NO: 965754 - RNA, 19 nt, Human
caggacccgcggggcuccc

SEQ ID NO: 965755 - RNA, 22 nt, Human
caggauuccaccugaggcgcga

SEQ ID NO: 965756 - RNA, 24 nt, Human
cauguugcccuggcuggucuugaa

SEQ ID NO: 965757 - RNA, 24 nt, Human
ccaaagugcugagauuacaggccu

SEQ ID NO: 965758 - RNA, 20 nt, Human
cccgcggggcucccacgagg

SEQ ID NO: 965759 - RNA, 19 nt, Human
ccugaggcgcgaggagccu

SEQ ID NO: 965760 - RNA, 31 nt, Human
ccuggccucaagccuuccuuccgccucggcc

SEQ ID NO: 965761 - RNA, 23 nt, Human
ccuuccuuccgccucggccuccc

SEQ ID NO: 965762 - RNA, 24 nt, Human
cgaggcuggguccaggcggaagcu

SEQ ID NO: 965763 - RNA, 24 nt, Human
cgccucggccucccaaagugcuga

SEQ ID NO: 965764 - RNA, 21 nt, Human
cggaagcugaggcuccgcggc

SEQ ID NO: 965765 - RNA, 24 nt, Human
cggcuccgggcugcugucaccccc

SEQ ID NO: 965766 - RNA, 21 nt, Human
cucccaaagugcugagauuac

SEQ ID NO: 965767 - RNA, 22 nt, Human
cugagcucugcacuuucaacag

SEQ ID NO: 965768 - RNA, 19 nt, Human
cugcgguccccaccucuuc

SEQ ID NO: 965769 - RNA, 26 nt, Human
cugggacgacuccuuuggucucuucu

SEQ ID NO: 965770 - RNA, 19 nt, Human
cugugaggcacagggcagg

SEQ ID NO: 965771 - RNA, 26 nt, Human
gacuccuuuggucucuucugggguuc

SEQ ID NO: 965772 - RNA, 24 nt, Human
gauuacaggccugagcugcuguau

SEQ ID NO: 965773 - RNA, 22 nt, Human
gccucagucuuccacaucuggg

SEQ ID NO: 965774 - RNA, 23 nt, Human
gcuggucuugaacuccuggccuc

SEQ ID NO: 965775 - RNA, 21 nt, Human
ggagcucuugggaacagaggg

SEQ ID NO: 965776 - RNA, 24 nt, Human
ggcuggucuugaacuccuggccuc

SEQ ID NO: 965777 - RNA, 22 nt, Human
uagagaugaggucucaccaugu

SEQ ID NO: 965778 - RNA, 24 nt, Human
ucccaaagugcugagauuacaggc

SEQ ID NO: 965779 - RNA, 28 nt, Human
ucgcaaaaaccugggggucccggguguu

SEQ ID NO: 965780 - RNA, 18 nt, Human
ucggccucccaaagugcu

SEQ ID NO: 965781 - RNA, 21 nt, Human
ucugggcaggacccgcggggc

SEQ ID NO: 965782 - RNA, 23 nt, Human
ucugggcaggacccgcggggcuc

SEQ ID NO: 965783 - RNA, 19 nt, Human
ucuugaacuccuggccuca

SEQ ID NO: 965784 - RNA, 21 nt, Human
ucuugaacuccuggccucaag

SEQ ID NO: 965785 - RNA, 21 nt, Human
ugaagucaacugcuagaaauc

SEQ ID NO: 965786 - RNA, 19 nt, Human
ugagauuacaggccugagc

SEQ ID NO: 965787 - RNA, 19 nt, Human
ugagauuacaggccugagc

SEQ ID NO: 965788 - RNA, 22 nt, Human
ugagauuacaggccugagcugc

SEQ ID NO: 965789 - RNA, 24 nt, Human
ugagauuacaggccugagcugcug

SEQ ID NO: 965790 - RNA, 24 nt, Human
ugcacuuucaacaggccucagucu

SEQ ID NO: 965791 - RNA, 24 nt, Human
ugcccuggcuggucuugaacuccu

SEQ ID NO: 965792 - RNA, 21 nt, Human
uggccucaagccuuccuuccg

SEQ ID NO: 965793 - RNA, 24 nt, Human
uggccucaagccuuccuuccgccu

SEQ ID NO: 965794 - RNA, 18 nt, Human
ugggaacagagggugcca

SEQ ID NO: 965795 - RNA, 22 nt, Human
ugggaacagagggugccagggc

SEQ ID NO: 965796 - RNA, 20 nt, Human
ugggcaggacccgcggggcu

SEQ ID NO: 965797 - RNA, 22 nt, Human
ugguccaggugacccugacugc

SEQ ID NO: 965798 - RNA, 24 nt, Human
uguagagaugaggucucaccaugu

SEQ ID NO: 965799 - RNA, 24 nt, Human
uuguagagaugaggucucaccaug

SEQ ID NO: 965800 - RNA, 27 nt, Human
uuuuuuuuuuuuuuuuacauuuuuuaa

SEQ ID NO: 965801 - RNA, 20 nt, Human
aacccggggaccuccuaaaa

SEQ ID NO: 965802 - RNA, 21 nt, Human
ccgcugucgccgccggcaacc

SEQ ID NO: 965803 - RNA, 24 nt, Human
ucccccgcugucgccgccggcaac

SEQ ID NO: 965804 - RNA, 23 nt, Human
aaagguacauauucuuguucaug

SEQ ID NO: 965805 - RNA, 21 nt, Human
aagagguguuugcuuuuggua

SEQ ID NO: 965806 - RNA, 25 nt, Human
acacucauacaauacauggcuaaac

SEQ ID NO: 965807 - RNA, 26 nt, Human
accauaaucaccauaauguucaaauu

SEQ ID NO: 965808 - RNA, 23 nt, Human
agaaaagauucucacugcuuaga

SEQ ID NO: 965809 - RNA, 19 nt, Human
aggagggaaggguguuuuc

SEQ ID NO: 965810 - RNA, 19 nt, Human
agggaaaccaaucuugggg

SEQ ID NO: 965811 - RNA, 19 nt, Human
aguaauggcagaaggaggg

SEQ ID NO: 965812 - RNA, 18 nt, Human
aucccauucuccucacca

SEQ ID NO: 965813 - RNA, 25 nt, Human
cagcauacaauagauauacaugaua

SEQ ID NO: 965814 - RNA, 19 nt, Human
caucucuucauuauauguu

SEQ ID NO: 965815 - RNA, 21 nt, Human
caugugaaaacccaacuaauc

SEQ ID NO: 965816 - RNA, 23 nt, Human
caugugaaaacccaacuaaucua

SEQ ID NO: 965817 - RNA, 21 nt, Human
cuggaauagaggcauagaaaa

SEQ ID NO: 965818 - RNA, 22 nt, Human
cuucuacuuuuugcuggaauag

SEQ ID NO: 965819 - RNA, 21 nt, Human
gacagguuauuucucuuucuc

SEQ ID NO: 965820 - RNA, 21 nt, Human
gagggaaggguguuuucuuug

SEQ ID NO: 965821 - RNA, 25 nt, Human
gcaaaaaguaaagaccagcauacaa

SEQ ID NO: 965822 - RNA, 24 nt, Human
gcuaaacugaaauaaaaagguaag

SEQ ID NO: 965823 - RNA, 21 nt, Human
ggaauagaggcauagaaaaga

SEQ ID NO: 965824 - RNA, 22 nt, Human
ggcagaaggagggaaggguguu

SEQ ID NO: 965825 - RNA, 20 nt, Human
guaaagaccagcauacaaua

SEQ ID NO: 965826 - RNA, 18 nt, Human
guagaaguuucaucuaca

SEQ ID NO: 965827 - RNA, 19 nt, Human
guugccauaguaauggcag

SEQ ID NO: 965828 - RNA, 22 nt, Human
uaacauaucauaaacauuaccu

SEQ ID NO: 965829 - RNA, 27 nt, Human
uacaauacauggcuaaacugaaauaaa

SEQ ID NO: 965830 - RNA, 21 nt, Human
uagaaaagauucucacugcuu

SEQ ID NO: 965831 - RNA, 18 nt, Human
uagcuguguaguuaaaca

SEQ ID NO: 965832 - RNA, 26 nt, Human
uaucccauucuccucaccauaaucac

SEQ ID NO: 965833 - RNA, 21 nt, Human
ucaugauauacauaugcauau

SEQ ID NO: 965834 - RNA, 21 nt, Human
ucuuuuuagaagucuucaggc

SEQ ID NO: 965835 - RNA, 19 nt, Human
ugaaaagggcuguggagca

SEQ ID NO: 965836 - RNA, 20 nt, Human
ugaaauaaaaagguaagaua

SEQ ID NO: 965837 - RNA, 20 nt, Human
ugcuagagaaugccauuuua

SEQ ID NO: 965838 - RNA, 18 nt, Human
uggcaaaaaguaaagacc

SEQ ID NO: 965839 - RNA, 19 nt, Human
uggcagaaggagggaaggg

SEQ ID NO: 965840 - RNA, 19 nt, Human
uggcagaaggagggaaggg

SEQ ID NO: 965841 - RNA, 20 nt, Human
uggcagaaggagggaagggu

SEQ ID NO: 965842 - RNA, 21 nt, Human
uggcagaaggagggaagggug

SEQ ID NO: 965843 - RNA, 18 nt, Human
uuaaagcacagugcuuaa

SEQ ID NO: 965844 - RNA, 21 nt, Human
uucaugauauacauaugcaua

SEQ ID NO: 965845 - RNA, 18 nt, Human
uugaagcaaagcuaauuc

SEQ ID NO: 965846 - RNA, 24 nt, Human
uuguuuggguccugaaaagggcug

SEQ ID NO: 965847 - RNA, 30 nt, Human
uuucaugauauacauaugcauauuucacuu

SEQ ID NO: 965848 - RNA, 27 nt, Human
aaaaaaaaaaaaaaaugggguggggag

SEQ ID NO: 965849 - RNA, 20 nt, Human
aaaaacaccuuuuccguggc

SEQ ID NO: 965850 - RNA, 24 nt, Human
aaaacaccggaauuuggaaaaaca

SEQ ID NO: 965851 - RNA, 22 nt, Human
aaaaugcaucuccgucaucuuc

SEQ ID NO: 965852 - RNA, 24 nt, Human
aaacaccggaauuuggaaaaacaa

SEQ ID NO: 965853 - RNA, 24 nt, Human
aaaccuacagcucguucccucuga

SEQ ID NO: 965854 - RNA, 19 nt, Human
aaagccucaaccuuaccaa

SEQ ID NO: 965855 - RNA, 18 nt, Human
aaaucugucauacuuucc

SEQ ID NO: 965856 - RNA, 20 nt, Human
aaccuacagcucguucccuc

SEQ ID NO: 965857 - RNA, 19 nt, Human
aagcaaucaugcaauucuc

SEQ ID NO: 965858 - RNA, 18 nt, Human
aaguagaaaucugucaua

SEQ ID NO: 965859 - RNA, 24 nt, Human
aaguaugguauugauccuauaacc

SEQ ID NO: 965860 - RNA, 18 nt, Human
aauccaccaccugauuug

SEQ ID NO: 965861 - RNA, 23 nt, Human
acaaaauagaagcagcagcuguc

SEQ ID NO: 965862 - RNA, 22 nt, Human
accccaccccacccaggggcug

SEQ ID NO: 965863 - RNA, 21 nt, Human
acccucgugcaggaccucaug

SEQ ID NO: 965864 - RNA, 19 nt, Human
agaauacaaguaaggaccc

SEQ ID NO: 965865 - RNA, 22 nt, Human
agagaacauggccaccagccug

SEQ ID NO: 965866 - RNA, 23 nt, Human
agcacauuuccuuugcuccagca

SEQ ID NO: 965867 - RNA, 23 nt, Human
agcuacgagccgccggcagccuc

SEQ ID NO: 965868 - RNA, 22 nt, Human
agcugaaaaugccuucagauac

SEQ ID NO: 965869 - RNA, 23 nt, Human
aggcacacagggguuuguuuauu

SEQ ID NO: 965870 - RNA, 26 nt, Human
aggugggugguaggcacacagggguu

SEQ ID NO: 965871 - RNA, 22 nt, Human
auauucucugagcuaagugugg

SEQ ID NO: 965872 - RNA, 25 nt, Human
auggggcggagugcugggcacaugu

SEQ ID NO: 965873 - RNA, 23 nt, Human
auuacaaagcaugggaacuguga

SEQ ID NO: 965874 - RNA, 22 nt, Human
caaacacaacagaaagaagcuu

SEQ ID NO: 965875 - RNA, 24 nt, Human
caaauagcaauuauugucauccca

SEQ ID NO: 965876 - RNA, 18 nt, Human
cacucuaucauugaaccc

SEQ ID NO: 965877 - RNA, 18 nt, Human
cacucugcccuugucuuc

SEQ ID NO: 965878 - RNA, 22 nt, Human
cagaaaaauagccucugcucua

SEQ ID NO: 965879 - RNA, 23 nt, Human
caugcaauucucauuauagccac

SEQ ID NO: 965880 - RNA, 25 nt, Human
cauuagguaagcaugugugugcuga

SEQ ID NO: 965881 - RNA, 24 nt, Human
cccaauucagagaacauggccacc

SEQ ID NO: 965882 - RNA, 22 nt, Human
ccccugaagagaaaauugugga

SEQ ID NO: 965883 - RNA, 19 nt, Human
ccuucacaaaauagaagca

SEQ ID NO: 965884 - RNA, 19 nt, Human
cuaaccaguaauauccaua

SEQ ID NO: 965885 - RNA, 18 nt, Human
cuagaagaacuaggaaaa

SEQ ID NO: 965886 - RNA, 21 nt, Human
cuaguuaaagaagggaacaag

SEQ ID NO: 965887 - RNA, 20 nt, Human
cucaacuaaacagaacuaaa

SEQ ID NO: 965888 - RNA, 20 nt, Human
cuccauccucaguccugauc

SEQ ID NO: 965889 - RNA, 21 nt, Human
cuccgucaucuuccacucuuc

SEQ ID NO: 965890 - RNA, 25 nt, Human
cucuaaguuaaaaaaaaaauuaagc

SEQ ID NO: 965891 - RNA, 23 nt, Human
cugaagauuugaaucacaaguag

SEQ ID NO: 965892 - RNA, 18 nt, Human
cugauucugcagcaaaaa

SEQ ID NO: 965893 - RNA, 18 nt, Human
cugcucuuucaauuucuu

SEQ ID NO: 965894 - RNA, 21 nt, Human
cuggcuaaaacugcugcuuug

SEQ ID NO: 965895 - RNA, 18 nt, Human
cuggcucccucccggcgg

SEQ ID NO: 965896 - RNA, 23 nt, Human
cuguauuacucugaaaaauauga

SEQ ID NO: 965897 - RNA, 20 nt, Human
cuugauaugaaaucuaugcc

SEQ ID NO: 965898 - RNA, 21 nt, Human
cuugcaaagccucaaccuuac

SEQ ID NO: 965899 - RNA, 22 nt, Human
gaaaugcccuugauaugaaauc

SEQ ID NO: 965900 - RNA, 19 nt, Human
gaacaaacacuccauuuuc

SEQ ID NO: 965901 - RNA, 19 nt, Human
gaacccagcuacgagccgc

SEQ ID NO: 965902 - RNA, 22 nt, Human
gacaaacacauacaaguugaaa

SEQ ID NO: 965903 - RNA, 20 nt, Human
gagauggcacauaacuguga

SEQ ID NO: 965904 - RNA, 21 nt, Human
gcaaagccucaaccuuaccaa

SEQ ID NO: 965905 - RNA, 23 nt, Human
gcaaagugcagccugacacuuaa

SEQ ID NO: 965906 - RNA, 20 nt, Human
gcagcacauuuccuuugcuc

SEQ ID NO: 965907 - RNA, 19 nt, Human
gcuuuuuuuccuucugauu

SEQ ID NO: 965908 - RNA, 21 nt, Human
ggacagaccccuugccccccg

SEQ ID NO: 965909 - RNA, 20 nt, Human
gggauagagauagguucagg

SEQ ID NO: 965910 - RNA, 23 nt, Human
ggucuccuguauuucuuugcuga

SEQ ID NO: 965911 - RNA, 22 nt, Human
guauauacauaucuauauucca

SEQ ID NO: 965912 - RNA, 23 nt, Human
guguggcuuuugucacagugaug

SEQ ID NO: 965913 - RNA, 24 nt, Human
guucaguacagggguucccucuau

SEQ ID NO: 965914 - RNA, 23 nt, Human
uaaaacagaaacaaaucuagaau

SEQ ID NO: 965915 - RNA, 23 nt, Human
uaaagagaaguggguuuacgcaa

SEQ ID NO: 965916 - RNA, 24 nt, Human
uaaagagaaguggguuuacgcaac

SEQ ID NO: 965917 - RNA, 18 nt, Human
uaaagugaugaaagacaa

SEQ ID NO: 965918 - RNA, 18 nt, Human
uaaauaaauugcuagagc

SEQ ID NO: 965919 - RNA, 22 nt, Human
uaaauaaauugcuagagcugaa

SEQ ID NO: 965920 - RNA, 24 nt, Human
uaacaaguacagcaccacucgaga

SEQ ID NO: 965921 - RNA, 18 nt, Human
uaacgggagacaaaaaaa

SEQ ID NO: 965922 - RNA, 23 nt, Human
uaacugagauuuuccuuucucaa

SEQ ID NO: 965923 - RNA, 21 nt, Human
uaacugauucugcagcaaaaa

SEQ ID NO: 965924 - RNA, 22 nt, Human
uaacuuaguucugaucacuuga

SEQ ID NO: 965925 - RNA, 22 nt, Human
uaacuugcaaagccucaaccuu

SEQ ID NO: 965926 - RNA, 21 nt, Human
uaagaaaguacaccuguaaca

SEQ ID NO: 965927 - RNA, 19 nt, Human
uaagagacaaacacauaca

SEQ ID NO: 965928 - RNA, 25 nt, Human
uaagagacaaacacauacaaguuga

SEQ ID NO: 965929 - RNA, 20 nt, Human
uaagauaauauguggaggua

SEQ ID NO: 965930 - RNA, 22 nt, Human
uaauuugacaacagcuuccccu

SEQ ID NO: 965931 - RNA, 19 nt, Human
uacauggagauaaagugau

SEQ ID NO: 965932 - RNA, 22 nt, Human
uaccuugcuuuccucuucuuug

SEQ ID NO: 965933 - RNA, 25 nt, Human
uacuacaggaaauaaaaauucuguc

SEQ ID NO: 965934 - RNA, 18 nt, Human
uacuauaaucauaauagg

SEQ ID NO: 965935 - RNA, 21 nt, Human
uagaaaucugucauacuuucc

SEQ ID NO: 965936 - RNA, 20 nt, Human
uagaauauauuagaaucuga

SEQ ID NO: 965937 - RNA, 24 nt, Human
uagcaggauggcacuccauauuuu

SEQ ID NO: 965938 - RNA, 18 nt, Human
uauauguguauauacaua

SEQ ID NO: 965939 - RNA, 19 nt, Human
uaucagacagggauagaga

SEQ ID NO: 965940 - RNA, 24 nt, Human
uaugcugaauauaaaauaugugau

SEQ ID NO: 965941 - RNA, 25 nt, Human
uauggagcaaagugcagccugacac

SEQ ID NO: 965942 - RNA, 25 nt, Human
ucaaccucaaacaaugccuucagaa

SEQ ID NO: 965943 - RNA, 23 nt, Human
ucacuuccuccacccuccuucug

SEQ ID NO: 965944 - RNA, 21 nt, Human
ucagaagacucacauacucaa

SEQ ID NO: 965945 - RNA, 22 nt, Human
ucagaagacucacauacucaaa

SEQ ID NO: 965946 - RNA, 21 nt, Human
ucauacuuuccuucugguugu

SEQ ID NO: 965947 - RNA, 26 nt, Human
ucauacuuuccuucugguuguaaucc

SEQ ID NO: 965948 - RNA, 18 nt, Human
uccgcagauaaaagccca

SEQ ID NO: 965949 - RNA, 24 nt, Human
uccgucaucuuccacucuucuucu

SEQ ID NO: 965950 - RNA, 22 nt, Human
uccucaguccugaucacugucu

SEQ ID NO: 965951 - RNA, 22 nt, Human
ucgcugggaucuggcucccucc

SEQ ID NO: 965952 - RNA, 22 nt, Human
ucgugcaggaccucaugucugg

SEQ ID NO: 965953 - RNA, 23 nt, Human
ucuaacuuuuucaccagguguua

SEQ ID NO: 965954 - RNA, 18 nt, Human
ucugcacccaauucagag

SEQ ID NO: 965955 - RNA, 21 nt, Human
ucuugguacucuguggagccu

SEQ ID NO: 965956 - RNA, 28 nt, Human
ucuuugcugaucaaaaaaaaaaaaaaaa

SEQ ID NO: 965957 - RNA, 20 nt, Human
ugaaaaguaacaaaaggaaa

SEQ ID NO: 965958 - RNA, 21 nt, Human
ugaaaugcccuugauaugaaa

SEQ ID NO: 965959 - RNA, 24 nt, Human
ugaaaugcccuugauaugaaaucu

SEQ ID NO: 965960 - RNA, 22 nt, Human
ugaaccaccccaccccacccag

SEQ ID NO: 965961 - RNA, 19 nt, Human
ugacaaguacaauuccggg

SEQ ID NO: 965962 - RNA, 22 nt, Human
ugaccuggaucuuacuuaauga

SEQ ID NO: 965963 - RNA, 21 nt, Human
ugacgguauuuccaggugagu

SEQ ID NO: 965964 - RNA, 19 nt, Human
ugagaacaaguaucuguau

SEQ ID NO: 965965 - RNA, 18 nt, Human
ugagaguagagauauugc

SEQ ID NO: 965966 - RNA, 21 nt, Human
ugaugaaagacaagaaggcua

SEQ ID NO: 965967 - RNA, 21 nt, Human
ugcugagaucaaccucaaaca

SEQ ID NO: 965968 - RNA, 19 nt, Human
uggaucuuacuuaaugaca

SEQ ID NO: 965969 - RNA, 22 nt, Human
uggcuaaaacugcugcuuuguu

SEQ ID NO: 965970 - RNA, 26 nt, Human
ugggguggggagauggcacauaacug

SEQ ID NO: 965971 - RNA, 18 nt, Human
uguaaaugccacacacug

SEQ ID NO: 965972 - RNA, 22 nt, Human
uguaaaugccacacacugugcu

SEQ ID NO: 965973 - RNA, 23 nt, Human
uuagguaagcaugugugugcuga

SEQ ID NO: 965974 - RNA, 18 nt, Human
uucacaaaauagaagcag

SEQ ID NO: 965975 - RNA, 19 nt, Human
uucacaaaauagaagcagc

SEQ ID NO: 965976 - RNA, 23 nt, Human
uuccuccacccuccuucuguucu

SEQ ID NO: 965977 - RNA, 23 nt, Human
uucuagaagaacuaggaaaacuc

SEQ ID NO: 965978 - RNA, 24 nt, Human
uucuguucuggugcguagggcuug

SEQ ID NO: 965979 - RNA, 22 nt, Human
uugaacccuggcuaaaacugcu

SEQ ID NO: 965980 - RNA, 22 nt, Human
uugcuuuccucuucuuugauug

SEQ ID NO: 965981 - RNA, 26 nt, Human
uuucuauuccccucauacuugagagu

SEQ ID NO: 965982 - RNA, 21 nt, Human
uuuuaucagaagacucacaua

SEQ ID NO: 965983 - RNA, 22 nt, Human
uuuuuaaaaauucaaauggcuu

SEQ ID NO: 965984 - RNA, 22 nt, Human
aauugccucuaggguccuccug

SEQ ID NO: 965985 - RNA, 18 nt, Human
acauggaggagaggggac

SEQ ID NO: 965986 - RNA, 23 nt, Human
agccagugccaggcaggauggcg

SEQ ID NO: 965987 - RNA, 25 nt, Human
aggaaugacagggaguuggucaaaa

SEQ ID NO: 965988 - RNA, 23 nt, Human
aggauggcggccccaaugcuugg

SEQ ID NO: 965989 - RNA, 19 nt, Human
aggcaggauggcggcccca

SEQ ID NO: 965990 - RNA, 20 nt, Human
agguuagguuaggaaugaca

SEQ ID NO: 965991 - RNA, 20 nt, Human
auggaggagaggggacuaca

SEQ ID NO: 965992 - RNA, 18 nt, Human
cagugccaggcaggaugg

SEQ ID NO: 965993 - RNA, 24 nt, Human
caucauuuaauugccucuaggguc

SEQ ID NO: 965994 - RNA, 18 nt, Human
ccccaaugcuuggcuggg

SEQ ID NO: 965995 - RNA, 21 nt, Human
gaauguugccuuuacauggag

SEQ ID NO: 965996 - RNA, 20 nt, Human
gacuacauuuagagaaggag

SEQ ID NO: 965997 - RNA, 19 nt, Human
gccuuuggcagagcucugg

SEQ ID NO: 965998 - RNA, 20 nt, Human
ggaguuggucaaaagguccu

SEQ ID NO: 965999 - RNA, 21 nt, Human
ggauggcggccccaaugcuug

SEQ ID NO: 966000 - RNA, 19 nt, Human
ggcagagggcggcgguagc

SEQ ID NO: 966001 - RNA, 18 nt, Human
ggcggcgguagcggcagc

SEQ ID NO: 966002 - RNA, 23 nt, Human
ggggaguguggugauggagucca

SEQ ID NO: 966003 - RNA, 21 nt, Human
uaagacaauuucugagacuaa

SEQ ID NO: 966004 - RNA, 22 nt, Human
uacauggaggagaggggacuac

SEQ ID NO: 966005 - RNA, 22 nt, Human
uccagcaggggaacucuggaca

SEQ ID NO: 966006 - RNA, 22 nt, Human
uccuucauggccaggugaaggc

SEQ ID NO: 966007 - RNA, 23 nt, Human
ugaaggcuggggggaguguggug

SEQ ID NO: 966008 - RNA, 21 nt, Human
ugauggaaccaacagaggugc

SEQ ID NO: 966009 - RNA, 22 nt, Human
ugccaggcaggauggcggcccc

SEQ ID NO: 966010 - RNA, 22 nt, Human
ugcuuggcugggggcagccagc

SEQ ID NO: 966011 - RNA, 20 nt, Human
uggaaccaacagaggugccc

SEQ ID NO: 966012 - RNA, 22 nt, Human
uggcggccccaaugcuuggcug

SEQ ID NO: 966013 - RNA, 21 nt, Human
ugggagagggacugcggggcc

SEQ ID NO: 966014 - RNA, 24 nt, Human
ugggggcagccagcauuuggggcu

SEQ ID NO: 966015 - RNA, 22 nt, Human
uggggguagacagacgggccgg

SEQ ID NO: 966016 - RNA, 20 nt, Human
uuacauggaggagaggggac

SEQ ID NO: 966017 - RNA, 18 nt, Human
uuuuuuuuuuugaacagg

SEQ ID NO: 966018 - RNA, 23 nt, Human
uuuuuuuuuuugaacaggacauc

SEQ ID NO: 966019 - RNA, 22 nt, Human
uuuuuuuuuuuuuugaacagga

SEQ ID NO: 966020 - RNA, 23 nt, Human
uuuuuuuuuuuuuuuugaacagg

SEQ ID NO: 966021 - RNA, 20 nt, Human
uuuuuuuuuuuuuuuuuugg

SEQ ID NO: 966022 - RNA, 19 nt, Human
agacaggccugcagccgcu

SEQ ID NO: 966023 - RNA, 22 nt, Human
agaguggagaguccgguggggg

SEQ ID NO: 966024 - RNA, 21 nt, Human
aggcaaaccucuccuuccuuc

SEQ ID NO: 966025 - RNA, 21 nt, Human
agggagggggugcugagggcu

SEQ ID NO: 966026 - RNA, 19 nt, Human
agguggggagggagggggu

SEQ ID NO: 966027 - RNA, 23 nt, Human
caggguggacgaggaaaagguca

SEQ ID NO: 966028 - RNA, 18 nt, Human
cagguggggagggagggg

SEQ ID NO: 966029 - RNA, 24 nt, Human
cccaugccccuuuguggggggcga

SEQ ID NO: 966030 - RNA, 22 nt, Human
ccccuaggaccugccggagagu

SEQ ID NO: 966031 - RNA, 25 nt, Human
ccccuaggaccugccggagagugga

SEQ ID NO: 966032 - RNA, 24 nt, Human
cccgaguuuuuuuuuuuuuuuuuc

SEQ ID NO: 966033 - RNA, 21 nt, Human
cgaguuuuuuuuuuuuuuuuu

SEQ ID NO: 966034 - RNA, 22 nt, Human
gagcaggcaaaccucuccuucc

SEQ ID NO: 966035 - RNA, 22 nt, Human
gaguuuuuuuuuuuuuuuuuuu

SEQ ID NO: 966036 - RNA, 21 nt, Human
gccgcuuguggauguuguggg

SEQ ID NO: 966037 - RNA, 18 nt, Human
gccugcagccgcuugugg

SEQ ID NO: 966038 - RNA, 18 nt, Human
ggacagagccaugagggg

SEQ ID NO: 966039 - RNA, 19 nt, Human
ggagggagggggugcugag

SEQ ID NO: 966040 - RNA, 20 nt, Human
ggcacugaggcacuuguggg

SEQ ID NO: 966041 - RNA, 22 nt, Human
ggcugcccgcuuggccggcucc

SEQ ID NO: 966042 - RNA, 18 nt, Human
gggagggccaggugggga

SEQ ID NO: 966043 - RNA, 21 nt, Human
ggggccgacccagugggcacu

SEQ ID NO: 966044 - RNA, 21 nt, Human
ggggggcgagagcuguccugg

SEQ ID NO: 966045 - RNA, 22 nt, Human
guccugggagggccaggugggg

SEQ ID NO: 966046 - RNA, 19 nt, Human
guggggagggagggggugc

SEQ ID NO: 966047 - RNA, 19 nt, Human
uccccaagcccagggugga

SEQ ID NO: 966048 - RNA, 24 nt, Human
ugaggggaagcuucuucacccgcu

SEQ ID NO: 966049 - RNA, 22 nt, Human
ugcccgcuuggccggcuccagc

SEQ ID NO: 966050 - RNA, 28 nt, Human
ugggagggccagguggggagggaggggg

SEQ ID NO: 966051 - RNA, 24 nt, Human
uggggagggagggggugcugaggg

SEQ ID NO: 966052 - RNA, 21 nt, Human
ugguggacagagccaugaggg

SEQ ID NO: 966053 - RNA, 22 nt, Human
ugucugccccgcucuggcccug

SEQ ID NO: 966054 - RNA, 19 nt, Human
uuuuuuuuuuuuuugucca

SEQ ID NO: 966055 - RNA, 21 nt, Human
uuuuuuuuuuuuuuuguccaa

SEQ ID NO: 966056 - RNA, 18 nt, Human
uuuuuuuuuuuuuuuuug

SEQ ID NO: 966057 - RNA, 19 nt, Human
uuuuuuuuuuuuuuuuugu

SEQ ID NO: 966058 - RNA, 23 nt, Human
aaaaagagaauuuuguaagaaaa

SEQ ID NO: 966059 - RNA, 22 nt, Human
aagaaaaagcuugcuguuaaug

SEQ ID NO: 966060 - RNA, 26 nt, Human
aagaaaacauucuuggcaugaaagcu

SEQ ID NO: 966061 - RNA, 21 nt, Human
agccgggcggagccggccgac

SEQ ID NO: 966062 - RNA, 21 nt, Human
caacuuuauuggcagaaaggc

SEQ ID NO: 966063 - RNA, 25 nt, Human
cacauuaacauggaagauacuuaac

SEQ ID NO: 966064 - RNA, 18 nt, Human
cggccgaccuagcggcgg

SEQ ID NO: 966065 - RNA, 23 nt, Human
cggccgggcuggggcgcagggcc

SEQ ID NO: 966066 - RNA, 22 nt, Human
cuagcggcggcgaggcggaggu

SEQ ID NO: 966067 - RNA, 21 nt, Human
gauggcugguauuuucagucu

SEQ ID NO: 966068 - RNA, 19 nt, Human
uaaaaagagaauuuuguaa

SEQ ID NO: 966069 - RNA, 18 nt, Human
uacauaaaagaaaaagcu

SEQ ID NO: 966070 - RNA, 20 nt, Human
uggaagauacuuaaccugcu

SEQ ID NO: 966071 - RNA, 21 nt, Human
uggaagauacuuaaccugcuu

SEQ ID NO: 966072 - RNA, 23 nt, Human
aaaaccccgagauaaaaagugag

SEQ ID NO: 966073 - RNA, 20 nt, Human
accccgagauaaaaagugag

SEQ ID NO: 966074 - RNA, 20 nt, Human
aggcccagggcccuugacaa

SEQ ID NO: 966075 - RNA, 19 nt, Human
cacggccgcugcgcacggc

SEQ ID NO: 966076 - RNA, 23 nt, Human
ccagcaaaaauuaaaaccccgag

SEQ ID NO: 966077 - RNA, 24 nt, Human
ccagcaaaaauuaaaaccccgaga

SEQ ID NO: 966078 - RNA, 21 nt, Human
cccgcacggccgcugcgcacg

SEQ ID NO: 966079 - RNA, 26 nt, Human
cccgcacggccgcugcgcacggcccg

SEQ ID NO: 966080 - RNA, 22 nt, Human
cgagauaaaaagugagugugaa

SEQ ID NO: 966081 - RNA, 21 nt, Human
cggcccgagcgcagccggcag

SEQ ID NO: 966082 - RNA, 21 nt, Human
cugcggccgcuuggacuuggc

SEQ ID NO: 966083 - RNA, 22 nt, Human
gacugcggccgcuuggacuugg

SEQ ID NO: 966084 - RNA, 21 nt, Human
gcccuugacaagaagccccag

SEQ ID NO: 966085 - RNA, 18 nt, Human
gggcccuugacaagaagc

SEQ ID NO: 966086 - RNA, 23 nt, Human
uaaaaccccgagauaaaaaguga

SEQ ID NO: 966087 - RNA, 21 nt, Human
uaaacccaaacccccagcaaa

SEQ ID NO: 966088 - RNA, 19 nt, Human
ugaauagguaaagacugcg

SEQ ID NO: 966089 - RNA, 23 nt, Human
ugcccgcacggccgcugcgcacg

SEQ ID NO: 966090 - RNA, 24 nt, Human
aacaaaccucuccugccguugauc

SEQ ID NO: 966091 - RNA, 21 nt, Human
agggaacaaaccucuccugcc

SEQ ID NO: 966092 - RNA, 21 nt, Human
cagccuccauccuccuuccug

SEQ ID NO: 966093 - RNA, 19 nt, Human
cagcggacccaccggucuc

SEQ ID NO: 966094 - RNA, 21 nt, Human
cagcggacccaccggucucuc

SEQ ID NO: 966095 - RNA, 23 nt, Human
caguccuuauugaugagagugac

SEQ ID NO: 966096 - RNA, 22 nt, Human
ccaccggucucuccggccuucu

SEQ ID NO: 966097 - RNA, 22 nt, Human
cccaccagccuccauccuccuu

SEQ ID NO: 966098 - RNA, 22 nt, Human
cuccuucccaccagccuacguc

SEQ ID NO: 966099 - RNA, 24 nt, Human
cugauguuggugaugauuucaccc

SEQ ID NO: 966100 - RNA, 20 nt, Human
gaagcauuucuggucuuuca

SEQ ID NO: 966101 - RNA, 20 nt, Human
gaucugucccucccaccagc

SEQ ID NO: 966102 - RNA, 20 nt, Human
gcucucucucuggucuuucu

SEQ ID NO: 966103 - RNA, 24 nt, Human
ggucuauucccuuccuuuucaaag

SEQ ID NO: 966104 - RNA, 18 nt, Human
ucccaccagccuccaucc

SEQ ID NO: 966105 - RNA, 22 nt, Human
ucccaccagccuccauccuccu

SEQ ID NO: 966106 - RNA, 24 nt, Human
ucucaguggugccugccccuuguu

SEQ ID NO: 966107 - RNA, 21 nt, Human
ucucucaguggugccugcccc

SEQ ID NO: 966108 - RNA, 21 nt, Human
ucucuggucuuucuuuuucuu

SEQ ID NO: 966109 - RNA, 19 nt, Human
ucuuagguggccgaggcuu

SEQ ID NO: 966110 - RNA, 21 nt, Human
ucuuucuuuuucuucuguucu

SEQ ID NO: 966111 - RNA, 24 nt, Human
ucuuuuucuucuguucuguuugga

SEQ ID NO: 966112 - RNA, 18 nt, Human
uggcaggaacggagggcu

SEQ ID NO: 966113 - RNA, 18 nt, Human
uggcaggaacggagggcu

SEQ ID NO: 966114 - RNA, 21 nt, Human
uggcuucuugggucuauuccc

SEQ ID NO: 966115 - RNA, 20 nt, Human
ugucccucccaccagccucc

SEQ ID NO: 966116 - RNA, 23 nt, Human
uguuuggaagcauuucuggucuu

SEQ ID NO: 966117 - RNA, 18 nt, Human
aggccagcaggcucaaga

SEQ ID NO: 966118 - RNA, 22 nt, Human
aggggucagaggucaagaggcc

SEQ ID NO: 966119 - RNA, 21 nt, Human
aguucuguggacggggcuggu

SEQ ID NO: 966120 - RNA, 21 nt, Human
cuggcccggggagagaaugac

SEQ ID NO: 966121 - RNA, 18 nt, Human
ggaagaugagggcagggc

SEQ ID NO: 966122 - RNA, 22 nt, Human
uggcccggggagagaaugacag

SEQ ID NO: 966123 - RNA, 19 nt, Human
aaaacgucccagggccccc

SEQ ID NO: 966124 - RNA, 23 nt, Human
aaagccggggaagccagggaccc

SEQ ID NO: 966125 - RNA, 24 nt, Human
aacugacccuguaaaguuaaaaac

SEQ ID NO: 966126 - RNA, 22 nt, Human
aagcagcagggauucaccaggg

SEQ ID NO: 966127 - RNA, 18 nt, Human
aaguagaagggaggggag

SEQ ID NO: 966128 - RNA, 21 nt, Human
aauauaagaaacauagaucuc

SEQ ID NO: 966129 - RNA, 23 nt, Human
aaucaggcacacacacggcuccc

SEQ ID NO: 966130 - RNA, 20 nt, Human
acacacacggcucccacgug

SEQ ID NO: 966131 - RNA, 21 nt, Human
acaccccacgcaugcacacgg

SEQ ID NO: 966132 - RNA, 21 nt, Human
acagaccggcgugccaggccc

SEQ ID NO: 966133 - RNA, 19 nt, Human
acagggcgagucuccgagc

SEQ ID NO: 966134 - RNA, 21 nt, Human
acccaguuucacccacacaca

SEQ ID NO: 966135 - RNA, 19 nt, Human
acccgcggccugccgcccc

SEQ ID NO: 966136 - RNA, 25 nt, Human
accucccgccccagccucccugguc

SEQ ID NO: 966137 - RNA, 20 nt, Human
acucugugcccagggagugg

SEQ ID NO: 966138 - RNA, 25 nt, Human
acucugugcccagggaguggggccg

SEQ ID NO: 966139 - RNA, 18 nt, Human
agaagggaggggagagga

SEQ ID NO: 966140 - RNA, 18 nt, Human
agacagggugcucucaca

SEQ ID NO: 966141 - RNA, 21 nt, Human
agcgaagaggcuggcgcugaa

SEQ ID NO: 966142 - RNA, 21 nt, Human
agggcaggacaggagacuuug

SEQ ID NO: 966143 - RNA, 20 nt, Human
agggcggggcgggcaggcac

SEQ ID NO: 966144 - RNA, 22 nt, Human
aggugggggcgcugccuccaag

SEQ ID NO: 966145 - RNA, 21 nt, Human
agugaggggccggagauggaa

SEQ ID NO: 966146 - RNA, 19 nt, Human
aguggguggaugaaggugg

SEQ ID NO: 966147 - RNA, 25 nt, Human
auggagcuuaguccagacuccaaac

SEQ ID NO: 966148 - RNA, 21 nt, Human
cacccaguuucacccacacac

SEQ ID NO: 966149 - RNA, 23 nt, Human
cacccgggcgcggaccgcggugg

SEQ ID NO: 966150 - RNA, 18 nt, Human
caccucccgccccagccu

SEQ ID NO: 966151 - RNA, 27 nt, Human
caccucccgccccagccucccuggucc

SEQ ID NO: 966152 - RNA, 23 nt, Human
cacgccuccacggccccgcgcua

SEQ ID NO: 966153 - RNA, 21 nt, Human
cagaccagcuggagcgucccc

SEQ ID NO: 966154 - RNA, 25 nt, Human
cagaccagcuggagcguccccugcc

SEQ ID NO: 966155 - RNA, 20 nt, Human
cagcaaacaggacgauucau

SEQ ID NO: 966156 - RNA, 19 nt, Human
cagccagggcaagggccag

SEQ ID NO: 966157 - RNA, 21 nt, Human
cagcugcagugggaccagugg

SEQ ID NO: 966158 - RNA, 25 nt, Human
caggacccgcggccugccgccccuc

SEQ ID NO: 966159 - RNA, 22 nt, Human
caggagacuuugggguccaagg

SEQ ID NO: 966160 - RNA, 20 nt, Human
caggcacacacacggcuccc

SEQ ID NO: 966161 - RNA, 19 nt, Human
cagggccccccaccccaca

SEQ ID NO: 966162 - RNA, 20 nt, Human
caguaaucaggcacacacac

SEQ ID NO: 966163 - RNA, 19 nt, Human
caucgagaaucccaauguc

SEQ ID NO: 966164 - RNA, 26 nt, Human
ccacacacauaaagggcaggacaaua

SEQ ID NO: 966165 - RNA, 18 nt, Human
ccaccccacaggucaucg

SEQ ID NO: 966166 - RNA, 21 nt, Human
ccagccucccugguccacgcc

SEQ ID NO: 966167 - RNA, 18 nt, Human
ccagggccuguggugaac

SEQ ID NO: 966168 - RNA, 24 nt, Human
ccaggggugagcugggguccaggg

SEQ ID NO: 966169 - RNA, 23 nt, Human
cccacgcaugcacacggugcacg

SEQ ID NO: 966170 - RNA, 23 nt, Human
ccccaagcagcagggauucacca

SEQ ID NO: 966171 - RNA, 23 nt, Human
ccccagccucccugguccacgcc

SEQ ID NO: 966172 - RNA, 21 nt, Human
ccccagggcgggccacuaggg

SEQ ID NO: 966173 - RNA, 27 nt, Human
cccccacggacaggaacacaguggagc

SEQ ID NO: 966174 - RNA, 24 nt, Human
ccccccuccccccgagucaccaag

SEQ ID NO: 966175 - RNA, 24 nt, Human
cccccgagucaccaaggcgggucc

SEQ ID NO: 966176 - RNA, 19 nt, Human
cccccggccgauggucucc

SEQ ID NO: 966177 - RNA, 21 nt, Human
cccgggguggggguggggggc

SEQ ID NO: 966178 - RNA, 23 nt, Human
cccucccaccacgagcagcaccu

SEQ ID NO: 966179 - RNA, 19 nt, Human
cccugcgagcaggcacagg

SEQ ID NO: 966180 - RNA, 19 nt, Human
cccugguccacgcccuucc

SEQ ID NO: 966181 - RNA, 19 nt, Human
ccgcgccgggggcgcugcc

SEQ ID NO: 966182 - RNA, 24 nt, Human
ccgcggccugccgccccucccacc

SEQ ID NO: 966183 - RNA, 23 nt, Human
ccgcuccuccagccgccgguccu

SEQ ID NO: 966184 - RNA, 19 nt, Human
ccgggccaucgcccgcgcc

SEQ ID NO: 966185 - RNA, 21 nt, Human
ccuccaaggggcccuuggggc

SEQ ID NO: 966186 - RNA, 26 nt, Human
ccucccgccccagccucccuggucca

SEQ ID NO: 966187 - RNA, 24 nt, Human
ccucccugguccacgcccuuccug

SEQ ID NO: 966188 - RNA, 21 nt, Human
ccugacugugcgcuggguggg

SEQ ID NO: 966189 - RNA, 18 nt, Human
ccuggacuguuggcggaa

SEQ ID NO: 966190 - RNA, 18 nt, Human
ccuguggugaacugacuc

SEQ ID NO: 966191 - RNA, 19 nt, Human
ccuuggccgggcccgggcc

SEQ ID NO: 966192 - RNA, 21 nt, Human
ccuuggggagagacccuguga

SEQ ID NO: 966193 - RNA, 20 nt, Human
cgagcaggcacaggaaucca

SEQ ID NO: 966194 - RNA, 26 nt, Human
cgccccucccaccacgagcagcaccu

SEQ ID NO: 966195 - RNA, 18 nt, Human
cgccgccgggaccggggc

SEQ ID NO: 966196 - RNA, 18 nt, Human
cggagcgaagaggcuggc

SEQ ID NO: 966197 - RNA, 23 nt, Human
cggcaccucccgccccagccucc

SEQ ID NO: 966198 - RNA, 20 nt, Human
cggcagggcacggccggggc

SEQ ID NO: 966199 - RNA, 21 nt, Human
cggccggggcgggaguggggg

SEQ ID NO: 966200 - RNA, 21 nt, Human
cggcgucgggacugugcacgg

SEQ ID NO: 966201 - RNA, 22 nt, Human
cgggagggcuguagggauggca

SEQ ID NO: 966202 - RNA, 25 nt, Human
cgggcaggcacagaccggcgugcca

SEQ ID NO: 966203 - RNA, 22 nt, Human
cgggguggggguggggggcccu

SEQ ID NO: 966204 - RNA, 18 nt, Human
cgguggagcggcagggcc

SEQ ID NO: 966205 - RNA, 24 nt, Human
cgugccaggccccuggguugugaa

SEQ ID NO: 966206 - RNA, 24 nt, Human
cuaggggucccccuaugaugcccu

SEQ ID NO: 966207 - RNA, 19 nt, Human
cuccuccagccgccggucc

SEQ ID NO: 966208 - RNA, 24 nt, Human
cuccuuggggagagacccugugag

SEQ ID NO: 966209 - RNA, 21 nt, Human
cucuggaaggacaggcugggc

SEQ ID NO: 966210 - RNA, 22 nt, Human
cugugugaccuggacuguuggc

SEQ ID NO: 966211 - RNA, 18 nt, Human
cuuugggguccaaggcag

SEQ ID NO: 966212 - RNA, 18 nt, Human
gaaaacuucuguuuucuu

SEQ ID NO: 966213 - RNA, 20 nt, Human
gacaggcugggcaaacagcu

SEQ ID NO: 966214 - RNA, 22 nt, Human
gaccuucucugccucccugcga

SEQ ID NO: 966215 - RNA, 21 nt, Human
gacucuccccagggccugugg

SEQ ID NO: 966216 - RNA, 21 nt, Human
gacuuccgcuccucccggggg

SEQ ID NO: 966217 - RNA, 26 nt, Human
gacuuccgcuccucccgggggaccuu

SEQ ID NO: 966218 - RNA, 19 nt, Human
gagcaggcacaggaaucca

SEQ ID NO: 966219 - RNA, 22 nt, Human
gagcagggggugaaaccccccg

SEQ ID NO: 966220 - RNA, 22 nt, Human
gaggcucuggaaggacaggcug

SEQ ID NO: 966221 - RNA, 20 nt, Human
gauucaugcaacauuccugg

SEQ ID NO: 966222 - RNA, 18 nt, Human
gcaccccacccccggcac

SEQ ID NO: 966223 - RNA, 22 nt, Human
gcagugaggggccggagaugga

SEQ ID NO: 966224 - RNA, 22 nt, Human
gccccuggguugugaaaacuuc

SEQ ID NO: 966225 - RNA, 25 nt, Human
gcccgggccgccgaacgcgagcccc

SEQ ID NO: 966226 - RNA, 22 nt, Human
gccgaacgcgagccccgggcca

SEQ ID NO: 966227 - RNA, 18 nt, Human
gccggugggccagggcgg

SEQ ID NO: 966228 - RNA, 23 nt, Human
gcgcguccuccaccugcagcugc

SEQ ID NO: 966229 - RNA, 24 nt, Human
gcgcugggugggcugggcggccgg

SEQ ID NO: 966230 - RNA, 21 nt, Human
gcggcccgggguggggguggg

SEQ ID NO: 966231 - RNA, 20 nt, Human
gcgggaguggggguggggcg

SEQ ID NO: 966232 - RNA, 18 nt, Human
gcgugccaggccccuggg

SEQ ID NO: 966233 - RNA, 19 nt, Human
gcuagggcaccccaccccc

SEQ ID NO: 966234 - RNA, 18 nt, Human
gcuaguccagagcggccc

SEQ ID NO: 966235 - RNA, 18 nt, Human
gcucaggcugggugaggc

SEQ ID NO: 966236 - RNA, 20 nt, Human
gcugcgaaggagguggucac

SEQ ID NO: 966237 - RNA, 20 nt, Human
ggaagaggagacagggugcu

SEQ ID NO: 966238 - RNA, 21 nt, Human
ggagcggcagggcccugcccu

SEQ ID NO: 966239 - RNA, 19 nt, Human
ggagcgggagggcuguagg

SEQ ID NO: 966240 - RNA, 19 nt, Human
ggaugaagguggaacccga

SEQ ID NO: 966241 - RNA, 21 nt, Human
ggcaguggcagugaggggccg

SEQ ID NO: 966242 - RNA, 23 nt, Human
ggcggccggugagggcacuaagc

SEQ ID NO: 966243 - RNA, 18 nt, Human
ggcugggcacccucgggg

SEQ ID NO: 966244 - RNA, 20 nt, Human
gggcaaacagcuggacccag

SEQ ID NO: 966245 - RNA, 21 nt, Human
gggcaggccgagcccgcggcc

SEQ ID NO: 966246 - RNA, 18 nt, Human
gggccagggcggggcggg

SEQ ID NO: 966247 - RNA, 19 nt, Human
gggccagggcggggcgggc

SEQ ID NO: 966248 - RNA, 19 nt, Human
gggcccuggccaaccccag

SEQ ID NO: 966249 - RNA, 18 nt, Human
gggcgggagugggggugg

SEQ ID NO: 966250 - RNA, 21 nt, Human
gggcggggcgggcaggcacag

SEQ ID NO: 966251 - RNA, 19 nt, Human
gggcugggcacccucgggg

SEQ ID NO: 966252 - RNA, 18 nt, Human
ggggagaaagccggggaa

SEQ ID NO: 966253 - RNA, 22 nt, Human
ggggcgggaguggggguggggc

SEQ ID NO: 966254 - RNA, 20 nt, Human
gggugggcugggcggccggu

SEQ ID NO: 966255 - RNA, 20 nt, Human
ggguggggguggggggcccu

SEQ ID NO: 966256 - RNA, 20 nt, Human
ggucggggagggcucgcggg

SEQ ID NO: 966257 - RNA, 18 nt, Human
ggugcaggauggccucug

SEQ ID NO: 966258 - RNA, 27 nt, Human
guaaucaggcacacacacggcucccac

SEQ ID NO: 966259 - RNA, 21 nt, Human
gugacugcugcugugugaccu

SEQ ID NO: 966260 - RNA, 21 nt, Human
gugaggaagauggcugcggug

SEQ ID NO: 966261 - RNA, 21 nt, Human
gugcacgccuccacggccccg

SEQ ID NO: 966262 - RNA, 18 nt, Human
guggagcggcgccgcucc

SEQ ID NO: 966263 - RNA, 24 nt, Human
uagggcaccccacccccggcaccu

SEQ ID NO: 966264 - RNA, 20 nt, Human
uaucacaacgucagggucag

SEQ ID NO: 966265 - RNA, 23 nt, Human
ucaccagggaaccccgcucaggc

SEQ ID NO: 966266 - RNA, 22 nt, Human
ucacccacacacauaaagggca

SEQ ID NO: 966267 - RNA, 21 nt, Human
ucagggcagacaccggggagg

SEQ ID NO: 966268 - RNA, 27 nt, Human
uccagacuccaaacccuagguuuaaaa

SEQ ID NO: 966269 - RNA, 18 nt, Human
ucccagggccccccaccc

SEQ ID NO: 966270 - RNA, 19 nt, Human
uccccaggaggcgcucguc

SEQ ID NO: 966271 - RNA, 28 nt, Human
uccccaggaggcgcucgucgauggagcg

SEQ ID NO: 966272 - RNA, 19 nt, Human
ucccccuaugaugcccuca

SEQ ID NO: 966273 - RNA, 21 nt, Human
ucccgggggaccuucucugcc

SEQ ID NO: 966274 - RNA, 23 nt, Human
ucccugcgagcaggcacaggaau

SEQ ID NO: 966275 - RNA, 28 nt, Human
ucgagaaucccaaugucuccccccuccc

SEQ ID NO: 966276 - RNA, 24 nt, Human
ucgcgggcgaagcugccgccgccg

SEQ ID NO: 966277 - RNA, 21 nt, Human
ucucccaggccggcugguccc

SEQ ID NO: 966278 - RNA, 23 nt, Human
ucucugcuguaguugcccaagag

SEQ ID NO: 966279 - RNA, 21 nt, Human
ucugugcccagggaguggggc

SEQ ID NO: 966280 - RNA, 19 nt, Human
ugagcugggguccaggggu

SEQ ID NO: 966281 - RNA, 24 nt, Human
ugagcugggguccagggguuugcc

SEQ ID NO: 966282 - RNA, 20 nt, Human
ugaggagucacagugugggg

SEQ ID NO: 966283 - RNA, 22 nt, Human
ugagugacguggauggagcuua

SEQ ID NO: 966284 - RNA, 18 nt, Human
ugaguggguggaugaagg

SEQ ID NO: 966285 - RNA, 21 nt, Human
ugcccucaucccccccggccg

SEQ ID NO: 966286 - RNA, 20 nt, Human
ugccgccgccgggaccgggg

SEQ ID NO: 966287 - RNA, 19 nt, Human
ugccggugaguggguggau

SEQ ID NO: 966288 - RNA, 26 nt, Human
ugcgcguccuccaccugcagcugcuu

SEQ ID NO: 966289 - RNA, 25 nt, Human
ugcugugugaccuggacuguuggcg

SEQ ID NO: 966290 - RNA, 19 nt, Human
uggaagacugggcagcugc

SEQ ID NO: 966291 - RNA, 21 nt, Human
uggagcggcgccgcuccucca

SEQ ID NO: 966292 - RNA, 22 nt, Human
uggagcggcgccgcuccuccag

SEQ ID NO: 966293 - RNA, 19 nt, Human
uggcagugaggggccggag

SEQ ID NO: 966294 - RNA, 20 nt, Human
uggcugcgguggagcggcag

SEQ ID NO: 966295 - RNA, 18 nt, Human
ugggccagggcggggcgg

SEQ ID NO: 966296 - RNA, 19 nt, Human
ugggccagggcggggcggg

SEQ ID NO: 966297 - RNA, 20 nt, Human
uggggcacacuagagcucag

SEQ ID NO: 966298 - RNA, 19 nt, Human
ugggguggcaguggcagug

SEQ ID NO: 966299 - RNA, 22 nt, Human
ugggguggcaguggcagugagg

SEQ ID NO: 966300 - RNA, 22 nt, Human
ugugaaaacuucuguuuucuuu

SEQ ID NO: 966301 - RNA, 23 nt, Human
ugugaaaacuucuguuuucuuuu

SEQ ID NO: 966302 - RNA, 22 nt, Human
uguggcagucuguuacagugac

SEQ ID NO: 966303 - RNA, 26 nt, Human
ugugggguggcaguggcagugagggg

SEQ ID NO: 966304 - RNA, 19 nt, Human
uuggacggagcgaagaggc

SEQ ID NO: 966305 - RNA, 24 nt, Human
uuuaaaaacgucccagggcccccc

SEQ ID NO: 966306 - RNA, 18 nt, Human
aaaacagauggaucccau

SEQ ID NO: 966307 - RNA, 25 nt, Human
aaaagaacaaaacaaaacaaaagug

SEQ ID NO: 966308 - RNA, 20 nt, Human
aaacagauggaucccauagg

SEQ ID NO: 966309 - RNA, 19 nt, Human
aaagaaacgaggucggaug

SEQ ID NO: 966310 - RNA, 19 nt, Human
aaauuacuccaucuccccu

SEQ ID NO: 966311 - RNA, 21 nt, Human
aacaaaagaacauaggaaaga

SEQ ID NO: 966312 - RNA, 25 nt, Human
aagaaaccccagggaagagacaggc

SEQ ID NO: 966313 - RNA, 18 nt, Human
aagaggagaaauaaaggc

SEQ ID NO: 966314 - RNA, 23 nt, Human
aaggccauggaaagaaaccccag

SEQ ID NO: 966315 - RNA, 22 nt, Human
acaaaacaaaagugcacuccuc

SEQ ID NO: 966316 - RNA, 25 nt, Human
acagaauuuucuugaagggagaaag

SEQ ID NO: 966317 - RNA, 18 nt, Human
acagaugugccugcgccc

SEQ ID NO: 966318 - RNA, 20 nt, Human
acaggccucguucacagacc

SEQ ID NO: 966319 - RNA, 18 nt, Human
acagucccaaguccccca

SEQ ID NO: 966320 - RNA, 22 nt, Human
accuccaacccaggcacaguuc

SEQ ID NO: 966321 - RNA, 23 nt, Human
accuccaacccaggcacaguucc

SEQ ID NO: 966322 - RNA, 18 nt, Human
acugcacagccacagaau

SEQ ID NO: 966323 - RNA, 23 nt, Human
agaaauaaaggccauggaaagaa

SEQ ID NO: 966324 - RNA, 19 nt, Human
agaacagacuuggggcuuc

SEQ ID NO: 966325 - RNA, 23 nt, Human
agacagccaggcaaagucagaac

SEQ ID NO: 966326 - RNA, 21 nt, Human
agaccuccaacccaggcacag

SEQ ID NO: 966327 - RNA, 21 nt, Human
agcaguucagaccgcggccuc

SEQ ID NO: 966328 - RNA, 25 nt, Human
agccaacgcucgugaaguuuccaca

SEQ ID NO: 966329 - RNA, 21 nt, Human
agccacagaauuuucuugaag

SEQ ID NO: 966330 - RNA, 19 nt, Human
aggaaagaaaagaaacgag

SEQ ID NO: 966331 - RNA, 23 nt, Human
aggaagaaaagggggugaccugg

SEQ ID NO: 966332 - RNA, 19 nt, Human
aggagaaauaaaggccaug

SEQ ID NO: 966333 - RNA, 24 nt, Human
aggagacagccaggcaaagucaga

SEQ ID NO: 966334 - RNA, 23 nt, Human
aggcagggaauaaaaaauucaag

SEQ ID NO: 966335 - RNA, 21 nt, Human
agguagugcuguggggagggc

SEQ ID NO: 966336 - RNA, 22 nt, Human
auaaaggccauggaaagaaacc

SEQ ID NO: 966337 - RNA, 19 nt, Human
auggggcccgggacugggc

SEQ ID NO: 966338 - RNA, 19 nt, Human
augguuuuaucugaggccu

SEQ ID NO: 966339 - RNA, 18 nt, Human
caaaacaaaacaaaagug

SEQ ID NO: 966340 - RNA, 24 nt, Human
caaaacaaaacaaaagugcacucc

SEQ ID NO: 966341 - RNA, 22 nt, Human
caaaacaaaagugcacuccucu

SEQ ID NO: 966342 - RNA, 25 nt, Human
caaaagaacauaggaaagaaaagaa

SEQ ID NO: 966343 - RNA, 20 nt, Human
caaaagugcacuccucuugu

SEQ ID NO: 966344 - RNA, 21 nt, Human
caaaauuacuccaucuccccu

SEQ ID NO: 966345 - RNA, 24 nt, Human
caaggagacagccaggcaaaguca

SEQ ID NO: 966346 - RNA, 21 nt, Human
cacagggacagccagagccgg

SEQ ID NO: 966347 - RNA, 19 nt, Human
cacagucccaaguccccca

SEQ ID NO: 966348 - RNA, 21 nt, Human
cacaguuccaaaaagaacaaa

SEQ ID NO: 966349 - RNA, 19 nt, Human
caccccugacgaucgcggg

SEQ ID NO: 966350 - RNA, 24 nt, Human
cacccuccggcccaccguggcacc

SEQ ID NO: 966351 - RNA, 18 nt, Human
cacccuggaguacacucc

SEQ ID NO: 966352 - RNA, 22 nt, Human
cacuccagcgaagccgaggccc

SEQ ID NO: 966353 - RNA, 18 nt, Human
cacucgugaccaugcaau

SEQ ID NO: 966354 - RNA, 21 nt, Human
cacucgugaccaugcaauacc

SEQ ID NO: 966355 - RNA, 23 nt, Human
cagaacagacuuggggcuuccag

SEQ ID NO: 966356 - RNA, 24 nt, Human
cagaauuuucuugaagggagaaag

SEQ ID NO: 966357 - RNA, 22 nt, Human
cagcaaaauuacuccaucuccc

SEQ ID NO: 966358 - RNA, 24 nt, Human
cagcaaaauuacuccaucuccccu

SEQ ID NO: 966359 - RNA, 20 nt, Human
cagcagcgaacagagagggg

SEQ ID NO: 966360 - RNA, 23 nt, Human
caggcacaguuccaaaaagaaca

SEQ ID NO: 966361 - RNA, 24 nt, Human
caggcacaguuccaaaaagaacaa

SEQ ID NO: 966362 - RNA, 22 nt, Human
cagucccaagucccccaaccuu

SEQ ID NO: 966363 - RNA, 23 nt, Human
caucucuauuuuaaaugacccag

SEQ ID NO: 966364 - RNA, 22 nt, Human
cauggaaagcaguucagaccgc

SEQ ID NO: 966365 - RNA, 22 nt, Human
ccaaaaagaacaaaacaaaaca

SEQ ID NO: 966366 - RNA, 24 nt, Human
ccaaaaagaacaaaacaaaacaaa

SEQ ID NO: 966367 - RNA, 20 nt, Human
ccaacccaggcacaguucca

SEQ ID NO: 966368 - RNA, 27 nt, Human
ccacagagaagagccugcaaaacuccc

SEQ ID NO: 966369 - RNA, 22 nt, Human
ccaggcacaguuccaaaaagaa

SEQ ID NO: 966370 - RNA, 20 nt, Human
ccauuggccaagaacgccga

SEQ ID NO: 966371 - RNA, 18 nt, Human
cccacucugccuucaccc

SEQ ID NO: 966372 - RNA, 21 nt, Human
cccagcaaacagguccaccuc

SEQ ID NO: 966373 - RNA, 23 nt, Human
cccagcaaacagguccaccucau

SEQ ID NO: 966374 - RNA, 22 nt, Human
ccccagggaagagacaggccuc

SEQ ID NO: 966375 - RNA, 21 nt, Human
cccuguccagaccuccaaccc

SEQ ID NO: 966376 - RNA, 23 nt, Human
cccugucccagcuggcaacgugg

SEQ ID NO: 966377 - RNA, 19 nt, Human
ccgcugcggggcuggcucc

SEQ ID NO: 966378 - RNA, 21 nt, Human
ccgcugcggggcuggcuccgg

SEQ ID NO: 966379 - RNA, 19 nt, Human
ccuccaacccaggcacagg

SEQ ID NO: 966380 - RNA, 22 nt, Human
ccuuacaaucucccgcacugcu

SEQ ID NO: 966381 - RNA, 18 nt, Human
cgcugcccuccucgcagc

SEQ ID NO: 966382 - RNA, 20 nt, Human
cucaugcucacugcguucuc

SEQ ID NO: 966383 - RNA, 22 nt, Human
cuccagcgaagccgaggcccag

SEQ ID NO: 966384 - RNA, 20 nt, Human
cuccaucuccccugucccag

SEQ ID NO: 966385 - RNA, 18 nt, Human
cucugccuucacccugga

SEQ ID NO: 966386 - RNA, 25 nt, Human
cugcaacauaaacauuuucuuuucc

SEQ ID NO: 966387 - RNA, 18 nt, Human
cugcagggguggacauga

SEQ ID NO: 966388 - RNA, 18 nt, Human
gaacaaaacaaaacaaaa

SEQ ID NO: 966389 - RNA, 23 nt, Human
gaacacaaucauuaugcugaccg

SEQ ID NO: 966390 - RNA, 24 nt, Human
gaagucuuuccacagcaaaauuac

SEQ ID NO: 966391 - RNA, 19 nt, Human
gaaguuccaugcaggcugg

SEQ ID NO: 966392 - RNA, 20 nt, Human
gacaugugagacuugcuuca

SEQ ID NO: 966393 - RNA, 24 nt, Human
gacccagccuggacaucaaggaca

SEQ ID NO: 966394 - RNA, 19 nt, Human
gagagaggggucccuccuc

SEQ ID NO: 966395 - RNA, 22 nt, Human
gcacaguuccaaaaagaacaaa

SEQ ID NO: 966396 - RNA, 23 nt, Human
gcacaguuccaaaaagaacaaaa

SEQ ID NO: 966397 - RNA, 24 nt, Human
gcagauguguccccaggggccugc

SEQ ID NO: 966398 - RNA, 20 nt, Human
gcauggaaagcaguucagac

SEQ ID NO: 966399 - RNA, 18 nt, Human
gccuugcucaguguuucc

SEQ ID NO: 966400 - RNA, 18 nt, Human
gcugcuuccgggcaccug

SEQ ID NO: 966401 - RNA, 19 nt, Human
gcugugacucaggugcuga

SEQ ID NO: 966402 - RNA, 24 nt, Human
gcugugcuugaguuucaaaggggg

SEQ ID NO: 966403 - RNA, 23 nt, Human
ggacugggcucccuguccagacc

SEQ ID NO: 966404 - RNA, 23 nt, Human
ggagugagggugggggucggggu

SEQ ID NO: 966405 - RNA, 25 nt, Human
ggcacagggacagccagagccggca

SEQ ID NO: 966406 - RNA, 21 nt, Human
ggcagauguguccccaggggc

SEQ ID NO: 966407 - RNA, 18 nt, Human
ggcccgggacugggcucc

SEQ ID NO: 966408 - RNA, 18 nt, Human
ggcugggcuuggcugggc

SEQ ID NO: 966409 - RNA, 18 nt, Human
gggaaagagacaaccaug

SEQ ID NO: 966410 - RNA, 23 nt, Human
gggcacugugaaugauggaaacg

SEQ ID NO: 966411 - RNA, 19 nt, Human
gggguggacaugaugcucc

SEQ ID NO: 966412 - RNA, 23 nt, Human
gggucggggugagguagugcugu

SEQ ID NO: 966413 - RNA, 18 nt, Human
guaaucgcaaaucacugc

SEQ ID NO: 966414 - RNA, 19 nt, Human
uaaaacuucaaaguacugc

SEQ ID NO: 966415 - RNA, 21 nt, Human
uaaaacuucaaaguacugcac

SEQ ID NO: 966416 - RNA, 23 nt, Human
uagaaaaaggcaacauuuucuuu

SEQ ID NO: 966417 - RNA, 24 nt, Human
uagaaaaaggcaacauuuucuuua

SEQ ID NO: 966418 - RNA, 18 nt, Human
uauaaaagcugaguccug

SEQ ID NO: 966419 - RNA, 18 nt, Human
ucacugcguucucagggu

SEQ ID NO: 966420 - RNA, 18 nt, Human
ucagcguucacuuccuuc

SEQ ID NO: 966421 - RNA, 22 nt, Human
uccaaaaagaacaaaacaaaac

SEQ ID NO: 966422 - RNA, 21 nt, Human
uccaacccaggcacaguucca

SEQ ID NO: 966423 - RNA, 20 nt, Human
uccacagcaaaauuacucca

SEQ ID NO: 966424 - RNA, 24 nt, Human
uccacagcaaaauuacuccaucuc

SEQ ID NO: 966425 - RNA, 21 nt, Human
ucccccaaccuuccugauugc

SEQ ID NO: 966426 - RNA, 19 nt, Human
ucccuccucgcugcccucc

SEQ ID NO: 966427 - RNA, 19 nt, Human
uccgggcaccugggcugug

SEQ ID NO: 966428 - RNA, 23 nt, Human
ucggggugagguagugcuguggg

SEQ ID NO: 966429 - RNA, 21 nt, Human
ucuguggucccuccgcugcgg

SEQ ID NO: 966430 - RNA, 21 nt, Human
ucuucagaaaugcgucacauu

SEQ ID NO: 966431 - RNA, 21 nt, Human
ugacauagcgggggaaagaga

SEQ ID NO: 966432 - RNA, 22 nt, Human
ugacaugaauacaucagcaagg

SEQ ID NO: 966433 - RNA, 19 nt, Human
ugaccaugcaauacccugc

SEQ ID NO: 966434 - RNA, 20 nt, Human
ugaccugggguucccagcaa

SEQ ID NO: 966435 - RNA, 22 nt, Human
ugaccugggguucccagcaaac

SEQ ID NO: 966436 - RNA, 18 nt, Human
ugaguuucaaagggggag

SEQ ID NO: 966437 - RNA, 20 nt, Human
ugcccgcaccacuauggggc

SEQ ID NO: 966438 - RNA, 18 nt, Human
uggaaagaaaccccaggg

SEQ ID NO: 966439 - RNA, 18 nt, Human
uggccaagaacgccgaca

SEQ ID NO: 966440 - RNA, 19 nt, Human
uggcugggcuuggcugggc

SEQ ID NO: 966441 - RNA, 24 nt, Human
uuaaaguaaucgcaaaucacugcc

SEQ ID NO: 966442 - RNA, 21 nt, Human
uucaaagggggagagguuugu

SEQ ID NO: 966443 - RNA, 22 nt, Human
uucaccagccgccaccgcuucc

SEQ ID NO: 966444 - RNA, 23 nt, Human
uuuacacucccucagacgcuuua

SEQ ID NO: 966445 - RNA, 20 nt, Human
uuuauaagaaaggaaacugc

SEQ ID NO: 966446 - RNA, 22 nt, Human
aaaacaaacaaacaaaaaauuu

SEQ ID NO: 966447 - RNA, 19 nt, Human
aacugcgcugagaaaaaca

SEQ ID NO: 966448 - RNA, 19 nt, Human
aagaggaaagagaaacccg

SEQ ID NO: 966449 - RNA, 19 nt, Human
acacacaccaagacaucca

SEQ ID NO: 966450 - RNA, 24 nt, Human
acggcuggccgucuggcaguggag

SEQ ID NO: 966451 - RNA, 18 nt, Human
aggaaagagaaacccagc

SEQ ID NO: 966452 - RNA, 21 nt, Human
aggaagucuggccgacugagc

SEQ ID NO: 966453 - RNA, 22 nt, Human
aggaagucuggccgacugagcc

SEQ ID NO: 966454 - RNA, 22 nt, Human
aguauuauauauauuuauauau

SEQ ID NO: 966455 - RNA, 18 nt, Human
auacaaagucugaauaug

SEQ ID NO: 966456 - RNA, 20 nt, Human
augaaauguuccuugacccc

SEQ ID NO: 966457 - RNA, 20 nt, Human
caaaaaauuuucauuccacu

SEQ ID NO: 966458 - RNA, 26 nt, Human
caaaacaaaacugcgcugagaaaaac

SEQ ID NO: 966459 - RNA, 20 nt, Human
caagagaaaaccuuucuguu

SEQ ID NO: 966460 - RNA, 19 nt, Human
caagguagcagcaccacuc

SEQ ID NO: 966461 - RNA, 18 nt, Human
cacagccugucuucacug

SEQ ID NO: 966462 - RNA, 20 nt, Human
caccaagacauccagagugu

SEQ ID NO: 966463 - RNA, 21 nt, Human
cauaucccaccaagagaaaac

SEQ ID NO: 966464 - RNA, 22 nt, Human
caucccggugaaucaaagacgg

SEQ ID NO: 966465 - RNA, 18 nt, Human
ccaccaagagaaaaccuu

SEQ ID NO: 966466 - RNA, 18 nt, Human
cccccagguucugacucu

SEQ ID NO: 966467 - RNA, 24 nt, Human
cccuguuccuuuucuccaaaaaga

SEQ ID NO: 966468 - RNA, 19 nt, Human
ccgcugcuggcucccccuc

SEQ ID NO: 966469 - RNA, 21 nt, Human
ccgcugcuggcucccccucgc

SEQ ID NO: 966470 - RNA, 20 nt, Human
ccggggcggcggcggcggcg

SEQ ID NO: 966471 - RNA, 26 nt, Human
ccggggcggcggcggcggcggcuuuu

SEQ ID NO: 966472 - RNA, 21 nt, Human
ccuguuccuuuucuccaaaaa

SEQ ID NO: 966473 - RNA, 20 nt, Human
cgccgggaggcgggugccgg

SEQ ID NO: 966474 - RNA, 18 nt, Human
cggcaggacagcaaacgg

SEQ ID NO: 966475 - RNA, 20 nt, Human
cggcaggacagcaaacggcu

SEQ ID NO: 966476 - RNA, 23 nt, Human
cggcgaccgccgcugcuggcucc

SEQ ID NO: 966477 - RNA, 25 nt, Human
cggcucccccccgugcagagaccau

SEQ ID NO: 966478 - RNA, 22 nt, Human
cgugugacacuuccacaucgcg

SEQ ID NO: 966479 - RNA, 18 nt, Human
cugaggugauaaccacuc

SEQ ID NO: 966480 - RNA, 23 nt, Human
cugaggugauaaccacucagugg

SEQ ID NO: 966481 - RNA, 22 nt, Human
cuggcaguggagucuguccccu

SEQ ID NO: 966482 - RNA, 19 nt, Human
cuggccgucuggcagugga

SEQ ID NO: 966483 - RNA, 19 nt, Human
cuggcucccccucgccggc

SEQ ID NO: 966484 - RNA, 23 nt, Human
cuugaccccaaggucucagcaga

SEQ ID NO: 966485 - RNA, 21 nt, Human
gaauaugaaaauaagauuucc

SEQ ID NO: 966486 - RNA, 21 nt, Human
gcagcggcggcggcuccuccg

SEQ ID NO: 966487 - RNA, 18 nt, Human
gccggcgaccgccgcugc

SEQ ID NO: 966488 - RNA, 21 nt, Human
gccggcgaccgccgcugcugg

SEQ ID NO: 966489 - RNA, 27 nt, Human
gcggcggcggcggcggcugcggcggug

SEQ ID NO: 966490 - RNA, 22 nt, Human
gcggcggcggcggcugcggcgg

SEQ ID NO: 966491 - RNA, 20 nt, Human
gcggcgguggcgucggcagc

SEQ ID NO: 966492 - RNA, 19 nt, Human
gcucccccccgugcagaga

SEQ ID NO: 966493 - RNA, 24 nt, Human
ggagauggggguggacaaaaaaaa

SEQ ID NO: 966494 - RNA, 18 nt, Human
ggcagcuucuuccucugc

SEQ ID NO: 966495 - RNA, 18 nt, Human
ggcggcggcggcggcggc

SEQ ID NO: 966496 - RNA, 24 nt, Human
ggggcggcggcggcggcggcugcg

SEQ ID NO: 966497 - RNA, 23 nt, Human
guccauggguuggugaugugucc

SEQ ID NO: 966498 - RNA, 22 nt, Human
gugccggggcggcggcggcggc

SEQ ID NO: 966499 - RNA, 21 nt, Human
guggcgucggcagcggcggcg

SEQ ID NO: 966500 - RNA, 19 nt, Human
gugucugcgaguccauggg

SEQ ID NO: 966501 - RNA, 23 nt, Human
uaauccaauggacacacaaaaca

SEQ ID NO: 966502 - RNA, 23 nt, Human
uacaaagucugaauaugaaaaua

SEQ ID NO: 966503 - RNA, 24 nt, Human
uacacacaucccaaguucugcaua

SEQ ID NO: 966504 - RNA, 20 nt, Human
uaggaagagggguuagccag

SEQ ID NO: 966505 - RNA, 28 nt, Human
uauuauauauuuauauauacacacaucc

SEQ ID NO: 966506 - RNA, 21 nt, Human
uccaauggacacacaaaacaa

SEQ ID NO: 966507 - RNA, 22 nt, Human
uccaauggacacacaaaacaaa

SEQ ID NO: 966508 - RNA, 20 nt, Human
ucccaaguucugcauauccc

SEQ ID NO: 966509 - RNA, 19 nt, Human
uccuugaccccaaggucuc

SEQ ID NO: 966510 - RNA, 22 nt, Human
ucgcgggagcaggacccgugcu

SEQ ID NO: 966511 - RNA, 26 nt, Human
ucggcagcggcggcggcuccuccggc

SEQ ID NO: 966512 - RNA, 18 nt, Human
ucucgggccucgcagcuc

SEQ ID NO: 966513 - RNA, 20 nt, Human
ucugaauaugaaaauaagau

SEQ ID NO: 966514 - RNA, 21 nt, Human
ucugacucucgggccucgcag

SEQ ID NO: 966515 - RNA, 19 nt, Human
ucuguccccuucggcagcu

SEQ ID NO: 966516 - RNA, 25 nt, Human
ucuguccccuucggcagcuucuucc

SEQ ID NO: 966517 - RNA, 18 nt, Human
ucuucacugggcaaaagu

SEQ ID NO: 966518 - RNA, 19 nt, Human
ucuuccucugcuuggcugg

SEQ ID NO: 966519 - RNA, 19 nt, Human
ugaaaauaagauuuccucu

SEQ ID NO: 966520 - RNA, 23 nt, Human
ugaaaauaagauuuccucugaaa

SEQ ID NO: 966521 - RNA, 19 nt, Human
ugaaauguuccuugacccc

SEQ ID NO: 966522 - RNA, 20 nt, Human
ugaccccaaggucucagcag

SEQ ID NO: 966523 - RNA, 24 nt, Human
ugagaaaaacaguuucauaaauua

SEQ ID NO: 966524 - RNA, 24 nt, Human
ugcagagaccaucccucuccccca

SEQ ID NO: 966525 - RNA, 25 nt, Human
ugcauaucccaccaagagaaaaccu

SEQ ID NO: 966526 - RNA, 22 nt, Human
ugccggcgaccgccgcugcugg

SEQ ID NO: 966527 - RNA, 19 nt, Human
ugcggcgguggcgucggca

SEQ ID NO: 966528 - RNA, 21 nt, Human
uggacacacaaaacaaaacug

SEQ ID NO: 966529 - RNA, 18 nt, Human
uggcgucggcagcggcgg

SEQ ID NO: 966530 - RNA, 23 nt, Human
uguuaggaaguugggggaagaga

SEQ ID NO: 966531 - RNA, 20 nt, Human
uuccacugcccuguuccuuu

SEQ ID NO: 966532 - RNA, 20 nt, Human
uucggcagcuucuuccucug

SEQ ID NO: 966533 - RNA, 24 nt, Human
uugaccccaaggucucagcagaag

SEQ ID NO: 966534 - RNA, 18 nt, Human
uuggugauguguccuugg

SEQ ID NO: 966535 - RNA, 20 nt, Human
aaaaacauacagcacagaac

SEQ ID NO: 966536 - RNA, 23 nt, Human
aagaaggcucugagccacaggca

SEQ ID NO: 966537 - RNA, 23 nt, Human
agcacagcggcggccgcgcagcc

SEQ ID NO: 966538 - RNA, 18 nt, Human
agcgcccagcugcuuggg

SEQ ID NO: 966539 - RNA, 24 nt, Human
auuaaaaacauacagcacagaaca

SEQ ID NO: 966540 - RNA, 21 nt, Human
cacagcggcggccgcgcagcc

SEQ ID NO: 966541 - RNA, 18 nt, Human
cagcacagcggcggccgc

SEQ ID NO: 966542 - RNA, 18 nt, Human
cagcugcuuggggcugcu

SEQ ID NO: 966543 - RNA, 22 nt, Human
cccgggagaccgcugcuugggg

SEQ ID NO: 966544 - RNA, 19 nt, Human
ccgcugcuugggguugcac

SEQ ID NO: 966545 - RNA, 21 nt, Human
ccgcugcuugggguugcacgu

SEQ ID NO: 966546 - RNA, 18 nt, Human
cgcgcagccccggcccgg

SEQ ID NO: 966547 - RNA, 22 nt, Human
cugucccaguuccagcagcccc

SEQ ID NO: 966548 - RNA, 21 nt, Human
gagaacgagagcagagcaaga

SEQ ID NO: 966549 - RNA, 18 nt, Human
gagagcagagcaagagga

SEQ ID NO: 966550 - RNA, 25 nt, Human
gcagagcaagaggauggugcccucc

SEQ ID NO: 966551 - RNA, 19 nt, Human
gcagugccgggagcagugc

SEQ ID NO: 966552 - RNA, 24 nt, Human
guauguacaccuuuaauaugcaua

SEQ ID NO: 966553 - RNA, 18 nt, Human
uaauaugcauaugagaaa

SEQ ID NO: 966554 - RNA, 25 nt, Human
uagcaggcgagccacuguccccucu

SEQ ID NO: 966555 - RNA, 19 nt, Human
uccugaccuggugcgcagu

SEQ ID NO: 966556 - RNA, 18 nt, Human
ugaccuggugcgcagugc

SEQ ID NO: 966557 - RNA, 23 nt, Human
ugaccuuaaaggaagccuuccuu

SEQ ID NO: 966558 - RNA, 22 nt, Human
ugccgggagcagugcuggccau

SEQ ID NO: 966559 - RNA, 20 nt, Human
uuagucuuaaaaaauauaaa

SEQ ID NO: 966560 - RNA, 19 nt, Human
uugcaaaagucauaguugc

SEQ ID NO: 966561 - RNA, 26 nt, Human
aaaaggcuuccuccuggagagaauuu

SEQ ID NO: 966562 - RNA, 22 nt, Human
aaacagugguuuguacugaaac

SEQ ID NO: 966563 - RNA, 21 nt, Human
aaacguaaucaucuaugucca

SEQ ID NO: 966564 - RNA, 18 nt, Human
aaaggcuuccuccuggag

SEQ ID NO: 966565 - RNA, 18 nt, Human
aaaugaucaaacacccuc

SEQ ID NO: 966566 - RNA, 24 nt, Human
aaauguucuuccaagcugaacucc

SEQ ID NO: 966567 - RNA, 22 nt, Human
aacaaacaccaauaacccagau

SEQ ID NO: 966568 - RNA, 23 nt, Human
aagaaaaucacaaauacucaaag

SEQ ID NO: 966569 - RNA, 23 nt, Human
aagaaagaaagcacuuacuaugc

SEQ ID NO: 966570 - RNA, 25 nt, Human
aagaaggaaaaaggcuuccuccugg

SEQ ID NO: 966571 - RNA, 21 nt, Human
aagaugcugaaccagaaggaa

SEQ ID NO: 966572 - RNA, 18 nt, Human
aagcaaacucaggcaagc

SEQ ID NO: 966573 - RNA, 19 nt, Human
aagcaaacucaggcaagca

SEQ ID NO: 966574 - RNA, 18 nt, Human
aagcacugccaugcagaa

SEQ ID NO: 966575 - RNA, 21 nt, Human
aaggaauaccucauuuuugau

SEQ ID NO: 966576 - RNA, 25 nt, Human
aauuaauccucaauggaaaaaauau

SEQ ID NO: 966577 - RNA, 24 nt, Human
acaacaaacauagugaucuuuucc

SEQ ID NO: 966578 - RNA, 23 nt, Human
acacacuaaaaccauuucugccu

SEQ ID NO: 966579 - RNA, 21 nt, Human
acagagaagcugugcuaaaac

SEQ ID NO: 966580 - RNA, 25 nt, Human
acuccaagaugcugaaccagaagga

SEQ ID NO: 966581 - RNA, 21 nt, Human
acugauccauguugccucagc

SEQ ID NO: 966582 - RNA, 21 nt, Human
agaaagggguacguguccagc

SEQ ID NO: 966583 - RNA, 25 nt, Human
agagaaaaaaacuuuugcaggaugu

SEQ ID NO: 966584 - RNA, 19 nt, Human
agcucaccacaaagaccug

SEQ ID NO: 966585 - RNA, 23 nt, Human
aggaaaaaggcuuccuccuggag

SEQ ID NO: 966586 - RNA, 21 nt, Human
aggaacauggauuaaggcaaa

SEQ ID NO: 966587 - RNA, 21 nt, Human
aggaauucuggguucucacug

SEQ ID NO: 966588 - RNA, 20 nt, Human
aggaauuuucacuucaacau

SEQ ID NO: 966589 - RNA, 20 nt, Human
aggacacacaauggccaaaa

SEQ ID NO: 966590 - RNA, 21 nt, Human
aggacacacaauggccaaaag

SEQ ID NO: 966591 - RNA, 23 nt, Human
aggcaaagugaggcauugcaacc

SEQ ID NO: 966592 - RNA, 22 nt, Human
aggcagcucaguucuuuucuuu

SEQ ID NO: 966593 - RNA, 20 nt, Human
aggcuuccuccuggagagaa

SEQ ID NO: 966594 - RNA, 25 nt, Human
agggguacguguccagcagcauucg

SEQ ID NO: 966595 - RNA, 21 nt, Human
agguuuucacaaaauacaaag

SEQ ID NO: 966596 - RNA, 19 nt, Human
agugaugaucagccacugc

SEQ ID NO: 966597 - RNA, 22 nt, Human
agugaugaucagccacugcugc

SEQ ID NO: 966598 - RNA, 27 nt, Human
aucaaacacccuccaaucaguucucag

SEQ ID NO: 966599 - RNA, 19 nt, Human
caaaauacaaagcucaaac

SEQ ID NO: 966600 - RNA, 22 nt, Human
caauagccuccucccuccccag

SEQ ID NO: 966601 - RNA, 20 nt, Human
cacaaguugucccauccuuc

SEQ ID NO: 966602 - RNA, 24 nt, Human
cacacauacacacacuaaaaccau

SEQ ID NO: 966603 - RNA, 20 nt, Human
caccacaaaacagaaucaaa

SEQ ID NO: 966604 - RNA, 25 nt, Human
caccacaaagaccugacaauucaaa

SEQ ID NO: 966605 - RNA, 18 nt, Human
cacuaaaaccauuucugc

SEQ ID NO: 966606 - RNA, 25 nt, Human
caggaacaaacaccaauaacccaga

SEQ ID NO: 966607 - RNA, 27 nt, Human
caggaacaaacaccaauaacccagaua

SEQ ID NO: 966608 - RNA, 19 nt, Human
cauacacacacuaaaacca

SEQ ID NO: 966609 - RNA, 23 nt, Human
caucaggaacaaacaccaauaac

SEQ ID NO: 966610 - RNA, 19 nt, Human
ccacagccacuugccuccu

SEQ ID NO: 966611 - RNA, 22 nt, Human
ccagcagcauucgagcucucag

SEQ ID NO: 966612 - RNA, 22 nt, Human
ccucagccuguuaaaaacuaaa

SEQ ID NO: 966613 - RNA, 24 nt, Human
ccuccaaucaguucucaguuucau

SEQ ID NO: 966614 - RNA, 21 nt, Human
ccucuugagagaaagaguaag

SEQ ID NO: 966615 - RNA, 23 nt, Human
cgccacagccacuugccuccucu

SEQ ID NO: 966616 - RNA, 18 nt, Human
cuccaagaugcugaacca

SEQ ID NO: 966617 - RNA, 24 nt, Human
cuccaagaugcugaaccagaagga

SEQ ID NO: 966618 - RNA, 24 nt, Human
cuccguucgucaaaacuuccuuca

SEQ ID NO: 966619 - RNA, 18 nt, Human
cuggguucucacugaagc

SEQ ID NO: 966620 - RNA, 25 nt, Human
cuuaggagagaaaaaaacuuuugca

SEQ ID NO: 966621 - RNA, 19 nt, Human
gaacaaacaccaauaaccc

SEQ ID NO: 966622 - RNA, 21 nt, Human
gagaaaaaaacuuuugcagga

SEQ ID NO: 966623 - RNA, 23 nt, Human
gauaguucaaacagugguuugua

SEQ ID NO: 966624 - RNA, 19 nt, Human
ggaagggcaagaaggaaaa

SEQ ID NO: 966625 - RNA, 21 nt, Human
ggagagaauuuuuuuccuuuc

SEQ ID NO: 966626 - RNA, 22 nt, Human
ggcucacuucagaauuuucuaa

SEQ ID NO: 966627 - RNA, 22 nt, Human
gggcaagaaggaaaaaggcuuc

SEQ ID NO: 966628 - RNA, 19 nt, Human
guaaauccuccuccaggaa

SEQ ID NO: 966629 - RNA, 20 nt, Human
guaauaauagaaagggguac

SEQ ID NO: 966630 - RNA, 19 nt, Human
guagcuuaaaaagaaagaa

SEQ ID NO: 966631 - RNA, 21 nt, Human
uaaauccuccuccaggaauuc

SEQ ID NO: 966632 - RNA, 22 nt, Human
uaacccagauaguucaaacagg

SEQ ID NO: 966633 - RNA, 18 nt, Human
uaagaaaaucacaaauac

SEQ ID NO: 966634 - RNA, 26 nt, Human
uagccuccucccuccccagaaguagc

SEQ ID NO: 966635 - RNA, 22 nt, Human
uaggagagaaaaaaacuuuugc

SEQ ID NO: 966636 - RNA, 23 nt, Human
uauaguaagaaaaucacaaauac

SEQ ID NO: 966637 - RNA, 22 nt, Human
uauguccaccacaaaacagaau

SEQ ID NO: 966638 - RNA, 21 nt, Human
ucacaaaauacaaagcucaaa

SEQ ID NO: 966639 - RNA, 19 nt, Human
ucagccacugcugcggccg

SEQ ID NO: 966640 - RNA, 21 nt, Human
ucagugaugaucagccacugc

SEQ ID NO: 966641 - RNA, 18 nt, Human
uccaagcugaacuccaag

SEQ ID NO: 966642 - RNA, 21 nt, Human
uccauguugccucagccuguu

SEQ ID NO: 966643 - RNA, 21 nt, Human
uccccagaaguagcuuaaaaa

SEQ ID NO: 966644 - RNA, 24 nt, Human
ucccuccccagaaguagcuuaaaa

SEQ ID NO: 966645 - RNA, 24 nt, Human
uccuucaggacacacaauggccaa

SEQ ID NO: 966646 - RNA, 19 nt, Human
ucucuacuccguucgucaa

SEQ ID NO: 966647 - RNA, 24 nt, Human
ucugaagauugcuuuucugagcuu

SEQ ID NO: 966648 - RNA, 25 nt, Human
ugaaccagaaggaauuuucacuuca

SEQ ID NO: 966649 - RNA, 19 nt, Human
ugagagaaagaguaaggaa

SEQ ID NO: 966650 - RNA, 19 nt, Human
ugccaugcagaauucagcu

SEQ ID NO: 966651 - RNA, 19 nt, Human
ugccucagccuguuaaaaa

SEQ ID NO: 966652 - RNA, 19 nt, Human
ugccugaagcaaacucagg

SEQ ID NO: 966653 - RNA, 21 nt, Human
uggaaaaaauaugaaggaggc

SEQ ID NO: 966654 - RNA, 21 nt, Human
uguaaauccuccuccaggaau

SEQ ID NO: 966655 - RNA, 21 nt, Human
uguccaccacaaaacagaauc

SEQ ID NO: 966656 - RNA, 18 nt, Human
uuacaguuuucuuagugu

SEQ ID NO: 966657 - RNA, 26 nt, Human
uucaagguuuuacaguuuucuuaguu

SEQ ID NO: 966658 - RNA, 24 nt, Human
uucacacauacacacacuaaaacc

SEQ ID NO: 966659 - RNA, 21 nt, Human
uucacuucaacauuucugaau

SEQ ID NO: 966660 - RNA, 22 nt, Human
uucagaauuuucuaacuugucc

SEQ ID NO: 966661 - RNA, 19 nt, Human
uugccucagccuguuaaaa

SEQ ID NO: 966662 - RNA, 19 nt, Human
uugguuggguauuuuagaa

SEQ ID NO: 966663 - RNA, 20 nt, Human
uugguuggguauuuuagaag

SEQ ID NO: 966664 - RNA, 24 nt, Human
aaaguguucagauuacagguguga

SEQ ID NO: 966665 - RNA, 22 nt, Human
aagaaaaaucccagagguggag

SEQ ID NO: 966666 - RNA, 20 nt, Human
aagcucgacuucacuccugc

SEQ ID NO: 966667 - RNA, 25 nt, Human
aagugauccucccgccucggccucc

SEQ ID NO: 966668 - RNA, 23 nt, Human
aagugugugccaccgugccuggc

SEQ ID NO: 966669 - RNA, 19 nt, Human
acaagagauccucccuccu

SEQ ID NO: 966670 - RNA, 24 nt, Human
acuauguugcccaggcuggucuug

SEQ ID NO: 966671 - RNA, 25 nt, Human
acuauguugcccaggcuggucuuga

SEQ ID NO: 966672 - RNA, 24 nt, Human
agagauccucccuccucagccucc

SEQ ID NO: 966673 - RNA, 24 nt, Human
agauuacaggugugagccacggca

SEQ ID NO: 966674 - RNA, 24 nt, Human
agauuacaggugugagccacggca

SEQ ID NO: 966675 - RNA, 23 nt, Human
agcuggggcuacaagugugugcc

SEQ ID NO: 966676 - RNA, 19 nt, Human
aggagaaaaauggaagaaa

SEQ ID NO: 966677 - RNA, 24 nt, Human
aggagucucacuauguugcccagg

SEQ ID NO: 966678 - RNA, 21 nt, Human
agguggaggcucaaucaaaag

SEQ ID NO: 966679 - RNA, 19 nt, Human
agugcaguggugugaucac

SEQ ID NO: 966680 - RNA, 22 nt, Human
agugcaguggugugaucacagc

SEQ ID NO: 966681 - RNA, 20 nt, Human
aguuucuucaucuccauagg

SEQ ID NO: 966682 - RNA, 21 nt, Human
caaaugauuuuagugugugga

SEQ ID NO: 966683 - RNA, 28 nt, Human
caagacagguuccaagacaugcucugcc

SEQ ID NO: 966684 - RNA, 24 nt, Human
caagagauccucccuccucagccu

SEQ ID NO: 966685 - RNA, 23 nt, Human
caagaugcuggggcuggaaaugc

SEQ ID NO: 966686 - RNA, 27 nt, Human
caagugauccucccgccucggccuccc

SEQ ID NO: 966687 - RNA, 28 nt, Human
caagugauccucccgccucggccuccca

SEQ ID NO: 966688 - RNA, 18 nt, Human
cacaccugaggcugcccc

SEQ ID NO: 966689 - RNA, 20 nt, Human
cacaccugaggcugccccuc

SEQ ID NO: 966690 - RNA, 18 nt, Human
caccugaggcugccccuc

SEQ ID NO: 966691 - RNA, 20 nt, Human
caccuggccucaaguuucug

SEQ ID NO: 966692 - RNA, 21 nt, Human
cacgcuggcagagcuuaguga

SEQ ID NO: 966693 - RNA, 19 nt, Human
cacuauguugcccaggcug

SEQ ID NO: 966694 - RNA, 24 nt, Human
cacuauguugcccaggcuggucuu

SEQ ID NO: 966695 - RNA, 27 nt, Human
cacuauguugcccaggcuggucuugaa

SEQ ID NO: 966696 - RNA, 19 nt, Human
cacucaagucucugcccau

SEQ ID NO: 966697 - RNA, 20 nt, Human
cagauuacaggugugagcca

SEQ ID NO: 966698 - RNA, 19 nt, Human
cagcaagaugcuggggcug

SEQ ID NO: 966699 - RNA, 24 nt, Human
cagccucgaacuccuaggcacaag

SEQ ID NO: 966700 - RNA, 30 nt, Human
cagcuugaugaaggcacagaagguugucuu

SEQ ID NO: 966701 - RNA, 23 nt, Human
caggcacacaccugaggcugccc

SEQ ID NO: 966702 - RNA, 21 nt, Human
ccaaaguguucagauuacagg

SEQ ID NO: 966703 - RNA, 24 nt, Human
ccaaaguguucagauuacaggugu

SEQ ID NO: 966704 - RNA, 19 nt, Human
ccacauucauucccaagcu

SEQ ID NO: 966705 - RNA, 24 nt, Human
ccacugcagccucgaacuccuagg

SEQ ID NO: 966706 - RNA, 21 nt, Human
ccagagguggaggcucaauca

SEQ ID NO: 966707 - RNA, 19 nt, Human
ccaggcacacaccugaggc

SEQ ID NO: 966708 - RNA, 20 nt, Human
ccaggcacacaccugaggcu

SEQ ID NO: 966709 - RNA, 24 nt, Human
ccaggcuggucuugaacuccuggg

SEQ ID NO: 966710 - RNA, 19 nt, Human
cccaggcuggagugcagug

SEQ ID NO: 966711 - RNA, 22 nt, Human
cccaggcuggagugcaguggug

SEQ ID NO: 966712 - RNA, 22 nt, Human
ccucagccucccuaguagcugg

SEQ ID NO: 966713 - RNA, 24 nt, Human
ccucccacgauggguagcaggaac

SEQ ID NO: 966714 - RNA, 19 nt, Human
ccucccgccucggccuccc

SEQ ID NO: 966715 - RNA, 24 nt, Human
ccucccuccucagccucccuagua

SEQ ID NO: 966716 - RNA, 25 nt, Human
ccuccuaagagaggagaaaaaugga

SEQ ID NO: 966717 - RNA, 21 nt, Human
ccugaugguggccucccacga

SEQ ID NO: 966718 - RNA, 18 nt, Human
ccugggcucaagugaucc

SEQ ID NO: 966719 - RNA, 22 nt, Human
ccugggcucaagugauccuccc

SEQ ID NO: 966720 - RNA, 19 nt, Human
cggggagggaaacugucuc

SEQ ID NO: 966721 - RNA, 18 nt, Human
cuacaagugugugccacc

SEQ ID NO: 966722 - RNA, 24 nt, Human
cucaagugauccucccgccucggc

SEQ ID NO: 966723 - RNA, 22 nt, Human
cucagccucccuaguagcuggg

SEQ ID NO: 966724 - RNA, 22 nt, Human
cucaggagcgaggaccucgaag

SEQ ID NO: 966725 - RNA, 18 nt, Human
cugccguccuccuccaac

SEQ ID NO: 966726 - RNA, 19 nt, Human
cuggucuugaacuccuggg

SEQ ID NO: 966727 - RNA, 20 nt, Human
cuugaacuccugggcucaag

SEQ ID NO: 966728 - RNA, 23 nt, Human
cuuguucccaggcuggagugcag

SEQ ID NO: 966729 - RNA, 23 nt, Human
gaacuccuaggcacaagagaucc

SEQ ID NO: 966730 - RNA, 22 nt, Human
gaagaaaaaucccagaggugga

SEQ ID NO: 966731 - RNA, 20 nt, Human
gaccaacgccauucguggca

SEQ ID NO: 966732 - RNA, 20 nt, Human
gacccccaacugugucccag

SEQ ID NO: 966733 - RNA, 24 nt, Human
gacccccaacugugucccagacac

SEQ ID NO: 966734 - RNA, 18 nt, Human
gagcgaggaccucgaagg

SEQ ID NO: 966735 - RNA, 18 nt, Human
gauccucccgccucggcc

SEQ ID NO: 966736 - RNA, 18 nt, Human
gauggcaggaauuccaag

SEQ ID NO: 966737 - RNA, 18 nt, Human
gauuacaggugugagcca

SEQ ID NO: 966738 - RNA, 20 nt, Human
gccaagcaagaggccaggcu

SEQ ID NO: 966739 - RNA, 22 nt, Human
gccaagcaagaggccaggcuuc

SEQ ID NO: 966740 - RNA, 20 nt, Human
gccacggcaccuggccucaa

SEQ ID NO: 966741 - RNA, 23 nt, Human
gccucggccucccaaaguguuca

SEQ ID NO: 966742 - RNA, 18 nt, Human
gcugggugcaagaggcug

SEQ ID NO: 966743 - RNA, 21 nt, Human
ggacaugguggguacacaacc

SEQ ID NO: 966744 - RNA, 22 nt, Human
ggcuggagugcaguggugugau

SEQ ID NO: 966745 - RNA, 18 nt, Human
ggcuggucuugaacuccu

SEQ ID NO: 966746 - RNA, 19 nt, Human
ggcuucgugcaaaagaagg

SEQ ID NO: 966747 - RNA, 18 nt, Human
gggcagcaguggggggac

SEQ ID NO: 966748 - RNA, 18 nt, Human
gggcagcaguggggggac

SEQ ID NO: 966749 - RNA, 23 nt, Human
gggcagcaguggggggacguugu

SEQ ID NO: 966750 - RNA, 21 nt, Human
gggcucaagugauccucccgc

SEQ ID NO: 966751 - RNA, 22 nt, Human
gggcucaagugauccucccgcc

SEQ ID NO: 966752 - RNA, 24 nt, Human
gguacacaaccagcuugaugaagg

SEQ ID NO: 966753 - RNA, 22 nt, Human
gguaggagccucugguggcuca

SEQ ID NO: 966754 - RNA, 24 nt, Human
gugauccucccgccucggccuccc

SEQ ID NO: 966755 - RNA, 18 nt, Human
uaagagaggagaaaaaug

SEQ ID NO: 966756 - RNA, 19 nt, Human
uaaggggucauuaaucucu

SEQ ID NO: 966757 - RNA, 22 nt, Human
uaaugucucucgaucaagcuuu

SEQ ID NO: 966758 - RNA, 22 nt, Human
uacaggugugagccacggcacc

SEQ ID NO: 966759 - RNA, 22 nt, Human
uacaggugugagccacggcacc

SEQ ID NO: 966760 - RNA, 23 nt, Human
uacaggugugagccacggcaccu

SEQ ID NO: 966761 - RNA, 23 nt, Human
uagagacaggagucucacuaugu

SEQ ID NO: 966762 - RNA, 23 nt, Human
uagccuauucuccugcaauccuu

SEQ ID NO: 966763 - RNA, 22 nt, Human
uaggaucuuccacauucauucc

SEQ ID NO: 966764 - RNA, 26 nt, Human
uaguagcuggggcuacaagugugugc

SEQ ID NO: 966765 - RNA, 20 nt, Human
uauguugcccaggcuggucu

SEQ ID NO: 966766 - RNA, 23 nt, Human
uauguugcccaggcuggucuuga

SEQ ID NO: 966767 - RNA, 24 nt, Human
uauguugcccaggcuggucuugaa

SEQ ID NO: 966768 - RNA, 20 nt, Human
ucagaauauaggaucuucca

SEQ ID NO: 966769 - RNA, 22 nt, Human
ucagauuacaggugugagccac

SEQ ID NO: 966770 - RNA, 23 nt, Human
ucagccucccuaguagcuggggc

SEQ ID NO: 966771 - RNA, 22 nt, Human
ucaggagcgaggaccucgaagg

SEQ ID NO: 966772 - RNA, 23 nt, Human
ucccaaaguguucagauuacagg

SEQ ID NO: 966773 - RNA, 19 nt, Human
ucccagacacggcugugug

SEQ ID NO: 966774 - RNA, 24 nt, Human
ucccaggcuggagugcaguggugu

SEQ ID NO: 966775 - RNA, 22 nt, Human
ucccuaguagcuggggcuacaa

SEQ ID NO: 966776 - RNA, 21 nt, Human
ucccucaggagcgaggaccuc

SEQ ID NO: 966777 - RNA, 22 nt, Human
ucccugagcgucuccccagcuc

SEQ ID NO: 966778 - RNA, 23 nt, Human
uccucagccucccuaguagcugg

SEQ ID NO: 966779 - RNA, 21 nt, Human
uccugggcucaagugauccuc

SEQ ID NO: 966780 - RNA, 22 nt, Human
uccugggcucaagugauccucc

SEQ ID NO: 966781 - RNA, 23 nt, Human
uccugggcucaagugauccuccc

SEQ ID NO: 966782 - RNA, 19 nt, Human
ucucacuauguugcccagg

SEQ ID NO: 966783 - RNA, 23 nt, Human
ucucacuauguugcccaggcugg

SEQ ID NO: 966784 - RNA, 24 nt, Human
ucucacuauguugcccaggcuggu

SEQ ID NO: 966785 - RNA, 26 nt, Human
ucucacuauguugcccaggcuggucu

SEQ ID NO: 966786 - RNA, 21 nt, Human
ucuccugcaauccuuaaagag

SEQ ID NO: 966787 - RNA, 23 nt, Human
ucucugugacaguccaggguccc

SEQ ID NO: 966788 - RNA, 19 nt, Human
ucugucaucggcuguguga

SEQ ID NO: 966789 - RNA, 23 nt, Human
ucuugaacuccugggcucaagug

SEQ ID NO: 966790 - RNA, 25 nt, Human
ugaacuccugggcucaagugauccu

SEQ ID NO: 966791 - RNA, 18 nt, Human
ugagcgucuccccagcuc

SEQ ID NO: 966792 - RNA, 21 nt, Human
ugcaagaggcugugagcggug

SEQ ID NO: 966793 - RNA, 21 nt, Human
ugcccaggcacacaccugagg

SEQ ID NO: 966794 - RNA, 24 nt, Human
ugcccaggcuggucuugaacuccu

SEQ ID NO: 966795 - RNA, 28 nt, Human
ugcccaggcuggucuugaacuccugggc

SEQ ID NO: 966796 - RNA, 18 nt, Human
ugcugaguagaugcuguu

SEQ ID NO: 966797 - RNA, 21 nt, Human
ugcuugcauauauuuaccuuu

SEQ ID NO: 966798 - RNA, 19 nt, Human
uggagugcaguggugugau

SEQ ID NO: 966799 - RNA, 19 nt, Human
uggagugcaguggugugau

SEQ ID NO: 966800 - RNA, 21 nt, Human
uggagugcaguggugugauca

SEQ ID NO: 966801 - RNA, 28 nt, Human
uggagugcaguggugugauggcucuagc

SEQ ID NO: 966802 - RNA, 18 nt, Human
uggcaggaauuccaaggg

SEQ ID NO: 966803 - RNA, 24 nt, Human
ugggcucaagugauccucccgccu

SEQ ID NO: 966804 - RNA, 23 nt, Human
ugggguaggagccucugguggcu

SEQ ID NO: 966805 - RNA, 24 nt, Human
uggugugaucacagcccacugcag

SEQ ID NO: 966806 - RNA, 19 nt, Human
uguccugucucucagaaua

SEQ ID NO: 966807 - RNA, 21 nt, Human
uguccugucucucagaauaua

SEQ ID NO: 966808 - RNA, 19 nt, Human
ugucucucagaauauagga

SEQ ID NO: 966809 - RNA, 19 nt, Human
ugucucugccguccuccuc

SEQ ID NO: 966810 - RNA, 20 nt, Human
ugucucugccguccuccucc

SEQ ID NO: 966811 - RNA, 23 nt, Human
ugucucugccguccuccuccaac

SEQ ID NO: 966812 - RNA, 18 nt, Human
uuaaagagcugauaaugu

SEQ ID NO: 966813 - RNA, 23 nt, Human
uucccaggcuggagugcaguggu

SEQ ID NO: 966814 - RNA, 19 nt, Human
uucccugagcgucucccca

SEQ ID NO: 966815 - RNA, 23 nt, Human
uuuaguguguggagguugaaccu

SEQ ID NO: 966816 - RNA, 18 nt, Human
aaauaauccagucuggag

SEQ ID NO: 966817 - RNA, 18 nt, Human
acccugagaggacaaaaa

SEQ ID NO: 966818 - RNA, 19 nt, Human
acccugagaggacaaaaac

SEQ ID NO: 966819 - RNA, 26 nt, Human
acccugagaggacaaaaacaggaagc

SEQ ID NO: 966820 - RNA, 21 nt, Human
agaggcucugccucuccugcc

SEQ ID NO: 966821 - RNA, 18 nt, Human
agcacaggggcuucaggg

SEQ ID NO: 966822 - RNA, 24 nt, Human
aggggacaguggcaggggucccuu

SEQ ID NO: 966823 - RNA, 22 nt, Human
cagcggggaagcccuagaacuc

SEQ ID NO: 966824 - RNA, 19 nt, Human
caggggacuuggguuccau

SEQ ID NO: 966825 - RNA, 19 nt, Human
caugagcagacaaugaggc

SEQ ID NO: 966826 - RNA, 21 nt, Human
ccacgcccucccucauguagg

SEQ ID NO: 966827 - RNA, 18 nt, Human
ccagcccgcugaggggcc

SEQ ID NO: 966828 - RNA, 26 nt, Human
cccaacccugagaggacaaaaacagg

SEQ ID NO: 966829 - RNA, 21 nt, Human
ccccggugcccgauagauggg

SEQ ID NO: 966830 - RNA, 24 nt, Human
ccggugcccgauagaugggccgga

SEQ ID NO: 966831 - RNA, 20 nt, Human
ccugccacccuggugaggga

SEQ ID NO: 966832 - RNA, 21 nt, Human
ccugggcugcagcaugauugg

SEQ ID NO: 966833 - RNA, 18 nt, Human
ccuugccacgcccucccu

SEQ ID NO: 966834 - RNA, 19 nt, Human
ccuugccacgcccucccuc

SEQ ID NO: 966835 - RNA, 21 nt, Human
cgggccggagccccggugccc

SEQ ID NO: 966836 - RNA, 19 nt, Human
cuggagcagucgggguccu

SEQ ID NO: 966837 - RNA, 19 nt, Human
gaacacacguuggcaggag

SEQ ID NO: 966838 - RNA, 21 nt, Human
gacaaaaacaggaagcucugu

SEQ ID NO: 966839 - RNA, 18 nt, Human
gacaguggcagggguccc

SEQ ID NO: 966840 - RNA, 18 nt, Human
gaggggccagccacggcg

SEQ ID NO: 966841 - RNA, 21 nt, Human
gcaaguguugucccaccuccu

SEQ ID NO: 966842 - RNA, 23 nt, Human
ggcccaaaaccucugccagagga

SEQ ID NO: 966843 - RNA, 20 nt, Human
gggaagcccuagaacuccaa

SEQ ID NO: 966844 - RNA, 18 nt, Human
gggacaguggcagggguc

SEQ ID NO: 966845 - RNA, 23 nt, Human
gugggaaaacuccgcugcagaga

SEQ ID NO: 966846 - RNA, 19 nt, Human
uagccugccuauucuggca

SEQ ID NO: 966847 - RNA, 19 nt, Human
ucccaccuccuggcccaaa

SEQ ID NO: 966848 - RNA, 24 nt, Human
ucccugagucaggcggggccccug

SEQ ID NO: 966849 - RNA, 18 nt, Human
uccgcaguaggucuuggc

SEQ ID NO: 966850 - RNA, 21 nt, Human
uccgcaguaggucuuggcccu

SEQ ID NO: 966851 - RNA, 23 nt, Human
uccugggucccgggccggagccc

SEQ ID NO: 966852 - RNA, 24 nt, Human
ucuccgucacuagcuaggccacag

SEQ ID NO: 966853 - RNA, 22 nt, Human
ugagcagacaaugaggcggccc

SEQ ID NO: 966854 - RNA, 20 nt, Human
uggcaggaguggcuguccug

SEQ ID NO: 966855 - RNA, 19 nt, Human
uggcaggggucccuugcca

SEQ ID NO: 966856 - RNA, 21 nt, Human
uggcaggggucccuugccaac

SEQ ID NO: 966857 - RNA, 18 nt, Human
uggcccaaaaccucugcc

SEQ ID NO: 966858 - RNA, 22 nt, Human
uggcuguccugucccugaguca

SEQ ID NO: 966859 - RNA, 19 nt, Human
ugguccugggucccgggcc

SEQ ID NO: 966860 - RNA, 19 nt, Human
uguccugucccugagucag

SEQ ID NO: 966861 - RNA, 22 nt, Human
uuccaugcaaguguugucccac

SEQ ID NO: 966862 - RNA, 21 nt, Human
uucccggcagcggggaagccc

SEQ ID NO: 966863 - RNA, 26 nt, Human
aaggauuucuuucuaggggaaguggu

SEQ ID NO: 966864 - RNA, 22 nt, Human
aaucuacccacccacuucccca

SEQ ID NO: 966865 - RNA, 24 nt, Human
acaacucgagucugucuuguuuuu

SEQ ID NO: 966866 - RNA, 24 nt, Human
acgcacgcacgcuucuucggcccc

SEQ ID NO: 966867 - RNA, 26 nt, Human
auagaaaaccuaacaaaaauacccug

SEQ ID NO: 966868 - RNA, 18 nt, Human
aucuauggccauggucgc

SEQ ID NO: 966869 - RNA, 23 nt, Human
cacccacuuccccaaagagggca

SEQ ID NO: 966870 - RNA, 26 nt, Human
cacccacuuccccaaagagggcaaca

SEQ ID NO: 966871 - RNA, 19 nt, Human
cagccccccaugcacacac

SEQ ID NO: 966872 - RNA, 22 nt, Human
cagccccccaugcacacacacc

SEQ ID NO: 966873 - RNA, 18 nt, Human
ccaagccaacgcugaaag

SEQ ID NO: 966874 - RNA, 22 nt, Human
ccaagccaacgcugaaaguaaa

SEQ ID NO: 966875 - RNA, 21 nt, Human
ccauggucgcuuccccugcag

SEQ ID NO: 966876 - RNA, 20 nt, Human
ccauucccucuuggagucac

SEQ ID NO: 966877 - RNA, 22 nt, Human
cccgcgcugcugcgccgccagg

SEQ ID NO: 966878 - RNA, 23 nt, Human
ccuaacaacucgagucugucuug

SEQ ID NO: 966879 - RNA, 25 nt, Human
ccuccaagccaacgcugaaaguaaa

SEQ ID NO: 966880 - RNA, 18 nt, Human
ccucccgcgcugcugcgc

SEQ ID NO: 966881 - RNA, 18 nt, Human
ccuccgagcgaugcuccu

SEQ ID NO: 966882 - RNA, 18 nt, Human
cgccgccucccgcgcugc

SEQ ID NO: 966883 - RNA, 21 nt, Human
cuucgccgccucccgcgcugc

SEQ ID NO: 966884 - RNA, 24 nt, Human
cuugauugguuccucagcccuaac

SEQ ID NO: 966885 - RNA, 25 nt, Human
gaacugcaucuucuagauuugaacc

SEQ ID NO: 966886 - RNA, 20 nt, Human
gaaguggcagcggagggucc

SEQ ID NO: 966887 - RNA, 26 nt, Human
gaucuauggccauggucgcuuccccu

SEQ ID NO: 966888 - RNA, 20 nt, Human
gccaacgcugaaaguaaagu

SEQ ID NO: 966889 - RNA, 22 nt, Human
gccccggcgucccaggggcggg

SEQ ID NO: 966890 - RNA, 22 nt, Human
gcgccgccaggcaacccccccc

SEQ ID NO: 966891 - RNA, 22 nt, Human
gcggcggcggcgagucgcuccc

SEQ ID NO: 966892 - RNA, 19 nt, Human
ggcgggcgcuggggucucc

SEQ ID NO: 966893 - RNA, 19 nt, Human
ggggcgggggccggggccu

SEQ ID NO: 966894 - RNA, 23 nt, Human
ggucgcuuccccugcagaaggcg

SEQ ID NO: 966895 - RNA, 21 nt, Human
uaacaaaaauacccugguuca

SEQ ID NO: 966896 - RNA, 23 nt, Human
uaccuugauugguuccucagccc

SEQ ID NO: 966897 - RNA, 30 nt, Human
ucagcaacacuuuuaccccaacauuuucuu

SEQ ID NO: 966898 - RNA, 19 nt, Human
uccccugcagaaggcgggc

SEQ ID NO: 966899 - RNA, 19 nt, Human
ucgccgccucccgcgcugc

SEQ ID NO: 966900 - RNA, 22 nt, Human
ugcuauaaaguauuucauagga

SEQ ID NO: 966901 - RNA, 21 nt, Human
uggccauggucgcuuccccug

SEQ ID NO: 966902 - RNA, 23 nt, Human
ugguuccucagcccuaacaacuc

SEQ ID NO: 966903 - RNA, 19 nt, Human
uguccccuccgagcgaugc

SEQ ID NO: 966904 - RNA, 22 nt, Human
uguccccuccgagcgaugcucc

SEQ ID NO: 966905 - RNA, 23 nt, Human
uuccccaaagagggcaaaaauug

SEQ ID NO: 966906 - RNA, 20 nt, Human
uugcaaaucugccaugugcu

SEQ ID NO: 966907 - RNA, 19 nt, Human
uuggaucuucauugcuccu

SEQ ID NO: 966908 - RNA, 22 nt, Human
uuguccccuccgagcgaugcuc

SEQ ID NO: 966909 - RNA, 26 nt, Human
uuugaaccaugugcuuuaccaacagc

SEQ ID NO: 966910 - RNA, 20 nt, Human
aaccauguggcuucaaugca

SEQ ID NO: 966911 - RNA, 22 nt, Human
aacucuuaaaagagcagugcaa

SEQ ID NO: 966912 - RNA, 21 nt, Human
aauuccuugaaggggugagcu

SEQ ID NO: 966913 - RNA, 19 nt, Human
acaguucgaucuaagcaca

SEQ ID NO: 966914 - RNA, 22 nt, Human
accccaaaggaagcuccaaaca

SEQ ID NO: 966915 - RNA, 27 nt, Human
accggggggagggggugcaggagaggg

SEQ ID NO: 966916 - RNA, 20 nt, Human
agaaauuggcguuugaguuc

SEQ ID NO: 966917 - RNA, 21 nt, Human
agaggcugccucugagagugg

SEQ ID NO: 966918 - RNA, 22 nt, Human
agcuuauggccucugcuacccu

SEQ ID NO: 966919 - RNA, 19 nt, Human
aggaagauggaggggcugc

SEQ ID NO: 966920 - RNA, 22 nt, Human
aggaagcuccaaacagcaacug

SEQ ID NO: 966921 - RNA, 26 nt, Human
aggaagcuccaaacagcaacugggcc

SEQ ID NO: 966922 - RNA, 20 nt, Human
aggcaggggcgcgcggggcc

SEQ ID NO: 966923 - RNA, 20 nt, Human
agggaguagggggaaauggu

SEQ ID NO: 966924 - RNA, 22 nt, Human
agguggcuguggggagacgggg

SEQ ID NO: 966925 - RNA, 22 nt, Human
agugacaaagggggucacuuug

SEQ ID NO: 966926 - RNA, 22 nt, Human
aguucugauaaaacaaguugag

SEQ ID NO: 966927 - RNA, 18 nt, Human
augcuccuauuuguuucc

SEQ ID NO: 966928 - RNA, 22 nt, Human
augugugugugugugugugugg

SEQ ID NO: 966929 - RNA, 22 nt, Human
augugugugugugugugugugu

SEQ ID NO: 966930 - RNA, 23 nt, Human
auguguguguguguguguguguu

SEQ ID NO: 966931 - RNA, 20 nt, Human
caaaugcaacauucccuuua

SEQ ID NO: 966932 - RNA, 18 nt, Human
caagaaccaaauaagaga

SEQ ID NO: 966933 - RNA, 22 nt, Human
caccacauacuucacuuauccc

SEQ ID NO: 966934 - RNA, 27 nt, Human
caccacauacuucacuuaucccuaaag

SEQ ID NO: 966935 - RNA, 19 nt, Human
caccccaaaggaagcucca

SEQ ID NO: 966936 - RNA, 19 nt, Human
caccgccccggcccccugc

SEQ ID NO: 966937 - RNA, 20 nt, Human
caccgccccggcccccugcc

SEQ ID NO: 966938 - RNA, 23 nt, Human
cacuagagacuuuuuaaccaaaa

SEQ ID NO: 966939 - RNA, 21 nt, Human
caggagccccggagagcagcg

SEQ ID NO: 966940 - RNA, 20 nt, Human
cagggaaaccggggaaaucg

SEQ ID NO: 966941 - RNA, 22 nt, Human
cauuagaaauacaaauuaaucc

SEQ ID NO: 966942 - RNA, 18 nt, Human
ccaccggggccggggguu

SEQ ID NO: 966943 - RNA, 25 nt, Human
ccauccuucgggccuggucuccuga

SEQ ID NO: 966944 - RNA, 22 nt, Human
ccaucuccuccgccgccugcaa

SEQ ID NO: 966945 - RNA, 21 nt, Human
cccccgccauccucccacccc

SEQ ID NO: 966946 - RNA, 18 nt, Human
cccccgcgcguuuccagc

SEQ ID NO: 966947 - RNA, 19 nt, Human
ccccgccauccucccaccc

SEQ ID NO: 966948 - RNA, 23 nt, Human
ccccgccauccucccaccccaaa

SEQ ID NO: 966949 - RNA, 23 nt, Human
ccccggcugagggugccggcgag

SEQ ID NO: 966950 - RNA, 27 nt, Human
ccccugcccccgccauccucccacccc

SEQ ID NO: 966951 - RNA, 20 nt, Human
cccucguuaaggcaccgccc

SEQ ID NO: 966952 - RNA, 20 nt, Human
ccgccccggcccccugcccc

SEQ ID NO: 966953 - RNA, 21 nt, Human
ccgccugcaagauaaauguga

SEQ ID NO: 966954 - RNA, 18 nt, Human
ccggggccggggguuggg

SEQ ID NO: 966955 - RNA, 18 nt, Human
ccuuccucuccccuuucc

SEQ ID NO: 966956 - RNA, 21 nt, Human
ccuuccucuccccuuuccguc

SEQ ID NO: 966957 - RNA, 20 nt, Human
cgagccuacggccuccccgg

SEQ ID NO: 966958 - RNA, 20 nt, Human
cguguauauaugugugugug

SEQ ID NO: 966959 - RNA, 21 nt, Human
cucaggcucccccgcgcguuu

SEQ ID NO: 966960 - RNA, 23 nt, Human
cuccaaacagcaacugggccugc

SEQ ID NO: 966961 - RNA, 23 nt, Human
cucccaaaagcugaggccauuaa

SEQ ID NO: 966962 - RNA, 18 nt, Human
cuccguugcccacucuuc

SEQ ID NO: 966963 - RNA, 19 nt, Human
cuccugaugggcuaggugg

SEQ ID NO: 966964 - RNA, 22 nt, Human
cucuaaucucccaaauaaccgg

SEQ ID NO: 966965 - RNA, 20 nt, Human
cugcccccgccauccuccca

SEQ ID NO: 966966 - RNA, 25 nt, Human
cugggcuggguucagggaaaccggg

SEQ ID NO: 966967 - RNA, 19 nt, Human
cuuaaaaccuucuuggaau

SEQ ID NO: 966968 - RNA, 18 nt, Human
gaaaauacuucaaaccau

SEQ ID NO: 966969 - RNA, 26 nt, Human
gacccgggcggggguggggggaggcc

SEQ ID NO: 966970 - RNA, 26 nt, Human
gagcagcgggaccccguaggcagggg

SEQ ID NO: 966971 - RNA, 18 nt, Human
gagcgcgcgcgcgugugg

SEQ ID NO: 966972 - RNA, 19 nt, Human
gaggccaccggggccgggg

SEQ ID NO: 966973 - RNA, 19 nt, Human
gagggagggggacugaggc

SEQ ID NO: 966974 - RNA, 22 nt, Human
gcgcgcguguggcggaggaggg

SEQ ID NO: 966975 - RNA, 20 nt, Human
gcgcguguggcggaggaggg

SEQ ID NO: 966976 - RNA, 20 nt, Human
gcggcggcguggcgaaggag

SEQ ID NO: 966977 - RNA, 26 nt, Human
gcugccucugagaguggaaggcaaac

SEQ ID NO: 966978 - RNA, 22 nt, Human
ggagagggagggaguaggggga

SEQ ID NO: 966979 - RNA, 20 nt, Human
ggaggccaccggggccgggg

SEQ ID NO: 966980 - RNA, 22 nt, Human
ggaggccaccggggccgggggu

SEQ ID NO: 966981 - RNA, 21 nt, Human
ggaguagggggaaauggugga

SEQ ID NO: 966982 - RNA, 20 nt, Human
ggccggggguuggggcuggc

SEQ ID NO: 966983 - RNA, 18 nt, Human
ggccuggucuccugaugg

SEQ ID NO: 966984 - RNA, 18 nt, Human
gggcggggguggggggag

SEQ ID NO: 966985 - RNA, 21 nt, Human
gggcggggguggggggaggcc

SEQ ID NO: 966986 - RNA, 19 nt, Human
gggcugggcuggguucagg

SEQ ID NO: 966987 - RNA, 22 nt, Human
ggggagggggugcaggagaggg

SEQ ID NO: 966988 - RNA, 18 nt, Human
ggguagugccuagcaaag

SEQ ID NO: 966989 - RNA, 22 nt, Human
ggguggggggaggccaccgggg

SEQ ID NO: 966990 - RNA, 18 nt, Human
ggugcaggagagggaggg

SEQ ID NO: 966991 - RNA, 19 nt, Human
gugccggcgaggagguggc

SEQ ID NO: 966992 - RNA, 20 nt, Human
gugcuucucaaagaagcagg

SEQ ID NO: 966993 - RNA, 24 nt, Human
guggcggaggagggggacccgggc

SEQ ID NO: 966994 - RNA, 23 nt, Human
gugugugugagcgcgcgcgcgug

SEQ ID NO: 966995 - RNA, 21 nt, Human
gugugugugugugugugugug

SEQ ID NO: 966996 - RNA, 23 nt, Human
uaaaaaacacagaacuuuuuaug

SEQ ID NO: 966997 - RNA, 18 nt, Human
uaaaacaaguugagauuc

SEQ ID NO: 966998 - RNA, 23 nt, Human
uaaaagagcagugcaaaagagaa

SEQ ID NO: 966999 - RNA, 21 nt, Human
uaaaauccaaacaugaaaaua

SEQ ID NO: 967000 - RNA, 20 nt, Human
uaaaaugccaaagggaguaa

SEQ ID NO: 967001 - RNA, 27 nt, Human
uauaauaucacggaauagagagacaaa

SEQ ID NO: 967002 - RNA, 19 nt, Human
uauaugugugugugugugu

SEQ ID NO: 967003 - RNA, 23 nt, Human
uauaugugugugugugugugugu

SEQ ID NO: 967004 - RNA, 19 nt, Human
uaucugugugguuguggac

SEQ ID NO: 967005 - RNA, 21 nt, Human
uauggccucugcuacccuagc

SEQ ID NO: 967006 - RNA, 18 nt, Human
uaugugugugugugugug

SEQ ID NO: 967007 - RNA, 23 nt, Human
uaugugugugugugugugugugu

SEQ ID NO: 967008 - RNA, 24 nt, Human
uaugugugugugugugugugugug

SEQ ID NO: 967009 - RNA, 24 nt, Human
uauuauuaaaauccaaacaugaaa

SEQ ID NO: 967010 - RNA, 21 nt, Human
ucagauccauccuucgggccu

SEQ ID NO: 967011 - RNA, 18 nt, Human
ucaugcaguugggugcuc

SEQ ID NO: 967012 - RNA, 18 nt, Human
uccaguggauggacaaug

SEQ ID NO: 967013 - RNA, 19 nt, Human
ucccaaaagcugaggccau

SEQ ID NO: 967014 - RNA, 23 nt, Human
ucccaaaugcaacauucccuuua

SEQ ID NO: 967015 - RNA, 20 nt, Human
uccuucgggccuggucuccu

SEQ ID NO: 967016 - RNA, 22 nt, Human
uccuugaaggggugagcuccug

SEQ ID NO: 967017 - RNA, 24 nt, Human
ucuaaaccauguggcuucaaugca

SEQ ID NO: 967018 - RNA, 21 nt, Human
ucuaggguucuauucugaagg

SEQ ID NO: 967019 - RNA, 21 nt, Human
ucuccuccgccgccugcaaga

SEQ ID NO: 967020 - RNA, 22 nt, Human
ucugcuaaaacucuuaaaagag

SEQ ID NO: 967021 - RNA, 27 nt, Human
ugaagcagcccaagaaccaaauaagag

SEQ ID NO: 967022 - RNA, 25 nt, Human
ugaagucagcccugguuuaacuccu

SEQ ID NO: 967023 - RNA, 23 nt, Human
ugaccuuaaauuuauuuuagcau

SEQ ID NO: 967024 - RNA, 20 nt, Human
ugacuccccugugcgccuug

SEQ ID NO: 967025 - RNA, 19 nt, Human
ugacugggccuguugaagu

SEQ ID NO: 967026 - RNA, 18 nt, Human
ugagcgcgcgcgcgugug

SEQ ID NO: 967027 - RNA, 21 nt, Human
ugaggccauuaaaaaacacag

SEQ ID NO: 967028 - RNA, 25 nt, Human
ugccgagcaggaagauggaggggcu

SEQ ID NO: 967029 - RNA, 23 nt, Human
ugccuagcaaaguugcgagguga

SEQ ID NO: 967030 - RNA, 22 nt, Human
uggauggacaaugugcuugccc

SEQ ID NO: 967031 - RNA, 20 nt, Human
uggcacaaagaaugcuccua

SEQ ID NO: 967032 - RNA, 21 nt, Human
uggccugagccucccaaaagc

SEQ ID NO: 967033 - RNA, 22 nt, Human
uggccugagccucccaaaagcu

SEQ ID NO: 967034 - RNA, 20 nt, Human
uggcggaggagggggacccg

SEQ ID NO: 967035 - RNA, 20 nt, Human
uggcguguauauaugugugu

SEQ ID NO: 967036 - RNA, 23 nt, Human
uggcguguauauaugugugugug

SEQ ID NO: 967037 - RNA, 29 nt, Human
uggcguguauauaugugugugugugugug

SEQ ID NO: 967038 - RNA, 20 nt, Human
uggcuguggggagacgggau

SEQ ID NO: 967039 - RNA, 26 nt, Human
uggggcuggcaggagccccggagagc

SEQ ID NO: 967040 - RNA, 21 nt, Human
ugguggagggagggggacuga

SEQ ID NO: 967041 - RNA, 22 nt, Human
ugguggagggagggggacugag

SEQ ID NO: 967042 - RNA, 24 nt, Human
ugguggagggagggggacugaggc

SEQ ID NO: 967043 - RNA, 25 nt, Human
ugguggagggagggggacugaggcu

SEQ ID NO: 967044 - RNA, 19 nt, Human
uguauauaugugugugugu

SEQ ID NO: 967045 - RNA, 19 nt, Human
ugugagcgcgcgcgcgugu

SEQ ID NO: 967046 - RNA, 23 nt, Human
uguggggagacgggaucccaaac

SEQ ID NO: 967047 - RNA, 18 nt, Human
ugugugugugugugugug

SEQ ID NO: 967048 - RNA, 18 nt, Human
ugugugugugugugugug

SEQ ID NO: 967049 - RNA, 18 nt, Human
ugugugugugugugugug

SEQ ID NO: 967050 - RNA, 18 nt, Human
ugugugugugugugugug

SEQ ID NO: 967051 - RNA, 18 nt, Human
ugugugugugugugugug

SEQ ID NO: 967052 - RNA, 21 nt, Human
ugugugugugugugugugugu

SEQ ID NO: 967053 - RNA, 21 nt, Human
ugugugugugugugugugugu

SEQ ID NO: 967054 - RNA, 21 nt, Human
ugugugugugugugugugugu

SEQ ID NO: 967055 - RNA, 21 nt, Human
ugugugugugugugugugugu

SEQ ID NO: 967056 - RNA, 21 nt, Human
ugugugugugugugugugugu

SEQ ID NO: 967057 - RNA, 22 nt, Human
ugugugugugugugugugugug

SEQ ID NO: 967058 - RNA, 22 nt, Human
ugugugugugugugugugugug

SEQ ID NO: 967059 - RNA, 19 nt, Human
uguuucuuuagcucugucc

SEQ ID NO: 967060 - RNA, 23 nt, Human
uuagcauauucacguguuucuug

SEQ ID NO: 967061 - RNA, 23 nt, Human
uucaaaccauuucguuagcagca

SEQ ID NO: 967062 - RNA, 18 nt, Human
uucagggaaaccggggaa

SEQ ID NO: 967063 - RNA, 22 nt, Human
uucagucaugcaguugggugcu

SEQ ID NO: 967064 - RNA, 18 nt, Human
uuccaguggauggacaau

SEQ ID NO: 967065 - RNA, 24 nt, Human
uuccuugaaggggugagcuccugg

SEQ ID NO: 967066 - RNA, 23 nt, Human
uugccagaaugacuccccugugc

SEQ ID NO: 967067 - RNA, 21 nt, Human
uuugcuguccuggaggguaaa

SEQ ID NO: 967068 - RNA, 19 nt, Human
aagcaucccaauauccaaa

SEQ ID NO: 967069 - RNA, 19 nt, Human
aauauccaaaccaaaagag

SEQ ID NO: 967070 - RNA, 21 nt, Human
agaagacaaaaaaaaaaacau

SEQ ID NO: 967071 - RNA, 18 nt, Human
agcaucccaauauccaaa

SEQ ID NO: 967072 - RNA, 19 nt, Human
aggacccuuaaagucaaaa

SEQ ID NO: 967073 - RNA, 19 nt, Human
augcugaaacccagccgug

SEQ ID NO: 967074 - RNA, 21 nt, Human
cagacucagaguccugacuga

SEQ ID NO: 967075 - RNA, 18 nt, Human
cagcgaccucucgcccug

SEQ ID NO: 967076 - RNA, 18 nt, Human
cagcgaccucucgcccug

SEQ ID NO: 967077 - RNA, 18 nt, Human
cccgcaccuucucuugau

SEQ ID NO: 967078 - RNA, 23 nt, Human
ccugguugccccagcucccgcca

SEQ ID NO: 967079 - RNA, 22 nt, Human
cugacagugaugaacauauuug

SEQ ID NO: 967080 - RNA, 21 nt, Human
cuuuauucaccuuucaguuca

SEQ ID NO: 967081 - RNA, 24 nt, Human
gacccuuaaagucaaaauauuuaa

SEQ ID NO: 967082 - RNA, 18 nt, Human
gcccgagaaaguccuggu

SEQ ID NO: 967083 - RNA, 20 nt, Human
guggaugcugaaacccagcc

SEQ ID NO: 967084 - RNA, 22 nt, Human
uaaaaugcgaggagagcuugga

SEQ ID NO: 967085 - RNA, 24 nt, Human
uccaaaccaaaagagauuccagaa

SEQ ID NO: 967086 - RNA, 25 nt, Human
uccaaaccaaaagagauuccagaag

SEQ ID NO: 967087 - RNA, 22 nt, Human
uccagaagacaaaaaaaaaaac

SEQ ID NO: 967088 - RNA, 18 nt, Human
ucccaauauccaaaccaa

SEQ ID NO: 967089 - RNA, 24 nt, Human
ucccgggaucagaucacugggguc

SEQ ID NO: 967090 - RNA, 24 nt, Human
uccugacugaagcauuuacuugag

SEQ ID NO: 967091 - RNA, 19 nt, Human
ucugaguugcguuccuggg

SEQ ID NO: 967092 - RNA, 20 nt, Human
ugacaaggaugguuuaauuu

SEQ ID NO: 967093 - RNA, 20 nt, Human
ugccccagcucccgcaccuu

SEQ ID NO: 967094 - RNA, 19 nt, Human
uggaucuuguaaacacuac

SEQ ID NO: 967095 - RNA, 20 nt, Human
uggccgagcucccucugguc

SEQ ID NO: 967096 - RNA, 19 nt, Human
ugggugcccgagaaagucc

SEQ ID NO: 967097 - RNA, 20 nt, Human
ugggugcccgagaaaguccu

SEQ ID NO: 967098 - RNA, 25 nt, Human
uuuccucacucauaugcaucucaga

SEQ ID NO: 967099 - RNA, 23 nt, Human
uuugcagguauuucaucagcugg

SEQ ID NO: 967100 - RNA, 24 nt, Human
aaaaaaagugggaagagccgguac

SEQ ID NO: 967101 - RNA, 20 nt, Human
aacagagaaggguugugacc

SEQ ID NO: 967102 - RNA, 18 nt, Human
aagaaggcugucaaaaac

SEQ ID NO: 967103 - RNA, 18 nt, Human
aaggcagaccaacagaga

SEQ ID NO: 967104 - RNA, 23 nt, Human
aagucaccucagacagacacugg

SEQ ID NO: 967105 - RNA, 23 nt, Human
acaccaagcagcgcagcagggaa

SEQ ID NO: 967106 - RNA, 18 nt, Human
acgccgcugcaucgcaga

SEQ ID NO: 967107 - RNA, 20 nt, Human
acucucccaugacucuggau

SEQ ID NO: 967108 - RNA, 18 nt, Human
acugaccucaaauaaaua

SEQ ID NO: 967109 - RNA, 22 nt, Human
acuuaagugcuuugaaagggca

SEQ ID NO: 967110 - RNA, 22 nt, Human
agcagaaggcagaccaacagag

SEQ ID NO: 967111 - RNA, 23 nt, Human
aggccucacgccgcugcaucgca

SEQ ID NO: 967112 - RNA, 22 nt, Human
caagaaggcugucaaaaacagc

SEQ ID NO: 967113 - RNA, 21 nt, Human
caaugugcaguguaaacgagc

SEQ ID NO: 967114 - RNA, 19 nt, Human
cacagauucuaugucccuc

SEQ ID NO: 967115 - RNA, 24 nt, Human
caccaagcagcgcagcagggaacc

SEQ ID NO: 967116 - RNA, 19 nt, Human
cagcagaaggcagaccaac

SEQ ID NO: 967117 - RNA, 24 nt, Human
caggauggagaaauacaucaagaa

SEQ ID NO: 967118 - RNA, 18 nt, Human
caguaucagcagcagagc

SEQ ID NO: 967119 - RNA, 18 nt, Human
ccaaccagcccaggccuc

SEQ ID NO: 967120 - RNA, 22 nt, Human
ccagcccgguaccccgcgcccc

SEQ ID NO: 967121 - RNA, 21 nt, Human
ccccagcgccgcucucgcgcc

SEQ ID NO: 967122 - RNA, 19 nt, Human
cccccagcgccgcucucgc

SEQ ID NO: 967123 - RNA, 23 nt, Human
cccccagcgccgcucucgcgccc

SEQ ID NO: 967124 - RNA, 25 nt, Human
cccccagcgccgcucucgcgcccau

SEQ ID NO: 967125 - RNA, 18 nt, Human
ccccgcgcccccacccgc

SEQ ID NO: 967126 - RNA, 23 nt, Human
ccccgcgcccccacccgccccca

SEQ ID NO: 967127 - RNA, 19 nt, Human
ccgcgcccccacccgcccc

SEQ ID NO: 967128 - RNA, 22 nt, Human
ccgcuccgcgcagcccgccgcc

SEQ ID NO: 967129 - RNA, 22 nt, Human
ccgcuccgcgcagcccgccgcc

SEQ ID NO: 967130 - RNA, 23 nt, Human
ccgcuccgcgcagcccgccgccu

SEQ ID NO: 967131 - RNA, 20 nt, Human
ccucgguccgcggcugcagg

SEQ ID NO: 967132 - RNA, 18 nt, Human
ccugggaguggauccucc

SEQ ID NO: 967133 - RNA, 26 nt, Human
ccugguugguucucgagucuuucagc

SEQ ID NO: 967134 - RNA, 21 nt, Human
cgguaccccgcgcccccaccc

SEQ ID NO: 967135 - RNA, 22 nt, Human
cucagacagacacuggaacacg

SEQ ID NO: 967136 - RNA, 20 nt, Human
cugcaggauggagaaauaca

SEQ ID NO: 967137 - RNA, 20 nt, Human
gagaaauacaucaagaaggc

SEQ ID NO: 967138 - RNA, 22 nt, Human
gcagcgcagcagggaaccagaa

SEQ ID NO: 967139 - RNA, 21 nt, Human
gcaguaaaaaauccccaagga

SEQ ID NO: 967140 - RNA, 20 nt, Human
gccagcccgguaccccgcgc

SEQ ID NO: 967141 - RNA, 18 nt, Human
gcccccacccgcccccag

SEQ ID NO: 967142 - RNA, 24 nt, Human
ggaagacugugguuucuguagccc

SEQ ID NO: 967143 - RNA, 21 nt, Human
gggccaccaucaaaagaguga

SEQ ID NO: 967144 - RNA, 24 nt, Human
ggggcgccggccggccgccagccc

SEQ ID NO: 967145 - RNA, 19 nt, Human
gucauccugggaguggauc

SEQ ID NO: 967146 - RNA, 22 nt, Human
uaucagcagcagagcuacggag

SEQ ID NO: 967147 - RNA, 18 nt, Human
ucaaaaacagcucucaga

SEQ ID NO: 967148 - RNA, 20 nt, Human
ucacaccaagcagcgcagca

SEQ ID NO: 967149 - RNA, 19 nt, Human
uccgaccagggaccuccaa

SEQ ID NO: 967150 - RNA, 21 nt, Human
uccgcauacuaaugagggggc

SEQ ID NO: 967151 - RNA, 21 nt, Human
ucuccaaccagcccaggccuc

SEQ ID NO: 967152 - RNA, 24 nt, Human
ucuccgaccagggaccuccaggac

SEQ ID NO: 967153 - RNA, 21 nt, Human
ugaaagggcaguaaaaaaucc

SEQ ID NO: 967154 - RNA, 30 nt, Human
ugaaagggcaguaaaaaauccccaaggaaa

SEQ ID NO: 967155 - RNA, 21 nt, Human
ugagaagucuuuccaauucaa

SEQ ID NO: 967156 - RNA, 21 nt, Human
uggaaaggguguacucuccca

SEQ ID NO: 967157 - RNA, 23 nt, Human
uggcacacugccugguauacacc

SEQ ID NO: 967158 - RNA, 18 nt, Human
ugggaagagcuaaaauuu

SEQ ID NO: 967159 - RNA, 23 nt, Human
uguaaacgagcagaaguuuuaca

SEQ ID NO: 967160 - RNA, 22 nt, Human
ugugcaaaaacaaacacugacc

SEQ ID NO: 967161 - RNA, 19 nt, Human
uuggcauugcucggccggc

SEQ ID NO: 967162 - RNA, 23 nt, Human
uuucccaaaacauuauuccugga

SEQ ID NO: 967163 - RNA, 18 nt, Human
cagcagccgcagcagcgg

SEQ ID NO: 967164 - RNA, 18 nt, Human
cagcagcgcgcucauggc

SEQ ID NO: 967165 - RNA, 21 nt, Human
cagcagcgcgcucauggcguc

SEQ ID NO: 967166 - RNA, 22 nt, Human
caguaaaugcucauagaccccc

SEQ ID NO: 967167 - RNA, 23 nt, Human
cgcgacccggucccugcacuggu

SEQ ID NO: 967168 - RNA, 24 nt, Human
cuagcacuuggggaaaaagagucu

SEQ ID NO: 967169 - RNA, 21 nt, Human
cugcacugguccccaaccgca

SEQ ID NO: 967170 - RNA, 19 nt, Human
gacccggucccugcacugg

SEQ ID NO: 967171 - RNA, 22 nt, Human
gcaaccgugcgcagcagccgca

SEQ ID NO: 967172 - RNA, 23 nt, Human
ggcacgcagcggcuggggcaacc

SEQ ID NO: 967173 - RNA, 22 nt, Human
ggggcaaccgugcgcagcagcc

SEQ ID NO: 967174 - RNA, 24 nt, Human
guccuuagagaugggaaucuugac

SEQ ID NO: 967175 - RNA, 19 nt, Human
uaaaugcucauagaccccc

SEQ ID NO: 967176 - RNA, 23 nt, Human
uaacaggaagucaguaaaugcuc

SEQ ID NO: 967177 - RNA, 31 nt, Human
uauauauugcauagcucaaaaaguuugaaaa

SEQ ID NO: 967178 - RNA, 22 nt, Human
uuaacaggaagucaguaaaugc

SEQ ID NO: 967179 - RNA, 25 nt, Human
uugcauagcucaaaaaguuugaaaa

SEQ ID NO: 967180 - RNA, 22 nt, Human
cuccgcauaggaggcgcagggc

SEQ ID NO: 967181 - RNA, 20 nt, Human
gccgaagucccaguccuaaa

SEQ ID NO: 967182 - RNA, 25 nt, Human
uagccgaagucccaguccuaaagcc

SEQ ID NO: 967183 - RNA, 18 nt, Human
uaggaggcgcagggccug

SEQ ID NO: 967184 - RNA, 22 nt, Human
ucccuagccgaagucccagucc

SEQ ID NO: 967185 - RNA, 19 nt, Human
uccuaaagccuaagagacc

SEQ ID NO: 967186 - RNA, 22 nt, Human
caacucccacaauuccagcgcc

SEQ ID NO: 967187 - RNA, 23 nt, Human
cagacacaacucccacaauucca

SEQ ID NO: 967188 - RNA, 23 nt, Human
cagcuccaccuguacaggauaac

SEQ ID NO: 967189 - RNA, 21 nt, Human
ccacaauuccagcgccgcggc

SEQ ID NO: 967190 - RNA, 20 nt, Human
ccgcggcggcgaccagcucc

SEQ ID NO: 967191 - RNA, 19 nt, Human
ggcggcgaccagcuccacc

SEQ ID NO: 967192 - RNA, 18 nt, Human
ucccacaauuccagcgcc

SEQ ID NO: 967193 - RNA, 20 nt, Human
uggcagacacaacucccaca

SEQ ID NO: 967194 - RNA, 24 nt, Human
aaaaaaaaaaaaaguacugcccgg

SEQ ID NO: 967195 - RNA, 23 nt, Human
aaaaacccaccuggcguuccaga

SEQ ID NO: 967196 - RNA, 20 nt, Human
aaaccugaagaagcugcugu

SEQ ID NO: 967197 - RNA, 23 nt, Human
aagagcacccagucacaaagccc

SEQ ID NO: 967198 - RNA, 24 nt, Human
aagagcacccagucacaaagccca

SEQ ID NO: 967199 - RNA, 18 nt, Human
aaggccacggcgcccucc

SEQ ID NO: 967200 - RNA, 20 nt, Human
aagggcaauccgggcacgcu

SEQ ID NO: 967201 - RNA, 24 nt, Human
aauguccagccacugcauuguggc

SEQ ID NO: 967202 - RNA, 21 nt, Human
acccagucacaaagcccauga

SEQ ID NO: 967203 - RNA, 21 nt, Human
accugacuccuuucucuucuc

SEQ ID NO: 967204 - RNA, 21 nt, Human
acuggcucagggcacacaugc

SEQ ID NO: 967205 - RNA, 25 nt, Human
agaaaaacccaccuggcguuccaga

SEQ ID NO: 967206 - RNA, 21 nt, Human
agacagggugaggcugcccag

SEQ ID NO: 967207 - RNA, 20 nt, Human
agagauaagcuccggccccc

SEQ ID NO: 967208 - RNA, 21 nt, Human
agagcaggcccgucagggaca

SEQ ID NO: 967209 - RNA, 19 nt, Human
agagcccagcacggccagg

SEQ ID NO: 967210 - RNA, 21 nt, Human
agaggggagaacucugcaggg

SEQ ID NO: 967211 - RNA, 23 nt, Human
agcagccggaagagcaccaacaa

SEQ ID NO: 967212 - RNA, 19 nt, Human
agcagccgugugguguagc

SEQ ID NO: 967213 - RNA, 23 nt, Human
agcaggacucuuaggccucccuc

SEQ ID NO: 967214 - RNA, 25 nt, Human
agcgcugaccacugccgcccccaug

SEQ ID NO: 967215 - RNA, 20 nt, Human
aggaugcugcccaccaagga

SEQ ID NO: 967216 - RNA, 25 nt, Human
aggcagggacucccugcuggcugcu

SEQ ID NO: 967217 - RNA, 20 nt, Human
aggccaagcccuggcccacg

SEQ ID NO: 967218 - RNA, 23 nt, Human
aggccacaucagaggagaagcgg

SEQ ID NO: 967219 - RNA, 19 nt, Human
aggcggcagcaggagcagc

SEQ ID NO: 967220 - RNA, 24 nt, Human
agggaguggggcugguugcgcagg

SEQ ID NO: 967221 - RNA, 20 nt, Human
agggugccugcugcaaagag

SEQ ID NO: 967222 - RNA, 19 nt, Human
aguggcagaaucucagagg

SEQ ID NO: 967223 - RNA, 24 nt, Human
agugggcuccuaugccagaaaaac

SEQ ID NO: 967224 - RNA, 22 nt, Human
aucccaccucucauccucucag

SEQ ID NO: 967225 - RNA, 18 nt, Human
auccccaagaggaccgcc

SEQ ID NO: 967226 - RNA, 22 nt, Human
aucuguuuuuccccucccguuu

SEQ ID NO: 967227 - RNA, 20 nt, Human
augcagcagggggcagaguc

SEQ ID NO: 967228 - RNA, 20 nt, Human
auguaaucaccucacucagg

SEQ ID NO: 967229 - RNA, 19 nt, Human
caagagcacccagucacaa

SEQ ID NO: 967230 - RNA, 21 nt, Human
caaguccauccuuguaaaccu

SEQ ID NO: 967231 - RNA, 22 nt, Human
cacaaagcccaugagucccaaa

SEQ ID NO: 967232 - RNA, 18 nt, Human
cacaacagcugccucugc

SEQ ID NO: 967233 - RNA, 21 nt, Human
cacaacagcugccucugccca

SEQ ID NO: 967234 - RNA, 22 nt, Human
cacaugcagcagggggcagagu

SEQ ID NO: 967235 - RNA, 24 nt, Human
caccacguccuggaacuccacgcc

SEQ ID NO: 967236 - RNA, 22 nt, Human
caccccaccuagagguuggaag

SEQ ID NO: 967237 - RNA, 23 nt, Human
caccgcgucagcccucuccaggu

SEQ ID NO: 967238 - RNA, 26 nt, Human
caccgcgucagcccucuccagguacu

SEQ ID NO: 967239 - RNA, 19 nt, Human
caccucccucacacggggc

SEQ ID NO: 967240 - RNA, 24 nt, Human
cacugcauuguggcacugguggca

SEQ ID NO: 967241 - RNA, 20 nt, Human
cacugucuuguuggcaaagc

SEQ ID NO: 967242 - RNA, 24 nt, Human
cagagcccagcacggccaggagcc

SEQ ID NO: 967243 - RNA, 18 nt, Human
cagagggucaucgaggag

SEQ ID NO: 967244 - RNA, 23 nt, Human
cagcacccggucugaguucagga

SEQ ID NO: 967245 - RNA, 20 nt, Human
cagcacugucuuguuggcaa

SEQ ID NO: 967246 - RNA, 18 nt, Human
cagcagcacucgcccuga

SEQ ID NO: 967247 - RNA, 22 nt, Human
cagcagcugcuggaacagggag

SEQ ID NO: 967248 - RNA, 19 nt, Human
cagcaggugguuggccaca

SEQ ID NO: 967249 - RNA, 23 nt, Human
cagccagcaccucuguauaggcc

SEQ ID NO: 967250 - RNA, 22 nt, Human
cagcccaggcuuuggggacagc

SEQ ID NO: 967251 - RNA, 18 nt, Human
cagcugccucugcccaag

SEQ ID NO: 967252 - RNA, 19 nt, Human
cagcugcuugaagggugcc

SEQ ID NO: 967253 - RNA, 20 nt, Human
caggagccccagcaggccug

SEQ ID NO: 967254 - RNA, 26 nt, Human
caggcgaccagaugugcucugcuccu

SEQ ID NO: 967255 - RNA, 21 nt, Human
cagggccugccacaaggcccu

SEQ ID NO: 967256 - RNA, 18 nt, Human
cagggugcccuuuucccu

SEQ ID NO: 967257 - RNA, 20 nt, Human
caguggagacagggugaggc

SEQ ID NO: 967258 - RNA, 24 nt, Human
cauaagacagcgacaagcccacca

SEQ ID NO: 967259 - RNA, 25 nt, Human
cauccagaccacccauggauguaau

SEQ ID NO: 967260 - RNA, 22 nt, Human
cauccggaaccucaaaccugaa

SEQ ID NO: 967261 - RNA, 18 nt, Human
caucgaggagauagagcu

SEQ ID NO: 967262 - RNA, 24 nt, Human
ccaaacacaacagcugccucugcc

SEQ ID NO: 967263 - RNA, 18 nt, Human
ccaagcccuggcccacgg

SEQ ID NO: 967264 - RNA, 20 nt, Human
ccacugaacaaaaagggcuc

SEQ ID NO: 967265 - RNA, 22 nt, Human
ccacugcauuguggcacuggug

SEQ ID NO: 967266 - RNA, 20 nt, Human
ccacugccgcccccaugagc

SEQ ID NO: 967267 - RNA, 21 nt, Human
ccagagcccagcacggccagg

SEQ ID NO: 967268 - RNA, 20 nt, Human
ccagccgcucgacgcucacc

SEQ ID NO: 967269 - RNA, 23 nt, Human
ccagcucaccauccagaccaccc

SEQ ID NO: 967270 - RNA, 18 nt, Human
ccaggcgccgcagcuccc

SEQ ID NO: 967271 - RNA, 22 nt, Human
ccaugagucccaaauacacugg

SEQ ID NO: 967272 - RNA, 18 nt, Human
ccauucucagcccaggcu

SEQ ID NO: 967273 - RNA, 21 nt, Human
cccacggccuuccaguaagcu

SEQ ID NO: 967274 - RNA, 20 nt, Human
ccccaugagcuguagccgaa

SEQ ID NO: 967275 - RNA, 22 nt, Human
cccuagaccucgagcaggacuc

SEQ ID NO: 967276 - RNA, 22 nt, Human
cccuagaccucgagcaggacuc

SEQ ID NO: 967277 - RNA, 19 nt, Human
cccuccuucuugcuuucuu

SEQ ID NO: 967278 - RNA, 18 nt, Human
cccucucuaacccacccu

SEQ ID NO: 967279 - RNA, 22 nt, Human
cccugggguuccuggggcaggu

SEQ ID NO: 967280 - RNA, 23 nt, Human
cccuguaguggcgcugcacguga

SEQ ID NO: 967281 - RNA, 23 nt, Human
ccgaccagcagagagggacgaau

SEQ ID NO: 967282 - RNA, 19 nt, Human
ccuaauaucuggcuggagc

SEQ ID NO: 967283 - RNA, 23 nt, Human
ccucacacggggcuccugccccc

SEQ ID NO: 967284 - RNA, 27 nt, Human
ccucaccuugccaucuguuuuuccccu

SEQ ID NO: 967285 - RNA, 24 nt, Human
ccucccguuucuccgcccccaggc

SEQ ID NO: 967286 - RNA, 19 nt, Human
ccuccuccagccccuccuu

SEQ ID NO: 967287 - RNA, 24 nt, Human
ccucgagcaggacucuuaggccuc

SEQ ID NO: 967288 - RNA, 19 nt, Human
ccucuguauaggcccggcc

SEQ ID NO: 967289 - RNA, 18 nt, Human
ccugccacucuguccagg

SEQ ID NO: 967290 - RNA, 19 nt, Human
ccuggccaaacacaacagc

SEQ ID NO: 967291 - RNA, 23 nt, Human
ccuguagguggccccuguggccc

SEQ ID NO: 967292 - RNA, 25 nt, Human
ccuguggcccggagcacagagaggc

SEQ ID NO: 967293 - RNA, 19 nt, Human
ccuuguaaaccuugauucc

SEQ ID NO: 967294 - RNA, 22 nt, Human
ccuuuucccuccuguucuccca

SEQ ID NO: 967295 - RNA, 22 nt, Human
cgaugcccaacuucucuccagg

SEQ ID NO: 967296 - RNA, 21 nt, Human
cgcagcucccgugaggaggcc

SEQ ID NO: 967297 - RNA, 19 nt, Human
cgccucaccuugccaucug

SEQ ID NO: 967298 - RNA, 23 nt, Human
cgcugaccacugccgcccccaug

SEQ ID NO: 967299 - RNA, 22 nt, Human
cguggcuugcaugagaagcaga

SEQ ID NO: 967300 - RNA, 25 nt, Human
cuaacccacccugcucuggauaccc

SEQ ID NO: 967301 - RNA, 22 nt, Human
cucagagacccugggccuuuaa

SEQ ID NO: 967302 - RNA, 18 nt, Human
cucagccuucagcugaga

SEQ ID NO: 967303 - RNA, 20 nt, Human
cucaugcuucgcucaauucc

SEQ ID NO: 967304 - RNA, 22 nt, Human
cuccagccccuccuuuguuuuc

SEQ ID NO: 967305 - RNA, 23 nt, Human
cucccaguaaacuugcagguggu

SEQ ID NO: 967306 - RNA, 19 nt, Human
cuccccgucuaacccaccc

SEQ ID NO: 967307 - RNA, 20 nt, Human
cuccuaugccagaaaaaccc

SEQ ID NO: 967308 - RNA, 24 nt, Human
cuccuccagccccuccuuuguuuu

SEQ ID NO: 967309 - RNA, 23 nt, Human
cuccuccucaaaccuguaggugg

SEQ ID NO: 967310 - RNA, 18 nt, Human
cucuguauaggcccggcc

SEQ ID NO: 967311 - RNA, 18 nt, Human
cugcagcagcugcuggaa

SEQ ID NO: 967312 - RNA, 18 nt, Human
cugcagcaggcgaccaga

SEQ ID NO: 967313 - RNA, 19 nt, Human
cugcccccauuaccagccc

SEQ ID NO: 967314 - RNA, 19 nt, Human
cugcccggccggggugcug

SEQ ID NO: 967315 - RNA, 23 nt, Human
cuggcccugggguuccuggggca

SEQ ID NO: 967316 - RNA, 21 nt, Human
cugggcccgccccggcuggca

SEQ ID NO: 967317 - RNA, 24 nt, Human
cuucagggccugccacaaggcccu

SEQ ID NO: 967318 - RNA, 22 nt, Human
cuugccggagccugugcggccc

SEQ ID NO: 967319 - RNA, 23 nt, Human
cuuguaaaccuugauuccgaccg

SEQ ID NO: 967320 - RNA, 22 nt, Human
gaacagucccacugaacaaaaa

SEQ ID NO: 967321 - RNA, 25 nt, Human
gaagagcaccaacaacagggaagac

SEQ ID NO: 967322 - RNA, 21 nt, Human
gacagcacgagcaagggcaau

SEQ ID NO: 967323 - RNA, 19 nt, Human
gagaggacuguucugaguc

SEQ ID NO: 967324 - RNA, 18 nt, Human
gagcacagagaggccagc

SEQ ID NO: 967325 - RNA, 18 nt, Human
gagcagcagccagggcag

SEQ ID NO: 967326 - RNA, 18 nt, Human
gauacacaggaucuuggc

SEQ ID NO: 967327 - RNA, 20 nt, Human
gaugcagaguggcagcugcu

SEQ ID NO: 967328 - RNA, 21 nt, Human
gcaagugggcuccuaugccag

SEQ ID NO: 967329 - RNA, 22 nt, Human
gccagccggugcccagcugcag

SEQ ID NO: 967330 - RNA, 24 nt, Human
gccaggagccccagcaggccugcc

SEQ ID NO: 967331 - RNA, 21 nt, Human
gcccggagcacagagaggcca

SEQ ID NO: 967332 - RNA, 19 nt, Human
gcccugggguuccuggggc

SEQ ID NO: 967333 - RNA, 21 nt, Human
gccggggaguccagcucuacc

SEQ ID NO: 967334 - RNA, 21 nt, Human
gcgcaggguggccggggaguc

SEQ ID NO: 967335 - RNA, 20 nt, Human
gcuauucucagccuucagcu

SEQ ID NO: 967336 - RNA, 21 nt, Human
gcucugcuccuccuccagccc

SEQ ID NO: 967337 - RNA, 19 nt, Human
gcugcaguggcuggcccug

SEQ ID NO: 967338 - RNA, 18 nt, Human
gcuuucuuccugcagcag

SEQ ID NO: 967339 - RNA, 23 nt, Human
ggaagaccuagccggcgcuauuc

SEQ ID NO: 967340 - RNA, 24 nt, Human
ggaagagcaccaacaacagggaag

SEQ ID NO: 967341 - RNA, 18 nt, Human
ggagcuauucucagccuu

SEQ ID NO: 967342 - RNA, 22 nt, Human
ggaggguagaaggggagauugg

SEQ ID NO: 967343 - RNA, 18 nt, Human
ggccagagcccagcacgg

SEQ ID NO: 967344 - RNA, 20 nt, Human
ggccggggugcugggcccgc

SEQ ID NO: 967345 - RNA, 23 nt, Human
ggccuggaucagagagaggggag

SEQ ID NO: 967346 - RNA, 18 nt, Human
ggcuguggcugagucaga

SEQ ID NO: 967347 - RNA, 18 nt, Human
gggcagugggaacacugg

SEQ ID NO: 967348 - RNA, 23 nt, Human
ggggaguccagcucuaccacucu

SEQ ID NO: 967349 - RNA, 23 nt, Human
ggggugcugggcccgccccggcu

SEQ ID NO: 967350 - RNA, 20 nt, Human
ggugaggcugcccaggcgcc

SEQ ID NO: 967351 - RNA, 20 nt, Human
gguugcgcaggguggccggg

SEQ ID NO: 967352 - RNA, 19 nt, Human
guacugacugggcuguggc

SEQ ID NO: 967353 - RNA, 19 nt, Human
gugcugggcccgccccggc

SEQ ID NO: 967354 - RNA, 19 nt, Human
guguagcucagcaugccca

SEQ ID NO: 967355 - RNA, 21 nt, Human
guucuccuccucaaaccugua

SEQ ID NO: 967356 - RNA, 24 nt, Human
uaaacaagcagccagcaccucugu

SEQ ID NO: 967357 - RNA, 23 nt, Human
uaagacagcgacaagcccaccag

SEQ ID NO: 967358 - RNA, 24 nt, Human
uaagcuccggccccccucacccag

SEQ ID NO: 967359 - RNA, 19 nt, Human
uaaggacucgaugcagcag

SEQ ID NO: 967360 - RNA, 19 nt, Human
uacaguggagacaggguga

SEQ ID NO: 967361 - RNA, 18 nt, Human
uacugcccggccggggug

SEQ ID NO: 967362 - RNA, 18 nt, Human
uagagcuccuuuuccugg

SEQ ID NO: 967363 - RNA, 25 nt, Human
uaucaaauaaaacuaugaaaaugca

SEQ ID NO: 967364 - RNA, 25 nt, Human
uaugcaaaaaaaaaaaaaguacugc

SEQ ID NO: 967365 - RNA, 26 nt, Human
uaugcaaaaaaaaaaaaaguacugcc

SEQ ID NO: 967366 - RNA, 21 nt, Human
ucaaaggcggcagcaggagca

SEQ ID NO: 967367 - RNA, 20 nt, Human
ucaaggagucgcagguucuc

SEQ ID NO: 967368 - RNA, 19 nt, Human
ucacagguguacucuucca

SEQ ID NO: 967369 - RNA, 23 nt, Human
ucacaucccucugcauaaaaauc

SEQ ID NO: 967370 - RNA, 21 nt, Human
ucacccagcucaccauccaga

SEQ ID NO: 967371 - RNA, 20 nt, Human
ucagcagcguuccgcguggc

SEQ ID NO: 967372 - RNA, 21 nt, Human
uccacagcggccagaggguca

SEQ ID NO: 967373 - RNA, 26 nt, Human
uccagccccuccuuuguuuucucucc

SEQ ID NO: 967374 - RNA, 19 nt, Human
uccaucagcagcaccgcgu

SEQ ID NO: 967375 - RNA, 18 nt, Human
ucccaguaaacuugcagg

SEQ ID NO: 967376 - RNA, 19 nt, Human
ucccucacacggggcuccu

SEQ ID NO: 967377 - RNA, 21 nt, Human
ucccugcuggcugcucugcag

SEQ ID NO: 967378 - RNA, 20 nt, Human
uccgcccccaggcauccgga

SEQ ID NO: 967379 - RNA, 20 nt, Human
uccgggcacgcuguccuccg

SEQ ID NO: 967380 - RNA, 20 nt, Human
ucgcucaauuccuaauaucu

SEQ ID NO: 967381 - RNA, 19 nt, Human
ucucagagacccugggccu

SEQ ID NO: 967382 - RNA, 21 nt, Human
ucucagagggagguccuggag

SEQ ID NO: 967383 - RNA, 20 nt, Human
ucuccagguacucagugcgg

SEQ ID NO: 967384 - RNA, 20 nt, Human
ucuccagguacucagugcgg

SEQ ID NO: 967385 - RNA, 25 nt, Human
ucugcauaaaaaucuuucagaguuu

SEQ ID NO: 967386 - RNA, 24 nt, Human
ucugcuccuccuccagccccuccu

SEQ ID NO: 967387 - RNA, 20 nt, Human
ucugugaggagagcccuggc

SEQ ID NO: 967388 - RNA, 19 nt, Human
ugaagcugcucaccaggcc

SEQ ID NO: 967389 - RNA, 19 nt, Human
ugaagggugccugcugcaa

SEQ ID NO: 967390 - RNA, 18 nt, Human
ugacugggcuguggcuga

SEQ ID NO: 967391 - RNA, 22 nt, Human
ugacugggcuguggcugaguca

SEQ ID NO: 967392 - RNA, 18 nt, Human
ugagaagcagagagaaga

SEQ ID NO: 967393 - RNA, 19 nt, Human
ugagaagcagagagaagag

SEQ ID NO: 967394 - RNA, 18 nt, Human
ugaggaugaagggcaggc

SEQ ID NO: 967395 - RNA, 18 nt, Human
ugaggcagggacucccug

SEQ ID NO: 967396 - RNA, 24 nt, Human
ugcaaaaaaaaaaaaaguacugcc

SEQ ID NO: 967397 - RNA, 22 nt, Human
ugcaaagagcacugcccggaga

SEQ ID NO: 967398 - RNA, 19 nt, Human
ugcaugagaagcagagaga

SEQ ID NO: 967399 - RNA, 23 nt, Human
ugccggagccugugcggcccacg

SEQ ID NO: 967400 - RNA, 22 nt, Human
ugcggagagaagagccccauag

SEQ ID NO: 967401 - RNA, 22 nt, Human
uggagagguagagccccagagg

SEQ ID NO: 967402 - RNA, 20 nt, Human
uggagcuucauuuccuccua

SEQ ID NO: 967403 - RNA, 19 nt, Human
uggaucagagagaggggag

SEQ ID NO: 967404 - RNA, 20 nt, Human
uggcaaacuggcaccucugg

SEQ ID NO: 967405 - RNA, 20 nt, Human
uggcaaagcguuugcagaug

SEQ ID NO: 967406 - RNA, 22 nt, Human
uggcuaaggccaagcccuggcc

SEQ ID NO: 967407 - RNA, 24 nt, Human
uggcucagggcacacaugcagcag

SEQ ID NO: 967408 - RNA, 20 nt, Human
uggcuggcccugggguuccu

SEQ ID NO: 967409 - RNA, 24 nt, Human
uggcuggcccugggguuccugggg

SEQ ID NO: 967410 - RNA, 20 nt, Human
ugggaucugagcugggccag

SEQ ID NO: 967411 - RNA, 19 nt, Human
ugggucagccagccggugc

SEQ ID NO: 967412 - RNA, 22 nt, Human
uggucagcacugucuuguuggc

SEQ ID NO: 967413 - RNA, 23 nt, Human
ugguggaggguugcgccuccugg

SEQ ID NO: 967414 - RNA, 23 nt, Human
ugguguagcucagcaugcccagg

SEQ ID NO: 967415 - RNA, 22 nt, Human
ugguuggccacaucugcaucca

SEQ ID NO: 967416 - RNA, 21 nt, Human
uguaaacaagcagccagcacc

SEQ ID NO: 967417 - RNA, 19 nt, Human
uguacuucacaauccccug

SEQ ID NO: 967418 - RNA, 20 nt, Human
uguagccgaauguccagcca

SEQ ID NO: 967419 - RNA, 19 nt, Human
uguagguggccccuguggc

SEQ ID NO: 967420 - RNA, 19 nt, Human
ugucugugugaagcugcuc

SEQ ID NO: 967421 - RNA, 24 nt, Human
uuauguaggcccuggggguccagg

SEQ ID NO: 967422 - RNA, 19 nt, Human
uucacaauccccugccaga

SEQ ID NO: 967423 - RNA, 22 nt, Human
uucacaauccccugccagaccu

SEQ ID NO: 967424 - RNA, 25 nt, Human
uucucuggguucuguacugacuggg

SEQ ID NO: 967425 - RNA, 18 nt, Human
uugcagauggucugcugg

SEQ ID NO: 967426 - RNA, 21 nt, Human
uuggcaaagcguuugcagaug

SEQ ID NO: 967427 - RNA, 24 nt, Human
uuugcagauggucugcuggagcag

SEQ ID NO: 967428 - RNA, 21 nt, Human
uuuucucuggguucuguacug

SEQ ID NO: 967429 - RNA, 22 nt, Human
aaaaaaagaaauacuuuaaaaa

SEQ ID NO: 967430 - RNA, 28 nt, Human
aaaaaaagaaauacuuuaaaaacgaccu

SEQ ID NO: 967431 - RNA, 21 nt, Human
aaaaaagaaauacuuuaaaaa

SEQ ID NO: 967432 - RNA, 18 nt, Human
aaaacaugaaguuaacuu

SEQ ID NO: 967433 - RNA, 22 nt, Human
aacaaaccaggcaaaauaucac

SEQ ID NO: 967434 - RNA, 19 nt, Human
aaggaacugcauuucggga

SEQ ID NO: 967435 - RNA, 20 nt, Human
aaggcaucauuuuggagaaa

SEQ ID NO: 967436 - RNA, 24 nt, Human
aauccuaucucggaauuguugagu

SEQ ID NO: 967437 - RNA, 19 nt, Human
acuccccaccccaaggcau

SEQ ID NO: 967438 - RNA, 19 nt, Human
agcucuucccacuaccacu

SEQ ID NO: 967439 - RNA, 19 nt, Human
aggcaaaauaucacauaua

SEQ ID NO: 967440 - RNA, 18 nt, Human
aggcgcggcaucacgucc

SEQ ID NO: 967441 - RNA, 18 nt, Human
augaaacuuucauuuggg

SEQ ID NO: 967442 - RNA, 22 nt, Human
caccccaaggcaucauuuugga

SEQ ID NO: 967443 - RNA, 18 nt, Human
cacguguuaguucccagg

SEQ ID NO: 967444 - RNA, 25 nt, Human
cagcuuuauugugaaagaauccaga

SEQ ID NO: 967445 - RNA, 22 nt, Human
cauggacccaccagucuugauu

SEQ ID NO: 967446 - RNA, 24 nt, Human
ccaguuaaaaaaagaaauacuuua

SEQ ID NO: 967447 - RNA, 19 nt, Human
ccucuguacaguguggagg

SEQ ID NO: 967448 - RNA, 21 nt, Human
ccuuccaaaacaugaaguuaa

SEQ ID NO: 967449 - RNA, 18 nt, Human
cuauccucuaaaagcaaa

SEQ ID NO: 967450 - RNA, 25 nt, Human
cucaacugaaugcaugaacuaacac

SEQ ID NO: 967451 - RNA, 22 nt, Human
cucacacugaaaaaaauacuaa

SEQ ID NO: 967452 - RNA, 19 nt, Human
cucuaaaagcaaagagaaa

SEQ ID NO: 967453 - RNA, 24 nt, Human
cucuaaaagcaaagagaaagugau

SEQ ID NO: 967454 - RNA, 18 nt, Human
cugaaugcaugaacuaac

SEQ ID NO: 967455 - RNA, 22 nt, Human
cuuuaaaaacgaccugcccuuc

SEQ ID NO: 967456 - RNA, 18 nt, Human
gaaaaugaaggugacucu

SEQ ID NO: 967457 - RNA, 19 nt, Human
gaacaaggaaguggcauaa

SEQ ID NO: 967458 - RNA, 22 nt, Human
gcauaagcaacucagugugugc

SEQ ID NO: 967459 - RNA, 22 nt, Human
ggagcucuucccacuaccacuc

SEQ ID NO: 967460 - RNA, 19 nt, Human
gucacacuugacagaagca

SEQ ID NO: 967461 - RNA, 23 nt, Human
uaacacagggccauggacccacc

SEQ ID NO: 967462 - RNA, 22 nt, Human
uagaaggaaucuaaauggggca

SEQ ID NO: 967463 - RNA, 23 nt, Human
uauauggcaucaucacaccaccg

SEQ ID NO: 967464 - RNA, 23 nt, Human
ucacacugaaaaaaauacuaaca

SEQ ID NO: 967465 - RNA, 19 nt, Human
uccaaaacaugaaguuaac

SEQ ID NO: 967466 - RNA, 24 nt, Human
uccaaguugcuuucuagauccuuu

SEQ ID NO: 967467 - RNA, 20 nt, Human
ucccacuaccacuccccacc

SEQ ID NO: 967468 - RNA, 18 nt, Human
ucgaacccaggggccgcg

SEQ ID NO: 967469 - RNA, 21 nt, Human
ucuugauugaguuacagaaaa

SEQ ID NO: 967470 - RNA, 24 nt, Human
ugaaaaaaauacuaacacagcuca

SEQ ID NO: 967471 - RNA, 25 nt, Human
ugaaaaaaauacuaacacagcucau

SEQ ID NO: 967472 - RNA, 22 nt, Human
ugaaagaauccagagaucucac

SEQ ID NO: 967473 - RNA, 19 nt, Human
ugacagaagcaagcccugc

SEQ ID NO: 967474 - RNA, 23 nt, Human
ugauaugacaaacuaggcauaau

SEQ ID NO: 967475 - RNA, 18 nt, Human
ugugugccccuuagggug

SEQ ID NO: 967476 - RNA, 25 nt, Human
uuacagaaaaugaaggugacucuuu

SEQ ID NO: 967477 - RNA, 19 nt, Human
uuacuuaaacauuuaaggc

SEQ ID NO: 967478 - RNA, 23 nt, Human
uuccaaguugcuuucuagauccu

SEQ ID NO: 967479 - RNA, 23 nt, Human
uuggagaaaaaagugucuucuau

SEQ ID NO: 967480 - RNA, 23 nt, Human
aaaaaaccagaucucaugagaac

SEQ ID NO: 967481 - RNA, 19 nt, Human
aacauggagaaaccccauc

SEQ ID NO: 967482 - RNA, 20 nt, Human
aacauggagaaaccccaucu

SEQ ID NO: 967483 - RNA, 21 nt, Human
aacauggagaaaccccaucuc

SEQ ID NO: 967484 - RNA, 23 nt, Human
aagagaaucauuuuuuucuuaaa

SEQ ID NO: 967485 - RNA, 25 nt, Human
aagcagcaggacugggaaggcugca

SEQ ID NO: 967486 - RNA, 22 nt, Human
aaucacuugaacccuggaggcg

SEQ ID NO: 967487 - RNA, 19 nt, Human
acaagcagcaggacuggga

SEQ ID NO: 967488 - RNA, 23 nt, Human
acauugcacuccagccugggaau

SEQ ID NO: 967489 - RNA, 25 nt, Human
acauugcacuccagccugggaauaa

SEQ ID NO: 967490 - RNA, 24 nt, Human
accccaucucuacuaaaaauacaa

SEQ ID NO: 967491 - RNA, 23 nt, Human
acuccagccugggaauaagguga

SEQ ID NO: 967492 - RNA, 20 nt, Human
acugccacaaaugggagagg

SEQ ID NO: 967493 - RNA, 24 nt, Human
agaaacuggauauuuuaugaauaa

SEQ ID NO: 967494 - RNA, 21 nt, Human
agaaagaggcaaacaccaagg

SEQ ID NO: 967495 - RNA, 22 nt, Human
agacagguggaucaccugaggg

SEQ ID NO: 967496 - RNA, 22 nt, Human
agacagguggaucaccugaggu

SEQ ID NO: 967497 - RNA, 21 nt, Human
agaggaggcguuuggagcuga

SEQ ID NO: 967498 - RNA, 19 nt, Human
agaggagugguaauaaaag

SEQ ID NO: 967499 - RNA, 24 nt, Human
agauguuggaagcuaguccaaacu

SEQ ID NO: 967500 - RNA, 23 nt, Human
agcuggguguggugguacaugcc

SEQ ID NO: 967501 - RNA, 21 nt, Human
aggcagcagagacugaggguc

SEQ ID NO: 967502 - RNA, 18 nt, Human
aggcaggagaaucacuug

SEQ ID NO: 967503 - RNA, 23 nt, Human
aggcaggagaaucacuugaaccc

SEQ ID NO: 967504 - RNA, 24 nt, Human
aggcaugguggcucaugccuguaa

SEQ ID NO: 967505 - RNA, 24 nt, Human
aggcggggguugcagugagccaag

SEQ ID NO: 967506 - RNA, 24 nt, Human
aggcugaggcaggagaaucacuug

SEQ ID NO: 967507 - RNA, 18 nt, Human
aggucgggaguucaagac

SEQ ID NO: 967508 - RNA, 23 nt, Human
aguccugguguguuuagauuugg

SEQ ID NO: 967509 - RNA, 24 nt, Human
agucugaucaacauggagaaaccc

SEQ ID NO: 967510 - RNA, 23 nt, Human
aguugacuguggcaauguagacc

SEQ ID NO: 967511 - RNA, 24 nt, Human
aucacgacauugcacuccagccug

SEQ ID NO: 967512 - RNA, 22 nt, Human
aucccagcacuuugggaggcca

SEQ ID NO: 967513 - RNA, 18 nt, Human
augaaaggaucuucugga

SEQ ID NO: 967514 - RNA, 19 nt, Human
augccuguaaucccagcac

SEQ ID NO: 967515 - RNA, 23 nt, Human
auggagacugcuuuccuggguuu

SEQ ID NO: 967516 - RNA, 27 nt, Human
auuacacuagagaaauuggcaagcacu

SEQ ID NO: 967517 - RNA, 18 nt, Human
auugcacuccagccuggg

SEQ ID NO: 967518 - RNA, 23 nt, Human
auugcacuccagccugggaauaa

SEQ ID NO: 967519 - RNA, 21 nt, Human
auuuaagaugagauuuggaug

SEQ ID NO: 967520 - RNA, 24 nt, Human
caaaaaaugguaaaggucacagaa

SEQ ID NO: 967521 - RNA, 19 nt, Human
caaaauaagggcuaaagaa

SEQ ID NO: 967522 - RNA, 23 nt, Human
caaaauaagggcuaaagaaaaau

SEQ ID NO: 967523 - RNA, 23 nt, Human
caaacaccaagguauaauagaaa

SEQ ID NO: 967524 - RNA, 23 nt, Human
caaauaguugacuguggcaaugu

SEQ ID NO: 967525 - RNA, 24 nt, Human
caagacagguggaucaccugaggu

SEQ ID NO: 967526 - RNA, 22 nt, Human
caauuucuaccacaagcagcag

SEQ ID NO: 967527 - RNA, 20 nt, Human
cacacacuuucaaaaaacca

SEQ ID NO: 967528 - RNA, 23 nt, Human
cacaguuccacaggcuuaacagg

SEQ ID NO: 967529 - RNA, 21 nt, Human
cacaugguggcaggagggaga

SEQ ID NO: 967530 - RNA, 23 nt, Human
caccugaggucgggaguucaaga

SEQ ID NO: 967531 - RNA, 21 nt, Human
caccuucuucacaugguggca

SEQ ID NO: 967532 - RNA, 19 nt, Human
cacuccagccugggaauaa

SEQ ID NO: 967533 - RNA, 19 nt, Human
cacuccagccugggaauaa

SEQ ID NO: 967534 - RNA, 23 nt, Human
cacuccagccugggaauaaggug

SEQ ID NO: 967535 - RNA, 25 nt, Human
cacugcuauaaagaacuaccagaaa

SEQ ID NO: 967536 - RNA, 25 nt, Human
cagagcccaaucccauggccccugc

SEQ ID NO: 967537 - RNA, 21 nt, Human
cagcaaaaaacuucacaugaa

SEQ ID NO: 967538 - RNA, 20 nt, Human
cagcacuuugggaggccaag

SEQ ID NO: 967539 - RNA, 26 nt, Human
cagcacuuugggaggccaagacaggu

SEQ ID NO: 967540 - RNA, 19 nt, Human
cagcagcaggcuuggacug

SEQ ID NO: 967541 - RNA, 19 nt, Human
cagcaggcuuggacugggc

SEQ ID NO: 967542 - RNA, 24 nt, Human
cagcuacucaggaggcugaggcag

SEQ ID NO: 967543 - RNA, 24 nt, Human
caggaggcugaggcaggagaauca

SEQ ID NO: 967544 - RNA, 24 nt, Human
cagguggaucaccugaggucggga

SEQ ID NO: 967545 - RNA, 24 nt, Human
caugccuguaaucccagcacuuug

SEQ ID NO: 967546 - RNA, 18 nt, Human
cauugcacuccagccugg

SEQ ID NO: 967547 - RNA, 19 nt, Human
cauugcacuccagccuggg

SEQ ID NO: 967548 - RNA, 19 nt, Human
cauugcacuccagccuggg

SEQ ID NO: 967549 - RNA, 19 nt, Human
cauugcacuccagccuggg

SEQ ID NO: 967550 - RNA, 20 nt, Human
cauugcacuccagccuggga

SEQ ID NO: 967551 - RNA, 22 nt, Human
cauugcacuccagccugggaau

SEQ ID NO: 967552 - RNA, 23 nt, Human
cauugcacuccagccugggaaua

SEQ ID NO: 967553 - RNA, 23 nt, Human
ccaaacuuagaaagaggcaaaca

SEQ ID NO: 967554 - RNA, 25 nt, Human
ccagucccaaggcgacggaugggag

SEQ ID NO: 967555 - RNA, 18 nt, Human
cccaaagguugaaaugcc

SEQ ID NO: 967556 - RNA, 21 nt, Human
ccugggagaggaggcguuugg

SEQ ID NO: 967557 - RNA, 21 nt, Human
ccuguaaucccagcuacucag

SEQ ID NO: 967558 - RNA, 22 nt, Human
cucaccuucuagggaggugcca

SEQ ID NO: 967559 - RNA, 23 nt, Human
cucaggaccgugaauagagacac

SEQ ID NO: 967560 - RNA, 24 nt, Human
cucaugccuguaaucccagcacuu

SEQ ID NO: 967561 - RNA, 23 nt, Human
cugaucaacauggagaaacccca

SEQ ID NO: 967562 - RNA, 23 nt, Human
cugcuauaaagaacuaccagaaa

SEQ ID NO: 967563 - RNA, 21 nt, Human
cuuucaaaaaaccagaucuca

SEQ ID NO: 967564 - RNA, 19 nt, Human
gaaacgccauugacuucaa

SEQ ID NO: 967565 - RNA, 19 nt, Human
gaagaaauacugucuccau

SEQ ID NO: 967566 - RNA, 21 nt, Human
gagagcuucuuucuuuuuggg

SEQ ID NO: 967567 - RNA, 23 nt, Human
gaucaccugaggucgggaguuca

SEQ ID NO: 967568 - RNA, 24 nt, Human
gaucaccugaggucgggaguucaa

SEQ ID NO: 967569 - RNA, 21 nt, Human
gaugggagaaguccuggugug

SEQ ID NO: 967570 - RNA, 19 nt, Human
gcacagucuuuuugcaauc

SEQ ID NO: 967571 - RNA, 23 nt, Human
gcaggagaaucacuugaacccug

SEQ ID NO: 967572 - RNA, 20 nt, Human
gccuggagagagucuguggu

SEQ ID NO: 967573 - RNA, 22 nt, Human
gcuaggcaugguggcucaugcc

SEQ ID NO: 967574 - RNA, 20 nt, Human
ggagacugcuuuccuggguu

SEQ ID NO: 967575 - RNA, 19 nt, Human
ggagagagagagagagagc

SEQ ID NO: 967576 - RNA, 20 nt, Human
ggagcgugugggcaggcaga

SEQ ID NO: 967577 - RNA, 19 nt, Human
ggaguugggguaggcagga

SEQ ID NO: 967578 - RNA, 20 nt, Human
ggaugggagaaguccuggug

SEQ ID NO: 967579 - RNA, 18 nt, Human
ggcaggcagaugaccugg

SEQ ID NO: 967580 - RNA, 21 nt, Human
ggcuaggcaugguggcucaug

SEQ ID NO: 967581 - RNA, 21 nt, Human
ggcucaugccuguaaucccag

SEQ ID NO: 967582 - RNA, 20 nt, Human
gggacagggagggguggugg

SEQ ID NO: 967583 - RNA, 21 nt, Human
ggggaguugggguaggcagga

SEQ ID NO: 967584 - RNA, 24 nt, Human
ggggguugcagugagccaagauca

SEQ ID NO: 967585 - RNA, 19 nt, Human
gggguugcagugagccaag

SEQ ID NO: 967586 - RNA, 21 nt, Human
gguacaugccuguaaucccag

SEQ ID NO: 967587 - RNA, 21 nt, Human
ggucccauucccacaacacau

SEQ ID NO: 967588 - RNA, 21 nt, Human
ggucuugugaagguggaacag

SEQ ID NO: 967589 - RNA, 21 nt, Human
gguggaaggagaaaaggaagc

SEQ ID NO: 967590 - RNA, 24 nt, Human
ggugguacaugccuguaaucccag

SEQ ID NO: 967591 - RNA, 23 nt, Human
gguguggugguacaugccuguaa

SEQ ID NO: 967592 - RNA, 20 nt, Human
gguugcagugagccaagauc

SEQ ID NO: 967593 - RNA, 19 nt, Human
gucuugugaagguggaaca

SEQ ID NO: 967594 - RNA, 23 nt, Human
guggcucaugccuguaaucccag

SEQ ID NO: 967595 - RNA, 18 nt, Human
uaaaaauacaaaauuagc

SEQ ID NO: 967596 - RNA, 19 nt, Human
uaaaaauacaaaauuagcu

SEQ ID NO: 967597 - RNA, 18 nt, Human
uaaagaacuaccagaaac

SEQ ID NO: 967598 - RNA, 19 nt, Human
uaacaggaagcaugacugg

SEQ ID NO: 967599 - RNA, 25 nt, Human
uacacuagagaaauuggcaagcacu

SEQ ID NO: 967600 - RNA, 20 nt, Human
uagaagaaauacugucucca

SEQ ID NO: 967601 - RNA, 23 nt, Human
uagaaguacaaauaguugacugu

SEQ ID NO: 967602 - RNA, 22 nt, Human
uagagaaauuggcaagcacugc

SEQ ID NO: 967603 - RNA, 21 nt, Human
uagagaaccucaacaaggcug

SEQ ID NO: 967604 - RNA, 19 nt, Human
uagcccauucucacacugc

SEQ ID NO: 967605 - RNA, 24 nt, Human
uagucugaucaacauggagaaacc

SEQ ID NO: 967606 - RNA, 21 nt, Human
ucacaagaacagcaaggggga

SEQ ID NO: 967607 - RNA, 24 nt, Human
ucacagaaugaucauuguuuuucu

SEQ ID NO: 967608 - RNA, 23 nt, Human
ucaccugaggucgggaguucaag

SEQ ID NO: 967609 - RNA, 19 nt, Human
ucagaaaguccauuguuaa

SEQ ID NO: 967610 - RNA, 23 nt, Human
ucaucgagggcuccucaauguug

SEQ ID NO: 967611 - RNA, 22 nt, Human
ucaugccuguaaucccagcacu

SEQ ID NO: 967612 - RNA, 19 nt, Human
ucccaaagguugaaaugcc

SEQ ID NO: 967613 - RNA, 21 nt, Human
ucccaaggcgacggaugggag

SEQ ID NO: 967614 - RNA, 20 nt, Human
ucccauggccccugcucagg

SEQ ID NO: 967615 - RNA, 21 nt, Human
ucgccagcuccuucucucagg

SEQ ID NO: 967616 - RNA, 20 nt, Human
ucucuacuaaaaauacaaaa

SEQ ID NO: 967617 - RNA, 20 nt, Human
ugaaaaaugaaagccagagg

SEQ ID NO: 967618 - RNA, 18 nt, Human
ugaaagccagaggagugg

SEQ ID NO: 967619 - RNA, 22 nt, Human
ugaaaugccagcaaaaaacuuc

SEQ ID NO: 967620 - RNA, 22 nt, Human
ugaaggagggagagcgggacca

SEQ ID NO: 967621 - RNA, 22 nt, Human
ugaagugacauugagcagagac

SEQ ID NO: 967622 - RNA, 24 nt, Human
ugagaacucacuaucacaagaaca

SEQ ID NO: 967623 - RNA, 20 nt, Human
ugaggcaggagaaucacuug

SEQ ID NO: 967624 - RNA, 24 nt, Human
ugaggcaggagaaucacuugaacc

SEQ ID NO: 967625 - RNA, 25 nt, Human
ugaggcaggagaaucacuugaaccc

SEQ ID NO: 967626 - RNA, 30 nt, Human
ugagucagugcccagagcccaaucccaugg

SEQ ID NO: 967627 - RNA, 19 nt, Human
ugaugcaggaacuucagau

SEQ ID NO: 967628 - RNA, 23 nt, Human
ugaugcaggaacuucagauaggc

SEQ ID NO: 967629 - RNA, 19 nt, Human
ugauugacuauggagacug

SEQ ID NO: 967630 - RNA, 23 nt, Human
ugccuguaaucccagcacuuugg

SEQ ID NO: 967631 - RNA, 24 nt, Human
ugccuguaaucccagcacuuuggg

SEQ ID NO: 967632 - RNA, 24 nt, Human
ugccuguaaucccagcuacucagg

SEQ ID NO: 967633 - RNA, 23 nt, Human
uggaggcggggguugcagugagc

SEQ ID NO: 967634 - RNA, 24 nt, Human
uggaucaccugaggucgggaguuc

SEQ ID NO: 967635 - RNA, 18 nt, Human
uggcaauguagacccuga

SEQ ID NO: 967636 - RNA, 24 nt, Human
uggcuaggcaugguggcucaugcc

SEQ ID NO: 967637 - RNA, 22 nt, Human
uggcucaugccuguaaucccag

SEQ ID NO: 967638 - RNA, 24 nt, Human
uggcucaugccuguaaucccagca

SEQ ID NO: 967639 - RNA, 19 nt, Human
uggcugggacagggagggg

SEQ ID NO: 967640 - RNA, 24 nt, Human
ugggaggccaagacagguggauca

SEQ ID NO: 967641 - RNA, 21 nt, Human
ugguacaugccuguaauccca

SEQ ID NO: 967642 - RNA, 22 nt, Human
ugguacaugccuguaaucccag

SEQ ID NO: 967643 - RNA, 24 nt, Human
ugguggcucaugccuguaauccca

SEQ ID NO: 967644 - RNA, 24 nt, Human
uggugguacaugccuguaauccca

SEQ ID NO: 967645 - RNA, 21 nt, Human
uguggggaagguucucgccag

SEQ ID NO: 967646 - RNA, 18 nt, Human
uguuggggaagaagcaga

SEQ ID NO: 967647 - RNA, 18 nt, Human
uuagcugggugugguggu

SEQ ID NO: 967648 - RNA, 20 nt, Human
uuagcuggguguggugguac

SEQ ID NO: 967649 - RNA, 24 nt, Human
uuagcuggguguggugguacaugc

SEQ ID NO: 967650 - RNA, 23 nt, Human
uucauuguccucuacauuuguaa

SEQ ID NO: 967651 - RNA, 18 nt, Human
uuccaaagaaucacugug

SEQ ID NO: 967652 - RNA, 24 nt, Human
uugaacccuggaggcggggguugc

SEQ ID NO: 967653 - RNA, 20 nt, Human
uugcagugagccaagaucac

SEQ ID NO: 967654 - RNA, 20 nt, Human
uuuuggguuugagggauagg

SEQ ID NO: 967655 - RNA, 24 nt, Human
accgagcgcucguccagggaaggc

SEQ ID NO: 967656 - RNA, 27 nt, Human
caaauauaaagagguuuauucauucug

SEQ ID NO: 967657 - RNA, 20 nt, Human
caccccucccgucgacccca

SEQ ID NO: 967658 - RNA, 21 nt, Human
ccgcggggccgggagcuacgc

SEQ ID NO: 967659 - RNA, 25 nt, Human
ccucccgucgaccccacaguucagg

SEQ ID NO: 967660 - RNA, 20 nt, Human
cgcggggccgggagcuacgc

SEQ ID NO: 967661 - RNA, 20 nt, Human
gcaaauauaaagagguuuau

SEQ ID NO: 967662 - RNA, 21 nt, Human
gcaccccucccgucgacccca

SEQ ID NO: 967663 - RNA, 18 nt, Human
ggggccgggagcuacgca

SEQ ID NO: 967664 - RNA, 27 nt, Human
uaggauacaaaauagaacauguaaaag

SEQ ID NO: 967665 - RNA, 19 nt, Human
uuuuuuuuuuuuuuuuugc

SEQ ID NO: 967666 - RNA, 21 nt, Human
uuuuuuuuuuuuuuuuugcaa

SEQ ID NO: 967667 - RNA, 23 nt, Human
uuuuuuuuuuuuuuuuugcaaau

SEQ ID NO: 967668 - RNA, 20 nt, Human
uuuuuuuuuuuuuuuuuugg

SEQ ID NO: 967669 - RNA, 22 nt, Human
aaacaagaacagaaaaaggcug

SEQ ID NO: 967670 - RNA, 23 nt, Human
aaacaagaacagaaaaaggcuga

SEQ ID NO: 967671 - RNA, 25 nt, Human
aaacaagaacagaaaaaggcugaaa

SEQ ID NO: 967672 - RNA, 22 nt, Human
aaagcagauugaaaugcuccuc

SEQ ID NO: 967673 - RNA, 19 nt, Human
aaccaucaaaacaagaaca

SEQ ID NO: 967674 - RNA, 22 nt, Human
acaaaaccaucaaaacaagaac

SEQ ID NO: 967675 - RNA, 21 nt, Human
acaggagcaggaaccugaagc

SEQ ID NO: 967676 - RNA, 20 nt, Human
acgccgggauuccuugauac

SEQ ID NO: 967677 - RNA, 19 nt, Human
agaaaaaggcugaaaaucc

SEQ ID NO: 967678 - RNA, 22 nt, Human
agaaaaaggcugaaaauccguu

SEQ ID NO: 967679 - RNA, 26 nt, Human
agcaggaaccugaagcugcuuccaag

SEQ ID NO: 967680 - RNA, 19 nt, Human
aggcaggaaagcagauuga

SEQ ID NO: 967681 - RNA, 22 nt, Human
aguagccaaucacaaagucaaa

SEQ ID NO: 967682 - RNA, 21 nt, Human
caaaccccauguucucaggga

SEQ ID NO: 967683 - RNA, 19 nt, Human
caaacuagugccccagaag

SEQ ID NO: 967684 - RNA, 20 nt, Human
cagcccauagauguacugca

SEQ ID NO: 967685 - RNA, 20 nt, Human
caucaaaacaagaacagaag

SEQ ID NO: 967686 - RNA, 24 nt, Human
cccugcaauuaauuauaaucccuu

SEQ ID NO: 967687 - RNA, 19 nt, Human
ccucucugaugggcaaggg

SEQ ID NO: 967688 - RNA, 25 nt, Human
ccuucuguacuacaggagcaggaac

SEQ ID NO: 967689 - RNA, 25 nt, Human
ccuugcccaccuugauguaaggcag

SEQ ID NO: 967690 - RNA, 21 nt, Human
cugaaaauccguucaaacccc

SEQ ID NO: 967691 - RNA, 24 nt, Human
cugaggucuucauagauugguggc

SEQ ID NO: 967692 - RNA, 18 nt, Human
cugcuuccaaggcucugg

SEQ ID NO: 967693 - RNA, 21 nt, Human
cuggacacuuggcacgcaggg

SEQ ID NO: 967694 - RNA, 27 nt, Human
gagcaggaaccugaagcugcuuccaag

SEQ ID NO: 967695 - RNA, 22 nt, Human
gcuguccacgccgggauuccuu

SEQ ID NO: 967696 - RNA, 20 nt, Human
gggcaagggggaaucacagc

SEQ ID NO: 967697 - RNA, 20 nt, Human
uaauuccucacccccuggcc

SEQ ID NO: 967698 - RNA, 27 nt, Human
uacacaaaaccaucaaaacaagaacag

SEQ ID NO: 967699 - RNA, 21 nt, Human
uagccaaucacaaagucaaac

SEQ ID NO: 967700 - RNA, 21 nt, Human
uauuuccucuuacacaaaacc

SEQ ID NO: 967701 - RNA, 20 nt, Human
ucaaaacaagaacagaaaaa

SEQ ID NO: 967702 - RNA, 20 nt, Human
ucaaaacaagaacagaaaaa

SEQ ID NO: 967703 - RNA, 18 nt, Human
ucacagcccauagaugua

SEQ ID NO: 967704 - RNA, 21 nt, Human
uccagcacuaauuccucaccc

SEQ ID NO: 967705 - RNA, 21 nt, Human
ucucugaugggcaagggggaa

SEQ ID NO: 967706 - RNA, 22 nt, Human
ucuggacacuuggcacgcaggg

SEQ ID NO: 967707 - RNA, 19 nt, Human
uggacacuuggcacgcagg

SEQ ID NO: 967708 - RNA, 23 nt, Human
uucaaaccccauguucucaggga

SEQ ID NO: 967709 - RNA, 22 nt, Human
uucauagauugguggcuugagc

SEQ ID NO: 967710 - RNA, 22 nt, Human
uucuguacuacaggagcaggaa

SEQ ID NO: 967711 - RNA, 25 nt, Human
uuuuuuuuuuuggcaguaaagggcu

SEQ ID NO: 967712 - RNA, 22 nt, Human
uuuuuuuuuuuuuuuuuggcag

SEQ ID NO: 967713 - RNA, 23 nt, Human
uuuuuuuuuuuuuuuuuggcagu

SEQ ID NO: 967714 - RNA, 22 nt, Human
uuuuuuuuuuuuuuuuuuuggc

SEQ ID NO: 967715 - RNA, 28 nt, Human
uuuuuuuuuuuuuuuuuuuuuuuggggg

SEQ ID NO: 967716 - RNA, 22 nt, Human
aagggaccuccaucccuccuug

SEQ ID NO: 967717 - RNA, 25 nt, Human
acaacaaaggggccagaguagggcg

SEQ ID NO: 967718 - RNA, 23 nt, Human
acagccaaggggccuuuauugga

SEQ ID NO: 967719 - RNA, 21 nt, Human
agagaugggagcggcaugagg

SEQ ID NO: 967720 - RNA, 22 nt, Human
agcaguacagacagggcugagg

SEQ ID NO: 967721 - RNA, 19 nt, Human
aggggucuucaugggcugu

SEQ ID NO: 967722 - RNA, 24 nt, Human
auaguagcggaaacaggcaagccc

SEQ ID NO: 967723 - RNA, 20 nt, Human
aucauucugaaggaaauaag

SEQ ID NO: 967724 - RNA, 19 nt, Human
auuccaggcucguuuagcu

SEQ ID NO: 967725 - RNA, 20 nt, Human
cacauaggagcaggcaggug

SEQ ID NO: 967726 - RNA, 21 nt, Human
cacuggccuaguccccaaggc

SEQ ID NO: 967727 - RNA, 18 nt, Human
cacugggcauaauauagu

SEQ ID NO: 967728 - RNA, 23 nt, Human
caguacagacagggcugaggcug

SEQ ID NO: 967729 - RNA, 19 nt, Human
caugaucucucuuccuaca

SEQ ID NO: 967730 - RNA, 23 nt, Human
cccccacagagcugagcuugcuu

SEQ ID NO: 967731 - RNA, 23 nt, Human
cccguggugccggccccugugcu

SEQ ID NO: 967732 - RNA, 25 nt, Human
ccucuaugggucccuuccccuuaga

SEQ ID NO: 967733 - RNA, 18 nt, Human
cggccccugugcugacca

SEQ ID NO: 967734 - RNA, 22 nt, Human
cggccccugugcugaccacccu

SEQ ID NO: 967735 - RNA, 24 nt, Human
cguggugccggccccugugcugac

SEQ ID NO: 967736 - RNA, 26 nt, Human
cuaugggucccuuccccuuagaauuu

SEQ ID NO: 967737 - RNA, 20 nt, Human
cugagaaggggucuucaugg

SEQ ID NO: 967738 - RNA, 20 nt, Human
cuggucccugucuucuucca

SEQ ID NO: 967739 - RNA, 19 nt, Human
cuuagcugccauacuucug

SEQ ID NO: 967740 - RNA, 18 nt, Human
gacguggggugaggagga

SEQ ID NO: 967741 - RNA, 23 nt, Human
gagcaguacagacagggcugagg

SEQ ID NO: 967742 - RNA, 19 nt, Human
gaggaggaacacugggcau

SEQ ID NO: 967743 - RNA, 18 nt, Human
gccaugccacagccaagg

SEQ ID NO: 967744 - RNA, 23 nt, Human
gcuugcuugguuaucugggacug

SEQ ID NO: 967745 - RNA, 19 nt, Human
ggacguggggugaggagga

SEQ ID NO: 967746 - RNA, 24 nt, Human
ggcugagaaggggucuucaugggc

SEQ ID NO: 967747 - RNA, 21 nt, Human
gggaacaugagaaagucuggc

SEQ ID NO: 967748 - RNA, 21 nt, Human
gggagcggcaugaggggaagg

SEQ ID NO: 967749 - RNA, 19 nt, Human
gggcugagaaggggucuuc

SEQ ID NO: 967750 - RNA, 20 nt, Human
ggggugaggaggaacacugg

SEQ ID NO: 967751 - RNA, 21 nt, Human
guagggcgaaauuccuccuuc

SEQ ID NO: 967752 - RNA, 22 nt, Human
gucccugucuucuuccagccag

SEQ ID NO: 967753 - RNA, 22 nt, Human
gucuggucccugucuucuucca

SEQ ID NO: 967754 - RNA, 21 nt, Human
uagcggaaacaggcaagccuc

SEQ ID NO: 967755 - RNA, 24 nt, Human
uauaguagcggaaacaggcaagcc

SEQ ID NO: 967756 - RNA, 26 nt, Human
uaugggggauggggaucauucugaag

SEQ ID NO: 967757 - RNA, 19 nt, Human
ucagguuuuggggcugaga

SEQ ID NO: 967758 - RNA, 19 nt, Human
ucuaugggucccuuccccu

SEQ ID NO: 967759 - RNA, 21 nt, Human
ucugggacugcugcucagucu

SEQ ID NO: 967760 - RNA, 20 nt, Human
ugaggagguaagcaggccug

SEQ ID NO: 967761 - RNA, 24 nt, Human
ugcgauguuggucuuuugaaggag

SEQ ID NO: 967762 - RNA, 30 nt, Human
ugggccucugagcucuuccuccacucccuc

SEQ ID NO: 967763 - RNA, 23 nt, Human
uggucuggccugaccccaggacg

SEQ ID NO: 967764 - RNA, 23 nt, Human
ugucugcgauguuggucuuuuga

SEQ ID NO: 967765 - RNA, 24 nt, Human
ugugaggagguaagcaggccugag

SEQ ID NO: 967766 - RNA, 20 nt, Human
uuuuuuuuuuuuuuugugac

SEQ ID NO: 967767 - RNA, 19 nt, Human
uuuuuuuuuuuuuuuuugu

SEQ ID NO: 967768 - RNA, 20 nt, Human
uuuuuuuuuuuuuuuuuugg

SEQ ID NO: 967769 - RNA, 21 nt, Human
aagagaagggggauuggggaa

SEQ ID NO: 967770 - RNA, 19 nt, Human
aaggaaaccaaaaaggagg

SEQ ID NO: 967771 - RNA, 23 nt, Human
acaaaaaaaaccuugucaguaau

SEQ ID NO: 967772 - RNA, 24 nt, Human
accaccaaggaaaccaaaaaggag

SEQ ID NO: 967773 - RNA, 21 nt, Human
acuacaaauccuauaaaauug

SEQ ID NO: 967774 - RNA, 24 nt, Human
agaaaagaggcacaccucugagga

SEQ ID NO: 967775 - RNA, 27 nt, Human
agaaaagaggcacaccucugaggaugc

SEQ ID NO: 967776 - RNA, 21 nt, Human
agaacagccuccgacuuaaaa

SEQ ID NO: 967777 - RNA, 21 nt, Human
agcaagcaacaaacaaaaaaa

SEQ ID NO: 967778 - RNA, 20 nt, Human
aggaugccuuuguuuucuug

SEQ ID NO: 967779 - RNA, 21 nt, Human
aguaauacacagaugaaucuc

SEQ ID NO: 967780 - RNA, 20 nt, Human
auuaccaaagcaagcaacaa

SEQ ID NO: 967781 - RNA, 24 nt, Human
caaagcaagcaacaaacaaaaaaa

SEQ ID NO: 967782 - RNA, 20 nt, Human
caagcaacaaacaaaaaaaa

SEQ ID NO: 967783 - RNA, 24 nt, Human
caagcaacaaacaaaaaaaaccuu

SEQ ID NO: 967784 - RNA, 18 nt, Human
cacaccucugaggaugcc

SEQ ID NO: 967785 - RNA, 22 nt, Human
cagggucaaugcaauggucugg

SEQ ID NO: 967786 - RNA, 26 nt, Human
cauucuucuuuuaauuaaucuggaag

SEQ ID NO: 967787 - RNA, 23 nt, Human
cuagacucaaacacaagucaaaa

SEQ ID NO: 967788 - RNA, 21 nt, Human
gacuuaguuuugguucuccuu

SEQ ID NO: 967789 - RNA, 22 nt, Human
gggcagagggaguauuuccucu

SEQ ID NO: 967790 - RNA, 19 nt, Human
uaaauuuugcgacuuaguu

SEQ ID NO: 967791 - RNA, 28 nt, Human
uaaccaaaacacaugaaaaguuuaugcc

SEQ ID NO: 967792 - RNA, 22 nt, Human
uaauaauaaagaaaagaggcac

SEQ ID NO: 967793 - RNA, 24 nt, Human
uaauaauaaagaaaagaggcacac

SEQ ID NO: 967794 - RNA, 22 nt, Human
uacaaaugccuaucguaacuua

SEQ ID NO: 967795 - RNA, 19 nt, Human
uaccaaagcaagcaacaaa

SEQ ID NO: 967796 - RNA, 21 nt, Human
uaccaaagcaagcaacaaaca

SEQ ID NO: 967797 - RNA, 22 nt, Human
uaccaaagcaagcaacaaacaa

SEQ ID NO: 967798 - RNA, 23 nt, Human
uaccaaagcaagcaacaaacaaa

SEQ ID NO: 967799 - RNA, 24 nt, Human
uaccaccaaggaaaccaaaaagga

SEQ ID NO: 967800 - RNA, 25 nt, Human
ucuagacucaaacacaagucaaaau

SEQ ID NO: 967801 - RNA, 20 nt, Human
ucuggaagaagagaaggggg

SEQ ID NO: 967802 - RNA, 19 nt, Human
ugaaaagaggaaaguaaug

SEQ ID NO: 967803 - RNA, 18 nt, Human
ugaauggauacaaaugcc

SEQ ID NO: 967804 - RNA, 20 nt, Human
aacaaaaaccuguauuuaag

SEQ ID NO: 967805 - RNA, 18 nt, Human
aaccauggcguaagagcc

SEQ ID NO: 967806 - RNA, 19 nt, Human
aaccugcucauaaccaugg

SEQ ID NO: 967807 - RNA, 21 nt, Human
aacuggaguaacccucagucc

SEQ ID NO: 967808 - RNA, 19 nt, Human
acaggccauguccccaaag

SEQ ID NO: 967809 - RNA, 20 nt, Human
acagucacaaaacagccagc

SEQ ID NO: 967810 - RNA, 19 nt, Human
acccuggaaaagucugugg

SEQ ID NO: 967811 - RNA, 18 nt, Human
acuugucaccccuuccuc

SEQ ID NO: 967812 - RNA, 22 nt, Human
agaaaucccagacccucugcuc

SEQ ID NO: 967813 - RNA, 27 nt, Human
agacuagaagaggggguaggaauccag

SEQ ID NO: 967814 - RNA, 21 nt, Human
agagcaaaaguccggauuucu

SEQ ID NO: 967815 - RNA, 19 nt, Human
agauggcaggguggaggca

SEQ ID NO: 967816 - RNA, 22 nt, Human
agcaucuccccucccagacagc

SEQ ID NO: 967817 - RNA, 21 nt, Human
agccauggccugcuggaagcc

SEQ ID NO: 967818 - RNA, 21 nt, Human
aggcccaggacggcacgacaa

SEQ ID NO: 967819 - RNA, 23 nt, Human
auccuucccaguucucucuguca

SEQ ID NO: 967820 - RNA, 22 nt, Human
aucugauuucggauucccgggg

SEQ ID NO: 967821 - RNA, 19 nt, Human
caaaacagccagccauggc

SEQ ID NO: 967822 - RNA, 22 nt, Human
caacaaaaaccuguauuuaagc

SEQ ID NO: 967823 - RNA, 19 nt, Human
caacggaagcgaaccugga

SEQ ID NO: 967824 - RNA, 22 nt, Human
caagacuccuggaauccagcac

SEQ ID NO: 967825 - RNA, 23 nt, Human
caccaugggaucaggcagaccuc

SEQ ID NO: 967826 - RNA, 19 nt, Human
cacuuggcugucucuucag

SEQ ID NO: 967827 - RNA, 19 nt, Human
cagacagccugaggcccag

SEQ ID NO: 967828 - RNA, 22 nt, Human
cagccauggccugcuggaagcc

SEQ ID NO: 967829 - RNA, 27 nt, Human
cagcuccuugaccacuugucaccccuu

SEQ ID NO: 967830 - RNA, 22 nt, Human
caggacaagcacugagcaggcu

SEQ ID NO: 967831 - RNA, 24 nt, Human
cagggggccaggcugggcccccag

SEQ ID NO: 967832 - RNA, 25 nt, Human
caucggaaaggaggcuuaugauccc

SEQ ID NO: 967833 - RNA, 21 nt, Human
caucuccccucccagacagcc

SEQ ID NO: 967834 - RNA, 25 nt, Human
ccaacucucaaauccgacgauuagc

SEQ ID NO: 967835 - RNA, 20 nt, Human
ccagacagccugaggcccag

SEQ ID NO: 967836 - RNA, 19 nt, Human
ccaggucuucacuguugac

SEQ ID NO: 967837 - RNA, 20 nt, Human
cccccagcacucccggcagu

SEQ ID NO: 967838 - RNA, 19 nt, Human
ccccuccauucugcccacu

SEQ ID NO: 967839 - RNA, 21 nt, Human
ccccucccagacagccugagg

SEQ ID NO: 967840 - RNA, 22 nt, Human
ccccucccagacagccugaggc

SEQ ID NO: 967841 - RNA, 20 nt, Human
cccgggggguccaggggggg

SEQ ID NO: 967842 - RNA, 18 nt, Human
cccuccauucugcccacu

SEQ ID NO: 967843 - RNA, 22 nt, Human
ccgaagccacguuccaagucac

SEQ ID NO: 967844 - RNA, 27 nt, Human
ccgccgucguccccgcgcggugguccg

SEQ ID NO: 967845 - RNA, 20 nt, Human
ccuccauucugcccacugag

SEQ ID NO: 967846 - RNA, 24 nt, Human
ccucccagacagccugaggcccag

SEQ ID NO: 967847 - RNA, 23 nt, Human
cgacaagaaugcaggccugugcc

SEQ ID NO: 967848 - RNA, 22 nt, Human
cgccccggcuuccgucagagac

SEQ ID NO: 967849 - RNA, 24 nt, Human
cgccugggauucacucccaucccu

SEQ ID NO: 967850 - RNA, 21 nt, Human
cgcuaauaauuaccccugcac

SEQ ID NO: 967851 - RNA, 23 nt, Human
cggaaaggaggcuuaugauccca

SEQ ID NO: 967852 - RNA, 23 nt, Human
cggaagcgaaccuggauccuucc

SEQ ID NO: 967853 - RNA, 24 nt, Human
cggaggcaagugcuggaugugggg

SEQ ID NO: 967854 - RNA, 18 nt, Human
cggauucccgggguucac

SEQ ID NO: 967855 - RNA, 23 nt, Human
cggcacgacaagaaugcaggccu

SEQ ID NO: 967856 - RNA, 20 nt, Human
cggccagagcagcccugcgg

SEQ ID NO: 967857 - RNA, 21 nt, Human
cgggggguccagggggggccc

SEQ ID NO: 967858 - RNA, 22 nt, Human
cgggguucaccaugggaucagg

SEQ ID NO: 967859 - RNA, 19 nt, Human
cgugaaagagcaggcaaga

SEQ ID NO: 967860 - RNA, 19 nt, Human
cucccagacagccugaggc

SEQ ID NO: 967861 - RNA, 20 nt, Human
cuccgccugggauucacucc

SEQ ID NO: 967862 - RNA, 18 nt, Human
cugacaaggguggcacag

SEQ ID NO: 967863 - RNA, 18 nt, Human
cuggcugccagcucuggc

SEQ ID NO: 967864 - RNA, 24 nt, Human
cuuagacuaagugggccgacagcg

SEQ ID NO: 967865 - RNA, 19 nt, Human
cuucuccugggaaaagggc

SEQ ID NO: 967866 - RNA, 21 nt, Human
cuuucggcccgcucagcuucc

SEQ ID NO: 967867 - RNA, 18 nt, Human
gaaaggcagagcuggcug

SEQ ID NO: 967868 - RNA, 21 nt, Human
gaaaucccagacccucugcuc

SEQ ID NO: 967869 - RNA, 25 nt, Human
gaggauggagagcaaaaguccggaa

SEQ ID NO: 967870 - RNA, 21 nt, Human
gccccggcuuccgucagagac

SEQ ID NO: 967871 - RNA, 23 nt, Human
gccgaaggacccucaucaaccug

SEQ ID NO: 967872 - RNA, 19 nt, Human
gcgcggugguccggcaggu

SEQ ID NO: 967873 - RNA, 23 nt, Human
gcugccagcucuggccuccgccu

SEQ ID NO: 967874 - RNA, 18 nt, Human
gcuuuugcugaaagcaga

SEQ ID NO: 967875 - RNA, 20 nt, Human
ggaccacccuggaaaagucu

SEQ ID NO: 967876 - RNA, 19 nt, Human
ggacucaagcuaccaacgg

SEQ ID NO: 967877 - RNA, 22 nt, Human
ggcaggacaagcacugagcagg

SEQ ID NO: 967878 - RNA, 21 nt, Human
gggcaagacuagaagaggggg

SEQ ID NO: 967879 - RNA, 21 nt, Human
gggucccggccagagcagccc

SEQ ID NO: 967880 - RNA, 20 nt, Human
gucacaaaacagccagccau

SEQ ID NO: 967881 - RNA, 24 nt, Human
guggcacagacgcaccucaccugc

SEQ ID NO: 967882 - RNA, 19 nt, Human
uaacagucacaaaacagcc

SEQ ID NO: 967883 - RNA, 19 nt, Human
uaacccucagucccaggac

SEQ ID NO: 967884 - RNA, 20 nt, Human
ucaaccugcucauaaccaug

SEQ ID NO: 967885 - RNA, 20 nt, Human
ucaccccuuccucagauggc

SEQ ID NO: 967886 - RNA, 21 nt, Human
uccaaaaugucuugagcuggu

SEQ ID NO: 967887 - RNA, 21 nt, Human
uccaacucucaaauccgacga

SEQ ID NO: 967888 - RNA, 22 nt, Human
uccaacucucaaauccgacgau

SEQ ID NO: 967889 - RNA, 18 nt, Human
uccagcacugcuugcacc

SEQ ID NO: 967890 - RNA, 19 nt, Human
uccaugcagucagacucca

SEQ ID NO: 967891 - RNA, 21 nt, Human
uccaugcagucagacuccaug

SEQ ID NO: 967892 - RNA, 18 nt, Human
ucccagacagccugaggc

SEQ ID NO: 967893 - RNA, 20 nt, Human
ucccagacagccugaggccc

SEQ ID NO: 967894 - RNA, 19 nt, Human
ucccagaguucaauuccug

SEQ ID NO: 967895 - RNA, 24 nt, Human
ucccagaguucaauuccugcaaac

SEQ ID NO: 967896 - RNA, 23 nt, Human
uccccaaagccccuagagggugu

SEQ ID NO: 967897 - RNA, 23 nt, Human
uccccucccagacagccugaggc

SEQ ID NO: 967898 - RNA, 23 nt, Human
ucccggccagagcagcccugcgg

SEQ ID NO: 967899 - RNA, 25 nt, Human
ucccggccagagcagcccugcgggc

SEQ ID NO: 967900 - RNA, 25 nt, Human
ucccuaaaggaucuuaucucaaucu

SEQ ID NO: 967901 - RNA, 18 nt, Human
uccggacuccgaccgucc

SEQ ID NO: 967902 - RNA, 20 nt, Human
uccucagauggcagggugga

SEQ ID NO: 967903 - RNA, 19 nt, Human
uccuugaccacuugucacc

SEQ ID NO: 967904 - RNA, 22 nt, Human
ucucccggccagcgggucccgg

SEQ ID NO: 967905 - RNA, 20 nt, Human
ucugaggucccggggggucc

SEQ ID NO: 967906 - RNA, 23 nt, Human
ucugucaggaucuggaacuucca

SEQ ID NO: 967907 - RNA, 18 nt, Human
ucuuccggacuccgaccg

SEQ ID NO: 967908 - RNA, 21 nt, Human
ugaaagcagaaaucccagacc

SEQ ID NO: 967909 - RNA, 20 nt, Human
ugagaugccaagacuccugg

SEQ ID NO: 967910 - RNA, 21 nt, Human
ugagcaggcucccagaggugu

SEQ ID NO: 967911 - RNA, 19 nt, Human
ugaggucccggggggucca

SEQ ID NO: 967912 - RNA, 22 nt, Human
ugcacaauguaacagucacaaa

SEQ ID NO: 967913 - RNA, 23 nt, Human
ugccuggcaggacuacuugggca

SEQ ID NO: 967914 - RNA, 18 nt, Human
ugggaggaguauguggac

SEQ ID NO: 967915 - RNA, 19 nt, Human
ugggaggaguauguggacg

SEQ ID NO: 967916 - RNA, 21 nt, Human
uuucggcccgcucagcuuccg

SEQ ID NO: 967917 - RNA, 20 nt, Human
uuuugcugaaagcagaaauc

SEQ ID NO: 967918 - RNA, 23 nt, Human
uuuuuuuuuuuuuuuuuuaaaag

SEQ ID NO: 967919 - RNA, 20 nt, Human
aaaaaaggcaagagaaaaaa

SEQ ID NO: 967920 - RNA, 22 nt, Human
aaaaggcaagagaaaaaaggga

SEQ ID NO: 967921 - RNA, 21 nt, Human
aaaggcaagagaaaaaaggga

SEQ ID NO: 967922 - RNA, 21 nt, Human
aaccugcauuuucccgaaagg

SEQ ID NO: 967923 - RNA, 20 nt, Human
acaaacaaauccagcaggca

SEQ ID NO: 967924 - RNA, 22 nt, Human
agaaaaaagggaauuuugcuag

SEQ ID NO: 967925 - RNA, 23 nt, Human
agacugagucguccagcuccguu

SEQ ID NO: 967926 - RNA, 23 nt, Human
agggauccacuggggaagauuuc

SEQ ID NO: 967927 - RNA, 25 nt, Human
auaauaacaaagagaaaguaaugac

SEQ ID NO: 967928 - RNA, 21 nt, Human
aucaaauugaccuccauuuau

SEQ ID NO: 967929 - RNA, 19 nt, Human
auccagguaaccgcagcag

SEQ ID NO: 967930 - RNA, 20 nt, Human
augguaaaauauaagacuuc

SEQ ID NO: 967931 - RNA, 24 nt, Human
auuucuuauuguugcuguuuaaau

SEQ ID NO: 967932 - RNA, 22 nt, Human
caaaaaagggaaaagauggcua

SEQ ID NO: 967933 - RNA, 21 nt, Human
cacagaccaagagacugaguc

SEQ ID NO: 967934 - RNA, 22 nt, Human
cagcaggcauagaaaacggcug

SEQ ID NO: 967935 - RNA, 23 nt, Human
cagcaggcauagaaaacggcuga

SEQ ID NO: 967936 - RNA, 21 nt, Human
cauagaaaacggcugaacugc

SEQ ID NO: 967937 - RNA, 23 nt, Human
ccagcgaugcaauguaaggcgaa

SEQ ID NO: 967938 - RNA, 21 nt, Human
cccagcgaugcaauguaaggc

SEQ ID NO: 967939 - RNA, 22 nt, Human
cggcugaacugcuagucccuua

SEQ ID NO: 967940 - RNA, 19 nt, Human
cuauagaagucaauucaaa

SEQ ID NO: 967941 - RNA, 18 nt, Human
gaaaagauggcuauagaa

SEQ ID NO: 967942 - RNA, 21 nt, Human
gcaguggcugggaacaaauac

SEQ ID NO: 967943 - RNA, 22 nt, Human
gcuguuucuucuuccugucagc

SEQ ID NO: 967944 - RNA, 21 nt, Human
gguaacaaagccagccucaga

SEQ ID NO: 967945 - RNA, 22 nt, Human
gucuacucuccaaaaaagggaa

SEQ ID NO: 967946 - RNA, 21 nt, Human
uaaaaaaggcaagagaaaaaa

SEQ ID NO: 967947 - RNA, 21 nt, Human
uacaaacaaauccagcaggca

SEQ ID NO: 967948 - RNA, 24 nt, Human
uacaguuguccauugucugcuaca

SEQ ID NO: 967949 - RNA, 19 nt, Human
uagaaaacggcugaacugc

SEQ ID NO: 967950 - RNA, 22 nt, Human
uauaauaacaaagagaaaguaa

SEQ ID NO: 967951 - RNA, 21 nt, Human
ugagcaguggcugggaacaaa

SEQ ID NO: 967952 - RNA, 23 nt, Human
uggcugggaacaaauacaaacaa

SEQ ID NO: 967953 - RNA, 25 nt, Human
ugggaacaaauacaaacaaauccag

SEQ ID NO: 967954 - RNA, 19 nt, Human
uuggaugcuguuucuucuu

SEQ ID NO: 967955 - RNA, 19 nt, Human
uuugcuagucuacucucca

SEQ ID NO: 967956 - RNA, 21 nt, Human
aagcagaaagcccaaaucaga

SEQ ID NO: 967957 - RNA, 23 nt, Human
aagcagaaagcccaaaucagaca

SEQ ID NO: 967958 - RNA, 18 nt, Human
acaagaauucauuguucu

SEQ ID NO: 967959 - RNA, 25 nt, Human
agaucaccaccuuaaacuuccuaaa

SEQ ID NO: 967960 - RNA, 24 nt, Human
agcagaaagcccaaaucagacagu

SEQ ID NO: 967961 - RNA, 22 nt, Human
agcuccuuggcgccuccuguua

SEQ ID NO: 967962 - RNA, 23 nt, Human
aggaagugucuauauagggugug

SEQ ID NO: 967963 - RNA, 19 nt, Human
aguaaagcagaaagcccaa

SEQ ID NO: 967964 - RNA, 20 nt, Human
aucagacagugaaucaggga

SEQ ID NO: 967965 - RNA, 20 nt, Human
cacuguuaucaucccuaccu

SEQ ID NO: 967966 - RNA, 22 nt, Human
cagagacucucucaaaacaagg

SEQ ID NO: 967967 - RNA, 23 nt, Human
cagguuaaaaaauaaauuccuuu

SEQ ID NO: 967968 - RNA, 23 nt, Human
caugcacaugcacauguacaccu

SEQ ID NO: 967969 - RNA, 22 nt, Human
cccacuguuaucaucccuaccu

SEQ ID NO: 967970 - RNA, 21 nt, Human
gcagacacugcccagacuaga

SEQ ID NO: 967971 - RNA, 21 nt, Human
gcgccuccuguuaggaaggca

SEQ ID NO: 967972 - RNA, 26 nt, Human
ggaccggaagaagcaauacagaguuu

SEQ ID NO: 967973 - RNA, 18 nt, Human
uaagugggagugguggaa

SEQ ID NO: 967974 - RNA, 24 nt, Human
uagaaaauagcagagacucucuca

SEQ ID NO: 967975 - RNA, 25 nt, Human
uagcauucaggaagugucuauauag

SEQ ID NO: 967976 - RNA, 23 nt, Human
ucagggauuaagugggaguggug

SEQ ID NO: 967977 - RNA, 18 nt, Human
uccaugcacaugcacaug

SEQ ID NO: 967978 - RNA, 18 nt, Human
uccaugcacaugcacaug

SEQ ID NO: 967979 - RNA, 19 nt, Human
uccaugcacaugcacaugu

SEQ ID NO: 967980 - RNA, 23 nt, Human
uccuaaauguucaugagucaaac

SEQ ID NO: 967981 - RNA, 18 nt, Human
uccuuccaugcacaugca

SEQ ID NO: 967982 - RNA, 21 nt, Human
ucucucaaaacaagaauucau

SEQ ID NO: 967983 - RNA, 19 nt, Human
ugaaagagaagaucaccac

SEQ ID NO: 967984 - RNA, 22 nt, Human
ugcccagacuagaucuuuuauc

SEQ ID NO: 967985 - RNA, 20 nt, Human
ugucuauauaggguguggag

SEQ ID NO: 967986 - RNA, 29 nt, Human
uuaccccacuguuaucaucccuaccuuuu

SEQ ID NO: 967987 - RNA, 19 nt, Human
uuggcgccuccuguuagga

SEQ ID NO: 967988 - RNA, 21 nt, Human
aagcaagcuucgugucaugca

SEQ ID NO: 967989 - RNA, 23 nt, Human
aagcuucgugucaugcagcagag

SEQ ID NO: 967990 - RNA, 18 nt, Human
acaacacaaagauggaac

SEQ ID NO: 967991 - RNA, 19 nt, Human
agaaggaagggauccuggc

SEQ ID NO: 967992 - RNA, 19 nt, Human
agagaaacugaggcacaga

SEQ ID NO: 967993 - RNA, 18 nt, Human
agcaagaugcccaaaguc

SEQ ID NO: 967994 - RNA, 20 nt, Human
agccaagagcaagaugccca

SEQ ID NO: 967995 - RNA, 22 nt, Human
agccaagagcaagaugcccaaa

SEQ ID NO: 967996 - RNA, 23 nt, Human
agggauccuggccggagccuggc

SEQ ID NO: 967997 - RNA, 22 nt, Human
cacagcaagcuaaauucuuggg

SEQ ID NO: 967998 - RNA, 20 nt, Human
cacugcacagcaagcuaaau

SEQ ID NO: 967999 - RNA, 25 nt, Human
cagcucccagaacaaaguaaagaua

SEQ ID NO: 968000 - RNA, 22 nt, Human
cauuucacagauguauguggaa

SEQ ID NO: 968001 - RNA, 23 nt, Human
ccaaaauguaaacuuuuccagac

SEQ ID NO: 968002 - RNA, 19 nt, Human
ccagccaagagcaagaugc

SEQ ID NO: 968003 - RNA, 24 nt, Human
ccugcagccacugcacagcaagcu

SEQ ID NO: 968004 - RNA, 20 nt, Human
ccugcagccacugcacagcc

SEQ ID NO: 968005 - RNA, 20 nt, Human
cucccagaacaaaguaaaga

SEQ ID NO: 968006 - RNA, 18 nt, Human
cuucuggguuuugcaaau

SEQ ID NO: 968007 - RNA, 18 nt, Human
gacugguggucagugugu

SEQ ID NO: 968008 - RNA, 22 nt, Human
gccaaugaggagaaggaaggga

SEQ ID NO: 968009 - RNA, 18 nt, Human
gcuuccuuuauacaauaa

SEQ ID NO: 968010 - RNA, 22 nt, Human
gucccuuuguuggucucuggug

SEQ ID NO: 968011 - RNA, 20 nt, Human
uaucagaaccagcagguucc

SEQ ID NO: 968012 - RNA, 21 nt, Human
uauguggaagaaacaucacca

SEQ ID NO: 968013 - RNA, 24 nt, Human
ucagauguccuggcuuucagucug

SEQ ID NO: 968014 - RNA, 24 nt, Human
ucugcuacaacacaaagauggaac

SEQ ID NO: 968015 - RNA, 24 nt, Human
ucuugggaagccucacuuccuugu

SEQ ID NO: 968016 - RNA, 20 nt, Human
ugacuuuuuagcuucugggu

SEQ ID NO: 968017 - RNA, 24 nt, Human
ugagaaggguacagacgugcagca

SEQ ID NO: 968018 - RNA, 22 nt, Human
ugaggagaaggaagggauccug

SEQ ID NO: 968019 - RNA, 21 nt, Human
ugccaggcagaagcaagcuuc

SEQ ID NO: 968020 - RNA, 24 nt, Human
ugggccuguggccaaguucagugu

SEQ ID NO: 968021 - RNA, 20 nt, Human
aaccaacuuccccugugacu

SEQ ID NO: 968022 - RNA, 21 nt, Human
aacucuuccucagcucuacca

SEQ ID NO: 968023 - RNA, 26 nt, Human
augguaccaucugcaucacccgaggg

SEQ ID NO: 968024 - RNA, 22 nt, Human
caucaaagaaauaccuaacgau

SEQ ID NO: 968025 - RNA, 23 nt, Human
caucaaagaaauaccuaacgaug

SEQ ID NO: 968026 - RNA, 19 nt, Human
cccaugccaaggcauaggg

SEQ ID NO: 968027 - RNA, 22 nt, Human
cuuguugcagaugacuuucuug

SEQ ID NO: 968028 - RNA, 18 nt, Human
ucccagagcaauuuguug

SEQ ID NO: 968029 - RNA, 25 nt, Human
ugaccagagagaauuccuuucccag

SEQ ID NO: 968030 - RNA, 18 nt, Human
uggaugaacuuguugcag

SEQ ID NO: 968031 - RNA, 20 nt, Human
uggaugaacuuguugcagau

SEQ ID NO: 968032 - RNA, 20 nt, Human
uuccccugugacucuccaga

SEQ ID NO: 968033 - RNA, 26 nt, Human
aaacagcaggucccuaaagcccccag

SEQ ID NO: 968034 - RNA, 23 nt, Human
aaaccccgucucugcugaaaaua

SEQ ID NO: 968035 - RNA, 24 nt, Human
aacagcaggucccuaaagcccccc

SEQ ID NO: 968036 - RNA, 20 nt, Human
aagagaaucgcuugaaccca

SEQ ID NO: 968037 - RNA, 23 nt, Human
aagauugcgccacugcacuccag

SEQ ID NO: 968038 - RNA, 24 nt, Human
aaucgcuugaacccagaaggugga

SEQ ID NO: 968039 - RNA, 21 nt, Human
accccacccacccuugggcug

SEQ ID NO: 968040 - RNA, 24 nt, Human
acugcacuccagccuuggcaacag

SEQ ID NO: 968041 - RNA, 24 nt, Human
acugcacuccagccuuggcaacag

SEQ ID NO: 968042 - RNA, 19 nt, Human
acugcacuccagccuuggg

SEQ ID NO: 968043 - RNA, 22 nt, Human
agacccagaggguaaucacaug

SEQ ID NO: 968044 - RNA, 21 nt, Human
agaggguaaucacauggcugc

SEQ ID NO: 968045 - RNA, 22 nt, Human
agaggguaaucacauggcugcg

SEQ ID NO: 968046 - RNA, 23 nt, Human
agccuggccagcauggcaaaccc

SEQ ID NO: 968047 - RNA, 23 nt, Human
agcugggcgugguggcgcgcgcc

SEQ ID NO: 968048 - RNA, 21 nt, Human
aggaaacagcaggucccuaaa

SEQ ID NO: 968049 - RNA, 19 nt, Human
agguggagguugcaaugag

SEQ ID NO: 968050 - RNA, 24 nt, Human
agguggagguugcaaugaguuaag

SEQ ID NO: 968051 - RNA, 22 nt, Human
aguuuggagccugugucccgcc

SEQ ID NO: 968052 - RNA, 25 nt, Human
auugcgccacugcacuccagccuug

SEQ ID NO: 968053 - RNA, 18 nt, Human
cacccccucucugggcac

SEQ ID NO: 968054 - RNA, 18 nt, Human
cacccuugggcugucagg

SEQ ID NO: 968055 - RNA, 25 nt, Human
cacgccuguaauucccagcacuuug

SEQ ID NO: 968056 - RNA, 19 nt, Human
cacugcacuccagccuugg

SEQ ID NO: 968057 - RNA, 21 nt, Human
cacugcacuccagccuuggca

SEQ ID NO: 968058 - RNA, 22 nt, Human
cacugcacuccagccuuggcaa

SEQ ID NO: 968059 - RNA, 23 nt, Human
cacugcacuccagccuuggcaac

SEQ ID NO: 968060 - RNA, 24 nt, Human
cacugcacuccagccuuggcaaca

SEQ ID NO: 968061 - RNA, 29 nt, Human
cagaagguggagguugcaaugacaacggu

SEQ ID NO: 968062 - RNA, 18 nt, Human
cagcacuuugggagacgg

SEQ ID NO: 968063 - RNA, 19 nt, Human
cagcaggccagucacguca

SEQ ID NO: 968064 - RNA, 23 nt, Human
cagcauggcaaaccccgucucug

SEQ ID NO: 968065 - RNA, 21 nt, Human
cagccgagugcccugccucuu

SEQ ID NO: 968066 - RNA, 22 nt, Human
cagccuuggcaacagagggaga

SEQ ID NO: 968067 - RNA, 22 nt, Human
cagcuccucagccugcaccccc

SEQ ID NO: 968068 - RNA, 20 nt, Human
ccacugcacuccagccuugg

SEQ ID NO: 968069 - RNA, 21 nt, Human
ccacugcacuccagccuuggc

SEQ ID NO: 968070 - RNA, 24 nt, Human
ccacugcacuccagccuuggcaac

SEQ ID NO: 968071 - RNA, 24 nt, Human
cccagguuggcuggucucaggaac

SEQ ID NO: 968072 - RNA, 24 nt, Human
ccccacccacccuugggcugucag

SEQ ID NO: 968073 - RNA, 23 nt, Human
cccccuccacauccagcaggcca

SEQ ID NO: 968074 - RNA, 23 nt, Human
ccccucucugggcacuggugcaa

SEQ ID NO: 968075 - RNA, 20 nt, Human
ccugcacccccucucugggc

SEQ ID NO: 968076 - RNA, 22 nt, Human
ccuggccagcauggcaaacccc

SEQ ID NO: 968077 - RNA, 18 nt, Human
ccuguaauucccagcacu

SEQ ID NO: 968078 - RNA, 23 nt, Human
ccuguaauucccagcacuuuggg

SEQ ID NO: 968079 - RNA, 21 nt, Human
cgagaccagccuggccagcau

SEQ ID NO: 968080 - RNA, 20 nt, Human
cgcagccgagugcccugccc

SEQ ID NO: 968081 - RNA, 24 nt, Human
cgccacugcacuccagccuuggca

SEQ ID NO: 968082 - RNA, 22 nt, Human
cggagaugggcggaucacuuga

SEQ ID NO: 968083 - RNA, 24 nt, Human
cggaucacuugaauccagcaguuc

SEQ ID NO: 968084 - RNA, 23 nt, Human
cucaagcccucaccccacccacc

SEQ ID NO: 968085 - RNA, 25 nt, Human
cucacgccuguaauucccagcacuu

SEQ ID NO: 968086 - RNA, 18 nt, Human
cuccucagccugcacccc

SEQ ID NO: 968087 - RNA, 19 nt, Human
cucugggcacuggugcaag

SEQ ID NO: 968088 - RNA, 21 nt, Human
cucugggcagcuccucagccu

SEQ ID NO: 968089 - RNA, 18 nt, Human
cugcacccccucucuggg

SEQ ID NO: 968090 - RNA, 23 nt, Human
cugcacgcgcccccuccacaucc

SEQ ID NO: 968091 - RNA, 21 nt, Human
gaaacagcaggucccuaaagc

SEQ ID NO: 968092 - RNA, 22 nt, Human
gacccuuucccugucucaaaga

SEQ ID NO: 968093 - RNA, 21 nt, Human
gaggacacugagacccagagg

SEQ ID NO: 968094 - RNA, 23 nt, Human
gagguugcaaugaguuaagauug

SEQ ID NO: 968095 - RNA, 24 nt, Human
gaucacuugaauccagcaguucga

SEQ ID NO: 968096 - RNA, 18 nt, Human
gcagccgagugcccugcc

SEQ ID NO: 968097 - RNA, 19 nt, Human
gcagcuccucagccugcac

SEQ ID NO: 968098 - RNA, 21 nt, Human
gccugcacgcgcccccuccac

SEQ ID NO: 968099 - RNA, 24 nt, Human
gccuggccagcauggcaaaccccg

SEQ ID NO: 968100 - RNA, 19 nt, Human
gcgcccccuccacauccag

SEQ ID NO: 968101 - RNA, 18 nt, Human
gcuccucagccugcaccc

SEQ ID NO: 968102 - RNA, 18 nt, Human
ggagguugcaaugaguua

SEQ ID NO: 968103 - RNA, 20 nt, Human
ggagguugcaaugaguuaag

SEQ ID NO: 968104 - RNA, 22 nt, Human
ggagguugcaaugaguuaagau

SEQ ID NO: 968105 - RNA, 24 nt, Human
ggagguugcaaugaguuaagauug

SEQ ID NO: 968106 - RNA, 23 nt, Human
ggaucacuugaauccagcaguuc

SEQ ID NO: 968107 - RNA, 21 nt, Human
ggcaaaccccgucucugcuga

SEQ ID NO: 968108 - RNA, 22 nt, Human
ggcucacgccuguaauucccag

SEQ ID NO: 968109 - RNA, 25 nt, Human
gguggcucacgccuguaauucccag

SEQ ID NO: 968110 - RNA, 22 nt, Human
gguggugucuccauuuuacaga

SEQ ID NO: 968111 - RNA, 23 nt, Human
gguuugguggcucacgccuguaa

SEQ ID NO: 968112 - RNA, 18 nt, Human
gucauacaugccacuccc

SEQ ID NO: 968113 - RNA, 24 nt, Human
guggcucacgccuguaauucccag

SEQ ID NO: 968114 - RNA, 22 nt, Human
guuuggagccugugucccgccc

SEQ ID NO: 968115 - RNA, 19 nt, Human
uaaagagaaucgcuugaac

SEQ ID NO: 968116 - RNA, 22 nt, Human
uaaauaaauagauagauagaua

SEQ ID NO: 968117 - RNA, 22 nt, Human
uacaugccacucccagccaggc

SEQ ID NO: 968118 - RNA, 22 nt, Human
uagauagauagauaauuuaaca

SEQ ID NO: 968119 - RNA, 23 nt, Human
ucaaauaaauaaauaaauagaua

SEQ ID NO: 968120 - RNA, 23 nt, Human
ucacgccuguaauucccagcacu

SEQ ID NO: 968121 - RNA, 24 nt, Human
ucaggccggguuugguggcucacg

SEQ ID NO: 968122 - RNA, 20 nt, Human
uccucagccugcacccccuc

SEQ ID NO: 968123 - RNA, 24 nt, Human
ucgcuugaacccagaagguggagg

SEQ ID NO: 968124 - RNA, 21 nt, Human
ucuccauuuuacagaugagga

SEQ ID NO: 968125 - RNA, 18 nt, Human
ucucugcugaaaauacac

SEQ ID NO: 968126 - RNA, 19 nt, Human
ugaggacacugagacccag

SEQ ID NO: 968127 - RNA, 27 nt, Human
ugaggacacugagacccagaggguaau

SEQ ID NO: 968128 - RNA, 22 nt, Human
ugaguuaagauugcgccacugc

SEQ ID NO: 968129 - RNA, 22 nt, Human
ugcacccccucucugggcacug

SEQ ID NO: 968130 - RNA, 26 nt, Human
ugccagcccacgcccuguuacccauc

SEQ ID NO: 968131 - RNA, 21 nt, Human
ugcccugccucuuacaucaac

SEQ ID NO: 968132 - RNA, 23 nt, Human
ugccugcacgcgcccccuccaca

SEQ ID NO: 968133 - RNA, 21 nt, Human
ugcgccacugcacuccagccu

SEQ ID NO: 968134 - RNA, 19 nt, Human
ugcgcuaggaaacagcagg

SEQ ID NO: 968135 - RNA, 23 nt, Human
ugcugaaaauacacaaauuagcu

SEQ ID NO: 968136 - RNA, 21 nt, Human
uggagccugugucccgcccaa

SEQ ID NO: 968137 - RNA, 22 nt, Human
uggcucacgccuguaauuccca

SEQ ID NO: 968138 - RNA, 25 nt, Human
uggcucacgccuguaauucccagca

SEQ ID NO: 968139 - RNA, 19 nt, Human
ugggagacggagaugggcg

SEQ ID NO: 968140 - RNA, 24 nt, Human
ugggagacggagaugggcggauca

SEQ ID NO: 968141 - RNA, 23 nt, Human
ugggcagcuccucagccugcacc

SEQ ID NO: 968142 - RNA, 20 nt, Human
ugggcggaucacuugaaucc

SEQ ID NO: 968143 - RNA, 25 nt, Human
ugguggcucacgccuguaauuccca

SEQ ID NO: 968144 - RNA, 23 nt, Human
ugugagcggugcucugggcagcu

SEQ ID NO: 968145 - RNA, 18 nt, Human
uuagcugggcgugguggc

SEQ ID NO: 968146 - RNA, 20 nt, Human
uuagcugggcgugguggcgc

SEQ ID NO: 968147 - RNA, 20 nt, Human
uuagcugggcgugguggcgc

SEQ ID NO: 968148 - RNA, 24 nt, Human
uugaacccagaagguggagguugc

SEQ ID NO: 968149 - RNA, 20 nt, Human
uugcaaugaguuaagauugc

SEQ ID NO: 968150 - RNA, 22 nt, Human
uugcaaugaguuaagauugcgc

SEQ ID NO: 968151 - RNA, 23 nt, Human
uugcgccacugcacuccagccuu

SEQ ID NO: 968152 - RNA, 24 nt, Human
uuuacagaugaggacacugagacc

SEQ ID NO: 968153 - RNA, 18 nt, Human
uuucaagcuccaguuugg

SEQ ID NO: 968154 - RNA, 20 nt, Human
uuuucguuuguuuguuuuuu

SEQ ID NO: 968155 - RNA, 21 nt, Human
aaaccauagaaacacacuggc

SEQ ID NO: 968156 - RNA, 19 nt, Human
aaagucuuuucuccccacc

SEQ ID NO: 968157 - RNA, 21 nt, Human
aaaugccuuauaaaagaccau

SEQ ID NO: 968158 - RNA, 24 nt, Human
aaauguauggucagugaaacacag

SEQ ID NO: 968159 - RNA, 24 nt, Human
aacaaagucuuuuccaaccaacgg

SEQ ID NO: 968160 - RNA, 23 nt, Human
aacuuuuaaaagaauacuagcag

SEQ ID NO: 968161 - RNA, 18 nt, Human
aagaagaacaagaaccaa

SEQ ID NO: 968162 - RNA, 21 nt, Human
aagcuuuucaaucugaggaaa

SEQ ID NO: 968163 - RNA, 24 nt, Human
aaugcuuguaaaucugagacugac

SEQ ID NO: 968164 - RNA, 25 nt, Human
acccucaacauuucacgagaacauc

SEQ ID NO: 968165 - RNA, 18 nt, Human
acugugugcaaguaucag

SEQ ID NO: 968166 - RNA, 18 nt, Human
agaauaugauucuuacca

SEQ ID NO: 968167 - RNA, 23 nt, Human
agacugacuggacccacccagac

SEQ ID NO: 968168 - RNA, 22 nt, Human
aucaucuuuauaaagaauuuuu

SEQ ID NO: 968169 - RNA, 25 nt, Human
auucauaacucugugcuauauuacu

SEQ ID NO: 968170 - RNA, 22 nt, Human
caaaauagauggcucuccuccc

SEQ ID NO: 968171 - RNA, 21 nt, Human
caaagaucccacccuaaucca

SEQ ID NO: 968172 - RNA, 22 nt, Human
cacagagugccuuuaugaccag

SEQ ID NO: 968173 - RNA, 23 nt, Human
caccauuuuccauuacuguucuc

SEQ ID NO: 968174 - RNA, 21 nt, Human
cacccauuuccucugacucca

SEQ ID NO: 968175 - RNA, 22 nt, Human
cacccauuuccucugacuccag

SEQ ID NO: 968176 - RNA, 20 nt, Human
cagagcuccaccauggucuc

SEQ ID NO: 968177 - RNA, 18 nt, Human
cauaaacacagucugugc

SEQ ID NO: 968178 - RNA, 24 nt, Human
cauacucauucuguaguuuguaua

SEQ ID NO: 968179 - RNA, 22 nt, Human
cauacuuuuggcuauguucaca

SEQ ID NO: 968180 - RNA, 18 nt, Human
caucagaaaaacaugacg

SEQ ID NO: 968181 - RNA, 21 nt, Human
ccacauaaacacacugucaaa

SEQ ID NO: 968182 - RNA, 24 nt, Human
ccacccagacccagggcaaagaua

SEQ ID NO: 968183 - RNA, 25 nt, Human
ccauccagucugcgcuuuugacugu

SEQ ID NO: 968184 - RNA, 21 nt, Human
ccccaauaucuucacagagug

SEQ ID NO: 968185 - RNA, 23 nt, Human
ccccaauaucuucacagagugcc

SEQ ID NO: 968186 - RNA, 18 nt, Human
ccccgcgcccagggcucc

SEQ ID NO: 968187 - RNA, 18 nt, Human
ccuaauccaguucuaagg

SEQ ID NO: 968188 - RNA, 18 nt, Human
ccugaguggcugaguucu

SEQ ID NO: 968189 - RNA, 23 nt, Human
ccuuaaagucuuuucuccccacc

SEQ ID NO: 968190 - RNA, 23 nt, Human
ccuuauaaaagaccauccaucca

SEQ ID NO: 968191 - RNA, 21 nt, Human
ccuucuuuguuuucucacccc

SEQ ID NO: 968192 - RNA, 19 nt, Human
cggcacauacuuuuggcua

SEQ ID NO: 968193 - RNA, 18 nt, Human
cuaaaagcucaguuguaa

SEQ ID NO: 968194 - RNA, 19 nt, Human
cuacugcagccaggugaga

SEQ ID NO: 968195 - RNA, 22 nt, Human
cucuggaaggaaagcuccaaaa

SEQ ID NO: 968196 - RNA, 22 nt, Human
cugacuccagagcuccaccaug

SEQ ID NO: 968197 - RNA, 22 nt, Human
cugcagaagacagacuaaucca

SEQ ID NO: 968198 - RNA, 22 nt, Human
gaccauccauccagucugcgcu

SEQ ID NO: 968199 - RNA, 21 nt, Human
gagaagguaauuaguaagcac

SEQ ID NO: 968200 - RNA, 24 nt, Human
gcagaaccucaagggagccaagag

SEQ ID NO: 968201 - RNA, 20 nt, Human
gcagaagacagacuaaucca

SEQ ID NO: 968202 - RNA, 19 nt, Human
gccgcccccgcgcccaggg

SEQ ID NO: 968203 - RNA, 25 nt, Human
gcuguagagagguagcccaguucaa

SEQ ID NO: 968204 - RNA, 24 nt, Human
ggucaggaaggaaaaaauaauucc

SEQ ID NO: 968205 - RNA, 19 nt, Human
gucaucuugggcaugaagc

SEQ ID NO: 968206 - RNA, 18 nt, Human
gucuuuucuccccacccu

SEQ ID NO: 968207 - RNA, 22 nt, Human
gugaagaucaaaugcaauaacg

SEQ ID NO: 968208 - RNA, 22 nt, Human
uaaaagaauacuagcagcuuuu

SEQ ID NO: 968209 - RNA, 24 nt, Human
uaaaagaccauccauccagucugc

SEQ ID NO: 968210 - RNA, 23 nt, Human
uaaaagcagcagcuuugugcuga

SEQ ID NO: 968211 - RNA, 21 nt, Human
uaaaagcucaguuguaaccac

SEQ ID NO: 968212 - RNA, 18 nt, Human
uaaaaugcacuuucugug

SEQ ID NO: 968213 - RNA, 19 nt, Human
uaaaaugcacuuucuguga

SEQ ID NO: 968214 - RNA, 22 nt, Human
uaaacacagucugugcaacggc

SEQ ID NO: 968215 - RNA, 24 nt, Human
uaaaccauagaaacacacuggcuc

SEQ ID NO: 968216 - RNA, 19 nt, Human
uaacacugugaaguacaca

SEQ ID NO: 968217 - RNA, 18 nt, Human
uaacugaaaagguaggua

SEQ ID NO: 968218 - RNA, 18 nt, Human
uacacaugaaacaaaguc

SEQ ID NO: 968219 - RNA, 19 nt, Human
uacauguuaccauaucauc

SEQ ID NO: 968220 - RNA, 21 nt, Human
uagauggcucuccucccuuaa

SEQ ID NO: 968221 - RNA, 29 nt, Human
uaggaacaaaauagauggcucuccucccc

SEQ ID NO: 968222 - RNA, 25 nt, Human
uaggugucucuucauuuuauauuuc

SEQ ID NO: 968223 - RNA, 18 nt, Human
uaguaagcaccaccuagc

SEQ ID NO: 968224 - RNA, 18 nt, Human
uauaaaguacaauuguau

SEQ ID NO: 968225 - RNA, 18 nt, Human
uaucuccaucaaagugau

SEQ ID NO: 968226 - RNA, 24 nt, Human
uauggaugaagcuauucuaguuga

SEQ ID NO: 968227 - RNA, 19 nt, Human
ucaagggagccaagagcuc

SEQ ID NO: 968228 - RNA, 25 nt, Human
ucacacaguaaaccauagaaacaca

SEQ ID NO: 968229 - RNA, 19 nt, Human
ucagcuuuucaaagauccc

SEQ ID NO: 968230 - RNA, 24 nt, Human
ucaugucacauuuaagaagaacaa

SEQ ID NO: 968231 - RNA, 20 nt, Human
uccacagcuccugagauugc

SEQ ID NO: 968232 - RNA, 22 nt, Human
uccacagcuccugagauugccu

SEQ ID NO: 968233 - RNA, 22 nt, Human
uccauuacuguucucaccaaau

SEQ ID NO: 968234 - RNA, 29 nt, Human
uccccaauaucuucacagagugccuuuau

SEQ ID NO: 968235 - RNA, 22 nt, Human
uccucugacuccagagcuccac

SEQ ID NO: 968236 - RNA, 20 nt, Human
ucugaggaaaauccugagaa

SEQ ID NO: 968237 - RNA, 25 nt, Human
ucugugcaacggcacauacuuuugg

SEQ ID NO: 968238 - RNA, 20 nt, Human
ucuuuguuuucucaccccuc

SEQ ID NO: 968239 - RNA, 23 nt, Human
ugacuccagagcuccaccauggu

SEQ ID NO: 968240 - RNA, 23 nt, Human
ugacuccagagcuccaccauggu

SEQ ID NO: 968241 - RNA, 22 nt, Human
ugagaaagacagugugcuuugc

SEQ ID NO: 968242 - RNA, 20 nt, Human
ugaggaaacagcuguagaga

SEQ ID NO: 968243 - RNA, 18 nt, Human
ugauuugagauaaucaca

SEQ ID NO: 968244 - RNA, 19 nt, Human
uggacccacccagacccag

SEQ ID NO: 968245 - RNA, 18 nt, Human
uggcugaaguaaaagcag

SEQ ID NO: 968246 - RNA, 24 nt, Human
ugguaaggggaagaggcagauaug

SEQ ID NO: 968247 - RNA, 21 nt, Human
uguauggucagugaaacacag

SEQ ID NO: 968248 - RNA, 26 nt, Human
uguuuucucaccccucuuaacuucca

SEQ ID NO: 968249 - RNA, 20 nt, Human
uuaaaaugcacuuucuguga

SEQ ID NO: 968250 - RNA, 24 nt, Human
uucacgagaacaucaguucauaaa

SEQ ID NO: 968251 - RNA, 21 nt, Human
uuccucugacuccagagcucc

SEQ ID NO: 968252 - RNA, 21 nt, Human
uugggggcucagaugaacagc

SEQ ID NO: 968253 - RNA, 26 nt, Human
aaaaaaguaacacaguaaaagccaua

SEQ ID NO: 968254 - RNA, 20 nt, Human
aaacaucuaacuacagugau

SEQ ID NO: 968255 - RNA, 24 nt, Human
aaagcgcgugcgacuccagcccuc

SEQ ID NO: 968256 - RNA, 19 nt, Human
aaaugggagcauucaacaa

SEQ ID NO: 968257 - RNA, 24 nt, Human
aacaaaagcaacacuaguuaucac

SEQ ID NO: 968258 - RNA, 24 nt, Human
aagcagcgaggcccggccccagag

SEQ ID NO: 968259 - RNA, 21 nt, Human
aaggaaaauucagcuucccga

SEQ ID NO: 968260 - RNA, 19 nt, Human
aaggcaggaccuggcugug

SEQ ID NO: 968261 - RNA, 19 nt, Human
aagggcagcgaagacccag

SEQ ID NO: 968262 - RNA, 21 nt, Human
acagagcacgccucagaccag

SEQ ID NO: 968263 - RNA, 19 nt, Human
accccgcgggccuccgggc

SEQ ID NO: 968264 - RNA, 21 nt, Human
acuggagaggagggugggaag

SEQ ID NO: 968265 - RNA, 22 nt, Human
agaaucggcccccuccucccuc

SEQ ID NO: 968266 - RNA, 22 nt, Human
agacccaggggccaaacuggca

SEQ ID NO: 968267 - RNA, 19 nt, Human
agaccuccaaaccuacccc

SEQ ID NO: 968268 - RNA, 20 nt, Human
agaccuccaaaccuacccca

SEQ ID NO: 968269 - RNA, 24 nt, Human
agaggagggugggaagccaagggc

SEQ ID NO: 968270 - RNA, 18 nt, Human
agcaccccuccccuaucc

SEQ ID NO: 968271 - RNA, 23 nt, Human
agcacggagaaggcggcuggguc

SEQ ID NO: 968272 - RNA, 19 nt, Human
agcagcgccggaggagcgc

SEQ ID NO: 968273 - RNA, 22 nt, Human
agcccccuucugcacagcccau

SEQ ID NO: 968274 - RNA, 18 nt, Human
agcgcgugcgacuccagc

SEQ ID NO: 968275 - RNA, 22 nt, Human
aggaacaucacgggcggcucug

SEQ ID NO: 968276 - RNA, 20 nt, Human
aggagggugggaagccaagg

SEQ ID NO: 968277 - RNA, 19 nt, Human
agggcuccggagccgcggg

SEQ ID NO: 968278 - RNA, 21 nt, Human
auaaagauaacuugaugaaug

SEQ ID NO: 968279 - RNA, 18 nt, Human
caaagaacacaagaucaa

SEQ ID NO: 968280 - RNA, 22 nt, Human
caacccucuccuuuucauauug

SEQ ID NO: 968281 - RNA, 22 nt, Human
cacaagaucaauacugaggcag

SEQ ID NO: 968282 - RNA, 23 nt, Human
cacaagaucaauacugaggcagg

SEQ ID NO: 968283 - RNA, 18 nt, Human
cagacaggcgcuaaggac

SEQ ID NO: 968284 - RNA, 21 nt, Human
cagcccccuucugcacagccc

SEQ ID NO: 968285 - RNA, 23 nt, Human
cagcgaagacccaggggccaaac

SEQ ID NO: 968286 - RNA, 19 nt, Human
cagcgccggaggagcgcag

SEQ ID NO: 968287 - RNA, 18 nt, Human
cagcgggagagcucgacu

SEQ ID NO: 968288 - RNA, 18 nt, Human
caggucagggcccugggg

SEQ ID NO: 968289 - RNA, 19 nt, Human
cagugccugacccccuuag

SEQ ID NO: 968290 - RNA, 21 nt, Human
ccaaaccuaccccagccacac

SEQ ID NO: 968291 - RNA, 21 nt, Human
ccaaaccuaccccagccacac

SEQ ID NO: 968292 - RNA, 20 nt, Human
ccaaaccuaccccagccacc

SEQ ID NO: 968293 - RNA, 20 nt, Human
ccagcccucccucaggccca

SEQ ID NO: 968294 - RNA, 18 nt, Human
cccaccccgcgggccucc

SEQ ID NO: 968295 - RNA, 21 nt, Human
cccagguccccgggagacgga

SEQ ID NO: 968296 - RNA, 23 nt, Human
ccccaaggccccagcuccucucc

SEQ ID NO: 968297 - RNA, 23 nt, Human
ccccagccacaccugacgcuguc

SEQ ID NO: 968298 - RNA, 20 nt, Human
cccccuucugcacagcccau

SEQ ID NO: 968299 - RNA, 19 nt, Human
ccccgccugggccuaaagc

SEQ ID NO: 968300 - RNA, 21 nt, Human
ccccuaaaccagaaucggccc

SEQ ID NO: 968301 - RNA, 22 nt, Human
ccccuccucccucacuuguccc

SEQ ID NO: 968302 - RNA, 26 nt, Human
cccgcagugcccccagcgggagagcu

SEQ ID NO: 968303 - RNA, 21 nt, Human
cccgcgccccucuacccgccu

SEQ ID NO: 968304 - RNA, 18 nt, Human
cccuaggggaagggaacc

SEQ ID NO: 968305 - RNA, 21 nt, Human
cccucuccgaaucagccccaa

SEQ ID NO: 968306 - RNA, 18 nt, Human
ccgcauggacuaccuggg

SEQ ID NO: 968307 - RNA, 19 nt, Human
ccgcgccccacggcucggc

SEQ ID NO: 968308 - RNA, 21 nt, Human
ccgcgccccacggcucggcgg

SEQ ID NO: 968309 - RNA, 21 nt, Human
ccgcgccccucuacccgccuu

SEQ ID NO: 968310 - RNA, 21 nt, Human
ccggccccagagcacggagaa

SEQ ID NO: 968311 - RNA, 19 nt, Human
ccgggcuucaggcagcggg

SEQ ID NO: 968312 - RNA, 20 nt, Human
ccuccaaaccuaccccagcc

SEQ ID NO: 968313 - RNA, 23 nt, Human
ccuccgggccgccgggagccagg

SEQ ID NO: 968314 - RNA, 22 nt, Human
ccuccgggcuucaggcagcggg

SEQ ID NO: 968315 - RNA, 19 nt, Human
cgaaggcaccggggcgggg

SEQ ID NO: 968316 - RNA, 18 nt, Human
cgaaucagccccaacagg

SEQ ID NO: 968317 - RNA, 19 nt, Human
cgacccccgccugggccua

SEQ ID NO: 968318 - RNA, 24 nt, Human
cgccagcuccagcucugccuuggg

SEQ ID NO: 968319 - RNA, 21 nt, Human
cggcaagcgcggccuucccuc

SEQ ID NO: 968320 - RNA, 20 nt, Human
cggccccagagcacggagaa

SEQ ID NO: 968321 - RNA, 20 nt, Human
cggccgcccgcgccccacgg

SEQ ID NO: 968322 - RNA, 19 nt, Human
cuaaagcacuuucgcucuc

SEQ ID NO: 968323 - RNA, 18 nt, Human
cuccccuauccuggcccc

SEQ ID NO: 968324 - RNA, 20 nt, Human
cugaaggaugcagggggcug

SEQ ID NO: 968325 - RNA, 19 nt, Human
cugguccggggauggcugc

SEQ ID NO: 968326 - RNA, 21 nt, Human
cugguccggggauggcugcgc

SEQ ID NO: 968327 - RNA, 21 nt, Human
cuguugcgcuucuagucacau

SEQ ID NO: 968328 - RNA, 19 nt, Human
cuuccugauugaguaccug

SEQ ID NO: 968329 - RNA, 22 nt, Human
gacgcugucuggguggcgccag

SEQ ID NO: 968330 - RNA, 18 nt, Human
gacuugguguaacuggca

SEQ ID NO: 968331 - RNA, 23 nt, Human
gagacgaggccgggcuuagaaaa

SEQ ID NO: 968332 - RNA, 22 nt, Human
gagcaccccuccccuauccugg

SEQ ID NO: 968333 - RNA, 20 nt, Human
gaucaucuaaaacaaaagca

SEQ ID NO: 968334 - RNA, 19 nt, Human
gcagagcgaggaccgcggc

SEQ ID NO: 968335 - RNA, 19 nt, Human
gccagcuccagcucugccu

SEQ ID NO: 968336 - RNA, 20 nt, Human
gccaggacacgggcacaggg

SEQ ID NO: 968337 - RNA, 23 nt, Human
gcccucuccgaaucagccccaac

SEQ ID NO: 968338 - RNA, 19 nt, Human
gcccugcacauagaucauc

SEQ ID NO: 968339 - RNA, 22 nt, Human
gccuccccgcagugcccccagc

SEQ ID NO: 968340 - RNA, 20 nt, Human
gcgcggcgagggcuccggag

SEQ ID NO: 968341 - RNA, 21 nt, Human
gcucgcgucucugcagccgca

SEQ ID NO: 968342 - RNA, 23 nt, Human
gcugugguguucagagggagguc

SEQ ID NO: 968343 - RNA, 19 nt, Human
ggaaacuuugcucuugcca

SEQ ID NO: 968344 - RNA, 22 nt, Human
ggagacggcaagcgcggccuuc

SEQ ID NO: 968345 - RNA, 21 nt, Human
ggagugggaaggggaggaaug

SEQ ID NO: 968346 - RNA, 19 nt, Human
ggccaaacuggcacugagg

SEQ ID NO: 968347 - RNA, 18 nt, Human
ggcccuggggcuggaggu

SEQ ID NO: 968348 - RNA, 24 nt, Human
ggccgccgggagccagggagcagc

SEQ ID NO: 968349 - RNA, 21 nt, Human
ggcggcgcggccccugguccg

SEQ ID NO: 968350 - RNA, 20 nt, Human
ggcugguggagcggaagggc

SEQ ID NO: 968351 - RNA, 18 nt, Human
gggaagccaagggcgcgc

SEQ ID NO: 968352 - RNA, 18 nt, Human
gguggcggcgcggccccu

SEQ ID NO: 968353 - RNA, 25 nt, Human
guaacacaguaaaagccauaaagca

SEQ ID NO: 968354 - RNA, 20 nt, Human
gucaaggaaaauucagcuuc

SEQ ID NO: 968355 - RNA, 24 nt, Human
gucaaggaaaauucagcuucccga

SEQ ID NO: 968356 - RNA, 23 nt, Human
guggcgccagcuccagcucugcc

SEQ ID NO: 968357 - RNA, 20 nt, Human
uaaaagucacuugaauggac

SEQ ID NO: 968358 - RNA, 24 nt, Human
uaacaaauauugcacauguagcac

SEQ ID NO: 968359 - RNA, 20 nt, Human
uaagcagcgaggcccggccc

SEQ ID NO: 968360 - RNA, 22 nt, Human
uaauaguaauaaauacucuuga

SEQ ID NO: 968361 - RNA, 18 nt, Human
uacacugaaaauuaaagg

SEQ ID NO: 968362 - RNA, 20 nt, Human
uaccccagccacaccugacu

SEQ ID NO: 968363 - RNA, 23 nt, Human
ucagaauaaaagucacuugaaug

SEQ ID NO: 968364 - RNA, 20 nt, Human
uccaaaccuaccccagccaa

SEQ ID NO: 968365 - RNA, 20 nt, Human
ucccaccccgcgggccuccg

SEQ ID NO: 968366 - RNA, 23 nt, Human
ucccagauggugcuggaacgagc

SEQ ID NO: 968367 - RNA, 20 nt, Human
ucccgaggccucgccucccc

SEQ ID NO: 968368 - RNA, 22 nt, Human
ucccucacuugucccagggagg

SEQ ID NO: 968369 - RNA, 21 nt, Human
ucccucaggcccagguccccg

SEQ ID NO: 968370 - RNA, 21 nt, Human
uccgcgccuucucccaaccuu

SEQ ID NO: 968371 - RNA, 22 nt, Human
ucgacuauggcgagaagucugu

SEQ ID NO: 968372 - RNA, 23 nt, Human
ucuaacuacagugauuauaaaga

SEQ ID NO: 968373 - RNA, 19 nt, Human
ucugcagccgcaguggaag

SEQ ID NO: 968374 - RNA, 18 nt, Human
ucugggaggugcgugaga

SEQ ID NO: 968375 - RNA, 21 nt, Human
ugagcuggggaagccaaaggc

SEQ ID NO: 968376 - RNA, 18 nt, Human
ugaggagcucuggucucu

SEQ ID NO: 968377 - RNA, 19 nt, Human
ugcccuaggggaagggaac

SEQ ID NO: 968378 - RNA, 24 nt, Human
ugcccugcacauagaucaucuaaa

SEQ ID NO: 968379 - RNA, 22 nt, Human
ugccugacccccuuaguaaugu

SEQ ID NO: 968380 - RNA, 19 nt, Human
uggcagaccuccaaaccua

SEQ ID NO: 968381 - RNA, 19 nt, Human
uggccuccgggcuucaggc

SEQ ID NO: 968382 - RNA, 25 nt, Human
uggcugugguguucagagggguagc

SEQ ID NO: 968383 - RNA, 21 nt, Human
uuccugauugaguaccugaaa

SEQ ID NO: 968384 - RNA, 18 nt, Human
uucgcuguagcucugucu

SEQ ID NO: 968385 - RNA, 23 nt, Human
aaaaaaaagggaaaagaaaaugu

SEQ ID NO: 968386 - RNA, 18 nt, Human
aaaacaaaggccaugguc

SEQ ID NO: 968387 - RNA, 25 nt, Human
aaaacauacacuuauuguggcccuc

SEQ ID NO: 968388 - RNA, 25 nt, Human
aaaaggaacaggaagcccaugaggg

SEQ ID NO: 968389 - RNA, 18 nt, Human
aaagaaaauguagauuuc

SEQ ID NO: 968390 - RNA, 20 nt, Human
aacauggugaaacccugucu

SEQ ID NO: 968391 - RNA, 21 nt, Human
aacauggugaaacccugucuc

SEQ ID NO: 968392 - RNA, 22 nt, Human
aagacgaagacgauguacagaa

SEQ ID NO: 968393 - RNA, 20 nt, Human
aagcaaucugguugugcaga

SEQ ID NO: 968394 - RNA, 24 nt, Human
aagcagagguugcagugagccaag

SEQ ID NO: 968395 - RNA, 25 nt, Human
aagcagagguugcagugagccaaga

SEQ ID NO: 968396 - RNA, 19 nt, Human
aagcccaaaaggaacagga

SEQ ID NO: 968397 - RNA, 18 nt, Human
aagcuggucaggcagaug

SEQ ID NO: 968398 - RNA, 23 nt, Human
aagugacagcgggaggauggguc

SEQ ID NO: 968399 - RNA, 24 nt, Human
aauaauacaauaaaauauaaaaca

SEQ ID NO: 968400 - RNA, 18 nt, Human
aauugcuugaacucggga

SEQ ID NO: 968401 - RNA, 23 nt, Human
acaaggcgagacucugucucaaa

SEQ ID NO: 968402 - RNA, 24 nt, Human
acaaggcgagacucugucucaaaa

SEQ ID NO: 968403 - RNA, 23 nt, Human
accccaaagacagugaaaaaaga

SEQ ID NO: 968404 - RNA, 19 nt, Human
acuccagccugggugacaa

SEQ ID NO: 968405 - RNA, 23 nt, Human
acuccagccugggugacaaggcg

SEQ ID NO: 968406 - RNA, 25 nt, Human
acuggacuccagccugggugacaag

SEQ ID NO: 968407 - RNA, 18 nt, Human
agaacguucacuugaccc

SEQ ID NO: 968408 - RNA, 24 nt, Human
agacggguggaucacgaggucagg

SEQ ID NO: 968409 - RNA, 21 nt, Human
agacgugguccucagaaucca

SEQ ID NO: 968410 - RNA, 22 nt, Human
agagguugcagugagccaagau

SEQ ID NO: 968411 - RNA, 24 nt, Human
agagguugcagugagccaagauug

SEQ ID NO: 968412 - RNA, 25 nt, Human
agaugccaacagcugccagggagcc

SEQ ID NO: 968413 - RNA, 24 nt, Human
agauguauaagcccaaaaggaaca

SEQ ID NO: 968414 - RNA, 22 nt, Human
agcagcuccacgaagguccugg

SEQ ID NO: 968415 - RNA, 21 nt, Human
agcccaaaaggaacaggaagc

SEQ ID NO: 968416 - RNA, 22 nt, Human
agccuggccaacauggugaaac

SEQ ID NO: 968417 - RNA, 24 nt, Human
agccuggccaacauggugaaaccc

SEQ ID NO: 968418 - RNA, 24 nt, Human
agccugggugacaaggcgagacuc

SEQ ID NO: 968419 - RNA, 24 nt, Human
agcuggguggugguggugcaugcc

SEQ ID NO: 968420 - RNA, 21 nt, Human
aggaagcccaugagggauacc

SEQ ID NO: 968421 - RNA, 25 nt, Human
aggcagauggcagccacggguguuu

SEQ ID NO: 968422 - RNA, 24 nt, Human
aggcaggagaauugcuugaacucg

SEQ ID NO: 968423 - RNA, 24 nt, Human
aggcaugguggcucacgccuguaa

SEQ ID NO: 968424 - RNA, 29 nt, Human
aggcuagcaccauuccugaugacaggggu

SEQ ID NO: 968425 - RNA, 21 nt, Human
aggcugagacggguggaucac

SEQ ID NO: 968426 - RNA, 19 nt, Human
agggagaaguaagaguagu

SEQ ID NO: 968427 - RNA, 22 nt, Human
agggagaaguaagaguagucca

SEQ ID NO: 968428 - RNA, 24 nt, Human
aguacuuugggaggcugagacggg

SEQ ID NO: 968429 - RNA, 23 nt, Human
agugcagauggcgcccaggagga

SEQ ID NO: 968430 - RNA, 18 nt, Human
aguguauuauuuauuuuu

SEQ ID NO: 968431 - RNA, 20 nt, Human
auagagcucuucaaacuggg

SEQ ID NO: 968432 - RNA, 19 nt, Human
aucacgaggucaggaguuc

SEQ ID NO: 968433 - RNA, 21 nt, Human
aucacgaggucaggaguucga

SEQ ID NO: 968434 - RNA, 24 nt, Human
auugugccacuggacuccagccug

SEQ ID NO: 968435 - RNA, 18 nt, Human
caaaaaaaaaaaaaggga

SEQ ID NO: 968436 - RNA, 24 nt, Human
caaaaaaaaaaaaagggaaaagaa

SEQ ID NO: 968437 - RNA, 20 nt, Human
caaaaaauagcuggguggug

SEQ ID NO: 968438 - RNA, 26 nt, Human
caaaaacaaaggccauggucaccaag

SEQ ID NO: 968439 - RNA, 24 nt, Human
caacauggugaaacccugucucca

SEQ ID NO: 968440 - RNA, 24 nt, Human
cacgccuguaaucccaguacuuug

SEQ ID NO: 968441 - RNA, 24 nt, Human
cacuggacuccagccugggugaca

SEQ ID NO: 968442 - RNA, 25 nt, Human
cacuguacaugggacagcuccaaaa

SEQ ID NO: 968443 - RNA, 20 nt, Human
cagcgggaggaugggucuug

SEQ ID NO: 968444 - RNA, 18 nt, Human
cagcugccagggagccca

SEQ ID NO: 968445 - RNA, 20 nt, Human
caggcagauggcagccacgg

SEQ ID NO: 968446 - RNA, 24 nt, Human
caguacuuugggaggcugagacgg

SEQ ID NO: 968447 - RNA, 26 nt, Human
caguacuuugggaggcugagacgggu

SEQ ID NO: 968448 - RNA, 19 nt, Human
ccacaaaaacaaaggccau

SEQ ID NO: 968449 - RNA, 21 nt, Human
ccacaaaaacaaaggccaugg

SEQ ID NO: 968450 - RNA, 20 nt, Human
ccacuggacuccagccuggg

SEQ ID NO: 968451 - RNA, 20 nt, Human
ccacuggacuccagccuggg

SEQ ID NO: 968452 - RNA, 21 nt, Human
ccacuggacuccagccugggu

SEQ ID NO: 968453 - RNA, 21 nt, Human
ccacuggacuccagccugggu

SEQ ID NO: 968454 - RNA, 23 nt, Human
ccacuggacuccagccuggguga

SEQ ID NO: 968455 - RNA, 24 nt, Human
ccacuggacuccagccugggugac

SEQ ID NO: 968456 - RNA, 24 nt, Human
ccagcuacucagagcugaggcagg

SEQ ID NO: 968457 - RNA, 21 nt, Human
ccauaaaguccucccaugcag

SEQ ID NO: 968458 - RNA, 18 nt, Human
ccauggucaccaagcugg

SEQ ID NO: 968459 - RNA, 19 nt, Human
cccaaaaggaacaggaagc

SEQ ID NO: 968460 - RNA, 26 nt, Human
cccacaaaaacaaaggccauggucac

SEQ ID NO: 968461 - RNA, 21 nt, Human
ccgcugggaagaaaaccccaa

SEQ ID NO: 968462 - RNA, 21 nt, Human
ccuauaaucccagcuacucag

SEQ ID NO: 968463 - RNA, 18 nt, Human
ccucuuccucccccucuu

SEQ ID NO: 968464 - RNA, 20 nt, Human
ccucuuccucccccucuuuc

SEQ ID NO: 968465 - RNA, 22 nt, Human
ccuggccaacauggugaaaccc

SEQ ID NO: 968466 - RNA, 24 nt, Human
ccuggccaacauggugaaacccug

SEQ ID NO: 968467 - RNA, 22 nt, Human
ccugggugacaaggcgagacuc

SEQ ID NO: 968468 - RNA, 24 nt, Human
cgagaccagccuggccaacauggu

SEQ ID NO: 968469 - RNA, 18 nt, Human
cgcccaggaggaagacga

SEQ ID NO: 968470 - RNA, 23 nt, Human
cgccuguaaucccaguacuuugg

SEQ ID NO: 968471 - RNA, 24 nt, Human
cgccuguaaucccaguacuuuggg

SEQ ID NO: 968472 - RNA, 24 nt, Human
cgcugggaagaaaaccccaaagac

SEQ ID NO: 968473 - RNA, 24 nt, Human
cgggaagcagagguugcagugagc

SEQ ID NO: 968474 - RNA, 24 nt, Human
cuagcaccauuccugaugucaccc

SEQ ID NO: 968475 - RNA, 24 nt, Human
cucaaaaaaaaaaaaagggaaaag

SEQ ID NO: 968476 - RNA, 22 nt, Human
cucacgccuguaaucccaguac

SEQ ID NO: 968477 - RNA, 24 nt, Human
cucacgccuguaaucccaguacuu

SEQ ID NO: 968478 - RNA, 21 nt, Human
cucagagcugaggcaggagaa

SEQ ID NO: 968479 - RNA, 24 nt, Human
cucccccucuuucuuuuucauuga

SEQ ID NO: 968480 - RNA, 19 nt, Human
cucugucucaaaaaaaaaa

SEQ ID NO: 968481 - RNA, 25 nt, Human
cucuuccucuuccucccccucuucc

SEQ ID NO: 968482 - RNA, 22 nt, Human
cucuuucuuuuucauugaggag

SEQ ID NO: 968483 - RNA, 24 nt, Human
cuggccaacauggugaaacccugu

SEQ ID NO: 968484 - RNA, 20 nt, Human
cuggguggugguggugcaug

SEQ ID NO: 968485 - RNA, 23 nt, Human
gacccacaaaaacaaaggccaug

SEQ ID NO: 968486 - RNA, 19 nt, Human
gagauguauaagcccaaaa

SEQ ID NO: 968487 - RNA, 24 nt, Human
gagcugaggcaggagaauugcuug

SEQ ID NO: 968488 - RNA, 18 nt, Human
gagguugcagugagccaa

SEQ ID NO: 968489 - RNA, 24 nt, Human
gaucacgaggucaggaguucgaga

SEQ ID NO: 968490 - RNA, 19 nt, Human
gauggcagccacggguguu

SEQ ID NO: 968491 - RNA, 20 nt, Human
gauguauaagcccaaaagga

SEQ ID NO: 968492 - RNA, 24 nt, Human
gccaacauggugaaacccugucuc

SEQ ID NO: 968493 - RNA, 19 nt, Human
gccacuggacuccagccug

SEQ ID NO: 968494 - RNA, 24 nt, Human
gccacuggacuccagccuggguga

SEQ ID NO: 968495 - RNA, 19 nt, Human
gccauggucaccaagcugg

SEQ ID NO: 968496 - RNA, 27 nt, Human
gcuagcaccauuccugaugacaggggu

SEQ ID NO: 968497 - RNA, 20 nt, Human
ggaagcagagguugcaguga

SEQ ID NO: 968498 - RNA, 28 nt, Human
ggacagcuccaaaagaggagggaacgcc

SEQ ID NO: 968499 - RNA, 21 nt, Human
ggcccucugcacaagcaaucu

SEQ ID NO: 968500 - RNA, 20 nt, Human
ggcggcaggcucccugaggu

SEQ ID NO: 968501 - RNA, 21 nt, Human
ggcucacgccuguaaucccag

SEQ ID NO: 968502 - RNA, 23 nt, Human
gguggaucacgaggucaggaguu

SEQ ID NO: 968503 - RNA, 24 nt, Human
gguggcucacgccuguaaucccag

SEQ ID NO: 968504 - RNA, 24 nt, Human
gguggugcaugccuauaaucccag

SEQ ID NO: 968505 - RNA, 22 nt, Human
guaaaaauacaaaaaauagcug

SEQ ID NO: 968506 - RNA, 20 nt, Human
gucacccugggugagacgug

SEQ ID NO: 968507 - RNA, 24 nt, Human
guccaaagugacagcgggaggaug

SEQ ID NO: 968508 - RNA, 19 nt, Human
gucucaaaaaaaaaaaaag

SEQ ID NO: 968509 - RNA, 24 nt, Human
gugacaaggcgagacucugucuca

SEQ ID NO: 968510 - RNA, 23 nt, Human
guggaucacgaggucaggaguuc

SEQ ID NO: 968511 - RNA, 19 nt, Human
uagagcucuucaaacuggg

SEQ ID NO: 968512 - RNA, 24 nt, Human
uagcuggguggugguggugcaugc

SEQ ID NO: 968513 - RNA, 21 nt, Human
uaguaccuguauagagcucuu

SEQ ID NO: 968514 - RNA, 21 nt, Human
uauaagcccaaaaggaacagg

SEQ ID NO: 968515 - RNA, 24 nt, Human
ucacgaggucaggaguucgagacc

SEQ ID NO: 968516 - RNA, 22 nt, Human
ucacgccuguaaucccaguacu

SEQ ID NO: 968517 - RNA, 25 nt, Human
ucacuugacccacaaaaacaaaggc

SEQ ID NO: 968518 - RNA, 21 nt, Human
uccaaagugacagcgggagga

SEQ ID NO: 968519 - RNA, 19 nt, Human
uccagccugggugacaagg

SEQ ID NO: 968520 - RNA, 23 nt, Human
uccagccugggugacaaggcgag

SEQ ID NO: 968521 - RNA, 24 nt, Human
uccagccugggugacaaggcgaga

SEQ ID NO: 968522 - RNA, 20 nt, Human
ucccagacaggcaagugcag

SEQ ID NO: 968523 - RNA, 21 nt, Human
uccucccaugcaggaagccag

SEQ ID NO: 968524 - RNA, 19 nt, Human
ucgagugcagauggcgccc

SEQ ID NO: 968525 - RNA, 22 nt, Human
ucucaaaaaaaaaaaaagggaa

SEQ ID NO: 968526 - RNA, 24 nt, Human
ucuggccaggcaugguggcucacg

SEQ ID NO: 968527 - RNA, 23 nt, Human
ucugguugugcagagucuuggug

SEQ ID NO: 968528 - RNA, 21 nt, Human
ucugucucaaaaaaaaaaaaa

SEQ ID NO: 968529 - RNA, 22 nt, Human
ucugucucaaaaaaaaaaaaag

SEQ ID NO: 968530 - RNA, 21 nt, Human
ucuuccucccccucuuucuuu

SEQ ID NO: 968531 - RNA, 24 nt, Human
ucuuccucuuccucccccucuuuc

SEQ ID NO: 968532 - RNA, 24 nt, Human
ucuuucuuuuucauugaggaggcu

SEQ ID NO: 968533 - RNA, 18 nt, Human
ugaaaccauguucagggu

SEQ ID NO: 968534 - RNA, 21 nt, Human
ugacccacaaaaacaaaggcc

SEQ ID NO: 968535 - RNA, 22 nt, Human
ugacccacaaaaacaaaggcca

SEQ ID NO: 968536 - RNA, 24 nt, Human
ugagacggguggaucacgagguca

SEQ ID NO: 968537 - RNA, 21 nt, Human
ugagccaagauugugccacug

SEQ ID NO: 968538 - RNA, 24 nt, Human
ugagccaagauugugccacuggac

SEQ ID NO: 968539 - RNA, 23 nt, Human
ugaggcaggagaauugcuugaac

SEQ ID NO: 968540 - RNA, 25 nt, Human
ugaggcaggagaauugcuugaacuc

SEQ ID NO: 968541 - RNA, 19 nt, Human
ugcacugcaggaugcgggg

SEQ ID NO: 968542 - RNA, 18 nt, Human
ugccuauaaucccagcua

SEQ ID NO: 968543 - RNA, 19 nt, Human
ugcggggagcuccauaaag

SEQ ID NO: 968544 - RNA, 22 nt, Human
uggagaagcagcuccacgaagg

SEQ ID NO: 968545 - RNA, 22 nt, Human
uggaucacgaggucaggaguuc

SEQ ID NO: 968546 - RNA, 24 nt, Human
uggaucacgaggucaggaguucga

SEQ ID NO: 968547 - RNA, 24 nt, Human
uggccaacauggugaaacccuguc

SEQ ID NO: 968548 - RNA, 23 nt, Human
uggcggcaggcucccugaggucg

SEQ ID NO: 968549 - RNA, 22 nt, Human
uggcucacgccuguaaucccag

SEQ ID NO: 968550 - RNA, 24 nt, Human
uggcucacgccuguaaucccagua

SEQ ID NO: 968551 - RNA, 19 nt, Human
ugggaagaaaaccccaaag

SEQ ID NO: 968552 - RNA, 22 nt, Human
ugggaagaaaaccccaaagaca

SEQ ID NO: 968553 - RNA, 19 nt, Human
ugggaggcugagacgggug

SEQ ID NO: 968554 - RNA, 24 nt, Human
ugggaggcugagacggguggauca

SEQ ID NO: 968555 - RNA, 19 nt, Human
uggguccacuguacauggg

SEQ ID NO: 968556 - RNA, 22 nt, Human
uggugcaugccuauaaucccag

SEQ ID NO: 968557 - RNA, 24 nt, Human
ugguggcucacgccuguaauccca

SEQ ID NO: 968558 - RNA, 24 nt, Human
ugguggugcaugccuauaauccca

SEQ ID NO: 968559 - RNA, 22 nt, Human
ugucucaaaaaaaaaaaaaggg

SEQ ID NO: 968560 - RNA, 19 nt, Human
uguucuaagaaaacauaga

SEQ ID NO: 968561 - RNA, 20 nt, Human
uguuuggccccuucccuugu

SEQ ID NO: 968562 - RNA, 23 nt, Human
uucuguagcaguucgggugaaua

SEQ ID NO: 968563 - RNA, 22 nt, Human
uugcagugagccaagauugugc

SEQ ID NO: 968564 - RNA, 24 nt, Human
uugcuugaacucgggaagcagagg

SEQ ID NO: 968565 - RNA, 23 nt, Human
uugugccacuggacuccagccug

SEQ ID NO: 968566 - RNA, 24 nt, Human
uuucuucuucuuuucucuuccccu

SEQ ID NO: 968567 - RNA, 23 nt, Human
uuuuuuuuuuuuuugggugugga

SEQ ID NO: 968568 - RNA, 21 nt, Human
uuuuuuuuuuuuuuuuugggu

SEQ ID NO: 968569 - RNA, 24 nt, Human
uuuuuuuuuuuuuuuuuuuuuggg

SEQ ID NO: 968570 - RNA, 19 nt, Human
aaaaaaacuugaaauacca

SEQ ID NO: 968571 - RNA, 18 nt, Human
aaagguggaggagaucag

SEQ ID NO: 968572 - RNA, 21 nt, Human
acuucugucauuggagaaagg

SEQ ID NO: 968573 - RNA, 22 nt, Human
agaagaaaaaaaaugcuucaag

SEQ ID NO: 968574 - RNA, 22 nt, Human
agacaccaggccagcuccagca

SEQ ID NO: 968575 - RNA, 21 nt, Human
cagcaacacugcacaaguuuu

SEQ ID NO: 968576 - RNA, 19 nt, Human
ccuuacucucucucucucc

SEQ ID NO: 968577 - RNA, 27 nt, Human
cuuauaaaaaaaaaaacuugaaauacc

SEQ ID NO: 968578 - RNA, 22 nt, Human
gcauacccacagagaaugaucu

SEQ ID NO: 968579 - RNA, 22 nt, Human
uaaaaaaaaaaacuugaaauac

SEQ ID NO: 968580 - RNA, 22 nt, Human
uaaaucagcaccucaaaaauua

SEQ ID NO: 968581 - RNA, 19 nt, Human
uacucucucucucuccucg

SEQ ID NO: 968582 - RNA, 23 nt, Human
uauucugcaauuuugccucuaaa

SEQ ID NO: 968583 - RNA, 23 nt, Human
ucuaauccaguagaagaaaaaaa

SEQ ID NO: 968584 - RNA, 22 nt, Human
ugauaugcugcuaucucucuug

SEQ ID NO: 968585 - RNA, 24 nt, Human
uggagacaccaggccagcuccagc

SEQ ID NO: 968586 - RNA, 19 nt, Human
uuacucucucucucuccuc

SEQ ID NO: 968587 - RNA, 20 nt, Human
uugccucuaaaucagcaccu

SEQ ID NO: 968588 - RNA, 19 nt, Human
aaaacagagguaccagaac

SEQ ID NO: 968589 - RNA, 22 nt, Human
aaaacagagguaccagaacuga

SEQ ID NO: 968590 - RNA, 22 nt, Human
agaucauucacaguuuccaaag

SEQ ID NO: 968591 - RNA, 22 nt, Human
aggagcugcggggcuccuggcg

SEQ ID NO: 968592 - RNA, 19 nt, Human
aggcggccagcgcgcaggc

SEQ ID NO: 968593 - RNA, 23 nt, Human
aguggcagaaaaugguucuucua

SEQ ID NO: 968594 - RNA, 24 nt, Human
caaaauauuuccacuccuaaccaa

SEQ ID NO: 968595 - RNA, 24 nt, Human
ccccucaggcgccggagaagcgcg

SEQ ID NO: 968596 - RNA, 18 nt, Human
cuaaccaaacugcaaccc

SEQ ID NO: 968597 - RNA, 21 nt, Human
cuagugauaaggguucuauuu

SEQ ID NO: 968598 - RNA, 22 nt, Human
cugcaacccuuucaguauagcc

SEQ ID NO: 968599 - RNA, 20 nt, Human
gacaucauuaacaaacaaaa

SEQ ID NO: 968600 - RNA, 21 nt, Human
gaggagcugcggggcuccugg

SEQ ID NO: 968601 - RNA, 19 nt, Human
gccccuggcgggcgggcgg

SEQ ID NO: 968602 - RNA, 19 nt, Human
gcugcggggcuccuggcgg

SEQ ID NO: 968603 - RNA, 23 nt, Human
ggagccccuggcgggcgggcggg

SEQ ID NO: 968604 - RNA, 19 nt, Human
ggcgagggcggcggagccc

SEQ ID NO: 968605 - RNA, 18 nt, Human
ggcggcggagccccuggc

SEQ ID NO: 968606 - RNA, 18 nt, Human
ggcuggcagcgcgcaggc

SEQ ID NO: 968607 - RNA, 23 nt, Human
gggcgggcuggcagcgcgcaggc

SEQ ID NO: 968608 - RNA, 25 nt, Human
gggcgggcuggcagcgcgcaggcgg

SEQ ID NO: 968609 - RNA, 22 nt, Human
uaaaaggaaaggaaacuugcuu

SEQ ID NO: 968610 - RNA, 19 nt, Human
uauugugcuauuccuagga

SEQ ID NO: 968611 - RNA, 19 nt, Human
ucagacucauggaaacauc

SEQ ID NO: 968612 - RNA, 19 nt, Human
ucccggaggagcugcgggg

SEQ ID NO: 968613 - RNA, 18 nt, Human
uggcagcgcgcaggcggc

SEQ ID NO: 968614 - RNA, 24 nt, Human
uuaguggcagaaaaugguucuucu

SEQ ID NO: 968615 - RNA, 24 nt, Human
uucuucuagugauaaggguucuau

SEQ ID NO: 968616 - RNA, 20 nt, Human
uuguauaaaaggaaaggaaa

SEQ ID NO: 968617 - RNA, 22 nt, Human
uuucagacauguuuucauauac

SEQ ID NO: 968618 - RNA, 19 nt, Human
uuugcaauuuguauaaaag

SEQ ID NO: 968619 - RNA, 23 nt, Human
accccgccaccuucccccucaaa

SEQ ID NO: 968620 - RNA, 21 nt, Human
agcaccugcccugccagccug

SEQ ID NO: 968621 - RNA, 19 nt, Human
aggccccaugugagcccag

SEQ ID NO: 968622 - RNA, 20 nt, Human
aggcggggccccuggugagg

SEQ ID NO: 968623 - RNA, 24 nt, Human
aggcggggccccuggugaggaugc

SEQ ID NO: 968624 - RNA, 21 nt, Human
augacacgguucccaccccgc

SEQ ID NO: 968625 - RNA, 26 nt, Human
caccccgccaccuucccccucaaaac

SEQ ID NO: 968626 - RNA, 22 nt, Human
cacguugucucgaagcaugggu

SEQ ID NO: 968627 - RNA, 23 nt, Human
ccacccacacgcagguuuauuuc

SEQ ID NO: 968628 - RNA, 22 nt, Human
ccacccacccucccauuaaagu

SEQ ID NO: 968629 - RNA, 18 nt, Human
ccacccucccauuaaagu

SEQ ID NO: 968630 - RNA, 22 nt, Human
ccacgcagcaccugcccugcca

SEQ ID NO: 968631 - RNA, 18 nt, Human
ccaucuuccaggggugga

SEQ ID NO: 968632 - RNA, 23 nt, Human
cccagccguggcccugccugagc

SEQ ID NO: 968633 - RNA, 19 nt, Human
ccccaugugagcccagggu

SEQ ID NO: 968634 - RNA, 22 nt, Human
ccccgccaccuucccccucaaa

SEQ ID NO: 968635 - RNA, 24 nt, Human
ccccucaaaacacugaucgggcga

SEQ ID NO: 968636 - RNA, 19 nt, Human
cccugugccugccggcccc

SEQ ID NO: 968637 - RNA, 23 nt, Human
ccgcaggccaccugggagcagca

SEQ ID NO: 968638 - RNA, 19 nt, Human
ccgccaccuucccccucaa

SEQ ID NO: 968639 - RNA, 19 nt, Human
ccgccucaccugccgccgc

SEQ ID NO: 968640 - RNA, 22 nt, Human
ccgcugggccgccucagcccgc

SEQ ID NO: 968641 - RNA, 26 nt, Human
cugccagccugucugcggcccaccca

SEQ ID NO: 968642 - RNA, 21 nt, Human
cugcggcccacccacccuccc

SEQ ID NO: 968643 - RNA, 18 nt, Human
gagaacacuccacccaca

SEQ ID NO: 968644 - RNA, 21 nt, Human
gagaacacuccacccacacgc

SEQ ID NO: 968645 - RNA, 19 nt, Human
gagcauagcaguggccgca

SEQ ID NO: 968646 - RNA, 18 nt, Human
gagcccaggguaggacgg

SEQ ID NO: 968647 - RNA, 19 nt, Human
gccugccggccccgcccag

SEQ ID NO: 968648 - RNA, 23 nt, Human
gcuguccccaagacacucaagag

SEQ ID NO: 968649 - RNA, 19 nt, Human
ggcuucuguaccuccuccc

SEQ ID NO: 968650 - RNA, 19 nt, Human
ggugggcacaggccccaug

SEQ ID NO: 968651 - RNA, 22 nt, Human
gucugcggcccacccacccucc

SEQ ID NO: 968652 - RNA, 22 nt, Human
ucccaccccgccaccuuccccc

SEQ ID NO: 968653 - RNA, 25 nt, Human
ucccaccccgccaccuucccccuca

SEQ ID NO: 968654 - RNA, 18 nt, Human
ucgggcgacgauccgcug

SEQ ID NO: 968655 - RNA, 20 nt, Human
ugccggccccgcccagccac

SEQ ID NO: 968656 - RNA, 21 nt, Human
uggagagggccccacgcagca

SEQ ID NO: 968657 - RNA, 20 nt, Human
ugggagcagcaggcggggcc

SEQ ID NO: 968658 - RNA, 19 nt, Human
uggugaggaugccuuguaa

SEQ ID NO: 968659 - RNA, 21 nt, Human
uguaccuccucccugugccug

SEQ ID NO: 968660 - RNA, 22 nt, Human
ugucucgaagcauggguuucca

SEQ ID NO: 968661 - RNA, 21 nt, Human
uucccaccccgccaccuuccc

SEQ ID NO: 968662 - RNA, 19 nt, Human
uugguuccgccucaccugc

SEQ ID NO: 968663 - RNA, 24 nt, Human
aaagagcgagacuccgucucaaaa

SEQ ID NO: 968664 - RNA, 18 nt, Human
aacauggugaaaccccgc

SEQ ID NO: 968665 - RNA, 20 nt, Human
aacauggugaaaccccgccu

SEQ ID NO: 968666 - RNA, 21 nt, Human
aacauggugaaaccccgccuc

SEQ ID NO: 968667 - RNA, 23 nt, Human
aaggcgggcggaucacgagguca

SEQ ID NO: 968668 - RNA, 25 nt, Human
aaucccuugaacccaggaggcggag

SEQ ID NO: 968669 - RNA, 18 nt, Human
aauguuacucuuuuucua

SEQ ID NO: 968670 - RNA, 24 nt, Human
accccgccucuacuaaaaauacaa

SEQ ID NO: 968671 - RNA, 18 nt, Human
acugcacuccagccuggg

SEQ ID NO: 968672 - RNA, 24 nt, Human
acugcacuccagccugggcgaaag

SEQ ID NO: 968673 - RNA, 26 nt, Human
acugcacuccagccugggcgaaagag

SEQ ID NO: 968674 - RNA, 24 nt, Human
agccugggcgaaagagcgagacuc

SEQ ID NO: 968675 - RNA, 23 nt, Human
agcugggugugguggcgugugcc

SEQ ID NO: 968676 - RNA, 23 nt, Human
aggcaggagaaucccuugaaccc

SEQ ID NO: 968677 - RNA, 24 nt, Human
aggcaggagaaucccuugaaccca

SEQ ID NO: 968678 - RNA, 21 nt, Human
aggcggagauuacagugagcc

SEQ ID NO: 968679 - RNA, 24 nt, Human
aggcggagauuacagugagccgag

SEQ ID NO: 968680 - RNA, 24 nt, Human
aggcgggcggaucacgaggucagg

SEQ ID NO: 968681 - RNA, 24 nt, Human
aggcugaggcaggagaaucccuug

SEQ ID NO: 968682 - RNA, 23 nt, Human
aguggcucaugccuguaauccca

SEQ ID NO: 968683 - RNA, 24 nt, Human
aguggcucaugccuguaaucccag

SEQ ID NO: 968684 - RNA, 21 nt, Human
auaaacuuuuggagggagcau

SEQ ID NO: 968685 - RNA, 19 nt, Human
augccuguaaucccagcac

SEQ ID NO: 968686 - RNA, 24 nt, Human
auugcgccacugcacuccagccug

SEQ ID NO: 968687 - RNA, 18 nt, Human
caccguuuucuggaaugu

SEQ ID NO: 968688 - RNA, 23 nt, Human
cacuccagccugggcgaaagagc

SEQ ID NO: 968689 - RNA, 24 nt, Human
cacuccagccugggcgaaagagcg

SEQ ID NO: 968690 - RNA, 19 nt, Human
cacugcacuccagccuggg

SEQ ID NO: 968691 - RNA, 20 nt, Human
cacugcacuccagccugggc

SEQ ID NO: 968692 - RNA, 22 nt, Human
cacugcacuccagccugggcga

SEQ ID NO: 968693 - RNA, 23 nt, Human
cacugcacuccagccugggcgaa

SEQ ID NO: 968694 - RNA, 24 nt, Human
cacugcacuccagccugggcgaaa

SEQ ID NO: 968695 - RNA, 18 nt, Human
cacuuuggaggacaaggc

SEQ ID NO: 968696 - RNA, 23 nt, Human
cacuuuggaggacaaggcgggcg

SEQ ID NO: 968697 - RNA, 21 nt, Human
cagcacuuuggaggacaaggc

SEQ ID NO: 968698 - RNA, 23 nt, Human
cagcacuuuggaggacaaggcgg

SEQ ID NO: 968699 - RNA, 24 nt, Human
cagcuacuugggaggcugaggcag

SEQ ID NO: 968700 - RNA, 24 nt, Human
caugccuguaaucccagcacuuug

SEQ ID NO: 968701 - RNA, 20 nt, Human
ccacugcacuccagccuggg

SEQ ID NO: 968702 - RNA, 20 nt, Human
ccacugcacuccagccuggg

SEQ ID NO: 968703 - RNA, 21 nt, Human
ccacugcacuccagccugggc

SEQ ID NO: 968704 - RNA, 21 nt, Human
ccacugcacuccagccugggc

SEQ ID NO: 968705 - RNA, 22 nt, Human
ccacugcacuccagccugggcg

SEQ ID NO: 968706 - RNA, 22 nt, Human
ccuggcuaacauggugaaaccc

SEQ ID NO: 968707 - RNA, 23 nt, Human
ccuggcuaacauggugaaacccc

SEQ ID NO: 968708 - RNA, 24 nt, Human
ccuggcuaacauggugaaaccccg

SEQ ID NO: 968709 - RNA, 22 nt, Human
ccugggcgaaagagcgagacuc

SEQ ID NO: 968710 - RNA, 21 nt, Human
ccuguagucccagcuacuugg

SEQ ID NO: 968711 - RNA, 18 nt, Human
cucaaaaaaaaaaaaaaa

SEQ ID NO: 968712 - RNA, 23 nt, Human
cucaugccuguaaucccagcacu

SEQ ID NO: 968713 - RNA, 24 nt, Human
cucaugccuguaaucccagcacuu

SEQ ID NO: 968714 - RNA, 19 nt, Human
cuccgucucaaaaaaaaaa

SEQ ID NO: 968715 - RNA, 20 nt, Human
cucuacuaaaaauacaaaaa

SEQ ID NO: 968716 - RNA, 21 nt, Human
cucuacuaaaaauacaaaaaa

SEQ ID NO: 968717 - RNA, 23 nt, Human
cucuucuauuuuaaaugcagaag

SEQ ID NO: 968718 - RNA, 19 nt, Human
gaaaccccgccucuacuaa

SEQ ID NO: 968719 - RNA, 21 nt, Human
gaaagagcgagacuccgucuc

SEQ ID NO: 968720 - RNA, 19 nt, Human
gacaaggcgggcggaucac

SEQ ID NO: 968721 - RNA, 23 nt, Human
gagaccauccuggcuaacauggu

SEQ ID NO: 968722 - RNA, 23 nt, Human
gagauuacagugagccgagauug

SEQ ID NO: 968723 - RNA, 23 nt, Human
gagauugcgccacugcacuccag

SEQ ID NO: 968724 - RNA, 19 nt, Human
gagcgagacuccgucucaa

SEQ ID NO: 968725 - RNA, 22 nt, Human
gcaggagaaucccuugaaccca

SEQ ID NO: 968726 - RNA, 22 nt, Human
gccacugcacuccagccugggc

SEQ ID NO: 968727 - RNA, 24 nt, Human
gccacugcacuccagccugggcga

SEQ ID NO: 968728 - RNA, 24 nt, Human
gcgcccaguggcucaugccuguaa

SEQ ID NO: 968729 - RNA, 22 nt, Human
gcgugugccuguagucccagcu

SEQ ID NO: 968730 - RNA, 24 nt, Human
gcuaacauggugaaaccccgccuc

SEQ ID NO: 968731 - RNA, 21 nt, Human
ggagaaucccuugaacccagg

SEQ ID NO: 968732 - RNA, 22 nt, Human
ggagauuacagugagccgagau

SEQ ID NO: 968733 - RNA, 21 nt, Human
ggaggcggagauuacagugag

SEQ ID NO: 968734 - RNA, 21 nt, Human
ggcggaucacgaggucaggag

SEQ ID NO: 968735 - RNA, 22 nt, Human
uaacauggugaaaccccgccuc

SEQ ID NO: 968736 - RNA, 24 nt, Human
uaacauggugaaaccccgccucua

SEQ ID NO: 968737 - RNA, 24 nt, Human
uaaguaauacaaagaaaguaagga

SEQ ID NO: 968738 - RNA, 20 nt, Human
ucaaaaaaaaaaaaaaaaaa

SEQ ID NO: 968739 - RNA, 21 nt, Human
ucaaaaaaaaaaaaaaaaaaa

SEQ ID NO: 968740 - RNA, 24 nt, Human
ucacgaggucaggagauggagacc

SEQ ID NO: 968741 - RNA, 23 nt, Human
uccacagauggggcaauuaagga

SEQ ID NO: 968742 - RNA, 23 nt, Human
uccagccugggcgaaagagcgag

SEQ ID NO: 968743 - RNA, 24 nt, Human
uccagccugggcgaaagagcgaga

SEQ ID NO: 968744 - RNA, 23 nt, Human
uccgucucaaaaaaaaaaaaaaa

SEQ ID NO: 968745 - RNA, 24 nt, Human
ucuggccgcgcccaguggcucaug

SEQ ID NO: 968746 - RNA, 26 nt, Human
ugacugaauuaccauggcguaauuga

SEQ ID NO: 968747 - RNA, 22 nt, Human
ugagccgagauugcgccacugc

SEQ ID NO: 968748 - RNA, 19 nt, Human
ugaggcaggagaaucccuu

SEQ ID NO: 968749 - RNA, 24 nt, Human
ugaggcaggagaaucccuugaacc

SEQ ID NO: 968750 - RNA, 25 nt, Human
ugaggcaggagaaucccuugaaccc

SEQ ID NO: 968751 - RNA, 18 nt, Human
ugccuguaaucccagcac

SEQ ID NO: 968752 - RNA, 23 nt, Human
ugccuguagucccagcuacuugg

SEQ ID NO: 968753 - RNA, 24 nt, Human
ugccuguagucccagcuacuuggg

SEQ ID NO: 968754 - RNA, 19 nt, Human
ugcugcauugugaaaacaa

SEQ ID NO: 968755 - RNA, 24 nt, Human
uggccgcgcccaguggcucaugcc

SEQ ID NO: 968756 - RNA, 24 nt, Human
uggcucaugccuguaaucccagca

SEQ ID NO: 968757 - RNA, 18 nt, Human
ugggaggcugaggcagga

SEQ ID NO: 968758 - RNA, 19 nt, Human
ugggaggcugaggcaggag

SEQ ID NO: 968759 - RNA, 18 nt, Human
ugggugugguggcgugug

SEQ ID NO: 968760 - RNA, 24 nt, Human
ugguggcgugugccuguaguccca

SEQ ID NO: 968761 - RNA, 18 nt, Human
uguguuucuuucaagcuu

SEQ ID NO: 968762 - RNA, 25 nt, Human
uuaaauacuaacaauacagguugcu

SEQ ID NO: 968763 - RNA, 22 nt, Human
uuacagugagccgagauugcgc

SEQ ID NO: 968764 - RNA, 19 nt, Human
uuagcugggugugguggcg

SEQ ID NO: 968765 - RNA, 20 nt, Human
uuagcugggugugguggcgu

SEQ ID NO: 968766 - RNA, 24 nt, Human
uuagcugggugugguggcgugugc

SEQ ID NO: 968767 - RNA, 23 nt, Human
uugcgccacugcacuccagccug

SEQ ID NO: 968768 - RNA, 21 nt, Human
aggcucagagguggucaacaa

SEQ ID NO: 968769 - RNA, 22 nt, Human
ccagcagggaagugcucuuuuc

SEQ ID NO: 968770 - RNA, 22 nt, Human
ccaggaccaagggcaaugcagc

SEQ ID NO: 968771 - RNA, 20 nt, Human
cccccgagcgcggcguccug

SEQ ID NO: 968772 - RNA, 22 nt, Human
cggcccgggccggucgcgacga

SEQ ID NO: 968773 - RNA, 21 nt, Human
cuuggccucugccccagcagg

SEQ ID NO: 968774 - RNA, 19 nt, Human
gcugccgacgcugccacgg

SEQ ID NO: 968775 - RNA, 20 nt, Human
gcugcugccuguguucccca

SEQ ID NO: 968776 - RNA, 19 nt, Human
ggcagagaggugauggggc

SEQ ID NO: 968777 - RNA, 19 nt, Human
ggccagggcucuggcuugg

SEQ ID NO: 968778 - RNA, 23 nt, Human
ggccagggcucuggcuuggccuc

SEQ ID NO: 968779 - RNA, 18 nt, Human
gggcagagaggugauggg

SEQ ID NO: 968780 - RNA, 23 nt, Human
gggcucuggcuuggccucugccc

SEQ ID NO: 968781 - RNA, 20 nt, Human
ggggcaggcaggcccaggac

SEQ ID NO: 968782 - RNA, 18 nt, Human
guccugcggcccgggccg

SEQ ID NO: 968783 - RNA, 18 nt, Human
ucagagguggucaacaau

SEQ ID NO: 968784 - RNA, 26 nt, Human
uccagacucaagcagggcagagaggu

SEQ ID NO: 968785 - RNA, 19 nt, Human
ugauggggccagggcucug

SEQ ID NO: 968786 - RNA, 24 nt, Human
ugcagcuuccaggcagggaggucc

SEQ ID NO: 968787 - RNA, 21 nt, Human
uggcggagagguggcucagcu

SEQ ID NO: 968788 - RNA, 22 nt, Human
uggcuuggccucugccccagca

SEQ ID NO: 968789 - RNA, 21 nt, Human
uucacugccaauguggcugcu

SEQ ID NO: 968790 - RNA, 21 nt, Human
uuuuucaaggcucagaggugg

SEQ ID NO: 968791 - RNA, 24 nt, Human
aaaaaaaaaaagcuuaaaacaaaa

SEQ ID NO: 968792 - RNA, 26 nt, Human
aaaaaaaaagcuuaaaacaaaacaaa

SEQ ID NO: 968793 - RNA, 24 nt, Human
aaaaaagaaaaucauuuaucccac

SEQ ID NO: 968794 - RNA, 26 nt, Human
aaaaacaagcaaaaaaaaaaagcuua

SEQ ID NO: 968795 - RNA, 18 nt, Human
aaacaaaacaaaacaaaa

SEQ ID NO: 968796 - RNA, 22 nt, Human
aaacaaaacaaaacaaaacaaa

SEQ ID NO: 968797 - RNA, 26 nt, Human
aaacaaaacaaaacaaaagcgaagcc

SEQ ID NO: 968798 - RNA, 20 nt, Human
aagcaaaaaaaaaaagcuua

SEQ ID NO: 968799 - RNA, 23 nt, Human
aaucuguagucccagccacuugg

SEQ ID NO: 968800 - RNA, 21 nt, Human
acaaaacaaaacaaaacaaaa

SEQ ID NO: 968801 - RNA, 18 nt, Human
acaaaacaaaacaaaagc

SEQ ID NO: 968802 - RNA, 20 nt, Human
acaaaacaaaacaaaagcga

SEQ ID NO: 968803 - RNA, 25 nt, Human
acaagcaaaaaaaaaaagcuuaaaa

SEQ ID NO: 968804 - RNA, 26 nt, Human
acagagcaagacccugucaaguuaga

SEQ ID NO: 968805 - RNA, 21 nt, Human
accacuuugccaguucauguc

SEQ ID NO: 968806 - RNA, 21 nt, Human
accccaucccucuccagccaa

SEQ ID NO: 968807 - RNA, 22 nt, Human
acugcacucuugccugaaugac

SEQ ID NO: 968808 - RNA, 24 nt, Human
acugcacucuugccugaaugacag

SEQ ID NO: 968809 - RNA, 26 nt, Human
acugcacucuugccugaaugacagag

SEQ ID NO: 968810 - RNA, 19 nt, Human
agaaagaaaagaaaaaaag

SEQ ID NO: 968811 - RNA, 18 nt, Human
agacaagaccauaggaag

SEQ ID NO: 968812 - RNA, 22 nt, Human
aggugggaggauugcuugaguu

SEQ ID NO: 968813 - RNA, 24 nt, Human
aucacacuacugcacucuugccug

SEQ ID NO: 968814 - RNA, 22 nt, Human
caaaacaaaacaaaacaaaagc

SEQ ID NO: 968815 - RNA, 18 nt, Human
caaaacaaaacaaaagcg

SEQ ID NO: 968816 - RNA, 21 nt, Human
caccccaucccucuccagcca

SEQ ID NO: 968817 - RNA, 23 nt, Human
cacucuugccugaaugacagagc

SEQ ID NO: 968818 - RNA, 22 nt, Human
cacuuugccaguucaugucacu

SEQ ID NO: 968819 - RNA, 18 nt, Human
cccaucccucuccagcca

SEQ ID NO: 968820 - RNA, 20 nt, Human
ccucugccuccuuguguccc

SEQ ID NO: 968821 - RNA, 27 nt, Human
ccucugccuccuuguguccccguuggg

SEQ ID NO: 968822 - RNA, 18 nt, Human
cuacugcacucuugccug

SEQ ID NO: 968823 - RNA, 21 nt, Human
cuacugcacucuugccugaau

SEQ ID NO: 968824 - RNA, 22 nt, Human
cuccucugccuccuuguguccc

SEQ ID NO: 968825 - RNA, 25 nt, Human
cucuucacauacacauucccuuuaa

SEQ ID NO: 968826 - RNA, 21 nt, Human
cuguagucccagccacuuggg

SEQ ID NO: 968827 - RNA, 18 nt, Human
gaaccaaagagucuuucu

SEQ ID NO: 968828 - RNA, 21 nt, Human
gaggugggaggauugcuugag

SEQ ID NO: 968829 - RNA, 20 nt, Human
gcccaccccaucccucucca

SEQ ID NO: 968830 - RNA, 23 nt, Human
gcggcaguaagaagugaucacac

SEQ ID NO: 968831 - RNA, 23 nt, Human
ggcugaggugggaggauugcuug

SEQ ID NO: 968832 - RNA, 20 nt, Human
ggcuggaagcuugaggcggc

SEQ ID NO: 968833 - RNA, 24 nt, Human
uaaaacaaaacaaaacaaaacaaa

SEQ ID NO: 968834 - RNA, 24 nt, Human
uaaaacaaaacaaaacaaaacaaa

SEQ ID NO: 968835 - RNA, 19 nt, Human
uaagaagugaucacacuac

SEQ ID NO: 968836 - RNA, 18 nt, Human
uaggaagaaagaaaagaa

SEQ ID NO: 968837 - RNA, 19 nt, Human
uaggaagaaagaaaagaaa

SEQ ID NO: 968838 - RNA, 21 nt, Human
ucaggagaguaguuuauucag

SEQ ID NO: 968839 - RNA, 18 nt, Human
ucccagccacuugggugg

SEQ ID NO: 968840 - RNA, 20 nt, Human
uccccguugggcccacccca

SEQ ID NO: 968841 - RNA, 25 nt, Human
ucuguagucccagccacuugggugg

SEQ ID NO: 968842 - RNA, 20 nt, Human
ugaaagcuuuuaaaaccacu

SEQ ID NO: 968843 - RNA, 19 nt, Human
ugaaaguggaguagagggg

SEQ ID NO: 968844 - RNA, 25 nt, Human
ugaaugacagagcaagacccuguca

SEQ ID NO: 968845 - RNA, 20 nt, Human
ugaggugggaggauugcuug

SEQ ID NO: 968846 - RNA, 22 nt, Human
ugaggugggaggauugcuugag

SEQ ID NO: 968847 - RNA, 23 nt, Human
ugaggugggaggauugcuugagu

SEQ ID NO: 968848 - RNA, 30 nt, Human
ugaggugggaggauugcuugaguugaggcc

SEQ ID NO: 968849 - RNA, 18 nt, Human
uggguggcugagguggga

SEQ ID NO: 968850 - RNA, 22 nt, Human
uggguggcugaggugggaggau

SEQ ID NO: 968851 - RNA, 21 nt, Human
uucagacaagaccauaggaag

SEQ ID NO: 968852 - RNA, 21 nt, Human
uugaaaguggaguagaggggu

SEQ ID NO: 968853 - RNA, 19 nt, Human
uugcuugaguugaggcugg

SEQ ID NO: 968854 - RNA, 25 nt, Human
uuggguggcugaggugggaggauug

SEQ ID NO: 968855 - RNA, 19 nt, Human
accaggcucucugagacaa

SEQ ID NO: 968856 - RNA, 21 nt, Human
accccacccagagcacccuga

SEQ ID NO: 968857 - RNA, 23 nt, Human
agacguggaccccgggagugacc

SEQ ID NO: 968858 - RNA, 21 nt, Human
agcugagcuuuaucaccaguu

SEQ ID NO: 968859 - RNA, 21 nt, Human
aggacgaggggaggacgacgg

SEQ ID NO: 968860 - RNA, 22 nt, Human
agggaggcaguucccagacacc

SEQ ID NO: 968861 - RNA, 20 nt, Human
cacuggcgauggggcagggc

SEQ ID NO: 968862 - RNA, 18 nt, Human
ccaccccacccagagcac

SEQ ID NO: 968863 - RNA, 24 nt, Human
ccaccccagaccagccucccagcg

SEQ ID NO: 968864 - RNA, 20 nt, Human
ccaggcucucugagacaaga

SEQ ID NO: 968865 - RNA, 21 nt, Human
ccucugcaggcucccucugaa

SEQ ID NO: 968866 - RNA, 20 nt, Human
cuggcgauggggcagggccu

SEQ ID NO: 968867 - RNA, 19 nt, Human
gcacagaugagggaggcag

SEQ ID NO: 968868 - RNA, 21 nt, Human
gcagggccuggcggaacuugg

SEQ ID NO: 968869 - RNA, 22 nt, Human
gggcagggccuggcggaacuug

SEQ ID NO: 968870 - RNA, 25 nt, Human
gggcagggccuggcggaacuugggg

SEQ ID NO: 968871 - RNA, 24 nt, Human
gugaccaccccagaccagccuccc

SEQ ID NO: 968872 - RNA, 26 nt, Human
ucacugggccaccccacccagagcac

SEQ ID NO: 968873 - RNA, 24 nt, Human
ucccaagucuccuucuccugcaaa

SEQ ID NO: 968874 - RNA, 18 nt, Human
ucugcaggcucccucuga

SEQ ID NO: 968875 - RNA, 18 nt, Human
ucugcaggcucccucuga

SEQ ID NO: 968876 - RNA, 22 nt, Human
ugaccaccccagaccagccucc

SEQ ID NO: 968877 - RNA, 23 nt, Human
ugccucccaagucuccuucuccu

SEQ ID NO: 968878 - RNA, 23 nt, Human
uggagcccagacguggaccccgg

SEQ ID NO: 968879 - RNA, 18 nt, Human
uuaucaccaguuuccugu

SEQ ID NO: 968880 - RNA, 18 nt, Human
uugcuccauagcagcuuc

SEQ ID NO: 968881 - RNA, 20 nt, Human
uuuuuuuuuuuuuuuuuugg

SEQ ID NO: 968882 - RNA, 24 nt, Human
uuuuuuuuuuuuuuuuuugucguu

SEQ ID NO: 968883 - RNA, 22 nt, Human
acaggaaaaaaaaaucuuuuca

SEQ ID NO: 968884 - RNA, 22 nt, Human
cacaggaaaaaaaaaucuuuuc

SEQ ID NO: 968885 - RNA, 23 nt, Human
cacccuuggccuugugguggcuc

SEQ ID NO: 968886 - RNA, 22 nt, Human
cacgcccugaauguugggcagg

SEQ ID NO: 968887 - RNA, 22 nt, Human
cagcacggccgccagguacacc

SEQ ID NO: 968888 - RNA, 18 nt, Human
caggaucucggcggucag

SEQ ID NO: 968889 - RNA, 21 nt, Human
cauuguguuucuccucuccua

SEQ ID NO: 968890 - RNA, 18 nt, Human
ccuugugguggcucuugg

SEQ ID NO: 968891 - RNA, 27 nt, Human
cgccagguacaccugcgcucuggcccc

SEQ ID NO: 968892 - RNA, 22 nt, Human
cucggcggucaggugcuccagc

SEQ ID NO: 968893 - RNA, 21 nt, Human
cucucaaaaaaaagucugaau

SEQ ID NO: 968894 - RNA, 20 nt, Human
cugugggacucaacucuguc

SEQ ID NO: 968895 - RNA, 25 nt, Human
cuugugguggcucuuggucuucugg

SEQ ID NO: 968896 - RNA, 22 nt, Human
gagccacaggaaaaaaaaaucu

SEQ ID NO: 968897 - RNA, 18 nt, Human
gccacaggaaaaaaaaau

SEQ ID NO: 968898 - RNA, 18 nt, Human
gcgaauggccagcuacag

SEQ ID NO: 968899 - RNA, 24 nt, Human
gcugugggacucaacucugucuug

SEQ ID NO: 968900 - RNA, 19 nt, Human
gugggacucaacucugucu

SEQ ID NO: 968901 - RNA, 24 nt, Human
ucuggggcagaagcacgcccugaa

SEQ ID NO: 968902 - RNA, 21 nt, Human
ucuugugcguucuugcucucc

SEQ ID NO: 968903 - RNA, 23 nt, Human
uugguggccauuguguuucuccu

SEQ ID NO: 968904 - RNA, 25 nt, Human
uuuuauucaucuuacauuucucuca

SEQ ID NO: 968905 - RNA, 19 nt, Human
aaaaugccucuuccccacc

SEQ ID NO: 968906 - RNA, 28 nt, Human
aaaaugccucuuccccaccuaaaauucu

SEQ ID NO: 968907 - RNA, 21 nt, Human
aaauaucucacauuaugcaau

SEQ ID NO: 968908 - RNA, 19 nt, Human
aacacaacaaaagcuguga

SEQ ID NO: 968909 - RNA, 18 nt, Human
aacauuagguguaugcua

SEQ ID NO: 968910 - RNA, 22 nt, Human
aagagcgcaagcagugccacgg

SEQ ID NO: 968911 - RNA, 22 nt, Human
aagcugugaucacauuacauca

SEQ ID NO: 968912 - RNA, 24 nt, Human
aaggguauuuuuuuuuucuuaagg

SEQ ID NO: 968913 - RNA, 25 nt, Human
aaucacaaacacuaaaaauaaaucc

SEQ ID NO: 968914 - RNA, 25 nt, Human
aauuaccuacuuacaauaucucuau

SEQ ID NO: 968915 - RNA, 19 nt, Human
acaagcaaaaugccucuuc

SEQ ID NO: 968916 - RNA, 23 nt, Human
acaagcaaaaugccucuucccca

SEQ ID NO: 968917 - RNA, 24 nt, Human
acaguguaacaaauauauaagugc

SEQ ID NO: 968918 - RNA, 19 nt, Human
accaauaauauuuugaguu

SEQ ID NO: 968919 - RNA, 19 nt, Human
acggguuuccuaauaggag

SEQ ID NO: 968920 - RNA, 21 nt, Human
agaaauugcaauucccuaacc

SEQ ID NO: 968921 - RNA, 21 nt, Human
agaauagacaaaauacaccaa

SEQ ID NO: 968922 - RNA, 23 nt, Human
agagaccauuuuaauauaaugua

SEQ ID NO: 968923 - RNA, 19 nt, Human
agcagaaugguaguggcuc

SEQ ID NO: 968924 - RNA, 23 nt, Human
aggaagaaagauaucuaaaccau

SEQ ID NO: 968925 - RNA, 24 nt, Human
aggggaguauccgguggcaaagag

SEQ ID NO: 968926 - RNA, 18 nt, Human
aguccuuuuccuggaagu

SEQ ID NO: 968927 - RNA, 20 nt, Human
caacacaacaaaagcuguga

SEQ ID NO: 968928 - RNA, 20 nt, Human
caauacaguguaacaaauau

SEQ ID NO: 968929 - RNA, 22 nt, Human
cacaaacacuaaaaauaaaucc

SEQ ID NO: 968930 - RNA, 18 nt, Human
cacaaugaauuuaaucac

SEQ ID NO: 968931 - RNA, 23 nt, Human
cacaaugaauuuaaucacaaaca

SEQ ID NO: 968932 - RNA, 24 nt, Human
cagaauagacaaaauacaccaaua

SEQ ID NO: 968933 - RNA, 21 nt, Human
caguacauuaaacagaucaaa

SEQ ID NO: 968934 - RNA, 22 nt, Human
caugcaacccacggguuuccua

SEQ ID NO: 968935 - RNA, 19 nt, Human
ccaaacagcuacuacaagc

SEQ ID NO: 968936 - RNA, 24 nt, Human
cuaacaaaauaucucacauuaugc

SEQ ID NO: 968937 - RNA, 24 nt, Human
gagagagaccauuuuaauauaaug

SEQ ID NO: 968938 - RNA, 18 nt, Human
gaggcacaaagcaaaggg

SEQ ID NO: 968939 - RNA, 18 nt, Human
ggagagugagaaugagaa

SEQ ID NO: 968940 - RNA, 21 nt, Human
ggaugagauguugugcuuuag

SEQ ID NO: 968941 - RNA, 21 nt, Human
ggccuccagucacuagcacag

SEQ ID NO: 968942 - RNA, 18 nt, Human
uaacaaauauauaagugc

SEQ ID NO: 968943 - RNA, 21 nt, Human
uaaguguuugugcccaagcau

SEQ ID NO: 968944 - RNA, 18 nt, Human
uacaagcaaaaugaaggu

SEQ ID NO: 968945 - RNA, 20 nt, Human
uaggaaaggcgaggauugcg

SEQ ID NO: 968946 - RNA, 21 nt, Human
uagguguaugcuauuuuuggu

SEQ ID NO: 968947 - RNA, 21 nt, Human
uauauuaagaaaugacaagca

SEQ ID NO: 968948 - RNA, 19 nt, Human
uauccagaauagacaaaau

SEQ ID NO: 968949 - RNA, 25 nt, Human
uaucucuuuuuuuuuucuaaugcaa

SEQ ID NO: 968950 - RNA, 21 nt, Human
uauuauguuucuguguaugga

SEQ ID NO: 968951 - RNA, 23 nt, Human
ucacaaacacuaaaaauaaaucc

SEQ ID NO: 968952 - RNA, 19 nt, Human
ucagcagaaugguaguggc

SEQ ID NO: 968953 - RNA, 27 nt, Human
ucagcagaaugguaguggcucgccucc

SEQ ID NO: 968954 - RNA, 20 nt, Human
ucaguacaacuuuguagcug

SEQ ID NO: 968955 - RNA, 25 nt, Human
ucaguucuugccagauuuaaauagu

SEQ ID NO: 968956 - RNA, 21 nt, Human
uccaaccacccaaacagcuac

SEQ ID NO: 968957 - RNA, 20 nt, Human
uccccaccuaaaauucuaug

SEQ ID NO: 968958 - RNA, 19 nt, Human
uccuggaagucggucagcu

SEQ ID NO: 968959 - RNA, 25 nt, Human
ucuuuuuuuuuucuaaugcaaguua

SEQ ID NO: 968960 - RNA, 22 nt, Human
ugaaaaacaauguaaauucccg

SEQ ID NO: 968961 - RNA, 20 nt, Human
ugaauuuaaucacaaacacu

SEQ ID NO: 968962 - RNA, 20 nt, Human
ugagagaagggagggagagu

SEQ ID NO: 968963 - RNA, 23 nt, Human
ugagagugagagaagggagggag

SEQ ID NO: 968964 - RNA, 21 nt, Human
ugauaugcuugcaaguuuaca

SEQ ID NO: 968965 - RNA, 23 nt, Human
uggaaggggaguauccgguggca

SEQ ID NO: 968966 - RNA, 25 nt, Human
uggcaaagagcgcaagcagugccac

SEQ ID NO: 968967 - RNA, 18 nt, Human
uguaugcuauuuuugguu

SEQ ID NO: 968968 - RNA, 20 nt, Human
ugucuuaaucucuuaaagua

SEQ ID NO: 968969 - RNA, 18 nt, Human
uguuuuguuuucauuuuu

SEQ ID NO: 968970 - RNA, 24 nt, Human
uuaaaguaguugcgggcuuuuccu

SEQ ID NO: 968971 - RNA, 21 nt, Human
uuagguguaugcuauuuuugg

SEQ ID NO: 968972 - RNA, 19 nt, Human
uucauauuacauauagcuc

SEQ ID NO: 968973 - RNA, 19 nt, Human
uucauuuuuacagcaagac

SEQ ID NO: 968974 - RNA, 21 nt, Human
uucuguguauggacauguaua

SEQ ID NO: 968975 - RNA, 19 nt, Human
uugcgggcuuuuccuucuu

SEQ ID NO: 968976 - RNA, 21 nt, Human
uuucauuuuuacagcaagacu

SEQ ID NO: 968977 - RNA, 23 nt, Human
uuuuaugcauugcacuuauugcu

SEQ ID NO: 968978 - RNA, 21 nt, Human
uuuuuuuuuuuaaaaaaggau

SEQ ID NO: 968979 - RNA, 24 nt, Human
aaaaugcugggauuacagguguga

SEQ ID NO: 968980 - RNA, 23 nt, Human
aaauacacaagaggaucugaagc

SEQ ID NO: 968981 - RNA, 25 nt, Human
aaaugaccuuguguauucugcaaau

SEQ ID NO: 968982 - RNA, 26 nt, Human
aaaugcugggauuacaggugugagcc

SEQ ID NO: 968983 - RNA, 19 nt, Human
aacauaugccacccaucuc

SEQ ID NO: 968984 - RNA, 19 nt, Human
aacauugugaaaccccauc

SEQ ID NO: 968985 - RNA, 20 nt, Human
aacauugugaaaccccaucu

SEQ ID NO: 968986 - RNA, 21 nt, Human
aacauugugaaaccccaucuc

SEQ ID NO: 968987 - RNA, 27 nt, Human
aacccauccucccaccauggccuccca

SEQ ID NO: 968988 - RNA, 20 nt, Human
aagagagaguggggaggugc

SEQ ID NO: 968989 - RNA, 23 nt, Human
aagaucacgccauugcacuccag

SEQ ID NO: 968990 - RNA, 26 nt, Human
aagcaggagaaagagagaggggaccc

SEQ ID NO: 968991 - RNA, 24 nt, Human
aaguagcugagacuacaggcacac

SEQ ID NO: 968992 - RNA, 18 nt, Human
acacagauccaaaccaua

SEQ ID NO: 968993 - RNA, 21 nt, Human
acacagauccaaaccauauca

SEQ ID NO: 968994 - RNA, 22 nt, Human
acagaucaccugaagucaggag

SEQ ID NO: 968995 - RNA, 18 nt, Human
accacgcugcccagccaa

SEQ ID NO: 968996 - RNA, 22 nt, Human
acucacugucaugagaccagca

SEQ ID NO: 968997 - RNA, 18 nt, Human
acuccagccucugacucc

SEQ ID NO: 968998 - RNA, 21 nt, Human
acugcaccuggcccauagaug

SEQ ID NO: 968999 - RNA, 24 nt, Human
acuguguugcccaggcuggucuug

SEQ ID NO: 969000 - RNA, 25 nt, Human
acuguguugcccaggcuggucuuga

SEQ ID NO: 969001 - RNA, 23 nt, Human
acuuaauagaagaggaaagaaaa

SEQ ID NO: 969002 - RNA, 19 nt, Human
agaacucaucuaaaacuga

SEQ ID NO: 969003 - RNA, 18 nt, Human
agaagcccuuagaaaugg

SEQ ID NO: 969004 - RNA, 26 nt, Human
agacagaucaccugaagucaggaguu

SEQ ID NO: 969005 - RNA, 19 nt, Human
agaccagcacugaggggac

SEQ ID NO: 969006 - RNA, 25 nt, Human
agaucaccugaagucaggaguuuga

SEQ ID NO: 969007 - RNA, 23 nt, Human
agccaggcgugguggugugcacc

SEQ ID NO: 969008 - RNA, 24 nt, Human
agccuggccaacauugugaaaccc

SEQ ID NO: 969009 - RNA, 19 nt, Human
aggaaagaaaaugguucau

SEQ ID NO: 969010 - RNA, 20 nt, Human
aggaguuugagaccagccug

SEQ ID NO: 969011 - RNA, 20 nt, Human
aggcacacaccacgcugccc

SEQ ID NO: 969012 - RNA, 26 nt, Human
aggcagacagaucaccugaagucagg

SEQ ID NO: 969013 - RNA, 24 nt, Human
aggcaugguggcucacgccuguaa

SEQ ID NO: 969014 - RNA, 24 nt, Human
aggcugagguaggagaauggcuug

SEQ ID NO: 969015 - RNA, 25 nt, Human
agggagacuuucaacagcaaaacuc

SEQ ID NO: 969016 - RNA, 20 nt, Human
agggaguccucagggaauuu

SEQ ID NO: 969017 - RNA, 18 nt, Human
agguaggagaauggcuug

SEQ ID NO: 969018 - RNA, 24 nt, Human
aggugaagucugcagugagccaag

SEQ ID NO: 969019 - RNA, 23 nt, Human
agucgccucccagccggccccac

SEQ ID NO: 969020 - RNA, 23 nt, Human
agugauaaaaaccagaauuuucc

SEQ ID NO: 969021 - RNA, 18 nt, Human
auagagaacucaucuaaa

SEQ ID NO: 969022 - RNA, 21 nt, Human
auaugccacccaucucaaaau

SEQ ID NO: 969023 - RNA, 20 nt, Human
aucaacuccaggauggcugg

SEQ ID NO: 969024 - RNA, 23 nt, Human
aucacgccauugcacuccagccu

SEQ ID NO: 969025 - RNA, 24 nt, Human
auccaaaccauaucaaaauccaau

SEQ ID NO: 969026 - RNA, 18 nt, Human
auggccucccaaguagcu

SEQ ID NO: 969027 - RNA, 20 nt, Human
auggugguggagagaaggcu

SEQ ID NO: 969028 - RNA, 21 nt, Human
auugcacuccagccucugacu

SEQ ID NO: 969029 - RNA, 22 nt, Human
caaaacucccaccuuggccucc

SEQ ID NO: 969030 - RNA, 26 nt, Human
caaaacucccaccuuggccucccaaa

SEQ ID NO: 969031 - RNA, 24 nt, Human
caaaaugcugggauuacaggugug

SEQ ID NO: 969032 - RNA, 31 nt, Human
caacccauccucccaccauggccucccaagg

SEQ ID NO: 969033 - RNA, 26 nt, Human
caauugcuaccauuuaaaaaucaggu

SEQ ID NO: 969034 - RNA, 24 nt, Human
caauuuuuuaauuuuuuaguagag

SEQ ID NO: 969035 - RNA, 22 nt, Human
cacagauccaaaccauaucaaa

SEQ ID NO: 969036 - RNA, 20 nt, Human
caccacgcugcccagccaau

SEQ ID NO: 969037 - RNA, 23 nt, Human
caccugaagucaggaguuugaga

SEQ ID NO: 969038 - RNA, 24 nt, Human
cacgccuguaaucucagcucuuug

SEQ ID NO: 969039 - RNA, 22 nt, Human
cacgcugcccagccaauuuuuu

SEQ ID NO: 969040 - RNA, 19 nt, Human
cacuguguugcccaggcug

SEQ ID NO: 969041 - RNA, 21 nt, Human
cacuguguugcccaggcuggu

SEQ ID NO: 969042 - RNA, 24 nt, Human
cacuguguugcccaggcuggucuu

SEQ ID NO: 969043 - RNA, 24 nt, Human
cacuucagccucccaaaaugcugg

SEQ ID NO: 969044 - RNA, 21 nt, Human
cagaaggcaaagugggagcag

SEQ ID NO: 969045 - RNA, 24 nt, Human
cagacagaucaccugaagucagga

SEQ ID NO: 969046 - RNA, 21 nt, Human
cagaucaccugaagucaggag

SEQ ID NO: 969047 - RNA, 24 nt, Human
cagcacugaggggacggugccaaa

SEQ ID NO: 969048 - RNA, 22 nt, Human
cagccucugacuccugugcuca

SEQ ID NO: 969049 - RNA, 24 nt, Human
cagcuaccugggaggcugagguag

SEQ ID NO: 969050 - RNA, 24 nt, Human
cagcucuuugggaggccgaggcag

SEQ ID NO: 969051 - RNA, 19 nt, Human
cagggucuugcuauauugg

SEQ ID NO: 969052 - RNA, 23 nt, Human
caggugucacuguguugcccagg

SEQ ID NO: 969053 - RNA, 22 nt, Human
cauaugccacccaucucaaaau

SEQ ID NO: 969054 - RNA, 19 nt, Human
cauugcacuccagccucug

SEQ ID NO: 969055 - RNA, 21 nt, Human
cauugcacuccagccucugac

SEQ ID NO: 969056 - RNA, 21 nt, Human
cauugcacuccagccucugac

SEQ ID NO: 969057 - RNA, 21 nt, Human
ccaaaaugcugggauuacagg

SEQ ID NO: 969058 - RNA, 21 nt, Human
ccaaaaugcugggauuacagg

SEQ ID NO: 969059 - RNA, 24 nt, Human
ccaaaaugcugggauuacaggugu

SEQ ID NO: 969060 - RNA, 20 nt, Human
ccacugcaccuggcccauag

SEQ ID NO: 969061 - RNA, 21 nt, Human
ccacugcaccuggcccauaga

SEQ ID NO: 969062 - RNA, 20 nt, Human
ccagccggccccaccucuaa

SEQ ID NO: 969063 - RNA, 18 nt, Human
ccauugcacuccagccuc

SEQ ID NO: 969064 - RNA, 20 nt, Human
ccauugcacuccagccucug

SEQ ID NO: 969065 - RNA, 22 nt, Human
ccauugcacuccagccucugac

SEQ ID NO: 969066 - RNA, 24 nt, Human
cccaaguagcugagacuacaggca

SEQ ID NO: 969067 - RNA, 21 nt, Human
cccauagucccagcuaccugg

SEQ ID NO: 969068 - RNA, 21 nt, Human
cccaucuccacuaaaaauaca

SEQ ID NO: 969069 - RNA, 24 nt, Human
ccgcacgaccacgcacccgcggcu

SEQ ID NO: 969070 - RNA, 23 nt, Human
ccucugacuccugugcucaaccc

SEQ ID NO: 969071 - RNA, 27 nt, Human
ccucuggccucaagcaaaacucccacc

SEQ ID NO: 969072 - RNA, 22 nt, Human
ccugaagucaggaguuugagac

SEQ ID NO: 969073 - RNA, 23 nt, Human
ccugaagucaggaguuugagacc

SEQ ID NO: 969074 - RNA, 23 nt, Human
ccuggccaacauugugaaacccc

SEQ ID NO: 969075 - RNA, 24 nt, Human
ccuggccaacauugugaaacccca

SEQ ID NO: 969076 - RNA, 20 nt, Human
cgaggcagacagaucaccug

SEQ ID NO: 969077 - RNA, 26 nt, Human
cgaggcagacagaucaccugaaguca

SEQ ID NO: 969078 - RNA, 23 nt, Human
cgccauugcacuccagccucuga

SEQ ID NO: 969079 - RNA, 24 nt, Human
cgccuguaaucucagcucuuuggg

SEQ ID NO: 969080 - RNA, 18 nt, Human
cuaccagaucucacgaua

SEQ ID NO: 969081 - RNA, 23 nt, Human
cucacgauaacucacugucauga

SEQ ID NO: 969082 - RNA, 20 nt, Human
cucacgccuguaaucucagc

SEQ ID NO: 969083 - RNA, 24 nt, Human
cucacgccuguaaucucagcucuu

SEQ ID NO: 969084 - RNA, 21 nt, Human
cucccaaguagcugagacuac

SEQ ID NO: 969085 - RNA, 20 nt, Human
cucccaccauggccucccaa

SEQ ID NO: 969086 - RNA, 23 nt, Human
cucccaccuuggccucccaaauu

SEQ ID NO: 969087 - RNA, 20 nt, Human
cucggauuacaggagugagc

SEQ ID NO: 969088 - RNA, 23 nt, Human
cuggccaacauugugaaacccca

SEQ ID NO: 969089 - RNA, 22 nt, Human
cuuuuaaacuaccagaucucac

SEQ ID NO: 969090 - RNA, 18 nt, Human
gacuuucaacagcaaaac

SEQ ID NO: 969091 - RNA, 20 nt, Human
gagaaagagagaguggggag

SEQ ID NO: 969092 - RNA, 22 nt, Human
gagcaggcaucuucacguggcc

SEQ ID NO: 969093 - RNA, 22 nt, Human
gagccacagcuuccagccuuaa

SEQ ID NO: 969094 - RNA, 27 nt, Human
gaggcagacagaucaccugaagucagg

SEQ ID NO: 969095 - RNA, 24 nt, Human
gaucaccugaagucaggaguuuga

SEQ ID NO: 969096 - RNA, 18 nt, Human
gauuacaggagugagcca

SEQ ID NO: 969097 - RNA, 22 nt, Human
gauuacaggagugagccacugc

SEQ ID NO: 969098 - RNA, 23 nt, Human
gauuacaggagugagccacugca

SEQ ID NO: 969099 - RNA, 18 nt, Human
gauuacaggugugagcca

SEQ ID NO: 969100 - RNA, 24 nt, Human
gccaacauugugaaaccccaucuc

SEQ ID NO: 969101 - RNA, 22 nt, Human
gcucaacccauccucccaccau

SEQ ID NO: 969102 - RNA, 22 nt, Human
ggagaauggcuugaacucagga

SEQ ID NO: 969103 - RNA, 20 nt, Human
ggauuacaggagugagccac

SEQ ID NO: 969104 - RNA, 22 nt, Human
ggauuacaggagugagccacug

SEQ ID NO: 969105 - RNA, 19 nt, Human
ggucuugaaccucuggccu

SEQ ID NO: 969106 - RNA, 24 nt, Human
gguggcucacgccuguaaucucag

SEQ ID NO: 969107 - RNA, 24 nt, Human
gguggugugcacccauagucccag

SEQ ID NO: 969108 - RNA, 20 nt, Human
gugaauaucaacuccaggau

SEQ ID NO: 969109 - RNA, 23 nt, Human
gugccaaaccauucaugaaggcu

SEQ ID NO: 969110 - RNA, 21 nt, Human
uaaaaauacaaaaauuagcca

SEQ ID NO: 969111 - RNA, 22 nt, Human
uacaggagugagccacugcacc

SEQ ID NO: 969112 - RNA, 22 nt, Human
uacaggagugagccacugcacc

SEQ ID NO: 969113 - RNA, 23 nt, Human
uacaggagugagccacugcaccu

SEQ ID NO: 969114 - RNA, 23 nt, Human
uacaggagugagccacugcaccu

SEQ ID NO: 969115 - RNA, 21 nt, Human
uacaggugugagccacagcuu

SEQ ID NO: 969116 - RNA, 24 nt, Human
uacaggugugagccacagcuucca

SEQ ID NO: 969117 - RNA, 20 nt, Human
uagacacagggucuugcuau

SEQ ID NO: 969118 - RNA, 22 nt, Human
uagagaacucaucuaaaacuga

SEQ ID NO: 969119 - RNA, 24 nt, Human
uagagaacuguaacuuaaacagaa

SEQ ID NO: 969120 - RNA, 21 nt, Human
uauucugcaaauacacaagag

SEQ ID NO: 969121 - RNA, 24 nt, Human
ucaacagcaaaacucagagcacaa

SEQ ID NO: 969122 - RNA, 25 nt, Human
ucaacccauccucccaccauggccu

SEQ ID NO: 969123 - RNA, 23 nt, Human
ucaccugaagucaggaguuugag

SEQ ID NO: 969124 - RNA, 24 nt, Human
ucacgccauugcacuccagccucu

SEQ ID NO: 969125 - RNA, 18 nt, Human
ucacugccucucccaggc

SEQ ID NO: 969126 - RNA, 23 nt, Human
ucacugccucucccaggccacug

SEQ ID NO: 969127 - RNA, 24 nt, Human
ucacuucagccucccaaaaugcug

SEQ ID NO: 969128 - RNA, 23 nt, Human
ucccaaaaugcugggauuacagg

SEQ ID NO: 969129 - RNA, 24 nt, Human
ucccaaguagcugagacuacaggc

SEQ ID NO: 969130 - RNA, 23 nt, Human
ucccagccggccccaccucuaac

SEQ ID NO: 969131 - RNA, 22 nt, Human
ucggauuacaggagugagccac

SEQ ID NO: 969132 - RNA, 24 nt, Human
ucggauuacaggagugagccacug

SEQ ID NO: 969133 - RNA, 21 nt, Human
ucuauggugguggagagaagg

SEQ ID NO: 969134 - RNA, 29 nt, Human
ucucccaggccacugggaaaugaccuugu

SEQ ID NO: 969135 - RNA, 21 nt, Human
ucugcagugagccaagaucac

SEQ ID NO: 969136 - RNA, 21 nt, Human
ucuuagagaacuguaacuuaa

SEQ ID NO: 969137 - RNA, 19 nt, Human
ugaaaccccaucuccacua

SEQ ID NO: 969138 - RNA, 22 nt, Human
ugaaaccccaucuccacuaaaa

SEQ ID NO: 969139 - RNA, 21 nt, Human
ugaaagccacuguugcguuug

SEQ ID NO: 969140 - RNA, 23 nt, Human
ugacuccugugcucaacccaucc

SEQ ID NO: 969141 - RNA, 18 nt, Human
ugagaccagccuggccaa

SEQ ID NO: 969142 - RNA, 21 nt, Human
ugagaccagccuggccaacau

SEQ ID NO: 969143 - RNA, 21 nt, Human
ugagacuacaggcacacacca

SEQ ID NO: 969144 - RNA, 26 nt, Human
ugagacuacaggcacacaccacgcug

SEQ ID NO: 969145 - RNA, 21 nt, Human
ugagauuugguggggacacag

SEQ ID NO: 969146 - RNA, 21 nt, Human
ugccaaaccauucaugaaggc

SEQ ID NO: 969147 - RNA, 22 nt, Human
ugcccaggcuggucuugaaccu

SEQ ID NO: 969148 - RNA, 23 nt, Human
ugcccaggcuggucuugaaccuc

SEQ ID NO: 969149 - RNA, 23 nt, Human
ugccgcacgaccacgcacccgcg

SEQ ID NO: 969150 - RNA, 24 nt, Human
ugcuauauuggccaagauggucuc

SEQ ID NO: 969151 - RNA, 18 nt, Human
ugcucaacccauccuccc

SEQ ID NO: 969152 - RNA, 25 nt, Human
ugcugggauuacaggugugagccac

SEQ ID NO: 969153 - RNA, 19 nt, Human
uggcagaaggcaaaguggg

SEQ ID NO: 969154 - RNA, 20 nt, Human
uggcagaaggcaaaguggga

SEQ ID NO: 969155 - RNA, 21 nt, Human
uggcccauagaugcauuaaca

SEQ ID NO: 969156 - RNA, 20 nt, Human
uggccucaagcaaaacuccc

SEQ ID NO: 969157 - RNA, 21 nt, Human
uggccucaagcaaaacuccca

SEQ ID NO: 969158 - RNA, 21 nt, Human
uggcucacgccuguaaucuca

SEQ ID NO: 969159 - RNA, 22 nt, Human
uggcucacgccuguaaucucag

SEQ ID NO: 969160 - RNA, 24 nt, Human
ugggaggccgaggcagacagauca

SEQ ID NO: 969161 - RNA, 18 nt, Human
ugggaggcugagguagga

SEQ ID NO: 969162 - RNA, 22 nt, Human
ugggaggcugagguaggagaau

SEQ ID NO: 969163 - RNA, 18 nt, Human
ugggauuacaggugugag

SEQ ID NO: 969164 - RNA, 19 nt, Human
ugggauuacaggugugagc

SEQ ID NO: 969165 - RNA, 21 nt, Human
ugggauuacaggugugagcca

SEQ ID NO: 969166 - RNA, 22 nt, Human
ugggauuacaggugugagccac

SEQ ID NO: 969167 - RNA, 22 nt, Human
ugggauuacaggugugagccac

SEQ ID NO: 969168 - RNA, 22 nt, Human
ugggauuacaggugugagccac

SEQ ID NO: 969169 - RNA, 27 nt, Human
ugggauuacaggugugagccacagcuu

SEQ ID NO: 969170 - RNA, 25 nt, Human
uggucucauaccccuacccucaaau

SEQ ID NO: 969171 - RNA, 24 nt, Human
ugguggcucacgccuguaaucuca

SEQ ID NO: 969172 - RNA, 22 nt, Human
ugucacuguguugcccaggcug

SEQ ID NO: 969173 - RNA, 22 nt, Human
ugugacacaaaggucccaugug

SEQ ID NO: 969174 - RNA, 18 nt, Human
ugugguuuugaaaggucc

SEQ ID NO: 969175 - RNA, 23 nt, Human
ugugguuuugaaagguccauugg

SEQ ID NO: 969176 - RNA, 24 nt, Human
uguguugcccaggcuggucuugaa

SEQ ID NO: 969177 - RNA, 18 nt, Human
uguugcccaggcuggucu

SEQ ID NO: 969178 - RNA, 22 nt, Human
uguugcccaggcuggucuugaa

SEQ ID NO: 969179 - RNA, 24 nt, Human
uuacaggugugagccacagcuucc

SEQ ID NO: 969180 - RNA, 19 nt, Human
uuauuuagcacaauugcua

SEQ ID NO: 969181 - RNA, 20 nt, Human
uucaugaaggcuucacaccc

SEQ ID NO: 969182 - RNA, 19 nt, Human
uucucaugguuugguucca

SEQ ID NO: 969183 - RNA, 25 nt, Human
uugggaggccgaggcagacagauca

SEQ ID NO: 969184 - RNA, 22 nt, Human
uuguugugguuuugaaaggucc

SEQ ID NO: 969185 - RNA, 22 nt, Human
uuuacucauggcagaaggcaaa

SEQ ID NO: 969186 - RNA, 23 nt, Human
uuugaaagguccauuggaaucca

SEQ ID NO: 969187 - RNA, 24 nt, Human
uuuggccaggcaugguggcucacg

SEQ ID NO: 969188 - RNA, 26 nt, Human
aacacagaaaggaauagaaaaccuga

SEQ ID NO: 969189 - RNA, 19 nt, Human
acacguggcaggacaggag

SEQ ID NO: 969190 - RNA, 21 nt, Human
accagagcauccuggcugcac

SEQ ID NO: 969191 - RNA, 20 nt, Human
aggacccugccccuggaggc

SEQ ID NO: 969192 - RNA, 21 nt, Human
auccuggccccugccggcugc

SEQ ID NO: 969193 - RNA, 18 nt, Human
caaaagacacguggcagg

SEQ ID NO: 969194 - RNA, 21 nt, Human
cacagaaaggaauagaaaacc

SEQ ID NO: 969195 - RNA, 19 nt, Human
cacagcaccauuccacgca

SEQ ID NO: 969196 - RNA, 18 nt, Human
cacagcugcaggcugccc

SEQ ID NO: 969197 - RNA, 19 nt, Human
caccagggccccaucggca

SEQ ID NO: 969198 - RNA, 18 nt, Human
caccuccuucccggaguc

SEQ ID NO: 969199 - RNA, 19 nt, Human
caggacccugccccuggag

SEQ ID NO: 969200 - RNA, 21 nt, Human
ccaccagagcauccuggcugc

SEQ ID NO: 969201 - RNA, 21 nt, Human
ccccaugcagccuuucccuuc

SEQ ID NO: 969202 - RNA, 19 nt, Human
ccccugcagcuccgcaggc

SEQ ID NO: 969203 - RNA, 23 nt, Human
ccccuggaggccucgccugcccc

SEQ ID NO: 969204 - RNA, 20 nt, Human
ccuccaagaggagaggcggg

SEQ ID NO: 969205 - RNA, 22 nt, Human
ccugccccugcagcuccgcagg

SEQ ID NO: 969206 - RNA, 21 nt, Human
ccuggcugcaccuccuucccg

SEQ ID NO: 969207 - RNA, 23 nt, Human
cgccugccccugcagcuccgcag

SEQ ID NO: 969208 - RNA, 20 nt, Human
cguggcaggacaggagacug

SEQ ID NO: 969209 - RNA, 19 nt, Human
cuaaacaccagccucgugc

SEQ ID NO: 969210 - RNA, 20 nt, Human
cuaaacaccagccucgugcc

SEQ ID NO: 969211 - RNA, 21 nt, Human
cuguuaugggguggggccugg

SEQ ID NO: 969212 - RNA, 26 nt, Human
cuuggcccugggcugcuccccuuggg

SEQ ID NO: 969213 - RNA, 27 nt, Human
cuuggcccugggcugcuccccuugggg

SEQ ID NO: 969214 - RNA, 24 nt, Human
gacgcacuguggccuggggaaggc

SEQ ID NO: 969215 - RNA, 18 nt, Human
gagaagaaugugugaucc

SEQ ID NO: 969216 - RNA, 19 nt, Human
gagagcccggccgggggca

SEQ ID NO: 969217 - RNA, 19 nt, Human
gcccggccgggggcacagg

SEQ ID NO: 969218 - RNA, 20 nt, Human
gccucgccugccccugcagc

SEQ ID NO: 969219 - RNA, 24 nt, Human
gccuuuggggaguucugacaccag

SEQ ID NO: 969220 - RNA, 20 nt, Human
gcucucagagccucaagucu

SEQ ID NO: 969221 - RNA, 18 nt, Human
ggccccaucggcagcucc

SEQ ID NO: 969222 - RNA, 19 nt, Human
ggccuggacacagcugcag

SEQ ID NO: 969223 - RNA, 21 nt, Human
ggccuggggaaggcagcgggg

SEQ ID NO: 969224 - RNA, 22 nt, Human
ggccuuuggggaguucugacac

SEQ ID NO: 969225 - RNA, 22 nt, Human
ggcggggcuugaaagauuugag

SEQ ID NO: 969226 - RNA, 23 nt, Human
gggccucaggcaaugccgggccc

SEQ ID NO: 969227 - RNA, 21 nt, Human
ggggcucccccaugcagccuu

SEQ ID NO: 969228 - RNA, 19 nt, Human
gggggcacagggucugggc

SEQ ID NO: 969229 - RNA, 18 nt, Human
guggcugaggccaccugu

SEQ ID NO: 969230 - RNA, 21 nt, Human
uaaccccugccugccgcccuc

SEQ ID NO: 969231 - RNA, 22 nt, Human
ucaccgggcucacaccggggaa

SEQ ID NO: 969232 - RNA, 19 nt, Human
ucagagccucaagucuguc

SEQ ID NO: 969233 - RNA, 20 nt, Human
ucagcaggcagguggucgga

SEQ ID NO: 969234 - RNA, 18 nt, Human
ucagcucucagagccuca

SEQ ID NO: 969235 - RNA, 21 nt, Human
uccaccagagcauccuggcug

SEQ ID NO: 969236 - RNA, 22 nt, Human
uccaccagagcauccuggcugc

SEQ ID NO: 969237 - RNA, 27 nt, Human
ucccggaguccuggcuugacucagaga

SEQ ID NO: 969238 - RNA, 20 nt, Human
uccuggcugcaccuccuucc

SEQ ID NO: 969239 - RNA, 19 nt, Human
ucugucuccacauccaagg

SEQ ID NO: 969240 - RNA, 21 nt, Human
ugacuccacuuggacgcacag

SEQ ID NO: 969241 - RNA, 26 nt, Human
ugcaaacacagaaaggaauagaaaac

SEQ ID NO: 969242 - RNA, 19 nt, Human
uggcaaggggcacagcacc

SEQ ID NO: 969243 - RNA, 20 nt, Human
uggcaggacaggagacugga

SEQ ID NO: 969244 - RNA, 18 nt, Human
uggcccugggcugcuccc

SEQ ID NO: 969245 - RNA, 20 nt, Human
uggcuugccuaccuauucca

SEQ ID NO: 969246 - RNA, 18 nt, Human
uggggaaggcagcggggc

SEQ ID NO: 969247 - RNA, 20 nt, Human
uggggaaggcagcggggcuu

SEQ ID NO: 969248 - RNA, 21 nt, Human
ugggguggggccugggccugg

SEQ ID NO: 969249 - RNA, 22 nt, Human
uguguggcugaggccaccuguu

SEQ ID NO: 969250 - RNA, 20 nt, Human
uguuaugggguggggccugg

SEQ ID NO: 969251 - RNA, 21 nt, Human
uguuaugggguggggccuggg

SEQ ID NO: 969252 - RNA, 19 nt, Human
uuaacgugagaccuuggac

SEQ ID NO: 969253 - RNA, 19 nt, Human
uucagcucucagagccuca

SEQ ID NO: 969254 - RNA, 19 nt, Human
uuggacaaguguuuucagc

SEQ ID NO: 969255 - RNA, 26 nt, Human
uuugcaaaagacacguggcaggacag

SEQ ID NO: 969256 - RNA, 21 nt, Human
uuugcaaacacagaaaggaau

SEQ ID NO: 969257 - RNA, 20 nt, Human
uuuuuuuuuuuuuuuuuugg

SEQ ID NO: 969258 - RNA, 20 nt, Human
aaacccgcaggcugguccaa

SEQ ID NO: 969259 - RNA, 22 nt, Human
aagagcccaggauaaacccgca

SEQ ID NO: 969260 - RNA, 19 nt, Human
aaguagcucacgaagagga

SEQ ID NO: 969261 - RNA, 21 nt, Human
aaugagcagcaaguacaucau

SEQ ID NO: 969262 - RNA, 19 nt, Human
acacccacgucagcgcucu

SEQ ID NO: 969263 - RNA, 23 nt, Human
acugcugucuggcuccagggggu

SEQ ID NO: 969264 - RNA, 22 nt, Human
agcugcuggaaacaggaggcac

SEQ ID NO: 969265 - RNA, 22 nt, Human
agggacuguggaaacccaaaca

SEQ ID NO: 969266 - RNA, 19 nt, Human
agugcgggggcagggacug

SEQ ID NO: 969267 - RNA, 18 nt, Human
caccagguaggcgcccac

SEQ ID NO: 969268 - RNA, 22 nt, Human
caccugggccccaaugagcagc

SEQ ID NO: 969269 - RNA, 24 nt, Human
caccugggccccaaugagcagcaa

SEQ ID NO: 969270 - RNA, 22 nt, Human
cagaaagagcccaggauaaacc

SEQ ID NO: 969271 - RNA, 22 nt, Human
caggagcaccugggccccaaug

SEQ ID NO: 969272 - RNA, 23 nt, Human
ccaaugagcagcaaguacaucau

SEQ ID NO: 969273 - RNA, 24 nt, Human
cccaaugagcagcaaguacaucau

SEQ ID NO: 969274 - RNA, 19 nt, Human
cccaggauaaacccgcagg

SEQ ID NO: 969275 - RNA, 25 nt, Human
cccccgccgccgccgccgccgccgg

SEQ ID NO: 969276 - RNA, 19 nt, Human
ccccgccgccgccgccgcc

SEQ ID NO: 969277 - RNA, 21 nt, Human
ccccguugcugggcuuggguc

SEQ ID NO: 969278 - RNA, 19 nt, Human
ccccucgucgccgcccgag

SEQ ID NO: 969279 - RNA, 24 nt, Human
cccgcaggcugguccaaauaccag

SEQ ID NO: 969280 - RNA, 21 nt, Human
cccgcgugccccgaaguagcu

SEQ ID NO: 969281 - RNA, 21 nt, Human
ccgcccccguccugccggggc

SEQ ID NO: 969282 - RNA, 19 nt, Human
ccgcccgagccguuggcug

SEQ ID NO: 969283 - RNA, 18 nt, Human
ccgccgccgccgccgccg

SEQ ID NO: 969284 - RNA, 22 nt, Human
ccgccgccgccgccgccgccgc

SEQ ID NO: 969285 - RNA, 25 nt, Human
ccgccgccgccgccgccgccgccgg

SEQ ID NO: 969286 - RNA, 23 nt, Human
ccgccgccgccgccgccgccgcu

SEQ ID NO: 969287 - RNA, 23 nt, Human
ccgccgccgccgccgccgcugcc

SEQ ID NO: 969288 - RNA, 24 nt, Human
ccgccgccgccgccgccgcugccg

SEQ ID NO: 969289 - RNA, 26 nt, Human
ccgccgccgccgccgccgcugccgcu

SEQ ID NO: 969290 - RNA, 26 nt, Human
ccgccgccgccgccgccgcugccgcu

SEQ ID NO: 969291 - RNA, 18 nt, Human
ccgccgccgccgcugccg

SEQ ID NO: 969292 - RNA, 21 nt, Human
ccgccgccgcugccgcuuucc

SEQ ID NO: 969293 - RNA, 18 nt, Human
ccgcugccgcuuucccgc

SEQ ID NO: 969294 - RNA, 23 nt, Human
ccucgaggcugcgugcugucccc

SEQ ID NO: 969295 - RNA, 27 nt, Human
cgcagccgaucaggcgcggccggugcc

SEQ ID NO: 969296 - RNA, 24 nt, Human
cgccaugacgaugccgccgcagcc

SEQ ID NO: 969297 - RNA, 20 nt, Human
cgccgcuccggccgccgccc

SEQ ID NO: 969298 - RNA, 22 nt, Human
cgccucgucccccugcagcucg

SEQ ID NO: 969299 - RNA, 20 nt, Human
cgggccccucgucgccgccc

SEQ ID NO: 969300 - RNA, 23 nt, Human
cuccucgccgccgccgccgccgc

SEQ ID NO: 969301 - RNA, 20 nt, Human
cugcgugcuguccccgcccc

SEQ ID NO: 969302 - RNA, 19 nt, Human
gaacaggauuccuauauag

SEQ ID NO: 969303 - RNA, 20 nt, Human
gaacucgggcagcgccgaca

SEQ ID NO: 969304 - RNA, 21 nt, Human
gaacucgggcagcgccgacag

SEQ ID NO: 969305 - RNA, 23 nt, Human
gagcagcaaguacaucauguugg

SEQ ID NO: 969306 - RNA, 23 nt, Human
gaugcccaggagcaccugggccc

SEQ ID NO: 969307 - RNA, 24 nt, Human
gcaccugggccccaaugagcagca

SEQ ID NO: 969308 - RNA, 21 nt, Human
gcagcgccgacagcagcgcgc

SEQ ID NO: 969309 - RNA, 19 nt, Human
gccaugacgaugccgccgc

SEQ ID NO: 969310 - RNA, 20 nt, Human
gcccaggagcaccugggccc

SEQ ID NO: 969311 - RNA, 21 nt, Human
gccccgggugucggggccgcu

SEQ ID NO: 969312 - RNA, 22 nt, Human
gcgccgacagcagcgcgcccag

SEQ ID NO: 969313 - RNA, 23 nt, Human
gcgcucugcagguugaaccuacg

SEQ ID NO: 969314 - RNA, 19 nt, Human
gcucacgaagaggaugagc

SEQ ID NO: 969315 - RNA, 21 nt, Human
gcuccucgccgccgccgccgc

SEQ ID NO: 969316 - RNA, 19 nt, Human
gcucgcuuuccauggcggg

SEQ ID NO: 969317 - RNA, 20 nt, Human
gcucugagugcgggggcagg

SEQ ID NO: 969318 - RNA, 19 nt, Human
ggccgcccccguccugccg

SEQ ID NO: 969319 - RNA, 18 nt, Human
ggcgggggugcgcgccuc

SEQ ID NO: 969320 - RNA, 18 nt, Human
gggccgcugccgggcggg

SEQ ID NO: 969321 - RNA, 22 nt, Human
gucgggccccucgucgccgccc

SEQ ID NO: 969322 - RNA, 23 nt, Human
ucccccgccgccgccgccgccgc

SEQ ID NO: 969323 - RNA, 19 nt, Human
ucccccugcagcucgccgc

SEQ ID NO: 969324 - RNA, 21 nt, Human
ucccccugcagcucgccgcuc

SEQ ID NO: 969325 - RNA, 18 nt, Human
uccccugcauccuucccc

SEQ ID NO: 969326 - RNA, 21 nt, Human
uccccugcauccuucccccgc

SEQ ID NO: 969327 - RNA, 18 nt, Human
ucgcccgccucguacuug

SEQ ID NO: 969328 - RNA, 18 nt, Human
ucgccgccgccgccgccg

SEQ ID NO: 969329 - RNA, 18 nt, Human
ucgccgcuccggccgccg

SEQ ID NO: 969330 - RNA, 21 nt, Human
ucgccgcuccggccgccgccc

SEQ ID NO: 969331 - RNA, 18 nt, Human
ucgggccccucgucgccg

SEQ ID NO: 969332 - RNA, 18 nt, Human
ugagcagcaaguacauca

SEQ ID NO: 969333 - RNA, 21 nt, Human
ugagugcgggggcagggacug

SEQ ID NO: 969334 - RNA, 18 nt, Human
ugccggggcuggagaggu

SEQ ID NO: 969335 - RNA, 19 nt, Human
ugccggggcuggagaggug

SEQ ID NO: 969336 - RNA, 19 nt, Human
ugccucaggaccccguugc

SEQ ID NO: 969337 - RNA, 19 nt, Human
ugcgccucgucccccugca

SEQ ID NO: 969338 - RNA, 20 nt, Human
uggaaaagcaggacaccuuc

SEQ ID NO: 969339 - RNA, 23 nt, Human
uggaaaagcaggacaccuucuuu

SEQ ID NO: 969340 - RNA, 21 nt, Human
uggagagguggaaggcacagc

SEQ ID NO: 969341 - RNA, 26 nt, Human
uggcgggcucugagugcgggggcagg

SEQ ID NO: 969342 - RNA, 19 nt, Human
uggucaggacgcucaccag

SEQ ID NO: 969343 - RNA, 23 nt, Human
ugucggggccgcugccgggcggg

SEQ ID NO: 969344 - RNA, 21 nt, Human
uucccccgccgccgccgccgc

SEQ ID NO: 969345 - RNA, 21 nt, Human
uucggagagcauggccugcuc

SEQ ID NO: 969346 - RNA, 22 nt, Human
uugauguuggaaaagcaggaca

SEQ ID NO: 969347 - RNA, 18 nt, Human
aagugguaucugaggggc

SEQ ID NO: 969348 - RNA, 20 nt, Human
acacgaucggguauaaaaca

SEQ ID NO: 969349 - RNA, 19 nt, Human
acagcucuggggacaggag

SEQ ID NO: 969350 - RNA, 24 nt, Human
augcacaguuuuaacugaggacac

SEQ ID NO: 969351 - RNA, 18 nt, Human
cacaguuuuaacugagga

SEQ ID NO: 969352 - RNA, 21 nt, Human
cacaguuuuaacugaggacac

SEQ ID NO: 969353 - RNA, 18 nt, Human
cacgcacaccacacacga

SEQ ID NO: 969354 - RNA, 23 nt, Human
cauaaauauauauuuaugcaagu

SEQ ID NO: 969355 - RNA, 20 nt, Human
caucacccaacggcacuguu

SEQ ID NO: 969356 - RNA, 20 nt, Human
cccacugcagggccguacag

SEQ ID NO: 969357 - RNA, 19 nt, Human
ccgccgcgccgcgcagcgc

SEQ ID NO: 969358 - RNA, 20 nt, Human
ccgccgcgccgcgcagcgcu

SEQ ID NO: 969359 - RNA, 21 nt, Human
ccgucucgagggcccggccgc

SEQ ID NO: 969360 - RNA, 25 nt, Human
cgcacaccacacacgaucggguaua

SEQ ID NO: 969361 - RNA, 22 nt, Human
cgccguggccgggugggcgcgg

SEQ ID NO: 969362 - RNA, 22 nt, Human
cucccagugggauucacagccc

SEQ ID NO: 969363 - RNA, 21 nt, Human
gccgcccucccagugggauuc

SEQ ID NO: 969364 - RNA, 19 nt, Human
ggacacacaagccuuccuc

SEQ ID NO: 969365 - RNA, 20 nt, Human
gugaccucgaggcuucagcc

SEQ ID NO: 969366 - RNA, 19 nt, Human
uacagcucuggggacagga

SEQ ID NO: 969367 - RNA, 18 nt, Human
ucugucaucaggaaaugc

SEQ ID NO: 969368 - RNA, 21 nt, Human
ugagugcccgccguggccggg

SEQ ID NO: 969369 - RNA, 22 nt, Human
ugauugcaucacccaacggcac

SEQ ID NO: 969370 - RNA, 20 nt, Human
ugucaucaggaaaugcugag

SEQ ID NO: 969371 - RNA, 22 nt, Human
uuuuuuuuuuuuuuuuuucagg

SEQ ID NO: 969372 - RNA, 21 nt, Human
aaaaugaaaucuuccucucca

SEQ ID NO: 969373 - RNA, 18 nt, Human
aagcacauguaaauuaau

SEQ ID NO: 969374 - RNA, 19 nt, Human
aauccccaauauaauuugc

SEQ ID NO: 969375 - RNA, 21 nt, Human
acaaagcaaaauaaagugaaa

SEQ ID NO: 969376 - RNA, 23 nt, Human
acagaaagagcugaagcuuuuga

SEQ ID NO: 969377 - RNA, 24 nt, Human
acucugaucuggaggaagagauca

SEQ ID NO: 969378 - RNA, 20 nt, Human
agacugaaagaggaaacuga

SEQ ID NO: 969379 - RNA, 19 nt, Human
agacuuucagaaauucacc

SEQ ID NO: 969380 - RNA, 19 nt, Human
aguaaaugauauaaaauaa

SEQ ID NO: 969381 - RNA, 19 nt, Human
aucucuucucuuuccucuu

SEQ ID NO: 969382 - RNA, 18 nt, Human
aucugcaucuuccauuau

SEQ ID NO: 969383 - RNA, 21 nt, Human
auuguauuucaaggaaaagga

SEQ ID NO: 969384 - RNA, 22 nt, Human
caaaauucuaauccccaauaua

SEQ ID NO: 969385 - RNA, 22 nt, Human
caagaggauggaccacacacca

SEQ ID NO: 969386 - RNA, 27 nt, Human
cacagcaauuuugaacaauuuugccag

SEQ ID NO: 969387 - RNA, 21 nt, Human
cagaaagagcugaagcuuuug

SEQ ID NO: 969388 - RNA, 20 nt, Human
cagggcacagaaagagcuga

SEQ ID NO: 969389 - RNA, 22 nt, Human
ccagggcacagaaagagcugaa

SEQ ID NO: 969390 - RNA, 19 nt, Human
ccuggccucuuuuuucugg

SEQ ID NO: 969391 - RNA, 23 nt, Human
cgaucucuucucuuuccucuuuc

SEQ ID NO: 969392 - RNA, 22 nt, Human
cgccacacaaaaagcacaugua

SEQ ID NO: 969393 - RNA, 21 nt, Human
cuaaugccuaggaccaaaaca

SEQ ID NO: 969394 - RNA, 19 nt, Human
cuccauguucugcuccauc

SEQ ID NO: 969395 - RNA, 19 nt, Human
cucuucucuuuccucuuuc

SEQ ID NO: 969396 - RNA, 22 nt, Human
cugagcgaucucuucucuuucc

SEQ ID NO: 969397 - RNA, 27 nt, Human
cuuuccucuuucuuccuggccucuuuu

SEQ ID NO: 969398 - RNA, 19 nt, Human
cuuucuuccuggccucuuu

SEQ ID NO: 969399 - RNA, 19 nt, Human
cuuuugagccauuucuuug

SEQ ID NO: 969400 - RNA, 21 nt, Human
gagaaaauacuauaggaguaa

SEQ ID NO: 969401 - RNA, 21 nt, Human
gccacacaaaaagcacaugua

SEQ ID NO: 969402 - RNA, 18 nt, Human
ggaggagcuuaaaaugaa

SEQ ID NO: 969403 - RNA, 20 nt, Human
gggaaaagaaaagaugaagg

SEQ ID NO: 969404 - RNA, 21 nt, Human
uaaauauaaccaugugugaca

SEQ ID NO: 969405 - RNA, 24 nt, Human
uagccaguuccuuucaaugugcuc

SEQ ID NO: 969406 - RNA, 21 nt, Human
uaggaccaaaacaaaguagac

SEQ ID NO: 969407 - RNA, 23 nt, Human
uaggaccaaaacaaaguagacug

SEQ ID NO: 969408 - RNA, 21 nt, Human
uauaucaaugagcacaaagca

SEQ ID NO: 969409 - RNA, 22 nt, Human
uauuguauuucaaggaaaagga

SEQ ID NO: 969410 - RNA, 19 nt, Human
ucaaaauucuaauccccaa

SEQ ID NO: 969411 - RNA, 21 nt, Human
ucaccccugagcgaucucuuc

SEQ ID NO: 969412 - RNA, 23 nt, Human
ucagaaauucaccuuucaaacau

SEQ ID NO: 969413 - RNA, 23 nt, Human
uccacagcaauuuugaacaauuu

SEQ ID NO: 969414 - RNA, 24 nt, Human
uccauccuaagaucauuauuaaaa

SEQ ID NO: 969415 - RNA, 21 nt, Human
ucuccauguucugcuccaucc

SEQ ID NO: 969416 - RNA, 25 nt, Human
ucuuuccucuuucuuccuggccucu

SEQ ID NO: 969417 - RNA, 19 nt, Human
ugacgugcaucucagcucc

SEQ ID NO: 969418 - RNA, 20 nt, Human
ugacgugcaucucagcuccc

SEQ ID NO: 969419 - RNA, 19 nt, Human
ugagcacaaagcaaaauaa

SEQ ID NO: 969420 - RNA, 20 nt, Human
ugagcacaaagcaaaauaaa

SEQ ID NO: 969421 - RNA, 22 nt, Human
ugccuaggaccaaaacaaagua

SEQ ID NO: 969422 - RNA, 25 nt, Human
ugccuaggaccaaaacaaaguagac

SEQ ID NO: 969423 - RNA, 18 nt, Human
uggcagucagcagagaau

SEQ ID NO: 969424 - RNA, 22 nt, Human
ugugacaauagagacaauuguu

SEQ ID NO: 969425 - RNA, 18 nt, Human
ugugcucagcaagaggau

SEQ ID NO: 969426 - RNA, 23 nt, Human
uguucugcuccauccuaagauca

SEQ ID NO: 969427 - RNA, 19 nt, Human
uuauauauuucaguauauu

SEQ ID NO: 969428 - RNA, 22 nt, Human
uucaaacauguuuuaggaacac

SEQ ID NO: 969429 - RNA, 18 nt, Human
uugaaaggagaaagaaau

SEQ ID NO: 969430 - RNA, 18 nt, Human
uugaaggaacccaaggua

SEQ ID NO: 969431 - RNA, 19 nt, Human
uugacucugaucuggagga

SEQ ID NO: 969432 - RNA, 18 nt, Human
uuuuuuuuuuuuuuccug

SEQ ID NO: 969433 - RNA, 22 nt, Human
uuuuuuuuuuuuuuuuccuguu

SEQ ID NO: 969434 - RNA, 20 nt, Human
aaaagauguggaaauucuua

SEQ ID NO: 969435 - RNA, 23 nt, Human
aaggaccaggaacuccucaaaaa

SEQ ID NO: 969436 - RNA, 21 nt, Human
accacaaauauguagcuauaa

SEQ ID NO: 969437 - RNA, 22 nt, Human
agcuauaauguaacaaugagua

SEQ ID NO: 969438 - RNA, 23 nt, Human
aggaacuccucaaaaauaacauc

SEQ ID NO: 969439 - RNA, 18 nt, Human
auaauguaacaaugagua

SEQ ID NO: 969440 - RNA, 19 nt, Human
auggaucauauagucuaac

SEQ ID NO: 969441 - RNA, 18 nt, Human
caccauaaaagaugugga

SEQ ID NO: 969442 - RNA, 21 nt, Human
ccaagcuagacuucaggccuu

SEQ ID NO: 969443 - RNA, 22 nt, Human
ccuggauuuagaauccuacagc

SEQ ID NO: 969444 - RNA, 24 nt, Human
cuagcuccuccuuuuuaaccucua

SEQ ID NO: 969445 - RNA, 19 nt, Human
gucggacgcgugggcgacc

SEQ ID NO: 969446 - RNA, 22 nt, Human
ucaaaaauaacaucuuacugaa

SEQ ID NO: 969447 - RNA, 23 nt, Human
uccaccauaaaagauguggaaau

SEQ ID NO: 969448 - RNA, 19 nt, Human
ucuuccacaauacuuaaau

SEQ ID NO: 969449 - RNA, 19 nt, Human
ugaguacucucauuuuuuc

SEQ ID NO: 969450 - RNA, 22 nt, Human
ugcucaguuugaaacaaucacc

SEQ ID NO: 969451 - RNA, 23 nt, Human
uguuuguuuaauaaaauagacac

SEQ ID NO: 969452 - RNA, 19 nt, Human
uuacugaaucaaugcaaug

SEQ ID NO: 969453 - RNA, 22 nt, Human
uuugaaacaaucaccuggauuu

SEQ ID NO: 969454 - RNA, 19 nt, Human
uuuuuuuuuuuuuuugcaa

SEQ ID NO: 969455 - RNA, 23 nt, Human
aggaacaccucaaaaauaacauc

SEQ ID NO: 969456 - RNA, 28 nt, Human
caggaacaccucaaaaauaacaucuuaa

SEQ ID NO: 969457 - RNA, 22 nt, Human
caggccagauuuuggccuaagu

SEQ ID NO: 969458 - RNA, 19 nt, Human
cagugaaagaccaggaaca

SEQ ID NO: 969459 - RNA, 18 nt, Human
cuaucuuguccuuuuuac

SEQ ID NO: 969460 - RNA, 25 nt, Human
cugaaaaauauacaacuuaacauga

SEQ ID NO: 969461 - RNA, 21 nt, Human
uaaacuacagauaccacguga

SEQ ID NO: 969462 - RNA, 21 nt, Human
uagcaguuacaacuaccaaac

SEQ ID NO: 969463 - RNA, 23 nt, Human
uaucuuguccuuuuuaccucccu

SEQ ID NO: 969464 - RNA, 22 nt, Human
ucaaaaauaacaucuuaaugaa

SEQ ID NO: 969465 - RNA, 20 nt, Human
uccacuguaaguaaagaaug

SEQ ID NO: 969466 - RNA, 19 nt, Human
ugccucucacuuuaaauuu

SEQ ID NO: 969467 - RNA, 18 nt, Human
uguccuuuuuaccucccu

SEQ ID NO: 969468 - RNA, 20 nt, Human
uguuggaauugucagugaaa

SEQ ID NO: 969469 - RNA, 18 nt, Human
uuuuuuuuuuuuuuuucg

SEQ ID NO: 969470 - RNA, 25 nt, Human
uuuuuuuuuuuuuuuuucgaauuuu

SEQ ID NO: 969471 - RNA, 22 nt, Human
aauuucuccacagggucuuauu

SEQ ID NO: 969472 - RNA, 19 nt, Human
agcuggggcgcuccccaag

SEQ ID NO: 969473 - RNA, 19 nt, Human
cauuucuugauagcaaggu

SEQ ID NO: 969474 - RNA, 22 nt, Human
ccacugccgcuccgaaacuugc

SEQ ID NO: 969475 - RNA, 19 nt, Human
ccagaguuuacuguaugac

SEQ ID NO: 969476 - RNA, 18 nt, Human
ccgggggacaggcaggcu

SEQ ID NO: 969477 - RNA, 20 nt, Human
cgggugaugacagcguucuc

SEQ ID NO: 969478 - RNA, 23 nt, Human
ggaacaacgaauuucuccacagg

SEQ ID NO: 969479 - RNA, 19 nt, Human
guaaagcaaggacauuauc

SEQ ID NO: 969480 - RNA, 18 nt, Human
uagaacguucccggggga

SEQ ID NO: 969481 - RNA, 24 nt, Human
uaucuggaagaaucauccagaguu

SEQ ID NO: 969482 - RNA, 24 nt, Human
ucagugggaacaacgaauuucucc

SEQ ID NO: 969483 - RNA, 18 nt, Human
uccccaaggauguuagaa

SEQ ID NO: 969484 - RNA, 19 nt, Human
uugauagcaagguucauuu

SEQ ID NO: 969485 - RNA, 19 nt, Human
aagaugcuuuccugaacca

SEQ ID NO: 969486 - RNA, 26 nt, Human
acagcagccuccuuggcugcuccucc

SEQ ID NO: 969487 - RNA, 19 nt, Human
acugccguugccuccgcag

SEQ ID NO: 969488 - RNA, 20 nt, Human
aggagcagcacugccguugc

SEQ ID NO: 969489 - RNA, 18 nt, Human
cacugccguugccuccgc

SEQ ID NO: 969490 - RNA, 23 nt, Human
caggcccagcccaguggcugggg

SEQ ID NO: 969491 - RNA, 22 nt, Human
caguggcugggggcugaggccu

SEQ ID NO: 969492 - RNA, 23 nt, Human
cccacacuugggucaccauuucc

SEQ ID NO: 969493 - RNA, 20 nt, Human
ccccacacuugggucaccau

SEQ ID NO: 969494 - RNA, 19 nt, Human
ccuccgcagcuggguugcu

SEQ ID NO: 969495 - RNA, 20 nt, Human
ccuccuucuuccccggucuc

SEQ ID NO: 969496 - RNA, 20 nt, Human
ccuguaggaccuucccuccc

SEQ ID NO: 969497 - RNA, 19 nt, Human
ccuucccucccuuuagggu

SEQ ID NO: 969498 - RNA, 21 nt, Human
ccuucccucccuuuaggguuc

SEQ ID NO: 969499 - RNA, 21 nt, Human
ccuuggcugcuccuccuucuu

SEQ ID NO: 969500 - RNA, 19 nt, Human
cucccuuuucccuugcagc

SEQ ID NO: 969501 - RNA, 19 nt, Human
cugaaccacaacccccaca

SEQ ID NO: 969502 - RNA, 21 nt, Human
gaaccacaacccccacacuug

SEQ ID NO: 969503 - RNA, 19 nt, Human
gaccuguaggaccuucccu

SEQ ID NO: 969504 - RNA, 20 nt, Human
gcagcuggguugcuccggga

SEQ ID NO: 969505 - RNA, 19 nt, Human
ggagcagcacugccguugc

SEQ ID NO: 969506 - RNA, 18 nt, Human
ggcugggggcugaggccu

SEQ ID NO: 969507 - RNA, 21 nt, Human
ggcugggggcugaggccuucc

SEQ ID NO: 969508 - RNA, 30 nt, Human
ggcugggggcugaggccuuccagucccagg

SEQ ID NO: 969509 - RNA, 23 nt, Human
guggcugggggcugaggccuucc

SEQ ID NO: 969510 - RNA, 26 nt, Human
ucccugaucugucccucccuuuuccc

SEQ ID NO: 969511 - RNA, 19 nt, Human
ucccuuuucccuugcagcu

SEQ ID NO: 969512 - RNA, 19 nt, Human
ucugucccucccuuuuccc

SEQ ID NO: 969513 - RNA, 20 nt, Human
ucugucccucccuuuucccu

SEQ ID NO: 969514 - RNA, 22 nt, Human
uuccuccuccuugugugggugg

SEQ ID NO: 969515 - RNA, 22 nt, Human
aagaggucaaggagcccagagc

SEQ ID NO: 969516 - RNA, 21 nt, Human
agcccagaguguggagggacc

SEQ ID NO: 969517 - RNA, 20 nt, Human
agggaccauucaugcugcug

SEQ ID NO: 969518 - RNA, 19 nt, Human
auucaugcugcuggugcaa

SEQ ID NO: 969519 - RNA, 23 nt, Human
caagaggucaaggagcccagagc

SEQ ID NO: 969520 - RNA, 18 nt, Human
cagcugccucuucucaag

SEQ ID NO: 969521 - RNA, 19 nt, Human
cagcugccucuucucaaga

SEQ ID NO: 969522 - RNA, 18 nt, Human
cagugugaauccaucucu

SEQ ID NO: 969523 - RNA, 19 nt, Human
cccagggcugugugccagc

SEQ ID NO: 969524 - RNA, 20 nt, Human
cuccucaaauucaccaagga

SEQ ID NO: 969525 - RNA, 23 nt, Human
cuccucaaauucaccaaggaggg

SEQ ID NO: 969526 - RNA, 24 nt, Human
cuggugcaagauauggcuuuuccu

SEQ ID NO: 969527 - RNA, 21 nt, Human
cugugugccagcugccucuuc

SEQ ID NO: 969528 - RNA, 18 nt, Human
gcccagaguguggaggga

SEQ ID NO: 969529 - RNA, 20 nt, Human
gcccagaguguggagggacc

SEQ ID NO: 969530 - RNA, 24 nt, Human
ucaaggagcccagagcccagagug

SEQ ID NO: 969531 - RNA, 19 nt, Human
ugaauccaucucuccucaa

SEQ ID NO: 969532 - RNA, 18 nt, Human
ugccagcugccucuucuc

SEQ ID NO: 969533 - RNA, 24 nt, Human
uggagggaccauucaugcugcugg

SEQ ID NO: 969534 - RNA, 21 nt, Human
ugggucuucugguggauaugg

SEQ ID NO: 969535 - RNA, 18 nt, Human
aaaauacagaaacaaccc

SEQ ID NO: 969536 - RNA, 23 nt, Human
aaagccccugguagcugugccca

SEQ ID NO: 969537 - RNA, 19 nt, Human
acuacaacgcagaggacca

SEQ ID NO: 969538 - RNA, 18 nt, Human
agagccggccucagcccc

SEQ ID NO: 969539 - RNA, 19 nt, Human
agaggaccaggcaggccag

SEQ ID NO: 969540 - RNA, 21 nt, Human
aggcacucacgggccaggcuu

SEQ ID NO: 969541 - RNA, 18 nt, Human
agggaggggugugcaaga

SEQ ID NO: 969542 - RNA, 24 nt, Human
agugcagccuggcccgagccaccu

SEQ ID NO: 969543 - RNA, 25 nt, Human
caaaagccccugguagcugugccca

SEQ ID NO: 969544 - RNA, 28 nt, Human
caaagcaaagcccguggauauauccaag

SEQ ID NO: 969545 - RNA, 22 nt, Human
caagauuaacaaugcuaaaucc

SEQ ID NO: 969546 - RNA, 18 nt, Human
caccuuuauuucagagug

SEQ ID NO: 969547 - RNA, 23 nt, Human
cagaguggccccaccugcccuug

SEQ ID NO: 969548 - RNA, 23 nt, Human
caggcuucacucgacucuucuca

SEQ ID NO: 969549 - RNA, 21 nt, Human
cauccagggauucgaaagggu

SEQ ID NO: 969550 - RNA, 21 nt, Human
ccaggauauaguucagaucgc

SEQ ID NO: 969551 - RNA, 22 nt, Human
ccccaccugcccuugcccccuc

SEQ ID NO: 969552 - RNA, 20 nt, Human
ccggccucagcccccucagc

SEQ ID NO: 969553 - RNA, 24 nt, Human
ccuccccugcuuucgguaagaacc

SEQ ID NO: 969554 - RNA, 21 nt, Human
ccuggcccgagccaccuuccc

SEQ ID NO: 969555 - RNA, 24 nt, Human
ccuggcccgagccaccuucccggc

SEQ ID NO: 969556 - RNA, 21 nt, Human
ccuuggcucuggccccguagc

SEQ ID NO: 969557 - RNA, 19 nt, Human
ccuugucauaugcugucca

SEQ ID NO: 969558 - RNA, 22 nt, Human
cgaaggggaagaaggcugugcu

SEQ ID NO: 969559 - RNA, 22 nt, Human
cggcaagugacgaccuccuucu

SEQ ID NO: 969560 - RNA, 21 nt, Human
cuaaauccucaagcugacuga

SEQ ID NO: 969561 - RNA, 18 nt, Human
cuccuugggguagccgcu

SEQ ID NO: 969562 - RNA, 23 nt, Human
cuccuugggguagccgcuguugg

SEQ ID NO: 969563 - RNA, 20 nt, Human
cugauccuccuuuuccucaa

SEQ ID NO: 969564 - RNA, 23 nt, Human
cuggccccguagcaguguggaca

SEQ ID NO: 969565 - RNA, 19 nt, Human
cugggcucugggggagggg

SEQ ID NO: 969566 - RNA, 18 nt, Human
cuugcccccucuaggcua

SEQ ID NO: 969567 - RNA, 27 nt, Human
cuuggcucuggccccguagccgguucc

SEQ ID NO: 969568 - RNA, 18 nt, Human
cuugguuacagggagggg

SEQ ID NO: 969569 - RNA, 18 nt, Human
gaagcuuccuuggcucug

SEQ ID NO: 969570 - RNA, 20 nt, Human
gaucgcugcugagugacaac

SEQ ID NO: 969571 - RNA, 19 nt, Human
gccuacucaguuccuucuc

SEQ ID NO: 969572 - RNA, 21 nt, Human
gccuacucaguuccuucucaa

SEQ ID NO: 969573 - RNA, 20 nt, Human
gcugcggcuuccuccccuga

SEQ ID NO: 969574 - RNA, 21 nt, Human
gcugcggcuuccuccccugcu

SEQ ID NO: 969575 - RNA, 21 nt, Human
ggacagagcacggguuuugag

SEQ ID NO: 969576 - RNA, 21 nt, Human
gggaggggcugggcugcccag

SEQ ID NO: 969577 - RNA, 24 nt, Human
gggggaggggcugggcugcccagu

SEQ ID NO: 969578 - RNA, 24 nt, Human
ggguagccgcuguuggggcugucu

SEQ ID NO: 969579 - RNA, 19 nt, Human
ggugugcaagagccugggc

SEQ ID NO: 969580 - RNA, 27 nt, Human
gguuaggggcuuccaaaagccccuggu

SEQ ID NO: 969581 - RNA, 21 nt, Human
guagcaguguggacagagcac

SEQ ID NO: 969582 - RNA, 23 nt, Human
guuaaaauacagaaacaacccuu

SEQ ID NO: 969583 - RNA, 23 nt, Human
uagcacuacaacgcagaggacca

SEQ ID NO: 969584 - RNA, 18 nt, Human
uaggggcuuccaaaagcc

SEQ ID NO: 969585 - RNA, 24 nt, Human
uauaguucagaucgcugcugagug

SEQ ID NO: 969586 - RNA, 19 nt, Human
uaugcuguccagaaugaag

SEQ ID NO: 969587 - RNA, 20 nt, Human
uauuucagaguguuccuuga

SEQ ID NO: 969588 - RNA, 23 nt, Human
uauuucagaguguuccuugguua

SEQ ID NO: 969589 - RNA, 19 nt, Human
ucagaucgcugcugaguga

SEQ ID NO: 969590 - RNA, 18 nt, Human
ucagcccccucagccauc

SEQ ID NO: 969591 - RNA, 23 nt, Human
ucagcccccucagccauccaggg

SEQ ID NO: 969592 - RNA, 21 nt, Human
uccccugcuuucgguaagaac

SEQ ID NO: 969593 - RNA, 21 nt, Human
ucccgagauugagguagcacu

SEQ ID NO: 969594 - RNA, 23 nt, Human
uccuuggcucuggccccguagca

SEQ ID NO: 969595 - RNA, 22 nt, Human
ugaaacagcuagagagagggcg

SEQ ID NO: 969596 - RNA, 20 nt, Human
ugcccccucuaggcuaagug

SEQ ID NO: 969597 - RNA, 19 nt, Human
uggcccgagccaccuuccc

SEQ ID NO: 969598 - RNA, 24 nt, Human
uggcccgagccaccuucccggcaa

SEQ ID NO: 969599 - RNA, 18 nt, Human
uggggcugucugggggaa

SEQ ID NO: 969600 - RNA, 24 nt, Human
ugucugggggaagaaguggaagcu

SEQ ID NO: 969601 - RNA, 26 nt, Human
ugugacuaccuguuaagguccugcaa

SEQ ID NO: 969602 - RNA, 22 nt, Human
uucauugcuuuuaaaaauucug

SEQ ID NO: 969603 - RNA, 19 nt, Human
uugaaaaguaggugguuag

SEQ ID NO: 969604 - RNA, 24 nt, Human
uugugacuaccuguuaagguccug

SEQ ID NO: 969605 - RNA, 19 nt, Human
aagaggaacacaggagaca

SEQ ID NO: 969606 - RNA, 24 nt, Human
aauaccuauuuauuaucuuacagc

SEQ ID NO: 969607 - RNA, 18 nt, Human
aguuacuaaaaaaaacca

SEQ ID NO: 969608 - RNA, 24 nt, Human
auacagccaaaacuauaaucucaa

SEQ ID NO: 969609 - RNA, 21 nt, Human
auagcaaauauccauuaucuc

SEQ ID NO: 969610 - RNA, 21 nt, Human
cagaggcgcccucggcuccga

SEQ ID NO: 969611 - RNA, 22 nt, Human
cagcgcucucgcagaggcgccc

SEQ ID NO: 969612 - RNA, 23 nt, Human
ccuucauaauuauacaccuggcc

SEQ ID NO: 969613 - RNA, 20 nt, Human
cgcagcgcucucgcagaggc

SEQ ID NO: 969614 - RNA, 25 nt, Human
cuccgaaaaugucucuggaaagaag

SEQ ID NO: 969615 - RNA, 22 nt, Human
gcccucggcuccgaaaaugucu

SEQ ID NO: 969616 - RNA, 20 nt, Human
ggcgggaggacaagggagug

SEQ ID NO: 969617 - RNA, 22 nt, Human
ggcugggcugguccucaagcgc

SEQ ID NO: 969618 - RNA, 23 nt, Human
uacaccuggccgaucgauagucu

SEQ ID NO: 969619 - RNA, 23 nt, Human
uagcaaauauccauuaucucaag

SEQ ID NO: 969620 - RNA, 27 nt, Human
uaggaaaaaugcugaucaauacaaugg

SEQ ID NO: 969621 - RNA, 21 nt, Human
uauuucauguuuccuacuugu

SEQ ID NO: 969622 - RNA, 19 nt, Human
uauuuuuuucuucucacag

SEQ ID NO: 969623 - RNA, 24 nt, Human
uauuuuuuucuucucacaguuuua

SEQ ID NO: 969624 - RNA, 20 nt, Human
ucgccaggcgggaggacaag

SEQ ID NO: 969625 - RNA, 18 nt, Human
ucgcgcgaucuccggcgc

SEQ ID NO: 969626 - RNA, 22 nt, Human
ucggaaccuguucgcagcgcuc

SEQ ID NO: 969627 - RNA, 18 nt, Human
ugaaauaaauauaugauu

SEQ ID NO: 969628 - RNA, 18 nt, Human
ugccuauagacauuuuuu

SEQ ID NO: 969629 - RNA, 19 nt, Human
uggaauaccuugauuuaaa

SEQ ID NO: 969630 - RNA, 24 nt, Human
uggcucccuguggagcagcaaucc

SEQ ID NO: 969631 - RNA, 22 nt, Human
uguguuagaagagauuugggag

SEQ ID NO: 969632 - RNA, 18 nt, Human
uuggguuggcucaccgca

SEQ ID NO: 969633 - RNA, 21 nt, Human
uugugaagcauugaagaggaa

SEQ ID NO: 969634 - RNA, 23 nt, Human
uuuaaauaccucauuguuucaua

SEQ ID NO: 969635 - RNA, 26 nt, Human
uuuaaauaccucauuguuucauauua

SEQ ID NO: 969636 - RNA, 20 nt, Human
uuuaagcauuucuagaccuu

SEQ ID NO: 969637 - RNA, 23 nt, Human
uuuuuuuuuuuuuuuuuuuaugg

SEQ ID NO: 969638 - RNA, 20 nt, Human
accagcagggugggcaccgg

SEQ ID NO: 969639 - RNA, 27 nt, Human
accagcagggugggcaccgggcaggcc

SEQ ID NO: 969640 - RNA, 20 nt, Human
acccacuggcugcuggagcu

SEQ ID NO: 969641 - RNA, 21 nt, Human
accuuggaggcugcaugaugg

SEQ ID NO: 969642 - RNA, 20 nt, Human
acugcaccugagggcugagc

SEQ ID NO: 969643 - RNA, 21 nt, Human
agaggcugcugggcaggccug

SEQ ID NO: 969644 - RNA, 20 nt, Human
agagguucuugauuucugag

SEQ ID NO: 969645 - RNA, 19 nt, Human
agccgccccuuuguugucc

SEQ ID NO: 969646 - RNA, 24 nt, Human
agcgucaggucaggcccaucccuc

SEQ ID NO: 969647 - RNA, 21 nt, Human
aggcagagguucuugauuucu

SEQ ID NO: 969648 - RNA, 23 nt, Human
aggcccacuagcauggcugguuu

SEQ ID NO: 969649 - RNA, 20 nt, Human
agggagcagaggcugcuggg

SEQ ID NO: 969650 - RNA, 22 nt, Human
agggccuccuuucccaguuggg

SEQ ID NO: 969651 - RNA, 18 nt, Human
agugcagcucuugggugg

SEQ ID NO: 969652 - RNA, 24 nt, Human
auccacaugguaaagccuguugug

SEQ ID NO: 969653 - RNA, 23 nt, Human
cacagaugggaggggagggcugg

SEQ ID NO: 969654 - RNA, 19 nt, Human
cacagcacccugggcccug

SEQ ID NO: 969655 - RNA, 20 nt, Human
cacagcacccugggcccuga

SEQ ID NO: 969656 - RNA, 25 nt, Human
cacccuguuggggagagcguguccu

SEQ ID NO: 969657 - RNA, 20 nt, Human
caccgcggcaucaagcaggu

SEQ ID NO: 969658 - RNA, 18 nt, Human
cacugugggccagccugu

SEQ ID NO: 969659 - RNA, 22 nt, Human
cagagggccuccuuucccaguu

SEQ ID NO: 969660 - RNA, 24 nt, Human
cagaugggaggggagggcuggggg

SEQ ID NO: 969661 - RNA, 20 nt, Human
cagcagggugggcaccgggc

SEQ ID NO: 969662 - RNA, 19 nt, Human
cagcaguggcuugcagacg

SEQ ID NO: 969663 - RNA, 19 nt, Human
cagcaguggcuugcagacg

SEQ ID NO: 969664 - RNA, 21 nt, Human
cagccaggcugaccaguacgu

SEQ ID NO: 969665 - RNA, 21 nt, Human
cagcgccuggauccugcgccc

SEQ ID NO: 969666 - RNA, 21 nt, Human
caguggcuugcagacgucugc

SEQ ID NO: 969667 - RNA, 19 nt, Human
caucccuccugagcugagg

SEQ ID NO: 969668 - RNA, 19 nt, Human
ccagcagggugggcaccgg

SEQ ID NO: 969669 - RNA, 18 nt, Human
ccaggcuggguagggcca

SEQ ID NO: 969670 - RNA, 19 nt, Human
cccagagccccuuacagag

SEQ ID NO: 969671 - RNA, 18 nt, Human
cccagccccccgcugcca

SEQ ID NO: 969672 - RNA, 24 nt, Human
cccagccccccgcugccggggccg

SEQ ID NO: 969673 - RNA, 21 nt, Human
ccccaggagggagcagaggcu

SEQ ID NO: 969674 - RNA, 23 nt, Human
ccccaggugcugauccaagccuc

SEQ ID NO: 969675 - RNA, 19 nt, Human
ccccccgcugccacacagc

SEQ ID NO: 969676 - RNA, 22 nt, Human
ccccccgcugccacacagccag

SEQ ID NO: 969677 - RNA, 19 nt, Human
ccccuuguucccccaccuc

SEQ ID NO: 969678 - RNA, 20 nt, Human
ccgcaccuggcuccuggugc

SEQ ID NO: 969679 - RNA, 18 nt, Human
ccucacaggcgcggaggg

SEQ ID NO: 969680 - RNA, 21 nt, Human
ccucaggcccacuagcauggc

SEQ ID NO: 969681 - RNA, 23 nt, Human
ccuccugagcugagggacggugc

SEQ ID NO: 969682 - RNA, 21 nt, Human
ccugcaggcucaggguuggcu

SEQ ID NO: 969683 - RNA, 19 nt, Human
ccugcgugugaucagaggg

SEQ ID NO: 969684 - RNA, 22 nt, Human
cgccgaagcacccuguugggga

SEQ ID NO: 969685 - RNA, 20 nt, Human
cggaagaccccuuguucccc

SEQ ID NO: 969686 - RNA, 21 nt, Human
cggugggcuuccugcaggucu

SEQ ID NO: 969687 - RNA, 22 nt, Human
cgucccagagccccuuacagag

SEQ ID NO: 969688 - RNA, 23 nt, Human
cucggaagaccccuuguuccccc

SEQ ID NO: 969689 - RNA, 23 nt, Human
cucuuggguggcuccucccuggg

SEQ ID NO: 969690 - RNA, 22 nt, Human
cugcaggucucccugcaggcuc

SEQ ID NO: 969691 - RNA, 21 nt, Human
cugugugcuggagggagcccc

SEQ ID NO: 969692 - RNA, 23 nt, Human
gaagaccccuuguucccccaccu

SEQ ID NO: 969693 - RNA, 25 nt, Human
gaagcacccuguuggggagagcgug

SEQ ID NO: 969694 - RNA, 21 nt, Human
gaccccuuguucccccaccuc

SEQ ID NO: 969695 - RNA, 21 nt, Human
gagcguguccuugcuggcugu

SEQ ID NO: 969696 - RNA, 19 nt, Human
gaggcugcaugauggcggg

SEQ ID NO: 969697 - RNA, 18 nt, Human
gagguucuugauuucuga

SEQ ID NO: 969698 - RNA, 21 nt, Human
gcacaagagugcagcucuugg

SEQ ID NO: 969699 - RNA, 20 nt, Human
gccagccugucucggaggca

SEQ ID NO: 969700 - RNA, 20 nt, Human
gccuggauccugcgcccggg

SEQ ID NO: 969701 - RNA, 20 nt, Human
gcgcccgggcaguccugggc

SEQ ID NO: 969702 - RNA, 18 nt, Human
gcggcgggcagggucugg

SEQ ID NO: 969703 - RNA, 21 nt, Human
gcggcgggcagggucugggcg

SEQ ID NO: 969704 - RNA, 21 nt, Human
gcucggaagaccccuuguucc

SEQ ID NO: 969705 - RNA, 18 nt, Human
gcuguggguccccaggag

SEQ ID NO: 969706 - RNA, 21 nt, Human
gcuugcucaggcuucucuccu

SEQ ID NO: 969707 - RNA, 22 nt, Human
ggaggggagggcugggggcugc

SEQ ID NO: 969708 - RNA, 21 nt, Human
ggcagcgccuggauccugcgc

SEQ ID NO: 969709 - RNA, 19 nt, Human
ggccaggcuggguagggcc

SEQ ID NO: 969710 - RNA, 19 nt, Human
ggcuggguagggccacugc

SEQ ID NO: 969711 - RNA, 19 nt, Human
ggcuugcagacgucugcug

SEQ ID NO: 969712 - RNA, 20 nt, Human
gggaggggagggcugggggc

SEQ ID NO: 969713 - RNA, 25 nt, Human
gggcagcgccuggauccugcgcccg

SEQ ID NO: 969714 - RNA, 22 nt, Human
gggcaggccugggcauagggag

SEQ ID NO: 969715 - RNA, 22 nt, Human
gggccagccugucucggaggca

SEQ ID NO: 969716 - RNA, 18 nt, Human
gguagggccacugcaccu

SEQ ID NO: 969717 - RNA, 18 nt, Human
guccucacaggcgcggag

SEQ ID NO: 969718 - RNA, 27 nt, Human
uacguccucagcugggaccagcagcuc

SEQ ID NO: 969719 - RNA, 22 nt, Human
ucacagcacccugggcccugac

SEQ ID NO: 969720 - RNA, 19 nt, Human
ucacaggcgcggagggccc

SEQ ID NO: 969721 - RNA, 24 nt, Human
ucccagagccccuuacagaggcac

SEQ ID NO: 969722 - RNA, 21 nt, Human
uccccaggagggagcagaggc

SEQ ID NO: 969723 - RNA, 18 nt, Human
uccccagggcagcugugg

SEQ ID NO: 969724 - RNA, 21 nt, Human
ucccccaccucccgccgaagc

SEQ ID NO: 969725 - RNA, 22 nt, Human
ucccugugugugucugcuggcc

SEQ ID NO: 969726 - RNA, 26 nt, Human
ucggaagaccccuuguucccccaccu

SEQ ID NO: 969727 - RNA, 20 nt, Human
ucuccucugcaggcuggcca

SEQ ID NO: 969728 - RNA, 21 nt, Human
ucuugauuucugaguguuugg

SEQ ID NO: 969729 - RNA, 22 nt, Human
ugccacacagccaggcugacca

SEQ ID NO: 969730 - RNA, 21 nt, Human
ugcugggcaggccuggcccug

SEQ ID NO: 969731 - RNA, 22 nt, Human
ugcuggggugagggcugugugc

SEQ ID NO: 969732 - RNA, 23 nt, Human
ugcuguggguccccaggagggag

SEQ ID NO: 969733 - RNA, 19 nt, Human
uggcaagaccaccgaggac

SEQ ID NO: 969734 - RNA, 22 nt, Human
uggcaccuuggaggcugcauga

SEQ ID NO: 969735 - RNA, 20 nt, Human
ugggaagggucucagcagug

SEQ ID NO: 969736 - RNA, 21 nt, Human
ugggaccagcagcucaaccuc

SEQ ID NO: 969737 - RNA, 19 nt, Human
ugggaugacgaggggcugg

SEQ ID NO: 969738 - RNA, 22 nt, Human
ugggcccugacgcuggugcagg

SEQ ID NO: 969739 - RNA, 19 nt, Human
uggggagagcguguccuug

SEQ ID NO: 969740 - RNA, 20 nt, Human
uggggagagcguguccuugc

SEQ ID NO: 969741 - RNA, 21 nt, Human
uggggagagcguguccuugcu

SEQ ID NO: 969742 - RNA, 21 nt, Human
uggggugagggcugugugcug

SEQ ID NO: 969743 - RNA, 18 nt, Human
uguucccccaccucccgc

SEQ ID NO: 969744 - RNA, 18 nt, Human
uguuguccccagcccccc

SEQ ID NO: 969745 - RNA, 21 nt, Human
uuacagaggcacagaugggag

SEQ ID NO: 969746 - RNA, 21 nt, Human
uuccuggcccuaagggucauu

SEQ ID NO: 969747 - RNA, 25 nt, Human
uuuccuggcccuaagggucauuuua

SEQ ID NO: 969748 - RNA, 27 nt, Human
aaaaauauuagggggagaccgguaccc

SEQ ID NO: 969749 - RNA, 24 nt, Human
aacccccuucuuaauauucugcca

SEQ ID NO: 969750 - RNA, 21 nt, Human
aagcaccaagacgacuucccc

SEQ ID NO: 969751 - RNA, 22 nt, Human
aagcaccaagacgacuuccccc

SEQ ID NO: 969752 - RNA, 21 nt, Human
aagcagagcacggaggccaga

SEQ ID NO: 969753 - RNA, 25 nt, Human
aagcauacuaggaguuauguuugcu

SEQ ID NO: 969754 - RNA, 27 nt, Human
aagccaggacagccuugaggcagagga

SEQ ID NO: 969755 - RNA, 20 nt, Human
aaucuccuuccacacaaccc

SEQ ID NO: 969756 - RNA, 22 nt, Human
acaggagcaaaaaaaggaagag

SEQ ID NO: 969757 - RNA, 25 nt, Human
accccauccuuucccuugccuguga

SEQ ID NO: 969758 - RNA, 25 nt, Human
accucgaugaccuggaauacagcua

SEQ ID NO: 969759 - RNA, 20 nt, Human
agagcacggaggccagaagc

SEQ ID NO: 969760 - RNA, 22 nt, Human
agagcacggaggccagaagcac

SEQ ID NO: 969761 - RNA, 20 nt, Human
agagccucccacccccacau

SEQ ID NO: 969762 - RNA, 21 nt, Human
agcagcgccagacugagcgcg

SEQ ID NO: 969763 - RNA, 20 nt, Human
agccacuguuggguuacccc

SEQ ID NO: 969764 - RNA, 23 nt, Human
agccacuguuggguuaccccauc

SEQ ID NO: 969765 - RNA, 22 nt, Human
agccaugcucaugccuccucug

SEQ ID NO: 969766 - RNA, 19 nt, Human
agccuugaggcagaggagg

SEQ ID NO: 969767 - RNA, 18 nt, Human
agcuauacuugucugcau

SEQ ID NO: 969768 - RNA, 26 nt, Human
aggaagaaguggaaagcaugacagaa

SEQ ID NO: 969769 - RNA, 20 nt, Human
aggacagccuugaggcagag

SEQ ID NO: 969770 - RNA, 20 nt, Human
aggagggguuaggugcuuca

SEQ ID NO: 969771 - RNA, 23 nt, Human
aggaggugggcugacuaccucga

SEQ ID NO: 969772 - RNA, 19 nt, Human
aggcagagaaaaugggggg

SEQ ID NO: 969773 - RNA, 18 nt, Human
aggcagaggaggugggcc

SEQ ID NO: 969774 - RNA, 19 nt, Human
agggaggagaugagguugg

SEQ ID NO: 969775 - RNA, 18 nt, Human
agggagggauccauggug

SEQ ID NO: 969776 - RNA, 30 nt, Human
agugauggggagagaugauccaggaagaaa

SEQ ID NO: 969777 - RNA, 20 nt, Human
aguuuuguguuuuuauuuug

SEQ ID NO: 969778 - RNA, 18 nt, Human
auacagcuaccccuccca

SEQ ID NO: 969779 - RNA, 24 nt, Human
aucuaacccucccgcuccccccaa

SEQ ID NO: 969780 - RNA, 21 nt, Human
aucuuccaccuguuucuccac

SEQ ID NO: 969781 - RNA, 23 nt, Human
augagguuggaggcaccaugugc

SEQ ID NO: 969782 - RNA, 23 nt, Human
caaccccaagaggcucggcagcu

SEQ ID NO: 969783 - RNA, 22 nt, Human
caagacgccgagcugcagcacg

SEQ ID NO: 969784 - RNA, 19 nt, Human
cacaaaguccacucggcug

SEQ ID NO: 969785 - RNA, 20 nt, Human
cacagcagcaccgacaggac

SEQ ID NO: 969786 - RNA, 18 nt, Human
cacaggcucggacaaaaa

SEQ ID NO: 969787 - RNA, 23 nt, Human
caccaagacgacuucccccggga

SEQ ID NO: 969788 - RNA, 19 nt, Human
caccaccgccaccuugccu

SEQ ID NO: 969789 - RNA, 21 nt, Human
caccagcaaaguacgggaaac

SEQ ID NO: 969790 - RNA, 19 nt, Human
caccagcauccaccaguag

SEQ ID NO: 969791 - RNA, 18 nt, Human
caccgcaaaacuaaccag

SEQ ID NO: 969792 - RNA, 30 nt, Human
caccuccaccuuaaaagccacuguuggggg

SEQ ID NO: 969793 - RNA, 21 nt, Human
cagauaguaaaagaagggccc

SEQ ID NO: 969794 - RNA, 21 nt, Human
cagccagguuggggaggaggg

SEQ ID NO: 969795 - RNA, 20 nt, Human
cagcgucuugaagagagaga

SEQ ID NO: 969796 - RNA, 18 nt, Human
caggccaaagggguucaa

SEQ ID NO: 969797 - RNA, 21 nt, Human
cauccuuucuccucauccaag

SEQ ID NO: 969798 - RNA, 18 nt, Human
ccaaagcucucagcuuca

SEQ ID NO: 969799 - RNA, 20 nt, Human
ccacaccuggggcaccauaa

SEQ ID NO: 969800 - RNA, 20 nt, Human
ccacagaagaggugaagcag

SEQ ID NO: 969801 - RNA, 19 nt, Human
ccaccaccgccaccuugcc

SEQ ID NO: 969802 - RNA, 21 nt, Human
ccaccaccgccaccuugccug

SEQ ID NO: 969803 - RNA, 21 nt, Human
ccaccaccgccaccuugccug

SEQ ID NO: 969804 - RNA, 19 nt, Human
ccaccugggauucuagccu

SEQ ID NO: 969805 - RNA, 20 nt, Human
ccagacugagcgcggagaug

SEQ ID NO: 969806 - RNA, 19 nt, Human
ccagcaaaguacgggaaac

SEQ ID NO: 969807 - RNA, 25 nt, Human
ccaugcucaugccuccucugcuccu

SEQ ID NO: 969808 - RNA, 23 nt, Human
cccaaaucuccuuccacacaacc

SEQ ID NO: 969809 - RNA, 21 nt, Human
cccaccuccaccuuaaaagcc

SEQ ID NO: 969810 - RNA, 22 nt, Human
cccaccuccaccuuaaaagcca

SEQ ID NO: 969811 - RNA, 19 nt, Human
cccccgggaucggcguggg

SEQ ID NO: 969812 - RNA, 18 nt, Human
ccccgggaucggcguggg

SEQ ID NO: 969813 - RNA, 19 nt, Human
cccuccaggcaacagcccc

SEQ ID NO: 969814 - RNA, 25 nt, Human
ccgagcugcagcacgaacaucccca

SEQ ID NO: 969815 - RNA, 19 nt, Human
ccucugcacuccacaugau

SEQ ID NO: 969816 - RNA, 21 nt, Human
ccugccagcuagagaaaagga

SEQ ID NO: 969817 - RNA, 18 nt, Human
ccugggcagcucagccag

SEQ ID NO: 969818 - RNA, 23 nt, Human
ccuuccacacaacccccuucuua

SEQ ID NO: 969819 - RNA, 23 nt, Human
cgacaggaccacugugcaggaga

SEQ ID NO: 969820 - RNA, 19 nt, Human
cgcagucagcaaggaggcc

SEQ ID NO: 969821 - RNA, 20 nt, Human
cgccagacugagcgcggaga

SEQ ID NO: 969822 - RNA, 21 nt, Human
cggacaaaaagguggacaaga

SEQ ID NO: 969823 - RNA, 25 nt, Human
cuagccaucuuccaccuguuucucc

SEQ ID NO: 969824 - RNA, 19 nt, Human
cucccacccccacaugaga

SEQ ID NO: 969825 - RNA, 20 nt, Human
cucccuucucccaaaucucc

SEQ ID NO: 969826 - RNA, 21 nt, Human
cucugccuaaucuuccucgga

SEQ ID NO: 969827 - RNA, 22 nt, Human
cuggaauacagcuaccccuccc

SEQ ID NO: 969828 - RNA, 18 nt, Human
cugggcagcucagccagg

SEQ ID NO: 969829 - RNA, 21 nt, Human
gaacaggagcaaaaaaaggaa

SEQ ID NO: 969830 - RNA, 22 nt, Human
gaagucaaaugagaggguuggg

SEQ ID NO: 969831 - RNA, 20 nt, Human
gaccacaggcucggacaaaa

SEQ ID NO: 969832 - RNA, 18 nt, Human
gagcacgugcagcgcggc

SEQ ID NO: 969833 - RNA, 22 nt, Human
gaggagaugagguuggaggcac

SEQ ID NO: 969834 - RNA, 18 nt, Human
gaggagggguuaggugcu

SEQ ID NO: 969835 - RNA, 19 nt, Human
gauggcccauccuuucucc

SEQ ID NO: 969836 - RNA, 23 nt, Human
gcaaaaaaaggaagagagccucc

SEQ ID NO: 969837 - RNA, 24 nt, Human
gcaccagcaaaguacgggaaacca

SEQ ID NO: 969838 - RNA, 22 nt, Human
gcagagcacggaggccagaagc

SEQ ID NO: 969839 - RNA, 26 nt, Human
gcagagcacggaggccagaagcacca

SEQ ID NO: 969840 - RNA, 19 nt, Human
gcagcucagccagguuggg

SEQ ID NO: 969841 - RNA, 18 nt, Human
gccagacugagcgcggag

SEQ ID NO: 969842 - RNA, 24 nt, Human
gcugcagcacgaacauccccagca

SEQ ID NO: 969843 - RNA, 18 nt, Human
ggaaagcaagagaagagg

SEQ ID NO: 969844 - RNA, 24 nt, Human
ggaaaucuggagagggagggaucc

SEQ ID NO: 969845 - RNA, 22 nt, Human
ggaacaggagcaaaaaaaggaa

SEQ ID NO: 969846 - RNA, 22 nt, Human
ggacacacaccaaauguaauga

SEQ ID NO: 969847 - RNA, 21 nt, Human
ggaggcagacaccgcaaaacc

SEQ ID NO: 969848 - RNA, 18 nt, Human
ggagggguuggggaaauc

SEQ ID NO: 969849 - RNA, 19 nt, Human
gggaaagcaagagaagagg

SEQ ID NO: 969850 - RNA, 22 nt, Human
gggaggcagacaccgcaaaacu

SEQ ID NO: 969851 - RNA, 18 nt, Human
gggaguguugggugggag

SEQ ID NO: 969852 - RNA, 21 nt, Human
gggaguguugggugggagagg

SEQ ID NO: 969853 - RNA, 20 nt, Human
ggggaggagggguuggggaa

SEQ ID NO: 969854 - RNA, 20 nt, Human
ggggguggagauaagaggga

SEQ ID NO: 969855 - RNA, 28 nt, Human
ggugaagcagagcacggaggccagaaaa

SEQ ID NO: 969856 - RNA, 21 nt, Human
gucacccuuucucacagaucc

SEQ ID NO: 969857 - RNA, 18 nt, Human
gucaugguccucaucaca

SEQ ID NO: 969858 - RNA, 20 nt, Human
gugcagcgcggccccgcugg

SEQ ID NO: 969859 - RNA, 21 nt, Human
gugcagcgcggccccgcuggu

SEQ ID NO: 969860 - RNA, 19 nt, Human
uaaaagaagggccccagcc

SEQ ID NO: 969861 - RNA, 21 nt, Human
uaaaagaagggccccagccac

SEQ ID NO: 969862 - RNA, 24 nt, Human
uaaaagacaaugucauugugugaa

SEQ ID NO: 969863 - RNA, 22 nt, Human
uaacaagaugagagggggcaaa

SEQ ID NO: 969864 - RNA, 19 nt, Human
uaagagggaguguugggug

SEQ ID NO: 969865 - RNA, 18 nt, Human
uaaggaaggcagagaaaa

SEQ ID NO: 969866 - RNA, 18 nt, Human
uacagugagaugaagugg

SEQ ID NO: 969867 - RNA, 18 nt, Human
uaccaaggcaagugaugg

SEQ ID NO: 969868 - RNA, 19 nt, Human
uaccaaggcaagugauggg

SEQ ID NO: 969869 - RNA, 21 nt, Human
uacccuccaggcaacagcccc

SEQ ID NO: 969870 - RNA, 21 nt, Human
ucacacacaugucaucagggc

SEQ ID NO: 969871 - RNA, 23 nt, Human
ucacaucuaacccucccgcuccc

SEQ ID NO: 969872 - RNA, 19 nt, Human
ucaggccaaagggguucaa

SEQ ID NO: 969873 - RNA, 25 nt, Human
uccaccaccgccaccuugccuggau

SEQ ID NO: 969874 - RNA, 18 nt, Human
uccauccccucagucacc

SEQ ID NO: 969875 - RNA, 20 nt, Human
ucccaaaucuccuuccacac

SEQ ID NO: 969876 - RNA, 25 nt, Human
uccuuccacacaacccccuucuuaa

SEQ ID NO: 969877 - RNA, 18 nt, Human
ucggaagucucccuucuc

SEQ ID NO: 969878 - RNA, 18 nt, Human
ucucccaaaucuccuucc

SEQ ID NO: 969879 - RNA, 22 nt, Human
ucuggagagggagggauccaug

SEQ ID NO: 969880 - RNA, 21 nt, Human
ugacagaaggaaacaacaggg

SEQ ID NO: 969881 - RNA, 23 nt, Human
ugacagaaggaaacaacaggguu

SEQ ID NO: 969882 - RNA, 18 nt, Human
ugagagggggcaaucugg

SEQ ID NO: 969883 - RNA, 19 nt, Human
ugagagggggcaaucuggg

SEQ ID NO: 969884 - RNA, 21 nt, Human
ugagagggggcaaucuggggg

SEQ ID NO: 969885 - RNA, 21 nt, Human
ugaggcagaggaggugggcug

SEQ ID NO: 969886 - RNA, 22 nt, Human
ugcaaugggcagcgagucagcc

SEQ ID NO: 969887 - RNA, 23 nt, Human
ugcagaacuuaagaccaggacaa

SEQ ID NO: 969888 - RNA, 19 nt, Human
ugcccauuauucaccaguc

SEQ ID NO: 969889 - RNA, 19 nt, Human
ugccuggauggcccauccu

SEQ ID NO: 969890 - RNA, 18 nt, Human
ugcugggggagugggugg

SEQ ID NO: 969891 - RNA, 22 nt, Human
uggaaagcaugacagaaggaaa

SEQ ID NO: 969892 - RNA, 19 nt, Human
uggauggaggccagggagg

SEQ ID NO: 969893 - RNA, 23 nt, Human
ugggaagucaaaugagaggguug

SEQ ID NO: 969894 - RNA, 18 nt, Human
ugggagaagagaaagcug

SEQ ID NO: 969895 - RNA, 19 nt, Human
ugggagagacaaaggcaug

SEQ ID NO: 969896 - RNA, 22 nt, Human
ugggagagacaaaggcauggug

SEQ ID NO: 969897 - RNA, 18 nt, Human
ugggggaguggguggguu

SEQ ID NO: 969898 - RNA, 19 nt, Human
ugggggguggagauaagag

SEQ ID NO: 969899 - RNA, 21 nt, Human
ugggggguggagauaagaggg

SEQ ID NO: 969900 - RNA, 20 nt, Human
uggucaguucggccggacug

SEQ ID NO: 969901 - RNA, 18 nt, Human
uggugggaagucaaauga

SEQ ID NO: 969902 - RNA, 23 nt, Human
uguccauuguucaaguuccccag

SEQ ID NO: 969903 - RNA, 18 nt, Human
ugucugcauggauggagg

SEQ ID NO: 969904 - RNA, 22 nt, Human
ugucugcauggauggaggccag

SEQ ID NO: 969905 - RNA, 19 nt, Human
uguugggugggagaggugg

SEQ ID NO: 969906 - RNA, 22 nt, Human
uguuggguuacccuauaagcag

SEQ ID NO: 969907 - RNA, 25 nt, Human
uuaauauucugccauucacaucuaa

SEQ ID NO: 969908 - RNA, 23 nt, Human
uuagagccuacaaaggucuuacu

SEQ ID NO: 969909 - RNA, 26 nt, Human
uuagggcaccagcaaaguuggagacc

SEQ ID NO: 969910 - RNA, 25 nt, Human
uucaaaccccauccuuucccuugcc

SEQ ID NO: 969911 - RNA, 19 nt, Human
uuccaucucuccuaucuau

SEQ ID NO: 969912 - RNA, 24 nt, Human
uuggggaggagggguuggggaaau

SEQ ID NO: 969913 - RNA, 22 nt, Human
uuuuuuuuuuuuuuggauucca

SEQ ID NO: 969914 - RNA, 18 nt, Human
uuuuuuuuuuuuuuuuug

SEQ ID NO: 969915 - RNA, 22 nt, Human
uuuuuuuuuuuuuuuuuggauu

SEQ ID NO: 969916 - RNA, 21 nt, Human
aaaauaugcaccaguucccuc

SEQ ID NO: 969917 - RNA, 19 nt, Human
aagggugcccugcaccucc

SEQ ID NO: 969918 - RNA, 18 nt, Human
accgcgccacugccagcc

SEQ ID NO: 969919 - RNA, 25 nt, Human
accuggaggcggccuaggggugagg

SEQ ID NO: 969920 - RNA, 21 nt, Human
cagcagugccugugucggcgc

SEQ ID NO: 969921 - RNA, 22 nt, Human
cagcagugccugugucggcguc

SEQ ID NO: 969922 - RNA, 19 nt, Human
cauggcucgcaaguugucc

SEQ ID NO: 969923 - RNA, 21 nt, Human
cccucggucccgacgcaucuu

SEQ ID NO: 969924 - RNA, 20 nt, Human
cccuguaccgcgccacugcc

SEQ ID NO: 969925 - RNA, 21 nt, Human
ccgccagccccauggcucgca

SEQ ID NO: 969926 - RNA, 18 nt, Human
ccucggucccgacgcauc

SEQ ID NO: 969927 - RNA, 22 nt, Human
cgcuccggaaggcggcgccggg

SEQ ID NO: 969928 - RNA, 19 nt, Human
cggugcgggcugcuccugc

SEQ ID NO: 969929 - RNA, 26 nt, Human
cuaggggugaggggcuucucaagggu

SEQ ID NO: 969930 - RNA, 19 nt, Human
cucaagggugcccugcacc

SEQ ID NO: 969931 - RNA, 24 nt, Human
cuccuucccugaguugugugugug

SEQ ID NO: 969932 - RNA, 19 nt, Human
gaguuguguguguguacau

SEQ ID NO: 969933 - RNA, 18 nt, Human
gcggccuaggggugaggg

SEQ ID NO: 969934 - RNA, 19 nt, Human
ggacuccuggguagcaccu

SEQ ID NO: 969935 - RNA, 20 nt, Human
ggagucccaggaccuccuuc

SEQ ID NO: 969936 - RNA, 24 nt, Human
guguacauggaggggacuccuggg

SEQ ID NO: 969937 - RNA, 22 nt, Human
uaaaauaugcaccaguucccuc

SEQ ID NO: 969938 - RNA, 25 nt, Human
uacauggaggggacuccuggguagc

SEQ ID NO: 969939 - RNA, 19 nt, Human
uagcaccuggaggcggccu

SEQ ID NO: 969940 - RNA, 22 nt, Human
ugcaccuccagaggugcagucu

SEQ ID NO: 969941 - RNA, 21 nt, Human
uguguguguguacauggaggg

SEQ ID NO: 969942 - RNA, 20 nt, Human
uugggcaggauguagcauga

SEQ ID NO: 969943 - RNA, 18 nt, Human
uuuuuuuuuuuuuuuuug

SEQ ID NO: 969944 - RNA, 23 nt, Human
aaaaaucuaugaagaucuaccua

SEQ ID NO: 969945 - RNA, 20 nt, Human
aaagagacugaggcuaccaa

SEQ ID NO: 969946 - RNA, 20 nt, Human
aaauaaaaccauguuuaccc

SEQ ID NO: 969947 - RNA, 21 nt, Human
aaauaaccuuuaaaaugaaag

SEQ ID NO: 969948 - RNA, 22 nt, Human
aacuuguuucucaaacucacuu

SEQ ID NO: 969949 - RNA, 22 nt, Human
aagaaaaaaaaaucuaugaaga

SEQ ID NO: 969950 - RNA, 21 nt, Human
aagaaaaaaaaucauugcaga

SEQ ID NO: 969951 - RNA, 21 nt, Human
aagaagcauuuguuguacaag

SEQ ID NO: 969952 - RNA, 22 nt, Human
aagcauaauuaugugucuaugc

SEQ ID NO: 969953 - RNA, 19 nt, Human
aauagaaauaaaacaacac

SEQ ID NO: 969954 - RNA, 23 nt, Human
aauuacugcaaaguaguucaagc

SEQ ID NO: 969955 - RNA, 19 nt, Human
aauucaauuacaggaguug

SEQ ID NO: 969956 - RNA, 24 nt, Human
acaauagaaauaaaacaacacaaa

SEQ ID NO: 969957 - RNA, 21 nt, Human
acagaccaaugucaagaacuu

SEQ ID NO: 969958 - RNA, 25 nt, Human
acagcaaaacagaccaaugucaaga

SEQ ID NO: 969959 - RNA, 24 nt, Human
accaaugucaagaacuugguuuua

SEQ ID NO: 969960 - RNA, 19 nt, Human
accagagacuuccuccagg

SEQ ID NO: 969961 - RNA, 18 nt, Human
acuaaaacuaaacacaua

SEQ ID NO: 969962 - RNA, 19 nt, Human
acugcagcauauuagacua

SEQ ID NO: 969963 - RNA, 24 nt, Human
acugcagcauauuagacuacauga

SEQ ID NO: 969964 - RNA, 22 nt, Human
agacaaauggugaaauuuaagg

SEQ ID NO: 969965 - RNA, 23 nt, Human
agcucuccucuaacaaaagaaaa

SEQ ID NO: 969966 - RNA, 22 nt, Human
aggaaauuaaagcucuaagaac

SEQ ID NO: 969967 - RNA, 18 nt, Human
aguaguuccuguucaugu

SEQ ID NO: 969968 - RNA, 24 nt, Human
auaaccuuuaaaaugaaagacaaa

SEQ ID NO: 969969 - RNA, 28 nt, Human
auaccagagacuuccuccaaccggaggg

SEQ ID NO: 969970 - RNA, 24 nt, Human
auauucacagcaaaacagaccaau

SEQ ID NO: 969971 - RNA, 23 nt, Human
auuaccauccgccauuggaauaa

SEQ ID NO: 969972 - RNA, 23 nt, Human
caaaacagaccaaugucaagaac

SEQ ID NO: 969973 - RNA, 22 nt, Human
caaacagcauauucuauacuga

SEQ ID NO: 969974 - RNA, 23 nt, Human
caagaccacuacacaguuuuugu

SEQ ID NO: 969975 - RNA, 22 nt, Human
caagauaucagagcagaaaaaa

SEQ ID NO: 969976 - RNA, 24 nt, Human
caaggaaaaauugcaggaaauuaa

SEQ ID NO: 969977 - RNA, 23 nt, Human
caaguccccaggacaguagaucc

SEQ ID NO: 969978 - RNA, 21 nt, Human
caauagaaauaaaacaacaca

SEQ ID NO: 969979 - RNA, 19 nt, Human
cacucuauuagguccuuaa

SEQ ID NO: 969980 - RNA, 21 nt, Human
cacuucagaucaugugagcac

SEQ ID NO: 969981 - RNA, 20 nt, Human
cagcaaaacagaccaauguc

SEQ ID NO: 969982 - RNA, 20 nt, Human
cagcacaauagaaauaaaac

SEQ ID NO: 969983 - RNA, 20 nt, Human
cagcaucaagaccacuacac

SEQ ID NO: 969984 - RNA, 24 nt, Human
caguuguaaaacuaaaccauaagc

SEQ ID NO: 969985 - RNA, 26 nt, Human
cauugaaaaauauaaaaaaauaacug

SEQ ID NO: 969986 - RNA, 23 nt, Human
cauuguagccuugguguguggaa

SEQ ID NO: 969987 - RNA, 20 nt, Human
ccaaauuaccuaugacaaaa

SEQ ID NO: 969988 - RNA, 19 nt, Human
ccagugaccaaugaauuag

SEQ ID NO: 969989 - RNA, 20 nt, Human
ccuuuaaaaugaaagacaaa

SEQ ID NO: 969990 - RNA, 19 nt, Human
cuaaaccauaagcccagca

SEQ ID NO: 969991 - RNA, 20 nt, Human
cuaacaaaaaugagaaaaaa

SEQ ID NO: 969992 - RNA, 22 nt, Human
cucaaggaaaaauugcaggaaa

SEQ ID NO: 969993 - RNA, 24 nt, Human
cucaaggaaaaauugcaggaaauu

SEQ ID NO: 969994 - RNA, 21 nt, Human
cuccaacaaagcuucagugga

SEQ ID NO: 969995 - RNA, 21 nt, Human
cuccauaccagagacuuccuc

SEQ ID NO: 969996 - RNA, 23 nt, Human
cucuaacaaaagaaaaaaaaauc

SEQ ID NO: 969997 - RNA, 20 nt, Human
cuucuacuauaaacacugaa

SEQ ID NO: 969998 - RNA, 25 nt, Human
cuucuuguagaaguaaacuucucua

SEQ ID NO: 969999 - RNA, 23 nt, Human
gcaaaaugccagcauauggccuc

SEQ ID NO: 970000 - RNA, 23 nt, Human
ggcaaaacaauucaaaacucaag

SEQ ID NO: 970001 - RNA, 22 nt, Human
ggcacauuugcuaaguuguuuu

SEQ ID NO: 970002 - RNA, 18 nt, Human
ggucuuggaaaaguaaug

SEQ ID NO: 970003 - RNA, 20 nt, Human
gucauauauaaaaauaaggu

SEQ ID NO: 970004 - RNA, 20 nt, Human
uaaaaauaagguaaucucau

SEQ ID NO: 970005 - RNA, 24 nt, Human
uaaaacaaaggucuucauaaggua

SEQ ID NO: 970006 - RNA, 24 nt, Human
uaaacaagaaaaaaaaucauugca

SEQ ID NO: 970007 - RNA, 21 nt, Human
uaaagagacugaggcuaccag

SEQ ID NO: 970008 - RNA, 22 nt, Human
uaaagagacugaggcuaccaua

SEQ ID NO: 970009 - RNA, 23 nt, Human
uaaagagacugaggcuaccauag

SEQ ID NO: 970010 - RNA, 25 nt, Human
uaaauugguuguuacaugcugauca

SEQ ID NO: 970011 - RNA, 20 nt, Human
uaacaaaaaugagaaaaaaa

SEQ ID NO: 970012 - RNA, 20 nt, Human
uaacucaugcuuaccuacca

SEQ ID NO: 970013 - RNA, 21 nt, Human
uaagcaugaaaacaguaacau

SEQ ID NO: 970014 - RNA, 24 nt, Human
uaauauuuuuuucuggucuuggaa

SEQ ID NO: 970015 - RNA, 23 nt, Human
uacaaauggcuuguaaauguucc

SEQ ID NO: 970016 - RNA, 24 nt, Human
uacacuaaaacuaaacacauacug

SEQ ID NO: 970017 - RNA, 20 nt, Human
uacagagagaaguuguguga

SEQ ID NO: 970018 - RNA, 23 nt, Human
uacagcacaauagaaauaaaaca

SEQ ID NO: 970019 - RNA, 22 nt, Human
uacaugauuuuuaacuaaaaau

SEQ ID NO: 970020 - RNA, 21 nt, Human
uacauugaauaaaacauuagc

SEQ ID NO: 970021 - RNA, 23 nt, Human
uacugaauuagauuaucauccca

SEQ ID NO: 970022 - RNA, 18 nt, Human
uagcucuuaagcucucag

SEQ ID NO: 970023 - RNA, 22 nt, Human
uauauugacuaucucugaaaua

SEQ ID NO: 970024 - RNA, 25 nt, Human
uaucugaaggagaaguaguuccugu

SEQ ID NO: 970025 - RNA, 20 nt, Human
uaugcaguuacuaagucacc

SEQ ID NO: 970026 - RNA, 23 nt, Human
ucaaucaaaauugaaauggcugg

SEQ ID NO: 970027 - RNA, 21 nt, Human
ucagaacuccauaccagagac

SEQ ID NO: 970028 - RNA, 21 nt, Human
ucagaacugauccauaaucuc

SEQ ID NO: 970029 - RNA, 23 nt, Human
ucagacaauacuguguccacuuu

SEQ ID NO: 970030 - RNA, 22 nt, Human
ucagagcagaaaaaacuuaaaa

SEQ ID NO: 970031 - RNA, 23 nt, Human
ucaguggaaaacagagccccaag

SEQ ID NO: 970032 - RNA, 21 nt, Human
uccaauauucacagcaaaaca

SEQ ID NO: 970033 - RNA, 18 nt, Human
uccacuuuaucaacaaac

SEQ ID NO: 970034 - RNA, 18 nt, Human
uccccaggacaguagauc

SEQ ID NO: 970035 - RNA, 21 nt, Human
uccccaggacaguagauccug

SEQ ID NO: 970036 - RNA, 19 nt, Human
uccuagguaaaucaauuug

SEQ ID NO: 970037 - RNA, 18 nt, Human
ucucagaacuccauacca

SEQ ID NO: 970038 - RNA, 19 nt, Human
ucuccaacaaagcuucagu

SEQ ID NO: 970039 - RNA, 25 nt, Human
ucuccucuaacaaaagaaaaaaaaa

SEQ ID NO: 970040 - RNA, 20 nt, Human
ucugcgaggcaccaaauguu

SEQ ID NO: 970041 - RNA, 21 nt, Human
ucuguaggaucuaaacaacca

SEQ ID NO: 970042 - RNA, 21 nt, Human
ugaaauucuauguacuuguau

SEQ ID NO: 970043 - RNA, 22 nt, Human
ugaauuagagauggugaauauu

SEQ ID NO: 970044 - RNA, 20 nt, Human
ugagaaaaaaaaguuggcag

SEQ ID NO: 970045 - RNA, 18 nt, Human
uggaaaccacuaaauguc

SEQ ID NO: 970046 - RNA, 21 nt, Human
uggaaacgaauuauuuccagu

SEQ ID NO: 970047 - RNA, 25 nt, Human
uggaauaauuuaauuggacaaagca

SEQ ID NO: 970048 - RNA, 20 nt, Human
ugguaaagacaagagcugua

SEQ ID NO: 970049 - RNA, 23 nt, Human
ugguauuuucucaucuaaaaauu

SEQ ID NO: 970050 - RNA, 20 nt, Human
uggugaauauuaccauccgc

SEQ ID NO: 970051 - RNA, 24 nt, Human
uguaaaauaacuuugacacuucag

SEQ ID NO: 970052 - RNA, 20 nt, Human
uguaauauuuuuuucugguc

SEQ ID NO: 970053 - RNA, 18 nt, Human
uguaauguuaacagucuu

SEQ ID NO: 970054 - RNA, 22 nt, Human
ugugaaauucuauguacuuguu

SEQ ID NO: 970055 - RNA, 23 nt, Human
uguggaagucuuaaaacaaaggu

SEQ ID NO: 970056 - RNA, 18 nt, Human
ugugugaaaauggcacau

SEQ ID NO: 970057 - RNA, 18 nt, Human
uguuugguuuacuuuuug

SEQ ID NO: 970058 - RNA, 19 nt, Human
uguuugguuuacuuuuugu

SEQ ID NO: 970059 - RNA, 20 nt, Human
uuaauaauaauaguguuauu

SEQ ID NO: 970060 - RNA, 23 nt, Human
uucaguggaaaacagagccucuu

SEQ ID NO: 970061 - RNA, 19 nt, Human
uugcuaaguuguuuuuaug

SEQ ID NO: 970062 - RNA, 25 nt, Human
uuggaagaguguuugaugggaaugu

SEQ ID NO: 970063 - RNA, 22 nt, Human
uuguguugucaaugccugcuuc

SEQ ID NO: 970064 - RNA, 20 nt, Human
uuuauacacagcaaaauaua

SEQ ID NO: 970065 - RNA, 21 nt, Human
uuuccauguaaauugguuguu

SEQ ID NO: 970066 - RNA, 19 nt, Human
uuugagaaagguggauuca

SEQ ID NO: 970067 - RNA, 23 nt, Human
uuugcaaaugauaggcaaccacc

SEQ ID NO: 970068 - RNA, 24 nt, Human
uuuuagagcgguuaaaaugcuguu

SEQ ID NO: 970069 - RNA, 22 nt, Human
acaauugaccccuuuuugggua

SEQ ID NO: 970070 - RNA, 21 nt, Human
acacggcucucgccuggcugg

SEQ ID NO: 970071 - RNA, 23 nt, Human
acgcagcccccgcccugggaccu

SEQ ID NO: 970072 - RNA, 19 nt, Human
agauggucuggcacaaagc

SEQ ID NO: 970073 - RNA, 23 nt, Human
agucaggaaggaaguacugcuag

SEQ ID NO: 970074 - RNA, 27 nt, Human
cagcccccggcgcccaggcgucucccu

SEQ ID NO: 970075 - RNA, 18 nt, Human
cgcccugggaccugcagc

SEQ ID NO: 970076 - RNA, 27 nt, Human
cgcccugggaccugcagcccccggcgc

SEQ ID NO: 970077 - RNA, 21 nt, Human
cgcugggaucccacacggcuc

SEQ ID NO: 970078 - RNA, 21 nt, Human
cuccuuggcgggggcgggagu

SEQ ID NO: 970079 - RNA, 20 nt, Human
cuggcagguaguaggaguca

SEQ ID NO: 970080 - RNA, 23 nt, Human
gacaauugaccccuuuuugggua

SEQ ID NO: 970081 - RNA, 24 nt, Human
gcccugggaccugcagcccccggc

SEQ ID NO: 970082 - RNA, 19 nt, Human
gcgugccuggcucugcggc

SEQ ID NO: 970083 - RNA, 18 nt, Human
ggacgcagcccccgcccu

SEQ ID NO: 970084 - RNA, 25 nt, Human
uacuagaguuauacauuuuauuuga

SEQ ID NO: 970085 - RNA, 23 nt, Human
uacugcuaguucguauccagucu

SEQ ID NO: 970086 - RNA, 19 nt, Human
uagaauauaugcugaaggu

SEQ ID NO: 970087 - RNA, 24 nt, Human
uauaugcugaaggugaaaugaggg

SEQ ID NO: 970088 - RNA, 22 nt, Human
uaugaucccagcgcagagcaag

SEQ ID NO: 970089 - RNA, 25 nt, Human
ucauuccacagauacugacugagug

SEQ ID NO: 970090 - RNA, 20 nt, Human
uccucagagauaagcuccca

SEQ ID NO: 970091 - RNA, 23 nt, Human
uggagaaaggggaacagggauga

SEQ ID NO: 970092 - RNA, 24 nt, Human
ugggaccugcagcccccggcgccc

SEQ ID NO: 970093 - RNA, 20 nt, Human
uuccacagauacugacugag

SEQ ID NO: 970094 - RNA, 22 nt, Human
uuccacagauacugacugagug

SEQ ID NO: 970095 - RNA, 18 nt, Human
uuggagaaaggggaacag

SEQ ID NO: 970096 - RNA, 21 nt, Human
aaagggaggcauuucccugau

SEQ ID NO: 970097 - RNA, 23 nt, Human
aacaaaaggagaaugaggcuuaa

SEQ ID NO: 970098 - RNA, 18 nt, Human
aagaauguguuggcucuu

SEQ ID NO: 970099 - RNA, 18 nt, Human
aagaauguguuggcucuu

SEQ ID NO: 970100 - RNA, 21 nt, Human
aagcagugaugagaggccaga

SEQ ID NO: 970101 - RNA, 21 nt, Human
aagcagugaugagaggccaga

SEQ ID NO: 970102 - RNA, 19 nt, Human
aaggaucacuucaucaagu

SEQ ID NO: 970103 - RNA, 19 nt, Human
aaggaucacuucaucaagu

SEQ ID NO: 970104 - RNA, 18 nt, Human
aagggguuguuaagcuga

SEQ ID NO: 970105 - RNA, 18 nt, Human
aagggguuguuaagcuga

SEQ ID NO: 970106 - RNA, 20 nt, Human
acacccccugugaccccagg

SEQ ID NO: 970107 - RNA, 22 nt, Human
acagcaguggugguuugggcag

SEQ ID NO: 970108 - RNA, 22 nt, Human
acagcaguggugguuugggcag

SEQ ID NO: 970109 - RNA, 22 nt, Human
acaggucaguaucacuaagaac

SEQ ID NO: 970110 - RNA, 22 nt, Human
acaggucaguaucacuaagaac

SEQ ID NO: 970111 - RNA, 19 nt, Human
acuugguucaaaggggacu

SEQ ID NO: 970112 - RNA, 19 nt, Human
acuugguucaaaggggacu

SEQ ID NO: 970113 - RNA, 23 nt, Human
agagacagaguugaggcagcugg

SEQ ID NO: 970114 - RNA, 23 nt, Human
agagacagaguugaggcagcugg

SEQ ID NO: 970115 - RNA, 18 nt, Human
agaggaacccaagcucug

SEQ ID NO: 970116 - RNA, 18 nt, Human
agcagccucugagggcag

SEQ ID NO: 970117 - RNA, 22 nt, Human
agcaguggugguuugggcagcc

SEQ ID NO: 970118 - RNA, 22 nt, Human
agcaguggugguuugggcagcc

SEQ ID NO: 970119 - RNA, 18 nt, Human
aggaagggaggagagagg

SEQ ID NO: 970120 - RNA, 28 nt, Human
aggaagggaggagagagggggagaggag

SEQ ID NO: 970121 - RNA, 20 nt, Human
aggagagagggggagaggag

SEQ ID NO: 970122 - RNA, 22 nt, Human
aggauaaggcagauuuaccaaa

SEQ ID NO: 970123 - RNA, 22 nt, Human
aggauaaggcagauuuaccaaa

SEQ ID NO: 970124 - RNA, 24 nt, Human
aggcaagccagaguccuaaccaag

SEQ ID NO: 970125 - RNA, 24 nt, Human
aggcaagccagaguccuaaccaag

SEQ ID NO: 970126 - RNA, 21 nt, Human
aggcagauuuaccaaagggag

SEQ ID NO: 970127 - RNA, 21 nt, Human
aggcagauuuaccaaagggag

SEQ ID NO: 970128 - RNA, 19 nt, Human
aggccagcacaguuguacu

SEQ ID NO: 970129 - RNA, 19 nt, Human
agugggcuguccccgggga

SEQ ID NO: 970130 - RNA, 19 nt, Human
agugggcuguccccgggga

SEQ ID NO: 970131 - RNA, 23 nt, Human
aguuccauuggcagccagauggc

SEQ ID NO: 970132 - RNA, 23 nt, Human
aguuccauuggcagccagauggc

SEQ ID NO: 970133 - RNA, 24 nt, Human
augugcuugcugacagcaguggug

SEQ ID NO: 970134 - RNA, 24 nt, Human
augugcuugcugacagcaguggug

SEQ ID NO: 970135 - RNA, 23 nt, Human
auugcggccagggccugacgggu

SEQ ID NO: 970136 - RNA, 18 nt, Human
caagugccaggcacucug

SEQ ID NO: 970137 - RNA, 18 nt, Human
cacaauucaaauccaguu

SEQ ID NO: 970138 - RNA, 24 nt, Human
cacacagacacacaacgcaggucu

SEQ ID NO: 970139 - RNA, 24 nt, Human
cacacagacacacaacgcaggucu

SEQ ID NO: 970140 - RNA, 22 nt, Human
cacaucugcaugcaguuagggg

SEQ ID NO: 970141 - RNA, 23 nt, Human
cacccccugugaccccaggcuca

SEQ ID NO: 970142 - RNA, 25 nt, Human
caccgagccgugcggggagcucacu

SEQ ID NO: 970143 - RNA, 23 nt, Human
cagcaguggugguuugggcagcc

SEQ ID NO: 970144 - RNA, 23 nt, Human
cagcaguggugguuugggcagcc

SEQ ID NO: 970145 - RNA, 24 nt, Human
cagcgggcucugcaacccucagac

SEQ ID NO: 970146 - RNA, 24 nt, Human
cagcgggcucugcaacccucagac

SEQ ID NO: 970147 - RNA, 18 nt, Human
cagcuacccaucccccuc

SEQ ID NO: 970148 - RNA, 18 nt, Human
cagcuacccaucccccuc

SEQ ID NO: 970149 - RNA, 20 nt, Human
cagcugccaaggacagggca

SEQ ID NO: 970150 - RNA, 21 nt, Human
caggaggcugaggcagaaccu

SEQ ID NO: 970151 - RNA, 21 nt, Human
caggaggcugaggcagaaccu

SEQ ID NO: 970152 - RNA, 27 nt, Human
caguaggguuccucucaauaccuccuu

SEQ ID NO: 970153 - RNA, 21 nt, Human
cagugaugagaggccagaaga

SEQ ID NO: 970154 - RNA, 21 nt, Human
cagugaugagaggccagaaga

SEQ ID NO: 970155 - RNA, 24 nt, Human
caucuucauaggagaagauggccu

SEQ ID NO: 970156 - RNA, 26 nt, Human
ccaaaaguuuugugcagaauaacugg

SEQ ID NO: 970157 - RNA, 21 nt, Human
ccacagcgggcucugcaaccc

SEQ ID NO: 970158 - RNA, 21 nt, Human
ccacagcgggcucugcaaccc

SEQ ID NO: 970159 - RNA, 22 nt, Human
cccccugugaccccaggcucau

SEQ ID NO: 970160 - RNA, 22 nt, Human
cccucagacauguggcagaucu

SEQ ID NO: 970161 - RNA, 22 nt, Human
cccucagacauguggcagaucu

SEQ ID NO: 970162 - RNA, 19 nt, Human
cccucuuccccucugaguc

SEQ ID NO: 970163 - RNA, 19 nt, Human
cccucuuccccucugaguc

SEQ ID NO: 970164 - RNA, 20 nt, Human
cccuguguugguacuagcac

SEQ ID NO: 970165 - RNA, 23 nt, Human
ccgcccgacacccccugugaccc

SEQ ID NO: 970166 - RNA, 22 nt, Human
ccucauguguuuccaaucuuac

SEQ ID NO: 970167 - RNA, 19 nt, Human
ccugagguccuaagggugu

SEQ ID NO: 970168 - RNA, 19 nt, Human
ccugagguccuaagggugu

SEQ ID NO: 970169 - RNA, 21 nt, Human
ccugcuucaaccagguccaga

SEQ ID NO: 970170 - RNA, 21 nt, Human
ccugcuucaaccagguccaga

SEQ ID NO: 970171 - RNA, 20 nt, Human
ccuggaggacuuccaccuuu

SEQ ID NO: 970172 - RNA, 20 nt, Human
ccuggaggacuuccaccuuu

SEQ ID NO: 970173 - RNA, 21 nt, Human
ccugggccugagcuggacuug

SEQ ID NO: 970174 - RNA, 21 nt, Human
ccugggccugagcuggacuug

SEQ ID NO: 970175 - RNA, 22 nt, Human
ccuggggucaagggggacuguc

SEQ ID NO: 970176 - RNA, 22 nt, Human
ccuggggucaagggggacuguc

SEQ ID NO: 970177 - RNA, 21 nt, Human
cgggugaagagugggcucacc

SEQ ID NO: 970178 - RNA, 19 nt, Human
cuaagaacauucaaaagca

SEQ ID NO: 970179 - RNA, 19 nt, Human
cuaagaacauucaaaagca

SEQ ID NO: 970180 - RNA, 25 nt, Human
cuaagaacauucaaaagcauugaaa

SEQ ID NO: 970181 - RNA, 25 nt, Human
cuaagaacauucaaaagcauugaaa

SEQ ID NO: 970182 - RNA, 24 nt, Human
cuagagucugaugugcuugcugac

SEQ ID NO: 970183 - RNA, 24 nt, Human
cuagagucugaugugcuugcugac

SEQ ID NO: 970184 - RNA, 19 nt, Human
cucccaccuccugggccug

SEQ ID NO: 970185 - RNA, 19 nt, Human
cucccaccuccugggccug

SEQ ID NO: 970186 - RNA, 23 nt, Human
cuccuuuaacucuaagaagacuu

SEQ ID NO: 970187 - RNA, 23 nt, Human
cucucccugagccucaacuccag

SEQ ID NO: 970188 - RNA, 23 nt, Human
cucucccugagccucaacuccag

SEQ ID NO: 970189 - RNA, 21 nt, Human
cucuuggccagcacccccucc

SEQ ID NO: 970190 - RNA, 21 nt, Human
cucuuggccagcacccccucc

SEQ ID NO: 970191 - RNA, 21 nt, Human
cugggcagggcugcaggugug

SEQ ID NO: 970192 - RNA, 20 nt, Human
cuuggaaauuccugaggcuc

SEQ ID NO: 970193 - RNA, 20 nt, Human
cuuggaaauuccugaggcuc

SEQ ID NO: 970194 - RNA, 23 nt, Human
cuuuccugcuucaaccaggucca

SEQ ID NO: 970195 - RNA, 20 nt, Human
cuuuuccaaauauuccagca

SEQ ID NO: 970196 - RNA, 20 nt, Human
cuuuuccaaauauuccagca

SEQ ID NO: 970197 - RNA, 24 nt, Human
gaacaaaaggagaaugaggcuuaa

SEQ ID NO: 970198 - RNA, 23 nt, Human
gacagcaguggugguuugggcag

SEQ ID NO: 970199 - RNA, 23 nt, Human
gacagcaguggugguuugggcag

SEQ ID NO: 970200 - RNA, 19 nt, Human
gaccccauugugucucugg

SEQ ID NO: 970201 - RNA, 21 nt, Human
gaccuucucccaccuccuggg

SEQ ID NO: 970202 - RNA, 21 nt, Human
gaccuucucccaccuccuggg

SEQ ID NO: 970203 - RNA, 20 nt, Human
gagcagccucugagggcagu

SEQ ID NO: 970204 - RNA, 21 nt, Human
gagccgugcgggcucugggac

SEQ ID NO: 970205 - RNA, 22 nt, Human
gagccucaacuccaggucacug

SEQ ID NO: 970206 - RNA, 22 nt, Human
gagccucaacuccaggucacug

SEQ ID NO: 970207 - RNA, 21 nt, Human
gaggagagagggggagaggag

SEQ ID NO: 970208 - RNA, 18 nt, Human
gaggcagcuggggaaggc

SEQ ID NO: 970209 - RNA, 21 nt, Human
gaggcagcuggggaaggcaag

SEQ ID NO: 970210 - RNA, 19 nt, Human
gaucccuggaggacuucca

SEQ ID NO: 970211 - RNA, 19 nt, Human
gaucccuggaggacuucca

SEQ ID NO: 970212 - RNA, 21 nt, Human
gaugauggagggggggcgcau

SEQ ID NO: 970213 - RNA, 21 nt, Human
gaugauggagggggggcgcau

SEQ ID NO: 970214 - RNA, 18 nt, Human
gcagagcugccagagaca

SEQ ID NO: 970215 - RNA, 18 nt, Human
gcagagcugccagagaca

SEQ ID NO: 970216 - RNA, 21 nt, Human
gcagugaugagaggccagaag

SEQ ID NO: 970217 - RNA, 21 nt, Human
gcagugaugagaggccagaag

SEQ ID NO: 970218 - RNA, 22 nt, Human
gccuagacuccuggguguggag

SEQ ID NO: 970219 - RNA, 22 nt, Human
gccuagacuccuggguguggag

SEQ ID NO: 970220 - RNA, 18 nt, Human
gcugggccagcccaaccu

SEQ ID NO: 970221 - RNA, 18 nt, Human
gcugggccagcccaaccu

SEQ ID NO: 970222 - RNA, 18 nt, Human
ggaaggagguggaguagg

SEQ ID NO: 970223 - RNA, 18 nt, Human
ggaaggagguggaguagg

SEQ ID NO: 970224 - RNA, 18 nt, Human
ggaaggagguggaguagg

SEQ ID NO: 970225 - RNA, 24 nt, Human
ggagugagcaggaggcuuguccau

SEQ ID NO: 970226 - RNA, 20 nt, Human
ggcagggcugcagguguguc

SEQ ID NO: 970227 - RNA, 22 nt, Human
ggcugcaggugugucuggggag

SEQ ID NO: 970228 - RNA, 22 nt, Human
gggaaggaagggaggagagagg

SEQ ID NO: 970229 - RNA, 20 nt, Human
gggaugcacuuuccuccgcc

SEQ ID NO: 970230 - RNA, 18 nt, Human
gggcccuggggucaaggg

SEQ ID NO: 970231 - RNA, 18 nt, Human
gggcccuggggucaaggg

SEQ ID NO: 970232 - RNA, 24 nt, Human
gggcugcaggugugucuggggagg

SEQ ID NO: 970233 - RNA, 18 nt, Human
gggugggguggagugagc

SEQ ID NO: 970234 - RNA, 21 nt, Human
ggugcagagcugccagagaca

SEQ ID NO: 970235 - RNA, 21 nt, Human
ggugcagagcugccagagaca

SEQ ID NO: 970236 - RNA, 23 nt, Human
guagcucugguggucucgacggu

SEQ ID NO: 970237 - RNA, 24 nt, Human
guagcucugguggucucgacgguc

SEQ ID NO: 970238 - RNA, 18 nt, Human
gugcuugcugacagcagu

SEQ ID NO: 970239 - RNA, 18 nt, Human
gugcuugcugacagcagu

SEQ ID NO: 970240 - RNA, 21 nt, Human
guuaaugauuacuuggggguu

SEQ ID NO: 970241 - RNA, 21 nt, Human
guuaaugauuacuuggggguu

SEQ ID NO: 970242 - RNA, 21 nt, Human
guugaggcagcuggggaaggc

SEQ ID NO: 970243 - RNA, 25 nt, Human
uaagguucccaguccucccugggaa

SEQ ID NO: 970244 - RNA, 25 nt, Human
uaagguucccaguccucccugggaa

SEQ ID NO: 970245 - RNA, 18 nt, Human
uaccaaggccuagacucc

SEQ ID NO: 970246 - RNA, 18 nt, Human
uaccaaggccuagacucc

SEQ ID NO: 970247 - RNA, 21 nt, Human
uaccaaggccuagacuccugg

SEQ ID NO: 970248 - RNA, 21 nt, Human
uaccaaggccuagacuccugg

SEQ ID NO: 970249 - RNA, 21 nt, Human
uacccaucccccucuuugggg

SEQ ID NO: 970250 - RNA, 21 nt, Human
uacccaucccccucuuugggg

SEQ ID NO: 970251 - RNA, 18 nt, Human
uaggaugccagaugauuc

SEQ ID NO: 970252 - RNA, 18 nt, Human
uaggaugccagaugauuc

SEQ ID NO: 970253 - RNA, 22 nt, Human
uagggaagggguuguuaagcug

SEQ ID NO: 970254 - RNA, 22 nt, Human
uagggaagggguuguuaagcug

SEQ ID NO: 970255 - RNA, 21 nt, Human
uauauuaucacaggucaguau

SEQ ID NO: 970256 - RNA, 21 nt, Human
uauauuaucacaggucaguau

SEQ ID NO: 970257 - RNA, 22 nt, Human
uaucacuaagaacauucaaaag

SEQ ID NO: 970258 - RNA, 20 nt, Human
uauggaagucccaagugcca

SEQ ID NO: 970259 - RNA, 21 nt, Human
ucaacaaucuccuucaguucu

SEQ ID NO: 970260 - RNA, 21 nt, Human
ucaacaaucuccuucaguucu

SEQ ID NO: 970261 - RNA, 23 nt, Human
ucaacacacagacacacaacgca

SEQ ID NO: 970262 - RNA, 23 nt, Human
ucaacacacagacacacaacgca

SEQ ID NO: 970263 - RNA, 31 nt, Human
ucaacaguaggguuccucucaauaccuccuu

SEQ ID NO: 970264 - RNA, 21 nt, Human
ucaagagauaagguucccagu

SEQ ID NO: 970265 - RNA, 21 nt, Human
ucaagagauaagguucccagu

SEQ ID NO: 970266 - RNA, 20 nt, Human
ucaagggggacugucugggc

SEQ ID NO: 970267 - RNA, 20 nt, Human
ucaagggggacugucugggc

SEQ ID NO: 970268 - RNA, 24 nt, Human
uccaaguuuugaguuccauuggca

SEQ ID NO: 970269 - RNA, 24 nt, Human
uccaaguuuugaguuccauuggca

SEQ ID NO: 970270 - RNA, 27 nt, Human
uccauuggcagccagauggcauaauga

SEQ ID NO: 970271 - RNA, 27 nt, Human
uccauuggcagccagauggcauaauga

SEQ ID NO: 970272 - RNA, 19 nt, Human
ucccaagugccaggcacuc

SEQ ID NO: 970273 - RNA, 19 nt, Human
uccccggggagguagcucu

SEQ ID NO: 970274 - RNA, 19 nt, Human
uccccggggagguagcucu

SEQ ID NO: 970275 - RNA, 22 nt, Human
ucccucugccucauguguuucc

SEQ ID NO: 970276 - RNA, 22 nt, Human
ucccucugccucauguguuucc

SEQ ID NO: 970277 - RNA, 22 nt, Human
ucccugagccucaacuccaggu

SEQ ID NO: 970278 - RNA, 22 nt, Human
ucccugagccucaacuccaggu

SEQ ID NO: 970279 - RNA, 18 nt, Human
ucccugaugggcccuggg

SEQ ID NO: 970280 - RNA, 22 nt, Human
ucccuggaggacuuccaccuuu

SEQ ID NO: 970281 - RNA, 22 nt, Human
ucccuggaggacuuccaccuuu

SEQ ID NO: 970282 - RNA, 25 nt, Human
ucccuggaggacuuccaccuuugcc

SEQ ID NO: 970283 - RNA, 25 nt, Human
ucccuggaggacuuccaccuuugcc

SEQ ID NO: 970284 - RNA, 21 nt, Human
ucccuguguugguacuagcac

SEQ ID NO: 970285 - RNA, 22 nt, Human
uccugcuucaaccagguccaga

SEQ ID NO: 970286 - RNA, 22 nt, Human
uccugcuucaaccagguccaga

SEQ ID NO: 970287 - RNA, 20 nt, Human
uccuggccacuguccaggcu

SEQ ID NO: 970288 - RNA, 20 nt, Human
uccuggccacuguccaggcu

SEQ ID NO: 970289 - RNA, 19 nt, Human
ucuggauuauuucacuacu

SEQ ID NO: 970290 - RNA, 19 nt, Human
ucuggauuauuucacuacu

SEQ ID NO: 970291 - RNA, 26 nt, Human
ucuuaccuccacagcgggcucugcaa

SEQ ID NO: 970292 - RNA, 26 nt, Human
ucuuaccuccacagcgggcucugcaa

SEQ ID NO: 970293 - RNA, 18 nt, Human
ucuucauaggagaagaug

SEQ ID NO: 970294 - RNA, 18 nt, Human
ucuucauaggagaagaug

SEQ ID NO: 970295 - RNA, 21 nt, Human
ucuuccccucugagucucugg

SEQ ID NO: 970296 - RNA, 21 nt, Human
ucuuccccucugagucucugg

SEQ ID NO: 970297 - RNA, 21 nt, Human
ucuuccugugcaggaagaccc

SEQ ID NO: 970298 - RNA, 21 nt, Human
ucuuccugugcaggaagaccc

SEQ ID NO: 970299 - RNA, 22 nt, Human
ugacaccaucugacaccgagcc

SEQ ID NO: 970300 - RNA, 18 nt, Human
ugaccccaggcucauccu

SEQ ID NO: 970301 - RNA, 22 nt, Human
ugagaaaagcagugaugagagg

SEQ ID NO: 970302 - RNA, 22 nt, Human
ugagaaaagcagugaugagagg

SEQ ID NO: 970303 - RNA, 18 nt, Human
ugaguugucauuggcuaa

SEQ ID NO: 970304 - RNA, 18 nt, Human
ugaguugucauuggcuaa

SEQ ID NO: 970305 - RNA, 24 nt, Human
ugauguuucaggaggcugaggcag

SEQ ID NO: 970306 - RNA, 24 nt, Human
ugauguuucaggaggcugaggcag

SEQ ID NO: 970307 - RNA, 22 nt, Human
ugcaaagaggaauucccaaaag

SEQ ID NO: 970308 - RNA, 22 nt, Human
ugcaaagaggaauucccaaaag

SEQ ID NO: 970309 - RNA, 22 nt, Human
ugccaggcacucuguaggcagc

SEQ ID NO: 970310 - RNA, 24 nt, Human
ugccucauguguuuccaaucuuac

SEQ ID NO: 970311 - RNA, 18 nt, Human
ugcugacagcaguggugg

SEQ ID NO: 970312 - RNA, 18 nt, Human
ugcugacagcaguggugg

SEQ ID NO: 970313 - RNA, 19 nt, Human
uggaaggagguggaguagg

SEQ ID NO: 970314 - RNA, 19 nt, Human
uggaaggagguggaguagg

SEQ ID NO: 970315 - RNA, 21 nt, Human
uggaaggagguggaguagggg

SEQ ID NO: 970316 - RNA, 25 nt, Human
uggaggacuuccaccuuugccuaca

SEQ ID NO: 970317 - RNA, 25 nt, Human
uggaggacuuccaccuuugccuaca

SEQ ID NO: 970318 - RNA, 19 nt, Human
uggccugagguccuaaggg

SEQ ID NO: 970319 - RNA, 19 nt, Human
uggccugagguccuaaggg

SEQ ID NO: 970320 - RNA, 19 nt, Human
ugggcccuggggucaaggg

SEQ ID NO: 970321 - RNA, 19 nt, Human
ugggcccuggggucaaggg

SEQ ID NO: 970322 - RNA, 18 nt, Human
ugggcuguccccggggag

SEQ ID NO: 970323 - RNA, 18 nt, Human
ugggcuguccccggggag

SEQ ID NO: 970324 - RNA, 20 nt, Human
uggggaugauggaggggggg

SEQ ID NO: 970325 - RNA, 20 nt, Human
uggggaugauggaggggggg

SEQ ID NO: 970326 - RNA, 24 nt, Human
uggggauguuuuccuaggcugggc

SEQ ID NO: 970327 - RNA, 24 nt, Human
uggggauguuuuccuaggcugggc

SEQ ID NO: 970328 - RNA, 22 nt, Human
ugggguggagugagcaggaggc

SEQ ID NO: 970329 - RNA, 23 nt, Human
ugggguggagugagcaggaggcu

SEQ ID NO: 970330 - RNA, 24 nt, Human
uguacagcaggccagcacaguugu

SEQ ID NO: 970331 - RNA, 21 nt, Human
uguccaggcuagagucugaug

SEQ ID NO: 970332 - RNA, 21 nt, Human
uguccaggcuagagucugaug

SEQ ID NO: 970333 - RNA, 21 nt, Human
uguccaggcuagagucugaug

SEQ ID NO: 970334 - RNA, 21 nt, Human
uguccaggcuagagucugaug

SEQ ID NO: 970335 - RNA, 21 nt, Human
uguccauugcggccagggccu

SEQ ID NO: 970336 - RNA, 22 nt, Human
uguccgugacagccugacacug

SEQ ID NO: 970337 - RNA, 22 nt, Human
ugugaccccaggcucauccuuu

SEQ ID NO: 970338 - RNA, 24 nt, Human
uguggagagcacauggucccuggg

SEQ ID NO: 970339 - RNA, 24 nt, Human
uguggagagcacauggucccuggg

SEQ ID NO: 970340 - RNA, 25 nt, Human
uguuaaagagucuuccugugcagga

SEQ ID NO: 970341 - RNA, 25 nt, Human
uguuaaagagucuuccugugcagga

SEQ ID NO: 970342 - RNA, 21 nt, Human
uucaucuucauaggagaagau

SEQ ID NO: 970343 - RNA, 21 nt, Human
uucaucuucauaggagaagau

SEQ ID NO: 970344 - RNA, 25 nt, Human
uuccugaggcucugugaccuucucc

SEQ ID NO: 970345 - RNA, 25 nt, Human
uuccugaggcucugugaccuucucc

SEQ ID NO: 970346 - RNA, 23 nt, Human
uugaggcagcuggggaaggcaag

SEQ ID NO: 970347 - RNA, 22 nt, Human
uuggcacuucgggugcugggca

SEQ ID NO: 970348 - RNA, 22 nt, Human
uuggcacuucgggugcugggca

SEQ ID NO: 970349 - RNA, 19 nt, Human
uuggcagccagauggcaua

SEQ ID NO: 970350 - RNA, 19 nt, Human
uuggcagccagauggcaua

SEQ ID NO: 970351 - RNA, 20 nt, Human
uuuccacaucugcaugcagu

SEQ ID NO: 970352 - RNA, 20 nt, Human
uuuccacaucugcaugcagu

SEQ ID NO: 970353 - RNA, 20 nt, Human
uuucccugaugggcccuggg

SEQ ID NO: 970354 - RNA, 26 nt, Human
uuugaagcuuguacagcaggccagca

SEQ ID NO: 970355 - RNA, 22 nt, Human
uuugggguuucuagccagccuc

SEQ ID NO: 970356 - RNA, 22 nt, Human
uuugggguuucuagccagccuc

SEQ ID NO: 970357 - RNA, 18 nt, Human
uuuugugcagaauaacug

SEQ ID NO: 970358 - RNA, 18 nt, Human
uuuugugcagaauaacug

SEQ ID NO: 970359 - RNA, 18 nt, Human
uuuuuuuuuuuuuuuuug

SEQ ID NO: 970360 - RNA, 21 nt, Human
uuuuuuuuuuuuuuuuuuugg

SEQ ID NO: 970361 - RNA, 18 nt, Human
aggucccaagcgcucuuc

SEQ ID NO: 970362 - RNA, 19 nt, Human
aucgcugcugguuguucag

SEQ ID NO: 970363 - RNA, 21 nt, Human
cuggagguccuuuguaccugg

SEQ ID NO: 970364 - RNA, 22 nt, Human
ucagaguuccacuggagaagug

SEQ ID NO: 970365 - RNA, 21 nt, Human
uggcuggcucuggucuggagg

SEQ ID NO: 970366 - RNA, 21 nt, Human
uuugcugcuggcuggcucugg

SEQ ID NO: 970367 - RNA, 20 nt, Human
aaaaaagagauuagaaaaga

SEQ ID NO: 970368 - RNA, 19 nt, Human
aaaaacacuccccacagcc

SEQ ID NO: 970369 - RNA, 22 nt, Human
aaacccaucuccuuuccgcaaa

SEQ ID NO: 970370 - RNA, 21 nt, Human
aaauagccucaaaagcacaga

SEQ ID NO: 970371 - RNA, 19 nt, Human
aacacagugaaaccccauc

SEQ ID NO: 970372 - RNA, 20 nt, Human
aacacagugaaaccccaucu

SEQ ID NO: 970373 - RNA, 21 nt, Human
aacacagugaaaccccaucuc

SEQ ID NO: 970374 - RNA, 21 nt, Human
aacacagugaaaccccaucuc

SEQ ID NO: 970375 - RNA, 20 nt, Human
aacagaaugagacuccaccu

SEQ ID NO: 970376 - RNA, 23 nt, Human
aacagaaugagacuccaccucaa

SEQ ID NO: 970377 - RNA, 19 nt, Human
aagcaggaugcuggagaug

SEQ ID NO: 970378 - RNA, 19 nt, Human
aagcaggaugcuggagaug

SEQ ID NO: 970379 - RNA, 21 nt, Human
aagcauccagcaccuaggauc

SEQ ID NO: 970380 - RNA, 24 nt, Human
aaguggagguugcagugagccaag

SEQ ID NO: 970381 - RNA, 24 nt, Human
aaucauuuaauuuuuuauaauggc

SEQ ID NO: 970382 - RNA, 24 nt, Human
aaucgcuugaacccaggaagugga

SEQ ID NO: 970383 - RNA, 23 nt, Human
aaugauaagaguaaaaaaagaga

SEQ ID NO: 970384 - RNA, 22 nt, Human
acaccauguauuggcuacaaac

SEQ ID NO: 970385 - RNA, 24 nt, Human
acagaaugagacuccaccucaaaa

SEQ ID NO: 970386 - RNA, 24 nt, Human
acccaggaaguggagguugcagug

SEQ ID NO: 970387 - RNA, 20 nt, Human
accccagcaaaagcaaacca

SEQ ID NO: 970388 - RNA, 18 nt, Human
accccaucucugcuaaaa

SEQ ID NO: 970389 - RNA, 22 nt, Human
accuuguauccaaagucaacua

SEQ ID NO: 970390 - RNA, 22 nt, Human
acgccgcugccgccggacaaac

SEQ ID NO: 970391 - RNA, 24 nt, Human
acuacuggaagaauaaucccucca

SEQ ID NO: 970392 - RNA, 23 nt, Human
acuggauacaagggaagcaucua

SEQ ID NO: 970393 - RNA, 18 nt, Human
agaacuccuucuuaaaug

SEQ ID NO: 970394 - RNA, 22 nt, Human
agaaucgcuugaacccaggaag

SEQ ID NO: 970395 - RNA, 22 nt, Human
agaauuccaggcagacggauuc

SEQ ID NO: 970396 - RNA, 19 nt, Human
agacaaaaguaaaacaaug

SEQ ID NO: 970397 - RNA, 20 nt, Human
agcacucugggaggcugagg

SEQ ID NO: 970398 - RNA, 24 nt, Human
agcacucugggaggcugagguggg

SEQ ID NO: 970399 - RNA, 24 nt, Human
agccuggccaacacagugaaaccc

SEQ ID NO: 970400 - RNA, 24 nt, Human
agccugggcaacagaaugagacuc

SEQ ID NO: 970401 - RNA, 23 nt, Human
agcugggugugguggcacgcgcc

SEQ ID NO: 970402 - RNA, 20 nt, Human
aggcaauauugacaagcagg

SEQ ID NO: 970403 - RNA, 23 nt, Human
aggcaggagaaucgcuugaaccc

SEQ ID NO: 970404 - RNA, 24 nt, Human
aggcaggagaaucgcuugaaccca

SEQ ID NO: 970405 - RNA, 22 nt, Human
aggccuggcaaggacccccucc

SEQ ID NO: 970406 - RNA, 20 nt, Human
aggcugaggcaggagaaucg

SEQ ID NO: 970407 - RNA, 24 nt, Human
aggcugaggcaggagaaucgcuug

SEQ ID NO: 970408 - RNA, 24 nt, Human
aggcugagguggguggaucacuug

SEQ ID NO: 970409 - RNA, 21 nt, Human
aguugcuggugaaggauaaau

SEQ ID NO: 970410 - RNA, 22 nt, Human
aucccccgccggaguccccaac

SEQ ID NO: 970411 - RNA, 20 nt, Human
augacaccagcagaccaagg

SEQ ID NO: 970412 - RNA, 25 nt, Human
auggggcaacaaagacuucauagaa

SEQ ID NO: 970413 - RNA, 22 nt, Human
caaaaaaaaaaaaugauaagag

SEQ ID NO: 970414 - RNA, 20 nt, Human
caaaaacacuccccacagcc

SEQ ID NO: 970415 - RNA, 23 nt, Human
caaaagcacagauaauaguaaca

SEQ ID NO: 970416 - RNA, 19 nt, Human
caaagucaacuaucacugc

SEQ ID NO: 970417 - RNA, 18 nt, Human
caacaaagacuucauaga

SEQ ID NO: 970418 - RNA, 23 nt, Human
caacagaaugagacuccaccuca

SEQ ID NO: 970419 - RNA, 21 nt, Human
caaccaaagacuaacaugaug

SEQ ID NO: 970420 - RNA, 24 nt, Human
caccauguauuggcuacaaacaag

SEQ ID NO: 970421 - RNA, 19 nt, Human
cacgcauggaugacaaagc

SEQ ID NO: 970422 - RNA, 18 nt, Human
cacgucggccagccaggc

SEQ ID NO: 970423 - RNA, 23 nt, Human
cagcaaugacaccagcagaccaa

SEQ ID NO: 970424 - RNA, 20 nt, Human
cagcaucugggagcuucuug

SEQ ID NO: 970425 - RNA, 24 nt, Human
cagcuacuuaggaggcugaggcag

SEQ ID NO: 970426 - RNA, 19 nt, Human
cagcucacuggagucagga

SEQ ID NO: 970427 - RNA, 18 nt, Human
cagcuggaacuugugcuc

SEQ ID NO: 970428 - RNA, 20 nt, Human
caggccagccugggcaacag

SEQ ID NO: 970429 - RNA, 19 nt, Human
caggccccgaggccuggag

SEQ ID NO: 970430 - RNA, 22 nt, Human
caggggccacucccaaaagacc

SEQ ID NO: 970431 - RNA, 18 nt, Human
ccaaacccaucuccuuuc

SEQ ID NO: 970432 - RNA, 23 nt, Human
ccagcacccauaugugcacgcag

SEQ ID NO: 970433 - RNA, 22 nt, Human
ccaggcccuggaccagcugggg

SEQ ID NO: 970434 - RNA, 25 nt, Human
cccaaaagaccagcuggaacuugug

SEQ ID NO: 970435 - RNA, 25 nt, Human
cccaacgccgcugccgccggacaaa

SEQ ID NO: 970436 - RNA, 22 nt, Human
cccaggcccuggaccagcuggg

SEQ ID NO: 970437 - RNA, 19 nt, Human
ccccaacgccgcugccgcc

SEQ ID NO: 970438 - RNA, 18 nt, Human
cccccaucugauucaccc

SEQ ID NO: 970439 - RNA, 20 nt, Human
ccccgaggccuggaggcggg

SEQ ID NO: 970440 - RNA, 21 nt, Human
ccccugggacauaauuauccc

SEQ ID NO: 970441 - RNA, 18 nt, Human
cccgaggccuggaggcgg

SEQ ID NO: 970442 - RNA, 25 nt, Human
cccgcgcgcagcgccgccaacgcca

SEQ ID NO: 970443 - RNA, 27 nt, Human
cccgcgcgcagcgccgccaacgccacg

SEQ ID NO: 970444 - RNA, 20 nt, Human
cccuccugcccugcccuccc

SEQ ID NO: 970445 - RNA, 22 nt, Human
cccuggaccagcuggggacccu

SEQ ID NO: 970446 - RNA, 19 nt, Human
ccgcccccgccucuguccc

SEQ ID NO: 970447 - RNA, 18 nt, Human
ccgccggacaaacuuucc

SEQ ID NO: 970448 - RNA, 24 nt, Human
ccgccggacaaacuuuccggcccg

SEQ ID NO: 970449 - RNA, 20 nt, Human
ccgggcgcgcaucccccgcc

SEQ ID NO: 970450 - RNA, 25 nt, Human
ccuccugcccugcccucccgcgcgc

SEQ ID NO: 970451 - RNA, 18 nt, Human
ccucugucccuccugccc

SEQ ID NO: 970452 - RNA, 24 nt, Human
ccuggccaacacagugaaacccca

SEQ ID NO: 970453 - RNA, 18 nt, Human
ccuguaaucccagcuacu

SEQ ID NO: 970454 - RNA, 21 nt, Human
ccuguaaucccagcuacuuag

SEQ ID NO: 970455 - RNA, 22 nt, Human
ccuguaauccuagcacucuggg

SEQ ID NO: 970456 - RNA, 21 nt, Human
ccuucagggccugaaacccaa

SEQ ID NO: 970457 - RNA, 22 nt, Human
ccuucagggccugaaacccaaa

SEQ ID NO: 970458 - RNA, 20 nt, Human
cgagaggccagaguccuugg

SEQ ID NO: 970459 - RNA, 21 nt, Human
cgagaggccagaguccuuggg

SEQ ID NO: 970460 - RNA, 22 nt, Human
cgcccccggccgccccaggccu

SEQ ID NO: 970461 - RNA, 21 nt, Human
cgccuguaaucccagcuacuu

SEQ ID NO: 970462 - RNA, 24 nt, Human
cgccuguaaucccagcuacuuagg

SEQ ID NO: 970463 - RNA, 19 nt, Human
cgugcugggggcgcugagg

SEQ ID NO: 970464 - RNA, 23 nt, Human
cuccaaacccaucuccuuuccgc

SEQ ID NO: 970465 - RNA, 20 nt, Human
cuccaccucaaaaaaaaaaa

SEQ ID NO: 970466 - RNA, 18 nt, Human
cuccccagcaucugggag

SEQ ID NO: 970467 - RNA, 25 nt, Human
cucugucccuccugcccugcccucc

SEQ ID NO: 970468 - RNA, 18 nt, Human
cugccaagaggcaaaggc

SEQ ID NO: 970469 - RNA, 19 nt, Human
cugcccugcccucccgcgc

SEQ ID NO: 970470 - RNA, 25 nt, Human
cuggaccagcuggggacccuccuga

SEQ ID NO: 970471 - RNA, 18 nt, Human
cuggaggcgggacggagg

SEQ ID NO: 970472 - RNA, 23 nt, Human
cuggccaacacagugaaacccca

SEQ ID NO: 970473 - RNA, 25 nt, Human
cugggaggcugagguggguggauca

SEQ ID NO: 970474 - RNA, 19 nt, Human
cugggugugguggcacgcg

SEQ ID NO: 970475 - RNA, 23 nt, Human
gaaaaucaacaaacaauaaauca

SEQ ID NO: 970476 - RNA, 18 nt, Human
gaaguggagguugcagug

SEQ ID NO: 970477 - RNA, 21 nt, Human
gaaguggagguugcagugagc

SEQ ID NO: 970478 - RNA, 23 nt, Human
gaauauucuucuuauaaaaacug

SEQ ID NO: 970479 - RNA, 22 nt, Human
gagaagauaggagaacucgaga

SEQ ID NO: 970480 - RNA, 20 nt, Human
gaggcaugaaacuagauccu

SEQ ID NO: 970481 - RNA, 18 nt, Human
gagguugcagugagccaa

SEQ ID NO: 970482 - RNA, 22 nt, Human
gagguugcagugagccaagauc

SEQ ID NO: 970483 - RNA, 23 nt, Human
gaucacuugagcucaggaguuca

SEQ ID NO: 970484 - RNA, 22 nt, Human
gaucaggccagccugggcaaca

SEQ ID NO: 970485 - RNA, 20 nt, Human
gaugacaguguucaacuacc

SEQ ID NO: 970486 - RNA, 22 nt, Human
gcaggagaaucgcuugaaccca

SEQ ID NO: 970487 - RNA, 24 nt, Human
gccacaguuccagaauuccaggca

SEQ ID NO: 970488 - RNA, 23 nt, Human
gccagaguccuugggggcucugc

SEQ ID NO: 970489 - RNA, 22 nt, Human
gccccaggccuggcaaggaccc

SEQ ID NO: 970490 - RNA, 19 nt, Human
gccccgaggccuggaggcg

SEQ ID NO: 970491 - RNA, 19 nt, Human
gccuccaaacccaucuccu

SEQ ID NO: 970492 - RNA, 24 nt, Human
gcucuggggccuaggaagcaggau

SEQ ID NO: 970493 - RNA, 21 nt, Human
ggaggcugaggcaggagaauc

SEQ ID NO: 970494 - RNA, 20 nt, Human
ggagguugcagugagccaag

SEQ ID NO: 970495 - RNA, 24 nt, Human
ggagguugcagugagccaagauca

SEQ ID NO: 970496 - RNA, 23 nt, Human
ggccuguaauccuagcacucugg

SEQ ID NO: 970497 - RNA, 20 nt, Human
ggcgugcugggggcgcugag

SEQ ID NO: 970498 - RNA, 23 nt, Human
gggcaggggccacucccaaaaga

SEQ ID NO: 970499 - RNA, 21 nt, Human
ggguccaaaggagggaccugg

SEQ ID NO: 970500 - RNA, 24 nt, Human
gggugugguggcacgcgccuguaa

SEQ ID NO: 970501 - RNA, 24 nt, Human
gguggcacgcgccuguaaucccag

SEQ ID NO: 970502 - RNA, 24 nt, Human
guaaaaaaagagacuucccccuuc

SEQ ID NO: 970503 - RNA, 18 nt, Human
gucagaguugcuggugaa

SEQ ID NO: 970504 - RNA, 19 nt, Human
gucccuccugcccugcccu

SEQ ID NO: 970505 - RNA, 26 nt, Human
gucccuuccuuacaugaucugcaguc

SEQ ID NO: 970506 - RNA, 22 nt, Human
gugauacaaaaacacuccccac

SEQ ID NO: 970507 - RNA, 25 nt, Human
guuaauuuuuguguguauaaauuuu

SEQ ID NO: 970508 - RNA, 24 nt, Human
uaaaaaaagagacuucccccuucc

SEQ ID NO: 970509 - RNA, 21 nt, Human
uacaaacaagacauacuuuaa

SEQ ID NO: 970510 - RNA, 19 nt, Human
uacacuagugaggaagaca

SEQ ID NO: 970511 - RNA, 22 nt, Human
uacacuagugaggaagacaaaa

SEQ ID NO: 970512 - RNA, 22 nt, Human
uacagagauaaaggguauguuu

SEQ ID NO: 970513 - RNA, 21 nt, Human
uagaaaagaugauauccucau

SEQ ID NO: 970514 - RNA, 21 nt, Human
uagaacugaggccucccguca

SEQ ID NO: 970515 - RNA, 24 nt, Human
uagcacucugggaggcugaggugg

SEQ ID NO: 970516 - RNA, 20 nt, Human
uagcugggugugguggcacg

SEQ ID NO: 970517 - RNA, 21 nt, Human
uaggaagcaggaugcuggaga

SEQ ID NO: 970518 - RNA, 18 nt, Human
uaugugcacgcauggaug

SEQ ID NO: 970519 - RNA, 21 nt, Human
ucaacaaacaauaaaucaagc

SEQ ID NO: 970520 - RNA, 18 nt, Human
ucauuuggauuuaggggu

SEQ ID NO: 970521 - RNA, 25 nt, Human
uccaaacccaucuccuuuccgcaaa

SEQ ID NO: 970522 - RNA, 19 nt, Human
uccagcacaucacuggaua

SEQ ID NO: 970523 - RNA, 20 nt, Human
uccagcacaucacuggauac

SEQ ID NO: 970524 - RNA, 19 nt, Human
ucccaaaagaccagcugga

SEQ ID NO: 970525 - RNA, 18 nt, Human
uccccaacgccgcugccg

SEQ ID NO: 970526 - RNA, 22 nt, Human
uccucaagaaccuucagggccu

SEQ ID NO: 970527 - RNA, 23 nt, Human
uccugaaaauguagcaaccagcu

SEQ ID NO: 970528 - RNA, 21 nt, Human
ucuagaaaaucaacaaacaau

SEQ ID NO: 970529 - RNA, 23 nt, Human
ucuccccuaggucuccauaagag

SEQ ID NO: 970530 - RNA, 23 nt, Human
ucuucauucuccccagcaucugg

SEQ ID NO: 970531 - RNA, 22 nt, Human
ugaaacccaaaaugaagaauug

SEQ ID NO: 970532 - RNA, 18 nt, Human
ugaaugucagaacuccuu

SEQ ID NO: 970533 - RNA, 21 nt, Human
ugacaguguucaacuacugga

SEQ ID NO: 970534 - RNA, 19 nt, Human
ugaggaaacugagguucag

SEQ ID NO: 970535 - RNA, 23 nt, Human
ugaggaaacugagguucagggag

SEQ ID NO: 970536 - RNA, 20 nt, Human
ugaggcaggagaaucgcuug

SEQ ID NO: 970537 - RNA, 24 nt, Human
ugaggcaggagaaucgcuugaacc

SEQ ID NO: 970538 - RNA, 25 nt, Human
ugaggcaggagaaucgcuugaaccc

SEQ ID NO: 970539 - RNA, 21 nt, Human
ugagguggguggaucacuuga

SEQ ID NO: 970540 - RNA, 22 nt, Human
ugagguggguggaucacuugag

SEQ ID NO: 970541 - RNA, 23 nt, Human
ugagguggguggaucacuugagc

SEQ ID NO: 970542 - RNA, 24 nt, Human
ugagguggguggaucacuugagcu

SEQ ID NO: 970543 - RNA, 18 nt, Human
ugaguggggaaucaggaa

SEQ ID NO: 970544 - RNA, 21 nt, Human
ugcccugcccucccgcgcgca

SEQ ID NO: 970545 - RNA, 23 nt, Human
ugcccugcccucccgcgcgcagc

SEQ ID NO: 970546 - RNA, 25 nt, Human
ugcugggggcgcugaggggccgggc

SEQ ID NO: 970547 - RNA, 23 nt, Human
uggaccagcuggggacccuccug

SEQ ID NO: 970548 - RNA, 24 nt, Human
uggaucacuugagcucaggaguuc

SEQ ID NO: 970549 - RNA, 19 nt, Human
uggcaaagccagcuccagc

SEQ ID NO: 970550 - RNA, 21 nt, Human
uggcacgcgccuguaauccca

SEQ ID NO: 970551 - RNA, 21 nt, Human
uggccuccaaacccaucuccu

SEQ ID NO: 970552 - RNA, 20 nt, Human
ugggaggcugaggugggugg

SEQ ID NO: 970553 - RNA, 23 nt, Human
ugggaggcugagguggguggauc

SEQ ID NO: 970554 - RNA, 24 nt, Human
ugggaggcugagguggguggauca

SEQ ID NO: 970555 - RNA, 24 nt, Human
ugguggcacgcgccuguaauccca

SEQ ID NO: 970556 - RNA, 27 nt, Human
uguaaaaauccugaaaauguagcaacc

SEQ ID NO: 970557 - RNA, 21 nt, Human
ugucauugaguggggaaucag

SEQ ID NO: 970558 - RNA, 23 nt, Human
ugugcacgcauggaugacaaagc

SEQ ID NO: 970559 - RNA, 23 nt, Human
uuagaaaagaugauauccucauu

SEQ ID NO: 970560 - RNA, 18 nt, Human
uuagcugggugugguggc

SEQ ID NO: 970561 - RNA, 20 nt, Human
uuagcugggugugguggcac

SEQ ID NO: 970562 - RNA, 22 nt, Human
uuagcugggugugguggcacgc

SEQ ID NO: 970563 - RNA, 22 nt, Human
uucaacuacuggaagaauaauc

SEQ ID NO: 970564 - RNA, 19 nt, Human
uucccaggcccuggaccag

SEQ ID NO: 970565 - RNA, 18 nt, Human
uugcagugagccaagauc

SEQ ID NO: 970566 - RNA, 21 nt, Human
uuucccaggcccuggaccagc

SEQ ID NO: 970567 - RNA, 24 nt, Human
uuucccaggcccuggaccagcugg

SEQ ID NO: 970568 - RNA, 20 nt, Human
uuuccgcaaagccauccugc

SEQ ID NO: 970569 - RNA, 19 nt, Human
uuugagcagcugucagcug

SEQ ID NO: 970570 - RNA, 20 nt, Human
uuugccaaaccuuguaucca

SEQ ID NO: 970571 - RNA, 22 nt, Human
uuugccaaaccuuguauccaaa

SEQ ID NO: 970572 - RNA, 18 nt, Human
uuuuuuuuuugccaaacc

SEQ ID NO: 970573 - RNA, 18 nt, Human
aaagugcugggauuacag

SEQ ID NO: 970574 - RNA, 24 nt, Human
aaagugcugggauuacagucauga

SEQ ID NO: 970575 - RNA, 26 nt, Human
aagugcugggauuacagucaugagcu

SEQ ID NO: 970576 - RNA, 19 nt, Human
aaugaggaaugcaggaggg

SEQ ID NO: 970577 - RNA, 24 nt, Human
accauugauugcuaagcaccugga

SEQ ID NO: 970578 - RNA, 23 nt, Human
aggaaugcaggagggagugagga

SEQ ID NO: 970579 - RNA, 22 nt, Human
aggagggagugaggaccagggc

SEQ ID NO: 970580 - RNA, 21 nt, Human
aggcugguuucaaacucuggc

SEQ ID NO: 970581 - RNA, 24 nt, Human
agugcugggauuacagucaugagc

SEQ ID NO: 970582 - RNA, 21 nt, Human
caaagggugcucaauaaacac

SEQ ID NO: 970583 - RNA, 22 nt, Human
caaagugcugggauuacaguca

SEQ ID NO: 970584 - RNA, 24 nt, Human
cacuauguuaccuaggcugguuuc

SEQ ID NO: 970585 - RNA, 22 nt, Human
cagggcccuggcaggaagcaga

SEQ ID NO: 970586 - RNA, 18 nt, Human
caugagcugccacaacca

SEQ ID NO: 970587 - RNA, 21 nt, Human
ccaaagugcugggauuacagu

SEQ ID NO: 970588 - RNA, 24 nt, Human
ccaaagugcugggauuacagucau

SEQ ID NO: 970589 - RNA, 19 nt, Human
ccagggcccuggcaggaag

SEQ ID NO: 970590 - RNA, 26 nt, Human
ccucccaccuuggccucccaaagugc

SEQ ID NO: 970591 - RNA, 20 nt, Human
ccucugccgcagcacugagg

SEQ ID NO: 970592 - RNA, 22 nt, Human
ccucugccgcagcacugaggcu

SEQ ID NO: 970593 - RNA, 24 nt, Human
cucaauugauccucccaccuuggc

SEQ ID NO: 970594 - RNA, 24 nt, Human
cucugccgcagcacugaggcugaa

SEQ ID NO: 970595 - RNA, 18 nt, Human
gauuacagucaugagcug

SEQ ID NO: 970596 - RNA, 19 nt, Human
gauuacagucaugagcugc

SEQ ID NO: 970597 - RNA, 19 nt, Human
gauuacagucaugagcugc

SEQ ID NO: 970598 - RNA, 19 nt, Human
ggagggagugaggaccagg

SEQ ID NO: 970599 - RNA, 24 nt, Human
gggggucucacuauguuaccuagg

SEQ ID NO: 970600 - RNA, 18 nt, Human
gguaggagaaccggucuc

SEQ ID NO: 970601 - RNA, 19 nt, Human
gguaggagaaccggucucg

SEQ ID NO: 970602 - RNA, 21 nt, Human
gugcguccugggcagagcgag

SEQ ID NO: 970603 - RNA, 19 nt, Human
gugcugggauuacagucau

SEQ ID NO: 970604 - RNA, 20 nt, Human
uaccuuuagccuggaauacc

SEQ ID NO: 970605 - RNA, 19 nt, Human
uagcuggcuuuggcucugg

SEQ ID NO: 970606 - RNA, 23 nt, Human
uauguuaccuaggcugguuucaa

SEQ ID NO: 970607 - RNA, 24 nt, Human
uauguuaccuaggcugguuucaaa

SEQ ID NO: 970608 - RNA, 25 nt, Human
ucaauugauccucccaccuuggccu

SEQ ID NO: 970609 - RNA, 22 nt, Human
ucccaaagugcugggauuacag

SEQ ID NO: 970610 - RNA, 23 nt, Human
uccugggcagagcgagagacuug

SEQ ID NO: 970611 - RNA, 23 nt, Human
ucucacuauguuaccuaggcugg

SEQ ID NO: 970612 - RNA, 24 nt, Human
ucucacuauguuaccuaggcuggu

SEQ ID NO: 970613 - RNA, 24 nt, Human
ugagcugccacaaccagccuguaa

SEQ ID NO: 970614 - RNA, 18 nt, Human
ugaggaccagggcccugg

SEQ ID NO: 970615 - RNA, 26 nt, Human
ugcggguaggagaaccggucucgggu

SEQ ID NO: 970616 - RNA, 18 nt, Human
ugcguccugggcagagcg

SEQ ID NO: 970617 - RNA, 22 nt, Human
uggcaggaagcagaggacagga

SEQ ID NO: 970618 - RNA, 22 nt, Human
ugggauuacagucaugagcugc

SEQ ID NO: 970619 - RNA, 23 nt, Human
ugggauuacagucaugagcugcc

SEQ ID NO: 970620 - RNA, 24 nt, Human
ugggauuacagucaugagcugcca

SEQ ID NO: 970621 - RNA, 23 nt, Human
uugcuaagcaccuggagccaugu

SEQ ID NO: 970622 - RNA, 18 nt, Human
uuggccucccaaagugcu

SEQ ID NO: 970623 - RNA, 20 nt, Human
uuggcucuggccaccccuuu

SEQ ID NO: 970624 - RNA, 21 nt, Human
aaaccaguuccaugacacuga

SEQ ID NO: 970625 - RNA, 21 nt, Human
aaacuucgggcaaagcuaaug

SEQ ID NO: 970626 - RNA, 19 nt, Human
aaaggcugcucugugaaga

SEQ ID NO: 970627 - RNA, 22 nt, Human
aagaguguggggaaaaacuucg

SEQ ID NO: 970628 - RNA, 22 nt, Human
accaaaccgccccgaccacccc

SEQ ID NO: 970629 - RNA, 20 nt, Human
acccucauguccagaccacu

SEQ ID NO: 970630 - RNA, 24 nt, Human
acugaaaagagagcacaggagucg

SEQ ID NO: 970631 - RNA, 26 nt, Human
agaaaaagagaucacuuaggaccuug

SEQ ID NO: 970632 - RNA, 21 nt, Human
agaaacuguacccucaugucc

SEQ ID NO: 970633 - RNA, 21 nt, Human
auacuuguugaauguaacuag

SEQ ID NO: 970634 - RNA, 21 nt, Human
augacacugaaaagagagcac

SEQ ID NO: 970635 - RNA, 22 nt, Human
augcauugguccaaagacaccc

SEQ ID NO: 970636 - RNA, 23 nt, Human
caccaaaccgccccgaccacccc

SEQ ID NO: 970637 - RNA, 19 nt, Human
cacguagaaguuacagccg

SEQ ID NO: 970638 - RNA, 22 nt, Human
cauaauagcaugcuaaagaaga

SEQ ID NO: 970639 - RNA, 20 nt, Human
ccacuaaaauccuagccagg

SEQ ID NO: 970640 - RNA, 21 nt, Human
ccaggaguggucacuuucccc

SEQ ID NO: 970641 - RNA, 25 nt, Human
ccccgaccacccccgcucccaggag

SEQ ID NO: 970642 - RNA, 27 nt, Human
ccccgccaccaaaccgccccgaccacc

SEQ ID NO: 970643 - RNA, 20 nt, Human
ccgaccacccccgcucccag

SEQ ID NO: 970644 - RNA, 23 nt, Human
ccugcucagaaaaagagaucacu

SEQ ID NO: 970645 - RNA, 18 nt, Human
cugcauaauaaagcugcg

SEQ ID NO: 970646 - RNA, 27 nt, Human
gauuaaaggcugucuuuaaccuugugg

SEQ ID NO: 970647 - RNA, 18 nt, Human
gcauugguccaaagacac

SEQ ID NO: 970648 - RNA, 22 nt, Human
gccccgaccacccccgcuccca

SEQ ID NO: 970649 - RNA, 18 nt, Human
gcuaaagaagaguguggg

SEQ ID NO: 970650 - RNA, 19 nt, Human
ggcggagguugaugucuuc

SEQ ID NO: 970651 - RNA, 18 nt, Human
guugaugucuucacuagg

SEQ ID NO: 970652 - RNA, 20 nt, Human
uaaagcugcgacuggccucc

SEQ ID NO: 970653 - RNA, 19 nt, Human
uaacaugaaauucauaaaa

SEQ ID NO: 970654 - RNA, 23 nt, Human
uaaccugauauccugcucagaaa

SEQ ID NO: 970655 - RNA, 20 nt, Human
uagcaugcuaaagaagagug

SEQ ID NO: 970656 - RNA, 25 nt, Human
uaggcagaaacuguacccucauguc

SEQ ID NO: 970657 - RNA, 21 nt, Human
uaugcauugguccaaagacac

SEQ ID NO: 970658 - RNA, 19 nt, Human
uauuucacaauauuaacau

SEQ ID NO: 970659 - RNA, 19 nt, Human
uccaaagacacccuccuaa

SEQ ID NO: 970660 - RNA, 21 nt, Human
ucccaggaguggucacuuucc

SEQ ID NO: 970661 - RNA, 26 nt, Human
uccccauaauagcaugcuaaagaaga

SEQ ID NO: 970662 - RNA, 23 nt, Human
uccccgccaccaaaccgccccga

SEQ ID NO: 970663 - RNA, 23 nt, Human
ucuggggaggagggggauuaaag

SEQ ID NO: 970664 - RNA, 22 nt, Human
ugaagaagguagaaaguauuaa

SEQ ID NO: 970665 - RNA, 19 nt, Human
uggggaaaaacuucgggca

SEQ ID NO: 970666 - RNA, 24 nt, Human
uggggaggagggggauuaaaggcu

SEQ ID NO: 970667 - RNA, 21 nt, Human
ugguaggcagaaacuguaccc

SEQ ID NO: 970668 - RNA, 21 nt, Human
uguccagaccacuuguguguc

SEQ ID NO: 970669 - RNA, 25 nt, Human
uguccagaccacuugugugucccaa

SEQ ID NO: 970670 - RNA, 23 nt, Human
uuaaggcggagguugaugucuuc

SEQ ID NO: 970671 - RNA, 22 nt, Human
uuuuuuuuuaaccugauauccu

SEQ ID NO: 970672 - RNA, 20 nt, Human
aaaaaaagacaaguacaauu

SEQ ID NO: 970673 - RNA, 23 nt, Human
aaacaaaaauauggaauccaaag

SEQ ID NO: 970674 - RNA, 21 nt, Human
aaacaaacaccaauaacagca

SEQ ID NO: 970675 - RNA, 18 nt, Human
aaauauaugagcagcuga

SEQ ID NO: 970676 - RNA, 20 nt, Human
aacacccuuggaccaucucc

SEQ ID NO: 970677 - RNA, 25 nt, Human
aaccaauuuggaacccauaaaaacc

SEQ ID NO: 970678 - RNA, 19 nt, Human
aacccauaaaaaccuuuaa

SEQ ID NO: 970679 - RNA, 18 nt, Human
aagaaaaacacagagaca

SEQ ID NO: 970680 - RNA, 22 nt, Human
aagaaaaacacagagacaaauc

SEQ ID NO: 970681 - RNA, 24 nt, Human
aauaaaaaguuaagaaaaaagucc

SEQ ID NO: 970682 - RNA, 24 nt, Human
acagaacacccuuggaccaucucc

SEQ ID NO: 970683 - RNA, 21 nt, Human
acagcugugcccuuguaggag

SEQ ID NO: 970684 - RNA, 19 nt, Human
acucuguugccacuaauaa

SEQ ID NO: 970685 - RNA, 20 nt, Human
agaaacaaaaauauggaauc

SEQ ID NO: 970686 - RNA, 18 nt, Human
agaagcagggcagugaag

SEQ ID NO: 970687 - RNA, 20 nt, Human
agcuauguauguaacacaaa

SEQ ID NO: 970688 - RNA, 20 nt, Human
aggacuccaaggccaaugag

SEQ ID NO: 970689 - RNA, 18 nt, Human
agggcaggggcccggggc

SEQ ID NO: 970690 - RNA, 22 nt, Human
aguaugaaaacaacccgacaga

SEQ ID NO: 970691 - RNA, 23 nt, Human
aucucuguaaauauuuuuuaaaa

SEQ ID NO: 970692 - RNA, 19 nt, Human
auugcuguucuucuccccc

SEQ ID NO: 970693 - RNA, 23 nt, Human
auuuccuuccucuuuuuuguuuc

SEQ ID NO: 970694 - RNA, 24 nt, Human
caaaauaguaggacuccaaggcca

SEQ ID NO: 970695 - RNA, 26 nt, Human
caauaacagcaggauuauuucugcca

SEQ ID NO: 970696 - RNA, 24 nt, Human
caccaauaacagcaggauuauuuc

SEQ ID NO: 970697 - RNA, 20 nt, Human
cacugaugcaaaaaaaggaa

SEQ ID NO: 970698 - RNA, 21 nt, Human
cagauuagaagcagggcagug

SEQ ID NO: 970699 - RNA, 22 nt, Human
caucaugguuguaucuuccucc

SEQ ID NO: 970700 - RNA, 18 nt, Human
ccacugauuuccuuccuc

SEQ ID NO: 970701 - RNA, 21 nt, Human
cugccacugauuuccuuccuc

SEQ ID NO: 970702 - RNA, 27 nt, Human
cuuuuuuguuucaaaaauuauuguuug

SEQ ID NO: 970703 - RNA, 19 nt, Human
gaugaaagcuuacauggaa

SEQ ID NO: 970704 - RNA, 19 nt, Human
ggaaguaugaaaacaaccc

SEQ ID NO: 970705 - RNA, 19 nt, Human
ggggacgcggcuccgcggg

SEQ ID NO: 970706 - RNA, 18 nt, Human
guaggaaaacugagggcc

SEQ ID NO: 970707 - RNA, 19 nt, Human
uaaauucucaggaaaauga

SEQ ID NO: 970708 - RNA, 24 nt, Human
uaacuaaauauaugagcagcugaa

SEQ ID NO: 970709 - RNA, 18 nt, Human
uaagaaaaacacagagac

SEQ ID NO: 970710 - RNA, 20 nt, Human
uaauaugugacauuucccuu

SEQ ID NO: 970711 - RNA, 24 nt, Human
uaccacugaagucacuggguacaa

SEQ ID NO: 970712 - RNA, 21 nt, Human
uaccuaagugacuaaccaauu

SEQ ID NO: 970713 - RNA, 24 nt, Human
uaggaagagcuaauaaaaaguuaa

SEQ ID NO: 970714 - RNA, 23 nt, Human
uagggcaggggcccggggcugcc

SEQ ID NO: 970715 - RNA, 22 nt, Human
uaucacugaugcaaaaaaagga

SEQ ID NO: 970716 - RNA, 25 nt, Human
uaucacugaugcaaaaaaaggaagu

SEQ ID NO: 970717 - RNA, 23 nt, Human
ucucaaaacuuccuagcucaucu

SEQ ID NO: 970718 - RNA, 25 nt, Human
ucugaauuggagagaaaccgggguc

SEQ ID NO: 970719 - RNA, 25 nt, Human
ugcaaaaaaaggaaguaugaaaaca

SEQ ID NO: 970720 - RNA, 31 nt, Human
ugcaaaauaaaaacgaguuuaugcucuuaaa

SEQ ID NO: 970721 - RNA, 19 nt, Human
ugccuugcgggacauaggg

SEQ ID NO: 970722 - RNA, 26 nt, Human
ugccuugcgggacauagggcaggggc

SEQ ID NO: 970723 - RNA, 21 nt, Human
uggaaagaaccagauuagaag

SEQ ID NO: 970724 - RNA, 23 nt, Human
uggaaagaaccagauuagaagca

SEQ ID NO: 970725 - RNA, 22 nt, Human
ugggcaugaacaaaaacugacc

SEQ ID NO: 970726 - RNA, 18 nt, Human
uuggaauuuguugaugaa

SEQ ID NO: 970727 - RNA, 21 nt, Human
uuguaucuuccuccuaaucaa

SEQ ID NO: 970728 - RNA, 18 nt, Human
uuucauaauguucaaaag

SEQ ID NO: 970729 - RNA, 20 nt, Human
uuuguugaugaaagcuuaca

SEQ ID NO: 970730 - RNA, 19 nt, Human
aaaaaccucaaaucuuuaa

SEQ ID NO: 970731 - RNA, 19 nt, Human
aaacaaacaugguaaaaac

SEQ ID NO: 970732 - RNA, 23 nt, Human
aaacagccccagggcccgagagc

SEQ ID NO: 970733 - RNA, 23 nt, Human
aaagugcaucgggacuggccccc

SEQ ID NO: 970734 - RNA, 20 nt, Human
aacaugguaaaaacagcccu

SEQ ID NO: 970735 - RNA, 23 nt, Human
aagcugguuucuuucgugacaca

SEQ ID NO: 970736 - RNA, 22 nt, Human
agacaccugagcuucaaaaaca

SEQ ID NO: 970737 - RNA, 23 nt, Human
aggcacuuugaguggugggaccc

SEQ ID NO: 970738 - RNA, 20 nt, Human
caaagcugggcccauaacac

SEQ ID NO: 970739 - RNA, 22 nt, Human
caccugagcuucaaaaacaaac

SEQ ID NO: 970740 - RNA, 20 nt, Human
cagccccgcccccccacccc

SEQ ID NO: 970741 - RNA, 21 nt, Human
cagccccgcccccccacccca

SEQ ID NO: 970742 - RNA, 23 nt, Human
cagccccgcccccccaccccaag

SEQ ID NO: 970743 - RNA, 19 nt, Human
cagggucagccccgccccc

SEQ ID NO: 970744 - RNA, 23 nt, Human
ccaccccaaguaaaagcagaccc

SEQ ID NO: 970745 - RNA, 18 nt, Human
cccccaaagcugggccca

SEQ ID NO: 970746 - RNA, 22 nt, Human
cccccaaagcugggcccauaag

SEQ ID NO: 970747 - RNA, 19 nt, Human
cccccagggcccuuggggc

SEQ ID NO: 970748 - RNA, 21 nt, Human
cccccccaccccaaguaaaag

SEQ ID NO: 970749 - RNA, 24 nt, Human
cccccccaccccaaguaaaagcag

SEQ ID NO: 970750 - RNA, 20 nt, Human
ccccgcccccccaccccaag

SEQ ID NO: 970751 - RNA, 22 nt, Human
ccccgcccccccaccccaagua

SEQ ID NO: 970752 - RNA, 24 nt, Human
ccccgcccccccaccccaaguaaa

SEQ ID NO: 970753 - RNA, 20 nt, Human
ccccgggccuggaggggggg

SEQ ID NO: 970754 - RNA, 22 nt, Human
ccccucuccaacaccccucaaa

SEQ ID NO: 970755 - RNA, 21 nt, Human
ccccuggggcuguccucgggc

SEQ ID NO: 970756 - RNA, 19 nt, Human
ccucgggcuguuucagccc

SEQ ID NO: 970757 - RNA, 19 nt, Human
cgcccccccaccccaagua

SEQ ID NO: 970758 - RNA, 23 nt, Human
cgggaggguggcugcccccaggg

SEQ ID NO: 970759 - RNA, 18 nt, Human
gacagcggugugguuugg

SEQ ID NO: 970760 - RNA, 24 nt, Human
gaggggguggggagggagaaggug

SEQ ID NO: 970761 - RNA, 18 nt, Human
gccccgcccccccacccc

SEQ ID NO: 970762 - RNA, 23 nt, Human
gcccuuggggcuaaggggacagc

SEQ ID NO: 970763 - RNA, 19 nt, Human
ggacagcggugugguuugg

SEQ ID NO: 970764 - RNA, 22 nt, Human
ggaggguucagggucagccccg

SEQ ID NO: 970765 - RNA, 21 nt, Human
ggaguccccucuccaacaccc

SEQ ID NO: 970766 - RNA, 19 nt, Human
ggggguggggagggagaag

SEQ ID NO: 970767 - RNA, 19 nt, Human
gggguggggagggagaagg

SEQ ID NO: 970768 - RNA, 24 nt, Human
guaaaaacagccccagggcccgag

SEQ ID NO: 970769 - RNA, 23 nt, Human
gugcagcccagacgugagacacc

SEQ ID NO: 970770 - RNA, 20 nt, Human
uaaaaacagccccagggccc

SEQ ID NO: 970771 - RNA, 19 nt, Human
uaaaagcagacccugcagc

SEQ ID NO: 970772 - RNA, 24 nt, Human
ucaaaaacaaacaugguaaaaaca

SEQ ID NO: 970773 - RNA, 23 nt, Human
uccaacaccccucaaagugcauc

SEQ ID NO: 970774 - RNA, 20 nt, Human
ugagacaccugagcuucaaa

SEQ ID NO: 970775 - RNA, 23 nt, Human
uggaaaaaccucaaaucuuuaau

SEQ ID NO: 970776 - RNA, 21 nt, Human
uggcugcccccagggcccuug

SEQ ID NO: 970777 - RNA, 23 nt, Human
uggcugcccccagggcccuuggg

SEQ ID NO: 970778 - RNA, 23 nt, Human
uggcugcccccagggcccuuggg

SEQ ID NO: 970779 - RNA, 18 nt, Human
uggggagggagaaggugg

SEQ ID NO: 970780 - RNA, 21 nt, Human
uugaguggugggaccccuccc

SEQ ID NO: 970781 - RNA, 24 nt, Human
uuuuuuuuuucuggaaaaaccuca

SEQ ID NO: 970782 - RNA, 18 nt, Human
uuuuuuuuuuuuuuucug

SEQ ID NO: 970783 - RNA, 21 nt, Human
agggaccccagacucugccaa

SEQ ID NO: 970784 - RNA, 23 nt, Human
ccagggaccccagacucugccaa

SEQ ID NO: 970785 - RNA, 24 nt, Human
ccagggaccccagacucugccaag

SEQ ID NO: 970786 - RNA, 18 nt, Human
ggcucaguccagggaccc

SEQ ID NO: 970787 - RNA, 20 nt, Human
ucaauucauuuaagcuuccc

SEQ ID NO: 970788 - RNA, 18 nt, Human
ugcauagcuucaauucau

SEQ ID NO: 970789 - RNA, 24 nt, Human
uuuaagcuucccaauaauggguaa

SEQ ID NO: 970790 - RNA, 20 nt, Human
aaaaaacuuaguuugucaac

SEQ ID NO: 970791 - RNA, 22 nt, Human
aaccaucuuuucaucuaaucug

SEQ ID NO: 970792 - RNA, 19 nt, Human
aauggcuuugguuggauug

SEQ ID NO: 970793 - RNA, 19 nt, Human
acaaagcaggagagcugag

SEQ ID NO: 970794 - RNA, 19 nt, Human
acaaagcaggagagcugag

SEQ ID NO: 970795 - RNA, 22 nt, Human
acccugccaccccuguuaucuc

SEQ ID NO: 970796 - RNA, 19 nt, Human
agaaagggcaguuggaagu

SEQ ID NO: 970797 - RNA, 18 nt, Human
agaaaggugagaaaaagg

SEQ ID NO: 970798 - RNA, 20 nt, Human
agaagaaagggcaguuggaa

SEQ ID NO: 970799 - RNA, 23 nt, Human
agagagucccaucuaacucaaaa

SEQ ID NO: 970800 - RNA, 21 nt, Human
agagucccaucuaacucaaaa

SEQ ID NO: 970801 - RNA, 21 nt, Human
agccaucagaagaaagggcag

SEQ ID NO: 970802 - RNA, 21 nt, Human
aggcagaaaggugagaaaaag

SEQ ID NO: 970803 - RNA, 18 nt, Human
aggcagugccuucuggug

SEQ ID NO: 970804 - RNA, 21 nt, Human
agggagcaagugcuggcuuca

SEQ ID NO: 970805 - RNA, 18 nt, Human
agggcgggcgccagggcc

SEQ ID NO: 970806 - RNA, 19 nt, Human
auggcuuccgaacuccagg

SEQ ID NO: 970807 - RNA, 24 nt, Human
auuaaaaauuuuuuuguaugaaug

SEQ ID NO: 970808 - RNA, 25 nt, Human
caagaacccuucucccuggcuugaa

SEQ ID NO: 970809 - RNA, 19 nt, Human
cacagcagcugucuuaaga

SEQ ID NO: 970810 - RNA, 20 nt, Human
cacagcagcugucuuaagac

SEQ ID NO: 970811 - RNA, 18 nt, Human
caccaagaacccuucucc

SEQ ID NO: 970812 - RNA, 18 nt, Human
caggagccugaaagcagu

SEQ ID NO: 970813 - RNA, 19 nt, Human
cagggcgggcgccagggcc

SEQ ID NO: 970814 - RNA, 23 nt, Human
cagucuaucagagaauaaaccag

SEQ ID NO: 970815 - RNA, 19 nt, Human
cagugauuuucucucuuuc

SEQ ID NO: 970816 - RNA, 22 nt, Human
ccaagaaagggaaauaggucuc

SEQ ID NO: 970817 - RNA, 19 nt, Human
ccagacacccacggccauc

SEQ ID NO: 970818 - RNA, 31 nt, Human
ccauccaucaugaaucaaugaaaucauuucc

SEQ ID NO: 970819 - RNA, 24 nt, Human
ccaugucccuccagccucagugcc

SEQ ID NO: 970820 - RNA, 23 nt, Human
cccugcaucaccaagaacccuuc

SEQ ID NO: 970821 - RNA, 24 nt, Human
ccuuuggucacagcagcugucuua

SEQ ID NO: 970822 - RNA, 20 nt, Human
cgccagggccgcgucugcuc

SEQ ID NO: 970823 - RNA, 22 nt, Human
cuccagccucagugccugcacg

SEQ ID NO: 970824 - RNA, 18 nt, Human
gcagaaaggugagaaaaa

SEQ ID NO: 970825 - RNA, 21 nt, Human
gcuccaugucccuccagccuc

SEQ ID NO: 970826 - RNA, 24 nt, Human
ggcacaaagcaggagagcugaggg

SEQ ID NO: 970827 - RNA, 21 nt, Human
gggcuccaugucccuccagcc

SEQ ID NO: 970828 - RNA, 20 nt, Human
uaaaccaggagccugaaagc

SEQ ID NO: 970829 - RNA, 18 nt, Human
uaaggcacaaagcaggag

SEQ ID NO: 970830 - RNA, 18 nt, Human
uaagguggaggaauagcc

SEQ ID NO: 970831 - RNA, 19 nt, Human
uagcuuggucucugucccu

SEQ ID NO: 970832 - RNA, 22 nt, Human
ucaaagacagaagaggucagga

SEQ ID NO: 970833 - RNA, 24 nt, Human
uccagagagucccaucuaacucaa

SEQ ID NO: 970834 - RNA, 21 nt, Human
uccagggagcaagugcuggcc

SEQ ID NO: 970835 - RNA, 20 nt, Human
ucccaaagcuuacaaccauc

SEQ ID NO: 970836 - RNA, 29 nt, Human
ucccucaaagacagaagaggucaggaagu

SEQ ID NO: 970837 - RNA, 19 nt, Human
ucuagcuuggucucugucc

SEQ ID NO: 970838 - RNA, 18 nt, Human
ugauuuucucucuuuccu

SEQ ID NO: 970839 - RNA, 20 nt, Human
ugcccugcaucaccaagaac

SEQ ID NO: 970840 - RNA, 22 nt, Human
ugccugggcccuacguaggcug

SEQ ID NO: 970841 - RNA, 20 nt, Human
ugcgcagggcgggcgccagg

SEQ ID NO: 970842 - RNA, 20 nt, Human
ugcuggcuucagcucaaagu

SEQ ID NO: 970843 - RNA, 20 nt, Human
uggaagagggggcuccaugu

SEQ ID NO: 970844 - RNA, 25 nt, Human
uggaaguauagugucuggaagaggg

SEQ ID NO: 970845 - RNA, 19 nt, Human
uggcuuugguuggauugca

SEQ ID NO: 970846 - RNA, 19 nt, Human
uucaacuauccagagaguc

SEQ ID NO: 970847 - RNA, 24 nt, Human
uucaacuauccagagagucccauc

SEQ ID NO: 970848 - RNA, 18 nt, Human
uuccaggggcugggaaua

SEQ ID NO: 970849 - RNA, 22 nt, Human
uuccugguuugagucacagaga

SEQ ID NO: 970850 - RNA, 19 nt, Human
uugaggccacgaagagcuu

SEQ ID NO: 970851 - RNA, 24 nt, Human
uugccaacuaggaguucaauggga

SEQ ID NO: 970852 - RNA, 22 nt, Human
acacacaccgacacucucacac

SEQ ID NO: 970853 - RNA, 20 nt, Human
acucacccccacacaugcac

SEQ ID NO: 970854 - RNA, 22 nt, Human
agacuggcacccaggguggcac

SEQ ID NO: 970855 - RNA, 19 nt, Human
agcccagagcuuugcggag

SEQ ID NO: 970856 - RNA, 20 nt, Human
aggcaccaacaucuaugcac

SEQ ID NO: 970857 - RNA, 21 nt, Human
auacccagauauccugcagcc

SEQ ID NO: 970858 - RNA, 24 nt, Human
cacaagcccagagcuuugcggagc

SEQ ID NO: 970859 - RNA, 18 nt, Human
cacacaugcacacacacc

SEQ ID NO: 970860 - RNA, 24 nt, Human
cacacaugcacacacaccgacacu

SEQ ID NO: 970861 - RNA, 19 nt, Human
cacacccucccuccccuga

SEQ ID NO: 970862 - RNA, 19 nt, Human
caccaggccuuccccauuc

SEQ ID NO: 970863 - RNA, 18 nt, Human
cacccuuacuccugccua

SEQ ID NO: 970864 - RNA, 24 nt, Human
cagucauauacccagacccacccu

SEQ ID NO: 970865 - RNA, 22 nt, Human
cauacccagauauccugcagcc

SEQ ID NO: 970866 - RNA, 21 nt, Human
ccccacacaugcacacacacc

SEQ ID NO: 970867 - RNA, 24 nt, Human
ccuuuccacaccaggccuucccca

SEQ ID NO: 970868 - RNA, 22 nt, Human
cuccugccuauccuagucaugu

SEQ ID NO: 970869 - RNA, 21 nt, Human
gaggucugcaggucagugggu

SEQ ID NO: 970870 - RNA, 24 nt, Human
gcaaggaggugugcaaauucagua

SEQ ID NO: 970871 - RNA, 21 nt, Human
gcacaccuguacacaaauaca

SEQ ID NO: 970872 - RNA, 20 nt, Human
gccugcacacagccucccac

SEQ ID NO: 970873 - RNA, 19 nt, Human
ggaagggaauuaauugugg

SEQ ID NO: 970874 - RNA, 19 nt, Human
uaacgcaggcaccaacauc

SEQ ID NO: 970875 - RNA, 22 nt, Human
uauccugcagccugcacacagc

SEQ ID NO: 970876 - RNA, 19 nt, Human
uaugcacaaacagcugcac

SEQ ID NO: 970877 - RNA, 20 nt, Human
uaugcacaaacagcugcaca

SEQ ID NO: 970878 - RNA, 22 nt, Human
ucacacaagcccagagcuuugc

SEQ ID NO: 970879 - RNA, 26 nt, Human
uccccauuccaggcuguagucugggg

SEQ ID NO: 970880 - RNA, 21 nt, Human
uccccugccuuuccacaccag

SEQ ID NO: 970881 - RNA, 20 nt, Human
ugaggagaugguaucuugga

SEQ ID NO: 970882 - RNA, 21 nt, Human
ugaggagaugguaucuuggag

SEQ ID NO: 970883 - RNA, 18 nt, Human
ugcacacacaccgacacu

SEQ ID NO: 970884 - RNA, 24 nt, Human
ugcacacacaccgacacucucaca

SEQ ID NO: 970885 - RNA, 21 nt, Human
ugcacauaccuacacacaccc

SEQ ID NO: 970886 - RNA, 23 nt, Human
ugcacaugcagacucacccccac

SEQ ID NO: 970887 - RNA, 23 nt, Human
ugcggagcuacagaaggagagac

SEQ ID NO: 970888 - RNA, 21 nt, Human
uggcacaggcacaugcacaua

SEQ ID NO: 970889 - RNA, 24 nt, Human
uguacaccugcaugggcuggcaca

SEQ ID NO: 970890 - RNA, 21 nt, Human
ugugcaaauucaguaacgcag

SEQ ID NO: 970891 - RNA, 21 nt, Human
uguggugguggccgaagaccu

SEQ ID NO: 970892 - RNA, 21 nt, Human
uguggugguggccgaagaccu

SEQ ID NO: 970893 - RNA, 24 nt, Human
uuaauuguggugguggccgaagac

SEQ ID NO: 970894 - RNA, 25 nt, Human
uuccacaccaggccuuccccauucu

SEQ ID NO: 970895 - RNA, 20 nt, Human
uugggaagggaauuaauugu

SEQ ID NO: 970896 - RNA, 20 nt, Human
aaaacucaaggaccaucccc

SEQ ID NO: 970897 - RNA, 24 nt, Human
auuucauucgcuaauggggagcaa

SEQ ID NO: 970898 - RNA, 21 nt, Human
caaaacucaaggaccaucccc

SEQ ID NO: 970899 - RNA, 22 nt, Human
caaaacucaaggaccauccccc

SEQ ID NO: 970900 - RNA, 24 nt, Human
caaggaccauccccccaucccuga

SEQ ID NO: 970901 - RNA, 22 nt, Human
caucccugacaaucuggggcgu

SEQ ID NO: 970902 - RNA, 21 nt, Human
ccugacaaucuggggcguccc

SEQ ID NO: 970903 - RNA, 18 nt, Human
cgagguggugaaagggug

SEQ ID NO: 970904 - RNA, 21 nt, Human
cgagguggugaaagggugcag

SEQ ID NO: 970905 - RNA, 18 nt, Human
cucaaggaccaucccccc

SEQ ID NO: 970906 - RNA, 21 nt, Human
gcugggauggaggcggcggcc

SEQ ID NO: 970907 - RNA, 21 nt, Human
ggagagcaugcaaaacucaag

SEQ ID NO: 970908 - RNA, 18 nt, Human
ggugcagaagugggaggg

SEQ ID NO: 970909 - RNA, 23 nt, Human
uggaggcggcggccgagccugga

SEQ ID NO: 970910 - RNA, 19 nt, Human
ugggauggaggcggcggcc

SEQ ID NO: 970911 - RNA, 19 nt, Human
ugggauggaggcggcggcc

SEQ ID NO: 970912 - RNA, 24 nt, Human
uuuuuuuuaggacugcaucaauuu

SEQ ID NO: 970913 - RNA, 19 nt, Human
aaaaaaacagccagagaac

SEQ ID NO: 970914 - RNA, 21 nt, Human
aaaaaacagccagagaacaau

SEQ ID NO: 970915 - RNA, 23 nt, Human
aaaaaagaaaaggaaggagagga

SEQ ID NO: 970916 - RNA, 21 nt, Human
aaaacauccaaaccagccccc

SEQ ID NO: 970917 - RNA, 19 nt, Human
aaacauccaaaccagcccc

SEQ ID NO: 970918 - RNA, 22 nt, Human
aaacauccaaaccagcccccac

SEQ ID NO: 970919 - RNA, 18 nt, Human
aaaccagcccccaccucc

SEQ ID NO: 970920 - RNA, 20 nt, Human
aaccagcccccaccuccccc

SEQ ID NO: 970921 - RNA, 21 nt, Human
aacccagaaggucgcugucac

SEQ ID NO: 970922 - RNA, 26 nt, Human
aagggcuggaaggcugguggccagcg

SEQ ID NO: 970923 - RNA, 18 nt, Human
acaaacaacgcaaaggcc

SEQ ID NO: 970924 - RNA, 19 nt, Human
acacaucuuaaauaaauaa

SEQ ID NO: 970925 - RNA, 19 nt, Human
acagcagcgccauggcccc

SEQ ID NO: 970926 - RNA, 22 nt, Human
accccccccacccucccggccu

SEQ ID NO: 970927 - RNA, 24 nt, Human
accugugcaccccccccacccucc

SEQ ID NO: 970928 - RNA, 22 nt, Human
acgggguccgggaaccagcugc

SEQ ID NO: 970929 - RNA, 23 nt, Human
acuccguggagcggcugccggcc

SEQ ID NO: 970930 - RNA, 22 nt, Human
acuuuucucacugcuguucagc

SEQ ID NO: 970931 - RNA, 24 nt, Human
agacaaucggcaggguccccuccu

SEQ ID NO: 970932 - RNA, 19 nt, Human
aggccagggccggccgggu

SEQ ID NO: 970933 - RNA, 19 nt, Human
agggaggucacucuuucca

SEQ ID NO: 970934 - RNA, 24 nt, Human
agggguucucagguuggcuucugu

SEQ ID NO: 970935 - RNA, 20 nt, Human
agucauuaauccuggcucca

SEQ ID NO: 970936 - RNA, 22 nt, Human
caaaccagcccccaccuccccc

SEQ ID NO: 970937 - RNA, 19 nt, Human
caaagggaggucacucuuu

SEQ ID NO: 970938 - RNA, 24 nt, Human
caccccccccacccucccggccuu

SEQ ID NO: 970939 - RNA, 19 nt, Human
caccuccccccgaaaaaaa

SEQ ID NO: 970940 - RNA, 24 nt, Human
cacgcccacguccccaucgcggca

SEQ ID NO: 970941 - RNA, 21 nt, Human
cagacccccuccacgggacug

SEQ ID NO: 970942 - RNA, 18 nt, Human
cagacuuuucucacugcu

SEQ ID NO: 970943 - RNA, 20 nt, Human
cagcccccaccucccccccc

SEQ ID NO: 970944 - RNA, 19 nt, Human
cagcguucugugccggcuc

SEQ ID NO: 970945 - RNA, 21 nt, Human
caggggacccggcuggacagc

SEQ ID NO: 970946 - RNA, 20 nt, Human
cauccaaaccagcccccacc

SEQ ID NO: 970947 - RNA, 22 nt, Human
cauggccccggagggcggcagg

SEQ ID NO: 970948 - RNA, 22 nt, Human
ccaaaccagcccccaccucccc

SEQ ID NO: 970949 - RNA, 24 nt, Human
ccaccuccccccgaaaaaaaagaa

SEQ ID NO: 970950 - RNA, 19 nt, Human
ccccaucgcggcagacaau

SEQ ID NO: 970951 - RNA, 18 nt, Human
cccccaccuccccccgaa

SEQ ID NO: 970952 - RNA, 18 nt, Human
ccccgaaaaaaaagaaaa

SEQ ID NO: 970953 - RNA, 19 nt, Human
ccccgaaaaaaaagaaaag

SEQ ID NO: 970954 - RNA, 19 nt, Human
ccccgcaggugcgggcggu

SEQ ID NO: 970955 - RNA, 22 nt, Human
ccccgcgcccggcucccugagg

SEQ ID NO: 970956 - RNA, 22 nt, Human
ccccggaaucccagcguugccc

SEQ ID NO: 970957 - RNA, 22 nt, Human
ccccgugcccgcucccucugcc

SEQ ID NO: 970958 - RNA, 18 nt, Human
cccgccaaucccagugcc

SEQ ID NO: 970959 - RNA, 24 nt, Human
cccgccucccgguccggccccggc

SEQ ID NO: 970960 - RNA, 18 nt, Human
cccgcucccucugccucc

SEQ ID NO: 970961 - RNA, 21 nt, Human
cccggaaucccagcguugccc

SEQ ID NO: 970962 - RNA, 19 nt, Human
cccggccccgcgccucacc

SEQ ID NO: 970963 - RNA, 19 nt, Human
cccuccgcgaaaauagcuu

SEQ ID NO: 970964 - RNA, 26 nt, Human
cccucugccuccacuuccccggaauc

SEQ ID NO: 970965 - RNA, 22 nt, Human
ccgaaaaaaaagaaaaggaagg

SEQ ID NO: 970966 - RNA, 20 nt, Human
ccggaacaucaugggugcug

SEQ ID NO: 970967 - RNA, 19 nt, Human
ccggaggugcuuccugccu

SEQ ID NO: 970968 - RNA, 18 nt, Human
ccggccccggccccgcgc

SEQ ID NO: 970969 - RNA, 23 nt, Human
ccggcucucggaaaacauccaaa

SEQ ID NO: 970970 - RNA, 19 nt, Human
ccgugcccgcucccucugc

SEQ ID NO: 970971 - RNA, 18 nt, Human
ccuccaaccggaggugcu

SEQ ID NO: 970972 - RNA, 19 nt, Human
ccuccacuuccccggaauc

SEQ ID NO: 970973 - RNA, 18 nt, Human
ccucccgguccggccccg

SEQ ID NO: 970974 - RNA, 21 nt, Human
ccucccgguccggccccggcc

SEQ ID NO: 970975 - RNA, 18 nt, Human
ccuccgcgaaaauagcuu

SEQ ID NO: 970976 - RNA, 25 nt, Human
ccugcagacuuuucucacugcuguu

SEQ ID NO: 970977 - RNA, 21 nt, Human
cgcaguacucgcucacuuuga

SEQ ID NO: 970978 - RNA, 20 nt, Human
cgccugagcgccggcugccc

SEQ ID NO: 970979 - RNA, 24 nt, Human
cggaaaacauccaaaccagccccc

SEQ ID NO: 970980 - RNA, 22 nt, Human
cggcccgggccggggugggcag

SEQ ID NO: 970981 - RNA, 22 nt, Human
cggcucucggaaaacauccaaa

SEQ ID NO: 970982 - RNA, 20 nt, Human
cgggggguccccgccucccg

SEQ ID NO: 970983 - RNA, 18 nt, Human
cguggagcggcugccggc

SEQ ID NO: 970984 - RNA, 24 nt, Human
cuaccugugcaccccccccacccu

SEQ ID NO: 970985 - RNA, 20 nt, Human
cuagacacaacugaaaaaaa

SEQ ID NO: 970986 - RNA, 22 nt, Human
cucccugggcggcugguccccg

SEQ ID NO: 970987 - RNA, 20 nt, Human
cuccucacccuuggcuucuc

SEQ ID NO: 970988 - RNA, 26 nt, Human
cuccugccggcucucuggggucgggg

SEQ ID NO: 970989 - RNA, 18 nt, Human
cucucuguugccccugcc

SEQ ID NO: 970990 - RNA, 23 nt, Human
cugaagccacagccagcgcagua

SEQ ID NO: 970991 - RNA, 19 nt, Human
cugccccgcaggugcgggc

SEQ ID NO: 970992 - RNA, 21 nt, Human
cuggaaaagccucuggggcga

SEQ ID NO: 970993 - RNA, 20 nt, Human
cuggcuccagauccucucuc

SEQ ID NO: 970994 - RNA, 22 nt, Human
cuguggcuggaaugccugagag

SEQ ID NO: 970995 - RNA, 19 nt, Human
cuuccugccuccucacccu

SEQ ID NO: 970996 - RNA, 25 nt, Human
cuugagaccguccccggcucucgga

SEQ ID NO: 970997 - RNA, 21 nt, Human
gaaaaaaacagccagagaaca

SEQ ID NO: 970998 - RNA, 21 nt, Human
gaaaacauccaaaccagcccc

SEQ ID NO: 970999 - RNA, 22 nt, Human
gaaaacauccaaaccagccccc

SEQ ID NO: 971000 - RNA, 18 nt, Human
gaacgcccggcauugucg

SEQ ID NO: 971001 - RNA, 19 nt, Human
gacccccuccacgggacug

SEQ ID NO: 971002 - RNA, 18 nt, Human
gacggugacuucggggcg

SEQ ID NO: 971003 - RNA, 20 nt, Human
gaugucguauuucaaagacu

SEQ ID NO: 971004 - RNA, 21 nt, Human
gcaguacucgcucacuuugau

SEQ ID NO: 971005 - RNA, 20 nt, Human
gccaggggcugggaugacgg

SEQ ID NO: 971006 - RNA, 18 nt, Human
gccgcucccacaggcugg

SEQ ID NO: 971007 - RNA, 21 nt, Human
gcgcagggccccgcgcccggc

SEQ ID NO: 971008 - RNA, 20 nt, Human
gcgcuggcucucugcuucuc

SEQ ID NO: 971009 - RNA, 18 nt, Human
gcggcccgggccggggug

SEQ ID NO: 971010 - RNA, 25 nt, Human
gcugggucuuguccccuuccuucug

SEQ ID NO: 971011 - RNA, 20 nt, Human
gcuuggacccgccaauccca

SEQ ID NO: 971012 - RNA, 23 nt, Human
ggaaaacauccaaaccagccccc

SEQ ID NO: 971013 - RNA, 24 nt, Human
ggaaaacauccaaaccagccccca

SEQ ID NO: 971014 - RNA, 22 nt, Human
ggaacaucaugggugcuggaaa

SEQ ID NO: 971015 - RNA, 18 nt, Human
ggcaggaaggccaggggc

SEQ ID NO: 971016 - RNA, 21 nt, Human
ggccaggggcugggaugacgg

SEQ ID NO: 971017 - RNA, 18 nt, Human
gggacccggcuggacagc

SEQ ID NO: 971018 - RNA, 19 nt, Human
gggccggggugggcagggg

SEQ ID NO: 971019 - RNA, 22 nt, Human
gugaggccagggccggccgggu

SEQ ID NO: 971020 - RNA, 21 nt, Human
gugcaccccccccacccuccc

SEQ ID NO: 971021 - RNA, 23 nt, Human
gugcgggcgguggggcggggggu

SEQ ID NO: 971022 - RNA, 20 nt, Human
guggagcggcugccggcccc

SEQ ID NO: 971023 - RNA, 26 nt, Human
guugugaagggugggcccagaccccc

SEQ ID NO: 971024 - RNA, 21 nt, Human
guuuccaaccugguugucggc

SEQ ID NO: 971025 - RNA, 20 nt, Human
ucaccgcggcccgggccggg

SEQ ID NO: 971026 - RNA, 19 nt, Human
ucaugggugcuggaaaagc

SEQ ID NO: 971027 - RNA, 31 nt, Human
uccaaaccagcccccaccuccccccgaaaag

SEQ ID NO: 971028 - RNA, 21 nt, Human
uccccccgaaaaaaaagaaaa

SEQ ID NO: 971029 - RNA, 19 nt, Human
ucccucugccuccacuucc

SEQ ID NO: 971030 - RNA, 20 nt, Human
ucccugagggcgccgcaggu

SEQ ID NO: 971031 - RNA, 18 nt, Human
ucccugggcggcuggucc

SEQ ID NO: 971032 - RNA, 19 nt, Human
ucccugggcggcugguccc

SEQ ID NO: 971033 - RNA, 23 nt, Human
ucccugggcggcugguccccgga

SEQ ID NO: 971034 - RNA, 26 nt, Human
uccggccccggccccgcgccgguucc

SEQ ID NO: 971035 - RNA, 19 nt, Human
uccguggagcggcugccgg

SEQ ID NO: 971036 - RNA, 23 nt, Human
ucucucuguugccccugccgcuc

SEQ ID NO: 971037 - RNA, 25 nt, Human
ucugccuccacuuccccggaauccc

SEQ ID NO: 971038 - RNA, 23 nt, Human
ucuguugccccugccgcucccac

SEQ ID NO: 971039 - RNA, 22 nt, Human
ugaaaaaaacagccagagaaca

SEQ ID NO: 971040 - RNA, 20 nt, Human
ugagcugaacagcagcgcca

SEQ ID NO: 971041 - RNA, 21 nt, Human
ugcaccccccccacccucccg

SEQ ID NO: 971042 - RNA, 19 nt, Human
ugccgcucccacaggcugg

SEQ ID NO: 971043 - RNA, 25 nt, Human
ugccggcgcuccgagccagcguucu

SEQ ID NO: 971044 - RNA, 22 nt, Human
ugccuccacuuccccggaaucc

SEQ ID NO: 971045 - RNA, 26 nt, Human
ugccugagcugaacagccggggguuc

SEQ ID NO: 971046 - RNA, 22 nt, Human
ugcugugccccugugccugagc

SEQ ID NO: 971047 - RNA, 19 nt, Human
uggaaagaagguguccugg

SEQ ID NO: 971048 - RNA, 22 nt, Human
uggaaugccugagagggucggg

SEQ ID NO: 971049 - RNA, 21 nt, Human
uggagcggcugccggccccgu

SEQ ID NO: 971050 - RNA, 21 nt, Human
uggcaguggcucugcucucuu

SEQ ID NO: 971051 - RNA, 19 nt, Human
uggccaggaggcccacggg

SEQ ID NO: 971052 - RNA, 21 nt, Human
uggcucucugcuucucugcug

SEQ ID NO: 971053 - RNA, 24 nt, Human
uggcuggcaagccugggugccucc

SEQ ID NO: 971054 - RNA, 21 nt, Human
uggcuucucgacaauuaguuu

SEQ ID NO: 971055 - RNA, 24 nt, Human
uggcuucucgacaauuaguuuuua

SEQ ID NO: 971056 - RNA, 19 nt, Human
uggcuucugugucuuuucc

SEQ ID NO: 971057 - RNA, 20 nt, Human
uggcuuggcucaggcagcag

SEQ ID NO: 971058 - RNA, 23 nt, Human
ugggaugacggugacuucggggc

SEQ ID NO: 971059 - RNA, 23 nt, Human
ugggcccagacccccuccacggg

SEQ ID NO: 971060 - RNA, 23 nt, Human
ugggugcuggaaaagccucuggg

SEQ ID NO: 971061 - RNA, 19 nt, Human
uguauuaaaaacaguccca

SEQ ID NO: 971062 - RNA, 23 nt, Human
ugucugaacuguccuugaaaggc

SEQ ID NO: 971063 - RNA, 23 nt, Human
ugugcaaaaggcaaagggagguc

SEQ ID NO: 971064 - RNA, 21 nt, Human
ugugcaccccccccacccucc

SEQ ID NO: 971065 - RNA, 22 nt, Human
uucaaagacuucccuccgcgaa

SEQ ID NO: 971066 - RNA, 20 nt, Human
uucccaaaccucugcugugc

SEQ ID NO: 971067 - RNA, 21 nt, Human
uucucugcuggccggcacugu

SEQ ID NO: 971068 - RNA, 19 nt, Human
uuggacccgccaaucccag

SEQ ID NO: 971069 - RNA, 20 nt, Human
uuucaaagacuucccuccgc

SEQ ID NO: 971070 - RNA, 18 nt, Human
uuuccggcgcgucaagcc

SEQ ID NO: 971071 - RNA, 21 nt, Human
aaagggaaagguggcaaaagg

SEQ ID NO: 971072 - RNA, 22 nt, Human
aaauagaaaugaggcuuauuua

SEQ ID NO: 971073 - RNA, 23 nt, Human
aaccacuuuucagcugagaacac

SEQ ID NO: 971074 - RNA, 26 nt, Human
aagaagaaauagaaaugaggggaccc

SEQ ID NO: 971075 - RNA, 23 nt, Human
acaaaacauagaguuagaugggu

SEQ ID NO: 971076 - RNA, 20 nt, Human
acaaguugccaagagggaaa

SEQ ID NO: 971077 - RNA, 18 nt, Human
agaagaaauagaaaugag

SEQ ID NO: 971078 - RNA, 19 nt, Human
agcugccaggaaaucagag

SEQ ID NO: 971079 - RNA, 19 nt, Human
aguugccaagagggaaaaa

SEQ ID NO: 971080 - RNA, 21 nt, Human
auagguuuuccccagcgaaag

SEQ ID NO: 971081 - RNA, 19 nt, Human
aucuggauguauaauaaau

SEQ ID NO: 971082 - RNA, 19 nt, Human
aucuuggagggacaugaag

SEQ ID NO: 971083 - RNA, 22 nt, Human
caaaauggaagcuugacacccc

SEQ ID NO: 971084 - RNA, 18 nt, Human
caguagguuccauagguu

SEQ ID NO: 971085 - RNA, 25 nt, Human
cauuuaauuaccaagguaagaauca

SEQ ID NO: 971086 - RNA, 18 nt, Human
ccaaaaaguuauuccauu

SEQ ID NO: 971087 - RNA, 19 nt, Human
ccagaguaacucugacaca

SEQ ID NO: 971088 - RNA, 24 nt, Human
cccuaaaauacucaauauaaaaca

SEQ ID NO: 971089 - RNA, 20 nt, Human
ccgaggaaggugaagggcgg

SEQ ID NO: 971090 - RNA, 23 nt, Human
ccuaaaauacucaauauaaaaca

SEQ ID NO: 971091 - RNA, 23 nt, Human
ccuguucugaguguauuuagaag

SEQ ID NO: 971092 - RNA, 19 nt, Human
cgauguggagguguccgcc

SEQ ID NO: 971093 - RNA, 19 nt, Human
cuaagagaccgggaagcca

SEQ ID NO: 971094 - RNA, 22 nt, Human
cuuuucagcugagaacacuugc

SEQ ID NO: 971095 - RNA, 21 nt, Human
gacacaaguugccaagaggga

SEQ ID NO: 971096 - RNA, 20 nt, Human
gaggcuuauuuaagguacaa

SEQ ID NO: 971097 - RNA, 20 nt, Human
gcggagugcguggccgcccc

SEQ ID NO: 971098 - RNA, 19 nt, Human
gcuccuggcgaccuucugg

SEQ ID NO: 971099 - RNA, 21 nt, Human
ggaaauaaagggaaagguggc

SEQ ID NO: 971100 - RNA, 20 nt, Human
gggaagccacaaaacauaga

SEQ ID NO: 971101 - RNA, 22 nt, Human
gguacacaugauucucugugca

SEQ ID NO: 971102 - RNA, 24 nt, Human
guaaagcaaaauaaauauauacaa

SEQ ID NO: 971103 - RNA, 22 nt, Human
gucuuuuaaagacuucccuaaa

SEQ ID NO: 971104 - RNA, 23 nt, Human
uagauaccaaaauggaagcuuga

SEQ ID NO: 971105 - RNA, 19 nt, Human
uagcucagcaagcagagac

SEQ ID NO: 971106 - RNA, 22 nt, Human
uauccuagaucauccuuaguua

SEQ ID NO: 971107 - RNA, 19 nt, Human
uauguuacccaaaauaggc

SEQ ID NO: 971108 - RNA, 18 nt, Human
ucacaagacuagauggag

SEQ ID NO: 971109 - RNA, 20 nt, Human
ucagaccagaguaacucuga

SEQ ID NO: 971110 - RNA, 21 nt, Human
ucagcaagacagguagggucg

SEQ ID NO: 971111 - RNA, 20 nt, Human
ucagcaagcagagacgauca

SEQ ID NO: 971112 - RNA, 24 nt, Human
ucuaagagaccgggaagccacaaa

SEQ ID NO: 971113 - RNA, 21 nt, Human
ucuccaugugcuauguuaccc

SEQ ID NO: 971114 - RNA, 18 nt, Human
ugagcugaacaucaguag

SEQ ID NO: 971115 - RNA, 25 nt, Human
ugagcugaacaucaguaggaaaauu

SEQ ID NO: 971116 - RNA, 23 nt, Human
ugccaagagggaaaaaauacuuc

SEQ ID NO: 971117 - RNA, 18 nt, Human
ugccaggaaaucagagcc

SEQ ID NO: 971118 - RNA, 21 nt, Human
uggaugggaauagauguggua

SEQ ID NO: 971119 - RNA, 20 nt, Human
uggcaaaaggcgauguggag

SEQ ID NO: 971120 - RNA, 25 nt, Human
uggcagugcccuauaacuuucagau

SEQ ID NO: 971121 - RNA, 23 nt, Human
uggcugcggaggccgggaaaaug

SEQ ID NO: 971122 - RNA, 18 nt, Human
uguauggccuuccagggu

SEQ ID NO: 971123 - RNA, 21 nt, Human
uguccgcccuuccgggguuuu

SEQ ID NO: 971124 - RNA, 19 nt, Human
ugugcaacuagcuggugga
